United States Patent 11,369,692 (MATERIALS AND METHODS FOR TREATMENT OF DUCHENNE MUSCULAR DYSTROPHY) - sequence listing, part 18

SEQ ID NO: 583663 - DNA, 20 bp, Artificial Sequence
  chemically synthesized
atgagcatatttgggtttta

SEQ ID NO: 583664 - DNA, 20 bp, Artificial Sequence
  chemically synthesized
gactagtgacatgagcatat

SEQ ID NO: 583665 - DNA, 20 bp, Artificial Sequence
  chemically synthesized
tcatgtcactagtctctcta

SEQ ID NO: 583666 - DNA, 20 bp, Artificial Sequence
  chemically synthesized
tagtctctctacaatgcttc

SEQ ID NO: 583667 - DNA, 20 bp, Artificial Sequence
  chemically synthesized
tcaattacccttcaaataaa

SEQ ID NO: 583668 - DNA, 20 bp, Artificial Sequence
  chemically synthesized
ttacccttcaaataaaatgt

SEQ ID NO: 583669 - DNA, 20 bp, Artificial Sequence
  chemically synthesized
ttctctaacatgtcttaaaa

SEQ ID NO: 583670 - DNA, 20 bp, Artificial Sequence
  chemically synthesized
acccattcccaaccccaact

SEQ ID NO: 583671 - DNA, 20 bp, Artificial Sequence
  chemically synthesized
tggaggcaaaatggagccta

SEQ ID NO: 583672 - DNA, 20 bp, Artificial Sequence
  chemically synthesized
ccattttgcctccaactgtt

SEQ ID NO: 583673 - DNA, 20 bp, Artificial Sequence
  chemically synthesized
tgcctggaacactctcccct

SEQ ID NO: 583674 - DNA, 20 bp, Artificial Sequence
  chemically synthesized
gcaatactccagactgggtg

SEQ ID NO: 583675 - DNA, 20 bp, Artificial Sequence
  chemically synthesized
agactgggtgaggtgattct

SEQ ID NO: 583676 - DNA, 20 bp, Artificial Sequence
  chemically synthesized
gtatttgtcacgtacagtta

SEQ ID NO: 583677 - DNA, 20 bp, Artificial Sequence
  chemically synthesized
actttctaggagtctaggaa

SEQ ID NO: 583678 - DNA, 20 bp, Artificial Sequence
  chemically synthesized
tacaatatggatcaagataa

SEQ ID NO: 583679 - DNA, 20 bp, Artificial Sequence
  chemically synthesized
tactgtgtgccctcctgtgt

SEQ ID NO: 583680 - DNA, 20 bp, Artificial Sequence
  chemically synthesized
taatctgacaaataatttat

SEQ ID NO: 583681 - DNA, 20 bp, Artificial Sequence
  chemically synthesized
taatccttaataaattattt

SEQ ID NO: 583682 - DNA, 20 bp, Artificial Sequence
  chemically synthesized
agtcaaatagtgtactggaa

SEQ ID NO: 583683 - DNA, 20 bp, Artificial Sequence
  chemically synthesized
tcttttctgctaatctatga

SEQ ID NO: 583684 - DNA, 20 bp, Artificial Sequence
  chemically synthesized
atggtctcccaaagcagcgt

SEQ ID NO: 583685 - DNA, 20 bp, Artificial Sequence
  chemically synthesized
ctttgtacaagtatgccatt

SEQ ID NO: 583686 - DNA, 20 bp, Artificial Sequence
  chemically synthesized
taaaatgttatacaccacat

SEQ ID NO: 583687 - DNA, 20 bp, Artificial Sequence
  chemically synthesized
ctaattactgctcatagttc

SEQ ID NO: 583688 - DNA, 20 bp, Artificial Sequence
  chemically synthesized
ctcgagaactatgagcagta

SEQ ID NO: 583689 - DNA, 20 bp, Artificial Sequence
  chemically synthesized
aagaaaggggataactaggt

SEQ ID NO: 583690 - DNA, 20 bp, Artificial Sequence
  chemically synthesized
acatttgttctcactttgga

SEQ ID NO: 583691 - DNA, 20 bp, Artificial Sequence
  chemically synthesized
acgttatccaaagtgagaac

SEQ ID NO: 583692 - DNA, 20 bp, Artificial Sequence
  chemically synthesized
atctctttattctttccatg

SEQ ID NO: 583693 - DNA, 20 bp, Artificial Sequence
  chemically synthesized
cttatcatcagcagtgttat

SEQ ID NO: 583694 - DNA, 20 bp, Artificial Sequence
  chemically synthesized
ttcccctggaggaagcctta

SEQ ID NO: 583695 - DNA, 20 bp, Artificial Sequence
  chemically synthesized
atgtgtttccctaatcttct

SEQ ID NO: 583696 - DNA, 20 bp, Artificial Sequence
  chemically synthesized
aagggaatatagattgttta

SEQ ID NO: 583697 - DNA, 20 bp, Artificial Sequence
  chemically synthesized
tagctaataaagggaatata

SEQ ID NO: 583698 - DNA, 20 bp, Artificial Sequence
  chemically synthesized
cttgtagctaataaagggaa

SEQ ID NO: 583699 - DNA, 20 bp, Artificial Sequence
  chemically synthesized
gttttagataaatactagtc

SEQ ID NO: 583700 - DNA, 20 bp, Artificial Sequence
  chemically synthesized
acaagccgtagttcactgac

SEQ ID NO: 583701 - DNA, 20 bp, Artificial Sequence
  chemically synthesized
taaaacaggggtcagtgaac

SEQ ID NO: 583702 - DNA, 20 bp, Artificial Sequence
  chemically synthesized
tttgcaagaacaggcagttg

SEQ ID NO: 583703 - DNA, 20 bp, Artificial Sequence
  chemically synthesized
gtggctgtgttccaataaaa

SEQ ID NO: 583704 - DNA, 20 bp, Artificial Sequence
  chemically synthesized
tgcatttacaaactgcctat

SEQ ID NO: 583705 - DNA, 20 bp, Artificial Sequence
  chemically synthesized
tgaggtgcaaagcagccata

SEQ ID NO: 583706 - DNA, 20 bp, Artificial Sequence
  chemically synthesized
agtaacttcaacaaagatct

SEQ ID NO: 583707 - DNA, 20 bp, Artificial Sequence
  chemically synthesized
aaagccagatagtaaatatt

SEQ ID NO: 583708 - DNA, 20 bp, Artificial Sequence
  chemically synthesized
aaaacccaaaatatttacta

SEQ ID NO: 583709 - DNA, 20 bp, Artificial Sequence
  chemically synthesized
cacttcaagaaggttttggt

SEQ ID NO: 583710 - DNA, 20 bp, Artificial Sequence
  chemically synthesized
agtaatgtaagtcacttcaa

SEQ ID NO: 583711 - DNA, 20 bp, Artificial Sequence
  chemically synthesized
aattattggtttatataatt

SEQ ID NO: 583712 - DNA, 20 bp, Artificial Sequence
  chemically synthesized
ccatatttataaagtcaatt

SEQ ID NO: 583713 - DNA, 20 bp, Artificial Sequence
  chemically synthesized
ccaataattgactttataaa

SEQ ID NO: 583714 - DNA, 20 bp, Artificial Sequence
  chemically synthesized
tttgcctcaaatcgtgtctt

SEQ ID NO: 583715 - DNA, 20 bp, Artificial Sequence
  chemically synthesized
tgccatttgaatcttggaag

SEQ ID NO: 583716 - DNA, 20 bp, Artificial Sequence
  chemically synthesized
catcccctaattgcaatgta

SEQ ID NO: 583717 - DNA, 20 bp, Artificial Sequence
  chemically synthesized
tggactaggaatacgaagag

SEQ ID NO: 583718 - DNA, 20 bp, Artificial Sequence
  chemically synthesized
tacgaagagaaaagattctg

SEQ ID NO: 583719 - DNA, 20 bp, Artificial Sequence
  chemically synthesized
ctgtcctgattctcctctta

SEQ ID NO: 583720 - DNA, 20 bp, Artificial Sequence
  chemically synthesized
tctaaaatttcccttaagaa

SEQ ID NO: 583721 - DNA, 20 bp, Artificial Sequence
  chemically synthesized
atctgatcaaaaaataataa

SEQ ID NO: 583722 - DNA, 20 bp, Artificial Sequence
  chemically synthesized
attttattattttttgatca

SEQ ID NO: 583723 - DNA, 20 bp, Artificial Sequence
  chemically synthesized
tgatcagatggatttcaata

SEQ ID NO: 583724 - DNA, 20 bp, Artificial Sequence
  chemically synthesized
gttcactaactacagtcata

SEQ ID NO: 583725 - DNA, 20 bp, Artificial Sequence
  chemically synthesized
cttgagtgtgcatcccttgg

SEQ ID NO: 583726 - DNA, 20 bp, Artificial Sequence
  chemically synthesized
tgagcaaggccatggatgca

SEQ ID NO: 583727 - DNA, 20 bp, Artificial Sequence
  chemically synthesized
catccatggccttgctcaca

SEQ ID NO: 583728 - DNA, 20 bp, Artificial Sequence
  chemically synthesized
gctcacactgggttttacta

SEQ ID NO: 583729 - DNA, 20 bp, Artificial Sequence
  chemically synthesized
actgggttttactataatgc

SEQ ID NO: 583730 - DNA, 20 bp, Artificial Sequence
  chemically synthesized
aaataaattccagccaagaa

SEQ ID NO: 583731 - DNA, 20 bp, Artificial Sequence
  chemically synthesized
ctagccagtgtcccacttaa

SEQ ID NO: 583732 - DNA, 20 bp, Artificial Sequence
  chemically synthesized
gctcacttgaaaaaagggtt

SEQ ID NO: 583733 - DNA, 20 bp, Artificial Sequence
  chemically synthesized
gccctttttaggcttcacat

SEQ ID NO: 583734 - DNA, 20 bp, Artificial Sequence
  chemically synthesized
gtctgttgctctcgcccttt

SEQ ID NO: 583735 - DNA, 20 bp, Artificial Sequence
  chemically synthesized
cccttcggccgtcaaaaggg

SEQ ID NO: 583736 - DNA, 20 bp, Artificial Sequence
  chemically synthesized
acccttttgacggccgaagg

SEQ ID NO: 583737 - DNA, 20 bp, Artificial Sequence
  chemically synthesized
tccagaagaggtgatgaact

SEQ ID NO: 583738 - DNA, 20 bp, Artificial Sequence
  chemically synthesized
gaggtgatgaactctatgtt

SEQ ID NO: 583739 - DNA, 20 bp, Artificial Sequence
  chemically synthesized
gaactctatgtttctggttt

SEQ ID NO: 583740 - DNA, 20 bp, Artificial Sequence
  chemically synthesized
tctatgtttctggtttgtgt

SEQ ID NO: 583741 - DNA, 20 bp, Artificial Sequence
  chemically synthesized
gttccagcccatattcattt

SEQ ID NO: 583742 - DNA, 20 bp, Artificial Sequence
  chemically synthesized
gattctctgaaagtattttc

SEQ ID NO: 583743 - DNA, 20 bp, Artificial Sequence
  chemically synthesized
aaattcttttttgtgttcag

SEQ ID NO: 583744 - DNA, 20 bp, Artificial Sequence
  chemically synthesized
ccaagggagtcgtggtgccc

SEQ ID NO: 583745 - DNA, 20 bp, Artificial Sequence
  chemically synthesized
gcccttaagattaaatgaag

SEQ ID NO: 583746 - DNA, 20 bp, Artificial Sequence
  chemically synthesized
ctgtttaaacatatttattt

SEQ ID NO: 583747 - DNA, 20 bp, Artificial Sequence
  chemically synthesized
agtcaaaatcaattaaataa

SEQ ID NO: 583748 - DNA, 20 bp, Artificial Sequence
  chemically synthesized
ggtgctggactatggtaccc

SEQ ID NO: 583749 - DNA, 20 bp, Artificial Sequence
  chemically synthesized
ttttgtaattctgctgctgt

SEQ ID NO: 583750 - DNA, 20 bp, Artificial Sequence
  chemically synthesized
attctcccacagtgttacta

SEQ ID NO: 583751 - DNA, 20 bp, Artificial Sequence
  chemically synthesized
aaaagacattaagatgatag

SEQ ID NO: 583752 - DNA, 20 bp, Artificial Sequence
  chemically synthesized
gagaaaaagacattaagatg

SEQ ID NO: 583753 - DNA, 20 bp, Artificial Sequence
  chemically synthesized
catcttaatgtctttttctc

SEQ ID NO: 583754 - DNA, 20 bp, Artificial Sequence
  chemically synthesized
tataacctcagagttacgga

SEQ ID NO: 583755 - DNA, 20 bp, Artificial Sequence
  chemically synthesized
gtaactctgaggttatagta

SEQ ID NO: 583756 - DNA, 20 bp, Artificial Sequence
  chemically synthesized
gccttaagtagtagtacctt

SEQ ID NO: 583757 - DNA, 20 bp, Artificial Sequence
  chemically synthesized
ttaaggcccaattccaccca

SEQ ID NO: 583758 - DNA, 20 bp, Artificial Sequence
  chemically synthesized
tccacccacggagatttaat

SEQ ID NO: 583759 - DNA, 20 bp, Artificial Sequence
  chemically synthesized
actctctcttcccctttctt

SEQ ID NO: 583760 - DNA, 20 bp, Artificial Sequence
  chemically synthesized
gaaaggggaagagagagtat

SEQ ID NO: 583761 - DNA, 20 bp, Artificial Sequence
  chemically synthesized
gaccaattctaccatattgt

SEQ ID NO: 583762 - DNA, 20 bp, Artificial Sequence
  chemically synthesized
ttcattcatagactgcatga

SEQ ID NO: 583763 - DNA, 20 bp, Artificial Sequence
  chemically synthesized
gactgcatgaccaagattca

SEQ ID NO: 583764 - DNA, 20 bp, Artificial Sequence
  chemically synthesized
gctgtgcccacttagtagct

SEQ ID NO: 583765 - DNA, 20 bp, Artificial Sequence
  chemically synthesized
tttttggataaccattctct

SEQ ID NO: 583766 - DNA, 20 bp, Artificial Sequence
  chemically synthesized
acctatttcataaggctgct

SEQ ID NO: 583767 - DNA, 20 bp, Artificial Sequence
  chemically synthesized
caagtattctttgtgcattt

SEQ ID NO: 583768 - DNA, 20 bp, Artificial Sequence
  chemically synthesized
ctttcatttcgattattccc

SEQ ID NO: 583769 - DNA, 20 bp, Artificial Sequence
  chemically synthesized
aaaaataatacctgctttca

SEQ ID NO: 583770 - DNA, 20 bp, Artificial Sequence
  chemically synthesized
tagccattttcaaaaataat

SEQ ID NO: 583771 - DNA, 20 bp, Artificial Sequence
  chemically synthesized
ctggagggtctctaaggtct

SEQ ID NO: 583772 - DNA, 20 bp, Artificial Sequence
  chemically synthesized
ggcaaaacaacattgtcact

SEQ ID NO: 583773 - DNA, 20 bp, Artificial Sequence
  chemically synthesized
agttaaacatgaagtgacaa

SEQ ID NO: 583774 - DNA, 20 bp, Artificial Sequence
  chemically synthesized
tgaagtgacaatgttgtttt

SEQ ID NO: 583775 - DNA, 20 bp, Artificial Sequence
  chemically synthesized
atgcttcatattgaaaaaag

SEQ ID NO: 583776 - DNA, 20 bp, Artificial Sequence
  chemically synthesized
tatccattatctgggtgaat

SEQ ID NO: 583777 - DNA, 20 bp, Artificial Sequence
  chemically synthesized
ctccaaggaacatttgaatg

SEQ ID NO: 583778 - DNA, 20 bp, Artificial Sequence
  chemically synthesized
gatggaaatccccagaatca

SEQ ID NO: 583779 - DNA, 20 bp, Artificial Sequence
  chemically synthesized
gacgcaaatctctatgattc

SEQ ID NO: 583780 - DNA, 20 bp, Artificial Sequence
  chemically synthesized
cagtttacagacgcaaatct

SEQ ID NO: 583781 - DNA, 20 bp, Artificial Sequence
  chemically synthesized
atagagatttgcgtctgtaa

SEQ ID NO: 583782 - DNA, 20 bp, Artificial Sequence
  chemically synthesized
tttgaatgtgaatataataa

SEQ ID NO: 583783 - DNA, 20 bp, Artificial Sequence
  chemically synthesized
aagaggttggaaggggcagt

SEQ ID NO: 583784 - DNA, 20 bp, Artificial Sequence
  chemically synthesized
cccaacagggagaagtaatg

SEQ ID NO: 583785 - DNA, 20 bp, Artificial Sequence
  chemically synthesized
cacatgctgtgagtgacctc

SEQ ID NO: 583786 - DNA, 20 bp, Artificial Sequence
  chemically synthesized
gattcaatttgctgcctgca

SEQ ID NO: 583787 - DNA, 20 bp, Artificial Sequence
  chemically synthesized
gcaggcagcaaattgaatct

SEQ ID NO: 583788 - DNA, 20 bp, Artificial Sequence
  chemically synthesized
aaaacttgtctaataaagct

SEQ ID NO: 583789 - DNA, 20 bp, Artificial Sequence
  chemically synthesized
gaatctgaaagctttattag

SEQ ID NO: 583790 - DNA, 20 bp, Artificial Sequence
  chemically synthesized
gacaagaaaaacttgtctaa

SEQ ID NO: 583791 - DNA, 20 bp, Artificial Sequence
  chemically synthesized
ggtcaggacccagtttcaca

SEQ ID NO: 583792 - DNA, 20 bp, Artificial Sequence
  chemically synthesized
cttttttttcaaggtcagga

SEQ ID NO: 583793 - DNA, 20 bp, Artificial Sequence
  chemically synthesized
attgaattgtacacttcgat

SEQ ID NO: 583794 - DNA, 20 bp, Artificial Sequence
  chemically synthesized
actcaggattgaattgtaca

SEQ ID NO: 583795 - DNA, 20 bp, Artificial Sequence
  chemically synthesized
gtacaattcaatcctgagtt

SEQ ID NO: 583796 - DNA, 20 bp, Artificial Sequence
  chemically synthesized
ttaacaaataagcacataac

SEQ ID NO: 583797 - DNA, 20 bp, Artificial Sequence
  chemically synthesized
ccttttcctttgaacctgca

SEQ ID NO: 583798 - DNA, 20 bp, Artificial Sequence
  chemically synthesized
agaactcctattatttttat

SEQ ID NO: 583799 - DNA, 20 bp, Artificial Sequence
  chemically synthesized
aacaataaaaataataggag

SEQ ID NO: 583800 - DNA, 20 bp, Artificial Sequence
  chemically synthesized
tgtgatttggtgataggcac

SEQ ID NO: 583801 - DNA, 20 bp, Artificial Sequence
  chemically synthesized
ttagcatacttttcataact

SEQ ID NO: 583802 - DNA, 20 bp, Artificial Sequence
  chemically synthesized
gaagtgaatgggaattgttt

SEQ ID NO: 583803 - DNA, 20 bp, Artificial Sequence
  chemically synthesized
gtcatactgaagtgaatggg

SEQ ID NO: 583804 - DNA, 20 bp, Artificial Sequence
  chemically synthesized
taatgttcattatggattat

SEQ ID NO: 583805 - DNA, 20 bp, Artificial Sequence
  chemically synthesized
aaatgttctataatgttcat

SEQ ID NO: 583806 - DNA, 20 bp, Artificial Sequence
  chemically synthesized
ctgggaaaatgaagggacat

SEQ ID NO: 583807 - DNA, 20 bp, Artificial Sequence
  chemically synthesized
tgaagggacattggagattg

SEQ ID NO: 583808 - DNA, 20 bp, Artificial Sequence
  chemically synthesized
gggacattggagattggcta

SEQ ID NO: 583809 - DNA, 20 bp, Artificial Sequence
  chemically synthesized
atataaactcatatatatat

SEQ ID NO: 583810 - DNA, 20 bp, Artificial Sequence
  chemically synthesized
ataaaatctcttatatatat

SEQ ID NO: 583811 - DNA, 20 bp, Artificial Sequence
  chemically synthesized
gagtttatatataaatatat

SEQ ID NO: 583812 - DNA, 20 bp, Artificial Sequence
  chemically synthesized
gagtttatatataaatatat

SEQ ID NO: 583813 - DNA, 20 bp, Artificial Sequence
  chemically synthesized
atatatgagtttatatatat

SEQ ID NO: 583814 - DNA, 20 bp, Artificial Sequence
  chemically synthesized
gagtttatatataaatatat

SEQ ID NO: 583815 - DNA, 20 bp, Artificial Sequence
  chemically synthesized
aatatatatgagtttatata

SEQ ID NO: 583816 - DNA, 20 bp, Artificial Sequence
  chemically synthesized
tacagatagctatatctcta

SEQ ID NO: 583817 - DNA, 20 bp, Artificial Sequence
  chemically synthesized
tatatagacatataactgta

SEQ ID NO: 583818 - DNA, 20 bp, Artificial Sequence
  chemically synthesized
tatagtgatgtaatttagtt

SEQ ID NO: 583819 - DNA, 20 bp, Artificial Sequence
  chemically synthesized
tttaatattggagaacaatt

SEQ ID NO: 583820 - DNA, 20 bp, Artificial Sequence
  chemically synthesized
ttgactttttttttcctatt

SEQ ID NO: 583821 - DNA, 20 bp, Artificial Sequence
  chemically synthesized
tttacctaaatattaggata

SEQ ID NO: 583822 - DNA, 20 bp, Artificial Sequence
  chemically synthesized
cctaaatattaggataccta

SEQ ID NO: 583823 - DNA, 20 bp, Artificial Sequence
  chemically synthesized
atgttttactcttatttcca

SEQ ID NO: 583824 - DNA, 20 bp, Artificial Sequence
  chemically synthesized
tcttcagtatttttatgaaa

SEQ ID NO: 583825 - DNA, 20 bp, Artificial Sequence
  chemically synthesized
taccttcctcttaaaattca

SEQ ID NO: 583826 - DNA, 20 bp, Artificial Sequence
  chemically synthesized
ttgaaatcaaatttgagaac

SEQ ID NO: 583827 - DNA, 20 bp, Artificial Sequence
  chemically synthesized
tgtaaagcagaggttctcaa

SEQ ID NO: 583828 - DNA, 20 bp, Artificial Sequence
  chemically synthesized
ttcaagacacagtcaagaat

SEQ ID NO: 583829 - DNA, 20 bp, Artificial Sequence
  chemically synthesized
ataggggttatatctggcct

SEQ ID NO: 583830 - DNA, 20 bp, Artificial Sequence
  chemically synthesized
gcactgtaatcttaaaaaaa

SEQ ID NO: 583831 - DNA, 20 bp, Artificial Sequence
  chemically synthesized
cagtagtaagccctattttt

SEQ ID NO: 583832 - DNA, 20 bp, Artificial Sequence
  chemically synthesized
taaaaaaatagggcttacta

SEQ ID NO: 583833 - DNA, 20 bp, Artificial Sequence
  chemically synthesized
tggacccaaccccacatctc

SEQ ID NO: 583834 - DNA, 20 bp, Artificial Sequence
  chemically synthesized
tcaggagatgtggggttggg

SEQ ID NO: 583835 - DNA, 20 bp, Artificial Sequence
  chemically synthesized
aaatgatcgcgtgcttgacc

SEQ ID NO: 583836 - DNA, 20 bp, Artificial Sequence
  chemically synthesized
accaagaagattaaatgatc

SEQ ID NO: 583837 - DNA, 20 bp, Artificial Sequence
  chemically synthesized
atgtaataataataatacca

SEQ ID NO: 583838 - DNA, 20 bp, Artificial Sequence
  chemically synthesized
catgccaaataccaggtgtg

SEQ ID NO: 583839 - DNA, 20 bp, Artificial Sequence
  chemically synthesized
agtctatatatacccttttc

SEQ ID NO: 583840 - DNA, 20 bp, Artificial Sequence
  chemically synthesized
ttccatactatttttctgtt

SEQ ID NO: 583841 - DNA, 20 bp, Artificial Sequence
  chemically synthesized
ggccctcctcctacccttcc

SEQ ID NO: 583842 - DNA, 20 bp, Artificial Sequence
  chemically synthesized
acgttaaaaatttgagaaac

SEQ ID NO: 583843 - DNA, 20 bp, Artificial Sequence
  chemically synthesized
ccatggtctggcaacaaaac

SEQ ID NO: 583844 - DNA, 20 bp, Artificial Sequence
  chemically synthesized
ttgccagaccatggggactc

SEQ ID NO: 583845 - DNA, 20 bp, Artificial Sequence
  chemically synthesized
gatagaaaagaaaagtggga

SEQ ID NO: 583846 - DNA, 20 bp, Artificial Sequence
  chemically synthesized
ttcgaataggaaaaatacat

SEQ ID NO: 583847 - DNA, 20 bp, Artificial Sequence
  chemically synthesized
gttgaaaaactgtcaagtat

SEQ ID NO: 583848 - DNA, 20 bp, Artificial Sequence
  chemically synthesized
tctaccaatctgctatactt

SEQ ID NO: 583849 - DNA, 20 bp, Artificial Sequence
  chemically synthesized
tttaagaagagagttggcag

SEQ ID NO: 583850 - DNA, 20 bp, Artificial Sequence
  chemically synthesized
gagagttggcagttacgctt

SEQ ID NO: 583851 - DNA, 20 bp, Artificial Sequence
  chemically synthesized
gttggcagttacgcttctaa

SEQ ID NO: 583852 - DNA, 20 bp, Artificial Sequence
  chemically synthesized
ttgtacttcaattgtcgatt

SEQ ID NO: 583853 - DNA, 20 bp, Artificial Sequence
  chemically synthesized
tagcagttttgtacttcaat

SEQ ID NO: 583854 - DNA, 20 bp, Artificial Sequence
  chemically synthesized
agatttcgaaaggaaattgt

SEQ ID NO: 583855 - DNA, 20 bp, Artificial Sequence
  chemically synthesized
gctacaatttcctttcgaaa

SEQ ID NO: 583856 - DNA, 20 bp, Artificial Sequence
  chemically synthesized
aactttaccttcagagagaa

SEQ ID NO: 583857 - DNA, 20 bp, Artificial Sequence
  chemically synthesized
tcaattttaaaactattcag

SEQ ID NO: 583858 - DNA, 20 bp, Artificial Sequence
  chemically synthesized
tatttcctaaaacttcactg

SEQ ID NO: 583859 - DNA, 20 bp, Artificial Sequence
  chemically synthesized
gtaccctaccgctcaaaatg

SEQ ID NO: 583860 - DNA, 20 bp, Artificial Sequence
  chemically synthesized
cataaatatgcctaaatagt

SEQ ID NO: 583861 - DNA, 20 bp, Artificial Sequence
  chemically synthesized
tcttggtcagagtatgacag

SEQ ID NO: 583862 - DNA, 20 bp, Artificial Sequence
  chemically synthesized
caagattatggtatactctg

SEQ ID NO: 583863 - DNA, 20 bp, Artificial Sequence
  chemically synthesized
aacactcttcaagaaaggac

SEQ ID NO: 583864 - DNA, 20 bp, Artificial Sequence
  chemically synthesized
aatagcataagaaggttaaa

SEQ ID NO: 583865 - DNA, 20 bp, Artificial Sequence
  chemically synthesized
aattctgatgattagagatt

SEQ ID NO: 583866 - DNA, 20 bp, Artificial Sequence
  chemically synthesized
ctaacatcaattctgatgat

SEQ ID NO: 583867 - DNA, 20 bp, Artificial Sequence
  chemically synthesized
gagaaggctaacatcaattc

SEQ ID NO: 583868 - DNA, 20 bp, Artificial Sequence
  chemically synthesized
ttttcctagaaatgatgaac

SEQ ID NO: 583869 - DNA, 20 bp, Artificial Sequence
  chemically synthesized
gttaccatttccagttaggg

SEQ ID NO: 583870 - DNA, 20 bp, Artificial Sequence
  chemically synthesized
tctccctctcttaacctttt

SEQ ID NO: 583871 - DNA, 20 bp, Artificial Sequence
  chemically synthesized
aatactaaatactaaacagt

SEQ ID NO: 583872 - DNA, 20 bp, Artificial Sequence
  chemically synthesized
gtgatagaatgtgaaacttc

SEQ ID NO: 583873 - DNA, 20 bp, Artificial Sequence
  chemically synthesized
agtgctggggcctcaccagc

SEQ ID NO: 583874 - DNA, 20 bp, Artificial Sequence
  chemically synthesized
tgtatgtatcagtgaggtaa

SEQ ID NO: 583875 - DNA, 20 bp, Artificial Sequence
  chemically synthesized
ggccttgcagtatcttggga

SEQ ID NO: 583876 - DNA, 20 bp, Artificial Sequence
  chemically synthesized
tatcttgggatagggtttaa

SEQ ID NO: 583877 - DNA, 20 bp, Artificial Sequence
  chemically synthesized
tggatttattttgttattgg

SEQ ID NO: 583878 - DNA, 20 bp, Artificial Sequence
  chemically synthesized
ggtcttcacattttttgtac

SEQ ID NO: 583879 - DNA, 20 bp, Artificial Sequence
  chemically synthesized
caaagtctaatacgtcagga

SEQ ID NO: 583880 - DNA, 20 bp, Artificial Sequence
  chemically synthesized
cctgacgtattagactttga

SEQ ID NO: 583881 - DNA, 20 bp, Artificial Sequence
  chemically synthesized
ttagactttgaggaagtttt

SEQ ID NO: 583882 - DNA, 20 bp, Artificial Sequence
  chemically synthesized
tacgacatggctatactatt

SEQ ID NO: 583883 - DNA, 20 bp, Artificial Sequence
  chemically synthesized
caatagtatagccatgtcgt

SEQ ID NO: 583884 - DNA, 20 bp, Artificial Sequence
  chemically synthesized
tctttttcttcctcattaac

SEQ ID NO: 583885 - DNA, 20 bp, Artificial Sequence
  chemically synthesized
tcatctgttaatgaggaaga

SEQ ID NO: 583886 - DNA, 20 bp, Artificial Sequence
  chemically synthesized
attctgcttcaggtgaacct

SEQ ID NO: 583887 - DNA, 20 bp, Artificial Sequence
  chemically synthesized
ggttatgtttccactgttga

SEQ ID NO: 583888 - DNA, 20 bp, Artificial Sequence
  chemically synthesized
tgttgtggttatgtttccac

SEQ ID NO: 583889 - DNA, 20 bp, Artificial Sequence
  chemically synthesized
cacaccctttcctgttgtgg

SEQ ID NO: 583890 - DNA, 20 bp, Artificial Sequence
  chemically synthesized
ggttatatacccctcccctg

SEQ ID NO: 583891 - DNA, 20 bp, Artificial Sequence
  chemically synthesized
attttttttgtgaaaatggc

SEQ ID NO: 583892 - DNA, 20 bp, Artificial Sequence
  chemically synthesized
actcttgtcatactactttt

SEQ ID NO: 583893 - DNA, 20 bp, Artificial Sequence
  chemically synthesized
catttaagtgccaagtaacc

SEQ ID NO: 583894 - DNA, 20 bp, Artificial Sequence
  chemically synthesized
gtattattgaaatggaaatg

SEQ ID NO: 583895 - DNA, 20 bp, Artificial Sequence
  chemically synthesized
tatggctgcatagtattcca

SEQ ID NO: 583896 - DNA, 20 bp, Artificial Sequence
  chemically synthesized
gtttgctgagaatgatggtt

SEQ ID NO: 583897 - DNA, 20 bp, Artificial Sequence
  chemically synthesized
tgcgatagtttgctgagaat

SEQ ID NO: 583898 - DNA, 20 bp, Artificial Sequence
  chemically synthesized
gtttggttttttgtccttgc

SEQ ID NO: 583899 - DNA, 20 bp, Artificial Sequence
  chemically synthesized
gtgagtgagaatatgcggtg

SEQ ID NO: 583900 - DNA, 20 bp, Artificial Sequence
  chemically synthesized
cacctgtgagtgagaatatg

SEQ ID NO: 583901 - DNA, 20 bp, Artificial Sequence
  chemically synthesized
taacttttttttattatact

SEQ ID NO: 583902 - DNA, 20 bp, Artificial Sequence
  chemically synthesized
tgttttatttatttatttat

SEQ ID NO: 583903 - DNA, 20 bp, Artificial Sequence
  chemically synthesized
aaggttatttataccttttt

SEQ ID NO: 583904 - DNA, 20 bp, Artificial Sequence
  chemically synthesized
ggtataaataaccttatatg

SEQ ID NO: 583905 - DNA, 20 bp, Artificial Sequence
  chemically synthesized
tcaaatgaagataactaaat

SEQ ID NO: 583906 - DNA, 20 bp, Artificial Sequence
  chemically synthesized
tcagtgcaccatgtatcaag

SEQ ID NO: 583907 - DNA, 20 bp, Artificial Sequence
  chemically synthesized
tcactgcttgatacatggtg

SEQ ID NO: 583908 - DNA, 20 bp, Artificial Sequence
  chemically synthesized
aaaataagtctctatgattc

SEQ ID NO: 583909 - DNA, 20 bp, Artificial Sequence
  chemically synthesized
gggtattcaaaaataagtct

SEQ ID NO: 583910 - DNA, 20 bp, Artificial Sequence
  chemically synthesized
attctaagacttgtattaat

SEQ ID NO: 583911 - DNA, 20 bp, Artificial Sequence
  chemically synthesized
ctcagaagtagaccctgaga

SEQ ID NO: 583912 - DNA, 20 bp, Artificial Sequence
  chemically synthesized
agctctatcttctcttctac

SEQ ID NO: 583913 - DNA, 20 bp, Artificial Sequence
  chemically synthesized
cccaaccccacatctcctga

SEQ ID NO: 583914 - DNA, 20 bp, Artificial Sequence
  chemically synthesized
tggacccaaccccacatctc

SEQ ID NO: 583915 - DNA, 20 bp, Artificial Sequence
  chemically synthesized
tcaggagatgtggggttggg

SEQ ID NO: 583916 - DNA, 20 bp, Artificial Sequence
  chemically synthesized
tataggcttccttccgatgt

SEQ ID NO: 583917 - DNA, 20 bp, Artificial Sequence
  chemically synthesized
tacttattagcatgcctcgt

SEQ ID NO: 583918 - DNA, 20 bp, Artificial Sequence
  chemically synthesized
tatacgaggcatgctaataa

SEQ ID NO: 583919 - DNA, 20 bp, Artificial Sequence
  chemically synthesized
tggtcaactgcccaattcac

SEQ ID NO: 583920 - DNA, 20 bp, Artificial Sequence
  chemically synthesized
gaaggtgggatatttattga

SEQ ID NO: 583921 - DNA, 20 bp, Artificial Sequence
  chemically synthesized
tattggagttacaattcaag

SEQ ID NO: 583922 - DNA, 20 bp, Artificial Sequence
  chemically synthesized
atggtccctcccacaacacg

SEQ ID NO: 583923 - DNA, 20 bp, Artificial Sequence
  chemically synthesized
aggtaactgaatcatggggg

SEQ ID NO: 583924 - DNA, 20 bp, Artificial Sequence
  chemically synthesized
agcacaggaaaaccccaccc

SEQ ID NO: 583925 - DNA, 20 bp, Artificial Sequence
  chemically synthesized
gaataagtctcatgagatct

SEQ ID NO: 583926 - DNA, 20 bp, Artificial Sequence
  chemically synthesized
gatctgatggttttataaag

SEQ ID NO: 583927 - DNA, 20 bp, Artificial Sequence
  chemically synthesized
tgctcttccttcgccttctg

SEQ ID NO: 583928 - DNA, 20 bp, Artificial Sequence
  chemically synthesized
ggataatttatacaggaaaa

SEQ ID NO: 583929 - DNA, 20 bp, Artificial Sequence
  chemically synthesized
gggataaaggtgttggtctt

SEQ ID NO: 583930 - DNA, 20 bp, Artificial Sequence
  chemically synthesized
gaagaccaacacctttatcc

SEQ ID NO: 583931 - DNA, 20 bp, Artificial Sequence
  chemically synthesized
attccagagataatctcctc

SEQ ID NO: 583932 - DNA, 20 bp, Artificial Sequence
  chemically synthesized
gagcaggctggaagctgggg

SEQ ID NO: 583933 - DNA, 20 bp, Artificial Sequence
  chemically synthesized
actcacaggtacttgtagtt

SEQ ID NO: 583934 - DNA, 20 bp, Artificial Sequence
  chemically synthesized
gtacttgtagttagacgctt

SEQ ID NO: 583935 - DNA, 20 bp, Artificial Sequence
  chemically synthesized
ggtcaaatctatcttacctg

SEQ ID NO: 583936 - DNA, 20 bp, Artificial Sequence
  chemically synthesized
tacagaaacgaggcaggtaa

SEQ ID NO: 583937 - DNA, 20 bp, Artificial Sequence
  chemically synthesized
ccctttatttaggtattgtc

SEQ ID NO: 583938 - DNA, 20 bp, Artificial Sequence
  chemically synthesized
aaggaccgatactagatatt

SEQ ID NO: 583939 - DNA, 20 bp, Artificial Sequence
  chemically synthesized
aactatataagggatcaaca

SEQ ID NO: 583940 - DNA, 20 bp, Artificial Sequence
  chemically synthesized
cacaactgagatatcagaat

SEQ ID NO: 583941 - DNA, 20 bp, Artificial Sequence
  chemically synthesized
aggcttcttgacctccaata

SEQ ID NO: 583942 - DNA, 20 bp, Artificial Sequence
  chemically synthesized
aaaatcatctcttcctgtaa

SEQ ID NO: 583943 - DNA, 20 bp, Artificial Sequence
  chemically synthesized
ccaaacttaattacaggaag

SEQ ID NO: 583944 - DNA, 20 bp, Artificial Sequence
  chemically synthesized
acaggaagagatgattttac

SEQ ID NO: 583945 - DNA, 20 bp, Artificial Sequence
  chemically synthesized
cgcccggcccagagttttct

SEQ ID NO: 583946 - DNA, 20 bp, Artificial Sequence
  chemically synthesized
gtgagccaccgcgcccggcc

SEQ ID NO: 583947 - DNA, 20 bp, Artificial Sequence
  chemically synthesized
cgcctcggccttccaaagtg

SEQ ID NO: 583948 - DNA, 20 bp, Artificial Sequence
  chemically synthesized
tttgtgttttttagtagaga

SEQ ID NO: 583949 - DNA, 20 bp, Artificial Sequence
  chemically synthesized
accacgcccggctaattttt

SEQ ID NO: 583950 - DNA, 20 bp, Artificial Sequence
  chemically synthesized
aatggcgtgaacccgggagg

SEQ ID NO: 583951 - DNA, 20 bp, Artificial Sequence
  chemically synthesized
catatagaagagccagttaa

SEQ ID NO: 583952 - DNA, 20 bp, Artificial Sequence
  chemically synthesized
agagacatttgaatcaaata

SEQ ID NO: 583953 - DNA, 20 bp, Artificial Sequence
  chemically synthesized
tgaagactccaaatcaggat

SEQ ID NO: 583954 - DNA, 20 bp, Artificial Sequence
  chemically synthesized
ttgaaagaaattgcatatag

SEQ ID NO: 583955 - DNA, 20 bp, Artificial Sequence
  chemically synthesized
gaacattaatgttctacaat

SEQ ID NO: 583956 - DNA, 20 bp, Artificial Sequence
  chemically synthesized
acattaatgttctcaggccc

SEQ ID NO: 583957 - DNA, 20 bp, Artificial Sequence
  chemically synthesized
cccagcagcttgtggataag

SEQ ID NO: 583958 - DNA, 20 bp, Artificial Sequence
  chemically synthesized
gattcacattgacatttaca

SEQ ID NO: 583959 - DNA, 20 bp, Artificial Sequence
  chemically synthesized
acaggactttgcatgggtct

SEQ ID NO: 583960 - DNA, 20 bp, Artificial Sequence
  chemically synthesized
atgcaaagtcctgtctacct

SEQ ID NO: 583961 - DNA, 20 bp, Artificial Sequence
  chemically synthesized
tgaaagtctctagaggaact

SEQ ID NO: 583962 - DNA, 20 bp, Artificial Sequence
  chemically synthesized
gctctgcagggcaaatactg

SEQ ID NO: 583963 - DNA, 20 bp, Artificial Sequence
  chemically synthesized
tctccccaccccgaggatgt

SEQ ID NO: 583964 - DNA, 20 bp, Artificial Sequence
  chemically synthesized
gagtagaggtgctaaaataa

SEQ ID NO: 583965 - DNA, 20 bp, Artificial Sequence
  chemically synthesized
tctgctgtgtgcagcaagga

SEQ ID NO: 583966 - DNA, 20 bp, Artificial Sequence
  chemically synthesized
taggttatgctgatgctggc

SEQ ID NO: 583967 - DNA, 20 bp, Artificial Sequence
  chemically synthesized
tgcctcagcctcccatagtg

SEQ ID NO: 583968 - DNA, 20 bp, Artificial Sequence
  chemically synthesized
ttttgtatttttagtagaga

SEQ ID NO: 583969 - DNA, 20 bp, Artificial Sequence
  chemically synthesized
tgcctcagcctcctgagtag

SEQ ID NO: 583970 - DNA, 20 bp, Artificial Sequence
  chemically synthesized
tcaggaggctgaggcaggag

SEQ ID NO: 583971 - DNA, 20 bp, Artificial Sequence
  chemically synthesized
gaggcagaggttgctgtgag

SEQ ID NO: 583972 - DNA, 20 bp, Artificial Sequence
  chemically synthesized
ctgggcttcaaccccagagt

SEQ ID NO: 583973 - DNA, 20 bp, Artificial Sequence
  chemically synthesized
agattactgggcttcaaccc

SEQ ID NO: 583974 - DNA, 20 bp, Artificial Sequence
  chemically synthesized
tcttcgcaaagtatagatta

SEQ ID NO: 583975 - DNA, 20 bp, Artificial Sequence
  chemically synthesized
ccacccagttcttcgcaaag

SEQ ID NO: 583976 - DNA, 20 bp, Artificial Sequence
  chemically synthesized
tggtaatttttgagaattaa

SEQ ID NO: 583977 - DNA, 20 bp, Artificial Sequence
  chemically synthesized
taagaccaacacttttgatc

SEQ ID NO: 583978 - DNA, 20 bp, Artificial Sequence
  chemically synthesized
ttccctccttttccccaatg

SEQ ID NO: 583979 - DNA, 20 bp, Artificial Sequence
  chemically synthesized
gggtatgcatattggggata

SEQ ID NO: 583980 - DNA, 20 bp, Artificial Sequence
  chemically synthesized
aaagcacctcaaaagatcag

SEQ ID NO: 583981 - DNA, 20 bp, Artificial Sequence
  chemically synthesized
gaatctgggctgatcttttg

SEQ ID NO: 583982 - DNA, 20 bp, Artificial Sequence
  chemically synthesized
taacttagcagaagtaacct

SEQ ID NO: 583983 - DNA, 20 bp, Artificial Sequence
  chemically synthesized
gctacaagaccttctgatgc

SEQ ID NO: 583984 - DNA, 20 bp, Artificial Sequence
  chemically synthesized
gcctaggcatcagaaggtct

SEQ ID NO: 583985 - DNA, 20 bp, Artificial Sequence
  chemically synthesized
tcattacatggtattctcag

SEQ ID NO: 583986 - DNA, 20 bp, Artificial Sequence
  chemically synthesized
tcatcatcctgtaggctaga

SEQ ID NO: 583987 - DNA, 20 bp, Artificial Sequence
  chemically synthesized
ggccactcatcatcctgtag

SEQ ID NO: 583988 - DNA, 20 bp, Artificial Sequence
  chemically synthesized
gctggctgttggttgcagaa

SEQ ID NO: 583989 - DNA, 20 bp, Artificial Sequence
  chemically synthesized
ctggatagttattctgatgg

SEQ ID NO: 583990 - DNA, 20 bp, Artificial Sequence
  chemically synthesized
ctgtgtgtctgaagtttgct

SEQ ID NO: 583991 - DNA, 20 bp, Artificial Sequence
  chemically synthesized
tgctcataattctgtgtgtc

SEQ ID NO: 583992 - DNA, 20 bp, Artificial Sequence
  chemically synthesized
agaattatgagcaataaatc

SEQ ID NO: 583993 - DNA, 20 bp, Artificial Sequence
  chemically synthesized
aaaacttaacagttcaaaac

SEQ ID NO: 583994 - DNA, 20 bp, Artificial Sequence
  chemically synthesized
aaatcactcgttttgaactg

SEQ ID NO: 583995 - DNA, 20 bp, Artificial Sequence
  chemically synthesized
ttttgaactgttaagttttg

SEQ ID NO: 583996 - DNA, 20 bp, Artificial Sequence
  chemically synthesized
ttgcttagacacctgtccat

SEQ ID NO: 583997 - DNA, 20 bp, Artificial Sequence
  chemically synthesized
gtgtctaagcaacaacaatt

SEQ ID NO: 583998 - DNA, 20 bp, Artificial Sequence
  chemically synthesized
aaagcaaaacttgcaattgt

SEQ ID NO: 583999 - DNA, 20 bp, Artificial Sequence
  chemically synthesized
taagcaacaacaattgcaag

SEQ ID NO: 584000 - DNA, 20 bp, Artificial Sequence
  chemically synthesized
tttgctttttttttccagta

SEQ ID NO: 584001 - DNA, 20 bp, Artificial Sequence
  chemically synthesized
ggccttgcctgagctgtata

SEQ ID NO: 584002 - DNA, 20 bp, Artificial Sequence
  chemically synthesized
atttaagtaagcagccacaa

SEQ ID NO: 584003 - DNA, 20 bp, Artificial Sequence
  chemically synthesized
actaaaccaaactaccttgt

SEQ ID NO: 584004 - DNA, 20 bp, Artificial Sequence
  chemically synthesized
agtaagcagccacaaggtag

SEQ ID NO: 584005 - DNA, 20 bp, Artificial Sequence
  chemically synthesized
ctgaggcctaaagttgcttg

SEQ ID NO: 584006 - DNA, 20 bp, Artificial Sequence
  chemically synthesized
agaagctgaggcctaaagtt

SEQ ID NO: 584007 - DNA, 20 bp, Artificial Sequence
  chemically synthesized
caaaacaagcaactttaggc

SEQ ID NO: 584008 - DNA, 20 bp, Artificial Sequence
  chemically synthesized
atgtagaagctgaggcctaa

SEQ ID NO: 584009 - DNA, 20 bp, Artificial Sequence
  chemically synthesized
taataattgcaataattatt

SEQ ID NO: 584010 - DNA, 20 bp, Artificial Sequence
  chemically synthesized
attgcaataattattccaag

SEQ ID NO: 584011 - DNA, 20 bp, Artificial Sequence
  chemically synthesized
ccaccttgactggcctgttt

SEQ ID NO: 584012 - DNA, 20 bp, Artificial Sequence
  chemically synthesized
ggcatgagccaccttgactg

SEQ ID NO: 584013 - DNA, 20 bp, Artificial Sequence
  chemically synthesized
tgcctcagcctctcaaagtg

SEQ ID NO: 584014 - DNA, 20 bp, Artificial Sequence
  chemically synthesized
caggcggatcacttgaggtc

SEQ ID NO: 584015 - DNA, 20 bp, Artificial Sequence
  chemically synthesized
caccatgcccagctaatttt

SEQ ID NO: 584016 - DNA, 20 bp, Artificial Sequence
  chemically synthesized
ttgggaggctgaggcaggag

SEQ ID NO: 584017 - DNA, 20 bp, Artificial Sequence
  chemically synthesized
aacctctgcctttcaggttc

SEQ ID NO: 584018 - DNA, 20 bp, Artificial Sequence
  chemically synthesized
ctggagtgcagtggtgcgat

SEQ ID NO: 584019 - DNA, 20 bp, Artificial Sequence
  chemically synthesized
actccagcctgggcaacaga

SEQ ID NO: 584020 - DNA, 20 bp, Artificial Sequence
  chemically synthesized
agtaaaagtgatacaagttt

SEQ ID NO: 584021 - DNA, 20 bp, Artificial Sequence
  chemically synthesized
ttatctggagtaaaagtgat

SEQ ID NO: 584022 - DNA, 20 bp, Artificial Sequence
  chemically synthesized
cacttttactccagataaat

SEQ ID NO: 584023 - DNA, 20 bp, Artificial Sequence
  chemically synthesized
gcctgtgttttgttttgtgg

SEQ ID NO: 584024 - DNA, 20 bp, Artificial Sequence
  chemically synthesized
gtcaagctccacagcctgtg

SEQ ID NO: 584025 - DNA, 20 bp, Artificial Sequence
  chemically synthesized
acaaaacaaaacacaggctg

SEQ ID NO: 584026 - DNA, 20 bp, Artificial Sequence
  chemically synthesized
cacatgtcaagctccacagc

SEQ ID NO: 584027 - DNA, 20 bp, Artificial Sequence
  chemically synthesized
cttgacatgtggactgaaac

SEQ ID NO: 584028 - DNA, 20 bp, Artificial Sequence
  chemically synthesized
acatgtggactgaaaccctt

SEQ ID NO: 584029 - DNA, 20 bp, Artificial Sequence
  chemically synthesized
gtggactgaaacccttgctt

SEQ ID NO: 584030 - DNA, 20 bp, Artificial Sequence
  chemically synthesized
cagctagaaagcaagcaagc

SEQ ID NO: 584031 - DNA, 20 bp, Artificial Sequence
  chemically synthesized
tgaggtttagaggggagata

SEQ ID NO: 584032 - DNA, 20 bp, Artificial Sequence
  chemically synthesized
tttttaaagattaaggagcc

SEQ ID NO: 584033 - DNA, 20 bp, Artificial Sequence
  chemically synthesized
aagaacatatagataatttt

SEQ ID NO: 584034 - DNA, 20 bp, Artificial Sequence
  chemically synthesized
gtagaagctacacatatact

SEQ ID NO: 584035 - DNA, 20 bp, Artificial Sequence
  chemically synthesized
gttaaagctacaagtatatg

SEQ ID NO: 584036 - DNA, 20 bp, Artificial Sequence
  chemically synthesized
atttataattcattatagca

SEQ ID NO: 584037 - DNA, 20 bp, Artificial Sequence
  chemically synthesized
tagaatttataattcattat

SEQ ID NO: 584038 - DNA, 20 bp, Artificial Sequence
  chemically synthesized
atttgtattatgcttcttgt

SEQ ID NO: 584039 - DNA, 20 bp, Artificial Sequence
  chemically synthesized
atacaagaagcataatacaa

SEQ ID NO: 584040 - DNA, 20 bp, Artificial Sequence
  chemically synthesized
aaaagaaaatctaatttgta

SEQ ID NO: 584041 - DNA, 20 bp, Artificial Sequence
  chemically synthesized
tttttttatattgcatttat

SEQ ID NO: 584042 - DNA, 20 bp, Artificial Sequence
  chemically synthesized
gttcaaatatcagaataaag

SEQ ID NO: 584043 - DNA, 20 bp, Artificial Sequence
  chemically synthesized
tcagagctgcttttattaaa

SEQ ID NO: 584044 - DNA, 20 bp, Artificial Sequence
  chemically synthesized
aggtagtcatttaaattcag

SEQ ID NO: 584045 - DNA, 20 bp, Artificial Sequence
  chemically synthesized
tctgaatttaaatgactacc

SEQ ID NO: 584046 - DNA, 20 bp, Artificial Sequence
  chemically synthesized
catcttgacttaatgctcag

SEQ ID NO: 584047 - DNA, 20 bp, Artificial Sequence
  chemically synthesized
gacttaatgctcagatctgt

SEQ ID NO: 584048 - DNA, 20 bp, Artificial Sequence
  chemically synthesized
tgctaaagaggatgaaaagc

SEQ ID NO: 584049 - DNA, 20 bp, Artificial Sequence
  chemically synthesized
agaggaattttctcaaaagc

SEQ ID NO: 584050 - DNA, 20 bp, Artificial Sequence
  chemically synthesized
aactctgccagctatcacca

SEQ ID NO: 584051 - DNA, 20 bp, Artificial Sequence
  chemically synthesized
tgggaatgccctcagctcaa

SEQ ID NO: 584052 - DNA, 20 bp, Artificial Sequence
  chemically synthesized
tatgaaagatgagtatctct

SEQ ID NO: 584053 - DNA, 20 bp, Artificial Sequence
  chemically synthesized
aggctcacttcctcacttac

SEQ ID NO: 584054 - DNA, 20 bp, Artificial Sequence
  chemically synthesized
ttctgatgttctcttaacag

SEQ ID NO: 584055 - DNA, 20 bp, Artificial Sequence
  chemically synthesized
attgtctatagtgtggtcag

SEQ ID NO: 584056 - DNA, 20 bp, Artificial Sequence
  chemically synthesized
ataataccctcatcccatct

SEQ ID NO: 584057 - DNA, 20 bp, Artificial Sequence
  chemically synthesized
tgcttagttgttctctgtaa

SEQ ID NO: 584058 - DNA, 20 bp, Artificial Sequence
  chemically synthesized
tttctcaaatgtcagtgtgc

SEQ ID NO: 584059 - DNA, 20 bp, Artificial Sequence
  chemically synthesized
cagtgtgcacaggattcacc

SEQ ID NO: 584060 - DNA, 20 bp, Artificial Sequence
  chemically synthesized
acctggggattctattaaaa

SEQ ID NO: 584061 - DNA, 20 bp, Artificial Sequence
  chemically synthesized
ggattctattaaaatgcaga

SEQ ID NO: 584062 - DNA, 20 bp, Artificial Sequence
  chemically synthesized
agtgggtctaggataggggc

SEQ ID NO: 584063 - DNA, 20 bp, Artificial Sequence
  chemically synthesized
aagtgctgtagagtgtagtc

SEQ ID NO: 584064 - DNA, 20 bp, Artificial Sequence
  chemically synthesized
agacagtatatattttcttc

SEQ ID NO: 584065 - DNA, 20 bp, Artificial Sequence
  chemically synthesized
ctttctctttcaattacaat

SEQ ID NO: 584066 - DNA, 20 bp, Artificial Sequence
  chemically synthesized
aagaaaaatacattggaagt

SEQ ID NO: 584067 - DNA, 20 bp, Artificial Sequence
  chemically synthesized
tgtaacttacctaaatgtaa

SEQ ID NO: 584068 - DNA, 20 bp, Artificial Sequence
  chemically synthesized
tttaggtaagttacacgtta

SEQ ID NO: 584069 - DNA, 20 bp, Artificial Sequence
  chemically synthesized
cgttaaatggatttcggcgc

SEQ ID NO: 584070 - DNA, 20 bp, Artificial Sequence
  chemically synthesized
agccttcctaccatgtgtaa

SEQ ID NO: 584071 - DNA, 20 bp, Artificial Sequence
  chemically synthesized
gggacataaactcatgagtt

SEQ ID NO: 584072 - DNA, 20 bp, Artificial Sequence
  chemically synthesized
gtttgttaaactctgaactc

SEQ ID NO: 584073 - DNA, 20 bp, Artificial Sequence
  chemically synthesized
ttatgttccaatgatgtttt

SEQ ID NO: 584074 - DNA, 20 bp, Artificial Sequence
  chemically synthesized
atgaagagattatgttccaa

SEQ ID NO: 584075 - DNA, 20 bp, Artificial Sequence
  chemically synthesized
tcagactctgtaactccatg

SEQ ID NO: 584076 - DNA, 20 bp, Artificial Sequence
  chemically synthesized
ctatgttatcatttattggt

SEQ ID NO: 584077 - DNA, 20 bp, Artificial Sequence
  chemically synthesized
tggttccctcagcgcatatg

SEQ ID NO: 584078 - DNA, 20 bp, Artificial Sequence
  chemically synthesized
tactcaactgtgtcaggttt

SEQ ID NO: 584079 - DNA, 20 bp, Artificial Sequence
  chemically synthesized
cagggttatactcaactgtg

SEQ ID NO: 584080 - DNA, 20 bp, Artificial Sequence
  chemically synthesized
tgatacagcaatttcagtgt

SEQ ID NO: 584081 - DNA, 20 bp, Artificial Sequence
  chemically synthesized
ttgacaaaaaaaaaaaacca

SEQ ID NO: 584082 - DNA, 20 bp, Artificial Sequence
  chemically synthesized
gactttggagacttaagcat

SEQ ID NO: 584083 - DNA, 20 bp, Artificial Sequence
  chemically synthesized
attactcggcagtcatcaga

SEQ ID NO: 584084 - DNA, 20 bp, Artificial Sequence
  chemically synthesized
cagtgcatctcatgtgccct

SEQ ID NO: 584085 - DNA, 20 bp, Artificial Sequence
  chemically synthesized
ggcacatgagatgcactgtc

SEQ ID NO: 584086 - DNA, 20 bp, Artificial Sequence
  chemically synthesized
gatgcactgtccccagattg

SEQ ID NO: 584087 - DNA, 20 bp, Artificial Sequence
  chemically synthesized
attagaaggcataaatagtg

SEQ ID NO: 584088 - DNA, 20 bp, Artificial Sequence
  chemically synthesized
aattcattagaaggcataaa

SEQ ID NO: 584089 - DNA, 20 bp, Artificial Sequence
  chemically synthesized
tatttatgccttctaatgaa

SEQ ID NO: 584090 - DNA, 20 bp, Artificial Sequence
  chemically synthesized
ttatgattgtgctaccccag

SEQ ID NO: 584091 - DNA, 20 bp, Artificial Sequence
  chemically synthesized
gtgactggttcttcaggtaa

SEQ ID NO: 584092 - DNA, 20 bp, Artificial Sequence
  chemically synthesized
tttacctgaagaaccagtca

SEQ ID NO: 584093 - DNA, 20 bp, Artificial Sequence
  chemically synthesized
aagaaccagtcaccatgctt

SEQ ID NO: 584094 - DNA, 20 bp, Artificial Sequence
  chemically synthesized
ttgtctgcttttcaaagatc

SEQ ID NO: 584095 - DNA, 20 bp, Artificial Sequence
  chemically synthesized
tttgtttttttttttgcctt

SEQ ID NO: 584096 - DNA, 20 bp, Artificial Sequence
  chemically synthesized
ctttgggtgttgttttttgt

SEQ ID NO: 584097 - DNA, 20 bp, Artificial Sequence
  chemically synthesized
aaacatctttgggtgttgtt

SEQ ID NO: 584098 - DNA, 20 bp, Artificial Sequence
  chemically synthesized
aaacaaaaaacaacacccaa

SEQ ID NO: 584099 - DNA, 20 bp, Artificial Sequence
  chemically synthesized
gaactaaaaacatctttggg

SEQ ID NO: 584100 - DNA, 20 bp, Artificial Sequence
  chemically synthesized
attatggaatggtacagcaa

SEQ ID NO: 584101 - DNA, 20 bp, Artificial Sequence
  chemically synthesized
attctcatggcaatgttaat

SEQ ID NO: 584102 - DNA, 20 bp, Artificial Sequence
  chemically synthesized
catttagctgtagttttaac

SEQ ID NO: 584103 - DNA, 20 bp, Artificial Sequence
  chemically synthesized
ggaatatttcctcatttagc

SEQ ID NO: 584104 - DNA, 20 bp, Artificial Sequence
  chemically synthesized
aggaaatattcctcccccaa

SEQ ID NO: 584105 - DNA, 20 bp, Artificial Sequence
  chemically synthesized
tttagttcaagaaaaagaaa

SEQ ID NO: 584106 - DNA, 20 bp, Artificial Sequence
  chemically synthesized
taaaaatgggagagctctta

SEQ ID NO: 584107 - DNA, 20 bp, Artificial Sequence
  chemically synthesized
agaggtgctagtaggactgt

SEQ ID NO: 584108 - DNA, 20 bp, Artificial Sequence
  chemically synthesized
agtaggactgtgtgtgtttc

SEQ ID NO: 584109 - DNA, 20 bp, Artificial Sequence
  chemically synthesized
tgtgtgtgtttctgtggttt

SEQ ID NO: 584110 - DNA, 20 bp, Artificial Sequence
  chemically synthesized
agagtggaaggacaacttgg

SEQ ID NO: 584111 - DNA, 20 bp, Artificial Sequence
  chemically synthesized
agatgtagggctcctgcgag

SEQ ID NO: 584112 - DNA, 20 bp, Artificial Sequence
  chemically synthesized
agattgtgggagagtctgaa

SEQ ID NO: 584113 - DNA, 20 bp, Artificial Sequence
  chemically synthesized
caaggaagagaagagcacaa

SEQ ID NO: 584114 - DNA, 20 bp, Artificial Sequence
  chemically synthesized
gtacattccttggaaattga

SEQ ID NO: 584115 - DNA, 20 bp, Artificial Sequence
  chemically synthesized
ttttgcacagtcaataacac

SEQ ID NO: 584116 - DNA, 20 bp, Artificial Sequence
  chemically synthesized
atgactgggtgagagagaaa

SEQ ID NO: 584117 - DNA, 20 bp, Artificial Sequence
  chemically synthesized
tcagtccaggagctaggtca

SEQ ID NO: 584118 - DNA, 20 bp, Artificial Sequence
  chemically synthesized
tgccctcagctcttgaagta

SEQ ID NO: 584119 - DNA, 20 bp, Artificial Sequence
  chemically synthesized
gctctgagtggaaggcggta

SEQ ID NO: 584120 - DNA, 20 bp, Artificial Sequence
  chemically synthesized
gttaatcgaataagtaatgt

SEQ ID NO: 584121 - DNA, 20 bp, Artificial Sequence
  chemically synthesized
gaaaagcatacacattactt

SEQ ID NO: 584122 - DNA, 20 bp, Artificial Sequence
  chemically synthesized
atccaataatatattcacca

SEQ ID NO: 584123 - DNA, 20 bp, Artificial Sequence
  chemically synthesized
atccatttggtgaatatatt

SEQ ID NO: 584124 - DNA, 20 bp, Artificial Sequence
  chemically synthesized
aataaaattatgcctggaga

SEQ ID NO: 584125 - DNA, 20 bp, Artificial Sequence
  chemically synthesized
ttttgttggtttgttttcac

SEQ ID NO: 584126 - DNA, 20 bp, Artificial Sequence
  chemically synthesized
gagggaactgttttttgttg

SEQ ID NO: 584127 - DNA, 20 bp, Artificial Sequence
  chemically synthesized
ctgagagggaactgtttttt

SEQ ID NO: 584128 - DNA, 20 bp, Artificial Sequence
  chemically synthesized
taagctagttgctgagaggg

SEQ ID NO: 584129 - DNA, 20 bp, Artificial Sequence
  chemically synthesized
aaaacagttccctctcagca

SEQ ID NO: 584130 - DNA, 20 bp, Artificial Sequence
  chemically synthesized
actgggggtgagccagtaca

SEQ ID NO: 584131 - DNA, 20 bp, Artificial Sequence
  chemically synthesized
ctaatttggctcaaagcagg

SEQ ID NO: 584132 - DNA, 20 bp, Artificial Sequence
  chemically synthesized
gaagtagcccttcaaacttg

SEQ ID NO: 584133 - DNA, 20 bp, Artificial Sequence
  chemically synthesized
cagcacaccactggccatat

SEQ ID NO: 584134 - DNA, 20 bp, Artificial Sequence
  chemically synthesized
caactggatctctgatctca

SEQ ID NO: 584135 - DNA, 20 bp, Artificial Sequence
  chemically synthesized
tctcagggtgtttaaaaaca

SEQ ID NO: 584136 - DNA, 20 bp, Artificial Sequence
  chemically synthesized
gtttaaaaacaccttgtttt

SEQ ID NO: 584137 - DNA, 20 bp, Artificial Sequence
  chemically synthesized
attggcaaacactaaaaaca

SEQ ID NO: 584138 - DNA, 20 bp, Artificial Sequence
  chemically synthesized
cagcagaatgtgagcagaag

SEQ ID NO: 584139 - DNA, 20 bp, Artificial Sequence
  chemically synthesized
tgtgagcagaagtgttgttt

SEQ ID NO: 584140 - DNA, 20 bp, Artificial Sequence
  chemically synthesized
gttgtttgtcagtttggggc

SEQ ID NO: 584141 - DNA, 20 bp, Artificial Sequence
  chemically synthesized
tgaggctttgaaaaatttag

SEQ ID NO: 584142 - DNA, 20 bp, Artificial Sequence
  chemically synthesized
tgccgtaggacctaagagtc

SEQ ID NO: 584143 - DNA, 20 bp, Artificial Sequence
  chemically synthesized
attctctcctcagtaagttg

SEQ ID NO: 584144 - DNA, 20 bp, Artificial Sequence
  chemically synthesized
cagcaattagcaaggtctcc

SEQ ID NO: 584145 - DNA, 20 bp, Artificial Sequence
  chemically synthesized
ctgcatggtagccccggagt

SEQ ID NO: 584146 - DNA, 20 bp, Artificial Sequence
  chemically synthesized
aattttccaggtggtgttga

SEQ ID NO: 584147 - DNA, 20 bp, Artificial Sequence
  chemically synthesized
gattaggtgtaatagatatc

SEQ ID NO: 584148 - DNA, 20 bp, Artificial Sequence
  chemically synthesized
tctatgataaatgctcaggt

SEQ ID NO: 584149 - DNA, 20 bp, Artificial Sequence
  chemically synthesized
agaccctcagatcattttca

SEQ ID NO: 584150 - DNA, 20 bp, Artificial Sequence
  chemically synthesized
ccttggtagcttttctctgc

SEQ ID NO: 584151 - DNA, 20 bp, Artificial Sequence
  chemically synthesized
cctctgcctgccattccctt

SEQ ID NO: 584152 - DNA, 20 bp, Artificial Sequence
  chemically synthesized
aggaagaagatgaacaggac

SEQ ID NO: 584153 - DNA, 20 bp, Artificial Sequence
  chemically synthesized
tgcaataacatatgtaagaa

SEQ ID NO: 584154 - DNA, 20 bp, Artificial Sequence
  chemically synthesized
agcgtatgttttcctagtca

SEQ ID NO: 584155 - DNA, 20 bp, Artificial Sequence
  chemically synthesized
tgctcacatgacaacccagc

SEQ ID NO: 584156 - DNA, 20 bp, Artificial Sequence
  chemically synthesized
tgtaatgaactaaatatttc

SEQ ID NO: 584157 - DNA, 20 bp, Artificial Sequence
  chemically synthesized
ctactatactggtaaggtat

SEQ ID NO: 584158 - DNA, 20 bp, Artificial Sequence
  chemically synthesized
agtatagtagcactagtcac

SEQ ID NO: 584159 - DNA, 20 bp, Artificial Sequence
  chemically synthesized
ttatctcttataggcactgg

SEQ ID NO: 584160 - DNA, 20 bp, Artificial Sequence
  chemically synthesized
gtgcctataagagataatag

SEQ ID NO: 584161 - DNA, 20 bp, Artificial Sequence
  chemically synthesized
ttttgtatcactgtaaattc

SEQ ID NO: 584162 - DNA, 20 bp, Artificial Sequence
  chemically synthesized
ccttatgaggaatacaaata

SEQ ID NO: 584163 - DNA, 20 bp, Artificial Sequence
  chemically synthesized
tacaaataacttgattgatg

SEQ ID NO: 584164 - DNA, 20 bp, Artificial Sequence
  chemically synthesized
agtttctggctcttttccaa

SEQ ID NO: 584165 - DNA, 20 bp, Artificial Sequence
  chemically synthesized
ccattcctatttaaagagtt

SEQ ID NO: 584166 - DNA, 20 bp, Artificial Sequence
  chemically synthesized
gttcattccattcctattta

SEQ ID NO: 584167 - DNA, 20 bp, Artificial Sequence
  chemically synthesized
gaatgaacccaacctaactg

SEQ ID NO: 584168 - DNA, 20 bp, Artificial Sequence
  chemically synthesized
ggaatgtttcatatacacgt

SEQ ID NO: 584169 - DNA, 20 bp, Artificial Sequence
  chemically synthesized
tgaaatgattcgcattaaat

SEQ ID NO: 584170 - DNA, 20 bp, Artificial Sequence
  chemically synthesized
ataaagtaatggtttcattg

SEQ ID NO: 584171 - DNA, 20 bp, Artificial Sequence
  chemically synthesized
ttttctggaataaataaagt

SEQ ID NO: 584172 - DNA, 20 bp, Artificial Sequence
  chemically synthesized
gccagactttgtgccagtta

SEQ ID NO: 584173 - DNA, 20 bp, Artificial Sequence
  chemically synthesized
aggttacgaacttcagtttt

SEQ ID NO: 584174 - DNA, 20 bp, Artificial Sequence
  chemically synthesized
aatgcttagaggttacgaac

SEQ ID NO: 584175 - DNA, 20 bp, Artificial Sequence
  chemically synthesized
taatttacttacatgtctgt

SEQ ID NO: 584176 - DNA, 20 bp, Artificial Sequence
  chemically synthesized
gacatgtaagtaaattagaa

SEQ ID NO: 584177 - DNA, 20 bp, Artificial Sequence
  chemically synthesized
acagagattttaggaaaaaa

SEQ ID NO: 584178 - DNA, 20 bp, Artificial Sequence
  chemically synthesized
tcaacaagacacctcggggg

SEQ ID NO: 584179 - DNA, 20 bp, Artificial Sequence
  chemically synthesized
ctttcaaaataaattcaaat

SEQ ID NO: 584180 - DNA, 20 bp, Artificial Sequence
  chemically synthesized
tttattttgaaagacgacta

SEQ ID NO: 584181 - DNA, 20 bp, Artificial Sequence
  chemically synthesized
tgaaatgccctttttccacc

SEQ ID NO: 584182 - DNA, 20 bp, Artificial Sequence
  chemically synthesized
atacctcttgccattttgca

SEQ ID NO: 584183 - DNA, 20 bp, Artificial Sequence
  chemically synthesized
tgtcctggctatctagacta

SEQ ID NO: 584184 - DNA, 20 bp, Artificial Sequence
  chemically synthesized
ctaaacacttccatctactc

SEQ ID NO: 584185 - DNA, 20 bp, Artificial Sequence
  chemically synthesized
taaaaccacagagtagatgg

SEQ ID NO: 584186 - DNA, 20 bp, Artificial Sequence
  chemically synthesized
tagagaagaagagccatatg

SEQ ID NO: 584187 - DNA, 20 bp, Artificial Sequence
  chemically synthesized
gaagagccatatgatacgat

SEQ ID NO: 584188 - DNA, 20 bp, Artificial Sequence
  chemically synthesized
cgattcgtgttttgcattgt

SEQ ID NO: 584189 - DNA, 20 bp, Artificial Sequence
  chemically synthesized
gggaagtggtcagctggact

SEQ ID NO: 584190 - DNA, 20 bp, Artificial Sequence
  chemically synthesized
atttttcttgcctttgatag

SEQ ID NO: 584191 - DNA, 20 bp, Artificial Sequence
  chemically synthesized
tttgatggcaagtttctctt

SEQ ID NO: 584192 - DNA, 20 bp, Artificial Sequence
  chemically synthesized
cgaagagaaacttgccatca

SEQ ID NO: 584193 - DNA, 20 bp, Artificial Sequence
  chemically synthesized
ctggaagaaacaatttgatg

SEQ ID NO: 584194 - DNA, 20 bp, Artificial Sequence
  chemically synthesized
cttccagttgtgggatatga

SEQ ID NO: 584195 - DNA, 20 bp, Artificial Sequence
  chemically synthesized
aattaaagaataaaagattg

SEQ ID NO: 584196 - DNA, 20 bp, Artificial Sequence
  chemically synthesized
ggtactatgaattaaagaat

SEQ ID NO: 584197 - DNA, 20 bp, Artificial Sequence
  chemically synthesized
attctttaattcatagtacc

SEQ ID NO: 584198 - DNA, 20 bp, Artificial Sequence
  chemically synthesized
gccccttccccttcctctcc

SEQ ID NO: 584199 - DNA, 20 bp, Artificial Sequence
  chemically synthesized
ccaccctatctaaaaaaatc

SEQ ID NO: 584200 - DNA, 20 bp, Artificial Sequence
  chemically synthesized
ctaatcccagttggctaaac

SEQ ID NO: 584201 - DNA, 20 bp, Artificial Sequence
  chemically synthesized
aaaatcaaatgtttagccaa

SEQ ID NO: 584202 - DNA, 20 bp, Artificial Sequence
  chemically synthesized
caaatgtttagccaactggg

SEQ ID NO: 584203 - DNA, 20 bp, Artificial Sequence
  chemically synthesized
gtttagccaactgggattag

SEQ ID NO: 584204 - DNA, 20 bp, Artificial Sequence
  chemically synthesized
acccctctgtgcagaagtaa

SEQ ID NO: 584205 - DNA, 20 bp, Artificial Sequence
  chemically synthesized
aggacattgaacactcgaac

SEQ ID NO: 584206 - DNA, 20 bp, Artificial Sequence
  chemically synthesized
tgttcgagtgttcaatgtcc

SEQ ID NO: 584207 - DNA, 20 bp, Artificial Sequence
  chemically synthesized
tgagtcctctatgccttgta

SEQ ID NO: 584208 - DNA, 20 bp, Artificial Sequence
  chemically synthesized
tgttttctttatatccagtc

SEQ ID NO: 584209 - DNA, 20 bp, Artificial Sequence
  chemically synthesized
aggaaaagagaaagagataa

SEQ ID NO: 584210 - DNA, 20 bp, Artificial Sequence
  chemically synthesized
tgggacttgaaggagcctat

SEQ ID NO: 584211 - DNA, 20 bp, Artificial Sequence
  chemically synthesized
ccaggcgtgcaatcatttta

SEQ ID NO: 584212 - DNA, 20 bp, Artificial Sequence
  chemically synthesized
aagaaaaaataagcctaata

SEQ ID NO: 584213 - DNA, 20 bp, Artificial Sequence
  chemically synthesized
ctactcaggaggctgaggtg

SEQ ID NO: 584214 - DNA, 20 bp, Artificial Sequence
  chemically synthesized
catacatttttatgtagaga

SEQ ID NO: 584215 - DNA, 20 bp, Artificial Sequence
  chemically synthesized
tgggcagatcactggagtcc

SEQ ID NO: 584216 - DNA, 20 bp, Artificial Sequence
  chemically synthesized
gtggctcacacctgtaattc

SEQ ID NO: 584217 - DNA, 20 bp, Artificial Sequence
  chemically synthesized
agccaccacacccagcctta

SEQ ID NO: 584218 - DNA, 20 bp, Artificial Sequence
  chemically synthesized
ctttttaaatacagtttggt

SEQ ID NO: 584219 - DNA, 20 bp, Artificial Sequence
  chemically synthesized
ctatgagattactttttaaa

SEQ ID NO: 584220 - DNA, 20 bp, Artificial Sequence
  chemically synthesized
tgaatttgtgaccctagtct

SEQ ID NO: 584221 - DNA, 20 bp, Artificial Sequence
  chemically synthesized
ttatagctctctgatttaga

SEQ ID NO: 584222 - DNA, 20 bp, Artificial Sequence
  chemically synthesized
ccacatctgaagttatagct

SEQ ID NO: 584223 - DNA, 20 bp, Artificial Sequence
  chemically synthesized
tttttgtttgtttttctgtg

SEQ ID NO: 584224 - DNA, 20 bp, Artificial Sequence
  chemically synthesized
agggttttttgtttgttttt

SEQ ID NO: 584225 - DNA, 20 bp, Artificial Sequence
  chemically synthesized
tatgatcagcagggtttttt

SEQ ID NO: 584226 - DNA, 20 bp, Artificial Sequence
  chemically synthesized
ggaatatgatcagcagggtt

SEQ ID NO: 584227 - DNA, 20 bp, Artificial Sequence
  chemically synthesized
tggtgagggaatatgatcag

SEQ ID NO: 584228 - DNA, 20 bp, Artificial Sequence
  chemically synthesized
ccctcaccagtgtataccgg

SEQ ID NO: 584229 - DNA, 20 bp, Artificial Sequence
  chemically synthesized
aaggtcataaggaagtacaa

SEQ ID NO: 584230 - DNA, 20 bp, Artificial Sequence
  chemically synthesized
ggtatatgtagagcaatgtg

SEQ ID NO: 584231 - DNA, 20 bp, Artificial Sequence
  chemically synthesized
ttttcttttttttttttaga

SEQ ID NO: 584232 - DNA, 20 bp, Artificial Sequence
  chemically synthesized
aacctttgcctcctgggttc

SEQ ID NO: 584233 - DNA, 20 bp, Artificial Sequence
  chemically synthesized
ctgcctcagcctcccggtag

SEQ ID NO: 584234 - DNA, 20 bp, Artificial Sequence
  chemically synthesized
catcttggcctcccaatgtg

SEQ ID NO: 584235 - DNA, 20 bp, Artificial Sequence
  chemically synthesized
agcttttctaacattcataa

SEQ ID NO: 584236 - DNA, 20 bp, Artificial Sequence
  chemically synthesized
aatgttagaaaagctaagaa

SEQ ID NO: 584237 - DNA, 20 bp, Artificial Sequence
  chemically synthesized
ttgtgctataaatcttgttt

SEQ ID NO: 584238 - DNA, 20 bp, Artificial Sequence
  chemically synthesized
aagctacattgtgctataaa

SEQ ID NO: 584239 - DNA, 20 bp, Artificial Sequence
  chemically synthesized
aaacaagatttatagcacaa

SEQ ID NO: 584240 - DNA, 20 bp, Artificial Sequence
  chemically synthesized
tatctctattcctgtttctt

SEQ ID NO: 584241 - DNA, 20 bp, Artificial Sequence
  chemically synthesized
tgtgacaataatatctctat

SEQ ID NO: 584242 - DNA, 20 bp, Artificial Sequence
  chemically synthesized
tattaatggttatgtttaat

SEQ ID NO: 584243 - DNA, 20 bp, Artificial Sequence
  chemically synthesized
aatttaatttatattaatgg

SEQ ID NO: 584244 - DNA, 20 bp, Artificial Sequence
  chemically synthesized
atattatcttttgttcttag

SEQ ID NO: 584245 - DNA, 20 bp, Artificial Sequence
  chemically synthesized
tgtctgacatcaagtcaaat

SEQ ID NO: 584246 - DNA, 20 bp, Artificial Sequence
  chemically synthesized
tcaagtcaaatcaaggcttt

SEQ ID NO: 584247 - DNA, 20 bp, Artificial Sequence
  chemically synthesized
ctggataaaaacattgaaag

SEQ ID NO: 584248 - DNA, 20 bp, Artificial Sequence
  chemically synthesized
ttgtttgcttttgggttcaa

SEQ ID NO: 584249 - DNA, 20 bp, Artificial Sequence
  chemically synthesized
aatcagaggcattatttttt

SEQ ID NO: 584250 - DNA, 20 bp, Artificial Sequence
  chemically synthesized
gactaatcagaggcattatt

SEQ ID NO: 584251 - DNA, 20 bp, Artificial Sequence
  chemically synthesized
aagcaaacaaaaaataatgc

SEQ ID NO: 584252 - DNA, 20 bp, Artificial Sequence
  chemically synthesized
cgtgagtgatgacttccaag

SEQ ID NO: 584253 - DNA, 20 bp, Artificial Sequence
  chemically synthesized
ctcttagaatatttaatttt

SEQ ID NO: 584254 - DNA, 20 bp, Artificial Sequence
  chemically synthesized
gtgagtaatatatttgatct

SEQ ID NO: 584255 - DNA, 20 bp, Artificial Sequence
  chemically synthesized
ttgatcttctggtttccctg

SEQ ID NO: 584256 - DNA, 20 bp, Artificial Sequence
  chemically synthesized
ttatcagaatgattacttct

SEQ ID NO: 584257 - DNA, 20 bp, Artificial Sequence
  chemically synthesized
attgctactttctgttatca

SEQ ID NO: 584258 - DNA, 20 bp, Artificial Sequence
  chemically synthesized
gattaccacatttctcagtt

SEQ ID NO: 584259 - DNA, 20 bp, Artificial Sequence
  chemically synthesized
tgactaagattaccacattt

SEQ ID NO: 584260 - DNA, 20 bp, Artificial Sequence
  chemically synthesized
gtcatttcattgataaatga

SEQ ID NO: 584261 - DNA, 20 bp, Artificial Sequence
  chemically synthesized
tataaattaaatggtgtagg

SEQ ID NO: 584262 - DNA, 20 bp, Artificial Sequence
  chemically synthesized
ctctctatctcagcacatat

SEQ ID NO: 584263 - DNA, 20 bp, Artificial Sequence
  chemically synthesized
gagagaaaaggagagatagt

SEQ ID NO: 584264 - DNA, 20 bp, Artificial Sequence
  chemically synthesized
aaggagagatagtgatagat

SEQ ID NO: 584265 - DNA, 20 bp, Artificial Sequence
  chemically synthesized
agagatagtgatagattagg

SEQ ID NO: 584266 - DNA, 20 bp, Artificial Sequence
  chemically synthesized
tatcctcattctgaggggca

SEQ ID NO: 584267 - DNA, 20 bp, Artificial Sequence
  chemically synthesized
gaatgaggataaagagagat

SEQ ID NO: 584268 - DNA, 20 bp, Artificial Sequence
  chemically synthesized
gataaagagagatcaaagtt

SEQ ID NO: 584269 - DNA, 20 bp, Artificial Sequence
  chemically synthesized
gagatcaaagtttgctgttt

SEQ ID NO: 584270 - DNA, 20 bp, Artificial Sequence
  chemically synthesized
ttctcatggtgtaagtatct

SEQ ID NO: 584271 - DNA, 20 bp, Artificial Sequence
  chemically synthesized
taagtatctcagtgatttga

SEQ ID NO: 584272 - DNA, 20 bp, Artificial Sequence
  chemically synthesized
ggtatgtatttatcttacag

SEQ ID NO: 584273 - DNA, 20 bp, Artificial Sequence
  chemically synthesized
agacccagttgaagtggtta

SEQ ID NO: 584274 - DNA, 20 bp, Artificial Sequence
  chemically synthesized
ctgggtctcaactgaagaaa

SEQ ID NO: 584275 - DNA, 20 bp, Artificial Sequence
  chemically synthesized
cgttatcacatcaatttttg

SEQ ID NO: 584276 - DNA, 20 bp, Artificial Sequence
  chemically synthesized
ttaagaaaagttaatttaca

SEQ ID NO: 584277 - DNA, 20 bp, Artificial Sequence
  chemically synthesized
gtgatttagaatcagaagtc

SEQ ID NO: 584278 - DNA, 20 bp, Artificial Sequence
  chemically synthesized
ttaggaacgaaacctaagac

SEQ ID NO: 584279 - DNA, 20 bp, Artificial Sequence
  chemically synthesized
ttggaaaatgagatgggtca

SEQ ID NO: 584280 - DNA, 20 bp, Artificial Sequence
  chemically synthesized
gttaggtggtattattatat

SEQ ID NO: 584281 - DNA, 20 bp, Artificial Sequence
  chemically synthesized
tataataataccacctaact

SEQ ID NO: 584282 - DNA, 20 bp, Artificial Sequence
  chemically synthesized
ttaccatataaaatatctcg

SEQ ID NO: 584283 - DNA, 20 bp, Artificial Sequence
  chemically synthesized
catttttaccatataaaata

SEQ ID NO: 584284 - DNA, 20 bp, Artificial Sequence
  chemically synthesized
atatctaaccaacaaattta

SEQ ID NO: 584285 - DNA, 20 bp, Artificial Sequence
  chemically synthesized
cttttcttgaatatcttctg

SEQ ID NO: 584286 - DNA, 20 bp, Artificial Sequence
  chemically synthesized
gagaacttttcttgaatatc

SEQ ID NO: 584287 - DNA, 20 bp, Artificial Sequence
  chemically synthesized
agttacgataaaattttttt

SEQ ID NO: 584288 - DNA, 20 bp, Artificial Sequence
  chemically synthesized
ttcagtgctttattaaagga

SEQ ID NO: 584289 - DNA, 20 bp, Artificial Sequence
  chemically synthesized
ttttagttacctagaaaata

SEQ ID NO: 584290 - DNA, 20 bp, Artificial Sequence
  chemically synthesized
gagtaaatggacagactatt

SEQ ID NO: 584291 - DNA, 20 bp, Artificial Sequence
  chemically synthesized
actataatctctaatgtaga

SEQ ID NO: 584292 - DNA, 20 bp, Artificial Sequence
  chemically synthesized
ttaaaaatccacctctacat

SEQ ID NO: 584293 - DNA, 20 bp, Artificial Sequence
  chemically synthesized
agattggaaattatacagtt

SEQ ID NO: 584294 - DNA, 20 bp, Artificial Sequence
  chemically synthesized
aagtatttgctaataattat

SEQ ID NO: 584295 - DNA, 20 bp, Artificial Sequence
  chemically synthesized
gcaaatacttatgaaatgac

SEQ ID NO: 584296 - DNA, 20 bp, Artificial Sequence
  chemically synthesized
acttatgaaatgactacagt

SEQ ID NO: 584297 - DNA, 20 bp, Artificial Sequence
  chemically synthesized
aactcttgaaaaagtagcaa

SEQ ID NO: 584298 - DNA, 20 bp, Artificial Sequence
  chemically synthesized
accaaactcttgaaaaagta

SEQ ID NO: 584299 - DNA, 20 bp, Artificial Sequence
  chemically synthesized
aacaatcttgctactttttc

SEQ ID NO: 584300 - DNA, 20 bp, Artificial Sequence
  chemically synthesized
ttggtgtactgtagagttga

SEQ ID NO: 584301 - DNA, 20 bp, Artificial Sequence
  chemically synthesized
tatatattatacaagttctt

SEQ ID NO: 584302 - DNA, 20 bp, Artificial Sequence
  chemically synthesized
attatacaagttcttttttg

SEQ ID NO: 584303 - DNA, 20 bp, Artificial Sequence
  chemically synthesized
ttcttttttgttttgcttca

SEQ ID NO: 584304 - DNA, 20 bp, Artificial Sequence
  chemically synthesized
tttgttatgcaaatgaattt

SEQ ID NO: 584305 - DNA, 20 bp, Artificial Sequence
  chemically synthesized
aaattcatttgcataacaaa

SEQ ID NO: 584306 - DNA, 20 bp, Artificial Sequence
  chemically synthesized
ttttacagatttctattgag

SEQ ID NO: 584307 - DNA, 20 bp, Artificial Sequence
  chemically synthesized
tattgcaaattgttaccttt

SEQ ID NO: 584308 - DNA, 20 bp, Artificial Sequence
  chemically synthesized
atttccttaaatttgcttat

SEQ ID NO: 584309 - DNA, 20 bp, Artificial Sequence
  chemically synthesized
tacttatttgatttccttaa

SEQ ID NO: 584310 - DNA, 20 bp, Artificial Sequence
  chemically synthesized
aagttgggatttaagtactt

SEQ ID NO: 584311 - DNA, 20 bp, Artificial Sequence
  chemically synthesized
tgatacgctatttaaataag

SEQ ID NO: 584312 - DNA, 20 bp, Artificial Sequence
  chemically synthesized
tgcaatttagttagcatatt

SEQ ID NO: 584313 - DNA, 20 bp, Artificial Sequence
  chemically synthesized
tgctaactaaattgcaggtc

SEQ ID NO: 584314 - DNA, 20 bp, Artificial Sequence
  chemically synthesized
tagaacacgaattcactctg

SEQ ID NO: 584315 - DNA, 20 bp, Artificial Sequence
  chemically synthesized
tggataaactttgggaattc

SEQ ID NO: 584316 - DNA, 20 bp, Artificial Sequence
  chemically synthesized
tttacaaacaaaagaattcc

SEQ ID NO: 584317 - DNA, 20 bp, Artificial Sequence
  chemically synthesized
ttttgtttgtaaatggaaaa

SEQ ID NO: 584318 - DNA, 20 bp, Artificial Sequence
  chemically synthesized
gcaaaagtcacctataataa

SEQ ID NO: 584319 - DNA, 20 bp, Artificial Sequence
  chemically synthesized
attattctccattgtatata

SEQ ID NO: 584320 - DNA, 20 bp, Artificial Sequence
  chemically synthesized
actatatcaaactatgaaat

SEQ ID NO: 584321 - DNA, 20 bp, Artificial Sequence
  chemically synthesized
tcttcataaagcagaaattt

SEQ ID NO: 584322 - DNA, 20 bp, Artificial Sequence
  chemically synthesized
caggaattagttacaagaaa

SEQ ID NO: 584323 - DNA, 20 bp, Artificial Sequence
  chemically synthesized
aagaaaaagtgatttctgaa

SEQ ID NO: 584324 - DNA, 20 bp, Artificial Sequence
  chemically synthesized
ggtgatagatactgcaatca

SEQ ID NO: 584325 - DNA, 20 bp, Artificial Sequence
  chemically synthesized
aatatataatgatcaaatca

SEQ ID NO: 584326 - DNA, 20 bp, Artificial Sequence
  chemically synthesized
tgatttgatcattatatatt

SEQ ID NO: 584327 - DNA, 20 bp, Artificial Sequence
  chemically synthesized
atataagaatagctactcct

SEQ ID NO: 584328 - DNA, 20 bp, Artificial Sequence
  chemically synthesized
tctgatataagaatagctac

SEQ ID NO: 584329 - DNA, 20 bp, Artificial Sequence
  chemically synthesized
ctattcttatatcagacaaa

SEQ ID NO: 584330 - DNA, 20 bp, Artificial Sequence
  chemically synthesized
ctttatcttttatttacggt

SEQ ID NO: 584331 - DNA, 20 bp, Artificial Sequence
  chemically synthesized
aaagacattgtataatgata

SEQ ID NO: 584332 - DNA, 20 bp, Artificial Sequence
  chemically synthesized
atgcacctaacactggtgct

SEQ ID NO: 584333 - DNA, 20 bp, Artificial Sequence
  chemically synthesized
tcatttcttaggtctagtac

SEQ ID NO: 584334 - DNA, 20 bp, Artificial Sequence
  chemically synthesized
ccattgtttctttgttaagt

SEQ ID NO: 584335 - DNA, 20 bp, Artificial Sequence
  chemically synthesized
ttaagtccattgtttctttg

SEQ ID NO: 584336 - DNA, 20 bp, Artificial Sequence
  chemically synthesized
tctagggtgtaatttaagtc

SEQ ID NO: 584337 - DNA, 20 bp, Artificial Sequence
  chemically synthesized
tgagaagatacttgatatga

SEQ ID NO: 584338 - DNA, 20 bp, Artificial Sequence
  chemically synthesized
gtggtctgagaagatacttg

SEQ ID NO: 584339 - DNA, 20 bp, Artificial Sequence
  chemically synthesized
ggttccttttggagttgatt

SEQ ID NO: 584340 - DNA, 20 bp, Artificial Sequence
  chemically synthesized
gttttgagggttccttttgg

SEQ ID NO: 584341 - DNA, 20 bp, Artificial Sequence
  chemically synthesized
tcttaatttccatgtgtttg

SEQ ID NO: 584342 - DNA, 20 bp, Artificial Sequence
  chemically synthesized
gagcagatttcttaatttcc

SEQ ID NO: 584343 - DNA, 20 bp, Artificial Sequence
  chemically synthesized
aaattaagaaatctgctctt

SEQ ID NO: 584344 - DNA, 20 bp, Artificial Sequence
  chemically synthesized
taaccccaaaatcattcaag

SEQ ID NO: 584345 - DNA, 20 bp, Artificial Sequence
  chemically synthesized
ggaaattaaaatattttttg

SEQ ID NO: 584346 - DNA, 20 bp, Artificial Sequence
  chemically synthesized
cactgtttttgctgtatctc

SEQ ID NO: 584347 - DNA, 20 bp, Artificial Sequence
  chemically synthesized
actatgaactttcctcttag

SEQ ID NO: 584348 - DNA, 20 bp, Artificial Sequence
  chemically synthesized
tggatttgagtttagtttgt

SEQ ID NO: 584349 - DNA, 20 bp, Artificial Sequence
  chemically synthesized
tttcttctgctggatttgag

SEQ ID NO: 584350 - DNA, 20 bp, Artificial Sequence
  chemically synthesized
tttcttttcttctgctggat

SEQ ID NO: 584351 - DNA, 20 bp, Artificial Sequence
  chemically synthesized
tttgttatttcttttcttct

SEQ ID NO: 584352 - DNA, 20 bp, Artificial Sequence
  chemically synthesized
tttgtttcaacttcatttag

SEQ ID NO: 584353 - DNA, 20 bp, Artificial Sequence
  chemically synthesized
ttcatttatattttgtattt

SEQ ID NO: 584354 - DNA, 20 bp, Artificial Sequence
  chemically synthesized
gtttatcttttcaaagaact

SEQ ID NO: 584355 - DNA, 20 bp, Artificial Sequence
  chemically synthesized
tcttgctaatggtctatcaa

SEQ ID NO: 584356 - DNA, 20 bp, Artificial Sequence
  chemically synthesized
acaaaattgatagaccatta

SEQ ID NO: 584357 - DNA, 20 bp, Artificial Sequence
  chemically synthesized
attaaccaaggaaagaagag

SEQ ID NO: 584358 - DNA, 20 bp, Artificial Sequence
  chemically synthesized
gtttccagtttcatttctac

SEQ ID NO: 584359 - DNA, 20 bp, Artificial Sequence
  chemically synthesized
gtgatgtaggttgtagtgtt

SEQ ID NO: 584360 - DNA, 20 bp, Artificial Sequence
  chemically synthesized
tatttttgtgatgtaggttg

SEQ ID NO: 584361 - DNA, 20 bp, Artificial Sequence
  chemically synthesized
tatccatttcctctagattt

SEQ ID NO: 584362 - DNA, 20 bp, Artificial Sequence
  chemically synthesized
ccaggaatgtatccatttcc

SEQ ID NO: 584363 - DNA, 20 bp, Artificial Sequence
  chemically synthesized
tcctggaaacacacaaccct

SEQ ID NO: 584364 - DNA, 20 bp, Artificial Sequence
  chemically synthesized
tgatttaaactaggagggtt

SEQ ID NO: 584365 - DNA, 20 bp, Artificial Sequence
  chemically synthesized
cgttcagggtttctatttct

SEQ ID NO: 584366 - DNA, 20 bp, Artificial Sequence
  chemically synthesized
caagaagaaatagaaaccct

SEQ ID NO: 584367 - DNA, 20 bp, Artificial Sequence
  chemically synthesized
ccgcgcccagccaaagcgtt

SEQ ID NO: 584368 - DNA, 20 bp, Artificial Sequence
  chemically synthesized
ctgggcgcggtggctcacgt

SEQ ID NO: 584369 - DNA, 20 bp, Artificial Sequence
  chemically synthesized
ttttgtatttttagtagagt

SEQ ID NO: 584370 - DNA, 20 bp, Artificial Sequence
  chemically synthesized
tgcctcagcctcccaagtag

SEQ ID NO: 584371 - DNA, 20 bp, Artificial Sequence
  chemically synthesized
gctcactgcaacctccacct

SEQ ID NO: 584372 - DNA, 20 bp, Artificial Sequence
  chemically synthesized
atggagttttgctctttcac

SEQ ID NO: 584373 - DNA, 20 bp, Artificial Sequence
  chemically synthesized
ttttttttttttttttgaga

SEQ ID NO: 584374 - DNA, 20 bp, Artificial Sequence
  chemically synthesized
ctgctcgttactggtatgtt

SEQ ID NO: 584375 - DNA, 20 bp, Artificial Sequence
  chemically synthesized
caaaaaaaagtccaggacca

SEQ ID NO: 584376 - DNA, 20 bp, Artificial Sequence
  chemically synthesized
attccctctttatcttttga

SEQ ID NO: 584377 - DNA, 20 bp, Artificial Sequence
  chemically synthesized
gacttcatagaatgatttag

SEQ ID NO: 584378 - DNA, 20 bp, Artificial Sequence
  chemically synthesized
agggtgatactgacttcata

SEQ ID NO: 584379 - DNA, 20 bp, Artificial Sequence
  chemically synthesized
tcttttttgttatttccttt

SEQ ID NO: 584380 - DNA, 20 bp, Artificial Sequence
  chemically synthesized
ttgtgctgctatttttgtgc

SEQ ID NO: 584381 - DNA, 20 bp, Artificial Sequence
  chemically synthesized
ctccattcaagttgctgcaa

SEQ ID NO: 584382 - DNA, 20 bp, Artificial Sequence
  chemically synthesized
acgagtgagaacatatggta

SEQ ID NO: 584383 - DNA, 20 bp, Artificial Sequence
  chemically synthesized
tccgtatgtctttgtatcct

SEQ ID NO: 584384 - DNA, 20 bp, Artificial Sequence
  chemically synthesized
gactttggggactctaagtg

SEQ ID NO: 584385 - DNA, 20 bp, Artificial Sequence
  chemically synthesized
tcagtagttttgggggtata

SEQ ID NO: 584386 - DNA, 20 bp, Artificial Sequence
  chemically synthesized
tgcttattttttataatttc

SEQ ID NO: 584387 - DNA, 20 bp, Artificial Sequence
  chemically synthesized
tttgtgcggtacaagttata

SEQ ID NO: 584388 - DNA, 20 bp, Artificial Sequence
  chemically synthesized
aataaaaaaaaattttttaa

SEQ ID NO: 584389 - DNA, 20 bp, Artificial Sequence
  chemically synthesized
cctaaggtagctacaattgt

SEQ ID NO: 584390 - DNA, 20 bp, Artificial Sequence
  chemically synthesized
ttggatatttaaaaaatatt

SEQ ID NO: 584391 - DNA, 20 bp, Artificial Sequence
  chemically synthesized
taaaaaatattaaatgattt

SEQ ID NO: 584392 - DNA, 20 bp, Artificial Sequence
  chemically synthesized
tcaaataatatctatttcta

SEQ ID NO: 584393 - DNA, 20 bp, Artificial Sequence
  chemically synthesized
taagtaaggaaaaataatgt

SEQ ID NO: 584394 - DNA, 20 bp, Artificial Sequence
  chemically synthesized
taatacaatcataaaaaatc

SEQ ID NO: 584395 - DNA, 20 bp, Artificial Sequence
  chemically synthesized
ttttttaaacaaatgatttt

SEQ ID NO: 584396 - DNA, 20 bp, Artificial Sequence
  chemically synthesized
tctagtttacttttttaaac

SEQ ID NO: 584397 - DNA, 20 bp, Artificial Sequence
  chemically synthesized
tttaaaaaagtaaactagaa

SEQ ID NO: 584398 - DNA, 20 bp, Artificial Sequence
  chemically synthesized
aatagagtttaaaactatat

SEQ ID NO: 584399 - DNA, 20 bp, Artificial Sequence
  chemically synthesized
aatatagttttaaactctat

SEQ ID NO: 584400 - DNA, 20 bp, Artificial Sequence
  chemically synthesized
gttttaaactctatttgagt

SEQ ID NO: 584401 - DNA, 20 bp, Artificial Sequence
  chemically synthesized
ttgaaaatctcaaactcaaa

SEQ ID NO: 584402 - DNA, 20 bp, Artificial Sequence
  chemically synthesized
agagagagacaaagagacat

SEQ ID NO: 584403 - DNA, 20 bp, Artificial Sequence
  chemically synthesized
aggtgaaattcaaatctcta

SEQ ID NO: 584404 - DNA, 20 bp, Artificial Sequence
  chemically synthesized
ctgaaattagggaagcattt

SEQ ID NO: 584405 - DNA, 20 bp, Artificial Sequence
  chemically synthesized
tgaaataacctcaagagatg

SEQ ID NO: 584406 - DNA, 20 bp, Artificial Sequence
  chemically synthesized
tacataagtattctgacaga

SEQ ID NO: 584407 - DNA, 20 bp, Artificial Sequence
  chemically synthesized
tatacattaggaatgattgc

SEQ ID NO: 584408 - DNA, 20 bp, Artificial Sequence
  chemically synthesized
tttagcaatcattcctaatg

SEQ ID NO: 584409 - DNA, 20 bp, Artificial Sequence
  chemically synthesized
attgtgaagctatacattag

SEQ ID NO: 584410 - DNA, 20 bp, Artificial Sequence
  chemically synthesized
tttacaatgatctctgccac

SEQ ID NO: 584411 - DNA, 20 bp, Artificial Sequence
  chemically synthesized
tttaacaaattctttgaaag

SEQ ID NO: 584412 - DNA, 20 bp, Artificial Sequence
  chemically synthesized
tctttctgctttttaagttg

SEQ ID NO: 584413 - DNA, 20 bp, Artificial Sequence
  chemically synthesized
catattctttctgcttttta

SEQ ID NO: 584414 - DNA, 20 bp, Artificial Sequence
  chemically synthesized
ccaatagactaacatattct

SEQ ID NO: 584415 - DNA, 20 bp, Artificial Sequence
  chemically synthesized
tgcctcggcctcccaaagtc

SEQ ID NO: 584416 - DNA, 20 bp, Artificial Sequence
  chemically synthesized
cctgaggtcgggagttcgag

SEQ ID NO: 584417 - DNA, 20 bp, Artificial Sequence
  chemically synthesized
ttttgtatttttagtagaga

SEQ ID NO: 584418 - DNA, 20 bp, Artificial Sequence
  chemically synthesized
tgcctcagccttccaagtag

SEQ ID NO: 584419 - DNA, 20 bp, Artificial Sequence
  chemically synthesized
ttggaaggctgaggcaggag

SEQ ID NO: 584420 - DNA, 20 bp, Artificial Sequence
  chemically synthesized
aacctacacctcccaggttc

SEQ ID NO: 584421 - DNA, 20 bp, Artificial Sequence
  chemically synthesized
ttgtttgtttgtttttgaga

SEQ ID NO: 584422 - DNA, 20 bp, Artificial Sequence
  chemically synthesized
agatatgattttggttgttt

SEQ ID NO: 584423 - DNA, 20 bp, Artificial Sequence
  chemically synthesized
tcttagatatgattttggtt

SEQ ID NO: 584424 - DNA, 20 bp, Artificial Sequence
  chemically synthesized
tttttcttagatatgatttt

SEQ ID NO: 584425 - DNA, 20 bp, Artificial Sequence
  chemically synthesized
gtttttttcatttttcttag

SEQ ID NO: 584426 - DNA, 20 bp, Artificial Sequence
  chemically synthesized
tatctaagaaaaatgaaaaa

SEQ ID NO: 584427 - DNA, 20 bp, Artificial Sequence
  chemically synthesized
cattcacaaaatattaggaa

SEQ ID NO: 584428 - DNA, 20 bp, Artificial Sequence
  chemically synthesized
aatattttgtgaatgggtat

SEQ ID NO: 584429 - DNA, 20 bp, Artificial Sequence
  chemically synthesized
tctgcctagtttatttctat

SEQ ID NO: 584430 - DNA, 20 bp, Artificial Sequence
  chemically synthesized
atggggtggccttgtgtctg

SEQ ID NO: 584431 - DNA, 20 bp, Artificial Sequence
  chemically synthesized
gacacaaggccaccccatgg

SEQ ID NO: 584432 - DNA, 20 bp, Artificial Sequence
  chemically synthesized
gcagaaaggccttgtctctg

SEQ ID NO: 584433 - DNA, 20 bp, Artificial Sequence
  chemically synthesized
tcttagtgtttatctagaag

SEQ ID NO: 584434 - DNA, 20 bp, Artificial Sequence
  chemically synthesized
aatgtagtgattaggtatct

SEQ ID NO: 584435 - DNA, 20 bp, Artificial Sequence
  chemically synthesized
atacctaatcactacattga

SEQ ID NO: 584436 - DNA, 20 bp, Artificial Sequence
  chemically synthesized
ttcaagaaacagagtcaatg

SEQ ID NO: 584437 - DNA, 20 bp, Artificial Sequence
  chemically synthesized
gtagaagccatttctggatt

SEQ ID NO: 584438 - DNA, 20 bp, Artificial Sequence
  chemically synthesized
ttgaaagcatctaatccaga

SEQ ID NO: 584439 - DNA, 20 bp, Artificial Sequence
  chemically synthesized
ttcagaaagtagaagccatt

SEQ ID NO: 584440 - DNA, 20 bp, Artificial Sequence
  chemically synthesized
cttacagagttcagctggct

SEQ ID NO: 584441 - DNA, 20 bp, Artificial Sequence
  chemically synthesized
gcagccagctgaactctgta

SEQ ID NO: 584442 - DNA, 20 bp, Artificial Sequence
  chemically synthesized
ctcagtaagagggcattgga

SEQ ID NO: 584443 - DNA, 20 bp, Artificial Sequence
  chemically synthesized
actgagatgcccacactctg

SEQ ID NO: 584444 - DNA, 20 bp, Artificial Sequence
  chemically synthesized
taaggtaaatattcttaatt

SEQ ID NO: 584445 - DNA, 20 bp, Artificial Sequence
  chemically synthesized
taattttttgattacagata

SEQ ID NO: 584446 - DNA, 20 bp, Artificial Sequence
  chemically synthesized
gttgcttgtaatcttggcca

SEQ ID NO: 584447 - DNA, 20 bp, Artificial Sequence
  chemically synthesized
atactctgaaagccctctgg

SEQ ID NO: 584448 - DNA, 20 bp, Artificial Sequence
  chemically synthesized
agggctttcagagtattatg

SEQ ID NO: 584449 - DNA, 20 bp, Artificial Sequence
  chemically synthesized
ctaagttatttgtaatatgg

SEQ ID NO: 584450 - DNA, 20 bp, Artificial Sequence
  chemically synthesized
aattctagaatatacatacg

SEQ ID NO: 584451 - DNA, 20 bp, Artificial Sequence
  chemically synthesized
catacgaagggtttgaatga

SEQ ID NO: 584452 - DNA, 20 bp, Artificial Sequence
  chemically synthesized
ataaacatttagaaatatgg

SEQ ID NO: 584453 - DNA, 20 bp, Artificial Sequence
  chemically synthesized
acaatctcatccatatttct

SEQ ID NO: 584454 - DNA, 20 bp, Artificial Sequence
  chemically synthesized
tcatccatatttctaaatgt

SEQ ID NO: 584455 - DNA, 20 bp, Artificial Sequence
  chemically synthesized
tgagaagagaaaaaatttat

SEQ ID NO: 584456 - DNA, 20 bp, Artificial Sequence
  chemically synthesized
ttgggaaagtgaagctctcc

SEQ ID NO: 584457 - DNA, 20 bp, Artificial Sequence
  chemically synthesized
tcccaatgcataaacttgag

SEQ ID NO: 584458 - DNA, 20 bp, Artificial Sequence
  chemically synthesized
gctctcctcaagtttatgca

SEQ ID NO: 584459 - DNA, 20 bp, Artificial Sequence
  chemically synthesized
aaataaataaataaatacaa

SEQ ID NO: 584460 - DNA, 20 bp, Artificial Sequence
  chemically synthesized
tcataaataaataaataaat

SEQ ID NO: 584461 - DNA, 20 bp, Artificial Sequence
  chemically synthesized
aatggcatgaacccgggagg

SEQ ID NO: 584462 - DNA, 20 bp, Artificial Sequence
  chemically synthesized
ctgccaccaagcccggctaa

SEQ ID NO: 584463 - DNA, 20 bp, Artificial Sequence
  chemically synthesized
aaatacaaaaacaaaattag

SEQ ID NO: 584464 - DNA, 20 bp, Artificial Sequence
  chemically synthesized
ttttgtatttttagtagaga

SEQ ID NO: 584465 - DNA, 20 bp, Artificial Sequence
  chemically synthesized
acattttatttttttaaatt

SEQ ID NO: 584466 - DNA, 20 bp, Artificial Sequence
  chemically synthesized
atttttgtctgttatctctc

SEQ ID NO: 584467 - DNA, 20 bp, Artificial Sequence
  chemically synthesized
agtgaagttacaccaggtaa

SEQ ID NO: 584468 - DNA, 20 bp, Artificial Sequence
  chemically synthesized
aatgagattgtacgcatggc

SEQ ID NO: 584469 - DNA, 20 bp, Artificial Sequence
  chemically synthesized
gatgatttatgaaatccaag

SEQ ID NO: 584470 - DNA, 20 bp, Artificial Sequence
  chemically synthesized
taattacacttaaaacaata

SEQ ID NO: 584471 - DNA, 20 bp, Artificial Sequence
  chemically synthesized
actcacaaaagatgtgcatc

SEQ ID NO: 584472 - DNA, 20 bp, Artificial Sequence
  chemically synthesized
atcttttgtgagtaatatat

SEQ ID NO: 584473 - DNA, 20 bp, Artificial Sequence
  chemically synthesized
aggcaaaaaataaaccctaa

SEQ ID NO: 584474 - DNA, 20 bp, Artificial Sequence
  chemically synthesized
aacatttttaaaaacttcct

SEQ ID NO: 584475 - DNA, 20 bp, Artificial Sequence
  chemically synthesized
agctgtttttttttctccca

SEQ ID NO: 584476 - DNA, 20 bp, Artificial Sequence
  chemically synthesized
aactcattgggagaaaaaaa

SEQ ID NO: 584477 - DNA, 20 bp, Artificial Sequence
  chemically synthesized
gttgttaattaactagatga

SEQ ID NO: 584478 - DNA, 20 bp, Artificial Sequence
  chemically synthesized
cagggatgattcattttccc

SEQ ID NO: 584479 - DNA, 20 bp, Artificial Sequence
  chemically synthesized
ttacagtcagtcacaaccag

SEQ ID NO: 584480 - DNA, 20 bp, Artificial Sequence
  chemically synthesized
tatctgaggaaatgatgcct

SEQ ID NO: 584481 - DNA, 20 bp, Artificial Sequence
  chemically synthesized
ttgtgttaaaggttgggatg

SEQ ID NO: 584482 - DNA, 20 bp, Artificial Sequence
  chemically synthesized
gcagtaagtaaaacatatta

SEQ ID NO: 584483 - DNA, 20 bp, Artificial Sequence
  chemically synthesized
ttacttacacaaacctagta

SEQ ID NO: 584484 - DNA, 20 bp, Artificial Sequence
  chemically synthesized
aaagttagcaaagcaaacca

SEQ ID NO: 584485 - DNA, 20 bp, Artificial Sequence
  chemically synthesized
tgataaaatgaagccagctg

SEQ ID NO: 584486 - DNA, 20 bp, Artificial Sequence
  chemically synthesized
aaagtgataaaatgaagcca

SEQ ID NO: 584487 - DNA, 20 bp, Artificial Sequence
  chemically synthesized
aaaatatgtttatgtacttt

SEQ ID NO: 584488 - DNA, 20 bp, Artificial Sequence
  chemically synthesized
ctttcagttaacttttaaaa

SEQ ID NO: 584489 - DNA, 20 bp, Artificial Sequence
  chemically synthesized
ttttaaaagttaactgaaag

SEQ ID NO: 584490 - DNA, 20 bp, Artificial Sequence
  chemically synthesized
aatacaagaaaatggcacct

SEQ ID NO: 584491 - DNA, 20 bp, Artificial Sequence
  chemically synthesized
aaattgtatttttaactgtc

SEQ ID NO: 584492 - DNA, 20 bp, Artificial Sequence
  chemically synthesized
ataataaaaatcaaataaca

SEQ ID NO: 584493 - DNA, 20 bp, Artificial Sequence
  chemically synthesized
tacaaaagaagccatttgtt

SEQ ID NO: 584494 - DNA, 20 bp, Artificial Sequence
  chemically synthesized
aaataacaaatggcttcttt

SEQ ID NO: 584495 - DNA, 20 bp, Artificial Sequence
  chemically synthesized
atattgttgttactgatagc

SEQ ID NO: 584496 - DNA, 20 bp, Artificial Sequence
  chemically synthesized
ttactgatagcagttgtttt

SEQ ID NO: 584497 - DNA, 20 bp, Artificial Sequence
  chemically synthesized
tcctcaatagcaccccattt

SEQ ID NO: 584498 - DNA, 20 bp, Artificial Sequence
  chemically synthesized
gtttaaaattttgctaaagt

SEQ ID NO: 584499 - DNA, 20 bp, Artificial Sequence
  chemically synthesized
ctgactatatgagttatata

SEQ ID NO: 584500 - DNA, 20 bp, Artificial Sequence
  chemically synthesized
atgatcaaatacctctccat

SEQ ID NO: 584501 - DNA, 20 bp, Artificial Sequence
  chemically synthesized
aggtatttgatcatacgatc

SEQ ID NO: 584502 - DNA, 20 bp, Artificial Sequence
  chemically synthesized
tttttccagttattttgcag

SEQ ID NO: 584503 - DNA, 20 bp, Artificial Sequence
  chemically synthesized
aaataaagaagttggttagt

SEQ ID NO: 584504 - DNA, 20 bp, Artificial Sequence
  chemically synthesized
attttcaaagatggtatatt

SEQ ID NO: 584505 - DNA, 20 bp, Artificial Sequence
  chemically synthesized
ccttcacttcgtcaacttct

SEQ ID NO: 584506 - DNA, 20 bp, Artificial Sequence
  chemically synthesized
ggaagctgggttcatccctg

SEQ ID NO: 584507 - DNA, 20 bp, Artificial Sequence
  chemically synthesized
agaaactgagcagggatgaa

SEQ ID NO: 584508 - DNA, 20 bp, Artificial Sequence
  chemically synthesized
aacccagcttccaatcagaa

SEQ ID NO: 584509 - DNA, 20 bp, Artificial Sequence
  chemically synthesized
cgctcacctcccaagctgag

SEQ ID NO: 584510 - DNA, 20 bp, Artificial Sequence
  chemically synthesized
aaagacacatcagggagcaa

SEQ ID NO: 584511 - DNA, 20 bp, Artificial Sequence
  chemically synthesized
ccctgatgtgtctttaatta

SEQ ID NO: 584512 - DNA, 20 bp, Artificial Sequence
  chemically synthesized
aaatgcataattagtgtgtc

SEQ ID NO: 584513 - DNA, 20 bp, Artificial Sequence
  chemically synthesized
agatcttgcatatacatcgt

SEQ ID NO: 584514 - DNA, 20 bp, Artificial Sequence
  chemically synthesized
atcattttcttcataattat

SEQ ID NO: 584515 - DNA, 20 bp, Artificial Sequence
  chemically synthesized
tgagagaattgtgtttctgt

SEQ ID NO: 584516 - DNA, 20 bp, Artificial Sequence
  chemically synthesized
ttttcatgagagaattgtgt

SEQ ID NO: 584517 - DNA, 20 bp, Artificial Sequence
  chemically synthesized
agcacattttcatgagagaa

SEQ ID NO: 584518 - DNA, 20 bp, Artificial Sequence
  chemically synthesized
taaattttgatatatggact

SEQ ID NO: 584519 - DNA, 20 bp, Artificial Sequence
  chemically synthesized
tatatggactcaaagtttaa

SEQ ID NO: 584520 - DNA, 20 bp, Artificial Sequence
  chemically synthesized
aatttatttttaaaggttag

SEQ ID NO: 584521 - DNA, 20 bp, Artificial Sequence
  chemically synthesized
aaataaatttttgatccatg

SEQ ID NO: 584522 - DNA, 20 bp, Artificial Sequence
  chemically synthesized
gcagagatttaaacagccct

SEQ ID NO: 584523 - DNA, 20 bp, Artificial Sequence
  chemically synthesized
acaaggcagaaagctgtgag

SEQ ID NO: 584524 - DNA, 20 bp, Artificial Sequence
  chemically synthesized
agaggctcaaaaaatgacct

SEQ ID NO: 584525 - DNA, 20 bp, Artificial Sequence
  chemically synthesized
aggtcattttttgagcctct

SEQ ID NO: 584526 - DNA, 20 bp, Artificial Sequence
  chemically synthesized
ggaaacatctgaagattagc

SEQ ID NO: 584527 - DNA, 20 bp, Artificial Sequence
  chemically synthesized
gcaaaccccagctaatcttc

SEQ ID NO: 584528 - DNA, 20 bp, Artificial Sequence
  chemically synthesized
accatgaccttggaaacatc

SEQ ID NO: 584529 - DNA, 20 bp, Artificial Sequence
  chemically synthesized
caagaatgatttgagaatta

SEQ ID NO: 584530 - DNA, 20 bp, Artificial Sequence
  chemically synthesized
tgataggggcaaaaatgcaa

SEQ ID NO: 584531 - DNA, 20 bp, Artificial Sequence
  chemically synthesized
gatatatatatattttgaga

SEQ ID NO: 584532 - DNA, 20 bp, Artificial Sequence
  chemically synthesized
aacttctgcctctcgggttc

SEQ ID NO: 584533 - DNA, 20 bp, Artificial Sequence
  chemically synthesized
tgcctcagcctcccaagtag

SEQ ID NO: 584534 - DNA, 20 bp, Artificial Sequence
  chemically synthesized
tttcatatttttagtagaga

SEQ ID NO: 584535 - DNA, 20 bp, Artificial Sequence
  chemically synthesized
tgcctcggcctcgcaaagtg

SEQ ID NO: 584536 - DNA, 20 bp, Artificial Sequence
  chemically synthesized
catgcccagccaacttgata

SEQ ID NO: 584537 - DNA, 20 bp, Artificial Sequence
  chemically synthesized
tcctgtcttcccatttctcc

SEQ ID NO: 584538 - DNA, 20 bp, Artificial Sequence
  chemically synthesized
ggaataaattttcccttaag

SEQ ID NO: 584539 - DNA, 20 bp, Artificial Sequence
  chemically synthesized
tcctttttttttttctcctt

SEQ ID NO: 584540 - DNA, 20 bp, Artificial Sequence
  chemically synthesized
accatttttgtagcagacag

SEQ ID NO: 584541 - DNA, 20 bp, Artificial Sequence
  chemically synthesized
acagtgctgtctgctacaaa

SEQ ID NO: 584542 - DNA, 20 bp, Artificial Sequence
  chemically synthesized
aaaaagaaagaaccaggagc

SEQ ID NO: 584543 - DNA, 20 bp, Artificial Sequence
  chemically synthesized
gatctgccatgcctgagcat

SEQ ID NO: 584544 - DNA, 20 bp, Artificial Sequence
  chemically synthesized
cgataagttagcatcaagca

SEQ ID NO: 584545 - DNA, 20 bp, Artificial Sequence
  chemically synthesized
aagttagcatcaagcatttg

SEQ ID NO: 584546 - DNA, 20 bp, Artificial Sequence
  chemically synthesized
cattatgtataaaacaatcc

SEQ ID NO: 584547 - DNA, 20 bp, Artificial Sequence
  chemically synthesized
ttaaaagccactgagaaaat

SEQ ID NO: 584548 - DNA, 20 bp, Artificial Sequence
  chemically synthesized
atgaaagcaaaaattttctc

SEQ ID NO: 584549 - DNA, 20 bp, Artificial Sequence
  chemically synthesized
gatcacaaaggtacatgtaa

SEQ ID NO: 584550 - DNA, 20 bp, Artificial Sequence
  chemically synthesized
tatggtgtatgactatgaat

SEQ ID NO: 584551 - DNA, 20 bp, Artificial Sequence
  chemically synthesized
gtgcacaaatggacaattgc

SEQ ID NO: 584552 - DNA, 20 bp, Artificial Sequence
  chemically synthesized
aattgtccatttgtgcactg

SEQ ID NO: 584553 - DNA, 20 bp, Artificial Sequence
  chemically synthesized
ccatattaactgctctgagg

SEQ ID NO: 584554 - DNA, 20 bp, Artificial Sequence
  chemically synthesized
tcaacggaaactctgaaatt

SEQ ID NO: 584555 - DNA, 20 bp, Artificial Sequence
  chemically synthesized
gtcctgaaagcagcaaattt

SEQ ID NO: 584556 - DNA, 20 bp, Artificial Sequence
  chemically synthesized
aactaaatactgagcacatt

SEQ ID NO: 584557 - DNA, 20 bp, Artificial Sequence
  chemically synthesized
gcacattgttagcttatgaa

SEQ ID NO: 584558 - DNA, 20 bp, Artificial Sequence
  chemically synthesized
gcttatgaaaaatgattata

SEQ ID NO: 584559 - DNA, 20 bp, Artificial Sequence
  chemically synthesized
aactggatacaaactacttt

SEQ ID NO: 584560 - DNA, 20 bp, Artificial Sequence
  chemically synthesized
ccactccaaaaatctagaaa

SEQ ID NO: 584561 - DNA, 20 bp, Artificial Sequence
  chemically synthesized
gttgatatctacagagaaac

SEQ ID NO: 584562 - DNA, 20 bp, Artificial Sequence
  chemically synthesized
aacaccagacactgaaaatc

SEQ ID NO: 584563 - DNA, 20 bp, Artificial Sequence
  chemically synthesized
aacctgtgattttcagtgtc

SEQ ID NO: 584564 - DNA, 20 bp, Artificial Sequence
  chemically synthesized
ggtagagttgaagtttgcac

SEQ ID NO: 584565 - DNA, 20 bp, Artificial Sequence
  chemically synthesized
gacttttccttaggtagagt

SEQ ID NO: 584566 - DNA, 20 bp, Artificial Sequence
  chemically synthesized
agaagattgtttgttttcct

SEQ ID NO: 584567 - DNA, 20 bp, Artificial Sequence
  chemically synthesized
agcttcatttctagaagatt

SEQ ID NO: 584568 - DNA, 20 bp, Artificial Sequence
  chemically synthesized
cccaagcttcatttctagaa

SEQ ID NO: 584569 - DNA, 20 bp, Artificial Sequence
  chemically synthesized
aacaaacaatcttctagaaa

SEQ ID NO: 584570 - DNA, 20 bp, Artificial Sequence
  chemically synthesized
ttggcccaagcttcatttct

SEQ ID NO: 584571 - DNA, 20 bp, Artificial Sequence
  chemically synthesized
tagtttcccttgcgcttggc

SEQ ID NO: 584572 - DNA, 20 bp, Artificial Sequence
  chemically synthesized
aggtcgctgcttagtttccc

SEQ ID NO: 584573 - DNA, 20 bp, Artificial Sequence
  chemically synthesized
ttctgtctctaaggtcgctg

SEQ ID NO: 584574 - DNA, 20 bp, Artificial Sequence
  chemically synthesized
ttagattctgtctctaaggt

SEQ ID NO: 584575 - DNA, 20 bp, Artificial Sequence
  chemically synthesized
tgcaaacaacattaccatga

SEQ ID NO: 584576 - DNA, 20 bp, Artificial Sequence
  chemically synthesized
cagaatctaagtcatggtaa

SEQ ID NO: 584577 - DNA, 20 bp, Artificial Sequence
  chemically synthesized
caataacctcattatacaga

SEQ ID NO: 584578 - DNA, 20 bp, Artificial Sequence
  chemically synthesized
ataatgaggttattgacctg

SEQ ID NO: 584579 - DNA, 20 bp, Artificial Sequence
  chemically synthesized
attgacctgaactgttttca

SEQ ID NO: 584580 - DNA, 20 bp, Artificial Sequence
  chemically synthesized
aacctcgtcctcatgtttaa

SEQ ID NO: 584581 - DNA, 20 bp, Artificial Sequence
  chemically synthesized
ggatacaatgaacctcgtcc

SEQ ID NO: 584582 - DNA, 20 bp, Artificial Sequence
  chemically synthesized
ttggtttctcagttaatgtt

SEQ ID NO: 584583 - DNA, 20 bp, Artificial Sequence
  chemically synthesized
atggctgtttattgatcagt

SEQ ID NO: 584584 - DNA, 20 bp, Artificial Sequence
  chemically synthesized
caagactgatcaataaacag

SEQ ID NO: 584585 - DNA, 20 bp, Artificial Sequence
  chemically synthesized
tcctgagatcctgtaatcat

SEQ ID NO: 584586 - DNA, 20 bp, Artificial Sequence
  chemically synthesized
atatacgttagcagtaggtt

SEQ ID NO: 584587 - DNA, 20 bp, Artificial Sequence
  chemically synthesized
tctcatttgcaaatggaagc

SEQ ID NO: 584588 - DNA, 20 bp, Artificial Sequence
  chemically synthesized
ttttcaaaaaatagctaatc

SEQ ID NO: 584589 - DNA, 20 bp, Artificial Sequence
  chemically synthesized
agctattttttgaaaactga

SEQ ID NO: 584590 - DNA, 20 bp, Artificial Sequence
  chemically synthesized
ggagggagatggaaagccag

SEQ ID NO: 584591 - DNA, 20 bp, Artificial Sequence
  chemically synthesized
tggagaagaaaaaaaagtag

SEQ ID NO: 584592 - DNA, 20 bp, Artificial Sequence
  chemically synthesized
agtagaaaggtttatcccag

SEQ ID NO: 584593 - DNA, 20 bp, Artificial Sequence
  chemically synthesized
tttttagtgaaatgtcatgt

SEQ ID NO: 584594 - DNA, 20 bp, Artificial Sequence
  chemically synthesized
ataaaatactgaagcctcaa

SEQ ID NO: 584595 - DNA, 20 bp, Artificial Sequence
  chemically synthesized
taaaagagtaaaatcggcat

SEQ ID NO: 584596 - DNA, 20 bp, Artificial Sequence
  chemically synthesized
aagaaaggtcacggaccata

SEQ ID NO: 584597 - DNA, 20 bp, Artificial Sequence
  chemically synthesized
ggagacagacactatgatgc

SEQ ID NO: 584598 - DNA, 20 bp, Artificial Sequence
  chemically synthesized
acagacactatgatgcagta

SEQ ID NO: 584599 - DNA, 20 bp, Artificial Sequence
  chemically synthesized
ccttgatgcttttcatattg

SEQ ID NO: 584600 - DNA, 20 bp, Artificial Sequence
  chemically synthesized
gccagccttgatgcttttca

SEQ ID NO: 584601 - DNA, 20 bp, Artificial Sequence
  chemically synthesized
attgctttgcttgccagcct

SEQ ID NO: 584602 - DNA, 20 bp, Artificial Sequence
  chemically synthesized
aattctttggggctttattg

SEQ ID NO: 584603 - DNA, 20 bp, Artificial Sequence
  chemically synthesized
gattaaattctttggggctt

SEQ ID NO: 584604 - DNA, 20 bp, Artificial Sequence
  chemically synthesized
tcaaggtagattaaattctt

SEQ ID NO: 584605 - DNA, 20 bp, Artificial Sequence
  chemically synthesized
aaaagtagtcccaccttcaa

SEQ ID NO: 584606 - DNA, 20 bp, Artificial Sequence
  chemically synthesized
tcttaaggctattaacgagt

SEQ ID NO: 584607 - DNA, 20 bp, Artificial Sequence
  chemically synthesized
taggatatgctgatcaaaaa

SEQ ID NO: 584608 - DNA, 20 bp, Artificial Sequence
  chemically synthesized
tatttccttacaagttattt

SEQ ID NO: 584609 - DNA, 20 bp, Artificial Sequence
  chemically synthesized
atccattacctcataatggg

SEQ ID NO: 584610 - DNA, 20 bp, Artificial Sequence
  chemically synthesized
aggtaatggatattgctaga

SEQ ID NO: 584611 - DNA, 20 bp, Artificial Sequence
  chemically synthesized
ttaccttcactggctgagtg

SEQ ID NO: 584612 - DNA, 20 bp, Artificial Sequence
  chemically synthesized
agctaaacaaccggatgtgg

SEQ ID NO: 584613 - DNA, 20 bp, Artificial Sequence
  chemically synthesized
acaaaatctcttccacatcc

SEQ ID NO: 584614 - DNA, 20 bp, Artificial Sequence
  chemically synthesized
atctcttccacatccggttg

SEQ ID NO: 584615 - DNA, 20 bp, Artificial Sequence
  chemically synthesized
tgtttagcttgaactgctat

SEQ ID NO: 584616 - DNA, 20 bp, Artificial Sequence
  chemically synthesized
ggggaaaagaacccatatag

SEQ ID NO: 584617 - DNA, 20 bp, Artificial Sequence
  chemically synthesized
ggtacataagggcacaaaaa

SEQ ID NO: 584618 - DNA, 20 bp, Artificial Sequence
  chemically synthesized
aagtttaatgtgtttcacat

SEQ ID NO: 584619 - DNA, 20 bp, Artificial Sequence
  chemically synthesized
atgaattttttttaagttta

SEQ ID NO: 584620 - DNA, 20 bp, Artificial Sequence
  chemically synthesized
agatattggatgaatttttt

SEQ ID NO: 584621 - DNA, 20 bp, Artificial Sequence
  chemically synthesized
ttttgaaaagtagttaatgc

SEQ ID NO: 584622 - DNA, 20 bp, Artificial Sequence
  chemically synthesized
cataatttatatgaataaac

SEQ ID NO: 584623 - DNA, 20 bp, Artificial Sequence
  chemically synthesized
gagattattgtagctaaaac

SEQ ID NO: 584624 - DNA, 20 bp, Artificial Sequence
  chemically synthesized
taaaatgaacattaggatta

SEQ ID NO: 584625 - DNA, 20 bp, Artificial Sequence
  chemically synthesized
tgtataaagtaaaatgaaca

SEQ ID NO: 584626 - DNA, 20 bp, Artificial Sequence
  chemically synthesized
ttcattttactttatacact

SEQ ID NO: 584627 - DNA, 20 bp, Artificial Sequence
  chemically synthesized
acttattgttttacaaaatt

SEQ ID NO: 584628 - DNA, 20 bp, Artificial Sequence
  chemically synthesized
tgtttagtattggatataaa

SEQ ID NO: 584629 - DNA, 20 bp, Artificial Sequence
  chemically synthesized
aagctttgatactgtgcttt

SEQ ID NO: 584630 - DNA, 20 bp, Artificial Sequence
  chemically synthesized
aaacacttaaagcacagtat

SEQ ID NO: 584631 - DNA, 20 bp, Artificial Sequence
  chemically synthesized
ataaataataagctttgata

SEQ ID NO: 584632 - DNA, 20 bp, Artificial Sequence
  chemically synthesized
gtttgactcattaataaata

SEQ ID NO: 584633 - DNA, 20 bp, Artificial Sequence
  chemically synthesized
aattaatcgttcttcagaag

SEQ ID NO: 584634 - DNA, 20 bp, Artificial Sequence
  chemically synthesized
agtcaaacaggccttctgaa

SEQ ID NO: 584635 - DNA, 20 bp, Artificial Sequence
  chemically synthesized
gccttctgaagaacgattaa

SEQ ID NO: 584636 - DNA, 20 bp, Artificial Sequence
  chemically synthesized
aacgattaattttgtttatt

SEQ ID NO: 584637 - DNA, 20 bp, Artificial Sequence
  chemically synthesized
acctgaaggatttttttttg

SEQ ID NO: 584638 - DNA, 20 bp, Artificial Sequence
  chemically synthesized
atgcttatattcatatacct

SEQ ID NO: 584639 - DNA, 20 bp, Artificial Sequence
  chemically synthesized
ctagtcagcagacagtaaca

SEQ ID NO: 584640 - DNA, 20 bp, Artificial Sequence
  chemically synthesized
taatatttaacttcacttcc

SEQ ID NO: 584641 - DNA, 20 bp, Artificial Sequence
  chemically synthesized
gattaattgatactctatcc

SEQ ID NO: 584642 - DNA, 20 bp, Artificial Sequence
  chemically synthesized
aggccctgactgatgcctga

SEQ ID NO: 584643 - DNA, 20 bp, Artificial Sequence
  chemically synthesized
aatcaggagctgctctctgg

SEQ ID NO: 584644 - DNA, 20 bp, Artificial Sequence
  chemically synthesized
aatcttccccagagagcagc

SEQ ID NO: 584645 - DNA, 20 bp, Artificial Sequence
  chemically synthesized
cccggagcctcccagcactg

SEQ ID NO: 584646 - DNA, 20 bp, Artificial Sequence
  chemically synthesized
gtgtttaagtgtctccgtgc

SEQ ID NO: 584647 - DNA, 20 bp, Artificial Sequence
  chemically synthesized
gccactgtttccttcgtata

SEQ ID NO: 584648 - DNA, 20 bp, Artificial Sequence
  chemically synthesized
cagtatgagattatagtaat

SEQ ID NO: 584649 - DNA, 20 bp, Artificial Sequence
  chemically synthesized
aagagactgtactgggcagt

SEQ ID NO: 584650 - DNA, 20 bp, Artificial Sequence
  chemically synthesized
tgtacaattttgaccaaagt

SEQ ID NO: 584651 - DNA, 20 bp, Artificial Sequence
  chemically synthesized
aatttcacttcctttataac

SEQ ID NO: 584652 - DNA, 20 bp, Artificial Sequence
  chemically synthesized
tgctgcattttcagggaaca

SEQ ID NO: 584653 - DNA, 20 bp, Artificial Sequence
  chemically synthesized
cagatgaggaataaggaaaa

SEQ ID NO: 584654 - DNA, 20 bp, Artificial Sequence
  chemically synthesized
tttggaattcagtaagtaaa

SEQ ID NO: 584655 - DNA, 20 bp, Artificial Sequence
  chemically synthesized
tatcaccatttactacacca

SEQ ID NO: 584656 - DNA, 20 bp, Artificial Sequence
  chemically synthesized
gcatatcttcagcaaggtaa

SEQ ID NO: 584657 - DNA, 20 bp, Artificial Sequence
  chemically synthesized
acagtgctttaagttaactt

SEQ ID NO: 584658 - DNA, 20 bp, Artificial Sequence
  chemically synthesized
tacaaaatgaatggtggtga

SEQ ID NO: 584659 - DNA, 20 bp, Artificial Sequence
  chemically synthesized
gtcaccaccattcattttgt

SEQ ID NO: 584660 - DNA, 20 bp, Artificial Sequence
  chemically synthesized
gtcagtgaataaatagaaaa

SEQ ID NO: 584661 - DNA, 20 bp, Artificial Sequence
  chemically synthesized
agctaattactggtaataga

SEQ ID NO: 584662 - DNA, 20 bp, Artificial Sequence
  chemically synthesized
tactggtaatagacaatgtt

SEQ ID NO: 584663 - DNA, 20 bp, Artificial Sequence
  chemically synthesized
gtaatagacaatgttttctg

SEQ ID NO: 584664 - DNA, 20 bp, Artificial Sequence
  chemically synthesized
ctactatttgccttccccaa

SEQ ID NO: 584665 - DNA, 20 bp, Artificial Sequence
  chemically synthesized
ccttccccaaccctgattcc

SEQ ID NO: 584666 - DNA, 20 bp, Artificial Sequence
  chemically synthesized
gtcactactatcccacccac

SEQ ID NO: 584667 - DNA, 20 bp, Artificial Sequence
  chemically synthesized
acggtagtgacaatgatgtg

SEQ ID NO: 584668 - DNA, 20 bp, Artificial Sequence
  chemically synthesized
aactttggattcagacctag

SEQ ID NO: 584669 - DNA, 20 bp, Artificial Sequence
  chemically synthesized
aacacagctaggtctgaatc

SEQ ID NO: 584670 - DNA, 20 bp, Artificial Sequence
  chemically synthesized
ctactgccaatagtataaac

SEQ ID NO: 584671 - DNA, 20 bp, Artificial Sequence
  chemically synthesized
aacaacttaataacatatcc

SEQ ID NO: 584672 - DNA, 20 bp, Artificial Sequence
  chemically synthesized
atggtgaaagtaaaatttct

SEQ ID NO: 584673 - DNA, 20 bp, Artificial Sequence
  chemically synthesized
attttactttcaccatctga

SEQ ID NO: 584674 - DNA, 20 bp, Artificial Sequence
  chemically synthesized
cagcatatgtgataatatca

SEQ ID NO: 584675 - DNA, 20 bp, Artificial Sequence
  chemically synthesized
tctattatcagagaggtagg

SEQ ID NO: 584676 - DNA, 20 bp, Artificial Sequence
  chemically synthesized
gcctgtctccctctgaccca

SEQ ID NO: 584677 - DNA, 20 bp, Artificial Sequence
  chemically synthesized
tatttaaactgttccaactc

SEQ ID NO: 584678 - DNA, 20 bp, Artificial Sequence
  chemically synthesized
ggaggaagcaaaggagttgg

SEQ ID NO: 584679 - DNA, 20 bp, Artificial Sequence
  chemically synthesized
acataatgtgattaattgtg

SEQ ID NO: 584680 - DNA, 20 bp, Artificial Sequence
  chemically synthesized
aaactatacatatacacata

SEQ ID NO: 584681 - DNA, 20 bp, Artificial Sequence
  chemically synthesized
aatcacattatgtgtatatg

SEQ ID NO: 584682 - DNA, 20 bp, Artificial Sequence
  chemically synthesized
tatttgcccgttcaacggtt

SEQ ID NO: 584683 - DNA, 20 bp, Artificial Sequence
  chemically synthesized
cagtatttatttgcccgttc

SEQ ID NO: 584684 - DNA, 20 bp, Artificial Sequence
  chemically synthesized
tagactctgtatttaactct

SEQ ID NO: 584685 - DNA, 20 bp, Artificial Sequence
  chemically synthesized
gttaaatacagagtctactc

SEQ ID NO: 584686 - DNA, 20 bp, Artificial Sequence
  chemically synthesized
acagagtctactcttctgct

SEQ ID NO: 584687 - DNA, 20 bp, Artificial Sequence
  chemically synthesized
ttctgcttttggatttcccg

SEQ ID NO: 584688 - DNA, 20 bp, Artificial Sequence
  chemically synthesized
aaaattttacatcttcacgt

SEQ ID NO: 584689 - DNA, 20 bp, Artificial Sequence
  chemically synthesized
cattttaatttgtcatagaa

SEQ ID NO: 584690 - DNA, 20 bp, Artificial Sequence
  chemically synthesized
catttctatgacaaattaaa

SEQ ID NO: 584691 - DNA, 20 bp, Artificial Sequence
  chemically synthesized
tagtttaaaggaagtcaatg

SEQ ID NO: 584692 - DNA, 20 bp, Artificial Sequence
  chemically synthesized
aaatgtgggataaatggaat

SEQ ID NO: 584693 - DNA, 20 bp, Artificial Sequence
  chemically synthesized
tgttctcttggattgctaga

SEQ ID NO: 584694 - DNA, 20 bp, Artificial Sequence
  chemically synthesized
atttgtatttgtgatgttct

SEQ ID NO: 584695 - DNA, 20 bp, Artificial Sequence
  chemically synthesized
caagagaacatcacaaatac

SEQ ID NO: 584696 - DNA, 20 bp, Artificial Sequence
  chemically synthesized
atacaaatgttttagcattt

SEQ ID NO: 584697 - DNA, 20 bp, Artificial Sequence
  chemically synthesized
aagtgcaatagttataaagt

SEQ ID NO: 584698 - DNA, 20 bp, Artificial Sequence
  chemically synthesized
tcaaaactaataaatgttta

SEQ ID NO: 584699 - DNA, 20 bp, Artificial Sequence
  chemically synthesized
ttgaagcatagtaaacattt

SEQ ID NO: 584700 - DNA, 20 bp, Artificial Sequence
  chemically synthesized
gcatagtaaacatttattag

SEQ ID NO: 584701 - DNA, 20 bp, Artificial Sequence
  chemically synthesized
aattacaaatcaaaactaat

SEQ ID NO: 584702 - DNA, 20 bp, Artificial Sequence
  chemically synthesized
aatatgatcctccagccttt

SEQ ID NO: 584703 - DNA, 20 bp, Artificial Sequence
  chemically synthesized
ttttaatactcatagaagtt

SEQ ID NO: 584704 - DNA, 20 bp, Artificial Sequence
  chemically synthesized
tcacaggttttaatactcat

SEQ ID NO: 584705 - DNA, 20 bp, Artificial Sequence
  chemically synthesized
cttttccatgctagtacatc

SEQ ID NO: 584706 - DNA, 20 bp, Artificial Sequence
  chemically synthesized
gggagtgtttgaaaggaaag

SEQ ID NO: 584707 - DNA, 20 bp, Artificial Sequence
  chemically synthesized
gaaaaagaaaagtgaagtgg

SEQ ID NO: 584708 - DNA, 20 bp, Artificial Sequence
  chemically synthesized
tttgatacatttgatctaac

SEQ ID NO: 584709 - DNA, 20 bp, Artificial Sequence
  chemically synthesized
gtagtttggtgttcagtgca

SEQ ID NO: 584710 - DNA, 20 bp, Artificial Sequence
  chemically synthesized
ttaaaggttggaataatata

SEQ ID NO: 584711 - DNA, 20 bp, Artificial Sequence
  chemically synthesized
tatattattccaacctttaa

SEQ ID NO: 584712 - DNA, 20 bp, Artificial Sequence
  chemically synthesized
tattcaatatatttataagc

SEQ ID NO: 584713 - DNA, 20 bp, Artificial Sequence
  chemically synthesized
tctagtgctgtatcccaatc

SEQ ID NO: 584714 - DNA, 20 bp, Artificial Sequence
  chemically synthesized
tacaggtatacctcatttta

SEQ ID NO: 584715 - DNA, 20 bp, Artificial Sequence
  chemically synthesized
tgccttattggctctgcaga

SEQ ID NO: 584716 - DNA, 20 bp, Artificial Sequence
  chemically synthesized
tttttttttttttacaaact

SEQ ID NO: 584717 - DNA, 20 bp, Artificial Sequence
  chemically synthesized
atgcagggttgctacaaacc

SEQ ID NO: 584718 - DNA, 20 bp, Artificial Sequence
  chemically synthesized
gttggaaatgttgctgatag

SEQ ID NO: 584719 - DNA, 20 bp, Artificial Sequence
  chemically synthesized
tcagcaacatttccaacacc

SEQ ID NO: 584720 - DNA, 20 bp, Artificial Sequence
  chemically synthesized
ttgataattctcacaatatt

SEQ ID NO: 584721 - DNA, 20 bp, Artificial Sequence
  chemically synthesized
aacagttataaaaatattga

SEQ ID NO: 584722 - DNA, 20 bp, Artificial Sequence
  chemically synthesized
aaaatagtaacatcaaagat

SEQ ID NO: 584723 - DNA, 20 bp, Artificial Sequence
  chemically synthesized
aactattaaaatagtaacat

SEQ ID NO: 584724 - DNA, 20 bp, Artificial Sequence
  chemically synthesized
atctttgatgttactatttt

SEQ ID NO: 584725 - DNA, 20 bp, Artificial Sequence
  chemically synthesized
agtttgccatcctatatggg

SEQ ID NO: 584726 - DNA, 20 bp, Artificial Sequence
  chemically synthesized
agaatacatacattaatgga

SEQ ID NO: 584727 - DNA, 20 bp, Artificial Sequence
  chemically synthesized
gcgttcagaatacatacatt

SEQ ID NO: 584728 - DNA, 20 bp, Artificial Sequence
  chemically synthesized
taaagtgagagacatgcaac

SEQ ID NO: 584729 - DNA, 20 bp, Artificial Sequence
  chemically synthesized
cactttaaatcaaaagctag

SEQ ID NO: 584730 - DNA, 20 bp, Artificial Sequence
  chemically synthesized
caagcttaatcatttctagc

SEQ ID NO: 584731 - DNA, 20 bp, Artificial Sequence
  chemically synthesized
aaatcaaaagctagaaatga

SEQ ID NO: 584732 - DNA, 20 bp, Artificial Sequence
  chemically synthesized
cctaaccaagcttaatcatt

SEQ ID NO: 584733 - DNA, 20 bp, Artificial Sequence
  chemically synthesized
ctttcgacatgccttcctaa

SEQ ID NO: 584734 - DNA, 20 bp, Artificial Sequence
  chemically synthesized
aggcctagcttccagcctct

SEQ ID NO: 584735 - DNA, 20 bp, Artificial Sequence
  chemically synthesized
tagctaacgggcacaagagg

SEQ ID NO: 584736 - DNA, 20 bp, Artificial Sequence
  chemically synthesized
ccatattaacaataaggctg

SEQ ID NO: 584737 - DNA, 20 bp, Artificial Sequence
  chemically synthesized
ttggcttaggagaatgttgt

SEQ ID NO: 584738 - DNA, 20 bp, Artificial Sequence
  chemically synthesized
ggccttgctctggattaggc

SEQ ID NO: 584739 - DNA, 20 bp, Artificial Sequence
  chemically synthesized
gaattgggccttgctctgga

SEQ ID NO: 584740 - DNA, 20 bp, Artificial Sequence
  chemically synthesized
tgaacagaattgggccttgc

SEQ ID NO: 584741 - DNA, 20 bp, Artificial Sequence
  chemically synthesized
aagaaaagttggaagccagc

SEQ ID NO: 584742 - DNA, 20 bp, Artificial Sequence
  chemically synthesized
agcctcatgaacaaacctct

SEQ ID NO: 584743 - DNA, 20 bp, Artificial Sequence
  chemically synthesized
agccagcagaggtttgttca

SEQ ID NO: 584744 - DNA, 20 bp, Artificial Sequence
  chemically synthesized
tttcacttttatgttacgga

SEQ ID NO: 584745 - DNA, 20 bp, Artificial Sequence
  chemically synthesized
tgatcttctggatagtttgc

SEQ ID NO: 584746 - DNA, 20 bp, Artificial Sequence
  chemically synthesized
gatattagcttgatcttctg

SEQ ID NO: 584747 - DNA, 20 bp, Artificial Sequence
  chemically synthesized
ctaccttcatcatcttagat

SEQ ID NO: 584748 - DNA, 20 bp, Artificial Sequence
  chemically synthesized
tgaaggtagctacactaaac

SEQ ID NO: 584749 - DNA, 20 bp, Artificial Sequence
  chemically synthesized
cttcatctacactgaaaatc

SEQ ID NO: 584750 - DNA, 20 bp, Artificial Sequence
  chemically synthesized
ggcatctttttccaatagaa

SEQ ID NO: 584751 - DNA, 20 bp, Artificial Sequence
  chemically synthesized
tagctagagagaagtcaatg

SEQ ID NO: 584752 - DNA, 20 bp, Artificial Sequence
  chemically synthesized
ttccaaaaatcctagggccc

SEQ ID NO: 584753 - DNA, 20 bp, Artificial Sequence
  chemically synthesized
ttagcataatcttaagggcc

SEQ ID NO: 584754 - DNA, 20 bp, Artificial Sequence
  chemically synthesized
gtaaagagatgtgctatcat

SEQ ID NO: 584755 - DNA, 20 bp, Artificial Sequence
  chemically synthesized
gatagcacatctctttacag

SEQ ID NO: 584756 - DNA, 20 bp, Artificial Sequence
  chemically synthesized
aacaagcagtaatatattga

SEQ ID NO: 584757 - DNA, 20 bp, Artificial Sequence
  chemically synthesized
aaaaatctctttcaatatat

SEQ ID NO: 584758 - DNA, 20 bp, Artificial Sequence
  chemically synthesized
aggtctgatgaagatgtacc

SEQ ID NO: 584759 - DNA, 20 bp, Artificial Sequence
  chemically synthesized
gatgaagatgtaccaagaga

SEQ ID NO: 584760 - DNA, 20 bp, Artificial Sequence
  chemically synthesized
aaggctatagctgccctagg

SEQ ID NO: 584761 - DNA, 20 bp, Artificial Sequence
  chemically synthesized
tgagtcctttccagaagatt

SEQ ID NO: 584762 - DNA, 20 bp, Artificial Sequence
  chemically synthesized
tggaatggtgagtcctttcc

SEQ ID NO: 584763 - DNA, 20 bp, Artificial Sequence
  chemically synthesized
ccagatgccattaagaaaat

SEQ ID NO: 584764 - DNA, 20 bp, Artificial Sequence
  chemically synthesized
aggtaaatatcaacattaca

SEQ ID NO: 584765 - DNA, 20 bp, Artificial Sequence
  chemically synthesized
aacattacaaggtgtttgga

SEQ ID NO: 584766 - DNA, 20 bp, Artificial Sequence
  chemically synthesized
agtagcaactcttcatccat

SEQ ID NO: 584767 - DNA, 20 bp, Artificial Sequence
  chemically synthesized
acttatagatgagcaaaaca

SEQ ID NO: 584768 - DNA, 20 bp, Artificial Sequence
  chemically synthesized
gattctgtctcatgaaaaca

SEQ ID NO: 584769 - DNA, 20 bp, Artificial Sequence
  chemically synthesized
tttacagcgtcttcaccagg

SEQ ID NO: 584770 - DNA, 20 bp, Artificial Sequence
  chemically synthesized
accctttgttgtcatttcaa

SEQ ID NO: 584771 - DNA, 20 bp, Artificial Sequence
  chemically synthesized
acaatgttgaaatgacaaca

SEQ ID NO: 584772 - DNA, 20 bp, Artificial Sequence
  chemically synthesized
ccctgctgctgctttaccaa

SEQ ID NO: 584773 - DNA, 20 bp, Artificial Sequence
  chemically synthesized
tcaaggctctcataccctgc

SEQ ID NO: 584774 - DNA, 20 bp, Artificial Sequence
  chemically synthesized
tgttggttgatttttttcac

SEQ ID NO: 584775 - DNA, 20 bp, Artificial Sequence
  chemically synthesized
accatgaggtttgctatgtt

SEQ ID NO: 584776 - DNA, 20 bp, Artificial Sequence
  chemically synthesized
accaacatagcaaacctcat

SEQ ID NO: 584777 - DNA, 20 bp, Artificial Sequence
  chemically synthesized
ttcttagaataaaacaacca

SEQ ID NO: 584778 - DNA, 20 bp, Artificial Sequence
  chemically synthesized
ggcaagaccctccatcagca

SEQ ID NO: 584779 - DNA, 20 bp, Artificial Sequence
  chemically synthesized
gaaggctcagatgactgcta

SEQ ID NO: 584780 - DNA, 20 bp, Artificial Sequence
  chemically synthesized
ttaaaaaaatactttgttgc

SEQ ID NO: 584781 - DNA, 20 bp, Artificial Sequence
  chemically synthesized
tttttttaaataatttcaac

SEQ ID NO: 584782 - DNA, 20 bp, Artificial Sequence
  chemically synthesized
taaataatttcaactattgt

SEQ ID NO: 584783 - DNA, 20 bp, Artificial Sequence
  chemically synthesized
tagatttaaggggtacatgt

SEQ ID NO: 584784 - DNA, 20 bp, Artificial Sequence
  chemically synthesized
atatatttattgggtgatac

SEQ ID NO: 584785 - DNA, 20 bp, Artificial Sequence
  chemically synthesized
agtgcgcaccgtatctaata

SEQ ID NO: 584786 - DNA, 20 bp, Artificial Sequence
  chemically synthesized
ccttccttatctcttcccct

SEQ ID NO: 584787 - DNA, 20 bp, Artificial Sequence
  chemically synthesized
tctttatgtccatgagtgcc

SEQ ID NO: 584788 - DNA, 20 bp, Artificial Sequence
  chemically synthesized
taagtgagaacaaagtggta

SEQ ID NO: 584789 - DNA, 20 bp, Artificial Sequence
  chemically synthesized
ccaccattgatggtcatcta

SEQ ID NO: 584790 - DNA, 20 bp, Artificial Sequence
  chemically synthesized
atggtcatctaggttgattc

SEQ ID NO: 584791 - DNA, 20 bp, Artificial Sequence
  chemically synthesized
gtgcatgtgtctttttggta

SEQ ID NO: 584792 - DNA, 20 bp, Artificial Sequence
  chemically synthesized
ttttggatatatactcagta

SEQ ID NO: 584793 - DNA, 20 bp, Artificial Sequence
  chemically synthesized
tttaagttgagaaatcccca

SEQ ID NO: 584794 - DNA, 20 bp, Artificial Sequence
  chemically synthesized
acccactgtggaaagcagtt

SEQ ID NO: 584795 - DNA, 20 bp, Artificial Sequence
  chemically synthesized
ttagttcacccactgtggaa

SEQ ID NO: 584796 - DNA, 20 bp, Artificial Sequence
  chemically synthesized
tgcagcctcaccaacatcta

SEQ ID NO: 584797 - DNA, 20 bp, Artificial Sequence
  chemically synthesized
tcaccaacatctattgtgtt

SEQ ID NO: 584798 - DNA, 20 bp, Artificial Sequence
  chemically synthesized
ggtgtgagatggtatctcat

SEQ ID NO: 584799 - DNA, 20 bp, Artificial Sequence
  chemically synthesized
gagatggtatctcattgtgg

SEQ ID NO: 584800 - DNA, 20 bp, Artificial Sequence
  chemically synthesized
ttttttcatatctgttagcc

SEQ ID NO: 584801 - DNA, 20 bp, Artificial Sequence
  chemically synthesized
cactttttacatggggttat

SEQ ID NO: 584802 - DNA, 20 bp, Artificial Sequence
  chemically synthesized
tttacatggggttatctgcg

SEQ ID NO: 584803 - DNA, 20 bp, Artificial Sequence
  chemically synthesized
gttttgcttgttaagttccc

SEQ ID NO: 584804 - DNA, 20 bp, Artificial Sequence
  chemically synthesized
tattagatctttgtctgatg

SEQ ID NO: 584805 - DNA, 20 bp, Artificial Sequence
  chemically synthesized
tttctctcatcttgtgggtt

SEQ ID NO: 584806 - DNA, 20 bp, Artificial Sequence
  chemically synthesized
ggttgtctgtttactctgtt

SEQ ID NO: 584807 - DNA, 20 bp, Artificial Sequence
  chemically synthesized
cttttgctgtgtagaagctc

SEQ ID NO: 584808 - DNA, 20 bp, Artificial Sequence
  chemically synthesized
agtgggatctaattaaacta

SEQ ID NO: 584809 - DNA, 20 bp, Artificial Sequence
  chemically synthesized
ttagatcccacttgttaatt

SEQ ID NO: 584810 - DNA, 20 bp, Artificial Sequence
  chemically synthesized
ttaatttttggttttgttac

SEQ ID NO: 584811 - DNA, 20 bp, Artificial Sequence
  chemically synthesized
gatgtccagaatagtatttc

SEQ ID NO: 584812 - DNA, 20 bp, Artificial Sequence
  chemically synthesized
agtatttcctaggttttctt

SEQ ID NO: 584813 - DNA, 20 bp, Artificial Sequence
  chemically synthesized
aggttttcttctgcgattct

SEQ ID NO: 584814 - DNA, 20 bp, Artificial Sequence
  chemically synthesized
tcttctgcgattcttctagt

SEQ ID NO: 584815 - DNA, 20 bp, Artificial Sequence
  chemically synthesized
gagtcggaggttgcagtgag

SEQ ID NO: 584816 - DNA, 20 bp, Artificial Sequence
  chemically synthesized
ttgggaggctgaggcaggag

SEQ ID NO: 584817 - DNA, 20 bp, Artificial Sequence
  chemically synthesized
tgcctcagcctcccaagtag

SEQ ID NO: 584818 - DNA, 20 bp, Artificial Sequence
  chemically synthesized
ttttgtatttttagtagaga

SEQ ID NO: 584819 - DNA, 20 bp, Artificial Sequence
  chemically synthesized
agcaggtggatcacgaggtc

SEQ ID NO: 584820 - DNA, 20 bp, Artificial Sequence
  chemically synthesized
atctcctgacctcgtgatcc

SEQ ID NO: 584821 - DNA, 20 bp, Artificial Sequence
  chemically synthesized
tgcttcagcctcccaaagtg

SEQ ID NO: 584822 - DNA, 20 bp, Artificial Sequence
  chemically synthesized
gcgtgagccaccgcacctgg

SEQ ID NO: 584823 - DNA, 20 bp, Artificial Sequence
  chemically synthesized
aaaattaactcaagatggat

SEQ ID NO: 584824 - DNA, 20 bp, Artificial Sequence
  chemically synthesized
atatacaaaaattaactcaa

SEQ ID NO: 584825 - DNA, 20 bp, Artificial Sequence
  chemically synthesized
tatatagtgaaaggtaggag

SEQ ID NO: 584826 - DNA, 20 bp, Artificial Sequence
  chemically synthesized
cggttagccagctatcccag

SEQ ID NO: 584827 - DNA, 20 bp, Artificial Sequence
  chemically synthesized
cctttccccatttttttttt

SEQ ID NO: 584828 - DNA, 20 bp, Artificial Sequence
  chemically synthesized
agatcagatggctgtaggta

SEQ ID NO: 584829 - DNA, 20 bp, Artificial Sequence
  chemically synthesized
ctctattctgttctactggt

SEQ ID NO: 584830 - DNA, 20 bp, Artificial Sequence
  chemically synthesized
tctgttctactggtccaagt

SEQ ID NO: 584831 - DNA, 20 bp, Artificial Sequence
  chemically synthesized
gggtaactgtagccttatag

SEQ ID NO: 584832 - DNA, 20 bp, Artificial Sequence
  chemically synthesized
tagtttgaagttggttaata

SEQ ID NO: 584833 - DNA, 20 bp, Artificial Sequence
  chemically synthesized
gctttattcttttcacttag

SEQ ID NO: 584834 - DNA, 20 bp, Artificial Sequence
  chemically synthesized
agcattgtttttactcttca

SEQ ID NO: 584835 - DNA, 20 bp, Artificial Sequence
  chemically synthesized
ttttactcttcagactgttt

SEQ ID NO: 584836 - DNA, 20 bp, Artificial Sequence
  chemically synthesized
tagattcatatgaattttag

SEQ ID NO: 584837 - DNA, 20 bp, Artificial Sequence
  chemically synthesized
attctgtgaaaaatgacatt

SEQ ID NO: 584838 - DNA, 20 bp, Artificial Sequence
  chemically synthesized
gataggaatagcattgaatc

SEQ ID NO: 584839 - DNA, 20 bp, Artificial Sequence
  chemically synthesized
ggaatagcattgaatctgta

SEQ ID NO: 584840 - DNA, 20 bp, Artificial Sequence
  chemically synthesized
acatactgcttaaagcaatc

SEQ ID NO: 584841 - DNA, 20 bp, Artificial Sequence
  chemically synthesized
caatatcattaaaatggaca

SEQ ID NO: 584842 - DNA, 20 bp, Artificial Sequence
  chemically synthesized
cagtatgtccattttaatga

SEQ ID NO: 584843 - DNA, 20 bp, Artificial Sequence
  chemically synthesized
tcttcctttccattaacatg

SEQ ID NO: 584844 - DNA, 20 bp, Artificial Sequence
  chemically synthesized
ttaacatggaatgtttctcc

SEQ ID NO: 584845 - DNA, 20 bp, Artificial Sequence
  chemically synthesized
ctccatttgtttgtgttatc

SEQ ID NO: 584846 - DNA, 20 bp, Artificial Sequence
  chemically synthesized
ttatctatggtttctttcag

SEQ ID NO: 584847 - DNA, 20 bp, Artificial Sequence
  chemically synthesized
tattttttgtggttattgta

SEQ ID NO: 584848 - DNA, 20 bp, Artificial Sequence
  chemically synthesized
ttattgtaaatagtttgcat

SEQ ID NO: 584849 - DNA, 20 bp, Artificial Sequence
  chemically synthesized
tttgcattcttgatttggct

SEQ ID NO: 584850 - DNA, 20 bp, Artificial Sequence
  chemically synthesized
ttttaaattaaggcatgtac

SEQ ID NO: 584851 - DNA, 20 bp, Artificial Sequence
  chemically synthesized
gcatacactattgtatactt

SEQ ID NO: 584852 - DNA, 20 bp, Artificial Sequence
  chemically synthesized
aaagtgagtcacatgaactt

SEQ ID NO: 584853 - DNA, 20 bp, Artificial Sequence
  chemically synthesized
atgtatatgtatgctatgaa

SEQ ID NO: 584854 - DNA, 20 bp, Artificial Sequence
  chemically synthesized
caccgccttttggcaatgga

SEQ ID NO: 584855 - DNA, 20 bp, Artificial Sequence
  chemically synthesized
tccattgccaaaaggcggtg

SEQ ID NO: 584856 - DNA, 20 bp, Artificial Sequence
  chemically synthesized
tgccaaaaggcggtgaggag

SEQ ID NO: 584857 - DNA, 20 bp, Artificial Sequence
  chemically synthesized
ggtgaggagttttgcttgta

SEQ ID NO: 584858 - DNA, 20 bp, Artificial Sequence
  chemically synthesized
ttctgtcctctataacacct

SEQ ID NO: 584859 - DNA, 20 bp, Artificial Sequence
  chemically synthesized
ccgtccctctctttctctca

SEQ ID NO: 584860 - DNA, 20 bp, Artificial Sequence
  chemically synthesized
tcaagttgattgtatatacc

SEQ ID NO: 584861 - DNA, 20 bp, Artificial Sequence
  chemically synthesized
taatatttcttggataccaa

SEQ ID NO: 584862 - DNA, 20 bp, Artificial Sequence
  chemically synthesized
tttaagatgataactctagc

SEQ ID NO: 584863 - DNA, 20 bp, Artificial Sequence
  chemically synthesized
actctagcggcagattggag

SEQ ID NO: 584864 - DNA, 20 bp, Artificial Sequence
  chemically synthesized
cggacctctaaaggcatttc

SEQ ID NO: 584865 - DNA, 20 bp, Artificial Sequence
  chemically synthesized
ttcctgaacatccgtgctgc

SEQ ID NO: 584866 - DNA, 20 bp, Artificial Sequence
  chemically synthesized
aaagaaaattttcagaatca

SEQ ID NO: 584867 - DNA, 20 bp, Artificial Sequence
  chemically synthesized
tctcccaagttataaaatct

SEQ ID NO: 584868 - DNA, 20 bp, Artificial Sequence
  chemically synthesized
ctgtcttccctgtaccccta

SEQ ID NO: 584869 - DNA, 20 bp, Artificial Sequence
  chemically synthesized
ctgtccctatatggaaggaa

SEQ ID NO: 584870 - DNA, 20 bp, Artificial Sequence
  chemically synthesized
ggagacatgagtcaagatgc

SEQ ID NO: 584871 - DNA, 20 bp, Artificial Sequence
  chemically synthesized
ttgcaaaaagaagcgtagtg

SEQ ID NO: 584872 - DNA, 20 bp, Artificial Sequence
  chemically synthesized
ccttacccctaatctgcaca

SEQ ID NO: 584873 - DNA, 20 bp, Artificial Sequence
  chemically synthesized
ttaggggtaaggctaagaat

SEQ ID NO: 584874 - DNA, 20 bp, Artificial Sequence
  chemically synthesized
tattttgggtttttacatgt

SEQ ID NO: 584875 - DNA, 20 bp, Artificial Sequence
  chemically synthesized
attctctcctcacttctatt

SEQ ID NO: 584876 - DNA, 20 bp, Artificial Sequence
  chemically synthesized
ttgtattatttcttgagctt

SEQ ID NO: 584877 - DNA, 20 bp, Artificial Sequence
  chemically synthesized
attattatttgtattatttc

SEQ ID NO: 584878 - DNA, 20 bp, Artificial Sequence
  chemically synthesized
tcattggaggttaaatgaaa

SEQ ID NO: 584879 - DNA, 20 bp, Artificial Sequence
  chemically synthesized
aaggttttatatccaatgtt

SEQ ID NO: 584880 - DNA, 20 bp, Artificial Sequence
  chemically synthesized
cccatttttaaaattcagca

SEQ ID NO: 584881 - DNA, 20 bp, Artificial Sequence
  chemically synthesized
agtttactgttgttacctaa

SEQ ID NO: 584882 - DNA, 20 bp, Artificial Sequence
  chemically synthesized
cccattgtaagatatatcta

SEQ ID NO: 584883 - DNA, 20 bp, Artificial Sequence
  chemically synthesized
tgagtaaaacaaatgaatgg

SEQ ID NO: 584884 - DNA, 20 bp, Artificial Sequence
  chemically synthesized
cagagcaaacgttcccattc

SEQ ID NO: 584885 - DNA, 20 bp, Artificial Sequence
  chemically synthesized
tgtgtgtgtgtgtgtgtatt

SEQ ID NO: 584886 - DNA, 20 bp, Artificial Sequence
  chemically synthesized
ccataattaataactatcct

SEQ ID NO: 584887 - DNA, 20 bp, Artificial Sequence
  chemically synthesized
taatactctcataattttag

SEQ ID NO: 584888 - DNA, 20 bp, Artificial Sequence
  chemically synthesized
gaattaatactctcataatt

SEQ ID NO: 584889 - DNA, 20 bp, Artificial Sequence
  chemically synthesized
ctggatatttcttcctttaa

SEQ ID NO: 584890 - DNA, 20 bp, Artificial Sequence
  chemically synthesized
tctaaaggtacagaattttc

SEQ ID NO: 584891 - DNA, 20 bp, Artificial Sequence
  chemically synthesized
gaaatagtcaaaaatttcat

SEQ ID NO: 584892 - DNA, 20 bp, Artificial Sequence
  chemically synthesized
tgatttttggaactatttat

SEQ ID NO: 584893 - DNA, 20 bp, Artificial Sequence
  chemically synthesized
tgagtagtggtatctattct

SEQ ID NO: 584894 - DNA, 20 bp, Artificial Sequence
  chemically synthesized
gcagatagataggatcagga

SEQ ID NO: 584895 - DNA, 20 bp, Artificial Sequence
  chemically synthesized
aatgccagccttgttgccat

SEQ ID NO: 584896 - DNA, 20 bp, Artificial Sequence
  chemically synthesized
agagctccaaagtactaagt

SEQ ID NO: 584897 - DNA, 20 bp, Artificial Sequence
  chemically synthesized
gttcaagtcaccaaaatagc

SEQ ID NO: 584898 - DNA, 20 bp, Artificial Sequence
  chemically synthesized
cacatcatttccctctattg

SEQ ID NO: 584899 - DNA, 20 bp, Artificial Sequence
  chemically synthesized
ttcatccttcaatgacatag

SEQ ID NO: 584900 - DNA, 20 bp, Artificial Sequence
  chemically synthesized
tacagattttaagtacccat

SEQ ID NO: 584901 - DNA, 20 bp, Artificial Sequence
  chemically synthesized
atgaattctttcacccattg

SEQ ID NO: 584902 - DNA, 20 bp, Artificial Sequence
  chemically synthesized
agttattaagggcaagatac

SEQ ID NO: 584903 - DNA, 20 bp, Artificial Sequence
  chemically synthesized
gaatattttcagtgaagtta

SEQ ID NO: 584904 - DNA, 20 bp, Artificial Sequence
  chemically synthesized
taggataattgtcagtttct

SEQ ID NO: 584905 - DNA, 20 bp, Artificial Sequence
  chemically synthesized
ctttaatttttaggataatt

SEQ ID NO: 584906 - DNA, 20 bp, Artificial Sequence
  chemically synthesized
agttgtttcttgctttgttt

SEQ ID NO: 584907 - DNA, 20 bp, Artificial Sequence
  chemically synthesized
ttctttggagttgtttcttg

SEQ ID NO: 584908 - DNA, 20 bp, Artificial Sequence
  chemically synthesized
gtggtttctttggagttgtt

SEQ ID NO: 584909 - DNA, 20 bp, Artificial Sequence
  chemically synthesized
atctcatgtggtttctttgg

SEQ ID NO: 584910 - DNA, 20 bp, Artificial Sequence
  chemically synthesized
tttctgatctttccatctca

SEQ ID NO: 584911 - DNA, 20 bp, Artificial Sequence
  chemically synthesized
ataataaatgttttagcaac

SEQ ID NO: 584912 - DNA, 20 bp, Artificial Sequence
  chemically synthesized
cacagtgtttgacatataat

SEQ ID NO: 584913 - DNA, 20 bp, Artificial Sequence
  chemically synthesized
catttattatatgtcaaaca

SEQ ID NO: 584914 - DNA, 20 bp, Artificial Sequence
  chemically synthesized
gtatgtgtgtatgaaaagca

SEQ ID NO: 584915 - DNA, 20 bp, Artificial Sequence
  chemically synthesized
cacacatacactcctacaaa

SEQ ID NO: 584916 - DNA, 20 bp, Artificial Sequence
  chemically synthesized
ttcacagatgctgcaattga

SEQ ID NO: 584917 - DNA, 20 bp, Artificial Sequence
  chemically synthesized
aggtcaattatccaagacca

SEQ ID NO: 584918 - DNA, 20 bp, Artificial Sequence
  chemically synthesized
gtggcttgcaaatggcagag

SEQ ID NO: 584919 - DNA, 20 bp, Artificial Sequence
  chemically synthesized
cagattcagaaagaaggaaa

SEQ ID NO: 584920 - DNA, 20 bp, Artificial Sequence
  chemically synthesized
cacacacacacagtatacac

SEQ ID NO: 584921 - DNA, 20 bp, Artificial Sequence
  chemically synthesized
gcatacacgcacatgtgcat

SEQ ID NO: 584922 - DNA, 20 bp, Artificial Sequence
  chemically synthesized
ttattatttctttccaaaat

SEQ ID NO: 584923 - DNA, 20 bp, Artificial Sequence
  chemically synthesized
ttcattttttgtgagaaggg

SEQ ID NO: 584924 - DNA, 20 bp, Artificial Sequence
  chemically synthesized
ccttctcacaaaaaatgaaa

SEQ ID NO: 584925 - DNA, 20 bp, Artificial Sequence
  chemically synthesized
catagccttgtaatagctct

SEQ ID NO: 584926 - DNA, 20 bp, Artificial Sequence
  chemically synthesized
agctctgagggtttctctta

SEQ ID NO: 584927 - DNA, 20 bp, Artificial Sequence
  chemically synthesized
gagggtttctcttagtgggt

SEQ ID NO: 584928 - DNA, 20 bp, Artificial Sequence
  chemically synthesized
agttctctgacctggatatc

SEQ ID NO: 584929 - DNA, 20 bp, Artificial Sequence
  chemically synthesized
tctgatatccaggtcagaga

SEQ ID NO: 584930 - DNA, 20 bp, Artificial Sequence
  chemically synthesized
gtgaggccatttgcgagata

SEQ ID NO: 584931 - DNA, 20 bp, Artificial Sequence
  chemically synthesized
gcaaatggcctcacatcttt

SEQ ID NO: 584932 - DNA, 20 bp, Artificial Sequence
  chemically synthesized
aagccggccactataattag

SEQ ID NO: 584933 - DNA, 20 bp, Artificial Sequence
  chemically synthesized
aaacatagctaattatagtg

SEQ ID NO: 584934 - DNA, 20 bp, Artificial Sequence
  chemically synthesized
attcagacaagaaagtcgtc

SEQ ID NO: 584935 - DNA, 20 bp, Artificial Sequence
  chemically synthesized
taataacagaacatttccat

SEQ ID NO: 584936 - DNA, 20 bp, Artificial Sequence
  chemically synthesized
ttcttaatgtcccctccaat

SEQ ID NO: 584937 - DNA, 20 bp, Artificial Sequence
  chemically synthesized
taagatccttatgatacgag

SEQ ID NO: 584938 - DNA, 20 bp, Artificial Sequence
  chemically synthesized
atccttatgatacgaggaga

SEQ ID NO: 584939 - DNA, 20 bp, Artificial Sequence
  chemically synthesized
tcttctgaaatccagccctg

SEQ ID NO: 584940 - DNA, 20 bp, Artificial Sequence
  chemically synthesized
catttcaaaaacctatcagg

SEQ ID NO: 584941 - DNA, 20 bp, Artificial Sequence
  chemically synthesized
taagagataaataaaagtaa

SEQ ID NO: 584942 - DNA, 20 bp, Artificial Sequence
  chemically synthesized
tgatctgacaagcagtgaag

SEQ ID NO: 584943 - DNA, 20 bp, Artificial Sequence
  chemically synthesized
ttcatcactaatctttgctt

SEQ ID NO: 584944 - DNA, 20 bp, Artificial Sequence
  chemically synthesized
tacctcttttcatcactaat

SEQ ID NO: 584945 - DNA, 20 bp, Artificial Sequence
  chemically synthesized
gacttgctacttttaccctc

SEQ ID NO: 584946 - DNA, 20 bp, Artificial Sequence
  chemically synthesized
atatatttacattttctaat

SEQ ID NO: 584947 - DNA, 20 bp, Artificial Sequence
  chemically synthesized
atatttctaattctacatca

SEQ ID NO: 584948 - DNA, 20 bp, Artificial Sequence
  chemically synthesized
atcatgccgattgtgtgtgc

SEQ ID NO: 584949 - DNA, 20 bp, Artificial Sequence
  chemically synthesized
acaaaaaggaaaaaattctt

SEQ ID NO: 584950 - DNA, 20 bp, Artificial Sequence
  chemically synthesized
cctactaataaccttagaat

SEQ ID NO: 584951 - DNA, 20 bp, Artificial Sequence
  chemically synthesized
ttgtttatgtcctccttata

SEQ ID NO: 584952 - DNA, 20 bp, Artificial Sequence
  chemically synthesized
tgtttgaacatacatggaaa

SEQ ID NO: 584953 - DNA, 20 bp, Artificial Sequence
  chemically synthesized
aaataaataaataaataaat

SEQ ID NO: 584954 - DNA, 20 bp, Artificial Sequence
  chemically synthesized
tcattcgacaaacatttatt

SEQ ID NO: 584955 - DNA, 20 bp, Artificial Sequence
  chemically synthesized
aaacatagtaagcactgaat

SEQ ID NO: 584956 - DNA, 20 bp, Artificial Sequence
  chemically synthesized
aaacatttattcagtgctta

SEQ ID NO: 584957 - DNA, 20 bp, Artificial Sequence
  chemically synthesized
agagcaggaactgatcactt

SEQ ID NO: 584958 - DNA, 20 bp, Artificial Sequence
  chemically synthesized
cccttataatgaggtgcatg

SEQ ID NO: 584959 - DNA, 20 bp, Artificial Sequence
  chemically synthesized
acgtgatagctccgtacttc

SEQ ID NO: 584960 - DNA, 20 bp, Artificial Sequence
  chemically synthesized
agatccttcttttctctggc

SEQ ID NO: 584961 - DNA, 20 bp, Artificial Sequence
  chemically synthesized
tatacaagatccttcttttc

SEQ ID NO: 584962 - DNA, 20 bp, Artificial Sequence
  chemically synthesized
aactgtagtggagaagctac

SEQ ID NO: 584963 - DNA, 20 bp, Artificial Sequence
  chemically synthesized
attcccttatttaaaactct

SEQ ID NO: 584964 - DNA, 20 bp, Artificial Sequence
  chemically synthesized
tttaaataagggaatggcac

SEQ ID NO: 584965 - DNA, 20 bp, Artificial Sequence
  chemically synthesized
atagacataagatctactat

SEQ ID NO: 584966 - DNA, 20 bp, Artificial Sequence
  chemically synthesized
cataagatctactattaatg

SEQ ID NO: 584967 - DNA, 20 bp, Artificial Sequence
  chemically synthesized
tatctcattcagatcagctt

SEQ ID NO: 584968 - DNA, 20 bp, Artificial Sequence
  chemically synthesized
aatatttatatctcattcag

SEQ ID NO: 584969 - DNA, 20 bp, Artificial Sequence
  chemically synthesized
aaattaagtgaatggacact

SEQ ID NO: 584970 - DNA, 20 bp, Artificial Sequence
  chemically synthesized
cttttattttaagtacacgt

SEQ ID NO: 584971 - DNA, 20 bp, Artificial Sequence
  chemically synthesized
gtacaacaggccctcatgac

SEQ ID NO: 584972 - DNA, 20 bp, Artificial Sequence
  chemically synthesized
tgtgtcatgagggcctgttg

SEQ ID NO: 584973 - DNA, 20 bp, Artificial Sequence
  chemically synthesized
gaaaaaataactaatgggta

SEQ ID NO: 584974 - DNA, 20 bp, Artificial Sequence
  chemically synthesized
attttgtcaaccccacaatt

SEQ ID NO: 584975 - DNA, 20 bp, Artificial Sequence
  chemically synthesized
tagtggcccttatcatcaat

SEQ ID NO: 584976 - DNA, 20 bp, Artificial Sequence
  chemically synthesized
tttttttgttttttggcttt

SEQ ID NO: 584977 - DNA, 20 bp, Artificial Sequence
  chemically synthesized
aagtgtaggtttttttgttt

SEQ ID NO: 584978 - DNA, 20 bp, Artificial Sequence
  chemically synthesized
tgtttacaaagtgtaggttt

SEQ ID NO: 584979 - DNA, 20 bp, Artificial Sequence
  chemically synthesized
atagataatgtttacaaagt

SEQ ID NO: 584980 - DNA, 20 bp, Artificial Sequence
  chemically synthesized
gagatatatcgtacaataga

SEQ ID NO: 584981 - DNA, 20 bp, Artificial Sequence
  chemically synthesized
ccacaaatgtcttaggattt

SEQ ID NO: 584982 - DNA, 20 bp, Artificial Sequence
  chemically synthesized
ccatagtatccacaaatgtc

SEQ ID NO: 584983 - DNA, 20 bp, Artificial Sequence
  chemically synthesized
aagacatttgtggatactat

SEQ ID NO: 584984 - DNA, 20 bp, Artificial Sequence
  chemically synthesized
tacttcccttcccattgact

SEQ ID NO: 584985 - DNA, 20 bp, Artificial Sequence
  chemically synthesized
gctggaactttaaaggcagt

SEQ ID NO: 584986 - DNA, 20 bp, Artificial Sequence
  chemically synthesized
cccaggaccctagcggaaag

SEQ ID NO: 584987 - DNA, 20 bp, Artificial Sequence
  chemically synthesized
tctagaatgaaaagacctta

SEQ ID NO: 584988 - DNA, 20 bp, Artificial Sequence
  chemically synthesized
tcatgtgtctgcagatcagc

SEQ ID NO: 584989 - DNA, 20 bp, Artificial Sequence
  chemically synthesized
cagacacatgagtgagtaat

SEQ ID NO: 584990 - DNA, 20 bp, Artificial Sequence
  chemically synthesized
atatgtcactggaattttgt

SEQ ID NO: 584991 - DNA, 20 bp, Artificial Sequence
  chemically synthesized
tagtaaaacaaacaaacaat

SEQ ID NO: 584992 - DNA, 20 bp, Artificial Sequence
  chemically synthesized
ccagaaatcacatattgttt

SEQ ID NO: 584993 - DNA, 20 bp, Artificial Sequence
  chemically synthesized
tgtcccagaaatcacatatt

SEQ ID NO: 584994 - DNA, 20 bp, Artificial Sequence
  chemically synthesized
tttttgtcccagaaatcaca

SEQ ID NO: 584995 - DNA, 20 bp, Artificial Sequence
  chemically synthesized
catttatattaaaggcttac

SEQ ID NO: 584996 - DNA, 20 bp, Artificial Sequence
  chemically synthesized
gaccagggcacatttatatt

SEQ ID NO: 584997 - DNA, 20 bp, Artificial Sequence
  chemically synthesized
tatctctcattccatacaga

SEQ ID NO: 584998 - DNA, 20 bp, Artificial Sequence
  chemically synthesized
tcttgctacactttttagca

SEQ ID NO: 584999 - DNA, 20 bp, Artificial Sequence
  chemically synthesized
aatattgattccatttcata

SEQ ID NO: 585000 - DNA, 20 bp, Artificial Sequence
  chemically synthesized
gaaatcaggctctaacacaa

SEQ ID NO: 585001 - DNA, 20 bp, Artificial Sequence
  chemically synthesized
ggaatcaatattgtgttaga

SEQ ID NO: 585002 - DNA, 20 bp, Artificial Sequence
  chemically synthesized
ttagagcctgatttctgcag

SEQ ID NO: 585003 - DNA, 20 bp, Artificial Sequence
  chemically synthesized
agaaactcaactgaacaatg

SEQ ID NO: 585004 - DNA, 20 bp, Artificial Sequence
  chemically synthesized
aaaaacacaacattgttcag

SEQ ID NO: 585005 - DNA, 20 bp, Artificial Sequence
  chemically synthesized
gttcttttacttaactacaa

SEQ ID NO: 585006 - DNA, 20 bp, Artificial Sequence
  chemically synthesized
atgctgtcaagtacgtgcca

SEQ ID NO: 585007 - DNA, 20 bp, Artificial Sequence
  chemically synthesized
gtctccctttggtgagctgc

SEQ ID NO: 585008 - DNA, 20 bp, Artificial Sequence
  chemically synthesized
agacttaaaaaaaaaaaact

SEQ ID NO: 585009 - DNA, 20 bp, Artificial Sequence
  chemically synthesized
aaaaaaaaaacttagagatt

SEQ ID NO: 585010 - DNA, 20 bp, Artificial Sequence
  chemically synthesized
tttttgaaatccataaatct

SEQ ID NO: 585011 - DNA, 20 bp, Artificial Sequence
  chemically synthesized
cattatgctttgtatatttg

SEQ ID NO: 585012 - DNA, 20 bp, Artificial Sequence
  chemically synthesized
atatacaaagcataatgcag

SEQ ID NO: 585013 - DNA, 20 bp, Artificial Sequence
  chemically synthesized
gtttaaaaatcaatgctgca

SEQ ID NO: 585014 - DNA, 20 bp, Artificial Sequence
  chemically synthesized
ttcacagtttcacaacactt

SEQ ID NO: 585015 - DNA, 20 bp, Artificial Sequence
  chemically synthesized
agcttagtagattatatctt

SEQ ID NO: 585016 - DNA, 20 bp, Artificial Sequence
  chemically synthesized
acatttcaagtatgcagctt

SEQ ID NO: 585017 - DNA, 20 bp, Artificial Sequence
  chemically synthesized
ggccttgaacatttcaagta

SEQ ID NO: 585018 - DNA, 20 bp, Artificial Sequence
  chemically synthesized
ttaaggtggagagcttccat

SEQ ID NO: 585019 - DNA, 20 bp, Artificial Sequence
  chemically synthesized
gaaacccccactttaaggtg

SEQ ID NO: 585020 - DNA, 20 bp, Artificial Sequence
  chemically synthesized
gaagctctccaccttaaagt

SEQ ID NO: 585021 - DNA, 20 bp, Artificial Sequence
  chemically synthesized
tgactcaagtgattttttgg

SEQ ID NO: 585022 - DNA, 20 bp, Artificial Sequence
  chemically synthesized
caatatttatggaatgactc

SEQ ID NO: 585023 - DNA, 20 bp, Artificial Sequence
  chemically synthesized
tgagtcattccataaatatt

SEQ ID NO: 585024 - DNA, 20 bp, Artificial Sequence
  chemically synthesized
attacttattgtctgctaaa

SEQ ID NO: 585025 - DNA, 20 bp, Artificial Sequence
  chemically synthesized
tacatatctagtacctcaaa

SEQ ID NO: 585026 - DNA, 20 bp, Artificial Sequence
  chemically synthesized
tatgaggacacaaaaagttt

SEQ ID NO: 585027 - DNA, 20 bp, Artificial Sequence
  chemically synthesized
gtaagttttatgaggacaca

SEQ ID NO: 585028 - DNA, 20 bp, Artificial Sequence
  chemically synthesized
cacattatcaccattagaat

SEQ ID NO: 585029 - DNA, 20 bp, Artificial Sequence
  chemically synthesized
gtgtagtaaaagagaaatta

SEQ ID NO: 585030 - DNA, 20 bp, Artificial Sequence
  chemically synthesized
ctaagtctcttattcctatc

SEQ ID NO: 585031 - DNA, 20 bp, Artificial Sequence
  chemically synthesized
gcaaagggaggtggcatgtg

SEQ ID NO: 585032 - DNA, 20 bp, Artificial Sequence
  chemically synthesized
tttaaataccacctactcag

SEQ ID NO: 585033 - DNA, 20 bp, Artificial Sequence
  chemically synthesized
aagatctgaaggaagtgagg

SEQ ID NO: 585034 - DNA, 20 bp, Artificial Sequence
  chemically synthesized
ctttgcacttgctgtctctg

SEQ ID NO: 585035 - DNA, 20 bp, Artificial Sequence
  chemically synthesized
ctactactctccccttgctc

SEQ ID NO: 585036 - DNA, 20 bp, Artificial Sequence
  chemically synthesized
gatcttggctgttatcctga

SEQ ID NO: 585037 - DNA, 20 bp, Artificial Sequence
  chemically synthesized
agtgagattaggaagcatag

SEQ ID NO: 585038 - DNA, 20 bp, Artificial Sequence
  chemically synthesized
ctcctctgctgaaaactctc

SEQ ID NO: 585039 - DNA, 20 bp, Artificial Sequence
  chemically synthesized
ttaatacagcagccagaatg

SEQ ID NO: 585040 - DNA, 20 bp, Artificial Sequence
  chemically synthesized
agatcattctggctgctgta

SEQ ID NO: 585041 - DNA, 20 bp, Artificial Sequence
  chemically synthesized
gagaacagatggcagttaag

SEQ ID NO: 585042 - DNA, 20 bp, Artificial Sequence
  chemically synthesized
tcttaagggggtacaatctg

SEQ ID NO: 585043 - DNA, 20 bp, Artificial Sequence
  chemically synthesized
aagtccttccatccaaacaa

SEQ ID NO: 585044 - DNA, 20 bp, Artificial Sequence
  chemically synthesized
agttttccaaaataatggct

SEQ ID NO: 585045 - DNA, 20 bp, Artificial Sequence
  chemically synthesized
tgtataaagttttccaaaat

SEQ ID NO: 585046 - DNA, 20 bp, Artificial Sequence
  chemically synthesized
ttagttaagaactgtatgta

SEQ ID NO: 585047 - DNA, 20 bp, Artificial Sequence
  chemically synthesized
actaagggccaaagctctgg

SEQ ID NO: 585048 - DNA, 20 bp, Artificial Sequence
  chemically synthesized
gtgctgctattaaaccagac

SEQ ID NO: 585049 - DNA, 20 bp, Artificial Sequence
  chemically synthesized
ggtttaatagcagcacagga

SEQ ID NO: 585050 - DNA, 20 bp, Artificial Sequence
  chemically synthesized
aggcagcaagacctgggagt

SEQ ID NO: 585051 - DNA, 20 bp, Artificial Sequence
  chemically synthesized
ttggaaatagtcaattcatg

SEQ ID NO: 585052 - DNA, 20 bp, Artificial Sequence
  chemically synthesized
gaaaaatttcagtcagtttt

SEQ ID NO: 585053 - DNA, 20 bp, Artificial Sequence
  chemically synthesized
ggccaaatagaaaaatttca

SEQ ID NO: 585054 - DNA, 20 bp, Artificial Sequence
  chemically synthesized
gagccacagagcctgaacct

SEQ ID NO: 585055 - DNA, 20 bp, Artificial Sequence
  chemically synthesized
tggaataattatgcatactt

SEQ ID NO: 585056 - DNA, 20 bp, Artificial Sequence
  chemically synthesized
gtacaatgtgatgttttgat

SEQ ID NO: 585057 - DNA, 20 bp, Artificial Sequence
  chemically synthesized
tatatttatgaggtacaatg

SEQ ID NO: 585058 - DNA, 20 bp, Artificial Sequence
  chemically synthesized
gaaaagcatttgtttctaat

SEQ ID NO: 585059 - DNA, 20 bp, Artificial Sequence
  chemically synthesized
aataatcaaacattagaaac

SEQ ID NO: 585060 - DNA, 20 bp, Artificial Sequence
  chemically synthesized
tatagaaaagcatttgtttc

SEQ ID NO: 585061 - DNA, 20 bp, Artificial Sequence
  chemically synthesized
taaggagtttatagaaaagc

SEQ ID NO: 585062 - DNA, 20 bp, Artificial Sequence
  chemically synthesized
tctttctatgagtctatata

SEQ ID NO: 585063 - DNA, 20 bp, Artificial Sequence
  chemically synthesized
acaaataaattctaattata

SEQ ID NO: 585064 - DNA, 20 bp, Artificial Sequence
  chemically synthesized
acaatttataattagaattt

SEQ ID NO: 585065 - DNA, 20 bp, Artificial Sequence
  chemically synthesized
tctggaggctgaggcacaag

SEQ ID NO: 585066 - DNA, 20 bp, Artificial Sequence
  chemically synthesized
tgcctcagcctccagagtag

SEQ ID NO: 585067 - DNA, 20 bp, Artificial Sequence
  chemically synthesized
ccaccaagcctggctaattt

SEQ ID NO: 585068 - DNA, 20 bp, Artificial Sequence
  chemically synthesized
actaaaaacacaaaaattag

SEQ ID NO: 585069 - DNA, 20 bp, Artificial Sequence
  chemically synthesized
ttttgtgtttttagtacaga

SEQ ID NO: 585070 - DNA, 20 bp, Artificial Sequence
  chemically synthesized
catttcggcctctcaaagtg

SEQ ID NO: 585071 - DNA, 20 bp, Artificial Sequence
  chemically synthesized
actatatggtgttttataga

SEQ ID NO: 585072 - DNA, 20 bp, Artificial Sequence
  chemically synthesized
agtctaaaatatttactata

SEQ ID NO: 585073 - DNA, 20 bp, Artificial Sequence
  chemically synthesized
tcatgccacattggcagaat

SEQ ID NO: 585074 - DNA, 20 bp, Artificial Sequence
  chemically synthesized
actaaatgtggcccttggac

SEQ ID NO: 585075 - DNA, 20 bp, Artificial Sequence
  chemically synthesized
ttggaccatagtttgctgac

SEQ ID NO: 585076 - DNA, 20 bp, Artificial Sequence
  chemically synthesized
cccagatgttcttatttcta

SEQ ID NO: 585077 - DNA, 20 bp, Artificial Sequence
  chemically synthesized
gaaataagaacatctgggtt

SEQ ID NO: 585078 - DNA, 20 bp, Artificial Sequence
  chemically synthesized
gggcaagtcatttaactgct

SEQ ID NO: 585079 - DNA, 20 bp, Artificial Sequence
  chemically synthesized
tcatttaactgctctaagtt

SEQ ID NO: 585080 - DNA, 20 bp, Artificial Sequence
  chemically synthesized
ctttactcacagtaatatct

SEQ ID NO: 585081 - DNA, 20 bp, Artificial Sequence
  chemically synthesized
ttctcatacagatggacaaa

SEQ ID NO: 585082 - DNA, 20 bp, Artificial Sequence
  chemically synthesized
acatttgacattccaacttt

SEQ ID NO: 585083 - DNA, 20 bp, Artificial Sequence
  chemically synthesized
tcaaatgtgtgagcaggcaa

SEQ ID NO: 585084 - DNA, 20 bp, Artificial Sequence
  chemically synthesized
gtgtgagcaggcaacattgc

SEQ ID NO: 585085 - DNA, 20 bp, Artificial Sequence
  chemically synthesized
acttggggacgccccacaat

SEQ ID NO: 585086 - DNA, 20 bp, Artificial Sequence
  chemically synthesized
ttccaaggtcctcaaaaagg

SEQ ID NO: 585087 - DNA, 20 bp, Artificial Sequence
  chemically synthesized
cagaggccaatgccttgtaa

SEQ ID NO: 585088 - DNA, 20 bp, Artificial Sequence
  chemically synthesized
gcattggcctctgggatgca

SEQ ID NO: 585089 - DNA, 20 bp, Artificial Sequence
  chemically synthesized
aggccagggttgacccagca

SEQ ID NO: 585090 - DNA, 20 bp, Artificial Sequence
  chemically synthesized
agggttgacccagcatctcg

SEQ ID NO: 585091 - DNA, 20 bp, Artificial Sequence
  chemically synthesized
tagctcttggatggctccct

SEQ ID NO: 585092 - DNA, 20 bp, Artificial Sequence
  chemically synthesized
ggatggctccctgggtgctt

SEQ ID NO: 585093 - DNA, 20 bp, Artificial Sequence
  chemically synthesized
cacttagaaggatataggaa

SEQ ID NO: 585094 - DNA, 20 bp, Artificial Sequence
  chemically synthesized
aaaacacaacagtaagtctt

SEQ ID NO: 585095 - DNA, 20 bp, Artificial Sequence
  chemically synthesized
taatcaaagaagacttactg

SEQ ID NO: 585096 - DNA, 20 bp, Artificial Sequence
  chemically synthesized
aaataaaatgtgagtcttat

SEQ ID NO: 585097 - DNA, 20 bp, Artificial Sequence
  chemically synthesized
ttagctgctctgaaattggg

SEQ ID NO: 585098 - DNA, 20 bp, Artificial Sequence
  chemically synthesized
tttcaccaagaaaaatgtgc

SEQ ID NO: 585099 - DNA, 20 bp, Artificial Sequence
  chemically synthesized
ttttactgtttttaagatac

SEQ ID NO: 585100 - DNA, 20 bp, Artificial Sequence
  chemically synthesized
cctgatcactttccatattt

SEQ ID NO: 585101 - DNA, 20 bp, Artificial Sequence
  chemically synthesized
cagtaaaatatggaaagtga

SEQ ID NO: 585102 - DNA, 20 bp, Artificial Sequence
  chemically synthesized
tttcatagtaggtcaggatg

SEQ ID NO: 585103 - DNA, 20 bp, Artificial Sequence
  chemically synthesized
tagcagagtgtttgcactta

SEQ ID NO: 585104 - DNA, 20 bp, Artificial Sequence
  chemically synthesized
tttatgttaagtgcatagca

SEQ ID NO: 585105 - DNA, 20 bp, Artificial Sequence
  chemically synthesized
atggagattgagattaatta

SEQ ID NO: 585106 - DNA, 20 bp, Artificial Sequence
  chemically synthesized
gagaggctctgcaatggaga

SEQ ID NO: 585107 - DNA, 20 bp, Artificial Sequence
  chemically synthesized
attgctgagaggctctgcaa

SEQ ID NO: 585108 - DNA, 20 bp, Artificial Sequence
  chemically synthesized
agcaatactattaccatttt

SEQ ID NO: 585109 - DNA, 20 bp, Artificial Sequence
  chemically synthesized
agtttctgacctttcgtgac

SEQ ID NO: 585110 - DNA, 20 bp, Artificial Sequence
  chemically synthesized
tatgttaggttgtgccctag

SEQ ID NO: 585111 - DNA, 20 bp, Artificial Sequence
  chemically synthesized
caacctaacatatggtgaat

SEQ ID NO: 585112 - DNA, 20 bp, Artificial Sequence
  chemically synthesized
agaaagactagggttcaaat

SEQ ID NO: 585113 - DNA, 20 bp, Artificial Sequence
  chemically synthesized
gtagcatagtaattatgtat

SEQ ID NO: 585114 - DNA, 20 bp, Artificial Sequence
  chemically synthesized
aattactatgctacagggtc

SEQ ID NO: 585115 - DNA, 20 bp, Artificial Sequence
  chemically synthesized
aaatattgtaccaataaaaa

SEQ ID NO: 585116 - DNA, 20 bp, Artificial Sequence
  chemically synthesized
actttgttccgttctgagcc

SEQ ID NO: 585117 - DNA, 20 bp, Artificial Sequence
  chemically synthesized
tacggctcagaacggaacaa

SEQ ID NO: 585118 - DNA, 20 bp, Artificial Sequence
  chemically synthesized
ctcagaacggaacaaagtag

SEQ ID NO: 585119 - DNA, 20 bp, Artificial Sequence
  chemically synthesized
agtttcgattaggatgtaat

SEQ ID NO: 585120 - DNA, 20 bp, Artificial Sequence
  chemically synthesized
gatgtaatgtgagtttcaat

SEQ ID NO: 585121 - DNA, 20 bp, Artificial Sequence
  chemically synthesized
gtgagtttcaatcagggttt

SEQ ID NO: 585122 - DNA, 20 bp, Artificial Sequence
  chemically synthesized
atagggctgaagctgagaaa

SEQ ID NO: 585123 - DNA, 20 bp, Artificial Sequence
  chemically synthesized
gagctaccctgtgtactgca

SEQ ID NO: 585124 - DNA, 20 bp, Artificial Sequence
  chemically synthesized
atagaatgcttctctaccac

SEQ ID NO: 585125 - DNA, 20 bp, Artificial Sequence
  chemically synthesized
ccttcatgtattcaataata

SEQ ID NO: 585126 - DNA, 20 bp, Artificial Sequence
  chemically synthesized
gatgaattctaaccatcatg

SEQ ID NO: 585127 - DNA, 20 bp, Artificial Sequence
  chemically synthesized
ttctaaccatcatggcatgt

SEQ ID NO: 585128 - DNA, 20 bp, Artificial Sequence
  chemically synthesized
gctgaatgggtcctaatatc

SEQ ID NO: 585129 - DNA, 20 bp, Artificial Sequence
  chemically synthesized
tctctggattatatacccca

SEQ ID NO: 585130 - DNA, 20 bp, Artificial Sequence
  chemically synthesized
gaaaggcacatattaaacaa

SEQ ID NO: 585131 - DNA, 20 bp, Artificial Sequence
  chemically synthesized
cagagatatgtcaaaatcac

SEQ ID NO: 585132 - DNA, 20 bp, Artificial Sequence
  chemically synthesized
ataacttagagatgctctat

SEQ ID NO: 585133 - DNA, 20 bp, Artificial Sequence
  chemically synthesized
aacttctagtgtttaataat

SEQ ID NO: 585134 - DNA, 20 bp, Artificial Sequence
  chemically synthesized
tgttattattaaacactaga

SEQ ID NO: 585135 - DNA, 20 bp, Artificial Sequence
  chemically synthesized
tatctttaaaaagcaacttc

SEQ ID NO: 585136 - DNA, 20 bp, Artificial Sequence
  chemically synthesized
ttaatgaaaattagcctaat

SEQ ID NO: 585137 - DNA, 20 bp, Artificial Sequence
  chemically synthesized
cagaattgaattgctctttt

SEQ ID NO: 585138 - DNA, 20 bp, Artificial Sequence
  chemically synthesized
tgcactttaaataaaattaa

SEQ ID NO: 585139 - DNA, 20 bp, Artificial Sequence
  chemically synthesized
tttaaataaaattaaagatg

SEQ ID NO: 585140 - DNA, 20 bp, Artificial Sequence
  chemically synthesized
agagttgttttagataatga

SEQ ID NO: 585141 - DNA, 20 bp, Artificial Sequence
  chemically synthesized
ttatggtagcacttagaaag

SEQ ID NO: 585142 - DNA, 20 bp, Artificial Sequence
  chemically synthesized
tcaattacccatttgattgc

SEQ ID NO: 585143 - DNA, 20 bp, Artificial Sequence
  chemically synthesized
tttaattcaattacccattt

SEQ ID NO: 585144 - DNA, 20 bp, Artificial Sequence
  chemically synthesized
cgagtttaattcaattaccc

SEQ ID NO: 585145 - DNA, 20 bp, Artificial Sequence
  chemically synthesized
ctgtttttttttaaaaaaat

SEQ ID NO: 585146 - DNA, 20 bp, Artificial Sequence
  chemically synthesized
agagaatgcagatatattgt

SEQ ID NO: 585147 - DNA, 20 bp, Artificial Sequence
  chemically synthesized
atatatttgctgtttcctgt

SEQ ID NO: 585148 - DNA, 20 bp, Artificial Sequence
  chemically synthesized
gtacaggaaacagcaaatat

SEQ ID NO: 585149 - DNA, 20 bp, Artificial Sequence
  chemically synthesized
atttcagaaacccatatatt

SEQ ID NO: 585150 - DNA, 20 bp, Artificial Sequence
  chemically synthesized
attacataatgtgtcctttt

SEQ ID NO: 585151 - DNA, 20 bp, Artificial Sequence
  chemically synthesized
attatgtaataaagccaatt

SEQ ID NO: 585152 - DNA, 20 bp, Artificial Sequence
  chemically synthesized
acatattgagtaaaccagga

SEQ ID NO: 585153 - DNA, 20 bp, Artificial Sequence
  chemically synthesized
agcctttatacacttataac

SEQ ID NO: 585154 - DNA, 20 bp, Artificial Sequence
  chemically synthesized
agtctcctgaaaagtcaacg

SEQ ID NO: 585155 - DNA, 20 bp, Artificial Sequence
  chemically synthesized
attctagattctagtagagt

SEQ ID NO: 585156 - DNA, 20 bp, Artificial Sequence
  chemically synthesized
aatatgagttgtctgtatat

SEQ ID NO: 585157 - DNA, 20 bp, Artificial Sequence
  chemically synthesized
ttggattgtttactttctct

SEQ ID NO: 585158 - DNA, 20 bp, Artificial Sequence
  chemically synthesized
tttaccccaattttccgttg

SEQ ID NO: 585159 - DNA, 20 bp, Artificial Sequence
  chemically synthesized
tatatttaccccaattttcc

SEQ ID NO: 585160 - DNA, 20 bp, Artificial Sequence
  chemically synthesized
acaagttttcaagtttgttg

SEQ ID NO: 585161 - DNA, 20 bp, Artificial Sequence
  chemically synthesized
atccctggttgaacaagttt

SEQ ID NO: 585162 - DNA, 20 bp, Artificial Sequence
  chemically synthesized
atttgcatatccctggttga

SEQ ID NO: 585163 - DNA, 20 bp, Artificial Sequence
  chemically synthesized
taattttatcatatattgca

SEQ ID NO: 585164 - DNA, 20 bp, Artificial Sequence
  chemically synthesized
ctgaggagacctacagagaa

SEQ ID NO: 585165 - DNA, 20 bp, Artificial Sequence
  chemically synthesized
attagtgaagagctggaaca

SEQ ID NO: 585166 - DNA, 20 bp, Artificial Sequence
  chemically synthesized
cgttagattaacagtgaata

SEQ ID NO: 585167 - DNA, 20 bp, Artificial Sequence
  chemically synthesized
cactgttaatctaacgggca

SEQ ID NO: 585168 - DNA, 20 bp, Artificial Sequence
  chemically synthesized
accaaacaatcaatgtgccc

SEQ ID NO: 585169 - DNA, 20 bp, Artificial Sequence
  chemically synthesized
gttaatctaacgggcacatt

SEQ ID NO: 585170 - DNA, 20 bp, Artificial Sequence
  chemically synthesized
tctaacgggcacattgattg

SEQ ID NO: 585171 - DNA, 20 bp, Artificial Sequence
  chemically synthesized
aagtaatctggtaaaagtat

SEQ ID NO: 585172 - DNA, 20 bp, Artificial Sequence
  chemically synthesized
ttaaaatcaagaatactttt

SEQ ID NO: 585173 - DNA, 20 bp, Artificial Sequence
  chemically synthesized
aaatacgaacaaagattttt

SEQ ID NO: 585174 - DNA, 20 bp, Artificial Sequence
  chemically synthesized
ggactccataaaaatacgaa

SEQ ID NO: 585175 - DNA, 20 bp, Artificial Sequence
  chemically synthesized
tagcattaactttgcttatg

SEQ ID NO: 585176 - DNA, 20 bp, Artificial Sequence
  chemically synthesized
attatgaatagtagcattaa

SEQ ID NO: 585177 - DNA, 20 bp, Artificial Sequence
  chemically synthesized
caatgtccaaataacatctg

SEQ ID NO: 585178 - DNA, 20 bp, Artificial Sequence
  chemically synthesized
acatacatacatacacgttc

SEQ ID NO: 585179 - DNA, 20 bp, Artificial Sequence
  chemically synthesized
attagcatagtaataagtat

SEQ ID NO: 585180 - DNA, 20 bp, Artificial Sequence
  chemically synthesized
gtcacatgaattattaattt

SEQ ID NO: 585181 - DNA, 20 bp, Artificial Sequence
  chemically synthesized
gcatacttttaatttttaag

SEQ ID NO: 585182 - DNA, 20 bp, Artificial Sequence
  chemically synthesized
tgtgcgcatacttttaattt

SEQ ID NO: 585183 - DNA, 20 bp, Artificial Sequence
  chemically synthesized
aaaaattaaaagtatgcgca

SEQ ID NO: 585184 - DNA, 20 bp, Artificial Sequence
  chemically synthesized
aaagtatgcgcacatggctt

SEQ ID NO: 585185 - DNA, 20 bp, Artificial Sequence
  chemically synthesized
gcgcacatggctttgtagtt

SEQ ID NO: 585186 - DNA, 20 bp, Artificial Sequence
  chemically synthesized
tggatcctatacattattgt

SEQ ID NO: 585187 - DNA, 20 bp, Artificial Sequence
  chemically synthesized
atacattattgtgagtgctt

SEQ ID NO: 585188 - DNA, 20 bp, Artificial Sequence
  chemically synthesized
gcttccatgttttgccttct

SEQ ID NO: 585189 - DNA, 20 bp, Artificial Sequence
  chemically synthesized
gcgtgagccaccatgcctgg

SEQ ID NO: 585190 - DNA, 20 bp, Artificial Sequence
  chemically synthesized
agcctcagcatccgaaagtg

SEQ ID NO: 585191 - DNA, 20 bp, Artificial Sequence
  chemically synthesized
ctgacggatcacttgaggtc

SEQ ID NO: 585192 - DNA, 20 bp, Artificial Sequence
  chemically synthesized
ttttgtatttttagtagaga

SEQ ID NO: 585193 - DNA, 20 bp, Artificial Sequence
  chemically synthesized
tgcctcagactgccaagtag

SEQ ID NO: 585194 - DNA, 20 bp, Artificial Sequence
  chemically synthesized
agcctccgcctcctgggttc

SEQ ID NO: 585195 - DNA, 20 bp, Artificial Sequence
  chemically synthesized
gtaacatgctggtcattaaa

SEQ ID NO: 585196 - DNA, 20 bp, Artificial Sequence
  chemically synthesized
gttacataatcaattattat

SEQ ID NO: 585197 - DNA, 20 bp, Artificial Sequence
  chemically synthesized
agcttaaaatcatttataat

SEQ ID NO: 585198 - DNA, 20 bp, Artificial Sequence
  chemically synthesized
aattattataaatgatttta

SEQ ID NO: 585199 - DNA, 20 bp, Artificial Sequence
  chemically synthesized
aagttttaatttgaacatta

SEQ ID NO: 585200 - DNA, 20 bp, Artificial Sequence
  chemically synthesized
ttaaattaggctattttaag

SEQ ID NO: 585201 - DNA, 20 bp, Artificial Sequence
  chemically synthesized
agcctaatttaaataattat

SEQ ID NO: 585202 - DNA, 20 bp, Artificial Sequence
  chemically synthesized
agtgttcagaatttggaaac

SEQ ID NO: 585203 - DNA, 20 bp, Artificial Sequence
  chemically synthesized
atgtttaatacatctgaagc

SEQ ID NO: 585204 - DNA, 20 bp, Artificial Sequence
  chemically synthesized
catataaaaaagtagagttt

SEQ ID NO: 585205 - DNA, 20 bp, Artificial Sequence
  chemically synthesized
aaatgatacatataaaaaag

SEQ ID NO: 585206 - DNA, 20 bp, Artificial Sequence
  chemically synthesized
tattacttagtgtaaatgca

SEQ ID NO: 585207 - DNA, 20 bp, Artificial Sequence
  chemically synthesized
aaacaccgtagggccaagtt

SEQ ID NO: 585208 - DNA, 20 bp, Artificial Sequence
  chemically synthesized
aagcagttaacttggcccta

SEQ ID NO: 585209 - DNA, 20 bp, Artificial Sequence
  chemically synthesized
tatgtcagatatatacagag

SEQ ID NO: 585210 - DNA, 20 bp, Artificial Sequence
  chemically synthesized
tttctatatcatgaatcaca

SEQ ID NO: 585211 - DNA, 20 bp, Artificial Sequence
  chemically synthesized
tactgaatgaatgaatcagt

SEQ ID NO: 585212 - DNA, 20 bp, Artificial Sequence
  chemically synthesized
tcctttgagcaatagtgtca

SEQ ID NO: 585213 - DNA, 20 bp, Artificial Sequence
  chemically synthesized
cttcaaaattgccatatgct

SEQ ID NO: 585214 - DNA, 20 bp, Artificial Sequence
  chemically synthesized
ccaaatacttcaaaattgcc

SEQ ID NO: 585215 - DNA, 20 bp, Artificial Sequence
  chemically synthesized
ctgtatcactgaagagtata

SEQ ID NO: 585216 - DNA, 20 bp, Artificial Sequence
  chemically synthesized
tgaatatacaattctatata

SEQ ID NO: 585217 - DNA, 20 bp, Artificial Sequence
  chemically synthesized
caaactttatgcgttgaatt

SEQ ID NO: 585218 - DNA, 20 bp, Artificial Sequence
  chemically synthesized
taagccgtaaattcaacgca

SEQ ID NO: 585219 - DNA, 20 bp, Artificial Sequence
  chemically synthesized
aaattcaacgcataaagttt

SEQ ID NO: 585220 - DNA, 20 bp, Artificial Sequence
  chemically synthesized
tgaaaatatatcataaagta

SEQ ID NO: 585221 - DNA, 20 bp, Artificial Sequence
  chemically synthesized
tattttcatactgataacat

SEQ ID NO: 585222 - DNA, 20 bp, Artificial Sequence
  chemically synthesized
caaaactatgtaacattctg

SEQ ID NO: 585223 - DNA, 20 bp, Artificial Sequence
  chemically synthesized
taaaacccttcagaatgtta

SEQ ID NO: 585224 - DNA, 20 bp, Artificial Sequence
  chemically synthesized
ctcaactctcaaatatgagt

SEQ ID NO: 585225 - DNA, 20 bp, Artificial Sequence
  chemically synthesized
agatggaaactgaagagtga

SEQ ID NO: 585226 - DNA, 20 bp, Artificial Sequence
  chemically synthesized
taaataaagctatttcactc

SEQ ID NO: 585227 - DNA, 20 bp, Artificial Sequence
  chemically synthesized
tttattttttttattatact

SEQ ID NO: 585228 - DNA, 20 bp, Artificial Sequence
  chemically synthesized
taatgttcaaataacatctg

SEQ ID NO: 585229 - DNA, 20 bp, Artificial Sequence
  chemically synthesized
cccattgggaaataaagtaa

SEQ ID NO: 585230 - DNA, 20 bp, Artificial Sequence
  chemically synthesized
aaagtaacaaagattatggc

SEQ ID NO: 585231 - DNA, 20 bp, Artificial Sequence
  chemically synthesized
aagattatggccacagttta

SEQ ID NO: 585232 - DNA, 20 bp, Artificial Sequence
  chemically synthesized
atggccacagtttatcttgc

SEQ ID NO: 585233 - DNA, 20 bp, Artificial Sequence
  chemically synthesized
agtggaggagggagtgaact

SEQ ID NO: 585234 - DNA, 20 bp, Artificial Sequence
  chemically synthesized
cactaaatgacaatgtaaca

SEQ ID NO: 585235 - DNA, 20 bp, Artificial Sequence
  chemically synthesized
tccttatacataatggataa

SEQ ID NO: 585236 - DNA, 20 bp, Artificial Sequence
  chemically synthesized
tatacataatggataatcac

SEQ ID NO: 585237 - DNA, 20 bp, Artificial Sequence
  chemically synthesized
tatgatacctctaaaaacaa

SEQ ID NO: 585238 - DNA, 20 bp, Artificial Sequence
  chemically synthesized
agtgttcttcagcagtaact

SEQ ID NO: 585239 - DNA, 20 bp, Artificial Sequence
  chemically synthesized
gctgactatatcagttacta

SEQ ID NO: 585240 - DNA, 20 bp, Artificial Sequence
  chemically synthesized
accctgctgaccttgtggct

SEQ ID NO: 585241 - DNA, 20 bp, Artificial Sequence
  chemically synthesized
tagagatctcaggtcatgta

SEQ ID NO: 585242 - DNA, 20 bp, Artificial Sequence
  chemically synthesized
tcatggataatgaccagtct

SEQ ID NO: 585243 - DNA, 20 bp, Artificial Sequence
  chemically synthesized
attatcatctcactctgaaa

SEQ ID NO: 585244 - DNA, 20 bp, Artificial Sequence
  chemically synthesized
gatcactgagaaataaatga

SEQ ID NO: 585245 - DNA, 20 bp, Artificial Sequence
  chemically synthesized
gggtatgtccgggagtcaaa

SEQ ID NO: 585246 - DNA, 20 bp, Artificial Sequence
  chemically synthesized
atctacttaagaatctatga

SEQ ID NO: 585247 - DNA, 20 bp, Artificial Sequence
  chemically synthesized
cacagtttgaaaagcactgt

SEQ ID NO: 585248 - DNA, 20 bp, Artificial Sequence
  chemically synthesized
ttatttctggtctgtggaac

SEQ ID NO: 585249 - DNA, 20 bp, Artificial Sequence
  chemically synthesized
tggttccacagaccagaaat

SEQ ID NO: 585250 - DNA, 20 bp, Artificial Sequence
  chemically synthesized
ctactatatcctatctagag

SEQ ID NO: 585251 - DNA, 20 bp, Artificial Sequence
  chemically synthesized
gaatggataagtgttagcct

SEQ ID NO: 585252 - DNA, 20 bp, Artificial Sequence
  chemically synthesized
atgatacgactttgtgaata

SEQ ID NO: 585253 - DNA, 20 bp, Artificial Sequence
  chemically synthesized
tgaataaacagcttcatgaa

SEQ ID NO: 585254 - DNA, 20 bp, Artificial Sequence
  chemically synthesized
tcataaagctatattcatga

SEQ ID NO: 585255 - DNA, 20 bp, Artificial Sequence
  chemically synthesized
tggccaaattttttaaaaag

SEQ ID NO: 585256 - DNA, 20 bp, Artificial Sequence
  chemically synthesized
agttatgattagaagaattg

SEQ ID NO: 585257 - DNA, 20 bp, Artificial Sequence
  chemically synthesized
tgttggtagaaaataacacg

SEQ ID NO: 585258 - DNA, 20 bp, Artificial Sequence
  chemically synthesized
gccaccaagggaggtaactt

SEQ ID NO: 585259 - DNA, 20 bp, Artificial Sequence
  chemically synthesized
aacaatggaagttaaatgag

SEQ ID NO: 585260 - DNA, 20 bp, Artificial Sequence
  chemically synthesized
aaccttcctcatttaacttc

SEQ ID NO: 585261 - DNA, 20 bp, Artificial Sequence
  chemically synthesized
ctataatgcccaggggatgg

SEQ ID NO: 585262 - DNA, 20 bp, Artificial Sequence
  chemically synthesized
actaactataatgcccaggg

SEQ ID NO: 585263 - DNA, 20 bp, Artificial Sequence
  chemically synthesized
ttaagtggatgaatggacca

SEQ ID NO: 585264 - DNA, 20 bp, Artificial Sequence
  chemically synthesized
cattcatccacttaagcaga

SEQ ID NO: 585265 - DNA, 20 bp, Artificial Sequence
  chemically synthesized
tccaatcattttcaaacaat

SEQ ID NO: 585266 - DNA, 20 bp, Artificial Sequence
  chemically synthesized
cttaagcagaaattgtttga

SEQ ID NO: 585267 - DNA, 20 bp, Artificial Sequence
  chemically synthesized
tgcccatgggtgtcatctct

SEQ ID NO: 585268 - DNA, 20 bp, Artificial Sequence
  chemically synthesized
gatgacacccatgggcagag

SEQ ID NO: 585269 - DNA, 20 bp, Artificial Sequence
  chemically synthesized
taaaaaaaaaaaactgatag

SEQ ID NO: 585270 - DNA, 20 bp, Artificial Sequence
  chemically synthesized
agaacgtcagaagccatgct

SEQ ID NO: 585271 - DNA, 20 bp, Artificial Sequence
  chemically synthesized
cttttactgcatattagaat

SEQ ID NO: 585272 - DNA, 20 bp, Artificial Sequence
  chemically synthesized
atgtttatactttcttgaaa

SEQ ID NO: 585273 - DNA, 20 bp, Artificial Sequence
  chemically synthesized
aagtcattttgtcaccctaa

SEQ ID NO: 585274 - DNA, 20 bp, Artificial Sequence
  chemically synthesized
agggtgacaaaatgactttt

SEQ ID NO: 585275 - DNA, 20 bp, Artificial Sequence
  chemically synthesized
tactctctcctagatcattc

SEQ ID NO: 585276 - DNA, 20 bp, Artificial Sequence
  chemically synthesized
aatgatctaggagagagtag

SEQ ID NO: 585277 - DNA, 20 bp, Artificial Sequence
  chemically synthesized
ttggaaccttttaatttcta

SEQ ID NO: 585278 - DNA, 20 bp, Artificial Sequence
  chemically synthesized
aaccttttaatttctattgg

SEQ ID NO: 585279 - DNA, 20 bp, Artificial Sequence
  chemically synthesized
accagttccctctcactgct

SEQ ID NO: 585280 - DNA, 20 bp, Artificial Sequence
  chemically synthesized
actggtgtccaagatgggta

SEQ ID NO: 585281 - DNA, 20 bp, Artificial Sequence
  chemically synthesized
agagttaattctgagcagct

SEQ ID NO: 585282 - DNA, 20 bp, Artificial Sequence
  chemically synthesized
cagtcttcatgagtaaccac

SEQ ID NO: 585283 - DNA, 20 bp, Artificial Sequence
  chemically synthesized
actcatgaagactgggaaag

SEQ ID NO: 585284 - DNA, 20 bp, Artificial Sequence
  chemically synthesized
tgaagactgggaaagtgcag

SEQ ID NO: 585285 - DNA, 20 bp, Artificial Sequence
  chemically synthesized
ataagtgtgggaataaaatg

SEQ ID NO: 585286 - DNA, 20 bp, Artificial Sequence
  chemically synthesized
caaatctgaaataactatct

SEQ ID NO: 585287 - DNA, 20 bp, Artificial Sequence
  chemically synthesized
ttaagcttccagatagttat

SEQ ID NO: 585288 - DNA, 20 bp, Artificial Sequence
  chemically synthesized
tacattacctaaagaaggtt

SEQ ID NO: 585289 - DNA, 20 bp, Artificial Sequence
  chemically synthesized
ttcaaaatacattacctaaa

SEQ ID NO: 585290 - DNA, 20 bp, Artificial Sequence
  chemically synthesized
caatacattgatggctagaa

SEQ ID NO: 585291 - DNA, 20 bp, Artificial Sequence
  chemically synthesized
tttttaactaatatgtaaat

SEQ ID NO: 585292 - DNA, 20 bp, Artificial Sequence
  chemically synthesized
atgacaaattgtagcacaag

SEQ ID NO: 585293 - DNA, 20 bp, Artificial Sequence
  chemically synthesized
tcatcatgttgaacttctgt

SEQ ID NO: 585294 - DNA, 20 bp, Artificial Sequence
  chemically synthesized
cattcctatgcaattcaaag

SEQ ID NO: 585295 - DNA, 20 bp, Artificial Sequence
  chemically synthesized
tgcaattcaaaggttagttt

SEQ ID NO: 585296 - DNA, 20 bp, Artificial Sequence
  chemically synthesized
aatgaatgttttctacaaca

SEQ ID NO: 585297 - DNA, 20 bp, Artificial Sequence
  chemically synthesized
tctatgataaaggttttaat

SEQ ID NO: 585298 - DNA, 20 bp, Artificial Sequence
  chemically synthesized
aaaacatggttttctatgat

SEQ ID NO: 585299 - DNA, 20 bp, Artificial Sequence
  chemically synthesized
aaaacctttatcatagaaaa

SEQ ID NO: 585300 - DNA, 20 bp, Artificial Sequence
  chemically synthesized
tttacaacttgaagtaaaaa

SEQ ID NO: 585301 - DNA, 20 bp, Artificial Sequence
  chemically synthesized
ctctttcttactaaggcaaa

SEQ ID NO: 585302 - DNA, 20 bp, Artificial Sequence
  chemically synthesized
ctatgcactgtttgctactt

SEQ ID NO: 585303 - DNA, 20 bp, Artificial Sequence
  chemically synthesized
tttttatttccttttctatg

SEQ ID NO: 585304 - DNA, 20 bp, Artificial Sequence
  chemically synthesized
gtgcatagaaaaggaaataa

SEQ ID NO: 585305 - DNA, 20 bp, Artificial Sequence
  chemically synthesized
atgacagatatcaccatttt

SEQ ID NO: 585306 - DNA, 20 bp, Artificial Sequence
  chemically synthesized
aacatctcgtcagtattagg

SEQ ID NO: 585307 - DNA, 20 bp, Artificial Sequence
  chemically synthesized
aatgtactaacaagacaaat

SEQ ID NO: 585308 - DNA, 20 bp, Artificial Sequence
  chemically synthesized
ctccaattagtgagccttta

SEQ ID NO: 585309 - DNA, 20 bp, Artificial Sequence
  chemically synthesized
agcactccaattagtgagcc

SEQ ID NO: 585310 - DNA, 20 bp, Artificial Sequence
  chemically synthesized
taaaggctcactaattggag

SEQ ID NO: 585311 - DNA, 20 bp, Artificial Sequence
  chemically synthesized
acacacacacacacacacac

SEQ ID NO: 585312 - DNA, 20 bp, Artificial Sequence
  chemically synthesized
ttcttatgaaggaggaagaa

SEQ ID NO: 585313 - DNA, 20 bp, Artificial Sequence
  chemically synthesized
gccctcgccaagccaaggaa

SEQ ID NO: 585314 - DNA, 20 bp, Artificial Sequence
  chemically synthesized
gttcttttgaagcccttttc

SEQ ID NO: 585315 - DNA, 20 bp, Artificial Sequence
  chemically synthesized
agctgttagaatactataaa

SEQ ID NO: 585316 - DNA, 20 bp, Artificial Sequence
  chemically synthesized
gtatttatagtattctaaca

SEQ ID NO: 585317 - DNA, 20 bp, Artificial Sequence
  chemically synthesized
ccccatgtgctgccaaggtt

SEQ ID NO: 585318 - DNA, 20 bp, Artificial Sequence
  chemically synthesized
tttctctccccatgtgctgc

SEQ ID NO: 585319 - DNA, 20 bp, Artificial Sequence
  chemically synthesized
gcattgttgtctttcagcca

SEQ ID NO: 585320 - DNA, 20 bp, Artificial Sequence
  chemically synthesized
ctgaaagacaacaatgcaac

SEQ ID NO: 585321 - DNA, 20 bp, Artificial Sequence
  chemically synthesized
aacaatgcaacagaggattt

SEQ ID NO: 585322 - DNA, 20 bp, Artificial Sequence
  chemically synthesized
tttaataataataataataa

SEQ ID NO: 585323 - DNA, 20 bp, Artificial Sequence
  chemically synthesized
gaggcggaggttgcagtgag

SEQ ID NO: 585324 - DNA, 20 bp, Artificial Sequence
  chemically synthesized
caacctccgcctccaggttc

SEQ ID NO: 585325 - DNA, 20 bp, Artificial Sequence
  chemically synthesized
tgcctcagcctcccgagtag

SEQ ID NO: 585326 - DNA, 20 bp, Artificial Sequence
  chemically synthesized
ttttgtatttttagtggaga

SEQ ID NO: 585327 - DNA, 20 bp, Artificial Sequence
  chemically synthesized
actcattttctataaaactg

SEQ ID NO: 585328 - DNA, 20 bp, Artificial Sequence
  chemically synthesized
tcgaattttaagataatctg

SEQ ID NO: 585329 - DNA, 20 bp, Artificial Sequence
  chemically synthesized
tcatttgtattgtacttcat

SEQ ID NO: 585330 - DNA, 20 bp, Artificial Sequence
  chemically synthesized
ttacgtgtggtatgcttaag

SEQ ID NO: 585331 - DNA, 20 bp, Artificial Sequence
  chemically synthesized
attacattgtgttacgtgtg

SEQ ID NO: 585332 - DNA, 20 bp, Artificial Sequence
  chemically synthesized
ctattttattttacccatta

SEQ ID NO: 585333 - DNA, 20 bp, Artificial Sequence
  chemically synthesized
tcataactcatcagtgggtt

SEQ ID NO: 585334 - DNA, 20 bp, Artificial Sequence
  chemically synthesized
taagattctctcccgggcct

SEQ ID NO: 585335 - DNA, 20 bp, Artificial Sequence
  chemically synthesized
aggaggagttactcatctcc

SEQ ID NO: 585336 - DNA, 20 bp, Artificial Sequence
  chemically synthesized
tgtcttctggccggctctct

SEQ ID NO: 585337 - DNA, 20 bp, Artificial Sequence
  chemically synthesized
ttacgtcaggccaggagact

SEQ ID NO: 585338 - DNA, 20 bp, Artificial Sequence
  chemically synthesized
gccccaagtgaggactggac

SEQ ID NO: 585339 - DNA, 20 bp, Artificial Sequence
  chemically synthesized
cacctcacccggccgcaaca

SEQ ID NO: 585340 - DNA, 20 bp, Artificial Sequence
  chemically synthesized
cgcctcggcctcccagagtg

SEQ ID NO: 585341 - DNA, 20 bp, Artificial Sequence
  chemically synthesized
ttgtgtatttttagtagagg

SEQ ID NO: 585342 - DNA, 20 bp, Artificial Sequence
  chemically synthesized
aatggcgtgaacccaggagg

SEQ ID NO: 585343 - DNA, 20 bp, Artificial Sequence
  chemically synthesized
gtcaaatcttttttttgttt

SEQ ID NO: 585344 - DNA, 20 bp, Artificial Sequence
  chemically synthesized
tctcaaacaaacaaacaaaa

SEQ ID NO: 585345 - DNA, 20 bp, Artificial Sequence
  chemically synthesized
tccagtcaaatctttttttt

SEQ ID NO: 585346 - DNA, 20 bp, Artificial Sequence
  chemically synthesized
caaatccagtcaaatctttt

SEQ ID NO: 585347 - DNA, 20 bp, Artificial Sequence
  chemically synthesized
acaaacaaaaaaaagatttg

SEQ ID NO: 585348 - DNA, 20 bp, Artificial Sequence
  chemically synthesized
ttggttaatgacagactttc

SEQ ID NO: 585349 - DNA, 20 bp, Artificial Sequence
  chemically synthesized
cagtgggataggtcagagag

SEQ ID NO: 585350 - DNA, 20 bp, Artificial Sequence
  chemically synthesized
ttgatggtaccttgagtaaa

SEQ ID NO: 585351 - DNA, 20 bp, Artificial Sequence
  chemically synthesized
caaatacccatccatctcat

SEQ ID NO: 585352 - DNA, 20 bp, Artificial Sequence
  chemically synthesized
tttcaataactatccactga

SEQ ID NO: 585353 - DNA, 20 bp, Artificial Sequence
  chemically synthesized
tctaagtatttttaaaattc

SEQ ID NO: 585354 - DNA, 20 bp, Artificial Sequence
  chemically synthesized
agagccttgtagtcacagga

SEQ ID NO: 585355 - DNA, 20 bp, Artificial Sequence
  chemically synthesized
tgtgatacatatttatgcta

SEQ ID NO: 585356 - DNA, 20 bp, Artificial Sequence
  chemically synthesized
ttcattggggaagttgaaaa

SEQ ID NO: 585357 - DNA, 20 bp, Artificial Sequence
  chemically synthesized
aaagctcatatttaataaat

SEQ ID NO: 585358 - DNA, 20 bp, Artificial Sequence
  chemically synthesized
aaaacttctatttattaaat

SEQ ID NO: 585359 - DNA, 20 bp, Artificial Sequence
  chemically synthesized
gacattatattgcaatggta

SEQ ID NO: 585360 - DNA, 20 bp, Artificial Sequence
  chemically synthesized
cattttaaaagggtttatag

SEQ ID NO: 585361 - DNA, 20 bp, Artificial Sequence
  chemically synthesized
agtaaatattgacattttaa

SEQ ID NO: 585362 - DNA, 20 bp, Artificial Sequence
  chemically synthesized
aatattttagaaaattgaat

SEQ ID NO: 585363 - DNA, 20 bp, Artificial Sequence
  chemically synthesized
ggttctttgaagccctcttc

SEQ ID NO: 585364 - DNA, 20 bp, Artificial Sequence
  chemically synthesized
ctctttgccaagccaaggaa

SEQ ID NO: 585365 - DNA, 20 bp, Artificial Sequence
  chemically synthesized
tcttatgagggaggggagaa

SEQ ID NO: 585366 - DNA, 20 bp, Artificial Sequence
  chemically synthesized
aagggaacagtaaaagtcat

SEQ ID NO: 585367 - DNA, 20 bp, Artificial Sequence
  chemically synthesized
tctcattcaagaaactgttc

SEQ ID NO: 585368 - DNA, 20 bp, Artificial Sequence
  chemically synthesized
aggaaaaggataaacttgag

SEQ ID NO: 585369 - DNA, 20 bp, Artificial Sequence
  chemically synthesized
aaaaaagggagtagatggtc

SEQ ID NO: 585370 - DNA, 20 bp, Artificial Sequence
  chemically synthesized
accatctactcccttttttg

SEQ ID NO: 585371 - DNA, 20 bp, Artificial Sequence
  chemically synthesized
ctgggaggctgaggcatgag

SEQ ID NO: 585372 - DNA, 20 bp, Artificial Sequence
  chemically synthesized
ttttctatttttagtagaga

SEQ ID NO: 585373 - DNA, 20 bp, Artificial Sequence
  chemically synthesized
caggtggattgcctgagctt

SEQ ID NO: 585374 - DNA, 20 bp, Artificial Sequence
  chemically synthesized
ctcccaagctcaggcaatcc

SEQ ID NO: 585375 - DNA, 20 bp, Artificial Sequence
  chemically synthesized
ggccaaagcaggtggattgc

SEQ ID NO: 585376 - DNA, 20 bp, Artificial Sequence
  chemically synthesized
gactttgggaggccaaagca

SEQ ID NO: 585377 - DNA, 20 bp, Artificial Sequence
  chemically synthesized
agaggtactaacaataaaaa

SEQ ID NO: 585378 - DNA, 20 bp, Artificial Sequence
  chemically synthesized
cttaggaaatgtgttcccat

SEQ ID NO: 585379 - DNA, 20 bp, Artificial Sequence
  chemically synthesized
gacacttactggctttacga

SEQ ID NO: 585380 - DNA, 20 bp, Artificial Sequence
  chemically synthesized
gaatcccagtgctgacactt

SEQ ID NO: 585381 - DNA, 20 bp, Artificial Sequence
  chemically synthesized
aaagccagtaagtgtcagca

SEQ ID NO: 585382 - DNA, 20 bp, Artificial Sequence
  chemically synthesized
actgggattcaaacttagtc

SEQ ID NO: 585383 - DNA, 20 bp, Artificial Sequence
  chemically synthesized
aaggggaaagaaacaaaaga

SEQ ID NO: 585384 - DNA, 20 bp, Artificial Sequence
  chemically synthesized
ttattctacttcaactcagc

SEQ ID NO: 585385 - DNA, 20 bp, Artificial Sequence
  chemically synthesized
agaaaaaacaaaaagtaaga

SEQ ID NO: 585386 - DNA, 20 bp, Artificial Sequence
  chemically synthesized
accataatcttcctcttact

SEQ ID NO: 585387 - DNA, 20 bp, Artificial Sequence
  chemically synthesized
atctattagtggaattaggc

SEQ ID NO: 585388 - DNA, 20 bp, Artificial Sequence
  chemically synthesized
cgtgtttgtttaagtttgtg

SEQ ID NO: 585389 - DNA, 20 bp, Artificial Sequence
  chemically synthesized
ctatccacaaacttaaacaa

SEQ ID NO: 585390 - DNA, 20 bp, Artificial Sequence
  chemically synthesized
acaccttgaagcgtgtttgt

SEQ ID NO: 585391 - DNA, 20 bp, Artificial Sequence
  chemically synthesized
ttgataacaccttgaagcgt

SEQ ID NO: 585392 - DNA, 20 bp, Artificial Sequence
  chemically synthesized
tggcttgataacaccttgaa

SEQ ID NO: 585393 - DNA, 20 bp, Artificial Sequence
  chemically synthesized
cctctgggcaagagtataat

SEQ ID NO: 585394 - DNA, 20 bp, Artificial Sequence
  chemically synthesized
atttattgaatgtttttctc

SEQ ID NO: 585395 - DNA, 20 bp, Artificial Sequence
  chemically synthesized
caactgaacacagatttatt

SEQ ID NO: 585396 - DNA, 20 bp, Artificial Sequence
  chemically synthesized
ccttttaccatgcaactgaa

SEQ ID NO: 585397 - DNA, 20 bp, Artificial Sequence
  chemically synthesized
tttgtccagtaactgtcatc

SEQ ID NO: 585398 - DNA, 20 bp, Artificial Sequence
  chemically synthesized
agacctttagaaaaaagttt

SEQ ID NO: 585399 - DNA, 20 bp, Artificial Sequence
  chemically synthesized
caaggaagagacctttagaa

SEQ ID NO: 585400 - DNA, 20 bp, Artificial Sequence
  chemically synthesized
ctagctcaagttcacctgtt

SEQ ID NO: 585401 - DNA, 20 bp, Artificial Sequence
  chemically synthesized
gtgtactcaacattcacaaa

SEQ ID NO: 585402 - DNA, 20 bp, Artificial Sequence
  chemically synthesized
tgaatgttgagtacactcct

SEQ ID NO: 585403 - DNA, 20 bp, Artificial Sequence
  chemically synthesized
ggtaaggagtcagacttacc

SEQ ID NO: 585404 - DNA, 20 bp, Artificial Sequence
  chemically synthesized
aatctgatgttaccatgctt

SEQ ID NO: 585405 - DNA, 20 bp, Artificial Sequence
  chemically synthesized
aagcgtggaagcatggtaac

SEQ ID NO: 585406 - DNA, 20 bp, Artificial Sequence
  chemically synthesized
agaatcaaaatctgatgtta

SEQ ID NO: 585407 - DNA, 20 bp, Artificial Sequence
  chemically synthesized
ggaagcatggtaacatcaga

SEQ ID NO: 585408 - DNA, 20 bp, Artificial Sequence
  chemically synthesized
actctagactcaagaatata

SEQ ID NO: 585409 - DNA, 20 bp, Artificial Sequence
  chemically synthesized
atattcttgagtctagagtc

SEQ ID NO: 585410 - DNA, 20 bp, Artificial Sequence
  chemically synthesized
gagtctagagtcccaggctt

SEQ ID NO: 585411 - DNA, 20 bp, Artificial Sequence
  chemically synthesized
ttctttgtttgaaaagcatc

SEQ ID NO: 585412 - DNA, 20 bp, Artificial Sequence
  chemically synthesized
ttttccatgttctaaaccaa

SEQ ID NO: 585413 - DNA, 20 bp, Artificial Sequence
  chemically synthesized
aaaatctgaagttgaaccaa

SEQ ID NO: 585414 - DNA, 20 bp, Artificial Sequence
  chemically synthesized
gaaatctcatttggttcaac

SEQ ID NO: 585415 - DNA, 20 bp, Artificial Sequence
  chemically synthesized
acaaacgtgatctgtacaga

SEQ ID NO: 585416 - DNA, 20 bp, Artificial Sequence
  chemically synthesized
gaaatcattttctgtacaga

SEQ ID NO: 585417 - DNA, 20 bp, Artificial Sequence
  chemically synthesized
cacgtttgtagagacctcat

SEQ ID NO: 585418 - DNA, 20 bp, Artificial Sequence
  chemically synthesized
tccaggagacattctcacta

SEQ ID NO: 585419 - DNA, 20 bp, Artificial Sequence
  chemically synthesized
tctcctcctctgaagactac

SEQ ID NO: 585420 - DNA, 20 bp, Artificial Sequence
  chemically synthesized
tctgaagactactgctgatt

SEQ ID NO: 585421 - DNA, 20 bp, Artificial Sequence
  chemically synthesized
cttcacctctatggcacaaa

SEQ ID NO: 585422 - DNA, 20 bp, Artificial Sequence
  chemically synthesized
caaactaacaagaagagaag

SEQ ID NO: 585423 - DNA, 20 bp, Artificial Sequence
  chemically synthesized
caaactaggcttctcttctt

SEQ ID NO: 585424 - DNA, 20 bp, Artificial Sequence
  chemically synthesized
ctaggcttctcttcttgtta

SEQ ID NO: 585425 - DNA, 20 bp, Artificial Sequence
  chemically synthesized
tgagccagcttagggagtgc

SEQ ID NO: 585426 - DNA, 20 bp, Artificial Sequence
  chemically synthesized
cttagatgagccagcttagg

SEQ ID NO: 585427 - DNA, 20 bp, Artificial Sequence
  chemically synthesized
aagggagaggtcttagatga

SEQ ID NO: 585428 - DNA, 20 bp, Artificial Sequence
  chemically synthesized
ggtttgaagaggaatatgct

SEQ ID NO: 585429 - DNA, 20 bp, Artificial Sequence
  chemically synthesized
gacaaagagatggagcaggt

SEQ ID NO: 585430 - DNA, 20 bp, Artificial Sequence
  chemically synthesized
cccagtagtggcagggagca

SEQ ID NO: 585431 - DNA, 20 bp, Artificial Sequence
  chemically synthesized
caggtggttgcttctggggt

SEQ ID NO: 585432 - DNA, 20 bp, Artificial Sequence
  chemically synthesized
caacctcaggtggttgcttc

SEQ ID NO: 585433 - DNA, 20 bp, Artificial Sequence
  chemically synthesized
tagctttttcaacctcaggt

SEQ ID NO: 585434 - DNA, 20 bp, Artificial Sequence
  chemically synthesized
cggtatccagtctgtttcca

SEQ ID NO: 585435 - DNA, 20 bp, Artificial Sequence
  chemically synthesized
ctgaacgtacacggtatcca

SEQ ID NO: 585436 - DNA, 20 bp, Artificial Sequence
  chemically synthesized
tggataccgtgtacgttcag

SEQ ID NO: 585437 - DNA, 20 bp, Artificial Sequence
  chemically synthesized
aatatttgtggaggagcctt

SEQ ID NO: 585438 - DNA, 20 bp, Artificial Sequence
  chemically synthesized
acctactcaatatgagggct

SEQ ID NO: 585439 - DNA, 20 bp, Artificial Sequence
  chemically synthesized
ggtgaatttaacttgtattc

SEQ ID NO: 585440 - DNA, 20 bp, Artificial Sequence
  chemically synthesized
agtatttcatagccaactag

SEQ ID NO: 585441 - DNA, 20 bp, Artificial Sequence
  chemically synthesized
ctaggaattagctaagtgtg

SEQ ID NO: 585442 - DNA, 20 bp, Artificial Sequence
  chemically synthesized
cagttcacacttagctaatt

SEQ ID NO: 585443 - DNA, 20 bp, Artificial Sequence
  chemically synthesized
ctggaagttttatttacata

SEQ ID NO: 585444 - DNA, 20 bp, Artificial Sequence
  chemically synthesized
cctttacccctaatgtttct

SEQ ID NO: 585445 - DNA, 20 bp, Artificial Sequence
  chemically synthesized
aagttgtttccctttacccc

SEQ ID NO: 585446 - DNA, 20 bp, Artificial Sequence
  chemically synthesized
cttgtatattttgcatacaa

SEQ ID NO: 585447 - DNA, 20 bp, Artificial Sequence
  chemically synthesized
aaatatacaaggtatgttgg

SEQ ID NO: 585448 - DNA, 20 bp, Artificial Sequence
  chemically synthesized
tctgccatttccaatgttca

SEQ ID NO: 585449 - DNA, 20 bp, Artificial Sequence
  chemically synthesized
gaatgaacattggaaatggc

SEQ ID NO: 585450 - DNA, 20 bp, Artificial Sequence
  chemically synthesized
gccaatgctggctaaaacgg

SEQ ID NO: 585451 - DNA, 20 bp, Artificial Sequence
  chemically synthesized
tttacatacacataaatcca

SEQ ID NO: 585452 - DNA, 20 bp, Artificial Sequence
  chemically synthesized
tgatactaagggtcatttgt

SEQ ID NO: 585453 - DNA, 20 bp, Artificial Sequence
  chemically synthesized
tgtattgatcaaaaatgagt

SEQ ID NO: 585454 - DNA, 20 bp, Artificial Sequence
  chemically synthesized
ttaaaaaatgataaaatatt

SEQ ID NO: 585455 - DNA, 20 bp, Artificial Sequence
  chemically synthesized
ttaattagtttgaccgaaat

SEQ ID NO: 585456 - DNA, 20 bp, Artificial Sequence
  chemically synthesized
tagaaaagatgaaaatgtta

SEQ ID NO: 585457 - DNA, 20 bp, Artificial Sequence
  chemically synthesized
tctattggtcttctcttaat

SEQ ID NO: 585458 - DNA, 20 bp, Artificial Sequence
  chemically synthesized
tcttaataagagattgcaaa

SEQ ID NO: 585459 - DNA, 20 bp, Artificial Sequence
  chemically synthesized
gaaacaatatttgtttccta

SEQ ID NO: 585460 - DNA, 20 bp, Artificial Sequence
  chemically synthesized
taatctgtataggaaacaaa

SEQ ID NO: 585461 - DNA, 20 bp, Artificial Sequence
  chemically synthesized
ttattctgataagaaacaat

SEQ ID NO: 585462 - DNA, 20 bp, Artificial Sequence
  chemically synthesized
cttatcagaataagtacctg

SEQ ID NO: 585463 - DNA, 20 bp, Artificial Sequence
  chemically synthesized
ccttgaatttttttagaaag

SEQ ID NO: 585464 - DNA, 20 bp, Artificial Sequence
  chemically synthesized
gtagaaggccacatgacggt

SEQ ID NO: 585465 - DNA, 20 bp, Artificial Sequence
  chemically synthesized
tatgtaaccaagatgacaat

SEQ ID NO: 585466 - DNA, 20 bp, Artificial Sequence
  chemically synthesized
tcaaaggttgtaaaatgaca

SEQ ID NO: 585467 - DNA, 20 bp, Artificial Sequence
  chemically synthesized
tcattttacaacctttgata

SEQ ID NO: 585468 - DNA, 20 bp, Artificial Sequence
  chemically synthesized
taaataaaattttttttaat

SEQ ID NO: 585469 - DNA, 20 bp, Artificial Sequence
  chemically synthesized
aaaattttttttaatctcag

SEQ ID NO: 585470 - DNA, 20 bp, Artificial Sequence
  chemically synthesized
ttgaaatttttcaaaccaat

SEQ ID NO: 585471 - DNA, 20 bp, Artificial Sequence
  chemically synthesized
agattggtttgaaaaatttc

SEQ ID NO: 585472 - DNA, 20 bp, Artificial Sequence
  chemically synthesized
ttggtatgttgagttgcata

SEQ ID NO: 585473 - DNA, 20 bp, Artificial Sequence
  chemically synthesized
ggttcagcatctcttcttgt

SEQ ID NO: 585474 - DNA, 20 bp, Artificial Sequence
  chemically synthesized
ctagagcactaacaaagttc

SEQ ID NO: 585475 - DNA, 20 bp, Artificial Sequence
  chemically synthesized
taaaatggccataattaaag

SEQ ID NO: 585476 - DNA, 20 bp, Artificial Sequence
  chemically synthesized
taagtcttttgtcgttcaca

SEQ ID NO: 585477 - DNA, 20 bp, Artificial Sequence
  chemically synthesized
tttgtcgttcacagatagtt

SEQ ID NO: 585478 - DNA, 20 bp, Artificial Sequence
  chemically synthesized
agatagtttttggtttatgc

SEQ ID NO: 585479 - DNA, 20 bp, Artificial Sequence
  chemically synthesized
gatgatgcattctgacctct

SEQ ID NO: 585480 - DNA, 20 bp, Artificial Sequence
  chemically synthesized
cctatgggtctcaaagatgg

SEQ ID NO: 585481 - DNA, 20 bp, Artificial Sequence
  chemically synthesized
gggacacagacttctgatgc

SEQ ID NO: 585482 - DNA, 20 bp, Artificial Sequence
  chemically synthesized
atgccattgcttaaataact

SEQ ID NO: 585483 - DNA, 20 bp, Artificial Sequence
  chemically synthesized
gattataccattggacaaag

SEQ ID NO: 585484 - DNA, 20 bp, Artificial Sequence
  chemically synthesized
tgaactcatcagcttcttca

SEQ ID NO: 585485 - DNA, 20 bp, Artificial Sequence
  chemically synthesized
gttagtagtttcatgaactc

SEQ ID NO: 585486 - DNA, 20 bp, Artificial Sequence
  chemically synthesized
gtcttgcttgatcttgagtt

SEQ ID NO: 585487 - DNA, 20 bp, Artificial Sequence
  chemically synthesized
gcccatgtagttaattcttg

SEQ ID NO: 585488 - DNA, 20 bp, Artificial Sequence
  chemically synthesized
atgggcctgaatgaactgat

SEQ ID NO: 585489 - DNA, 20 bp, Artificial Sequence
  chemically synthesized
cctgaatgaactgataaaag

SEQ ID NO: 585490 - DNA, 20 bp, Artificial Sequence
  chemically synthesized
gaactgataaaagatttgat

SEQ ID NO: 585491 - DNA, 20 bp, Artificial Sequence
  chemically synthesized
ataaaagatttgattatggc

SEQ ID NO: 585492 - DNA, 20 bp, Artificial Sequence
  chemically synthesized
gcttttgtttaaaatattcc

SEQ ID NO: 585493 - DNA, 20 bp, Artificial Sequence
  chemically synthesized
atattcctcatgttttaatg

SEQ ID NO: 585494 - DNA, 20 bp, Artificial Sequence
  chemically synthesized
taacttaagagaaaaaggaa

SEQ ID NO: 585495 - DNA, 20 bp, Artificial Sequence
  chemically synthesized
ataactcatgagaatttaga

SEQ ID NO: 585496 - DNA, 20 bp, Artificial Sequence
  chemically synthesized
ataaaaagattaatgtttca

SEQ ID NO: 585497 - DNA, 20 bp, Artificial Sequence
  chemically synthesized
tcaggcagggataaaaagat

SEQ ID NO: 585498 - DNA, 20 bp, Artificial Sequence
  chemically synthesized
acagggatcaggcagggata

SEQ ID NO: 585499 - DNA, 20 bp, Artificial Sequence
  chemically synthesized
aattgaaaaaaatatataac

SEQ ID NO: 585500 - DNA, 20 bp, Artificial Sequence
  chemically synthesized
agtgcatagagtcagatgtg

SEQ ID NO: 585501 - DNA, 20 bp, Artificial Sequence
  chemically synthesized
accgggacagttttcccaaa

SEQ ID NO: 585502 - DNA, 20 bp, Artificial Sequence
  chemically synthesized
ttgggaaaactgtcccggta

SEQ ID NO: 585503 - DNA, 20 bp, Artificial Sequence
  chemically synthesized
ttctgtaagccaggtaccgg

SEQ ID NO: 585504 - DNA, 20 bp, Artificial Sequence
  chemically synthesized
tagaccttccttactcagtt

SEQ ID NO: 585505 - DNA, 20 bp, Artificial Sequence
  chemically synthesized
ttccaggttcctaaaatacc

SEQ ID NO: 585506 - DNA, 20 bp, Artificial Sequence
  chemically synthesized
ctatagattcagctgaagtg

SEQ ID NO: 585507 - DNA, 20 bp, Artificial Sequence
  chemically synthesized
tttacctgaagtaaaatacc

SEQ ID NO: 585508 - DNA, 20 bp, Artificial Sequence
  chemically synthesized
aggcaagtcaagaacttgac

SEQ ID NO: 585509 - DNA, 20 bp, Artificial Sequence
  chemically synthesized
tttgattttttaaaagtctc

SEQ ID NO: 585510 - DNA, 20 bp, Artificial Sequence
  chemically synthesized
gacttttaaaaaatcaaatc

SEQ ID NO: 585511 - DNA, 20 bp, Artificial Sequence
  chemically synthesized
taaaaaatatgaaacctcag

SEQ ID NO: 585512 - DNA, 20 bp, Artificial Sequence
  chemically synthesized
tagtttaaaaaatatgaaac

SEQ ID NO: 585513 - DNA, 20 bp, Artificial Sequence
  chemically synthesized
tgtcaatcatacctcaataa

SEQ ID NO: 585514 - DNA, 20 bp, Artificial Sequence
  chemically synthesized
ttttaaactactttattgag

SEQ ID NO: 585515 - DNA, 20 bp, Artificial Sequence
  chemically synthesized
tgcattaaatatgtacagct

SEQ ID NO: 585516 - DNA, 20 bp, Artificial Sequence
  chemically synthesized
agttctatgcattaaatatg

SEQ ID NO: 585517 - DNA, 20 bp, Artificial Sequence
  chemically synthesized
tatttaatgcatagaacttg

SEQ ID NO: 585518 - DNA, 20 bp, Artificial Sequence
  chemically synthesized
tttatggcatagattgtggt

SEQ ID NO: 585519 - DNA, 20 bp, Artificial Sequence
  chemically synthesized
ggtaacgcataggtttatgg

SEQ ID NO: 585520 - DNA, 20 bp, Artificial Sequence
  chemically synthesized
gaaacttttggaggtaacgc

SEQ ID NO: 585521 - DNA, 20 bp, Artificial Sequence
  chemically synthesized
taaacctatgcgttacctcc

SEQ ID NO: 585522 - DNA, 20 bp, Artificial Sequence
  chemically synthesized
aattagaaatttgctgaggg

SEQ ID NO: 585523 - DNA, 20 bp, Artificial Sequence
  chemically synthesized
cagtatatctctgaaactta

SEQ ID NO: 585524 - DNA, 20 bp, Artificial Sequence
  chemically synthesized
atctctgaaacttattcagc

SEQ ID NO: 585525 - DNA, 20 bp, Artificial Sequence
  chemically synthesized
catgaagaatcacaagctga

SEQ ID NO: 585526 - DNA, 20 bp, Artificial Sequence
  chemically synthesized
tattttaagtgtgattagct

SEQ ID NO: 585527 - DNA, 20 bp, Artificial Sequence
  chemically synthesized
taccaaataggctattttaa

SEQ ID NO: 585528 - DNA, 20 bp, Artificial Sequence
  chemically synthesized
gttaatcaaagtaagacttt

SEQ ID NO: 585529 - DNA, 20 bp, Artificial Sequence
  chemically synthesized
tataaacaaggaaagtctta

SEQ ID NO: 585530 - DNA, 20 bp, Artificial Sequence
  chemically synthesized
caaaagggtgatggtagaga

SEQ ID NO: 585531 - DNA, 20 bp, Artificial Sequence
  chemically synthesized
tttcagtaacccttggggtt

SEQ ID NO: 585532 - DNA, 20 bp, Artificial Sequence
  chemically synthesized
tttgcatttctttgtaaacg

SEQ ID NO: 585533 - DNA, 20 bp, Artificial Sequence
  chemically synthesized
aaaaaaaaaaaaaaaaatca

SEQ ID NO: 585534 - DNA, 20 bp, Artificial Sequence
  chemically synthesized
tttgtccgtccttaccaatt

SEQ ID NO: 585535 - DNA, 20 bp, Artificial Sequence
  chemically synthesized
ttatttcctttacaatctgg

SEQ ID NO: 585536 - DNA, 20 bp, Artificial Sequence
  chemically synthesized
tgttaatttggagaatcgca

SEQ ID NO: 585537 - DNA, 20 bp, Artificial Sequence
  chemically synthesized
ctcagtaataatatgggcag

SEQ ID NO: 585538 - DNA, 20 bp, Artificial Sequence
  chemically synthesized
agtcatccagcttctgcttg

SEQ ID NO: 585539 - DNA, 20 bp, Artificial Sequence
  chemically synthesized
tttatagcaagtcatccagc

SEQ ID NO: 585540 - DNA, 20 bp, Artificial Sequence
  chemically synthesized
ttgtagtttatagcaagtca

SEQ ID NO: 585541 - DNA, 20 bp, Artificial Sequence
  chemically synthesized
tgctgtggtggtgagtcctt

SEQ ID NO: 585542 - DNA, 20 bp, Artificial Sequence
  chemically synthesized
acaactttcatgcctggagc

SEQ ID NO: 585543 - DNA, 20 bp, Artificial Sequence
  chemically synthesized
gagcatggcacggaagaggt

SEQ ID NO: 585544 - DNA, 20 bp, Artificial Sequence
  chemically synthesized
tgccatgctccaagaaatcc

SEQ ID NO: 585545 - DNA, 20 bp, Artificial Sequence
  chemically synthesized
gaggatggcagtagcaatcc

SEQ ID NO: 585546 - DNA, 20 bp, Artificial Sequence
  chemically synthesized
ccatctgagaatgcctacag

SEQ ID NO: 585547 - DNA, 20 bp, Artificial Sequence
  chemically synthesized
gtccagagggcagcaagtca

SEQ ID NO: 585548 - DNA, 20 bp, Artificial Sequence
  chemically synthesized
ctgccctctggactcaaaaa

SEQ ID NO: 585549 - DNA, 20 bp, Artificial Sequence
  chemically synthesized
actcaaaaactgagtttgca

SEQ ID NO: 585550 - DNA, 20 bp, Artificial Sequence
  chemically synthesized
tggttgaagcagactgcaaa

SEQ ID NO: 585551 - DNA, 20 bp, Artificial Sequence
  chemically synthesized
catgaaagttagaaggaaga

SEQ ID NO: 585552 - DNA, 20 bp, Artificial Sequence
  chemically synthesized
agtaatcagacatttcatga

SEQ ID NO: 585553 - DNA, 20 bp, Artificial Sequence
  chemically synthesized
ggaaatctccttcatgaaat

SEQ ID NO: 585554 - DNA, 20 bp, Artificial Sequence
  chemically synthesized
agttcatctagttcatttca

SEQ ID NO: 585555 - DNA, 20 bp, Artificial Sequence
  chemically synthesized
aactagatgaactggcgttc

SEQ ID NO: 585556 - DNA, 20 bp, Artificial Sequence
  chemically synthesized
ctaagtttttcaatgggaaa

SEQ ID NO: 585557 - DNA, 20 bp, Artificial Sequence
  chemically synthesized
ctccattttgttcaagggaa

SEQ ID NO: 585558 - DNA, 20 bp, Artificial Sequence
  chemically synthesized
caaaatggagggttgacaaa

SEQ ID NO: 585559 - DNA, 20 bp, Artificial Sequence
  chemically synthesized
agtcaaactcagggtatttt

SEQ ID NO: 585560 - DNA, 20 bp, Artificial Sequence
  chemically synthesized
aagaaagctttaaaaatacc

SEQ ID NO: 585561 - DNA, 20 bp, Artificial Sequence
  chemically synthesized
ctgagtttgactacatttga

SEQ ID NO: 585562 - DNA, 20 bp, Artificial Sequence
  chemically synthesized
aaaagtagagaaataatata

SEQ ID NO: 585563 - DNA, 20 bp, Artificial Sequence
  chemically synthesized
gctagctcccaagtccttga

SEQ ID NO: 585564 - DNA, 20 bp, Artificial Sequence
  chemically synthesized
gattggggcactatcttttt

SEQ ID NO: 585565 - DNA, 20 bp, Artificial Sequence
  chemically synthesized
tatcctcccaacagaagact

SEQ ID NO: 585566 - DNA, 20 bp, Artificial Sequence
  chemically synthesized
gctgattggcacttatcaaa

SEQ ID NO: 585567 - DNA, 20 bp, Artificial Sequence
  chemically synthesized
ttatttaggccatctgtgtt

SEQ ID NO: 585568 - DNA, 20 bp, Artificial Sequence
  chemically synthesized
aatgtgcttatttaggccat

SEQ ID NO: 585569 - DNA, 20 bp, Artificial Sequence
  chemically synthesized
atcaggagggaggttagtca

SEQ ID NO: 585570 - DNA, 20 bp, Artificial Sequence
  chemically synthesized
aaaacttttgcaatagagga

SEQ ID NO: 585571 - DNA, 20 bp, Artificial Sequence
  chemically synthesized
caatctgtctcctctattgc

SEQ ID NO: 585572 - DNA, 20 bp, Artificial Sequence
  chemically synthesized
tcactacaattgagtccttt

SEQ ID NO: 585573 - DNA, 20 bp, Artificial Sequence
  chemically synthesized
agtcctttggtagtttttag

SEQ ID NO: 585574 - DNA, 20 bp, Artificial Sequence
  chemically synthesized
agagccagcagagccacatg

SEQ ID NO: 585575 - DNA, 20 bp, Artificial Sequence
  chemically synthesized
atttataaaccacagaagga

SEQ ID NO: 585576 - DNA, 20 bp, Artificial Sequence
  chemically synthesized
ctcaagaatcactttccttc

SEQ ID NO: 585577 - DNA, 20 bp, Artificial Sequence
  chemically synthesized
gggaggaaaaaaccccctcc

SEQ ID NO: 585578 - DNA, 20 bp, Artificial Sequence
  chemically synthesized
tttcatcttaatcacaggga

SEQ ID NO: 585579 - DNA, 20 bp, Artificial Sequence
  chemically synthesized
cgggacacataattttatgt

SEQ ID NO: 585580 - DNA, 20 bp, Artificial Sequence
  chemically synthesized
ccacacctcatattttaata

SEQ ID NO: 585581 - DNA, 20 bp, Artificial Sequence
  chemically synthesized
ttatctgacataagactgac

SEQ ID NO: 585582 - DNA, 20 bp, Artificial Sequence
  chemically synthesized
ttatgtttttaacctttaat

SEQ ID NO: 585583 - DNA, 20 bp, Artificial Sequence
  chemically synthesized
tagaatttctataaagggtc

SEQ ID NO: 585584 - DNA, 20 bp, Artificial Sequence
  chemically synthesized
ttgaatgctaagatcccggg

SEQ ID NO: 585585 - DNA, 20 bp, Artificial Sequence
  chemically synthesized
tagacataaaatatgttgat

SEQ ID NO: 585586 - DNA, 20 bp, Artificial Sequence
  chemically synthesized
ctcaatttagacataaaata

SEQ ID NO: 585587 - DNA, 20 bp, Artificial Sequence
  chemically synthesized
ctagaaggcatgcctttgaa

SEQ ID NO: 585588 - DNA, 20 bp, Artificial Sequence
  chemically synthesized
ggctgactgatgggaaaggg

SEQ ID NO: 585589 - DNA, 20 bp, Artificial Sequence
  chemically synthesized
caccctctacatcacgatct

SEQ ID NO: 585590 - DNA, 20 bp, Artificial Sequence
  chemically synthesized
ctacatcacgatctcattga

SEQ ID NO: 585591 - DNA, 20 bp, Artificial Sequence
  chemically synthesized
cgatctcattgattatgttt

SEQ ID NO: 585592 - DNA, 20 bp, Artificial Sequence
  chemically synthesized
agcttgctaagggttctgtg

SEQ ID NO: 585593 - DNA, 20 bp, Artificial Sequence
  chemically synthesized
caagatgaatattgctattt

SEQ ID NO: 585594 - DNA, 20 bp, Artificial Sequence
  chemically synthesized
tgaaaattgactgcacattg

SEQ ID NO: 585595 - DNA, 20 bp, Artificial Sequence
  chemically synthesized
tggagtgaaaattgactgca

SEQ ID NO: 585596 - DNA, 20 bp, Artificial Sequence
  chemically synthesized
ttaagggctgtgttctaata

SEQ ID NO: 585597 - DNA, 20 bp, Artificial Sequence
  chemically synthesized
atgtattagaacacagccct

SEQ ID NO: 585598 - DNA, 20 bp, Artificial Sequence
  chemically synthesized
cccttaaagcttttttttat

SEQ ID NO: 585599 - DNA, 20 bp, Artificial Sequence
  chemically synthesized
gtagtgaaacccagataaaa

SEQ ID NO: 585600 - DNA, 20 bp, Artificial Sequence
  chemically synthesized
tctctgtgagcctcagtttt

SEQ ID NO: 585601 - DNA, 20 bp, Artificial Sequence
  chemically synthesized
aataccctctctctgtgagc

SEQ ID NO: 585602 - DNA, 20 bp, Artificial Sequence
  chemically synthesized
atttttctaacaggtgtgct

SEQ ID NO: 585603 - DNA, 20 bp, Artificial Sequence
  chemically synthesized
gaggccttgccattcgggta

SEQ ID NO: 585604 - DNA, 20 bp, Artificial Sequence
  chemically synthesized
gtctgaggccttgccattcg

SEQ ID NO: 585605 - DNA, 20 bp, Artificial Sequence
  chemically synthesized
gaatggcaaggcctcagacc

SEQ ID NO: 585606 - DNA, 20 bp, Artificial Sequence
  chemically synthesized
ggccaccatggccagacaag

SEQ ID NO: 585607 - DNA, 20 bp, Artificial Sequence
  chemically synthesized
caaggcaagtttctttacat

SEQ ID NO: 585608 - DNA, 20 bp, Artificial Sequence
  chemically synthesized
tcctttgcattaactctttc

SEQ ID NO: 585609 - DNA, 20 bp, Artificial Sequence
  chemically synthesized
ctttcttaagattttagtaa

SEQ ID NO: 585610 - DNA, 20 bp, Artificial Sequence
  chemically synthesized
caccaaaaataaaattttta

SEQ ID NO: 585611 - DNA, 20 bp, Artificial Sequence
  chemically synthesized
aaattttatttttggtgttc

SEQ ID NO: 585612 - DNA, 20 bp, Artificial Sequence
  chemically synthesized
ggacactagactttgcttta

SEQ ID NO: 585613 - DNA, 20 bp, Artificial Sequence
  chemically synthesized
aagaaagatgggacactaga

SEQ ID NO: 585614 - DNA, 20 bp, Artificial Sequence
  chemically synthesized
ccatctttctttaatggaaa

SEQ ID NO: 585615 - DNA, 20 bp, Artificial Sequence
  chemically synthesized
ccttacagcctgctgtattc

SEQ ID NO: 585616 - DNA, 20 bp, Artificial Sequence
  chemically synthesized
ttattaagattgcacagttt

SEQ ID NO: 585617 - DNA, 20 bp, Artificial Sequence
  chemically synthesized
taaatgatttattaagattg

SEQ ID NO: 585618 - DNA, 20 bp, Artificial Sequence
  chemically synthesized
tttcactaataaatgattta

SEQ ID NO: 585619 - DNA, 20 bp, Artificial Sequence
  chemically synthesized
cttccattcctttcactaat

SEQ ID NO: 585620 - DNA, 20 bp, Artificial Sequence
  chemically synthesized
ttgttttttatccctctttg

SEQ ID NO: 585621 - DNA, 20 bp, Artificial Sequence
  chemically synthesized
cctgtgtgaataataattta

SEQ ID NO: 585622 - DNA, 20 bp, Artificial Sequence
  chemically synthesized
ccatttcctaattataagct

SEQ ID NO: 585623 - DNA, 20 bp, Artificial Sequence
  chemically synthesized
ctcccaaaaattctcaaacc

SEQ ID NO: 585624 - DNA, 20 bp, Artificial Sequence
  chemically synthesized
aatcatagatttgatgactt

SEQ ID NO: 585625 - DNA, 20 bp, Artificial Sequence
  chemically synthesized
aaactctcaagtcatcaaat

SEQ ID NO: 585626 - DNA, 20 bp, Artificial Sequence
  chemically synthesized
aagtcatcaaatctatgatt

SEQ ID NO: 585627 - DNA, 20 bp, Artificial Sequence
  chemically synthesized
ggggaggggaaacataaaat

SEQ ID NO: 585628 - DNA, 20 bp, Artificial Sequence
  chemically synthesized
atactcttttagcctttttc

SEQ ID NO: 585629 - DNA, 20 bp, Artificial Sequence
  chemically synthesized
ttcagtcctctgagcacatt

SEQ ID NO: 585630 - DNA, 20 bp, Artificial Sequence
  chemically synthesized
tgctcagaggactgaagcca

SEQ ID NO: 585631 - DNA, 20 bp, Artificial Sequence
  chemically synthesized
tttttcctggcagaaaactc

SEQ ID NO: 585632 - DNA, 20 bp, Artificial Sequence
  chemically synthesized
aaatcactgaggggagaggg

SEQ ID NO: 585633 - DNA, 20 bp, Artificial Sequence
  chemically synthesized
aaagcagctccctctcccct

SEQ ID NO: 585634 - DNA, 20 bp, Artificial Sequence
  chemically synthesized
catgatatttgcctcctgca

SEQ ID NO: 585635 - DNA, 20 bp, Artificial Sequence
  chemically synthesized
gagtcatgatatttgcctcc

SEQ ID NO: 585636 - DNA, 20 bp, Artificial Sequence
  chemically synthesized
agtcaccactcactgctgtg

SEQ ID NO: 585637 - DNA, 20 bp, Artificial Sequence
  chemically synthesized
cacagcagtgagtggtgact

SEQ ID NO: 585638 - DNA, 20 bp, Artificial Sequence
  chemically synthesized
cttgtagctttgataaagaa

SEQ ID NO: 585639 - DNA, 20 bp, Artificial Sequence
  chemically synthesized
aagtgattaacacagccgag

SEQ ID NO: 585640 - DNA, 20 bp, Artificial Sequence
  chemically synthesized
ggctctgccaaatgggtccc

SEQ ID NO: 585641 - DNA, 20 bp, Artificial Sequence
  chemically synthesized
tagacaatcgaagacacaat

SEQ ID NO: 585642 - DNA, 20 bp, Artificial Sequence
  chemically synthesized
aatgaaaacctgcattgtgt

SEQ ID NO: 585643 - DNA, 20 bp, Artificial Sequence
  chemically synthesized
tcccagtctgtgccccccgg

SEQ ID NO: 585644 - DNA, 20 bp, Artificial Sequence
  chemically synthesized
acagactgggacaaaagtca

SEQ ID NO: 585645 - DNA, 20 bp, Artificial Sequence
  chemically synthesized
aatcccttggtacaaataga

SEQ ID NO: 585646 - DNA, 20 bp, Artificial Sequence
  chemically synthesized
aaacaggatctatttgtacc

SEQ ID NO: 585647 - DNA, 20 bp, Artificial Sequence
  chemically synthesized
cttcctggaacacatttaag

SEQ ID NO: 585648 - DNA, 20 bp, Artificial Sequence
  chemically synthesized
aaaatgtgcctctttattat

SEQ ID NO: 585649 - DNA, 20 bp, Artificial Sequence
  chemically synthesized
ataaagaggcacattttaac

SEQ ID NO: 585650 - DNA, 20 bp, Artificial Sequence
  chemically synthesized
attgcatttaaaagagtaga

SEQ ID NO: 585651 - DNA, 20 bp, Artificial Sequence
  chemically synthesized
agtctttcctcccaaccaga

SEQ ID NO: 585652 - DNA, 20 bp, Artificial Sequence
  chemically synthesized
taactgtactttcttgttgg

SEQ ID NO: 585653 - DNA, 20 bp, Artificial Sequence
  chemically synthesized
gtacaattacatctcatgaa

SEQ ID NO: 585654 - DNA, 20 bp, Artificial Sequence
  chemically synthesized
ctagtacatattgtactcag

SEQ ID NO: 585655 - DNA, 20 bp, Artificial Sequence
  chemically synthesized
atggtcaggatcctagaact

SEQ ID NO: 585656 - DNA, 20 bp, Artificial Sequence
  chemically synthesized
atggcttccctgagacgatg

SEQ ID NO: 585657 - DNA, 20 bp, Artificial Sequence
  chemically synthesized
tggaagtcttgataccaaga

SEQ ID NO: 585658 - DNA, 20 bp, Artificial Sequence
  chemically synthesized
tttacccagtaacaaattta

SEQ ID NO: 585659 - DNA, 20 bp, Artificial Sequence
  chemically synthesized
gattaaatttacgagacata

SEQ ID NO: 585660 - DNA, 20 bp, Artificial Sequence
  chemically synthesized
gcacagtcttgggttcagtc

SEQ ID NO: 585661 - DNA, 20 bp, Artificial Sequence
  chemically synthesized
tgtgccactggctgagcagg

SEQ ID NO: 585662 - DNA, 20 bp, Artificial Sequence
  chemically synthesized
gattagcaaaatgttctcga

SEQ ID NO: 585663 - DNA, 20 bp, Artificial Sequence
  chemically synthesized
gtttgctacaactaaaatga

SEQ ID NO: 585664 - DNA, 20 bp, Artificial Sequence
  chemically synthesized
tgagtaacaaggagatagag

SEQ ID NO: 585665 - DNA, 20 bp, Artificial Sequence
  chemically synthesized
tattctagtgaagaggaagt

SEQ ID NO: 585666 - DNA, 20 bp, Artificial Sequence
  chemically synthesized
aactgagagcaaagggaaaa

SEQ ID NO: 585667 - DNA, 20 bp, Artificial Sequence
  chemically synthesized
ccagcaaaacaacagctaaa

SEQ ID NO: 585668 - DNA, 20 bp, Artificial Sequence
  chemically synthesized
cattttaatctccatttagc

SEQ ID NO: 585669 - DNA, 20 bp, Artificial Sequence
  chemically synthesized
gctaaatggagattaaaatg

SEQ ID NO: 585670 - DNA, 20 bp, Artificial Sequence
  chemically synthesized
aaggataagtaacatttttg

SEQ ID NO: 585671 - DNA, 20 bp, Artificial Sequence
  chemically synthesized
tgcccaacaatacattcatt

SEQ ID NO: 585672 - DNA, 20 bp, Artificial Sequence
  chemically synthesized
tcattaatagattgtaattt

SEQ ID NO: 585673 - DNA, 20 bp, Artificial Sequence
  chemically synthesized
atagattgtaatttcaacga

SEQ ID NO: 585674 - DNA, 20 bp, Artificial Sequence
  chemically synthesized
taatttcaacgattcggttt

SEQ ID NO: 585675 - DNA, 20 bp, Artificial Sequence
  chemically synthesized
ggtttatttgattggctact

SEQ ID NO: 585676 - DNA, 20 bp, Artificial Sequence
  chemically synthesized
aagattctttcaatatgctg

SEQ ID NO: 585677 - DNA, 20 bp, Artificial Sequence
  chemically synthesized
catattgaaagaatctttgg

SEQ ID NO: 585678 - DNA, 20 bp, Artificial Sequence
  chemically synthesized
ccctttcaaggaatctattc

SEQ ID NO: 585679 - DNA, 20 bp, Artificial Sequence
  chemically synthesized
tcttctagtgtccttgtaaa

SEQ ID NO: 585680 - DNA, 20 bp, Artificial Sequence
  chemically synthesized
gagatagtggtgttcaattg

SEQ ID NO: 585681 - DNA, 20 bp, Artificial Sequence
  chemically synthesized
tggcaggattgtctgaagcc

SEQ ID NO: 585682 - DNA, 20 bp, Artificial Sequence
  chemically synthesized
tgagatactgcaggtaagcg

SEQ ID NO: 585683 - DNA, 20 bp, Artificial Sequence
  chemically synthesized
agtaaatgatgcttacttgt

SEQ ID NO: 585684 - DNA, 20 bp, Artificial Sequence
  chemically synthesized
tcagcctaggatccagtaaa

SEQ ID NO: 585685 - DNA, 20 bp, Artificial Sequence
  chemically synthesized
gagggcattctcttatttat

SEQ ID NO: 585686 - DNA, 20 bp, Artificial Sequence
  chemically synthesized
ttcatctcccattgttcata

SEQ ID NO: 585687 - DNA, 20 bp, Artificial Sequence
  chemically synthesized
gaacaatgggagatgaataa

SEQ ID NO: 585688 - DNA, 20 bp, Artificial Sequence
  chemically synthesized
aggtttataagaaatcctaa

SEQ ID NO: 585689 - DNA, 20 bp, Artificial Sequence
  chemically synthesized
aagtagagttagaatccctg

SEQ ID NO: 585690 - DNA, 20 bp, Artificial Sequence
  chemically synthesized
attcaaagtcattgcgtctt

SEQ ID NO: 585691 - DNA, 20 bp, Artificial Sequence
  chemically synthesized
ctcttctttaaatgacttct

SEQ ID NO: 585692 - DNA, 20 bp, Artificial Sequence
  chemically synthesized
tttcatgtcatacctgtgat

SEQ ID NO: 585693 - DNA, 20 bp, Artificial Sequence
  chemically synthesized
tgatgtggccagactatacg

SEQ ID NO: 585694 - DNA, 20 bp, Artificial Sequence
  chemically synthesized
gtaaagtgtagtcagtctga

SEQ ID NO: 585695 - DNA, 20 bp, Artificial Sequence
  chemically synthesized
atccaaaattgaagttgttt

SEQ ID NO: 585696 - DNA, 20 bp, Artificial Sequence
  chemically synthesized
gattccttatccaaaattga

SEQ ID NO: 585697 - DNA, 20 bp, Artificial Sequence
  chemically synthesized
aattgtgcttaatacatatt

SEQ ID NO: 585698 - DNA, 20 bp, Artificial Sequence
  chemically synthesized
attttctatccctgttttaa

SEQ ID NO: 585699 - DNA, 20 bp, Artificial Sequence
  chemically synthesized
tactgtgattcattttctat

SEQ ID NO: 585700 - DNA, 20 bp, Artificial Sequence
  chemically synthesized
tgcctgcatcatatttgtta

SEQ ID NO: 585701 - DNA, 20 bp, Artificial Sequence
  chemically synthesized
gatgcaggcattctagtaac

SEQ ID NO: 585702 - DNA, 20 bp, Artificial Sequence
  chemically synthesized
attattattttactagaata

SEQ ID NO: 585703 - DNA, 20 bp, Artificial Sequence
  chemically synthesized
gacaacaatgatgatgatga

SEQ ID NO: 585704 - DNA, 20 bp, Artificial Sequence
  chemically synthesized
tgatgatgatgacaaagatt

SEQ ID NO: 585705 - DNA, 20 bp, Artificial Sequence
  chemically synthesized
cctgcttgactaaactttag

SEQ ID NO: 585706 - DNA, 20 bp, Artificial Sequence
  chemically synthesized
cgaaggttcagaagcctgac

SEQ ID NO: 585707 - DNA, 20 bp, Artificial Sequence
  chemically synthesized
tgacaggcttctttgctgaa

SEQ ID NO: 585708 - DNA, 20 bp, Artificial Sequence
  chemically synthesized
caggttcagcaaagaagcct

SEQ ID NO: 585709 - DNA, 20 bp, Artificial Sequence
  chemically synthesized
aaagggttcttgtaaaactg

SEQ ID NO: 585710 - DNA, 20 bp, Artificial Sequence
  chemically synthesized
ttcagcaagaatcctgtgag

SEQ ID NO: 585711 - DNA, 20 bp, Artificial Sequence
  chemically synthesized
attctggctaaaccaacctc

SEQ ID NO: 585712 - DNA, 20 bp, Artificial Sequence
  chemically synthesized
gccagaatcccacttacccc

SEQ ID NO: 585713 - DNA, 20 bp, Artificial Sequence
  chemically synthesized
agaggaaacatcaggggtaa

SEQ ID NO: 585714 - DNA, 20 bp, Artificial Sequence
  chemically synthesized
attacaggaggttggataga

SEQ ID NO: 585715 - DNA, 20 bp, Artificial Sequence
  chemically synthesized
tgacgttcaggtagggaact

SEQ ID NO: 585716 - DNA, 20 bp, Artificial Sequence
  chemically synthesized
ctgaacgtcaaatggtcctt

SEQ ID NO: 585717 - DNA, 20 bp, Artificial Sequence
  chemically synthesized
ttggttggttataaatttcc

SEQ ID NO: 585718 - DNA, 20 bp, Artificial Sequence
  chemically synthesized
taggagataaccacagcagc

SEQ ID NO: 585719 - DNA, 20 bp, Artificial Sequence
  chemically synthesized
ttaactgctcttcaaggtct

SEQ ID NO: 585720 - DNA, 20 bp, Artificial Sequence
  chemically synthesized
agaccttgggcagcttgaaa

SEQ ID NO: 585721 - DNA, 20 bp, Artificial Sequence
  chemically synthesized
agctcaaataaaagaccttg

SEQ ID NO: 585722 - DNA, 20 bp, Artificial Sequence
  chemically synthesized
agctgcccaaggtcttttat

SEQ ID NO: 585723 - DNA, 20 bp, Artificial Sequence
  chemically synthesized
ttatttgagcttcaatttct

SEQ ID NO: 585724 - DNA, 20 bp, Artificial Sequence
  chemically synthesized
gtattttcctttcaggtttc

SEQ ID NO: 585725 - DNA, 20 bp, Artificial Sequence
  chemically synthesized
ttttaaaatgtattttcctt

SEQ ID NO: 585726 - DNA, 20 bp, Artificial Sequence
  chemically synthesized
aattctcaaggcataagcca

SEQ ID NO: 585727 - DNA, 20 bp, Artificial Sequence
  chemically synthesized
gaaaatatatttttaaacat

SEQ ID NO: 585728 - DNA, 20 bp, Artificial Sequence
  chemically synthesized
catgaaatattacagaatct

SEQ ID NO: 585729 - DNA, 20 bp, Artificial Sequence
  chemically synthesized
tgctaaaataacacaaatca

SEQ ID NO: 585730 - DNA, 20 bp, Artificial Sequence
  chemically synthesized
gtgttattttagcagcataa

SEQ ID NO: 585731 - DNA, 20 bp, Artificial Sequence
  chemically synthesized
ttatttacatatattacatg

SEQ ID NO: 585732 - DNA, 20 bp, Artificial Sequence
  chemically synthesized
attaacctgctacaaaaatt

SEQ ID NO: 585733 - DNA, 20 bp, Artificial Sequence
  chemically synthesized
ttttgaaattccaaaaaggt

SEQ ID NO: 585734 - DNA, 20 bp, Artificial Sequence
  chemically synthesized
gctatgcctttgtgtaaggt

SEQ ID NO: 585735 - DNA, 20 bp, Artificial Sequence
  chemically synthesized
tgttgtgtattatatgccat

SEQ ID NO: 585736 - DNA, 20 bp, Artificial Sequence
  chemically synthesized
ctggtgctaatgctgaataa

SEQ ID NO: 585737 - DNA, 20 bp, Artificial Sequence
  chemically synthesized
aggtcttctaaatcccaaat

SEQ ID NO: 585738 - DNA, 20 bp, Artificial Sequence
  chemically synthesized
attgaataaaaatcactcat

SEQ ID NO: 585739 - DNA, 20 bp, Artificial Sequence
  chemically synthesized
acaaacaaaattatagttgg

SEQ ID NO: 585740 - DNA, 20 bp, Artificial Sequence
  chemically synthesized
taaaaccaaaccaactataa

SEQ ID NO: 585741 - DNA, 20 bp, Artificial Sequence
  chemically synthesized
gctatacaaacaaaattata

SEQ ID NO: 585742 - DNA, 20 bp, Artificial Sequence
  chemically synthesized
agaagcaagtatagtagaag

SEQ ID NO: 585743 - DNA, 20 bp, Artificial Sequence
  chemically synthesized
gcaatcatttcttctactat

SEQ ID NO: 585744 - DNA, 20 bp, Artificial Sequence
  chemically synthesized
tttcttctactatacttgct

SEQ ID NO: 585745 - DNA, 20 bp, Artificial Sequence
  chemically synthesized
ctagctttcttttatgtcat

SEQ ID NO: 585746 - DNA, 20 bp, Artificial Sequence
  chemically synthesized
acaaggaaaattggtaagtt

SEQ ID NO: 585747 - DNA, 20 bp, Artificial Sequence
  chemically synthesized
agttatgcgtttttgtgagc

SEQ ID NO: 585748 - DNA, 20 bp, Artificial Sequence
  chemically synthesized
ttctcatctcaaccacctgc

SEQ ID NO: 585749 - DNA, 20 bp, Artificial Sequence
  chemically synthesized
ttttacttctcatctcaacc

SEQ ID NO: 585750 - DNA, 20 bp, Artificial Sequence
  chemically synthesized
gatgagaagtaaaaagaaca

SEQ ID NO: 585751 - DNA, 20 bp, Artificial Sequence
  chemically synthesized
gattagagtagactgtaaca

SEQ ID NO: 585752 - DNA, 20 bp, Artificial Sequence
  chemically synthesized
atatgccaaccatcatcctt

SEQ ID NO: 585753 - DNA, 20 bp, Artificial Sequence
  chemically synthesized
tctatgtcgtagcattgttg

SEQ ID NO: 585754 - DNA, 20 bp, Artificial Sequence
  chemically synthesized
atgctgcttcctaacctatt

SEQ ID NO: 585755 - DNA, 20 bp, Artificial Sequence
  chemically synthesized
caatgcttaataccatgtca

SEQ ID NO: 585756 - DNA, 20 bp, Artificial Sequence
  chemically synthesized
tggcctaactctagacctca

SEQ ID NO: 585757 - DNA, 20 bp, Artificial Sequence
  chemically synthesized
tgaggtctagagttaggcca

SEQ ID NO: 585758 - DNA, 20 bp, Artificial Sequence
  chemically synthesized
gttcttgcctaacattttag

SEQ ID NO: 585759 - DNA, 20 bp, Artificial Sequence
  chemically synthesized
ctaactctcaatgcctcctc

SEQ ID NO: 585760 - DNA, 20 bp, Artificial Sequence
  chemically synthesized
agattggggacaatgatagc

SEQ ID NO: 585761 - DNA, 20 bp, Artificial Sequence
  chemically synthesized
acaatgatagcacctgcttc

SEQ ID NO: 585762 - DNA, 20 bp, Artificial Sequence
  chemically synthesized
acaataaagttattaagtag

SEQ ID NO: 585763 - DNA, 20 bp, Artificial Sequence
  chemically synthesized
taagtagcagtgattattgc

SEQ ID NO: 585764 - DNA, 20 bp, Artificial Sequence
  chemically synthesized
tcctggctctttatttacat

SEQ ID NO: 585765 - DNA, 20 bp, Artificial Sequence
  chemically synthesized
tgcctcagcctcccaaagtg

SEQ ID NO: 585766 - DNA, 20 bp, Artificial Sequence
  chemically synthesized
cactttgggaggctgaggca

SEQ ID NO: 585767 - DNA, 20 bp, Artificial Sequence
  chemically synthesized
ttgggaggctgaggcaggag

SEQ ID NO: 585768 - DNA, 20 bp, Artificial Sequence
  chemically synthesized
tttgttttgttttttgtttt

SEQ ID NO: 585769 - DNA, 20 bp, Artificial Sequence
  chemically synthesized
ttgttttgttttgttttgtt

SEQ ID NO: 585770 - DNA, 20 bp, Artificial Sequence
  chemically synthesized
tgtttttttgttttgttttg

SEQ ID NO: 585771 - DNA, 20 bp, Artificial Sequence
  chemically synthesized
ggctctgtttttttgttttg

SEQ ID NO: 585772 - DNA, 20 bp, Artificial Sequence
  chemically synthesized
attctggctctgtttttttg

SEQ ID NO: 585773 - DNA, 20 bp, Artificial Sequence
  chemically synthesized
tgtttattctggctctgttt

SEQ ID NO: 585774 - DNA, 20 bp, Artificial Sequence
  chemically synthesized
tttactcttgtttattctgg

SEQ ID NO: 585775 - DNA, 20 bp, Artificial Sequence
  chemically synthesized
tctgaagaaaatagctttac

SEQ ID NO: 585776 - DNA, 20 bp, Artificial Sequence
  chemically synthesized
actcttgatattctgaagaa

SEQ ID NO: 585777 - DNA, 20 bp, Artificial Sequence
  chemically synthesized
taaattctttattctgggat

SEQ ID NO: 585778 - DNA, 20 bp, Artificial Sequence
  chemically synthesized
tctcgtaaagagctatcatt

SEQ ID NO: 585779 - DNA, 20 bp, Artificial Sequence
  chemically synthesized
tatattatgaataataatag

SEQ ID NO: 585780 - DNA, 20 bp, Artificial Sequence
  chemically synthesized
tgtgacacactggtatatta

SEQ ID NO: 585781 - DNA, 20 bp, Artificial Sequence
  chemically synthesized
tgtgtcacataaacaatgtc

SEQ ID NO: 585782 - DNA, 20 bp, Artificial Sequence
  chemically synthesized
aattgttccaaagcatgtga

SEQ ID NO: 585783 - DNA, 20 bp, Artificial Sequence
  chemically synthesized
aatgtcacatgctttggaac

SEQ ID NO: 585784 - DNA, 20 bp, Artificial Sequence
  chemically synthesized
taagtcactaatgaacagta

SEQ ID NO: 585785 - DNA, 20 bp, Artificial Sequence
  chemically synthesized
aattcatttttctgtacatt

SEQ ID NO: 585786 - DNA, 20 bp, Artificial Sequence
  chemically synthesized
tacagaaaaatgaattttaa

SEQ ID NO: 585787 - DNA, 20 bp, Artificial Sequence
  chemically synthesized
catattgtttacgtatacaa

SEQ ID NO: 585788 - DNA, 20 bp, Artificial Sequence
  chemically synthesized
acaagacgtttcactgtaca

SEQ ID NO: 585789 - DNA, 20 bp, Artificial Sequence
  chemically synthesized
catatatacatgcatttaca

SEQ ID NO: 585790 - DNA, 20 bp, Artificial Sequence
  chemically synthesized
attcatgagactgtataagc

SEQ ID NO: 585791 - DNA, 20 bp, Artificial Sequence
  chemically synthesized
gcccaggctggatgttaatc

SEQ ID NO: 585792 - DNA, 20 bp, Artificial Sequence
  chemically synthesized
ctgaccctaggctcccacag

SEQ ID NO: 585793 - DNA, 20 bp, Artificial Sequence
  chemically synthesized
tttcccattcatcttaaagt

SEQ ID NO: 585794 - DNA, 20 bp, Artificial Sequence
  chemically synthesized
gatgaatgggaaatgttggg

SEQ ID NO: 585795 - DNA, 20 bp, Artificial Sequence
  chemically synthesized
agagttgggcaaaagaagca

SEQ ID NO: 585796 - DNA, 20 bp, Artificial Sequence
  chemically synthesized
attctgtgctatctgaaaca

SEQ ID NO: 585797 - DNA, 20 bp, Artificial Sequence
  chemically synthesized
aaagagaacaatatctcaat

SEQ ID NO: 585798 - DNA, 20 bp, Artificial Sequence
  chemically synthesized
atgaattgagatattgttct

SEQ ID NO: 585799 - DNA, 20 bp, Artificial Sequence
  chemically synthesized
attgagatattgttctcttt

SEQ ID NO: 585800 - DNA, 20 bp, Artificial Sequence
  chemically synthesized
tattgttctctttgcttgat

SEQ ID NO: 585801 - DNA, 20 bp, Artificial Sequence
  chemically synthesized
atgtttagttacctccttta

SEQ ID NO: 585802 - DNA, 20 bp, Artificial Sequence
  chemically synthesized
aaaatgatccaataaaaata

SEQ ID NO: 585803 - DNA, 20 bp, Artificial Sequence
  chemically synthesized
tactcacaagtagatgtaaa

SEQ ID NO: 585804 - DNA, 20 bp, Artificial Sequence
  chemically synthesized
agtagatgtaaaaagcgttt

SEQ ID NO: 585805 - DNA, 20 bp, Artificial Sequence
  chemically synthesized
tgttgttagttgaagctgta

SEQ ID NO: 585806 - DNA, 20 bp, Artificial Sequence
  chemically synthesized
aatatgatggctattatctc

SEQ ID NO: 585807 - DNA, 20 bp, Artificial Sequence
  chemically synthesized
aggagttcatcgctcagttt

SEQ ID NO: 585808 - DNA, 20 bp, Artificial Sequence
  chemically synthesized
agataaaaaggagttcatcg

SEQ ID NO: 585809 - DNA, 20 bp, Artificial Sequence
  chemically synthesized
ttatctgatcatgaaattgt

SEQ ID NO: 585810 - DNA, 20 bp, Artificial Sequence
  chemically synthesized
tgaaattgttcacgtttcat

SEQ ID NO: 585811 - DNA, 20 bp, Artificial Sequence
  chemically synthesized
gttaaatgttatacagattt

SEQ ID NO: 585812 - DNA, 20 bp, Artificial Sequence
  chemically synthesized
gcagtcttagttaaatgtta

SEQ ID NO: 585813 - DNA, 20 bp, Artificial Sequence
  chemically synthesized
tataacatttaactaagact

SEQ ID NO: 585814 - DNA, 20 bp, Artificial Sequence
  chemically synthesized
ttacactgttttctgtcagg

SEQ ID NO: 585815 - DNA, 20 bp, Artificial Sequence
  chemically synthesized
gacagaaaacagtgtaatgg

SEQ ID NO: 585816 - DNA, 20 bp, Artificial Sequence
  chemically synthesized
tagtcaaatctgacccatta

SEQ ID NO: 585817 - DNA, 20 bp, Artificial Sequence
  chemically synthesized
aatatctggaataatgaaat

SEQ ID NO: 585818 - DNA, 20 bp, Artificial Sequence
  chemically synthesized
gcttatcatgagacgaaatt

SEQ ID NO: 585819 - DNA, 20 bp, Artificial Sequence
  chemically synthesized
aattttcagcttaattatga

SEQ ID NO: 585820 - DNA, 20 bp, Artificial Sequence
  chemically synthesized
agcttaattatgatgttgct

SEQ ID NO: 585821 - DNA, 20 bp, Artificial Sequence
  chemically synthesized
cattgctccttctcactgac

SEQ ID NO: 585822 - DNA, 20 bp, Artificial Sequence
  chemically synthesized
ccatcatatttaggaacaga

SEQ ID NO: 585823 - DNA, 20 bp, Artificial Sequence
  chemically synthesized
aggtccatcatatttaggaa

SEQ ID NO: 585824 - DNA, 20 bp, Artificial Sequence
  chemically synthesized
aaatatgatggaccttcacc

SEQ ID NO: 585825 - DNA, 20 bp, Artificial Sequence
  chemically synthesized
gttaaaaacaatttccaaat

SEQ ID NO: 585826 - DNA, 20 bp, Artificial Sequence
  chemically synthesized
ataataatcctgaatttgga

SEQ ID NO: 585827 - DNA, 20 bp, Artificial Sequence
  chemically synthesized
ggttgactactatagacata

SEQ ID NO: 585828 - DNA, 20 bp, Artificial Sequence
  chemically synthesized
gcttttgattttttatatag

SEQ ID NO: 585829 - DNA, 20 bp, Artificial Sequence
  chemically synthesized
actggactatataaaaaatc

SEQ ID NO: 585830 - DNA, 20 bp, Artificial Sequence
  chemically synthesized
tcttttggtcgtgcagaagc

SEQ ID NO: 585831 - DNA, 20 bp, Artificial Sequence
  chemically synthesized
tatggctcttttggtcgtgc

SEQ ID NO: 585832 - DNA, 20 bp, Artificial Sequence
  chemically synthesized
tttcataattgttcatttgt

SEQ ID NO: 585833 - DNA, 20 bp, Artificial Sequence
  chemically synthesized
tttatttttcataattgttc

SEQ ID NO: 585834 - DNA, 20 bp, Artificial Sequence
  chemically synthesized
aatgaacaattatgaaaaat

SEQ ID NO: 585835 - DNA, 20 bp, Artificial Sequence
  chemically synthesized
gttcacagaaaagaaaatac

SEQ ID NO: 585836 - DNA, 20 bp, Artificial Sequence
  chemically synthesized
aggattttaaaagcatgaac

SEQ ID NO: 585837 - DNA, 20 bp, Artificial Sequence
  chemically synthesized
taccaaggctaagcttctgt

SEQ ID NO: 585838 - DNA, 20 bp, Artificial Sequence
  chemically synthesized
ttctctcattattaccaagg

SEQ ID NO: 585839 - DNA, 20 bp, Artificial Sequence
  chemically synthesized
ataatgagagaaatgaaaat

SEQ ID NO: 585840 - DNA, 20 bp, Artificial Sequence
  chemically synthesized
tttgtgtacctcttgtggaa

SEQ ID NO: 585841 - DNA, 20 bp, Artificial Sequence
  chemically synthesized
aaatttccaggtcaaagttt

SEQ ID NO: 585842 - DNA, 20 bp, Artificial Sequence
  chemically synthesized
tgggaataaaatttccaggt

SEQ ID NO: 585843 - DNA, 20 bp, Artificial Sequence
  chemically synthesized
ttattcccaggaatttattt

SEQ ID NO: 585844 - DNA, 20 bp, Artificial Sequence
  chemically synthesized
cccaggaatttattttgtag

SEQ ID NO: 585845 - DNA, 20 bp, Artificial Sequence
  chemically synthesized
acaaagacatatctgagact

SEQ ID NO: 585846 - DNA, 20 bp, Artificial Sequence
  chemically synthesized
ctgggtgatttataaaggaa

SEQ ID NO: 585847 - DNA, 20 bp, Artificial Sequence
  chemically synthesized
tgcttctcctttgccttctg

SEQ ID NO: 585848 - DNA, 20 bp, Artificial Sequence
  chemically synthesized
tgctgccatgtagaatgtgt

SEQ ID NO: 585849 - DNA, 20 bp, Artificial Sequence
  chemically synthesized
cttccctgctgccatgtaga

SEQ ID NO: 585850 - DNA, 20 bp, Artificial Sequence
  chemically synthesized
ttctacatggcagcagggaa

SEQ ID NO: 585851 - DNA, 20 bp, Artificial Sequence
  chemically synthesized
cagtaagtttcacaagatct

SEQ ID NO: 585852 - DNA, 20 bp, Artificial Sequence
  chemically synthesized
ctatcagatcttgtgaaact

SEQ ID NO: 585853 - DNA, 20 bp, Artificial Sequence
  chemically synthesized
tactgttctcctgataatca

SEQ ID NO: 585854 - DNA, 20 bp, Artificial Sequence
  chemically synthesized
acagtatgggggatcctctt

SEQ ID NO: 585855 - DNA, 20 bp, Artificial Sequence
  chemically synthesized
ctggctccacccttgacatg

SEQ ID NO: 585856 - DNA, 20 bp, Artificial Sequence
  chemically synthesized
ggggattaccataattcaag

SEQ ID NO: 585857 - DNA, 20 bp, Artificial Sequence
  chemically synthesized
ttttttacaaaagtaattga

SEQ ID NO: 585858 - DNA, 20 bp, Artificial Sequence
  chemically synthesized
gtaggaagatgagctggtac

SEQ ID NO: 585859 - DNA, 20 bp, Artificial Sequence
  chemically synthesized
gatatgttataccagaataa

SEQ ID NO: 585860 - DNA, 20 bp, Artificial Sequence
  chemically synthesized
tcttcagagcatttttcact

SEQ ID NO: 585861 - DNA, 20 bp, Artificial Sequence
  chemically synthesized
catcagtgaaaaatgctctg

SEQ ID NO: 585862 - DNA, 20 bp, Artificial Sequence
  chemically synthesized
aaaaaatatgtgttaaaagt

SEQ ID NO: 585863 - DNA, 20 bp, Artificial Sequence
  chemically synthesized
tgtgctcttctgcactttaa

SEQ ID NO: 585864 - DNA, 20 bp, Artificial Sequence
  chemically synthesized
gaatactctcgattcctgga

SEQ ID NO: 585865 - DNA, 20 bp, Artificial Sequence
  chemically synthesized
ccgtgaagtatttggaatac

SEQ ID NO: 585866 - DNA, 20 bp, Artificial Sequence
  chemically synthesized
tgagtaatgtataacgtgga

SEQ ID NO: 585867 - DNA, 20 bp, Artificial Sequence
  chemically synthesized
tgtataacgtggaaaaagat

SEQ ID NO: 585868 - DNA, 20 bp, Artificial Sequence
  chemically synthesized
ggaaaaagattaaggtttgt

SEQ ID NO: 585869 - DNA, 20 bp, Artificial Sequence
  chemically synthesized
taaggtttgtatcagattct

SEQ ID NO: 585870 - DNA, 20 bp, Artificial Sequence
  chemically synthesized
aatgatgtattttaccggtc

SEQ ID NO: 585871 - DNA, 20 bp, Artificial Sequence
  chemically synthesized
gcatggttttataatacata

SEQ ID NO: 585872 - DNA, 20 bp, Artificial Sequence
  chemically synthesized
ggaacatgttatatgaagag

SEQ ID NO: 585873 - DNA, 20 bp, Artificial Sequence
  chemically synthesized
cacataagggaattgaatgt

SEQ ID NO: 585874 - DNA, 20 bp, Artificial Sequence
  chemically synthesized
ttaacacataagggaattga

SEQ ID NO: 585875 - DNA, 20 bp, Artificial Sequence
  chemically synthesized
ttgtgtgaaattaggtcaag

SEQ ID NO: 585876 - DNA, 20 bp, Artificial Sequence
  chemically synthesized
acatcttgacctaatttcac

SEQ ID NO: 585877 - DNA, 20 bp, Artificial Sequence
  chemically synthesized
atacatttgaaattaacatt

SEQ ID NO: 585878 - DNA, 20 bp, Artificial Sequence
  chemically synthesized
tgaatgttaatttcaaatgt

SEQ ID NO: 585879 - DNA, 20 bp, Artificial Sequence
  chemically synthesized
atattaagataagcaaaagt

SEQ ID NO: 585880 - DNA, 20 bp, Artificial Sequence
  chemically synthesized
tttatttctaaaacagacac

SEQ ID NO: 585881 - DNA, 20 bp, Artificial Sequence
  chemically synthesized
tttagaaataaacatattaa

SEQ ID NO: 585882 - DNA, 20 bp, Artificial Sequence
  chemically synthesized
gtgttatgaaatccatctta

SEQ ID NO: 585883 - DNA, 20 bp, Artificial Sequence
  chemically synthesized
ttaacactttaatttttcta

SEQ ID NO: 585884 - DNA, 20 bp, Artificial Sequence
  chemically synthesized
tccagttcttcttactattt

SEQ ID NO: 585885 - DNA, 20 bp, Artificial Sequence
  chemically synthesized
atattctttttttgcttcta

SEQ ID NO: 585886 - DNA, 20 bp, Artificial Sequence
  chemically synthesized
tcaatctttttatattcttt

SEQ ID NO: 585887 - DNA, 20 bp, Artificial Sequence
  chemically synthesized
agaagcaaaaaaagaatata

SEQ ID NO: 585888 - DNA, 20 bp, Artificial Sequence
  chemically synthesized
catttgttttaattttgatt

SEQ ID NO: 585889 - DNA, 20 bp, Artificial Sequence
  chemically synthesized
ccagttgtcatttgttttaa

SEQ ID NO: 585890 - DNA, 20 bp, Artificial Sequence
  chemically synthesized
tgcaaatattcccagttgtc

SEQ ID NO: 585891 - DNA, 20 bp, Artificial Sequence
  chemically synthesized
ttttcctttttttactcatt

SEQ ID NO: 585892 - DNA, 20 bp, Artificial Sequence
  chemically synthesized
tgttctttatccagttttcc

SEQ ID NO: 585893 - DNA, 20 bp, Artificial Sequence
  chemically synthesized
atttctttttatgttcttta

SEQ ID NO: 585894 - DNA, 20 bp, Artificial Sequence
  chemically synthesized
tggattttttcttgtttatt

SEQ ID NO: 585895 - DNA, 20 bp, Artificial Sequence
  chemically synthesized
tactaactgtctggattttt

SEQ ID NO: 585896 - DNA, 20 bp, Artificial Sequence
  chemically synthesized
atttcattgattactaactg

SEQ ID NO: 585897 - DNA, 20 bp, Artificial Sequence
  chemically synthesized
tgctgttttcctttgcattt

SEQ ID NO: 585898 - DNA, 20 bp, Artificial Sequence
  chemically synthesized
gataaataatagtataacat

SEQ ID NO: 585899 - DNA, 20 bp, Artificial Sequence
  chemically synthesized
tactattatttatctattat

SEQ ID NO: 585900 - DNA, 20 bp, Artificial Sequence
  chemically synthesized
ccaaggaagatcataaaatt

SEQ ID NO: 585901 - DNA, 20 bp, Artificial Sequence
  chemically synthesized
ggctccaaggaagatcataa

SEQ ID NO: 585902 - DNA, 20 bp, Artificial Sequence
  chemically synthesized
aacagactgactgtgatcct

SEQ ID NO: 585903 - DNA, 20 bp, Artificial Sequence
  chemically synthesized
cacagtgcaatgaattactc

SEQ ID NO: 585904 - DNA, 20 bp, Artificial Sequence
  chemically synthesized
tataactggcagtgcagtag

SEQ ID NO: 585905 - DNA, 20 bp, Artificial Sequence
  chemically synthesized
tttatataactggcagtgca

SEQ ID NO: 585906 - DNA, 20 bp, Artificial Sequence
  chemically synthesized
aatgataataaacaactgtt

SEQ ID NO: 585907 - DNA, 20 bp, Artificial Sequence
  chemically synthesized
taaatacataaaccaataac

SEQ ID NO: 585908 - DNA, 20 bp, Artificial Sequence
  chemically synthesized
gcattgttatcctatgagat

SEQ ID NO: 585909 - DNA, 20 bp, Artificial Sequence
  chemically synthesized
ctatgagatgatagtttcat

SEQ ID NO: 585910 - DNA, 20 bp, Artificial Sequence
  chemically synthesized
atgtaggcctaggctcatgt

SEQ ID NO: 585911 - DNA, 20 bp, Artificial Sequence
  chemically synthesized
gcctaggctcatgtgcgtgt

SEQ ID NO: 585912 - DNA, 20 bp, Artificial Sequence
  chemically synthesized
tgtgttttactttttaacag

SEQ ID NO: 585913 - DNA, 20 bp, Artificial Sequence
  chemically synthesized
atttttaatatttttgctgt

SEQ ID NO: 585914 - DNA, 20 bp, Artificial Sequence
  chemically synthesized
tttcttatttttaatatttt

SEQ ID NO: 585915 - DNA, 20 bp, Artificial Sequence
  chemically synthesized
atattttatatccttattgt

SEQ ID NO: 585916 - DNA, 20 bp, Artificial Sequence
  chemically synthesized
tgtacgggtgttcaacgtgt

SEQ ID NO: 585917 - DNA, 20 bp, Artificial Sequence
  chemically synthesized
tttttgactctgtaataaca

SEQ ID NO: 585918 - DNA, 20 bp, Artificial Sequence
  chemically synthesized
cagagtcaaaaacttaaaaa

SEQ ID NO: 585919 - DNA, 20 bp, Artificial Sequence
  chemically synthesized
ttactttataaacttttttt

SEQ ID NO: 585920 - DNA, 20 bp, Artificial Sequence
  chemically synthesized
ttcattaatgataagttaac

SEQ ID NO: 585921 - DNA, 20 bp, Artificial Sequence
  chemically synthesized
cgcctcggcctcccaaagtg

SEQ ID NO: 585922 - DNA, 20 bp, Artificial Sequence
  chemically synthesized
ttttgtatttttagtagaga

SEQ ID NO: 585923 - DNA, 20 bp, Artificial Sequence
  chemically synthesized
tttagtgcagcctaactata

SEQ ID NO: 585924 - DNA, 20 bp, Artificial Sequence
  chemically synthesized
gacattattgtacggtacca

SEQ ID NO: 585925 - DNA, 20 bp, Artificial Sequence
  chemically synthesized
atggtaccgtacaataatgt

SEQ ID NO: 585926 - DNA, 20 bp, Artificial Sequence
  chemically synthesized
catacggtatttaccatgaa

SEQ ID NO: 585927 - DNA, 20 bp, Artificial Sequence
  chemically synthesized
tcagtaaagtcacatgcagt

SEQ ID NO: 585928 - DNA, 20 bp, Artificial Sequence
  chemically synthesized
tatctttgtgtaagtacact

SEQ ID NO: 585929 - DNA, 20 bp, Artificial Sequence
  chemically synthesized
gttctgaaaaatgtgtcatt

SEQ ID NO: 585930 - DNA, 20 bp, Artificial Sequence
  chemically synthesized
tggtaattcagaccgaaaag

SEQ ID NO: 585931 - DNA, 20 bp, Artificial Sequence
  chemically synthesized
gtgtttgtagtttccagggt

SEQ ID NO: 585932 - DNA, 20 bp, Artificial Sequence
  chemically synthesized
ttcactgtctcagtagtgtt

SEQ ID NO: 585933 - DNA, 20 bp, Artificial Sequence
  chemically synthesized
cattttcttcactgtctcag

SEQ ID NO: 585934 - DNA, 20 bp, Artificial Sequence
  chemically synthesized
catgaagaaggtagtcctct

SEQ ID NO: 585935 - DNA, 20 bp, Artificial Sequence
  chemically synthesized
gattgagattgcattgaatt

SEQ ID NO: 585936 - DNA, 20 bp, Artificial Sequence
  chemically synthesized
aatggttgctgcaattttga

SEQ ID NO: 585937 - DNA, 20 bp, Artificial Sequence
  chemically synthesized
ctaagaaatggttgctgcaa

SEQ ID NO: 585938 - DNA, 20 bp, Artificial Sequence
  chemically synthesized
tagaaattgacatgccaatc

SEQ ID NO: 585939 - DNA, 20 bp, Artificial Sequence
  chemically synthesized
tttgcacttacatataaatc

SEQ ID NO: 585940 - DNA, 20 bp, Artificial Sequence
  chemically synthesized
aaggcaactttgaagaacga

SEQ ID NO: 585941 - DNA, 20 bp, Artificial Sequence
  chemically synthesized
tgaagaacgacgaagtttaa

SEQ ID NO: 585942 - DNA, 20 bp, Artificial Sequence
  chemically synthesized
tttattataattaagcctgt

SEQ ID NO: 585943 - DNA, 20 bp, Artificial Sequence
  chemically synthesized
tgttctcacttcaatcccac

SEQ ID NO: 585944 - DNA, 20 bp, Artificial Sequence
  chemically synthesized
gtgagaacaaatcatctata

SEQ ID NO: 585945 - DNA, 20 bp, Artificial Sequence
  chemically synthesized
taaattaggaaacgctatat

SEQ ID NO: 585946 - DNA, 20 bp, Artificial Sequence
  chemically synthesized
tcagtaaatagcaccaagtt

SEQ ID NO: 585947 - DNA, 20 bp, Artificial Sequence
  chemically synthesized
atgatgtggagagtcaaggt

SEQ ID NO: 585948 - DNA, 20 bp, Artificial Sequence
  chemically synthesized
atcatacacaaaacataaat

SEQ ID NO: 585949 - DNA, 20 bp, Artificial Sequence
  chemically synthesized
tacacaaaacataaattcta

SEQ ID NO: 585950 - DNA, 20 bp, Artificial Sequence
  chemically synthesized
gtctgcaaacaatctagaat

SEQ ID NO: 585951 - DNA, 20 bp, Artificial Sequence
  chemically synthesized
caatgtaaaaggcaaaaaaa

SEQ ID NO: 585952 - DNA, 20 bp, Artificial Sequence
  chemically synthesized
aatacattaacctaaaattg

SEQ ID NO: 585953 - DNA, 20 bp, Artificial Sequence
  chemically synthesized
tatggctaatgctttttatg

SEQ ID NO: 585954 - DNA, 20 bp, Artificial Sequence
  chemically synthesized
tcagtcttttcctttatggc

SEQ ID NO: 585955 - DNA, 20 bp, Artificial Sequence
  chemically synthesized
aatctttcctgataaatgga

SEQ ID NO: 585956 - DNA, 20 bp, Artificial Sequence
  chemically synthesized
taacaatctttcctgataaa

SEQ ID NO: 585957 - DNA, 20 bp, Artificial Sequence
  chemically synthesized
aatcaaactccatttatcag

SEQ ID NO: 585958 - DNA, 20 bp, Artificial Sequence
  chemically synthesized
gttaagagaaaaaaataaag

SEQ ID NO: 585959 - DNA, 20 bp, Artificial Sequence
  chemically synthesized
atatctttttccaacctaaa

SEQ ID NO: 585960 - DNA, 20 bp, Artificial Sequence
  chemically synthesized
aactattatttttaatgggc

SEQ ID NO: 585961 - DNA, 20 bp, Artificial Sequence
  chemically synthesized
taaaaatggcactaatcgtc

SEQ ID NO: 585962 - DNA, 20 bp, Artificial Sequence
  chemically synthesized
tgttttaatttgcaatcacc

SEQ ID NO: 585963 - DNA, 20 bp, Artificial Sequence
  chemically synthesized
gaatgtgaaatggtatttca

SEQ ID NO: 585964 - DNA, 20 bp, Artificial Sequence
  chemically synthesized
ctgaaatgaccacactgaaa

SEQ ID NO: 585965 - DNA, 20 bp, Artificial Sequence
  chemically synthesized
cacactgaaaaactgttttt

SEQ ID NO: 585966 - DNA, 20 bp, Artificial Sequence
  chemically synthesized
tggctttggaatcaccaaaa

SEQ ID NO: 585967 - DNA, 20 bp, Artificial Sequence
  chemically synthesized
taggtcataagatgtgtaca

SEQ ID NO: 585968 - DNA, 20 bp, Artificial Sequence
  chemically synthesized
aatagacacagcccaatgtc

SEQ ID NO: 585969 - DNA, 20 bp, Artificial Sequence
  chemically synthesized
attctattgtgtgaatatgc

SEQ ID NO: 585970 - DNA, 20 bp, Artificial Sequence
  chemically synthesized
attgcctgtgccatagttag

SEQ ID NO: 585971 - DNA, 20 bp, Artificial Sequence
  chemically synthesized
atgctattgcctgtgccata

SEQ ID NO: 585972 - DNA, 20 bp, Artificial Sequence
  chemically synthesized
caaatacaagggcatatact

SEQ ID NO: 585973 - DNA, 20 bp, Artificial Sequence
  chemically synthesized
caagggcatatactggatga

SEQ ID NO: 585974 - DNA, 20 bp, Artificial Sequence
  chemically synthesized
ttttgacttctaacacctag

SEQ ID NO: 585975 - DNA, 20 bp, Artificial Sequence
  chemically synthesized
cactcttttgacttctaaca

SEQ ID NO: 585976 - DNA, 20 bp, Artificial Sequence
  chemically synthesized
ctaggtgttagaagtcaaaa

SEQ ID NO: 585977 - DNA, 20 bp, Artificial Sequence
  chemically synthesized
gtggtagtagcatggataca

SEQ ID NO: 585978 - DNA, 20 bp, Artificial Sequence
  chemically synthesized
aaatcataagaatagaaatt

SEQ ID NO: 585979 - DNA, 20 bp, Artificial Sequence
  chemically synthesized
aaatccctgaatttctattc

SEQ ID NO: 585980 - DNA, 20 bp, Artificial Sequence
  chemically synthesized
ttttctatgtgtctttatac

SEQ ID NO: 585981 - DNA, 20 bp, Artificial Sequence
  chemically synthesized
agtaatcttaaggcttttaa

SEQ ID NO: 585982 - DNA, 20 bp, Artificial Sequence
  chemically synthesized
ataaaactactttaaaagcc

SEQ ID NO: 585983 - DNA, 20 bp, Artificial Sequence
  chemically synthesized
ttgaagggaatgagtaatct

SEQ ID NO: 585984 - DNA, 20 bp, Artificial Sequence
  chemically synthesized
aacattcttgtcataggtct

SEQ ID NO: 585985 - DNA, 20 bp, Artificial Sequence
  chemically synthesized
gtttattctatttggggaga

SEQ ID NO: 585986 - DNA, 20 bp, Artificial Sequence
  chemically synthesized
aaagcagtttattctatttg

SEQ ID NO: 585987 - DNA, 20 bp, Artificial Sequence
  chemically synthesized
aaatctccccaaatagaata

SEQ ID NO: 585988 - DNA, 20 bp, Artificial Sequence
  chemically synthesized
aacatatttcattatgtaaa

SEQ ID NO: 585989 - DNA, 20 bp, Artificial Sequence
  chemically synthesized
taatatttttcagtgtaata

SEQ ID NO: 585990 - DNA, 20 bp, Artificial Sequence
  chemically synthesized
aaaatatattaaaaataaat

SEQ ID NO: 585991 - DNA, 20 bp, Artificial Sequence
  chemically synthesized
atattaaaaataaattatgg

SEQ ID NO: 585992 - DNA, 20 bp, Artificial Sequence
  chemically synthesized
tgcttgttagccatttgtat

SEQ ID NO: 585993 - DNA, 20 bp, Artificial Sequence
  chemically synthesized
catatgcttgttagccattt

SEQ ID NO: 585994 - DNA, 20 bp, Artificial Sequence
  chemically synthesized
gttgatcatttttttttttc

SEQ ID NO: 585995 - DNA, 20 bp, Artificial Sequence
  chemically synthesized
ggctttgatttgcatttccc

SEQ ID NO: 585996 - DNA, 20 bp, Artificial Sequence
  chemically synthesized
aagatgatatcttattttgg

SEQ ID NO: 585997 - DNA, 20 bp, Artificial Sequence
  chemically synthesized
ggtataagatgatatcttat

SEQ ID NO: 585998 - DNA, 20 bp, Artificial Sequence
  chemically synthesized
aatgttttgtggatcttcca

SEQ ID NO: 585999 - DNA, 20 bp, Artificial Sequence
  chemically synthesized
tcatatggtagttctatttt

SEQ ID NO: 586000 - DNA, 20 bp, Artificial Sequence
  chemically synthesized
acattaaaaatagaactacc

SEQ ID NO: 586001 - DNA, 20 bp, Artificial Sequence
  chemically synthesized
ttttggatatatgcccagag

SEQ ID NO: 586002 - DNA, 20 bp, Artificial Sequence
  chemically synthesized
gggcagatatctcttcaaaa

SEQ ID NO: 586003 - DNA, 20 bp, Artificial Sequence
  chemically synthesized
ttgaagagatatctgccctc

SEQ ID NO: 586004 - DNA, 20 bp, Artificial Sequence
  chemically synthesized
catttattgatggacattta

SEQ ID NO: 586005 - DNA, 20 bp, Artificial Sequence
  chemically synthesized
taaggctgaatagagttcca

SEQ ID NO: 586006 - DNA, 20 bp, Artificial Sequence
  chemically synthesized
aatccgtgttgttgcaaatg

SEQ ID NO: 586007 - DNA, 20 bp, Artificial Sequence
  chemically synthesized
aatcctgtcatttgcaacaa

SEQ ID NO: 586008 - DNA, 20 bp, Artificial Sequence
  chemically synthesized
acagtatttgcctttctttg

SEQ ID NO: 586009 - DNA, 20 bp, Artificial Sequence
  chemically synthesized
ggcaaagaaaggcaaatact

SEQ ID NO: 586010 - DNA, 20 bp, Artificial Sequence
  chemically synthesized
gtttctctgagtttgacatt

SEQ ID NO: 586011 - DNA, 20 bp, Artificial Sequence
  chemically synthesized
caccatttttctctgtttct

SEQ ID NO: 586012 - DNA, 20 bp, Artificial Sequence
  chemically synthesized
atctaataaccaccattttt

SEQ ID NO: 586013 - DNA, 20 bp, Artificial Sequence
  chemically synthesized
gttattagatcctgggggtg

SEQ ID NO: 586014 - DNA, 20 bp, Artificial Sequence
  chemically synthesized
ttgatgaaaagatacacaat

SEQ ID NO: 586015 - DNA, 20 bp, Artificial Sequence
  chemically synthesized
ccctgagttacaacagataa

SEQ ID NO: 586016 - DNA, 20 bp, Artificial Sequence
  chemically synthesized
tatacttggaaattactaaa

SEQ ID NO: 586017 - DNA, 20 bp, Artificial Sequence
  chemically synthesized
gtaaggtaatgaatatgttc

SEQ ID NO: 586018 - DNA, 20 bp, Artificial Sequence
  chemically synthesized
ggtaatgaatatgttctata

SEQ ID NO: 586019 - DNA, 20 bp, Artificial Sequence
  chemically synthesized
agcttgatttagtcattccg

SEQ ID NO: 586020 - DNA, 20 bp, Artificial Sequence
  chemically synthesized
agaaaatttaaaaatttaca

SEQ ID NO: 586021 - DNA, 20 bp, Artificial Sequence
  chemically synthesized
acatagattttcatatttgt

SEQ ID NO: 586022 - DNA, 20 bp, Artificial Sequence
  chemically synthesized
aaaggagtattataaattat

SEQ ID NO: 586023 - DNA, 20 bp, Artificial Sequence
  chemically synthesized
taccactcagaaagaatatt

SEQ ID NO: 586024 - DNA, 20 bp, Artificial Sequence
  chemically synthesized
agaaataaataataagtagt

SEQ ID NO: 586025 - DNA, 20 bp, Artificial Sequence
  chemically synthesized
aataaaattactattataac

SEQ ID NO: 586026 - DNA, 20 bp, Artificial Sequence
  chemically synthesized
acatatttcaggtacttcat

SEQ ID NO: 586027 - DNA, 20 bp, Artificial Sequence
  chemically synthesized
acaaagatggcactaaatat

SEQ ID NO: 586028 - DNA, 20 bp, Artificial Sequence
  chemically synthesized
attttgaaagatactggaaa

SEQ ID NO: 586029 - DNA, 20 bp, Artificial Sequence
  chemically synthesized
gcctcggcctccccaaagtg

SEQ ID NO: 586030 - DNA, 20 bp, Artificial Sequence
  chemically synthesized
ttttgtatttttagtagaga

SEQ ID NO: 586031 - DNA, 20 bp, Artificial Sequence
  chemically synthesized
aatggtgtgaacttaggagg

SEQ ID NO: 586032 - DNA, 20 bp, Artificial Sequence
  chemically synthesized
ataaatggatctatttaaac

SEQ ID NO: 586033 - DNA, 20 bp, Artificial Sequence
  chemically synthesized
acaaataactattgaaaagc

SEQ ID NO: 586034 - DNA, 20 bp, Artificial Sequence
  chemically synthesized
atgatactaagtattaaggg

SEQ ID NO: 586035 - DNA, 20 bp, Artificial Sequence
  chemically synthesized
gaagttgacttctcaatgta

SEQ ID NO: 586036 - DNA, 20 bp, Artificial Sequence
  chemically synthesized
tattaatattcattttcaaa

SEQ ID NO: 586037 - DNA, 20 bp, Artificial Sequence
  chemically synthesized
tattttgaaaattaaaacat

SEQ ID NO: 586038 - DNA, 20 bp, Artificial Sequence
  chemically synthesized
aattaacaaatggcaaacag

SEQ ID NO: 586039 - DNA, 20 bp, Artificial Sequence
  chemically synthesized
ggggactagaagaacagtta

SEQ ID NO: 586040 - DNA, 20 bp, Artificial Sequence
  chemically synthesized
gaatgcttatcaaatgcatt

SEQ ID NO: 586041 - DNA, 20 bp, Artificial Sequence
  chemically synthesized
ttatcaaatgcatttttgga

SEQ ID NO: 586042 - DNA, 20 bp, Artificial Sequence
  chemically synthesized
ggattatgattaatccaaaa

SEQ ID NO: 586043 - DNA, 20 bp, Artificial Sequence
  chemically synthesized
catgataatttaaacatgat

SEQ ID NO: 586044 - DNA, 20 bp, Artificial Sequence
  chemically synthesized
attatatcatgataatttaa

SEQ ID NO: 586045 - DNA, 20 bp, Artificial Sequence
  chemically synthesized
caagccaaccaaaatagaga

SEQ ID NO: 586046 - DNA, 20 bp, Artificial Sequence
  chemically synthesized
taagcatcttctctattttg

SEQ ID NO: 586047 - DNA, 20 bp, Artificial Sequence
  chemically synthesized
tttataacaacttatgttat

SEQ ID NO: 586048 - DNA, 20 bp, Artificial Sequence
  chemically synthesized
atagataacataagttgtta

SEQ ID NO: 586049 - DNA, 20 bp, Artificial Sequence
  chemically synthesized
agtctttattttttaagtac

SEQ ID NO: 586050 - DNA, 20 bp, Artificial Sequence
  chemically synthesized
tctgtacttaaaaaataaag

SEQ ID NO: 586051 - DNA, 20 bp, Artificial Sequence
  chemically synthesized
ttagttaggaattgtgtgag

SEQ ID NO: 586052 - DNA, 20 bp, Artificial Sequence
  chemically synthesized
atgaatgtaagtcattactt

SEQ ID NO: 586053 - DNA, 20 bp, Artificial Sequence
  chemically synthesized
tttgcctttttctttggctt

SEQ ID NO: 586054 - DNA, 20 bp, Artificial Sequence
  chemically synthesized
tgtttttgcctttttctttg

SEQ ID NO: 586055 - DNA, 20 bp, Artificial Sequence
  chemically synthesized
gaattgtttttgcctttttc

SEQ ID NO: 586056 - DNA, 20 bp, Artificial Sequence
  chemically synthesized
ttaagagtgtcaaaaagatg

SEQ ID NO: 586057 - DNA, 20 bp, Artificial Sequence
  chemically synthesized
ttttttctactgatttgtga

SEQ ID NO: 586058 - DNA, 20 bp, Artificial Sequence
  chemically synthesized
tgagtatttgtctttttttc

SEQ ID NO: 586059 - DNA, 20 bp, Artificial Sequence
  chemically synthesized
cctatgtataggcctattaa

SEQ ID NO: 586060 - DNA, 20 bp, Artificial Sequence
  chemically synthesized
ataggtgcaatattacacct

SEQ ID NO: 586061 - DNA, 20 bp, Artificial Sequence
  chemically synthesized
gggaggtgtaatattgcacc

SEQ ID NO: 586062 - DNA, 20 bp, Artificial Sequence
  chemically synthesized
tattgcacctattgatttaa

SEQ ID NO: 586063 - DNA, 20 bp, Artificial Sequence
  chemically synthesized
tattgtattgcagtgcaaga

SEQ ID NO: 586064 - DNA, 20 bp, Artificial Sequence
  chemically synthesized
tcccagagatatttcatttt

SEQ ID NO: 586065 - DNA, 20 bp, Artificial Sequence
  chemically synthesized
tggggttgggtgtcgatgag

SEQ ID NO: 586066 - DNA, 20 bp, Artificial Sequence
  chemically synthesized
tctctggtctaagtgcacta

SEQ ID NO: 586067 - DNA, 20 bp, Artificial Sequence
  chemically synthesized
acattttagtgcacttagac

SEQ ID NO: 586068 - DNA, 20 bp, Artificial Sequence
  chemically synthesized
aaaaattttctgcaatgaat

SEQ ID NO: 586069 - DNA, 20 bp, Artificial Sequence
  chemically synthesized
atgtgtacctatatttaaaa

SEQ ID NO: 586070 - DNA, 20 bp, Artificial Sequence
  chemically synthesized
acatgtatacttctatagaa

SEQ ID NO: 586071 - DNA, 20 bp, Artificial Sequence
  chemically synthesized
gctgtgaaatggtaaccaag

SEQ ID NO: 586072 - DNA, 20 bp, Artificial Sequence
  chemically synthesized
ctaacttcttgggttcaaat

SEQ ID NO: 586073 - DNA, 20 bp, Artificial Sequence
  chemically synthesized
taggatttgaacccaagaag

SEQ ID NO: 586074 - DNA, 20 bp, Artificial Sequence
  chemically synthesized
atagtacagtggttaacagg

SEQ ID NO: 586075 - DNA, 20 bp, Artificial Sequence
  chemically synthesized
tatactatatgagtgcaaaa

SEQ ID NO: 586076 - DNA, 20 bp, Artificial Sequence
  chemically synthesized
ctatatgagtgcaaaagaag

SEQ ID NO: 586077 - DNA, 20 bp, Artificial Sequence
  chemically synthesized
agtgcaaaagaaggtttgct

SEQ ID NO: 586078 - DNA, 20 bp, Artificial Sequence
  chemically synthesized
aaattcctttaggtactgac

SEQ ID NO: 586079 - DNA, 20 bp, Artificial Sequence
  chemically synthesized
ttttccttgccactatcaaa

SEQ ID NO: 586080 - DNA, 20 bp, Artificial Sequence
  chemically synthesized
cagttttcaaaactgccact

SEQ ID NO: 586081 - DNA, 20 bp, Artificial Sequence
  chemically synthesized
aagcaagagaatcaatgagt

SEQ ID NO: 586082 - DNA, 20 bp, Artificial Sequence
  chemically synthesized
aaactgccactcattgattc

SEQ ID NO: 586083 - DNA, 20 bp, Artificial Sequence
  chemically synthesized
tctcttgcttaaaattgtgt

SEQ ID NO: 586084 - DNA, 20 bp, Artificial Sequence
  chemically synthesized
tttgaagaatggaagatagc

SEQ ID NO: 586085 - DNA, 20 bp, Artificial Sequence
  chemically synthesized
aaagaagtgctttgttatta

SEQ ID NO: 586086 - DNA, 20 bp, Artificial Sequence
  chemically synthesized
tcagaggaacagaccaaaag

SEQ ID NO: 586087 - DNA, 20 bp, Artificial Sequence
  chemically synthesized
ccaaaacatgaaggattggg

SEQ ID NO: 586088 - DNA, 20 bp, Artificial Sequence
  chemically synthesized
ataaaactcttcccaatcct

SEQ ID NO: 586089 - DNA, 20 bp, Artificial Sequence
  chemically synthesized
acttttattacccaaaacat

SEQ ID NO: 586090 - DNA, 20 bp, Artificial Sequence
  chemically synthesized
taaaagttccacctcctcag

SEQ ID NO: 586091 - DNA, 20 bp, Artificial Sequence
  chemically synthesized
agttccacctcctcagagaa

SEQ ID NO: 586092 - DNA, 20 bp, Artificial Sequence
  chemically synthesized
agaatcattatttccttcca

SEQ ID NO: 586093 - DNA, 20 bp, Artificial Sequence
  chemically synthesized
ttaatccctctggaaggaaa

SEQ ID NO: 586094 - DNA, 20 bp, Artificial Sequence
  chemically synthesized
gtagcccaggtaattaatgc

SEQ ID NO: 586095 - DNA, 20 bp, Artificial Sequence
  chemically synthesized
ctgtgtgtatgtgtgagtat

SEQ ID NO: 586096 - DNA, 20 bp, Artificial Sequence
  chemically synthesized
agcgaatgattgattgtttt

SEQ ID NO: 586097 - DNA, 20 bp, Artificial Sequence
  chemically synthesized
tgttttattagcgaatgatt

SEQ ID NO: 586098 - DNA, 20 bp, Artificial Sequence
  chemically synthesized
tttctgttttattagcgaat

SEQ ID NO: 586099 - DNA, 20 bp, Artificial Sequence
  chemically synthesized
ctcttttctgttttattagc

SEQ ID NO: 586100 - DNA, 20 bp, Artificial Sequence
  chemically synthesized
taggagatttaccttctctt

SEQ ID NO: 586101 - DNA, 20 bp, Artificial Sequence
  chemically synthesized
agagaaggtaaatctcctaa

SEQ ID NO: 586102 - DNA, 20 bp, Artificial Sequence
  chemically synthesized
acaagaacataagcgttttt

SEQ ID NO: 586103 - DNA, 20 bp, Artificial Sequence
  chemically synthesized
ttcaaagtgtacaagaacat

SEQ ID NO: 586104 - DNA, 20 bp, Artificial Sequence
  chemically synthesized
tatgttcttgtacactttga

SEQ ID NO: 586105 - DNA, 20 bp, Artificial Sequence
  chemically synthesized
aatgtcatgtataaggacat

SEQ ID NO: 586106 - DNA, 20 bp, Artificial Sequence
  chemically synthesized
cttatacatgacatttccaa

SEQ ID NO: 586107 - DNA, 20 bp, Artificial Sequence
  chemically synthesized
actaaggaataaaattcttg

SEQ ID NO: 586108 - DNA, 20 bp, Artificial Sequence
  chemically synthesized
tcttgatatgttttctgtta

SEQ ID NO: 586109 - DNA, 20 bp, Artificial Sequence
  chemically synthesized
tctgttagttagcttgatgt

SEQ ID NO: 586110 - DNA, 20 bp, Artificial Sequence
  chemically synthesized
caaaatagctactaggtaaa

SEQ ID NO: 586111 - DNA, 20 bp, Artificial Sequence
  chemically synthesized
ttgttccagccgctgccctg

SEQ ID NO: 586112 - DNA, 20 bp, Artificial Sequence
  chemically synthesized
tggtattactaatttggggg

SEQ ID NO: 586113 - DNA, 20 bp, Artificial Sequence
  chemically synthesized
cattttatccaaaagaagat

SEQ ID NO: 586114 - DNA, 20 bp, Artificial Sequence
  chemically synthesized
gatatcttcccaggcacaaa

SEQ ID NO: 586115 - DNA, 20 bp, Artificial Sequence
  chemically synthesized
gagaccagttgtaaaaataa

SEQ ID NO: 586116 - DNA, 20 bp, Artificial Sequence
  chemically synthesized
ttttacattgtatatggatt

SEQ ID NO: 586117 - DNA, 20 bp, Artificial Sequence
  chemically synthesized
ttagtcacttttacattgta

SEQ ID NO: 586118 - DNA, 20 bp, Artificial Sequence
  chemically synthesized
ctgggggctgaatgtcataa

SEQ ID NO: 586119 - DNA, 20 bp, Artificial Sequence
  chemically synthesized
ggaatattactttaaaagta

SEQ ID NO: 586120 - DNA, 20 bp, Artificial Sequence
  chemically synthesized
tggatttcctttttaaagca

SEQ ID NO: 586121 - DNA, 20 bp, Artificial Sequence
  chemically synthesized
aagcatcgtaagtaaaatcc

SEQ ID NO: 586122 - DNA, 20 bp, Artificial Sequence
  chemically synthesized
aagcatgtggattttactta

SEQ ID NO: 586123 - DNA, 20 bp, Artificial Sequence
  chemically synthesized
ttatacatctatatttccta

SEQ ID NO: 586124 - DNA, 20 bp, Artificial Sequence
  chemically synthesized
tctatatttcctacattgtt

SEQ ID NO: 586125 - DNA, 20 bp, Artificial Sequence
  chemically synthesized
tgtgtcaaatcacagtgtat

SEQ ID NO: 586126 - DNA, 20 bp, Artificial Sequence
  chemically synthesized
tgcaataaaactaacataca

SEQ ID NO: 586127 - DNA, 20 bp, Artificial Sequence
  chemically synthesized
ataaccacttcattaccaca

SEQ ID NO: 586128 - DNA, 20 bp, Artificial Sequence
  chemically synthesized
catttacctcgtaatgtatt

SEQ ID NO: 586129 - DNA, 20 bp, Artificial Sequence
  chemically synthesized
gaggtaaatgaacatttcta

SEQ ID NO: 586130 - DNA, 20 bp, Artificial Sequence
  chemically synthesized
aaagtttactgaaaagtcaa

SEQ ID NO: 586131 - DNA, 20 bp, Artificial Sequence
  chemically synthesized
acagtgctgctcatgaacac

SEQ ID NO: 586132 - DNA, 20 bp, Artificial Sequence
  chemically synthesized
gcactgttattcattaattt

SEQ ID NO: 586133 - DNA, 20 bp, Artificial Sequence
  chemically synthesized
tattctttgaccatggagtt

SEQ ID NO: 586134 - DNA, 20 bp, Artificial Sequence
  chemically synthesized
gcttgttacctaactttagg

SEQ ID NO: 586135 - DNA, 20 bp, Artificial Sequence
  chemically synthesized
aatgcctccaggagccatta

SEQ ID NO: 586136 - DNA, 20 bp, Artificial Sequence
  chemically synthesized
caaatgaagtgaataggtga

SEQ ID NO: 586137 - DNA, 20 bp, Artificial Sequence
  chemically synthesized
aaaatccattttagaactat

SEQ ID NO: 586138 - DNA, 20 bp, Artificial Sequence
  chemically synthesized
tcaaacctcaatagttctaa

SEQ ID NO: 586139 - DNA, 20 bp, Artificial Sequence
  chemically synthesized
tagttctaaaatggatttta

SEQ ID NO: 586140 - DNA, 20 bp, Artificial Sequence
  chemically synthesized
caaaatcacattatttagtg

SEQ ID NO: 586141 - DNA, 20 bp, Artificial Sequence
  chemically synthesized
cacaaactcttcactaaata

SEQ ID NO: 586142 - DNA, 20 bp, Artificial Sequence
  chemically synthesized
ataatgtgattttggtcaca

SEQ ID NO: 586143 - DNA, 20 bp, Artificial Sequence
  chemically synthesized
tctttaaattttattgtcct

SEQ ID NO: 586144 - DNA, 20 bp, Artificial Sequence
  chemically synthesized
gagagagagagagacagaga

SEQ ID NO: 586145 - DNA, 20 bp, Artificial Sequence
  chemically synthesized
ttagtgctactttgtagagc

SEQ ID NO: 586146 - DNA, 20 bp, Artificial Sequence
  chemically synthesized
gagtgtgggaataaagtagc

SEQ ID NO: 586147 - DNA, 20 bp, Artificial Sequence
  chemically synthesized
aagcaaataagatcaaagat

SEQ ID NO: 586148 - DNA, 20 bp, Artificial Sequence
  chemically synthesized
aatcagaaatctttgatctt

SEQ ID NO: 586149 - DNA, 20 bp, Artificial Sequence
  chemically synthesized
gtccttcaagcaaataagat

SEQ ID NO: 586150 - DNA, 20 bp, Artificial Sequence
  chemically synthesized
gctgatacagaaaaatgtcc

SEQ ID NO: 586151 - DNA, 20 bp, Artificial Sequence
  chemically synthesized
ggaaatatcatttttaatat

SEQ ID NO: 586152 - DNA, 20 bp, Artificial Sequence
  chemically synthesized
tttgtttgctcattttgttc

SEQ ID NO: 586153 - DNA, 20 bp, Artificial Sequence
  chemically synthesized
taaaactgtacagatcatga

SEQ ID NO: 586154 - DNA, 20 bp, Artificial Sequence
  chemically synthesized
gaaaactaagtcatgatctg

SEQ ID NO: 586155 - DNA, 20 bp, Artificial Sequence
  chemically synthesized
ttgttatttgttatggttct

SEQ ID NO: 586156 - DNA, 20 bp, Artificial Sequence
  chemically synthesized
ccctgaggtgtctgttaaaa

SEQ ID NO: 586157 - DNA, 20 bp, Artificial Sequence
  chemically synthesized
tataaaagtaaaaagaagga

SEQ ID NO: 586158 - DNA, 20 bp, Artificial Sequence
  chemically synthesized
gaaatccatattctgaagta

SEQ ID NO: 586159 - DNA, 20 bp, Artificial Sequence
  chemically synthesized
taaatcactgtacttcagaa

SEQ ID NO: 586160 - DNA, 20 bp, Artificial Sequence
  chemically synthesized
gaggatacgtgattatgtgg

SEQ ID NO: 586161 - DNA, 20 bp, Artificial Sequence
  chemically synthesized
aaacttctgaatttgaggat

SEQ ID NO: 586162 - DNA, 20 bp, Artificial Sequence
  chemically synthesized
aatcacgtatcctcaaattc

SEQ ID NO: 586163 - DNA, 20 bp, Artificial Sequence
  chemically synthesized
ggcaccaccatccccagcta

SEQ ID NO: 586164 - DNA, 20 bp, Artificial Sequence
  chemically synthesized
ttcctcggcctcccaaagtg

SEQ ID NO: 586165 - DNA, 20 bp, Artificial Sequence
  chemically synthesized
ttgggaggccgaggaaggag

SEQ ID NO: 586166 - DNA, 20 bp, Artificial Sequence
  chemically synthesized
ccagcctgggaggcaacata

SEQ ID NO: 586167 - DNA, 20 bp, Artificial Sequence
  chemically synthesized
gggaggcaacatagtgagat

SEQ ID NO: 586168 - DNA, 20 bp, Artificial Sequence
  chemically synthesized
tcttcttctttttttttttg

SEQ ID NO: 586169 - DNA, 20 bp, Artificial Sequence
  chemically synthesized
ttctttcttcttcttttttt

SEQ ID NO: 586170 - DNA, 20 bp, Artificial Sequence
  chemically synthesized
agttacattttgataaattg

SEQ ID NO: 586171 - DNA, 20 bp, Artificial Sequence
  chemically synthesized
tttaaagttacattttgata

SEQ ID NO: 586172 - DNA, 20 bp, Artificial Sequence
  chemically synthesized
aactgatatttaaattgtat

SEQ ID NO: 586173 - DNA, 20 bp, Artificial Sequence
  chemically synthesized
tctgccctgtctaatacaat

SEQ ID NO: 586174 - DNA, 20 bp, Artificial Sequence
  chemically synthesized
gttacaagccgtactacact

SEQ ID NO: 586175 - DNA, 20 bp, Artificial Sequence
  chemically synthesized
tgcataagcaaatagtgtag

SEQ ID NO: 586176 - DNA, 20 bp, Artificial Sequence
  chemically synthesized
tctaaaaaacttgccaatct

SEQ ID NO: 586177 - DNA, 20 bp, Artificial Sequence
  chemically synthesized
tcaaaaaatcatgaagattg

SEQ ID NO: 586178 - DNA, 20 bp, Artificial Sequence
  chemically synthesized
gttacgctttcaaaaaatca

SEQ ID NO: 586179 - DNA, 20 bp, Artificial Sequence
  chemically synthesized
actgattattttctaaaatg

SEQ ID NO: 586180 - DNA, 20 bp, Artificial Sequence
  chemically synthesized
tggtatatatatttgaacac

SEQ ID NO: 586181 - DNA, 20 bp, Artificial Sequence
  chemically synthesized
tcaaatatatataccaattt

SEQ ID NO: 586182 - DNA, 20 bp, Artificial Sequence
  chemically synthesized
caataatatgaccatgaatt

SEQ ID NO: 586183 - DNA, 20 bp, Artificial Sequence
  chemically synthesized
atttcaatattttctgtcta

SEQ ID NO: 586184 - DNA, 20 bp, Artificial Sequence
  chemically synthesized
caatattttctgtctagaaa

SEQ ID NO: 586185 - DNA, 20 bp, Artificial Sequence
  chemically synthesized
agaatgagttttggagaaaa

SEQ ID NO: 586186 - DNA, 20 bp, Artificial Sequence
  chemically synthesized
tttgttttgttttttagaga

SEQ ID NO: 586187 - DNA, 20 bp, Artificial Sequence
  chemically synthesized
tctatttttgttttgttttg

SEQ ID NO: 586188 - DNA, 20 bp, Artificial Sequence
  chemically synthesized
ggttttctatttttgttttg

SEQ ID NO: 586189 - DNA, 20 bp, Artificial Sequence
  chemically synthesized
gtggtggttttctatttttg

SEQ ID NO: 586190 - DNA, 20 bp, Artificial Sequence
  chemically synthesized
tcagtgtggtggttttctat

SEQ ID NO: 586191 - DNA, 20 bp, Artificial Sequence
  chemically synthesized
ataggatttcttttcagtgt

SEQ ID NO: 586192 - DNA, 20 bp, Artificial Sequence
  chemically synthesized
attcagatgaaggcaaagga

SEQ ID NO: 586193 - DNA, 20 bp, Artificial Sequence
  chemically synthesized
tgaatggaatcattttattg

SEQ ID NO: 586194 - DNA, 20 bp, Artificial Sequence
  chemically synthesized
tatgtttaaacatgacaata

SEQ ID NO: 586195 - DNA, 20 bp, Artificial Sequence
  chemically synthesized
agaaaattttttttatattt

SEQ ID NO: 586196 - DNA, 20 bp, Artificial Sequence
  chemically synthesized
tatactatgaagcaaatgca

SEQ ID NO: 586197 - DNA, 20 bp, Artificial Sequence
  chemically synthesized
tgagtggataagcaatatgc

SEQ ID NO: 586198 - DNA, 20 bp, Artificial Sequence
  chemically synthesized
ctgattttcttctttgttag

SEQ ID NO: 586199 - DNA, 20 bp, Artificial Sequence
  chemically synthesized
aaggttaaaagttccaggga

SEQ ID NO: 586200 - DNA, 20 bp, Artificial Sequence
  chemically synthesized
attgctactcctgggaatgg

SEQ ID NO: 586201 - DNA, 20 bp, Artificial Sequence
  chemically synthesized
ctgggaatggtgatgcttag

SEQ ID NO: 586202 - DNA, 20 bp, Artificial Sequence
  chemically synthesized
ggcattggcatatgtgaagt

SEQ ID NO: 586203 - DNA, 20 bp, Artificial Sequence
  chemically synthesized
taaatttgaaaaagaaaaat

SEQ ID NO: 586204 - DNA, 20 bp, Artificial Sequence
  chemically synthesized
gacttttgccctgatttttt

SEQ ID NO: 586205 - DNA, 20 bp, Artificial Sequence
  chemically synthesized
attttggcacctgacttttg

SEQ ID NO: 586206 - DNA, 20 bp, Artificial Sequence
  chemically synthesized
gggcaaaagtcaggtgccaa

SEQ ID NO: 586207 - DNA, 20 bp, Artificial Sequence
  chemically synthesized
caaaatagttttatattctg

SEQ ID NO: 586208 - DNA, 20 bp, Artificial Sequence
  chemically synthesized
ttgggcagagggcagcaaac

SEQ ID NO: 586209 - DNA, 20 bp, Artificial Sequence
  chemically synthesized
gctgaatgtgacccataagc

SEQ ID NO: 586210 - DNA, 20 bp, Artificial Sequence
  chemically synthesized
tcagccaccatatgtctttg

SEQ ID NO: 586211 - DNA, 20 bp, Artificial Sequence
  chemically synthesized
tgtacagtttgagaactaac

SEQ ID NO: 586212 - DNA, 20 bp, Artificial Sequence
  chemically synthesized
tcacccatttattaattatt

SEQ ID NO: 586213 - DNA, 20 bp, Artificial Sequence
  chemically synthesized
cacgggacacagccatgccc

SEQ ID NO: 586214 - DNA, 20 bp, Artificial Sequence
  chemically synthesized
tatgtgtagttacgtattag

SEQ ID NO: 586215 - DNA, 20 bp, Artificial Sequence
  chemically synthesized
cggtccagatggtaaatgtt

SEQ ID NO: 586216 - DNA, 20 bp, Artificial Sequence
  chemically synthesized
tctataacggtccagatggt

SEQ ID NO: 586217 - DNA, 20 bp, Artificial Sequence
  chemically synthesized
ttaccatctggaccgttata

SEQ ID NO: 586218 - DNA, 20 bp, Artificial Sequence
  chemically synthesized
tggtcctgcctgtatttcag

SEQ ID NO: 586219 - DNA, 20 bp, Artificial Sequence
  chemically synthesized
gtgagttggtgagtgcagta

SEQ ID NO: 586220 - DNA, 20 bp, Artificial Sequence
  chemically synthesized
aattaatggatactgcattt

SEQ ID NO: 586221 - DNA, 20 bp, Artificial Sequence
  chemically synthesized
caaaaacagaccaggagggt

SEQ ID NO: 586222 - DNA, 20 bp, Artificial Sequence
  chemically synthesized
ttaaatccacgaccctcctg

SEQ ID NO: 586223 - DNA, 20 bp, Artificial Sequence
  chemically synthesized
tgtagccagtatgtacaaat

SEQ ID NO: 586224 - DNA, 20 bp, Artificial Sequence
  chemically synthesized
tccatctgggaccagctagc

SEQ ID NO: 586225 - DNA, 20 bp, Artificial Sequence
  chemically synthesized
aatttcagctaactgcgatt

SEQ ID NO: 586226 - DNA, 20 bp, Artificial Sequence
  chemically synthesized
aagtttcaaatttcagctaa

SEQ ID NO: 586227 - DNA, 20 bp, Artificial Sequence
  chemically synthesized
atgtctaccacttgaaatat

SEQ ID NO: 586228 - DNA, 20 bp, Artificial Sequence
  chemically synthesized
aatttgcattccaagaagtt

SEQ ID NO: 586229 - DNA, 20 bp, Artificial Sequence
  chemically synthesized
atttttgttttattttcttt

SEQ ID NO: 586230 - DNA, 20 bp, Artificial Sequence
  chemically synthesized
atcgtttccattttttaaat

SEQ ID NO: 586231 - DNA, 20 bp, Artificial Sequence
  chemically synthesized
ttctggcttttatgttgaca

SEQ ID NO: 586232 - DNA, 20 bp, Artificial Sequence
  chemically synthesized
attttaaaaattaatttttt

SEQ ID NO: 586233 - DNA, 20 bp, Artificial Sequence
  chemically synthesized
acatatgctgtaaaatacat

SEQ ID NO: 586234 - DNA, 20 bp, Artificial Sequence
  chemically synthesized
gcatggatgaattaaaatat

SEQ ID NO: 586235 - DNA, 20 bp, Artificial Sequence
  chemically synthesized
attctgagagatgtgtcatt

SEQ ID NO: 586236 - DNA, 20 bp, Artificial Sequence
  chemically synthesized
gtttgtgtaggtacacacta

SEQ ID NO: 586237 - DNA, 20 bp, Artificial Sequence
  chemically synthesized
tagtaggctatatgtaccac

SEQ ID NO: 586238 - DNA, 20 bp, Artificial Sequence
  chemically synthesized
atacctttttctatgtttag

SEQ ID NO: 586239 - DNA, 20 bp, Artificial Sequence
  chemically synthesized
taggtttaccataccttttt

SEQ ID NO: 586240 - DNA, 20 bp, Artificial Sequence
  chemically synthesized
tctaataggattataataca

SEQ ID NO: 586241 - DNA, 20 bp, Artificial Sequence
  chemically synthesized
atatatacactggtgatcta

SEQ ID NO: 586242 - DNA, 20 bp, Artificial Sequence
  chemically synthesized
tattagatcaccagtgtata

SEQ ID NO: 586243 - DNA, 20 bp, Artificial Sequence
  chemically synthesized
tacagtcatgctatgtgtaa

SEQ ID NO: 586244 - DNA, 20 bp, Artificial Sequence
  chemically synthesized
atagcatgactgtatttttg

SEQ ID NO: 586245 - DNA, 20 bp, Artificial Sequence
  chemically synthesized
aggtgaaatttatttggatt

SEQ ID NO: 586246 - DNA, 20 bp, Artificial Sequence
  chemically synthesized
aaataaacaggtgaaattta

SEQ ID NO: 586247 - DNA, 20 bp, Artificial Sequence
  chemically synthesized
atataatccaaataaatttc

SEQ ID NO: 586248 - DNA, 20 bp, Artificial Sequence
  chemically synthesized
ttactattttaatgtggcca

SEQ ID NO: 586249 - DNA, 20 bp, Artificial Sequence
  chemically synthesized
acgctctgtaataatgcaat

SEQ ID NO: 586250 - DNA, 20 bp, Artificial Sequence
  chemically synthesized
ccatagatgtcaaaagtcat

SEQ ID NO: 586251 - DNA, 20 bp, Artificial Sequence
  chemically synthesized
gagttttagtatatcttcta

SEQ ID NO: 586252 - DNA, 20 bp, Artificial Sequence
  chemically synthesized
taataaaaggtaagaggtaa

SEQ ID NO: 586253 - DNA, 20 bp, Artificial Sequence
  chemically synthesized
tatttgatgctccttcatac

SEQ ID NO: 586254 - DNA, 20 bp, Artificial Sequence
  chemically synthesized
ctactatttgatgctccttc

SEQ ID NO: 586255 - DNA, 20 bp, Artificial Sequence
  chemically synthesized
cgtatgaaggagcatcaaat

SEQ ID NO: 586256 - DNA, 20 bp, Artificial Sequence
  chemically synthesized
tcttgaacaaggtgtcccca

SEQ ID NO: 586257 - DNA, 20 bp, Artificial Sequence
  chemically synthesized
catgggattaacatacgtaa

SEQ ID NO: 586258 - DNA, 20 bp, Artificial Sequence
  chemically synthesized
ggaggccagaaattaaccac

SEQ ID NO: 586259 - DNA, 20 bp, Artificial Sequence
  chemically synthesized
atgtggttaatttctggcct

SEQ ID NO: 586260 - DNA, 20 bp, Artificial Sequence
  chemically synthesized
tgtgcatgaaaccagaaccc

SEQ ID NO: 586261 - DNA, 20 bp, Artificial Sequence
  chemically synthesized
ttcagacaaaactgtagggt

SEQ ID NO: 586262 - DNA, 20 bp, Artificial Sequence
  chemically synthesized
ctacagttttgtctgaagca

SEQ ID NO: 586263 - DNA, 20 bp, Artificial Sequence
  chemically synthesized
ccaaaaatgtaggacaagca

SEQ ID NO: 586264 - DNA, 20 bp, Artificial Sequence
  chemically synthesized
ctcagatgaggatgcctggt

SEQ ID NO: 586265 - DNA, 20 bp, Artificial Sequence
  chemically synthesized
tgcctctctctctttccttc

SEQ ID NO: 586266 - DNA, 20 bp, Artificial Sequence
  chemically synthesized
gaaaaagggaagtgagagtt

SEQ ID NO: 586267 - DNA, 20 bp, Artificial Sequence
  chemically synthesized
gggaagggacagtaactaac

SEQ ID NO: 586268 - DNA, 20 bp, Artificial Sequence
  chemically synthesized
aaggatactcagggaaggcc

SEQ ID NO: 586269 - DNA, 20 bp, Artificial Sequence
  chemically synthesized
ctgaaaaatgcagacatttg

SEQ ID NO: 586270 - DNA, 20 bp, Artificial Sequence
  chemically synthesized
agattaattctgaggtccct

SEQ ID NO: 586271 - DNA, 20 bp, Artificial Sequence
  chemically synthesized
tccattccctgccagagaca

SEQ ID NO: 586272 - DNA, 20 bp, Artificial Sequence
  chemically synthesized
acacagccctgaacgtgtca

SEQ ID NO: 586273 - DNA, 20 bp, Artificial Sequence
  chemically synthesized
gaacacaaaagatcttctct

SEQ ID NO: 586274 - DNA, 20 bp, Artificial Sequence
  chemically synthesized
atcttctctgagggtttatt

SEQ ID NO: 586275 - DNA, 20 bp, Artificial Sequence
  chemically synthesized
tgacagggtatcctgttgtc

SEQ ID NO: 586276 - DNA, 20 bp, Artificial Sequence
  chemically synthesized
ccctgtcaccctaagcagat

SEQ ID NO: 586277 - DNA, 20 bp, Artificial Sequence
  chemically synthesized
gtgaagaaaattaagcttac

SEQ ID NO: 586278 - DNA, 20 bp, Artificial Sequence
  chemically synthesized
ttatcttgctgtgaagaaaa

SEQ ID NO: 586279 - DNA, 20 bp, Artificial Sequence
  chemically synthesized
ctaacaaagcaattttggat

SEQ ID NO: 586280 - DNA, 20 bp, Artificial Sequence
  chemically synthesized
tgtgttaagccctcatccaa

SEQ ID NO: 586281 - DNA, 20 bp, Artificial Sequence
  chemically synthesized
aatggctggaacaccatggc

SEQ ID NO: 586282 - DNA, 20 bp, Artificial Sequence
  chemically synthesized
ggtgttccagccatttattt

SEQ ID NO: 586283 - DNA, 20 bp, Artificial Sequence
  chemically synthesized
gagtcccggctttggaggaa

SEQ ID NO: 586284 - DNA, 20 bp, Artificial Sequence
  chemically synthesized
acaggttatctggcaggagt

SEQ ID NO: 586285 - DNA, 20 bp, Artificial Sequence
  chemically synthesized
ctaacaattttgtccagccc

SEQ ID NO: 586286 - DNA, 20 bp, Artificial Sequence
  chemically synthesized
gatgtggcaacattttaggc

SEQ ID NO: 586287 - DNA, 20 bp, Artificial Sequence
  chemically synthesized
tattctcaggccttgggaac

SEQ ID NO: 586288 - DNA, 20 bp, Artificial Sequence
  chemically synthesized
aggtcctctgcattttccta

SEQ ID NO: 586289 - DNA, 20 bp, Artificial Sequence
  chemically synthesized
acgtcccgggggaaactcac

SEQ ID NO: 586290 - DNA, 20 bp, Artificial Sequence
  chemically synthesized
aaagatgccccaaaacttct

SEQ ID NO: 586291 - DNA, 20 bp, Artificial Sequence
  chemically synthesized
agttgggaacagagcaagtt

SEQ ID NO: 586292 - DNA, 20 bp, Artificial Sequence
  chemically synthesized
tatgcctccaaggctgtgtg

SEQ ID NO: 586293 - DNA, 20 bp, Artificial Sequence
  chemically synthesized
gtcgcagtatctactgtgta

SEQ ID NO: 586294 - DNA, 20 bp, Artificial Sequence
  chemically synthesized
cagtagatactgcgactttg

SEQ ID NO: 586295 - DNA, 20 bp, Artificial Sequence
  chemically synthesized
ttcagatttgttgttttaat

SEQ ID NO: 586296 - DNA, 20 bp, Artificial Sequence
  chemically synthesized
aaagaccatggcttcagatt

SEQ ID NO: 586297 - DNA, 20 bp, Artificial Sequence
  chemically synthesized
gtgatgaaaaagaccatggc

SEQ ID NO: 586298 - DNA, 20 bp, Artificial Sequence
  chemically synthesized
ataaaagtgatgaaaaagac

SEQ ID NO: 586299 - DNA, 20 bp, Artificial Sequence
  chemically synthesized
ttatataaattactcagagt

SEQ ID NO: 586300 - DNA, 20 bp, Artificial Sequence
  chemically synthesized
ttttaaatttttttttaaat

SEQ ID NO: 586301 - DNA, 20 bp, Artificial Sequence
  chemically synthesized
atttaaaaaaaaatttaaaa

SEQ ID NO: 586302 - DNA, 20 bp, Artificial Sequence
  chemically synthesized
agtaaccaactaaccaattc

SEQ ID NO: 586303 - DNA, 20 bp, Artificial Sequence
  chemically synthesized
taagtgttcatagaagggag

SEQ ID NO: 586304 - DNA, 20 bp, Artificial Sequence
  chemically synthesized
catcacttggtaattgaatt

SEQ ID NO: 586305 - DNA, 20 bp, Artificial Sequence
  chemically synthesized
agacaggaggcaggagagaa

SEQ ID NO: 586306 - DNA, 20 bp, Artificial Sequence
  chemically synthesized
ggctgcgcagaatagctttc

SEQ ID NO: 586307 - DNA, 20 bp, Artificial Sequence
  chemically synthesized
ccttttaatgggctgcgcag

SEQ ID NO: 586308 - DNA, 20 bp, Artificial Sequence
  chemically synthesized
ttaaaaggtactctgttggc

SEQ ID NO: 586309 - DNA, 20 bp, Artificial Sequence
  chemically synthesized
ttcttcttcctcacacactg

SEQ ID NO: 586310 - DNA, 20 bp, Artificial Sequence
  chemically synthesized
aaaaaatactgaaaagtatc

SEQ ID NO: 586311 - DNA, 20 bp, Artificial Sequence
  chemically synthesized
caacaaaaaatactgaaaag

SEQ ID NO: 586312 - DNA, 20 bp, Artificial Sequence
  chemically synthesized
ttgtagtatttgggacatag

SEQ ID NO: 586313 - DNA, 20 bp, Artificial Sequence
  chemically synthesized
atagttatgcttagaattct

SEQ ID NO: 586314 - DNA, 20 bp, Artificial Sequence
  chemically synthesized
ttcaaatcatattcagctgg

SEQ ID NO: 586315 - DNA, 20 bp, Artificial Sequence
  chemically synthesized
aagaaaacaataccagctga

SEQ ID NO: 586316 - DNA, 20 bp, Artificial Sequence
  chemically synthesized
taccagctgaatatgatttg

SEQ ID NO: 586317 - DNA, 20 bp, Artificial Sequence
  chemically synthesized
gagttttgtgtgccatgaca

SEQ ID NO: 586318 - DNA, 20 bp, Artificial Sequence
  chemically synthesized
cagggataaacacttttgaa

SEQ ID NO: 586319 - DNA, 20 bp, Artificial Sequence
  chemically synthesized
tttgtataaactcttttcaa

SEQ ID NO: 586320 - DNA, 20 bp, Artificial Sequence
  chemically synthesized
tttatacaaagttgacttta

SEQ ID NO: 586321 - DNA, 20 bp, Artificial Sequence
  chemically synthesized
ttactggggcttgacttctt

SEQ ID NO: 586322 - DNA, 20 bp, Artificial Sequence
  chemically synthesized
agctctgttcatgccattac

SEQ ID NO: 586323 - DNA, 20 bp, Artificial Sequence
  chemically synthesized
aatggcatgaacagagctca

SEQ ID NO: 586324 - DNA, 20 bp, Artificial Sequence
  chemically synthesized
tccagccactaagtatctac

SEQ ID NO: 586325 - DNA, 20 bp, Artificial Sequence
  chemically synthesized
tcacaggtcagccatgtcag

SEQ ID NO: 586326 - DNA, 20 bp, Artificial Sequence
  chemically synthesized
tctgcacattgccaatatct

SEQ ID NO: 586327 - DNA, 20 bp, Artificial Sequence
  chemically synthesized
ttgccaatatctctgtgctt

SEQ ID NO: 586328 - DNA, 20 bp, Artificial Sequence
  chemically synthesized
gaaatccaagaaaaattatg

SEQ ID NO: 586329 - DNA, 20 bp, Artificial Sequence
  chemically synthesized
taaagcgcggcataattttt

SEQ ID NO: 586330 - DNA, 20 bp, Artificial Sequence
  chemically synthesized
tttttcttggatttcccctt

SEQ ID NO: 586331 - DNA, 20 bp, Artificial Sequence
  chemically synthesized
ttacatttgaggatgaactt

SEQ ID NO: 586332 - DNA, 20 bp, Artificial Sequence
  chemically synthesized
gaaatggaaaaggataaagt

SEQ ID NO: 586333 - DNA, 20 bp, Artificial Sequence
  chemically synthesized
aaaaagtaaggataaatggt

SEQ ID NO: 586334 - DNA, 20 bp, Artificial Sequence
  chemically synthesized
caaactttttcagggaaaga

SEQ ID NO: 586335 - DNA, 20 bp, Artificial Sequence
  chemically synthesized
caagctacttctttccctga

SEQ ID NO: 586336 - DNA, 20 bp, Artificial Sequence
  chemically synthesized
gtttgggtgatccttagcat

SEQ ID NO: 586337 - DNA, 20 bp, Artificial Sequence
  chemically synthesized
tccaatttaggaagaccctg

SEQ ID NO: 586338 - DNA, 20 bp, Artificial Sequence
  chemically synthesized
ttctatcattgatagtttag

SEQ ID NO: 586339 - DNA, 20 bp, Artificial Sequence
  chemically synthesized
aaaatttgacttctatcatt

SEQ ID NO: 586340 - DNA, 20 bp, Artificial Sequence
  chemically synthesized
tttactctttcccccagcat

SEQ ID NO: 586341 - DNA, 20 bp, Artificial Sequence
  chemically synthesized
ggttcattattaagaaaaca

SEQ ID NO: 586342 - DNA, 20 bp, Artificial Sequence
  chemically synthesized
aaaattgaaaaaaataagca

SEQ ID NO: 586343 - DNA, 20 bp, Artificial Sequence
  chemically synthesized
ttttaaaaacgtataatttg

SEQ ID NO: 586344 - DNA, 20 bp, Artificial Sequence
  chemically synthesized
aaaggaaatcataacaaatt

SEQ ID NO: 586345 - DNA, 20 bp, Artificial Sequence
  chemically synthesized
aaatataaaattaggtatga

SEQ ID NO: 586346 - DNA, 20 bp, Artificial Sequence
  chemically synthesized
cttgaagcacattctaattt

SEQ ID NO: 586347 - DNA, 20 bp, Artificial Sequence
  chemically synthesized
aagaaaactgccaaattaga

SEQ ID NO: 586348 - DNA, 20 bp, Artificial Sequence
  chemically synthesized
ctgccaaattagaatgtgct

SEQ ID NO: 586349 - DNA, 20 bp, Artificial Sequence
  chemically synthesized
tttcagaaaaccagatctac

SEQ ID NO: 586350 - DNA, 20 bp, Artificial Sequence
  chemically synthesized
aaagaataagcagaggtaga

SEQ ID NO: 586351 - DNA, 20 bp, Artificial Sequence
  chemically synthesized
tattttaggatactgaatga

SEQ ID NO: 586352 - DNA, 20 bp, Artificial Sequence
  chemically synthesized
tggggtcttcaaagtaaaag

SEQ ID NO: 586353 - DNA, 20 bp, Artificial Sequence
  chemically synthesized
ttcttttactttgaagaccc

SEQ ID NO: 586354 - DNA, 20 bp, Artificial Sequence
  chemically synthesized
attttttatttttgttttct

SEQ ID NO: 586355 - DNA, 20 bp, Artificial Sequence
  chemically synthesized
aaaaagaaaacaaaaataaa

SEQ ID NO: 586356 - DNA, 20 bp, Artificial Sequence
  chemically synthesized
cagataaaatcattttttat

SEQ ID NO: 586357 - DNA, 20 bp, Artificial Sequence
  chemically synthesized
aagtagtacattaaaactag

SEQ ID NO: 586358 - DNA, 20 bp, Artificial Sequence
  chemically synthesized
aattttagatcaaaaactca

SEQ ID NO: 586359 - DNA, 20 bp, Artificial Sequence
  chemically synthesized
taaaatttaaaaataattag

SEQ ID NO: 586360 - DNA, 20 bp, Artificial Sequence
  chemically synthesized
agaacaacattttacaattt

SEQ ID NO: 586361 - DNA, 20 bp, Artificial Sequence
  chemically synthesized
ttttcttttattattgtact

SEQ ID NO: 586362 - DNA, 20 bp, Artificial Sequence
  chemically synthesized
cacctatgagtgagaacatg

SEQ ID NO: 586363 - DNA, 20 bp, Artificial Sequence
  chemically synthesized
atgagtgagaacatgcggtg

SEQ ID NO: 586364 - DNA, 20 bp, Artificial Sequence
  chemically synthesized
gtttggttttttgttcttgc

SEQ ID NO: 586365 - DNA, 20 bp, Artificial Sequence
  chemically synthesized
ttgcgacagtttactgagaa

SEQ ID NO: 586366 - DNA, 20 bp, Artificial Sequence
  chemically synthesized
caaatgtccaacaatgatag

SEQ ID NO: 586367 - DNA, 20 bp, Artificial Sequence
  chemically synthesized
ctataaagacacatgcacac

SEQ ID NO: 586368 - DNA, 20 bp, Artificial Sequence
  chemically synthesized
gtgcatgtgtctttatagca

SEQ ID NO: 586369 - DNA, 20 bp, Artificial Sequence
  chemically synthesized
aaccattgtggaagtcggtg

SEQ ID NO: 586370 - DNA, 20 bp, Artificial Sequence
  chemically synthesized
ccgacttccacaatggttga

SEQ ID NO: 586371 - DNA, 20 bp, Artificial Sequence
  chemically synthesized
tccacatcctctccagcacc

SEQ ID NO: 586372 - DNA, 20 bp, Artificial Sequence
  chemically synthesized
cctgttgtttcctgactttt

SEQ ID NO: 586373 - DNA, 20 bp, Artificial Sequence
  chemically synthesized
ggtgtgagatggtatctcat

SEQ ID NO: 586374 - DNA, 20 bp, Artificial Sequence
  chemically synthesized
gagatggtatctcattgtgg

SEQ ID NO: 586375 - DNA, 20 bp, Artificial Sequence
  chemically synthesized
gtgatggtgagcattttttc

SEQ ID NO: 586376 - DNA, 20 bp, Artificial Sequence
  chemically synthesized
cttcgcccactttttgatgg

SEQ ID NO: 586377 - DNA, 20 bp, Artificial Sequence
  chemically synthesized
gcccactttttgatggggtt

SEQ ID NO: 586378 - DNA, 20 bp, Artificial Sequence
  chemically synthesized
gtaaatttgttggagttcat

SEQ ID NO: 586379 - DNA, 20 bp, Artificial Sequence
  chemically synthesized
ggttgcctgttcactctgat

SEQ ID NO: 586380 - DNA, 20 bp, Artificial Sequence
  chemically synthesized
cttttgctgtgcagaagctc

SEQ ID NO: 586381 - DNA, 20 bp, Artificial Sequence
  chemically synthesized
aatgggatctaattaaacta

SEQ ID NO: 586382 - DNA, 20 bp, Artificial Sequence
  chemically synthesized
attagatcccatttgtcaat

SEQ ID NO: 586383 - DNA, 20 bp, Artificial Sequence
  chemically synthesized
caattttggcttttgttgcc

SEQ ID NO: 586384 - DNA, 20 bp, Artificial Sequence
  chemically synthesized
gcttttgttgccattggttt

SEQ ID NO: 586385 - DNA, 20 bp, Artificial Sequence
  chemically synthesized
gtccttcacatcccttgtaa

SEQ ID NO: 586386 - DNA, 20 bp, Artificial Sequence
  chemically synthesized
cctcttttatttccttgagc

SEQ ID NO: 586387 - DNA, 20 bp, Artificial Sequence
  chemically synthesized
tgagcatggaatgttcttcc

SEQ ID NO: 586388 - DNA, 20 bp, Artificial Sequence
  chemically synthesized
cagtatgaccattttcacga

SEQ ID NO: 586389 - DNA, 20 bp, Artificial Sequence
  chemically synthesized
tcatactgcccaaggtaatt

SEQ ID NO: 586390 - DNA, 20 bp, Artificial Sequence
  chemically synthesized
attctgtgaagaaaggcatt

SEQ ID NO: 586391 - DNA, 20 bp, Artificial Sequence
  chemically synthesized
tggttccatatgaactttaa

SEQ ID NO: 586392 - DNA, 20 bp, Artificial Sequence
  chemically synthesized
tccagctttgttcttttggc

SEQ ID NO: 586393 - DNA, 20 bp, Artificial Sequence
  chemically synthesized
aagtcaggtagtgtgatgcc

SEQ ID NO: 586394 - DNA, 20 bp, Artificial Sequence
  chemically synthesized
tggttactgtagccttgtag

SEQ ID NO: 586395 - DNA, 20 bp, Artificial Sequence
  chemically synthesized
ctgttttggtaccagtacca

SEQ ID NO: 586396 - DNA, 20 bp, Artificial Sequence
  chemically synthesized
tctgttccattgatctatat

SEQ ID NO: 586397 - DNA, 20 bp, Artificial Sequence
  chemically synthesized
ttccccattgcttgtttttc

SEQ ID NO: 586398 - DNA, 20 bp, Artificial Sequence
  chemically synthesized
gagaaaaacaagcaatgggg

SEQ ID NO: 586399 - DNA, 20 bp, Artificial Sequence
  chemically synthesized
tagggaatcctttccccatt

SEQ ID NO: 586400 - DNA, 20 bp, Artificial Sequence
  chemically synthesized
taaatagggaatcctttccc

SEQ ID NO: 586401 - DNA, 20 bp, Artificial Sequence
  chemically synthesized
tggctagccaattttcccag

SEQ ID NO: 586402 - DNA, 20 bp, Artificial Sequence
  chemically synthesized
gtgtaaggaagggatccagt

SEQ ID NO: 586403 - DNA, 20 bp, Artificial Sequence
  chemically synthesized
tataaggtgtaaggaaggga

SEQ ID NO: 586404 - DNA, 20 bp, Artificial Sequence
  chemically synthesized
ttatacaaaaatcaattcaa

SEQ ID NO: 586405 - DNA, 20 bp, Artificial Sequence
  chemically synthesized
taagtctttaatccatcttg

SEQ ID NO: 586406 - DNA, 20 bp, Artificial Sequence
  chemically synthesized
ggtttttatggttttaggtc

SEQ ID NO: 586407 - DNA, 20 bp, Artificial Sequence
  chemically synthesized
aggttatcttctagggtttt

SEQ ID NO: 586408 - DNA, 20 bp, Artificial Sequence
  chemically synthesized
gtaatgcctaggttatcttc

SEQ ID NO: 586409 - DNA, 20 bp, Artificial Sequence
  chemically synthesized
aatttcttttcttaaggaat

SEQ ID NO: 586410 - DNA, 20 bp, Artificial Sequence
  chemically synthesized
tgatggtttgagtaatcctt

SEQ ID NO: 586411 - DNA, 20 bp, Artificial Sequence
  chemically synthesized
catgtaaagggtaaaaccct

SEQ ID NO: 586412 - DNA, 20 bp, Artificial Sequence
  chemically synthesized
acatgttacaacctgttgca

SEQ ID NO: 586413 - DNA, 20 bp, Artificial Sequence
  chemically synthesized
acagaagaatagcgaataac

SEQ ID NO: 586414 - DNA, 20 bp, Artificial Sequence
  chemically synthesized
agaatagcgaataacagggg

SEQ ID NO: 586415 - DNA, 20 bp, Artificial Sequence
  chemically synthesized
caaagctatttcccctcatg

SEQ ID NO: 586416 - DNA, 20 bp, Artificial Sequence
  chemically synthesized
gaaaacacatcatgagggga

SEQ ID NO: 586417 - DNA, 20 bp, Artificial Sequence
  chemically synthesized
agtattgactttagaatact

SEQ ID NO: 586418 - DNA, 20 bp, Artificial Sequence
  chemically synthesized
ggtggtgtttcatacatatt

SEQ ID NO: 586419 - DNA, 20 bp, Artificial Sequence
  chemically synthesized
cattttcactttacctttgg

SEQ ID NO: 586420 - DNA, 20 bp, Artificial Sequence
  chemically synthesized
ggagcacactgcaattgaat

SEQ ID NO: 586421 - DNA, 20 bp, Artificial Sequence
  chemically synthesized
ctatgccaaggtcatatctt

SEQ ID NO: 586422 - DNA, 20 bp, Artificial Sequence
  chemically synthesized
tggcataggcacattatttc

SEQ ID NO: 586423 - DNA, 20 bp, Artificial Sequence
  chemically synthesized
cattatttcagctgcttagc

SEQ ID NO: 586424 - DNA, 20 bp, Artificial Sequence
  chemically synthesized
aaatgcattttcttataaaa

SEQ ID NO: 586425 - DNA, 20 bp, Artificial Sequence
  chemically synthesized
ttcagtgcactggatttatg

SEQ ID NO: 586426 - DNA, 20 bp, Artificial Sequence
  chemically synthesized
cagaaaattatattcagtgc

SEQ ID NO: 586427 - DNA, 20 bp, Artificial Sequence
  chemically synthesized
ccagtgcactgaatataatt

SEQ ID NO: 586428 - DNA, 20 bp, Artificial Sequence
  chemically synthesized
acgatctagtcttttgaaga

SEQ ID NO: 586429 - DNA, 20 bp, Artificial Sequence
  chemically synthesized
aaataaaatcagcaggtgcc

SEQ ID NO: 586430 - DNA, 20 bp, Artificial Sequence
  chemically synthesized
tccaaaaatcaataggcacc

SEQ ID NO: 586431 - DNA, 20 bp, Artificial Sequence
  chemically synthesized
actttttttcagtcttacga

SEQ ID NO: 586432 - DNA, 20 bp, Artificial Sequence
  chemically synthesized
tagttgtatcgatatttacc

SEQ ID NO: 586433 - DNA, 20 bp, Artificial Sequence
  chemically synthesized
tcgatacaactatttaatat

SEQ ID NO: 586434 - DNA, 20 bp, Artificial Sequence
  chemically synthesized
taatatgactgattttcaaa

SEQ ID NO: 586435 - DNA, 20 bp, Artificial Sequence
  chemically synthesized
caactcctagagacaacaaa

SEQ ID NO: 586436 - DNA, 20 bp, Artificial Sequence
  chemically synthesized
aggacgatatacattccata

SEQ ID NO: 586437 - DNA, 20 bp, Artificial Sequence
  chemically synthesized
cacagcagaatcaattgggt

SEQ ID NO: 586438 - DNA, 20 bp, Artificial Sequence
  chemically synthesized
taaaacaaaaactcctaccc

SEQ ID NO: 586439 - DNA, 20 bp, Artificial Sequence
  chemically synthesized
agaatcaattgggtaggagt

SEQ ID NO: 586440 - DNA, 20 bp, Artificial Sequence
  chemically synthesized
gggtaggagtttttgtttta

SEQ ID NO: 586441 - DNA, 20 bp, Artificial Sequence
  chemically synthesized
tggaattagattctctggta

SEQ ID NO: 586442 - DNA, 20 bp, Artificial Sequence
  chemically synthesized
ataccagagaatctaattcc

SEQ ID NO: 586443 - DNA, 20 bp, Artificial Sequence
  chemically synthesized
ctccattacaaacttatgga

SEQ ID NO: 586444 - DNA, 20 bp, Artificial Sequence
  chemically synthesized
tctatttataatatagaaat

SEQ ID NO: 586445 - DNA, 20 bp, Artificial Sequence
  chemically synthesized
gtttgtgtgggctctagcag

SEQ ID NO: 586446 - DNA, 20 bp, Artificial Sequence
  chemically synthesized
ttcttactactaataggcat

SEQ ID NO: 586447 - DNA, 20 bp, Artificial Sequence
  chemically synthesized
tattagtagtaagaaaatga

SEQ ID NO: 586448 - DNA, 20 bp, Artificial Sequence
  chemically synthesized
cattctcaatctgcatttac

SEQ ID NO: 586449 - DNA, 20 bp, Artificial Sequence
  chemically synthesized
cttagtaaatctgaggtaaa

SEQ ID NO: 586450 - DNA, 20 bp, Artificial Sequence
  chemically synthesized
tttactgcactacacttgac

SEQ ID NO: 586451 - DNA, 20 bp, Artificial Sequence
  chemically synthesized
gtccttccagctcttaactt

SEQ ID NO: 586452 - DNA, 20 bp, Artificial Sequence
  chemically synthesized
tgcattatgacttatgtgcc

SEQ ID NO: 586453 - DNA, 20 bp, Artificial Sequence
  chemically synthesized
tgacttatgtgcctttggat

SEQ ID NO: 586454 - DNA, 20 bp, Artificial Sequence
  chemically synthesized
tctgttctacaaaagaagaa

SEQ ID NO: 586455 - DNA, 20 bp, Artificial Sequence
  chemically synthesized
cttttattttgcatcactga

SEQ ID NO: 586456 - DNA, 20 bp, Artificial Sequence
  chemically synthesized
ataacacatgggaattcaac

SEQ ID NO: 586457 - DNA, 20 bp, Artificial Sequence
  chemically synthesized
agcacaggaaagacctgccc

SEQ ID NO: 586458 - DNA, 20 bp, Artificial Sequence
  chemically synthesized
aggtctttcctgtgctgttc

SEQ ID NO: 586459 - DNA, 20 bp, Artificial Sequence
  chemically synthesized
gaataagtctcatgagatct

SEQ ID NO: 586460 - DNA, 20 bp, Artificial Sequence
  chemically synthesized
gatctgatggttttgaaaag

SEQ ID NO: 586461 - DNA, 20 bp, Artificial Sequence
  chemically synthesized
agagagcttttggagggaaa

SEQ ID NO: 586462 - DNA, 20 bp, Artificial Sequence
  chemically synthesized
ggatgggcagcagtcaaaga

SEQ ID NO: 586463 - DNA, 20 bp, Artificial Sequence
  chemically synthesized
ctgggcaatttacaaaagaa

SEQ ID NO: 586464 - DNA, 20 bp, Artificial Sequence
  chemically synthesized
tgcatgttacgcacttccaa

SEQ ID NO: 586465 - DNA, 20 bp, Artificial Sequence
  chemically synthesized
gcgtaacatgcagagtctgg

SEQ ID NO: 586466 - DNA, 20 bp, Artificial Sequence
  chemically synthesized
cagaagaaaggaaaatgtgg

SEQ ID NO: 586467 - DNA, 20 bp, Artificial Sequence
  chemically synthesized
ggaaaaaatatatatctcaa

SEQ ID NO: 586468 - DNA, 20 bp, Artificial Sequence
  chemically synthesized
tagagactggaggtctacaa

SEQ ID NO: 586469 - DNA, 20 bp, Artificial Sequence
  chemically synthesized
gagggactcatttttaagaa

SEQ ID NO: 586470 - DNA, 20 bp, Artificial Sequence
  chemically synthesized
aaatgagtccctcccctgtg

SEQ ID NO: 586471 - DNA, 20 bp, Artificial Sequence
  chemically synthesized
ccattaaagacagtagattc

SEQ ID NO: 586472 - DNA, 20 bp, Artificial Sequence
  chemically synthesized
aactctgtcccattaaagac

SEQ ID NO: 586473 - DNA, 20 bp, Artificial Sequence
  chemically synthesized
ccaccgcccttactcagaga

SEQ ID NO: 586474 - DNA, 20 bp, Artificial Sequence
  chemically synthesized
gatctcttagcatggtggct

SEQ ID NO: 586475 - DNA, 20 bp, Artificial Sequence
  chemically synthesized
ttgaaaaggtatgtttgggc

SEQ ID NO: 586476 - DNA, 20 bp, Artificial Sequence
  chemically synthesized
ttgtgtttgacattgaaaag

SEQ ID NO: 586477 - DNA, 20 bp, Artificial Sequence
  chemically synthesized
tcctgaatagagcaaggtga

SEQ ID NO: 586478 - DNA, 20 bp, Artificial Sequence
  chemically synthesized
gattcctcctgaatagagca

SEQ ID NO: 586479 - DNA, 20 bp, Artificial Sequence
  chemically synthesized
ggaggaatcctaccataata

SEQ ID NO: 586480 - DNA, 20 bp, Artificial Sequence
  chemically synthesized
actgtaaacaaaatattatg

SEQ ID NO: 586481 - DNA, 20 bp, Artificial Sequence
  chemically synthesized
tgcagtactcaagagaagag

SEQ ID NO: 586482 - DNA, 20 bp, Artificial Sequence
  chemically synthesized
tcttttgtggtccaaggcca

SEQ ID NO: 586483 - DNA, 20 bp, Artificial Sequence
  chemically synthesized
caaggccattttgcttctgc

SEQ ID NO: 586484 - DNA, 20 bp, Artificial Sequence
  chemically synthesized
gaaagtaattatgtggaaag

SEQ ID NO: 586485 - DNA, 20 bp, Artificial Sequence
  chemically synthesized
atcctccctttgcctcgtag

SEQ ID NO: 586486 - DNA, 20 bp, Artificial Sequence
  chemically synthesized
agctatactacgaggcaaag

SEQ ID NO: 586487 - DNA, 20 bp, Artificial Sequence
  chemically synthesized
gaggcaaagggaggattatg

SEQ ID NO: 586488 - DNA, 20 bp, Artificial Sequence
  chemically synthesized
gggtttagggttactctctc

SEQ ID NO: 586489 - DNA, 20 bp, Artificial Sequence
  chemically synthesized
aaataataaaggaatagaca

SEQ ID NO: 586490 - DNA, 20 bp, Artificial Sequence
  chemically synthesized
tgtcatattaataagatgtt

SEQ ID NO: 586491 - DNA, 20 bp, Artificial Sequence
  chemically synthesized
cactaggatcatggaaataa

SEQ ID NO: 586492 - DNA, 20 bp, Artificial Sequence
  chemically synthesized
tccatgatcctagtgacttt

SEQ ID NO: 586493 - DNA, 20 bp, Artificial Sequence
  chemically synthesized
gtatgtatttattgtgtaca

SEQ ID NO: 586494 - DNA, 20 bp, Artificial Sequence
  chemically synthesized
ttatcatttttttatggtga

SEQ ID NO: 586495 - DNA, 20 bp, Artificial Sequence
  chemically synthesized
ttgtattcttgaaaattgcc

SEQ ID NO: 586496 - DNA, 20 bp, Artificial Sequence
  chemically synthesized
aagcagatacctaaaaggaa

SEQ ID NO: 586497 - DNA, 20 bp, Artificial Sequence
  chemically synthesized
aatctccattccttttaggt

SEQ ID NO: 586498 - DNA, 20 bp, Artificial Sequence
  chemically synthesized
atttatggaatgaacaaacc

SEQ ID NO: 586499 - DNA, 20 bp, Artificial Sequence
  chemically synthesized
ttcattaaagaaataaaaca

SEQ ID NO: 586500 - DNA, 20 bp, Artificial Sequence
  chemically synthesized
tgttgttgattgacagaagt

SEQ ID NO: 586501 - DNA, 20 bp, Artificial Sequence
  chemically synthesized
gaagttggttgattgattgt

SEQ ID NO: 586502 - DNA, 20 bp, Artificial Sequence
  chemically synthesized
aagttactttgaagttggtt

SEQ ID NO: 586503 - DNA, 20 bp, Artificial Sequence
  chemically synthesized
agagaagttactttgaagtt

SEQ ID NO: 586504 - DNA, 20 bp, Artificial Sequence
  chemically synthesized
tagcagccttagtatcaaat

SEQ ID NO: 586505 - DNA, 20 bp, Artificial Sequence
  chemically synthesized
cactgaactttgcatatcaa

SEQ ID NO: 586506 - DNA, 20 bp, Artificial Sequence
  chemically synthesized
ggttcagcgaggttaactgg

SEQ ID NO: 586507 - DNA, 20 bp, Artificial Sequence
  chemically synthesized
ggccagttaacctcgctgaa

SEQ ID NO: 586508 - DNA, 20 bp, Artificial Sequence
  chemically synthesized
ggaaatactgtgcaacatat

SEQ ID NO: 586509 - DNA, 20 bp, Artificial Sequence
  chemically synthesized
agctaattttttcagaattt

SEQ ID NO: 586510 - DNA, 20 bp, Artificial Sequence
  chemically synthesized
cataaaattctgaaaaaatt

SEQ ID NO: 586511 - DNA, 20 bp, Artificial Sequence
  chemically synthesized
gcaaattagtactgctctta

SEQ ID NO: 586512 - DNA, 20 bp, Artificial Sequence
  chemically synthesized
atataagagcagtactaatt

SEQ ID NO: 586513 - DNA, 20 bp, Artificial Sequence
  chemically synthesized
gtgatgaaaattagtaaaca

SEQ ID NO: 586514 - DNA, 20 bp, Artificial Sequence
  chemically synthesized
atttattagtagcaaaatct

SEQ ID NO: 586515 - DNA, 20 bp, Artificial Sequence
  chemically synthesized
acaaattattattgaatgat

SEQ ID NO: 586516 - DNA, 20 bp, Artificial Sequence
  chemically synthesized
atgttcaacaaattattatt

SEQ ID NO: 586517 - DNA, 20 bp, Artificial Sequence
  chemically synthesized
ttggatttcttttggtctta

SEQ ID NO: 586518 - DNA, 20 bp, Artificial Sequence
  chemically synthesized
ggattatacgggatgtaatt

SEQ ID NO: 586519 - DNA, 20 bp, Artificial Sequence
  chemically synthesized
acatcccgtataatcctagt

SEQ ID NO: 586520 - DNA, 20 bp, Artificial Sequence
  chemically synthesized
agaaaaatataaatccacaa

SEQ ID NO: 586521 - DNA, 20 bp, Artificial Sequence
  chemically synthesized
gtgtgtaaaatagactcaaa

SEQ ID NO: 586522 - DNA, 20 bp, Artificial Sequence
  chemically synthesized
aaaaaatgattttttcccct

SEQ ID NO: 586523 - DNA, 20 bp, Artificial Sequence
  chemically synthesized
gattttttcccctttaagat

SEQ ID NO: 586524 - DNA, 20 bp, Artificial Sequence
  chemically synthesized
tctctgcctgatgtagccaa

SEQ ID NO: 586525 - DNA, 20 bp, Artificial Sequence
  chemically synthesized
tcgtggttggctacatcagg

SEQ ID NO: 586526 - DNA, 20 bp, Artificial Sequence
  chemically synthesized
cttactctgtcttgttgaaa

SEQ ID NO: 586527 - DNA, 20 bp, Artificial Sequence
  chemically synthesized
acaacatgtattagccgcag

SEQ ID NO: 586528 - DNA, 20 bp, Artificial Sequence
  chemically synthesized
atgacacctctcaacattgc

SEQ ID NO: 586529 - DNA, 20 bp, Artificial Sequence
  chemically synthesized
ataacattaaaattaatttg

SEQ ID NO: 586530 - DNA, 20 bp, Artificial Sequence
  chemically synthesized
atattttatttttttcatac

SEQ ID NO: 586531 - DNA, 20 bp, Artificial Sequence
  chemically synthesized
cttaggttttgtaatttggt

SEQ ID NO: 586532 - DNA, 20 bp, Artificial Sequence
  chemically synthesized
aggaaagttggacatttcgt

SEQ ID NO: 586533 - DNA, 20 bp, Artificial Sequence
  chemically synthesized
aagtttttgttcaaataaaa

SEQ ID NO: 586534 - DNA, 20 bp, Artificial Sequence
  chemically synthesized
tcatatttgctcaaagttta

SEQ ID NO: 586535 - DNA, 20 bp, Artificial Sequence
  chemically synthesized
aagaataattcatatttgct

SEQ ID NO: 586536 - DNA, 20 bp, Artificial Sequence
  chemically synthesized
aattattcttatcagtctct

SEQ ID NO: 586537 - DNA, 20 bp, Artificial Sequence
  chemically synthesized
agttcagtatgtttaacatt

SEQ ID NO: 586538 - DNA, 20 bp, Artificial Sequence
  chemically synthesized
tttttcaaatggtgagttca

SEQ ID NO: 586539 - DNA, 20 bp, Artificial Sequence
  chemically synthesized
tggtacagcatttattgtga

SEQ ID NO: 586540 - DNA, 20 bp, Artificial Sequence
  chemically synthesized
atttcttaaaataacaaaat

SEQ ID NO: 586541 - DNA, 20 bp, Artificial Sequence
  chemically synthesized
aagcagagatttatacccac

SEQ ID NO: 586542 - DNA, 20 bp, Artificial Sequence
  chemically synthesized
aagcaaatgtgggtataaat

SEQ ID NO: 586543 - DNA, 20 bp, Artificial Sequence
  chemically synthesized
tatacattttattgcataag

SEQ ID NO: 586544 - DNA, 20 bp, Artificial Sequence
  chemically synthesized
tacagcaaaggtagagctat

SEQ ID NO: 586545 - DNA, 20 bp, Artificial Sequence
  chemically synthesized
cctttgctgtattttgacat

SEQ ID NO: 586546 - DNA, 20 bp, Artificial Sequence
  chemically synthesized
ttgacatttctgtttgcaat

SEQ ID NO: 586547 - DNA, 20 bp, Artificial Sequence
  chemically synthesized
gaagagctgtgcctctatta

SEQ ID NO: 586548 - DNA, 20 bp, Artificial Sequence
  chemically synthesized
acagctcttcatgaatatag

SEQ ID NO: 586549 - DNA, 20 bp, Artificial Sequence
  chemically synthesized
aaaattacgtcaaagatatc

SEQ ID NO: 586550 - DNA, 20 bp, Artificial Sequence
  chemically synthesized
aactctcatattttcatata

SEQ ID NO: 586551 - DNA, 20 bp, Artificial Sequence
  chemically synthesized
aacaccatatatgaaaatat

SEQ ID NO: 586552 - DNA, 20 bp, Artificial Sequence
  chemically synthesized
tgagagtttaaatcagcatg

SEQ ID NO: 586553 - DNA, 20 bp, Artificial Sequence
  chemically synthesized
ttttaatgcaaagcttctca

SEQ ID NO: 586554 - DNA, 20 bp, Artificial Sequence
  chemically synthesized
atatgtatttagttttaatg

SEQ ID NO: 586555 - DNA, 20 bp, Artificial Sequence
  chemically synthesized
atacagatgattcatatgta

SEQ ID NO: 586556 - DNA, 20 bp, Artificial Sequence
  chemically synthesized
ccactgaggctcccaaatac

SEQ ID NO: 586557 - DNA, 20 bp, Artificial Sequence
  chemically synthesized
tttaatacatacatgattgg

SEQ ID NO: 586558 - DNA, 20 bp, Artificial Sequence
  chemically synthesized
cattccaatcatgtatgtat

SEQ ID NO: 586559 - DNA, 20 bp, Artificial Sequence
  chemically synthesized
tgtcataaactttaatacat

SEQ ID NO: 586560 - DNA, 20 bp, Artificial Sequence
  chemically synthesized
cttaatatattactacactt

SEQ ID NO: 586561 - DNA, 20 bp, Artificial Sequence
  chemically synthesized
tctctaattatacaaaaaaa

SEQ ID NO: 586562 - DNA, 20 bp, Artificial Sequence
  chemically synthesized
ttgaaaatgcagctaatact

SEQ ID NO: 586563 - DNA, 20 bp, Artificial Sequence
  chemically synthesized
ccattttagagtcttcccac

SEQ ID NO: 586564 - DNA, 20 bp, Artificial Sequence
  chemically synthesized
gagagtggtcaagacttttg

SEQ ID NO: 586565 - DNA, 20 bp, Artificial Sequence
  chemically synthesized
atccttttgtctttgacata

SEQ ID NO: 586566 - DNA, 20 bp, Artificial Sequence
  chemically synthesized
cacttctccaattaggctac

SEQ ID NO: 586567 - DNA, 20 bp, Artificial Sequence
  chemically synthesized
ccccctcccccactttctct

SEQ ID NO: 586568 - DNA, 20 bp, Artificial Sequence
  chemically synthesized
cttttcttgttggctgatgg

SEQ ID NO: 586569 - DNA, 20 bp, Artificial Sequence
  chemically synthesized
tccaaactcacctgttgttg

SEQ ID NO: 586570 - DNA, 20 bp, Artificial Sequence
  chemically synthesized
ctgaaacttaccaacaacag

SEQ ID NO: 586571 - DNA, 20 bp, Artificial Sequence
  chemically synthesized
tgaaagcttgccttggaagg

SEQ ID NO: 586572 - DNA, 20 bp, Artificial Sequence
  chemically synthesized
tggaagcaggtccttccaag

SEQ ID NO: 586573 - DNA, 20 bp, Artificial Sequence
  chemically synthesized
ccagggctagggtctcattt

SEQ ID NO: 586574 - DNA, 20 bp, Artificial Sequence
  chemically synthesized
aggcatagattatccatatt

SEQ ID NO: 586575 - DNA, 20 bp, Artificial Sequence
  chemically synthesized
atatgggtcagaagtctagg

SEQ ID NO: 586576 - DNA, 20 bp, Artificial Sequence
  chemically synthesized
gtatcctgatactctaaaga

SEQ ID NO: 586577 - DNA, 20 bp, Artificial Sequence
  chemically synthesized
ataacaattactacaaagat

SEQ ID NO: 586578 - DNA, 20 bp, Artificial Sequence
  chemically synthesized
gttactatatttgtttctta

SEQ ID NO: 586579 - DNA, 20 bp, Artificial Sequence
  chemically synthesized
tttaatttttatgttactat

SEQ ID NO: 586580 - DNA, 20 bp, Artificial Sequence
  chemically synthesized
attaaataatggtgaagttg

SEQ ID NO: 586581 - DNA, 20 bp, Artificial Sequence
  chemically synthesized
tgaaaaatagtggcgaattt

SEQ ID NO: 586582 - DNA, 20 bp, Artificial Sequence
  chemically synthesized
atcatttcatctgagtatat

SEQ ID NO: 586583 - DNA, 20 bp, Artificial Sequence
  chemically synthesized
agatgaaatgataaaaccat

SEQ ID NO: 586584 - DNA, 20 bp, Artificial Sequence
  chemically synthesized
gagagggtgcatgaaacctt

SEQ ID NO: 586585 - DNA, 20 bp, Artificial Sequence
  chemically synthesized
atgaataatattgtcaatct

SEQ ID NO: 586586 - DNA, 20 bp, Artificial Sequence
  chemically synthesized
caaggtgctaaaataaaact

SEQ ID NO: 586587 - DNA, 20 bp, Artificial Sequence
  chemically synthesized
caacaactcaaagataaatt

SEQ ID NO: 586588 - DNA, 20 bp, Artificial Sequence
  chemically synthesized
tttgagttgttggtacttca

SEQ ID NO: 586589 - DNA, 20 bp, Artificial Sequence
  chemically synthesized
ggtacttcaaatagtttttt

SEQ ID NO: 586590 - DNA, 20 bp, Artificial Sequence
  chemically synthesized
agacgaatgctaagaatctg

SEQ ID NO: 586591 - DNA, 20 bp, Artificial Sequence
  chemically synthesized
gaatgctaagaatctgttaa

SEQ ID NO: 586592 - DNA, 20 bp, Artificial Sequence
  chemically synthesized
ttttccctaaaagcaagctt

SEQ ID NO: 586593 - DNA, 20 bp, Artificial Sequence
  chemically synthesized
aggcatccttttccctaaaa

SEQ ID NO: 586594 - DNA, 20 bp, Artificial Sequence
  chemically synthesized
cccccaaagaaccaagttta

SEQ ID NO: 586595 - DNA, 20 bp, Artificial Sequence
  chemically synthesized
gctttttcacccccaaagaa

SEQ ID NO: 586596 - DNA, 20 bp, Artificial Sequence
  chemically synthesized
agaaaattggtgaaaaatat

SEQ ID NO: 586597 - DNA, 20 bp, Artificial Sequence
  chemically synthesized
ttttacatgttaaattggaa

SEQ ID NO: 586598 - DNA, 20 bp, Artificial Sequence
  chemically synthesized
tggaagtaagatttatgtta

SEQ ID NO: 586599 - DNA, 20 bp, Artificial Sequence
  chemically synthesized
atctttaatatgttttaata

SEQ ID NO: 586600 - DNA, 20 bp, Artificial Sequence
  chemically synthesized
tctcacatggtttatcttta

SEQ ID NO: 586601 - DNA, 20 bp, Artificial Sequence
  chemically synthesized
attttgattccattctctca

SEQ ID NO: 586602 - DNA, 20 bp, Artificial Sequence
  chemically synthesized
gcaaggtaggaaattctcca

SEQ ID NO: 586603 - DNA, 20 bp, Artificial Sequence
  chemically synthesized
ttggtagcaaaagatgaaga

SEQ ID NO: 586604 - DNA, 20 bp, Artificial Sequence
  chemically synthesized
cgagatggggaaaagagcaa

SEQ ID NO: 586605 - DNA, 20 bp, Artificial Sequence
  chemically synthesized
ctgaaaattgttgatgaatg

SEQ ID NO: 586606 - DNA, 20 bp, Artificial Sequence
  chemically synthesized
tccatttccatttaaaggat

SEQ ID NO: 586607 - DNA, 20 bp, Artificial Sequence
  chemically synthesized
ttttaaatggttcatgaaat

SEQ ID NO: 586608 - DNA, 20 bp, Artificial Sequence
  chemically synthesized
gctaatttagtttcagaaag

SEQ ID NO: 586609 - DNA, 20 bp, Artificial Sequence
  chemically synthesized
tctcagctttctgaaactaa

SEQ ID NO: 586610 - DNA, 20 bp, Artificial Sequence
  chemically synthesized
tgaaaaacaaaagaagctaa

SEQ ID NO: 586611 - DNA, 20 bp, Artificial Sequence
  chemically synthesized
tctgaaactaaattagcttc

SEQ ID NO: 586612 - DNA, 20 bp, Artificial Sequence
  chemically synthesized
taaattagcttcttttgttt

SEQ ID NO: 586613 - DNA, 20 bp, Artificial Sequence
  chemically synthesized
tcagattcgaaactctatga

SEQ ID NO: 586614 - DNA, 20 bp, Artificial Sequence
  chemically synthesized
gacacagccaaaccatatca

SEQ ID NO: 586615 - DNA, 20 bp, Artificial Sequence
  chemically synthesized
tatgggaacaacagcttaag

SEQ ID NO: 586616 - DNA, 20 bp, Artificial Sequence
  chemically synthesized
cgtgtgggggttatgggaac

SEQ ID NO: 586617 - DNA, 20 bp, Artificial Sequence
  chemically synthesized
agcatgagggtaaccgcccg

SEQ ID NO: 586618 - DNA, 20 bp, Artificial Sequence
  chemically synthesized
agtgagttctcacgaggtct

SEQ ID NO: 586619 - DNA, 20 bp, Artificial Sequence
  chemically synthesized
cgaggtctgatggttttata

SEQ ID NO: 586620 - DNA, 20 bp, Artificial Sequence
  chemically synthesized
ctgctgccatgtgaagaaga

SEQ ID NO: 586621 - DNA, 20 bp, Artificial Sequence
  chemically synthesized
tgccatgtgaagaagaaggt

SEQ ID NO: 586622 - DNA, 20 bp, Artificial Sequence
  chemically synthesized
ggtgtttgcttccccatctg

SEQ ID NO: 586623 - DNA, 20 bp, Artificial Sequence
  chemically synthesized
cttccccatctgccatgatt

SEQ ID NO: 586624 - DNA, 20 bp, Artificial Sequence
  chemically synthesized
actgggtaatttataaagga

SEQ ID NO: 586625 - DNA, 20 bp, Artificial Sequence
  chemically synthesized
attaggaaaaatatgtttca

SEQ ID NO: 586626 - DNA, 20 bp, Artificial Sequence
  chemically synthesized
gacaaaaagaattaggaaaa

SEQ ID NO: 586627 - DNA, 20 bp, Artificial Sequence
  chemically synthesized
ttcatctacagcaaatattg

SEQ ID NO: 586628 - DNA, 20 bp, Artificial Sequence
  chemically synthesized
attggaaagtttctgcatct

SEQ ID NO: 586629 - DNA, 20 bp, Artificial Sequence
  chemically synthesized
attgagtgaacatattatca

SEQ ID NO: 586630 - DNA, 20 bp, Artificial Sequence
  chemically synthesized
tatctctggaaaattcactg

SEQ ID NO: 586631 - DNA, 20 bp, Artificial Sequence
  chemically synthesized
aagtcatctagtctccacag

SEQ ID NO: 586632 - DNA, 20 bp, Artificial Sequence
  chemically synthesized
ggatttactgtaaccaatgg

SEQ ID NO: 586633 - DNA, 20 bp, Artificial Sequence
  chemically synthesized
gaggttggagggggaaattg

SEQ ID NO: 586634 - DNA, 20 bp, Artificial Sequence
  chemically synthesized
aaggtgaggttggaggggga

SEQ ID NO: 586635 - DNA, 20 bp, Artificial Sequence
  chemically synthesized
tactttatgctcacatctac

SEQ ID NO: 586636 - DNA, 20 bp, Artificial Sequence
  chemically synthesized
aattccttccctggttgcag

SEQ ID NO: 586637 - DNA, 20 bp, Artificial Sequence
  chemically synthesized
attcttccttccacagtatt

SEQ ID NO: 586638 - DNA, 20 bp, Artificial Sequence
  chemically synthesized
atcacaataagttgaaaaga

SEQ ID NO: 586639 - DNA, 20 bp, Artificial Sequence
  chemically synthesized
attgaatcagaattccatgt

SEQ ID NO: 586640 - DNA, 20 bp, Artificial Sequence
  chemically synthesized
tgaaaagctatgacatggaa

SEQ ID NO: 586641 - DNA, 20 bp, Artificial Sequence
  chemically synthesized
ctgagtactgaagccaactg

SEQ ID NO: 586642 - DNA, 20 bp, Artificial Sequence
  chemically synthesized
gggagacccaaatcaagaca

SEQ ID NO: 586643 - DNA, 20 bp, Artificial Sequence
  chemically synthesized
ttgagctcaaatttttattt

SEQ ID NO: 586644 - DNA, 20 bp, Artificial Sequence
  chemically synthesized
gaaataaaaatttgagctca

SEQ ID NO: 586645 - DNA, 20 bp, Artificial Sequence
  chemically synthesized
tgagctcaagtagttttggg

SEQ ID NO: 586646 - DNA, 20 bp, Artificial Sequence
  chemically synthesized
tttagggataacagggagta

SEQ ID NO: 586647 - DNA, 20 bp, Artificial Sequence
  chemically synthesized
gctgttttggttacagtagc

SEQ ID NO: 586648 - DNA, 20 bp, Artificial Sequence
  chemically synthesized
ctgttttggtaccagtacca

SEQ ID NO: 586649 - DNA, 20 bp, Artificial Sequence
  chemically synthesized
tctgttccattggtctatat

SEQ ID NO: 586650 - DNA, 20 bp, Artificial Sequence
  chemically synthesized
tagatgtgtggtattatttc

SEQ ID NO: 586651 - DNA, 20 bp, Artificial Sequence
  chemically synthesized
tccccatttcttgttttttg

SEQ ID NO: 586652 - DNA, 20 bp, Artificial Sequence
  chemically synthesized
acaaaaaacaagaaatgggg

SEQ ID NO: 586653 - DNA, 20 bp, Artificial Sequence
  chemically synthesized
tagggaatcctttccccatt

SEQ ID NO: 586654 - DNA, 20 bp, Artificial Sequence
  chemically synthesized
cagctttctacatatggcta

SEQ ID NO: 586655 - DNA, 20 bp, Artificial Sequence
  chemically synthesized
gtgtaaggaagggatccagt

SEQ ID NO: 586656 - DNA, 20 bp, Artificial Sequence
  chemically synthesized
tataaggtgtaaggaaggga

SEQ ID NO: 586657 - DNA, 20 bp, Artificial Sequence
  chemically synthesized
acaaaaattaattaattcaa

SEQ ID NO: 586658 - DNA, 20 bp, Artificial Sequence
  chemically synthesized
taggttttcttctagggttt

SEQ ID NO: 586659 - DNA, 20 bp, Artificial Sequence
  chemically synthesized
gtattgcctaggttttcttc

SEQ ID NO: 586660 - DNA, 20 bp, Artificial Sequence
  chemically synthesized
tttgtcctgaatggtattgc

SEQ ID NO: 586661 - DNA, 20 bp, Artificial Sequence
  chemically synthesized
gcttctgttgccattgcttt

SEQ ID NO: 586662 - DNA, 20 bp, Artificial Sequence
  chemically synthesized
tcaattttggcttctgttgc

SEQ ID NO: 586663 - DNA, 20 bp, Artificial Sequence
  chemically synthesized
attagatcccatttgtcaat

SEQ ID NO: 586664 - DNA, 20 bp, Artificial Sequence
  chemically synthesized
aatgggatctaattaaacga

SEQ ID NO: 586665 - DNA, 20 bp, Artificial Sequence
  chemically synthesized
cttttgctgtgcagaagctc

SEQ ID NO: 586666 - DNA, 20 bp, Artificial Sequence
  chemically synthesized
aaattttctcccattatgta

SEQ ID NO: 586667 - DNA, 20 bp, Artificial Sequence
  chemically synthesized
tattagccctttgtcagatg

SEQ ID NO: 586668 - DNA, 20 bp, Artificial Sequence
  chemically synthesized
gtaaatttgtttaagttctt

SEQ ID NO: 586669 - DNA, 20 bp, Artificial Sequence
  chemically synthesized
ggttggtttttttcttgtaa

SEQ ID NO: 586670 - DNA, 20 bp, Artificial Sequence
  chemically synthesized
ttggccgacttttcgatgag

SEQ ID NO: 586671 - DNA, 20 bp, Artificial Sequence
  chemically synthesized
gagatggtatctcattgtgg

SEQ ID NO: 586672 - DNA, 20 bp, Artificial Sequence
  chemically synthesized
ggagtgagatggtatctcat

SEQ ID NO: 586673 - DNA, 20 bp, Artificial Sequence
  chemically synthesized
tccacatcctctccagcatc

SEQ ID NO: 586674 - DNA, 20 bp, Artificial Sequence
  chemically synthesized
caccaacggtgtgaaagtgt

SEQ ID NO: 586675 - DNA, 20 bp, Artificial Sequence
  chemically synthesized
ctgtcttccacaatggttga

SEQ ID NO: 586676 - DNA, 20 bp, Artificial Sequence
  chemically synthesized
aaccattgtggaagacagtg

SEQ ID NO: 586677 - DNA, 20 bp, Artificial Sequence
  chemically synthesized
ccattactgggtatataccc

SEQ ID NO: 586678 - DNA, 20 bp, Artificial Sequence
  chemically synthesized
gtgcatgtgtctttatagca

SEQ ID NO: 586679 - DNA, 20 bp, Artificial Sequence
  chemically synthesized
ctataaagacacatgcacac

SEQ ID NO: 586680 - DNA, 20 bp, Artificial Sequence
  chemically synthesized
caaatgtccatcagtgatag

SEQ ID NO: 586681 - DNA, 20 bp, Artificial Sequence
  chemically synthesized
cgcaaccataaaaaaggatg

SEQ ID NO: 586682 - DNA, 20 bp, Artificial Sequence
  chemically synthesized
gtttgctcagaatgttggtt

SEQ ID NO: 586683 - DNA, 20 bp, Artificial Sequence
  chemically synthesized
tgtgatagtttgctcagaat

SEQ ID NO: 586684 - DNA, 20 bp, Artificial Sequence
  chemically synthesized
gtttggttttctgtccttgt

SEQ ID NO: 586685 - DNA, 20 bp, Artificial Sequence
  chemically synthesized
atgagtgaggacatgcggtg

SEQ ID NO: 586686 - DNA, 20 bp, Artificial Sequence
  chemically synthesized
cacctatgagtgaggacatg

SEQ ID NO: 586687 - DNA, 20 bp, Artificial Sequence
  chemically synthesized
atgttgcctgcgctgtgtcc

SEQ ID NO: 586688 - DNA, 20 bp, Artificial Sequence
  chemically synthesized
agggtacatgtgcacaacgt

SEQ ID NO: 586689 - DNA, 20 bp, Artificial Sequence
  chemically synthesized
tatatgaaagatgtagggaa

SEQ ID NO: 586690 - DNA, 20 bp, Artificial Sequence
  chemically synthesized
gcccttcagatctaataact

SEQ ID NO: 586691 - DNA, 20 bp, Artificial Sequence
  chemically synthesized
aacttcctgtacttgcatct

SEQ ID NO: 586692 - DNA, 20 bp, Artificial Sequence
  chemically synthesized
ttagcacttaccatttttat

SEQ ID NO: 586693 - DNA, 20 bp, Artificial Sequence
  chemically synthesized
ttgtaatgtcaaaattacca

SEQ ID NO: 586694 - DNA, 20 bp, Artificial Sequence
  chemically synthesized
atatctgtcacattgctttg

SEQ ID NO: 586695 - DNA, 20 bp, Artificial Sequence
  chemically synthesized
taaccaaccaatatctgtca

SEQ ID NO: 586696 - DNA, 20 bp, Artificial Sequence
  chemically synthesized
tctatctattctgtctacct

SEQ ID NO: 586697 - DNA, 20 bp, Artificial Sequence
  chemically synthesized
caaaggaacgtaagggtgaa

SEQ ID NO: 586698 - DNA, 20 bp, Artificial Sequence
  chemically synthesized
cctttgttgtggtgcagctg

SEQ ID NO: 586699 - DNA, 20 bp, Artificial Sequence
  chemically synthesized
ggtgcagctgtagagtttgg

SEQ ID NO: 586700 - DNA, 20 bp, Artificial Sequence
  chemically synthesized
cttttagctgtagaagtgag

SEQ ID NO: 586701 - DNA, 20 bp, Artificial Sequence
  chemically synthesized
atgtgacctaattcaggcca

SEQ ID NO: 586702 - DNA, 20 bp, Artificial Sequence
  chemically synthesized
gtttcagagcagtctttcct

SEQ ID NO: 586703 - DNA, 20 bp, Artificial Sequence
  chemically synthesized
gggaaagaaggtccctaaag

SEQ ID NO: 586704 - DNA, 20 bp, Artificial Sequence
  chemically synthesized
agagatgattttcatcaaaa

SEQ ID NO: 586705 - DNA, 20 bp, Artificial Sequence
  chemically synthesized
tttgcagatgtgggttctga

SEQ ID NO: 586706 - DNA, 20 bp, Artificial Sequence
  chemically synthesized
tggtgacaaaaatggcctga

SEQ ID NO: 586707 - DNA, 20 bp, Artificial Sequence
  chemically synthesized
ctatttttctgtgttgacct

SEQ ID NO: 586708 - DNA, 20 bp, Artificial Sequence
  chemically synthesized
caaggttccggttttttgtt

SEQ ID NO: 586709 - DNA, 20 bp, Artificial Sequence
  chemically synthesized
atatgatcaaggttccggtt

SEQ ID NO: 586710 - DNA, 20 bp, Artificial Sequence
  chemically synthesized
acaataaatatgatcaaggt

SEQ ID NO: 586711 - DNA, 20 bp, Artificial Sequence
  chemically synthesized
accggaaccttgatcatatt

SEQ ID NO: 586712 - DNA, 20 bp, Artificial Sequence
  chemically synthesized
tgatcatatttattgtttaa

SEQ ID NO: 586713 - DNA, 20 bp, Artificial Sequence
  chemically synthesized
attgtttaaatcagtttgag

SEQ ID NO: 586714 - DNA, 20 bp, Artificial Sequence
  chemically synthesized
gtgacagaaaactggtctca

SEQ ID NO: 586715 - DNA, 20 bp, Artificial Sequence
  chemically synthesized
caccttctgtgaagtgtcat

SEQ ID NO: 586716 - DNA, 20 bp, Artificial Sequence
  chemically synthesized
ccatgacacttcacagaagg

SEQ ID NO: 586717 - DNA, 20 bp, Artificial Sequence
  chemically synthesized
attatttgttaacactaacc

SEQ ID NO: 586718 - DNA, 20 bp, Artificial Sequence
  chemically synthesized
ctcggttagtgttaacaaat

SEQ ID NO: 586719 - DNA, 20 bp, Artificial Sequence
  chemically synthesized
gttaacaaataatagttttc

SEQ ID NO: 586720 - DNA, 20 bp, Artificial Sequence
  chemically synthesized
cacattatgggattatgaaa

SEQ ID NO: 586721 - DNA, 20 bp, Artificial Sequence
  chemically synthesized
tattcacactatttcacatt

SEQ ID NO: 586722 - DNA, 20 bp, Artificial Sequence
  chemically synthesized
aatctctctcttctggaaca

SEQ ID NO: 586723 - DNA, 20 bp, Artificial Sequence
  chemically synthesized
aaacattatgttccagaaga

SEQ ID NO: 586724 - DNA, 20 bp, Artificial Sequence
  chemically synthesized
tctattttttgaactccaga

SEQ ID NO: 586725 - DNA, 20 bp, Artificial Sequence
  chemically synthesized
cagagagagatttttaaatt

SEQ ID NO: 586726 - DNA, 20 bp, Artificial Sequence
  chemically synthesized
gagatttttaaatttgcagt

SEQ ID NO: 586727 - DNA, 20 bp, Artificial Sequence
  chemically synthesized
ttaaatttgcagtttgagat

SEQ ID NO: 586728 - DNA, 20 bp, Artificial Sequence
  chemically synthesized
ttagagctttccaacagctg

SEQ ID NO: 586729 - DNA, 20 bp, Artificial Sequence
  chemically synthesized
gcaggtactactaggttaac

SEQ ID NO: 586730 - DNA, 20 bp, Artificial Sequence
  chemically synthesized
ccaggcaaatgccaccatct

SEQ ID NO: 586731 - DNA, 20 bp, Artificial Sequence
  chemically synthesized
tcttttcttaaatatgtgga

SEQ ID NO: 586732 - DNA, 20 bp, Artificial Sequence
  chemically synthesized
tacatgttcactattaaatt

SEQ ID NO: 586733 - DNA, 20 bp, Artificial Sequence
  chemically synthesized
ttaatacatgttcactatta

SEQ ID NO: 586734 - DNA, 20 bp, Artificial Sequence
  chemically synthesized
gggagaatgtggtacatact

SEQ ID NO: 586735 - DNA, 20 bp, Artificial Sequence
  chemically synthesized
cttgccaggcaagcaaggaa

SEQ ID NO: 586736 - DNA, 20 bp, Artificial Sequence
  chemically synthesized
gtctagaacaaagctgaatt

SEQ ID NO: 586737 - DNA, 20 bp, Artificial Sequence
  chemically synthesized
aattcagctttgttctagac

SEQ ID NO: 586738 - DNA, 20 bp, Artificial Sequence
  chemically synthesized
ctgtgtatcgactgtattct

SEQ ID NO: 586739 - DNA, 20 bp, Artificial Sequence
  chemically synthesized
tccccactccttgggagagt

SEQ ID NO: 586740 - DNA, 20 bp, Artificial Sequence
  chemically synthesized
caaggagaaatttaactgat

SEQ ID NO: 586741 - DNA, 20 bp, Artificial Sequence
  chemically synthesized
gacggtccaaggagaaattt

SEQ ID NO: 586742 - DNA, 20 bp, Artificial Sequence
  chemically synthesized
ttctccttggaccgtctagt

SEQ ID NO: 586743 - DNA, 20 bp, Artificial Sequence
  chemically synthesized
tacctcagatgtgtcaggca

SEQ ID NO: 586744 - DNA, 20 bp, Artificial Sequence
  chemically synthesized
gtatttcacttacaacgttc

SEQ ID NO: 586745 - DNA, 20 bp, Artificial Sequence
  chemically synthesized
taacaggaggccaagatgga

SEQ ID NO: 586746 - DNA, 20 bp, Artificial Sequence
  chemically synthesized
gagatgacaaggcaggctct

SEQ ID NO: 586747 - DNA, 20 bp, Artificial Sequence
  chemically synthesized
tatgggattagaaaggagaa

SEQ ID NO: 586748 - DNA, 20 bp, Artificial Sequence
  chemically synthesized
tagaaaggagaagtcagatt

SEQ ID NO: 586749 - DNA, 20 bp, Artificial Sequence
  chemically synthesized
tgttctgttttcttcctcgc

SEQ ID NO: 586750 - DNA, 20 bp, Artificial Sequence
  chemically synthesized
cccaatgttctttccatttg

SEQ ID NO: 586751 - DNA, 20 bp, Artificial Sequence
  chemically synthesized
gaccagtgggagaaaatatc

SEQ ID NO: 586752 - DNA, 20 bp, Artificial Sequence
  chemically synthesized
gataaatttctcctttagcc

SEQ ID NO: 586753 - DNA, 20 bp, Artificial Sequence
  chemically synthesized
aaaggagaaatttatcaagg

SEQ ID NO: 586754 - DNA, 20 bp, Artificial Sequence
  chemically synthesized
tgtacctatgtgggcgatgc

SEQ ID NO: 586755 - DNA, 20 bp, Artificial Sequence
  chemically synthesized
catcgcccacataggtacag

SEQ ID NO: 586756 - DNA, 20 bp, Artificial Sequence
  chemically synthesized
ataggtacagacttgtttgt

SEQ ID NO: 586757 - DNA, 20 bp, Artificial Sequence
  chemically synthesized
ctaggattttgtgactacat

SEQ ID NO: 586758 - DNA, 20 bp, Artificial Sequence
  chemically synthesized
tatttctttttctcttcctg

SEQ ID NO: 586759 - DNA, 20 bp, Artificial Sequence
  chemically synthesized
cacactgttcagcaattaca

SEQ ID NO: 586760 - DNA, 20 bp, Artificial Sequence
  chemically synthesized
gtaattgctgaacagtgtgt

SEQ ID NO: 586761 - DNA, 20 bp, Artificial Sequence
  chemically synthesized
ttttaaggccctgaggggaa

SEQ ID NO: 586762 - DNA, 20 bp, Artificial Sequence
  chemically synthesized
aggggaaggcagattaggat

SEQ ID NO: 586763 - DNA, 20 bp, Artificial Sequence
  chemically synthesized
gatagaagcttataatgtat

SEQ ID NO: 586764 - DNA, 20 bp, Artificial Sequence
  chemically synthesized
ctataaagcagcaatacatt

SEQ ID NO: 586765 - DNA, 20 bp, Artificial Sequence
  chemically synthesized
cttataatgtattgctgctt

SEQ ID NO: 586766 - DNA, 20 bp, Artificial Sequence
  chemically synthesized
ttgctgctttatagttttat

SEQ ID NO: 586767 - DNA, 20 bp, Artificial Sequence
  chemically synthesized
tgtcttaccatgtgctgagc

SEQ ID NO: 586768 - DNA, 20 bp, Artificial Sequence
  chemically synthesized
accatgtgctgagctcaggt

SEQ ID NO: 586769 - DNA, 20 bp, Artificial Sequence
  chemically synthesized
taggtgactacaaaagtaag

SEQ ID NO: 586770 - DNA, 20 bp, Artificial Sequence
  chemically synthesized
tgaaatacattcttaaataa

SEQ ID NO: 586771 - DNA, 20 bp, Artificial Sequence
  chemically synthesized
tttgctaatgacttattact

SEQ ID NO: 586772 - DNA, 20 bp, Artificial Sequence
  chemically synthesized
cttattacttgctgtttatt

SEQ ID NO: 586773 - DNA, 20 bp, Artificial Sequence
  chemically synthesized
gttagacaaaaagcaaattc

SEQ ID NO: 586774 - DNA, 20 bp, Artificial Sequence
  chemically synthesized
cgaataagaaaaacgctcga

SEQ ID NO: 586775 - DNA, 20 bp, Artificial Sequence
  chemically synthesized
tttttcttattcgagttcaa

SEQ ID NO: 586776 - DNA, 20 bp, Artificial Sequence
  chemically synthesized
tttttgacattgcgagttgc

SEQ ID NO: 586777 - DNA, 20 bp, Artificial Sequence
  chemically synthesized
gttagcagtaacttggccaa

SEQ ID NO: 586778 - DNA, 20 bp, Artificial Sequence
  chemically synthesized
tcttgaaccaccactgcact

SEQ ID NO: 586779 - DNA, 20 bp, Artificial Sequence
  chemically synthesized
cacagtgcagtggtggttca

SEQ ID NO: 586780 - DNA, 20 bp, Artificial Sequence
  chemically synthesized
ggccatcagaagttgacaat

SEQ ID NO: 586781 - DNA, 20 bp, Artificial Sequence
  chemically synthesized
agttgtaagaggatcagctt

SEQ ID NO: 586782 - DNA, 20 bp, Artificial Sequence
  chemically synthesized
tctcgtgtagttgtaagagg

SEQ ID NO: 586783 - DNA, 20 bp, Artificial Sequence
  chemically synthesized
cgagttttttcgcctttcca

SEQ ID NO: 586784 - DNA, 20 bp, Artificial Sequence
  chemically synthesized
gcttatgaggcacccactta

SEQ ID NO: 586785 - DNA, 20 bp, Artificial Sequence
  chemically synthesized
tgacgatacttttattttcg

SEQ ID NO: 586786 - DNA, 20 bp, Artificial Sequence
  chemically synthesized
caacaacaaaccatttcttg

SEQ ID NO: 586787 - DNA, 20 bp, Artificial Sequence
  chemically synthesized
acgttacaatccgatcaaga

SEQ ID NO: 586788 - DNA, 20 bp, Artificial Sequence
  chemically synthesized
gattgtaacgtgcaacaaaa

SEQ ID NO: 586789 - DNA, 20 bp, Artificial Sequence
  chemically synthesized
ctgaactgggcatcgccagt

SEQ ID NO: 586790 - DNA, 20 bp, Artificial Sequence
  chemically synthesized
tttggctttggaaagtgctt

SEQ ID NO: 586791 - DNA, 20 bp, Artificial Sequence
  chemically synthesized
ggtacaagtttggctttgga

SEQ ID NO: 586792 - DNA, 20 bp, Artificial Sequence
  chemically synthesized
accatgacttttggtacaag

SEQ ID NO: 586793 - DNA, 20 bp, Artificial Sequence
  chemically synthesized
cagtgaccatgacttttggt

SEQ ID NO: 586794 - DNA, 20 bp, Artificial Sequence
  chemically synthesized
ctcctgctggcctgacccac

SEQ ID NO: 586795 - DNA, 20 bp, Artificial Sequence
  chemically synthesized
tctcaaatgtagtggtttcg

SEQ ID NO: 586796 - DNA, 20 bp, Artificial Sequence
  chemically synthesized
tgagcatacttctcaaatgt

SEQ ID NO: 586797 - DNA, 20 bp, Artificial Sequence
  chemically synthesized
ccactgctggctgcaggcat

SEQ ID NO: 586798 - DNA, 20 bp, Artificial Sequence
  chemically synthesized
ccgaccgcacgtcgcacaac

SEQ ID NO: 586799 - DNA, 20 bp, Artificial Sequence
  chemically synthesized
aagttgaatgaatcgggcta

SEQ ID NO: 586800 - DNA, 20 bp, Artificial Sequence
  chemically synthesized
agatgaggcaaaacttccta

SEQ ID NO: 586801 - DNA, 20 bp, Artificial Sequence
  chemically synthesized
ttccctgtaaaaagttgtcg

SEQ ID NO: 586802 - DNA, 20 bp, Artificial Sequence
  chemically synthesized
tcgacaactttttacaggga

SEQ ID NO: 586803 - DNA, 20 bp, Artificial Sequence
  chemically synthesized
cacaactagcaggatgaaga

SEQ ID NO: 586804 - DNA, 20 bp, Artificial Sequence
  chemically synthesized
gtagcataaaaattcatgct

SEQ ID NO: 586805 - DNA, 20 bp, Artificial Sequence
  chemically synthesized
tattcctgtagcataaaaat

SEQ ID NO: 586806 - DNA, 20 bp, Artificial Sequence
  chemically synthesized
tttttgccaagaagaaataa

SEQ ID NO: 586807 - DNA, 20 bp, Artificial Sequence
  chemically synthesized
gttgactgtaacggttccta

SEQ ID NO: 586808 - DNA, 20 bp, Artificial Sequence
  chemically synthesized
tcctactttgattaataaag

SEQ ID NO: 586809 - DNA, 20 bp, Artificial Sequence
  chemically synthesized
gatgtgcttgagcctagtta

SEQ ID NO: 586810 - DNA, 20 bp, Artificial Sequence
  chemically synthesized
taggttggtgcaaaagaaat

SEQ ID NO: 586811 - DNA, 20 bp, Artificial Sequence
  chemically synthesized
ttttgtagggccatttttgt

SEQ ID NO: 586812 - DNA, 20 bp, Artificial Sequence
  chemically synthesized
ctgtgtcatctctctgtggt

SEQ ID NO: 586813 - DNA, 20 bp, Artificial Sequence
  chemically synthesized
gctagtaaggaatttgtgga

SEQ ID NO: 586814 - DNA, 20 bp, Artificial Sequence
  chemically synthesized
ccccacaattaatcacgcct

SEQ ID NO: 586815 - DNA, 20 bp, Artificial Sequence
  chemically synthesized
caaaggcatgaatccaagag

SEQ ID NO: 586816 - DNA, 20 bp, Artificial Sequence
  chemically synthesized
ctttgtgtagtcccttctca

SEQ ID NO: 586817 - DNA, 20 bp, Artificial Sequence
  chemically synthesized
attctgaacttggccatatg

SEQ ID NO: 586818 - DNA, 20 bp, Artificial Sequence
  chemically synthesized
gtagcaagtgtgatacaaac

SEQ ID NO: 586819 - DNA, 20 bp, Artificial Sequence
  chemically synthesized
tcttcaaagacttatcaagc

SEQ ID NO: 586820 - DNA, 20 bp, Artificial Sequence
  chemically synthesized
caccaatcttcaaagactta

SEQ ID NO: 586821 - DNA, 20 bp, Artificial Sequence
  chemically synthesized
acagaagcttgataagtctt

SEQ ID NO: 586822 - DNA, 20 bp, Artificial Sequence
  chemically synthesized
cttgataagtctttgaagat

SEQ ID NO: 586823 - DNA, 20 bp, Artificial Sequence
  chemically synthesized
gattggtgcttgttcttttg

SEQ ID NO: 586824 - DNA, 20 bp, Artificial Sequence
  chemically synthesized
tgtgtctcctttggcttccc

SEQ ID NO: 586825 - DNA, 20 bp, Artificial Sequence
  chemically synthesized
tgtcttctccatgtgtctcc

SEQ ID NO: 586826 - DNA, 20 bp, Artificial Sequence
  chemically synthesized
gctattggccatgagcctca

SEQ ID NO: 586827 - DNA, 20 bp, Artificial Sequence
  chemically synthesized
taaagctattggccatgagc

SEQ ID NO: 586828 - DNA, 20 bp, Artificial Sequence
  chemically synthesized
acaaactgaggctcatggcc

SEQ ID NO: 586829 - DNA, 20 bp, Artificial Sequence
  chemically synthesized
agtgaggccattttggactt

SEQ ID NO: 586830 - DNA, 20 bp, Artificial Sequence
  chemically synthesized
gagagttgactatgatattc

SEQ ID NO: 586831 - DNA, 20 bp, Artificial Sequence
  chemically synthesized
tggcttaaaataagatagtt

SEQ ID NO: 586832 - DNA, 20 bp, Artificial Sequence
  chemically synthesized
aagttactggcttaaaataa

SEQ ID NO: 586833 - DNA, 20 bp, Artificial Sequence
  chemically synthesized
aacaaaccactctaaaagtt

SEQ ID NO: 586834 - DNA, 20 bp, Artificial Sequence
  chemically synthesized
tttaagccagtaacttttag

SEQ ID NO: 586835 - DNA, 20 bp, Artificial Sequence
  chemically synthesized
actactctgcctggttcaaa

SEQ ID NO: 586836 - DNA, 20 bp, Artificial Sequence
  chemically synthesized
taacatgtcgaactaactat

SEQ ID NO: 586837 - DNA, 20 bp, Artificial Sequence
  chemically synthesized
aactatacaggattaaaaaa

SEQ ID NO: 586838 - DNA, 20 bp, Artificial Sequence
  chemically synthesized
agttctgcttcactttgaga

SEQ ID NO: 586839 - DNA, 20 bp, Artificial Sequence
  chemically synthesized
aaaaacaaataaagataaag

SEQ ID NO: 586840 - DNA, 20 bp, Artificial Sequence
  chemically synthesized
tgaagcagaactttatcttt

SEQ ID NO: 586841 - DNA, 20 bp, Artificial Sequence
  chemically synthesized
ttaccttactgtgtctctct

SEQ ID NO: 586842 - DNA, 20 bp, Artificial Sequence
  chemically synthesized
agcaaagataatgtcaccag

SEQ ID NO: 586843 - DNA, 20 bp, Artificial Sequence
  chemically synthesized
tctctgctaataatttacat

SEQ ID NO: 586844 - DNA, 20 bp, Artificial Sequence
  chemically synthesized
tagtggcctctctgtctctt

SEQ ID NO: 586845 - DNA, 20 bp, Artificial Sequence
  chemically synthesized
aggtcagcatccattccaga

SEQ ID NO: 586846 - DNA, 20 bp, Artificial Sequence
  chemically synthesized
ttgttttgttttgtttttgt

SEQ ID NO: 586847 - DNA, 20 bp, Artificial Sequence
  chemically synthesized
tttgttttgttttgttttgt

SEQ ID NO: 586848 - DNA, 20 bp, Artificial Sequence
  chemically synthesized
ttttgttttgttttgttttg

SEQ ID NO: 586849 - DNA, 20 bp, Artificial Sequence
  chemically synthesized
ttttgttttgttttgttttg

SEQ ID NO: 586850 - DNA, 20 bp, Artificial Sequence
  chemically synthesized
tttgtttttgttttgttttg

SEQ ID NO: 586851 - DNA, 20 bp, Artificial Sequence
  chemically synthesized
tttgttttgtttttgttttg

SEQ ID NO: 586852 - DNA, 20 bp, Artificial Sequence
  chemically synthesized
gtgtttttgttttgtttttg

SEQ ID NO: 586853 - DNA, 20 bp, Artificial Sequence
  chemically synthesized
cctaagtgtttttgttttgt

SEQ ID NO: 586854 - DNA, 20 bp, Artificial Sequence
  chemically synthesized
caaatgcctaagtgtttttg

SEQ ID NO: 586855 - DNA, 20 bp, Artificial Sequence
  chemically synthesized
ttccccaaatgcctaagtgt

SEQ ID NO: 586856 - DNA, 20 bp, Artificial Sequence
  chemically synthesized
cagcctttccccaaatgcct

SEQ ID NO: 586857 - DNA, 20 bp, Artificial Sequence
  chemically synthesized
tctagaactagagaacttca

SEQ ID NO: 586858 - DNA, 20 bp, Artificial Sequence
  chemically synthesized
tattagagaagatactgtga

SEQ ID NO: 586859 - DNA, 20 bp, Artificial Sequence
  chemically synthesized
gataattattagagaagata

SEQ ID NO: 586860 - DNA, 20 bp, Artificial Sequence
  chemically synthesized
agtccagaagtggaggcaat

SEQ ID NO: 586861 - DNA, 20 bp, Artificial Sequence
  chemically synthesized
ttctggactgcgtcagatcc

SEQ ID NO: 586862 - DNA, 20 bp, Artificial Sequence
  chemically synthesized
gatccacccgttttatgctc

SEQ ID NO: 586863 - DNA, 20 bp, Artificial Sequence
  chemically synthesized
gttttatgctctcttgcttt

SEQ ID NO: 586864 - DNA, 20 bp, Artificial Sequence
  chemically synthesized
aatcccaccatcaaagtaat

SEQ ID NO: 586865 - DNA, 20 bp, Artificial Sequence
  chemically synthesized
aagcaattattactttgatg

SEQ ID NO: 586866 - DNA, 20 bp, Artificial Sequence
  chemically synthesized
tggtgggattacataaaaag

SEQ ID NO: 586867 - DNA, 20 bp, Artificial Sequence
  chemically synthesized
aagtcaaggatgagaaaaat

SEQ ID NO: 586868 - DNA, 20 bp, Artificial Sequence
  chemically synthesized
ttttctcatccttgacttca

SEQ ID NO: 586869 - DNA, 20 bp, Artificial Sequence
  chemically synthesized
agctaagctaaatgattcaa

SEQ ID NO: 586870 - DNA, 20 bp, Artificial Sequence
  chemically synthesized
caaaaagctttattgaatca

SEQ ID NO: 586871 - DNA, 20 bp, Artificial Sequence
  chemically synthesized
agctttattgaatcatttag

SEQ ID NO: 586872 - DNA, 20 bp, Artificial Sequence
  chemically synthesized
tttcaaatgtaagctaagct

SEQ ID NO: 586873 - DNA, 20 bp, Artificial Sequence
  chemically synthesized
cccatacccaccactccatt

SEQ ID NO: 586874 - DNA, 20 bp, Artificial Sequence
  chemically synthesized
gtgtggagagggagagaagt

SEQ ID NO: 586875 - DNA, 20 bp, Artificial Sequence
  chemically synthesized
atattcctaccaacagtgtg

SEQ ID NO: 586876 - DNA, 20 bp, Artificial Sequence
  chemically synthesized
ttagtacaaccactatagag

SEQ ID NO: 586877 - DNA, 20 bp, Artificial Sequence
  chemically synthesized
gttcctcaaaaaagtaaaaa

SEQ ID NO: 586878 - DNA, 20 bp, Artificial Sequence
  chemically synthesized
ctttgggtatatacccagca

SEQ ID NO: 586879 - DNA, 20 bp, Artificial Sequence
  chemically synthesized
atgcagatatttcgtcaata

SEQ ID NO: 586880 - DNA, 20 bp, Artificial Sequence
  chemically synthesized
ttgacgaaatatctgcattc

SEQ ID NO: 586881 - DNA, 20 bp, Artificial Sequence
  chemically synthesized
gcagctctattcacaatagc

SEQ ID NO: 586882 - DNA, 20 bp, Artificial Sequence
  chemically synthesized
actccatttgtgtatatgta

SEQ ID NO: 586883 - DNA, 20 bp, Artificial Sequence
  chemically synthesized
ggagtactattctgccatag

SEQ ID NO: 586884 - DNA, 20 bp, Artificial Sequence
  chemically synthesized
gtttttctgtgcttggctta

SEQ ID NO: 586885 - DNA, 20 bp, Artificial Sequence
  chemically synthesized
acatgagatgtttttctgtg

SEQ ID NO: 586886 - DNA, 20 bp, Artificial Sequence
  chemically synthesized
tgagaacatgagatgttttt

SEQ ID NO: 586887 - DNA, 20 bp, Artificial Sequence
  chemically synthesized
tgcaaataagtgagaacatg

SEQ ID NO: 586888 - DNA, 20 bp, Artificial Sequence
  chemically synthesized
tgagttccattgttttgatt

SEQ ID NO: 586889 - DNA, 20 bp, Artificial Sequence
  chemically synthesized
tatgtccatgagttccattg

SEQ ID NO: 586890 - DNA, 20 bp, Artificial Sequence
  chemically synthesized
ctctctatgtccatgagttc

SEQ ID NO: 586891 - DNA, 20 bp, Artificial Sequence
  chemically synthesized
taaaaataaataagagtata

SEQ ID NO: 586892 - DNA, 20 bp, Artificial Sequence
  chemically synthesized
aataaataagagtataattg

SEQ ID NO: 586893 - DNA, 20 bp, Artificial Sequence
  chemically synthesized
aattggattgtttgtaacac

SEQ ID NO: 586894 - DNA, 20 bp, Artificial Sequence
  chemically synthesized
tggatcccccgttctccatg

SEQ ID NO: 586895 - DNA, 20 bp, Artificial Sequence
  chemically synthesized
tgatgtgattattatgcatt

SEQ ID NO: 586896 - DNA, 20 bp, Artificial Sequence
  chemically synthesized
atgtatttatggggtacttg

SEQ ID NO: 586897 - DNA, 20 bp, Artificial Sequence
  chemically synthesized
ggatatttgtgggaccagca

SEQ ID NO: 586898 - DNA, 20 bp, Artificial Sequence
  chemically synthesized
gggaaagatacacatatcta

SEQ ID NO: 586899 - DNA, 20 bp, Artificial Sequence
  chemically synthesized
aataaaaataccccaagttt

SEQ ID NO: 586900 - DNA, 20 bp, Artificial Sequence
  chemically synthesized
gctactataataaaaatacc

SEQ ID NO: 586901 - DNA, 20 bp, Artificial Sequence
  chemically synthesized
gcagccgttctcattgtctt

SEQ ID NO: 586902 - DNA, 20 bp, Artificial Sequence
  chemically synthesized
tgtaattatataatccattt

SEQ ID NO: 586903 - DNA, 20 bp, Artificial Sequence
  chemically synthesized
tggagggggacaaacattaa

SEQ ID NO: 586904 - DNA, 20 bp, Artificial Sequence
  chemically synthesized
gtatacattcagtatttatt

SEQ ID NO: 586905 - DNA, 20 bp, Artificial Sequence
  chemically synthesized
aatgtatacataaaccaagg

SEQ ID NO: 586906 - DNA, 20 bp, Artificial Sequence
  chemically synthesized
taggagtatagaaacagtac

SEQ ID NO: 586907 - DNA, 20 bp, Artificial Sequence
  chemically synthesized
aaggtactgtttctatactc

SEQ ID NO: 586908 - DNA, 20 bp, Artificial Sequence
  chemically synthesized
tctttgtgaccctctagact

SEQ ID NO: 586909 - DNA, 20 bp, Artificial Sequence
  chemically synthesized
gtgtcaatattacgtgagaa

SEQ ID NO: 586910 - DNA, 20 bp, Artificial Sequence
  chemically synthesized
attacgtgagaatcaggatt

SEQ ID NO: 586911 - DNA, 20 bp, Artificial Sequence
  chemically synthesized
tcagatttctaatcaactaa

SEQ ID NO: 586912 - DNA, 20 bp, Artificial Sequence
  chemically synthesized
ttaagatgcattcctatgta

SEQ ID NO: 586913 - DNA, 20 bp, Artificial Sequence
  chemically synthesized
tgtgagggggtgagaaactt

SEQ ID NO: 586914 - DNA, 20 bp, Artificial Sequence
  chemically synthesized
ctaccacaccttgcaatcta

SEQ ID NO: 586915 - DNA, 20 bp, Artificial Sequence
  chemically synthesized
cttaatagattgcaaggtgt

SEQ ID NO: 586916 - DNA, 20 bp, Artificial Sequence
  chemically synthesized
tcacaaggcaggcccatatt

SEQ ID NO: 586917 - DNA, 20 bp, Artificial Sequence
  chemically synthesized
tccctgaatatgggcctgcc

SEQ ID NO: 586918 - DNA, 20 bp, Artificial Sequence
  chemically synthesized
gaatatgggcctgccttgtg

SEQ ID NO: 586919 - DNA, 20 bp, Artificial Sequence
  chemically synthesized
tagaaatgagtgagccagct

SEQ ID NO: 586920 - DNA, 20 bp, Artificial Sequence
  chemically synthesized
tgagtgagccagctccaagc

SEQ ID NO: 586921 - DNA, 20 bp, Artificial Sequence
  chemically synthesized
gaaacaagacttcttgaagc

SEQ ID NO: 586922 - DNA, 20 bp, Artificial Sequence
  chemically synthesized
caagcttaagcttcaagaag

SEQ ID NO: 586923 - DNA, 20 bp, Artificial Sequence
  chemically synthesized
gagaaggaaacaagacttct

SEQ ID NO: 586924 - DNA, 20 bp, Artificial Sequence
  chemically synthesized
tgtttccttctctattagaa

SEQ ID NO: 586925 - DNA, 20 bp, Artificial Sequence
  chemically synthesized
ggcttattctcatgcaagaa

SEQ ID NO: 586926 - DNA, 20 bp, Artificial Sequence
  chemically synthesized
ttgcatgagaataagcccag

SEQ ID NO: 586927 - DNA, 20 bp, Artificial Sequence
  chemically synthesized
tcatccttcggcaagcgctc

SEQ ID NO: 586928 - DNA, 20 bp, Artificial Sequence
  chemically synthesized
gcagaggtgaatcatcctag

SEQ ID NO: 586929 - DNA, 20 bp, Artificial Sequence
  chemically synthesized
atctagcataagcgcagcta

SEQ ID NO: 586930 - DNA, 20 bp, Artificial Sequence
  chemically synthesized
agctaatgggtgggctaggg

SEQ ID NO: 586931 - DNA, 20 bp, Artificial Sequence
  chemically synthesized
atggtgataattttaagtca

SEQ ID NO: 586932 - DNA, 20 bp, Artificial Sequence
  chemically synthesized
ttttaagtcaataagtttta

SEQ ID NO: 586933 - DNA, 20 bp, Artificial Sequence
  chemically synthesized
taccaagcctcactcccatt

SEQ ID NO: 586934 - DNA, 20 bp, Artificial Sequence
  chemically synthesized
gggaaagccagaaatgggag

SEQ ID NO: 586935 - DNA, 20 bp, Artificial Sequence
  chemically synthesized
agagtcctcaatcctaaaat

SEQ ID NO: 586936 - DNA, 20 bp, Artificial Sequence
  chemically synthesized
caaaatcaaaatcagtaatt

SEQ ID NO: 586937 - DNA, 20 bp, Artificial Sequence
  chemically synthesized
ctcaatcctaaaattactga

SEQ ID NO: 586938 - DNA, 20 bp, Artificial Sequence
  chemically synthesized
actttttcagtggttacccc

SEQ ID NO: 586939 - DNA, 20 bp, Artificial Sequence
  chemically synthesized
aatgggggtaaccactgaaa

SEQ ID NO: 586940 - DNA, 20 bp, Artificial Sequence
  chemically synthesized
gggtatttctttccctcttt

SEQ ID NO: 586941 - DNA, 20 bp, Artificial Sequence
  chemically synthesized
agattggagagcaggagaag

SEQ ID NO: 586942 - DNA, 20 bp, Artificial Sequence
  chemically synthesized
aaccagtgggaggcgttggc

SEQ ID NO: 586943 - DNA, 20 bp, Artificial Sequence
  chemically synthesized
ttcttctcaactatcttctg

SEQ ID NO: 586944 - DNA, 20 bp, Artificial Sequence
  chemically synthesized
acctccactcaccttattcc

SEQ ID NO: 586945 - DNA, 20 bp, Artificial Sequence
  chemically synthesized
gaggaataaggtgagtggag

SEQ ID NO: 586946 - DNA, 20 bp, Artificial Sequence
  chemically synthesized
taacccaagtataactttcc

SEQ ID NO: 586947 - DNA, 20 bp, Artificial Sequence
  chemically synthesized
gttatgaaccccacaacgat

SEQ ID NO: 586948 - DNA, 20 bp, Artificial Sequence
  chemically synthesized
cagaaaatatgaacacattc

SEQ ID NO: 586949 - DNA, 20 bp, Artificial Sequence
  chemically synthesized
tatcttctgtggtcggatga

SEQ ID NO: 586950 - DNA, 20 bp, Artificial Sequence
  chemically synthesized
atactggaaaggcctttgca

SEQ ID NO: 586951 - DNA, 20 bp, Artificial Sequence
  chemically synthesized
cactgtatgcattccattga

SEQ ID NO: 586952 - DNA, 20 bp, Artificial Sequence
  chemically synthesized
caagagccattgaatcagta

SEQ ID NO: 586953 - DNA, 20 bp, Artificial Sequence
  chemically synthesized
agatcttgttaaaatcaggt

SEQ ID NO: 586954 - DNA, 20 bp, Artificial Sequence
  chemically synthesized
ctgattttaacaagatctca

SEQ ID NO: 586955 - DNA, 20 bp, Artificial Sequence
  chemically synthesized
taacaagatctcaaggtgat

SEQ ID NO: 586956 - DNA, 20 bp, Artificial Sequence
  chemically synthesized
agtcatcaattaatgttgtt

SEQ ID NO: 586957 - DNA, 20 bp, Artificial Sequence
  chemically synthesized
atatgtcattttgcctaagt

SEQ ID NO: 586958 - DNA, 20 bp, Artificial Sequence
  chemically synthesized
atcaattagcctatggtaag

SEQ ID NO: 586959 - DNA, 20 bp, Artificial Sequence
  chemically synthesized
tgtttatcaattagcctatg

SEQ ID NO: 586960 - DNA, 20 bp, Artificial Sequence
  chemically synthesized
gtatgcagtaggaacttaat

SEQ ID NO: 586961 - DNA, 20 bp, Artificial Sequence
  chemically synthesized
gtctttatttagatgttgga

SEQ ID NO: 586962 - DNA, 20 bp, Artificial Sequence
  chemically synthesized
atttctgagtttaatattag

SEQ ID NO: 586963 - DNA, 20 bp, Artificial Sequence
  chemically synthesized
tgtatatctcacatttattt

SEQ ID NO: 586964 - DNA, 20 bp, Artificial Sequence
  chemically synthesized
tgagatatacatccacttta

SEQ ID NO: 586965 - DNA, 20 bp, Artificial Sequence
  chemically synthesized
actgggtaaataattttcct

SEQ ID NO: 586966 - DNA, 20 bp, Artificial Sequence
  chemically synthesized
accaggaggaaaattattta

SEQ ID NO: 586967 - DNA, 20 bp, Artificial Sequence
  chemically synthesized
tttggtgaatcagtgagtga

SEQ ID NO: 586968 - DNA, 20 bp, Artificial Sequence
  chemically synthesized
ccactgcaaacactgtcact

SEQ ID NO: 586969 - DNA, 20 bp, Artificial Sequence
  chemically synthesized
cggtggttcattcaaggaat

SEQ ID NO: 586970 - DNA, 20 bp, Artificial Sequence
  chemically synthesized
tgtttgcaaagcataaactg

SEQ ID NO: 586971 - DNA, 20 bp, Artificial Sequence
  chemically synthesized
gagaaggcaatcctggcagt

SEQ ID NO: 586972 - DNA, 20 bp, Artificial Sequence
  chemically synthesized
tggtgagagaaggcaatcct

SEQ ID NO: 586973 - DNA, 20 bp, Artificial Sequence
  chemically synthesized
gagctgccatattgattatt

SEQ ID NO: 586974 - DNA, 20 bp, Artificial Sequence
  chemically synthesized
cagtgagctgccatattgat

SEQ ID NO: 586975 - DNA, 20 bp, Artificial Sequence
  chemically synthesized
aagtgctcagtgagctgcca

SEQ ID NO: 586976 - DNA, 20 bp, Artificial Sequence
  chemically synthesized
tcaattattgtcacgcatct

SEQ ID NO: 586977 - DNA, 20 bp, Artificial Sequence
  chemically synthesized
caagtccctgaactggaata

SEQ ID NO: 586978 - DNA, 20 bp, Artificial Sequence
  chemically synthesized
tgtctacattgtccccatgt

SEQ ID NO: 586979 - DNA, 20 bp, Artificial Sequence
  chemically synthesized
acaccaattcccctaacgtg

SEQ ID NO: 586980 - DNA, 20 bp, Artificial Sequence
  chemically synthesized
tgtgggttttcttctagtac

SEQ ID NO: 586981 - DNA, 20 bp, Artificial Sequence
  chemically synthesized
tggggttttcttttgtctct

SEQ ID NO: 586982 - DNA, 20 bp, Artificial Sequence
  chemically synthesized
ctaggggggcactgtctatg

SEQ ID NO: 586983 - DNA, 20 bp, Artificial Sequence
  chemically synthesized
cagtgcccccctagctgaga

SEQ ID NO: 586984 - DNA, 20 bp, Artificial Sequence
  chemically synthesized
tacggcaggtccttgaataa

SEQ ID NO: 586985 - DNA, 20 bp, Artificial Sequence
  chemically synthesized
ttcaaggacctgccgtacat

SEQ ID NO: 586986 - DNA, 20 bp, Artificial Sequence
  chemically synthesized
ataaagtatgatagtatata

SEQ ID NO: 586987 - DNA, 20 bp, Artificial Sequence
  chemically synthesized
agacgctgggagatgggcaa

SEQ ID NO: 586988 - DNA, 20 bp, Artificial Sequence
  chemically synthesized
caacagtgatgcattatgaa

SEQ ID NO: 586989 - DNA, 20 bp, Artificial Sequence
  chemically synthesized
aatgaggaactagaggcact

SEQ ID NO: 586990 - DNA, 20 bp, Artificial Sequence
  chemically synthesized
tctagactgagttatgaact

SEQ ID NO: 586991 - DNA, 20 bp, Artificial Sequence
  chemically synthesized
aacgtggcctcaaatattct

SEQ ID NO: 586992 - DNA, 20 bp, Artificial Sequence
  chemically synthesized
ttttcttaaagatacccctt

SEQ ID NO: 586993 - DNA, 20 bp, Artificial Sequence
  chemically synthesized
atttctacttcgggtgaagg

SEQ ID NO: 586994 - DNA, 20 bp, Artificial Sequence
  chemically synthesized
taatcatttctacttcgggt

SEQ ID NO: 586995 - DNA, 20 bp, Artificial Sequence
  chemically synthesized
taatccttcacccgaagtag

SEQ ID NO: 586996 - DNA, 20 bp, Artificial Sequence
  chemically synthesized
attatttaatcatactgcat

SEQ ID NO: 586997 - DNA, 20 bp, Artificial Sequence
  chemically synthesized
tatgctgaaactagaatgca

SEQ ID NO: 586998 - DNA, 20 bp, Artificial Sequence
  chemically synthesized
tttttttttaatcttttttt

SEQ ID NO: 586999 - DNA, 20 bp, Artificial Sequence
  chemically synthesized
tttttaatcttttttttttt

SEQ ID NO: 587000 - DNA, 20 bp, Artificial Sequence
  chemically synthesized
gtctcaaacaaacaaaaaaa

SEQ ID NO: 587001 - DNA, 20 bp, Artificial Sequence
  chemically synthesized
aacctccgcctcctgggttc

SEQ ID NO: 587002 - DNA, 20 bp, Artificial Sequence
  chemically synthesized
tgcctcagcctcccaagtag

SEQ ID NO: 587003 - DNA, 20 bp, Artificial Sequence
  chemically synthesized
ttttgtatttttagtagaga

SEQ ID NO: 587004 - DNA, 20 bp, Artificial Sequence
  chemically synthesized
ctccttggcctcccaaagtg

SEQ ID NO: 587005 - DNA, 20 bp, Artificial Sequence
  chemically synthesized
ttaattattttagtaattaa

SEQ ID NO: 587006 - DNA, 20 bp, Artificial Sequence
  chemically synthesized
actctatgggtaagatttca

SEQ ID NO: 587007 - DNA, 20 bp, Artificial Sequence
  chemically synthesized
atagaaaagacactctatgg

SEQ ID NO: 587008 - DNA, 20 bp, Artificial Sequence
  chemically synthesized
agtgtcttttctattaattt

SEQ ID NO: 587009 - DNA, 20 bp, Artificial Sequence
  chemically synthesized
ctcttccttaaccagcagct

SEQ ID NO: 587010 - DNA, 20 bp, Artificial Sequence
  chemically synthesized
ttatctcctagaggttgctt

SEQ ID NO: 587011 - DNA, 20 bp, Artificial Sequence
  chemically synthesized
cattgcagttatctcctaga

SEQ ID NO: 587012 - DNA, 20 bp, Artificial Sequence
  chemically synthesized
atgtaaatgactatcatgaa

SEQ ID NO: 587013 - DNA, 20 bp, Artificial Sequence
  chemically synthesized
tgcaatgtaaatgactatca

SEQ ID NO: 587014 - DNA, 20 bp, Artificial Sequence
  chemically synthesized
cagaatgttcattcttttat

SEQ ID NO: 587015 - DNA, 20 bp, Artificial Sequence
  chemically synthesized
actgtgatgtgggtgacatc

SEQ ID NO: 587016 - DNA, 20 bp, Artificial Sequence
  chemically synthesized
ggcaacctgtgactgatgac

SEQ ID NO: 587017 - DNA, 20 bp, Artificial Sequence
  chemically synthesized
aatgtaaccatcagaacaaa

SEQ ID NO: 587018 - DNA, 20 bp, Artificial Sequence
  chemically synthesized
tgaaatacccttttgatgac

SEQ ID NO: 587019 - DNA, 20 bp, Artificial Sequence
  chemically synthesized
ataagtgcaacattcagctc

SEQ ID NO: 587020 - DNA, 20 bp, Artificial Sequence
  chemically synthesized
ttcatttccacaacaaaatt

SEQ ID NO: 587021 - DNA, 20 bp, Artificial Sequence
  chemically synthesized
agacattgacgagagcattt

SEQ ID NO: 587022 - DNA, 20 bp, Artificial Sequence
  chemically synthesized
tttggtttttctcccttttg

SEQ ID NO: 587023 - DNA, 20 bp, Artificial Sequence
  chemically synthesized
agaaatttggtttttctccc

SEQ ID NO: 587024 - DNA, 20 bp, Artificial Sequence
  chemically synthesized
ataagggcctgatggagaaa

SEQ ID NO: 587025 - DNA, 20 bp, Artificial Sequence
  chemically synthesized
aggtggataaatgaggggaa

SEQ ID NO: 587026 - DNA, 20 bp, Artificial Sequence
  chemically synthesized
ggggaatgctgattttggca

SEQ ID NO: 587027 - DNA, 20 bp, Artificial Sequence
  chemically synthesized
gtgtcagctgagaaggatga

SEQ ID NO: 587028 - DNA, 20 bp, Artificial Sequence
  chemically synthesized
ggaaccccaggtttgcaaga

SEQ ID NO: 587029 - DNA, 20 bp, Artificial Sequence
  chemically synthesized
ggccagtgaaccatggaacc

SEQ ID NO: 587030 - DNA, 20 bp, Artificial Sequence
  chemically synthesized
tattgtgtagaaaatggatt

SEQ ID NO: 587031 - DNA, 20 bp, Artificial Sequence
  chemically synthesized
ttaccttttattgtgtagaa

SEQ ID NO: 587032 - DNA, 20 bp, Artificial Sequence
  chemically synthesized
aggcttataacagatctgta

SEQ ID NO: 587033 - DNA, 20 bp, Artificial Sequence
  chemically synthesized
ttttgccgtataccacctgc

SEQ ID NO: 587034 - DNA, 20 bp, Artificial Sequence
  chemically synthesized
agcatttggtatcccttttc

SEQ ID NO: 587035 - DNA, 20 bp, Artificial Sequence
  chemically synthesized
tattcatgtcagctgacccc

SEQ ID NO: 587036 - DNA, 20 bp, Artificial Sequence
  chemically synthesized
ttatactcatacatcaagat

SEQ ID NO: 587037 - DNA, 20 bp, Artificial Sequence
  chemically synthesized
cacatcttgatgtatgagta

SEQ ID NO: 587038 - DNA, 20 bp, Artificial Sequence
  chemically synthesized
gacagaaaagttcatttttg

SEQ ID NO: 587039 - DNA, 20 bp, Artificial Sequence
  chemically synthesized
catacaaaagtaaaataaca

SEQ ID NO: 587040 - DNA, 20 bp, Artificial Sequence
  chemically synthesized
attttacttttgtatggcat

SEQ ID NO: 587041 - DNA, 20 bp, Artificial Sequence
  chemically synthesized
ccacatattgtaaattctaa

SEQ ID NO: 587042 - DNA, 20 bp, Artificial Sequence
  chemically synthesized
aactgaggttaaataaggaa

SEQ ID NO: 587043 - DNA, 20 bp, Artificial Sequence
  chemically synthesized
atctttgttccttatttaac

SEQ ID NO: 587044 - DNA, 20 bp, Artificial Sequence
  chemically synthesized
atcgtgaaatgatattaaat

SEQ ID NO: 587045 - DNA, 20 bp, Artificial Sequence
  chemically synthesized
aacttccatttaatatcatt

SEQ ID NO: 587046 - DNA, 20 bp, Artificial Sequence
  chemically synthesized
gcaccaaccctgagactaga

SEQ ID NO: 587047 - DNA, 20 bp, Artificial Sequence
  chemically synthesized
tttctttccttttgtttctg

SEQ ID NO: 587048 - DNA, 20 bp, Artificial Sequence
  chemically synthesized
ataaaatgttttttctttcc

SEQ ID NO: 587049 - DNA, 20 bp, Artificial Sequence
  chemically synthesized
aaggggattttgctaatata

SEQ ID NO: 587050 - DNA, 20 bp, Artificial Sequence
  chemically synthesized
agaagaaatgacataataaa

SEQ ID NO: 587051 - DNA, 20 bp, Artificial Sequence
  chemically synthesized
ttcttctcctttctagaagt

SEQ ID NO: 587052 - DNA, 20 bp, Artificial Sequence
  chemically synthesized
taactcctttattagcacaa

SEQ ID NO: 587053 - DNA, 20 bp, Artificial Sequence
  chemically synthesized
aatctctcctccccgttcat

SEQ ID NO: 587054 - DNA, 20 bp, Artificial Sequence
  chemically synthesized
aatccatcatgaacggggag

SEQ ID NO: 587055 - DNA, 20 bp, Artificial Sequence
  chemically synthesized
agattgctaagaatagtcga

SEQ ID NO: 587056 - DNA, 20 bp, Artificial Sequence
  chemically synthesized
gaatttgtttttagttgaaa

SEQ ID NO: 587057 - DNA, 20 bp, Artificial Sequence
  chemically synthesized
gtcacttaagtatgctgtgc

SEQ ID NO: 587058 - DNA, 20 bp, Artificial Sequence
  chemically synthesized
catacttaagtgacacattt

SEQ ID NO: 587059 - DNA, 20 bp, Artificial Sequence
  chemically synthesized
tatgtagatagtggcaacaa

SEQ ID NO: 587060 - DNA, 20 bp, Artificial Sequence
  chemically synthesized
attagttgttacacaagtat

SEQ ID NO: 587061 - DNA, 20 bp, Artificial Sequence
  chemically synthesized
atcagtgcttcacaatttat

SEQ ID NO: 587062 - DNA, 20 bp, Artificial Sequence
  chemically synthesized
atttgttcattccaatataa

SEQ ID NO: 587063 - DNA, 20 bp, Artificial Sequence
  chemically synthesized
acaaattatcttgtatttgg

SEQ ID NO: 587064 - DNA, 20 bp, Artificial Sequence
  chemically synthesized
ggtttcctaatagaaaatta

SEQ ID NO: 587065 - DNA, 20 bp, Artificial Sequence
  chemically synthesized
gcttcagtgtaaccttctac

SEQ ID NO: 587066 - DNA, 20 bp, Artificial Sequence
  chemically synthesized
cccctacctttatttttgac

SEQ ID NO: 587067 - DNA, 20 bp, Artificial Sequence
  chemically synthesized
aagggatggggaagcagtgt

SEQ ID NO: 587068 - DNA, 20 bp, Artificial Sequence
  chemically synthesized
agaaagcaagtaaactttca

SEQ ID NO: 587069 - DNA, 20 bp, Artificial Sequence
  chemically synthesized
gggaagcagtgtgaaagttt

SEQ ID NO: 587070 - DNA, 20 bp, Artificial Sequence
  chemically synthesized
agtgtgaaagtttacttgct

SEQ ID NO: 587071 - DNA, 20 bp, Artificial Sequence
  chemically synthesized
gaaagtttacttgctttctg

SEQ ID NO: 587072 - DNA, 20 bp, Artificial Sequence
  chemically synthesized
ttctgggttacaatcaggcc

SEQ ID NO: 587073 - DNA, 20 bp, Artificial Sequence
  chemically synthesized
tcgtttttatcaatctattg

SEQ ID NO: 587074 - DNA, 20 bp, Artificial Sequence
  chemically synthesized
agaggacttttaattctgaa

SEQ ID NO: 587075 - DNA, 20 bp, Artificial Sequence
  chemically synthesized
tactttaaaagtgagaatgc

SEQ ID NO: 587076 - DNA, 20 bp, Artificial Sequence
  chemically synthesized
tgctggtgtttgaaaacaat

SEQ ID NO: 587077 - DNA, 20 bp, Artificial Sequence
  chemically synthesized
aagaagcccaacaaagccag

SEQ ID NO: 587078 - DNA, 20 bp, Artificial Sequence
  chemically synthesized
tgaaaacaatgctggctttg

SEQ ID NO: 587079 - DNA, 20 bp, Artificial Sequence
  chemically synthesized
gctaaaatgtgttggaaaat

SEQ ID NO: 587080 - DNA, 20 bp, Artificial Sequence
  chemically synthesized
atggctctcgtggaaggcac

SEQ ID NO: 587081 - DNA, 20 bp, Artificial Sequence
  chemically synthesized
ttcataatagtagcacatag

SEQ ID NO: 587082 - DNA, 20 bp, Artificial Sequence
  chemically synthesized
cccaagagccatatttacaa

SEQ ID NO: 587083 - DNA, 20 bp, Artificial Sequence
  chemically synthesized
aatttggaggtgagaatcag

SEQ ID NO: 587084 - DNA, 20 bp, Artificial Sequence
  chemically synthesized
ggtgagaatcagagatgatt

SEQ ID NO: 587085 - DNA, 20 bp, Artificial Sequence
  chemically synthesized
aagagcaagcacaaaatcat

SEQ ID NO: 587086 - DNA, 20 bp, Artificial Sequence
  chemically synthesized
ttctattttagtattactcc

SEQ ID NO: 587087 - DNA, 20 bp, Artificial Sequence
  chemically synthesized
attgtaattgctcaaaaaat

SEQ ID NO: 587088 - DNA, 20 bp, Artificial Sequence
  chemically synthesized
ttaatgatgagattatgaat

SEQ ID NO: 587089 - DNA, 20 bp, Artificial Sequence
  chemically synthesized
atttactgcaggcattaatg

SEQ ID NO: 587090 - DNA, 20 bp, Artificial Sequence
  chemically synthesized
gtaaattacctcctcatcac

SEQ ID NO: 587091 - DNA, 20 bp, Artificial Sequence
  chemically synthesized
atcactcctgtttacttttt

SEQ ID NO: 587092 - DNA, 20 bp, Artificial Sequence
  chemically synthesized
tatatggtattatagtacat

SEQ ID NO: 587093 - DNA, 20 bp, Artificial Sequence
  chemically synthesized
ataacacccatagcccttgt

SEQ ID NO: 587094 - DNA, 20 bp, Artificial Sequence
  chemically synthesized
actttaatgttccctcgcct

SEQ ID NO: 587095 - DNA, 20 bp, Artificial Sequence
  chemically synthesized
tatggtgggaccctctaaca

SEQ ID NO: 587096 - DNA, 20 bp, Artificial Sequence
  chemically synthesized
gggaaggaatgctgatgtca

SEQ ID NO: 587097 - DNA, 20 bp, Artificial Sequence
  chemically synthesized
ctgtcctctttgttttttat

SEQ ID NO: 587098 - DNA, 20 bp, Artificial Sequence
  chemically synthesized
agctcactggactctgtcct

SEQ ID NO: 587099 - DNA, 20 bp, Artificial Sequence
  chemically synthesized
aacaaagaggacagagtcca

SEQ ID NO: 587100 - DNA, 20 bp, Artificial Sequence
  chemically synthesized
cttccgggtagctgaacagg

SEQ ID NO: 587101 - DNA, 20 bp, Artificial Sequence
  chemically synthesized
tggagggacggaaaggggca

SEQ ID NO: 587102 - DNA, 20 bp, Artificial Sequence
  chemically synthesized
tatcataaacaggtgaaagc

SEQ ID NO: 587103 - DNA, 20 bp, Artificial Sequence
  chemically synthesized
tcaggaaaacactcgctttc

SEQ ID NO: 587104 - DNA, 20 bp, Artificial Sequence
  chemically synthesized
ctcacagaactcaggaaaac

SEQ ID NO: 587105 - DNA, 20 bp, Artificial Sequence
  chemically synthesized
gcctctggaacttctgaccc

SEQ ID NO: 587106 - DNA, 20 bp, Artificial Sequence
  chemically synthesized
ccagagatagtgtcagatcc

SEQ ID NO: 587107 - DNA, 20 bp, Artificial Sequence
  chemically synthesized
agagacacccagctggtgcc

SEQ ID NO: 587108 - DNA, 20 bp, Artificial Sequence
  chemically synthesized
ataaaagtcttcttctgtgt

SEQ ID NO: 587109 - DNA, 20 bp, Artificial Sequence
  chemically synthesized
ttcttctgtgttgacgattg

SEQ ID NO: 587110 - DNA, 20 bp, Artificial Sequence
  chemically synthesized
gtatggaaaattctttctaa

SEQ ID NO: 587111 - DNA, 20 bp, Artificial Sequence
  chemically synthesized
tatatactattgtcattaaa

SEQ ID NO: 587112 - DNA, 20 bp, Artificial Sequence
  chemically synthesized
ttaattcggtaataatggca

SEQ ID NO: 587113 - DNA, 20 bp, Artificial Sequence
  chemically synthesized
aatttcggcctatccaagaa

SEQ ID NO: 587114 - DNA, 20 bp, Artificial Sequence
  chemically synthesized
tcaataactattattatcat

SEQ ID NO: 587115 - DNA, 20 bp, Artificial Sequence
  chemically synthesized
gtgctcaataactattatta

SEQ ID NO: 587116 - DNA, 20 bp, Artificial Sequence
  chemically synthesized
caaacatcaggcttttagag

SEQ ID NO: 587117 - DNA, 20 bp, Artificial Sequence
  chemically synthesized
caagcctagctctaaaagcc

SEQ ID NO: 587118 - DNA, 20 bp, Artificial Sequence
  chemically synthesized
tctagttatgagaacaaaca

SEQ ID NO: 587119 - DNA, 20 bp, Artificial Sequence
  chemically synthesized
tctcaatttgctctgactgt

SEQ ID NO: 587120 - DNA, 20 bp, Artificial Sequence
  chemically synthesized
cctataatttcacactgaca

SEQ ID NO: 587121 - DNA, 20 bp, Artificial Sequence
  chemically synthesized
attataggaggcaaagtcaa

SEQ ID NO: 587122 - DNA, 20 bp, Artificial Sequence
  chemically synthesized
gggggaagggagtagtaatt

SEQ ID NO: 587123 - DNA, 20 bp, Artificial Sequence
  chemically synthesized
actactcccttcccccaacc

SEQ ID NO: 587124 - DNA, 20 bp, Artificial Sequence
  chemically synthesized
tcccccaaccctcagcttca

SEQ ID NO: 587125 - DNA, 20 bp, Artificial Sequence
  chemically synthesized
tctctaatttatagttgcta

SEQ ID NO: 587126 - DNA, 20 bp, Artificial Sequence
  chemically synthesized
aaaggacatgcataatttta

SEQ ID NO: 587127 - DNA, 20 bp, Artificial Sequence
  chemically synthesized
ttaaataagggaagggtggg

SEQ ID NO: 587128 - DNA, 20 bp, Artificial Sequence
  chemically synthesized
aagggtgggaagtgattatg

SEQ ID NO: 587129 - DNA, 20 bp, Artificial Sequence
  chemically synthesized
tcttgaataaataatttaat

SEQ ID NO: 587130 - DNA, 20 bp, Artificial Sequence
  chemically synthesized
cataaagaaaacatccaaat

SEQ ID NO: 587131 - DNA, 20 bp, Artificial Sequence
  chemically synthesized
ttcctggaaatccattattt

SEQ ID NO: 587132 - DNA, 20 bp, Artificial Sequence
  chemically synthesized
taaagaaaacattcaagata

SEQ ID NO: 587133 - DNA, 20 bp, Artificial Sequence
  chemically synthesized
tcccagaaacccattatctt

SEQ ID NO: 587134 - DNA, 20 bp, Artificial Sequence
  chemically synthesized
aacctcctactccctggttc

SEQ ID NO: 587135 - DNA, 20 bp, Artificial Sequence
  chemically synthesized
tgcctcagcctcccaaatag

SEQ ID NO: 587136 - DNA, 20 bp, Artificial Sequence
  chemically synthesized
ttttgtatttttaatagaga

SEQ ID NO: 587137 - DNA, 20 bp, Artificial Sequence
  chemically synthesized
cgcctgggcctcccaaagtg

SEQ ID NO: 587138 - DNA, 20 bp, Artificial Sequence
  chemically synthesized
ggcgtgagccaccacacccg

SEQ ID NO: 587139 - DNA, 20 bp, Artificial Sequence
  chemically synthesized
cggcccgttttcttatataa

SEQ ID NO: 587140 - DNA, 20 bp, Artificial Sequence
  chemically synthesized
tatataatagcgttttagca

SEQ ID NO: 587141 - DNA, 20 bp, Artificial Sequence
  chemically synthesized
tgtatttgtaacacagttca

SEQ ID NO: 587142 - DNA, 20 bp, Artificial Sequence
  chemically synthesized
ccactggagcttttatgtgc

SEQ ID NO: 587143 - DNA, 20 bp, Artificial Sequence
  chemically synthesized
cagggaccagatagttccac

SEQ ID NO: 587144 - DNA, 20 bp, Artificial Sequence
  chemically synthesized
gctaagacttccagctagag

SEQ ID NO: 587145 - DNA, 20 bp, Artificial Sequence
  chemically synthesized
gctagagaaatgatttccta

SEQ ID NO: 587146 - DNA, 20 bp, Artificial Sequence
  chemically synthesized
caatatggtaacaatgccag

SEQ ID NO: 587147 - DNA, 20 bp, Artificial Sequence
  chemically synthesized
attcagtcctgcccttaacg

SEQ ID NO: 587148 - DNA, 20 bp, Artificial Sequence
  chemically synthesized
cctatcacaagatgacgatt

SEQ ID NO: 587149 - DNA, 20 bp, Artificial Sequence
  chemically synthesized
atcaatttcctatcacaaga

SEQ ID NO: 587150 - DNA, 20 bp, Artificial Sequence
  chemically synthesized
atcgtcatcttgtgatagga

SEQ ID NO: 587151 - DNA, 20 bp, Artificial Sequence
  chemically synthesized
aaggagtcggaaagccaagc

SEQ ID NO: 587152 - DNA, 20 bp, Artificial Sequence
  chemically synthesized
aaaattaaataaagctagag

SEQ ID NO: 587153 - DNA, 20 bp, Artificial Sequence
  chemically synthesized
aggagaaaattaaataaagc

SEQ ID NO: 587154 - DNA, 20 bp, Artificial Sequence
  chemically synthesized
ttcatttgtataaggtaaat

SEQ ID NO: 587155 - DNA, 20 bp, Artificial Sequence
  chemically synthesized
tacaaatgaaaataaatctg

SEQ ID NO: 587156 - DNA, 20 bp, Artificial Sequence
  chemically synthesized
tgtatctgaggagtaaacat

SEQ ID NO: 587157 - DNA, 20 bp, Artificial Sequence
  chemically synthesized
cagatacatatttagaagca

SEQ ID NO: 587158 - DNA, 20 bp, Artificial Sequence
  chemically synthesized
atatttagaagcaacatgat

SEQ ID NO: 587159 - DNA, 20 bp, Artificial Sequence
  chemically synthesized
tttgtattaatctctaatca

SEQ ID NO: 587160 - DNA, 20 bp, Artificial Sequence
  chemically synthesized
tagagattaatacaaaatga

SEQ ID NO: 587161 - DNA, 20 bp, Artificial Sequence
  chemically synthesized
gccaactgtatattgtggaa

SEQ ID NO: 587162 - DNA, 20 bp, Artificial Sequence
  chemically synthesized
ttactttcataatttttatt

SEQ ID NO: 587163 - DNA, 20 bp, Artificial Sequence
  chemically synthesized
acaaaaattattcccatatt

SEQ ID NO: 587164 - DNA, 20 bp, Artificial Sequence
  chemically synthesized
tcactttaccgaggaaaaag

SEQ ID NO: 587165 - DNA, 20 bp, Artificial Sequence
  chemically synthesized
actttccagccaaatttctt

SEQ ID NO: 587166 - DNA, 20 bp, Artificial Sequence
  chemically synthesized
aatttcttaattgttttcca

SEQ ID NO: 587167 - DNA, 20 bp, Artificial Sequence
  chemically synthesized
taccatttacaaataagata

SEQ ID NO: 587168 - DNA, 20 bp, Artificial Sequence
  chemically synthesized
tttatgtgtagatagtaaat

SEQ ID NO: 587169 - DNA, 20 bp, Artificial Sequence
  chemically synthesized
atatgttgtcattttgttaa

SEQ ID NO: 587170 - DNA, 20 bp, Artificial Sequence
  chemically synthesized
ggtgtacgttatgcattcct

SEQ ID NO: 587171 - DNA, 20 bp, Artificial Sequence
  chemically synthesized
attacttgacattaaaaata

SEQ ID NO: 587172 - DNA, 20 bp, Artificial Sequence
  chemically synthesized
ctaattctgaaacaacataa

SEQ ID NO: 587173 - DNA, 20 bp, Artificial Sequence
  chemically synthesized
aatatagcaaaacatgttta

SEQ ID NO: 587174 - DNA, 20 bp, Artificial Sequence
  chemically synthesized
cagttgtgtaatatagcaaa

SEQ ID NO: 587175 - DNA, 20 bp, Artificial Sequence
  chemically synthesized
ccctttttgagaactagatg

SEQ ID NO: 587176 - DNA, 20 bp, Artificial Sequence
  chemically synthesized
aaaactatatgagtttttgc

SEQ ID NO: 587177 - DNA, 20 bp, Artificial Sequence
  chemically synthesized
aaaaccaaagcaaaaactca

SEQ ID NO: 587178 - DNA, 20 bp, Artificial Sequence
  chemically synthesized
tttaaaaaaactatatgagt

SEQ ID NO: 587179 - DNA, 20 bp, Artificial Sequence
  chemically synthesized
ttttcttttaaaaaaactat

SEQ ID NO: 587180 - DNA, 20 bp, Artificial Sequence
  chemically synthesized
ataatatcctaatattaaaa

SEQ ID NO: 587181 - DNA, 20 bp, Artificial Sequence
  chemically synthesized
attatccacataaaaatcac

SEQ ID NO: 587182 - DNA, 20 bp, Artificial Sequence
  chemically synthesized
ttaaccttttggtgaagctc

SEQ ID NO: 587183 - DNA, 20 bp, Artificial Sequence
  chemically synthesized
caccaaaaggttaaaacccc

SEQ ID NO: 587184 - DNA, 20 bp, Artificial Sequence
  chemically synthesized
gtgattccaaaataaacagt

SEQ ID NO: 587185 - DNA, 20 bp, Artificial Sequence
  chemically synthesized
agctttctatttaaatataa

SEQ ID NO: 587186 - DNA, 20 bp, Artificial Sequence
  chemically synthesized
atgtgacttatttgagacca

SEQ ID NO: 587187 - DNA, 20 bp, Artificial Sequence
  chemically synthesized
taaagaatgataaagcatat

SEQ ID NO: 587188 - DNA, 20 bp, Artificial Sequence
  chemically synthesized
cccatttatttaaaaccaaa

SEQ ID NO: 587189 - DNA, 20 bp, Artificial Sequence
  chemically synthesized
aagacatgaaagagatgaaa

SEQ ID NO: 587190 - DNA, 20 bp, Artificial Sequence
  chemically synthesized
ccttccctgaccccgttaat

SEQ ID NO: 587191 - DNA, 20 bp, Artificial Sequence
  chemically synthesized
tgccactctttttctgcccc

SEQ ID NO: 587192 - DNA, 20 bp, Artificial Sequence
  chemically synthesized
ggcaaatatgcaaatagaaa

SEQ ID NO: 587193 - DNA, 20 bp, Artificial Sequence
  chemically synthesized
tgggcagatcacctgaggtc

SEQ ID NO: 587194 - DNA, 20 bp, Artificial Sequence
  chemically synthesized
ttttgtattttaagtagaga

SEQ ID NO: 587195 - DNA, 20 bp, Artificial Sequence
  chemically synthesized
tgcctcagcttcccgagtag

SEQ ID NO: 587196 - DNA, 20 bp, Artificial Sequence
  chemically synthesized
tcgggaagctgaggcaggag

SEQ ID NO: 587197 - DNA, 20 bp, Artificial Sequence
  chemically synthesized
ggttcaagcgattctcctgc

SEQ ID NO: 587198 - DNA, 20 bp, Artificial Sequence
  chemically synthesized
aacctctgtctcctgggttc

SEQ ID NO: 587199 - DNA, 20 bp, Artificial Sequence
  chemically synthesized
ttttttttttttttttgaga

SEQ ID NO: 587200 - DNA, 20 bp, Artificial Sequence
  chemically synthesized
aaaaaaaaaaaaaaacaaaa

SEQ ID NO: 587201 - DNA, 20 bp, Artificial Sequence
  chemically synthesized
atatttattaggaatcttct

SEQ ID NO: 587202 - DNA, 20 bp, Artificial Sequence
  chemically synthesized
atcatcatcactctcttcct

SEQ ID NO: 587203 - DNA, 20 bp, Artificial Sequence
  chemically synthesized
ttcacccacacttctgactc

SEQ ID NO: 587204 - DNA, 20 bp, Artificial Sequence
  chemically synthesized
tcagagagaggaacacagag

SEQ ID NO: 587205 - DNA, 20 bp, Artificial Sequence
  chemically synthesized
gccattagcgtaaatttatg

SEQ ID NO: 587206 - DNA, 20 bp, Artificial Sequence
  chemically synthesized
aatttacgctaatggctata

SEQ ID NO: 587207 - DNA, 20 bp, Artificial Sequence
  chemically synthesized
tttaagggagtggtggacag

SEQ ID NO: 587208 - DNA, 20 bp, Artificial Sequence
  chemically synthesized
atagctatattatcttcacc

SEQ ID NO: 587209 - DNA, 20 bp, Artificial Sequence
  chemically synthesized
cacctcagcctccgaaagtg

SEQ ID NO: 587210 - DNA, 20 bp, Artificial Sequence
  chemically synthesized
aacctccacctcccgggttc

SEQ ID NO: 587211 - DNA, 20 bp, Artificial Sequence
  chemically synthesized
atttattttttgagacagag

SEQ ID NO: 587212 - DNA, 20 bp, Artificial Sequence
  chemically synthesized
tgtggagaaagtcacctgcc

SEQ ID NO: 587213 - DNA, 20 bp, Artificial Sequence
  chemically synthesized
caactgattatgatattagg

SEQ ID NO: 587214 - DNA, 20 bp, Artificial Sequence
  chemically synthesized
ctggaggacacagggagggg

SEQ ID NO: 587215 - DNA, 20 bp, Artificial Sequence
  chemically synthesized
tctaccctcctgtaataagt

SEQ ID NO: 587216 - DNA, 20 bp, Artificial Sequence
  chemically synthesized
ctcctgtaataagtaagagc

SEQ ID NO: 587217 - DNA, 20 bp, Artificial Sequence
  chemically synthesized
tttttttaaaagtaaaagaa

SEQ ID NO: 587218 - DNA, 20 bp, Artificial Sequence
  chemically synthesized
accagatttaggtaaataac

SEQ ID NO: 587219 - DNA, 20 bp, Artificial Sequence
  chemically synthesized
acctaaatctggtactgatc

SEQ ID NO: 587220 - DNA, 20 bp, Artificial Sequence
  chemically synthesized
atagaaagcaaatgatcagt

SEQ ID NO: 587221 - DNA, 20 bp, Artificial Sequence
  chemically synthesized
tgcctctgtatccctgttag

SEQ ID NO: 587222 - DNA, 20 bp, Artificial Sequence
  chemically synthesized
ccatatgcctctgtatccct

SEQ ID NO: 587223 - DNA, 20 bp, Artificial Sequence
  chemically synthesized
gaggcatatggatggagaaa

SEQ ID NO: 587224 - DNA, 20 bp, Artificial Sequence
  chemically synthesized
tgtctttgccattaaatgcc

SEQ ID NO: 587225 - DNA, 20 bp, Artificial Sequence
  chemically synthesized
attactacagcatccataat

SEQ ID NO: 587226 - DNA, 20 bp, Artificial Sequence
  chemically synthesized
tacatgatggtgttcgtaac

SEQ ID NO: 587227 - DNA, 20 bp, Artificial Sequence
  chemically synthesized
tttgtgggttgtgaaagagt

SEQ ID NO: 587228 - DNA, 20 bp, Artificial Sequence
  chemically synthesized
aactatctaaaatatacaat

SEQ ID NO: 587229 - DNA, 20 bp, Artificial Sequence
  chemically synthesized
ccttgttctctttttatgag

SEQ ID NO: 587230 - DNA, 20 bp, Artificial Sequence
  chemically synthesized
aaaagtctgtatctttacac

SEQ ID NO: 587231 - DNA, 20 bp, Artificial Sequence
  chemically synthesized
cccttcttggtttctacctt

SEQ ID NO: 587232 - DNA, 20 bp, Artificial Sequence
  chemically synthesized
cattaaaggtagaaaccaag

SEQ ID NO: 587233 - DNA, 20 bp, Artificial Sequence
  chemically synthesized
ttgaaaaaaaaaaatccctt

SEQ ID NO: 587234 - DNA, 20 bp, Artificial Sequence
  chemically synthesized
tttttttttttcaaataact

SEQ ID NO: 587235 - DNA, 20 bp, Artificial Sequence
  chemically synthesized
agagacacttaagcgcacat

SEQ ID NO: 587236 - DNA, 20 bp, Artificial Sequence
  chemically synthesized
tatgacattaaaaccataat

SEQ ID NO: 587237 - DNA, 20 bp, Artificial Sequence
  chemically synthesized
cgtaaagatgttgactgagc

SEQ ID NO: 587238 - DNA, 20 bp, Artificial Sequence
  chemically synthesized
aaatttcaatcaatatcctg

SEQ ID NO: 587239 - DNA, 20 bp, Artificial Sequence
  chemically synthesized
ttacataaagccttccagga

SEQ ID NO: 587240 - DNA, 20 bp, Artificial Sequence
  chemically synthesized
ttccactttgttcttcctat

SEQ ID NO: 587241 - DNA, 20 bp, Artificial Sequence
  chemically synthesized
tgaataggaagaacaaagtg

SEQ ID NO: 587242 - DNA, 20 bp, Artificial Sequence
  chemically synthesized
ggtttacacaaccagatcca

SEQ ID NO: 587243 - DNA, 20 bp, Artificial Sequence
  chemically synthesized
agatccaaaatgtttaaata

SEQ ID NO: 587244 - DNA, 20 bp, Artificial Sequence
  chemically synthesized
ctagtagcctctggactact

SEQ ID NO: 587245 - DNA, 20 bp, Artificial Sequence
  chemically synthesized
gaagagagagaaaggggaac

SEQ ID NO: 587246 - DNA, 20 bp, Artificial Sequence
  chemically synthesized
caccttggactcccaaagtc

SEQ ID NO: 587247 - DNA, 20 bp, Artificial Sequence
  chemically synthesized
tgggcggatcacctgaggtc

SEQ ID NO: 587248 - DNA, 20 bp, Artificial Sequence
  chemically synthesized
ttttgtatttttagtagaga

SEQ ID NO: 587249 - DNA, 20 bp, Artificial Sequence
  chemically synthesized
gcacctgccagcatgcccag

SEQ ID NO: 587250 - DNA, 20 bp, Artificial Sequence
  chemically synthesized
tgcctcagcctccctagtag

SEQ ID NO: 587251 - DNA, 20 bp, Artificial Sequence
  chemically synthesized
gcatttattacaaccatcac

SEQ ID NO: 587252 - DNA, 20 bp, Artificial Sequence
  chemically synthesized
cttaaaaaagtaacaccgaa

SEQ ID NO: 587253 - DNA, 20 bp, Artificial Sequence
  chemically synthesized
gattgaattgttcactttaa

SEQ ID NO: 587254 - DNA, 20 bp, Artificial Sequence
  chemically synthesized
ggtatgtgaattatagctcg

SEQ ID NO: 587255 - DNA, 20 bp, Artificial Sequence
  chemically synthesized
tgtgaattatagctcggtag

SEQ ID NO: 587256 - DNA, 20 bp, Artificial Sequence
  chemically synthesized
tcggtaggattgttttaaaa

SEQ ID NO: 587257 - DNA, 20 bp, Artificial Sequence
  chemically synthesized
tactttaacaacagtacttc

SEQ ID NO: 587258 - DNA, 20 bp, Artificial Sequence
  chemically synthesized
gtgaagtactgttgttaaag

SEQ ID NO: 587259 - DNA, 20 bp, Artificial Sequence
  chemically synthesized
tggattctgtatcctcttcc

SEQ ID NO: 587260 - DNA, 20 bp, Artificial Sequence
  chemically synthesized
aagaggatacagaatccaga

SEQ ID NO: 587261 - DNA, 20 bp, Artificial Sequence
  chemically synthesized
cttgtatgtatgaatctgct

SEQ ID NO: 587262 - DNA, 20 bp, Artificial Sequence
  chemically synthesized
aagagaacttgtatgtatga

SEQ ID NO: 587263 - DNA, 20 bp, Artificial Sequence
  chemically synthesized
agattcatacatacaagttc

SEQ ID NO: 587264 - DNA, 20 bp, Artificial Sequence
  chemically synthesized
gccatgaaaatacagtgggg

SEQ ID NO: 587265 - DNA, 20 bp, Artificial Sequence
  chemically synthesized
aatagtgctggatcaattga

SEQ ID NO: 587266 - DNA, 20 bp, Artificial Sequence
  chemically synthesized
actataaattcatatgtacc

SEQ ID NO: 587267 - DNA, 20 bp, Artificial Sequence
  chemically synthesized
atttaataaatagtattact

SEQ ID NO: 587268 - DNA, 20 bp, Artificial Sequence
  chemically synthesized
acctactgatttattaactt

SEQ ID NO: 587269 - DNA, 20 bp, Artificial Sequence
  chemically synthesized
agtttatttatttacttacc

SEQ ID NO: 587270 - DNA, 20 bp, Artificial Sequence
  chemically synthesized
aatgtacactaacgttcgcc

SEQ ID NO: 587271 - DNA, 20 bp, Artificial Sequence
  chemically synthesized
ccacaggtgtgaataattaa

SEQ ID NO: 587272 - DNA, 20 bp, Artificial Sequence
  chemically synthesized
aattaattttgatttatgac

SEQ ID NO: 587273 - DNA, 20 bp, Artificial Sequence
  chemically synthesized
ctagaaccagaccacgtcct

SEQ ID NO: 587274 - DNA, 20 bp, Artificial Sequence
  chemically synthesized
aatacttcgccatttcttca

SEQ ID NO: 587275 - DNA, 20 bp, Artificial Sequence
  chemically synthesized
tagaaaaaatgatgatggtg

SEQ ID NO: 587276 - DNA, 20 bp, Artificial Sequence
  chemically synthesized
cctgaccgtttgctttggct

SEQ ID NO: 587277 - DNA, 20 bp, Artificial Sequence
  chemically synthesized
tttgtttttttaacctgacc

SEQ ID NO: 587278 - DNA, 20 bp, Artificial Sequence
  chemically synthesized
ttgttttgtttttttaacct

SEQ ID NO: 587279 - DNA, 20 bp, Artificial Sequence
  chemically synthesized
gtatgtggattgttgttttg

SEQ ID NO: 587280 - DNA, 20 bp, Artificial Sequence
  chemically synthesized
ggctggtatgtggattgttg

SEQ ID NO: 587281 - DNA, 20 bp, Artificial Sequence
  chemically synthesized
gaggaggctggtatgtggat

SEQ ID NO: 587282 - DNA, 20 bp, Artificial Sequence
  chemically synthesized
ggtcggggaggaggctggta

SEQ ID NO: 587283 - DNA, 20 bp, Artificial Sequence
  chemically synthesized
ttgtatgtattttgtttcct

SEQ ID NO: 587284 - DNA, 20 bp, Artificial Sequence
  chemically synthesized
gttgcaagtatttgtatgta

SEQ ID NO: 587285 - DNA, 20 bp, Artificial Sequence
  chemically synthesized
aatgtctaacctttatccac

SEQ ID NO: 587286 - DNA, 20 bp, Artificial Sequence
  chemically synthesized
cctttatccactggagattt

SEQ ID NO: 587287 - DNA, 20 bp, Artificial Sequence
  chemically synthesized
tccactggagatttgtctgc

SEQ ID NO: 587288 - DNA, 20 bp, Artificial Sequence
  chemically synthesized
ttgtctgcttgagcttattt

SEQ ID NO: 587289 - DNA, 20 bp, Artificial Sequence
  chemically synthesized
ttcaagtttatcttgctctt

SEQ ID NO: 587290 - DNA, 20 bp, Artificial Sequence
  chemically synthesized
gcacttacaagcacgggtcc

SEQ ID NO: 587291 - DNA, 20 bp, Artificial Sequence
  chemically synthesized
attaaatgaaactggaggac

SEQ ID NO: 587292 - DNA, 20 bp, Artificial Sequence
  chemically synthesized
cgggtcctccagtttcattt

SEQ ID NO: 587293 - DNA, 20 bp, Artificial Sequence
  chemically synthesized
ttttaaacgttgttgcattt

SEQ ID NO: 587294 - DNA, 20 bp, Artificial Sequence
  chemically synthesized
actgaaacagacaaatgcaa

SEQ ID NO: 587295 - DNA, 20 bp, Artificial Sequence
  chemically synthesized
cacaattccaactaccttgt

SEQ ID NO: 587296 - DNA, 20 bp, Artificial Sequence
  chemically synthesized
aactaccttgtctttgcttc

SEQ ID NO: 587297 - DNA, 20 bp, Artificial Sequence
  chemically synthesized
taccactgggccctcggtca

SEQ ID NO: 587298 - DNA, 20 bp, Artificial Sequence
  chemically synthesized
ccagtggtacctcaaatacc

SEQ ID NO: 587299 - DNA, 20 bp, Artificial Sequence
  chemically synthesized
agttttctatctgagcacag

SEQ ID NO: 587300 - DNA, 20 bp, Artificial Sequence
  chemically synthesized
gatttatctactgagggggt

SEQ ID NO: 587301 - DNA, 20 bp, Artificial Sequence
  chemically synthesized
atataatcgtttattttcta

SEQ ID NO: 587302 - DNA, 20 bp, Artificial Sequence
  chemically synthesized
gataaatctctgtagaaaat

SEQ ID NO: 587303 - DNA, 20 bp, Artificial Sequence
  chemically synthesized
aaatttatgagggataatat

SEQ ID NO: 587304 - DNA, 20 bp, Artificial Sequence
  chemically synthesized
gacactaactttatttggag

SEQ ID NO: 587305 - DNA, 20 bp, Artificial Sequence
  chemically synthesized
gttctatttctgatagagag

SEQ ID NO: 587306 - DNA, 20 bp, Artificial Sequence
  chemically synthesized
catagcatgccatagcatac

SEQ ID NO: 587307 - DNA, 20 bp, Artificial Sequence
  chemically synthesized
aaccttttcacatttattat

SEQ ID NO: 587308 - DNA, 20 bp, Artificial Sequence
  chemically synthesized
ctggtatttaacccctttgt

SEQ ID NO: 587309 - DNA, 20 bp, Artificial Sequence
  chemically synthesized
gaaccacacctttgttgctt

SEQ ID NO: 587310 - DNA, 20 bp, Artificial Sequence
  chemically synthesized
ccaaatttgaaccacacctt

SEQ ID NO: 587311 - DNA, 20 bp, Artificial Sequence
  chemically synthesized
aaaggtgtggttcaaatttg

SEQ ID NO: 587312 - DNA, 20 bp, Artificial Sequence
  chemically synthesized
aaaatgaagtgttaacacca

SEQ ID NO: 587313 - DNA, 20 bp, Artificial Sequence
  chemically synthesized
tgagattttattttagtgaa

SEQ ID NO: 587314 - DNA, 20 bp, Artificial Sequence
  chemically synthesized
tggtcgtgtgactgaggaac

SEQ ID NO: 587315 - DNA, 20 bp, Artificial Sequence
  chemically synthesized
gttctatttgaaagcactga

SEQ ID NO: 587316 - DNA, 20 bp, Artificial Sequence
  chemically synthesized
tctcctgaaagaatctagat

SEQ ID NO: 587317 - DNA, 20 bp, Artificial Sequence
  chemically synthesized
taataagaaaatgccactaa

SEQ ID NO: 587318 - DNA, 20 bp, Artificial Sequence
  chemically synthesized
tctagggtataaccatcttc

SEQ ID NO: 587319 - DNA, 20 bp, Artificial Sequence
  chemically synthesized
tccgatgttttactaggtat

SEQ ID NO: 587320 - DNA, 20 bp, Artificial Sequence
  chemically synthesized
tggagcactgactatacatc

SEQ ID NO: 587321 - DNA, 20 bp, Artificial Sequence
  chemically synthesized
atgtatagtcagtgctccat

SEQ ID NO: 587322 - DNA, 20 bp, Artificial Sequence
  chemically synthesized
ttcttgttcaggtgtaaacc

SEQ ID NO: 587323 - DNA, 20 bp, Artificial Sequence
  chemically synthesized
acgtttatttctgtgaaaca

SEQ ID NO: 587324 - DNA, 20 bp, Artificial Sequence
  chemically synthesized
acctcttgtttcacagaaat

SEQ ID NO: 587325 - DNA, 20 bp, Artificial Sequence
  chemically synthesized
gtaaattagagtccaatgtc

SEQ ID NO: 587326 - DNA, 20 bp, Artificial Sequence
  chemically synthesized
tggtcctttatcaatgattc

SEQ ID NO: 587327 - DNA, 20 bp, Artificial Sequence
  chemically synthesized
aaatgaaattggtcctttat

SEQ ID NO: 587328 - DNA, 20 bp, Artificial Sequence
  chemically synthesized
aaaggaccaatttcatttcc

SEQ ID NO: 587329 - DNA, 20 bp, Artificial Sequence
  chemically synthesized
accattgtcaaaatctgata

SEQ ID NO: 587330 - DNA, 20 bp, Artificial Sequence
  chemically synthesized
ctattttatttaatcttcat

SEQ ID NO: 587331 - DNA, 20 bp, Artificial Sequence
  chemically synthesized
aatacttggcacataacagg

SEQ ID NO: 587332 - DNA, 20 bp, Artificial Sequence
  chemically synthesized
atttctcttcccctttcacc

SEQ ID NO: 587333 - DNA, 20 bp, Artificial Sequence
  chemically synthesized
aaatgaaatagatccaaaag

SEQ ID NO: 587334 - DNA, 20 bp, Artificial Sequence
  chemically synthesized
attggattaactttcatggt

SEQ ID NO: 587335 - DNA, 20 bp, Artificial Sequence
  chemically synthesized
tgtgcaattggattaacttt

SEQ ID NO: 587336 - DNA, 20 bp, Artificial Sequence
  chemically synthesized
tgacatgctctgattgtgca

SEQ ID NO: 587337 - DNA, 20 bp, Artificial Sequence
  chemically synthesized
tcccttggctgactgacatg

SEQ ID NO: 587338 - DNA, 20 bp, Artificial Sequence
  chemically synthesized
ctactgtgatgtctgcttat

SEQ ID NO: 587339 - DNA, 20 bp, Artificial Sequence
  chemically synthesized
tcataccgtcctactgtgat

SEQ ID NO: 587340 - DNA, 20 bp, Artificial Sequence
  chemically synthesized
atagacatccagcttattcc

SEQ ID NO: 587341 - DNA, 20 bp, Artificial Sequence
  chemically synthesized
tccatttggttgaatagaca

SEQ ID NO: 587342 - DNA, 20 bp, Artificial Sequence
  chemically synthesized
ccgaagcaatgttttgtttt

SEQ ID NO: 587343 - DNA, 20 bp, Artificial Sequence
  chemically synthesized
acaaatcagctaaaacaaaa

SEQ ID NO: 587344 - DNA, 20 bp, Artificial Sequence
  chemically synthesized
tatattcccccgaagcaatg

SEQ ID NO: 587345 - DNA, 20 bp, Artificial Sequence
  chemically synthesized
ggcattatattcccccgaag

SEQ ID NO: 587346 - DNA, 20 bp, Artificial Sequence
  chemically synthesized
atccattttcttagggaaga

SEQ ID NO: 587347 - DNA, 20 bp, Artificial Sequence
  chemically synthesized
atccagatcttccctaagaa

SEQ ID NO: 587348 - DNA, 20 bp, Artificial Sequence
  chemically synthesized
atctgtcctggttacctacc

SEQ ID NO: 587349 - DNA, 20 bp, Artificial Sequence
  chemically synthesized
atctccaggtaggtaaccag

SEQ ID NO: 587350 - DNA, 20 bp, Artificial Sequence
  chemically synthesized
gtaaccaggacagattaaaa

SEQ ID NO: 587351 - DNA, 20 bp, Artificial Sequence
  chemically synthesized
gattaaaaaagtgattccca

SEQ ID NO: 587352 - DNA, 20 bp, Artificial Sequence
  chemically synthesized
aaaagtgattcccatttaga

SEQ ID NO: 587353 - DNA, 20 bp, Artificial Sequence
  chemically synthesized
ttcccatttagatttagatt

SEQ ID NO: 587354 - DNA, 20 bp, Artificial Sequence
  chemically synthesized
tatgattccacaatctggtc

SEQ ID NO: 587355 - DNA, 20 bp, Artificial Sequence
  chemically synthesized
tataattttaaaaactgaag

SEQ ID NO: 587356 - DNA, 20 bp, Artificial Sequence
  chemically synthesized
atctttgatttgaaattaat

SEQ ID NO: 587357 - DNA, 20 bp, Artificial Sequence
  chemically synthesized
atataattcacagtttttat

SEQ ID NO: 587358 - DNA, 20 bp, Artificial Sequence
  chemically synthesized
atgtctaaatgtatataatt

SEQ ID NO: 587359 - DNA, 20 bp, Artificial Sequence
  chemically synthesized
tacatctacacatatagatg

SEQ ID NO: 587360 - DNA, 20 bp, Artificial Sequence
  chemically synthesized
ttattcatagttccttgcta

SEQ ID NO: 587361 - DNA, 20 bp, Artificial Sequence
  chemically synthesized
taacctaatgggcagaaaac

SEQ ID NO: 587362 - DNA, 20 bp, Artificial Sequence
  chemically synthesized
atctattttttaattcaatc

SEQ ID NO: 587363 - DNA, 20 bp, Artificial Sequence
  chemically synthesized
aaccaatgattgaattaaaa

SEQ ID NO: 587364 - DNA, 20 bp, Artificial Sequence
  chemically synthesized
tctttatgcaagcaggccct

SEQ ID NO: 587365 - DNA, 20 bp, Artificial Sequence
  chemically synthesized
attttctcaaatcccccagg

SEQ ID NO: 587366 - DNA, 20 bp, Artificial Sequence
  chemically synthesized
ataaaattaccttgacttgc

SEQ ID NO: 587367 - DNA, 20 bp, Artificial Sequence
  chemically synthesized
aaaagagcagcaactaaaag

SEQ ID NO: 587368 - DNA, 20 bp, Artificial Sequence
  chemically synthesized
agtgggatactagcaatgtt

SEQ ID NO: 587369 - DNA, 20 bp, Artificial Sequence
  chemically synthesized
tttcaaagagatttaaatga

SEQ ID NO: 587370 - DNA, 20 bp, Artificial Sequence
  chemically synthesized
aatatcttgtcagaatttca

SEQ ID NO: 587371 - DNA, 20 bp, Artificial Sequence
  chemically synthesized
tgtcccagtttgcattaaca

SEQ ID NO: 587372 - DNA, 20 bp, Artificial Sequence
  chemically synthesized
ttaaattgccatgtttgtgt

SEQ ID NO: 587373 - DNA, 20 bp, Artificial Sequence
  chemically synthesized
aattgcttatttttaaattg

SEQ ID NO: 587374 - DNA, 20 bp, Artificial Sequence
  chemically synthesized
tgtatggttaacatctttta

SEQ ID NO: 587375 - DNA, 20 bp, Artificial Sequence
  chemically synthesized
ttcaagaatctctaaatgat

SEQ ID NO: 587376 - DNA, 20 bp, Artificial Sequence
  chemically synthesized
gattttaatctcttatcatt

SEQ ID NO: 587377 - DNA, 20 bp, Artificial Sequence
  chemically synthesized
tttgaatcagaatttttctt

SEQ ID NO: 587378 - DNA, 20 bp, Artificial Sequence
  chemically synthesized
ttaaaatcgaacaagaaaaa

SEQ ID NO: 587379 - DNA, 20 bp, Artificial Sequence
  chemically synthesized
gtggctcatgcctgtaaccc

SEQ ID NO: 587380 - DNA, 20 bp, Artificial Sequence
  chemically synthesized
tgggcggatcacttgaggtc

SEQ ID NO: 587381 - DNA, 20 bp, Artificial Sequence
  chemically synthesized
ttttgtatttttagtgtaga

SEQ ID NO: 587382 - DNA, 20 bp, Artificial Sequence
  chemically synthesized
actaaaaatacaaaaatttg

SEQ ID NO: 587383 - DNA, 20 bp, Artificial Sequence
  chemically synthesized
tgcctcagcctccctagtag

SEQ ID NO: 587384 - DNA, 20 bp, Artificial Sequence
  chemically synthesized
agcctctgccttccacgttc

SEQ ID NO: 587385 - DNA, 20 bp, Artificial Sequence
  chemically synthesized
gtggagtgcagtggcacgat

SEQ ID NO: 587386 - DNA, 20 bp, Artificial Sequence
  chemically synthesized
attatgtcattatatctgag

SEQ ID NO: 587387 - DNA, 20 bp, Artificial Sequence
  chemically synthesized
aactttagcattactaacat

SEQ ID NO: 587388 - DNA, 20 bp, Artificial Sequence
  chemically synthesized
ccctgagctgtgacaaccaa

SEQ ID NO: 587389 - DNA, 20 bp, Artificial Sequence
  chemically synthesized
taagtatataacctaaagtt

SEQ ID NO: 587390 - DNA, 20 bp, Artificial Sequence
  chemically synthesized
acctaaagttacaagtttta

SEQ ID NO: 587391 - DNA, 20 bp, Artificial Sequence
  chemically synthesized
tgagaggacaaaaatataaa

SEQ ID NO: 587392 - DNA, 20 bp, Artificial Sequence
  chemically synthesized
gacaaaaatataaacaaggt

SEQ ID NO: 587393 - DNA, 20 bp, Artificial Sequence
  chemically synthesized
aaatataaacaaggtttttg

SEQ ID NO: 587394 - DNA, 20 bp, Artificial Sequence
  chemically synthesized
ctacttaaacaaaacaaaaa

SEQ ID NO: 587395 - DNA, 20 bp, Artificial Sequence
  chemically synthesized
gtttaagtagcagccatttt

SEQ ID NO: 587396 - DNA, 20 bp, Artificial Sequence
  chemically synthesized
ctgcttcttattctgtgggt

SEQ ID NO: 587397 - DNA, 20 bp, Artificial Sequence
  chemically synthesized
gatagggctcagttgagcag

SEQ ID NO: 587398 - DNA, 20 bp, Artificial Sequence
  chemically synthesized
agttgagcagttctgcttta

SEQ ID NO: 587399 - DNA, 20 bp, Artificial Sequence
  chemically synthesized
gcagttctgctttatgtggc

SEQ ID NO: 587400 - DNA, 20 bp, Artificial Sequence
  chemically synthesized
tctgctttatgtggcttcag

SEQ ID NO: 587401 - DNA, 20 bp, Artificial Sequence
  chemically synthesized
cagtttagcatgtaataatt

SEQ ID NO: 587402 - DNA, 20 bp, Artificial Sequence
  chemically synthesized
cactaaattattacatgcta

SEQ ID NO: 587403 - DNA, 20 bp, Artificial Sequence
  chemically synthesized
ttgtgagtcataattcggaa

SEQ ID NO: 587404 - DNA, 20 bp, Artificial Sequence
  chemically synthesized
cttatttgaggaaagagaaa

SEQ ID NO: 587405 - DNA, 20 bp, Artificial Sequence
  chemically synthesized
acatatgttaagtattttaa

SEQ ID NO: 587406 - DNA, 20 bp, Artificial Sequence
  chemically synthesized
ttaacatatgttgtactcgt

SEQ ID NO: 587407 - DNA, 20 bp, Artificial Sequence
  chemically synthesized
ccataaatttattcttacat

SEQ ID NO: 587408 - DNA, 20 bp, Artificial Sequence
  chemically synthesized
attgtaagacagctgaacaa

SEQ ID NO: 587409 - DNA, 20 bp, Artificial Sequence
  chemically synthesized
agacagctgaacaaaattgt

SEQ ID NO: 587410 - DNA, 20 bp, Artificial Sequence
  chemically synthesized
gcttaaaataattgaaaatt

SEQ ID NO: 587411 - DNA, 20 bp, Artificial Sequence
  chemically synthesized
gttgtcttttgggaactatg

SEQ ID NO: 587412 - DNA, 20 bp, Artificial Sequence
  chemically synthesized
gaactatgtgtagcttccat

SEQ ID NO: 587413 - DNA, 20 bp, Artificial Sequence
  chemically synthesized
acgtatattacacttcagtt

SEQ ID NO: 587414 - DNA, 20 bp, Artificial Sequence
  chemically synthesized
aatttaactgtatagcccaa

SEQ ID NO: 587415 - DNA, 20 bp, Artificial Sequence
  chemically synthesized
aaagggataagaggagattt

SEQ ID NO: 587416 - DNA, 20 bp, Artificial Sequence
  chemically synthesized
agtgactgcaaagggataag

SEQ ID NO: 587417 - DNA, 20 bp, Artificial Sequence
  chemically synthesized
tataaccagtaccctgtcaa

SEQ ID NO: 587418 - DNA, 20 bp, Artificial Sequence
  chemically synthesized
atattatgaaaatggaattg

SEQ ID NO: 587419 - DNA, 20 bp, Artificial Sequence
  chemically synthesized
ctcgcctttttcattcaaaa

SEQ ID NO: 587420 - DNA, 20 bp, Artificial Sequence
  chemically synthesized
cagactaaaattatatgcaa

SEQ ID NO: 587421 - DNA, 20 bp, Artificial Sequence
  chemically synthesized
tagatggacatttgtgataa

SEQ ID NO: 587422 - DNA, 20 bp, Artificial Sequence
  chemically synthesized
ttgtgataattcagtttttt

SEQ ID NO: 587423 - DNA, 20 bp, Artificial Sequence
  chemically synthesized
atgattagctattttttttt

SEQ ID NO: 587424 - DNA, 20 bp, Artificial Sequence
  chemically synthesized
caaattaacaaatgtgtatt

SEQ ID NO: 587425 - DNA, 20 bp, Artificial Sequence
  chemically synthesized
tctaagagctcaattgggca

SEQ ID NO: 587426 - DNA, 20 bp, Artificial Sequence
  chemically synthesized
atacgttatataccttgtct

SEQ ID NO: 587427 - DNA, 20 bp, Artificial Sequence
  chemically synthesized
tcataatccttggcttacat

SEQ ID NO: 587428 - DNA, 20 bp, Artificial Sequence
  chemically synthesized
gaagaaacaagcatgtaagc

SEQ ID NO: 587429 - DNA, 20 bp, Artificial Sequence
  chemically synthesized
ttaatcataatccttggctt

SEQ ID NO: 587430 - DNA, 20 bp, Artificial Sequence
  chemically synthesized
acaagcatgtaagccaagga

SEQ ID NO: 587431 - DNA, 20 bp, Artificial Sequence
  chemically synthesized
tataatacttaatcataatc

SEQ ID NO: 587432 - DNA, 20 bp, Artificial Sequence
  chemically synthesized
aggagaagttatttctgggg

SEQ ID NO: 587433 - DNA, 20 bp, Artificial Sequence
  chemically synthesized
tgcaacatgctgatctatct

SEQ ID NO: 587434 - DNA, 20 bp, Artificial Sequence
  chemically synthesized
gcataagtccaataaccaga

SEQ ID NO: 587435 - DNA, 20 bp, Artificial Sequence
  chemically synthesized
atgcaagcataagtccaata

SEQ ID NO: 587436 - DNA, 20 bp, Artificial Sequence
  chemically synthesized
tcagaatctggttattggac

SEQ ID NO: 587437 - DNA, 20 bp, Artificial Sequence
  chemically synthesized
cttatgcttgcatatattca

SEQ ID NO: 587438 - DNA, 20 bp, Artificial Sequence
  chemically synthesized
ttaaattcatttatacattt

SEQ ID NO: 587439 - DNA, 20 bp, Artificial Sequence
  chemically synthesized
atttattcgcttatttttac

SEQ ID NO: 587440 - DNA, 20 bp, Artificial Sequence
  chemically synthesized
tcgcttatttttacaaatgt

SEQ ID NO: 587441 - DNA, 20 bp, Artificial Sequence
  chemically synthesized
ttttacaaatgtttatgatt

SEQ ID NO: 587442 - DNA, 20 bp, Artificial Sequence
  chemically synthesized
gtcccaggaatgaacagtgg

SEQ ID NO: 587443 - DNA, 20 bp, Artificial Sequence
  chemically synthesized
cctgggacactgggagcagg

SEQ ID NO: 587444 - DNA, 20 bp, Artificial Sequence
  chemically synthesized
tcatatattttggggaaact

SEQ ID NO: 587445 - DNA, 20 bp, Artificial Sequence
  chemically synthesized
atctcttgatttattaaact

SEQ ID NO: 587446 - DNA, 20 bp, Artificial Sequence
  chemically synthesized
ctctccccgagctccagatc

SEQ ID NO: 587447 - DNA, 20 bp, Artificial Sequence
  chemically synthesized
taatgactaaagtccttatt

SEQ ID NO: 587448 - DNA, 20 bp, Artificial Sequence
  chemically synthesized
tttaccgtgttttctctgcc

SEQ ID NO: 587449 - DNA, 20 bp, Artificial Sequence
  chemically synthesized
ttagttcaaaagttagttta

SEQ ID NO: 587450 - DNA, 20 bp, Artificial Sequence
  chemically synthesized
tgttaattattagttcaaaa

SEQ ID NO: 587451 - DNA, 20 bp, Artificial Sequence
  chemically synthesized
ttgaactaataattaacatt

SEQ ID NO: 587452 - DNA, 20 bp, Artificial Sequence
  chemically synthesized
attttctgagtccattcttt

SEQ ID NO: 587453 - DNA, 20 bp, Artificial Sequence
  chemically synthesized
tttaaataagagagaattgt

SEQ ID NO: 587454 - DNA, 20 bp, Artificial Sequence
  chemically synthesized
aagtcaatttcaaagccttt

SEQ ID NO: 587455 - DNA, 20 bp, Artificial Sequence
  chemically synthesized
ccatacataagaaatcaaca

SEQ ID NO: 587456 - DNA, 20 bp, Artificial Sequence
  chemically synthesized
tcctcctcttcttctactct

SEQ ID NO: 587457 - DNA, 20 bp, Artificial Sequence
  chemically synthesized
aagagcaccgtaggcattcc

SEQ ID NO: 587458 - DNA, 20 bp, Artificial Sequence
  chemically synthesized
agacctccttcccaggtctg

SEQ ID NO: 587459 - DNA, 20 bp, Artificial Sequence
  chemically synthesized
acagacctgggaaggaggtc

SEQ ID NO: 587460 - DNA, 20 bp, Artificial Sequence
  chemically synthesized
aagcatcctctcacttcaat

SEQ ID NO: 587461 - DNA, 20 bp, Artificial Sequence
  chemically synthesized
aaacattcattgaagtgaga

SEQ ID NO: 587462 - DNA, 20 bp, Artificial Sequence
  chemically synthesized
ggagtctacatacttactct

SEQ ID NO: 587463 - DNA, 20 bp, Artificial Sequence
  chemically synthesized
accacaaactgcactcccca

SEQ ID NO: 587464 - DNA, 20 bp, Artificial Sequence
  chemically synthesized
gtagtaagctttgtggggag

SEQ ID NO: 587465 - DNA, 20 bp, Artificial Sequence
  chemically synthesized
gactcaggtaggaaggggta

SEQ ID NO: 587466 - DNA, 20 bp, Artificial Sequence
  chemically synthesized
ctctgtactccgtgtcccag

SEQ ID NO: 587467 - DNA, 20 bp, Artificial Sequence
  chemically synthesized
gcctgggacacggagtacag

SEQ ID NO: 587468 - DNA, 20 bp, Artificial Sequence
  chemically synthesized
ggagtacagaggagattgga

SEQ ID NO: 587469 - DNA, 20 bp, Artificial Sequence
  chemically synthesized
ggaatagagataataatccc

SEQ ID NO: 587470 - DNA, 20 bp, Artificial Sequence
  chemically synthesized
tagggtttactctaaagcaa

SEQ ID NO: 587471 - DNA, 20 bp, Artificial Sequence
  chemically synthesized
cgagaccagccacttcccca

SEQ ID NO: 587472 - DNA, 20 bp, Artificial Sequence
  chemically synthesized
ccctatggggaagtggctgg

SEQ ID NO: 587473 - DNA, 20 bp, Artificial Sequence
  chemically synthesized
agtggctggtctcgattgct

SEQ ID NO: 587474 - DNA, 20 bp, Artificial Sequence
  chemically synthesized
gctggtctcgattgctggca

SEQ ID NO: 587475 - DNA, 20 bp, Artificial Sequence
  chemically synthesized
gtggaacagcaccatttccc

SEQ ID NO: 587476 - DNA, 20 bp, Artificial Sequence
  chemically synthesized
tagacgttttcttcttccac

SEQ ID NO: 587477 - DNA, 20 bp, Artificial Sequence
  chemically synthesized
aaggatgcctgtactatact

SEQ ID NO: 587478 - DNA, 20 bp, Artificial Sequence
  chemically synthesized
gtatagtacaggcatccttt

SEQ ID NO: 587479 - DNA, 20 bp, Artificial Sequence
  chemically synthesized
ttatttgtttaaatgttcca

SEQ ID NO: 587480 - DNA, 20 bp, Artificial Sequence
  chemically synthesized
atctagacccaaggaattaa

SEQ ID NO: 587481 - DNA, 20 bp, Artificial Sequence
  chemically synthesized
agcagatttaattccttggg

SEQ ID NO: 587482 - DNA, 20 bp, Artificial Sequence
  chemically synthesized
tatctcatctttttctctct

SEQ ID NO: 587483 - DNA, 20 bp, Artificial Sequence
  chemically synthesized
gagtcaaatagtaatggagg

SEQ ID NO: 587484 - DNA, 20 bp, Artificial Sequence
  chemically synthesized
ctccattactatttgactcc

SEQ ID NO: 587485 - DNA, 20 bp, Artificial Sequence
  chemically synthesized
ttaagtaaaatcttgctaaa

SEQ ID NO: 587486 - DNA, 20 bp, Artificial Sequence
  chemically synthesized
tcaaatgtaatcagatttta

SEQ ID NO: 587487 - DNA, 20 bp, Artificial Sequence
  chemically synthesized
gtctaggtttttcaaatgta

SEQ ID NO: 587488 - DNA, 20 bp, Artificial Sequence
  chemically synthesized
taaaagccttgccaatgtgt

SEQ ID NO: 587489 - DNA, 20 bp, Artificial Sequence
  chemically synthesized
gaaaaacctagacacattgg

SEQ ID NO: 587490 - DNA, 20 bp, Artificial Sequence
  chemically synthesized
tgcttctagatgaaagttga

SEQ ID NO: 587491 - DNA, 20 bp, Artificial Sequence
  chemically synthesized
caactttcatctagaagcag

SEQ ID NO: 587492 - DNA, 20 bp, Artificial Sequence
  chemically synthesized
gttttcttttccttaaacgt

SEQ ID NO: 587493 - DNA, 20 bp, Artificial Sequence
  chemically synthesized
ttttgtttgtttggggggtt

SEQ ID NO: 587494 - DNA, 20 bp, Artificial Sequence
  chemically synthesized
cttaaatttttgtttgtttg

SEQ ID NO: 587495 - DNA, 20 bp, Artificial Sequence
  chemically synthesized
ttcctgctccttaaattttt

SEQ ID NO: 587496 - DNA, 20 bp, Artificial Sequence
  chemically synthesized
ctttttcctgctccttaaat

SEQ ID NO: 587497 - DNA, 20 bp, Artificial Sequence
  chemically synthesized
ttgagggttattattatttt

SEQ ID NO: 587498 - DNA, 20 bp, Artificial Sequence
  chemically synthesized
caaaaaaataataataaccc

SEQ ID NO: 587499 - DNA, 20 bp, Artificial Sequence
  chemically synthesized
atatttgaaaagaggggagt

SEQ ID NO: 587500 - DNA, 20 bp, Artificial Sequence
  chemically synthesized
agacatatttgaaaagaggg

SEQ ID NO: 587501 - DNA, 20 bp, Artificial Sequence
  chemically synthesized
tccagtacagaggagagatg

SEQ ID NO: 587502 - DNA, 20 bp, Artificial Sequence
  chemically synthesized
gttgtgcttattcatcatag

SEQ ID NO: 587503 - DNA, 20 bp, Artificial Sequence
  chemically synthesized
ctgggttcaaaccctatatt

SEQ ID NO: 587504 - DNA, 20 bp, Artificial Sequence
  chemically synthesized
aagaaaataagcatacaata

SEQ ID NO: 587505 - DNA, 20 bp, Artificial Sequence
  chemically synthesized
gtgtctctgtaggtcattaa

SEQ ID NO: 587506 - DNA, 20 bp, Artificial Sequence
  chemically synthesized
tcattaattacgctttaaaa

SEQ ID NO: 587507 - DNA, 20 bp, Artificial Sequence
  chemically synthesized
attactaggatcttaaaaaa

SEQ ID NO: 587508 - DNA, 20 bp, Artificial Sequence
  chemically synthesized
cattattgtgttattaggaa

SEQ ID NO: 587509 - DNA, 20 bp, Artificial Sequence
  chemically synthesized
attgtgttattaggaatttt

SEQ ID NO: 587510 - DNA, 20 bp, Artificial Sequence
  chemically synthesized
gattcaaaatgtataaataa

SEQ ID NO: 587511 - DNA, 20 bp, Artificial Sequence
  chemically synthesized
tcattctcattccagcagat

SEQ ID NO: 587512 - DNA, 20 bp, Artificial Sequence
  chemically synthesized
aaagttaacaatgggaatcc

SEQ ID NO: 587513 - DNA, 20 bp, Artificial Sequence
  chemically synthesized
aacaatgtgtatctaaatcc

SEQ ID NO: 587514 - DNA, 20 bp, Artificial Sequence
  chemically synthesized
agtattttgtaactgttggt

SEQ ID NO: 587515 - DNA, 20 bp, Artificial Sequence
  chemically synthesized
atataccaataaaacaaata

SEQ ID NO: 587516 - DNA, 20 bp, Artificial Sequence
  chemically synthesized
atatctatggcaagcttttt

SEQ ID NO: 587517 - DNA, 20 bp, Artificial Sequence
  chemically synthesized
gaatacttaaaatatctatg

SEQ ID NO: 587518 - DNA, 20 bp, Artificial Sequence
  chemically synthesized
tgaaaatgttgtatgtgtgt

SEQ ID NO: 587519 - DNA, 20 bp, Artificial Sequence
  chemically synthesized
gtgtacatgtttgtcattta

SEQ ID NO: 587520 - DNA, 20 bp, Artificial Sequence
  chemically synthesized
atgtctgttgcccatttttc

SEQ ID NO: 587521 - DNA, 20 bp, Artificial Sequence
  chemically synthesized
tcttttcacattatctgaaa

SEQ ID NO: 587522 - DNA, 20 bp, Artificial Sequence
  chemically synthesized
gaaacgtagtctcaattaat

SEQ ID NO: 587523 - DNA, 20 bp, Artificial Sequence
  chemically synthesized
gaaacatagattaattgaga

SEQ ID NO: 587524 - DNA, 20 bp, Artificial Sequence
  chemically synthesized
agattaattgagactacgtt

SEQ ID NO: 587525 - DNA, 20 bp, Artificial Sequence
  chemically synthesized
cagcttcctttttgcctttt

SEQ ID NO: 587526 - DNA, 20 bp, Artificial Sequence
  chemically synthesized
gttttttctaaataaaattt

SEQ ID NO: 587527 - DNA, 20 bp, Artificial Sequence
  chemically synthesized
acaacactatataaatttaa

SEQ ID NO: 587528 - DNA, 20 bp, Artificial Sequence
  chemically synthesized
tccatcttaaatttatatag

SEQ ID NO: 587529 - DNA, 20 bp, Artificial Sequence
  chemically synthesized
tagtgttgtttctaaccttg

SEQ ID NO: 587530 - DNA, 20 bp, Artificial Sequence
  chemically synthesized
atggtgctgggggaaaaaat

SEQ ID NO: 587531 - DNA, 20 bp, Artificial Sequence
  chemically synthesized
ccccagcaccatctcttctg

SEQ ID NO: 587532 - DNA, 20 bp, Artificial Sequence
  chemically synthesized
atctcttctgaattgattta

SEQ ID NO: 587533 - DNA, 20 bp, Artificial Sequence
  chemically synthesized
ggtgctttcttcatgatatt

SEQ ID NO: 587534 - DNA, 20 bp, Artificial Sequence
  chemically synthesized
ttcttcatgatattttaagt

SEQ ID NO: 587535 - DNA, 20 bp, Artificial Sequence
  chemically synthesized
gtttctgcttgttgatctac

SEQ ID NO: 587536 - DNA, 20 bp, Artificial Sequence
  chemically synthesized
taatgcactatgtcaattat

SEQ ID NO: 587537 - DNA, 20 bp, Artificial Sequence
  chemically synthesized
tcaattattgcagctttaaa

SEQ ID NO: 587538 - DNA, 20 bp, Artificial Sequence
  chemically synthesized
atttaaaaattttcagcgag

SEQ ID NO: 587539 - DNA, 20 bp, Artificial Sequence
  chemically synthesized
ttctcgctgaaaatttttaa

SEQ ID NO: 587540 - DNA, 20 bp, Artificial Sequence
  chemically synthesized
ccaagaacactgtaaataca

SEQ ID NO: 587541 - DNA, 20 bp, Artificial Sequence
  chemically synthesized
tttgaaagacagcatcttgc

SEQ ID NO: 587542 - DNA, 20 bp, Artificial Sequence
  chemically synthesized
gatttattctgagagttctt

SEQ ID NO: 587543 - DNA, 20 bp, Artificial Sequence
  chemically synthesized
caaagcttttactgtttaag

SEQ ID NO: 587544 - DNA, 20 bp, Artificial Sequence
  chemically synthesized
taaatcatcacttaaacagt

SEQ ID NO: 587545 - DNA, 20 bp, Artificial Sequence
  chemically synthesized
aaaagcttagccaaagcttt

SEQ ID NO: 587546 - DNA, 20 bp, Artificial Sequence
  chemically synthesized
ttaaacagtaaaagctttgg

SEQ ID NO: 587547 - DNA, 20 bp, Artificial Sequence
  chemically synthesized
aagacagcaaaaagcttagc

SEQ ID NO: 587548 - DNA, 20 bp, Artificial Sequence
  chemically synthesized
gtgtaaaaagaaagacagca

SEQ ID NO: 587549 - DNA, 20 bp, Artificial Sequence
  chemically synthesized
tttgtggaaaactttttttc

SEQ ID NO: 587550 - DNA, 20 bp, Artificial Sequence
  chemically synthesized
aaaaattaaatcactggaaa

SEQ ID NO: 587551 - DNA, 20 bp, Artificial Sequence
  chemically synthesized
atgttttcatatttaaaaga

SEQ ID NO: 587552 - DNA, 20 bp, Artificial Sequence
  chemically synthesized
ctagataagaaatgactacc

SEQ ID NO: 587553 - DNA, 20 bp, Artificial Sequence
  chemically synthesized
catttggtagtcatttctta

SEQ ID NO: 587554 - DNA, 20 bp, Artificial Sequence
  chemically synthesized
cagattataacaaggtccca

SEQ ID NO: 587555 - DNA, 20 bp, Artificial Sequence
  chemically synthesized
cccgttgggaccttgttata

SEQ ID NO: 587556 - DNA, 20 bp, Artificial Sequence
  chemically synthesized
aaaacacatgcgcttggaaa

SEQ ID NO: 587557 - DNA, 20 bp, Artificial Sequence
  chemically synthesized
taatctgcttttccaagcgc

SEQ ID NO: 587558 - DNA, 20 bp, Artificial Sequence
  chemically synthesized
tttgaaatttcagaaaacac

SEQ ID NO: 587559 - DNA, 20 bp, Artificial Sequence
  chemically synthesized
gttttctgaaatttcaaaag

SEQ ID NO: 587560 - DNA, 20 bp, Artificial Sequence
  chemically synthesized
aaatttcaaaagcctcgatt

SEQ ID NO: 587561 - DNA, 20 bp, Artificial Sequence
  chemically synthesized
cagcttttaaaacttcaaat

SEQ ID NO: 587562 - DNA, 20 bp, Artificial Sequence
  chemically synthesized
ctgaatacataaattcaaat

SEQ ID NO: 587563 - DNA, 20 bp, Artificial Sequence
  chemically synthesized
caatttgaatttatgtattc

SEQ ID NO: 587564 - DNA, 20 bp, Artificial Sequence
  chemically synthesized
tggaaatgctaactgtgttt

SEQ ID NO: 587565 - DNA, 20 bp, Artificial Sequence
  chemically synthesized
gacaagcctggaaatgctaa

SEQ ID NO: 587566 - DNA, 20 bp, Artificial Sequence
  chemically synthesized
aagaaacacagttagcattt

SEQ ID NO: 587567 - DNA, 20 bp, Artificial Sequence
  chemically synthesized
ccaggcttgtctcttgacag

SEQ ID NO: 587568 - DNA, 20 bp, Artificial Sequence
  chemically synthesized
ctcttgacagaacagtttaa

SEQ ID NO: 587569 - DNA, 20 bp, Artificial Sequence
  chemically synthesized
gtgatgaatgccaatatgaa

SEQ ID NO: 587570 - DNA, 20 bp, Artificial Sequence
  chemically synthesized
catcacatgaagtgttattt

SEQ ID NO: 587571 - DNA, 20 bp, Artificial Sequence
  chemically synthesized
tgttatttctttgtttacct

SEQ ID NO: 587572 - DNA, 20 bp, Artificial Sequence
  chemically synthesized
tctttgtttacctacttgct

SEQ ID NO: 587573 - DNA, 20 bp, Artificial Sequence
  chemically synthesized
ctacttgcttaatgcttatg

SEQ ID NO: 587574 - DNA, 20 bp, Artificial Sequence
  chemically synthesized
ctaaatgtctaaatgtattg

SEQ ID NO: 587575 - DNA, 20 bp, Artificial Sequence
  chemically synthesized
catttcaatacatttagaca

SEQ ID NO: 587576 - DNA, 20 bp, Artificial Sequence
  chemically synthesized
atttagctttttttagaaag

SEQ ID NO: 587577 - DNA, 20 bp, Artificial Sequence
  chemically synthesized
ctttttttagaaagaatggc

SEQ ID NO: 587578 - DNA, 20 bp, Artificial Sequence
  chemically synthesized
aaatctctcaccatcgtaat

SEQ ID NO: 587579 - DNA, 20 bp, Artificial Sequence
  chemically synthesized
gaagcacgtattacgatggt

SEQ ID NO: 587580 - DNA, 20 bp, Artificial Sequence
  chemically synthesized
acacatgagtagcgcttcct

SEQ ID NO: 587581 - DNA, 20 bp, Artificial Sequence
  chemically synthesized
tgaatttagcaacacatgag

SEQ ID NO: 587582 - DNA, 20 bp, Artificial Sequence
  chemically synthesized
atagactgccaaatcacatg

SEQ ID NO: 587583 - DNA, 20 bp, Artificial Sequence
  chemically synthesized
cccctcaccaaaatcatgcc

SEQ ID NO: 587584 - DNA, 20 bp, Artificial Sequence
  chemically synthesized
ttttggtgaggggatctaac

SEQ ID NO: 587585 - DNA, 20 bp, Artificial Sequence
  chemically synthesized
gtgtttcaggtaaagtgcta

SEQ ID NO: 587586 - DNA, 20 bp, Artificial Sequence
  chemically synthesized
caaaggatgtatggaatatt

SEQ ID NO: 587587 - DNA, 20 bp, Artificial Sequence
  chemically synthesized
ttttaatattccatacatcc

SEQ ID NO: 587588 - DNA, 20 bp, Artificial Sequence
  chemically synthesized
catcctttggattgcctttt

SEQ ID NO: 587589 - DNA, 20 bp, Artificial Sequence
  chemically synthesized
caatgaagaaactgaagttc

SEQ ID NO: 587590 - DNA, 20 bp, Artificial Sequence
  chemically synthesized
gatgtatcaatctctagaac

SEQ ID NO: 587591 - DNA, 20 bp, Artificial Sequence
  chemically synthesized
caaatgagaagtccctctct

SEQ ID NO: 587592 - DNA, 20 bp, Artificial Sequence
  chemically synthesized
atcattgtatctccattttc

SEQ ID NO: 587593 - DNA, 20 bp, Artificial Sequence
  chemically synthesized
aaaatggagatacaatgatc

SEQ ID NO: 587594 - DNA, 20 bp, Artificial Sequence
  chemically synthesized
aatgatcacctgtttacata

SEQ ID NO: 587595 - DNA, 20 bp, Artificial Sequence
  chemically synthesized
atataatgtttaattcatta

SEQ ID NO: 587596 - DNA, 20 bp, Artificial Sequence
  chemically synthesized
atgcacttgttgttgcctaa

SEQ ID NO: 587597 - DNA, 20 bp, Artificial Sequence
  chemically synthesized
agtactgctgaatctagagg

SEQ ID NO: 587598 - DNA, 20 bp, Artificial Sequence
  chemically synthesized
attcctagtgaaacattacc

SEQ ID NO: 587599 - DNA, 20 bp, Artificial Sequence
  chemically synthesized
ctgttatgtaaatgtgtgct

SEQ ID NO: 587600 - DNA, 20 bp, Artificial Sequence
  chemically synthesized
ctgtattctgttatgtaaat

SEQ ID NO: 587601 - DNA, 20 bp, Artificial Sequence
  chemically synthesized
cacacatttacataacagaa

SEQ ID NO: 587602 - DNA, 20 bp, Artificial Sequence
  chemically synthesized
acagttttatgttatgtaaa

SEQ ID NO: 587603 - DNA, 20 bp, Artificial Sequence
  chemically synthesized
acttttaacagtattctttc

SEQ ID NO: 587604 - DNA, 20 bp, Artificial Sequence
  chemically synthesized
ttaacagtattctttccata

SEQ ID NO: 587605 - DNA, 20 bp, Artificial Sequence
  chemically synthesized
aaaataaatttaacacagtt

SEQ ID NO: 587606 - DNA, 20 bp, Artificial Sequence
  chemically synthesized
ctgggagaaaataaatttaa

SEQ ID NO: 587607 - DNA, 20 bp, Artificial Sequence
  chemically synthesized
gtgtgtgtgtgtctgtgtgt

SEQ ID NO: 587608 - DNA, 20 bp, Artificial Sequence
  chemically synthesized
tgtgtttttgccctcctcta

SEQ ID NO: 587609 - DNA, 20 bp, Artificial Sequence
  chemically synthesized
tctcaatttatgcttatttt

SEQ ID NO: 587610 - DNA, 20 bp, Artificial Sequence
  chemically synthesized
tgccttgacttattctcaat

SEQ ID NO: 587611 - DNA, 20 bp, Artificial Sequence
  chemically synthesized
atctttcccggacagtactt

SEQ ID NO: 587612 - DNA, 20 bp, Artificial Sequence
  chemically synthesized
tcccggacagtactttgttg

SEQ ID NO: 587613 - DNA, 20 bp, Artificial Sequence
  chemically synthesized
ttgtaatttgagaaacttca

SEQ ID NO: 587614 - DNA, 20 bp, Artificial Sequence
  chemically synthesized
aacttatacttgaatccttc

SEQ ID NO: 587615 - DNA, 20 bp, Artificial Sequence
  chemically synthesized
gagggaaaaccaaaacaaaa

SEQ ID NO: 587616 - DNA, 20 bp, Artificial Sequence
  chemically synthesized
tgtagaaatcaatgttttgt

SEQ ID NO: 587617 - DNA, 20 bp, Artificial Sequence
  chemically synthesized
ggtgtgtgtagaaatcaatg

SEQ ID NO: 587618 - DNA, 20 bp, Artificial Sequence
  chemically synthesized
tactaggtgtgtgtagaaat

SEQ ID NO: 587619 - DNA, 20 bp, Artificial Sequence
  chemically synthesized
aaataaagttgatgcttggg

SEQ ID NO: 587620 - DNA, 20 bp, Artificial Sequence
  chemically synthesized
tgttggcttaaaaataaagt

SEQ ID NO: 587621 - DNA, 20 bp, Artificial Sequence
  chemically synthesized
caaccaggtatggtagacat

SEQ ID NO: 587622 - DNA, 20 bp, Artificial Sequence
  chemically synthesized
acatgtctaccatacctggt

SEQ ID NO: 587623 - DNA, 20 bp, Artificial Sequence
  chemically synthesized
agacatttgttcattttccc

SEQ ID NO: 587624 - DNA, 20 bp, Artificial Sequence
  chemically synthesized
ctcctgagggggataatata

SEQ ID NO: 587625 - DNA, 20 bp, Artificial Sequence
  chemically synthesized
tttatgcctcactattaagg

SEQ ID NO: 587626 - DNA, 20 bp, Artificial Sequence
  chemically synthesized
taaccttcaggtttttccct

SEQ ID NO: 587627 - DNA, 20 bp, Artificial Sequence
  chemically synthesized
gatattcgcattgctaacct

SEQ ID NO: 587628 - DNA, 20 bp, Artificial Sequence
  chemically synthesized
tcagctgataactggcagca

SEQ ID NO: 587629 - DNA, 20 bp, Artificial Sequence
  chemically synthesized
gttccttaatctctttagcc

SEQ ID NO: 587630 - DNA, 20 bp, Artificial Sequence
  chemically synthesized
gacgaggaaactgagggcta

SEQ ID NO: 587631 - DNA, 20 bp, Artificial Sequence
  chemically synthesized
ttaatcctcacaacactcta

SEQ ID NO: 587632 - DNA, 20 bp, Artificial Sequence
  chemically synthesized
ataaacattttagagtgttg

SEQ ID NO: 587633 - DNA, 20 bp, Artificial Sequence
  chemically synthesized
ttttagagtgttgtgaggat

SEQ ID NO: 587634 - DNA, 20 bp, Artificial Sequence
  chemically synthesized
aaagttttttttgcagaaac

SEQ ID NO: 587635 - DNA, 20 bp, Artificial Sequence
  chemically synthesized
gtgaagcactaggctaaatc

SEQ ID NO: 587636 - DNA, 20 bp, Artificial Sequence
  chemically synthesized
cagaaacccaagatttagcc

SEQ ID NO: 587637 - DNA, 20 bp, Artificial Sequence
  chemically synthesized
aaaaagggaaaatatggata

SEQ ID NO: 587638 - DNA, 20 bp, Artificial Sequence
  chemically synthesized
gaaaatatggatacagagct

SEQ ID NO: 587639 - DNA, 20 bp, Artificial Sequence
  chemically synthesized
acgtgggcttagacacaatt

SEQ ID NO: 587640 - DNA, 20 bp, Artificial Sequence
  chemically synthesized
ctagaattgtgtctaagccc

SEQ ID NO: 587641 - DNA, 20 bp, Artificial Sequence
  chemically synthesized
acttttatctatgtaagcac

SEQ ID NO: 587642 - DNA, 20 bp, Artificial Sequence
  chemically synthesized
gtactcctcctgtgtactca

SEQ ID NO: 587643 - DNA, 20 bp, Artificial Sequence
  chemically synthesized
tccccagcaaaatttgtcaa

SEQ ID NO: 587644 - DNA, 20 bp, Artificial Sequence
  chemically synthesized
atagattgacattaattctc

SEQ ID NO: 587645 - DNA, 20 bp, Artificial Sequence
  chemically synthesized
catctggtggcacatttact

SEQ ID NO: 587646 - DNA, 20 bp, Artificial Sequence
  chemically synthesized
ctgttgcattgtgattacat

SEQ ID NO: 587647 - DNA, 20 bp, Artificial Sequence
  chemically synthesized
ctcaataaatggctgttgca

SEQ ID NO: 587648 - DNA, 20 bp, Artificial Sequence
  chemically synthesized
cggatgtaaggtccatgagg

SEQ ID NO: 587649 - DNA, 20 bp, Artificial Sequence
  chemically synthesized
ccctgcctcatggaccttac

SEQ ID NO: 587650 - DNA, 20 bp, Artificial Sequence
  chemically synthesized
ctatagattttatttcttta

SEQ ID NO: 587651 - DNA, 20 bp, Artificial Sequence
  chemically synthesized
caagataaagaaataaaatc

SEQ ID NO: 587652 - DNA, 20 bp, Artificial Sequence
  chemically synthesized
acacttactgtatcacaatc

SEQ ID NO: 587653 - DNA, 20 bp, Artificial Sequence
  chemically synthesized
tcaatatttccatccctttt

SEQ ID NO: 587654 - DNA, 20 bp, Artificial Sequence
  chemically synthesized
gaggggaagatggggagcag

SEQ ID NO: 587655 - DNA, 20 bp, Artificial Sequence
  chemically synthesized
atttcccagtctcccttgcc

SEQ ID NO: 587656 - DNA, 20 bp, Artificial Sequence
  chemically synthesized
attggaggtggggttatgag

SEQ ID NO: 587657 - DNA, 20 bp, Artificial Sequence
  chemically synthesized
cattcttatgtacaagagca

SEQ ID NO: 587658 - DNA, 20 bp, Artificial Sequence
  chemically synthesized
tggctctgatgtctttaaca

SEQ ID NO: 587659 - DNA, 20 bp, Artificial Sequence
  chemically synthesized
gatcaggggggcccagggca

SEQ ID NO: 587660 - DNA, 20 bp, Artificial Sequence
  chemically synthesized
caaaaattttctggtcaaca

SEQ ID NO: 587661 - DNA, 20 bp, Artificial Sequence
  chemically synthesized
tgttgaccagaaaatttttg

SEQ ID NO: 587662 - DNA, 20 bp, Artificial Sequence
  chemically synthesized
ttgtaaagtttgcatgaacg

SEQ ID NO: 587663 - DNA, 20 bp, Artificial Sequence
  chemically synthesized
ttatgttaagccactgaggt

SEQ ID NO: 587664 - DNA, 20 bp, Artificial Sequence
  chemically synthesized
aaaaaaaaagcccacacctc

SEQ ID NO: 587665 - DNA, 20 bp, Artificial Sequence
  chemically synthesized
gtgggcttttttttttttat

SEQ ID NO: 587666 - DNA, 20 bp, Artificial Sequence
  chemically synthesized
aatatttgcatggcctcctc

SEQ ID NO: 587667 - DNA, 20 bp, Artificial Sequence
  chemically synthesized
aaggcctttgtacttgtttt

SEQ ID NO: 587668 - DNA, 20 bp, Artificial Sequence
  chemically synthesized
tcctgcctcaaggcctttgt

SEQ ID NO: 587669 - DNA, 20 bp, Artificial Sequence
  chemically synthesized
gaacttcttgttcacttctt

SEQ ID NO: 587670 - DNA, 20 bp, Artificial Sequence
  chemically synthesized
ttcagaaatggagtgaggaa

SEQ ID NO: 587671 - DNA, 20 bp, Artificial Sequence
  chemically synthesized
tggcccaaaagccttctatt

SEQ ID NO: 587672 - DNA, 20 bp, Artificial Sequence
  chemically synthesized
ccagatagaatctctgaata

SEQ ID NO: 587673 - DNA, 20 bp, Artificial Sequence
  chemically synthesized
agagattctatctggaatct

SEQ ID NO: 587674 - DNA, 20 bp, Artificial Sequence
  chemically synthesized
ggatagggattataaaagcc

SEQ ID NO: 587675 - DNA, 20 bp, Artificial Sequence
  chemically synthesized
aaactgaattcgatgtggga

SEQ ID NO: 587676 - DNA, 20 bp, Artificial Sequence
  chemically synthesized
aatccctatcccacatcgaa

SEQ ID NO: 587677 - DNA, 20 bp, Artificial Sequence
  chemically synthesized
taaaaataaattatagagca

SEQ ID NO: 587678 - DNA, 20 bp, Artificial Sequence
  chemically synthesized
attggagaacacagttcagt

SEQ ID NO: 587679 - DNA, 20 bp, Artificial Sequence
  chemically synthesized
ggaagtcctagggctcagtt

SEQ ID NO: 587680 - DNA, 20 bp, Artificial Sequence
  chemically synthesized
actgagccctaggacttccc

SEQ ID NO: 587681 - DNA, 20 bp, Artificial Sequence
  chemically synthesized
ctgtctacacagttgctgaa

SEQ ID NO: 587682 - DNA, 20 bp, Artificial Sequence
  chemically synthesized
catcctcagattttcccgaa

SEQ ID NO: 587683 - DNA, 20 bp, Artificial Sequence
  chemically synthesized
caggcttcgggaaaatctga

SEQ ID NO: 587684 - DNA, 20 bp, Artificial Sequence
  chemically synthesized
agatgaagatccaaagcatc

SEQ ID NO: 587685 - DNA, 20 bp, Artificial Sequence
  chemically synthesized
cggatggtaatggctttgtg

SEQ ID NO: 587686 - DNA, 20 bp, Artificial Sequence
  chemically synthesized
tgcattttctatcggatggt

SEQ ID NO: 587687 - DNA, 20 bp, Artificial Sequence
  chemically synthesized
attaagagggtatgacttca

SEQ ID NO: 587688 - DNA, 20 bp, Artificial Sequence
  chemically synthesized
gtatgacttcaaaccgtttt

SEQ ID NO: 587689 - DNA, 20 bp, Artificial Sequence
  chemically synthesized
ctgggattcaaatcagaaaa

SEQ ID NO: 587690 - DNA, 20 bp, Artificial Sequence
  chemically synthesized
ttttctgatttgaatcccag

SEQ ID NO: 587691 - DNA, 20 bp, Artificial Sequence
  chemically synthesized
ctgcgaagggaaaaactgaa

SEQ ID NO: 587692 - DNA, 20 bp, Artificial Sequence
  chemically synthesized
acgtttaggcaggaagatga

SEQ ID NO: 587693 - DNA, 20 bp, Artificial Sequence
  chemically synthesized
ccattgaacttgacagagga

SEQ ID NO: 587694 - DNA, 20 bp, Artificial Sequence
  chemically synthesized
aatggatgactccaccagct

SEQ ID NO: 587695 - DNA, 20 bp, Artificial Sequence
  chemically synthesized
tcaaggatgacttctacact

SEQ ID NO: 587696 - DNA, 20 bp, Artificial Sequence
  chemically synthesized
gctgaaagtgtagaagtcat

SEQ ID NO: 587697 - DNA, 20 bp, Artificial Sequence
  chemically synthesized
tctcaagtggacttatgagg

SEQ ID NO: 587698 - DNA, 20 bp, Artificial Sequence
  chemically synthesized
agagaagtgggcagattcaa

SEQ ID NO: 587699 - DNA, 20 bp, Artificial Sequence
  chemically synthesized
caggaggatggagagaagtg

SEQ ID NO: 587700 - DNA, 20 bp, Artificial Sequence
  chemically synthesized
gtctccttcgctccttctca

SEQ ID NO: 587701 - DNA, 20 bp, Artificial Sequence
  chemically synthesized
ttgatccaggtagtatacgt

SEQ ID NO: 587702 - DNA, 20 bp, Artificial Sequence
  chemically synthesized
ctgagtatgttgtgtgatgc

SEQ ID NO: 587703 - DNA, 20 bp, Artificial Sequence
  chemically synthesized
agtgagcatagtacccgata

SEQ ID NO: 587704 - DNA, 20 bp, Artificial Sequence
  chemically synthesized
ttctagtagtccccaatgtc

SEQ ID NO: 587705 - DNA, 20 bp, Artificial Sequence
  chemically synthesized
tcacctttataatgagtacc

SEQ ID NO: 587706 - DNA, 20 bp, Artificial Sequence
  chemically synthesized
tttataatgagtacccaatg

SEQ ID NO: 587707 - DNA, 20 bp, Artificial Sequence
  chemically synthesized
atgtttagcttctaactatc

SEQ ID NO: 587708 - DNA, 20 bp, Artificial Sequence
  chemically synthesized
ttcctacaaaaggcgtgact

SEQ ID NO: 587709 - DNA, 20 bp, Artificial Sequence
  chemically synthesized
tattccatggtgcatgtata

SEQ ID NO: 587710 - DNA, 20 bp, Artificial Sequence
  chemically synthesized
caacctaggtgcccaccagt

SEQ ID NO: 587711 - DNA, 20 bp, Artificial Sequence
  chemically synthesized
ccaccactggtgggcaccta

SEQ ID NO: 587712 - DNA, 20 bp, Artificial Sequence
  chemically synthesized
gtacatgtgtctctttggta

SEQ ID NO: 587713 - DNA, 20 bp, Artificial Sequence
  chemically synthesized
ttttaaatatataccaagta

SEQ ID NO: 587714 - DNA, 20 bp, Artificial Sequence
  chemically synthesized
tgagtttaggcactgtggag

SEQ ID NO: 587715 - DNA, 20 bp, Artificial Sequence
  chemically synthesized
cactgtttatgggaatgtaa

SEQ ID NO: 587716 - DNA, 20 bp, Artificial Sequence
  chemically synthesized
gagaaaagggaatgcttata

SEQ ID NO: 587717 - DNA, 20 bp, Artificial Sequence
  chemically synthesized
gtgaggcttcagagaaaagg

SEQ ID NO: 587718 - DNA, 20 bp, Artificial Sequence
  chemically synthesized
caaaaaacaacagatgatgg

SEQ ID NO: 587719 - DNA, 20 bp, Artificial Sequence
  chemically synthesized
tctgaagcctcaccatcatc

SEQ ID NO: 587720 - DNA, 20 bp, Artificial Sequence
  chemically synthesized
ttttaataatagccattctg

SEQ ID NO: 587721 - DNA, 20 bp, Artificial Sequence
  chemically synthesized
atttctaacagcctctctga

SEQ ID NO: 587722 - DNA, 20 bp, Artificial Sequence
  chemically synthesized
gaagtagagaccagatcaca

SEQ ID NO: 587723 - DNA, 20 bp, Artificial Sequence
  chemically synthesized
aatcctgatatggatatagt

SEQ ID NO: 587724 - DNA, 20 bp, Artificial Sequence
  chemically synthesized
aatccagcactatatccata

SEQ ID NO: 587725 - DNA, 20 bp, Artificial Sequence
  chemically synthesized
tagaggaagtgatgtctaac

SEQ ID NO: 587726 - DNA, 20 bp, Artificial Sequence
  chemically synthesized
gttagacatcacttcctcta

SEQ ID NO: 587727 - DNA, 20 bp, Artificial Sequence
  chemically synthesized
cacttcctctacaaagcttt

SEQ ID NO: 587728 - DNA, 20 bp, Artificial Sequence
  chemically synthesized
gggatgtctaattaatcaag

SEQ ID NO: 587729 - DNA, 20 bp, Artificial Sequence
  chemically synthesized
tgtagtcccacagcccctca

SEQ ID NO: 587730 - DNA, 20 bp, Artificial Sequence
  chemically synthesized
tcccatgttcatcaaactat

SEQ ID NO: 587731 - DNA, 20 bp, Artificial Sequence
  chemically synthesized
acaatagatagaaaatctgc

SEQ ID NO: 587732 - DNA, 20 bp, Artificial Sequence
  chemically synthesized
ctcagtacttagcatatagt

SEQ ID NO: 587733 - DNA, 20 bp, Artificial Sequence
  chemically synthesized
acaattaagatgatgtcatt

SEQ ID NO: 587734 - DNA, 20 bp, Artificial Sequence
  chemically synthesized
cattatttcatagtagtctg

SEQ ID NO: 587735 - DNA, 20 bp, Artificial Sequence
  chemically synthesized
accagggaaagctatacagc

SEQ ID NO: 587736 - DNA, 20 bp, Artificial Sequence
  chemically synthesized
tagtttacaaacacttgctg

SEQ ID NO: 587737 - DNA, 20 bp, Artificial Sequence
  chemically synthesized
gcacaacttggttcatgagc

SEQ ID NO: 587738 - DNA, 20 bp, Artificial Sequence
  chemically synthesized
tgaaccaagttgtgctcacc

SEQ ID NO: 587739 - DNA, 20 bp, Artificial Sequence
  chemically synthesized
tcaccacctgtttttgtaaa

SEQ ID NO: 587740 - DNA, 20 bp, Artificial Sequence
  chemically synthesized
gcagagttgagtagttgcag

SEQ ID NO: 587741 - DNA, 20 bp, Artificial Sequence
  chemically synthesized
agtgccagatactaaatgcc

SEQ ID NO: 587742 - DNA, 20 bp, Artificial Sequence
  chemically synthesized
tttagtatctggcactttac

SEQ ID NO: 587743 - DNA, 20 bp, Artificial Sequence
  chemically synthesized
tccctagtagatgtctaaga

SEQ ID NO: 587744 - DNA, 20 bp, Artificial Sequence
  chemically synthesized
ccactggtttatagagatta

SEQ ID NO: 587745 - DNA, 20 bp, Artificial Sequence
  chemically synthesized
cttcgcataccactggttta

SEQ ID NO: 587746 - DNA, 20 bp, Artificial Sequence
  chemically synthesized
ttttcatgacttcgcatacc

SEQ ID NO: 587747 - DNA, 20 bp, Artificial Sequence
  chemically synthesized
taattgtgtaaagtgctcat

SEQ ID NO: 587748 - DNA, 20 bp, Artificial Sequence
  chemically synthesized
ataataattgtgtaaagtgc

SEQ ID NO: 587749 - DNA, 20 bp, Artificial Sequence
  chemically synthesized
atagaaaaactagacattgc

SEQ ID NO: 587750 - DNA, 20 bp, Artificial Sequence
  chemically synthesized
gtttataatcagatgcaatg

SEQ ID NO: 587751 - DNA, 20 bp, Artificial Sequence
  chemically synthesized
catctgattataaacattaa

SEQ ID NO: 587752 - DNA, 20 bp, Artificial Sequence
  chemically synthesized
ttcgtgaatttaaacagaat

SEQ ID NO: 587753 - DNA, 20 bp, Artificial Sequence
  chemically synthesized
ttgattctaaggtaagtaga

SEQ ID NO: 587754 - DNA, 20 bp, Artificial Sequence
  chemically synthesized
gtcttttgactattttccat

SEQ ID NO: 587755 - DNA, 20 bp, Artificial Sequence
  chemically synthesized
ataggtcttttgactatttt

SEQ ID NO: 587756 - DNA, 20 bp, Artificial Sequence
  chemically synthesized
ctctgcctcacttttcttgt

SEQ ID NO: 587757 - DNA, 20 bp, Artificial Sequence
  chemically synthesized
tgtcttggcttttacattat

SEQ ID NO: 587758 - DNA, 20 bp, Artificial Sequence
  chemically synthesized
atttcacctcttttttgtta

SEQ ID NO: 587759 - DNA, 20 bp, Artificial Sequence
  chemically synthesized
ttactcaatttttttcccct

SEQ ID NO: 587760 - DNA, 20 bp, Artificial Sequence
  chemically synthesized
tttttcccctctgggcttta

SEQ ID NO: 587761 - DNA, 20 bp, Artificial Sequence
  chemically synthesized
ccacccccagaaaaaatgtc

SEQ ID NO: 587762 - DNA, 20 bp, Artificial Sequence
  chemically synthesized
catctgttttctcaaactat

SEQ ID NO: 587763 - DNA, 20 bp, Artificial Sequence
  chemically synthesized
catattccactggaaacata

SEQ ID NO: 587764 - DNA, 20 bp, Artificial Sequence
  chemically synthesized
ctctcactctctggggaact

SEQ ID NO: 587765 - DNA, 20 bp, Artificial Sequence
  chemically synthesized
agcagaaaggcaaagggtat

SEQ ID NO: 587766 - DNA, 20 bp, Artificial Sequence
  chemically synthesized
aacttagctgcaattatgtg

SEQ ID NO: 587767 - DNA, 20 bp, Artificial Sequence
  chemically synthesized
ttcttttaaagaatagtaac

SEQ ID NO: 587768 - DNA, 20 bp, Artificial Sequence
  chemically synthesized
ccagaccacatttaaggaaa

SEQ ID NO: 587769 - DNA, 20 bp, Artificial Sequence
  chemically synthesized
ttttcctctctcattctatt

SEQ ID NO: 587770 - DNA, 20 bp, Artificial Sequence
  chemically synthesized
agaaggcagctggttcttat

SEQ ID NO: 587771 - DNA, 20 bp, Artificial Sequence
  chemically synthesized
ttctcttaagctaactttta

SEQ ID NO: 587772 - DNA, 20 bp, Artificial Sequence
  chemically synthesized
ttttgcaaatctctttaaaa

SEQ ID NO: 587773 - DNA, 20 bp, Artificial Sequence
  chemically synthesized
caatatagtgagaagagtga

SEQ ID NO: 587774 - DNA, 20 bp, Artificial Sequence
  chemically synthesized
caagatcactcttctcacta

SEQ ID NO: 587775 - DNA, 20 bp, Artificial Sequence
  chemically synthesized
attgtttctgttgtagaaga

SEQ ID NO: 587776 - DNA, 20 bp, Artificial Sequence
  chemically synthesized
gttgaaataaaaaataaatg

SEQ ID NO: 587777 - DNA, 20 bp, Artificial Sequence
  chemically synthesized
tgcatgttgaaataaaaaat

SEQ ID NO: 587778 - DNA, 20 bp, Artificial Sequence
  chemically synthesized
ctcccgggttcgagcaattc

SEQ ID NO: 587779 - DNA, 20 bp, Artificial Sequence
  chemically synthesized
ctacaggcgcccgccaccac

SEQ ID NO: 587780 - DNA, 20 bp, Artificial Sequence
  chemically synthesized
aggcgcccgccaccactcct

SEQ ID NO: 587781 - DNA, 20 bp, Artificial Sequence
  chemically synthesized
gcccgccaccactcctgttt

SEQ ID NO: 587782 - DNA, 20 bp, Artificial Sequence
  chemically synthesized
ccaccactcctgtttgtttg

SEQ ID NO: 587783 - DNA, 20 bp, Artificial Sequence
  chemically synthesized
tgtttgtttgttttgttttg

SEQ ID NO: 587784 - DNA, 20 bp, Artificial Sequence
  chemically synthesized
ttttgtatttttaacagaga

SEQ ID NO: 587785 - DNA, 20 bp, Artificial Sequence
  chemically synthesized
cgcctcggcctcccagagtg

SEQ ID NO: 587786 - DNA, 20 bp, Artificial Sequence
  chemically synthesized
tgtcaactggcataagtaat

SEQ ID NO: 587787 - DNA, 20 bp, Artificial Sequence
  chemically synthesized
atgacagcttatcatgcatg

SEQ ID NO: 587788 - DNA, 20 bp, Artificial Sequence
  chemically synthesized
tggtggatttcttcatacct

SEQ ID NO: 587789 - DNA, 20 bp, Artificial Sequence
  chemically synthesized
actccaactggaatgtttgt

SEQ ID NO: 587790 - DNA, 20 bp, Artificial Sequence
  chemically synthesized
aaatttctgaactccaactg

SEQ ID NO: 587791 - DNA, 20 bp, Artificial Sequence
  chemically synthesized
ctacttagcctagcatatca

SEQ ID NO: 587792 - DNA, 20 bp, Artificial Sequence
  chemically synthesized
tgatatacacactgctcact

SEQ ID NO: 587793 - DNA, 20 bp, Artificial Sequence
  chemically synthesized
atacagtaagttaatgacag

SEQ ID NO: 587794 - DNA, 20 bp, Artificial Sequence
  chemically synthesized
agcatctaccacataccagg

SEQ ID NO: 587795 - DNA, 20 bp, Artificial Sequence
  chemically synthesized
tgaatgggtctccttttttt

SEQ ID NO: 587796 - DNA, 20 bp, Artificial Sequence
  chemically synthesized
aacctccacctcctgggttc

SEQ ID NO: 587797 - DNA, 20 bp, Artificial Sequence
  chemically synthesized
ctcggaggctgaggcaggag

SEQ ID NO: 587798 - DNA, 20 bp, Artificial Sequence
  chemically synthesized
ctgcctcagcctccgagtag

SEQ ID NO: 587799 - DNA, 20 bp, Artificial Sequence
  chemically synthesized
gtgaatgcatagctacactt

SEQ ID NO: 587800 - DNA, 20 bp, Artificial Sequence
  chemically synthesized
gcccttggtagatgtgtaat

SEQ ID NO: 587801 - DNA, 20 bp, Artificial Sequence
  chemically synthesized
aagctacgtgtatggactgg

SEQ ID NO: 587802 - DNA, 20 bp, Artificial Sequence
  chemically synthesized
aaacagagccagtccataca

SEQ ID NO: 587803 - DNA, 20 bp, Artificial Sequence
  chemically synthesized
ttaaactcttttgtatgatt

SEQ ID NO: 587804 - DNA, 20 bp, Artificial Sequence
  chemically synthesized
ttaaaccactaatcatacaa

SEQ ID NO: 587805 - DNA, 20 bp, Artificial Sequence
  chemically synthesized
ggtttgcattaaactctttt

SEQ ID NO: 587806 - DNA, 20 bp, Artificial Sequence
  chemically synthesized
aatttttttctatatatatg

SEQ ID NO: 587807 - DNA, 20 bp, Artificial Sequence
  chemically synthesized
tacatatatatagaaaaaaa

SEQ ID NO: 587808 - DNA, 20 bp, Artificial Sequence
  chemically synthesized
cctatgaaagttctgaaagt

SEQ ID NO: 587809 - DNA, 20 bp, Artificial Sequence
  chemically synthesized
cactggtcagctatagttat

SEQ ID NO: 587810 - DNA, 20 bp, Artificial Sequence
  chemically synthesized
ctcctctgtgtgtatttttg

SEQ ID NO: 587811 - DNA, 20 bp, Artificial Sequence
  chemically synthesized
atggcacataatgagattaa

SEQ ID NO: 587812 - DNA, 20 bp, Artificial Sequence
  chemically synthesized
ttttgtactcatggcacata

SEQ ID NO: 587813 - DNA, 20 bp, Artificial Sequence
  chemically synthesized
caggactctcaacaaatttg

SEQ ID NO: 587814 - DNA, 20 bp, Artificial Sequence
  chemically synthesized
tttcccaggactctcaacaa

SEQ ID NO: 587815 - DNA, 20 bp, Artificial Sequence
  chemically synthesized
ttgttattattgcttctttt

SEQ ID NO: 587816 - DNA, 20 bp, Artificial Sequence
  chemically synthesized
accttgattattattgttat

SEQ ID NO: 587817 - DNA, 20 bp, Artificial Sequence
  chemically synthesized
aaaattataaatgttgagga

SEQ ID NO: 587818 - DNA, 20 bp, Artificial Sequence
  chemically synthesized
caacatttataattttctca

SEQ ID NO: 587819 - DNA, 20 bp, Artificial Sequence
  chemically synthesized
gttatattccaaatgactgt

SEQ ID NO: 587820 - DNA, 20 bp, Artificial Sequence
  chemically synthesized
ttacagtcatttggaatata

SEQ ID NO: 587821 - DNA, 20 bp, Artificial Sequence
  chemically synthesized
aagaagagcagtggatctta

SEQ ID NO: 587822 - DNA, 20 bp, Artificial Sequence
  chemically synthesized
tgtattccggctgatattga

SEQ ID NO: 587823 - DNA, 20 bp, Artificial Sequence
  chemically synthesized
agatggtacaagacaaagga

SEQ ID NO: 587824 - DNA, 20 bp, Artificial Sequence
  chemically synthesized
aactttagccacactgaatt

SEQ ID NO: 587825 - DNA, 20 bp, Artificial Sequence
  chemically synthesized
aactaggaattcagtgtggc

SEQ ID NO: 587826 - DNA, 20 bp, Artificial Sequence
  chemically synthesized
cattacctctgggcattaaa

SEQ ID NO: 587827 - DNA, 20 bp, Artificial Sequence
  chemically synthesized
tgaacttagggagtctacct

SEQ ID NO: 587828 - DNA, 20 bp, Artificial Sequence
  chemically synthesized
gagtctacctaacagattac

SEQ ID NO: 587829 - DNA, 20 bp, Artificial Sequence
  chemically synthesized
tacctaacagattactcaag

SEQ ID NO: 587830 - DNA, 20 bp, Artificial Sequence
  chemically synthesized
accacttcacttagctaagc

SEQ ID NO: 587831 - DNA, 20 bp, Artificial Sequence
  chemically synthesized
ggattctagtattttaaaac

SEQ ID NO: 587832 - DNA, 20 bp, Artificial Sequence
  chemically synthesized
agaaatccttgaagataccc

SEQ ID NO: 587833 - DNA, 20 bp, Artificial Sequence
  chemically synthesized
tagaatccaaagggtatctt

SEQ ID NO: 587834 - DNA, 20 bp, Artificial Sequence
  chemically synthesized
actctattgtacatggctag

SEQ ID NO: 587835 - DNA, 20 bp, Artificial Sequence
  chemically synthesized
aaggcagtgtaaactaaaat

SEQ ID NO: 587836 - DNA, 20 bp, Artificial Sequence
  chemically synthesized
gagaaccagaaaacacatat

SEQ ID NO: 587837 - DNA, 20 bp, Artificial Sequence
  chemically synthesized
acttaggagaaaatttctct

SEQ ID NO: 587838 - DNA, 20 bp, Artificial Sequence
  chemically synthesized
gtatgtttacgaaaactgaa

SEQ ID NO: 587839 - DNA, 20 bp, Artificial Sequence
  chemically synthesized
agaaaaaaaaaaaaactccc

SEQ ID NO: 587840 - DNA, 20 bp, Artificial Sequence
  chemically synthesized
gaatgggaacagaattctct

SEQ ID NO: 587841 - DNA, 20 bp, Artificial Sequence
  chemically synthesized
ttattttactctcattttca

SEQ ID NO: 587842 - DNA, 20 bp, Artificial Sequence
  chemically synthesized
taccaatatcagggagaaaa

SEQ ID NO: 587843 - DNA, 20 bp, Artificial Sequence
  chemically synthesized
aaggtttagctacttgtgct

SEQ ID NO: 587844 - DNA, 20 bp, Artificial Sequence
  chemically synthesized
tgtatttaaggtttagctac

SEQ ID NO: 587845 - DNA, 20 bp, Artificial Sequence
  chemically synthesized
tcctcattatccactgtatt

SEQ ID NO: 587846 - DNA, 20 bp, Artificial Sequence
  chemically synthesized
actgagataccaatattttt

SEQ ID NO: 587847 - DNA, 20 bp, Artificial Sequence
  chemically synthesized
ctgtctcaaaataaataaat

SEQ ID NO: 587848 - DNA, 20 bp, Artificial Sequence
  chemically synthesized
gggtctcctggggtgtggta

SEQ ID NO: 587849 - DNA, 20 bp, Artificial Sequence
  chemically synthesized
cctcccgagcatctaggact

SEQ ID NO: 587850 - DNA, 20 bp, Artificial Sequence
  chemically synthesized
cttgaggccaggagttcaag

SEQ ID NO: 587851 - DNA, 20 bp, Artificial Sequence
  chemically synthesized
ttgggaggccaaggcaagag

SEQ ID NO: 587852 - DNA, 20 bp, Artificial Sequence
  chemically synthesized
tgctttgggaggccaaggca

SEQ ID NO: 587853 - DNA, 20 bp, Artificial Sequence
  chemically synthesized
atggctcatgcctgtcatct

SEQ ID NO: 587854 - DNA, 20 bp, Artificial Sequence
  chemically synthesized
tcaacttttaattttcattt

SEQ ID NO: 587855 - DNA, 20 bp, Artificial Sequence
  chemically synthesized
atcgtagtcagtcggggaag

SEQ ID NO: 587856 - DNA, 20 bp, Artificial Sequence
  chemically synthesized
gatcttccccgactgactac

SEQ ID NO: 587857 - DNA, 20 bp, Artificial Sequence
  chemically synthesized
ccaggattatactaaatgtg

SEQ ID NO: 587858 - DNA, 20 bp, Artificial Sequence
  chemically synthesized
gatataaccccatcctcagt

SEQ ID NO: 587859 - DNA, 20 bp, Artificial Sequence
  chemically synthesized
cataacattttcaatttatg

SEQ ID NO: 587860 - DNA, 20 bp, Artificial Sequence
  chemically synthesized
cagatgctcctcaccttagg

SEQ ID NO: 587861 - DNA, 20 bp, Artificial Sequence
  chemically synthesized
atggggatggtttcatggtt

SEQ ID NO: 587862 - DNA, 20 bp, Artificial Sequence
  chemically synthesized
ttggttaccttgattatggg

SEQ ID NO: 587863 - DNA, 20 bp, Artificial Sequence
  chemically synthesized
ttgatgcatatacttggtta

SEQ ID NO: 587864 - DNA, 20 bp, Artificial Sequence
  chemically synthesized
caagtatatgcatcaactcc

SEQ ID NO: 587865 - DNA, 20 bp, Artificial Sequence
  chemically synthesized
gagttgctgttcaatgagta

SEQ ID NO: 587866 - DNA, 20 bp, Artificial Sequence
  chemically synthesized
tcattctactctctggttct

SEQ ID NO: 587867 - DNA, 20 bp, Artificial Sequence
  chemically synthesized
gtcaccaaagggcaaatact

SEQ ID NO: 587868 - DNA, 20 bp, Artificial Sequence
  chemically synthesized
tcagtatttgccctttggtg

SEQ ID NO: 587869 - DNA, 20 bp, Artificial Sequence
  chemically synthesized
gatatcttggctactgtgaa

SEQ ID NO: 587870 - DNA, 20 bp, Artificial Sequence
  chemically synthesized
atgagagtgcagatatcttt

SEQ ID NO: 587871 - DNA, 20 bp, Artificial Sequence
  chemically synthesized
tgcagatatctttttgagat

SEQ ID NO: 587872 - DNA, 20 bp, Artificial Sequence
  chemically synthesized
ccacctatggtgtactagcg

SEQ ID NO: 587873 - DNA, 20 bp, Artificial Sequence
  chemically synthesized
cctcaacaacatttcttatc

SEQ ID NO: 587874 - DNA, 20 bp, Artificial Sequence
  chemically synthesized
aacatttcttatctcttgtt

SEQ ID NO: 587875 - DNA, 20 bp, Artificial Sequence
  chemically synthesized
tttcttatctcttgtttttg

SEQ ID NO: 587876 - DNA, 20 bp, Artificial Sequence
  chemically synthesized
gatgatagtgttcatctcac

SEQ ID NO: 587877 - DNA, 20 bp, Artificial Sequence
  chemically synthesized
tagtgttcatctcacagagg

SEQ ID NO: 587878 - DNA, 20 bp, Artificial Sequence
  chemically synthesized
caacaggaaaaaggcaaata

SEQ ID NO: 587879 - DNA, 20 bp, Artificial Sequence
  chemically synthesized
tgagttgtattaacaatcag

SEQ ID NO: 587880 - DNA, 20 bp, Artificial Sequence
  chemically synthesized
ttgttagtgtacagaaacag

SEQ ID NO: 587881 - DNA, 20 bp, Artificial Sequence
  chemically synthesized
taacaataagctacccaata

SEQ ID NO: 587882 - DNA, 20 bp, Artificial Sequence
  chemically synthesized
agaagaaaagcttattattg

SEQ ID NO: 587883 - DNA, 20 bp, Artificial Sequence
  chemically synthesized
caataataagcttttcttct

SEQ ID NO: 587884 - DNA, 20 bp, Artificial Sequence
  chemically synthesized
acaagataatccaatagaag

SEQ ID NO: 587885 - DNA, 20 bp, Artificial Sequence
  chemically synthesized
atcttgtcacctttgtcata

SEQ ID NO: 587886 - DNA, 20 bp, Artificial Sequence
  chemically synthesized
tattgattgaccataaatat

SEQ ID NO: 587887 - DNA, 20 bp, Artificial Sequence
  chemically synthesized
tcaacattaggagtgcagtt

SEQ ID NO: 587888 - DNA, 20 bp, Artificial Sequence
  chemically synthesized
gatttaagaaaaaaatatga

SEQ ID NO: 587889 - DNA, 20 bp, Artificial Sequence
  chemically synthesized
taagaaaaaaatatgaatag

SEQ ID NO: 587890 - DNA, 20 bp, Artificial Sequence
  chemically synthesized
gacaggcttatagatcacct

SEQ ID NO: 587891 - DNA, 20 bp, Artificial Sequence
  chemically synthesized
agtgtggtactgtcataagg

SEQ ID NO: 587892 - DNA, 20 bp, Artificial Sequence
  chemically synthesized
taccacactgtcttcatcat

SEQ ID NO: 587893 - DNA, 20 bp, Artificial Sequence
  chemically synthesized
ttcatcattgcagatttaca

SEQ ID NO: 587894 - DNA, 20 bp, Artificial Sequence
  chemically synthesized
agatttgaaatcaggtaatg

SEQ ID NO: 587895 - DNA, 20 bp, Artificial Sequence
  chemically synthesized
gactttgaaatcaggacatt

SEQ ID NO: 587896 - DNA, 20 bp, Artificial Sequence
  chemically synthesized
acttttttcttctttttcac

SEQ ID NO: 587897 - DNA, 20 bp, Artificial Sequence
  chemically synthesized
gatcaatttttcaatttgtg

SEQ ID NO: 587898 - DNA, 20 bp, Artificial Sequence
  chemically synthesized
aacatctgctaagatgtcga

SEQ ID NO: 587899 - DNA, 20 bp, Artificial Sequence
  chemically synthesized
tgattctccccaacttgttc

SEQ ID NO: 587900 - DNA, 20 bp, Artificial Sequence
  chemically synthesized
aagactcaatactgataagg

SEQ ID NO: 587901 - DNA, 20 bp, Artificial Sequence
  chemically synthesized
atggaatatggtcccattta

SEQ ID NO: 587902 - DNA, 20 bp, Artificial Sequence
  chemically synthesized
aatttctctcagcaatgtat

SEQ ID NO: 587903 - DNA, 20 bp, Artificial Sequence
  chemically synthesized
tgtattacagttttcagagt

SEQ ID NO: 587904 - DNA, 20 bp, Artificial Sequence
  chemically synthesized
tttcattctttgtagcataa

SEQ ID NO: 587905 - DNA, 20 bp, Artificial Sequence
  chemically synthesized
gaatgtaatttattcttgta

SEQ ID NO: 587906 - DNA, 20 bp, Artificial Sequence
  chemically synthesized
tcttgtatattgattatctt

SEQ ID NO: 587907 - DNA, 20 bp, Artificial Sequence
  chemically synthesized
tgctagatctgataagttca

SEQ ID NO: 587908 - DNA, 20 bp, Artificial Sequence
  chemically synthesized
ctagcagttattttgtggat

SEQ ID NO: 587909 - DNA, 20 bp, Artificial Sequence
  chemically synthesized
gatatcagatttttctacat

SEQ ID NO: 587910 - DNA, 20 bp, Artificial Sequence
  chemically synthesized
ttgtattgtctgtgaataaa

SEQ ID NO: 587911 - DNA, 20 bp, Artificial Sequence
  chemically synthesized
ttcttctatactgtggatgc

SEQ ID NO: 587912 - DNA, 20 bp, Artificial Sequence
  chemically synthesized
ttcctatctttctcctggac

SEQ ID NO: 587913 - DNA, 20 bp, Artificial Sequence
  chemically synthesized
ggaaaattttaaattactaa

SEQ ID NO: 587914 - DNA, 20 bp, Artificial Sequence
  chemically synthesized
ttaaattactaattcagttt

SEQ ID NO: 587915 - DNA, 20 bp, Artificial Sequence
  chemically synthesized
tatgtctatttttttcttga

SEQ ID NO: 587916 - DNA, 20 bp, Artificial Sequence
  chemically synthesized
agaaagacataaattaacaa

SEQ ID NO: 587917 - DNA, 20 bp, Artificial Sequence
  chemically synthesized
tctaagaattttttcattta

SEQ ID NO: 587918 - DNA, 20 bp, Artificial Sequence
  chemically synthesized
agtaattacccctttttcct

SEQ ID NO: 587919 - DNA, 20 bp, Artificial Sequence
  chemically synthesized
ttttttttggtcagtctagc

SEQ ID NO: 587920 - DNA, 20 bp, Artificial Sequence
  chemically synthesized
tgaaaatattttttacatgg

SEQ ID NO: 587921 - DNA, 20 bp, Artificial Sequence
  chemically synthesized
ctccatgtaaaaaatatttt

SEQ ID NO: 587922 - DNA, 20 bp, Artificial Sequence
  chemically synthesized
aatattttcaaagattaatg

SEQ ID NO: 587923 - DNA, 20 bp, Artificial Sequence
  chemically synthesized
caaagattaatgtatggttt

SEQ ID NO: 587924 - DNA, 20 bp, Artificial Sequence
  chemically synthesized
aacccccgttatttccttcc

SEQ ID NO: 587925 - DNA, 20 bp, Artificial Sequence
  chemically synthesized
tttccttccttatgcttcct

SEQ ID NO: 587926 - DNA, 20 bp, Artificial Sequence
  chemically synthesized
gcttactgtgttcttctttt

SEQ ID NO: 587927 - DNA, 20 bp, Artificial Sequence
  chemically synthesized
tttttctagtttcttatggc

SEQ ID NO: 587928 - DNA, 20 bp, Artificial Sequence
  chemically synthesized
cttatggcgaaagcttgagt

SEQ ID NO: 587929 - DNA, 20 bp, Artificial Sequence
  chemically synthesized
aaaattcttaaatcattaac

SEQ ID NO: 587930 - DNA, 20 bp, Artificial Sequence
  chemically synthesized
taaaataggtatttaaaact

SEQ ID NO: 587931 - DNA, 20 bp, Artificial Sequence
  chemically synthesized
gcagtgcttacagggaaact

SEQ ID NO: 587932 - DNA, 20 bp, Artificial Sequence
  chemically synthesized
actagaagtttccctgtaag

SEQ ID NO: 587933 - DNA, 20 bp, Artificial Sequence
  chemically synthesized
tttataggatgtaactaaag

SEQ ID NO: 587934 - DNA, 20 bp, Artificial Sequence
  chemically synthesized
atcctataaatcttgacatg

SEQ ID NO: 587935 - DNA, 20 bp, Artificial Sequence
  chemically synthesized
aaaaataaaagcacaacatg

SEQ ID NO: 587936 - DNA, 20 bp, Artificial Sequence
  chemically synthesized
aaaatattttataatttcct

SEQ ID NO: 587937 - DNA, 20 bp, Artificial Sequence
  chemically synthesized
ttttataatttcctatgtga

SEQ ID NO: 587938 - DNA, 20 bp, Artificial Sequence
  chemically synthesized
atgtgatttagtttttaacc

SEQ ID NO: 587939 - DNA, 20 bp, Artificial Sequence
  chemically synthesized
aacaaatctcaatacactca

SEQ ID NO: 587940 - DNA, 20 bp, Artificial Sequence
  chemically synthesized
attcaagcctgttgagtgta

SEQ ID NO: 587941 - DNA, 20 bp, Artificial Sequence
  chemically synthesized
agcctgttgagtgtattgag

SEQ ID NO: 587942 - DNA, 20 bp, Artificial Sequence
  chemically synthesized
gcacatgaaattttctctgg

SEQ ID NO: 587943 - DNA, 20 bp, Artificial Sequence
  chemically synthesized
gcactttaaaataatatgta

SEQ ID NO: 587944 - DNA, 20 bp, Artificial Sequence
  chemically synthesized
agaattcaccaacactatca

SEQ ID NO: 587945 - DNA, 20 bp, Artificial Sequence
  chemically synthesized
ggcctgccagctattgagag

SEQ ID NO: 587946 - DNA, 20 bp, Artificial Sequence
  chemically synthesized
gggactttcctattaattat

SEQ ID NO: 587947 - DNA, 20 bp, Artificial Sequence
  chemically synthesized
acgtttataattgttatatt

SEQ ID NO: 587948 - DNA, 20 bp, Artificial Sequence
  chemically synthesized
gaaaaaagaggtactatgca

SEQ ID NO: 587949 - DNA, 20 bp, Artificial Sequence
  chemically synthesized
ctcttttttctttgaaatta

SEQ ID NO: 587950 - DNA, 20 bp, Artificial Sequence
  chemically synthesized
atttaaaatatccaaccata

SEQ ID NO: 587951 - DNA, 20 bp, Artificial Sequence
  chemically synthesized
gattatttaaaatatccaac

SEQ ID NO: 587952 - DNA, 20 bp, Artificial Sequence
  chemically synthesized
attataggcagagatttcag

SEQ ID NO: 587953 - DNA, 20 bp, Artificial Sequence
  chemically synthesized
ctaagcattccaattatagg

SEQ ID NO: 587954 - DNA, 20 bp, Artificial Sequence
  chemically synthesized
gaaatctctgcctataattg

SEQ ID NO: 587955 - DNA, 20 bp, Artificial Sequence
  chemically synthesized
ggttgagtatcccatatcca

SEQ ID NO: 587956 - DNA, 20 bp, Artificial Sequence
  chemically synthesized
gtatcccatatccaaaatgc

SEQ ID NO: 587957 - DNA, 20 bp, Artificial Sequence
  chemically synthesized
tccaaaatgcttgggattgg

SEQ ID NO: 587958 - DNA, 20 bp, Artificial Sequence
  chemically synthesized
atgcttgggattggaagtgt

SEQ ID NO: 587959 - DNA, 20 bp, Artificial Sequence
  chemically synthesized
ggattggaagtgttttggat

SEQ ID NO: 587960 - DNA, 20 bp, Artificial Sequence
  chemically synthesized
tgttttggattttggatttc

SEQ ID NO: 587961 - DNA, 20 bp, Artificial Sequence
  chemically synthesized
taatatcttggagataggac

SEQ ID NO: 587962 - DNA, 20 bp, Artificial Sequence
  chemically synthesized
tatatgtatatatatagtat

SEQ ID NO: 587963 - DNA, 20 bp, Artificial Sequence
  chemically synthesized
aaataattttttgcatgaaa

SEQ ID NO: 587964 - DNA, 20 bp, Artificial Sequence
  chemically synthesized
tgcatgaaacaaagttttgg

SEQ ID NO: 587965 - DNA, 20 bp, Artificial Sequence
  chemically synthesized
cagtcaaaacacagccaaaa

SEQ ID NO: 587966 - DNA, 20 bp, Artificial Sequence
  chemically synthesized
tggtattatatcaaccttca

SEQ ID NO: 587967 - DNA, 20 bp, Artificial Sequence
  chemically synthesized
cattttagagcatttcaaat

SEQ ID NO: 587968 - DNA, 20 bp, Artificial Sequence
  chemically synthesized
cttattcatgtcttttttgt

SEQ ID NO: 587969 - DNA, 20 bp, Artificial Sequence
  chemically synthesized
ttttagtgtgtaattttaaa

SEQ ID NO: 587970 - DNA, 20 bp, Artificial Sequence
  chemically synthesized
tttttaactatttattttct

SEQ ID NO: 587971 - DNA, 20 bp, Artificial Sequence
  chemically synthesized
tattttcttagtgcttgctc

SEQ ID NO: 587972 - DNA, 20 bp, Artificial Sequence
  chemically synthesized
tctaaattttactgtgttaa

SEQ ID NO: 587973 - DNA, 20 bp, Artificial Sequence
  chemically synthesized
ataagcaggaggagcaaaaa

SEQ ID NO: 587974 - DNA, 20 bp, Artificial Sequence
  chemically synthesized
ctaagctccatttttgctcc

SEQ ID NO: 587975 - DNA, 20 bp, Artificial Sequence
  chemically synthesized
aaaattataacattgtgtta

SEQ ID NO: 587976 - DNA, 20 bp, Artificial Sequence
  chemically synthesized
ttttaacttctttaaaagac

SEQ ID NO: 587977 - DNA, 20 bp, Artificial Sequence
  chemically synthesized
aagactgtacaaatatagat

SEQ ID NO: 587978 - DNA, 20 bp, Artificial Sequence
  chemically synthesized
tatctacatatttatcagtt

SEQ ID NO: 587979 - DNA, 20 bp, Artificial Sequence
  chemically synthesized
tttcagcctgaatgacttta

SEQ ID NO: 587980 - DNA, 20 bp, Artificial Sequence
  chemically synthesized
ttttacctatatttttgaag

SEQ ID NO: 587981 - DNA, 20 bp, Artificial Sequence
  chemically synthesized
cctatatttttgaaggatag

SEQ ID NO: 587982 - DNA, 20 bp, Artificial Sequence
  chemically synthesized
atttcaatacctctggcctc

SEQ ID NO: 587983 - DNA, 20 bp, Artificial Sequence
  chemically synthesized
actcctcatgtacagggatc

SEQ ID NO: 587984 - DNA, 20 bp, Artificial Sequence
  chemically synthesized
atgaggagtcatttttttct

SEQ ID NO: 587985 - DNA, 20 bp, Artificial Sequence
  chemically synthesized
atttcaaatgaaactatttc

SEQ ID NO: 587986 - DNA, 20 bp, Artificial Sequence
  chemically synthesized
cataagagtcaaactattga

SEQ ID NO: 587987 - DNA, 20 bp, Artificial Sequence
  chemically synthesized
ctatttcaatagtttgactc

SEQ ID NO: 587988 - DNA, 20 bp, Artificial Sequence
  chemically synthesized
gttttagggtattgatctct

SEQ ID NO: 587989 - DNA, 20 bp, Artificial Sequence
  chemically synthesized
ctcttcgtgtttattctatt

SEQ ID NO: 587990 - DNA, 20 bp, Artificial Sequence
  chemically synthesized
tttattctatttggggtttg

SEQ ID NO: 587991 - DNA, 20 bp, Artificial Sequence
  chemically synthesized
tgagcttaaccgtatttgtg

SEQ ID NO: 587992 - DNA, 20 bp, Artificial Sequence
  chemically synthesized
aacatctacattgatatgct

SEQ ID NO: 587993 - DNA, 20 bp, Artificial Sequence
  chemically synthesized
gacacaaagctatgactcat

SEQ ID NO: 587994 - DNA, 20 bp, Artificial Sequence
  chemically synthesized
tataaaaaacgaacatgagt

SEQ ID NO: 587995 - DNA, 20 bp, Artificial Sequence
  chemically synthesized
tgactcatgttcgtttttta

SEQ ID NO: 587996 - DNA, 20 bp, Artificial Sequence
  chemically synthesized
atactgttttacctctgaca

SEQ ID NO: 587997 - DNA, 20 bp, Artificial Sequence
  chemically synthesized
tatttatctattttcaaatt

SEQ ID NO: 587998 - DNA, 20 bp, Artificial Sequence
  chemically synthesized
tatctgctcttgagccccat

SEQ ID NO: 587999 - DNA, 20 bp, Artificial Sequence
  chemically synthesized
atatagtgtgtatcttttag

SEQ ID NO: 588000 - DNA, 20 bp, Artificial Sequence
  chemically synthesized
actttcatttaattatttaa

SEQ ID NO: 588001 - DNA, 20 bp, Artificial Sequence
  chemically synthesized
cttcaaacaactgaagaaaa

SEQ ID NO: 588002 - DNA, 20 bp, Artificial Sequence
  chemically synthesized
atttaaacatgcttttcttc

SEQ ID NO: 588003 - DNA, 20 bp, Artificial Sequence
  chemically synthesized
attcagagacaacttttgtt

SEQ ID NO: 588004 - DNA, 20 bp, Artificial Sequence
  chemically synthesized
ctgatgttccttcttatgcc

SEQ ID NO: 588005 - DNA, 20 bp, Artificial Sequence
  chemically synthesized
atgcccagcgttttttaaat

SEQ ID NO: 588006 - DNA, 20 bp, Artificial Sequence
  chemically synthesized
gcctagatgaaatctgtgga

SEQ ID NO: 588007 - DNA, 20 bp, Artificial Sequence
  chemically synthesized
cactgtggggaaacagattc

SEQ ID NO: 588008 - DNA, 20 bp, Artificial Sequence
  chemically synthesized
acagccacacactgtgggga

SEQ ID NO: 588009 - DNA, 20 bp, Artificial Sequence
  chemically synthesized
ctaggcatacagtttgtttc

SEQ ID NO: 588010 - DNA, 20 bp, Artificial Sequence
  chemically synthesized
caacagaaacaaactgtatg

SEQ ID NO: 588011 - DNA, 20 bp, Artificial Sequence
  chemically synthesized
tctaggaaactaggcataca

SEQ ID NO: 588012 - DNA, 20 bp, Artificial Sequence
  chemically synthesized
tacctctaggaaactaggca

SEQ ID NO: 588013 - DNA, 20 bp, Artificial Sequence
  chemically synthesized
cctagtttcctagaggtaag

SEQ ID NO: 588014 - DNA, 20 bp, Artificial Sequence
  chemically synthesized
attgactaatgcaaattaag

SEQ ID NO: 588015 - DNA, 20 bp, Artificial Sequence
  chemically synthesized
acctcaagccagtaagactt

SEQ ID NO: 588016 - DNA, 20 bp, Artificial Sequence
  chemically synthesized
tagcaaaacttggaagtctt

SEQ ID NO: 588017 - DNA, 20 bp, Artificial Sequence
  chemically synthesized
attcaacatgcaggcacatt

SEQ ID NO: 588018 - DNA, 20 bp, Artificial Sequence
  chemically synthesized
cagctggcctaaagttgcag

SEQ ID NO: 588019 - DNA, 20 bp, Artificial Sequence
  chemically synthesized
gctgagttgctattctgcct

SEQ ID NO: 588020 - DNA, 20 bp, Artificial Sequence
  chemically synthesized
taggtctccaccgttactga

SEQ ID NO: 588021 - DNA, 20 bp, Artificial Sequence
  chemically synthesized
actgacaatgcttctggaca

SEQ ID NO: 588022 - DNA, 20 bp, Artificial Sequence
  chemically synthesized
ctggacatggagttttaaac

SEQ ID NO: 588023 - DNA, 20 bp, Artificial Sequence
  chemically synthesized
ggactgattttatttgaagc

SEQ ID NO: 588024 - DNA, 20 bp, Artificial Sequence
  chemically synthesized
agcagcttcatcaccacagg

SEQ ID NO: 588025 - DNA, 20 bp, Artificial Sequence
  chemically synthesized
atcagtccctgtggtgatga

SEQ ID NO: 588026 - DNA, 20 bp, Artificial Sequence
  chemically synthesized
gtgatgaagctgcttatttc

SEQ ID NO: 588027 - DNA, 20 bp, Artificial Sequence
  chemically synthesized
tagaacaagccatggaaata

SEQ ID NO: 588028 - DNA, 20 bp, Artificial Sequence
  chemically synthesized
gttctaccttgatagaacta

SEQ ID NO: 588029 - DNA, 20 bp, Artificial Sequence
  chemically synthesized
tattgcccccagtccccact

SEQ ID NO: 588030 - DNA, 20 bp, Artificial Sequence
  chemically synthesized
aaattcatattgttcatata

SEQ ID NO: 588031 - DNA, 20 bp, Artificial Sequence
  chemically synthesized
acggcatatgctaaattaaa

SEQ ID NO: 588032 - DNA, 20 bp, Artificial Sequence
  chemically synthesized
ggttgatatccagggtcata

SEQ ID NO: 588033 - DNA, 20 bp, Artificial Sequence
  chemically synthesized
ttctccagtgtgtcccattt

SEQ ID NO: 588034 - DNA, 20 bp, Artificial Sequence
  chemically synthesized
tcccattttactgattcttg

SEQ ID NO: 588035 - DNA, 20 bp, Artificial Sequence
  chemically synthesized
tctatgcccagcacatgagt

SEQ ID NO: 588036 - DNA, 20 bp, Artificial Sequence
  chemically synthesized
tatgtactattatctttatt

SEQ ID NO: 588037 - DNA, 20 bp, Artificial Sequence
  chemically synthesized
gcaccagctacttaaattat

SEQ ID NO: 588038 - DNA, 20 bp, Artificial Sequence
  chemically synthesized
aagtatgtaacatggtatct

SEQ ID NO: 588039 - DNA, 20 bp, Artificial Sequence
  chemically synthesized
ataatcacctatcttcccac

SEQ ID NO: 588040 - DNA, 20 bp, Artificial Sequence
  chemically synthesized
ataaacacaggtgggaagat

SEQ ID NO: 588041 - DNA, 20 bp, Artificial Sequence
  chemically synthesized
tattacccagcatttagttg

SEQ ID NO: 588042 - DNA, 20 bp, Artificial Sequence
  chemically synthesized
gccaacctgaagtccaagta

SEQ ID NO: 588043 - DNA, 20 bp, Artificial Sequence
  chemically synthesized
gtttctcctactgacttatt

SEQ ID NO: 588044 - DNA, 20 bp, Artificial Sequence
  chemically synthesized
ataagtcagtaggagaaaca

SEQ ID NO: 588045 - DNA, 20 bp, Artificial Sequence
  chemically synthesized
gtctatccatgacaaaaaca

SEQ ID NO: 588046 - DNA, 20 bp, Artificial Sequence
  chemically synthesized
tagagtctatccatgacaaa

SEQ ID NO: 588047 - DNA, 20 bp, Artificial Sequence
  chemically synthesized
caatataatgattgtttttt

SEQ ID NO: 588048 - DNA, 20 bp, Artificial Sequence
  chemically synthesized
actttatgagccaatataat

SEQ ID NO: 588049 - DNA, 20 bp, Artificial Sequence
  chemically synthesized
tctaactttatgagccaata

SEQ ID NO: 588050 - DNA, 20 bp, Artificial Sequence
  chemically synthesized
tattggctcataaagttaga

SEQ ID NO: 588051 - DNA, 20 bp, Artificial Sequence
  chemically synthesized
gaatatgggtcacgtgggac

SEQ ID NO: 588052 - DNA, 20 bp, Artificial Sequence
  chemically synthesized
ttgatgatctatttttgctg

SEQ ID NO: 588053 - DNA, 20 bp, Artificial Sequence
  chemically synthesized
tattaattttaaaatgtaaa

SEQ ID NO: 588054 - DNA, 20 bp, Artificial Sequence
  chemically synthesized
tctggagtgtttcagaggtt

SEQ ID NO: 588055 - DNA, 20 bp, Artificial Sequence
  chemically synthesized
gaatgtggatacggtttctg

SEQ ID NO: 588056 - DNA, 20 bp, Artificial Sequence
  chemically synthesized
agagaatctgtgaatgtgga

SEQ ID NO: 588057 - DNA, 20 bp, Artificial Sequence
  chemically synthesized
ccagaaaccgtatccacatt

SEQ ID NO: 588058 - DNA, 20 bp, Artificial Sequence
  chemically synthesized
atctttatggggtagataaa

SEQ ID NO: 588059 - DNA, 20 bp, Artificial Sequence
  chemically synthesized
aaggaaagtatctacaaaag

SEQ ID NO: 588060 - DNA, 20 bp, Artificial Sequence
  chemically synthesized
ggagaatacttaaggaaaaa

SEQ ID NO: 588061 - DNA, 20 bp, Artificial Sequence
  chemically synthesized
tatccacgttgctgcaaatg

SEQ ID NO: 588062 - DNA, 20 bp, Artificial Sequence
  chemically synthesized
ataatatttgtctttctgtg

SEQ ID NO: 588063 - DNA, 20 bp, Artificial Sequence
  chemically synthesized
agtgtctactttcatgagat

SEQ ID NO: 588064 - DNA, 20 bp, Artificial Sequence
  chemically synthesized
gggattacaggcatgagcca

SEQ ID NO: 588065 - DNA, 20 bp, Artificial Sequence
  chemically synthesized
cacctcagcctcccaaagtg

SEQ ID NO: 588066 - DNA, 20 bp, Artificial Sequence
  chemically synthesized
tgggtggatcacttgacctc

SEQ ID NO: 588067 - DNA, 20 bp, Artificial Sequence
  chemically synthesized
tttttttttttttggtagag

SEQ ID NO: 588068 - DNA, 20 bp, Artificial Sequence
  chemically synthesized
tcaggaggctgaggttggag

SEQ ID NO: 588069 - DNA, 20 bp, Artificial Sequence
  chemically synthesized
aaggaaaagtactatatttg

SEQ ID NO: 588070 - DNA, 20 bp, Artificial Sequence
  chemically synthesized
aagcctgtgtcttctcagat

SEQ ID NO: 588071 - DNA, 20 bp, Artificial Sequence
  chemically synthesized
aagcacatatctgagaagac

SEQ ID NO: 588072 - DNA, 20 bp, Artificial Sequence
  chemically synthesized
ttatgattatttgccagttt

SEQ ID NO: 588073 - DNA, 20 bp, Artificial Sequence
  chemically synthesized
cactacatttatgattattt

SEQ ID NO: 588074 - DNA, 20 bp, Artificial Sequence
  chemically synthesized
gtgaatattccccactacat

SEQ ID NO: 588075 - DNA, 20 bp, Artificial Sequence
  chemically synthesized
tctaccctgtcgtcactatt

SEQ ID NO: 588076 - DNA, 20 bp, Artificial Sequence
  chemically synthesized
aaggatcgagaactaaaagt

SEQ ID NO: 588077 - DNA, 20 bp, Artificial Sequence
  chemically synthesized
tggttagccttggacatata

SEQ ID NO: 588078 - DNA, 20 bp, Artificial Sequence
  chemically synthesized
gacatatatcttgttttttc

SEQ ID NO: 588079 - DNA, 20 bp, Artificial Sequence
  chemically synthesized
aaatggacataagaatgctg

SEQ ID NO: 588080 - DNA, 20 bp, Artificial Sequence
  chemically synthesized
gacataagaatgctgccatg

SEQ ID NO: 588081 - DNA, 20 bp, Artificial Sequence
  chemically synthesized
ttgtcgcaatatctcagtta

SEQ ID NO: 588082 - DNA, 20 bp, Artificial Sequence
  chemically synthesized
gactttgataagagttttac

SEQ ID NO: 588083 - DNA, 20 bp, Artificial Sequence
  chemically synthesized
tctatgaacaggactttgat

SEQ ID NO: 588084 - DNA, 20 bp, Artificial Sequence
  chemically synthesized
aagagctagtattaatgaca

SEQ ID NO: 588085 - DNA, 20 bp, Artificial Sequence
  chemically synthesized
gctcttgtaacttccaaatt

SEQ ID NO: 588086 - DNA, 20 bp, Artificial Sequence
  chemically synthesized
tagatagtgatatcacccac

SEQ ID NO: 588087 - DNA, 20 bp, Artificial Sequence
  chemically synthesized
tgggagaggaatataacatg

SEQ ID NO: 588088 - DNA, 20 bp, Artificial Sequence
  chemically synthesized
tttggatatactgactttga

SEQ ID NO: 588089 - DNA, 20 bp, Artificial Sequence
  chemically synthesized
tttcagattagacctacata

SEQ ID NO: 588090 - DNA, 20 bp, Artificial Sequence
  chemically synthesized
tatttggcccaatatatagt

SEQ ID NO: 588091 - DNA, 20 bp, Artificial Sequence
  chemically synthesized
gtctaatatttggcccaata

SEQ ID NO: 588092 - DNA, 20 bp, Artificial Sequence
  chemically synthesized
taagcagtctctaccaaagt

SEQ ID NO: 588093 - DNA, 20 bp, Artificial Sequence
  chemically synthesized
aaatcggtgactttggtaga

SEQ ID NO: 588094 - DNA, 20 bp, Artificial Sequence
  chemically synthesized
gactttggtagagactgctt

SEQ ID NO: 588095 - DNA, 20 bp, Artificial Sequence
  chemically synthesized
actacattttgaatgcccat

SEQ ID NO: 588096 - DNA, 20 bp, Artificial Sequence
  chemically synthesized
atggaagatctacacaacac

SEQ ID NO: 588097 - DNA, 20 bp, Artificial Sequence
  chemically synthesized
atcagctctctatctatcac

SEQ ID NO: 588098 - DNA, 20 bp, Artificial Sequence
  chemically synthesized
ccaacctcggactacctact

SEQ ID NO: 588099 - DNA, 20 bp, Artificial Sequence
  chemically synthesized
agaagatgaatatatttcta

SEQ ID NO: 588100 - DNA, 20 bp, Artificial Sequence
  chemically synthesized
atcaattagaataatatcta

SEQ ID NO: 588101 - DNA, 20 bp, Artificial Sequence
  chemically synthesized
ttgttatccatagcaacaaa

SEQ ID NO: 588102 - DNA, 20 bp, Artificial Sequence
  chemically synthesized
cttctcattctatacggttt

SEQ ID NO: 588103 - DNA, 20 bp, Artificial Sequence
  chemically synthesized
cctcccttcttctcattcta

SEQ ID NO: 588104 - DNA, 20 bp, Artificial Sequence
  chemically synthesized
tttacctgccccttacatcc

SEQ ID NO: 588105 - DNA, 20 bp, Artificial Sequence
  chemically synthesized
cttactatattgatgacact

SEQ ID NO: 588106 - DNA, 20 bp, Artificial Sequence
  chemically synthesized
agaggtaagaataaattcag

SEQ ID NO: 588107 - DNA, 20 bp, Artificial Sequence
  chemically synthesized
aataggactaagatatgtcc

SEQ ID NO: 588108 - DNA, 20 bp, Artificial Sequence
  chemically synthesized
accattattgccaataacaa

SEQ ID NO: 588109 - DNA, 20 bp, Artificial Sequence
  chemically synthesized
tcattgttgttattggcaat

SEQ ID NO: 588110 - DNA, 20 bp, Artificial Sequence
  chemically synthesized
ggcaataatggtttctgagc

SEQ ID NO: 588111 - DNA, 20 bp, Artificial Sequence
  chemically synthesized
tccctctcctctcttttgct

SEQ ID NO: 588112 - DNA, 20 bp, Artificial Sequence
  chemically synthesized
catttccctctcctctcttt

SEQ ID NO: 588113 - DNA, 20 bp, Artificial Sequence
  chemically synthesized
gaaatgtgataatagagaat

SEQ ID NO: 588114 - DNA, 20 bp, Artificial Sequence
  chemically synthesized
gtaacagtgactaactatga

SEQ ID NO: 588115 - DNA, 20 bp, Artificial Sequence
  chemically synthesized
ggttgcccagaatctgaatg

SEQ ID NO: 588116 - DNA, 20 bp, Artificial Sequence
  chemically synthesized
tgttcgacataatcagggca

SEQ ID NO: 588117 - DNA, 20 bp, Artificial Sequence
  chemically synthesized
catcagattccatttgtatt

SEQ ID NO: 588118 - DNA, 20 bp, Artificial Sequence
  chemically synthesized
tcaaaaactgaacttccccc

SEQ ID NO: 588119 - DNA, 20 bp, Artificial Sequence
  chemically synthesized
atggaatctgatgggggaag

SEQ ID NO: 588120 - DNA, 20 bp, Artificial Sequence
  chemically synthesized
cttataattctgtcactcat

SEQ ID NO: 588121 - DNA, 20 bp, Artificial Sequence
  chemically synthesized
agtggtagagtggtgcatgg

SEQ ID NO: 588122 - DNA, 20 bp, Artificial Sequence
  chemically synthesized
catcttagcctcccacagtg

SEQ ID NO: 588123 - DNA, 20 bp, Artificial Sequence
  chemically synthesized
gtgggaggctaagatgagtg

SEQ ID NO: 588124 - DNA, 20 bp, Artificial Sequence
  chemically synthesized
agttcgagatccaatctagg

SEQ ID NO: 588125 - DNA, 20 bp, Artificial Sequence
  chemically synthesized
aactatagtccaaatcatac

SEQ ID NO: 588126 - DNA, 20 bp, Artificial Sequence
  chemically synthesized
ttgagttctgcccattttga

SEQ ID NO: 588127 - DNA, 20 bp, Artificial Sequence
  chemically synthesized
tttgagctggttttctatcc

SEQ ID NO: 588128 - DNA, 20 bp, Artificial Sequence
  chemically synthesized
gtctgtatctttctcctaaa

SEQ ID NO: 588129 - DNA, 20 bp, Artificial Sequence
  chemically synthesized
atctttctcctaaagtccgt

SEQ ID NO: 588130 - DNA, 20 bp, Artificial Sequence
  chemically synthesized
catagctgtgaataacagaa

SEQ ID NO: 588131 - DNA, 20 bp, Artificial Sequence
  chemically synthesized
tcaggtgaatgtttttagct

SEQ ID NO: 588132 - DNA, 20 bp, Artificial Sequence
  chemically synthesized
ctcactatccctgatcaggt

SEQ ID NO: 588133 - DNA, 20 bp, Artificial Sequence
  chemically synthesized
gcagcagaaaaagggtaaag

SEQ ID NO: 588134 - DNA, 20 bp, Artificial Sequence
  chemically synthesized
gaaaaagggtaaagatatgc

SEQ ID NO: 588135 - DNA, 20 bp, Artificial Sequence
  chemically synthesized
agacagaataattaaccggg

SEQ ID NO: 588136 - DNA, 20 bp, Artificial Sequence
  chemically synthesized
gattcctctgaaatgagaga

SEQ ID NO: 588137 - DNA, 20 bp, Artificial Sequence
  chemically synthesized
ataaggctttctgctgaata

SEQ ID NO: 588138 - DNA, 20 bp, Artificial Sequence
  chemically synthesized
ataatggtaaatgataaatt

SEQ ID NO: 588139 - DNA, 20 bp, Artificial Sequence
  chemically synthesized
aaatgataaattgttagatt

SEQ ID NO: 588140 - DNA, 20 bp, Artificial Sequence
  chemically synthesized
atatagtactttcattttac

SEQ ID NO: 588141 - DNA, 20 bp, Artificial Sequence
  chemically synthesized
ctatgataaatgtttttaaa

SEQ ID NO: 588142 - DNA, 20 bp, Artificial Sequence
  chemically synthesized
ttatctctctctactatgat

SEQ ID NO: 588143 - DNA, 20 bp, Artificial Sequence
  chemically synthesized
ataagtctaaatttattata

SEQ ID NO: 588144 - DNA, 20 bp, Artificial Sequence
  chemically synthesized
ttttactaattatatgttgt

SEQ ID NO: 588145 - DNA, 20 bp, Artificial Sequence
  chemically synthesized
atgttccctttaaaattctc

SEQ ID NO: 588146 - DNA, 20 bp, Artificial Sequence
  chemically synthesized
tcattttattgattccttac

SEQ ID NO: 588147 - DNA, 20 bp, Artificial Sequence
  chemically synthesized
gaaaaatgtgttgatcattt

SEQ ID NO: 588148 - DNA, 20 bp, Artificial Sequence
  chemically synthesized
cacatttttctcttaggact

SEQ ID NO: 588149 - DNA, 20 bp, Artificial Sequence
  chemically synthesized
tcctcaggtgagtgtcctac

SEQ ID NO: 588150 - DNA, 20 bp, Artificial Sequence
  chemically synthesized
tgtattccttttttggagtg

SEQ ID NO: 588151 - DNA, 20 bp, Artificial Sequence
  chemically synthesized
cttttttggagtgttatgat

SEQ ID NO: 588152 - DNA, 20 bp, Artificial Sequence
  chemically synthesized
ataaaaagaactttgtaaat

SEQ ID NO: 588153 - DNA, 20 bp, Artificial Sequence
  chemically synthesized
tataaaatgtgtctcaaagg

SEQ ID NO: 588154 - DNA, 20 bp, Artificial Sequence
  chemically synthesized
aggctttgagggtagacaat

SEQ ID NO: 588155 - DNA, 20 bp, Artificial Sequence
  chemically synthesized
taaatgcagaatgccatttg

SEQ ID NO: 588156 - DNA, 20 bp, Artificial Sequence
  chemically synthesized
tattgcatttaaagtctatc

SEQ ID NO: 588157 - DNA, 20 bp, Artificial Sequence
  chemically synthesized
tgactggggcatgtatttct

SEQ ID NO: 588158 - DNA, 20 bp, Artificial Sequence
  chemically synthesized
taagttcaaagatttcatcc

SEQ ID NO: 588159 - DNA, 20 bp, Artificial Sequence
  chemically synthesized
aacatacaggaaaataagtt

SEQ ID NO: 588160 - DNA, 20 bp, Artificial Sequence
  chemically synthesized
ttattttcctgtatgttgtg

SEQ ID NO: 588161 - DNA, 20 bp, Artificial Sequence
  chemically synthesized
tgtatgttgtggtaggtttt

SEQ ID NO: 588162 - DNA, 20 bp, Artificial Sequence
  chemically synthesized
tccctgatttatccccaata

SEQ ID NO: 588163 - DNA, 20 bp, Artificial Sequence
  chemically synthesized
aatattttgtttgtcaaccc

SEQ ID NO: 588164 - DNA, 20 bp, Artificial Sequence
  chemically synthesized
tgtcaacccttctgatttgt

SEQ ID NO: 588165 - DNA, 20 bp, Artificial Sequence
  chemically synthesized
cactagtgctcatctgccac

SEQ ID NO: 588166 - DNA, 20 bp, Artificial Sequence
  chemically synthesized
cctgaactccttttccacag

SEQ ID NO: 588167 - DNA, 20 bp, Artificial Sequence
  chemically synthesized
ttaatgtgtactctgggaat

SEQ ID NO: 588168 - DNA, 20 bp, Artificial Sequence
  chemically synthesized
tgtgtactctgggaattctg

SEQ ID NO: 588169 - DNA, 20 bp, Artificial Sequence
  chemically synthesized
ttgagaagcagttagttcaa

SEQ ID NO: 588170 - DNA, 20 bp, Artificial Sequence
  chemically synthesized
gtggcaatctccattgaact

SEQ ID NO: 588171 - DNA, 20 bp, Artificial Sequence
  chemically synthesized
tcagacttacctattcaaat

SEQ ID NO: 588172 - DNA, 20 bp, Artificial Sequence
  chemically synthesized
tcccaagttgagctctgtat

SEQ ID NO: 588173 - DNA, 20 bp, Artificial Sequence
  chemically synthesized
agttgagctctgtatgtctg

SEQ ID NO: 588174 - DNA, 20 bp, Artificial Sequence
  chemically synthesized
gatgatcccttttccaggtt

SEQ ID NO: 588175 - DNA, 20 bp, Artificial Sequence
  chemically synthesized
attctaggatgatccctttt

SEQ ID NO: 588176 - DNA, 20 bp, Artificial Sequence
  chemically synthesized
tcaagtatttcttgaatctg

SEQ ID NO: 588177 - DNA, 20 bp, Artificial Sequence
  chemically synthesized
gaatagaactttaaaaacct

SEQ ID NO: 588178 - DNA, 20 bp, Artificial Sequence
  chemically synthesized
gtcaggtttttaaagttcta

SEQ ID NO: 588179 - DNA, 20 bp, Artificial Sequence
  chemically synthesized
ctaacttgagtcaccctgcc

SEQ ID NO: 588180 - DNA, 20 bp, Artificial Sequence
  chemically synthesized
gttgggacgtttttatatgc

SEQ ID NO: 588181 - DNA, 20 bp, Artificial Sequence
  chemically synthesized
aaggatgttgggacgttttt

SEQ ID NO: 588182 - DNA, 20 bp, Artificial Sequence
  chemically synthesized
ggtagaatataaggatgttg

SEQ ID NO: 588183 - DNA, 20 bp, Artificial Sequence
  chemically synthesized
tctaccctggaaaaaattct

SEQ ID NO: 588184 - DNA, 20 bp, Artificial Sequence
  chemically synthesized
gtcaagatggaccaggtcat

SEQ ID NO: 588185 - DNA, 20 bp, Artificial Sequence
  chemically synthesized
aaaggaagtccccttatcaa

SEQ ID NO: 588186 - DNA, 20 bp, Artificial Sequence
  chemically synthesized
cgcctatccacttaccctaa

SEQ ID NO: 588187 - DNA, 20 bp, Artificial Sequence
  chemically synthesized
ttgattagggtaagtggata

SEQ ID NO: 588188 - DNA, 20 bp, Artificial Sequence
  chemically synthesized
ggaaaaatattgtaaaattg

SEQ ID NO: 588189 - DNA, 20 bp, Artificial Sequence
  chemically synthesized
aaattggagggattatataa

SEQ ID NO: 588190 - DNA, 20 bp, Artificial Sequence
  chemically synthesized
tgtatattctaagaaaaata

SEQ ID NO: 588191 - DNA, 20 bp, Artificial Sequence
  chemically synthesized
aatatgcttaacttcaacct

SEQ ID NO: 588192 - DNA, 20 bp, Artificial Sequence
  chemically synthesized
agtgttttatgcaaaaagta

SEQ ID NO: 588193 - DNA, 20 bp, Artificial Sequence
  chemically synthesized
tcacagattatgaaatgtag

SEQ ID NO: 588194 - DNA, 20 bp, Artificial Sequence
  chemically synthesized
acatttcataatctgtgact

SEQ ID NO: 588195 - DNA, 20 bp, Artificial Sequence
  chemically synthesized
aaagaaaccaaactaaaagt

SEQ ID NO: 588196 - DNA, 20 bp, Artificial Sequence
  chemically synthesized
tcataatctgtgacttttag

SEQ ID NO: 588197 - DNA, 20 bp, Artificial Sequence
  chemically synthesized
tttggtttctttgaattaca

SEQ ID NO: 588198 - DNA, 20 bp, Artificial Sequence
  chemically synthesized
aaaaatggaggtattttgca

SEQ ID NO: 588199 - DNA, 20 bp, Artificial Sequence
  chemically synthesized
tgcaaaatacctccattttt

SEQ ID NO: 588200 - DNA, 20 bp, Artificial Sequence
  chemically synthesized
gatgtaggtaagacaactgt

SEQ ID NO: 588201 - DNA, 20 bp, Artificial Sequence
  chemically synthesized
gaattagatgtaggtaagac

SEQ ID NO: 588202 - DNA, 20 bp, Artificial Sequence
  chemically synthesized
tacatctaattcaacagcac

SEQ ID NO: 588203 - DNA, 20 bp, Artificial Sequence
  chemically synthesized
gactacaggcccacgtctgg

SEQ ID NO: 588204 - DNA, 20 bp, Artificial Sequence
  chemically synthesized
ttgtattttcttagtagcga

SEQ ID NO: 588205 - DNA, 20 bp, Artificial Sequence
  chemically synthesized
gatgggtggatcacctgagg

SEQ ID NO: 588206 - DNA, 20 bp, Artificial Sequence
  chemically synthesized
catctcggcctcccaaagtg

SEQ ID NO: 588207 - DNA, 20 bp, Artificial Sequence
  chemically synthesized
tgctttggaagacttgataa

SEQ ID NO: 588208 - DNA, 20 bp, Artificial Sequence
  chemically synthesized
gtttctatgaatactaaatt

SEQ ID NO: 588209 - DNA, 20 bp, Artificial Sequence
  chemically synthesized
aaatgaaaagataagagaat

SEQ ID NO: 588210 - DNA, 20 bp, Artificial Sequence
  chemically synthesized
tatcttttcatttctatttc

SEQ ID NO: 588211 - DNA, 20 bp, Artificial Sequence
  chemically synthesized
gatggatattagtaacctat

SEQ ID NO: 588212 - DNA, 20 bp, Artificial Sequence
  chemically synthesized
taggttactaatatccatca

SEQ ID NO: 588213 - DNA, 20 bp, Artificial Sequence
  chemically synthesized
taggtttggagtgggaattg

SEQ ID NO: 588214 - DNA, 20 bp, Artificial Sequence
  chemically synthesized
cagtttatatgtagaaaatg

SEQ ID NO: 588215 - DNA, 20 bp, Artificial Sequence
  chemically synthesized
aagagtttagggtaagtcaa

SEQ ID NO: 588216 - DNA, 20 bp, Artificial Sequence
  chemically synthesized
gtttagggtaagtcaatggt

SEQ ID NO: 588217 - DNA, 20 bp, Artificial Sequence
  chemically synthesized
cttcaatgtaggccattttt

SEQ ID NO: 588218 - DNA, 20 bp, Artificial Sequence
  chemically synthesized
taggccattttttcttgctt

SEQ ID NO: 588219 - DNA, 20 bp, Artificial Sequence
  chemically synthesized
ctgggaaagtaggagttagg

SEQ ID NO: 588220 - DNA, 20 bp, Artificial Sequence
  chemically synthesized
aacatatttggtgccagcta

SEQ ID NO: 588221 - DNA, 20 bp, Artificial Sequence
  chemically synthesized
gaaaaatcagcttcatagtt

SEQ ID NO: 588222 - DNA, 20 bp, Artificial Sequence
  chemically synthesized
cataaaacaattaactatga

SEQ ID NO: 588223 - DNA, 20 bp, Artificial Sequence
  chemically synthesized
tcatcaaaagactatgaaaa

SEQ ID NO: 588224 - DNA, 20 bp, Artificial Sequence
  chemically synthesized
gaagaattatgaatgccctt

SEQ ID NO: 588225 - DNA, 20 bp, Artificial Sequence
  chemically synthesized
ctgttctctgatgactcttg

SEQ ID NO: 588226 - DNA, 20 bp, Artificial Sequence
  chemically synthesized
cagagaacagatgggaagag

SEQ ID NO: 588227 - DNA, 20 bp, Artificial Sequence
  chemically synthesized
acctgtgaataataatatct

SEQ ID NO: 588228 - DNA, 20 bp, Artificial Sequence
  chemically synthesized
catatcaccaaagagctatt

SEQ ID NO: 588229 - DNA, 20 bp, Artificial Sequence
  chemically synthesized
taaaaatagctctttggtga

SEQ ID NO: 588230 - DNA, 20 bp, Artificial Sequence
  chemically synthesized
tcatcctacatatagccaca

SEQ ID NO: 588231 - DNA, 20 bp, Artificial Sequence
  chemically synthesized
tgtaggatgaggctaaaaca

SEQ ID NO: 588232 - DNA, 20 bp, Artificial Sequence
  chemically synthesized
caggaattagccctgaaact

SEQ ID NO: 588233 - DNA, 20 bp, Artificial Sequence
  chemically synthesized
cattcagtttcagggctaat

SEQ ID NO: 588234 - DNA, 20 bp, Artificial Sequence
  chemically synthesized
gtaggataaacaaatgtaca

SEQ ID NO: 588235 - DNA, 20 bp, Artificial Sequence
  chemically synthesized
ttgattcaaacattttgtac

SEQ ID NO: 588236 - DNA, 20 bp, Artificial Sequence
  chemically synthesized
acaaaatgtttgaatcaaag

SEQ ID NO: 588237 - DNA, 20 bp, Artificial Sequence
  chemically synthesized
agttatggcaaaaagcagct

SEQ ID NO: 588238 - DNA, 20 bp, Artificial Sequence
  chemically synthesized
tctagtcttaaaaaaatgga

SEQ ID NO: 588239 - DNA, 20 bp, Artificial Sequence
  chemically synthesized
atgttatcacatttccatgg

SEQ ID NO: 588240 - DNA, 20 bp, Artificial Sequence
  chemically synthesized
ctaaagagccagaccaattt

SEQ ID NO: 588241 - DNA, 20 bp, Artificial Sequence
  chemically synthesized
ctttacacttgacattatta

SEQ ID NO: 588242 - DNA, 20 bp, Artificial Sequence
  chemically synthesized
ctatataataatgtcaagtg

SEQ ID NO: 588243 - DNA, 20 bp, Artificial Sequence
  chemically synthesized
caagtgtaaagatttaaatc

SEQ ID NO: 588244 - DNA, 20 bp, Artificial Sequence
  chemically synthesized
tattcacattcagattaaac

SEQ ID NO: 588245 - DNA, 20 bp, Artificial Sequence
  chemically synthesized
tcgtaagaattttattcaca

SEQ ID NO: 588246 - DNA, 20 bp, Artificial Sequence
  chemically synthesized
tctgaatgtgaataaaattc

SEQ ID NO: 588247 - DNA, 20 bp, Artificial Sequence
  chemically synthesized
tactggccatctacaatata

SEQ ID NO: 588248 - DNA, 20 bp, Artificial Sequence
  chemically synthesized
aagagagtcctctgccctca

SEQ ID NO: 588249 - DNA, 20 bp, Artificial Sequence
  chemically synthesized
gcttttcccccagcaagatt

SEQ ID NO: 588250 - DNA, 20 bp, Artificial Sequence
  chemically synthesized
ttacatatgcttttccccca

SEQ ID NO: 588251 - DNA, 20 bp, Artificial Sequence
  chemically synthesized
catgtatcatacctatttac

SEQ ID NO: 588252 - DNA, 20 bp, Artificial Sequence
  chemically synthesized
acataagcagtttattctct

SEQ ID NO: 588253 - DNA, 20 bp, Artificial Sequence
  chemically synthesized
aagaaaaccttaagagaata

SEQ ID NO: 588254 - DNA, 20 bp, Artificial Sequence
  chemically synthesized
accttaagagaataaactgc

SEQ ID NO: 588255 - DNA, 20 bp, Artificial Sequence
  chemically synthesized
acctgctcttctcaaacata

SEQ ID NO: 588256 - DNA, 20 bp, Artificial Sequence
  chemically synthesized
agatgagtcttaagggatgt

SEQ ID NO: 588257 - DNA, 20 bp, Artificial Sequence
  chemically synthesized
aagagaattcaaccaaagga

SEQ ID NO: 588258 - DNA, 20 bp, Artificial Sequence
  chemically synthesized
acaagacaaaaaaaaaaaaa

SEQ ID NO: 588259 - DNA, 20 bp, Artificial Sequence
  chemically synthesized
gcggtttttttttttttttg

SEQ ID NO: 588260 - DNA, 20 bp, Artificial Sequence
  chemically synthesized
tttttgtcttgttttttgtt

SEQ ID NO: 588261 - DNA, 20 bp, Artificial Sequence
  chemically synthesized
tgacctgaagttttctgttc

SEQ ID NO: 588262 - DNA, 20 bp, Artificial Sequence
  chemically synthesized
acagaaaacttcaggtcatt

SEQ ID NO: 588263 - DNA, 20 bp, Artificial Sequence
  chemically synthesized
gtctgaagctttgaatgacc

SEQ ID NO: 588264 - DNA, 20 bp, Artificial Sequence
  chemically synthesized
ccactatttctgtttatgtc

SEQ ID NO: 588265 - DNA, 20 bp, Artificial Sequence
  chemically synthesized
tttttcataatttccactat

SEQ ID NO: 588266 - DNA, 20 bp, Artificial Sequence
  chemically synthesized
gttctgacctatctttccaa

SEQ ID NO: 588267 - DNA, 20 bp, Artificial Sequence
  chemically synthesized
gggttggaaagataggtcag

SEQ ID NO: 588268 - DNA, 20 bp, Artificial Sequence
  chemically synthesized
atttatcccagttttgtcca

SEQ ID NO: 588269 - DNA, 20 bp, Artificial Sequence
  chemically synthesized
tcagattttgcattatttat

SEQ ID NO: 588270 - DNA, 20 bp, Artificial Sequence
  chemically synthesized
ctccggagtccttactctag

SEQ ID NO: 588271 - DNA, 20 bp, Artificial Sequence
  chemically synthesized
tggctgtgcaatcttgggca

SEQ ID NO: 588272 - DNA, 20 bp, Artificial Sequence
  chemically synthesized
agactgataaaactctttgc

SEQ ID NO: 588273 - DNA, 20 bp, Artificial Sequence
  chemically synthesized
atattgccatgcactgttcc

SEQ ID NO: 588274 - DNA, 20 bp, Artificial Sequence
  chemically synthesized
ttaattgcttttccatagat

SEQ ID NO: 588275 - DNA, 20 bp, Artificial Sequence
  chemically synthesized
ccactttgctcatttatatt

SEQ ID NO: 588276 - DNA, 20 bp, Artificial Sequence
  chemically synthesized
caggtgctgcaaactgagga

SEQ ID NO: 588277 - DNA, 20 bp, Artificial Sequence
  chemically synthesized
tgctgcaaactgaggacaaa

SEQ ID NO: 588278 - DNA, 20 bp, Artificial Sequence
  chemically synthesized
tggggtaagcaagctttgtc

SEQ ID NO: 588279 - DNA, 20 bp, Artificial Sequence
  chemically synthesized
agaagcattgcctggggtaa

SEQ ID NO: 588280 - DNA, 20 bp, Artificial Sequence
  chemically synthesized
caaagcttgcttaccccagg

SEQ ID NO: 588281 - DNA, 20 bp, Artificial Sequence
  chemically synthesized
caagtgattcatgggcacat

SEQ ID NO: 588282 - DNA, 20 bp, Artificial Sequence
  chemically synthesized
aataagatttccaagtttcc

SEQ ID NO: 588283 - DNA, 20 bp, Artificial Sequence
  chemically synthesized
cagcatttttaataagattt

SEQ ID NO: 588284 - DNA, 20 bp, Artificial Sequence
  chemically synthesized
aataacagtcagcattttta

SEQ ID NO: 588285 - DNA, 20 bp, Artificial Sequence
  chemically synthesized
aaaaatgctgactgttattt

SEQ ID NO: 588286 - DNA, 20 bp, Artificial Sequence
  chemically synthesized
atcacctacaactgagtaac

SEQ ID NO: 588287 - DNA, 20 bp, Artificial Sequence
  chemically synthesized
gacctcattttttaaaaaaa

SEQ ID NO: 588288 - DNA, 20 bp, Artificial Sequence
  chemically synthesized
atgcagtatttttgcatagc

SEQ ID NO: 588289 - DNA, 20 bp, Artificial Sequence
  chemically synthesized
tgcaaaaatactgcatgcat

SEQ ID NO: 588290 - DNA, 20 bp, Artificial Sequence
  chemically synthesized
caggattcagcctgtgggta

SEQ ID NO: 588291 - DNA, 20 bp, Artificial Sequence
  chemically synthesized
ccttgactctccatccagcc

SEQ ID NO: 588292 - DNA, 20 bp, Artificial Sequence
  chemically synthesized
aacttcctttttttctcatt

SEQ ID NO: 588293 - DNA, 20 bp, Artificial Sequence
  chemically synthesized
aactggcaatgagaaaaaaa

SEQ ID NO: 588294 - DNA, 20 bp, Artificial Sequence
  chemically synthesized
ttgcccccaggatctgtccc

SEQ ID NO: 588295 - DNA, 20 bp, Artificial Sequence
  chemically synthesized
ggcaaaatgtgaatgtgtga

SEQ ID NO: 588296 - DNA, 20 bp, Artificial Sequence
  chemically synthesized
gccatttgagtcattaaaat

SEQ ID NO: 588297 - DNA, 20 bp, Artificial Sequence
  chemically synthesized
aaccaaatagctttcaacca

SEQ ID NO: 588298 - DNA, 20 bp, Artificial Sequence
  chemically synthesized
tcagaccccacccccaacca

SEQ ID NO: 588299 - DNA, 20 bp, Artificial Sequence
  chemically synthesized
tctcttaagttttctttaac

SEQ ID NO: 588300 - DNA, 20 bp, Artificial Sequence
  chemically synthesized
tgtaagacaactgttgtctc

SEQ ID NO: 588301 - DNA, 20 bp, Artificial Sequence
  chemically synthesized
ttagcaattcatattgctct

SEQ ID NO: 588302 - DNA, 20 bp, Artificial Sequence
  chemically synthesized
gtttgcatgcaaatacacgc

SEQ ID NO: 588303 - DNA, 20 bp, Artificial Sequence
  chemically synthesized
attgtttaaagaccttagct

SEQ ID NO: 588304 - DNA, 20 bp, Artificial Sequence
  chemically synthesized
atgtacttaaaggaagaaat

SEQ ID NO: 588305 - DNA, 20 bp, Artificial Sequence
  chemically synthesized
taatttgcatggcaaaccag

SEQ ID NO: 588306 - DNA, 20 bp, Artificial Sequence
  chemically synthesized
tgtactagtatataatctat

SEQ ID NO: 588307 - DNA, 20 bp, Artificial Sequence
  chemically synthesized
tagattatatactagtacat

SEQ ID NO: 588308 - DNA, 20 bp, Artificial Sequence
  chemically synthesized
gtttaagaattcagaagtag

SEQ ID NO: 588309 - DNA, 20 bp, Artificial Sequence
  chemically synthesized
tacatgaagtctcacacaag

SEQ ID NO: 588310 - DNA, 20 bp, Artificial Sequence
  chemically synthesized
ttaacttccatgtattctga

SEQ ID NO: 588311 - DNA, 20 bp, Artificial Sequence
  chemically synthesized
atattttcagattaccttgg

SEQ ID NO: 588312 - DNA, 20 bp, Artificial Sequence
  chemically synthesized
gtcccaaaggagataatatt

SEQ ID NO: 588313 - DNA, 20 bp, Artificial Sequence
  chemically synthesized
gaaaatattatctcctttgg

SEQ ID NO: 588314 - DNA, 20 bp, Artificial Sequence
  chemically synthesized
gaaggggctactacccagat

SEQ ID NO: 588315 - DNA, 20 bp, Artificial Sequence
  chemically synthesized
tcaccttggactttgcctat

SEQ ID NO: 588316 - DNA, 20 bp, Artificial Sequence
  chemically synthesized
ttacagttattattcttgcc

SEQ ID NO: 588317 - DNA, 20 bp, Artificial Sequence
  chemically synthesized
gtttgaaaaaaaaaaaaaaa

SEQ ID NO: 588318 - DNA, 20 bp, Artificial Sequence
  chemically synthesized
acatttaccagctggctttc

SEQ ID NO: 588319 - DNA, 20 bp, Artificial Sequence
  chemically synthesized
catgatcttaacatttacca

SEQ ID NO: 588320 - DNA, 20 bp, Artificial Sequence
  chemically synthesized
ctggtaaatgttaagatcat

SEQ ID NO: 588321 - DNA, 20 bp, Artificial Sequence
  chemically synthesized
tacactggggcttgcaaaat

SEQ ID NO: 588322 - DNA, 20 bp, Artificial Sequence
  chemically synthesized
ccctaactcagttattacac

SEQ ID NO: 588323 - DNA, 20 bp, Artificial Sequence
  chemically synthesized
caatggatactaaagccatt

SEQ ID NO: 588324 - DNA, 20 bp, Artificial Sequence
  chemically synthesized
tcgcaattaataaatcatct

SEQ ID NO: 588325 - DNA, 20 bp, Artificial Sequence
  chemically synthesized
aaatgctgcaaagttttatt

SEQ ID NO: 588326 - DNA, 20 bp, Artificial Sequence
  chemically synthesized
agtagtctcactaaatgctg

SEQ ID NO: 588327 - DNA, 20 bp, Artificial Sequence
  chemically synthesized
atatgaagtattctcgccaa

SEQ ID NO: 588328 - DNA, 20 bp, Artificial Sequence
  chemically synthesized
cttcaagagatgcatgtcaa

SEQ ID NO: 588329 - DNA, 20 bp, Artificial Sequence
  chemically synthesized
agtcttatttagacctaact

SEQ ID NO: 588330 - DNA, 20 bp, Artificial Sequence
  chemically synthesized
ttattttttttcccctgatg

SEQ ID NO: 588331 - DNA, 20 bp, Artificial Sequence
  chemically synthesized
aaaatgtctcatctttcagg

SEQ ID NO: 588332 - DNA, 20 bp, Artificial Sequence
  chemically synthesized
ctcaaaaaatgtctcatctt

SEQ ID NO: 588333 - DNA, 20 bp, Artificial Sequence
  chemically synthesized
gacatgccatatataaccat

SEQ ID NO: 588334 - DNA, 20 bp, Artificial Sequence
  chemically synthesized
cccctaaataattcagcatg

SEQ ID NO: 588335 - DNA, 20 bp, Artificial Sequence
  chemically synthesized
tgccatatatgctttttttc

SEQ ID NO: 588336 - DNA, 20 bp, Artificial Sequence
  chemically synthesized
aattgttaacattttgccat

SEQ ID NO: 588337 - DNA, 20 bp, Artificial Sequence
  chemically synthesized
gcaaaacatatgcccattta

SEQ ID NO: 588338 - DNA, 20 bp, Artificial Sequence
  chemically synthesized
ggaaaacagtgtaaatgggc

SEQ ID NO: 588339 - DNA, 20 bp, Artificial Sequence
  chemically synthesized
taaatgggcatatgttttgc

SEQ ID NO: 588340 - DNA, 20 bp, Artificial Sequence
  chemically synthesized
gcaattgtttcaatttttct

SEQ ID NO: 588341 - DNA, 20 bp, Artificial Sequence
  chemically synthesized
actaatatgcattaaggaat

SEQ ID NO: 588342 - DNA, 20 bp, Artificial Sequence
  chemically synthesized
cttcttttagacaagtctga

SEQ ID NO: 588343 - DNA, 20 bp, Artificial Sequence
  chemically synthesized
tctaaaagaagaaagaatta

SEQ ID NO: 588344 - DNA, 20 bp, Artificial Sequence
  chemically synthesized
ataatccttagcaataataa

SEQ ID NO: 588345 - DNA, 20 bp, Artificial Sequence
  chemically synthesized
gaaatcttaattattattgc

SEQ ID NO: 588346 - DNA, 20 bp, Artificial Sequence
  chemically synthesized
ttaattattattgctaagga

SEQ ID NO: 588347 - DNA, 20 bp, Artificial Sequence
  chemically synthesized
aggaattccacttcccactg

SEQ ID NO: 588348 - DNA, 20 bp, Artificial Sequence
  chemically synthesized
ttagaataatgtcagttgat

SEQ ID NO: 588349 - DNA, 20 bp, Artificial Sequence
  chemically synthesized
gattgctgacaacataatga

SEQ ID NO: 588350 - DNA, 20 bp, Artificial Sequence
  chemically synthesized
tcattatgttgtcagcaatc

SEQ ID NO: 588351 - DNA, 20 bp, Artificial Sequence
  chemically synthesized
ggggagccaggccttcaagc

SEQ ID NO: 588352 - DNA, 20 bp, Artificial Sequence
  chemically synthesized
agaatctcatcctaatttac

SEQ ID NO: 588353 - DNA, 20 bp, Artificial Sequence
  chemically synthesized
tgaaaccatagtaaattagg

SEQ ID NO: 588354 - DNA, 20 bp, Artificial Sequence
  chemically synthesized
aaaaatgatcctagccagct

SEQ ID NO: 588355 - DNA, 20 bp, Artificial Sequence
  chemically synthesized
tctgaggaatgtcaggcttc

SEQ ID NO: 588356 - DNA, 20 bp, Artificial Sequence
  chemically synthesized
aaacattattctgaggaatg

SEQ ID NO: 588357 - DNA, 20 bp, Artificial Sequence
  chemically synthesized
aagcctgacattcctcagaa

SEQ ID NO: 588358 - DNA, 20 bp, Artificial Sequence
  chemically synthesized
tgtgctacagggtcttattg

SEQ ID NO: 588359 - DNA, 20 bp, Artificial Sequence
  chemically synthesized
gtagcacatataataagtac

SEQ ID NO: 588360 - DNA, 20 bp, Artificial Sequence
  chemically synthesized
taaatatatcaaaatatcat

SEQ ID NO: 588361 - DNA, 20 bp, Artificial Sequence
  chemically synthesized
catatctgtgacttcatagg

SEQ ID NO: 588362 - DNA, 20 bp, Artificial Sequence
  chemically synthesized
cataggtactgattgtacta

SEQ ID NO: 588363 - DNA, 20 bp, Artificial Sequence
  chemically synthesized
cctactttcaaaatgaaaag

SEQ ID NO: 588364 - DNA, 20 bp, Artificial Sequence
  chemically synthesized
tggcgccccttgctattcat

SEQ ID NO: 588365 - DNA, 20 bp, Artificial Sequence
  chemically synthesized
gccccttgctattcatggac

SEQ ID NO: 588366 - DNA, 20 bp, Artificial Sequence
  chemically synthesized
gcttgcttaaagacttgtac

SEQ ID NO: 588367 - DNA, 20 bp, Artificial Sequence
  chemically synthesized
gcttaaagacttgtacacag

SEQ ID NO: 588368 - DNA, 20 bp, Artificial Sequence
  chemically synthesized
acttccccttacagccgatg

SEQ ID NO: 588369 - DNA, 20 bp, Artificial Sequence
  chemically synthesized
gcacctccttcgtgtacaaa

SEQ ID NO: 588370 - DNA, 20 bp, Artificial Sequence
  chemically synthesized
catcattaaactcattatta

SEQ ID NO: 588371 - DNA, 20 bp, Artificial Sequence
  chemically synthesized
taggcttaagcatgataata

SEQ ID NO: 588372 - DNA, 20 bp, Artificial Sequence
  chemically synthesized
cagaagaactggatacatct

SEQ ID NO: 588373 - DNA, 20 bp, Artificial Sequence
  chemically synthesized
gtttaagatagacaattcac

SEQ ID NO: 588374 - DNA, 20 bp, Artificial Sequence
  chemically synthesized
gaaatgtagtcagttagcga

SEQ ID NO: 588375 - DNA, 20 bp, Artificial Sequence
  chemically synthesized
ctgactacatttcacacttc

SEQ ID NO: 588376 - DNA, 20 bp, Artificial Sequence
  chemically synthesized
gtccactattatttgaactt

SEQ ID NO: 588377 - DNA, 20 bp, Artificial Sequence
  chemically synthesized
tcttaaaatttcagaagact

SEQ ID NO: 588378 - DNA, 20 bp, Artificial Sequence
  chemically synthesized
tacagggctccatatagaca

SEQ ID NO: 588379 - DNA, 20 bp, Artificial Sequence
  chemically synthesized
ttcaacttaacaacagtagt

SEQ ID NO: 588380 - DNA, 20 bp, Artificial Sequence
  chemically synthesized
aacttctattcccttctaac

SEQ ID NO: 588381 - DNA, 20 bp, Artificial Sequence
  chemically synthesized
gcgttgcactgagagtacac

SEQ ID NO: 588382 - DNA, 20 bp, Artificial Sequence
  chemically synthesized
actattgattagcaataggt

SEQ ID NO: 588383 - DNA, 20 bp, Artificial Sequence
  chemically synthesized
atattattttattaattttt

SEQ ID NO: 588384 - DNA, 20 bp, Artificial Sequence
  chemically synthesized
tttttacttgatttgctact

SEQ ID NO: 588385 - DNA, 20 bp, Artificial Sequence
  chemically synthesized
cacttttgtggcatacttcc

SEQ ID NO: 588386 - DNA, 20 bp, Artificial Sequence
  chemically synthesized
gaaatagacaactttaaaag

SEQ ID NO: 588387 - DNA, 20 bp, Artificial Sequence
  chemically synthesized
ccttgagttttttttttaag

SEQ ID NO: 588388 - DNA, 20 bp, Artificial Sequence
  chemically synthesized
aaaagtcaagttcagcttcc

SEQ ID NO: 588389 - DNA, 20 bp, Artificial Sequence
  chemically synthesized
cagtgctttaaaaagtcaag

SEQ ID NO: 588390 - DNA, 20 bp, Artificial Sequence
  chemically synthesized
ctacattaaatattgcactt

SEQ ID NO: 588391 - DNA, 20 bp, Artificial Sequence
  chemically synthesized
gcaatatttaatgtaggtca

SEQ ID NO: 588392 - DNA, 20 bp, Artificial Sequence
  chemically synthesized
aattttaagttaattacagc

SEQ ID NO: 588393 - DNA, 20 bp, Artificial Sequence
  chemically synthesized
attagaaagatctaaaattt

SEQ ID NO: 588394 - DNA, 20 bp, Artificial Sequence
  chemically synthesized
aaacaaagatgtagcaatat

SEQ ID NO: 588395 - DNA, 20 bp, Artificial Sequence
  chemically synthesized
aaacaggcatattgctacat

SEQ ID NO: 588396 - DNA, 20 bp, Artificial Sequence
  chemically synthesized
ttagagcccaataacagata

SEQ ID NO: 588397 - DNA, 20 bp, Artificial Sequence
  chemically synthesized
tttttctataatatataaag

SEQ ID NO: 588398 - DNA, 20 bp, Artificial Sequence
  chemically synthesized
ttatagaaaaataatcttcc

SEQ ID NO: 588399 - DNA, 20 bp, Artificial Sequence
  chemically synthesized
taaagtggattaaatcgact

SEQ ID NO: 588400 - DNA, 20 bp, Artificial Sequence
  chemically synthesized
tatacggagagaattcataa

SEQ ID NO: 588401 - DNA, 20 bp, Artificial Sequence
  chemically synthesized
ctcatttcttaccatcttaa

SEQ ID NO: 588402 - DNA, 20 bp, Artificial Sequence
  chemically synthesized
ttcttaccatcttaatttgg

SEQ ID NO: 588403 - DNA, 20 bp, Artificial Sequence
  chemically synthesized
tagttcagaaatgacattat

SEQ ID NO: 588404 - DNA, 20 bp, Artificial Sequence
  chemically synthesized
ttttattatttagataactg

SEQ ID NO: 588405 - DNA, 20 bp, Artificial Sequence
  chemically synthesized
atctaaataataaaatactt

SEQ ID NO: 588406 - DNA, 20 bp, Artificial Sequence
  chemically synthesized
ggtaagtcatatactttttt

SEQ ID NO: 588407 - DNA, 20 bp, Artificial Sequence
  chemically synthesized
gtatatgacttacctaagga

SEQ ID NO: 588408 - DNA, 20 bp, Artificial Sequence
  chemically synthesized
ctaaggaagtagtttaacta

SEQ ID NO: 588409 - DNA, 20 bp, Artificial Sequence
  chemically synthesized
attttatctatctataatca

SEQ ID NO: 588410 - DNA, 20 bp, Artificial Sequence
  chemically synthesized
agtcttggttttgaaaatct

SEQ ID NO: 588411 - DNA, 20 bp, Artificial Sequence
  chemically synthesized
gatattttgaataattaagt

SEQ ID NO: 588412 - DNA, 20 bp, Artificial Sequence
  chemically synthesized
gtgtgtgtgtgtgtgtgtgt

SEQ ID NO: 588413 - DNA, 20 bp, Artificial Sequence
  chemically synthesized
gtgtgtgtttaggtcaacta

SEQ ID NO: 588414 - DNA, 20 bp, Artificial Sequence
  chemically synthesized
ttcgttaagatgtattaaaa

SEQ ID NO: 588415 - DNA, 20 bp, Artificial Sequence
  chemically synthesized
gatattcatcaatgagttgt

SEQ ID NO: 588416 - DNA, 20 bp, Artificial Sequence
  chemically synthesized
cacccatcatccacataata

SEQ ID NO: 588417 - DNA, 20 bp, Artificial Sequence
  chemically synthesized
gtggatgatgggtgggatgc

SEQ ID NO: 588418 - DNA, 20 bp, Artificial Sequence
  chemically synthesized
gcaagagcttggcaaaagaa

SEQ ID NO: 588419 - DNA, 20 bp, Artificial Sequence
  chemically synthesized
cagttgttgatgttaatgtg

SEQ ID NO: 588420 - DNA, 20 bp, Artificial Sequence
  chemically synthesized
tttataaatgggattttgta

SEQ ID NO: 588421 - DNA, 20 bp, Artificial Sequence
  chemically synthesized
aaagcctagagagtttataa

SEQ ID NO: 588422 - DNA, 20 bp, Artificial Sequence
  chemically synthesized
aaatcccatttataaactct

SEQ ID NO: 588423 - DNA, 20 bp, Artificial Sequence
  chemically synthesized
tgctgcagttggaaagccta

SEQ ID NO: 588424 - DNA, 20 bp, Artificial Sequence
  chemically synthesized
tccaactgcagcagcacgca

SEQ ID NO: 588425 - DNA, 20 bp, Artificial Sequence
  chemically synthesized
cattccaagggaaatttaaa

SEQ ID NO: 588426 - DNA, 20 bp, Artificial Sequence
  chemically synthesized
gaatttgacagtaacctttt

SEQ ID NO: 588427 - DNA, 20 bp, Artificial Sequence
  chemically synthesized
tgacagtaacctttttgagg

SEQ ID NO: 588428 - DNA, 20 bp, Artificial Sequence
  chemically synthesized
ggaacttgagccaaagaggt

SEQ ID NO: 588429 - DNA, 20 bp, Artificial Sequence
  chemically synthesized
aagtgatagtgtcacttacc

SEQ ID NO: 588430 - DNA, 20 bp, Artificial Sequence
  chemically synthesized
taagtgacactatcactttt

SEQ ID NO: 588431 - DNA, 20 bp, Artificial Sequence
  chemically synthesized
gtaggaaagacagatctttg

SEQ ID NO: 588432 - DNA, 20 bp, Artificial Sequence
  chemically synthesized
gttttgtaggaaagacagat

SEQ ID NO: 588433 - DNA, 20 bp, Artificial Sequence
  chemically synthesized
cctacaaaacaatcatttat

SEQ ID NO: 588434 - DNA, 20 bp, Artificial Sequence
  chemically synthesized
tttagaaagcaattataaat

SEQ ID NO: 588435 - DNA, 20 bp, Artificial Sequence
  chemically synthesized
agattttagaaagcaattat

SEQ ID NO: 588436 - DNA, 20 bp, Artificial Sequence
  chemically synthesized
tgaatctcagttgtttttca

SEQ ID NO: 588437 - DNA, 20 bp, Artificial Sequence
  chemically synthesized
aaaatcttcttgaaaaacaa

SEQ ID NO: 588438 - DNA, 20 bp, Artificial Sequence
  chemically synthesized
ttcttgaaaaacaactgaga

SEQ ID NO: 588439 - DNA, 20 bp, Artificial Sequence
  chemically synthesized
acttcaacaagctgaatctc

SEQ ID NO: 588440 - DNA, 20 bp, Artificial Sequence
  chemically synthesized
attcacctttaagcaatcat

SEQ ID NO: 588441 - DNA, 20 bp, Artificial Sequence
  chemically synthesized
ttgctttaaaaatcacccat

SEQ ID NO: 588442 - DNA, 20 bp, Artificial Sequence
  chemically synthesized
aagtttgctttaaaaatcac

SEQ ID NO: 588443 - DNA, 20 bp, Artificial Sequence
  chemically synthesized
ggtgatttttaaagcaaact

SEQ ID NO: 588444 - DNA, 20 bp, Artificial Sequence
  chemically synthesized
tctgctattttaaacttgaa

SEQ ID NO: 588445 - DNA, 20 bp, Artificial Sequence
  chemically synthesized
gttttctgctattttaaact

SEQ ID NO: 588446 - DNA, 20 bp, Artificial Sequence
  chemically synthesized
atatatacttgtggctagtt

SEQ ID NO: 588447 - DNA, 20 bp, Artificial Sequence
  chemically synthesized
ataaaaaatttctttactgc

SEQ ID NO: 588448 - DNA, 20 bp, Artificial Sequence
  chemically synthesized
tttaatgttagtgcctttca

SEQ ID NO: 588449 - DNA, 20 bp, Artificial Sequence
  chemically synthesized
tctttagaagaatatttcat

SEQ ID NO: 588450 - DNA, 20 bp, Artificial Sequence
  chemically synthesized
tcatgaaatattcttctaaa

SEQ ID NO: 588451 - DNA, 20 bp, Artificial Sequence
  chemically synthesized
aaaacattttagcagacttt

SEQ ID NO: 588452 - DNA, 20 bp, Artificial Sequence
  chemically synthesized
aaagcttaaaaagtctgcta

SEQ ID NO: 588453 - DNA, 20 bp, Artificial Sequence
  chemically synthesized
acctcttttttctgtctgac

SEQ ID NO: 588454 - DNA, 20 bp, Artificial Sequence
  chemically synthesized
gtttgcagacctcctgccac

SEQ ID NO: 588455 - DNA, 20 bp, Artificial Sequence
  chemically synthesized
gacctcctgccaccgcagat

SEQ ID NO: 588456 - DNA, 20 bp, Artificial Sequence
  chemically synthesized
ttttcctgtagaatactggc

SEQ ID NO: 588457 - DNA, 20 bp, Artificial Sequence
  chemically synthesized
agaatactggcatctgtttt

SEQ ID NO: 588458 - DNA, 20 bp, Artificial Sequence
  chemically synthesized
gttgcattcaatgttctgac

SEQ ID NO: 588459 - DNA, 20 bp, Artificial Sequence
  chemically synthesized
aaaaagacatggggcttcat

SEQ ID NO: 588460 - DNA, 20 bp, Artificial Sequence
  chemically synthesized
ttttctcaaataaaaagaca

SEQ ID NO: 588461 - DNA, 20 bp, Artificial Sequence
  chemically synthesized
cccatgtctttttatttgag

SEQ ID NO: 588462 - DNA, 20 bp, Artificial Sequence
  chemically synthesized
tacaactgcatgtggtagca

SEQ ID NO: 588463 - DNA, 20 bp, Artificial Sequence
  chemically synthesized
ttcatagggaaattttcaca

SEQ ID NO: 588464 - DNA, 20 bp, Artificial Sequence
  chemically synthesized
tatcctttggatatgggcat

SEQ ID NO: 588465 - DNA, 20 bp, Artificial Sequence
  chemically synthesized
aaaactggagctaaccgaga

SEQ ID NO: 588466 - DNA, 20 bp, Artificial Sequence
  chemically synthesized
aaagcaccctctcggttagc

SEQ ID NO: 588467 - DNA, 20 bp, Artificial Sequence
  chemically synthesized
tagctccagtttttattttt

SEQ ID NO: 588468 - DNA, 20 bp, Artificial Sequence
  chemically synthesized
attataacatcctctagctg

SEQ ID NO: 588469 - DNA, 20 bp, Artificial Sequence
  chemically synthesized
tcttgaaaaggtttccaact

SEQ ID NO: 588470 - DNA, 20 bp, Artificial Sequence
  chemically synthesized
gaaatcgaatttgctcttga

SEQ ID NO: 588471 - DNA, 20 bp, Artificial Sequence
  chemically synthesized
ggaaaccttttcaagagcaa

SEQ ID NO: 588472 - DNA, 20 bp, Artificial Sequence
  chemically synthesized
cttgtccccacaaggatgtt

SEQ ID NO: 588473 - DNA, 20 bp, Artificial Sequence
  chemically synthesized
aagaaacccaaatactttgt

SEQ ID NO: 588474 - DNA, 20 bp, Artificial Sequence
  chemically synthesized
tttaaacatgaacaaagtat

SEQ ID NO: 588475 - DNA, 20 bp, Artificial Sequence
  chemically synthesized
tttttaatactgtgactaac

SEQ ID NO: 588476 - DNA, 20 bp, Artificial Sequence
  chemically synthesized
taattttatttaaatatctc

SEQ ID NO: 588477 - DNA, 20 bp, Artificial Sequence
  chemically synthesized
gcaattaattctcagttttt

SEQ ID NO: 588478 - DNA, 20 bp, Artificial Sequence
  chemically synthesized
gccacaaaaaactgagaatt

SEQ ID NO: 588479 - DNA, 20 bp, Artificial Sequence
  chemically synthesized
gctcctgaaagcaattaatt

SEQ ID NO: 588480 - DNA, 20 bp, Artificial Sequence
  chemically synthesized
attattttaaaatttattac

SEQ ID NO: 588481 - DNA, 20 bp, Artificial Sequence
  chemically synthesized
cataaaaatgctctggtgac

SEQ ID NO: 588482 - DNA, 20 bp, Artificial Sequence
  chemically synthesized
ctatagtcaccagagcattt

SEQ ID NO: 588483 - DNA, 20 bp, Artificial Sequence
  chemically synthesized
ccagagcatttttatgattg

SEQ ID NO: 588484 - DNA, 20 bp, Artificial Sequence
  chemically synthesized
ttatgattgtcaagcttaaa

SEQ ID NO: 588485 - DNA, 20 bp, Artificial Sequence
  chemically synthesized
aggaaaaaagtaaacaatat

SEQ ID NO: 588486 - DNA, 20 bp, Artificial Sequence
  chemically synthesized
ccaagtacacacaaaaacaa

SEQ ID NO: 588487 - DNA, 20 bp, Artificial Sequence
  chemically synthesized
tatttaatggtaaaaagcat

SEQ ID NO: 588488 - DNA, 20 bp, Artificial Sequence
  chemically synthesized
attttaatggccttacaaat

SEQ ID NO: 588489 - DNA, 20 bp, Artificial Sequence
  chemically synthesized
tgacataaggatttgagtca

SEQ ID NO: 588490 - DNA, 20 bp, Artificial Sequence
  chemically synthesized
acattattctgtcagtgaca

SEQ ID NO: 588491 - DNA, 20 bp, Artificial Sequence
  chemically synthesized
gtagaaaactctcctaatag

SEQ ID NO: 588492 - DNA, 20 bp, Artificial Sequence
  chemically synthesized
atatgaatcacatctattag

SEQ ID NO: 588493 - DNA, 20 bp, Artificial Sequence
  chemically synthesized
agcatgtactggggtctact

SEQ ID NO: 588494 - DNA, 20 bp, Artificial Sequence
  chemically synthesized
agctgacagtagaccccagt

SEQ ID NO: 588495 - DNA, 20 bp, Artificial Sequence
  chemically synthesized
tcctaaatgaaggaaggaat

SEQ ID NO: 588496 - DNA, 20 bp, Artificial Sequence
  chemically synthesized
gaggtaaagctcccttagac

SEQ ID NO: 588497 - DNA, 20 bp, Artificial Sequence
  chemically synthesized
tatgtgaaacgagagtctaa

SEQ ID NO: 588498 - DNA, 20 bp, Artificial Sequence
  chemically synthesized
ctctcgtttcacatacattt

SEQ ID NO: 588499 - DNA, 20 bp, Artificial Sequence
  chemically synthesized
tttccagtattcgaaaataa

SEQ ID NO: 588500 - DNA, 20 bp, Artificial Sequence
  chemically synthesized
gaggcaccgtgtcaccggtt

SEQ ID NO: 588501 - DNA, 20 bp, Artificial Sequence
  chemically synthesized
tcattgtgaggcaccgtgtc

SEQ ID NO: 588502 - DNA, 20 bp, Artificial Sequence
  chemically synthesized
tgaatagttcagtaactgtg

SEQ ID NO: 588503 - DNA, 20 bp, Artificial Sequence
  chemically synthesized
attcaagagagtatggccag

SEQ ID NO: 588504 - DNA, 20 bp, Artificial Sequence
  chemically synthesized
actagttacaaggaaatatc

SEQ ID NO: 588505 - DNA, 20 bp, Artificial Sequence
  chemically synthesized
gtgatatttccttgtaacta

SEQ ID NO: 588506 - DNA, 20 bp, Artificial Sequence
  chemically synthesized
gtaactagttggctttgctc

SEQ ID NO: 588507 - DNA, 20 bp, Artificial Sequence
  chemically synthesized
tcagcgttgcatgtgacagt

SEQ ID NO: 588508 - DNA, 20 bp, Artificial Sequence
  chemically synthesized
gcaccaacctaatatataga

SEQ ID NO: 588509 - DNA, 20 bp, Artificial Sequence
  chemically synthesized
taggttggtgcaaaagtaat

SEQ ID NO: 588510 - DNA, 20 bp, Artificial Sequence
  chemically synthesized
tataaaagtaatggcataaa

SEQ ID NO: 588511 - DNA, 20 bp, Artificial Sequence
  chemically synthesized
agatattgtgtcttattcat

SEQ ID NO: 588512 - DNA, 20 bp, Artificial Sequence
  chemically synthesized
tcttattcatgatagtttcc

SEQ ID NO: 588513 - DNA, 20 bp, Artificial Sequence
  chemically synthesized
agtacaatgtctgatgcatg

SEQ ID NO: 588514 - DNA, 20 bp, Artificial Sequence
  chemically synthesized
gattcatgcgttcactcagc

SEQ ID NO: 588515 - DNA, 20 bp, Artificial Sequence
  chemically synthesized
tcttccccacttcccttatt

SEQ ID NO: 588516 - DNA, 20 bp, Artificial Sequence
  chemically synthesized
attccttcctctcttcctcc

SEQ ID NO: 588517 - DNA, 20 bp, Artificial Sequence
  chemically synthesized
atacccattactgatcctcc

SEQ ID NO: 588518 - DNA, 20 bp, Artificial Sequence
  chemically synthesized
actgcctaagacctagaaaa

SEQ ID NO: 588519 - DNA, 20 bp, Artificial Sequence
  chemically synthesized
aactgtgtcttattttttca

SEQ ID NO: 588520 - DNA, 20 bp, Artificial Sequence
  chemically synthesized
ggcctaccatttgttgatca

SEQ ID NO: 588521 - DNA, 20 bp, Artificial Sequence
  chemically synthesized
accctccatatgcctaagtt

SEQ ID NO: 588522 - DNA, 20 bp, Artificial Sequence
  chemically synthesized
catcatggagattgcacacc

SEQ ID NO: 588523 - DNA, 20 bp, Artificial Sequence
  chemically synthesized
ttatgctcttggtcacatca

SEQ ID NO: 588524 - DNA, 20 bp, Artificial Sequence
  chemically synthesized
tctcatacagtggcatagag

SEQ ID NO: 588525 - DNA, 20 bp, Artificial Sequence
  chemically synthesized
aactattacatgagaatcac

SEQ ID NO: 588526 - DNA, 20 bp, Artificial Sequence
  chemically synthesized
tgcagtttattccaaaacaa

SEQ ID NO: 588527 - DNA, 20 bp, Artificial Sequence
  chemically synthesized
agtcactgatgcttgcacga

SEQ ID NO: 588528 - DNA, 20 bp, Artificial Sequence
  chemically synthesized
tttcccatttcagtagtcac

SEQ ID NO: 588529 - DNA, 20 bp, Artificial Sequence
  chemically synthesized
tctaaatacctccctgacat

SEQ ID NO: 588530 - DNA, 20 bp, Artificial Sequence
  chemically synthesized
acatcagatgtataccatag

SEQ ID NO: 588531 - DNA, 20 bp, Artificial Sequence
  chemically synthesized
tgcagtttagtaagatctcc

SEQ ID NO: 588532 - DNA, 20 bp, Artificial Sequence
  chemically synthesized
ggacctaatgcagcagaact

SEQ ID NO: 588533 - DNA, 20 bp, Artificial Sequence
  chemically synthesized
cagcagtattggcatttttt

SEQ ID NO: 588534 - DNA, 20 bp, Artificial Sequence
  chemically synthesized
agcagcaataagaattcctt

SEQ ID NO: 588535 - DNA, 20 bp, Artificial Sequence
  chemically synthesized
tataagcagcaataagaatt

SEQ ID NO: 588536 - DNA, 20 bp, Artificial Sequence
  chemically synthesized
agcaatcaaggaattcttat

SEQ ID NO: 588537 - DNA, 20 bp, Artificial Sequence
  chemically synthesized
tgagataaaaatgctgcagc

SEQ ID NO: 588538 - DNA, 20 bp, Artificial Sequence
  chemically synthesized
cagcatttttatctcagcct

SEQ ID NO: 588539 - DNA, 20 bp, Artificial Sequence
  chemically synthesized
ttatctcagcctctttgctt

SEQ ID NO: 588540 - DNA, 20 bp, Artificial Sequence
  chemically synthesized
tgtagttttgatcttggcac

SEQ ID NO: 588541 - DNA, 20 bp, Artificial Sequence
  chemically synthesized
aacctaattgtggaatcagc

SEQ ID NO: 588542 - DNA, 20 bp, Artificial Sequence
  chemically synthesized
aaccgaaataataaaaccat

SEQ ID NO: 588543 - DNA, 20 bp, Artificial Sequence
  chemically synthesized
atcagcaatggttttattat

SEQ ID NO: 588544 - DNA, 20 bp, Artificial Sequence
  chemically synthesized
tagatctaacaattttaaat

SEQ ID NO: 588545 - DNA, 20 bp, Artificial Sequence
  chemically synthesized
tgatttgcgattctatacaa

SEQ ID NO: 588546 - DNA, 20 bp, Artificial Sequence
  chemically synthesized
atttgtatagaatcgcaaat

SEQ ID NO: 588547 - DNA, 20 bp, Artificial Sequence
  chemically synthesized
aaaaacctgaaagccctgat

SEQ ID NO: 588548 - DNA, 20 bp, Artificial Sequence
  chemically synthesized
agaatcgcaaatcagggctt

SEQ ID NO: 588549 - DNA, 20 bp, Artificial Sequence
  chemically synthesized
aaattaaaaaaacctgaaag

SEQ ID NO: 588550 - DNA, 20 bp, Artificial Sequence
  chemically synthesized
agtctactgcatttgtatga

SEQ ID NO: 588551 - DNA, 20 bp, Artificial Sequence
  chemically synthesized
cagtgcatggcctgctcaag

SEQ ID NO: 588552 - DNA, 20 bp, Artificial Sequence
  chemically synthesized
tgatcccttatttttctttc

SEQ ID NO: 588553 - DNA, 20 bp, Artificial Sequence
  chemically synthesized
aagggatcaaaacagaaagt

SEQ ID NO: 588554 - DNA, 20 bp, Artificial Sequence
  chemically synthesized
accacatacaagctactact

SEQ ID NO: 588555 - DNA, 20 bp, Artificial Sequence
  chemically synthesized
agaaagtagtagcttgtatg

SEQ ID NO: 588556 - DNA, 20 bp, Artificial Sequence
  chemically synthesized
ctgagctggaaaagataaca

SEQ ID NO: 588557 - DNA, 20 bp, Artificial Sequence
  chemically synthesized
cactgtgtgaataaagttga

SEQ ID NO: 588558 - DNA, 20 bp, Artificial Sequence
  chemically synthesized
gttgttcactgtgtgaataa

SEQ ID NO: 588559 - DNA, 20 bp, Artificial Sequence
  chemically synthesized
acattaattaattttaattc

SEQ ID NO: 588560 - DNA, 20 bp, Artificial Sequence
  chemically synthesized
attcattaccaataaaattt

SEQ ID NO: 588561 - DNA, 20 bp, Artificial Sequence
  chemically synthesized
gcagtacattaatatgatat

SEQ ID NO: 588562 - DNA, 20 bp, Artificial Sequence
  chemically synthesized
gaataatccaacagatttaa

SEQ ID NO: 588563 - DNA, 20 bp, Artificial Sequence
  chemically synthesized
agaaaatcataattaaatct

SEQ ID NO: 588564 - DNA, 20 bp, Artificial Sequence
  chemically synthesized
ctaactatgatgaataatcc

SEQ ID NO: 588565 - DNA, 20 bp, Artificial Sequence
  chemically synthesized
tggattattcatcatagtta

SEQ ID NO: 588566 - DNA, 20 bp, Artificial Sequence
  chemically synthesized
catcatagttagaaagctta

SEQ ID NO: 588567 - DNA, 20 bp, Artificial Sequence
  chemically synthesized
tagttagaaagcttattgtg

SEQ ID NO: 588568 - DNA, 20 bp, Artificial Sequence
  chemically synthesized
aatattggaatcaaaacaca

SEQ ID NO: 588569 - DNA, 20 bp, Artificial Sequence
  chemically synthesized
atgcacttcttattaagaat

SEQ ID NO: 588570 - DNA, 20 bp, Artificial Sequence
  chemically synthesized
gtgcatatctaactcccgtg

SEQ ID NO: 588571 - DNA, 20 bp, Artificial Sequence
  chemically synthesized
agtagacttagaatggaatt

SEQ ID NO: 588572 - DNA, 20 bp, Artificial Sequence
  chemically synthesized
tatacctttgtccccagaaa

SEQ ID NO: 588573 - DNA, 20 bp, Artificial Sequence
  chemically synthesized
cctgcttcccaactctctgc

SEQ ID NO: 588574 - DNA, 20 bp, Artificial Sequence
  chemically synthesized
atagtaattctacatgtcct

SEQ ID NO: 588575 - DNA, 20 bp, Artificial Sequence
  chemically synthesized
tatattattttcaacttctc

SEQ ID NO: 588576 - DNA, 20 bp, Artificial Sequence
  chemically synthesized
gttattttctataatttagg

SEQ ID NO: 588577 - DNA, 20 bp, Artificial Sequence
  chemically synthesized
tgtagcagttctttctttgc

SEQ ID NO: 588578 - DNA, 20 bp, Artificial Sequence
  chemically synthesized
aatgttttcatagaaaaggt

SEQ ID NO: 588579 - DNA, 20 bp, Artificial Sequence
  chemically synthesized
gacttttaaaaaaatgtacg

SEQ ID NO: 588580 - DNA, 20 bp, Artificial Sequence
  chemically synthesized
tgtgttttcatgcagttttg

SEQ ID NO: 588581 - DNA, 20 bp, Artificial Sequence
  chemically synthesized
tttcatctattgtgttttca

SEQ ID NO: 588582 - DNA, 20 bp, Artificial Sequence
  chemically synthesized
cacattctatttttcatcta

SEQ ID NO: 588583 - DNA, 20 bp, Artificial Sequence
  chemically synthesized
acaatttcttataactgctt

SEQ ID NO: 588584 - DNA, 20 bp, Artificial Sequence
  chemically synthesized
gtcattgtacaatttcttat

SEQ ID NO: 588585 - DNA, 20 bp, Artificial Sequence
  chemically synthesized
gttataagaaattgtacaat

SEQ ID NO: 588586 - DNA, 20 bp, Artificial Sequence
  chemically synthesized
tttttatcttgctccctagt

SEQ ID NO: 588587 - DNA, 20 bp, Artificial Sequence
  chemically synthesized
tctgtttttttatcttgctc

SEQ ID NO: 588588 - DNA, 20 bp, Artificial Sequence
  chemically synthesized
ttccagttgcattttatctc

SEQ ID NO: 588589 - DNA, 20 bp, Artificial Sequence
  chemically synthesized
tgaaacatctccttgttcaa

SEQ ID NO: 588590 - DNA, 20 bp, Artificial Sequence
  chemically synthesized
ggaaacttcattgaacaagg

SEQ ID NO: 588591 - DNA, 20 bp, Artificial Sequence
  chemically synthesized
gatgtttcaagaatccaata

SEQ ID NO: 588592 - DNA, 20 bp, Artificial Sequence
  chemically synthesized
aattacaagtaaatctcagt

SEQ ID NO: 588593 - DNA, 20 bp, Artificial Sequence
  chemically synthesized
tgagacaggtaaatcattaa

SEQ ID NO: 588594 - DNA, 20 bp, Artificial Sequence
  chemically synthesized
gaccaatcagtaaactcggt

SEQ ID NO: 588595 - DNA, 20 bp, Artificial Sequence
  chemically synthesized
ggtaaatcattaaccgagtt

SEQ ID NO: 588596 - DNA, 20 bp, Artificial Sequence
  chemically synthesized
taggaaattgcaccataaaa

SEQ ID NO: 588597 - DNA, 20 bp, Artificial Sequence
  chemically synthesized
ggtgcaatttcctacaaata

SEQ ID NO: 588598 - DNA, 20 bp, Artificial Sequence
  chemically synthesized
cctacaaatatggtgcttta

SEQ ID NO: 588599 - DNA, 20 bp, Artificial Sequence
  chemically synthesized
ttcgtcagtgccaagaattc

SEQ ID NO: 588600 - DNA, 20 bp, Artificial Sequence
  chemically synthesized
aagaattcaggagtttgata

SEQ ID NO: 588601 - DNA, 20 bp, Artificial Sequence
  chemically synthesized
ataattagcatgactggtta

SEQ ID NO: 588602 - DNA, 20 bp, Artificial Sequence
  chemically synthesized
ttattagaaaatatagccaa

SEQ ID NO: 588603 - DNA, 20 bp, Artificial Sequence
  chemically synthesized
aatatagccaatactgtttt

SEQ ID NO: 588604 - DNA, 20 bp, Artificial Sequence
  chemically synthesized
tactgttttcagagatttta

SEQ ID NO: 588605 - DNA, 20 bp, Artificial Sequence
  chemically synthesized
agagattttaatgtgcttca

SEQ ID NO: 588606 - DNA, 20 bp, Artificial Sequence
  chemically synthesized
tctttcaacttctatcggat

SEQ ID NO: 588607 - DNA, 20 bp, Artificial Sequence
  chemically synthesized
cttgagtatttgtgcattta

SEQ ID NO: 588608 - DNA, 20 bp, Artificial Sequence
  chemically synthesized
aagttgaatgggtcctggtg

SEQ ID NO: 588609 - DNA, 20 bp, Artificial Sequence
  chemically synthesized
acttagcctgtccatagact

SEQ ID NO: 588610 - DNA, 20 bp, Artificial Sequence
  chemically synthesized
ttctctccattttcctaact

SEQ ID NO: 588611 - DNA, 20 bp, Artificial Sequence
  chemically synthesized
actgttttcttatccttcct

SEQ ID NO: 588612 - DNA, 20 bp, Artificial Sequence
  chemically synthesized
catttatttcagccattttt

SEQ ID NO: 588613 - DNA, 20 bp, Artificial Sequence
  chemically synthesized
tcattctgagctctccttga

SEQ ID NO: 588614 - DNA, 20 bp, Artificial Sequence
  chemically synthesized
atcttatacttcatatatgg

SEQ ID NO: 588615 - DNA, 20 bp, Artificial Sequence
  chemically synthesized
ccatgctccctgttgtacta

SEQ ID NO: 588616 - DNA, 20 bp, Artificial Sequence
  chemically synthesized
gccttctcggctccgtctcc

SEQ ID NO: 588617 - DNA, 20 bp, Artificial Sequence
  chemically synthesized
gccgcttctcctcctcactt

SEQ ID NO: 588618 - DNA, 20 bp, Artificial Sequence
  chemically synthesized
agttttactgggcattggag

SEQ ID NO: 588619 - DNA, 20 bp, Artificial Sequence
  chemically synthesized
gtcaaggaagtagaaagtta

SEQ ID NO: 588620 - DNA, 20 bp, Artificial Sequence
  chemically synthesized
cctttgtataggtatttata

SEQ ID NO: 588621 - DNA, 20 bp, Artificial Sequence
  chemically synthesized
tttccatttgtgtcattctc

SEQ ID NO: 588622 - DNA, 20 bp, Artificial Sequence
  chemically synthesized
aatattaagcatgaccgaat

SEQ ID NO: 588623 - DNA, 20 bp, Artificial Sequence
  chemically synthesized
agaagaaagccctcattcgg

SEQ ID NO: 588624 - DNA, 20 bp, Artificial Sequence
  chemically synthesized
tctctaaatttgaacggcac

SEQ ID NO: 588625 - DNA, 20 bp, Artificial Sequence
  chemically synthesized
ctaccattgtttcacaacta

SEQ ID NO: 588626 - DNA, 20 bp, Artificial Sequence
  chemically synthesized
ccatctagttgtgaaacaat

SEQ ID NO: 588627 - DNA, 20 bp, Artificial Sequence
  chemically synthesized
attttctttatccaatctac

SEQ ID NO: 588628 - DNA, 20 bp, Artificial Sequence
  chemically synthesized
catccgtgcttccgcaaagg

SEQ ID NO: 588629 - DNA, 20 bp, Artificial Sequence
  chemically synthesized
attatggcctccaactgcat

SEQ ID NO: 588630 - DNA, 20 bp, Artificial Sequence
  chemically synthesized
ctgttcctgcgttaatttgc

SEQ ID NO: 588631 - DNA, 20 bp, Artificial Sequence
  chemically synthesized
tttttcctgttcctgcgtta

SEQ ID NO: 588632 - DNA, 20 bp, Artificial Sequence
  chemically synthesized
tataagtgagaacatatagt

SEQ ID NO: 588633 - DNA, 20 bp, Artificial Sequence
  chemically synthesized
cacttataagtgagaacata

SEQ ID NO: 588634 - DNA, 20 bp, Artificial Sequence
  chemically synthesized
tatttacgtccatatatgct

SEQ ID NO: 588635 - DNA, 20 bp, Artificial Sequence
  chemically synthesized
agcatagtacctacctgatg

SEQ ID NO: 588636 - DNA, 20 bp, Artificial Sequence
  chemically synthesized
catcaggtaggtactatgct

SEQ ID NO: 588637 - DNA, 20 bp, Artificial Sequence
  chemically synthesized
aggggaatagcgcatgatgc

SEQ ID NO: 588638 - DNA, 20 bp, Artificial Sequence
  chemically synthesized
tatatacagagggtacatgt

SEQ ID NO: 588639 - DNA, 20 bp, Artificial Sequence
  chemically synthesized
ccctctgtatataaaataaa

SEQ ID NO: 588640 - DNA, 20 bp, Artificial Sequence
  chemically synthesized
ttgtattagtaaggtacaat

SEQ ID NO: 588641 - DNA, 20 bp, Artificial Sequence
  chemically synthesized
caaatgaacacacacatttg

SEQ ID NO: 588642 - DNA, 20 bp, Artificial Sequence
  chemically synthesized
tagagtcaggagcaggcctt

SEQ ID NO: 588643 - DNA, 20 bp, Artificial Sequence
  chemically synthesized
tccttctaaaactagaaata

SEQ ID NO: 588644 - DNA, 20 bp, Artificial Sequence
  chemically synthesized
tggaaaataaacagtctatt

SEQ ID NO: 588645 - DNA, 20 bp, Artificial Sequence
  chemically synthesized
cttcagttcattggcaggat

SEQ ID NO: 588646 - DNA, 20 bp, Artificial Sequence
  chemically synthesized
tttccttcagttcattggca

SEQ ID NO: 588647 - DNA, 20 bp, Artificial Sequence
  chemically synthesized
atatcaattatatatatata

SEQ ID NO: 588648 - DNA, 20 bp, Artificial Sequence
  chemically synthesized
accaaaattaattcatcata

SEQ ID NO: 588649 - DNA, 20 bp, Artificial Sequence
  chemically synthesized
cataaagagctttaagtact

SEQ ID NO: 588650 - DNA, 20 bp, Artificial Sequence
  chemically synthesized
tgttttgtaagggtatcttg

SEQ ID NO: 588651 - DNA, 20 bp, Artificial Sequence
  chemically synthesized
tctgcttgaaattgaggagc

SEQ ID NO: 588652 - DNA, 20 bp, Artificial Sequence
  chemically synthesized
acgtgctcctcaatttcaag

SEQ ID NO: 588653 - DNA, 20 bp, Artificial Sequence
  chemically synthesized
taggtaacactgtattgaat

SEQ ID NO: 588654 - DNA, 20 bp, Artificial Sequence
  chemically synthesized
gtgaggaaaatataaatatg

SEQ ID NO: 588655 - DNA, 20 bp, Artificial Sequence
  chemically synthesized
accagatttaaaatgtagcc

SEQ ID NO: 588656 - DNA, 20 bp, Artificial Sequence
  chemically synthesized
cattttaaatctggtcccag

SEQ ID NO: 588657 - DNA, 20 bp, Artificial Sequence
  chemically synthesized
aacgccaaaacatgtctggg

SEQ ID NO: 588658 - DNA, 20 bp, Artificial Sequence
  chemically synthesized
gacatgttttggcgttagaa

SEQ ID NO: 588659 - DNA, 20 bp, Artificial Sequence
  chemically synthesized
tgttttggcgttagaacttt

SEQ ID NO: 588660 - DNA, 20 bp, Artificial Sequence
  chemically synthesized
gcgttagaactttgtttgat

SEQ ID NO: 588661 - DNA, 20 bp, Artificial Sequence
  chemically synthesized
aatgcctttacagaatgatt

SEQ ID NO: 588662 - DNA, 20 bp, Artificial Sequence
  chemically synthesized
ccaattcaaatgcctttaca

SEQ ID NO: 588663 - DNA, 20 bp, Artificial Sequence
  chemically synthesized
aaggcatttgaattggtggc

SEQ ID NO: 588664 - DNA, 20 bp, Artificial Sequence
  chemically synthesized
tctgttctgtactttgtaac

SEQ ID NO: 588665 - DNA, 20 bp, Artificial Sequence
  chemically synthesized
aacagaactttgcaaagcga

SEQ ID NO: 588666 - DNA, 20 bp, Artificial Sequence
  chemically synthesized
actttgcaaagcgaataggt

SEQ ID NO: 588667 - DNA, 20 bp, Artificial Sequence
  chemically synthesized
attttagcaaactaaaacct

SEQ ID NO: 588668 - DNA, 20 bp, Artificial Sequence
  chemically synthesized
atgttagctctctctacgtt

SEQ ID NO: 588669 - DNA, 20 bp, Artificial Sequence
  chemically synthesized
atgaatgagttagaaggcga

SEQ ID NO: 588670 - DNA, 20 bp, Artificial Sequence
  chemically synthesized
aaatagaaaacatttaaggg

SEQ ID NO: 588671 - DNA, 20 bp, Artificial Sequence
  chemically synthesized
gagagaaaaacacagccctt

SEQ ID NO: 588672 - DNA, 20 bp, Artificial Sequence
  chemically synthesized
tgtgtttttctctccattta

SEQ ID NO: 588673 - DNA, 20 bp, Artificial Sequence
  chemically synthesized
tttttatcagggaaaggcca

SEQ ID NO: 588674 - DNA, 20 bp, Artificial Sequence
  chemically synthesized
ggcatcttgtccacagctgt

SEQ ID NO: 588675 - DNA, 20 bp, Artificial Sequence
  chemically synthesized
tcaggcataaaattctttct

SEQ ID NO: 588676 - DNA, 20 bp, Artificial Sequence
  chemically synthesized
agcatgcctctgaacacatt

SEQ ID NO: 588677 - DNA, 20 bp, Artificial Sequence
  chemically synthesized
tcgaatatcacgtcctgaga

SEQ ID NO: 588678 - DNA, 20 bp, Artificial Sequence
  chemically synthesized
attagaaattttaaaatgac

SEQ ID NO: 588679 - DNA, 20 bp, Artificial Sequence
  chemically synthesized
gtatcaccctctacccgcca

SEQ ID NO: 588680 - DNA, 20 bp, Artificial Sequence
  chemically synthesized
catatagaaaaagccaacaa

SEQ ID NO: 588681 - DNA, 20 bp, Artificial Sequence
  chemically synthesized
tatttttgaaaaacaatttt

SEQ ID NO: 588682 - DNA, 20 bp, Artificial Sequence
  chemically synthesized
ataagacaatgtgcaagtca

SEQ ID NO: 588683 - DNA, 20 bp, Artificial Sequence
  chemically synthesized
caaataccagtagagaacta

SEQ ID NO: 588684 - DNA, 20 bp, Artificial Sequence
  chemically synthesized
ttttcactctgtaagtcaat

SEQ ID NO: 588685 - DNA, 20 bp, Artificial Sequence
  chemically synthesized
tcattctctgctggaggatg

SEQ ID NO: 588686 - DNA, 20 bp, Artificial Sequence
  chemically synthesized
actttaactaccatgatatc

SEQ ID NO: 588687 - DNA, 20 bp, Artificial Sequence
  chemically synthesized
tagttaaagtgaggaaagat

SEQ ID NO: 588688 - DNA, 20 bp, Artificial Sequence
  chemically synthesized
aaagtgaggaaagatggtcg

SEQ ID NO: 588689 - DNA, 20 bp, Artificial Sequence
  chemically synthesized
ccagaccagtatcttcaact

SEQ ID NO: 588690 - DNA, 20 bp, Artificial Sequence
  chemically synthesized
ctatgtctaaaatttatgat

SEQ ID NO: 588691 - DNA, 20 bp, Artificial Sequence
  chemically synthesized
tgatgtgagttttgctccaa

SEQ ID NO: 588692 - DNA, 20 bp, Artificial Sequence
  chemically synthesized
tgagtcccttatttttattg

SEQ ID NO: 588693 - DNA, 20 bp, Artificial Sequence
  chemically synthesized
ctagctttgagtttgcccag

SEQ ID NO: 588694 - DNA, 20 bp, Artificial Sequence
  chemically synthesized
ttggattatgattgctagct

SEQ ID NO: 588695 - DNA, 20 bp, Artificial Sequence
  chemically synthesized
aatatgtttggattatgatt

SEQ ID NO: 588696 - DNA, 20 bp, Artificial Sequence
  chemically synthesized
attcccaaaatatgtttgga

SEQ ID NO: 588697 - DNA, 20 bp, Artificial Sequence
  chemically synthesized
tcagggattcccaaaatatg

SEQ ID NO: 588698 - DNA, 20 bp, Artificial Sequence
  chemically synthesized
gatactcagggattcccaaa

SEQ ID NO: 588699 - DNA, 20 bp, Artificial Sequence
  chemically synthesized
ttagtcatcatgcagatact

SEQ ID NO: 588700 - DNA, 20 bp, Artificial Sequence
  chemically synthesized
attattttcatttgctggca

SEQ ID NO: 588701 - DNA, 20 bp, Artificial Sequence
  chemically synthesized
atgtagaaaattgagaggcc

SEQ ID NO: 588702 - DNA, 20 bp, Artificial Sequence
  chemically synthesized
caaatttgaagaaaatagaa

SEQ ID NO: 588703 - DNA, 20 bp, Artificial Sequence
  chemically synthesized
atagaatatcgttttgatga

SEQ ID NO: 588704 - DNA, 20 bp, Artificial Sequence
  chemically synthesized
tatcgttttgatgaagctgc

SEQ ID NO: 588705 - DNA, 20 bp, Artificial Sequence
  chemically synthesized
agttagggtaggaaaacaca

SEQ ID NO: 588706 - DNA, 20 bp, Artificial Sequence
  chemically synthesized
tagttaaaaaaaatggtcaa

SEQ ID NO: 588707 - DNA, 20 bp, Artificial Sequence
  chemically synthesized
tggtcaaaggtgatttcaaa

SEQ ID NO: 588708 - DNA, 20 bp, Artificial Sequence
  chemically synthesized
aaatatgttttgagaaagtg

SEQ ID NO: 588709 - DNA, 20 bp, Artificial Sequence
  chemically synthesized
tgtgctttaagagaacagaa

SEQ ID NO: 588710 - DNA, 20 bp, Artificial Sequence
  chemically synthesized
gaatagaagtgtattaagga

SEQ ID NO: 588711 - DNA, 20 bp, Artificial Sequence
  chemically synthesized
tagggtaactactaggtgtc

SEQ ID NO: 588712 - DNA, 20 bp, Artificial Sequence
  chemically synthesized
ctcaagttttacaatgataa

SEQ ID NO: 588713 - DNA, 20 bp, Artificial Sequence
  chemically synthesized
gagagtgttgacaagaaaat

SEQ ID NO: 588714 - DNA, 20 bp, Artificial Sequence
  chemically synthesized
gctgtgttacaatataacta

SEQ ID NO: 588715 - DNA, 20 bp, Artificial Sequence
  chemically synthesized
tgttacaatataactatggc

SEQ ID NO: 588716 - DNA, 20 bp, Artificial Sequence
  chemically synthesized
aatagtaattacctcaactt

SEQ ID NO: 588717 - DNA, 20 bp, Artificial Sequence
  chemically synthesized
aagtacagcgctgagcactg

SEQ ID NO: 588718 - DNA, 20 bp, Artificial Sequence
  chemically synthesized
tgagcactgctcagcttaat

SEQ ID NO: 588719 - DNA, 20 bp, Artificial Sequence
  chemically synthesized
aagaagattataatatcttg

SEQ ID NO: 588720 - DNA, 20 bp, Artificial Sequence
  chemically synthesized
caatcaagaagattataata

SEQ ID NO: 588721 - DNA, 20 bp, Artificial Sequence
  chemically synthesized
taagcaagatattataatct

SEQ ID NO: 588722 - DNA, 20 bp, Artificial Sequence
  chemically synthesized
caagatattataatcttctt

SEQ ID NO: 588723 - DNA, 20 bp, Artificial Sequence
  chemically synthesized
ccagaatgagaaagcaatca

SEQ ID NO: 588724 - DNA, 20 bp, Artificial Sequence
  chemically synthesized
aaagagacatttaaaaataa

SEQ ID NO: 588725 - DNA, 20 bp, Artificial Sequence
  chemically synthesized
aaaaataattgtgtttttat

SEQ ID NO: 588726 - DNA, 20 bp, Artificial Sequence
  chemically synthesized
aacaagttattaaggaaagc

SEQ ID NO: 588727 - DNA, 20 bp, Artificial Sequence
  chemically synthesized
ttctcaagagcctgagaaac

SEQ ID NO: 588728 - DNA, 20 bp, Artificial Sequence
  chemically synthesized
aattgatgttagacacagag

SEQ ID NO: 588729 - DNA, 20 bp, Artificial Sequence
  chemically synthesized
ctctgtgtctaacatcaatt

SEQ ID NO: 588730 - DNA, 20 bp, Artificial Sequence
  chemically synthesized
caattaattgattttgagca

SEQ ID NO: 588731 - DNA, 20 bp, Artificial Sequence
  chemically synthesized
aattgattttgagcatttag

SEQ ID NO: 588732 - DNA, 20 bp, Artificial Sequence
  chemically synthesized
atgcccaacatgtgcttaga

SEQ ID NO: 588733 - DNA, 20 bp, Artificial Sequence
  chemically synthesized
aaggcttagtgatgcccaac

SEQ ID NO: 588734 - DNA, 20 bp, Artificial Sequence
  chemically synthesized
aacttggcaagagggacata

SEQ ID NO: 588735 - DNA, 20 bp, Artificial Sequence
  chemically synthesized
gggaaaaataaaagagtaat

SEQ ID NO: 588736 - DNA, 20 bp, Artificial Sequence
  chemically synthesized
agaaacctaacctcagaact

SEQ ID NO: 588737 - DNA, 20 bp, Artificial Sequence
  chemically synthesized
ccaagccttaagttctgagg

SEQ ID NO: 588738 - DNA, 20 bp, Artificial Sequence
  chemically synthesized
ttaagttctgaggttaggtt

SEQ ID NO: 588739 - DNA, 20 bp, Artificial Sequence
  chemically synthesized
ccagtcaacaagagaggcac

SEQ ID NO: 588740 - DNA, 20 bp, Artificial Sequence
  chemically synthesized
gcattctttttttttttttt

SEQ ID NO: 588741 - DNA, 20 bp, Artificial Sequence
  chemically synthesized
aaaaaaaaagaatgcacaag

SEQ ID NO: 588742 - DNA, 20 bp, Artificial Sequence
  chemically synthesized
actgataatggggagtgaat

SEQ ID NO: 588743 - DNA, 20 bp, Artificial Sequence
  chemically synthesized
ctgctttatccttaggttcc

SEQ ID NO: 588744 - DNA, 20 bp, Artificial Sequence
  chemically synthesized
atgacttgcttatgtcattt

SEQ ID NO: 588745 - DNA, 20 bp, Artificial Sequence
  chemically synthesized
atgacataagcaagtcatct

SEQ ID NO: 588746 - DNA, 20 bp, Artificial Sequence
  chemically synthesized
tgagaaaaatctaacagatg

SEQ ID NO: 588747 - DNA, 20 bp, Artificial Sequence
  chemically synthesized
gtaaaagagtggtgaaaact

SEQ ID NO: 588748 - DNA, 20 bp, Artificial Sequence
  chemically synthesized
attgataagaaagtaaaacc

SEQ ID NO: 588749 - DNA, 20 bp, Artificial Sequence
  chemically synthesized
aggttttactttcttatcaa

SEQ ID NO: 588750 - DNA, 20 bp, Artificial Sequence
  chemically synthesized
caatttagcttgtatgaagg

SEQ ID NO: 588751 - DNA, 20 bp, Artificial Sequence
  chemically synthesized
cctagagagaaaaaaattag

SEQ ID NO: 588752 - DNA, 20 bp, Artificial Sequence
  chemically synthesized
tctaatttttttctctctag

SEQ ID NO: 588753 - DNA, 20 bp, Artificial Sequence
  chemically synthesized
tggcttgaaaatatttcctt

SEQ ID NO: 588754 - DNA, 20 bp, Artificial Sequence
  chemically synthesized
gttttaggagtgaagtggat

SEQ ID NO: 588755 - DNA, 20 bp, Artificial Sequence
  chemically synthesized
acatccacttcactcctaaa

SEQ ID NO: 588756 - DNA, 20 bp, Artificial Sequence
  chemically synthesized
taatgtaatgaatataagaa

SEQ ID NO: 588757 - DNA, 20 bp, Artificial Sequence
  chemically synthesized
tatggataccagcagttcaa

SEQ ID NO: 588758 - DNA, 20 bp, Artificial Sequence
  chemically synthesized
ttaggatcagtaaaatagaa

SEQ ID NO: 588759 - DNA, 20 bp, Artificial Sequence
  chemically synthesized
aattgttatacttcttgccc

SEQ ID NO: 588760 - DNA, 20 bp, Artificial Sequence
  chemically synthesized
tgcccggttgattccatcgt

SEQ ID NO: 588761 - DNA, 20 bp, Artificial Sequence
  chemically synthesized
tgttattaatacaccctcct

SEQ ID NO: 588762 - DNA, 20 bp, Artificial Sequence
  chemically synthesized
ataacattctacacaatctt

SEQ ID NO: 588763 - DNA, 20 bp, Artificial Sequence
  chemically synthesized
gcatctggaggattaatctg

SEQ ID NO: 588764 - DNA, 20 bp, Artificial Sequence
  chemically synthesized
accagaagaactatgcatct

SEQ ID NO: 588765 - DNA, 20 bp, Artificial Sequence
  chemically synthesized
tccagatgcatagttcttct

SEQ ID NO: 588766 - DNA, 20 bp, Artificial Sequence
  chemically synthesized
ctgaatgttatgtacgctat

SEQ ID NO: 588767 - DNA, 20 bp, Artificial Sequence
  chemically synthesized
catccctgagagataccttt

SEQ ID NO: 588768 - DNA, 20 bp, Artificial Sequence
  chemically synthesized
atgactttccaattcttcat

SEQ ID NO: 588769 - DNA, 20 bp, Artificial Sequence
  chemically synthesized
tggtctagtcaactggaatg

SEQ ID NO: 588770 - DNA, 20 bp, Artificial Sequence
  chemically synthesized
ttactaggcactagagtgag

SEQ ID NO: 588771 - DNA, 20 bp, Artificial Sequence
  chemically synthesized
gctacctggcagtgctcaaa

SEQ ID NO: 588772 - DNA, 20 bp, Artificial Sequence
  chemically synthesized
cacctttatccatttaacaa

SEQ ID NO: 588773 - DNA, 20 bp, Artificial Sequence
  chemically synthesized
caatttataggatagataac

SEQ ID NO: 588774 - DNA, 20 bp, Artificial Sequence
  chemically synthesized
gattttataggatagataac

SEQ ID NO: 588775 - DNA, 20 bp, Artificial Sequence
  chemically synthesized
gtagatacagttcaagtaca

SEQ ID NO: 588776 - DNA, 20 bp, Artificial Sequence
  chemically synthesized
tacttgaactgtatctacat

SEQ ID NO: 588777 - DNA, 20 bp, Artificial Sequence
  chemically synthesized
acaaggactcattctgtcat

SEQ ID NO: 588778 - DNA, 20 bp, Artificial Sequence
  chemically synthesized
gggttggagactacagtgag

SEQ ID NO: 588779 - DNA, 20 bp, Artificial Sequence
  chemically synthesized
ttggaaggctaaggtgggag

SEQ ID NO: 588780 - DNA, 20 bp, Artificial Sequence
  chemically synthesized
cactttggaaggctaaggtg

SEQ ID NO: 588781 - DNA, 20 bp, Artificial Sequence
  chemically synthesized
gcccagcctaaatttcatta

SEQ ID NO: 588782 - DNA, 20 bp, Artificial Sequence
  chemically synthesized
tcattattttgattgaaaat

SEQ ID NO: 588783 - DNA, 20 bp, Artificial Sequence
  chemically synthesized
ctaaatggctaaatgagtga

SEQ ID NO: 588784 - DNA, 20 bp, Artificial Sequence
  chemically synthesized
ttcaacgtgcataaaaattc

SEQ ID NO: 588785 - DNA, 20 bp, Artificial Sequence
  chemically synthesized
taccaaatgtgctatgctct

SEQ ID NO: 588786 - DNA, 20 bp, Artificial Sequence
  chemically synthesized
catagcacatttggtaaaaa

SEQ ID NO: 588787 - DNA, 20 bp, Artificial Sequence
  chemically synthesized
agtacagaaatagaatttaa

SEQ ID NO: 588788 - DNA, 20 bp, Artificial Sequence
  chemically synthesized
gaacatttgaattgtctttg

SEQ ID NO: 588789 - DNA, 20 bp, Artificial Sequence
  chemically synthesized
gtggtggggttgccaaggaa

SEQ ID NO: 588790 - DNA, 20 bp, Artificial Sequence
  chemically synthesized
tgctgcctgagcagcagggc

SEQ ID NO: 588791 - DNA, 20 bp, Artificial Sequence
  chemically synthesized
gaatgacagacattttcctg

SEQ ID NO: 588792 - DNA, 20 bp, Artificial Sequence
  chemically synthesized
actgggaatgacagacattt

SEQ ID NO: 588793 - DNA, 20 bp, Artificial Sequence
  chemically synthesized
tgtgttgaagattattacct

SEQ ID NO: 588794 - DNA, 20 bp, Artificial Sequence
  chemically synthesized
ttcatatagattatgtgtgt

SEQ ID NO: 588795 - DNA, 20 bp, Artificial Sequence
  chemically synthesized
atggatttattggacattca

SEQ ID NO: 588796 - DNA, 20 bp, Artificial Sequence
  chemically synthesized
tgtccaataaatccatgaaa

SEQ ID NO: 588797 - DNA, 20 bp, Artificial Sequence
  chemically synthesized
agcactattaagcatctttt

SEQ ID NO: 588798 - DNA, 20 bp, Artificial Sequence
  chemically synthesized
tgtggttttaacttatattc

SEQ ID NO: 588799 - DNA, 20 bp, Artificial Sequence
  chemically synthesized
agaatatgtaggtatattgt

SEQ ID NO: 588800 - DNA, 20 bp, Artificial Sequence
  chemically synthesized
atggcacaaccactttagaa

SEQ ID NO: 588801 - DNA, 20 bp, Artificial Sequence
  chemically synthesized
actttagaaaactgtttagg

SEQ ID NO: 588802 - DNA, 20 bp, Artificial Sequence
  chemically synthesized
atattgtcaaacagcaccta

SEQ ID NO: 588803 - DNA, 20 bp, Artificial Sequence
  chemically synthesized
agaagtggaatggctgggtg

SEQ ID NO: 588804 - DNA, 20 bp, Artificial Sequence
  chemically synthesized
tttgtgagcatatgttttca

SEQ ID NO: 588805 - DNA, 20 bp, Artificial Sequence
  chemically synthesized
aatgaaaacatatgctcaca

SEQ ID NO: 588806 - DNA, 20 bp, Artificial Sequence
  chemically synthesized
tgtacaagccatttgtgagc

SEQ ID NO: 588807 - DNA, 20 bp, Artificial Sequence
  chemically synthesized
tgatggacattcaggtggtt

SEQ ID NO: 588808 - DNA, 20 bp, Artificial Sequence
  chemically synthesized
ctccttttgatggacattca

SEQ ID NO: 588809 - DNA, 20 bp, Artificial Sequence
  chemically synthesized
tcagctgttcattcctttat

SEQ ID NO: 588810 - DNA, 20 bp, Artificial Sequence
  chemically synthesized
ttttgatcagcatactactt

SEQ ID NO: 588811 - DNA, 20 bp, Artificial Sequence
  chemically synthesized
tgatcaaaatagtacatttt

SEQ ID NO: 588812 - DNA, 20 bp, Artificial Sequence
  chemically synthesized
tctgatttatatcaccatag

SEQ ID NO: 588813 - DNA, 20 bp, Artificial Sequence
  chemically synthesized
attcttctgatttatatcac

SEQ ID NO: 588814 - DNA, 20 bp, Artificial Sequence
  chemically synthesized
gccccaataggcacctattc

SEQ ID NO: 588815 - DNA, 20 bp, Artificial Sequence
  chemically synthesized
ttgactggaaggtagcatga

SEQ ID NO: 588816 - DNA, 20 bp, Artificial Sequence
  chemically synthesized
taaaaatttccattacctca

SEQ ID NO: 588817 - DNA, 20 bp, Artificial Sequence
  chemically synthesized
gggaccacttcacaaaagtt

SEQ ID NO: 588818 - DNA, 20 bp, Artificial Sequence
  chemically synthesized
tctgccatctaatatatttt

SEQ ID NO: 588819 - DNA, 20 bp, Artificial Sequence
  chemically synthesized
tcaagatactttgtataata

SEQ ID NO: 588820 - DNA, 20 bp, Artificial Sequence
  chemically synthesized
aatattatacaaagtatctt

SEQ ID NO: 588821 - DNA, 20 bp, Artificial Sequence
  chemically synthesized
gacttatttgggagaggagg

SEQ ID NO: 588822 - DNA, 20 bp, Artificial Sequence
  chemically synthesized
cttcctcctctcccaaataa

SEQ ID NO: 588823 - DNA, 20 bp, Artificial Sequence
  chemically synthesized
aggagagcagttaaaaatga

SEQ ID NO: 588824 - DNA, 20 bp, Artificial Sequence
  chemically synthesized
gtacttagatttgctggatg

SEQ ID NO: 588825 - DNA, 20 bp, Artificial Sequence
  chemically synthesized
gaagtaagagagagaaagta

SEQ ID NO: 588826 - DNA, 20 bp, Artificial Sequence
  chemically synthesized
gcaatcagcctatttcagtt

SEQ ID NO: 588827 - DNA, 20 bp, Artificial Sequence
  chemically synthesized
gaaaacaactaactgaaata

SEQ ID NO: 588828 - DNA, 20 bp, Artificial Sequence
  chemically synthesized
aaattctgtctgcaaatgac

SEQ ID NO: 588829 - DNA, 20 bp, Artificial Sequence
  chemically synthesized
acgaagtctgttcctgtata

SEQ ID NO: 588830 - DNA, 20 bp, Artificial Sequence
  chemically synthesized
agatgccacttgactcgtct

SEQ ID NO: 588831 - DNA, 20 bp, Artificial Sequence
  chemically synthesized
acacgtgtgtatgtgggggt

SEQ ID NO: 588832 - DNA, 20 bp, Artificial Sequence
  chemically synthesized
gtatgtgggggtgtatgttt

SEQ ID NO: 588833 - DNA, 20 bp, Artificial Sequence
  chemically synthesized
agattaagaaggaaaaagcg

SEQ ID NO: 588834 - DNA, 20 bp, Artificial Sequence
  chemically synthesized
aattcaagatcgttgaatct

SEQ ID NO: 588835 - DNA, 20 bp, Artificial Sequence
  chemically synthesized
ttttattctaaagagctttt

SEQ ID NO: 588836 - DNA, 20 bp, Artificial Sequence
  chemically synthesized
attgtcaaaattttattcta

SEQ ID NO: 588837 - DNA, 20 bp, Artificial Sequence
  chemically synthesized
tctttgttttatactcactg

SEQ ID NO: 588838 - DNA, 20 bp, Artificial Sequence
  chemically synthesized
gtccatacagtggcacacat

SEQ ID NO: 588839 - DNA, 20 bp, Artificial Sequence
  chemically synthesized
tatggacaacctcaaaggtg

SEQ ID NO: 588840 - DNA, 20 bp, Artificial Sequence
  chemically synthesized
tttgccctcagttctctgtc

SEQ ID NO: 588841 - DNA, 20 bp, Artificial Sequence
  chemically synthesized
ttccaagctcagcttttcct

SEQ ID NO: 588842 - DNA, 20 bp, Artificial Sequence
  chemically synthesized
gtataaacagtgaggaaaag

SEQ ID NO: 588843 - DNA, 20 bp, Artificial Sequence
  chemically synthesized
gagcctcaattcattccaag

SEQ ID NO: 588844 - DNA, 20 bp, Artificial Sequence
  chemically synthesized
gaaccagaaagacgaaggtt

SEQ ID NO: 588845 - DNA, 20 bp, Artificial Sequence
  chemically synthesized
aagcaaaaggagctgcacac

SEQ ID NO: 588846 - DNA, 20 bp, Artificial Sequence
  chemically synthesized
aagcagcagtgtgcagctcc

SEQ ID NO: 588847 - DNA, 20 bp, Artificial Sequence
  chemically synthesized
ttaaaattccctcacctatt

SEQ ID NO: 588848 - DNA, 20 bp, Artificial Sequence
  chemically synthesized
gaatataattggtccagggc

SEQ ID NO: 588849 - DNA, 20 bp, Artificial Sequence
  chemically synthesized
ctgcagatgggcaaatgtca

SEQ ID NO: 588850 - DNA, 20 bp, Artificial Sequence
  chemically synthesized
cgttgtctttgttaacaagt

SEQ ID NO: 588851 - DNA, 20 bp, Artificial Sequence
  chemically synthesized
tccacgttgtctttgttaac

SEQ ID NO: 588852 - DNA, 20 bp, Artificial Sequence
  chemically synthesized
acaacgtggaggcagctaat

SEQ ID NO: 588853 - DNA, 20 bp, Artificial Sequence
  chemically synthesized
cttacaccagacatgtgtgc

SEQ ID NO: 588854 - DNA, 20 bp, Artificial Sequence
  chemically synthesized
attcaattttcatactgcaa

SEQ ID NO: 588855 - DNA, 20 bp, Artificial Sequence
  chemically synthesized
aaaaaaagaagtggttttta

SEQ ID NO: 588856 - DNA, 20 bp, Artificial Sequence
  chemically synthesized
attagctggaaaaaaaaaga

SEQ ID NO: 588857 - DNA, 20 bp, Artificial Sequence
  chemically synthesized
tccagttgcccaccacctga

SEQ ID NO: 588858 - DNA, 20 bp, Artificial Sequence
  chemically synthesized
caagaacagaacaagaggaa

SEQ ID NO: 588859 - DNA, 20 bp, Artificial Sequence
  chemically synthesized
acaggagggagtcttccgaa

SEQ ID NO: 588860 - DNA, 20 bp, Artificial Sequence
  chemically synthesized
aatatccagaaaaatgtcga

SEQ ID NO: 588861 - DNA, 20 bp, Artificial Sequence
  chemically synthesized
tgatttttggaaaatggcat

SEQ ID NO: 588862 - DNA, 20 bp, Artificial Sequence
  chemically synthesized
tcattgtttacatttattct

SEQ ID NO: 588863 - DNA, 20 bp, Artificial Sequence
  chemically synthesized
ggttttcttctatcactttt

SEQ ID NO: 588864 - DNA, 20 bp, Artificial Sequence
  chemically synthesized
gatttttataatgaagagac

SEQ ID NO: 588865 - DNA, 20 bp, Artificial Sequence
  chemically synthesized
gaaaaaaataccttgttttg

SEQ ID NO: 588866 - DNA, 20 bp, Artificial Sequence
  chemically synthesized
aaaaaatccagaaaaaaata

SEQ ID NO: 588867 - DNA, 20 bp, Artificial Sequence
  chemically synthesized
accaaaacaaggtatttttt

SEQ ID NO: 588868 - DNA, 20 bp, Artificial Sequence
  chemically synthesized
tttgcattagtacatattac

SEQ ID NO: 588869 - DNA, 20 bp, Artificial Sequence
  chemically synthesized
gagaaagaataaaatgttat

SEQ ID NO: 588870 - DNA, 20 bp, Artificial Sequence
  chemically synthesized
cagctcctctaatataattt

SEQ ID NO: 588871 - DNA, 20 bp, Artificial Sequence
  chemically synthesized
ttaatggtatttttctacat

SEQ ID NO: 588872 - DNA, 20 bp, Artificial Sequence
  chemically synthesized
gctgttacaagttccataaa

SEQ ID NO: 588873 - DNA, 20 bp, Artificial Sequence
  chemically synthesized
tttataagatatcaagtaaa

SEQ ID NO: 588874 - DNA, 20 bp, Artificial Sequence
  chemically synthesized
tctgtattttgcaaaaggca

SEQ ID NO: 588875 - DNA, 20 bp, Artificial Sequence
  chemically synthesized
acatgctgccttttgcaaaa

SEQ ID NO: 588876 - DNA, 20 bp, Artificial Sequence
  chemically synthesized
cagattactactgaaatcag

SEQ ID NO: 588877 - DNA, 20 bp, Artificial Sequence
  chemically synthesized
gtcttaataattctaagctt

SEQ ID NO: 588878 - DNA, 20 bp, Artificial Sequence
  chemically synthesized
atacgtctgtcttaataatt

SEQ ID NO: 588879 - DNA, 20 bp, Artificial Sequence
  chemically synthesized
gaaaaagaatggtattgaat

SEQ ID NO: 588880 - DNA, 20 bp, Artificial Sequence
  chemically synthesized
ttcaaactataaatgaaata

SEQ ID NO: 588881 - DNA, 20 bp, Artificial Sequence
  chemically synthesized
acaaaactcaatatttcatt

SEQ ID NO: 588882 - DNA, 20 bp, Artificial Sequence
  chemically synthesized
tacatactaccctaatccta

SEQ ID NO: 588883 - DNA, 20 bp, Artificial Sequence
  chemically synthesized
tatacccttcttcaatccac

SEQ ID NO: 588884 - DNA, 20 bp, Artificial Sequence
  chemically synthesized
gaaaattcagttttaagttt

SEQ ID NO: 588885 - DNA, 20 bp, Artificial Sequence
  chemically synthesized
ttaaaggagaaaattcagtt

SEQ ID NO: 588886 - DNA, 20 bp, Artificial Sequence
  chemically synthesized
aaactgcttaaaggagaaaa

SEQ ID NO: 588887 - DNA, 20 bp, Artificial Sequence
  chemically synthesized
aaactgaattttctccttta

SEQ ID NO: 588888 - DNA, 20 bp, Artificial Sequence
  chemically synthesized
tttactaattaaaatatcta

SEQ ID NO: 588889 - DNA, 20 bp, Artificial Sequence
  chemically synthesized
acatagctaaccttatttgt

SEQ ID NO: 588890 - DNA, 20 bp, Artificial Sequence
  chemically synthesized
tgcaatacatagctaacctt

SEQ ID NO: 588891 - DNA, 20 bp, Artificial Sequence
  chemically synthesized
ctgggacatctgcaatacat

SEQ ID NO: 588892 - DNA, 20 bp, Artificial Sequence
  chemically synthesized
tctgtatggtaactgccttt

SEQ ID NO: 588893 - DNA, 20 bp, Artificial Sequence
  chemically synthesized
aggcagttaccatacagaaa

SEQ ID NO: 588894 - DNA, 20 bp, Artificial Sequence
  chemically synthesized
attatcttattgtgataatt

SEQ ID NO: 588895 - DNA, 20 bp, Artificial Sequence
  chemically synthesized
atacttcataaagtgctatc

SEQ ID NO: 588896 - DNA, 20 bp, Artificial Sequence
  chemically synthesized
taaaggtcccaggaccaggc

SEQ ID NO: 588897 - DNA, 20 bp, Artificial Sequence
  chemically synthesized
cagattgttatcacatttca

SEQ ID NO: 588898 - DNA, 20 bp, Artificial Sequence
  chemically synthesized
taatttaaaagtgtacaact

SEQ ID NO: 588899 - DNA, 20 bp, Artificial Sequence
  chemically synthesized
accaaatacttcataattat

SEQ ID NO: 588900 - DNA, 20 bp, Artificial Sequence
  chemically synthesized
agatgtttttggtagaaaaa

SEQ ID NO: 588901 - DNA, 20 bp, Artificial Sequence
  chemically synthesized
atcaaagtgaaagacaaaat

SEQ ID NO: 588902 - DNA, 20 bp, Artificial Sequence
  chemically synthesized
atccacattgtttattcaca

SEQ ID NO: 588903 - DNA, 20 bp, Artificial Sequence
  chemically synthesized
tctcattcttttttgatcca

SEQ ID NO: 588904 - DNA, 20 bp, Artificial Sequence
  chemically synthesized
atgagaaatatcaacccaga

SEQ ID NO: 588905 - DNA, 20 bp, Artificial Sequence
  chemically synthesized
tcaacccagaatatgtttga

SEQ ID NO: 588906 - DNA, 20 bp, Artificial Sequence
  chemically synthesized
gatgctgttgtcctctttaa

SEQ ID NO: 588907 - DNA, 20 bp, Artificial Sequence
  chemically synthesized
ttaaagaggacaacagcatc

SEQ ID NO: 588908 - DNA, 20 bp, Artificial Sequence
  chemically synthesized
gaggacaacagcatccctag

SEQ ID NO: 588909 - DNA, 20 bp, Artificial Sequence
  chemically synthesized
cagcatccctagattagatt

SEQ ID NO: 588910 - DNA, 20 bp, Artificial Sequence
  chemically synthesized
tcagcatgacattctaatat

SEQ ID NO: 588911 - DNA, 20 bp, Artificial Sequence
  chemically synthesized
tatattagaatgtcatgctg

SEQ ID NO: 588912 - DNA, 20 bp, Artificial Sequence
  chemically synthesized
agagttcatcacatctaatt

SEQ ID NO: 588913 - DNA, 20 bp, Artificial Sequence
  chemically synthesized
acaaacaagagaaaagatct

SEQ ID NO: 588914 - DNA, 20 bp, Artificial Sequence
  chemically synthesized
tcaatcaaatagatcttttc

SEQ ID NO: 588915 - DNA, 20 bp, Artificial Sequence
  chemically synthesized
aatgaattacttttgaacat

SEQ ID NO: 588916 - DNA, 20 bp, Artificial Sequence
  chemically synthesized
catgatgaaaaaaacacaaa

SEQ ID NO: 588917 - DNA, 20 bp, Artificial Sequence
  chemically synthesized
gaaataaattaaagccttgt

SEQ ID NO: 588918 - DNA, 20 bp, Artificial Sequence
  chemically synthesized
gcatgtgaaataaattaaag

SEQ ID NO: 588919 - DNA, 20 bp, Artificial Sequence
  chemically synthesized
ctttaatttatttcacatgc

SEQ ID NO: 588920 - DNA, 20 bp, Artificial Sequence
  chemically synthesized
acttcccctcttctccagtg

SEQ ID NO: 588921 - DNA, 20 bp, Artificial Sequence
  chemically synthesized
gctatacactggagaagagg

SEQ ID NO: 588922 - DNA, 20 bp, Artificial Sequence
  chemically synthesized
acactggagaagaggggaag

SEQ ID NO: 588923 - DNA, 20 bp, Artificial Sequence
  chemically synthesized
gaccaggtgttatataaatg

SEQ ID NO: 588924 - DNA, 20 bp, Artificial Sequence
  chemically synthesized
atggacagatttttaaacta

SEQ ID NO: 588925 - DNA, 20 bp, Artificial Sequence
  chemically synthesized
catattatttattgaaacat

SEQ ID NO: 588926 - DNA, 20 bp, Artificial Sequence
  chemically synthesized
cacatgtttatattcatttc

SEQ ID NO: 588927 - DNA, 20 bp, Artificial Sequence
  chemically synthesized
tttttatagagaaggatgcc

SEQ ID NO: 588928 - DNA, 20 bp, Artificial Sequence
  chemically synthesized
cagatgagccccattcaacc

SEQ ID NO: 588929 - DNA, 20 bp, Artificial Sequence
  chemically synthesized
gtcctggccgagagtatgtg

SEQ ID NO: 588930 - DNA, 20 bp, Artificial Sequence
  chemically synthesized
atgtgggatgatttatctca

SEQ ID NO: 588931 - DNA, 20 bp, Artificial Sequence
  chemically synthesized
attgtgatttgttgtcccat

SEQ ID NO: 588932 - DNA, 20 bp, Artificial Sequence
  chemically synthesized
atttctttgtatggcataca

SEQ ID NO: 588933 - DNA, 20 bp, Artificial Sequence
  chemically synthesized
ttaccaggtctattctttta

SEQ ID NO: 588934 - DNA, 20 bp, Artificial Sequence
  chemically synthesized
cttctctgagtccttggttt

SEQ ID NO: 588935 - DNA, 20 bp, Artificial Sequence
  chemically synthesized
aagtggttcttctctgagtc

SEQ ID NO: 588936 - DNA, 20 bp, Artificial Sequence
  chemically synthesized
aatggcagaaggtaatattc

SEQ ID NO: 588937 - DNA, 20 bp, Artificial Sequence
  chemically synthesized
taaaggtaactttttaaaat

SEQ ID NO: 588938 - DNA, 20 bp, Artificial Sequence
  chemically synthesized
tggctctcagttatgaaaag

SEQ ID NO: 588939 - DNA, 20 bp, Artificial Sequence
  chemically synthesized
acctaatcatcatgcagacg

SEQ ID NO: 588940 - DNA, 20 bp, Artificial Sequence
  chemically synthesized
ccagaaacaaaacgtctgca

SEQ ID NO: 588941 - DNA, 20 bp, Artificial Sequence
  chemically synthesized
agaacacctaatcatcatgc

SEQ ID NO: 588942 - DNA, 20 bp, Artificial Sequence
  chemically synthesized
tttattctggagagtggggc

SEQ ID NO: 588943 - DNA, 20 bp, Artificial Sequence
  chemically synthesized
ataaatagctgtgtagaaga

SEQ ID NO: 588944 - DNA, 20 bp, Artificial Sequence
  chemically synthesized
tcatattttaagaagacaat

SEQ ID NO: 588945 - DNA, 20 bp, Artificial Sequence
  chemically synthesized
gacataaatattttcctaaa

SEQ ID NO: 588946 - DNA, 20 bp, Artificial Sequence
  chemically synthesized
aacatttaggaaaatattta

SEQ ID NO: 588947 - DNA, 20 bp, Artificial Sequence
  chemically synthesized
cataatagcctttgggtaag

SEQ ID NO: 588948 - DNA, 20 bp, Artificial Sequence
  chemically synthesized
attaacttgacagaggtctt

SEQ ID NO: 588949 - DNA, 20 bp, Artificial Sequence
  chemically synthesized
gtcaatcaaaatttaaatgt

SEQ ID NO: 588950 - DNA, 20 bp, Artificial Sequence
  chemically synthesized
cttaaacatcgacatttaaa

SEQ ID NO: 588951 - DNA, 20 bp, Artificial Sequence
  chemically synthesized
tgacaaccaacagtaacgag

SEQ ID NO: 588952 - DNA, 20 bp, Artificial Sequence
  chemically synthesized
tatgtacatctttgtttgtt

SEQ ID NO: 588953 - DNA, 20 bp, Artificial Sequence
  chemically synthesized
ttccgtgtatgtacatcttt

SEQ ID NO: 588954 - DNA, 20 bp, Artificial Sequence
  chemically synthesized
tttattccgtgtatgtacat

SEQ ID NO: 588955 - DNA, 20 bp, Artificial Sequence
  chemically synthesized
tttgtccctattaccacaat

SEQ ID NO: 588956 - DNA, 20 bp, Artificial Sequence
  chemically synthesized
agggacaaaagaaaatcacg

SEQ ID NO: 588957 - DNA, 20 bp, Artificial Sequence
  chemically synthesized
ttattctctgtgaaagcatc

SEQ ID NO: 588958 - DNA, 20 bp, Artificial Sequence
  chemically synthesized
gactaataatgctcaatagt

SEQ ID NO: 588959 - DNA, 20 bp, Artificial Sequence
  chemically synthesized
tgctcaatagttgaggattt

SEQ ID NO: 588960 - DNA, 20 bp, Artificial Sequence
  chemically synthesized
ctttagataaagtgacctgg

SEQ ID NO: 588961 - DNA, 20 bp, Artificial Sequence
  chemically synthesized
tctgttcttctttgtgcatc

SEQ ID NO: 588962 - DNA, 20 bp, Artificial Sequence
  chemically synthesized
tgactcgggagcgtcataca

SEQ ID NO: 588963 - DNA, 20 bp, Artificial Sequence
  chemically synthesized
tccaaccattctcgttttct

SEQ ID NO: 588964 - DNA, 20 bp, Artificial Sequence
  chemically synthesized
attcaaggggctccaaccat

SEQ ID NO: 588965 - DNA, 20 bp, Artificial Sequence
  chemically synthesized
gaatgaaatcaacttcaaca

SEQ ID NO: 588966 - DNA, 20 bp, Artificial Sequence
  chemically synthesized
tacatgaatctgtatgttga

SEQ ID NO: 588967 - DNA, 20 bp, Artificial Sequence
  chemically synthesized
ctcccattattgggcattgg

SEQ ID NO: 588968 - DNA, 20 bp, Artificial Sequence
  chemically synthesized
aattatttacaatcacatct

SEQ ID NO: 588969 - DNA, 20 bp, Artificial Sequence
  chemically synthesized
acaatatagtaaactcccag

SEQ ID NO: 588970 - DNA, 20 bp, Artificial Sequence
  chemically synthesized
tcttttatttaatattttat

SEQ ID NO: 588971 - DNA, 20 bp, Artificial Sequence
  chemically synthesized
ttaatgggttttacaccttt

SEQ ID NO: 588972 - DNA, 20 bp, Artificial Sequence
  chemically synthesized
tcccataggttgccttctta

SEQ ID NO: 588973 - DNA, 20 bp, Artificial Sequence
  chemically synthesized
acctatgggagaaagactat

SEQ ID NO: 588974 - DNA, 20 bp, Artificial Sequence
  chemically synthesized
gagaaagactataggtgctt

SEQ ID NO: 588975 - DNA, 20 bp, Artificial Sequence
  chemically synthesized
aagactataggtgctttttt

SEQ ID NO: 588976 - DNA, 20 bp, Artificial Sequence
  chemically synthesized
ctataggtgcttttttgttt

SEQ ID NO: 588977 - DNA, 20 bp, Artificial Sequence
  chemically synthesized
ggtgcttttttgtttgtttg

SEQ ID NO: 588978 - DNA, 20 bp, Artificial Sequence
  chemically synthesized
aacctctgcctcccgggttc

SEQ ID NO: 588979 - DNA, 20 bp, Artificial Sequence
  chemically synthesized
tcgggaggctgaggcaggag

SEQ ID NO: 588980 - DNA, 20 bp, Artificial Sequence
  chemically synthesized
tttttgtatttttagtagag

SEQ ID NO: 588981 - DNA, 20 bp, Artificial Sequence
  chemically synthesized
caccttggcctcccgaagtg

SEQ ID NO: 588982 - DNA, 20 bp, Artificial Sequence
  chemically synthesized
tattttcaaacttttctaca

SEQ ID NO: 588983 - DNA, 20 bp, Artificial Sequence
  chemically synthesized
ctttttaaagctcagtgtag

SEQ ID NO: 588984 - DNA, 20 bp, Artificial Sequence
  chemically synthesized
ggtttcactttgtttttcat

SEQ ID NO: 588985 - DNA, 20 bp, Artificial Sequence
  chemically synthesized
aaggcaatatggcggtttca

SEQ ID NO: 588986 - DNA, 20 bp, Artificial Sequence
  chemically synthesized
tttcaggacaaaggcaatat

SEQ ID NO: 588987 - DNA, 20 bp, Artificial Sequence
  chemically synthesized
tttgttctgtgcccatttta

SEQ ID NO: 588988 - DNA, 20 bp, Artificial Sequence
  chemically synthesized
gaacatgcatataggaatat

SEQ ID NO: 588989 - DNA, 20 bp, Artificial Sequence
  chemically synthesized
ctccatttctatcatagtta

SEQ ID NO: 588990 - DNA, 20 bp, Artificial Sequence
  chemically synthesized
gtgaagggaaaggtattctc

SEQ ID NO: 588991 - DNA, 20 bp, Artificial Sequence
  chemically synthesized
cagttatctatctatcatct

SEQ ID NO: 588992 - DNA, 20 bp, Artificial Sequence
  chemically synthesized
attctcaaaaatcactactg

SEQ ID NO: 588993 - DNA, 20 bp, Artificial Sequence
  chemically synthesized
gagttttgtaaacaattcag

SEQ ID NO: 588994 - DNA, 20 bp, Artificial Sequence
  chemically synthesized
tgaattgtttacaaaactca

SEQ ID NO: 588995 - DNA, 20 bp, Artificial Sequence
  chemically synthesized
taattatttggcaaagcatg

SEQ ID NO: 588996 - DNA, 20 bp, Artificial Sequence
  chemically synthesized
tttgatcaagtaaaggtctt

SEQ ID NO: 588997 - DNA, 20 bp, Artificial Sequence
  chemically synthesized
ttgaggtgatatgctaattt

SEQ ID NO: 588998 - DNA, 20 bp, Artificial Sequence
  chemically synthesized
ttctaccccaaataaatggt

SEQ ID NO: 588999 - DNA, 20 bp, Artificial Sequence
  chemically synthesized
cggctagaagagagggtttt

SEQ ID NO: 589000 - DNA, 20 bp, Artificial Sequence
  chemically synthesized
ccttcaaaaccctctcttct

SEQ ID NO: 589001 - DNA, 20 bp, Artificial Sequence
  chemically synthesized
atctcaaaacggctagaaga

SEQ ID NO: 589002 - DNA, 20 bp, Artificial Sequence
  chemically synthesized
gattgtcaatgggtacaaag

SEQ ID NO: 589003 - DNA, 20 bp, Artificial Sequence
  chemically synthesized
attgacaatcctctccccat

SEQ ID NO: 589004 - DNA, 20 bp, Artificial Sequence
  chemically synthesized
ggggaaaagcgagaatgggg

SEQ ID NO: 589005 - DNA, 20 bp, Artificial Sequence
  chemically synthesized
tttggtgaccaccgtccatt

SEQ ID NO: 589006 - DNA, 20 bp, Artificial Sequence
  chemically synthesized
atttactgcttctatgagat

SEQ ID NO: 589007 - DNA, 20 bp, Artificial Sequence
  chemically synthesized
gcttctatgagatcgatgtt

SEQ ID NO: 589008 - DNA, 20 bp, Artificial Sequence
  chemically synthesized
gccaaacacagaaagacaaa

SEQ ID NO: 589009 - DNA, 20 bp, Artificial Sequence
  chemically synthesized
aacaagctgcatttgtcttt

SEQ ID NO: 589010 - DNA, 20 bp, Artificial Sequence
  chemically synthesized
gctgcatttgtctttctgtg

SEQ ID NO: 589011 - DNA, 20 bp, Artificial Sequence
  chemically synthesized
gagatgatatctcattgtgg

SEQ ID NO: 589012 - DNA, 20 bp, Artificial Sequence
  chemically synthesized
ggaatgagatgatatctcat

SEQ ID NO: 589013 - DNA, 20 bp, Artificial Sequence
  chemically synthesized
atcgtatggtagttctattt

SEQ ID NO: 589014 - DNA, 20 bp, Artificial Sequence
  chemically synthesized
ctctatgacatactgatttt

SEQ ID NO: 589015 - DNA, 20 bp, Artificial Sequence
  chemically synthesized
atgcagatatctctatgaca

SEQ ID NO: 589016 - DNA, 20 bp, Artificial Sequence
  chemically synthesized
tcatagagatatctgcattc

SEQ ID NO: 589017 - DNA, 20 bp, Artificial Sequence
  chemically synthesized
ccaagatatagaatcaactt

SEQ ID NO: 589018 - DNA, 20 bp, Artificial Sequence
  chemically synthesized
catccattattaaacactta

SEQ ID NO: 589019 - DNA, 20 bp, Artificial Sequence
  chemically synthesized
catccatgttgtcataaatg

SEQ ID NO: 589020 - DNA, 20 bp, Artificial Sequence
  chemically synthesized
aggatactatgttaagtgtc

SEQ ID NO: 589021 - DNA, 20 bp, Artificial Sequence
  chemically synthesized
tcctgaaatgttataatgtc

SEQ ID NO: 589022 - DNA, 20 bp, Artificial Sequence
  chemically synthesized
taatgtcctcggtttaggat

SEQ ID NO: 589023 - DNA, 20 bp, Artificial Sequence
  chemically synthesized
tagcttgagtagaatggcaa

SEQ ID NO: 589024 - DNA, 20 bp, Artificial Sequence
  chemically synthesized
tacaggcatgagccaccatg

SEQ ID NO: 589025 - DNA, 20 bp, Artificial Sequence
  chemically synthesized
caccttggcctcccaaagtg

SEQ ID NO: 589026 - DNA, 20 bp, Artificial Sequence
  chemically synthesized
ttgtatttttttagtagaga

SEQ ID NO: 589027 - DNA, 20 bp, Artificial Sequence
  chemically synthesized
aatggcgtgaacccgggcag

SEQ ID NO: 589028 - DNA, 20 bp, Artificial Sequence
  chemically synthesized
tgaataaattaatatgctat

SEQ ID NO: 589029 - DNA, 20 bp, Artificial Sequence
  chemically synthesized
ttacaataagtctctccctc

SEQ ID NO: 589030 - DNA, 20 bp, Artificial Sequence
  chemically synthesized
attacgaatctggagaagtc

SEQ ID NO: 589031 - DNA, 20 bp, Artificial Sequence
  chemically synthesized
actgtaaatcttgggacttc

SEQ ID NO: 589032 - DNA, 20 bp, Artificial Sequence
  chemically synthesized
atcattggctttcctgggtc

SEQ ID NO: 589033 - DNA, 20 bp, Artificial Sequence
  chemically synthesized
actcagacaggaactacatc

SEQ ID NO: 589034 - DNA, 20 bp, Artificial Sequence
  chemically synthesized
tggggctggaacttaacgtc

SEQ ID NO: 589035 - DNA, 20 bp, Artificial Sequence
  chemically synthesized
taagttccagccccagaact

SEQ ID NO: 589036 - DNA, 20 bp, Artificial Sequence
  chemically synthesized
gcttaagactcaagaagacc

SEQ ID NO: 589037 - DNA, 20 bp, Artificial Sequence
  chemically synthesized
acacccatcttttcctgcct

SEQ ID NO: 589038 - DNA, 20 bp, Artificial Sequence
  chemically synthesized
aggcaggaaaagatgggtgt

SEQ ID NO: 589039 - DNA, 20 bp, Artificial Sequence
  chemically synthesized
caggcaggagttccttttaa

SEQ ID NO: 589040 - DNA, 20 bp, Artificial Sequence
  chemically synthesized
gagttccttttaatcaggct

SEQ ID NO: 589041 - DNA, 20 bp, Artificial Sequence
  chemically synthesized
attgaagacctaatcaaaaa

SEQ ID NO: 589042 - DNA, 20 bp, Artificial Sequence
  chemically synthesized
ggctttttgattaggtcttc

SEQ ID NO: 589043 - DNA, 20 bp, Artificial Sequence
  chemically synthesized
tcaattgaggacctaagtcc

SEQ ID NO: 589044 - DNA, 20 bp, Artificial Sequence
  chemically synthesized
tcgattggacttaggtcctc

SEQ ID NO: 589045 - DNA, 20 bp, Artificial Sequence
  chemically synthesized
cacccacacaagggagaaca

SEQ ID NO: 589046 - DNA, 20 bp, Artificial Sequence
  chemically synthesized
tgaatcagtagagggagcaa

SEQ ID NO: 589047 - DNA, 20 bp, Artificial Sequence
  chemically synthesized
acaatcggctttgctccctc

SEQ ID NO: 589048 - DNA, 20 bp, Artificial Sequence
  chemically synthesized
tgtttatgaggctgtttctg

SEQ ID NO: 589049 - DNA, 20 bp, Artificial Sequence
  chemically synthesized
tattctgggtgtgtttatga

SEQ ID NO: 589050 - DNA, 20 bp, Artificial Sequence
  chemically synthesized
cctcataaacacacccagaa

SEQ ID NO: 589051 - DNA, 20 bp, Artificial Sequence
  chemically synthesized
ttggtcaaacattattctgg

SEQ ID NO: 589052 - DNA, 20 bp, Artificial Sequence
  chemically synthesized
ttgaagttaaattgatagac

SEQ ID NO: 589053 - DNA, 20 bp, Artificial Sequence
  chemically synthesized
cacatcaggctagaatttgg

SEQ ID NO: 589054 - DNA, 20 bp, Artificial Sequence
  chemically synthesized
cggttccaaattctagcctg

SEQ ID NO: 589055 - DNA, 20 bp, Artificial Sequence
  chemically synthesized
agaaatctagccttttccaa

SEQ ID NO: 589056 - DNA, 20 bp, Artificial Sequence
  chemically synthesized
ttaaagcaaatttggaaaag

SEQ ID NO: 589057 - DNA, 20 bp, Artificial Sequence
  chemically synthesized
ggtctgtcaaatagattcat

SEQ ID NO: 589058 - DNA, 20 bp, Artificial Sequence
  chemically synthesized
taactgctccaggtctgtca

SEQ ID NO: 589059 - DNA, 20 bp, Artificial Sequence
  chemically synthesized
gcagttattttgtctgatgc

SEQ ID NO: 589060 - DNA, 20 bp, Artificial Sequence
  chemically synthesized
tattttgtctgatgctaagg

SEQ ID NO: 589061 - DNA, 20 bp, Artificial Sequence
  chemically synthesized
agcacaaagacaattttttc

SEQ ID NO: 589062 - DNA, 20 bp, Artificial Sequence
  chemically synthesized
agcgcaagaaaaaattgtct

SEQ ID NO: 589063 - DNA, 20 bp, Artificial Sequence
  chemically synthesized
gaaaaaattgtctttgtgct

SEQ ID NO: 589064 - DNA, 20 bp, Artificial Sequence
  chemically synthesized
cccgtattagcatgtttttc

SEQ ID NO: 589065 - DNA, 20 bp, Artificial Sequence
  chemically synthesized
atgtttttttccccgtatta

SEQ ID NO: 589066 - DNA, 20 bp, Artificial Sequence
  chemically synthesized
acggggaaaaaaacataaag

SEQ ID NO: 589067 - DNA, 20 bp, Artificial Sequence
  chemically synthesized
gagttgcaaaaatcctctct

SEQ ID NO: 589068 - DNA, 20 bp, Artificial Sequence
  chemically synthesized
tctcatttttaaaataaaat

SEQ ID NO: 589069 - DNA, 20 bp, Artificial Sequence
  chemically synthesized
aaattttattttaaaaatga

SEQ ID NO: 589070 - DNA, 20 bp, Artificial Sequence
  chemically synthesized
tataatctaataaatacctc

SEQ ID NO: 589071 - DNA, 20 bp, Artificial Sequence
  chemically synthesized
agaaagcttgagaggtattt

SEQ ID NO: 589072 - DNA, 20 bp, Artificial Sequence
  chemically synthesized
gaggtatttattagattata

SEQ ID NO: 589073 - DNA, 20 bp, Artificial Sequence
  chemically synthesized
ccctgagtctacattaaaaa

SEQ ID NO: 589074 - DNA, 20 bp, Artificial Sequence
  chemically synthesized
gtagactcaggggtacatgt

SEQ ID NO: 589075 - DNA, 20 bp, Artificial Sequence
  chemically synthesized
aagggtatactgcgtgatgc

SEQ ID NO: 589076 - DNA, 20 bp, Artificial Sequence
  chemically synthesized
atactgcgtgatgctgaggt

SEQ ID NO: 589077 - DNA, 20 bp, Artificial Sequence
  chemically synthesized
gatgctgaggtttgggcttc

SEQ ID NO: 589078 - DNA, 20 bp, Artificial Sequence
  chemically synthesized
agtgaacatagtacccaaca

SEQ ID NO: 589079 - DNA, 20 bp, Artificial Sequence
  chemically synthesized
gtgcctaattcgtgttggaa

SEQ ID NO: 589080 - DNA, 20 bp, Artificial Sequence
  chemically synthesized
ttttttctatgaatgttccc

SEQ ID NO: 589081 - DNA, 20 bp, Artificial Sequence
  chemically synthesized
ttcatagaaaaaactgtaca

SEQ ID NO: 589082 - DNA, 20 bp, Artificial Sequence
  chemically synthesized
atgcgtaaagaaaccctttg

SEQ ID NO: 589083 - DNA, 20 bp, Artificial Sequence
  chemically synthesized
ctaatgacagaacaatgtca

SEQ ID NO: 589084 - DNA, 20 bp, Artificial Sequence
  chemically synthesized
cattagaagacatgtacaaa

SEQ ID NO: 589085 - DNA, 20 bp, Artificial Sequence
  chemically synthesized
aaaaatagtttttgataaac

SEQ ID NO: 589086 - DNA, 20 bp, Artificial Sequence
  chemically synthesized
acgttatgaagacattaagc

SEQ ID NO: 589087 - DNA, 20 bp, Artificial Sequence
  chemically synthesized
agtttcttgcagtatatttt

SEQ ID NO: 589088 - DNA, 20 bp, Artificial Sequence
  chemically synthesized
aaatgtcgaagactttgaaa

SEQ ID NO: 589089 - DNA, 20 bp, Artificial Sequence
  chemically synthesized
gagctcacccaaaaggactg

SEQ ID NO: 589090 - DNA, 20 bp, Artificial Sequence
  chemically synthesized
tttaaaaggttcttttccta

SEQ ID NO: 589091 - DNA, 20 bp, Artificial Sequence
  chemically synthesized
aaggcattatttggaaataa

SEQ ID NO: 589092 - DNA, 20 bp, Artificial Sequence
  chemically synthesized
catagtttctcctaaagtat

SEQ ID NO: 589093 - DNA, 20 bp, Artificial Sequence
  chemically synthesized
gtgttaaggttgcctttata

SEQ ID NO: 589094 - DNA, 20 bp, Artificial Sequence
  chemically synthesized
tacctgttattttccttgct

SEQ ID NO: 589095 - DNA, 20 bp, Artificial Sequence
  chemically synthesized
aaccacaaagttaacttgag

SEQ ID NO: 589096 - DNA, 20 bp, Artificial Sequence
  chemically synthesized
tgaactatttgttttaaatg

SEQ ID NO: 589097 - DNA, 20 bp, Artificial Sequence
  chemically synthesized
tgaaattgagtaattgaact

SEQ ID NO: 589098 - DNA, 20 bp, Artificial Sequence
  chemically synthesized
aattactcaatttcatgcgg

SEQ ID NO: 589099 - DNA, 20 bp, Artificial Sequence
  chemically synthesized
tttaacattgctagtacatc

SEQ ID NO: 589100 - DNA, 20 bp, Artificial Sequence
  chemically synthesized
accttgcttacgtgagttat

SEQ ID NO: 589101 - DNA, 20 bp, Artificial Sequence
  chemically synthesized
ggatgtgtaactgccttaca

SEQ ID NO: 589102 - DNA, 20 bp, Artificial Sequence
  chemically synthesized
taatcttatatttattttaa

SEQ ID NO: 589103 - DNA, 20 bp, Artificial Sequence
  chemically synthesized
aaatctgaattaaaataaat

SEQ ID NO: 589104 - DNA, 20 bp, Artificial Sequence
  chemically synthesized
gtgttaacctactagaaagt

SEQ ID NO: 589105 - DNA, 20 bp, Artificial Sequence
  chemically synthesized
tgactttttatatgcttaca

SEQ ID NO: 589106 - DNA, 20 bp, Artificial Sequence
  chemically synthesized
aaaactttatttgacttttt

SEQ ID NO: 589107 - DNA, 20 bp, Artificial Sequence
  chemically synthesized
taagcatataaaaagtcaaa

SEQ ID NO: 589108 - DNA, 20 bp, Artificial Sequence
  chemically synthesized
caatacctgatgaatttcca

SEQ ID NO: 589109 - DNA, 20 bp, Artificial Sequence
  chemically synthesized
aaattattcttttgtagacc

SEQ ID NO: 589110 - DNA, 20 bp, Artificial Sequence
  chemically synthesized
ggtctacaaaagaataattt

SEQ ID NO: 589111 - DNA, 20 bp, Artificial Sequence
  chemically synthesized
gagttttcctgaaaaccaat

SEQ ID NO: 589112 - DNA, 20 bp, Artificial Sequence
  chemically synthesized
tatcaactctcaaaacctgt

SEQ ID NO: 589113 - DNA, 20 bp, Artificial Sequence
  chemically synthesized
ataaaaagtgcaagaacaca

SEQ ID NO: 589114 - DNA, 20 bp, Artificial Sequence
  chemically synthesized
gggatttatgacgcataata

SEQ ID NO: 589115 - DNA, 20 bp, Artificial Sequence
  chemically synthesized
cacccttcctgatattcaat

SEQ ID NO: 589116 - DNA, 20 bp, Artificial Sequence
  chemically synthesized
caggcattgaatatcaggaa

SEQ ID NO: 589117 - DNA, 20 bp, Artificial Sequence
  chemically synthesized
gtaaatagaggggatctact

SEQ ID NO: 589118 - DNA, 20 bp, Artificial Sequence
  chemically synthesized
cataaaaataacatttatca

SEQ ID NO: 589119 - DNA, 20 bp, Artificial Sequence
  chemically synthesized
tggctgatcacagtattata

SEQ ID NO: 589120 - DNA, 20 bp, Artificial Sequence
  chemically synthesized
taaatggattggaatggata

SEQ ID NO: 589121 - DNA, 20 bp, Artificial Sequence
  chemically synthesized
gccactggtctggtctttct

SEQ ID NO: 589122 - DNA, 20 bp, Artificial Sequence
  chemically synthesized
cctgcaaaggaggagcaaaa

SEQ ID NO: 589123 - DNA, 20 bp, Artificial Sequence
  chemically synthesized
tgtggatatctccgtatgac

SEQ ID NO: 589124 - DNA, 20 bp, Artificial Sequence
  chemically synthesized
tcatcttctggctttggcta

SEQ ID NO: 589125 - DNA, 20 bp, Artificial Sequence
  chemically synthesized
cctttgtttacatctcatct

SEQ ID NO: 589126 - DNA, 20 bp, Artificial Sequence
  chemically synthesized
ctttctcactctgacctcac

SEQ ID NO: 589127 - DNA, 20 bp, Artificial Sequence
  chemically synthesized
caaaatcatcagttgaggct

SEQ ID NO: 589128 - DNA, 20 bp, Artificial Sequence
  chemically synthesized
agaaaacaataagcctcaac

SEQ ID NO: 589129 - DNA, 20 bp, Artificial Sequence
  chemically synthesized
catgtgtcaaaatcatcagt

SEQ ID NO: 589130 - DNA, 20 bp, Artificial Sequence
  chemically synthesized
cctttagcttctgtaatatt

SEQ ID NO: 589131 - DNA, 20 bp, Artificial Sequence
  chemically synthesized
ttttttaaagtctgtaaccc

SEQ ID NO: 589132 - DNA, 20 bp, Artificial Sequence
  chemically synthesized
gataaaatggcagagaagcc

SEQ ID NO: 589133 - DNA, 20 bp, Artificial Sequence
  chemically synthesized
ataatgtatttgccaaatcc

SEQ ID NO: 589134 - DNA, 20 bp, Artificial Sequence
  chemically synthesized
ggatttggcaaatacattat

SEQ ID NO: 589135 - DNA, 20 bp, Artificial Sequence
  chemically synthesized
aatacattattgttgatttt

SEQ ID NO: 589136 - DNA, 20 bp, Artificial Sequence
  chemically synthesized
cgtatctttagaacatggaa

SEQ ID NO: 589137 - DNA, 20 bp, Artificial Sequence
  chemically synthesized
tatcatgcatcggttttctt

SEQ ID NO: 589138 - DNA, 20 bp, Artificial Sequence
  chemically synthesized
tttatcaccttgtatcatgc

SEQ ID NO: 589139 - DNA, 20 bp, Artificial Sequence
  chemically synthesized
tcactctccacttccttaca

SEQ ID NO: 589140 - DNA, 20 bp, Artificial Sequence
  chemically synthesized
aagtggagagtgagaacagc

SEQ ID NO: 589141 - DNA, 20 bp, Artificial Sequence
  chemically synthesized
tcctctctctatagatttgg

SEQ ID NO: 589142 - DNA, 20 bp, Artificial Sequence
  chemically synthesized
cactatcctctctctataga

SEQ ID NO: 589143 - DNA, 20 bp, Artificial Sequence
  chemically synthesized
atccttcactatcctctctc

SEQ ID NO: 589144 - DNA, 20 bp, Artificial Sequence
  chemically synthesized
atctatagagagaggatagt

SEQ ID NO: 589145 - DNA, 20 bp, Artificial Sequence
  chemically synthesized
ggatttatgttggaatgact

SEQ ID NO: 589146 - DNA, 20 bp, Artificial Sequence
  chemically synthesized
atgacttacggttttgtgta

SEQ ID NO: 589147 - DNA, 20 bp, Artificial Sequence
  chemically synthesized
tagtttttcttaaagaataa

SEQ ID NO: 589148 - DNA, 20 bp, Artificial Sequence
  chemically synthesized
attccttatcaagaggataa

SEQ ID NO: 589149 - DNA, 20 bp, Artificial Sequence
  chemically synthesized
gataaggaattagtggtgaa

SEQ ID NO: 589150 - DNA, 20 bp, Artificial Sequence
  chemically synthesized
ttcctaacattaaatgtctt

SEQ ID NO: 589151 - DNA, 20 bp, Artificial Sequence
  chemically synthesized
atctcttcacaactctgatt

SEQ ID NO: 589152 - DNA, 20 bp, Artificial Sequence
  chemically synthesized
tttaacatatctcttcacaa

SEQ ID NO: 589153 - DNA, 20 bp, Artificial Sequence
  chemically synthesized
tagtcctttcaacatttcca

SEQ ID NO: 589154 - DNA, 20 bp, Artificial Sequence
  chemically synthesized
agaaacgtagcatcatcatc

SEQ ID NO: 589155 - DNA, 20 bp, Artificial Sequence
  chemically synthesized
gaaagcactagatgatgatg

SEQ ID NO: 589156 - DNA, 20 bp, Artificial Sequence
  chemically synthesized
atatttttgcagctatttta

SEQ ID NO: 589157 - DNA, 20 bp, Artificial Sequence
  chemically synthesized
aaatatgatcacgtatggtc

SEQ ID NO: 589158 - DNA, 20 bp, Artificial Sequence
  chemically synthesized
attaggttattttagtggag

SEQ ID NO: 589159 - DNA, 20 bp, Artificial Sequence
  chemically synthesized
gtaaagaattttaatttatt

SEQ ID NO: 589160 - DNA, 20 bp, Artificial Sequence
  chemically synthesized
aatgcattatcataagacca

SEQ ID NO: 589161 - DNA, 20 bp, Artificial Sequence
  chemically synthesized
gagattggctggctttgtat

SEQ ID NO: 589162 - DNA, 20 bp, Artificial Sequence
  chemically synthesized
tacactctcccaagagattg

SEQ ID NO: 589163 - DNA, 20 bp, Artificial Sequence
  chemically synthesized
taaactttctacactctccc

SEQ ID NO: 589164 - DNA, 20 bp, Artificial Sequence
  chemically synthesized
caatctcttgggagagtgta

SEQ ID NO: 589165 - DNA, 20 bp, Artificial Sequence
  chemically synthesized
gaacttgaaaagtaccgcca

SEQ ID NO: 589166 - DNA, 20 bp, Artificial Sequence
  chemically synthesized
tgcaaatctgttctttacat

SEQ ID NO: 589167 - DNA, 20 bp, Artificial Sequence
  chemically synthesized
attcaatcacaaatgtaaag

SEQ ID NO: 589168 - DNA, 20 bp, Artificial Sequence
  chemically synthesized
ttacatctaagcagaagcgt

SEQ ID NO: 589169 - DNA, 20 bp, Artificial Sequence
  chemically synthesized
atctttttaatccaccacgc

SEQ ID NO: 589170 - DNA, 20 bp, Artificial Sequence
  chemically synthesized
agcagaagcgtggtggatta

SEQ ID NO: 589171 - DNA, 20 bp, Artificial Sequence
  chemically synthesized
attgaaatctttttaatcca

SEQ ID NO: 589172 - DNA, 20 bp, Artificial Sequence
  chemically synthesized
taccatattaaattttgaat

SEQ ID NO: 589173 - DNA, 20 bp, Artificial Sequence
  chemically synthesized
ggtaaaggaaaagatggtaa

SEQ ID NO: 589174 - DNA, 20 bp, Artificial Sequence
  chemically synthesized
ctaaagtgattagcatactg

SEQ ID NO: 589175 - DNA, 20 bp, Artificial Sequence
  chemically synthesized
ttcctatgataagggaccta

SEQ ID NO: 589176 - DNA, 20 bp, Artificial Sequence
  chemically synthesized
cataggaaagaatcttaaac

SEQ ID NO: 589177 - DNA, 20 bp, Artificial Sequence
  chemically synthesized
ccattgtcccaagcacctgt

SEQ ID NO: 589178 - DNA, 20 bp, Artificial Sequence
  chemically synthesized
tgaccaccattgtcccaagc

SEQ ID NO: 589179 - DNA, 20 bp, Artificial Sequence
  chemically synthesized
acaatggtggtcaacccctt

SEQ ID NO: 589180 - DNA, 20 bp, Artificial Sequence
  chemically synthesized
catgacacacaggctctaaa

SEQ ID NO: 589181 - DNA, 20 bp, Artificial Sequence
  chemically synthesized
tgttcttgtagaaaggtaat

SEQ ID NO: 589182 - DNA, 20 bp, Artificial Sequence
  chemically synthesized
ttacctttctacaagaacat

SEQ ID NO: 589183 - DNA, 20 bp, Artificial Sequence
  chemically synthesized
catctgacattagcgtatta

SEQ ID NO: 589184 - DNA, 20 bp, Artificial Sequence
  chemically synthesized
gcttgccatccaggagtcga

SEQ ID NO: 589185 - DNA, 20 bp, Artificial Sequence
  chemically synthesized
tggatggcaagcaagctgca

SEQ ID NO: 589186 - DNA, 20 bp, Artificial Sequence
  chemically synthesized
ccttacccaatcccagtgca

SEQ ID NO: 589187 - DNA, 20 bp, Artificial Sequence
  chemically synthesized
ctagccttacccaatcccag

SEQ ID NO: 589188 - DNA, 20 bp, Artificial Sequence
  chemically synthesized
cttatctctgtgttgcagat

SEQ ID NO: 589189 - DNA, 20 bp, Artificial Sequence
  chemically synthesized
aaaggccacagagaattcag

SEQ ID NO: 589190 - DNA, 20 bp, Artificial Sequence
  chemically synthesized
atgagatttttagctactgt

SEQ ID NO: 589191 - DNA, 20 bp, Artificial Sequence
  chemically synthesized
ttaataatgagatttttagc

SEQ ID NO: 589192 - DNA, 20 bp, Artificial Sequence
  chemically synthesized
ctgctcaaaagtcattaata

SEQ ID NO: 589193 - DNA, 20 bp, Artificial Sequence
  chemically synthesized
attaatgacttttgagcagc

SEQ ID NO: 589194 - DNA, 20 bp, Artificial Sequence
  chemically synthesized
acttttgagcagccacggtt

SEQ ID NO: 589195 - DNA, 20 bp, Artificial Sequence
  chemically synthesized
tttgtctttgttaagtctct

SEQ ID NO: 589196 - DNA, 20 bp, Artificial Sequence
  chemically synthesized
ttttctattttagtcccaga

SEQ ID NO: 589197 - DNA, 20 bp, Artificial Sequence
  chemically synthesized
ttacatttttctattttagt

SEQ ID NO: 589198 - DNA, 20 bp, Artificial Sequence
  chemically synthesized
aaaatgtaactgtgtctcaa

SEQ ID NO: 589199 - DNA, 20 bp, Artificial Sequence
  chemically synthesized
ggctgaaagagtgaactgta

SEQ ID NO: 589200 - DNA, 20 bp, Artificial Sequence
  chemically synthesized
gaaagagtgaactgtacagg

SEQ ID NO: 589201 - DNA, 20 bp, Artificial Sequence
  chemically synthesized
tgagcaaagatttacataac

SEQ ID NO: 589202 - DNA, 20 bp, Artificial Sequence
  chemically synthesized
ttcctgagcaaccagctgag

SEQ ID NO: 589203 - DNA, 20 bp, Artificial Sequence
  chemically synthesized
cccgtggtctgttttcctct

SEQ ID NO: 589204 - DNA, 20 bp, Artificial Sequence
  chemically synthesized
ccagcccgtggtctgttttc

SEQ ID NO: 589205 - DNA, 20 bp, Artificial Sequence
  chemically synthesized
acaaactcttccagcccgtg

SEQ ID NO: 589206 - DNA, 20 bp, Artificial Sequence
  chemically synthesized
gaaaacagaccacgggctgg

SEQ ID NO: 589207 - DNA, 20 bp, Artificial Sequence
  chemically synthesized
tgataacgggcattgaagca

SEQ ID NO: 589208 - DNA, 20 bp, Artificial Sequence
  chemically synthesized
tgggctatcattttaaatcc

SEQ ID NO: 589209 - DNA, 20 bp, Artificial Sequence
  chemically synthesized
tgggtctctagtgcatcctg

SEQ ID NO: 589210 - DNA, 20 bp, Artificial Sequence
  chemically synthesized
ggagtcttgtggagggaata

SEQ ID NO: 589211 - DNA, 20 bp, Artificial Sequence
  chemically synthesized
acaatccctcagctttcttc

SEQ ID NO: 589212 - DNA, 20 bp, Artificial Sequence
  chemically synthesized
ataaactaaagaagaaagct

SEQ ID NO: 589213 - DNA, 20 bp, Artificial Sequence
  chemically synthesized
gttttgggtgtatacaatcc

SEQ ID NO: 589214 - DNA, 20 bp, Artificial Sequence
  chemically synthesized
tttcccacgcttctaacagt

SEQ ID NO: 589215 - DNA, 20 bp, Artificial Sequence
  chemically synthesized
atttaaaggtgccaggtttc

SEQ ID NO: 589216 - DNA, 20 bp, Artificial Sequence
  chemically synthesized
aaatcagagatttaaaggtg

SEQ ID NO: 589217 - DNA, 20 bp, Artificial Sequence
  chemically synthesized
gaaacctggcacctttaaat

SEQ ID NO: 589218 - DNA, 20 bp, Artificial Sequence
  chemically synthesized
gggcaactaagggataaaat

SEQ ID NO: 589219 - DNA, 20 bp, Artificial Sequence
  chemically synthesized
agttgcccatgacattgcct

SEQ ID NO: 589220 - DNA, 20 bp, Artificial Sequence
  chemically synthesized
gctttaattgtctaacttat

SEQ ID NO: 589221 - DNA, 20 bp, Artificial Sequence
  chemically synthesized
aagttagacaattaaagcat

SEQ ID NO: 589222 - DNA, 20 bp, Artificial Sequence
  chemically synthesized
gcatggttagacaaaaactg

SEQ ID NO: 589223 - DNA, 20 bp, Artificial Sequence
  chemically synthesized
tgcatacaaaggcacaaaat

SEQ ID NO: 589224 - DNA, 20 bp, Artificial Sequence
  chemically synthesized
tgtttgcatacaaaggcaca

SEQ ID NO: 589225 - DNA, 20 bp, Artificial Sequence
  chemically synthesized
tttgtgttttgtcaactgaa

SEQ ID NO: 589226 - DNA, 20 bp, Artificial Sequence
  chemically synthesized
tcattcgtagtcattgtact

SEQ ID NO: 589227 - DNA, 20 bp, Artificial Sequence
  chemically synthesized
tgtttatttcattggtgtta

SEQ ID NO: 589228 - DNA, 20 bp, Artificial Sequence
  chemically synthesized
ttctcacctgtcctaccaac

SEQ ID NO: 589229 - DNA, 20 bp, Artificial Sequence
  chemically synthesized
ttattagtttgagctcctta

SEQ ID NO: 589230 - DNA, 20 bp, Artificial Sequence
  chemically synthesized
tccagatgatacgtagggtt

SEQ ID NO: 589231 - DNA, 20 bp, Artificial Sequence
  chemically synthesized
gaaaagaaggcctcttgcca

SEQ ID NO: 589232 - DNA, 20 bp, Artificial Sequence
  chemically synthesized
ccatttctcggggagcagcc

SEQ ID NO: 589233 - DNA, 20 bp, Artificial Sequence
  chemically synthesized
gaggatcatcagcctttgga

SEQ ID NO: 589234 - DNA, 20 bp, Artificial Sequence
  chemically synthesized
caagttatacaggagtaggc

SEQ ID NO: 589235 - DNA, 20 bp, Artificial Sequence
  chemically synthesized
tttatatctgcccttagcac

SEQ ID NO: 589236 - DNA, 20 bp, Artificial Sequence
  chemically synthesized
aaattcatttccctatatat

SEQ ID NO: 589237 - DNA, 20 bp, Artificial Sequence
  chemically synthesized
tccattgagattttgtgggc

SEQ ID NO: 589238 - DNA, 20 bp, Artificial Sequence
  chemically synthesized
aacctgttagcgcagttcca

SEQ ID NO: 589239 - DNA, 20 bp, Artificial Sequence
  chemically synthesized
atctcaatggaactgcgcta

SEQ ID NO: 589240 - DNA, 20 bp, Artificial Sequence
  chemically synthesized
tccatgacccctttgaattc

SEQ ID NO: 589241 - DNA, 20 bp, Artificial Sequence
  chemically synthesized
atttcttcaaagctccaaat

SEQ ID NO: 589242 - DNA, 20 bp, Artificial Sequence
  chemically synthesized
atctctaccaaacaactatt

SEQ ID NO: 589243 - DNA, 20 bp, Artificial Sequence
  chemically synthesized
tgggcaatacgagaaggctc

SEQ ID NO: 589244 - DNA, 20 bp, Artificial Sequence
  chemically synthesized
tcccctgattatccttcctt

SEQ ID NO: 589245 - DNA, 20 bp, Artificial Sequence
  chemically synthesized
aattctctctgtgtgtatct

SEQ ID NO: 589246 - DNA, 20 bp, Artificial Sequence
  chemically synthesized
taggcaaatttgaaagtcac

SEQ ID NO: 589247 - DNA, 20 bp, Artificial Sequence
  chemically synthesized
aaacctattgacacttgtac

SEQ ID NO: 589248 - DNA, 20 bp, Artificial Sequence
  chemically synthesized
aaacatatgtacaagtgtca

SEQ ID NO: 589249 - DNA, 20 bp, Artificial Sequence
  chemically synthesized
gtacaagtgtcaataggttt

SEQ ID NO: 589250 - DNA, 20 bp, Artificial Sequence
  chemically synthesized
caataggtttgtaggattat

SEQ ID NO: 589251 - DNA, 20 bp, Artificial Sequence
  chemically synthesized
gaaaatgcaaaccaaaattg

SEQ ID NO: 589252 - DNA, 20 bp, Artificial Sequence
  chemically synthesized
aaaatgtaaaacttttcaat

SEQ ID NO: 589253 - DNA, 20 bp, Artificial Sequence
  chemically synthesized
atctttggaaattttatgtt

SEQ ID NO: 589254 - DNA, 20 bp, Artificial Sequence
  chemically synthesized
gctttcactggctaatcaga

SEQ ID NO: 589255 - DNA, 20 bp, Artificial Sequence
  chemically synthesized
agaaaaatagataaagcaat

SEQ ID NO: 589256 - DNA, 20 bp, Artificial Sequence
  chemically synthesized
tatttgccctattatttctc

SEQ ID NO: 589257 - DNA, 20 bp, Artificial Sequence
  chemically synthesized
attgatgataattaagaaaa

SEQ ID NO: 589258 - DNA, 20 bp, Artificial Sequence
  chemically synthesized
caactgcaaagttgtactgg

SEQ ID NO: 589259 - DNA, 20 bp, Artificial Sequence
  chemically synthesized
attcatggtgaatctcaaga

SEQ ID NO: 589260 - DNA, 20 bp, Artificial Sequence
  chemically synthesized
tttaacaaataaacgaggtc

SEQ ID NO: 589261 - DNA, 20 bp, Artificial Sequence
  chemically synthesized
aggcgttcagcagtcacgtt

SEQ ID NO: 589262 - DNA, 20 bp, Artificial Sequence
  chemically synthesized
tttgttaaggcgttcagcag

SEQ ID NO: 589263 - DNA, 20 bp, Artificial Sequence
  chemically synthesized
taaagccatggccgattcat

SEQ ID NO: 589264 - DNA, 20 bp, Artificial Sequence
  chemically synthesized
aaaagcacccatgaatcggc

SEQ ID NO: 589265 - DNA, 20 bp, Artificial Sequence
  chemically synthesized
cttcgcagctataaagccat

SEQ ID NO: 589266 - DNA, 20 bp, Artificial Sequence
  chemically synthesized
aaagattcatacttatgtca

SEQ ID NO: 589267 - DNA, 20 bp, Artificial Sequence
  chemically synthesized
tactcgaagttttggtattt

SEQ ID NO: 589268 - DNA, 20 bp, Artificial Sequence
  chemically synthesized
tgagaaccactttacctact

SEQ ID NO: 589269 - DNA, 20 bp, Artificial Sequence
  chemically synthesized
tcgatgtatcctcatattca

SEQ ID NO: 589270 - DNA, 20 bp, Artificial Sequence
  chemically synthesized
gcactaatttagtctccaaa

SEQ ID NO: 589271 - DNA, 20 bp, Artificial Sequence
  chemically synthesized
aataatgaccactgaataat

SEQ ID NO: 589272 - DNA, 20 bp, Artificial Sequence
  chemically synthesized
ttggattcattactgtccct

SEQ ID NO: 589273 - DNA, 20 bp, Artificial Sequence
  chemically synthesized
agtttgcctttcgaatagtg

SEQ ID NO: 589274 - DNA, 20 bp, Artificial Sequence
  chemically synthesized
gtaatagtttgcctttcgaa

SEQ ID NO: 589275 - DNA, 20 bp, Artificial Sequence
  chemically synthesized
aagggtgtaacattctctgt

SEQ ID NO: 589276 - DNA, 20 bp, Artificial Sequence
  chemically synthesized
ccttcctaagttgtgagtgg

SEQ ID NO: 589277 - DNA, 20 bp, Artificial Sequence
  chemically synthesized
attaggtttccactgacctt

SEQ ID NO: 589278 - DNA, 20 bp, Artificial Sequence
  chemically synthesized
aactagataaagtactacaa

SEQ ID NO: 589279 - DNA, 20 bp, Artificial Sequence
  chemically synthesized
aaaattcagtgctaaaaaaa

SEQ ID NO: 589280 - DNA, 20 bp, Artificial Sequence
  chemically synthesized
gtaattgaaaacaaaaaaag

SEQ ID NO: 589281 - DNA, 20 bp, Artificial Sequence
  chemically synthesized
taaaattgaagccccacttt

SEQ ID NO: 589282 - DNA, 20 bp, Artificial Sequence
  chemically synthesized
atgataaaagacagtaactc

SEQ ID NO: 589283 - DNA, 20 bp, Artificial Sequence
  chemically synthesized
cttgataccttaaacttcag

SEQ ID NO: 589284 - DNA, 20 bp, Artificial Sequence
  chemically synthesized
caatgaacaggaaacaaccc

SEQ ID NO: 589285 - DNA, 20 bp, Artificial Sequence
  chemically synthesized
aattaattcaacatggtttt

SEQ ID NO: 589286 - DNA, 20 bp, Artificial Sequence
  chemically synthesized
tcactcactaattaattcaa

SEQ ID NO: 589287 - DNA, 20 bp, Artificial Sequence
  chemically synthesized
cacagttcatcacttattat

SEQ ID NO: 589288 - DNA, 20 bp, Artificial Sequence
  chemically synthesized
tgcattggtgtagttaggtt

SEQ ID NO: 589289 - DNA, 20 bp, Artificial Sequence
  chemically synthesized
gaagggaagaggaaagggca

SEQ ID NO: 589290 - DNA, 20 bp, Artificial Sequence
  chemically synthesized
atatacagtttacacgttat

SEQ ID NO: 589291 - DNA, 20 bp, Artificial Sequence
  chemically synthesized
acattgtggaatggaagata

SEQ ID NO: 589292 - DNA, 20 bp, Artificial Sequence
  chemically synthesized
gtgggttcagctcttttcaa

SEQ ID NO: 589293 - DNA, 20 bp, Artificial Sequence
  chemically synthesized
tcattatatgggcaaaaaga

SEQ ID NO: 589294 - DNA, 20 bp, Artificial Sequence
  chemically synthesized
gcagcacttgactaaggttc

SEQ ID NO: 589295 - DNA, 20 bp, Artificial Sequence
  chemically synthesized
atgcagtatacagagtggct

SEQ ID NO: 589296 - DNA, 20 bp, Artificial Sequence
  chemically synthesized
acataagatgcagtatacag

SEQ ID NO: 589297 - DNA, 20 bp, Artificial Sequence
  chemically synthesized
agattgaatatacaaatgat

SEQ ID NO: 589298 - DNA, 20 bp, Artificial Sequence
  chemically synthesized
aagagggcaaattgatttat

SEQ ID NO: 589299 - DNA, 20 bp, Artificial Sequence
  chemically synthesized
tcataagacccaagagggca

SEQ ID NO: 589300 - DNA, 20 bp, Artificial Sequence
  chemically synthesized
ttcgtctataaaatcaggat

SEQ ID NO: 589301 - DNA, 20 bp, Artificial Sequence
  chemically synthesized
cagaacctagcaatcaccta

SEQ ID NO: 589302 - DNA, 20 bp, Artificial Sequence
  chemically synthesized
ttgctaggttctgcataata

SEQ ID NO: 589303 - DNA, 20 bp, Artificial Sequence
  chemically synthesized
tggcacactagaatcactag

SEQ ID NO: 589304 - DNA, 20 bp, Artificial Sequence
  chemically synthesized
gaatttttttaaagcttccc

SEQ ID NO: 589305 - DNA, 20 bp, Artificial Sequence
  chemically synthesized
cctgagaataggaatttttt

SEQ ID NO: 589306 - DNA, 20 bp, Artificial Sequence
  chemically synthesized
tcccacctgcagaaattctg

SEQ ID NO: 589307 - DNA, 20 bp, Artificial Sequence
  chemically synthesized
ctagttcccacctgcagaaa

SEQ ID NO: 589308 - DNA, 20 bp, Artificial Sequence
  chemically synthesized
aactaggcatctctattttt

SEQ ID NO: 589309 - DNA, 20 bp, Artificial Sequence
  chemically synthesized
catctctatttttttttgtt

SEQ ID NO: 589310 - DNA, 20 bp, Artificial Sequence
  chemically synthesized
ttttttgttttttgtttttt

SEQ ID NO: 589311 - DNA, 20 bp, Artificial Sequence
  chemically synthesized
agagtaattccaacttgtag

SEQ ID NO: 589312 - DNA, 20 bp, Artificial Sequence
  chemically synthesized
caacaattagtgtttaaaga

SEQ ID NO: 589313 - DNA, 20 bp, Artificial Sequence
  chemically synthesized
tttactcaggtgacaacaat

SEQ ID NO: 589314 - DNA, 20 bp, Artificial Sequence
  chemically synthesized
aaagttatatatttctagaa

SEQ ID NO: 589315 - DNA, 20 bp, Artificial Sequence
  chemically synthesized
gcacgtatttttaaagggca

SEQ ID NO: 589316 - DNA, 20 bp, Artificial Sequence
  chemically synthesized
tttttctttgcaacttaatg

SEQ ID NO: 589317 - DNA, 20 bp, Artificial Sequence
  chemically synthesized
attaatattccaaatttgct

SEQ ID NO: 589318 - DNA, 20 bp, Artificial Sequence
  chemically synthesized
ggcatggatggctccatagt

SEQ ID NO: 589319 - DNA, 20 bp, Artificial Sequence
  chemically synthesized
gacgaaaatgtgcttaaggc

SEQ ID NO: 589320 - DNA, 20 bp, Artificial Sequence
  chemically synthesized
acatctactgacagacgaaa

SEQ ID NO: 589321 - DNA, 20 bp, Artificial Sequence
  chemically synthesized
tgtcagtagatgtatattct

SEQ ID NO: 589322 - DNA, 20 bp, Artificial Sequence
  chemically synthesized
ttttaagtgataatccctaa

SEQ ID NO: 589323 - DNA, 20 bp, Artificial Sequence
  chemically synthesized
ttctgccaggaaatcctttt

SEQ ID NO: 589324 - DNA, 20 bp, Artificial Sequence
  chemically synthesized
taaaaaggatttcctggcag

SEQ ID NO: 589325 - DNA, 20 bp, Artificial Sequence
  chemically synthesized
gcagcgagtatctttctcca

SEQ ID NO: 589326 - DNA, 20 bp, Artificial Sequence
  chemically synthesized
ttaattagatgaattccata

SEQ ID NO: 589327 - DNA, 20 bp, Artificial Sequence
  chemically synthesized
ggagctcacttcagacccag

SEQ ID NO: 589328 - DNA, 20 bp, Artificial Sequence
  chemically synthesized
ccattccatgccttgagagg

SEQ ID NO: 589329 - DNA, 20 bp, Artificial Sequence
  chemically synthesized
ctacactaactctgcgtttg

SEQ ID NO: 589330 - DNA, 20 bp, Artificial Sequence
  chemically synthesized
agtggtagactacactaact

SEQ ID NO: 589331 - DNA, 20 bp, Artificial Sequence
  chemically synthesized
gcagagttagtgtagtctac

SEQ ID NO: 589332 - DNA, 20 bp, Artificial Sequence
  chemically synthesized
tttattttaatgtgataaaa

SEQ ID NO: 589333 - DNA, 20 bp, Artificial Sequence
  chemically synthesized
ggaagaaacgtataaatcag

SEQ ID NO: 589334 - DNA, 20 bp, Artificial Sequence
  chemically synthesized
taaagaaactcagctgattt

SEQ ID NO: 589335 - DNA, 20 bp, Artificial Sequence
  chemically synthesized
tccaaagggtaaagaaactc

SEQ ID NO: 589336 - DNA, 20 bp, Artificial Sequence
  chemically synthesized
tcagctgagtttctttaccc

SEQ ID NO: 589337 - DNA, 20 bp, Artificial Sequence
  chemically synthesized
gttaaaggaactgatagttt

SEQ ID NO: 589338 - DNA, 20 bp, Artificial Sequence
  chemically synthesized
ctggaattgttaaaggaact

SEQ ID NO: 589339 - DNA, 20 bp, Artificial Sequence
  chemically synthesized
tggcattttagaaatacggt

SEQ ID NO: 589340 - DNA, 20 bp, Artificial Sequence
  chemically synthesized
attttagaaatacggtcaaa

SEQ ID NO: 589341 - DNA, 20 bp, Artificial Sequence
  chemically synthesized
gtcaaagtttgattaaaatg

SEQ ID NO: 589342 - DNA, 20 bp, Artificial Sequence
  chemically synthesized
agtagaacaaacaatattta

SEQ ID NO: 589343 - DNA, 20 bp, Artificial Sequence
  chemically synthesized
tgaatgaaaagcagtgtaaa

SEQ ID NO: 589344 - DNA, 20 bp, Artificial Sequence
  chemically synthesized
aatatgcccacacatactga

SEQ ID NO: 589345 - DNA, 20 bp, Artificial Sequence
  chemically synthesized
ttaacaggcatgcatataat

SEQ ID NO: 589346 - DNA, 20 bp, Artificial Sequence
  chemically synthesized
gagtacataatagttagaaa

SEQ ID NO: 589347 - DNA, 20 bp, Artificial Sequence
  chemically synthesized
tactgaagtgttgtttttat

SEQ ID NO: 589348 - DNA, 20 bp, Artificial Sequence
  chemically synthesized
atagggaagaggtactgaag

SEQ ID NO: 589349 - DNA, 20 bp, Artificial Sequence
  chemically synthesized
ttttaaatcacagtccacag

SEQ ID NO: 589350 - DNA, 20 bp, Artificial Sequence
  chemically synthesized
tggaaaagctgaactgtgga

SEQ ID NO: 589351 - DNA, 20 bp, Artificial Sequence
  chemically synthesized
tgggatcacgtcgtaacctg

SEQ ID NO: 589352 - DNA, 20 bp, Artificial Sequence
  chemically synthesized
gacctgatttccctaacctg

SEQ ID NO: 589353 - DNA, 20 bp, Artificial Sequence
  chemically synthesized
aattaataaaagaattcaca

SEQ ID NO: 589354 - DNA, 20 bp, Artificial Sequence
  chemically synthesized
tttttcaaataaaaagattt

SEQ ID NO: 589355 - DNA, 20 bp, Artificial Sequence
  chemically synthesized
aatactttgtttttcaaata

SEQ ID NO: 589356 - DNA, 20 bp, Artificial Sequence
  chemically synthesized
acagtgctatttgctaaata

SEQ ID NO: 589357 - DNA, 20 bp, Artificial Sequence
  chemically synthesized
ttgaggaagacctactgacc

SEQ ID NO: 589358 - DNA, 20 bp, Artificial Sequence
  chemically synthesized
gcggatactttttgcctaaa

SEQ ID NO: 589359 - DNA, 20 bp, Artificial Sequence
  chemically synthesized
cctaaaagcagatttgactc

SEQ ID NO: 589360 - DNA, 20 bp, Artificial Sequence
  chemically synthesized
ctgataatcatcagagtcaa

SEQ ID NO: 589361 - DNA, 20 bp, Artificial Sequence
  chemically synthesized
tgcacttctccaaattgact

SEQ ID NO: 589362 - DNA, 20 bp, Artificial Sequence
  chemically synthesized
tactattgatttgttggtgc

SEQ ID NO: 589363 - DNA, 20 bp, Artificial Sequence
  chemically synthesized
aaggcaccaacaaatcaata

SEQ ID NO: 589364 - DNA, 20 bp, Artificial Sequence
  chemically synthesized
tgaacatcaaagaatcttac

SEQ ID NO: 589365 - DNA, 20 bp, Artificial Sequence
  chemically synthesized
gattctttgatgttcatctt

SEQ ID NO: 589366 - DNA, 20 bp, Artificial Sequence
  chemically synthesized
catactttcccatttaaagt

SEQ ID NO: 589367 - DNA, 20 bp, Artificial Sequence
  chemically synthesized
ataactggataagctcttaa

SEQ ID NO: 589368 - DNA, 20 bp, Artificial Sequence
  chemically synthesized
acaggtaaggaaacaccctt

SEQ ID NO: 589369 - DNA, 20 bp, Artificial Sequence
  chemically synthesized
cccaacgtacagttgaaaat

SEQ ID NO: 589370 - DNA, 20 bp, Artificial Sequence
  chemically synthesized
gctatgtatttaaatttcat

SEQ ID NO: 589371 - DNA, 20 bp, Artificial Sequence
  chemically synthesized
actaaattcaaatggtatta

SEQ ID NO: 589372 - DNA, 20 bp, Artificial Sequence
  chemically synthesized
gcaaaataataccatttgaa

SEQ ID NO: 589373 - DNA, 20 bp, Artificial Sequence
  chemically synthesized
ttgaatttagttttagcctt

SEQ ID NO: 589374 - DNA, 20 bp, Artificial Sequence
  chemically synthesized
agccagtggtcatccagtga

SEQ ID NO: 589375 - DNA, 20 bp, Artificial Sequence
  chemically synthesized
atcttaatcactggatgacc

SEQ ID NO: 589376 - DNA, 20 bp, Artificial Sequence
  chemically synthesized
tgttgaagccagtggtcatc

SEQ ID NO: 589377 - DNA, 20 bp, Artificial Sequence
  chemically synthesized
ctagacatgcctagggacta

SEQ ID NO: 589378 - DNA, 20 bp, Artificial Sequence
  chemically synthesized
tttccttttgcagtaaaaga

SEQ ID NO: 589379 - DNA, 20 bp, Artificial Sequence
  chemically synthesized
attctttccttttgcagtaa

SEQ ID NO: 589380 - DNA, 20 bp, Artificial Sequence
  chemically synthesized
acttcttaactcattggcta

SEQ ID NO: 589381 - DNA, 20 bp, Artificial Sequence
  chemically synthesized
tggatgaaaagtggttctga

SEQ ID NO: 589382 - DNA, 20 bp, Artificial Sequence
  chemically synthesized
atatgggctaaaattaccat

SEQ ID NO: 589383 - DNA, 20 bp, Artificial Sequence
  chemically synthesized
tctgagtgaaattatacaga

SEQ ID NO: 589384 - DNA, 20 bp, Artificial Sequence
  chemically synthesized
tacaacaaccttatggctaa

SEQ ID NO: 589385 - DNA, 20 bp, Artificial Sequence
  chemically synthesized
agaggaacaaattctccatt

SEQ ID NO: 589386 - DNA, 20 bp, Artificial Sequence
  chemically synthesized
cattttatttatcaatttga

SEQ ID NO: 589387 - DNA, 20 bp, Artificial Sequence
  chemically synthesized
tacatctgtttctaattgtg

SEQ ID NO: 589388 - DNA, 20 bp, Artificial Sequence
  chemically synthesized
caattagaaacagatgtaac

SEQ ID NO: 589389 - DNA, 20 bp, Artificial Sequence
  chemically synthesized
gcatctaaagccattgttac

SEQ ID NO: 589390 - DNA, 20 bp, Artificial Sequence
  chemically synthesized
tactatgcaactgtggccct

SEQ ID NO: 589391 - DNA, 20 bp, Artificial Sequence
  chemically synthesized
tatgttttagaaggcattga

SEQ ID NO: 589392 - DNA, 20 bp, Artificial Sequence
  chemically synthesized
taccagaacaatttttgttc

SEQ ID NO: 589393 - DNA, 20 bp, Artificial Sequence
  chemically synthesized
cctatttgttctgagaaaga

SEQ ID NO: 589394 - DNA, 20 bp, Artificial Sequence
  chemically synthesized
taggttgaacataaatgcaa

SEQ ID NO: 589395 - DNA, 20 bp, Artificial Sequence
  chemically synthesized
taaaatgttcaaataaaaaa

SEQ ID NO: 589396 - DNA, 20 bp, Artificial Sequence
  chemically synthesized
ttcgatgggacctaataaat

SEQ ID NO: 589397 - DNA, 20 bp, Artificial Sequence
  chemically synthesized
gaagctttcctttggatttc

SEQ ID NO: 589398 - DNA, 20 bp, Artificial Sequence
  chemically synthesized
taagcatgagaaatccaaag

SEQ ID NO: 589399 - DNA, 20 bp, Artificial Sequence
  chemically synthesized
gtaatttcatgaagctttcc

SEQ ID NO: 589400 - DNA, 20 bp, Artificial Sequence
  chemically synthesized
tagcatttaaggtaatttca

SEQ ID NO: 589401 - DNA, 20 bp, Artificial Sequence
  chemically synthesized
ttcatgaaattaccttaaat

SEQ ID NO: 589402 - DNA, 20 bp, Artificial Sequence
  chemically synthesized
ttaaatagtcacagacctga

SEQ ID NO: 589403 - DNA, 20 bp, Artificial Sequence
  chemically synthesized
tctcaggtctgtgactattt

SEQ ID NO: 589404 - DNA, 20 bp, Artificial Sequence
  chemically synthesized
aaaggatttatttttctatt

SEQ ID NO: 589405 - DNA, 20 bp, Artificial Sequence
  chemically synthesized
accagtgaccctggtgatag

SEQ ID NO: 589406 - DNA, 20 bp, Artificial Sequence
  chemically synthesized
gcaggagtttaaccaagtgc

SEQ ID NO: 589407 - DNA, 20 bp, Artificial Sequence
  chemically synthesized
aatatgatacattataacgc

SEQ ID NO: 589408 - DNA, 20 bp, Artificial Sequence
  chemically synthesized
atgactatcccactggaaag

SEQ ID NO: 589409 - DNA, 20 bp, Artificial Sequence
  chemically synthesized
gcttagtgggaatgaagaac

SEQ ID NO: 589410 - DNA, 20 bp, Artificial Sequence
  chemically synthesized
gtggccattgagaacttgaa

SEQ ID NO: 589411 - DNA, 20 bp, Artificial Sequence
  chemically synthesized
taagataggggtgatagaga

SEQ ID NO: 589412 - DNA, 20 bp, Artificial Sequence
  chemically synthesized
cttctttgtctatctctgcc

SEQ ID NO: 589413 - DNA, 20 bp, Artificial Sequence
  chemically synthesized
cagtgtcagtggtaataata

SEQ ID NO: 589414 - DNA, 20 bp, Artificial Sequence
  chemically synthesized
ctgccatacattaaatacct

SEQ ID NO: 589415 - DNA, 20 bp, Artificial Sequence
  chemically synthesized
ttaaatacctttcagattaa

SEQ ID NO: 589416 - DNA, 20 bp, Artificial Sequence
  chemically synthesized
taaaagtgcttttacctatc

SEQ ID NO: 589417 - DNA, 20 bp, Artificial Sequence
  chemically synthesized
gaaatatttttatcacttca

SEQ ID NO: 589418 - DNA, 20 bp, Artificial Sequence
  chemically synthesized
ggacgtggttgtaggactgc

SEQ ID NO: 589419 - DNA, 20 bp, Artificial Sequence
  chemically synthesized
tttttaaagtgtacagtttg

SEQ ID NO: 589420 - DNA, 20 bp, Artificial Sequence
  chemically synthesized
aaaatcgcctttttaaagtg

SEQ ID NO: 589421 - DNA, 20 bp, Artificial Sequence
  chemically synthesized
tcaaactgtacactttaaaa

SEQ ID NO: 589422 - DNA, 20 bp, Artificial Sequence
  chemically synthesized
tttctctctttccaattcct

SEQ ID NO: 589423 - DNA, 20 bp, Artificial Sequence
  chemically synthesized
acttttagagtgactaaacc

SEQ ID NO: 589424 - DNA, 20 bp, Artificial Sequence
  chemically synthesized
ttgtttctcggtagtaatca

SEQ ID NO: 589425 - DNA, 20 bp, Artificial Sequence
  chemically synthesized
acatttctaaatatttttat

SEQ ID NO: 589426 - DNA, 20 bp, Artificial Sequence
  chemically synthesized
agaaatgtaggatgcatcaa

SEQ ID NO: 589427 - DNA, 20 bp, Artificial Sequence
  chemically synthesized
gatgtcaagcaacttagggg

SEQ ID NO: 589428 - DNA, 20 bp, Artificial Sequence
  chemically synthesized
tttagaaatctgtgccccta

SEQ ID NO: 589429 - DNA, 20 bp, Artificial Sequence
  chemically synthesized
agagaatcagtggggtgggg

SEQ ID NO: 589430 - DNA, 20 bp, Artificial Sequence
  chemically synthesized
ctccaatctcacccccaccc

SEQ ID NO: 589431 - DNA, 20 bp, Artificial Sequence
  chemically synthesized
cccactgattctctaatcac

SEQ ID NO: 589432 - DNA, 20 bp, Artificial Sequence
  chemically synthesized
ggaacagatggtaaaatcaa

SEQ ID NO: 589433 - DNA, 20 bp, Artificial Sequence
  chemically synthesized
aaaggttcagcaagaaaagt

SEQ ID NO: 589434 - DNA, 20 bp, Artificial Sequence
  chemically synthesized
ttggaggtaaaaatcaaatc

SEQ ID NO: 589435 - DNA, 20 bp, Artificial Sequence
  chemically synthesized
atagtggattaaatcgaccg

SEQ ID NO: 589436 - DNA, 20 bp, Artificial Sequence
  chemically synthesized
aataaatagtggattaaatc

SEQ ID NO: 589437 - DNA, 20 bp, Artificial Sequence
  chemically synthesized
tgaataggcactcaataaat

SEQ ID NO: 589438 - DNA, 20 bp, Artificial Sequence
  chemically synthesized
ttcatggctataccagtctg

SEQ ID NO: 589439 - DNA, 20 bp, Artificial Sequence
  chemically synthesized
cacgtttttccggccactgt

SEQ ID NO: 589440 - DNA, 20 bp, Artificial Sequence
  chemically synthesized
tggtcacacgtttttccggc

SEQ ID NO: 589441 - DNA, 20 bp, Artificial Sequence
  chemically synthesized
ccggaaaaacgtgtgaccaa

SEQ ID NO: 589442 - DNA, 20 bp, Artificial Sequence
  chemically synthesized
tgtggaaatcagaattggtc

SEQ ID NO: 589443 - DNA, 20 bp, Artificial Sequence
  chemically synthesized
cctaattcctagttaaccct

SEQ ID NO: 589444 - DNA, 20 bp, Artificial Sequence
  chemically synthesized
gggttaactaggaattagga

SEQ ID NO: 589445 - DNA, 20 bp, Artificial Sequence
  chemically synthesized
ttgcttggcatattctatca

SEQ ID NO: 589446 - DNA, 20 bp, Artificial Sequence
  chemically synthesized
acatttctttgcacatacca

SEQ ID NO: 589447 - DNA, 20 bp, Artificial Sequence
  chemically synthesized
tttggtatgtgcaaagaaat

SEQ ID NO: 589448 - DNA, 20 bp, Artificial Sequence
  chemically synthesized
tcctgctgcacccagaaagg

SEQ ID NO: 589449 - DNA, 20 bp, Artificial Sequence
  chemically synthesized
cctttctgggtgcagcagga

SEQ ID NO: 589450 - DNA, 20 bp, Artificial Sequence
  chemically synthesized
gggtgcagcaggaacttgat

SEQ ID NO: 589451 - DNA, 20 bp, Artificial Sequence
  chemically synthesized
ctttgaccatcatgatgagc

SEQ ID NO: 589452 - DNA, 20 bp, Artificial Sequence
  chemically synthesized
tcatgatggtcaaagcctga

SEQ ID NO: 589453 - DNA, 20 bp, Artificial Sequence
  chemically synthesized
ctgaagattaacaagctggg

SEQ ID NO: 589454 - DNA, 20 bp, Artificial Sequence
  chemically synthesized
ttgtgcgttgcattctgctc

SEQ ID NO: 589455 - DNA, 20 bp, Artificial Sequence
  chemically synthesized
cagagcagaatgcaacgcac

SEQ ID NO: 589456 - DNA, 20 bp, Artificial Sequence
  chemically synthesized
tttaattcaatgtcattact

SEQ ID NO: 589457 - DNA, 20 bp, Artificial Sequence
  chemically synthesized
ttcgtgtttgttctctatgg

SEQ ID NO: 589458 - DNA, 20 bp, Artificial Sequence
  chemically synthesized
tttatgcactaaaggtatgt

SEQ ID NO: 589459 - DNA, 20 bp, Artificial Sequence
  chemically synthesized
atattcaccaagaaaagtag

SEQ ID NO: 589460 - DNA, 20 bp, Artificial Sequence
  chemically synthesized
aaatgcttcactgccctgtt

SEQ ID NO: 589461 - DNA, 20 bp, Artificial Sequence
  chemically synthesized
cgttaacagggcagtgaagc

SEQ ID NO: 589462 - DNA, 20 bp, Artificial Sequence
  chemically synthesized
attctcttgagaagataatc

SEQ ID NO: 589463 - DNA, 20 bp, Artificial Sequence
  chemically synthesized
atctttacacctagcattag

SEQ ID NO: 589464 - DNA, 20 bp, Artificial Sequence
  chemically synthesized
actgaaacacttcttcaatt

SEQ ID NO: 589465 - DNA, 20 bp, Artificial Sequence
  chemically synthesized
tctcaatctcaaaattgaag

SEQ ID NO: 589466 - DNA, 20 bp, Artificial Sequence
  chemically synthesized
tctcaaaattgaagaagtgt

SEQ ID NO: 589467 - DNA, 20 bp, Artificial Sequence
  chemically synthesized
cagtttgttaagcccatgat

SEQ ID NO: 589468 - DNA, 20 bp, Artificial Sequence
  chemically synthesized
gaaaaagacaagctttcatc

SEQ ID NO: 589469 - DNA, 20 bp, Artificial Sequence
  chemically synthesized
ctagaatgtgagagaaaaag

SEQ ID NO: 589470 - DNA, 20 bp, Artificial Sequence
  chemically synthesized
agcacagctatgtctggggt

SEQ ID NO: 589471 - DNA, 20 bp, Artificial Sequence
  chemically synthesized
catgtaggacagattacctc

SEQ ID NO: 589472 - DNA, 20 bp, Artificial Sequence
  chemically synthesized
tcacattaattcacatgtag

SEQ ID NO: 589473 - DNA, 20 bp, Artificial Sequence
  chemically synthesized
atagtgactaggtactttat

SEQ ID NO: 589474 - DNA, 20 bp, Artificial Sequence
  chemically synthesized
gtataactcgctgtctttca

SEQ ID NO: 589475 - DNA, 20 bp, Artificial Sequence
  chemically synthesized
tctttcaactggtttattca

SEQ ID NO: 589476 - DNA, 20 bp, Artificial Sequence
  chemically synthesized
aggagaacaaaaaaatgctt

SEQ ID NO: 589477 - DNA, 20 bp, Artificial Sequence
  chemically synthesized
tgagaaagaggagaacaaaa

SEQ ID NO: 589478 - DNA, 20 bp, Artificial Sequence
  chemically synthesized
aacactttccataggaccag

SEQ ID NO: 589479 - DNA, 20 bp, Artificial Sequence
  chemically synthesized
tctggtcctatggaaagtgt

SEQ ID NO: 589480 - DNA, 20 bp, Artificial Sequence
  chemically synthesized
attgctacagaaattatttc

SEQ ID NO: 589481 - DNA, 20 bp, Artificial Sequence
  chemically synthesized
ttctttagtttattgtgatc

SEQ ID NO: 589482 - DNA, 20 bp, Artificial Sequence
  chemically synthesized
gaagttaagtctatttttat

SEQ ID NO: 589483 - DNA, 20 bp, Artificial Sequence
  chemically synthesized
aatttaacttagcaaacagg

SEQ ID NO: 589484 - DNA, 20 bp, Artificial Sequence
  chemically synthesized
gttttggaattaaaaacagt

SEQ ID NO: 589485 - DNA, 20 bp, Artificial Sequence
  chemically synthesized
gagtttttgtttatgcatta

SEQ ID NO: 589486 - DNA, 20 bp, Artificial Sequence
  chemically synthesized
gaacctcttggggttagagt

SEQ ID NO: 589487 - DNA, 20 bp, Artificial Sequence
  chemically synthesized
aatcaagaacctcttggggt

SEQ ID NO: 589488 - DNA, 20 bp, Artificial Sequence
  chemically synthesized
aaactctaaccccaagaggt

SEQ ID NO: 589489 - DNA, 20 bp, Artificial Sequence
  chemically synthesized
cattaggtgtcatgcagttc

SEQ ID NO: 589490 - DNA, 20 bp, Artificial Sequence
  chemically synthesized
gtctctgccatctctaatgc

SEQ ID NO: 589491 - DNA, 20 bp, Artificial Sequence
  chemically synthesized
taatgctactgtttactatt

SEQ ID NO: 589492 - DNA, 20 bp, Artificial Sequence
  chemically synthesized
gattttagttagccaaataa

SEQ ID NO: 589493 - DNA, 20 bp, Artificial Sequence
  chemically synthesized
gtatttgcctagggtgctaa

SEQ ID NO: 589494 - DNA, 20 bp, Artificial Sequence
  chemically synthesized
aggcaaatacacccacagag

SEQ ID NO: 589495 - DNA, 20 bp, Artificial Sequence
  chemically synthesized
actgtccattgtaacattaa

SEQ ID NO: 589496 - DNA, 20 bp, Artificial Sequence
  chemically synthesized
ctaaaataggcaaggtaaga

SEQ ID NO: 589497 - DNA, 20 bp, Artificial Sequence
  chemically synthesized
ctgggtctaaaataggcaag

SEQ ID NO: 589498 - DNA, 20 bp, Artificial Sequence
  chemically synthesized
cttaccttgcctattttaga

SEQ ID NO: 589499 - DNA, 20 bp, Artificial Sequence
  chemically synthesized
agctttttgagagcaaacaa

SEQ ID NO: 589500 - DNA, 20 bp, Artificial Sequence
  chemically synthesized
tttgagagcaaacaatcaag

SEQ ID NO: 589501 - DNA, 20 bp, Artificial Sequence
  chemically synthesized
aactaacaaaaacaaaactt

SEQ ID NO: 589502 - DNA, 20 bp, Artificial Sequence
  chemically synthesized
aagaaactaacaaaaacaaa

SEQ ID NO: 589503 - DNA, 20 bp, Artificial Sequence
  chemically synthesized
aacaatcaagttttgttttt

SEQ ID NO: 589504 - DNA, 20 bp, Artificial Sequence
  chemically synthesized
tttcttctcaagacttatcc

SEQ ID NO: 589505 - DNA, 20 bp, Artificial Sequence
  chemically synthesized
agagctataaaagatagaat

SEQ ID NO: 589506 - DNA, 20 bp, Artificial Sequence
  chemically synthesized
atagaatttgggattacctg

SEQ ID NO: 589507 - DNA, 20 bp, Artificial Sequence
  chemically synthesized
ttacctgtgttgcttattag

SEQ ID NO: 589508 - DNA, 20 bp, Artificial Sequence
  chemically synthesized
agttcatatatatcctcaca

SEQ ID NO: 589509 - DNA, 20 bp, Artificial Sequence
  chemically synthesized
agttggcctcacatttgcct

SEQ ID NO: 589510 - DNA, 20 bp, Artificial Sequence
  chemically synthesized
tgttcctgcacttaaatcaa

SEQ ID NO: 589511 - DNA, 20 bp, Artificial Sequence
  chemically synthesized
aaaataatgagaaaaagcac

SEQ ID NO: 589512 - DNA, 20 bp, Artificial Sequence
  chemically synthesized
ttccaactactctgtgtttt

SEQ ID NO: 589513 - DNA, 20 bp, Artificial Sequence
  chemically synthesized
acaagttttttccaactact

SEQ ID NO: 589514 - DNA, 20 bp, Artificial Sequence
  chemically synthesized
acagagtagttggaaaaaac

SEQ ID NO: 589515 - DNA, 20 bp, Artificial Sequence
  chemically synthesized
ttatacacatatagcaaaac

SEQ ID NO: 589516 - DNA, 20 bp, Artificial Sequence
  chemically synthesized
aatttaacccccacgcagca

SEQ ID NO: 589517 - DNA, 20 bp, Artificial Sequence
  chemically synthesized
gctgcgtgggggttaaattt

SEQ ID NO: 589518 - DNA, 20 bp, Artificial Sequence
  chemically synthesized
ttagggtaagaaaataatga

SEQ ID NO: 589519 - DNA, 20 bp, Artificial Sequence
  chemically synthesized
tataaactgaaatgtactat

SEQ ID NO: 589520 - DNA, 20 bp, Artificial Sequence
  chemically synthesized
tttaaacttgtatagtacat

SEQ ID NO: 589521 - DNA, 20 bp, Artificial Sequence
  chemically synthesized
cagtttataaatttctttct

SEQ ID NO: 589522 - DNA, 20 bp, Artificial Sequence
  chemically synthesized
agtggcacacctatccacat

SEQ ID NO: 589523 - DNA, 20 bp, Artificial Sequence
  chemically synthesized
atagaaaaaagctaaacaaa

SEQ ID NO: 589524 - DNA, 20 bp, Artificial Sequence
  chemically synthesized
gcttcctgaatcttagtttg

SEQ ID NO: 589525 - DNA, 20 bp, Artificial Sequence
  chemically synthesized
acttagcttcctgaatctta

SEQ ID NO: 589526 - DNA, 20 bp, Artificial Sequence
  chemically synthesized
agttacttagcttcctgaat

SEQ ID NO: 589527 - DNA, 20 bp, Artificial Sequence
  chemically synthesized
gtgtgaccttaaataagtta

SEQ ID NO: 589528 - DNA, 20 bp, Artificial Sequence
  chemically synthesized
aacttatttaaggtcacaca

SEQ ID NO: 589529 - DNA, 20 bp, Artificial Sequence
  chemically synthesized
tttttggcagagacatatgt

SEQ ID NO: 589530 - DNA, 20 bp, Artificial Sequence
  chemically synthesized
gggtaattgtagtatagtgg

SEQ ID NO: 589531 - DNA, 20 bp, Artificial Sequence
  chemically synthesized
ttatcttacgcatttctagg

SEQ ID NO: 589532 - DNA, 20 bp, Artificial Sequence
  chemically synthesized
ctagaaatgcgtaagataaa

SEQ ID NO: 589533 - DNA, 20 bp, Artificial Sequence
  chemically synthesized
atgcgtaagataaaggtagt

SEQ ID NO: 589534 - DNA, 20 bp, Artificial Sequence
  chemically synthesized
agtttttgttttattcctaa

SEQ ID NO: 589535 - DNA, 20 bp, Artificial Sequence
  chemically synthesized
acttgtaatatctctgatat

SEQ ID NO: 589536 - DNA, 20 bp, Artificial Sequence
  chemically synthesized
accaacaagatgcaaactga

SEQ ID NO: 589537 - DNA, 20 bp, Artificial Sequence
  chemically synthesized
tactgttattataaaactat

SEQ ID NO: 589538 - DNA, 20 bp, Artificial Sequence
  chemically synthesized
ttttaataaattacagagtg

SEQ ID NO: 589539 - DNA, 20 bp, Artificial Sequence
  chemically synthesized
attcaatcttgtggctgaaa

SEQ ID NO: 589540 - DNA, 20 bp, Artificial Sequence
  chemically synthesized
gttaaagcaaactttcagcc

SEQ ID NO: 589541 - DNA, 20 bp, Artificial Sequence
  chemically synthesized
gcagattcaatcttgtggct

SEQ ID NO: 589542 - DNA, 20 bp, Artificial Sequence
  chemically synthesized
ttcagccacaagattgaatc

SEQ ID NO: 589543 - DNA, 20 bp, Artificial Sequence
  chemically synthesized
cacatatctgtggataaaac

SEQ ID NO: 589544 - DNA, 20 bp, Artificial Sequence
  chemically synthesized
tgctgttttatccacagata

SEQ ID NO: 589545 - DNA, 20 bp, Artificial Sequence
  chemically synthesized
tgttcatccttatcccaaca

SEQ ID NO: 589546 - DNA, 20 bp, Artificial Sequence
  chemically synthesized
atcagagttgtctctttttc

SEQ ID NO: 589547 - DNA, 20 bp, Artificial Sequence
  chemically synthesized
tgtgttaggcaagtgacaga

SEQ ID NO: 589548 - DNA, 20 bp, Artificial Sequence
  chemically synthesized
tgtttttgttgttctctgat

SEQ ID NO: 589549 - DNA, 20 bp, Artificial Sequence
  chemically synthesized
ttttctgccaaacagatgca

SEQ ID NO: 589550 - DNA, 20 bp, Artificial Sequence
  chemically synthesized
tttctgttgaaacatactgc

SEQ ID NO: 589551 - DNA, 20 bp, Artificial Sequence
  chemically synthesized
actgtgtttttcataatgat

SEQ ID NO: 589552 - DNA, 20 bp, Artificial Sequence
  chemically synthesized
tcaaggtactgtgtttttca

SEQ ID NO: 589553 - DNA, 20 bp, Artificial Sequence
  chemically synthesized
taaaatacaaggtcaaggta

SEQ ID NO: 589554 - DNA, 20 bp, Artificial Sequence
  chemically synthesized
gacatccactctaggttagg

SEQ ID NO: 589555 - DNA, 20 bp, Artificial Sequence
  chemically synthesized
tctctcatgcctgcaagtca

SEQ ID NO: 589556 - DNA, 20 bp, Artificial Sequence
  chemically synthesized
ataagaatgagtgatgatgc

SEQ ID NO: 589557 - DNA, 20 bp, Artificial Sequence
  chemically synthesized
agctaatattgtcctttgag

SEQ ID NO: 589558 - DNA, 20 bp, Artificial Sequence
  chemically synthesized
tacattgtcattctgtaaag

SEQ ID NO: 589559 - DNA, 20 bp, Artificial Sequence
  chemically synthesized
gaatgggtctcttgcaacag

SEQ ID NO: 589560 - DNA, 20 bp, Artificial Sequence
  chemically synthesized
aagctaatttcttgctggta

SEQ ID NO: 589561 - DNA, 20 bp, Artificial Sequence
  chemically synthesized
aagcaatttaccagcaagaa

SEQ ID NO: 589562 - DNA, 20 bp, Artificial Sequence
  chemically synthesized
ggatgctagctcatctcaca

SEQ ID NO: 589563 - DNA, 20 bp, Artificial Sequence
  chemically synthesized
ctgagaccacgcgggccaaa

SEQ ID NO: 589564 - DNA, 20 bp, Artificial Sequence
  chemically synthesized
tagtacagtatttaaaatga

SEQ ID NO: 589565 - DNA, 20 bp, Artificial Sequence
  chemically synthesized
tggatgtgttattaggataa

SEQ ID NO: 589566 - DNA, 20 bp, Artificial Sequence
  chemically synthesized
cttgagagttgaacaatggg

SEQ ID NO: 589567 - DNA, 20 bp, Artificial Sequence
  chemically synthesized
gaggagaactacagagatgg

SEQ ID NO: 589568 - DNA, 20 bp, Artificial Sequence
  chemically synthesized
tcccacagaagtactctgtt

SEQ ID NO: 589569 - DNA, 20 bp, Artificial Sequence
  chemically synthesized
taaaatggagaaataagtca

SEQ ID NO: 589570 - DNA, 20 bp, Artificial Sequence
  chemically synthesized
gtacacccaccacttcatta

SEQ ID NO: 589571 - DNA, 20 bp, Artificial Sequence
  chemically synthesized
agtctcagaaacattccgaa

SEQ ID NO: 589572 - DNA, 20 bp, Artificial Sequence
  chemically synthesized
acttaggaaatcagtcttcg

SEQ ID NO: 589573 - DNA, 20 bp, Artificial Sequence
  chemically synthesized
tcctaagtcttccaataaac

SEQ ID NO: 589574 - DNA, 20 bp, Artificial Sequence
  chemically synthesized
ccccacccaccgtctaaagc

SEQ ID NO: 589575 - DNA, 20 bp, Artificial Sequence
  chemically synthesized
cggtgggtggggtgcaggtg

SEQ ID NO: 589576 - DNA, 20 bp, Artificial Sequence
  chemically synthesized
ggagaatttacccagggctt

SEQ ID NO: 589577 - DNA, 20 bp, Artificial Sequence
  chemically synthesized
ttatgtctggagaatttacc

SEQ ID NO: 589578 - DNA, 20 bp, Artificial Sequence
  chemically synthesized
tttcatgtgaaatattgcag

SEQ ID NO: 589579 - DNA, 20 bp, Artificial Sequence
  chemically synthesized
acatgaaagactctttttct

SEQ ID NO: 589580 - DNA, 20 bp, Artificial Sequence
  chemically synthesized
aagactctttttcttagaga

SEQ ID NO: 589581 - DNA, 20 bp, Artificial Sequence
  chemically synthesized
accaaggtgaactttggtct

SEQ ID NO: 589582 - DNA, 20 bp, Artificial Sequence
  chemically synthesized
tgttgggaaattgagaggta

SEQ ID NO: 589583 - DNA, 20 bp, Artificial Sequence
  chemically synthesized
ggaataactattttatgtga

SEQ ID NO: 589584 - DNA, 20 bp, Artificial Sequence
  chemically synthesized
tacacatccgatattttggt

SEQ ID NO: 589585 - DNA, 20 bp, Artificial Sequence
  chemically synthesized
taaaactacacatccgatat

SEQ ID NO: 589586 - DNA, 20 bp, Artificial Sequence
  chemically synthesized
caaaaccaaaatatcggatg

SEQ ID NO: 589587 - DNA, 20 bp, Artificial Sequence
  chemically synthesized
gtagttttaatcaagcaaat

SEQ ID NO: 589588 - DNA, 20 bp, Artificial Sequence
  chemically synthesized
gccctataaaacatttattt

SEQ ID NO: 589589 - DNA, 20 bp, Artificial Sequence
  chemically synthesized
aaaggccctataaaacattt

SEQ ID NO: 589590 - DNA, 20 bp, Artificial Sequence
  chemically synthesized
aataaatgttttatagggcc

SEQ ID NO: 589591 - DNA, 20 bp, Artificial Sequence
  chemically synthesized
attctggaaaatgtagtaat

SEQ ID NO: 589592 - DNA, 20 bp, Artificial Sequence
  chemically synthesized
aagggggatgtggtgggatg

SEQ ID NO: 589593 - DNA, 20 bp, Artificial Sequence
  chemically synthesized
tccctgaaaccttgaatgtc

SEQ ID NO: 589594 - DNA, 20 bp, Artificial Sequence
  chemically synthesized
tttccaaatctggtgacatt

SEQ ID NO: 589595 - DNA, 20 bp, Artificial Sequence
  chemically synthesized
gccgcaaaaggacaccagtc

SEQ ID NO: 589596 - DNA, 20 bp, Artificial Sequence
  chemically synthesized
caaatgtccaacaatgatag

SEQ ID NO: 589597 - DNA, 20 bp, Artificial Sequence
  chemically synthesized
ttgcgatagtttactgagaa

SEQ ID NO: 589598 - DNA, 20 bp, Artificial Sequence
  chemically synthesized
gtttggttttttgttcttgc

SEQ ID NO: 589599 - DNA, 20 bp, Artificial Sequence
  chemically synthesized
gtgagtgagagtatgcagtg

SEQ ID NO: 589600 - DNA, 20 bp, Artificial Sequence
  chemically synthesized
cacctgtgagtgagagtatg

SEQ ID NO: 589601 - DNA, 20 bp, Artificial Sequence
  chemically synthesized
attattattattattatact

SEQ ID NO: 589602 - DNA, 20 bp, Artificial Sequence
  chemically synthesized
aggagcagatgttgaacttg

SEQ ID NO: 589603 - DNA, 20 bp, Artificial Sequence
  chemically synthesized
ttctggtagccccaggtgtt

SEQ ID NO: 589604 - DNA, 20 bp, Artificial Sequence
  chemically synthesized
aagaattcttccttgcctct

SEQ ID NO: 589605 - DNA, 20 bp, Artificial Sequence
  chemically synthesized
gccttcagagggataattga

SEQ ID NO: 589606 - DNA, 20 bp, Artificial Sequence
  chemically synthesized
attgaccttgattttggaca

SEQ ID NO: 589607 - DNA, 20 bp, Artificial Sequence
  chemically synthesized
ttgattttggacacctagct

SEQ ID NO: 589608 - DNA, 20 bp, Artificial Sequence
  chemically synthesized
aataaatgtctattaagcca

SEQ ID NO: 589609 - DNA, 20 bp, Artificial Sequence
  chemically synthesized
taacaaattaccacaagctg

SEQ ID NO: 589610 - DNA, 20 bp, Artificial Sequence
  chemically synthesized
ataacaaccatactccctgc

SEQ ID NO: 589611 - DNA, 20 bp, Artificial Sequence
  chemically synthesized
attgccaagtgcatacgaaa

SEQ ID NO: 589612 - DNA, 20 bp, Artificial Sequence
  chemically synthesized
ctaccagcttttagcatcct

SEQ ID NO: 589613 - DNA, 20 bp, Artificial Sequence
  chemically synthesized
ttaaaggatgctaaaagctg

SEQ ID NO: 589614 - DNA, 20 bp, Artificial Sequence
  chemically synthesized
aatctttggacctaaagcct

SEQ ID NO: 589615 - DNA, 20 bp, Artificial Sequence
  chemically synthesized
aagctggtaggctttaggtc

SEQ ID NO: 589616 - DNA, 20 bp, Artificial Sequence
  chemically synthesized
gtccaaagattgactagaag

SEQ ID NO: 589617 - DNA, 20 bp, Artificial Sequence
  chemically synthesized
caggccaaatacacagcagc

SEQ ID NO: 589618 - DNA, 20 bp, Artificial Sequence
  chemically synthesized
gaaaatggattgttgacttt

SEQ ID NO: 589619 - DNA, 20 bp, Artificial Sequence
  chemically synthesized
tgactagacagtaactagaa

SEQ ID NO: 589620 - DNA, 20 bp, Artificial Sequence
  chemically synthesized
atgttaagacttcaagggtg

SEQ ID NO: 589621 - DNA, 20 bp, Artificial Sequence
  chemically synthesized
ctgaatattcagagacttta

SEQ ID NO: 589622 - DNA, 20 bp, Artificial Sequence
  chemically synthesized
ctctccattttcatcatcca

SEQ ID NO: 589623 - DNA, 20 bp, Artificial Sequence
  chemically synthesized
caggtcattactaccgatca

SEQ ID NO: 589624 - DNA, 20 bp, Artificial Sequence
  chemically synthesized
catatgccctcagtaagcag

SEQ ID NO: 589625 - DNA, 20 bp, Artificial Sequence
  chemically synthesized
cttctcagggatgcaagctg

SEQ ID NO: 589626 - DNA, 20 bp, Artificial Sequence
  chemically synthesized
agtatagatgtgctctcctc

SEQ ID NO: 589627 - DNA, 20 bp, Artificial Sequence
  chemically synthesized
aaacactcctggtgggaagg

SEQ ID NO: 589628 - DNA, 20 bp, Artificial Sequence
  chemically synthesized
aagctttcccttcccaccag

SEQ ID NO: 589629 - DNA, 20 bp, Artificial Sequence
  chemically synthesized
gtgatatgaatacagaattg

SEQ ID NO: 589630 - DNA, 20 bp, Artificial Sequence
  chemically synthesized
agctttgaagagaaagggaa

SEQ ID NO: 589631 - DNA, 20 bp, Artificial Sequence
  chemically synthesized
aatgattagcatttactgag

SEQ ID NO: 589632 - DNA, 20 bp, Artificial Sequence
  chemically synthesized
gagtgtattaaaaatgctca

SEQ ID NO: 589633 - DNA, 20 bp, Artificial Sequence
  chemically synthesized
aggtgaggtaattgaggatc

SEQ ID NO: 589634 - DNA, 20 bp, Artificial Sequence
  chemically synthesized
agtatgtgtggatgtaaaca

SEQ ID NO: 589635 - DNA, 20 bp, Artificial Sequence
  chemically synthesized
tacaagagaatggcaaagca

SEQ ID NO: 589636 - DNA, 20 bp, Artificial Sequence
  chemically synthesized
aaaactttcaagtctatcca

SEQ ID NO: 589637 - DNA, 20 bp, Artificial Sequence
  chemically synthesized
taagcaaaatggatagactt

SEQ ID NO: 589638 - DNA, 20 bp, Artificial Sequence
  chemically synthesized
attaaatctacagttttaaa

SEQ ID NO: 589639 - DNA, 20 bp, Artificial Sequence
  chemically synthesized
agaaaaacattttttaaaac

SEQ ID NO: 589640 - DNA, 20 bp, Artificial Sequence
  chemically synthesized
ttttgagacttaattaaatc

SEQ ID NO: 589641 - DNA, 20 bp, Artificial Sequence
  chemically synthesized
acactcctctgtgaacagtt

SEQ ID NO: 589642 - DNA, 20 bp, Artificial Sequence
  chemically synthesized
tgtggctgtgagctgaagat

SEQ ID NO: 589643 - DNA, 20 bp, Artificial Sequence
  chemically synthesized
actccacatagactatgata

SEQ ID NO: 589644 - DNA, 20 bp, Artificial Sequence
  chemically synthesized
gaggaagaggcaggagaact

SEQ ID NO: 589645 - DNA, 20 bp, Artificial Sequence
  chemically synthesized
accctcaggttccatcatgc

SEQ ID NO: 589646 - DNA, 20 bp, Artificial Sequence
  chemically synthesized
aggtataagagggaaagttg

SEQ ID NO: 589647 - DNA, 20 bp, Artificial Sequence
  chemically synthesized
agaatatgaaagtcagaata

SEQ ID NO: 589648 - DNA, 20 bp, Artificial Sequence
  chemically synthesized
tgaggactagaaagccactg

SEQ ID NO: 589649 - DNA, 20 bp, Artificial Sequence
  chemically synthesized
ttaccagctcaaaacgtatc

SEQ ID NO: 589650 - DNA, 20 bp, Artificial Sequence
  chemically synthesized
tgaacctgatatatttctca

SEQ ID NO: 589651 - DNA, 20 bp, Artificial Sequence
  chemically synthesized
taataacatagcggtatagt

SEQ ID NO: 589652 - DNA, 20 bp, Artificial Sequence
  chemically synthesized
taatcatgtttgaatatagg

SEQ ID NO: 589653 - DNA, 20 bp, Artificial Sequence
  chemically synthesized
gaagctaatcctatattcaa

SEQ ID NO: 589654 - DNA, 20 bp, Artificial Sequence
  chemically synthesized
aaaaataatcatgtttgaat

SEQ ID NO: 589655 - DNA, 20 bp, Artificial Sequence
  chemically synthesized
ctatttgtttctaaaaataa

SEQ ID NO: 589656 - DNA, 20 bp, Artificial Sequence
  chemically synthesized
tttctatttcctctgtttct

SEQ ID NO: 589657 - DNA, 20 bp, Artificial Sequence
  chemically synthesized
ctcttgttattttctatttc

SEQ ID NO: 589658 - DNA, 20 bp, Artificial Sequence
  chemically synthesized
agaggaaggaagagatatcc

SEQ ID NO: 589659 - DNA, 20 bp, Artificial Sequence
  chemically synthesized
gacccccagcaatagcagct

SEQ ID NO: 589660 - DNA, 20 bp, Artificial Sequence
  chemically synthesized
gctgggggtctctgtaaata

SEQ ID NO: 589661 - DNA, 20 bp, Artificial Sequence
  chemically synthesized
aacgcactgattgtaatgaa

SEQ ID NO: 589662 - DNA, 20 bp, Artificial Sequence
  chemically synthesized
agcacccttcattacaatca

SEQ ID NO: 589663 - DNA, 20 bp, Artificial Sequence
  chemically synthesized
ttgtgtgttacagaaaaacg

SEQ ID NO: 589664 - DNA, 20 bp, Artificial Sequence
  chemically synthesized
aacacacaacgttatcataa

SEQ ID NO: 589665 - DNA, 20 bp, Artificial Sequence
  chemically synthesized
tctactaacttaaagacatg

SEQ ID NO: 589666 - DNA, 20 bp, Artificial Sequence
  chemically synthesized
taaataatttttaaaatcct

SEQ ID NO: 589667 - DNA, 20 bp, Artificial Sequence
  chemically synthesized
aattacttcaattcaatcgt

SEQ ID NO: 589668 - DNA, 20 bp, Artificial Sequence
  chemically synthesized
tattctctaaagaaaatgga

SEQ ID NO: 589669 - DNA, 20 bp, Artificial Sequence
  chemically synthesized
cctttcaggcccatagactt

SEQ ID NO: 589670 - DNA, 20 bp, Artificial Sequence
  chemically synthesized
taactaattcacttgaagaa

SEQ ID NO: 589671 - DNA, 20 bp, Artificial Sequence
  chemically synthesized
ctttaaaatactgcaattaa

SEQ ID NO: 589672 - DNA, 20 bp, Artificial Sequence
  chemically synthesized
tattttaaagttcacaccag

SEQ ID NO: 589673 - DNA, 20 bp, Artificial Sequence
  chemically synthesized
ctagttgagctggattttat

SEQ ID NO: 589674 - DNA, 20 bp, Artificial Sequence
  chemically synthesized
catactacctacctagttga

SEQ ID NO: 589675 - DNA, 20 bp, Artificial Sequence
  chemically synthesized
tggtatagcagaaacgagtc

SEQ ID NO: 589676 - DNA, 20 bp, Artificial Sequence
  chemically synthesized
ctcagattttaaatccaggg

SEQ ID NO: 589677 - DNA, 20 bp, Artificial Sequence
  chemically synthesized
ccctggatttaaaatctgag

SEQ ID NO: 589678 - DNA, 20 bp, Artificial Sequence
  chemically synthesized
aatcaaagaggaaatcagct

SEQ ID NO: 589679 - DNA, 20 bp, Artificial Sequence
  chemically synthesized
aatctgagagctgatttcct

SEQ ID NO: 589680 - DNA, 20 bp, Artificial Sequence
  chemically synthesized
gattccttcatgtaccaatt

SEQ ID NO: 589681 - DNA, 20 bp, Artificial Sequence
  chemically synthesized
caattgtgtgattttaacta

SEQ ID NO: 589682 - DNA, 20 bp, Artificial Sequence
  chemically synthesized
agctgagaaattaagacata

SEQ ID NO: 589683 - DNA, 20 bp, Artificial Sequence
  chemically synthesized
cagctgtaaaatgggcataa

SEQ ID NO: 589684 - DNA, 20 bp, Artificial Sequence
  chemically synthesized
tgtaattccagcagctagaa

SEQ ID NO: 589685 - DNA, 20 bp, Artificial Sequence
  chemically synthesized
ggcacagagcagaggctcag

SEQ ID NO: 589686 - DNA, 20 bp, Artificial Sequence
  chemically synthesized
atttaaatatatgtacattc

SEQ ID NO: 589687 - DNA, 20 bp, Artificial Sequence
  chemically synthesized
ctatacaatgctgtgctact

SEQ ID NO: 589688 - DNA, 20 bp, Artificial Sequence
  chemically synthesized
gcattcaatgacgtcacact

SEQ ID NO: 589689 - DNA, 20 bp, Artificial Sequence
  chemically synthesized
tcttggcggggagagagagt

SEQ ID NO: 589690 - DNA, 20 bp, Artificial Sequence
  chemically synthesized
tggaacagtggtttgctggt

SEQ ID NO: 589691 - DNA, 20 bp, Artificial Sequence
  chemically synthesized
agataatgaggacctggaac

SEQ ID NO: 589692 - DNA, 20 bp, Artificial Sequence
  chemically synthesized
ccaggtcctcattatctggc

SEQ ID NO: 589693 - DNA, 20 bp, Artificial Sequence
  chemically synthesized
ttgtgcagtgacgcccagag

SEQ ID NO: 589694 - DNA, 20 bp, Artificial Sequence
  chemically synthesized
gggaaattttcaaggcaagg

SEQ ID NO: 589695 - DNA, 20 bp, Artificial Sequence
  chemically synthesized
tctaacttggggtagtcaga

SEQ ID NO: 589696 - DNA, 20 bp, Artificial Sequence
  chemically synthesized
tagacttgggtacctcttcc

SEQ ID NO: 589697 - DNA, 20 bp, Artificial Sequence
  chemically synthesized
ttatcctaacgtatgataat

SEQ ID NO: 589698 - DNA, 20 bp, Artificial Sequence
  chemically synthesized
cctaacgtatgataataatt

SEQ ID NO: 589699 - DNA, 20 bp, Artificial Sequence
  chemically synthesized
gggactgtcttattcctaat

SEQ ID NO: 589700 - DNA, 20 bp, Artificial Sequence
  chemically synthesized
tcctaattagagtttctgta

SEQ ID NO: 589701 - DNA, 20 bp, Artificial Sequence
  chemically synthesized
gaacaactaaaaaaccccaa

SEQ ID NO: 589702 - DNA, 20 bp, Artificial Sequence
  chemically synthesized
caacatgtacaaaaccagat

SEQ ID NO: 589703 - DNA, 20 bp, Artificial Sequence
  chemically synthesized
gaattgccaacatgtacaaa

SEQ ID NO: 589704 - DNA, 20 bp, Artificial Sequence
  chemically synthesized
accactcttacataggcact

SEQ ID NO: 589705 - DNA, 20 bp, Artificial Sequence
  chemically synthesized
acataggcactctgtgcttg

SEQ ID NO: 589706 - DNA, 20 bp, Artificial Sequence
  chemically synthesized
ctacttgtgtggattagtgt

SEQ ID NO: 589707 - DNA, 20 bp, Artificial Sequence
  chemically synthesized
agcagcattacgactacttg

SEQ ID NO: 589708 - DNA, 20 bp, Artificial Sequence
  chemically synthesized
agacattaacaatgaagatc

SEQ ID NO: 589709 - DNA, 20 bp, Artificial Sequence
  chemically synthesized
acttgatctgtcacaggcgt

SEQ ID NO: 589710 - DNA, 20 bp, Artificial Sequence
  chemically synthesized
cttgtgacatttgaagtcat

SEQ ID NO: 589711 - DNA, 20 bp, Artificial Sequence
  chemically synthesized
tgtaggtggctgtcctacga

SEQ ID NO: 589712 - DNA, 20 bp, Artificial Sequence
  chemically synthesized
caaagatgcaaaagaaatgt

SEQ ID NO: 589713 - DNA, 20 bp, Artificial Sequence
  chemically synthesized
ctagagaaaaactatattat

SEQ ID NO: 589714 - DNA, 20 bp, Artificial Sequence
  chemically synthesized
gagggaaaaaacaggaataa

SEQ ID NO: 589715 - DNA, 20 bp, Artificial Sequence
  chemically synthesized
ctctgctctggaaggtattt

SEQ ID NO: 589716 - DNA, 20 bp, Artificial Sequence
  chemically synthesized
gcagaaagttggaacacaag

SEQ ID NO: 589717 - DNA, 20 bp, Artificial Sequence
  chemically synthesized
tcccctcttgtgttccaact

SEQ ID NO: 589718 - DNA, 20 bp, Artificial Sequence
  chemically synthesized
ttctgaaatctcatgtcacc

SEQ ID NO: 589719 - DNA, 20 bp, Artificial Sequence
  chemically synthesized
ggctttaagcacaaggtgac

SEQ ID NO: 589720 - DNA, 20 bp, Artificial Sequence
  chemically synthesized
aagctgttctcacttatggc

SEQ ID NO: 589721 - DNA, 20 bp, Artificial Sequence
  chemically synthesized
aagccccagccataagtgag

SEQ ID NO: 589722 - DNA, 20 bp, Artificial Sequence
  chemically synthesized
cctgcgactgccaatccctg

SEQ ID NO: 589723 - DNA, 20 bp, Artificial Sequence
  chemically synthesized
gagaaaagatcaaaacaacc

SEQ ID NO: 589724 - DNA, 20 bp, Artificial Sequence
  chemically synthesized
cctgggttgttttgatcttt

SEQ ID NO: 589725 - DNA, 20 bp, Artificial Sequence
  chemically synthesized
gttgttttgatcttttctcg

SEQ ID NO: 589726 - DNA, 20 bp, Artificial Sequence
  chemically synthesized
ctccaaatagtaccaaggga

SEQ ID NO: 589727 - DNA, 20 bp, Artificial Sequence
  chemically synthesized
ggaggagttctctttattat

SEQ ID NO: 589728 - DNA, 20 bp, Artificial Sequence
  chemically synthesized
gataattcagaatattttga

SEQ ID NO: 589729 - DNA, 20 bp, Artificial Sequence
  chemically synthesized
gccaaagataattcagaata

SEQ ID NO: 589730 - DNA, 20 bp, Artificial Sequence
  chemically synthesized
tcaaaatattctgaattatc

SEQ ID NO: 589731 - DNA, 20 bp, Artificial Sequence
  chemically synthesized
aaggactgggggggcttgac

SEQ ID NO: 589732 - DNA, 20 bp, Artificial Sequence
  chemically synthesized
atgaaagttgaaaggactgg

SEQ ID NO: 589733 - DNA, 20 bp, Artificial Sequence
  chemically synthesized
gccttcagtctctttccctt

SEQ ID NO: 589734 - DNA, 20 bp, Artificial Sequence
  chemically synthesized
ggatcatagactttacttaa

SEQ ID NO: 589735 - DNA, 20 bp, Artificial Sequence
  chemically synthesized
ctatctttctatccatccaa

SEQ ID NO: 589736 - DNA, 20 bp, Artificial Sequence
  chemically synthesized
ttggatggatagaaagatag

SEQ ID NO: 589737 - DNA, 20 bp, Artificial Sequence
  chemically synthesized
aaagatagaagggattattg

SEQ ID NO: 589738 - DNA, 20 bp, Artificial Sequence
  chemically synthesized
agaatgaacatataggtggt

SEQ ID NO: 589739 - DNA, 20 bp, Artificial Sequence
  chemically synthesized
aattgcttgaactcttactg

SEQ ID NO: 589740 - DNA, 20 bp, Artificial Sequence
  chemically synthesized
atggaagagaagtgcagtga

SEQ ID NO: 589741 - DNA, 20 bp, Artificial Sequence
  chemically synthesized
accccctaggtgtctccctc

SEQ ID NO: 589742 - DNA, 20 bp, Artificial Sequence
  chemically synthesized
ttctgcatttacccggctgc

SEQ ID NO: 589743 - DNA, 20 bp, Artificial Sequence
  chemically synthesized
cctcataattctgaattgta

SEQ ID NO: 589744 - DNA, 20 bp, Artificial Sequence
  chemically synthesized
ctgtcatgttattaaagcta

SEQ ID NO: 589745 - DNA, 20 bp, Artificial Sequence
  chemically synthesized
cagaatagatacagaagctg

SEQ ID NO: 589746 - DNA, 20 bp, Artificial Sequence
  chemically synthesized
ctgtatctattctgaaattc

SEQ ID NO: 589747 - DNA, 20 bp, Artificial Sequence
  chemically synthesized
tgggttttccaagaatagaa

SEQ ID NO: 589748 - DNA, 20 bp, Artificial Sequence
  chemically synthesized
attaagaagttagctgaaca

SEQ ID NO: 589749 - DNA, 20 bp, Artificial Sequence
  chemically synthesized
ctaacttcttaatgccaagc

SEQ ID NO: 589750 - DNA, 20 bp, Artificial Sequence
  chemically synthesized
actacatggttgattgaaac

SEQ ID NO: 589751 - DNA, 20 bp, Artificial Sequence
  chemically synthesized
cgtaactgcctccactacat

SEQ ID NO: 589752 - DNA, 20 bp, Artificial Sequence
  chemically synthesized
aaaaatatccttgtttggat

SEQ ID NO: 589753 - DNA, 20 bp, Artificial Sequence
  chemically synthesized
ccttttgctctcaaaaatat

SEQ ID NO: 589754 - DNA, 20 bp, Artificial Sequence
  chemically synthesized
agagcaaaaggaggcccaat

SEQ ID NO: 589755 - DNA, 20 bp, Artificial Sequence
  chemically synthesized
ataggataaacaagtagaaa

SEQ ID NO: 589756 - DNA, 20 bp, Artificial Sequence
  chemically synthesized
tcagaacaatcccactttct

SEQ ID NO: 589757 - DNA, 20 bp, Artificial Sequence
  chemically synthesized
tctatacgttgactgtaagt

SEQ ID NO: 589758 - DNA, 20 bp, Artificial Sequence
  chemically synthesized
aattgagtctatttccactt

SEQ ID NO: 589759 - DNA, 20 bp, Artificial Sequence
  chemically synthesized
ttttttctccatgaagcctt

SEQ ID NO: 589760 - DNA, 20 bp, Artificial Sequence
  chemically synthesized
ttcctgttagctaaatcaag

SEQ ID NO: 589761 - DNA, 20 bp, Artificial Sequence
  chemically synthesized
aaaaaaaaaggaaagaaaag

SEQ ID NO: 589762 - DNA, 20 bp, Artificial Sequence
  chemically synthesized
gcactccagcctgggcaaca

SEQ ID NO: 589763 - DNA, 20 bp, Artificial Sequence
  chemically synthesized
ttagcaggctgaggcaggag

SEQ ID NO: 589764 - DNA, 20 bp, Artificial Sequence
  chemically synthesized
tgcctcagcctgctaagtag

SEQ ID NO: 589765 - DNA, 20 bp, Artificial Sequence
  chemically synthesized
actaaatatacaaaaattag

SEQ ID NO: 589766 - DNA, 20 bp, Artificial Sequence
  chemically synthesized
ttttgtatatttagtagaga

SEQ ID NO: 589767 - DNA, 20 bp, Artificial Sequence
  chemically synthesized
caccttggcctcccaaagtg

SEQ ID NO: 589768 - DNA, 20 bp, Artificial Sequence
  chemically synthesized
ccctagaatgcacagttgaa

SEQ ID NO: 589769 - DNA, 20 bp, Artificial Sequence
  chemically synthesized
cgtacttcaactgtgcattc

SEQ ID NO: 589770 - DNA, 20 bp, Artificial Sequence
  chemically synthesized
cccacatggcctagccaata

SEQ ID NO: 589771 - DNA, 20 bp, Artificial Sequence
  chemically synthesized
gcaatgaatatttattaaac

SEQ ID NO: 589772 - DNA, 20 bp, Artificial Sequence
  chemically synthesized
atttattaaacgaatgattg

SEQ ID NO: 589773 - DNA, 20 bp, Artificial Sequence
  chemically synthesized
tttcagaaaactcagcaatc

SEQ ID NO: 589774 - DNA, 20 bp, Artificial Sequence
  chemically synthesized
caaaacaacaatggcaagaa

SEQ ID NO: 589775 - DNA, 20 bp, Artificial Sequence
  chemically synthesized
gaaaacatcattcttgccat

SEQ ID NO: 589776 - DNA, 20 bp, Artificial Sequence
  chemically synthesized
tggtgagataaacagaaata

SEQ ID NO: 589777 - DNA, 20 bp, Artificial Sequence
  chemically synthesized
ttaacttccaatcctcttat

SEQ ID NO: 589778 - DNA, 20 bp, Artificial Sequence
  chemically synthesized
acttatttacataatctgaa

SEQ ID NO: 589779 - DNA, 20 bp, Artificial Sequence
  chemically synthesized
ttatttccagttaaacattc

SEQ ID NO: 589780 - DNA, 20 bp, Artificial Sequence
  chemically synthesized
tcagaagcaaaatgtcttct

SEQ ID NO: 589781 - DNA, 20 bp, Artificial Sequence
  chemically synthesized
aataaaacggacagaagaca

SEQ ID NO: 589782 - DNA, 20 bp, Artificial Sequence
  chemically synthesized
tctttcaattatctaggatt

SEQ ID NO: 589783 - DNA, 20 bp, Artificial Sequence
  chemically synthesized
attccttttctttcaattat

SEQ ID NO: 589784 - DNA, 20 bp, Artificial Sequence
  chemically synthesized
tgagtatttgttcaatccat

SEQ ID NO: 589785 - DNA, 20 bp, Artificial Sequence
  chemically synthesized
atttgtctaaataaatcatg

SEQ ID NO: 589786 - DNA, 20 bp, Artificial Sequence
  chemically synthesized
atatctaatttgaacatccc

SEQ ID NO: 589787 - DNA, 20 bp, Artificial Sequence
  chemically synthesized
atatggaaatcatagtgcat

SEQ ID NO: 589788 - DNA, 20 bp, Artificial Sequence
  chemically synthesized
aatagcaaaactgatatgca

SEQ ID NO: 589789 - DNA, 20 bp, Artificial Sequence
  chemically synthesized
atcagttttgctatttttaa

SEQ ID NO: 589790 - DNA, 20 bp, Artificial Sequence
  chemically synthesized
tgcttcttatgtaagaatgt

SEQ ID NO: 589791 - DNA, 20 bp, Artificial Sequence
  chemically synthesized
ctaatggaagtttactattt

SEQ ID NO: 589792 - DNA, 20 bp, Artificial Sequence
  chemically synthesized
cttcttaattaactactaat

SEQ ID NO: 589793 - DNA, 20 bp, Artificial Sequence
  chemically synthesized
acaaatatagaagagtgata

SEQ ID NO: 589794 - DNA, 20 bp, Artificial Sequence
  chemically synthesized
ccatgaattacttcaggtgg

SEQ ID NO: 589795 - DNA, 20 bp, Artificial Sequence
  chemically synthesized
tgaccccatgaattacttca

SEQ ID NO: 589796 - DNA, 20 bp, Artificial Sequence
  chemically synthesized
ttatttaatttcaattaaaa

SEQ ID NO: 589797 - DNA, 20 bp, Artificial Sequence
  chemically synthesized
aggcctttttcccttaataa

SEQ ID NO: 589798 - DNA, 20 bp, Artificial Sequence
  chemically synthesized
cataatactttaggtgatat

SEQ ID NO: 589799 - DNA, 20 bp, Artificial Sequence
  chemically synthesized
gtatgattgtatgatacata

SEQ ID NO: 589800 - DNA, 20 bp, Artificial Sequence
  chemically synthesized
caaggggtcaatttccaatg

SEQ ID NO: 589801 - DNA, 20 bp, Artificial Sequence
  chemically synthesized
aggcccaaggggtcaatttc

SEQ ID NO: 589802 - DNA, 20 bp, Artificial Sequence
  chemically synthesized
ggctcatatttgtctcacgt

SEQ ID NO: 589803 - DNA, 20 bp, Artificial Sequence
  chemically synthesized
tgagccttcggtacaactag

SEQ ID NO: 589804 - DNA, 20 bp, Artificial Sequence
  chemically synthesized
agttgctaacttctctatag

SEQ ID NO: 589805 - DNA, 20 bp, Artificial Sequence
  chemically synthesized
aggtagaaggtagggatcct

SEQ ID NO: 589806 - DNA, 20 bp, Artificial Sequence
  chemically synthesized
ccttctacctcccagagctg

SEQ ID NO: 589807 - DNA, 20 bp, Artificial Sequence
  chemically synthesized
cttactatgtgaagattcta

SEQ ID NO: 589808 - DNA, 20 bp, Artificial Sequence
  chemically synthesized
tttattgaacacttactatg

SEQ ID NO: 589809 - DNA, 20 bp, Artificial Sequence
  chemically synthesized
ttactagtaatagtaatggc

SEQ ID NO: 589810 - DNA, 20 bp, Artificial Sequence
  chemically synthesized
caaggtggagactattatga

SEQ ID NO: 589811 - DNA, 20 bp, Artificial Sequence
  chemically synthesized
tagaaaagttctagttgggt

SEQ ID NO: 589812 - DNA, 20 bp, Artificial Sequence
  chemically synthesized
gttctagttgggtcagagat

SEQ ID NO: 589813 - DNA, 20 bp, Artificial Sequence
  chemically synthesized
gggtcagagattaaagatta

SEQ ID NO: 589814 - DNA, 20 bp, Artificial Sequence
  chemically synthesized
tcttttaattaagtgggtct

SEQ ID NO: 589815 - DNA, 20 bp, Artificial Sequence
  chemically synthesized
tatgcttagtagtactaata

SEQ ID NO: 589816 - DNA, 20 bp, Artificial Sequence
  chemically synthesized
agtagtcttacctattttga

SEQ ID NO: 589817 - DNA, 20 bp, Artificial Sequence
  chemically synthesized
cctcagatattctggtactg

SEQ ID NO: 589818 - DNA, 20 bp, Artificial Sequence
  chemically synthesized
atgtgcctcagatattctgg

SEQ ID NO: 589819 - DNA, 20 bp, Artificial Sequence
  chemically synthesized
gatggtagttcttaacaccc

SEQ ID NO: 589820 - DNA, 20 bp, Artificial Sequence
  chemically synthesized
gttctaggattaaaggatta

SEQ ID NO: 589821 - DNA, 20 bp, Artificial Sequence
  chemically synthesized
agaaacactgttctaggatt

SEQ ID NO: 589822 - DNA, 20 bp, Artificial Sequence
  chemically synthesized
ttaatcctttaatcctagaa

SEQ ID NO: 589823 - DNA, 20 bp, Artificial Sequence
  chemically synthesized
taaggttgagaaacactgtt

SEQ ID NO: 589824 - DNA, 20 bp, Artificial Sequence
  chemically synthesized
tgatgtctgggtcctgcctc

SEQ ID NO: 589825 - DNA, 20 bp, Artificial Sequence
  chemically synthesized
ctgggtcctgcctccataga

SEQ ID NO: 589826 - DNA, 20 bp, Artificial Sequence
  chemically synthesized
aatagctcaactgtctcccc

SEQ ID NO: 589827 - DNA, 20 bp, Artificial Sequence
  chemically synthesized
atcgaactgttggttctcag

SEQ ID NO: 589828 - DNA, 20 bp, Artificial Sequence
  chemically synthesized
cgtcgatcgaactgttggtt

SEQ ID NO: 589829 - DNA, 20 bp, Artificial Sequence
  chemically synthesized
ctgagaaccaacagttcgat

SEQ ID NO: 589830 - DNA, 20 bp, Artificial Sequence
  chemically synthesized
tgtgggttaacaaggtctcc

SEQ ID NO: 589831 - DNA, 20 bp, Artificial Sequence
  chemically synthesized
acttggagaccttgttaacc

SEQ ID NO: 589832 - DNA, 20 bp, Artificial Sequence
  chemically synthesized
cttggccctactcccaaaaa

SEQ ID NO: 589833 - DNA, 20 bp, Artificial Sequence
  chemically synthesized
ctcccaaaaactctgattta

SEQ ID NO: 589834 - DNA, 20 bp, Artificial Sequence
  chemically synthesized
ccaccccaagcctactaaat

SEQ ID NO: 589835 - DNA, 20 bp, Artificial Sequence
  chemically synthesized
gccaagactttctagttcta

SEQ ID NO: 589836 - DNA, 20 bp, Artificial Sequence
  chemically synthesized
catcatgctcggcatcacct

SEQ ID NO: 589837 - DNA, 20 bp, Artificial Sequence
  chemically synthesized
ggttctgacactccaaatgt

SEQ ID NO: 589838 - DNA, 20 bp, Artificial Sequence
  chemically synthesized
gactgccgggctacaccccc

SEQ ID NO: 589839 - DNA, 20 bp, Artificial Sequence
  chemically synthesized
aagccagtagattattaaag

SEQ ID NO: 589840 - DNA, 20 bp, Artificial Sequence
  chemically synthesized
aaacatcactttaataatct

SEQ ID NO: 589841 - DNA, 20 bp, Artificial Sequence
  chemically synthesized
gtgaaaatgtcttgaaagcc

SEQ ID NO: 589842 - DNA, 20 bp, Artificial Sequence
  chemically synthesized
accactaaacaccttatcat

SEQ ID NO: 589843 - DNA, 20 bp, Artificial Sequence
  chemically synthesized
ccgtggaagctgctatgata

SEQ ID NO: 589844 - DNA, 20 bp, Artificial Sequence
  chemically synthesized
caccttatcatagcagcttc

SEQ ID NO: 589845 - DNA, 20 bp, Artificial Sequence
  chemically synthesized
cttccacggattgctgtgcc

SEQ ID NO: 589846 - DNA, 20 bp, Artificial Sequence
  chemically synthesized
atatgtcctttgccttatgt

SEQ ID NO: 589847 - DNA, 20 bp, Artificial Sequence
  chemically synthesized
cagcttggtgaatggtatca

SEQ ID NO: 589848 - DNA, 20 bp, Artificial Sequence
  chemically synthesized
ctgataccattcaccaagct

SEQ ID NO: 589849 - DNA, 20 bp, Artificial Sequence
  chemically synthesized
gaatgaacaacacacaatcc

SEQ ID NO: 589850 - DNA, 20 bp, Artificial Sequence
  chemically synthesized
cattagatgctgatagaaca

SEQ ID NO: 589851 - DNA, 20 bp, Artificial Sequence
  chemically synthesized
ccaactgatgtcctgccatg

SEQ ID NO: 589852 - DNA, 20 bp, Artificial Sequence
  chemically synthesized
taatgtcgacataaggaggc

SEQ ID NO: 589853 - DNA, 20 bp, Artificial Sequence
  chemically synthesized
ctctggccatggaagatatg

SEQ ID NO: 589854 - DNA, 20 bp, Artificial Sequence
  chemically synthesized
tgatttaattcaagaattcc

SEQ ID NO: 589855 - DNA, 20 bp, Artificial Sequence
  chemically synthesized
cttctttaagatttcatgac

SEQ ID NO: 589856 - DNA, 20 bp, Artificial Sequence
  chemically synthesized
acaaaggtgttttctcttct

SEQ ID NO: 589857 - DNA, 20 bp, Artificial Sequence
  chemically synthesized
tcttaaagaagagaaaacac

SEQ ID NO: 589858 - DNA, 20 bp, Artificial Sequence
  chemically synthesized
tctccattaggctaaaacaa

SEQ ID NO: 589859 - DNA, 20 bp, Artificial Sequence
  chemically synthesized
ataatagtattcccagatcc

SEQ ID NO: 589860 - DNA, 20 bp, Artificial Sequence
  chemically synthesized
cggaagcaggagggaaaggg

SEQ ID NO: 589861 - DNA, 20 bp, Artificial Sequence
  chemically synthesized
tgaaagcccctccctttccc

SEQ ID NO: 589862 - DNA, 20 bp, Artificial Sequence
  chemically synthesized
ctcattacactgcatgagaa

SEQ ID NO: 589863 - DNA, 20 bp, Artificial Sequence
  chemically synthesized
accgcctctgtcctatgtgc

SEQ ID NO: 589864 - DNA, 20 bp, Artificial Sequence
  chemically synthesized
ctagataccgcctctgtcct

SEQ ID NO: 589865 - DNA, 20 bp, Artificial Sequence
  chemically synthesized
agtatagcagatggtgggat

SEQ ID NO: 589866 - DNA, 20 bp, Artificial Sequence
  chemically synthesized
actagcaagtatagcagatg

SEQ ID NO: 589867 - DNA, 20 bp, Artificial Sequence
  chemically synthesized
ccaccatctgctatacttgc

SEQ ID NO: 589868 - DNA, 20 bp, Artificial Sequence
  chemically synthesized
ctcggtatttcttccaaatg

SEQ ID NO: 589869 - DNA, 20 bp, Artificial Sequence
  chemically synthesized
gtgaacacaatagattctca

SEQ ID NO: 589870 - DNA, 20 bp, Artificial Sequence
  chemically synthesized
ccatgagaatctattgtgtt

SEQ ID NO: 589871 - DNA, 20 bp, Artificial Sequence
  chemically synthesized
gatgataaaactgtgaacac

SEQ ID NO: 589872 - DNA, 20 bp, Artificial Sequence
  chemically synthesized
atatctgcctgatgaaacaa

SEQ ID NO: 589873 - DNA, 20 bp, Artificial Sequence
  chemically synthesized
agcccattttacagaaactt

SEQ ID NO: 589874 - DNA, 20 bp, Artificial Sequence
  chemically synthesized
tgggctgttaaacacagatg

SEQ ID NO: 589875 - DNA, 20 bp, Artificial Sequence
  chemically synthesized
tgtttttaaaaacttttcat

SEQ ID NO: 589876 - DNA, 20 bp, Artificial Sequence
  chemically synthesized
tgaaaagtttttaaaaacat

SEQ ID NO: 589877 - DNA, 20 bp, Artificial Sequence
  chemically synthesized
tatttacttaactgaagccc

SEQ ID NO: 589878 - DNA, 20 bp, Artificial Sequence
  chemically synthesized
ttgcactcgacgttagtatt

SEQ ID NO: 589879 - DNA, 20 bp, Artificial Sequence
  chemically synthesized
gtattgtcataaaatgtgtt

SEQ ID NO: 589880 - DNA, 20 bp, Artificial Sequence
  chemically synthesized
gagctttttatgctcccata

SEQ ID NO: 589881 - DNA, 20 bp, Artificial Sequence
  chemically synthesized
ctaaatggtctctaaatgca

SEQ ID NO: 589882 - DNA, 20 bp, Artificial Sequence
  chemically synthesized
catttagtatttcttttgga

SEQ ID NO: 589883 - DNA, 20 bp, Artificial Sequence
  chemically synthesized
agtatttcttttggaaacgg

SEQ ID NO: 589884 - DNA, 20 bp, Artificial Sequence
  chemically synthesized
tggaatgggaattcaaacaa

SEQ ID NO: 589885 - DNA, 20 bp, Artificial Sequence
  chemically synthesized
tttgaattcccattccattt

SEQ ID NO: 589886 - DNA, 20 bp, Artificial Sequence
  chemically synthesized
tctggaatctcctttttacc

SEQ ID NO: 589887 - DNA, 20 bp, Artificial Sequence
  chemically synthesized
taaccaatcaaaaggtaaaa

SEQ ID NO: 589888 - DNA, 20 bp, Artificial Sequence
  chemically synthesized
ctttttaccttttgattggt

SEQ ID NO: 589889 - DNA, 20 bp, Artificial Sequence
  chemically synthesized
atcagttgctagttgacaat

SEQ ID NO: 589890 - DNA, 20 bp, Artificial Sequence
  chemically synthesized
gtaaagggaaaaatacaatt

SEQ ID NO: 589891 - DNA, 20 bp, Artificial Sequence
  chemically synthesized
aattttgaagcatcaataga

SEQ ID NO: 589892 - DNA, 20 bp, Artificial Sequence
  chemically synthesized
gatatttaatccgtttctat

SEQ ID NO: 589893 - DNA, 20 bp, Artificial Sequence
  chemically synthesized
tgaaggcaatgtgatattta

SEQ ID NO: 589894 - DNA, 20 bp, Artificial Sequence
  chemically synthesized
gggagataaaagaggcaaat

SEQ ID NO: 589895 - DNA, 20 bp, Artificial Sequence
  chemically synthesized
aacattcataatactttgag

SEQ ID NO: 589896 - DNA, 20 bp, Artificial Sequence
  chemically synthesized
agctctgctcaaagtattat

SEQ ID NO: 589897 - DNA, 20 bp, Artificial Sequence
  chemically synthesized
gaaaaatgcaacgacgatgc

SEQ ID NO: 589898 - DNA, 20 bp, Artificial Sequence
  chemically synthesized
aaaagaatgtaagctgggaa

SEQ ID NO: 589899 - DNA, 20 bp, Artificial Sequence
  chemically synthesized
atttgcctctaaactttttt

SEQ ID NO: 589900 - DNA, 20 bp, Artificial Sequence
  chemically synthesized
agaaccctgtattgaaacat

SEQ ID NO: 589901 - DNA, 20 bp, Artificial Sequence
  chemically synthesized
atgggtgagaaggaaatcaa

SEQ ID NO: 589902 - DNA, 20 bp, Artificial Sequence
  chemically synthesized
ttaacacattttagcagagt

SEQ ID NO: 589903 - DNA, 20 bp, Artificial Sequence
  chemically synthesized
aaaatgtgttaactgcagca

SEQ ID NO: 589904 - DNA, 20 bp, Artificial Sequence
  chemically synthesized
acaccaggaagttgttgtac

SEQ ID NO: 589905 - DNA, 20 bp, Artificial Sequence
  chemically synthesized
gtgcctttcagaaaatctcc

SEQ ID NO: 589906 - DNA, 20 bp, Artificial Sequence
  chemically synthesized
gtcatgtgcaacaaaacaga

SEQ ID NO: 589907 - DNA, 20 bp, Artificial Sequence
  chemically synthesized
aaaattattggaaagtgaca

SEQ ID NO: 589908 - DNA, 20 bp, Artificial Sequence
  chemically synthesized
agtgacagaatgtttgagtg

SEQ ID NO: 589909 - DNA, 20 bp, Artificial Sequence
  chemically synthesized
atggctttgcaaactgttga

SEQ ID NO: 589910 - DNA, 20 bp, Artificial Sequence
  chemically synthesized
attgaggatgaaacattttc

SEQ ID NO: 589911 - DNA, 20 bp, Artificial Sequence
  chemically synthesized
acatttctgctagcataatg

SEQ ID NO: 589912 - DNA, 20 bp, Artificial Sequence
  chemically synthesized
cccttctaatactatacaat

SEQ ID NO: 589913 - DNA, 20 bp, Artificial Sequence
  chemically synthesized
aattgtcaaatggatgcatg

SEQ ID NO: 589914 - DNA, 20 bp, Artificial Sequence
  chemically synthesized
catttgacaatttatcgagt

SEQ ID NO: 589915 - DNA, 20 bp, Artificial Sequence
  chemically synthesized
atttacagtccagtaagaat

SEQ ID NO: 589916 - DNA, 20 bp, Artificial Sequence
  chemically synthesized
cagtccagtaagaattacag

SEQ ID NO: 589917 - DNA, 20 bp, Artificial Sequence
  chemically synthesized
gtgcataacttaataagtca

SEQ ID NO: 589918 - DNA, 20 bp, Artificial Sequence
  chemically synthesized
tgggatgagttgttagcctg

SEQ ID NO: 589919 - DNA, 20 bp, Artificial Sequence
  chemically synthesized
gacaaaagaggacaattaga

SEQ ID NO: 589920 - DNA, 20 bp, Artificial Sequence
  chemically synthesized
tttgcgggggagctcaagtc

SEQ ID NO: 589921 - DNA, 20 bp, Artificial Sequence
  chemically synthesized
agacacatttgggtgagact

SEQ ID NO: 589922 - DNA, 20 bp, Artificial Sequence
  chemically synthesized
tgggtgagacttggggattt

SEQ ID NO: 589923 - DNA, 20 bp, Artificial Sequence
  chemically synthesized
tggtatgtcagagtcactct

SEQ ID NO: 589924 - DNA, 20 bp, Artificial Sequence
  chemically synthesized
accactactctatctataaa

SEQ ID NO: 589925 - DNA, 20 bp, Artificial Sequence
  chemically synthesized
aattggccttaggttgtaag

SEQ ID NO: 589926 - DNA, 20 bp, Artificial Sequence
  chemically synthesized
gatgagaagtaacagttaat

SEQ ID NO: 589927 - DNA, 20 bp, Artificial Sequence
  chemically synthesized
tcattaactgttacttctca

SEQ ID NO: 589928 - DNA, 20 bp, Artificial Sequence
  chemically synthesized
ttccagagctatgtaattac

SEQ ID NO: 589929 - DNA, 20 bp, Artificial Sequence
  chemically synthesized
caatacaggtccaagataat

SEQ ID NO: 589930 - DNA, 20 bp, Artificial Sequence
  chemically synthesized
tttaactttttcagtctctg

SEQ ID NO: 589931 - DNA, 20 bp, Artificial Sequence
  chemically synthesized
aatgaattaacccttagagt

SEQ ID NO: 589932 - DNA, 20 bp, Artificial Sequence
  chemically synthesized
gagtgtccgtttcatctaaa

SEQ ID NO: 589933 - DNA, 20 bp, Artificial Sequence
  chemically synthesized
gtttcatctaaaggaggatt

SEQ ID NO: 589934 - DNA, 20 bp, Artificial Sequence
  chemically synthesized
tttttgcaagttccagcatc

SEQ ID NO: 589935 - DNA, 20 bp, Artificial Sequence
  chemically synthesized
tatatgtaaagctgtattaa

SEQ ID NO: 589936 - DNA, 20 bp, Artificial Sequence
  chemically synthesized
tctttgaaaaacaaagttaa

SEQ ID NO: 589937 - DNA, 20 bp, Artificial Sequence
  chemically synthesized
tttttttcttttttctctgt

SEQ ID NO: 589938 - DNA, 20 bp, Artificial Sequence
  chemically synthesized
tttctcatcacaagagaaca

SEQ ID NO: 589939 - DNA, 20 bp, Artificial Sequence
  chemically synthesized
ttgcttaaataaaattttgt

SEQ ID NO: 589940 - DNA, 20 bp, Artificial Sequence
  chemically synthesized
aacaatttgatgcgtgttca

SEQ ID NO: 589941 - DNA, 20 bp, Artificial Sequence
  chemically synthesized
taatctagtgagcccagaca

SEQ ID NO: 589942 - DNA, 20 bp, Artificial Sequence
  chemically synthesized
aaaactacttgtctgggctc

SEQ ID NO: 589943 - DNA, 20 bp, Artificial Sequence
  chemically synthesized
aagataattaaattttcatg

SEQ ID NO: 589944 - DNA, 20 bp, Artificial Sequence
  chemically synthesized
agctcaagataattaaattt

SEQ ID NO: 589945 - DNA, 20 bp, Artificial Sequence
  chemically synthesized
gagctacataattgttcttc

SEQ ID NO: 589946 - DNA, 20 bp, Artificial Sequence
  chemically synthesized
aatgtactttgttttaaatt

SEQ ID NO: 589947 - DNA, 20 bp, Artificial Sequence
  chemically synthesized
ctggcttaaaaagtaatgta

SEQ ID NO: 589948 - DNA, 20 bp, Artificial Sequence
  chemically synthesized
tagaattggaattttaactt

SEQ ID NO: 589949 - DNA, 20 bp, Artificial Sequence
  chemically synthesized
acagtgcactcccaaagcat

SEQ ID NO: 589950 - DNA, 20 bp, Artificial Sequence
  chemically synthesized
attttgaatattttaaacca

SEQ ID NO: 589951 - DNA, 20 bp, Artificial Sequence
  chemically synthesized
aaattatataatgataatct

SEQ ID NO: 589952 - DNA, 20 bp, Artificial Sequence
  chemically synthesized
taatgataatctcagtgctt

SEQ ID NO: 589953 - DNA, 20 bp, Artificial Sequence
  chemically synthesized
taccttaaaactgaaaagca

SEQ ID NO: 589954 - DNA, 20 bp, Artificial Sequence
  chemically synthesized
gcttttcagttttaaggtat

SEQ ID NO: 589955 - DNA, 20 bp, Artificial Sequence
  chemically synthesized
ggtattcatgttttagtcaa

SEQ ID NO: 589956 - DNA, 20 bp, Artificial Sequence
  chemically synthesized
tttattcgtatctttcttac

SEQ ID NO: 589957 - DNA, 20 bp, Artificial Sequence
  chemically synthesized
acaaataagataattatttt

SEQ ID NO: 589958 - DNA, 20 bp, Artificial Sequence
  chemically synthesized
acaaagtacagcatacgtaa

SEQ ID NO: 589959 - DNA, 20 bp, Artificial Sequence
  chemically synthesized
tctgtcttcagataacttat

SEQ ID NO: 589960 - DNA, 20 bp, Artificial Sequence
  chemically synthesized
ccatgaatagggtgaaaatt

SEQ ID NO: 589961 - DNA, 20 bp, Artificial Sequence
  chemically synthesized
ttgaattaattcttaaattg

SEQ ID NO: 589962 - DNA, 20 bp, Artificial Sequence
  chemically synthesized
ctatgtttcagaatttgtgc

SEQ ID NO: 589963 - DNA, 20 bp, Artificial Sequence
  chemically synthesized
tagcacaaattctgaaacat

SEQ ID NO: 589964 - DNA, 20 bp, Artificial Sequence
  chemically synthesized
gaacatttgcaaaaaagccg

SEQ ID NO: 589965 - DNA, 20 bp, Artificial Sequence
  chemically synthesized
acctgcaaggtgggcaagga

SEQ ID NO: 589966 - DNA, 20 bp, Artificial Sequence
  chemically synthesized
gggtttgtagttctattgca

SEQ ID NO: 589967 - DNA, 20 bp, Artificial Sequence
  chemically synthesized
ttcactagtagatcacgatc

SEQ ID NO: 589968 - DNA, 20 bp, Artificial Sequence
  chemically synthesized
tttaacgtagatagtaaggc

SEQ ID NO: 589969 - DNA, 20 bp, Artificial Sequence
  chemically synthesized
atgtgccagcaagactgata

SEQ ID NO: 589970 - DNA, 20 bp, Artificial Sequence
  chemically synthesized
aacttttaattgaaagaaag

SEQ ID NO: 589971 - DNA, 20 bp, Artificial Sequence
  chemically synthesized
aattaaaagttgcaattaca

SEQ ID NO: 589972 - DNA, 20 bp, Artificial Sequence
  chemically synthesized
gctttcttttaaacctctcg

SEQ ID NO: 589973 - DNA, 20 bp, Artificial Sequence
  chemically synthesized
aagtaggttgaatcactacg

SEQ ID NO: 589974 - DNA, 20 bp, Artificial Sequence
  chemically synthesized
cctacttgtccccaaagcgt

SEQ ID NO: 589975 - DNA, 20 bp, Artificial Sequence
  chemically synthesized
ccagcatgattttcaatcaa

SEQ ID NO: 589976 - DNA, 20 bp, Artificial Sequence
  chemically synthesized
aaatttgttgggccggccca

SEQ ID NO: 589977 - DNA, 20 bp, Artificial Sequence
  chemically synthesized
tcaccaacccttctcatatc

SEQ ID NO: 589978 - DNA, 20 bp, Artificial Sequence
  chemically synthesized
attcccagtaaagtaacatt

SEQ ID NO: 589979 - DNA, 20 bp, Artificial Sequence
  chemically synthesized
ggagacctacttcagtccat

SEQ ID NO: 589980 - DNA, 20 bp, Artificial Sequence
  chemically synthesized
cctcaaccccattcatatgt

SEQ ID NO: 589981 - DNA, 20 bp, Artificial Sequence
  chemically synthesized
tttatgaggacattagactt

SEQ ID NO: 589982 - DNA, 20 bp, Artificial Sequence
  chemically synthesized
tttctggtgagtcctccccc

SEQ ID NO: 589983 - DNA, 20 bp, Artificial Sequence
  chemically synthesized
aagattaaggtgatgacagg

SEQ ID NO: 589984 - DNA, 20 bp, Artificial Sequence
  chemically synthesized
cagttccggaagttgaacgt

SEQ ID NO: 589985 - DNA, 20 bp, Artificial Sequence
  chemically synthesized
aactgcaagaaatacatttc

SEQ ID NO: 589986 - DNA, 20 bp, Artificial Sequence
  chemically synthesized
tgttgcttaagccacccagt

SEQ ID NO: 589987 - DNA, 20 bp, Artificial Sequence
  chemically synthesized
agcaaggtaaacacccactg

SEQ ID NO: 589988 - DNA, 20 bp, Artificial Sequence
  chemically synthesized
agccacccagtgggtgttta

SEQ ID NO: 589989 - DNA, 20 bp, Artificial Sequence
  chemically synthesized
taattattaattggcattac

SEQ ID NO: 589990 - DNA, 20 bp, Artificial Sequence
  chemically synthesized
tacacttactgggtcaattc

SEQ ID NO: 589991 - DNA, 20 bp, Artificial Sequence
  chemically synthesized
attgacccagtaagtgtaat

SEQ ID NO: 589992 - DNA, 20 bp, Artificial Sequence
  chemically synthesized
gtttgtattgtttacataag

SEQ ID NO: 589993 - DNA, 20 bp, Artificial Sequence
  chemically synthesized
ctaaatgagctaagggtttg

SEQ ID NO: 589994 - DNA, 20 bp, Artificial Sequence
  chemically synthesized
caatacaaacccttagctca

SEQ ID NO: 589995 - DNA, 20 bp, Artificial Sequence
  chemically synthesized
ggagccaatctaaatgagct

SEQ ID NO: 589996 - DNA, 20 bp, Artificial Sequence
  chemically synthesized
atatttgctatgtaagtgat

SEQ ID NO: 589997 - DNA, 20 bp, Artificial Sequence
  chemically synthesized
atgcacacataaatagaaat

SEQ ID NO: 589998 - DNA, 20 bp, Artificial Sequence
  chemically synthesized
gggtatgcacacataaatag

SEQ ID NO: 589999 - DNA, 20 bp, Artificial Sequence
  chemically synthesized
tcttgtatatgttttatagt

SEQ ID NO: 590000 - DNA, 20 bp, Artificial Sequence
  chemically synthesized
caacacacatgtgttcttgt

SEQ ID NO: 590001 - DNA, 20 bp, Artificial Sequence
  chemically synthesized
atacaagaacacatgtgtgt

SEQ ID NO: 590002 - DNA, 20 bp, Artificial Sequence
  chemically synthesized
tatggacatttgggttgttt

SEQ ID NO: 590003 - DNA, 20 bp, Artificial Sequence
  chemically synthesized
tacatgcgtatggacatttg

SEQ ID NO: 590004 - DNA, 20 bp, Artificial Sequence
  chemically synthesized
tgaattcttttctctcaata

SEQ ID NO: 590005 - DNA, 20 bp, Artificial Sequence
  chemically synthesized
tgagagaaaagaattcacag

SEQ ID NO: 590006 - DNA, 20 bp, Artificial Sequence
  chemically synthesized
gagtagctagttttagtttg

SEQ ID NO: 590007 - DNA, 20 bp, Artificial Sequence
  chemically synthesized
atctttaaagagtagctagt

SEQ ID NO: 590008 - DNA, 20 bp, Artificial Sequence
  chemically synthesized
atttgtatctttaaagagta

SEQ ID NO: 590009 - DNA, 20 bp, Artificial Sequence
  chemically synthesized
tacaaatacaggtgttgaac

SEQ ID NO: 590010 - DNA, 20 bp, Artificial Sequence
  chemically synthesized
tacgttttttaaaaaatgag

SEQ ID NO: 590011 - DNA, 20 bp, Artificial Sequence
  chemically synthesized
tttggctctggggggaagga

SEQ ID NO: 590012 - DNA, 20 bp, Artificial Sequence
  chemically synthesized
gattagcaaggggtaacata

SEQ ID NO: 590013 - DNA, 20 bp, Artificial Sequence
  chemically synthesized
aacatctgtgttccaacatt

SEQ ID NO: 590014 - DNA, 20 bp, Artificial Sequence
  chemically synthesized
tggctaccgtgttggacagc

SEQ ID NO: 590015 - DNA, 20 bp, Artificial Sequence
  chemically synthesized
gccataaatgtaaaatatac

SEQ ID NO: 590016 - DNA, 20 bp, Artificial Sequence
  chemically synthesized
tacataattagtaattttta

SEQ ID NO: 590017 - DNA, 20 bp, Artificial Sequence
  chemically synthesized
ttgattacatatttaaataa

SEQ ID NO: 590018 - DNA, 20 bp, Artificial Sequence
  chemically synthesized
gtatcctattacattaattt

SEQ ID NO: 590019 - DNA, 20 bp, Artificial Sequence
  chemically synthesized
aatataatgtgagtcaaata

SEQ ID NO: 590020 - DNA, 20 bp, Artificial Sequence
  chemically synthesized
ccactttaaacactccctgt

SEQ ID NO: 590021 - DNA, 20 bp, Artificial Sequence
  chemically synthesized
acaatataaacgtttacagg

SEQ ID NO: 590022 - DNA, 20 bp, Artificial Sequence
  chemically synthesized
tatgaaatatatcacaatat

SEQ ID NO: 590023 - DNA, 20 bp, Artificial Sequence
  chemically synthesized
tgttaattgtataataaaat

SEQ ID NO: 590024 - DNA, 20 bp, Artificial Sequence
  chemically synthesized
tttatccttaagggtgaaaa

SEQ ID NO: 590025 - DNA, 20 bp, Artificial Sequence
  chemically synthesized
tcacccttaaggataaaagg

SEQ ID NO: 590026 - DNA, 20 bp, Artificial Sequence
  chemically synthesized
agttttataagttccattga

SEQ ID NO: 590027 - DNA, 20 bp, Artificial Sequence
  chemically synthesized
tgacttacttagaaggtgtc

SEQ ID NO: 590028 - DNA, 20 bp, Artificial Sequence
  chemically synthesized
aaccacatctcattgctttt

SEQ ID NO: 590029 - DNA, 20 bp, Artificial Sequence
  chemically synthesized
tgttgaaattaaccacatct

SEQ ID NO: 590030 - DNA, 20 bp, Artificial Sequence
  chemically synthesized
ttttagagcagattttaaaa

SEQ ID NO: 590031 - DNA, 20 bp, Artificial Sequence
  chemically synthesized
ccccttttctggatttttag

SEQ ID NO: 590032 - DNA, 20 bp, Artificial Sequence
  chemically synthesized
ctaaaaatccagaaaagggg

SEQ ID NO: 590033 - DNA, 20 bp, Artificial Sequence
  chemically synthesized
gggaaaatccaggccccttt

SEQ ID NO: 590034 - DNA, 20 bp, Artificial Sequence
  chemically synthesized
ttcaatatatcaactcacca

SEQ ID NO: 590035 - DNA, 20 bp, Artificial Sequence
  chemically synthesized
atattaagatttcattgaat

SEQ ID NO: 590036 - DNA, 20 bp, Artificial Sequence
  chemically synthesized
acttgtccacgtaggctata

SEQ ID NO: 590037 - DNA, 20 bp, Artificial Sequence
  chemically synthesized
agcatagcaacgatacaatt

SEQ ID NO: 590038 - DNA, 20 bp, Artificial Sequence
  chemically synthesized
gtagcttccctaattattga

SEQ ID NO: 590039 - DNA, 20 bp, Artificial Sequence
  chemically synthesized
aatttttaatataggcattc

SEQ ID NO: 590040 - DNA, 20 bp, Artificial Sequence
  chemically synthesized
tctgctttgcaaattgtatg

SEQ ID NO: 590041 - DNA, 20 bp, Artificial Sequence
  chemically synthesized
aatgctaaattatgtaattt

SEQ ID NO: 590042 - DNA, 20 bp, Artificial Sequence
  chemically synthesized
gtatgaatatctaatggcct

SEQ ID NO: 590043 - DNA, 20 bp, Artificial Sequence
  chemically synthesized
gtacatgacattctgactct

SEQ ID NO: 590044 - DNA, 20 bp, Artificial Sequence
  chemically synthesized
ttccagtgtcaactgataaa

SEQ ID NO: 590045 - DNA, 20 bp, Artificial Sequence
  chemically synthesized
atatatgtatgtgtgtatac

SEQ ID NO: 590046 - DNA, 20 bp, Artificial Sequence
  chemically synthesized
atacatatatcttctgtctt

SEQ ID NO: 590047 - DNA, 20 bp, Artificial Sequence
  chemically synthesized
tcttctgtctttatagttta

SEQ ID NO: 590048 - DNA, 20 bp, Artificial Sequence
  chemically synthesized
tggcctgatcaaaattcatt

SEQ ID NO: 590049 - DNA, 20 bp, Artificial Sequence
  chemically synthesized
tgcaatatatgacattgttt

SEQ ID NO: 590050 - DNA, 20 bp, Artificial Sequence
  chemically synthesized
tccttttttgcaatatatga

SEQ ID NO: 590051 - DNA, 20 bp, Artificial Sequence
  chemically synthesized
acaatgtcatatattgcaaa

SEQ ID NO: 590052 - DNA, 20 bp, Artificial Sequence
  chemically synthesized
gtcatatattgcaaaaaagg

SEQ ID NO: 590053 - DNA, 20 bp, Artificial Sequence
  chemically synthesized
tattgcaaaaaaggatttgt

SEQ ID NO: 590054 - DNA, 20 bp, Artificial Sequence
  chemically synthesized
agaggattataccgagttct

SEQ ID NO: 590055 - DNA, 20 bp, Artificial Sequence
  chemically synthesized
agaaaaaaaaaaaaaaaaaa

SEQ ID NO: 590056 - DNA, 20 bp, Artificial Sequence
  chemically synthesized
tttttttttttcttctgaga

SEQ ID NO: 590057 - DNA, 20 bp, Artificial Sequence
  chemically synthesized
aatcacttgaacccgggagg

SEQ ID NO: 590058 - DNA, 20 bp, Artificial Sequence
  chemically synthesized
aaactccgcctcccgggttc

SEQ ID NO: 590059 - DNA, 20 bp, Artificial Sequence
  chemically synthesized
tacctcagcctcccgagtag

SEQ ID NO: 590060 - DNA, 20 bp, Artificial Sequence
  chemically synthesized
ggcgggcggatcatgaggtc

SEQ ID NO: 590061 - DNA, 20 bp, Artificial Sequence
  chemically synthesized
cgcctcggcctcctgaagcg

SEQ ID NO: 590062 - DNA, 20 bp, Artificial Sequence
  chemically synthesized
gtagctcatgcctgtaatct

SEQ ID NO: 590063 - DNA, 20 bp, Artificial Sequence
  chemically synthesized
aaaatttctaacttatgaac

SEQ ID NO: 590064 - DNA, 20 bp, Artificial Sequence
  chemically synthesized
aataactatgctatcacttt

SEQ ID NO: 590065 - DNA, 20 bp, Artificial Sequence
  chemically synthesized
gacctggggggtattatcat

SEQ ID NO: 590066 - DNA, 20 bp, Artificial Sequence
  chemically synthesized
ggtagaacagcagaactaat

SEQ ID NO: 590067 - DNA, 20 bp, Artificial Sequence
  chemically synthesized
atttagaggtctcactcaaa

SEQ ID NO: 590068 - DNA, 20 bp, Artificial Sequence
  chemically synthesized
tgcttttctgtttttgtaag

SEQ ID NO: 590069 - DNA, 20 bp, Artificial Sequence
  chemically synthesized
aaataaaatattttttgctt

SEQ ID NO: 590070 - DNA, 20 bp, Artificial Sequence
  chemically synthesized
aacattataaataaaatatt

SEQ ID NO: 590071 - DNA, 20 bp, Artificial Sequence
  chemically synthesized
ccaccattaatgggcaccta

SEQ ID NO: 590072 - DNA, 20 bp, Artificial Sequence
  chemically synthesized
gttgcacaggccatgatttt

SEQ ID NO: 590073 - DNA, 20 bp, Artificial Sequence
  chemically synthesized
catccatgttgttgcacagg

SEQ ID NO: 590074 - DNA, 20 bp, Artificial Sequence
  chemically synthesized
cgttgtctgttcctgcgtta

SEQ ID NO: 590075 - DNA, 20 bp, Artificial Sequence
  chemically synthesized
agacaacgagtactgcatgt

SEQ ID NO: 590076 - DNA, 20 bp, Artificial Sequence
  chemically synthesized
tctttatgtccatgtgcact

SEQ ID NO: 590077 - DNA, 20 bp, Artificial Sequence
  chemically synthesized
ctggatatagtgcatgatga

SEQ ID NO: 590078 - DNA, 20 bp, Artificial Sequence
  chemically synthesized
tttataatttcaacttttat

SEQ ID NO: 590079 - DNA, 20 bp, Artificial Sequence
  chemically synthesized
gtttccaaagaatgttagta

SEQ ID NO: 590080 - DNA, 20 bp, Artificial Sequence
  chemically synthesized
tacttttaataatttcattt

SEQ ID NO: 590081 - DNA, 20 bp, Artificial Sequence
  chemically synthesized
atgatgatcatgcatgtgta

SEQ ID NO: 590082 - DNA, 20 bp, Artificial Sequence
  chemically synthesized
cgccttggcctcccacagtg

SEQ ID NO: 590083 - DNA, 20 bp, Artificial Sequence
  chemically synthesized
ttttgtgttttcagtagaga

SEQ ID NO: 590084 - DNA, 20 bp, Artificial Sequence
  chemically synthesized
ccaccatgcctggctaattt

SEQ ID NO: 590085 - DNA, 20 bp, Artificial Sequence
  chemically synthesized
cctctgcccccaccaggttc

SEQ ID NO: 590086 - DNA, 20 bp, Artificial Sequence
  chemically synthesized
ggggcagaggttacagtcag

SEQ ID NO: 590087 - DNA, 20 bp, Artificial Sequence
  chemically synthesized
ttttttttttttttttgaga

SEQ ID NO: 590088 - DNA, 20 bp, Artificial Sequence
  chemically synthesized
agtaaaataatatattcttt

SEQ ID NO: 590089 - DNA, 20 bp, Artificial Sequence
  chemically synthesized
aaatagtaaaataatatatt

SEQ ID NO: 590090 - DNA, 20 bp, Artificial Sequence
  chemically synthesized
atatgttatgctgcctatcc

SEQ ID NO: 590091 - DNA, 20 bp, Artificial Sequence
  chemically synthesized
caagacagtggctctagtgt

SEQ ID NO: 590092 - DNA, 20 bp, Artificial Sequence
  chemically synthesized
ataataataaaacctgtcct

SEQ ID NO: 590093 - DNA, 20 bp, Artificial Sequence
  chemically synthesized
catcacaacaatcccacagg

SEQ ID NO: 590094 - DNA, 20 bp, Artificial Sequence
  chemically synthesized
cctgtcctgtgggattgttg

SEQ ID NO: 590095 - DNA, 20 bp, Artificial Sequence
  chemically synthesized
atgatgcctaagtgttgtag

SEQ ID NO: 590096 - DNA, 20 bp, Artificial Sequence
  chemically synthesized
actacaacacttaggcatca

SEQ ID NO: 590097 - DNA, 20 bp, Artificial Sequence
  chemically synthesized
atccctcataaagtggggct

SEQ ID NO: 590098 - DNA, 20 bp, Artificial Sequence
  chemically synthesized
acacatgatccctcataaag

SEQ ID NO: 590099 - DNA, 20 bp, Artificial Sequence
  chemically synthesized
atcatgtgtccaagaagaac

SEQ ID NO: 590100 - DNA, 20 bp, Artificial Sequence
  chemically synthesized
ttcaaatatctttttggttg

SEQ ID NO: 590101 - DNA, 20 bp, Artificial Sequence
  chemically synthesized
accaggttcaactaaatgca

SEQ ID NO: 590102 - DNA, 20 bp, Artificial Sequence
  chemically synthesized
gtagcctcaagtcctcatgt

SEQ ID NO: 590103 - DNA, 20 bp, Artificial Sequence
  chemically synthesized
ctctgttctacttgatattg

SEQ ID NO: 590104 - DNA, 20 bp, Artificial Sequence
  chemically synthesized
catgttctttgttgccttat

SEQ ID NO: 590105 - DNA, 20 bp, Artificial Sequence
  chemically synthesized
agaacatgtataaggatgca

SEQ ID NO: 590106 - DNA, 20 bp, Artificial Sequence
  chemically synthesized
tacgaagtcaaatgcaagat

SEQ ID NO: 590107 - DNA, 20 bp, Artificial Sequence
  chemically synthesized
taagtgatacgaagtcaaat

SEQ ID NO: 590108 - DNA, 20 bp, Artificial Sequence
  chemically synthesized
ttttaaattaaaatagttct

SEQ ID NO: 590109 - DNA, 20 bp, Artificial Sequence
  chemically synthesized
tactaaacctatttttaata

SEQ ID NO: 590110 - DNA, 20 bp, Artificial Sequence
  chemically synthesized
taaaaatcctactattaaaa

SEQ ID NO: 590111 - DNA, 20 bp, Artificial Sequence
  chemically synthesized
gatgacaaccactagccgca

SEQ ID NO: 590112 - DNA, 20 bp, Artificial Sequence
  chemically synthesized
aatttttatttaatattaaa

SEQ ID NO: 590113 - DNA, 20 bp, Artificial Sequence
  chemically synthesized
cacaaagttatattggacat

SEQ ID NO: 590114 - DNA, 20 bp, Artificial Sequence
  chemically synthesized
aaacccatgtagtattttgc

SEQ ID NO: 590115 - DNA, 20 bp, Artificial Sequence
  chemically synthesized
aagcaatagcaaaatactac

SEQ ID NO: 590116 - DNA, 20 bp, Artificial Sequence
  chemically synthesized
cctccagagaattacattta

SEQ ID NO: 590117 - DNA, 20 bp, Artificial Sequence
  chemically synthesized
cttctcttaaagtgtctgca

SEQ ID NO: 590118 - DNA, 20 bp, Artificial Sequence
  chemically synthesized
catgaaggtgctaactctga

SEQ ID NO: 590119 - DNA, 20 bp, Artificial Sequence
  chemically synthesized
taatgacagttgtccaccaa

SEQ ID NO: 590120 - DNA, 20 bp, Artificial Sequence
  chemically synthesized
ctcacttgttcttcatgtaa

SEQ ID NO: 590121 - DNA, 20 bp, Artificial Sequence
  chemically synthesized
ttaggatttcagagtttacg

SEQ ID NO: 590122 - DNA, 20 bp, Artificial Sequence
  chemically synthesized
gtaacatttgtttaggattt

SEQ ID NO: 590123 - DNA, 20 bp, Artificial Sequence
  chemically synthesized
tcataataagtaacatttgt

SEQ ID NO: 590124 - DNA, 20 bp, Artificial Sequence
  chemically synthesized
aaatgatcataataagtaac

SEQ ID NO: 590125 - DNA, 20 bp, Artificial Sequence
  chemically synthesized
caaatgctttaactgtgaca

SEQ ID NO: 590126 - DNA, 20 bp, Artificial Sequence
  chemically synthesized
ccacaaatgtgccttatctc

SEQ ID NO: 590127 - DNA, 20 bp, Artificial Sequence
  chemically synthesized
tggtccaaagactccagggc

SEQ ID NO: 590128 - DNA, 20 bp, Artificial Sequence
  chemically synthesized
tttatatctgaattataaag

SEQ ID NO: 590129 - DNA, 20 bp, Artificial Sequence
  chemically synthesized
actgagacatttattttgac

SEQ ID NO: 590130 - DNA, 20 bp, Artificial Sequence
  chemically synthesized
tatgcttctaagtggcagct

SEQ ID NO: 590131 - DNA, 20 bp, Artificial Sequence
  chemically synthesized
taaaacttcgtgaagtttta

SEQ ID NO: 590132 - DNA, 20 bp, Artificial Sequence
  chemically synthesized
agaagcatattaaaacttca

SEQ ID NO: 590133 - DNA, 20 bp, Artificial Sequence
  chemically synthesized
tagcatgttgtaaaacttcg

SEQ ID NO: 590134 - DNA, 20 bp, Artificial Sequence
  chemically synthesized
agttttacaacatgctaatt

SEQ ID NO: 590135 - DNA, 20 bp, Artificial Sequence
  chemically synthesized
acatgctaatttaatgcttt

SEQ ID NO: 590136 - DNA, 20 bp, Artificial Sequence
  chemically synthesized
gctttattagcttatttcat

SEQ ID NO: 590137 - DNA, 20 bp, Artificial Sequence
  chemically synthesized
aaattaagtcccattgtgga

SEQ ID NO: 590138 - DNA, 20 bp, Artificial Sequence
  chemically synthesized
taatttccaaatttaaatgt

SEQ ID NO: 590139 - DNA, 20 bp, Artificial Sequence
  chemically synthesized
gtttagtaacactgatatat

SEQ ID NO: 590140 - DNA, 20 bp, Artificial Sequence
  chemically synthesized
tctatatatgtttttgtctt

SEQ ID NO: 590141 - DNA, 20 bp, Artificial Sequence
  chemically synthesized
attaattttcaattctctat

SEQ ID NO: 590142 - DNA, 20 bp, Artificial Sequence
  chemically synthesized
aattaatgtagttcagctgc

SEQ ID NO: 590143 - DNA, 20 bp, Artificial Sequence
  chemically synthesized
aaagtgttttatgaataata

SEQ ID NO: 590144 - DNA, 20 bp, Artificial Sequence
  chemically synthesized
atttagtctctacaattgaa

SEQ ID NO: 590145 - DNA, 20 bp, Artificial Sequence
  chemically synthesized
ctaaattattttcctcctaa

SEQ ID NO: 590146 - DNA, 20 bp, Artificial Sequence
  chemically synthesized
tatgtttctttctccccttt

SEQ ID NO: 590147 - DNA, 20 bp, Artificial Sequence
  chemically synthesized
caaagagatcccacaatttt

SEQ ID NO: 590148 - DNA, 20 bp, Artificial Sequence
  chemically synthesized
aatgggcattcccatctgca

SEQ ID NO: 590149 - DNA, 20 bp, Artificial Sequence
  chemically synthesized
tgaattactgggtagagaaa

SEQ ID NO: 590150 - DNA, 20 bp, Artificial Sequence
  chemically synthesized
ggactctgagtccttccatt

SEQ ID NO: 590151 - DNA, 20 bp, Artificial Sequence
  chemically synthesized
tggggctgggaaatgtagtt

SEQ ID NO: 590152 - DNA, 20 bp, Artificial Sequence
  chemically synthesized
acacttgtctctgccacaac

SEQ ID NO: 590153 - DNA, 20 bp, Artificial Sequence
  chemically synthesized
tctctctctccccagccttc

SEQ ID NO: 590154 - DNA, 20 bp, Artificial Sequence
  chemically synthesized
caggacttactttgtcttct

SEQ ID NO: 590155 - DNA, 20 bp, Artificial Sequence
  chemically synthesized
agtaagtcctggcagagaaa

SEQ ID NO: 590156 - DNA, 20 bp, Artificial Sequence
  chemically synthesized
gaattcctttcttctttaca

SEQ ID NO: 590157 - DNA, 20 bp, Artificial Sequence
  chemically synthesized
attcttgaagttggggacac

SEQ ID NO: 590158 - DNA, 20 bp, Artificial Sequence
  chemically synthesized
tggggacactagagattatc

SEQ ID NO: 590159 - DNA, 20 bp, Artificial Sequence
  chemically synthesized
ttatttttccctgcatcaaa

SEQ ID NO: 590160 - DNA, 20 bp, Artificial Sequence
  chemically synthesized
aaggggtattaggaaagaat

SEQ ID NO: 590161 - DNA, 20 bp, Artificial Sequence
  chemically synthesized
tggattctttcctaataccc

SEQ ID NO: 590162 - DNA, 20 bp, Artificial Sequence
  chemically synthesized
accctgaactacagtcttaa

SEQ ID NO: 590163 - DNA, 20 bp, Artificial Sequence
  chemically synthesized
ctcaagttcaagggactcca

SEQ ID NO: 590164 - DNA, 20 bp, Artificial Sequence
  chemically synthesized
cccttgaacttgagagatcc

SEQ ID NO: 590165 - DNA, 20 bp, Artificial Sequence
  chemically synthesized
tcctcaagagaagatggatg

SEQ ID NO: 590166 - DNA, 20 bp, Artificial Sequence
  chemically synthesized
caacttgttctttcatctac

SEQ ID NO: 590167 - DNA, 20 bp, Artificial Sequence
  chemically synthesized
tgtatccataacttccggcc

SEQ ID NO: 590168 - DNA, 20 bp, Artificial Sequence
  chemically synthesized
tcccttgcttaaagacccac

SEQ ID NO: 590169 - DNA, 20 bp, Artificial Sequence
  chemically synthesized
caaatatgaccttataactc

SEQ ID NO: 590170 - DNA, 20 bp, Artificial Sequence
  chemically synthesized
tagcctgcaccttctacctg

SEQ ID NO: 590171 - DNA, 20 bp, Artificial Sequence
  chemically synthesized
aaactctcttgaatttatcc

SEQ ID NO: 590172 - DNA, 20 bp, Artificial Sequence
  chemically synthesized
aaacaagtggataaattcaa

SEQ ID NO: 590173 - DNA, 20 bp, Artificial Sequence
  chemically synthesized
ataaattcaagagagtttat

SEQ ID NO: 590174 - DNA, 20 bp, Artificial Sequence
  chemically synthesized
gcggggttcttcttttgctt

SEQ ID NO: 590175 - DNA, 20 bp, Artificial Sequence
  chemically synthesized
accatcgagcggggttcttc

SEQ ID NO: 590176 - DNA, 20 bp, Artificial Sequence
  chemically synthesized
aaccccgctcgatggtaggg

SEQ ID NO: 590177 - DNA, 20 bp, Artificial Sequence
  chemically synthesized
ggtaggggaaagcttgtgag

SEQ ID NO: 590178 - DNA, 20 bp, Artificial Sequence
  chemically synthesized
taagatcaaaaactcagctc

SEQ ID NO: 590179 - DNA, 20 bp, Artificial Sequence
  chemically synthesized
tcttccagacttgtatatgc

SEQ ID NO: 590180 - DNA, 20 bp, Artificial Sequence
  chemically synthesized
tttggtcatcctcatccatt

SEQ ID NO: 590181 - DNA, 20 bp, Artificial Sequence
  chemically synthesized
cctttaatattcctcaaaaa

SEQ ID NO: 590182 - DNA, 20 bp, Artificial Sequence
  chemically synthesized
cagaaaatgggctcaaaaag

SEQ ID NO: 590183 - DNA, 20 bp, Artificial Sequence
  chemically synthesized
cagtacatgttcattcaaca

SEQ ID NO: 590184 - DNA, 20 bp, Artificial Sequence
  chemically synthesized
tgccttccttcttaagggaa

SEQ ID NO: 590185 - DNA, 20 bp, Artificial Sequence
  chemically synthesized
acctgacaaatgttttttag

SEQ ID NO: 590186 - DNA, 20 bp, Artificial Sequence
  chemically synthesized
tcagcactaaaaaacatttg

SEQ ID NO: 590187 - DNA, 20 bp, Artificial Sequence
  chemically synthesized
ttcttgttgccaaacctgac

SEQ ID NO: 590188 - DNA, 20 bp, Artificial Sequence
  chemically synthesized
tatatgcagagacttccatc

SEQ ID NO: 590189 - DNA, 20 bp, Artificial Sequence
  chemically synthesized
ggatgaagaaaaagaaagtg

SEQ ID NO: 590190 - DNA, 20 bp, Artificial Sequence
  chemically synthesized
tgtgaggatgaagaaaaaga

SEQ ID NO: 590191 - DNA, 20 bp, Artificial Sequence
  chemically synthesized
attttcattttagaaagtca

SEQ ID NO: 590192 - DNA, 20 bp, Artificial Sequence
  chemically synthesized
cttttgatgatttacacaat

SEQ ID NO: 590193 - DNA, 20 bp, Artificial Sequence
  chemically synthesized
ttaatattattatagacttt

SEQ ID NO: 590194 - DNA, 20 bp, Artificial Sequence
  chemically synthesized
agtctataataatattaatg

SEQ ID NO: 590195 - DNA, 20 bp, Artificial Sequence
  chemically synthesized
tgggggaaataaggcaattc

SEQ ID NO: 590196 - DNA, 20 bp, Artificial Sequence
  chemically synthesized
cttatttcccccaacaaccc

SEQ ID NO: 590197 - DNA, 20 bp, Artificial Sequence
  chemically synthesized
taatttactatccgtgaacc

SEQ ID NO: 590198 - DNA, 20 bp, Artificial Sequence
  chemically synthesized
ttcatctctatcatcttccc

SEQ ID NO: 590199 - DNA, 20 bp, Artificial Sequence
  chemically synthesized
aaaatctctagattggtact

SEQ ID NO: 590200 - DNA, 20 bp, Artificial Sequence
  chemically synthesized
ttaagctccaagtaccaatc

SEQ ID NO: 590201 - DNA, 20 bp, Artificial Sequence
  chemically synthesized
aggaattaattataaaaatc

SEQ ID NO: 590202 - DNA, 20 bp, Artificial Sequence
  chemically synthesized
atatttttgcatgaggtcgg

SEQ ID NO: 590203 - DNA, 20 bp, Artificial Sequence
  chemically synthesized
acattttcaattgtatcttg

SEQ ID NO: 590204 - DNA, 20 bp, Artificial Sequence
  chemically synthesized
aattacattttcaattgtat

SEQ ID NO: 590205 - DNA, 20 bp, Artificial Sequence
  chemically synthesized
ttatgttatattctgttttg

SEQ ID NO: 590206 - DNA, 20 bp, Artificial Sequence
  chemically synthesized
tgttgattatttatgttata

SEQ ID NO: 590207 - DNA, 20 bp, Artificial Sequence
  chemically synthesized
gtctatcttattgcctatgg

SEQ ID NO: 590208 - DNA, 20 bp, Artificial Sequence
  chemically synthesized
tttcaatatttctacctcat

SEQ ID NO: 590209 - DNA, 20 bp, Artificial Sequence
  chemically synthesized
acttactgtgatcttctaga

SEQ ID NO: 590210 - DNA, 20 bp, Artificial Sequence
  chemically synthesized
tgtgctgggtcctaggagga

SEQ ID NO: 590211 - DNA, 20 bp, Artificial Sequence
  chemically synthesized
acaacacgtaataaatgctg

SEQ ID NO: 590212 - DNA, 20 bp, Artificial Sequence
  chemically synthesized
cttgggaagtgctgacacaa

SEQ ID NO: 590213 - DNA, 20 bp, Artificial Sequence
  chemically synthesized
ttaatttctttcagttctgg

SEQ ID NO: 590214 - DNA, 20 bp, Artificial Sequence
  chemically synthesized
agacaaccagatggttatga

SEQ ID NO: 590215 - DNA, 20 bp, Artificial Sequence
  chemically synthesized
ttctgtgctgctaaacaaac

SEQ ID NO: 590216 - DNA, 20 bp, Artificial Sequence
  chemically synthesized
aaaacaaattaaaaacagaa

SEQ ID NO: 590217 - DNA, 20 bp, Artificial Sequence
  chemically synthesized
taaacaaacttctgttttta

SEQ ID NO: 590218 - DNA, 20 bp, Artificial Sequence
  chemically synthesized
tagcaaaacaaattaaaaac

SEQ ID NO: 590219 - DNA, 20 bp, Artificial Sequence
  chemically synthesized
gactaacattttcctcatga

SEQ ID NO: 590220 - DNA, 20 bp, Artificial Sequence
  chemically synthesized
ggataatgagcacaatgtca

SEQ ID NO: 590221 - DNA, 20 bp, Artificial Sequence
  chemically synthesized
tgacattgtgctcattatcc

SEQ ID NO: 590222 - DNA, 20 bp, Artificial Sequence
  chemically synthesized
agaaatgcatttctatgtct

SEQ ID NO: 590223 - DNA, 20 bp, Artificial Sequence
  chemically synthesized
tgagacgtggatttatcgtc

SEQ ID NO: 590224 - DNA, 20 bp, Artificial Sequence
  chemically synthesized
gcttagagcaaattctgaga

SEQ ID NO: 590225 - DNA, 20 bp, Artificial Sequence
  chemically synthesized
cataactccgtcatctcctc

SEQ ID NO: 590226 - DNA, 20 bp, Artificial Sequence
  chemically synthesized
ttctcaagaagtctgcacat

SEQ ID NO: 590227 - DNA, 20 bp, Artificial Sequence
  chemically synthesized
atatctttgactttgatttt

SEQ ID NO: 590228 - DNA, 20 bp, Artificial Sequence
  chemically synthesized
tcaacattttatatctttga

SEQ ID NO: 590229 - DNA, 20 bp, Artificial Sequence
  chemically synthesized
tctcatagctaatgtcaggt

SEQ ID NO: 590230 - DNA, 20 bp, Artificial Sequence
  chemically synthesized
catttctcatagctaatgtc

SEQ ID NO: 590231 - DNA, 20 bp, Artificial Sequence
  chemically synthesized
cacctgacattagctatgag

SEQ ID NO: 590232 - DNA, 20 bp, Artificial Sequence
  chemically synthesized
tgtttatggcaaacactgat

SEQ ID NO: 590233 - DNA, 20 bp, Artificial Sequence
  chemically synthesized
tgttgggagaaagcgaggat

SEQ ID NO: 590234 - DNA, 20 bp, Artificial Sequence
  chemically synthesized
acaacaaataacaattagat

SEQ ID NO: 590235 - DNA, 20 bp, Artificial Sequence
  chemically synthesized
tgaaataagtcttgctcatg

SEQ ID NO: 590236 - DNA, 20 bp, Artificial Sequence
  chemically synthesized
gctattgaaataagtcttgc

SEQ ID NO: 590237 - DNA, 20 bp, Artificial Sequence
  chemically synthesized
aatgaatggaggaggaatga

SEQ ID NO: 590238 - DNA, 20 bp, Artificial Sequence
  chemically synthesized
agacatgtaagagaattatt

SEQ ID NO: 590239 - DNA, 20 bp, Artificial Sequence
  chemically synthesized
cttacatgtctgcctccttc

SEQ ID NO: 590240 - DNA, 20 bp, Artificial Sequence
  chemically synthesized
aacacctaatatggaccaga

SEQ ID NO: 590241 - DNA, 20 bp, Artificial Sequence
  chemically synthesized
tcacatggacagaaattttt

SEQ ID NO: 590242 - DNA, 20 bp, Artificial Sequence
  chemically synthesized
catcccccattacttgaagt

SEQ ID NO: 590243 - DNA, 20 bp, Artificial Sequence
  chemically synthesized
tgatgtaaatttggcattga

SEQ ID NO: 590244 - DNA, 20 bp, Artificial Sequence
  chemically synthesized
taaatttggcattgaagagg

SEQ ID NO: 590245 - DNA, 20 bp, Artificial Sequence
  chemically synthesized
aaggtcatagagctagaaaa

SEQ ID NO: 590246 - DNA, 20 bp, Artificial Sequence
  chemically synthesized
caatttataaataagacagc

SEQ ID NO: 590247 - DNA, 20 bp, Artificial Sequence
  chemically synthesized
taataccttatagcatggct

SEQ ID NO: 590248 - DNA, 20 bp, Artificial Sequence
  chemically synthesized
atggcctaataaaaaagtag

SEQ ID NO: 590249 - DNA, 20 bp, Artificial Sequence
  chemically synthesized
gtagctaagctttactgtat

SEQ ID NO: 590250 - DNA, 20 bp, Artificial Sequence
  chemically synthesized
actataaaacaggtatacag

SEQ ID NO: 590251 - DNA, 20 bp, Artificial Sequence
  chemically synthesized
cctgttttatagtagcactg

SEQ ID NO: 590252 - DNA, 20 bp, Artificial Sequence
  chemically synthesized
acctatcttgaagacttgtt

SEQ ID NO: 590253 - DNA, 20 bp, Artificial Sequence
  chemically synthesized
acaacaagtcttcaagatag

SEQ ID NO: 590254 - DNA, 20 bp, Artificial Sequence
  chemically synthesized
gaagagctagaatttaaaca

SEQ ID NO: 590255 - DNA, 20 bp, Artificial Sequence
  chemically synthesized
gcagatgttgcaattaaact

SEQ ID NO: 590256 - DNA, 20 bp, Artificial Sequence
  chemically synthesized
tcactgggctctactctgta

SEQ ID NO: 590257 - DNA, 20 bp, Artificial Sequence
  chemically synthesized
ctgtttttgattaatttgag

SEQ ID NO: 590258 - DNA, 20 bp, Artificial Sequence
  chemically synthesized
agaatccctttgtttactgt

SEQ ID NO: 590259 - DNA, 20 bp, Artificial Sequence
  chemically synthesized
ttaatcaaaaacagtaaaca

SEQ ID NO: 590260 - DNA, 20 bp, Artificial Sequence
  chemically synthesized
accagtagaatccctttgtt

SEQ ID NO: 590261 - DNA, 20 bp, Artificial Sequence
  chemically synthesized
gacgtgaaccagtagaatcc

SEQ ID NO: 590262 - DNA, 20 bp, Artificial Sequence
  chemically synthesized
cttcacttgcagcccccttc

SEQ ID NO: 590263 - DNA, 20 bp, Artificial Sequence
  chemically synthesized
gagagatatggagcaggacc

SEQ ID NO: 590264 - DNA, 20 bp, Artificial Sequence
  chemically synthesized
aaatcaaggagacctactgc

SEQ ID NO: 590265 - DNA, 20 bp, Artificial Sequence
  chemically synthesized
gaaacctttgcagtaggtct

SEQ ID NO: 590266 - DNA, 20 bp, Artificial Sequence
  chemically synthesized
gtcatctttgaacctgttac

SEQ ID NO: 590267 - DNA, 20 bp, Artificial Sequence
  chemically synthesized
ggttcatctgggcctgaggt

SEQ ID NO: 590268 - DNA, 20 bp, Artificial Sequence
  chemically synthesized
agagattcccttggtgaata

SEQ ID NO: 590269 - DNA, 20 bp, Artificial Sequence
  chemically synthesized
aaactatattgactgtgtga

SEQ ID NO: 590270 - DNA, 20 bp, Artificial Sequence
  chemically synthesized
aatctctctcacacagtcaa

SEQ ID NO: 590271 - DNA, 20 bp, Artificial Sequence
  chemically synthesized
actgtctacaaatatgtgag

SEQ ID NO: 590272 - DNA, 20 bp, Artificial Sequence
  chemically synthesized
gaatgaatattactacatga

SEQ ID NO: 590273 - DNA, 20 bp, Artificial Sequence
  chemically synthesized
acgtgaatgaatattactac

SEQ ID NO: 590274 - DNA, 20 bp, Artificial Sequence
  chemically synthesized
ttcaaacagaaatatgccag

SEQ ID NO: 590275 - DNA, 20 bp, Artificial Sequence
  chemically synthesized
cgtaatcattcctggcatat

SEQ ID NO: 590276 - DNA, 20 bp, Artificial Sequence
  chemically synthesized
attgtcctgagctccccttc

SEQ ID NO: 590277 - DNA, 20 bp, Artificial Sequence
  chemically synthesized
ccattaatatttcatacaca

SEQ ID NO: 590278 - DNA, 20 bp, Artificial Sequence
  chemically synthesized
aaatgaattgtttagtgtta

SEQ ID NO: 590279 - DNA, 20 bp, Artificial Sequence
  chemically synthesized
gtaaaactcctataaaaatg

SEQ ID NO: 590280 - DNA, 20 bp, Artificial Sequence
  chemically synthesized
actaaacaattcatttttat

SEQ ID NO: 590281 - DNA, 20 bp, Artificial Sequence
  chemically synthesized
tactcatctcccacaaattc

SEQ ID NO: 590282 - DNA, 20 bp, Artificial Sequence
  chemically synthesized
gctaatttttcatatttaaa

SEQ ID NO: 590283 - DNA, 20 bp, Artificial Sequence
  chemically synthesized
aaataataaaatagttctgc

SEQ ID NO: 590284 - DNA, 20 bp, Artificial Sequence
  chemically synthesized
actctaccacatttgcaacg

SEQ ID NO: 590285 - DNA, 20 bp, Artificial Sequence
  chemically synthesized
tcgttgcaaatgtggtagag

SEQ ID NO: 590286 - DNA, 20 bp, Artificial Sequence
  chemically synthesized
tatgagctacatatttttgg

SEQ ID NO: 590287 - DNA, 20 bp, Artificial Sequence
  chemically synthesized
caattaggttaatgctgacc

SEQ ID NO: 590288 - DNA, 20 bp, Artificial Sequence
  chemically synthesized
atacaactaaaataaaatta

SEQ ID NO: 590289 - DNA, 20 bp, Artificial Sequence
  chemically synthesized
aattgattgaagatatattt

SEQ ID NO: 590290 - DNA, 20 bp, Artificial Sequence
  chemically synthesized
aaatcatatcacttatgaag

SEQ ID NO: 590291 - DNA, 20 bp, Artificial Sequence
  chemically synthesized
gaaacaatacttcataagtg

SEQ ID NO: 590292 - DNA, 20 bp, Artificial Sequence
  chemically synthesized
tacttcataagtgatatgat

SEQ ID NO: 590293 - DNA, 20 bp, Artificial Sequence
  chemically synthesized
tgaacttacgagggatgtgg

SEQ ID NO: 590294 - DNA, 20 bp, Artificial Sequence
  chemically synthesized
caaatcactagcatatacat

SEQ ID NO: 590295 - DNA, 20 bp, Artificial Sequence
  chemically synthesized
tcaatctggaatgtatatgc

SEQ ID NO: 590296 - DNA, 20 bp, Artificial Sequence
  chemically synthesized
aaaatcaatactttaatttt

SEQ ID NO: 590297 - DNA, 20 bp, Artificial Sequence
  chemically synthesized
ttaaacatgtaaaattaaag

SEQ ID NO: 590298 - DNA, 20 bp, Artificial Sequence
  chemically synthesized
catgtgatattttgatactt

SEQ ID NO: 590299 - DNA, 20 bp, Artificial Sequence
  chemically synthesized
aaaaatcagcatctcaatta

SEQ ID NO: 590300 - DNA, 20 bp, Artificial Sequence
  chemically synthesized
tcaaatcagggtaattgaga

SEQ ID NO: 590301 - DNA, 20 bp, Artificial Sequence
  chemically synthesized
tgggaaaagaagcacatgga

SEQ ID NO: 590302 - DNA, 20 bp, Artificial Sequence
  chemically synthesized
tttacatctaagcgctttcc

SEQ ID NO: 590303 - DNA, 20 bp, Artificial Sequence
  chemically synthesized
cactcaagtagtttacatct

SEQ ID NO: 590304 - DNA, 20 bp, Artificial Sequence
  chemically synthesized
cccagaggcagtgacactca

SEQ ID NO: 590305 - DNA, 20 bp, Artificial Sequence
  chemically synthesized
ttttttctgaaataaccaca

SEQ ID NO: 590306 - DNA, 20 bp, Artificial Sequence
  chemically synthesized
agggtccttgcccttgggcc

SEQ ID NO: 590307 - DNA, 20 bp, Artificial Sequence
  chemically synthesized
ccatgctttcaaaggcaaag

SEQ ID NO: 590308 - DNA, 20 bp, Artificial Sequence
  chemically synthesized
tggtcctacagactcctaat

SEQ ID NO: 590309 - DNA, 20 bp, Artificial Sequence
  chemically synthesized
gcggggcttctagtgagcat

SEQ ID NO: 590310 - DNA, 20 bp, Artificial Sequence
  chemically synthesized
tgaatgccagatcatgggag

SEQ ID NO: 590311 - DNA, 20 bp, Artificial Sequence
  chemically synthesized
aaacatttgcccagggagtt

SEQ ID NO: 590312 - DNA, 20 bp, Artificial Sequence
  chemically synthesized
aatccctcaactccctgggc

SEQ ID NO: 590313 - DNA, 20 bp, Artificial Sequence
  chemically synthesized
tttttcccactcacctcatg

SEQ ID NO: 590314 - DNA, 20 bp, Artificial Sequence
  chemically synthesized
cccatttcccacccacatgt

SEQ ID NO: 590315 - DNA, 20 bp, Artificial Sequence
  chemically synthesized
aggaggtagggaaaaaaggc

SEQ ID NO: 590316 - DNA, 20 bp, Artificial Sequence
  chemically synthesized
catctgccaatgggcattta

SEQ ID NO: 590317 - DNA, 20 bp, Artificial Sequence
  chemically synthesized
gtaatcttaaggtccatcca

SEQ ID NO: 590318 - DNA, 20 bp, Artificial Sequence
  chemically synthesized
tgaaacaatatggatggacc

SEQ ID NO: 590319 - DNA, 20 bp, Artificial Sequence
  chemically synthesized
gcagtatttgtctgtgtctg

SEQ ID NO: 590320 - DNA, 20 bp, Artificial Sequence
  chemically synthesized
gacagacacagacaaatact

SEQ ID NO: 590321 - DNA, 20 bp, Artificial Sequence
  chemically synthesized
gtctttgattttatgagttt

SEQ ID NO: 590322 - DNA, 20 bp, Artificial Sequence
  chemically synthesized
ccagtccagtctttgatttt

SEQ ID NO: 590323 - DNA, 20 bp, Artificial Sequence
  chemically synthesized
ctggcaaccaccagtccagt

SEQ ID NO: 590324 - DNA, 20 bp, Artificial Sequence
  chemically synthesized
cttaactgaaatgtaatgtc

SEQ ID NO: 590325 - DNA, 20 bp, Artificial Sequence
  chemically synthesized
ttaacacagtaaaatttttt

SEQ ID NO: 590326 - DNA, 20 bp, Artificial Sequence
  chemically synthesized
ttaggatacattggcttttc

SEQ ID NO: 590327 - DNA, 20 bp, Artificial Sequence
  chemically synthesized
aagcctgttatttaggatac

SEQ ID NO: 590328 - DNA, 20 bp, Artificial Sequence
  chemically synthesized
aagccaatgtatcctaaata

SEQ ID NO: 590329 - DNA, 20 bp, Artificial Sequence
  chemically synthesized
agagttttgtactggaatga

SEQ ID NO: 590330 - DNA, 20 bp, Artificial Sequence
  chemically synthesized
atacaataaaataaattcct

SEQ ID NO: 590331 - DNA, 20 bp, Artificial Sequence
  chemically synthesized
gaatttattttattgtatca

SEQ ID NO: 590332 - DNA, 20 bp, Artificial Sequence
  chemically synthesized
tgtatcaagtggtttgctat

SEQ ID NO: 590333 - DNA, 20 bp, Artificial Sequence
  chemically synthesized
aaattccttgccagggaata

SEQ ID NO: 590334 - DNA, 20 bp, Artificial Sequence
  chemically synthesized
ttgtttttttaaatagtgca

SEQ ID NO: 590335 - DNA, 20 bp, Artificial Sequence
  chemically synthesized
tctttctgtctgtctgtctg

SEQ ID NO: 590336 - DNA, 20 bp, Artificial Sequence
  chemically synthesized
ataatgatatggacatctag

SEQ ID NO: 590337 - DNA, 20 bp, Artificial Sequence
  chemically synthesized
caatcataatgatatggaca

SEQ ID NO: 590338 - DNA, 20 bp, Artificial Sequence
  chemically synthesized
gaatctagatgtccatatca

SEQ ID NO: 590339 - DNA, 20 bp, Artificial Sequence
  chemically synthesized
cagactattaaatatatcct

SEQ ID NO: 590340 - DNA, 20 bp, Artificial Sequence
  chemically synthesized
ctatgcagaagactatgtga

SEQ ID NO: 590341 - DNA, 20 bp, Artificial Sequence
  chemically synthesized
ccaggatggtatgaggagtg

SEQ ID NO: 590342 - DNA, 20 bp, Artificial Sequence
  chemically synthesized
agctatgcattggtgtctaa

SEQ ID NO: 590343 - DNA, 20 bp, Artificial Sequence
  chemically synthesized
aacttataacttgtgttatg

SEQ ID NO: 590344 - DNA, 20 bp, Artificial Sequence
  chemically synthesized
gcttttgaatgtgttcaagt

SEQ ID NO: 590345 - DNA, 20 bp, Artificial Sequence
  chemically synthesized
attagaaatgtatgccaggg

SEQ ID NO: 590346 - DNA, 20 bp, Artificial Sequence
  chemically synthesized
gtgtgaatcttttgggatcc

SEQ ID NO: 590347 - DNA, 20 bp, Artificial Sequence
  chemically synthesized
taaagaaacaaatggatccc

SEQ ID NO: 590348 - DNA, 20 bp, Artificial Sequence
  chemically synthesized
ctttatttctggcaatataa

SEQ ID NO: 590349 - DNA, 20 bp, Artificial Sequence
  chemically synthesized
atgaactatcaatttaattg

SEQ ID NO: 590350 - DNA, 20 bp, Artificial Sequence
  chemically synthesized
aaagctaaatttgttgtttg

SEQ ID NO: 590351 - DNA, 20 bp, Artificial Sequence
  chemically synthesized
gaaacacttcaaacaacaaa

SEQ ID NO: 590352 - DNA, 20 bp, Artificial Sequence
  chemically synthesized
ttcttttctaaagctaaatt

SEQ ID NO: 590353 - DNA, 20 bp, Artificial Sequence
  chemically synthesized
ttatgactctatagtcaagt

SEQ ID NO: 590354 - DNA, 20 bp, Artificial Sequence
  chemically synthesized
taaaaattatgactctatag

SEQ ID NO: 590355 - DNA, 20 bp, Artificial Sequence
  chemically synthesized
tggtaatttatgaagagact

SEQ ID NO: 590356 - DNA, 20 bp, Artificial Sequence
  chemically synthesized
atacattttagctaaaatat

SEQ ID NO: 590357 - DNA, 20 bp, Artificial Sequence
  chemically synthesized
tatcattttgaaacccaaaa

SEQ ID NO: 590358 - DNA, 20 bp, Artificial Sequence
  chemically synthesized
tgaaaagtgaaatctatatt

SEQ ID NO: 590359 - DNA, 20 bp, Artificial Sequence
  chemically synthesized
agatttcacttttcatgttc

SEQ ID NO: 590360 - DNA, 20 bp, Artificial Sequence
  chemically synthesized
ttaatgaccactttcagcat

SEQ ID NO: 590361 - DNA, 20 bp, Artificial Sequence
  chemically synthesized
ttagtatgttagcaatgttt

SEQ ID NO: 590362 - DNA, 20 bp, Artificial Sequence
  chemically synthesized
attagatcttagtatgttag

SEQ ID NO: 590363 - DNA, 20 bp, Artificial Sequence
  chemically synthesized
gctaacatactaagatctaa

SEQ ID NO: 590364 - DNA, 20 bp, Artificial Sequence
  chemically synthesized
tcaaaaatagagtatttcaa

SEQ ID NO: 590365 - DNA, 20 bp, Artificial Sequence
  chemically synthesized
atgtgtgaaatttatgtttg

SEQ ID NO: 590366 - DNA, 20 bp, Artificial Sequence
  chemically synthesized
aagcaaaatatgtgtgaaat

SEQ ID NO: 590367 - DNA, 20 bp, Artificial Sequence
  chemically synthesized
aaacataaatttcacacata

SEQ ID NO: 590368 - DNA, 20 bp, Artificial Sequence
  chemically synthesized
tttacattttgggcagtaac

SEQ ID NO: 590369 - DNA, 20 bp, Artificial Sequence
  chemically synthesized
tttattttatgttctattta

SEQ ID NO: 590370 - DNA, 20 bp, Artificial Sequence
  chemically synthesized
gaactgtgacaaaaagaaaa

SEQ ID NO: 590371 - DNA, 20 bp, Artificial Sequence
  chemically synthesized
acaaaaagaaaaatgtgatt

SEQ ID NO: 590372 - DNA, 20 bp, Artificial Sequence
  chemically synthesized
ccatagtccaacccatctta

SEQ ID NO: 590373 - DNA, 20 bp, Artificial Sequence
  chemically synthesized
atagctttagtcttaagatg

SEQ ID NO: 590374 - DNA, 20 bp, Artificial Sequence
  chemically synthesized
gactaaagctattattttag

SEQ ID NO: 590375 - DNA, 20 bp, Artificial Sequence
  chemically synthesized
attataaacacacctaaaat

SEQ ID NO: 590376 - DNA, 20 bp, Artificial Sequence
  chemically synthesized
aaaataattgtatttcagaa

SEQ ID NO: 590377 - DNA, 20 bp, Artificial Sequence
  chemically synthesized
tcaggatcagttgagtaaaa

SEQ ID NO: 590378 - DNA, 20 bp, Artificial Sequence
  chemically synthesized
tcattttactcaactgatcc

SEQ ID NO: 590379 - DNA, 20 bp, Artificial Sequence
  chemically synthesized
atcctgaagttttaaggcat

SEQ ID NO: 590380 - DNA, 20 bp, Artificial Sequence
  chemically synthesized
aattgagtgatttttatatc

SEQ ID NO: 590381 - DNA, 20 bp, Artificial Sequence
  chemically synthesized
tccttactagagtctaaatt

SEQ ID NO: 590382 - DNA, 20 bp, Artificial Sequence
  chemically synthesized
aaaatgattaaatgagaagt

SEQ ID NO: 590383 - DNA, 20 bp, Artificial Sequence
  chemically synthesized
gttacttctcatttaatcat

SEQ ID NO: 590384 - DNA, 20 bp, Artificial Sequence
  chemically synthesized
cttctcatttaatcattttg

SEQ ID NO: 590385 - DNA, 20 bp, Artificial Sequence
  chemically synthesized
taaagagtttaaacaaacca

SEQ ID NO: 590386 - DNA, 20 bp, Artificial Sequence
  chemically synthesized
atttctttcccaaataacta

SEQ ID NO: 590387 - DNA, 20 bp, Artificial Sequence
  chemically synthesized
agagctataatagcagaaat

SEQ ID NO: 590388 - DNA, 20 bp, Artificial Sequence
  chemically synthesized
agaggagaaggtgtatttct

SEQ ID NO: 590389 - DNA, 20 bp, Artificial Sequence
  chemically synthesized
tatatatttaatattactat

SEQ ID NO: 590390 - DNA, 20 bp, Artificial Sequence
  chemically synthesized
acagatacctaatcagactt

SEQ ID NO: 590391 - DNA, 20 bp, Artificial Sequence
  chemically synthesized
cccactgtccaaaccaataa

SEQ ID NO: 590392 - DNA, 20 bp, Artificial Sequence
  chemically synthesized
cagtgggataataaggctag

SEQ ID NO: 590393 - DNA, 20 bp, Artificial Sequence
  chemically synthesized
ctctcccattcctactttat

SEQ ID NO: 590394 - DNA, 20 bp, Artificial Sequence
  chemically synthesized
ggagagataggcaggggtgg

SEQ ID NO: 590395 - DNA, 20 bp, Artificial Sequence
  chemically synthesized
tcagcgatcctaacgttccc

SEQ ID NO: 590396 - DNA, 20 bp, Artificial Sequence
  chemically synthesized
acaacagggaacgttaggat

SEQ ID NO: 590397 - DNA, 20 bp, Artificial Sequence
  chemically synthesized
ctttttccttgcgtaagcta

SEQ ID NO: 590398 - DNA, 20 bp, Artificial Sequence
  chemically synthesized
ccttgtaactctaaaaacta

SEQ ID NO: 590399 - DNA, 20 bp, Artificial Sequence
  chemically synthesized
ttaagtcctttcagattctt

SEQ ID NO: 590400 - DNA, 20 bp, Artificial Sequence
  chemically synthesized
cccagatggacttaagtcct

SEQ ID NO: 590401 - DNA, 20 bp, Artificial Sequence
  chemically synthesized
atagagtaacaactttcaga

SEQ ID NO: 590402 - DNA, 20 bp, Artificial Sequence
  chemically synthesized
aagaacaaataagaattact

SEQ ID NO: 590403 - DNA, 20 bp, Artificial Sequence
  chemically synthesized
ttaggcagaaaatgaacaca

SEQ ID NO: 590404 - DNA, 20 bp, Artificial Sequence
  chemically synthesized
gaaaatgaacacattcagat

SEQ ID NO: 590405 - DNA, 20 bp, Artificial Sequence
  chemically synthesized
tttgttttttaaaaaattac

SEQ ID NO: 590406 - DNA, 20 bp, Artificial Sequence
  chemically synthesized
tactctagcttttgtgtaga

SEQ ID NO: 590407 - DNA, 20 bp, Artificial Sequence
  chemically synthesized
tccagagtctagggtgtaga

SEQ ID NO: 590408 - DNA, 20 bp, Artificial Sequence
  chemically synthesized
tccagagtctaggcaagaga

SEQ ID NO: 590409 - DNA, 20 bp, Artificial Sequence
  chemically synthesized
cagatgaccctgatctcctg

SEQ ID NO: 590410 - DNA, 20 bp, Artificial Sequence
  chemically synthesized
aaagtcagatgaccctgatc

SEQ ID NO: 590411 - DNA, 20 bp, Artificial Sequence
  chemically synthesized
gagatcagggtcatctgact

SEQ ID NO: 590412 - DNA, 20 bp, Artificial Sequence
  chemically synthesized
acgtatttaacaacaaaact

SEQ ID NO: 590413 - DNA, 20 bp, Artificial Sequence
  chemically synthesized
tctatacctccaattaatca

SEQ ID NO: 590414 - DNA, 20 bp, Artificial Sequence
  chemically synthesized
attggaggtatagatggtgt

SEQ ID NO: 590415 - DNA, 20 bp, Artificial Sequence
  chemically synthesized
ggtatagatggtgtccaggc

SEQ ID NO: 590416 - DNA, 20 bp, Artificial Sequence
  chemically synthesized
tctgcttctcctccctggct

SEQ ID NO: 590417 - DNA, 20 bp, Artificial Sequence
  chemically synthesized
ctcatcacctcatctataaa

SEQ ID NO: 590418 - DNA, 20 bp, Artificial Sequence
  chemically synthesized
gatgagctcaggtgagtatt

SEQ ID NO: 590419 - DNA, 20 bp, Artificial Sequence
  chemically synthesized
ttagatgtccctcaggtgct

SEQ ID NO: 590420 - DNA, 20 bp, Artificial Sequence
  chemically synthesized
tctctatttagatgtccctc

SEQ ID NO: 590421 - DNA, 20 bp, Artificial Sequence
  chemically synthesized
attagacatttgtgtattct

SEQ ID NO: 590422 - DNA, 20 bp, Artificial Sequence
  chemically synthesized
ttcttgtagcttcctcagaa

SEQ ID NO: 590423 - DNA, 20 bp, Artificial Sequence
  chemically synthesized
aaaatgatttgggctggaat

SEQ ID NO: 590424 - DNA, 20 bp, Artificial Sequence
  chemically synthesized
aatggtaattgcgttcaaag

SEQ ID NO: 590425 - DNA, 20 bp, Artificial Sequence
  chemically synthesized
taagtattgacgacatcctt

SEQ ID NO: 590426 - DNA, 20 bp, Artificial Sequence
  chemically synthesized
agtcatataagcaaggaaca

SEQ ID NO: 590427 - DNA, 20 bp, Artificial Sequence
  chemically synthesized
tctgcttaaaacactctgtt

SEQ ID NO: 590428 - DNA, 20 bp, Artificial Sequence
  chemically synthesized
atggaccactgtcaactctg

SEQ ID NO: 590429 - DNA, 20 bp, Artificial Sequence
  chemically synthesized
tctccacatcatgttgccag

SEQ ID NO: 590430 - DNA, 20 bp, Artificial Sequence
  chemically synthesized
ggagacaacaaatatagata

SEQ ID NO: 590431 - DNA, 20 bp, Artificial Sequence
  chemically synthesized
tgtagcacatagacttcaag

SEQ ID NO: 590432 - DNA, 20 bp, Artificial Sequence
  chemically synthesized
atagacttcaagggttgttt

SEQ ID NO: 590433 - DNA, 20 bp, Artificial Sequence
  chemically synthesized
atttgaacattctctagtat

SEQ ID NO: 590434 - DNA, 20 bp, Artificial Sequence
  chemically synthesized
atcctatcagtattttgaga

SEQ ID NO: 590435 - DNA, 20 bp, Artificial Sequence
  chemically synthesized
cacattgcttgctcatgaag

SEQ ID NO: 590436 - DNA, 20 bp, Artificial Sequence
  chemically synthesized
gtgggaatatactgcctcca

SEQ ID NO: 590437 - DNA, 20 bp, Artificial Sequence
  chemically synthesized
aagcacgctagtttttacaa

SEQ ID NO: 590438 - DNA, 20 bp, Artificial Sequence
  chemically synthesized
aatcacatttgtaaaaacta

SEQ ID NO: 590439 - DNA, 20 bp, Artificial Sequence
  chemically synthesized
atgaagatttaataaagcac

SEQ ID NO: 590440 - DNA, 20 bp, Artificial Sequence
  chemically synthesized
gctttattaaatcttcatgg

SEQ ID NO: 590441 - DNA, 20 bp, Artificial Sequence
  chemically synthesized
ctatcagttaatcttgccca

SEQ ID NO: 590442 - DNA, 20 bp, Artificial Sequence
  chemically synthesized
gaggaataattatttctaat

SEQ ID NO: 590443 - DNA, 20 bp, Artificial Sequence
  chemically synthesized
tgtattatatctttaataat

SEQ ID NO: 590444 - DNA, 20 bp, Artificial Sequence
  chemically synthesized
aggaggctataactgaaaat

SEQ ID NO: 590445 - DNA, 20 bp, Artificial Sequence
  chemically synthesized
tttcagttatagcctccttc

SEQ ID NO: 590446 - DNA, 20 bp, Artificial Sequence
  chemically synthesized
acggttacactttgtgtgtc

SEQ ID NO: 590447 - DNA, 20 bp, Artificial Sequence
  chemically synthesized
gtaaccgtgcataaatactg

SEQ ID NO: 590448 - DNA, 20 bp, Artificial Sequence
  chemically synthesized
tactgtcaagctttgaggaa

SEQ ID NO: 590449 - DNA, 20 bp, Artificial Sequence
  chemically synthesized
ttccagaaatcgatattcct

SEQ ID NO: 590450 - DNA, 20 bp, Artificial Sequence
  chemically synthesized
aatatcgatttctggaaatc

SEQ ID NO: 590451 - DNA, 20 bp, Artificial Sequence
  chemically synthesized
aatctcggtaccaataaaac

SEQ ID NO: 590452 - DNA, 20 bp, Artificial Sequence
  chemically synthesized
aatcctccgttttattggta

SEQ ID NO: 590453 - DNA, 20 bp, Artificial Sequence
  chemically synthesized
gttacaaaaagtggtgctta

SEQ ID NO: 590454 - DNA, 20 bp, Artificial Sequence
  chemically synthesized
catgggatagttacaaaaag

SEQ ID NO: 590455 - DNA, 20 bp, Artificial Sequence
  chemically synthesized
tcattgaaattaaataaata

SEQ ID NO: 590456 - DNA, 20 bp, Artificial Sequence
  chemically synthesized
acaaagaatttctagaatac

SEQ ID NO: 590457 - DNA, 20 bp, Artificial Sequence
  chemically synthesized
tctccagtattctagaaatt

SEQ ID NO: 590458 - DNA, 20 bp, Artificial Sequence
  chemically synthesized
tgctataatttaaaataaat

SEQ ID NO: 590459 - DNA, 20 bp, Artificial Sequence
  chemically synthesized
agttctactttggtttggtt

SEQ ID NO: 590460 - DNA, 20 bp, Artificial Sequence
  chemically synthesized
cacagtccggtcagttctac

SEQ ID NO: 590461 - DNA, 20 bp, Artificial Sequence
  chemically synthesized
aagacgtttgttgaatgacc

SEQ ID NO: 590462 - DNA, 20 bp, Artificial Sequence
  chemically synthesized
acatattctagctgattaga

SEQ ID NO: 590463 - DNA, 20 bp, Artificial Sequence
  chemically synthesized
cagaccttggcacatattct

SEQ ID NO: 590464 - DNA, 20 bp, Artificial Sequence
  chemically synthesized
cctagagagcaatgactatt

SEQ ID NO: 590465 - DNA, 20 bp, Artificial Sequence
  chemically synthesized
tatttttgtctgaattcctc

SEQ ID NO: 590466 - DNA, 20 bp, Artificial Sequence
  chemically synthesized
agttttctactattattata

SEQ ID NO: 590467 - DNA, 20 bp, Artificial Sequence
  chemically synthesized
gatccgtcttaatgtccctt

SEQ ID NO: 590468 - DNA, 20 bp, Artificial Sequence
  chemically synthesized
taatctccctagtccaacat

SEQ ID NO: 590469 - DNA, 20 bp, Artificial Sequence
  chemically synthesized
taagccatgatgttggacta

SEQ ID NO: 590470 - DNA, 20 bp, Artificial Sequence
  chemically synthesized
cgtctgggaaaggtctggtg

SEQ ID NO: 590471 - DNA, 20 bp, Artificial Sequence
  chemically synthesized
ctcctgttttcctgatggac

SEQ ID NO: 590472 - DNA, 20 bp, Artificial Sequence
  chemically synthesized
accatttcccacccgccaac

SEQ ID NO: 590473 - DNA, 20 bp, Artificial Sequence
  chemically synthesized
gtttctctgatatcccatgc

SEQ ID NO: 590474 - DNA, 20 bp, Artificial Sequence
  chemically synthesized
ccccagctatactgtgttgc

SEQ ID NO: 590475 - DNA, 20 bp, Artificial Sequence
  chemically synthesized
tttgctttccaaatagttca

SEQ ID NO: 590476 - DNA, 20 bp, Artificial Sequence
  chemically synthesized
cttgtttgctttccaaatag

SEQ ID NO: 590477 - DNA, 20 bp, Artificial Sequence
  chemically synthesized
gaatcctccagggttacctt

SEQ ID NO: 590478 - DNA, 20 bp, Artificial Sequence
  chemically synthesized
aaagcaaacaaggtaaccct

SEQ ID NO: 590479 - DNA, 20 bp, Artificial Sequence
  chemically synthesized
tcaggaatcctccagggtta

SEQ ID NO: 590480 - DNA, 20 bp, Artificial Sequence
  chemically synthesized
aaaaaagtatagtgtgtgat

SEQ ID NO: 590481 - DNA, 20 bp, Artificial Sequence
  chemically synthesized
gaaaaaaaaaaaagtatagt

SEQ ID NO: 590482 - DNA, 20 bp, Artificial Sequence
  chemically synthesized
ttaacttgattttttcattg

SEQ ID NO: 590483 - DNA, 20 bp, Artificial Sequence
  chemically synthesized
tttattaatgtaatgattta

SEQ ID NO: 590484 - DNA, 20 bp, Artificial Sequence
  chemically synthesized
actaagtaaatttattaatg

SEQ ID NO: 590485 - DNA, 20 bp, Artificial Sequence
  chemically synthesized
cattaataaatttacttagt

SEQ ID NO: 590486 - DNA, 20 bp, Artificial Sequence
  chemically synthesized
ttatatgcaatgactaacag

SEQ ID NO: 590487 - DNA, 20 bp, Artificial Sequence
  chemically synthesized
ttaaaatttgattttagcca

SEQ ID NO: 590488 - DNA, 20 bp, Artificial Sequence
  chemically synthesized
attgatatctacattttaaa

SEQ ID NO: 590489 - DNA, 20 bp, Artificial Sequence
  chemically synthesized
ataggtagtctctgctctca

SEQ ID NO: 590490 - DNA, 20 bp, Artificial Sequence
  chemically synthesized
cctgtaatcgtgtcacttgg

SEQ ID NO: 590491 - DNA, 20 bp, Artificial Sequence
  chemically synthesized
tgtgtaagctgatccaagtg

SEQ ID NO: 590492 - DNA, 20 bp, Artificial Sequence
  chemically synthesized
gtgtcacttggatcagctta

SEQ ID NO: 590493 - DNA, 20 bp, Artificial Sequence
  chemically synthesized
gttatctctgctgtctctgc

SEQ ID NO: 590494 - DNA, 20 bp, Artificial Sequence
  chemically synthesized
tcaggagttatctctgctgt

SEQ ID NO: 590495 - DNA, 20 bp, Artificial Sequence
  chemically synthesized
tctatgcccattattcttaa

SEQ ID NO: 590496 - DNA, 20 bp, Artificial Sequence
  chemically synthesized
atatgtctgtgtgtgtatgt

SEQ ID NO: 590497 - DNA, 20 bp, Artificial Sequence
  chemically synthesized
gttactgatcttctctgagc

SEQ ID NO: 590498 - DNA, 20 bp, Artificial Sequence
  chemically synthesized
gccattattcaccctgtaag

SEQ ID NO: 590499 - DNA, 20 bp, Artificial Sequence
  chemically synthesized
aatatccccccctcctttac

SEQ ID NO: 590500 - DNA, 20 bp, Artificial Sequence
  chemically synthesized
gtgttgtttctacttctctt

SEQ ID NO: 590501 - DNA, 20 bp, Artificial Sequence
  chemically synthesized
agaagtagaaacaacacata

SEQ ID NO: 590502 - DNA, 20 bp, Artificial Sequence
  chemically synthesized
cactttgcaagcactgtatg

SEQ ID NO: 590503 - DNA, 20 bp, Artificial Sequence
  chemically synthesized
aagagaacaaaaaatcaatt

SEQ ID NO: 590504 - DNA, 20 bp, Artificial Sequence
  chemically synthesized
ctgtataatttgaagcaaat

SEQ ID NO: 590505 - DNA, 20 bp, Artificial Sequence
  chemically synthesized
aacgggatatttttgagccc

SEQ ID NO: 590506 - DNA, 20 bp, Artificial Sequence
  chemically synthesized
aacacttgggctcaaaaata

SEQ ID NO: 590507 - DNA, 20 bp, Artificial Sequence
  chemically synthesized
actgtccgtgaaacatgcca

SEQ ID NO: 590508 - DNA, 20 bp, Artificial Sequence
  chemically synthesized
gtgatgataaaatcaatttg

SEQ ID NO: 590509 - DNA, 20 bp, Artificial Sequence
  chemically synthesized
ggcacccaagaactgagaca

SEQ ID NO: 590510 - DNA, 20 bp, Artificial Sequence
  chemically synthesized
ttggattctactaacccaca

SEQ ID NO: 590511 - DNA, 20 bp, Artificial Sequence
  chemically synthesized
gtgatgttctatatcgttta

SEQ ID NO: 590512 - DNA, 20 bp, Artificial Sequence
  chemically synthesized
atatgagttgtgatgttcta

SEQ ID NO: 590513 - DNA, 20 bp, Artificial Sequence
  chemically synthesized
ttcaaatatgttaactaaag

SEQ ID NO: 590514 - DNA, 20 bp, Artificial Sequence
  chemically synthesized
gagttactgttcaaagatta

SEQ ID NO: 590515 - DNA, 20 bp, Artificial Sequence
  chemically synthesized
gggaatagagagttactgtt

SEQ ID NO: 590516 - DNA, 20 bp, Artificial Sequence
  chemically synthesized
acctcccaagcctctgttaa

SEQ ID NO: 590517 - DNA, 20 bp, Artificial Sequence
  chemically synthesized
agagtagaatcatggttaac

SEQ ID NO: 590518 - DNA, 20 bp, Artificial Sequence
  chemically synthesized
atatagggtacatgcttaaa

SEQ ID NO: 590519 - DNA, 20 bp, Artificial Sequence
  chemically synthesized
aatatatatttatatagggt

SEQ ID NO: 590520 - DNA, 20 bp, Artificial Sequence
  chemically synthesized
taattttaaattacattgac

SEQ ID NO: 590521 - DNA, 20 bp, Artificial Sequence
  chemically synthesized
ttgttctctagaaattaata

SEQ ID NO: 590522 - DNA, 20 bp, Artificial Sequence
  chemically synthesized
gtattttttctcactacccc

SEQ ID NO: 590523 - DNA, 20 bp, Artificial Sequence
  chemically synthesized
tgtcactccaacgaccttga

SEQ ID NO: 590524 - DNA, 20 bp, Artificial Sequence
  chemically synthesized
acacacaccagtgaagttat

SEQ ID NO: 590525 - DNA, 20 bp, Artificial Sequence
  chemically synthesized
gcacacacacatatacacac

SEQ ID NO: 590526 - DNA, 20 bp, Artificial Sequence
  chemically synthesized
gcgtgtgtgtgtatatgtgt

SEQ ID NO: 590527 - DNA, 20 bp, Artificial Sequence
  chemically synthesized
tgtgtgtgcttacaatcccc

SEQ ID NO: 590528 - DNA, 20 bp, Artificial Sequence
  chemically synthesized
cttttgagtttaaaatctag

SEQ ID NO: 590529 - DNA, 20 bp, Artificial Sequence
  chemically synthesized
aaggcattgttggttctctt

SEQ ID NO: 590530 - DNA, 20 bp, Artificial Sequence
  chemically synthesized
tagaaaaggatctcagggaa

SEQ ID NO: 590531 - DNA, 20 bp, Artificial Sequence
  chemically synthesized
cactggccctttaaccccaa

SEQ ID NO: 590532 - DNA, 20 bp, Artificial Sequence
  chemically synthesized
tccttcttccacagagtgga

SEQ ID NO: 590533 - DNA, 20 bp, Artificial Sequence
  chemically synthesized
tccactctgtggaagaagga

SEQ ID NO: 590534 - DNA, 20 bp, Artificial Sequence
  chemically synthesized
ttcattatattttggctctg

SEQ ID NO: 590535 - DNA, 20 bp, Artificial Sequence
  chemically synthesized
tctctggtctggactttagc

SEQ ID NO: 590536 - DNA, 20 bp, Artificial Sequence
  chemically synthesized
tagctaaagtccagaccaga

SEQ ID NO: 590537 - DNA, 20 bp, Artificial Sequence
  chemically synthesized
ggaaaaactcattcttaagg

SEQ ID NO: 590538 - DNA, 20 bp, Artificial Sequence
  chemically synthesized
ttgaaaaccataccttaaga

SEQ ID NO: 590539 - DNA, 20 bp, Artificial Sequence
  chemically synthesized
ggggaggaagcaagaaaatt

SEQ ID NO: 590540 - DNA, 20 bp, Artificial Sequence
  chemically synthesized
aacctacaagcatctaattt

SEQ ID NO: 590541 - DNA, 20 bp, Artificial Sequence
  chemically synthesized
agcaagaaaattagatgctt

SEQ ID NO: 590542 - DNA, 20 bp, Artificial Sequence
  chemically synthesized
tcatcagcaagaagggcaaa

SEQ ID NO: 590543 - DNA, 20 bp, Artificial Sequence
  chemically synthesized
aaagagttggtcatagcaag

SEQ ID NO: 590544 - DNA, 20 bp, Artificial Sequence
  chemically synthesized
gtttaacactgcatggccca

SEQ ID NO: 590545 - DNA, 20 bp, Artificial Sequence
  chemically synthesized
cttctcaaggcctcaatttc

SEQ ID NO: 590546 - DNA, 20 bp, Artificial Sequence
  chemically synthesized
acattgttatcttatggatg

SEQ ID NO: 590547 - DNA, 20 bp, Artificial Sequence
  chemically synthesized
acacatcccctgaaggccat

SEQ ID NO: 590548 - DNA, 20 bp, Artificial Sequence
  chemically synthesized
ttttcttcattggtttccat

SEQ ID NO: 590549 - DNA, 20 bp, Artificial Sequence
  chemically synthesized
attgatttcaggttttcttc

SEQ ID NO: 590550 - DNA, 20 bp, Artificial Sequence
  chemically synthesized
aaaacataaccatattgatt

SEQ ID NO: 590551 - DNA, 20 bp, Artificial Sequence
  chemically synthesized
aaaacctgaaatcaatatgg

SEQ ID NO: 590552 - DNA, 20 bp, Artificial Sequence
  chemically synthesized
gaagacagaaaacataacca

SEQ ID NO: 590553 - DNA, 20 bp, Artificial Sequence
  chemically synthesized
cattcaaaagaatggctaag

SEQ ID NO: 590554 - DNA, 20 bp, Artificial Sequence
  chemically synthesized
ggaaaatgcatccgggaaat

SEQ ID NO: 590555 - DNA, 20 bp, Artificial Sequence
  chemically synthesized
tggagtgtaagccagctctt

SEQ ID NO: 590556 - DNA, 20 bp, Artificial Sequence
  chemically synthesized
tagttctaaagctccaaaga

SEQ ID NO: 590557 - DNA, 20 bp, Artificial Sequence
  chemically synthesized
tgtcagcaaggaagaagaga

SEQ ID NO: 590558 - DNA, 20 bp, Artificial Sequence
  chemically synthesized
aacatcttttctcaaaatag

SEQ ID NO: 590559 - DNA, 20 bp, Artificial Sequence
  chemically synthesized
aggggggagagacctgcctt

SEQ ID NO: 590560 - DNA, 20 bp, Artificial Sequence
  chemically synthesized
gcccacttactgccaggtgg

SEQ ID NO: 590561 - DNA, 20 bp, Artificial Sequence
  chemically synthesized
cgcagagcccatatggcatc

SEQ ID NO: 590562 - DNA, 20 bp, Artificial Sequence
  chemically synthesized
tccccaaattcttaaaaacc

SEQ ID NO: 590563 - DNA, 20 bp, Artificial Sequence
  chemically synthesized
caatgttaactcagaaagca

SEQ ID NO: 590564 - DNA, 20 bp, Artificial Sequence
  chemically synthesized
ttctgctttctgagttaaca

SEQ ID NO: 590565 - DNA, 20 bp, Artificial Sequence
  chemically synthesized
ggcttattgtcatctagtac

SEQ ID NO: 590566 - DNA, 20 bp, Artificial Sequence
  chemically synthesized
tttattctagctgtatactc

SEQ ID NO: 590567 - DNA, 20 bp, Artificial Sequence
  chemically synthesized
agctgtatactcatatgttt

SEQ ID NO: 590568 - DNA, 20 bp, Artificial Sequence
  chemically synthesized
tatactcatatgtttgagtg

SEQ ID NO: 590569 - DNA, 20 bp, Artificial Sequence
  chemically synthesized
gttttgtttactgatacttc

SEQ ID NO: 590570 - DNA, 20 bp, Artificial Sequence
  chemically synthesized
tttactgatacttcctcagt

SEQ ID NO: 590571 - DNA, 20 bp, Artificial Sequence
  chemically synthesized
attcatcattgtctcactat

SEQ ID NO: 590572 - DNA, 20 bp, Artificial Sequence
  chemically synthesized
tctcattattattataggtc

SEQ ID NO: 590573 - DNA, 20 bp, Artificial Sequence
  chemically synthesized
ctgtcgttgaattaggcata

SEQ ID NO: 590574 - DNA, 20 bp, Artificial Sequence
  chemically synthesized
ttgacgaacctgtacttgga

SEQ ID NO: 590575 - DNA, 20 bp, Artificial Sequence
  chemically synthesized
ggctattactctctctttct

SEQ ID NO: 590576 - DNA, 20 bp, Artificial Sequence
  chemically synthesized
actgggtaatttataaagga

SEQ ID NO: 590577 - DNA, 20 bp, Artificial Sequence
  chemically synthesized
cttcaccttctactatgatt

SEQ ID NO: 590578 - DNA, 20 bp, Artificial Sequence
  chemically synthesized
actatgcccttcaccttcta

SEQ ID NO: 590579 - DNA, 20 bp, Artificial Sequence
  chemically synthesized
gccaccttgtaaaggaggtg

SEQ ID NO: 590580 - DNA, 20 bp, Artificial Sequence
  chemically synthesized
ctttataaaaccatctgatc

SEQ ID NO: 590581 - DNA, 20 bp, Artificial Sequence
  chemically synthesized
gatagtgaatcatgagatca

SEQ ID NO: 590582 - DNA, 20 bp, Artificial Sequence
  chemically synthesized
ggaggcaattggatcttgag

SEQ ID NO: 590583 - DNA, 20 bp, Artificial Sequence
  chemically synthesized
ctggtctctcccttgacaca

SEQ ID NO: 590584 - DNA, 20 bp, Artificial Sequence
  chemically synthesized
cacggggattataattcaaa

SEQ ID NO: 590585 - DNA, 20 bp, Artificial Sequence
  chemically synthesized
atacacacacattgatatgg

SEQ ID NO: 590586 - DNA, 20 bp, Artificial Sequence
  chemically synthesized
agttaatattgtgattatat

SEQ ID NO: 590587 - DNA, 20 bp, Artificial Sequence
  chemically synthesized
gtcagatatttcagttaata

SEQ ID NO: 590588 - DNA, 20 bp, Artificial Sequence
  chemically synthesized
aatgagaggaaatagtctta

SEQ ID NO: 590589 - DNA, 20 bp, Artificial Sequence
  chemically synthesized
acattctagaggaaaaaagt

SEQ ID NO: 590590 - DNA, 20 bp, Artificial Sequence
  chemically synthesized
gaaaaaagtaattgattata

SEQ ID NO: 590591 - DNA, 20 bp, Artificial Sequence
  chemically synthesized
aggtatatttaacaagcagg

SEQ ID NO: 590592 - DNA, 20 bp, Artificial Sequence
  chemically synthesized
agaacatttccacaaacact

SEQ ID NO: 590593 - DNA, 20 bp, Artificial Sequence
  chemically synthesized
agaaaaataagaataagatc

SEQ ID NO: 590594 - DNA, 20 bp, Artificial Sequence
  chemically synthesized
taactaacagagtataatta

SEQ ID NO: 590595 - DNA, 20 bp, Artificial Sequence
  chemically synthesized
atgtttgtaatacaaagcac

SEQ ID NO: 590596 - DNA, 20 bp, Artificial Sequence
  chemically synthesized
ttatctatcccttcaagcat

SEQ ID NO: 590597 - DNA, 20 bp, Artificial Sequence
  chemically synthesized
tgatgtgactatttcatatt

SEQ ID NO: 590598 - DNA, 20 bp, Artificial Sequence
  chemically synthesized
atatattgatggggtacaag

SEQ ID NO: 590599 - DNA, 20 bp, Artificial Sequence
  chemically synthesized
cttttaagttttttctttca

SEQ ID NO: 590600 - DNA, 20 bp, Artificial Sequence
  chemically synthesized
agagcatttccatttttctt

SEQ ID NO: 590601 - DNA, 20 bp, Artificial Sequence
  chemically synthesized
acgtcttagtgcatttatgt

SEQ ID NO: 590602 - DNA, 20 bp, Artificial Sequence
  chemically synthesized
agtgacttttgctaacactt

SEQ ID NO: 590603 - DNA, 20 bp, Artificial Sequence
  chemically synthesized
aggttcagtgaactttctca

SEQ ID NO: 590604 - DNA, 20 bp, Artificial Sequence
  chemically synthesized
tttgaattgagctttgcatg

SEQ ID NO: 590605 - DNA, 20 bp, Artificial Sequence
  chemically synthesized
ttcctaggtgcctttttgaa

SEQ ID NO: 590606 - DNA, 20 bp, Artificial Sequence
  chemically synthesized
ttttaattgagttaaagcat

SEQ ID NO: 590607 - DNA, 20 bp, Artificial Sequence
  chemically synthesized
tatttatgcaagagaaacta

SEQ ID NO: 590608 - DNA, 20 bp, Artificial Sequence
  chemically synthesized
tatcaaaacaagcctatgag

SEQ ID NO: 590609 - DNA, 20 bp, Artificial Sequence
  chemically synthesized
ctaataatcgtctctcatag

SEQ ID NO: 590610 - DNA, 20 bp, Artificial Sequence
  chemically synthesized
tgatctaataatcgtctctc

SEQ ID NO: 590611 - DNA, 20 bp, Artificial Sequence
  chemically synthesized
aatttgagagaaaaattaac

SEQ ID NO: 590612 - DNA, 20 bp, Artificial Sequence
  chemically synthesized
taatagtgatgcaataaacc

SEQ ID NO: 590613 - DNA, 20 bp, Artificial Sequence
  chemically synthesized
catactgcctaggtgaaact

SEQ ID NO: 590614 - DNA, 20 bp, Artificial Sequence
  chemically synthesized
gattataatgattaaaatac

SEQ ID NO: 590615 - DNA, 20 bp, Artificial Sequence
  chemically synthesized
gtaatgtaggagtctgatta

SEQ ID NO: 590616 - DNA, 20 bp, Artificial Sequence
  chemically synthesized
cagtggtatgtaatgtagga

SEQ ID NO: 590617 - DNA, 20 bp, Artificial Sequence
  chemically synthesized
cagactcctacattacatac

SEQ ID NO: 590618 - DNA, 20 bp, Artificial Sequence
  chemically synthesized
gaaagataatttttttctag

SEQ ID NO: 590619 - DNA, 20 bp, Artificial Sequence
  chemically synthesized
ccccaacttgtttaacactt

SEQ ID NO: 590620 - DNA, 20 bp, Artificial Sequence
  chemically synthesized
tgtcagattattacccccca

SEQ ID NO: 590621 - DNA, 20 bp, Artificial Sequence
  chemically synthesized
atccccttacctgggagaat

SEQ ID NO: 590622 - DNA, 20 bp, Artificial Sequence
  chemically synthesized
atctgacattctcccaggta

SEQ ID NO: 590623 - DNA, 20 bp, Artificial Sequence
  chemically synthesized
tgtcatgaagttaaataaca

SEQ ID NO: 590624 - DNA, 20 bp, Artificial Sequence
  chemically synthesized
acactgggaagagagtattt

SEQ ID NO: 590625 - DNA, 20 bp, Artificial Sequence
  chemically synthesized
ataatgtttagattcttaac

SEQ ID NO: 590626 - DNA, 20 bp, Artificial Sequence
  chemically synthesized
aaatagtccccttgataatg

SEQ ID NO: 590627 - DNA, 20 bp, Artificial Sequence
  chemically synthesized
aagcaaaatagtccccttga

SEQ ID NO: 590628 - DNA, 20 bp, Artificial Sequence
  chemically synthesized
aaacattatcaaggggacta

SEQ ID NO: 590629 - DNA, 20 bp, Artificial Sequence
  chemically synthesized
ggggactattttgcttaatt

SEQ ID NO: 590630 - DNA, 20 bp, Artificial Sequence
  chemically synthesized
aaaggaacatgggtatactt

SEQ ID NO: 590631 - DNA, 20 bp, Artificial Sequence
  chemically synthesized
taatagccacctcagtgatg

SEQ ID NO: 590632 - DNA, 20 bp, Artificial Sequence
  chemically synthesized
gtgtgtaatagccacctcag

SEQ ID NO: 590633 - DNA, 20 bp, Artificial Sequence
  chemically synthesized
tgagccacaattttctgatt

SEQ ID NO: 590634 - DNA, 20 bp, Artificial Sequence
  chemically synthesized
acttctcatgagccacaatt

SEQ ID NO: 590635 - DNA, 20 bp, Artificial Sequence
  chemically synthesized
tcagaaaattgtggctcatg

SEQ ID NO: 590636 - DNA, 20 bp, Artificial Sequence
  chemically synthesized
gacatcccctattgaatagg

SEQ ID NO: 590637 - DNA, 20 bp, Artificial Sequence
  chemically synthesized
taggggatgtcttaggacca

SEQ ID NO: 590638 - DNA, 20 bp, Artificial Sequence
  chemically synthesized
gctgttaacattaataggca

SEQ ID NO: 590639 - DNA, 20 bp, Artificial Sequence
  chemically synthesized
ataacgataaaaggatatgt

SEQ ID NO: 590640 - DNA, 20 bp, Artificial Sequence
  chemically synthesized
aatggcgtgaacctgggatg

SEQ ID NO: 590641 - DNA, 20 bp, Artificial Sequence
  chemically synthesized
ttttgtatttttagtagaga

SEQ ID NO: 590642 - DNA, 20 bp, Artificial Sequence
  chemically synthesized
cgccttggcctcccaaagtg

SEQ ID NO: 590643 - DNA, 20 bp, Artificial Sequence
  chemically synthesized
tccaatgttaatatggtgcc

SEQ ID NO: 590644 - DNA, 20 bp, Artificial Sequence
  chemically synthesized
ctttattgaatacgaacaca

SEQ ID NO: 590645 - DNA, 20 bp, Artificial Sequence
  chemically synthesized
atataagtattatgacaagg

SEQ ID NO: 590646 - DNA, 20 bp, Artificial Sequence
  chemically synthesized
acaaggcagtgatttggaca

SEQ ID NO: 590647 - DNA, 20 bp, Artificial Sequence
  chemically synthesized
taactggacatgagccctga

SEQ ID NO: 590648 - DNA, 20 bp, Artificial Sequence
  chemically synthesized
attgggaattatatttccac

SEQ ID NO: 590649 - DNA, 20 bp, Artificial Sequence
  chemically synthesized
gttggtggtggggcctggcg

SEQ ID NO: 590650 - DNA, 20 bp, Artificial Sequence
  chemically synthesized
ggtcatggggacagatccct

SEQ ID NO: 590651 - DNA, 20 bp, Artificial Sequence
  chemically synthesized
tattgtcctcagtgtagtga

SEQ ID NO: 590652 - DNA, 20 bp, Artificial Sequence
  chemically synthesized
gtgagtgagttttcatgaga

SEQ ID NO: 590653 - DNA, 20 bp, Artificial Sequence
  chemically synthesized
tggctcctggggaggcctca

SEQ ID NO: 590654 - DNA, 20 bp, Artificial Sequence
  chemically synthesized
acaggaagtgtggcacaggc

SEQ ID NO: 590655 - DNA, 20 bp, Artificial Sequence
  chemically synthesized
cattatatttcaacaagaaa

SEQ ID NO: 590656 - DNA, 20 bp, Artificial Sequence
  chemically synthesized
tggacttggggcctggtgtg

SEQ ID NO: 590657 - DNA, 20 bp, Artificial Sequence
  chemically synthesized
agtcacggaggtggatccct

SEQ ID NO: 590658 - DNA, 20 bp, Artificial Sequence
  chemically synthesized
agcagctgagttcttgagcg

SEQ ID NO: 590659 - DNA, 20 bp, Artificial Sequence
  chemically synthesized
ctgagttcttgagcgatctg

SEQ ID NO: 590660 - DNA, 20 bp, Artificial Sequence
  chemically synthesized
taaatgtgtggcaacctccc

SEQ ID NO: 590661 - DNA, 20 bp, Artificial Sequence
  chemically synthesized
gcttctgctctggccatgtg

SEQ ID NO: 590662 - DNA, 20 bp, Artificial Sequence
  chemically synthesized
tggccatgtgacatgcttac

SEQ ID NO: 590663 - DNA, 20 bp, Artificial Sequence
  chemically synthesized
cagcttctggggaggcctcc

SEQ ID NO: 590664 - DNA, 20 bp, Artificial Sequence
  chemically synthesized
aagcaggacaccagcatcta

SEQ ID NO: 590665 - DNA, 20 bp, Artificial Sequence
  chemically synthesized
aagctgagtagatgctggtg

SEQ ID NO: 590666 - DNA, 20 bp, Artificial Sequence
  chemically synthesized
gtacaacctgcagaatcatg

SEQ ID NO: 590667 - DNA, 20 bp, Artificial Sequence
  chemically synthesized
taaaaagagctttaatcgat

SEQ ID NO: 590668 - DNA, 20 bp, Artificial Sequence
  chemically synthesized
gtatttttaaaaagagcttt

SEQ ID NO: 590669 - DNA, 20 bp, Artificial Sequence
  chemically synthesized
ctgggtaatgtatttttaaa

SEQ ID NO: 590670 - DNA, 20 bp, Artificial Sequence
  chemically synthesized
tccccgtctgtccttgatac

SEQ ID NO: 590671 - DNA, 20 bp, Artificial Sequence
  chemically synthesized
ccttgatactcttgtttttc

SEQ ID NO: 590672 - DNA, 20 bp, Artificial Sequence
  chemically synthesized
ttattcctattgtatctact

SEQ ID NO: 590673 - DNA, 20 bp, Artificial Sequence
  chemically synthesized
tttgatgttaagaaaatgat

SEQ ID NO: 590674 - DNA, 20 bp, Artificial Sequence
  chemically synthesized
acacttatatcaaagagctt

SEQ ID NO: 590675 - DNA, 20 bp, Artificial Sequence
  chemically synthesized
taaattgaacacttatatca

SEQ ID NO: 590676 - DNA, 20 bp, Artificial Sequence
  chemically synthesized
tttcttatgcttagtcttat

SEQ ID NO: 590677 - DNA, 20 bp, Artificial Sequence
  chemically synthesized
agggaaagtgtattattttc

SEQ ID NO: 590678 - DNA, 20 bp, Artificial Sequence
  chemically synthesized
gtgatatatttgaacatttt

SEQ ID NO: 590679 - DNA, 20 bp, Artificial Sequence
  chemically synthesized
gtagaggtaacagtttagaa

SEQ ID NO: 590680 - DNA, 20 bp, Artificial Sequence
  chemically synthesized
ctgtgggattaagtagaggt

SEQ ID NO: 590681 - DNA, 20 bp, Artificial Sequence
  chemically synthesized
ccaataattttatcacctct

SEQ ID NO: 590682 - DNA, 20 bp, Artificial Sequence
  chemically synthesized
actgttacagtttccatttc

SEQ ID NO: 590683 - DNA, 20 bp, Artificial Sequence
  chemically synthesized
gagtatatggcttttactgt

SEQ ID NO: 590684 - DNA, 20 bp, Artificial Sequence
  chemically synthesized
ctaatgtccaccttagagta

SEQ ID NO: 590685 - DNA, 20 bp, Artificial Sequence
  chemically synthesized
agaaagtctcttggtctaca

SEQ ID NO: 590686 - DNA, 20 bp, Artificial Sequence
  chemically synthesized
ataggtagattattctgtct

SEQ ID NO: 590687 - DNA, 20 bp, Artificial Sequence
  chemically synthesized
tgtttaatgatttctatata

SEQ ID NO: 590688 - DNA, 20 bp, Artificial Sequence
  chemically synthesized
aggcaaaatttctatttgtt

SEQ ID NO: 590689 - DNA, 20 bp, Artificial Sequence
  chemically synthesized
atttataaggcaaaatttct

SEQ ID NO: 590690 - DNA, 20 bp, Artificial Sequence
  chemically synthesized
acaactataacatagctgat

SEQ ID NO: 590691 - DNA, 20 bp, Artificial Sequence
  chemically synthesized
ccttgtcatcactggaagaa

SEQ ID NO: 590692 - DNA, 20 bp, Artificial Sequence
  chemically synthesized
acacagaaatgcaaacattg

SEQ ID NO: 590693 - DNA, 20 bp, Artificial Sequence
  chemically synthesized
ctctccacgaagaaactttt

SEQ ID NO: 590694 - DNA, 20 bp, Artificial Sequence
  chemically synthesized
tttcttcgtggagagttcta

SEQ ID NO: 590695 - DNA, 20 bp, Artificial Sequence
  chemically synthesized
aaaagttcaatactatttat

SEQ ID NO: 590696 - DNA, 20 bp, Artificial Sequence
  chemically synthesized
tataataggccatttgttca

SEQ ID NO: 590697 - DNA, 20 bp, Artificial Sequence
  chemically synthesized
gggcccttaaatttcgaaat

SEQ ID NO: 590698 - DNA, 20 bp, Artificial Sequence
  chemically synthesized
tttaactttctctttggaaa

SEQ ID NO: 590699 - DNA, 20 bp, Artificial Sequence
  chemically synthesized
aataatttagcagcattttc

SEQ ID NO: 590700 - DNA, 20 bp, Artificial Sequence
  chemically synthesized
aaatgctgctaaattatttg

SEQ ID NO: 590701 - DNA, 20 bp, Artificial Sequence
  chemically synthesized
tccaagccttgggattttat

SEQ ID NO: 590702 - DNA, 20 bp, Artificial Sequence
  chemically synthesized
aaaaagccaaaataaaatcc

SEQ ID NO: 590703 - DNA, 20 bp, Artificial Sequence
  chemically synthesized
caaaataaaatcccaaggct

SEQ ID NO: 590704 - DNA, 20 bp, Artificial Sequence
  chemically synthesized
cttgtttcaaactccaagcc

SEQ ID NO: 590705 - DNA, 20 bp, Artificial Sequence
  chemically synthesized
atgctcccttccctttcacc

SEQ ID NO: 590706 - DNA, 20 bp, Artificial Sequence
  chemically synthesized
ttgataagagaggcaggaaa

SEQ ID NO: 590707 - DNA, 20 bp, Artificial Sequence
  chemically synthesized
gatagatttaatggcatttt

SEQ ID NO: 590708 - DNA, 20 bp, Artificial Sequence
  chemically synthesized
ggcattttttttgttttaaa

SEQ ID NO: 590709 - DNA, 20 bp, Artificial Sequence
  chemically synthesized
ataatgcttaagaagaaaaa

SEQ ID NO: 590710 - DNA, 20 bp, Artificial Sequence
  chemically synthesized
gaaaaattatgtttattaca

SEQ ID NO: 590711 - DNA, 20 bp, Artificial Sequence
  chemically synthesized
tgtgggaaattgacttgaac

SEQ ID NO: 590712 - DNA, 20 bp, Artificial Sequence
  chemically synthesized
aaattgacttgaacagatgt

SEQ ID NO: 590713 - DNA, 20 bp, Artificial Sequence
  chemically synthesized
gggaattacgcaaaataatt

SEQ ID NO: 590714 - DNA, 20 bp, Artificial Sequence
  chemically synthesized
atttttatgatgtctctact

SEQ ID NO: 590715 - DNA, 20 bp, Artificial Sequence
  chemically synthesized
agtcagtaattggctcactg

SEQ ID NO: 590716 - DNA, 20 bp, Artificial Sequence
  chemically synthesized
aattggctcactgaaatgct

SEQ ID NO: 590717 - DNA, 20 bp, Artificial Sequence
  chemically synthesized
gattgtgataactgaaaggt

SEQ ID NO: 590718 - DNA, 20 bp, Artificial Sequence
  chemically synthesized
caatttcaagagagtattaa

SEQ ID NO: 590719 - DNA, 20 bp, Artificial Sequence
  chemically synthesized
tctcttgaaattgacacttt

SEQ ID NO: 590720 - DNA, 20 bp, Artificial Sequence
  chemically synthesized
cataaggtcaattattactc

SEQ ID NO: 590721 - DNA, 20 bp, Artificial Sequence
  chemically synthesized
catgagagtaataattgacc

SEQ ID NO: 590722 - DNA, 20 bp, Artificial Sequence
  chemically synthesized
aattgaccttatgctttagg

SEQ ID NO: 590723 - DNA, 20 bp, Artificial Sequence
  chemically synthesized
cattcaaagtaaaaatattt

SEQ ID NO: 590724 - DNA, 20 bp, Artificial Sequence
  chemically synthesized
acatcttattattagagatg

SEQ ID NO: 590725 - DNA, 20 bp, Artificial Sequence
  chemically synthesized
tattattagagatgagaaga

SEQ ID NO: 590726 - DNA, 20 bp, Artificial Sequence
  chemically synthesized
agaagatttagttttaacaa

SEQ ID NO: 590727 - DNA, 20 bp, Artificial Sequence
  chemically synthesized
caaagattttaggaatgttt

SEQ ID NO: 590728 - DNA, 20 bp, Artificial Sequence
  chemically synthesized
attatctgcaaagattttag

SEQ ID NO: 590729 - DNA, 20 bp, Artificial Sequence
  chemically synthesized
agactctttctaattatctg

SEQ ID NO: 590730 - DNA, 20 bp, Artificial Sequence
  chemically synthesized
atatatgtttttattacaga

SEQ ID NO: 590731 - DNA, 20 bp, Artificial Sequence
  chemically synthesized
gcacattccaaattaaatat

SEQ ID NO: 590732 - DNA, 20 bp, Artificial Sequence
  chemically synthesized
acatatatatttaatttgga

SEQ ID NO: 590733 - DNA, 20 bp, Artificial Sequence
  chemically synthesized
ctctgttccttgtcccttgc

SEQ ID NO: 590734 - DNA, 20 bp, Artificial Sequence
  chemically synthesized
gttgccaagactctacttta

SEQ ID NO: 590735 - DNA, 20 bp, Artificial Sequence
  chemically synthesized
atatcattaaaacaaaaatt

SEQ ID NO: 590736 - DNA, 20 bp, Artificial Sequence
  chemically synthesized
gaaatacataatctgtaaat

SEQ ID NO: 590737 - DNA, 20 bp, Artificial Sequence
  chemically synthesized
ttttacacataattttgcaa

SEQ ID NO: 590738 - DNA, 20 bp, Artificial Sequence
  chemically synthesized
ttgcatactcattcttaaca

SEQ ID NO: 590739 - DNA, 20 bp, Artificial Sequence
  chemically synthesized
cattgacattctggtagttc

SEQ ID NO: 590740 - DNA, 20 bp, Artificial Sequence
  chemically synthesized
tcaatgcattcttccatttc

SEQ ID NO: 590741 - DNA, 20 bp, Artificial Sequence
  chemically synthesized
gggaccactcagttcaatgt

SEQ ID NO: 590742 - DNA, 20 bp, Artificial Sequence
  chemically synthesized
tcctaataatttataacatc

SEQ ID NO: 590743 - DNA, 20 bp, Artificial Sequence
  chemically synthesized
gttatgtctatttatttcct

SEQ ID NO: 590744 - DNA, 20 bp, Artificial Sequence
  chemically synthesized
gggcaaaatgttaaatttct

SEQ ID NO: 590745 - DNA, 20 bp, Artificial Sequence
  chemically synthesized
acagaaatttaacattttgc

SEQ ID NO: 590746 - DNA, 20 bp, Artificial Sequence
  chemically synthesized
aatccttgttcatgcattta

SEQ ID NO: 590747 - DNA, 20 bp, Artificial Sequence
  chemically synthesized
ttcaaatccttgttcatgca

SEQ ID NO: 590748 - DNA, 20 bp, Artificial Sequence
  chemically synthesized
aagcaaactaaatgcatgaa

SEQ ID NO: 590749 - DNA, 20 bp, Artificial Sequence
  chemically synthesized
tgcatgaacaaggatttgaa

SEQ ID NO: 590750 - DNA, 20 bp, Artificial Sequence
  chemically synthesized
ctggaggcctccgttcccaa

SEQ ID NO: 590751 - DNA, 20 bp, Artificial Sequence
  chemically synthesized
gagaaaaaaaaaatttaaaa

SEQ ID NO: 590752 - DNA, 20 bp, Artificial Sequence
  chemically synthesized
ttttctcttgacacatatca

SEQ ID NO: 590753 - DNA, 20 bp, Artificial Sequence
  chemically synthesized
actcatttctttagatagta

SEQ ID NO: 590754 - DNA, 20 bp, Artificial Sequence
  chemically synthesized
gtagcatgtttcattccttg

SEQ ID NO: 590755 - DNA, 20 bp, Artificial Sequence
  chemically synthesized
cttcaccactcttgctaaaa

SEQ ID NO: 590756 - DNA, 20 bp, Artificial Sequence
  chemically synthesized
cttccctttttcctttaccc

SEQ ID NO: 590757 - DNA, 20 bp, Artificial Sequence
  chemically synthesized
cccaataaatatgataaaat

SEQ ID NO: 590758 - DNA, 20 bp, Artificial Sequence
  chemically synthesized
taaattccacaacaaaggga

SEQ ID NO: 590759 - DNA, 20 bp, Artificial Sequence
  chemically synthesized
ctgcaacaaaacctggcaca

SEQ ID NO: 590760 - DNA, 20 bp, Artificial Sequence
  chemically synthesized
tactagtcaatcagcctgtg

SEQ ID NO: 590761 - DNA, 20 bp, Artificial Sequence
  chemically synthesized
agagcaaaaatgaatgacta

SEQ ID NO: 590762 - DNA, 20 bp, Artificial Sequence
  chemically synthesized
accccatcagcctctgtcca

SEQ ID NO: 590763 - DNA, 20 bp, Artificial Sequence
  chemically synthesized
attttagaagaagtacctat

SEQ ID NO: 590764 - DNA, 20 bp, Artificial Sequence
  chemically synthesized
cctccattcgtttgtccttt

SEQ ID NO: 590765 - DNA, 20 bp, Artificial Sequence
  chemically synthesized
gtctactgtttcttccctcc

SEQ ID NO: 590766 - DNA, 20 bp, Artificial Sequence
  chemically synthesized
ttctcaagtatcccgcagtc

SEQ ID NO: 590767 - DNA, 20 bp, Artificial Sequence
  chemically synthesized
ttcattcattttgtttgttt

SEQ ID NO: 590768 - DNA, 20 bp, Artificial Sequence
  chemically synthesized
ggctttcattcattttgttt

SEQ ID NO: 590769 - DNA, 20 bp, Artificial Sequence
  chemically synthesized
cagtggctttcattcatttt

SEQ ID NO: 590770 - DNA, 20 bp, Artificial Sequence
  chemically synthesized
ctgacagtggctttcattca

SEQ ID NO: 590771 - DNA, 20 bp, Artificial Sequence
  chemically synthesized
tctgtgttccaagaactgac

SEQ ID NO: 590772 - DNA, 20 bp, Artificial Sequence
  chemically synthesized
gacctcaaagcaaggtctaa

SEQ ID NO: 590773 - DNA, 20 bp, Artificial Sequence
  chemically synthesized
tgtctcaaatctcaattaga

SEQ ID NO: 590774 - DNA, 20 bp, Artificial Sequence
  chemically synthesized
atactcatttccaatagcaa

SEQ ID NO: 590775 - DNA, 20 bp, Artificial Sequence
  chemically synthesized
tgctattggaaatgagtatg

SEQ ID NO: 590776 - DNA, 20 bp, Artificial Sequence
  chemically synthesized
gtatggaaagctttcagaat

SEQ ID NO: 590777 - DNA, 20 bp, Artificial Sequence
  chemically synthesized
tggaataaaacttccattct

SEQ ID NO: 590778 - DNA, 20 bp, Artificial Sequence
  chemically synthesized
atatataattactaaatgga

SEQ ID NO: 590779 - DNA, 20 bp, Artificial Sequence
  chemically synthesized
atggtgcgtttgtggagggg

SEQ ID NO: 590780 - DNA, 20 bp, Artificial Sequence
  chemically synthesized
tagattgtacaggtttaatg

SEQ ID NO: 590781 - DNA, 20 bp, Artificial Sequence
  chemically synthesized
ccattgttgtcatagattgt

SEQ ID NO: 590782 - DNA, 20 bp, Artificial Sequence
  chemically synthesized
ggataaattcccattgttgt

SEQ ID NO: 590783 - DNA, 20 bp, Artificial Sequence
  chemically synthesized
agttcacatcagataccatt

SEQ ID NO: 590784 - DNA, 20 bp, Artificial Sequence
  chemically synthesized
ctagtataaggactcaaaaa

SEQ ID NO: 590785 - DNA, 20 bp, Artificial Sequence
  chemically synthesized
gatccagaaaattgaaggta

SEQ ID NO: 590786 - DNA, 20 bp, Artificial Sequence
  chemically synthesized
ggttctgcacttgaagggca

SEQ ID NO: 590787 - DNA, 20 bp, Artificial Sequence
  chemically synthesized
ggcacttggtttttcaggaa

SEQ ID NO: 590788 - DNA, 20 bp, Artificial Sequence
  chemically synthesized
ccacatttctctataaatta

SEQ ID NO: 590789 - DNA, 20 bp, Artificial Sequence
  chemically synthesized
atatacttaactaggaaagt

SEQ ID NO: 590790 - DNA, 20 bp, Artificial Sequence
  chemically synthesized
tagttaagtatatttaacaa

SEQ ID NO: 590791 - DNA, 20 bp, Artificial Sequence
  chemically synthesized
tatttaacaacttagattct

SEQ ID NO: 590792 - DNA, 20 bp, Artificial Sequence
  chemically synthesized
ttttaattaaaaataccaaa

SEQ ID NO: 590793 - DNA, 20 bp, Artificial Sequence
  chemically synthesized
gtttctatttgtttatactc

SEQ ID NO: 590794 - DNA, 20 bp, Artificial Sequence
  chemically synthesized
attgtctttagtgtgtttct

SEQ ID NO: 590795 - DNA, 20 bp, Artificial Sequence
  chemically synthesized
aaaatgcataattgtcttta

SEQ ID NO: 590796 - DNA, 20 bp, Artificial Sequence
  chemically synthesized
gaacatttccggacctgcac

SEQ ID NO: 590797 - DNA, 20 bp, Artificial Sequence
  chemically synthesized
gtccggaaatgttcatagac

SEQ ID NO: 590798 - DNA, 20 bp, Artificial Sequence
  chemically synthesized
agtcatttttcaaatttgag

SEQ ID NO: 590799 - DNA, 20 bp, Artificial Sequence
  chemically synthesized
ttttcaaatttgagcatgga

SEQ ID NO: 590800 - DNA, 20 bp, Artificial Sequence
  chemically synthesized
aaatagtataggggtccaaa

SEQ ID NO: 590801 - DNA, 20 bp, Artificial Sequence
  chemically synthesized
gacttaataactccctaaaa

SEQ ID NO: 590802 - DNA, 20 bp, Artificial Sequence
  chemically synthesized
gttattaagtctatagaaaa

SEQ ID NO: 590803 - DNA, 20 bp, Artificial Sequence
  chemically synthesized
aattatgcttttaggaagtg

SEQ ID NO: 590804 - DNA, 20 bp, Artificial Sequence
  chemically synthesized
gtaaactttgtattttatta

SEQ ID NO: 590805 - DNA, 20 bp, Artificial Sequence
  chemically synthesized
agaagcataataataaaata

SEQ ID NO: 590806 - DNA, 20 bp, Artificial Sequence
  chemically synthesized
tttatctatatcaaagttac

SEQ ID NO: 590807 - DNA, 20 bp, Artificial Sequence
  chemically synthesized
ttcatttatcagcattatta

SEQ ID NO: 590808 - DNA, 20 bp, Artificial Sequence
  chemically synthesized
gctgataaatgaaagaattg

SEQ ID NO: 590809 - DNA, 20 bp, Artificial Sequence
  chemically synthesized
aaagtacagttgcatattta

SEQ ID NO: 590810 - DNA, 20 bp, Artificial Sequence
  chemically synthesized
attgtagtaaggatagaaat

SEQ ID NO: 590811 - DNA, 20 bp, Artificial Sequence
  chemically synthesized
aaatcattccttatagaaca

SEQ ID NO: 590812 - DNA, 20 bp, Artificial Sequence
  chemically synthesized
taaaccttatgttctataag

SEQ ID NO: 590813 - DNA, 20 bp, Artificial Sequence
  chemically synthesized
tctttaaaattttatgatat

SEQ ID NO: 590814 - DNA, 20 bp, Artificial Sequence
  chemically synthesized
cataaaattttaaagataat

SEQ ID NO: 590815 - DNA, 20 bp, Artificial Sequence
  chemically synthesized
gatgtttttcatccagttca

SEQ ID NO: 590816 - DNA, 20 bp, Artificial Sequence
  chemically synthesized
agttcaaaatgcttcaccat

SEQ ID NO: 590817 - DNA, 20 bp, Artificial Sequence
  chemically synthesized
cttatacttctcatggacac

SEQ ID NO: 590818 - DNA, 20 bp, Artificial Sequence
  chemically synthesized
ccatgagaagtataagttag

SEQ ID NO: 590819 - DNA, 20 bp, Artificial Sequence
  chemically synthesized
ctaggattttaagaaattca

SEQ ID NO: 590820 - DNA, 20 bp, Artificial Sequence
  chemically synthesized
cgttattttacactattttg

SEQ ID NO: 590821 - DNA, 20 bp, Artificial Sequence
  chemically synthesized
catatttcaaggatatttat

SEQ ID NO: 590822 - DNA, 20 bp, Artificial Sequence
  chemically synthesized
gctctcactgtgttgcccag

SEQ ID NO: 590823 - DNA, 20 bp, Artificial Sequence
  chemically synthesized
tttggaggccaaggtgggat

SEQ ID NO: 590824 - DNA, 20 bp, Artificial Sequence
  chemically synthesized
cagcatttttggaggccaag

SEQ ID NO: 590825 - DNA, 20 bp, Artificial Sequence
  chemically synthesized
caccttggcctccaaaaatg

SEQ ID NO: 590826 - DNA, 20 bp, Artificial Sequence
  chemically synthesized
ctcttgatcacacccacaat

SEQ ID NO: 590827 - DNA, 20 bp, Artificial Sequence
  chemically synthesized
tctctgtaattatgaagaga

SEQ ID NO: 590828 - DNA, 20 bp, Artificial Sequence
  chemically synthesized
tatggggttattttttcttc

SEQ ID NO: 590829 - DNA, 20 bp, Artificial Sequence
  chemically synthesized
taaggaaaaatcacaaaata

SEQ ID NO: 590830 - DNA, 20 bp, Artificial Sequence
  chemically synthesized
actacagtaagcagcctatt

SEQ ID NO: 590831 - DNA, 20 bp, Artificial Sequence
  chemically synthesized
gatagaatgtaattttaaag

SEQ ID NO: 590832 - DNA, 20 bp, Artificial Sequence
  chemically synthesized
atcataaaaagtaggccatt

SEQ ID NO: 590833 - DNA, 20 bp, Artificial Sequence
  chemically synthesized
tcattgagccgttcttaagg

SEQ ID NO: 590834 - DNA, 20 bp, Artificial Sequence
  chemically synthesized
taaactaagtttcaattatc

SEQ ID NO: 590835 - DNA, 20 bp, Artificial Sequence
  chemically synthesized
gaatctagtgataattgaaa

SEQ ID NO: 590836 - DNA, 20 bp, Artificial Sequence
  chemically synthesized
tatcttagttcacttttaaa

SEQ ID NO: 590837 - DNA, 20 bp, Artificial Sequence
  chemically synthesized
aagataactaaaatattttc

SEQ ID NO: 590838 - DNA, 20 bp, Artificial Sequence
  chemically synthesized
ggagacccttaactcctatg

SEQ ID NO: 590839 - DNA, 20 bp, Artificial Sequence
  chemically synthesized
actgtcatccttttaagcaa

SEQ ID NO: 590840 - DNA, 20 bp, Artificial Sequence
  chemically synthesized
tgtggtggagagagaatcta

SEQ ID NO: 590841 - DNA, 20 bp, Artificial Sequence
  chemically synthesized
tgcttgtggtggagagagaa

SEQ ID NO: 590842 - DNA, 20 bp, Artificial Sequence
  chemically synthesized
acttgcatctcccacttagg

SEQ ID NO: 590843 - DNA, 20 bp, Artificial Sequence
  chemically synthesized
gtgtacttgcatctcccact

SEQ ID NO: 590844 - DNA, 20 bp, Artificial Sequence
  chemically synthesized
gtcctgtgaatacaaagatc

SEQ ID NO: 590845 - DNA, 20 bp, Artificial Sequence
  chemically synthesized
aatggagatcatgaaataac

SEQ ID NO: 590846 - DNA, 20 bp, Artificial Sequence
  chemically synthesized
ttttcgtattgggtagaaat

SEQ ID NO: 590847 - DNA, 20 bp, Artificial Sequence
  chemically synthesized
taggatggagtaacaggaaa

SEQ ID NO: 590848 - DNA, 20 bp, Artificial Sequence
  chemically synthesized
ttctatgtgaaaagtgaacc

SEQ ID NO: 590849 - DNA, 20 bp, Artificial Sequence
  chemically synthesized
taaaaaaaaaaattatggac

SEQ ID NO: 590850 - DNA, 20 bp, Artificial Sequence
  chemically synthesized
gtccataattttttttttta

SEQ ID NO: 590851 - DNA, 20 bp, Artificial Sequence
  chemically synthesized
ccactcccagggatatgaaa

SEQ ID NO: 590852 - DNA, 20 bp, Artificial Sequence
  chemically synthesized
tgaagtgtttcatccatgtg

SEQ ID NO: 590853 - DNA, 20 bp, Artificial Sequence
  chemically synthesized
ggatgaaacacttcaaaaag

SEQ ID NO: 590854 - DNA, 20 bp, Artificial Sequence
  chemically synthesized
gaaagaaactatactttttg

SEQ ID NO: 590855 - DNA, 20 bp, Artificial Sequence
  chemically synthesized
ttcaaaaagtatagtttctt

SEQ ID NO: 590856 - DNA, 20 bp, Artificial Sequence
  chemically synthesized
ttttgaattaaggggtgata

SEQ ID NO: 590857 - DNA, 20 bp, Artificial Sequence
  chemically synthesized
cttatcaccccttaattcaa

SEQ ID NO: 590858 - DNA, 20 bp, Artificial Sequence
  chemically synthesized
ttagtcaagtcatattcatg

SEQ ID NO: 590859 - DNA, 20 bp, Artificial Sequence
  chemically synthesized
gtgtgatgttactgattttt

SEQ ID NO: 590860 - DNA, 20 bp, Artificial Sequence
  chemically synthesized
tgtggacagtagtgtgatgt

SEQ ID NO: 590861 - DNA, 20 bp, Artificial Sequence
  chemically synthesized
tgtccacagatattgggtta

SEQ ID NO: 590862 - DNA, 20 bp, Artificial Sequence
  chemically synthesized
tattgggttagtcagatttc

SEQ ID NO: 590863 - DNA, 20 bp, Artificial Sequence
  chemically synthesized
tttagtcaggtaatcgagaa

SEQ ID NO: 590864 - DNA, 20 bp, Artificial Sequence
  chemically synthesized
cacttaatttcaagcaggtt

SEQ ID NO: 590865 - DNA, 20 bp, Artificial Sequence
  chemically synthesized
accttcccacttaatttcaa

SEQ ID NO: 590866 - DNA, 20 bp, Artificial Sequence
  chemically synthesized
tcagtatgctatgttataaa

SEQ ID NO: 590867 - DNA, 20 bp, Artificial Sequence
  chemically synthesized
catttccaattaatgtcagc

SEQ ID NO: 590868 - DNA, 20 bp, Artificial Sequence
  chemically synthesized
ctcattcatttccaattaat

SEQ ID NO: 590869 - DNA, 20 bp, Artificial Sequence
  chemically synthesized
ttgtttttattctggagcag

SEQ ID NO: 590870 - DNA, 20 bp, Artificial Sequence
  chemically synthesized
attgcaactctccttttata

SEQ ID NO: 590871 - DNA, 20 bp, Artificial Sequence
  chemically synthesized
aggcattgcaactctccttt

SEQ ID NO: 590872 - DNA, 20 bp, Artificial Sequence
  chemically synthesized
ataaagaatactcataaatt

SEQ ID NO: 590873 - DNA, 20 bp, Artificial Sequence
  chemically synthesized
gaatactcataaattgtgag

SEQ ID NO: 590874 - DNA, 20 bp, Artificial Sequence
  chemically synthesized
ttgtctattcccacaccact

SEQ ID NO: 590875 - DNA, 20 bp, Artificial Sequence
  chemically synthesized
tgctagatttatcttcctaa

SEQ ID NO: 590876 - DNA, 20 bp, Artificial Sequence
  chemically synthesized
aattttgtattttcaattgt

SEQ ID NO: 590877 - DNA, 20 bp, Artificial Sequence
  chemically synthesized
aactattacaccttctttta

SEQ ID NO: 590878 - DNA, 20 bp, Artificial Sequence
  chemically synthesized
aattctacatttgagagctt

SEQ ID NO: 590879 - DNA, 20 bp, Artificial Sequence
  chemically synthesized
tagatgagaattctacattt

SEQ ID NO: 590880 - DNA, 20 bp, Artificial Sequence
  chemically synthesized
attgacttgtcatctgttag

SEQ ID NO: 590881 - DNA, 20 bp, Artificial Sequence
  chemically synthesized
ctaacagatgacaagtcaat

SEQ ID NO: 590882 - DNA, 20 bp, Artificial Sequence
  chemically synthesized
gacaagtcaattttggctta

SEQ ID NO: 590883 - DNA, 20 bp, Artificial Sequence
  chemically synthesized
tggcttagacagtttcagct

SEQ ID NO: 590884 - DNA, 20 bp, Artificial Sequence
  chemically synthesized
ataaaaagaagtataggaaa

SEQ ID NO: 590885 - DNA, 20 bp, Artificial Sequence
  chemically synthesized
tttttatcatttggtcctgt

SEQ ID NO: 590886 - DNA, 20 bp, Artificial Sequence
  chemically synthesized
gtagacagaggcatgacatt

SEQ ID NO: 590887 - DNA, 20 bp, Artificial Sequence
  chemically synthesized
ctttcctattacagaggcat

SEQ ID NO: 590888 - DNA, 20 bp, Artificial Sequence
  chemically synthesized
taggactggagagtggtatg

SEQ ID NO: 590889 - DNA, 20 bp, Artificial Sequence
  chemically synthesized
gtgccaacaaagatgcaatt

SEQ ID NO: 590890 - DNA, 20 bp, Artificial Sequence
  chemically synthesized
cacacatacgcacaaataat

SEQ ID NO: 590891 - DNA, 20 bp, Artificial Sequence
  chemically synthesized
tgttcataaatcacatttta

SEQ ID NO: 590892 - DNA, 20 bp, Artificial Sequence
  chemically synthesized
actattttaagcagaataaa

SEQ ID NO: 590893 - DNA, 20 bp, Artificial Sequence
  chemically synthesized
aactagggagaggaacatgg

SEQ ID NO: 590894 - DNA, 20 bp, Artificial Sequence
  chemically synthesized
aggtatagatcctactttca

SEQ ID NO: 590895 - DNA, 20 bp, Artificial Sequence
  chemically synthesized
tatgtgcatttaattccccc

SEQ ID NO: 590896 - DNA, 20 bp, Artificial Sequence
  chemically synthesized
attaaatgcacataggaaaa

SEQ ID NO: 590897 - DNA, 20 bp, Artificial Sequence
  chemically synthesized
gacttctaaatctatacaca

SEQ ID NO: 590898 - DNA, 20 bp, Artificial Sequence
  chemically synthesized
aataatgaaagcttcttgtg

SEQ ID NO: 590899 - DNA, 20 bp, Artificial Sequence
  chemically synthesized
taaggatatatgtgaataat

SEQ ID NO: 590900 - DNA, 20 bp, Artificial Sequence
  chemically synthesized
acacataccccacatataca

SEQ ID NO: 590901 - DNA, 20 bp, Artificial Sequence
  chemically synthesized
ttttttttttttattatact

SEQ ID NO: 590902 - DNA, 20 bp, Artificial Sequence
  chemically synthesized
agggtacatgtgcacaacgt

SEQ ID NO: 590903 - DNA, 20 bp, Artificial Sequence
  chemically synthesized
cacctatgagtgagaacatg

SEQ ID NO: 590904 - DNA, 20 bp, Artificial Sequence
  chemically synthesized
atgagtgagaacatgcggtg

SEQ ID NO: 590905 - DNA, 20 bp, Artificial Sequence
  chemically synthesized
gtttggttttttgtccttgc

SEQ ID NO: 590906 - DNA, 20 bp, Artificial Sequence
  chemically synthesized
tgcaatagtttgctgagaac

SEQ ID NO: 590907 - DNA, 20 bp, Artificial Sequence
  chemically synthesized
gtttgctgagaacgatggtt

SEQ ID NO: 590908 - DNA, 20 bp, Artificial Sequence
  chemically synthesized
ctcctcaagtaagccataac

SEQ ID NO: 590909 - DNA, 20 bp, Artificial Sequence
  chemically synthesized
tagctttggcaaacacttgt

SEQ ID NO: 590910 - DNA, 20 bp, Artificial Sequence
  chemically synthesized
tgagcaagtggttagctaat

SEQ ID NO: 590911 - DNA, 20 bp, Artificial Sequence
  chemically synthesized
aattagctaaccacttgctc

SEQ ID NO: 590912 - DNA, 20 bp, Artificial Sequence
  chemically synthesized
atactatggaaatgacctac

SEQ ID NO: 590913 - DNA, 20 bp, Artificial Sequence
  chemically synthesized
taacgtttttgcacagaata

SEQ ID NO: 590914 - DNA, 20 bp, Artificial Sequence
  chemically synthesized
tttcttccaaagttcgttct

SEQ ID NO: 590915 - DNA, 20 bp, Artificial Sequence
  chemically synthesized
acagcagcattttcaccatg

SEQ ID NO: 590916 - DNA, 20 bp, Artificial Sequence
  chemically synthesized
actatgcatggtgaaaatgc

SEQ ID NO: 590917 - DNA, 20 bp, Artificial Sequence
  chemically synthesized
tctatgatgggctgttttgt

SEQ ID NO: 590918 - DNA, 20 bp, Artificial Sequence
  chemically synthesized
gtttcttctactctatgatg

SEQ ID NO: 590919 - DNA, 20 bp, Artificial Sequence
  chemically synthesized
aggcacttgtcctcccaggc

SEQ ID NO: 590920 - DNA, 20 bp, Artificial Sequence
  chemically synthesized
ggacgagattttcgtcaatg

SEQ ID NO: 590921 - DNA, 20 bp, Artificial Sequence
  chemically synthesized
gattgagtctgatataaggg

SEQ ID NO: 590922 - DNA, 20 bp, Artificial Sequence
  chemically synthesized
aatttctcatcttatgaatg

SEQ ID NO: 590923 - DNA, 20 bp, Artificial Sequence
  chemically synthesized
tcataagatgagaaatttgc

SEQ ID NO: 590924 - DNA, 20 bp, Artificial Sequence
  chemically synthesized
ttctggtaaattaaacagag

SEQ ID NO: 590925 - DNA, 20 bp, Artificial Sequence
  chemically synthesized
atctttaatttaaaacatta

SEQ ID NO: 590926 - DNA, 20 bp, Artificial Sequence
  chemically synthesized
tcttaatttatgctcaacag

SEQ ID NO: 590927 - DNA, 20 bp, Artificial Sequence
  chemically synthesized
ttactataaattgaatgtca

SEQ ID NO: 590928 - DNA, 20 bp, Artificial Sequence
  chemically synthesized
tgtgacattcaatttatagt

SEQ ID NO: 590929 - DNA, 20 bp, Artificial Sequence
  chemically synthesized
tagctataatttatttttaa

SEQ ID NO: 590930 - DNA, 20 bp, Artificial Sequence
  chemically synthesized
actatagttagcaataatat

SEQ ID NO: 590931 - DNA, 20 bp, Artificial Sequence
  chemically synthesized
tcccaacacaaataaatgac

SEQ ID NO: 590932 - DNA, 20 bp, Artificial Sequence
  chemically synthesized
catattcatggagaacctag

SEQ ID NO: 590933 - DNA, 20 bp, Artificial Sequence
  chemically synthesized
acatcacgtctactatttta

SEQ ID NO: 590934 - DNA, 20 bp, Artificial Sequence
  chemically synthesized
aatgaagttttatgttccaa

SEQ ID NO: 590935 - DNA, 20 bp, Artificial Sequence
  chemically synthesized
ttcttcctttgcctcagaaa

SEQ ID NO: 590936 - DNA, 20 bp, Artificial Sequence
  chemically synthesized
ttcagaaaaatagtagagcc

SEQ ID NO: 590937 - DNA, 20 bp, Artificial Sequence
  chemically synthesized
aattccaaagtatcatgata

SEQ ID NO: 590938 - DNA, 20 bp, Artificial Sequence
  chemically synthesized
gaatttaggaggctgctata

SEQ ID NO: 590939 - DNA, 20 bp, Artificial Sequence
  chemically synthesized
gctatactgagtttagtcct

SEQ ID NO: 590940 - DNA, 20 bp, Artificial Sequence
  chemically synthesized
aactgagggttggagaaaaa

SEQ ID NO: 590941 - DNA, 20 bp, Artificial Sequence
  chemically synthesized
atctttctttttctccaacc

SEQ ID NO: 590942 - DNA, 20 bp, Artificial Sequence
  chemically synthesized
atgtccttacctcttaatct

SEQ ID NO: 590943 - DNA, 20 bp, Artificial Sequence
  chemically synthesized
tcatatgatcacataaaact

SEQ ID NO: 590944 - DNA, 20 bp, Artificial Sequence
  chemically synthesized
atcttctctctgatcaagca

SEQ ID NO: 590945 - DNA, 20 bp, Artificial Sequence
  chemically synthesized
ctctgatcaagcagtctgct

SEQ ID NO: 590946 - DNA, 20 bp, Artificial Sequence
  chemically synthesized
atttatcaaatcactaagca

SEQ ID NO: 590947 - DNA, 20 bp, Artificial Sequence
  chemically synthesized
aaattaaatgataaactttc

SEQ ID NO: 590948 - DNA, 20 bp, Artificial Sequence
  chemically synthesized
aaaaacacttcaaagcaaat

SEQ ID NO: 590949 - DNA, 20 bp, Artificial Sequence
  chemically synthesized
ataaactttcatttgctttg

SEQ ID NO: 590950 - DNA, 20 bp, Artificial Sequence
  chemically synthesized
ttgctttgaagtgtttttta

SEQ ID NO: 590951 - DNA, 20 bp, Artificial Sequence
  chemically synthesized
ttccctctgctaactttggg

SEQ ID NO: 590952 - DNA, 20 bp, Artificial Sequence
  chemically synthesized
tttccttccctctgctaact

SEQ ID NO: 590953 - DNA, 20 bp, Artificial Sequence
  chemically synthesized
ttagcagagggaaggaaata

SEQ ID NO: 590954 - DNA, 20 bp, Artificial Sequence
  chemically synthesized
ctattgttttctatttcaat

SEQ ID NO: 590955 - DNA, 20 bp, Artificial Sequence
  chemically synthesized
cttagctttgttgatttttc

SEQ ID NO: 590956 - DNA, 20 bp, Artificial Sequence
  chemically synthesized
atagaaaaatcaacaaagct

SEQ ID NO: 590957 - DNA, 20 bp, Artificial Sequence
  chemically synthesized
tttaaaaaaactcttagctt

SEQ ID NO: 590958 - DNA, 20 bp, Artificial Sequence
  chemically synthesized
gatttgtttttaaaaaaact

SEQ ID NO: 590959 - DNA, 20 bp, Artificial Sequence
  chemically synthesized
aagatttgtcaattttattg

SEQ ID NO: 590960 - DNA, 20 bp, Artificial Sequence
  chemically synthesized
acctaaagatttgtcaattt

SEQ ID NO: 590961 - DNA, 20 bp, Artificial Sequence
  chemically synthesized
ataaaattgacaaatcttta

SEQ ID NO: 590962 - DNA, 20 bp, Artificial Sequence
  chemically synthesized
ttttttttacttaatctacc

SEQ ID NO: 590963 - DNA, 20 bp, Artificial Sequence
  chemically synthesized
tgtaatgtctcctctttcat

SEQ ID NO: 590964 - DNA, 20 bp, Artificial Sequence
  chemically synthesized
ctggtatccaaaaagaatgc

SEQ ID NO: 590965 - DNA, 20 bp, Artificial Sequence
  chemically synthesized
ttttttctaggttaacatac

SEQ ID NO: 590966 - DNA, 20 bp, Artificial Sequence
  chemically synthesized
agattcaatattggtagatt

SEQ ID NO: 590967 - DNA, 20 bp, Artificial Sequence
  chemically synthesized
tttcttcaagattcaatatt

SEQ ID NO: 590968 - DNA, 20 bp, Artificial Sequence
  chemically synthesized
tactcagattttctatttct

SEQ ID NO: 590969 - DNA, 20 bp, Artificial Sequence
  chemically synthesized
tccttactagtttcggccta

SEQ ID NO: 590970 - DNA, 20 bp, Artificial Sequence
  chemically synthesized
tgagtaggccgaaactagta

SEQ ID NO: 590971 - DNA, 20 bp, Artificial Sequence
  chemically synthesized
actactgattcaatctcctt

SEQ ID NO: 590972 - DNA, 20 bp, Artificial Sequence
  chemically synthesized
tttgttggaaggttttggac

SEQ ID NO: 590973 - DNA, 20 bp, Artificial Sequence
  chemically synthesized
tcctgggcttttctttgttg

SEQ ID NO: 590974 - DNA, 20 bp, Artificial Sequence
  chemically synthesized
accagtgatgacatttggtc

SEQ ID NO: 590975 - DNA, 20 bp, Artificial Sequence
  chemically synthesized
taattcttctttaactgttc

SEQ ID NO: 590976 - DNA, 20 bp, Artificial Sequence
  chemically synthesized
aatttttctgaagaatttga

SEQ ID NO: 590977 - DNA, 20 bp, Artificial Sequence
  chemically synthesized
atactgatgccccttgtaga

SEQ ID NO: 590978 - DNA, 20 bp, Artificial Sequence
  chemically synthesized
gctagtattttaatgagtta

SEQ ID NO: 590979 - DNA, 20 bp, Artificial Sequence
  chemically synthesized
cctttcaatatactgttgag

SEQ ID NO: 590980 - DNA, 20 bp, Artificial Sequence
  chemically synthesized
ctgaactcaacagtatattg

SEQ ID NO: 590981 - DNA, 20 bp, Artificial Sequence
  chemically synthesized
ggattatacacgagagccat

SEQ ID NO: 590982 - DNA, 20 bp, Artificial Sequence
  chemically synthesized
taatgttgtgtatcacactg

SEQ ID NO: 590983 - DNA, 20 bp, Artificial Sequence
  chemically synthesized
tctgttaatgttgtgtatca

SEQ ID NO: 590984 - DNA, 20 bp, Artificial Sequence
  chemically synthesized
tctgcagctattgagatgac

SEQ ID NO: 590985 - DNA, 20 bp, Artificial Sequence
  chemically synthesized
catctcaatagctgcagaaa

SEQ ID NO: 590986 - DNA, 20 bp, Artificial Sequence
  chemically synthesized
agctgcagaaaaagcgctta

SEQ ID NO: 590987 - DNA, 20 bp, Artificial Sequence
  chemically synthesized
tgaaagtgttgaaacttgtt

SEQ ID NO: 590988 - DNA, 20 bp, Artificial Sequence
  chemically synthesized
cgttctattcctagtttgtt

SEQ ID NO: 590989 - DNA, 20 bp, Artificial Sequence
  chemically synthesized
tgcggtaatttcgttctatt

SEQ ID NO: 590990 - DNA, 20 bp, Artificial Sequence
  chemically synthesized
ttcactgtgggtttttcata

SEQ ID NO: 590991 - DNA, 20 bp, Artificial Sequence
  chemically synthesized
cattaaatgtgatattcact

SEQ ID NO: 590992 - DNA, 20 bp, Artificial Sequence
  chemically synthesized
cttgtttctgatcttaaggg

SEQ ID NO: 590993 - DNA, 20 bp, Artificial Sequence
  chemically synthesized
ggcaaaagtgtgcattcttg

SEQ ID NO: 590994 - DNA, 20 bp, Artificial Sequence
  chemically synthesized
tgttctggctagtacttctg

SEQ ID NO: 590995 - DNA, 20 bp, Artificial Sequence
  chemically synthesized
aaaggaagatgtaaaattat

SEQ ID NO: 590996 - DNA, 20 bp, Artificial Sequence
  chemically synthesized
gtctctgtgtggcgtcactc

SEQ ID NO: 590997 - DNA, 20 bp, Artificial Sequence
  chemically synthesized
gtatcctgcaactttgctga

SEQ ID NO: 590998 - DNA, 20 bp, Artificial Sequence
  chemically synthesized
acaaagtcatcattcaacag

SEQ ID NO: 590999 - DNA, 20 bp, Artificial Sequence
  chemically synthesized
atgagattgttttctaaatt

SEQ ID NO: 591000 - DNA, 20 bp, Artificial Sequence
  chemically synthesized
tttattgctattgtaaatga

SEQ ID NO: 591001 - DNA, 20 bp, Artificial Sequence
  chemically synthesized
tctttttattgctattgtaa

SEQ ID NO: 591002 - DNA, 20 bp, Artificial Sequence
  chemically synthesized
aatttctttcaacaatattt

SEQ ID NO: 591003 - DNA, 20 bp, Artificial Sequence
  chemically synthesized
ggaattacactgtatctgta

SEQ ID NO: 591004 - DNA, 20 bp, Artificial Sequence
  chemically synthesized
tatttctgtaaaaaatgcga

SEQ ID NO: 591005 - DNA, 20 bp, Artificial Sequence
  chemically synthesized
ttaccttatttctgtaaaaa

SEQ ID NO: 591006 - DNA, 20 bp, Artificial Sequence
  chemically synthesized
tttggctatttggagtcgtt

SEQ ID NO: 591007 - DNA, 20 bp, Artificial Sequence
  chemically synthesized
agactgttttggctatttgg

SEQ ID NO: 591008 - DNA, 20 bp, Artificial Sequence
  chemically synthesized
agtttattcttcttcctcaa

SEQ ID NO: 591009 - DNA, 20 bp, Artificial Sequence
  chemically synthesized
aaactagcaagtgtgatgcc

SEQ ID NO: 591010 - DNA, 20 bp, Artificial Sequence
  chemically synthesized
aaactggaggcatcacactt

SEQ ID NO: 591011 - DNA, 20 bp, Artificial Sequence
  chemically synthesized
tatcgtgcgctcttgactga

SEQ ID NO: 591012 - DNA, 20 bp, Artificial Sequence
  chemically synthesized
cacccctattgaaggtgatg

SEQ ID NO: 591013 - DNA, 20 bp, Artificial Sequence
  chemically synthesized
cattctttgcaatgtgtata

SEQ ID NO: 591014 - DNA, 20 bp, Artificial Sequence
  chemically synthesized
attttgagttgatttttatg

SEQ ID NO: 591015 - DNA, 20 bp, Artificial Sequence
  chemically synthesized
ctttactccatttcattttg

SEQ ID NO: 591016 - DNA, 20 bp, Artificial Sequence
  chemically synthesized
atgttttcttctatgagttt

SEQ ID NO: 591017 - DNA, 20 bp, Artificial Sequence
  chemically synthesized
tttcccttatgttttcttct

SEQ ID NO: 591018 - DNA, 20 bp, Artificial Sequence
  chemically synthesized
aatgtcaggaaatttttccc

SEQ ID NO: 591019 - DNA, 20 bp, Artificial Sequence
  chemically synthesized
atatatttctgcttatctag

SEQ ID NO: 591020 - DNA, 20 bp, Artificial Sequence
  chemically synthesized
gtttgatatatttctgctta

SEQ ID NO: 591021 - DNA, 20 bp, Artificial Sequence
  chemically synthesized
agctttttagtttgatatat

SEQ ID NO: 591022 - DNA, 20 bp, Artificial Sequence
  chemically synthesized
agcagaaatatatcaaacta

SEQ ID NO: 591023 - DNA, 20 bp, Artificial Sequence
  chemically synthesized
cccttgctttgtagaagctt

SEQ ID NO: 591024 - DNA, 20 bp, Artificial Sequence
  chemically synthesized
gattgtttcccttgctttgt

SEQ ID NO: 591025 - DNA, 20 bp, Artificial Sequence
  chemically synthesized
ttaattctgttgattgtttc

SEQ ID NO: 591026 - DNA, 20 bp, Artificial Sequence
  chemically synthesized
aggttgcttttaattctgtt

SEQ ID NO: 591027 - DNA, 20 bp, Artificial Sequence
  chemically synthesized
ctataggttgcttttaattc

SEQ ID NO: 591028 - DNA, 20 bp, Artificial Sequence
  chemically synthesized
accttttctctcattctata

SEQ ID NO: 591029 - DNA, 20 bp, Artificial Sequence
  chemically synthesized
gcaacctatagaatgagaga

SEQ ID NO: 591030 - DNA, 20 bp, Artificial Sequence
  chemically synthesized
tattgacaccttatcagata

SEQ ID NO: 591031 - DNA, 20 bp, Artificial Sequence
  chemically synthesized
gaggtagtatatcattgtgg

SEQ ID NO: 591032 - DNA, 20 bp, Artificial Sequence
  chemically synthesized
tccgtgaggtagtatatcat

SEQ ID NO: 591033 - DNA, 20 bp, Artificial Sequence
  chemically synthesized
tccacaatgatatactacct

SEQ ID NO: 591034 - DNA, 20 bp, Artificial Sequence
  chemically synthesized
caccaacacatgtaatgatc

SEQ ID NO: 591035 - DNA, 20 bp, Artificial Sequence
  chemically synthesized
ctggtggaaatataaaattg

SEQ ID NO: 591036 - DNA, 20 bp, Artificial Sequence
  chemically synthesized
agcttttgtggaaaacaata

SEQ ID NO: 591037 - DNA, 20 bp, Artificial Sequence
  chemically synthesized
atttttttgaggaaactcca

SEQ ID NO: 591038 - DNA, 20 bp, Artificial Sequence
  chemically synthesized
gtttagataaatatccagat

SEQ ID NO: 591039 - DNA, 20 bp, Artificial Sequence
  chemically synthesized
tcttcaagatcctaaattga

SEQ ID NO: 591040 - DNA, 20 bp, Artificial Sequence
  chemically synthesized
ttgaagagatatctgcattc

SEQ ID NO: 591041 - DNA, 20 bp, Artificial Sequence
  chemically synthesized
cattcccctgtcaatagaca

SEQ ID NO: 591042 - DNA, 20 bp, Artificial Sequence
  chemically synthesized
attccattgtatgtatataa

SEQ ID NO: 591043 - DNA, 20 bp, Artificial Sequence
  chemically synthesized
catccacattgtagcatatg

SEQ ID NO: 591044 - DNA, 20 bp, Artificial Sequence
  chemically synthesized
ttttatttagcaaaatggct

SEQ ID NO: 591045 - DNA, 20 bp, Artificial Sequence
  chemically synthesized
gcagtatttgtccttttacg

SEQ ID NO: 591046 - DNA, 20 bp, Artificial Sequence
  chemically synthesized
ttagcaaccaccattgtact

SEQ ID NO: 591047 - DNA, 20 bp, Artificial Sequence
  chemically synthesized
taaagatctgctatgcaaca

SEQ ID NO: 591048 - DNA, 20 bp, Artificial Sequence
  chemically synthesized
cacttaaaatttattaagag

SEQ ID NO: 591049 - DNA, 20 bp, Artificial Sequence
  chemically synthesized
ttcattaaaaaaataaaaac

SEQ ID NO: 591050 - DNA, 20 bp, Artificial Sequence
  chemically synthesized
tgtttttttcttaatgaagc

SEQ ID NO: 591051 - DNA, 20 bp, Artificial Sequence
  chemically synthesized
agaattgtatgtgttgaaaa

SEQ ID NO: 591052 - DNA, 20 bp, Artificial Sequence
  chemically synthesized
tttcccaaccagttggcatt

SEQ ID NO: 591053 - DNA, 20 bp, Artificial Sequence
  chemically synthesized
aaataccatgttagctgtct

SEQ ID NO: 591054 - DNA, 20 bp, Artificial Sequence
  chemically synthesized
cttttattatctcttcatat

SEQ ID NO: 591055 - DNA, 20 bp, Artificial Sequence
  chemically synthesized
tagcatatcttttggactaa

SEQ ID NO: 591056 - DNA, 20 bp, Artificial Sequence
  chemically synthesized
ttggactaaggtagattatt

SEQ ID NO: 591057 - DNA, 20 bp, Artificial Sequence
  chemically synthesized
aatccttagcactgggctct

SEQ ID NO: 591058 - DNA, 20 bp, Artificial Sequence
  chemically synthesized
aaacaggaagagcccagtgc

SEQ ID NO: 591059 - DNA, 20 bp, Artificial Sequence
  chemically synthesized
gaagggtgggtgataatact

SEQ ID NO: 591060 - DNA, 20 bp, Artificial Sequence
  chemically synthesized
agatacctgaaatatgaatc

SEQ ID NO: 591061 - DNA, 20 bp, Artificial Sequence
  chemically synthesized
ctgaaatatgaatctgatgt

SEQ ID NO: 591062 - DNA, 20 bp, Artificial Sequence
  chemically synthesized
attctttaaaaaactaaaac

SEQ ID NO: 591063 - DNA, 20 bp, Artificial Sequence
  chemically synthesized
ttttttaaagaattttacaa

SEQ ID NO: 591064 - DNA, 20 bp, Artificial Sequence
  chemically synthesized
atctctacagctatttaaaa

SEQ ID NO: 591065 - DNA, 20 bp, Artificial Sequence
  chemically synthesized
aacagatttttaaatagctg

SEQ ID NO: 591066 - DNA, 20 bp, Artificial Sequence
  chemically synthesized
cctacttttgggtacaactg

SEQ ID NO: 591067 - DNA, 20 bp, Artificial Sequence
  chemically synthesized
attatcctacttttgggtac

SEQ ID NO: 591068 - DNA, 20 bp, Artificial Sequence
  chemically synthesized
aaagtaggataataaagatc

SEQ ID NO: 591069 - DNA, 20 bp, Artificial Sequence
  chemically synthesized
tgccaaagaaggaggaaaca

SEQ ID NO: 591070 - DNA, 20 bp, Artificial Sequence
  chemically synthesized
ttgaagacaaataacaaact

SEQ ID NO: 591071 - DNA, 20 bp, Artificial Sequence
  chemically synthesized
ttatttgtcttcaatttatg

SEQ ID NO: 591072 - DNA, 20 bp, Artificial Sequence
  chemically synthesized
caatttatgctatgcttctt

SEQ ID NO: 591073 - DNA, 20 bp, Artificial Sequence
  chemically synthesized
taatcggtgggtctgctgga

SEQ ID NO: 591074 - DNA, 20 bp, Artificial Sequence
  chemically synthesized
aaagccatatccagcagacc

SEQ ID NO: 591075 - DNA, 20 bp, Artificial Sequence
  chemically synthesized
catgaactaatttatttcca

SEQ ID NO: 591076 - DNA, 20 bp, Artificial Sequence
  chemically synthesized
aagaatttacagtcctgtgt

SEQ ID NO: 591077 - DNA, 20 bp, Artificial Sequence
  chemically synthesized
taagcattttaatttcttga

SEQ ID NO: 591078 - DNA, 20 bp, Artificial Sequence
  chemically synthesized
aaagctccttcaagaaatta

SEQ ID NO: 591079 - DNA, 20 bp, Artificial Sequence
  chemically synthesized
taatgatctatccaactttg

SEQ ID NO: 591080 - DNA, 20 bp, Artificial Sequence
  chemically synthesized
gacaaattgaggattcattc

SEQ ID NO: 591081 - DNA, 20 bp, Artificial Sequence
  chemically synthesized
tttccaaaaaattgacaaat

SEQ ID NO: 591082 - DNA, 20 bp, Artificial Sequence
  chemically synthesized
tttcaatagctgtagaaggt

SEQ ID NO: 591083 - DNA, 20 bp, Artificial Sequence
  chemically synthesized
cagctattgaaaattcagag

SEQ ID NO: 591084 - DNA, 20 bp, Artificial Sequence
  chemically synthesized
tgcaggaaggatgatataga

SEQ ID NO: 591085 - DNA, 20 bp, Artificial Sequence
  chemically synthesized
taaggttgcaggaaggatga

SEQ ID NO: 591086 - DNA, 20 bp, Artificial Sequence
  chemically synthesized
ttcctgcaaccttaccacag

SEQ ID NO: 591087 - DNA, 20 bp, Artificial Sequence
  chemically synthesized
attttatcttcatttaaagc

SEQ ID NO: 591088 - DNA, 20 bp, Artificial Sequence
  chemically synthesized
tcacaatgcatctttcaatc

SEQ ID NO: 591089 - DNA, 20 bp, Artificial Sequence
  chemically synthesized
agatgcattgtgagagaagt

SEQ ID NO: 591090 - DNA, 20 bp, Artificial Sequence
  chemically synthesized
tgatgctttattgtatatct

SEQ ID NO: 591091 - DNA, 20 bp, Artificial Sequence
  chemically synthesized
tgttctttctttcaggttaa

SEQ ID NO: 591092 - DNA, 20 bp, Artificial Sequence
  chemically synthesized
tcaattccaattaactttgc

SEQ ID NO: 591093 - DNA, 20 bp, Artificial Sequence
  chemically synthesized
ctacaatgttcctagtgata

SEQ ID NO: 591094 - DNA, 20 bp, Artificial Sequence
  chemically synthesized
tagtgatagacagttttaat

SEQ ID NO: 591095 - DNA, 20 bp, Artificial Sequence
  chemically synthesized
tctttttcaaatactccaag

SEQ ID NO: 591096 - DNA, 20 bp, Artificial Sequence
  chemically synthesized
ttgtctctttttcaaatact

SEQ ID NO: 591097 - DNA, 20 bp, Artificial Sequence
  chemically synthesized
ggaaatccttagtggaaaga

SEQ ID NO: 591098 - DNA, 20 bp, Artificial Sequence
  chemically synthesized
ctaaaacctagtctttccac

SEQ ID NO: 591099 - DNA, 20 bp, Artificial Sequence
  chemically synthesized
actaaggatttccttttctt

SEQ ID NO: 591100 - DNA, 20 bp, Artificial Sequence
  chemically synthesized
atttccttttctttaaagtt

SEQ ID NO: 591101 - DNA, 20 bp, Artificial Sequence
  chemically synthesized
ctgtgtcttctctactcaaa

SEQ ID NO: 591102 - DNA, 20 bp, Artificial Sequence
  chemically synthesized
gctcagctaacatgctgcag

SEQ ID NO: 591103 - DNA, 20 bp, Artificial Sequence
  chemically synthesized
ctcacttagcctctctgtgc

SEQ ID NO: 591104 - DNA, 20 bp, Artificial Sequence
  chemically synthesized
ttactatgtgccaggccaaa

SEQ ID NO: 591105 - DNA, 20 bp, Artificial Sequence
  chemically synthesized
atgatagtgatagttttatt

SEQ ID NO: 591106 - DNA, 20 bp, Artificial Sequence
  chemically synthesized
tgcttcataaaaatgatagt

SEQ ID NO: 591107 - DNA, 20 bp, Artificial Sequence
  chemically synthesized
ggttcaagaagaatgcttta

SEQ ID NO: 591108 - DNA, 20 bp, Artificial Sequence
  chemically synthesized
gtagagaagtggttcaagaa

SEQ ID NO: 591109 - DNA, 20 bp, Artificial Sequence
  chemically synthesized
acaattcttcagatctaagc

SEQ ID NO: 591110 - DNA, 20 bp, Artificial Sequence
  chemically synthesized
attttgaggtatccataaac

SEQ ID NO: 591111 - DNA, 20 bp, Artificial Sequence
  chemically synthesized
agttgtttatggatacctca

SEQ ID NO: 591112 - DNA, 20 bp, Artificial Sequence
  chemically synthesized
gacaggtgggtcaggctagt

SEQ ID NO: 591113 - DNA, 20 bp, Artificial Sequence
  chemically synthesized
tacttcctacactgaaagca

SEQ ID NO: 591114 - DNA, 20 bp, Artificial Sequence
  chemically synthesized
agtcagaatagcatcaatca

SEQ ID NO: 591115 - DNA, 20 bp, Artificial Sequence
  chemically synthesized
gaacgatgaatggcctgctc

SEQ ID NO: 591116 - DNA, 20 bp, Artificial Sequence
  chemically synthesized
gtatgatgatagctgtttca

SEQ ID NO: 591117 - DNA, 20 bp, Artificial Sequence
  chemically synthesized
atttatagaggtatgatgat

SEQ ID NO: 591118 - DNA, 20 bp, Artificial Sequence
  chemically synthesized
gaccccaccaggaatggccg

SEQ ID NO: 591119 - DNA, 20 bp, Artificial Sequence
  chemically synthesized
cacaggtatttgaaattaga

SEQ ID NO: 591120 - DNA, 20 bp, Artificial Sequence
  chemically synthesized
gaattgagaattgtccacac

SEQ ID NO: 591121 - DNA, 20 bp, Artificial Sequence
  chemically synthesized
ccatcattctgtaataggtc

SEQ ID NO: 591122 - DNA, 20 bp, Artificial Sequence
  chemically synthesized
tgctctagctatagaattgt

SEQ ID NO: 591123 - DNA, 20 bp, Artificial Sequence
  chemically synthesized
tggtgttgctctagctatag

SEQ ID NO: 591124 - DNA, 20 bp, Artificial Sequence
  chemically synthesized
tatagctagagcaacaccac

SEQ ID NO: 591125 - DNA, 20 bp, Artificial Sequence
  chemically synthesized
gctagagcaacaccacgaaa

SEQ ID NO: 591126 - DNA, 20 bp, Artificial Sequence
  chemically synthesized
aggctgagcatgtttttcct

SEQ ID NO: 591127 - DNA, 20 bp, Artificial Sequence
  chemically synthesized
cttagctataggaaggctga

SEQ ID NO: 591128 - DNA, 20 bp, Artificial Sequence
  chemically synthesized
tactcttctggcctccgtac

SEQ ID NO: 591129 - DNA, 20 bp, Artificial Sequence
  chemically synthesized
tttattagaataaagagttc

SEQ ID NO: 591130 - DNA, 20 bp, Artificial Sequence
  chemically synthesized
ttacagagtccacatgtggg

SEQ ID NO: 591131 - DNA, 20 bp, Artificial Sequence
  chemically synthesized
ttgatctatattattccgtg

SEQ ID NO: 591132 - DNA, 20 bp, Artificial Sequence
  chemically synthesized
tttcacggaataatatagat

SEQ ID NO: 591133 - DNA, 20 bp, Artificial Sequence
  chemically synthesized
atatagatcaatgtttctca

SEQ ID NO: 591134 - DNA, 20 bp, Artificial Sequence
  chemically synthesized
aggtcttagaaatctgaggt

SEQ ID NO: 591135 - DNA, 20 bp, Artificial Sequence
  chemically synthesized
ggagattttaaaactgacac

SEQ ID NO: 591136 - DNA, 20 bp, Artificial Sequence
  chemically synthesized
tatgtgtacacatattttcc

SEQ ID NO: 591137 - DNA, 20 bp, Artificial Sequence
  chemically synthesized
tcagctcaactgaaactgat

SEQ ID NO: 591138 - DNA, 20 bp, Artificial Sequence
  chemically synthesized
caggaacactgtaatcagct

SEQ ID NO: 591139 - DNA, 20 bp, Artificial Sequence
  chemically synthesized
ctgatagctgattacagtgt

SEQ ID NO: 591140 - DNA, 20 bp, Artificial Sequence
  chemically synthesized
ctttgttgatatttataagg

SEQ ID NO: 591141 - DNA, 20 bp, Artificial Sequence
  chemically synthesized
caattctttacactttacat

SEQ ID NO: 591142 - DNA, 20 bp, Artificial Sequence
  chemically synthesized
cttgttttcttccattctaa

SEQ ID NO: 591143 - DNA, 20 bp, Artificial Sequence
  chemically synthesized
cattcactaactcctcatct

SEQ ID NO: 591144 - DNA, 20 bp, Artificial Sequence
  chemically synthesized
tttcatttctattttaaaag

SEQ ID NO: 591145 - DNA, 20 bp, Artificial Sequence
  chemically synthesized
atttatctgtattcatatga

SEQ ID NO: 591146 - DNA, 20 bp, Artificial Sequence
  chemically synthesized
ataaatgtcttgatgtgaat

SEQ ID NO: 591147 - DNA, 20 bp, Artificial Sequence
  chemically synthesized
tttatacaatactattttta

SEQ ID NO: 591148 - DNA, 20 bp, Artificial Sequence
  chemically synthesized
gttacttttgtatatcggga

SEQ ID NO: 591149 - DNA, 20 bp, Artificial Sequence
  chemically synthesized
ttcttaaaaagtataagtaa

SEQ ID NO: 591150 - DNA, 20 bp, Artificial Sequence
  chemically synthesized
aaaaggattttagaataaat

SEQ ID NO: 591151 - DNA, 20 bp, Artificial Sequence
  chemically synthesized
taaatggaagttttaaaaca

SEQ ID NO: 591152 - DNA, 20 bp, Artificial Sequence
  chemically synthesized
aattcttcatatggcaagct

SEQ ID NO: 591153 - DNA, 20 bp, Artificial Sequence
  chemically synthesized
tatgaattcttcatatggca

SEQ ID NO: 591154 - DNA, 20 bp, Artificial Sequence
  chemically synthesized
tcatactagtctttttggat

SEQ ID NO: 591155 - DNA, 20 bp, Artificial Sequence
  chemically synthesized
agtaaaatttaatctgcaca

SEQ ID NO: 591156 - DNA, 20 bp, Artificial Sequence
  chemically synthesized
gtgtaagacaaagccatttg

SEQ ID NO: 591157 - DNA, 20 bp, Artificial Sequence
  chemically synthesized
ttgtttggactggcttttgg

SEQ ID NO: 591158 - DNA, 20 bp, Artificial Sequence
  chemically synthesized
tttctgttttacttgtttgg

SEQ ID NO: 591159 - DNA, 20 bp, Artificial Sequence
  chemically synthesized
ctacattcagtttctgtttt

SEQ ID NO: 591160 - DNA, 20 bp, Artificial Sequence
  chemically synthesized
gttccaactctacattcagt

SEQ ID NO: 591161 - DNA, 20 bp, Artificial Sequence
  chemically synthesized
atatcagttccaactctaca

SEQ ID NO: 591162 - DNA, 20 bp, Artificial Sequence
  chemically synthesized
agttggaactgatattcaat

SEQ ID NO: 591163 - DNA, 20 bp, Artificial Sequence
  chemically synthesized
atattcaattttggattaga

SEQ ID NO: 591164 - DNA, 20 bp, Artificial Sequence
  chemically synthesized
gtttttttttcctttcaata

SEQ ID NO: 591165 - DNA, 20 bp, Artificial Sequence
  chemically synthesized
aaacagcagatctgaaatta

SEQ ID NO: 591166 - DNA, 20 bp, Artificial Sequence
  chemically synthesized
aaacacagtaatttcagatc

SEQ ID NO: 591167 - DNA, 20 bp, Artificial Sequence
  chemically synthesized
tcagtaaacctgacactaat

SEQ ID NO: 591168 - DNA, 20 bp, Artificial Sequence
  chemically synthesized
ttaaaaaactcagattagtg

SEQ ID NO: 591169 - DNA, 20 bp, Artificial Sequence
  chemically synthesized
gaattaatttttttaaaaaa

SEQ ID NO: 591170 - DNA, 20 bp, Artificial Sequence
  chemically synthesized
tttaaaaaaattaattctga

SEQ ID NO: 591171 - DNA, 20 bp, Artificial Sequence
  chemically synthesized
aattctgacaaagcttgaga

SEQ ID NO: 591172 - DNA, 20 bp, Artificial Sequence
  chemically synthesized
ctcactattaaaacattatc

SEQ ID NO: 591173 - DNA, 20 bp, Artificial Sequence
  chemically synthesized
tcaacattcaattaagtcaa

SEQ ID NO: 591174 - DNA, 20 bp, Artificial Sequence
  chemically synthesized
aattaagtcaattcagcttt

SEQ ID NO: 591175 - DNA, 20 bp, Artificial Sequence
  chemically synthesized
tgcagaattttctactcaaa

SEQ ID NO: 591176 - DNA, 20 bp, Artificial Sequence
  chemically synthesized
acacacacacacacacacac

SEQ ID NO: 591177 - DNA, 20 bp, Artificial Sequence
  chemically synthesized
agatttatagtgaaggcata

SEQ ID NO: 591178 - DNA, 20 bp, Artificial Sequence
  chemically synthesized
atatgccttcactataaatc

SEQ ID NO: 591179 - DNA, 20 bp, Artificial Sequence
  chemically synthesized
ttgtcttttctaacctaatc

SEQ ID NO: 591180 - DNA, 20 bp, Artificial Sequence
  chemically synthesized
ggcaattgatcactccaaag

SEQ ID NO: 591181 - DNA, 20 bp, Artificial Sequence
  chemically synthesized
tttggagtgatcaattgcct

SEQ ID NO: 591182 - DNA, 20 bp, Artificial Sequence
  chemically synthesized
tgagttttgtccccctcaac

SEQ ID NO: 591183 - DNA, 20 bp, Artificial Sequence
  chemically synthesized
ttccagcagaacttctgagg

SEQ ID NO: 591184 - DNA, 20 bp, Artificial Sequence
  chemically synthesized
cattatagaaagacttcaac

SEQ ID NO: 591185 - DNA, 20 bp, Artificial Sequence
  chemically synthesized
aagcataaataacatttgca

SEQ ID NO: 591186 - DNA, 20 bp, Artificial Sequence
  chemically synthesized
cataaagcataaataacatt

SEQ ID NO: 591187 - DNA, 20 bp, Artificial Sequence
  chemically synthesized
aaacaaactgcaaatgttat

SEQ ID NO: 591188 - DNA, 20 bp, Artificial Sequence
  chemically synthesized
aacctgaatataagactggg

SEQ ID NO: 591189 - DNA, 20 bp, Artificial Sequence
  chemically synthesized
tataagactgggtctcgatt

SEQ ID NO: 591190 - DNA, 20 bp, Artificial Sequence
  chemically synthesized
tagatccacaaaatgcaaac

SEQ ID NO: 591191 - DNA, 20 bp, Artificial Sequence
  chemically synthesized
acccttttgtgcgtggaatc

SEQ ID NO: 591192 - DNA, 20 bp, Artificial Sequence
  chemically synthesized
aagggtgcaaacacgaactt

SEQ ID NO: 591193 - DNA, 20 bp, Artificial Sequence
  chemically synthesized
gatatgagaatcataaaagt

SEQ ID NO: 591194 - DNA, 20 bp, Artificial Sequence
  chemically synthesized
atctttcaaatatacttatg

SEQ ID NO: 591195 - DNA, 20 bp, Artificial Sequence
  chemically synthesized
atgggacaggtatggataag

SEQ ID NO: 591196 - DNA, 20 bp, Artificial Sequence
  chemically synthesized
cgatctttgtatactcgttg

SEQ ID NO: 591197 - DNA, 20 bp, Artificial Sequence
  chemically synthesized
acttccaggttgtctttctt

SEQ ID NO: 591198 - DNA, 20 bp, Artificial Sequence
  chemically synthesized
gaaagacaacctggaagtta

SEQ ID NO: 591199 - DNA, 20 bp, Artificial Sequence
  chemically synthesized
ggaagttaaaatgtttgaca

SEQ ID NO: 591200 - DNA, 20 bp, Artificial Sequence
  chemically synthesized
acattaagatttactaaaca

SEQ ID NO: 591201 - DNA, 20 bp, Artificial Sequence
  chemically synthesized
tttgtgaaattttgcaaact

SEQ ID NO: 591202 - DNA, 20 bp, Artificial Sequence
  chemically synthesized
catcatatcagatgaactta

SEQ ID NO: 591203 - DNA, 20 bp, Artificial Sequence
  chemically synthesized
ataagttcatctgatatgat

SEQ ID NO: 591204 - DNA, 20 bp, Artificial Sequence
  chemically synthesized
agaatacagaaattatattc

SEQ ID NO: 591205 - DNA, 20 bp, Artificial Sequence
  chemically synthesized
gtttacattttaaacttgtg

SEQ ID NO: 591206 - DNA, 20 bp, Artificial Sequence
  chemically synthesized
atattcagtccaaacatctc

SEQ ID NO: 591207 - DNA, 20 bp, Artificial Sequence
  chemically synthesized
caaaacttttaacctccact

SEQ ID NO: 591208 - DNA, 20 bp, Artificial Sequence
  chemically synthesized
caaagctcaaagtggaggtt

SEQ ID NO: 591209 - DNA, 20 bp, Artificial Sequence
  chemically synthesized
gaggttaaaagttttgactc

SEQ ID NO: 591210 - DNA, 20 bp, Artificial Sequence
  chemically synthesized
tttcaatgtatatgagataa

SEQ ID NO: 591211 - DNA, 20 bp, Artificial Sequence
  chemically synthesized
ttggtgacattctaatataa

SEQ ID NO: 591212 - DNA, 20 bp, Artificial Sequence
  chemically synthesized
tttaatatataaagccttaa

SEQ ID NO: 591213 - DNA, 20 bp, Artificial Sequence
  chemically synthesized
ttttatagattaaacataat

SEQ ID NO: 591214 - DNA, 20 bp, Artificial Sequence
  chemically synthesized
gtctctaacattagtggttt

SEQ ID NO: 591215 - DNA, 20 bp, Artificial Sequence
  chemically synthesized
gatgaatagtctctaacatt

SEQ ID NO: 591216 - DNA, 20 bp, Artificial Sequence
  chemically synthesized
atttatgcataatttctcca

SEQ ID NO: 591217 - DNA, 20 bp, Artificial Sequence
  chemically synthesized
gtgtgcatgtgtgaagaatc

SEQ ID NO: 591218 - DNA, 20 bp, Artificial Sequence
  chemically synthesized
agtcaagtggatagagaaac

SEQ ID NO: 591219 - DNA, 20 bp, Artificial Sequence
  chemically synthesized
cataccagaatttttgcatg

SEQ ID NO: 591220 - DNA, 20 bp, Artificial Sequence
  chemically synthesized
aatttttgcatgctgggttt

SEQ ID NO: 591221 - DNA, 20 bp, Artificial Sequence
  chemically synthesized
gtggctaggattaatgatct

SEQ ID NO: 591222 - DNA, 20 bp, Artificial Sequence
  chemically synthesized
taatgtagatgtttttgtgg

SEQ ID NO: 591223 - DNA, 20 bp, Artificial Sequence
  chemically synthesized
gccaaggtttaaattaatgt

SEQ ID NO: 591224 - DNA, 20 bp, Artificial Sequence
  chemically synthesized
tttacttgtttaacgtttgc

SEQ ID NO: 591225 - DNA, 20 bp, Artificial Sequence
  chemically synthesized
actttcgtaatttacttgtt

SEQ ID NO: 591226 - DNA, 20 bp, Artificial Sequence
  chemically synthesized
ggctcatactttcgtaattt

SEQ ID NO: 591227 - DNA, 20 bp, Artificial Sequence
  chemically synthesized
atcatgtcctacttctcttc

SEQ ID NO: 591228 - DNA, 20 bp, Artificial Sequence
  chemically synthesized
ccattgtttctcagcatctt

SEQ ID NO: 591229 - DNA, 20 bp, Artificial Sequence
  chemically synthesized
gaaatgtatttaagggatta

SEQ ID NO: 591230 - DNA, 20 bp, Artificial Sequence
  chemically synthesized
tatactgaagaaatgtattt

SEQ ID NO: 591231 - DNA, 20 bp, Artificial Sequence
  chemically synthesized
ttcttcagtatatctgaatt

SEQ ID NO: 591232 - DNA, 20 bp, Artificial Sequence
  chemically synthesized
ttgtagttagctaatgtata

SEQ ID NO: 591233 - DNA, 20 bp, Artificial Sequence
  chemically synthesized
agtatatacattagctaact

SEQ ID NO: 591234 - DNA, 20 bp, Artificial Sequence
  chemically synthesized
cactcaacccattcttaaaa

SEQ ID NO: 591235 - DNA, 20 bp, Artificial Sequence
  chemically synthesized
tccttcaggataatggggga

SEQ ID NO: 591236 - DNA, 20 bp, Artificial Sequence
  chemically synthesized
aggataatgggggaaaatgc

SEQ ID NO: 591237 - DNA, 20 bp, Artificial Sequence
  chemically synthesized
ggaaaatgcttatgcttttt

SEQ ID NO: 591238 - DNA, 20 bp, Artificial Sequence
  chemically synthesized
tattcaccctagcatgctat

SEQ ID NO: 591239 - DNA, 20 bp, Artificial Sequence
  chemically synthesized
gatcctttaaacatctggcc

SEQ ID NO: 591240 - DNA, 20 bp, Artificial Sequence
  chemically synthesized
tgcattttaaacagtaggcc

SEQ ID NO: 591241 - DNA, 20 bp, Artificial Sequence
  chemically synthesized
taggtacttaattgaaggtc

SEQ ID NO: 591242 - DNA, 20 bp, Artificial Sequence
  chemically synthesized
gtcttttctcttttatcatt

SEQ ID NO: 591243 - DNA, 20 bp, Artificial Sequence
  chemically synthesized
gataaaagagaaaagacagt

SEQ ID NO: 591244 - DNA, 20 bp, Artificial Sequence
  chemically synthesized
tgccaaagaattctttcata

SEQ ID NO: 591245 - DNA, 20 bp, Artificial Sequence
  chemically synthesized
aggccaaaagaagtgattct

SEQ ID NO: 591246 - DNA, 20 bp, Artificial Sequence
  chemically synthesized
attaattccaaggccaaaag

SEQ ID NO: 591247 - DNA, 20 bp, Artificial Sequence
  chemically synthesized
ttcattaaaatttaaatttc

SEQ ID NO: 591248 - DNA, 20 bp, Artificial Sequence
  chemically synthesized
atatcaaacttgagaagttg

SEQ ID NO: 591249 - DNA, 20 bp, Artificial Sequence
  chemically synthesized
tagacaatcagctcaacttc

SEQ ID NO: 591250 - DNA, 20 bp, Artificial Sequence
  chemically synthesized
ctttttgacatgttcctgtg

SEQ ID NO: 591251 - DNA, 20 bp, Artificial Sequence
  chemically synthesized
aatgcaagttctttgccgtc

SEQ ID NO: 591252 - DNA, 20 bp, Artificial Sequence
  chemically synthesized
aagttctttgccgtccaaag

SEQ ID NO: 591253 - DNA, 20 bp, Artificial Sequence
  chemically synthesized
agtgctatgtgaacatatat

SEQ ID NO: 591254 - DNA, 20 bp, Artificial Sequence
  chemically synthesized
aattgctttcttttcctgga

SEQ ID NO: 591255 - DNA, 20 bp, Artificial Sequence
  chemically synthesized
taatggtaggtctttgggta

SEQ ID NO: 591256 - DNA, 20 bp, Artificial Sequence
  chemically synthesized
ttattacactccgtatttct

SEQ ID NO: 591257 - DNA, 20 bp, Artificial Sequence
  chemically synthesized
gaatttttgaaatgataact

SEQ ID NO: 591258 - DNA, 20 bp, Artificial Sequence
  chemically synthesized
aacttgttttgtagacttga

SEQ ID NO: 591259 - DNA, 20 bp, Artificial Sequence
  chemically synthesized
aactagttcaagtctacaaa

SEQ ID NO: 591260 - DNA, 20 bp, Artificial Sequence
  chemically synthesized
acattcaattatgagagcaa

SEQ ID NO: 591261 - DNA, 20 bp, Artificial Sequence
  chemically synthesized
tgctctcataattgaatgtg

SEQ ID NO: 591262 - DNA, 20 bp, Artificial Sequence
  chemically synthesized
gttacattcttcacactgta

SEQ ID NO: 591263 - DNA, 20 bp, Artificial Sequence
  chemically synthesized
gacagaaaacaaaatacatt

SEQ ID NO: 591264 - DNA, 20 bp, Artificial Sequence
  chemically synthesized
atacacaaacatccaatgta

SEQ ID NO: 591265 - DNA, 20 bp, Artificial Sequence
  chemically synthesized
gtgttgctttctatggccaa

SEQ ID NO: 591266 - DNA, 20 bp, Artificial Sequence
  chemically synthesized
ttggccatagaaagcaacac

SEQ ID NO: 591267 - DNA, 20 bp, Artificial Sequence
  chemically synthesized
ttaccatttcaaaacacccg

SEQ ID NO: 591268 - DNA, 20 bp, Artificial Sequence
  chemically synthesized
cttttatatgaatattattt

SEQ ID NO: 591269 - DNA, 20 bp, Artificial Sequence
  chemically synthesized
acgtgttgtgctgttttaat

SEQ ID NO: 591270 - DNA, 20 bp, Artificial Sequence
  chemically synthesized
tgcctattacttacgtgttg

SEQ ID NO: 591271 - DNA, 20 bp, Artificial Sequence
  chemically synthesized
tcattctgacaaaagtatgt

SEQ ID NO: 591272 - DNA, 20 bp, Artificial Sequence
  chemically synthesized
gagattttttttcctgacaa

SEQ ID NO: 591273 - DNA, 20 bp, Artificial Sequence
  chemically synthesized
gaaaattcttctttagactg

SEQ ID NO: 591274 - DNA, 20 bp, Artificial Sequence
  chemically synthesized
ggctgcttgatatggatatg

SEQ ID NO: 591275 - DNA, 20 bp, Artificial Sequence
  chemically synthesized
catatcaagcagccatgaag

SEQ ID NO: 591276 - DNA, 20 bp, Artificial Sequence
  chemically synthesized
aactagaaacattccttcat

SEQ ID NO: 591277 - DNA, 20 bp, Artificial Sequence
  chemically synthesized
tcttcacaggtgtactttga

SEQ ID NO: 591278 - DNA, 20 bp, Artificial Sequence
  chemically synthesized
cacaggtgtactttgaatca

SEQ ID NO: 591279 - DNA, 20 bp, Artificial Sequence
  chemically synthesized
aaccactgataagttaatca

SEQ ID NO: 591280 - DNA, 20 bp, Artificial Sequence
  chemically synthesized
atcagattgattaacttatc

SEQ ID NO: 591281 - DNA, 20 bp, Artificial Sequence
  chemically synthesized
tccatgtattaatattttat

SEQ ID NO: 591282 - DNA, 20 bp, Artificial Sequence
  chemically synthesized
ggatgggggaaatttagtgc

SEQ ID NO: 591283 - DNA, 20 bp, Artificial Sequence
  chemically synthesized
agaacttaaatcacaggggt

SEQ ID NO: 591284 - DNA, 20 bp, Artificial Sequence
  chemically synthesized
ttatttataagccagcaccc

SEQ ID NO: 591285 - DNA, 20 bp, Artificial Sequence
  chemically synthesized
gtataacaataaataaaaat

SEQ ID NO: 591286 - DNA, 20 bp, Artificial Sequence
  chemically synthesized
aataaataaaaatagatgat

SEQ ID NO: 591287 - DNA, 20 bp, Artificial Sequence
  chemically synthesized
tccattttatttgccccaca

SEQ ID NO: 591288 - DNA, 20 bp, Artificial Sequence
  chemically synthesized
tttaaatatttcagtatata

SEQ ID NO: 591289 - DNA, 20 bp, Artificial Sequence
  chemically synthesized
catagatagcccttactact

SEQ ID NO: 591290 - DNA, 20 bp, Artificial Sequence
  chemically synthesized
cctgactacccatgtgtaca

SEQ ID NO: 591291 - DNA, 20 bp, Artificial Sequence
  chemically synthesized
acctgcattagatgctgaca

SEQ ID NO: 591292 - DNA, 20 bp, Artificial Sequence
  chemically synthesized
cctgctctctacagaggtta

SEQ ID NO: 591293 - DNA, 20 bp, Artificial Sequence
  chemically synthesized
tttaacctctgtagagagca

SEQ ID NO: 591294 - DNA, 20 bp, Artificial Sequence
  chemically synthesized
gagagcagggcgtttttgtc

SEQ ID NO: 591295 - DNA, 20 bp, Artificial Sequence
  chemically synthesized
attccagtcaccatatgatg

SEQ ID NO: 591296 - DNA, 20 bp, Artificial Sequence
  chemically synthesized
tgcatccgaaaaatgttagc

SEQ ID NO: 591297 - DNA, 20 bp, Artificial Sequence
  chemically synthesized
tcgttggtaactatgtactg

SEQ ID NO: 591298 - DNA, 20 bp, Artificial Sequence
  chemically synthesized
caacgatggatggatagaaa

SEQ ID NO: 591299 - DNA, 20 bp, Artificial Sequence
  chemically synthesized
gaaatattgttttagaaagt

SEQ ID NO: 591300 - DNA, 20 bp, Artificial Sequence
  chemically synthesized
catatccccatttccactat

SEQ ID NO: 591301 - DNA, 20 bp, Artificial Sequence
  chemically synthesized
atatgtagaaataaaataaa

SEQ ID NO: 591302 - DNA, 20 bp, Artificial Sequence
  chemically synthesized
tttaactgtattactaaata

SEQ ID NO: 591303 - DNA, 20 bp, Artificial Sequence
  chemically synthesized
aatccatgggttatatattg

SEQ ID NO: 591304 - DNA, 20 bp, Artificial Sequence
  chemically synthesized
aagcaattcaatatataacc

SEQ ID NO: 591305 - DNA, 20 bp, Artificial Sequence
  chemically synthesized
aatatataacccatggattg

SEQ ID NO: 591306 - DNA, 20 bp, Artificial Sequence
  chemically synthesized
attgggatgatttttcagtc

SEQ ID NO: 591307 - DNA, 20 bp, Artificial Sequence
  chemically synthesized
aaatttttaacctatttttc

SEQ ID NO: 591308 - DNA, 20 bp, Artificial Sequence
  chemically synthesized
ttttcagacacatggacaaa

SEQ ID NO: 591309 - DNA, 20 bp, Artificial Sequence
  chemically synthesized
aagaatgtttttatctttct

SEQ ID NO: 591310 - DNA, 20 bp, Artificial Sequence
  chemically synthesized
aagtcatgtcggagatccta

SEQ ID NO: 591311 - DNA, 20 bp, Artificial Sequence
  chemically synthesized
aagatccagagggtacatgt

SEQ ID NO: 591312 - DNA, 20 bp, Artificial Sequence
  chemically synthesized
ctggatatatggcgtgatgc

SEQ ID NO: 591313 - DNA, 20 bp, Artificial Sequence
  chemically synthesized
gaaaagctgcctattgtgta

SEQ ID NO: 591314 - DNA, 20 bp, Artificial Sequence
  chemically synthesized
agtaagcatagtacacaata

SEQ ID NO: 591315 - DNA, 20 bp, Artificial Sequence
  chemically synthesized
cctttccccttctattagtc

SEQ ID NO: 591316 - DNA, 20 bp, Artificial Sequence
  chemically synthesized
ataactgagtacatatagta

SEQ ID NO: 591317 - DNA, 20 bp, Artificial Sequence
  chemically synthesized
ggttttctgttcttatgtta

SEQ ID NO: 591318 - DNA, 20 bp, Artificial Sequence
  chemically synthesized
catctatgttgctgcaaagg

SEQ ID NO: 591319 - DNA, 20 bp, Artificial Sequence
  chemically synthesized
caacataggtgtccgtcaac

SEQ ID NO: 591320 - DNA, 20 bp, Artificial Sequence
  chemically synthesized
ccaaaaagacacatgcactc

SEQ ID NO: 591321 - DNA, 20 bp, Artificial Sequence
  chemically synthesized
tgtgtctttttggtagaacc

SEQ ID NO: 591322 - DNA, 20 bp, Artificial Sequence
  chemically synthesized
ttttggatatctactcagta

SEQ ID NO: 591323 - DNA, 20 bp, Artificial Sequence
  chemically synthesized
agttctttgagaaatgtcca

SEQ ID NO: 591324 - DNA, 20 bp, Artificial Sequence
  chemically synthesized
ttagttcagccactgtagaa

SEQ ID NO: 591325 - DNA, 20 bp, Artificial Sequence
  chemically synthesized
gcaaggccgcagagacaagg

SEQ ID NO: 591326 - DNA, 20 bp, Artificial Sequence
  chemically synthesized
taccatctcacacccgtcag

SEQ ID NO: 591327 - DNA, 20 bp, Artificial Sequence
  chemically synthesized
ggtgtgagatggtatctcct

SEQ ID NO: 591328 - DNA, 20 bp, Artificial Sequence
  chemically synthesized
gagatggtatctccttgcgg

SEQ ID NO: 591329 - DNA, 20 bp, Artificial Sequence
  chemically synthesized
tgagtgatgtgacgcatttt

SEQ ID NO: 591330 - DNA, 20 bp, Artificial Sequence
  chemically synthesized
tcttttgcccattttttaaa

SEQ ID NO: 591331 - DNA, 20 bp, Artificial Sequence
  chemically synthesized
cccattttttaaatgatgtt

SEQ ID NO: 591332 - DNA, 20 bp, Artificial Sequence
  chemically synthesized
tttaaatgatgttttatgat

SEQ ID NO: 591333 - DNA, 20 bp, Artificial Sequence
  chemically synthesized
tttatgatttttgtttgttc

SEQ ID NO: 591334 - DNA, 20 bp, Artificial Sequence
  chemically synthesized
gttcaattgtttaggttcct

SEQ ID NO: 591335 - DNA, 20 bp, Artificial Sequence
  chemically synthesized
ccgtcagatgcataacttgc

SEQ ID NO: 591336 - DNA, 20 bp, Artificial Sequence
  chemically synthesized
tgcaaaagttttctcccatt

SEQ ID NO: 591337 - DNA, 20 bp, Artificial Sequence
  chemically synthesized
ttttctcccatttggtgttt

SEQ ID NO: 591338 - DNA, 20 bp, Artificial Sequence
  chemically synthesized
agcaaggacttactaaaata

SEQ ID NO: 591339 - DNA, 20 bp, Artificial Sequence
  chemically synthesized
agctctttattttagtaagt

SEQ ID NO: 591340 - DNA, 20 bp, Artificial Sequence
  chemically synthesized
ttttttttttttttttttgc

SEQ ID NO: 591341 - DNA, 20 bp, Artificial Sequence
  chemically synthesized
tgggaaataccattctggac

SEQ ID NO: 591342 - DNA, 20 bp, Artificial Sequence
  chemically synthesized
caatgtccagaatggtattt

SEQ ID NO: 591343 - DNA, 20 bp, Artificial Sequence
  chemically synthesized
ggtatttcccagattttatt

SEQ ID NO: 591344 - DNA, 20 bp, Artificial Sequence
  chemically synthesized
agattttattctaggattct

SEQ ID NO: 591345 - DNA, 20 bp, Artificial Sequence
  chemically synthesized
ataagcattgggaaatggat

SEQ ID NO: 591346 - DNA, 20 bp, Artificial Sequence
  chemically synthesized
taaatctttaatccatttcc

SEQ ID NO: 591347 - DNA, 20 bp, Artificial Sequence
  chemically synthesized
caaaaaaataagcattggga

SEQ ID NO: 591348 - DNA, 20 bp, Artificial Sequence
  chemically synthesized
cgaacagttggctgtagctg

SEQ ID NO: 591349 - DNA, 20 bp, Artificial Sequence
  chemically synthesized
tatgtgtacatgacatcttg

SEQ ID NO: 591350 - DNA, 20 bp, Artificial Sequence
  chemically synthesized
atatttttttagggcattga

SEQ ID NO: 591351 - DNA, 20 bp, Artificial Sequence
  chemically synthesized
cctaaaaaaatataactttt

SEQ ID NO: 591352 - DNA, 20 bp, Artificial Sequence
  chemically synthesized
ttccaagtttagatttagca

SEQ ID NO: 591353 - DNA, 20 bp, Artificial Sequence
  chemically synthesized
ttaagtaggcagtttccaag

SEQ ID NO: 591354 - DNA, 20 bp, Artificial Sequence
  chemically synthesized
tagaattaagtaggcagttt

SEQ ID NO: 591355 - DNA, 20 bp, Artificial Sequence
  chemically synthesized
tctcattatagaattaagta

SEQ ID NO: 591356 - DNA, 20 bp, Artificial Sequence
  chemically synthesized
cctaacttttgaaatttatg

SEQ ID NO: 591357 - DNA, 20 bp, Artificial Sequence
  chemically synthesized
ggttacttgtcaagtagata

SEQ ID NO: 591358 - DNA, 20 bp, Artificial Sequence
  chemically synthesized
tatctacttgacaagtaacc

SEQ ID NO: 591359 - DNA, 20 bp, Artificial Sequence
  chemically synthesized
tccatattatggtgggtgat

SEQ ID NO: 591360 - DNA, 20 bp, Artificial Sequence
  chemically synthesized
ataatatggaagtgaggtag

SEQ ID NO: 591361 - DNA, 20 bp, Artificial Sequence
  chemically synthesized
aagtgaggtaggtgagattg

SEQ ID NO: 591362 - DNA, 20 bp, Artificial Sequence
  chemically synthesized
actaaaatgtctctgaacaa

SEQ ID NO: 591363 - DNA, 20 bp, Artificial Sequence
  chemically synthesized
ttgtcccaggtatttcatga

SEQ ID NO: 591364 - DNA, 20 bp, Artificial Sequence
  chemically synthesized
gacaaagtatctgaaatgtt

SEQ ID NO: 591365 - DNA, 20 bp, Artificial Sequence
  chemically synthesized
aaaagtttgggggacgtaat

SEQ ID NO: 591366 - DNA, 20 bp, Artificial Sequence
  chemically synthesized
ccatgattttacatacatgc

SEQ ID NO: 591367 - DNA, 20 bp, Artificial Sequence
  chemically synthesized
aatttcaaatataaggacag

SEQ ID NO: 591368 - DNA, 20 bp, Artificial Sequence
  chemically synthesized
cattgaaaagaagaaatgat

SEQ ID NO: 591369 - DNA, 20 bp, Artificial Sequence
  chemically synthesized
gatggtggatatcccaatta

SEQ ID NO: 591370 - DNA, 20 bp, Artificial Sequence
  chemically synthesized
tgatttgatcattacacatt

SEQ ID NO: 591371 - DNA, 20 bp, Artificial Sequence
  chemically synthesized
catagagattgtacatattt

SEQ ID NO: 591372 - DNA, 20 bp, Artificial Sequence
  chemically synthesized
tttatttttgtgttgataca

SEQ ID NO: 591373 - DNA, 20 bp, Artificial Sequence
  chemically synthesized
aaaataaaagctaaatctaa

SEQ ID NO: 591374 - DNA, 20 bp, Artificial Sequence
  chemically synthesized
tctaaagaaacatatttaga

SEQ ID NO: 591375 - DNA, 20 bp, Artificial Sequence
  chemically synthesized
cttttttctaaagaaacata

SEQ ID NO: 591376 - DNA, 20 bp, Artificial Sequence
  chemically synthesized
ctttagaaaaaaggaagaat

SEQ ID NO: 591377 - DNA, 20 bp, Artificial Sequence
  chemically synthesized
caataaaatattctaatagc

SEQ ID NO: 591378 - DNA, 20 bp, Artificial Sequence
  chemically synthesized
gagacttacagaactttctc

SEQ ID NO: 591379 - DNA, 20 bp, Artificial Sequence
  chemically synthesized
aaagttctgtaagtctccaa

SEQ ID NO: 591380 - DNA, 20 bp, Artificial Sequence
  chemically synthesized
aagttttatctatgttatgt

SEQ ID NO: 591381 - DNA, 20 bp, Artificial Sequence
  chemically synthesized
ctatgttatgtaagggtttt

SEQ ID NO: 591382 - DNA, 20 bp, Artificial Sequence
  chemically synthesized
ttttgaatgcttttctataa

SEQ ID NO: 591383 - DNA, 20 bp, Artificial Sequence
  chemically synthesized
tgcttcattgaaatttcttt

SEQ ID NO: 591384 - DNA, 20 bp, Artificial Sequence
  chemically synthesized
ttaatctatcaccatactta

SEQ ID NO: 591385 - DNA, 20 bp, Artificial Sequence
  chemically synthesized
tgaagcattttaagtatggt

SEQ ID NO: 591386 - DNA, 20 bp, Artificial Sequence
  chemically synthesized
tttaattttatttcaccaaa

SEQ ID NO: 591387 - DNA, 20 bp, Artificial Sequence
  chemically synthesized
cagatattcacagatggtct

SEQ ID NO: 591388 - DNA, 20 bp, Artificial Sequence
  chemically synthesized
aatgcaggtaatgaatgtgt

SEQ ID NO: 591389 - DNA, 20 bp, Artificial Sequence
  chemically synthesized
ttctggaatgcaggtaatga

SEQ ID NO: 591390 - DNA, 20 bp, Artificial Sequence
  chemically synthesized
aaatgtagcaacacgttgct

SEQ ID NO: 591391 - DNA, 20 bp, Artificial Sequence
  chemically synthesized
cctaattagcctatttgctc

SEQ ID NO: 591392 - DNA, 20 bp, Artificial Sequence
  chemically synthesized
aaataggctaattaggtgct

SEQ ID NO: 591393 - DNA, 20 bp, Artificial Sequence
  chemically synthesized
ggctaattaggtgctattgg

SEQ ID NO: 591394 - DNA, 20 bp, Artificial Sequence
  chemically synthesized
agtacaggcaggggaggaaa

SEQ ID NO: 591395 - DNA, 20 bp, Artificial Sequence
  chemically synthesized
ggggaggaaagcaggcttga

SEQ ID NO: 591396 - DNA, 20 bp, Artificial Sequence
  chemically synthesized
catgcttgaatctagatcaa

SEQ ID NO: 591397 - DNA, 20 bp, Artificial Sequence
  chemically synthesized
catgttctagagtgctggtt

SEQ ID NO: 591398 - DNA, 20 bp, Artificial Sequence
  chemically synthesized
cacccatcatgttctagagt

SEQ ID NO: 591399 - DNA, 20 bp, Artificial Sequence
  chemically synthesized
aacaggttctgtttatctgc

SEQ ID NO: 591400 - DNA, 20 bp, Artificial Sequence
  chemically synthesized
atctggagcagataaacaga

SEQ ID NO: 591401 - DNA, 20 bp, Artificial Sequence
  chemically synthesized
aaatgctatcatgaaacagg

SEQ ID NO: 591402 - DNA, 20 bp, Artificial Sequence
  chemically synthesized
ctgtttcatgatagcatttt

SEQ ID NO: 591403 - DNA, 20 bp, Artificial Sequence
  chemically synthesized
agagcgcctgcttcctagcc

SEQ ID NO: 591404 - DNA, 20 bp, Artificial Sequence
  chemically synthesized
ttgagcggggtggggagagc

SEQ ID NO: 591405 - DNA, 20 bp, Artificial Sequence
  chemically synthesized
ctgcatggttcaccttcctc

SEQ ID NO: 591406 - DNA, 20 bp, Artificial Sequence
  chemically synthesized
ctacaaagaggtatcaacac

SEQ ID NO: 591407 - DNA, 20 bp, Artificial Sequence
  chemically synthesized
atctggggctcacaaaacca

SEQ ID NO: 591408 - DNA, 20 bp, Artificial Sequence
  chemically synthesized
tttttgataccaaaaatctg

SEQ ID NO: 591409 - DNA, 20 bp, Artificial Sequence
  chemically synthesized
tactatttttgataccaaaa

SEQ ID NO: 591410 - DNA, 20 bp, Artificial Sequence
  chemically synthesized
gcctctgtggaaaccaccca

SEQ ID NO: 591411 - DNA, 20 bp, Artificial Sequence
  chemically synthesized
catagatgagaaaccccatg

SEQ ID NO: 591412 - DNA, 20 bp, Artificial Sequence
  chemically synthesized
ctgaatgtgctctaggcagc

SEQ ID NO: 591413 - DNA, 20 bp, Artificial Sequence
  chemically synthesized
gtaagtctctgtcacttaca

SEQ ID NO: 591414 - DNA, 20 bp, Artificial Sequence
  chemically synthesized
ttgggttgatacttgcacac

SEQ ID NO: 591415 - DNA, 20 bp, Artificial Sequence
  chemically synthesized
ccgcagtttctttatctact

SEQ ID NO: 591416 - DNA, 20 bp, Artificial Sequence
  chemically synthesized
acatacatatgtatatatac

SEQ ID NO: 591417 - DNA, 20 bp, Artificial Sequence
  chemically synthesized
cagcatttgcaatgacctgg

SEQ ID NO: 591418 - DNA, 20 bp, Artificial Sequence
  chemically synthesized
atcagtgagaacatatgctg

SEQ ID NO: 591419 - DNA, 20 bp, Artificial Sequence
  chemically synthesized
cacgtatcagtgagaacata

SEQ ID NO: 591420 - DNA, 20 bp, Artificial Sequence
  chemically synthesized
ttcttatgcctttgcatcct

SEQ ID NO: 591421 - DNA, 20 bp, Artificial Sequence
  chemically synthesized
aaaggcataagaatgataca

SEQ ID NO: 591422 - DNA, 20 bp, Artificial Sequence
  chemically synthesized
ctaaagaacttactcattgc

SEQ ID NO: 591423 - DNA, 20 bp, Artificial Sequence
  chemically synthesized
tgcaatagtttgctgagaat

SEQ ID NO: 591424 - DNA, 20 bp, Artificial Sequence
  chemically synthesized
gtttgctgagaatgatggtt

SEQ ID NO: 591425 - DNA, 20 bp, Artificial Sequence
  chemically synthesized
caaatgtccgacaatgatag

SEQ ID NO: 591426 - DNA, 20 bp, Artificial Sequence
  chemically synthesized
ctgtaaagacacatgcacat

SEQ ID NO: 591427 - DNA, 20 bp, Artificial Sequence
  chemically synthesized
gtgcatgtgtctttacagca

SEQ ID NO: 591428 - DNA, 20 bp, Artificial Sequence
  chemically synthesized
ccattactgggtatataccc

SEQ ID NO: 591429 - DNA, 20 bp, Artificial Sequence
  chemically synthesized
aaccattgtggaagtcagtg

SEQ ID NO: 591430 - DNA, 20 bp, Artificial Sequence
  chemically synthesized
ctgacttccacaatggttga

SEQ ID NO: 591431 - DNA, 20 bp, Artificial Sequence
  chemically synthesized
caccaacagtgtaaaagtgt

SEQ ID NO: 591432 - DNA, 20 bp, Artificial Sequence
  chemically synthesized
tccacatcctcaccagcacc

SEQ ID NO: 591433 - DNA, 20 bp, Artificial Sequence
  chemically synthesized
cctcaccagcacctgttgtt

SEQ ID NO: 591434 - DNA, 20 bp, Artificial Sequence
  chemically synthesized
actggcgtgagatggtacct

SEQ ID NO: 591435 - DNA, 20 bp, Artificial Sequence
  chemically synthesized
gtttggttttttgtccttgc

SEQ ID NO: 591436 - DNA, 20 bp, Artificial Sequence
  chemically synthesized
atgagcgagaacatgcggtg

SEQ ID NO: 591437 - DNA, 20 bp, Artificial Sequence
  chemically synthesized
cacctatgagcgagaacatg

SEQ ID NO: 591438 - DNA, 20 bp, Artificial Sequence
  chemically synthesized
agggtacatgtgcacaacgt

SEQ ID NO: 591439 - DNA, 20 bp, Artificial Sequence
  chemically synthesized
gattttttttttattctact

SEQ ID NO: 591440 - DNA, 20 bp, Artificial Sequence
  chemically synthesized
agttcttttttttgatattt

SEQ ID NO: 591441 - DNA, 20 bp, Artificial Sequence
  chemically synthesized
caaatgatattcttttttat

SEQ ID NO: 591442 - DNA, 20 bp, Artificial Sequence
  chemically synthesized
ggttgttatgatcttcaaga

SEQ ID NO: 591443 - DNA, 20 bp, Artificial Sequence
  chemically synthesized
ataaaaagatcaggtaatat

SEQ ID NO: 591444 - DNA, 20 bp, Artificial Sequence
  chemically synthesized
cgtgttagtaattgctctgg

SEQ ID NO: 591445 - DNA, 20 bp, Artificial Sequence
  chemically synthesized
tatctcatggaattcttaga

SEQ ID NO: 591446 - DNA, 20 bp, Artificial Sequence
  chemically synthesized
ggtaatataattcatttaca

SEQ ID NO: 591447 - DNA, 20 bp, Artificial Sequence
  chemically synthesized
tgtaaatgaattatattacc

SEQ ID NO: 591448 - DNA, 20 bp, Artificial Sequence
  chemically synthesized
tgtgaaagtgactttatctg

SEQ ID NO: 591449 - DNA, 20 bp, Artificial Sequence
  chemically synthesized
ctgcctggcttattattaaa

SEQ ID NO: 591450 - DNA, 20 bp, Artificial Sequence
  chemically synthesized
gaacaaggtggcacatttcc

SEQ ID NO: 591451 - DNA, 20 bp, Artificial Sequence
  chemically synthesized
aaggtggcacatttccttct

SEQ ID NO: 591452 - DNA, 20 bp, Artificial Sequence
  chemically synthesized
aagaatgtcattggagagca

SEQ ID NO: 591453 - DNA, 20 bp, Artificial Sequence
  chemically synthesized
tatcatttgaagtcatttct

SEQ ID NO: 591454 - DNA, 20 bp, Artificial Sequence
  chemically synthesized
atttttaaaacactgctctt

SEQ ID NO: 591455 - DNA, 20 bp, Artificial Sequence
  chemically synthesized
attttaaaatctcaaaagag

SEQ ID NO: 591456 - DNA, 20 bp, Artificial Sequence
  chemically synthesized
ggaggaaactatatagtgaa

SEQ ID NO: 591457 - DNA, 20 bp, Artificial Sequence
  chemically synthesized
taaaaaatctttgttcacta

SEQ ID NO: 591458 - DNA, 20 bp, Artificial Sequence
  chemically synthesized
cttctatttgggaaaaaaaa

SEQ ID NO: 591459 - DNA, 20 bp, Artificial Sequence
  chemically synthesized
cacaatgactgtgggcccct

SEQ ID NO: 591460 - DNA, 20 bp, Artificial Sequence
  chemically synthesized
tgactaacgaattccttgag

SEQ ID NO: 591461 - DNA, 20 bp, Artificial Sequence
  chemically synthesized
tccttgagtgcagtttcaag

SEQ ID NO: 591462 - DNA, 20 bp, Artificial Sequence
  chemically synthesized
tcttacccaattttccctgt

SEQ ID NO: 591463 - DNA, 20 bp, Artificial Sequence
  chemically synthesized
atgataatttgttaccacat

SEQ ID NO: 591464 - DNA, 20 bp, Artificial Sequence
  chemically synthesized
gttcaggacaggtccactga

SEQ ID NO: 591465 - DNA, 20 bp, Artificial Sequence
  chemically synthesized
caaaaaagagctaatttctc

SEQ ID NO: 591466 - DNA, 20 bp, Artificial Sequence
  chemically synthesized
aggaaaggatgctgtacctg

SEQ ID NO: 591467 - DNA, 20 bp, Artificial Sequence
  chemically synthesized
ttttctcatttcctttaaca

SEQ ID NO: 591468 - DNA, 20 bp, Artificial Sequence
  chemically synthesized
aacatctagttttattttct

SEQ ID NO: 591469 - DNA, 20 bp, Artificial Sequence
  chemically synthesized
gtattttcttaatttttttt

SEQ ID NO: 591470 - DNA, 20 bp, Artificial Sequence
  chemically synthesized
atagcctgcgatgcaggcag

SEQ ID NO: 591471 - DNA, 20 bp, Artificial Sequence
  chemically synthesized
tcttaatgttcttttgacag

SEQ ID NO: 591472 - DNA, 20 bp, Artificial Sequence
  chemically synthesized
acgaatttagcagactggcc

SEQ ID NO: 591473 - DNA, 20 bp, Artificial Sequence
  chemically synthesized
aaggctaagtgaagtagtaa

SEQ ID NO: 591474 - DNA, 20 bp, Artificial Sequence
  chemically synthesized
taagaaagacatgggatgaa

SEQ ID NO: 591475 - DNA, 20 bp, Artificial Sequence
  chemically synthesized
ctggataaaggagctaagag

SEQ ID NO: 591476 - DNA, 20 bp, Artificial Sequence
  chemically synthesized
cagtactcctgactctgcaa

SEQ ID NO: 591477 - DNA, 20 bp, Artificial Sequence
  chemically synthesized
actcctgactctgcaaggta

SEQ ID NO: 591478 - DNA, 20 bp, Artificial Sequence
  chemically synthesized
cctctaattggcaaaatgct

SEQ ID NO: 591479 - DNA, 20 bp, Artificial Sequence
  chemically synthesized
tctcaaggcatcttcgaact

SEQ ID NO: 591480 - DNA, 20 bp, Artificial Sequence
  chemically synthesized
aagatgccttgagaaattct

SEQ ID NO: 591481 - DNA, 20 bp, Artificial Sequence
  chemically synthesized
tactcttgttattgaatgta

SEQ ID NO: 591482 - DNA, 20 bp, Artificial Sequence
  chemically synthesized
cttccatgattttttagcca

SEQ ID NO: 591483 - DNA, 20 bp, Artificial Sequence
  chemically synthesized
gtaaaataataatagttctt

SEQ ID NO: 591484 - DNA, 20 bp, Artificial Sequence
  chemically synthesized
ttttacaaccccctcttttt

SEQ ID NO: 591485 - DNA, 20 bp, Artificial Sequence
  chemically synthesized
gaaatatacatacataccat

SEQ ID NO: 591486 - DNA, 20 bp, Artificial Sequence
  chemically synthesized
atttcaaactgtcaaaaatc

SEQ ID NO: 591487 - DNA, 20 bp, Artificial Sequence
  chemically synthesized
cttgcaatccagggattttt

SEQ ID NO: 591488 - DNA, 20 bp, Artificial Sequence
  chemically synthesized
gttgaattttacttgcaatc

SEQ ID NO: 591489 - DNA, 20 bp, Artificial Sequence
  chemically synthesized
attgttcttactttagactc

SEQ ID NO: 591490 - DNA, 20 bp, Artificial Sequence
  chemically synthesized
tatatttgttttaaatattt

SEQ ID NO: 591491 - DNA, 20 bp, Artificial Sequence
  chemically synthesized
taagtcaccaaataaagtat

SEQ ID NO: 591492 - DNA, 20 bp, Artificial Sequence
  chemically synthesized
aaaatgacagtagttcatta

SEQ ID NO: 591493 - DNA, 20 bp, Artificial Sequence
  chemically synthesized
tgaattgacacctatataaa

SEQ ID NO: 591494 - DNA, 20 bp, Artificial Sequence
  chemically synthesized
ctttcttctgagatgtaaaa

SEQ ID NO: 591495 - DNA, 20 bp, Artificial Sequence
  chemically synthesized
gtataagaacccatttcaac

SEQ ID NO: 591496 - DNA, 20 bp, Artificial Sequence
  chemically synthesized
tattaattagtaaaatagtt

SEQ ID NO: 591497 - DNA, 20 bp, Artificial Sequence
  chemically synthesized
ttttcttatttataaaatga

SEQ ID NO: 591498 - DNA, 20 bp, Artificial Sequence
  chemically synthesized
atgtcatgtggtttttatat

SEQ ID NO: 591499 - DNA, 20 bp, Artificial Sequence
  chemically synthesized
aactatagcttttgatgtca

SEQ ID NO: 591500 - DNA, 20 bp, Artificial Sequence
  chemically synthesized
ctatggctagcatttagaac

SEQ ID NO: 591501 - DNA, 20 bp, Artificial Sequence
  chemically synthesized
taaatgctagccatagaaat

SEQ ID NO: 591502 - DNA, 20 bp, Artificial Sequence
  chemically synthesized
aattgcactggggaggcagg

SEQ ID NO: 591503 - DNA, 20 bp, Artificial Sequence
  chemically synthesized
taaacgccgtttcttcatca

SEQ ID NO: 591504 - DNA, 20 bp, Artificial Sequence
  chemically synthesized
aaatcaggatgatgaagaaa

SEQ ID NO: 591505 - DNA, 20 bp, Artificial Sequence
  chemically synthesized
ttcagcccttgcatagtaaa

SEQ ID NO: 591506 - DNA, 20 bp, Artificial Sequence
  chemically synthesized
atgcaagggctgaatacaaa

SEQ ID NO: 591507 - DNA, 20 bp, Artificial Sequence
  chemically synthesized
aatacaaagggagattagtg

SEQ ID NO: 591508 - DNA, 20 bp, Artificial Sequence
  chemically synthesized
gtggactgtttggaaaaaga

SEQ ID NO: 591509 - DNA, 20 bp, Artificial Sequence
  chemically synthesized
tggaaaaagagaatgattat

SEQ ID NO: 591510 - DNA, 20 bp, Artificial Sequence
  chemically synthesized
atgcgagttgtcacacaggc

SEQ ID NO: 591511 - DNA, 20 bp, Artificial Sequence
  chemically synthesized
gtatggcacacaagctaaga

SEQ ID NO: 591512 - DNA, 20 bp, Artificial Sequence
  chemically synthesized
tttaatatgtaaatcccatt

SEQ ID NO: 591513 - DNA, 20 bp, Artificial Sequence
  chemically synthesized
gttgcaaagttgtattattc

SEQ ID NO: 591514 - DNA, 20 bp, Artificial Sequence
  chemically synthesized
tatccaaatttctctgtgcg

SEQ ID NO: 591515 - DNA, 20 bp, Artificial Sequence
  chemically synthesized
acaatacatacctgaatgag

SEQ ID NO: 591516 - DNA, 20 bp, Artificial Sequence
  chemically synthesized
tgctcattcaggtatgtatt

SEQ ID NO: 591517 - DNA, 20 bp, Artificial Sequence
  chemically synthesized
agggctagttagtaaatatt

SEQ ID NO: 591518 - DNA, 20 bp, Artificial Sequence
  chemically synthesized
taactagcccttcaaagaaa

SEQ ID NO: 591519 - DNA, 20 bp, Artificial Sequence
  chemically synthesized
aaagaaaaaaggcttctgac

SEQ ID NO: 591520 - DNA, 20 bp, Artificial Sequence
  chemically synthesized
gtttatttttacctccttgt

SEQ ID NO: 591521 - DNA, 20 bp, Artificial Sequence
  chemically synthesized
ctgattgcaattaaaaaaaa

SEQ ID NO: 591522 - DNA, 20 bp, Artificial Sequence
  chemically synthesized
cttttttttttttaattgca

SEQ ID NO: 591523 - DNA, 20 bp, Artificial Sequence
  chemically synthesized
gctcttagggtccatctgga

SEQ ID NO: 591524 - DNA, 20 bp, Artificial Sequence
  chemically synthesized
gttgttgttgctgctgctgc

SEQ ID NO: 591525 - DNA, 20 bp, Artificial Sequence
  chemically synthesized
cactcagctctcttttcctc

SEQ ID NO: 591526 - DNA, 20 bp, Artificial Sequence
  chemically synthesized
gagagcatgagaatgtaaat

SEQ ID NO: 591527 - DNA, 20 bp, Artificial Sequence
  chemically synthesized
cacagaaagaggttcggaac

SEQ ID NO: 591528 - DNA, 20 bp, Artificial Sequence
  chemically synthesized
tcaatgctttgttcctctcc

SEQ ID NO: 591529 - DNA, 20 bp, Artificial Sequence
  chemically synthesized
gagttcacttcctctctctt

SEQ ID NO: 591530 - DNA, 20 bp, Artificial Sequence
  chemically synthesized
tggaactatgtttctcatat

SEQ ID NO: 591531 - DNA, 20 bp, Artificial Sequence
  chemically synthesized
acattaacttctctctggaa

SEQ ID NO: 591532 - DNA, 20 bp, Artificial Sequence
  chemically synthesized
cattatcacttactcatgct

SEQ ID NO: 591533 - DNA, 20 bp, Artificial Sequence
  chemically synthesized
tacttaccattatcacttac

SEQ ID NO: 591534 - DNA, 20 bp, Artificial Sequence
  chemically synthesized
tttacaagtggtccccctcc

SEQ ID NO: 591535 - DNA, 20 bp, Artificial Sequence
  chemically synthesized
ggataaattatttttacagc

SEQ ID NO: 591536 - DNA, 20 bp, Artificial Sequence
  chemically synthesized
taaaaataatttatccatat

SEQ ID NO: 591537 - DNA, 20 bp, Artificial Sequence
  chemically synthesized
ggcacgcactctgtaggctt

SEQ ID NO: 591538 - DNA, 20 bp, Artificial Sequence
  chemically synthesized
agaacctaggcacgcactct

SEQ ID NO: 591539 - DNA, 20 bp, Artificial Sequence
  chemically synthesized
tgtgcctgtatgttaattgt

SEQ ID NO: 591540 - DNA, 20 bp, Artificial Sequence
  chemically synthesized
gaaagcacgaaaatgtgttt

SEQ ID NO: 591541 - DNA, 20 bp, Artificial Sequence
  chemically synthesized
acaaacacagaaacacattt

SEQ ID NO: 591542 - DNA, 20 bp, Artificial Sequence
  chemically synthesized
actatagtgaaagcacgaaa

SEQ ID NO: 591543 - DNA, 20 bp, Artificial Sequence
  chemically synthesized
ccttccaatgccctcatttt

SEQ ID NO: 591544 - DNA, 20 bp, Artificial Sequence
  chemically synthesized
aaaaaataagtatctgcatg

SEQ ID NO: 591545 - DNA, 20 bp, Artificial Sequence
  chemically synthesized
ttgtcaaaaaataagtatct

SEQ ID NO: 591546 - DNA, 20 bp, Artificial Sequence
  chemically synthesized
cagttgtaataacttcacat

SEQ ID NO: 591547 - DNA, 20 bp, Artificial Sequence
  chemically synthesized
caaggtctttcttgtgaaac

SEQ ID NO: 591548 - DNA, 20 bp, Artificial Sequence
  chemically synthesized
taggaacttgcaagataaac

SEQ ID NO: 591549 - DNA, 20 bp, Artificial Sequence
  chemically synthesized
ttgtttatcttgcaagttcc

SEQ ID NO: 591550 - DNA, 20 bp, Artificial Sequence
  chemically synthesized
tcctatcccttgaggcctgg

SEQ ID NO: 591551 - DNA, 20 bp, Artificial Sequence
  chemically synthesized
aagttttcatggaaaaaaat

SEQ ID NO: 591552 - DNA, 20 bp, Artificial Sequence
  chemically synthesized
atggaaaaaaatgaatgttt

SEQ ID NO: 591553 - DNA, 20 bp, Artificial Sequence
  chemically synthesized
gttattgccttagaataatt

SEQ ID NO: 591554 - DNA, 20 bp, Artificial Sequence
  chemically synthesized
caataacatctttccagtgt

SEQ ID NO: 591555 - DNA, 20 bp, Artificial Sequence
  chemically synthesized
agatttcatgccaaaaaaaa

SEQ ID NO: 591556 - DNA, 20 bp, Artificial Sequence
  chemically synthesized
ctactcggcctcccaaagtg

SEQ ID NO: 591557 - DNA, 20 bp, Artificial Sequence
  chemically synthesized
ttgggaggccgagtagggca

SEQ ID NO: 591558 - DNA, 20 bp, Artificial Sequence
  chemically synthesized
ttttgtatctttagtggaga

SEQ ID NO: 591559 - DNA, 20 bp, Artificial Sequence
  chemically synthesized
ctgcctctgtcttccagtag

SEQ ID NO: 591560 - DNA, 20 bp, Artificial Sequence
  chemically synthesized
aacctccccatcgtgggctc

SEQ ID NO: 591561 - DNA, 20 bp, Artificial Sequence
  chemically synthesized
atgcaaagtcatgaccctcc

SEQ ID NO: 591562 - DNA, 20 bp, Artificial Sequence
  chemically synthesized
ctccatttgccttgtatcat

SEQ ID NO: 591563 - DNA, 20 bp, Artificial Sequence
  chemically synthesized
tgatacaaggcaaatggagg

SEQ ID NO: 591564 - DNA, 20 bp, Artificial Sequence
  chemically synthesized
aagaaagaaaaaaagaagtc

SEQ ID NO: 591565 - DNA, 20 bp, Artificial Sequence
  chemically synthesized
aatggtgtgaacccgggagg

SEQ ID NO: 591566 - DNA, 20 bp, Artificial Sequence
  chemically synthesized
ttttatatttttagtagaga

SEQ ID NO: 591567 - DNA, 20 bp, Artificial Sequence
  chemically synthesized
cgcctcaggctcccaaagtg

SEQ ID NO: 591568 - DNA, 20 bp, Artificial Sequence
  chemically synthesized
tgagccaccctgcccggccc

SEQ ID NO: 591569 - DNA, 20 bp, Artificial Sequence
  chemically synthesized
atagtcttgtctgcctcact

SEQ ID NO: 591570 - DNA, 20 bp, Artificial Sequence
  chemically synthesized
gcagattcctaggcccctcc

SEQ ID NO: 591571 - DNA, 20 bp, Artificial Sequence
  chemically synthesized
cctagggagcttgttaataa

SEQ ID NO: 591572 - DNA, 20 bp, Artificial Sequence
  chemically synthesized
gcattattaacaagctccct

SEQ ID NO: 591573 - DNA, 20 bp, Artificial Sequence
  chemically synthesized
ccctccatcagaatctccta

SEQ ID NO: 591574 - DNA, 20 bp, Artificial Sequence
  chemically synthesized
attctatatcagtcttagag

SEQ ID NO: 591575 - DNA, 20 bp, Artificial Sequence
  chemically synthesized
caaggtatagtgtgaaagct

SEQ ID NO: 591576 - DNA, 20 bp, Artificial Sequence
  chemically synthesized
cattttattatcatcaagcc

SEQ ID NO: 591577 - DNA, 20 bp, Artificial Sequence
  chemically synthesized
aataaaatgagaaagcaagt

SEQ ID NO: 591578 - DNA, 20 bp, Artificial Sequence
  chemically synthesized
actctttgccacaagcttag

SEQ ID NO: 591579 - DNA, 20 bp, Artificial Sequence
  chemically synthesized
aattacattgactctttgcc

SEQ ID NO: 591580 - DNA, 20 bp, Artificial Sequence
  chemically synthesized
taataccatagattaatttt

SEQ ID NO: 591581 - DNA, 20 bp, Artificial Sequence
  chemically synthesized
attatcgtgatttctaatac

SEQ ID NO: 591582 - DNA, 20 bp, Artificial Sequence
  chemically synthesized
tatggtattagaaatcacga

SEQ ID NO: 591583 - DNA, 20 bp, Artificial Sequence
  chemically synthesized
acccccatggataagcatta

SEQ ID NO: 591584 - DNA, 20 bp, Artificial Sequence
  chemically synthesized
cctctgaggtatcatcaagg

SEQ ID NO: 591585 - DNA, 20 bp, Artificial Sequence
  chemically synthesized
acacatccctttaaccagca

SEQ ID NO: 591586 - DNA, 20 bp, Artificial Sequence
  chemically synthesized
gtgctggttaaagggatgtg

SEQ ID NO: 591587 - DNA, 20 bp, Artificial Sequence
  chemically synthesized
tagctgcacctttatattag

SEQ ID NO: 591588 - DNA, 20 bp, Artificial Sequence
  chemically synthesized
ttaataagataacaattata

SEQ ID NO: 591589 - DNA, 20 bp, Artificial Sequence
  chemically synthesized
ttaagttattatgaaatttt

SEQ ID NO: 591590 - DNA, 20 bp, Artificial Sequence
  chemically synthesized
ccccattagaatgatctgaa

SEQ ID NO: 591591 - DNA, 20 bp, Artificial Sequence
  chemically synthesized
taatggggaaaataacttct

SEQ ID NO: 591592 - DNA, 20 bp, Artificial Sequence
  chemically synthesized
tgggatttaagtgttagcaa

SEQ ID NO: 591593 - DNA, 20 bp, Artificial Sequence
  chemically synthesized
cttgctaacacttaaatccc

SEQ ID NO: 591594 - DNA, 20 bp, Artificial Sequence
  chemically synthesized
gaataagaaatttcaatctg

SEQ ID NO: 591595 - DNA, 20 bp, Artificial Sequence
  chemically synthesized
ctattatttatcctcactgt

SEQ ID NO: 591596 - DNA, 20 bp, Artificial Sequence
  chemically synthesized
gattatagacaactttttca

SEQ ID NO: 591597 - DNA, 20 bp, Artificial Sequence
  chemically synthesized
ataaggtgggaaaatagata

SEQ ID NO: 591598 - DNA, 20 bp, Artificial Sequence
  chemically synthesized
taatgaaaagataagtgact

SEQ ID NO: 591599 - DNA, 20 bp, Artificial Sequence
  chemically synthesized
tctttcatattgccacactc

SEQ ID NO: 591600 - DNA, 20 bp, Artificial Sequence
  chemically synthesized
gatcaagccctgagacactc

SEQ ID NO: 591601 - DNA, 20 bp, Artificial Sequence
  chemically synthesized
ttctaaacatctgagtgtct

SEQ ID NO: 591602 - DNA, 20 bp, Artificial Sequence
  chemically synthesized
tataaatgtggattttagag

SEQ ID NO: 591603 - DNA, 20 bp, Artificial Sequence
  chemically synthesized
ctctaaaatccacatttata

SEQ ID NO: 591604 - DNA, 20 bp, Artificial Sequence
  chemically synthesized
cctaggaaactgaatataaa

SEQ ID NO: 591605 - DNA, 20 bp, Artificial Sequence
  chemically synthesized
atttggacatgctagtttgg

SEQ ID NO: 591606 - DNA, 20 bp, Artificial Sequence
  chemically synthesized
aagaatctttatttggacat

SEQ ID NO: 591607 - DNA, 20 bp, Artificial Sequence
  chemically synthesized
cccaaactagcatgtccaaa

SEQ ID NO: 591608 - DNA, 20 bp, Artificial Sequence
  chemically synthesized
gtagaatattataaagtaag

SEQ ID NO: 591609 - DNA, 20 bp, Artificial Sequence
  chemically synthesized
ataaatcagtgttaactctt

SEQ ID NO: 591610 - DNA, 20 bp, Artificial Sequence
  chemically synthesized
gttaaacattaaagagttaa

SEQ ID NO: 591611 - DNA, 20 bp, Artificial Sequence
  chemically synthesized
gatttcagatttgtagtcaa

SEQ ID NO: 591612 - DNA, 20 bp, Artificial Sequence
  chemically synthesized
ttgactacaaatctgaaatc

SEQ ID NO: 591613 - DNA, 20 bp, Artificial Sequence
  chemically synthesized
gagagattgaagcgactgat

SEQ ID NO: 591614 - DNA, 20 bp, Artificial Sequence
  chemically synthesized
tgtactggagagattgaagc

SEQ ID NO: 591615 - DNA, 20 bp, Artificial Sequence
  chemically synthesized
ggacaaggacgattgtactg

SEQ ID NO: 591616 - DNA, 20 bp, Artificial Sequence
  chemically synthesized
gatgatagtggcttggacaa

SEQ ID NO: 591617 - DNA, 20 bp, Artificial Sequence
  chemically synthesized
tagtccgtgtgagagatgat

SEQ ID NO: 591618 - DNA, 20 bp, Artificial Sequence
  chemically synthesized
ttccactttcaccccctaca

SEQ ID NO: 591619 - DNA, 20 bp, Artificial Sequence
  chemically synthesized
agagtattagcttcactttg

SEQ ID NO: 591620 - DNA, 20 bp, Artificial Sequence
  chemically synthesized
gtggcaagtgattggagagt

SEQ ID NO: 591621 - DNA, 20 bp, Artificial Sequence
  chemically synthesized
tttattgtaattatggtggc

SEQ ID NO: 591622 - DNA, 20 bp, Artificial Sequence
  chemically synthesized
ttgttcgtttttataaattg

SEQ ID NO: 591623 - DNA, 20 bp, Artificial Sequence
  chemically synthesized
aagacttgttcgtttttata

SEQ ID NO: 591624 - DNA, 20 bp, Artificial Sequence
  chemically synthesized
gccagctcatataaagactt

SEQ ID NO: 591625 - DNA, 20 bp, Artificial Sequence
  chemically synthesized
atcctcaatgtcttagccat

SEQ ID NO: 591626 - DNA, 20 bp, Artificial Sequence
  chemically synthesized
gcaggagtaccactaatgca

SEQ ID NO: 591627 - DNA, 20 bp, Artificial Sequence
  chemically synthesized
cctgcctagaatactgttcc

SEQ ID NO: 591628 - DNA, 20 bp, Artificial Sequence
  chemically synthesized
caaaatatggcactttgaca

SEQ ID NO: 591629 - DNA, 20 bp, Artificial Sequence
  chemically synthesized
ggaaggcttctttttgctta

SEQ ID NO: 591630 - DNA, 20 bp, Artificial Sequence
  chemically synthesized
gaagcactgggaaggcttct

SEQ ID NO: 591631 - DNA, 20 bp, Artificial Sequence
  chemically synthesized
taagcaaaaagaagccttcc

SEQ ID NO: 591632 - DNA, 20 bp, Artificial Sequence
  chemically synthesized
ttagacaagggaagcactgg

SEQ ID NO: 591633 - DNA, 20 bp, Artificial Sequence
  chemically synthesized
agttatcatttctcagaagt

SEQ ID NO: 591634 - DNA, 20 bp, Artificial Sequence
  chemically synthesized
tatagcagttatcatttctc

SEQ ID NO: 591635 - DNA, 20 bp, Artificial Sequence
  chemically synthesized
cataacaatttcccaggaga

SEQ ID NO: 591636 - DNA, 20 bp, Artificial Sequence
  chemically synthesized
tggcataaacaaactatact

SEQ ID NO: 591637 - DNA, 20 bp, Artificial Sequence
  chemically synthesized
tgggagaaacatggagtata

SEQ ID NO: 591638 - DNA, 20 bp, Artificial Sequence
  chemically synthesized
tatatgggagaaacatggag

SEQ ID NO: 591639 - DNA, 20 bp, Artificial Sequence
  chemically synthesized
ctcccatatatttaccttcc

SEQ ID NO: 591640 - DNA, 20 bp, Artificial Sequence
  chemically synthesized
aatacctaaacccctttttt

SEQ ID NO: 591641 - DNA, 20 bp, Artificial Sequence
  chemically synthesized
aatgacaaaacaaagaaaaa

SEQ ID NO: 591642 - DNA, 20 bp, Artificial Sequence
  chemically synthesized
ctttgttttgtcatttctct

SEQ ID NO: 591643 - DNA, 20 bp, Artificial Sequence
  chemically synthesized
tcaaaggggtggttagaatg

SEQ ID NO: 591644 - DNA, 20 bp, Artificial Sequence
  chemically synthesized
cccctttgagttactcatca

SEQ ID NO: 591645 - DNA, 20 bp, Artificial Sequence
  chemically synthesized
ctgaatattttaataaactt

SEQ ID NO: 591646 - DNA, 20 bp, Artificial Sequence
  chemically synthesized
attaacaagaggaaaagcct

SEQ ID NO: 591647 - DNA, 20 bp, Artificial Sequence
  chemically synthesized
acaaagttagagtgacaaaa

SEQ ID NO: 591648 - DNA, 20 bp, Artificial Sequence
  chemically synthesized
ccccttcttgtcattcagat

SEQ ID NO: 591649 - DNA, 20 bp, Artificial Sequence
  chemically synthesized
catggctcagaaaaaaatgt

SEQ ID NO: 591650 - DNA, 20 bp, Artificial Sequence
  chemically synthesized
cgcctcagcctcccaaagtg

SEQ ID NO: 591651 - DNA, 20 bp, Artificial Sequence
  chemically synthesized
ttgggaggctgaggcgggtg

SEQ ID NO: 591652 - DNA, 20 bp, Artificial Sequence
  chemically synthesized
cgggtggatcgcttgaggtc

SEQ ID NO: 591653 - DNA, 20 bp, Artificial Sequence
  chemically synthesized
ttttgtatttttagtagaga

SEQ ID NO: 591654 - DNA, 20 bp, Artificial Sequence
  chemically synthesized
aggcatgcaccaccaggccc

SEQ ID NO: 591655 - DNA, 20 bp, Artificial Sequence
  chemically synthesized
ttgggaggcggaggcacacg

SEQ ID NO: 591656 - DNA, 20 bp, Artificial Sequence
  chemically synthesized
gcaacctctgcctcccatgt

SEQ ID NO: 591657 - DNA, 20 bp, Artificial Sequence
  chemically synthesized
gaggcagaggttgcagtgag

SEQ ID NO: 591658 - DNA, 20 bp, Artificial Sequence
  chemically synthesized
actttaaaatggggtaaaat

SEQ ID NO: 591659 - DNA, 20 bp, Artificial Sequence
  chemically synthesized
ttatgtatattttctagtta

SEQ ID NO: 591660 - DNA, 20 bp, Artificial Sequence
  chemically synthesized
ccatgtcgatacaaatcata

SEQ ID NO: 591661 - DNA, 20 bp, Artificial Sequence
  chemically synthesized
ttcagcaattaacaatcaag

SEQ ID NO: 591662 - DNA, 20 bp, Artificial Sequence
  chemically synthesized
gacgtgcaattttgggcgca

SEQ ID NO: 591663 - DNA, 20 bp, Artificial Sequence
  chemically synthesized
aaaattgcacgtcctgtaat

SEQ ID NO: 591664 - DNA, 20 bp, Artificial Sequence
  chemically synthesized
tttaacattcagaattcaac

SEQ ID NO: 591665 - DNA, 20 bp, Artificial Sequence
  chemically synthesized
tcatgtcaggtcacttgtca

SEQ ID NO: 591666 - DNA, 20 bp, Artificial Sequence
  chemically synthesized
acatgatgaataaaaactta

SEQ ID NO: 591667 - DNA, 20 bp, Artificial Sequence
  chemically synthesized
gaataaaaacttatagggtt

SEQ ID NO: 591668 - DNA, 20 bp, Artificial Sequence
  chemically synthesized
ttttttaatccttaaaccct

SEQ ID NO: 591669 - DNA, 20 bp, Artificial Sequence
  chemically synthesized
attaaaaaatttccataaag

SEQ ID NO: 591670 - DNA, 20 bp, Artificial Sequence
  chemically synthesized
gagattttaaaaaatagttc

SEQ ID NO: 591671 - DNA, 20 bp, Artificial Sequence
  chemically synthesized
aatatgattcctcttatatt

SEQ ID NO: 591672 - DNA, 20 bp, Artificial Sequence
  chemically synthesized
agaatagtggccagttaata

SEQ ID NO: 591673 - DNA, 20 bp, Artificial Sequence
  chemically synthesized
attattaactggccactatt

SEQ ID NO: 591674 - DNA, 20 bp, Artificial Sequence
  chemically synthesized
aatcattttttaaagttgta

SEQ ID NO: 591675 - DNA, 20 bp, Artificial Sequence
  chemically synthesized
aaacattttacaactttaaa

SEQ ID NO: 591676 - DNA, 20 bp, Artificial Sequence
  chemically synthesized
attacttgcattactcgtct

SEQ ID NO: 591677 - DNA, 20 bp, Artificial Sequence
  chemically synthesized
caagtaatgccaagtatgac

SEQ ID NO: 591678 - DNA, 20 bp, Artificial Sequence
  chemically synthesized
cagaaggaggtgcctctcct

SEQ ID NO: 591679 - DNA, 20 bp, Artificial Sequence
  chemically synthesized
tgtctgtaattatagcaaca

SEQ ID NO: 591680 - DNA, 20 bp, Artificial Sequence
  chemically synthesized
gtgttgctataattacagac

SEQ ID NO: 591681 - DNA, 20 bp, Artificial Sequence
  chemically synthesized
tattaggctaatggacattt

SEQ ID NO: 591682 - DNA, 20 bp, Artificial Sequence
  chemically synthesized
aaatgtccattagcctaata

SEQ ID NO: 591683 - DNA, 20 bp, Artificial Sequence
  chemically synthesized
aaatccatccatttttaatt

SEQ ID NO: 591684 - DNA, 20 bp, Artificial Sequence
  chemically synthesized
aaaacagctaattaaaaatg

SEQ ID NO: 591685 - DNA, 20 bp, Artificial Sequence
  chemically synthesized
agaaatgtgcacacttaaag

SEQ ID NO: 591686 - DNA, 20 bp, Artificial Sequence
  chemically synthesized
atttctataacaatataagt

SEQ ID NO: 591687 - DNA, 20 bp, Artificial Sequence
  chemically synthesized
caattcaaatactggggaaa

SEQ ID NO: 591688 - DNA, 20 bp, Artificial Sequence
  chemically synthesized
cctttccagaacattttagg

SEQ ID NO: 591689 - DNA, 20 bp, Artificial Sequence
  chemically synthesized
ttaacctaaaatgttctgga

SEQ ID NO: 591690 - DNA, 20 bp, Artificial Sequence
  chemically synthesized
tcttccttcttatgacaaca

SEQ ID NO: 591691 - DNA, 20 bp, Artificial Sequence
  chemically synthesized
tgtcataagaaggaagaatg

SEQ ID NO: 591692 - DNA, 20 bp, Artificial Sequence
  chemically synthesized
tgatggacgctgatgaacta

SEQ ID NO: 591693 - DNA, 20 bp, Artificial Sequence
  chemically synthesized
gtggcagacagccttcagct

SEQ ID NO: 591694 - DNA, 20 bp, Artificial Sequence
  chemically synthesized
tgagaaggctatcatccaat

SEQ ID NO: 591695 - DNA, 20 bp, Artificial Sequence
  chemically synthesized
tgaagggtcattcgaagctc

SEQ ID NO: 591696 - DNA, 20 bp, Artificial Sequence
  chemically synthesized
accaaacatatgggaagctt

SEQ ID NO: 591697 - DNA, 20 bp, Artificial Sequence
  chemically synthesized
tcgaagctctgaagcttccc

SEQ ID NO: 591698 - DNA, 20 bp, Artificial Sequence
  chemically synthesized
cccaattgaccaaacatatg

SEQ ID NO: 591699 - DNA, 20 bp, Artificial Sequence
  chemically synthesized
atcattgggcacctccatag

SEQ ID NO: 591700 - DNA, 20 bp, Artificial Sequence
  chemically synthesized
ccacatacacaaagttcaac

SEQ ID NO: 591701 - DNA, 20 bp, Artificial Sequence
  chemically synthesized
agtacagctgcagagtataa

SEQ ID NO: 591702 - DNA, 20 bp, Artificial Sequence
  chemically synthesized
ccaatttcgtcatgcaatta

SEQ ID NO: 591703 - DNA, 20 bp, Artificial Sequence
  chemically synthesized
ctgcttaattgcatgacgaa

SEQ ID NO: 591704 - DNA, 20 bp, Artificial Sequence
  chemically synthesized
cttctcaacaacagagtgca

SEQ ID NO: 591705 - DNA, 20 bp, Artificial Sequence
  chemically synthesized
aaaagtatgatcagcatggt

SEQ ID NO: 591706 - DNA, 20 bp, Artificial Sequence
  chemically synthesized
catacttttgatgcctataa

SEQ ID NO: 591707 - DNA, 20 bp, Artificial Sequence
  chemically synthesized
ttaatgagacagtcaaccca

SEQ ID NO: 591708 - DNA, 20 bp, Artificial Sequence
  chemically synthesized
attaactgctgaatctctca

SEQ ID NO: 591709 - DNA, 20 bp, Artificial Sequence
  chemically synthesized
gccttagtgttaagcaggct

SEQ ID NO: 591710 - DNA, 20 bp, Artificial Sequence
  chemically synthesized
caacttctctttctgtccaa

SEQ ID NO: 591711 - DNA, 20 bp, Artificial Sequence
  chemically synthesized
attcaagagagggcttagaa

SEQ ID NO: 591712 - DNA, 20 bp, Artificial Sequence
  chemically synthesized
ggaccaatacatattcaaga

SEQ ID NO: 591713 - DNA, 20 bp, Artificial Sequence
  chemically synthesized
cgcccggccagactctaaaa

SEQ ID NO: 591714 - DNA, 20 bp, Artificial Sequence
  chemically synthesized
cacttctgcctcccaaagtg

SEQ ID NO: 591715 - DNA, 20 bp, Artificial Sequence
  chemically synthesized
tgggtggatcacctgaggtc

SEQ ID NO: 591716 - DNA, 20 bp, Artificial Sequence
  chemically synthesized
ttttgtatttttagtagaga

SEQ ID NO: 591717 - DNA, 20 bp, Artificial Sequence
  chemically synthesized
gcctgtaatcccagatactt

SEQ ID NO: 591718 - DNA, 20 bp, Artificial Sequence
  chemically synthesized
tgcctcaaactcccaagtat

SEQ ID NO: 591719 - DNA, 20 bp, Artificial Sequence
  chemically synthesized
aatttccgccttatgggttc

SEQ ID NO: 591720 - DNA, 20 bp, Artificial Sequence
  chemically synthesized
aaggcggaaattacagtgag

SEQ ID NO: 591721 - DNA, 20 bp, Artificial Sequence
  chemically synthesized
aacaaataaagtaaaaataa

SEQ ID NO: 591722 - DNA, 20 bp, Artificial Sequence
  chemically synthesized
aaaaataaaaatgttttaga

SEQ ID NO: 591723 - DNA, 20 bp, Artificial Sequence
  chemically synthesized
atacagcccttgacttcctt

SEQ ID NO: 591724 - DNA, 20 bp, Artificial Sequence
  chemically synthesized
ttttatttggctgtcaggag

SEQ ID NO: 591725 - DNA, 20 bp, Artificial Sequence
  chemically synthesized
tactctatctgaggagccca

SEQ ID NO: 591726 - DNA, 20 bp, Artificial Sequence
  chemically synthesized
ttacgtacacgatctctttt

SEQ ID NO: 591727 - DNA, 20 bp, Artificial Sequence
  chemically synthesized
gtttcatattacatgttctt

SEQ ID NO: 591728 - DNA, 20 bp, Artificial Sequence
  chemically synthesized
aatacaactccagcaggcag

SEQ ID NO: 591729 - DNA, 20 bp, Artificial Sequence
  chemically synthesized
ttacatctaaaaagtatgcc

SEQ ID NO: 591730 - DNA, 20 bp, Artificial Sequence
  chemically synthesized
agacttgacctcatgggctc

SEQ ID NO: 591731 - DNA, 20 bp, Artificial Sequence
  chemically synthesized
tcaggaggctgagatgggag

SEQ ID NO: 591732 - DNA, 20 bp, Artificial Sequence
  chemically synthesized
ctggggggctgtggtgtaag

SEQ ID NO: 591733 - DNA, 20 bp, Artificial Sequence
  chemically synthesized
tacaccacagccccccagtg

SEQ ID NO: 591734 - DNA, 20 bp, Artificial Sequence
  chemically synthesized
tccttttgttatttccactc

SEQ ID NO: 591735 - DNA, 20 bp, Artificial Sequence
  chemically synthesized
gctccctttctgagcaaaga

SEQ ID NO: 591736 - DNA, 20 bp, Artificial Sequence
  chemically synthesized
agatgtatgttaacctcaaa

SEQ ID NO: 591737 - DNA, 20 bp, Artificial Sequence
  chemically synthesized
aggttaacatacatctactt

SEQ ID NO: 591738 - DNA, 20 bp, Artificial Sequence
  chemically synthesized
tacttctcagttttcctaca

SEQ ID NO: 591739 - DNA, 20 bp, Artificial Sequence
  chemically synthesized
aagatcagctctttggggct

SEQ ID NO: 591740 - DNA, 20 bp, Artificial Sequence
  chemically synthesized
acctcccctacatgtgtgat

SEQ ID NO: 591741 - DNA, 20 bp, Artificial Sequence
  chemically synthesized
aaggggccatctagctcagc

SEQ ID NO: 591742 - DNA, 20 bp, Artificial Sequence
  chemically synthesized
gagctagatggcccctttaa

SEQ ID NO: 591743 - DNA, 20 bp, Artificial Sequence
  chemically synthesized
gaaaataaaggagttctcca

SEQ ID NO: 591744 - DNA, 20 bp, Artificial Sequence
  chemically synthesized
aaacataggaacagaatgac

SEQ ID NO: 591745 - DNA, 20 bp, Artificial Sequence
  chemically synthesized
aagcaagggtcattctgttc

SEQ ID NO: 591746 - DNA, 20 bp, Artificial Sequence
  chemically synthesized
cattctgttcctatgtttct

SEQ ID NO: 591747 - DNA, 20 bp, Artificial Sequence
  chemically synthesized
ataagaggtgcttaaaaatt

SEQ ID NO: 591748 - DNA, 20 bp, Artificial Sequence
  chemically synthesized
gtgttagctaggacaataag

SEQ ID NO: 591749 - DNA, 20 bp, Artificial Sequence
  chemically synthesized
tgtctgaggtcaaatacatg

SEQ ID NO: 591750 - DNA, 20 bp, Artificial Sequence
  chemically synthesized
atgttatttaaaaagtcaga

SEQ ID NO: 591751 - DNA, 20 bp, Artificial Sequence
  chemically synthesized
attttatgaacatagtccat

SEQ ID NO: 591752 - DNA, 20 bp, Artificial Sequence
  chemically synthesized
agcaacccgtgaacttaacc

SEQ ID NO: 591753 - DNA, 20 bp, Artificial Sequence
  chemically synthesized
tctcaaaaaaagaaaaaaaa

SEQ ID NO: 591754 - DNA, 20 bp, Artificial Sequence
  chemically synthesized
ggatctcggctaccgggttc

SEQ ID NO: 591755 - DNA, 20 bp, Artificial Sequence
  chemically synthesized
cggcacatgccactacgccc

SEQ ID NO: 591756 - DNA, 20 bp, Artificial Sequence
  chemically synthesized
tttttgtatttgtagtagag

SEQ ID NO: 591757 - DNA, 20 bp, Artificial Sequence
  chemically synthesized
tgcctcggcctcccaaagtg

SEQ ID NO: 591758 - DNA, 20 bp, Artificial Sequence
  chemically synthesized
tccttatctacgcaaaagat

SEQ ID NO: 591759 - DNA, 20 bp, Artificial Sequence
  chemically synthesized
ttttttttccttatctacgc

SEQ ID NO: 591760 - DNA, 20 bp, Artificial Sequence
  chemically synthesized
atgagccccttatacaacac

SEQ ID NO: 591761 - DNA, 20 bp, Artificial Sequence
  chemically synthesized
taaggggctcatagccactt

SEQ ID NO: 591762 - DNA, 20 bp, Artificial Sequence
  chemically synthesized
atagccacttcatggattga

SEQ ID NO: 591763 - DNA, 20 bp, Artificial Sequence
  chemically synthesized
tttgtggcacttccctgtta

SEQ ID NO: 591764 - DNA, 20 bp, Artificial Sequence
  chemically synthesized
aagaatccagtagtgtattg

SEQ ID NO: 591765 - DNA, 20 bp, Artificial Sequence
  chemically synthesized
acaaaacaattcaatacact

SEQ ID NO: 591766 - DNA, 20 bp, Artificial Sequence
  chemically synthesized
gaacagatttgtgctgtttt

SEQ ID NO: 591767 - DNA, 20 bp, Artificial Sequence
  chemically synthesized
caagtactggaacagatttg

SEQ ID NO: 591768 - DNA, 20 bp, Artificial Sequence
  chemically synthesized
gttgatctcccaagtactgg

SEQ ID NO: 591769 - DNA, 20 bp, Artificial Sequence
  chemically synthesized
tgttcatcgcagccacattt

SEQ ID NO: 591770 - DNA, 20 bp, Artificial Sequence
  chemically synthesized
cacatttgtaggtttaaatg

SEQ ID NO: 591771 - DNA, 20 bp, Artificial Sequence
  chemically synthesized
ttaaatgttcagattgccta

SEQ ID NO: 591772 - DNA, 20 bp, Artificial Sequence
  chemically synthesized
tatgcatatatttgcatatg

SEQ ID NO: 591773 - DNA, 20 bp, Artificial Sequence
  chemically synthesized
atatatgcataatcatctgg

SEQ ID NO: 591774 - DNA, 20 bp, Artificial Sequence
  chemically synthesized
gtctgatagaaagcataacc

SEQ ID NO: 591775 - DNA, 20 bp, Artificial Sequence
  chemically synthesized
gctttctatcagactcataa

SEQ ID NO: 591776 - DNA, 20 bp, Artificial Sequence
  chemically synthesized
aaaatgctggagagaataaa

SEQ ID NO: 591777 - DNA, 20 bp, Artificial Sequence
  chemically synthesized
ttgtctataattgtattttg

SEQ ID NO: 591778 - DNA, 20 bp, Artificial Sequence
  chemically synthesized
taatatttaaaatgaacttt

SEQ ID NO: 591779 - DNA, 20 bp, Artificial Sequence
  chemically synthesized
aaggtgagtgtgtgaggatt

SEQ ID NO: 591780 - DNA, 20 bp, Artificial Sequence
  chemically synthesized
acttacctaaggtgagtgtg

SEQ ID NO: 591781 - DNA, 20 bp, Artificial Sequence
  chemically synthesized
cactcaccttaggtaagtaa

SEQ ID NO: 591782 - DNA, 20 bp, Artificial Sequence
  chemically synthesized
ttaggtaagtaaaaaagctt

SEQ ID NO: 591783 - DNA, 20 bp, Artificial Sequence
  chemically synthesized
cttcttactaactcaagctc

SEQ ID NO: 591784 - DNA, 20 bp, Artificial Sequence
  chemically synthesized
aatacagtgagtgagtgagt

SEQ ID NO: 591785 - DNA, 20 bp, Artificial Sequence
  chemically synthesized
agtgagggatgtgaaaacca

SEQ ID NO: 591786 - DNA, 20 bp, Artificial Sequence
  chemically synthesized
cggcctcaggaaggaaacat

SEQ ID NO: 591787 - DNA, 20 bp, Artificial Sequence
  chemically synthesized
ttccttcctgaggccgtgtg

SEQ ID NO: 591788 - DNA, 20 bp, Artificial Sequence
  chemically synthesized
aagatcactcgttttgactt

SEQ ID NO: 591789 - DNA, 20 bp, Artificial Sequence
  chemically synthesized
ttgtatgtattagaaagatc

SEQ ID NO: 591790 - DNA, 20 bp, Artificial Sequence
  chemically synthesized
ccaaataattattttagtaa

SEQ ID NO: 591791 - DNA, 20 bp, Artificial Sequence
  chemically synthesized
gcagatactacttgtgttta

SEQ ID NO: 591792 - DNA, 20 bp, Artificial Sequence
  chemically synthesized
acttaataaacacaagtagt

SEQ ID NO: 591793 - DNA, 20 bp, Artificial Sequence
  chemically synthesized
atctataaagcagatactac

SEQ ID NO: 591794 - DNA, 20 bp, Artificial Sequence
  chemically synthesized
ccaaattgaatatgaatatc

SEQ ID NO: 591795 - DNA, 20 bp, Artificial Sequence
  chemically synthesized
caactgagctactaagtatc

SEQ ID NO: 591796 - DNA, 20 bp, Artificial Sequence
  chemically synthesized
caggtctgttgtcctcatta

SEQ ID NO: 591797 - DNA, 20 bp, Artificial Sequence
  chemically synthesized
tgaggacaacagacctgcta

SEQ ID NO: 591798 - DNA, 20 bp, Artificial Sequence
  chemically synthesized
aattgctctcagagtgaatt

SEQ ID NO: 591799 - DNA, 20 bp, Artificial Sequence
  chemically synthesized
gtatggcctcacaagttgta

SEQ ID NO: 591800 - DNA, 20 bp, Artificial Sequence
  chemically synthesized
aggtttcgtggcttgaagat

SEQ ID NO: 591801 - DNA, 20 bp, Artificial Sequence
  chemically synthesized
cggggccaggtttcgtggct

SEQ ID NO: 591802 - DNA, 20 bp, Artificial Sequence
  chemically synthesized
tagagcccggggccaggttt

SEQ ID NO: 591803 - DNA, 20 bp, Artificial Sequence
  chemically synthesized
tgggcagatagagcccgggg

SEQ ID NO: 591804 - DNA, 20 bp, Artificial Sequence
  chemically synthesized
tatctgcccagtaaaaggac

SEQ ID NO: 591805 - DNA, 20 bp, Artificial Sequence
  chemically synthesized
catgggttagcacgtgtctt

SEQ ID NO: 591806 - DNA, 20 bp, Artificial Sequence
  chemically synthesized
ttttgtctaggaaggaataa

SEQ ID NO: 591807 - DNA, 20 bp, Artificial Sequence
  chemically synthesized
ttcttttttcttcatatatt

SEQ ID NO: 591808 - DNA, 20 bp, Artificial Sequence
  chemically synthesized
ggcaagtatctcacctctca

SEQ ID NO: 591809 - DNA, 20 bp, Artificial Sequence
  chemically synthesized
tgagaggtgagatacttgcc

SEQ ID NO: 591810 - DNA, 20 bp, Artificial Sequence
  chemically synthesized
ttgagcattcattgcagcat

SEQ ID NO: 591811 - DNA, 20 bp, Artificial Sequence
  chemically synthesized
acatacatatgcatatacat

SEQ ID NO: 591812 - DNA, 20 bp, Artificial Sequence
  chemically synthesized
tatgttggatagtggtgaac

SEQ ID NO: 591813 - DNA, 20 bp, Artificial Sequence
  chemically synthesized
cattgtagccattaatttat

SEQ ID NO: 591814 - DNA, 20 bp, Artificial Sequence
  chemically synthesized
cacccccacacttcagtctc

SEQ ID NO: 591815 - DNA, 20 bp, Artificial Sequence
  chemically synthesized
cacactctatgtccatgtgt

SEQ ID NO: 591816 - DNA, 20 bp, Artificial Sequence
  chemically synthesized
agtgagaacatggggtatct

SEQ ID NO: 591817 - DNA, 20 bp, Artificial Sequence
  chemically synthesized
ggggtatctttctgcttctg

SEQ ID NO: 591818 - DNA, 20 bp, Artificial Sequence
  chemically synthesized
tatacacatacactgatatt

SEQ ID NO: 591819 - DNA, 20 bp, Artificial Sequence
  chemically synthesized
aatgcacagtttgataaata

SEQ ID NO: 591820 - DNA, 20 bp, Artificial Sequence
  chemically synthesized
attgccagatatcgtaaatg

SEQ ID NO: 591821 - DNA, 20 bp, Artificial Sequence
  chemically synthesized
attggggcacattgtataca

SEQ ID NO: 591822 - DNA, 20 bp, Artificial Sequence
  chemically synthesized
acatgggtgtatacccagaa

SEQ ID NO: 591823 - DNA, 20 bp, Artificial Sequence
  chemically synthesized
atattccatagggtaaatat

SEQ ID NO: 591824 - DNA, 20 bp, Artificial Sequence
  chemically synthesized
ggaatattatgcagcccata

SEQ ID NO: 591825 - DNA, 20 bp, Artificial Sequence
  chemically synthesized
tattatgcagcccataaaat

SEQ ID NO: 591826 - DNA, 20 bp, Artificial Sequence
  chemically synthesized
acaatatatgctctttaatg

SEQ ID NO: 591827 - DNA, 20 bp, Artificial Sequence
  chemically synthesized
tctgatctgtgacagcatag

SEQ ID NO: 591828 - DNA, 20 bp, Artificial Sequence
  chemically synthesized
accgatctgatctgtgacag

SEQ ID NO: 591829 - DNA, 20 bp, Artificial Sequence
  chemically synthesized
tatgctgtcacagatcagat

SEQ ID NO: 591830 - DNA, 20 bp, Artificial Sequence
  chemically synthesized
ggtgattactcttgggagac

SEQ ID NO: 591831 - DNA, 20 bp, Artificial Sequence
  chemically synthesized
ttgcaaagaggaaccagggg

SEQ ID NO: 591832 - DNA, 20 bp, Artificial Sequence
  chemically synthesized
aagaggaaccaggggtactg

SEQ ID NO: 591833 - DNA, 20 bp, Artificial Sequence
  chemically synthesized
gttttctttcttgaagtgga

SEQ ID NO: 591834 - DNA, 20 bp, Artificial Sequence
  chemically synthesized
aagtggatgctgattacatg

SEQ ID NO: 591835 - DNA, 20 bp, Artificial Sequence
  chemically synthesized
atgctgattacatgactggc

SEQ ID NO: 591836 - DNA, 20 bp, Artificial Sequence
  chemically synthesized
tctctaaaatgttagcatac

SEQ ID NO: 591837 - DNA, 20 bp, Artificial Sequence
  chemically synthesized
tatgaaccacatccagagta

SEQ ID NO: 591838 - DNA, 20 bp, Artificial Sequence
  chemically synthesized
attatctttaattcacacaa

SEQ ID NO: 591839 - DNA, 20 bp, Artificial Sequence
  chemically synthesized
ttgtatggcctgtctggtca

SEQ ID NO: 591840 - DNA, 20 bp, Artificial Sequence
  chemically synthesized
gatgaatgccaattaatgta

SEQ ID NO: 591841 - DNA, 20 bp, Artificial Sequence
  chemically synthesized
cacatccacagtgatgatga

SEQ ID NO: 591842 - DNA, 20 bp, Artificial Sequence
  chemically synthesized
catgaacacatccacagtga

SEQ ID NO: 591843 - DNA, 20 bp, Artificial Sequence
  chemically synthesized
tcatgatatgaattgtcact

SEQ ID NO: 591844 - DNA, 20 bp, Artificial Sequence
  chemically synthesized
attgtcactccaagtttcct

SEQ ID NO: 591845 - DNA, 20 bp, Artificial Sequence
  chemically synthesized
taggagtataaagatgatgt

SEQ ID NO: 591846 - DNA, 20 bp, Artificial Sequence
  chemically synthesized
tactgtcacatgcctctcca

SEQ ID NO: 591847 - DNA, 20 bp, Artificial Sequence
  chemically synthesized
gtctgtgtcaacaatctaat

SEQ ID NO: 591848 - DNA, 20 bp, Artificial Sequence
  chemically synthesized
ctaggcaggaaaaaacctta

SEQ ID NO: 591849 - DNA, 20 bp, Artificial Sequence
  chemically synthesized
attaaggttttttcctgcct

SEQ ID NO: 591850 - DNA, 20 bp, Artificial Sequence
  chemically synthesized
tttttgttctatttacctgg

SEQ ID NO: 591851 - DNA, 20 bp, Artificial Sequence
  chemically synthesized
tggagctccaggccatttaa

SEQ ID NO: 591852 - DNA, 20 bp, Artificial Sequence
  chemically synthesized
agagcattgtgctgaacttt

SEQ ID NO: 591853 - DNA, 20 bp, Artificial Sequence
  chemically synthesized
ttttatagtctacacactgt

SEQ ID NO: 591854 - DNA, 20 bp, Artificial Sequence
  chemically synthesized
atgctttataaggatactac

SEQ ID NO: 591855 - DNA, 20 bp, Artificial Sequence
  chemically synthesized
gtggtggttaagataggcaa

SEQ ID NO: 591856 - DNA, 20 bp, Artificial Sequence
  chemically synthesized
gagtataatgtaaaataaaa

SEQ ID NO: 591857 - DNA, 20 bp, Artificial Sequence
  chemically synthesized
attatttttctcaattacat

SEQ ID NO: 591858 - DNA, 20 bp, Artificial Sequence
  chemically synthesized
ccctgaaataatgactgaat

SEQ ID NO: 591859 - DNA, 20 bp, Artificial Sequence
  chemically synthesized
cattttcccacatgtacttc

SEQ ID NO: 591860 - DNA, 20 bp, Artificial Sequence
  chemically synthesized
tgcagaaattaacatttctg

SEQ ID NO: 591861 - DNA, 20 bp, Artificial Sequence
  chemically synthesized
gtagcagaaatgttaatttc

SEQ ID NO: 591862 - DNA, 20 bp, Artificial Sequence
  chemically synthesized
agtcatcaggagaattccag

SEQ ID NO: 591863 - DNA, 20 bp, Artificial Sequence
  chemically synthesized
tcatgtcctaaattggctca

SEQ ID NO: 591864 - DNA, 20 bp, Artificial Sequence
  chemically synthesized
acatattccaacgaggtgga

SEQ ID NO: 591865 - DNA, 20 bp, Artificial Sequence
  chemically synthesized
tggaagaggttttctctctc

SEQ ID NO: 591866 - DNA, 20 bp, Artificial Sequence
  chemically synthesized
ggttttctctctcttcagct

SEQ ID NO: 591867 - DNA, 20 bp, Artificial Sequence
  chemically synthesized
tattcctcctgtagtcatag

SEQ ID NO: 591868 - DNA, 20 bp, Artificial Sequence
  chemically synthesized
agttttattcctcctgtagt

SEQ ID NO: 591869 - DNA, 20 bp, Artificial Sequence
  chemically synthesized
ctctttatgctcgtgaattc

SEQ ID NO: 591870 - DNA, 20 bp, Artificial Sequence
  chemically synthesized
gtttgccaagtatagggatg

SEQ ID NO: 591871 - DNA, 20 bp, Artificial Sequence
  chemically synthesized
cttggcaaacctggccactc

SEQ ID NO: 591872 - DNA, 20 bp, Artificial Sequence
  chemically synthesized
aaagagaagcctcagagtgg

SEQ ID NO: 591873 - DNA, 20 bp, Artificial Sequence
  chemically synthesized
ccactctgaggcttctcttt

SEQ ID NO: 591874 - DNA, 20 bp, Artificial Sequence
  chemically synthesized
aaactcattatagaattcat

SEQ ID NO: 591875 - DNA, 20 bp, Artificial Sequence
  chemically synthesized
aatctgacatgaattctata

SEQ ID NO: 591876 - DNA, 20 bp, Artificial Sequence
  chemically synthesized
tttaagttaaatgatttgct

SEQ ID NO: 591877 - DNA, 20 bp, Artificial Sequence
  chemically synthesized
ggataaaatatttttaagtt

SEQ ID NO: 591878 - DNA, 20 bp, Artificial Sequence
  chemically synthesized
gctctatatgccctttcatt

SEQ ID NO: 591879 - DNA, 20 bp, Artificial Sequence
  chemically synthesized
atgaaagggcatatagagct

SEQ ID NO: 591880 - DNA, 20 bp, Artificial Sequence
  chemically synthesized
caataacagctaatattcct

SEQ ID NO: 591881 - DNA, 20 bp, Artificial Sequence
  chemically synthesized
aggttaagaaattgcttatt

SEQ ID NO: 591882 - DNA, 20 bp, Artificial Sequence
  chemically synthesized
ggttcatgtgaaggttaaga

SEQ ID NO: 591883 - DNA, 20 bp, Artificial Sequence
  chemically synthesized
catgaaccccatgagataga

SEQ ID NO: 591884 - DNA, 20 bp, Artificial Sequence
  chemically synthesized
ttttacagttgacgaaatag

SEQ ID NO: 591885 - DNA, 20 bp, Artificial Sequence
  chemically synthesized
gaacctggaaagtaatctca

SEQ ID NO: 591886 - DNA, 20 bp, Artificial Sequence
  chemically synthesized
gcttcaatttgagaaactat

SEQ ID NO: 591887 - DNA, 20 bp, Artificial Sequence
  chemically synthesized
ggtaaaaagagttcctggtt

SEQ ID NO: 591888 - DNA, 20 bp, Artificial Sequence
  chemically synthesized
ttcatagaacagcctctgtc

SEQ ID NO: 591889 - DNA, 20 bp, Artificial Sequence
  chemically synthesized
cttttttttttttttttagt

SEQ ID NO: 591890 - DNA, 20 bp, Artificial Sequence
  chemically synthesized
tgccatcataagctaaataa

SEQ ID NO: 591891 - DNA, 20 bp, Artificial Sequence
  chemically synthesized
tacttaggaaagcccactta

SEQ ID NO: 591892 - DNA, 20 bp, Artificial Sequence
  chemically synthesized
taaataagtgggctttccta

SEQ ID NO: 591893 - DNA, 20 bp, Artificial Sequence
  chemically synthesized
acccttctatctcattattc

SEQ ID NO: 591894 - DNA, 20 bp, Artificial Sequence
  chemically synthesized
aagggttggtgttgaggcag

SEQ ID NO: 591895 - DNA, 20 bp, Artificial Sequence
  chemically synthesized
agagctattttcatttaaat

SEQ ID NO: 591896 - DNA, 20 bp, Artificial Sequence
  chemically synthesized
tagattattaattatggaac

SEQ ID NO: 591897 - DNA, 20 bp, Artificial Sequence
  chemically synthesized
catggcagtatttggcacat

SEQ ID NO: 591898 - DNA, 20 bp, Artificial Sequence
  chemically synthesized
atcaaggccattcacttttg

SEQ ID NO: 591899 - DNA, 20 bp, Artificial Sequence
  chemically synthesized
cgcttgtcgtagcagattga

SEQ ID NO: 591900 - DNA, 20 bp, Artificial Sequence
  chemically synthesized
tcaatcttagcgcttgtcgt

SEQ ID NO: 591901 - DNA, 20 bp, Artificial Sequence
  chemically synthesized
tcaatctgctacgacaagcg

SEQ ID NO: 591902 - DNA, 20 bp, Artificial Sequence
  chemically synthesized
cactcaatgaacttcaatct

SEQ ID NO: 591903 - DNA, 20 bp, Artificial Sequence
  chemically synthesized
gtccgagccctaaaagaaac

SEQ ID NO: 591904 - DNA, 20 bp, Artificial Sequence
  chemically synthesized
tttacatacatgtggcaatc

SEQ ID NO: 591905 - DNA, 20 bp, Artificial Sequence
  chemically synthesized
gtatgtaaaggcaagcaaga

SEQ ID NO: 591906 - DNA, 20 bp, Artificial Sequence
  chemically synthesized
atctcatccaggaaaccttg

SEQ ID NO: 591907 - DNA, 20 bp, Artificial Sequence
  chemically synthesized
agaaaaacacatttttcagt

SEQ ID NO: 591908 - DNA, 20 bp, Artificial Sequence
  chemically synthesized
gctgaaacatgaactgaaaa

SEQ ID NO: 591909 - DNA, 20 bp, Artificial Sequence
  chemically synthesized
tacgctatatttaggtatcc

SEQ ID NO: 591910 - DNA, 20 bp, Artificial Sequence
  chemically synthesized
cagaactttacttcaaaagg

SEQ ID NO: 591911 - DNA, 20 bp, Artificial Sequence
  chemically synthesized
aaagttctgtgagttctgac

SEQ ID NO: 591912 - DNA, 20 bp, Artificial Sequence
  chemically synthesized
tcatcgcaggcaagacacag

SEQ ID NO: 591913 - DNA, 20 bp, Artificial Sequence
  chemically synthesized
agagtagaagggttaaaaga

SEQ ID NO: 591914 - DNA, 20 bp, Artificial Sequence
  chemically synthesized
ccacagagtagaagggttaa

SEQ ID NO: 591915 - DNA, 20 bp, Artificial Sequence
  chemically synthesized
tgtattgtactgaaaataag

SEQ ID NO: 591916 - DNA, 20 bp, Artificial Sequence
  chemically synthesized
ttaggttcaggggtacacgt

SEQ ID NO: 591917 - DNA, 20 bp, Artificial Sequence
  chemically synthesized
acaggtgaactgcattttgc

SEQ ID NO: 591918 - DNA, 20 bp, Artificial Sequence
  chemically synthesized
cattttgcgggggtttggtg

SEQ ID NO: 591919 - DNA, 20 bp, Artificial Sequence
  chemically synthesized
ggaaaaataattattgggta

SEQ ID NO: 591920 - DNA, 20 bp, Artificial Sequence
  chemically synthesized
gtgtccatatgttctcatca

SEQ ID NO: 591921 - DNA, 20 bp, Artificial Sequence
  chemically synthesized
ataagtgagaacacgcagta

SEQ ID NO: 591922 - DNA, 20 bp, Artificial Sequence
  chemically synthesized
agaacacgcagtatttggtt

SEQ ID NO: 591923 - DNA, 20 bp, Artificial Sequence
  chemically synthesized
atttggttttctgtttccat

SEQ ID NO: 591924 - DNA, 20 bp, Artificial Sequence
  chemically synthesized
actactcacaatagcaaaga

SEQ ID NO: 591925 - DNA, 20 bp, Artificial Sequence
  chemically synthesized
gtgcatatgtctttatggta

SEQ ID NO: 591926 - DNA, 20 bp, Artificial Sequence
  chemically synthesized
ctctgggtatatgcccaata

SEQ ID NO: 591927 - DNA, 20 bp, Artificial Sequence
  chemically synthesized
agttatttgagaaatcacca

SEQ ID NO: 591928 - DNA, 20 bp, Artificial Sequence
  chemically synthesized
ttcggtcgttgaaagcagtg

SEQ ID NO: 591929 - DNA, 20 bp, Artificial Sequence
  chemically synthesized
gtgtgttaagtgttcctatt

SEQ ID NO: 591930 - DNA, 20 bp, Artificial Sequence
  chemically synthesized
caaataacttcctagaagga

SEQ ID NO: 591931 - DNA, 20 bp, Artificial Sequence
  chemically synthesized
ctacacagagatcactgaga

SEQ ID NO: 591932 - DNA, 20 bp, Artificial Sequence
  chemically synthesized
atttctgatagtagctagct

SEQ ID NO: 591933 - DNA, 20 bp, Artificial Sequence
  chemically synthesized
ttaataattttctacttaca

SEQ ID NO: 591934 - DNA, 20 bp, Artificial Sequence
  chemically synthesized
tttattaactttatgttact

SEQ ID NO: 591935 - DNA, 20 bp, Artificial Sequence
  chemically synthesized
tggagattctatcatgtcat

SEQ ID NO: 591936 - DNA, 20 bp, Artificial Sequence
  chemically synthesized
taatctctgattcaacttct

SEQ ID NO: 591937 - DNA, 20 bp, Artificial Sequence
  chemically synthesized
gaatctccaagaagttgaat

SEQ ID NO: 591938 - DNA, 20 bp, Artificial Sequence
  chemically synthesized
tggtaaactttgaaggtaat

SEQ ID NO: 591939 - DNA, 20 bp, Artificial Sequence
  chemically synthesized
gttgaatcagagattacctt

SEQ ID NO: 591940 - DNA, 20 bp, Artificial Sequence
  chemically synthesized
ttctaattctatgcaatttc

SEQ ID NO: 591941 - DNA, 20 bp, Artificial Sequence
  chemically synthesized
ctcccctcctaatggacttc

SEQ ID NO: 591942 - DNA, 20 bp, Artificial Sequence
  chemically synthesized
agttaaatttcacttttcct

SEQ ID NO: 591943 - DNA, 20 bp, Artificial Sequence
  chemically synthesized
agatagttaaatttcacttt

SEQ ID NO: 591944 - DNA, 20 bp, Artificial Sequence
  chemically synthesized
tccttcagctttgttagtga

SEQ ID NO: 591945 - DNA, 20 bp, Artificial Sequence
  chemically synthesized
taatctgaagacactcttcc

SEQ ID NO: 591946 - DNA, 20 bp, Artificial Sequence
  chemically synthesized
aaagctgaaggaagagtgtc

SEQ ID NO: 591947 - DNA, 20 bp, Artificial Sequence
  chemically synthesized
gaagagtgtcttcagattac

SEQ ID NO: 591948 - DNA, 20 bp, Artificial Sequence
  chemically synthesized
gctcttcacttgcccatttc

SEQ ID NO: 591949 - DNA, 20 bp, Artificial Sequence
  chemically synthesized
ggaaatgggcaagtgaagag

SEQ ID NO: 591950 - DNA, 20 bp, Artificial Sequence
  chemically synthesized
tggtcaacccacttttaagg

SEQ ID NO: 591951 - DNA, 20 bp, Artificial Sequence
  chemically synthesized
agacatctcattccttgctc

SEQ ID NO: 591952 - DNA, 20 bp, Artificial Sequence
  chemically synthesized
ccattgcttctgatcatgaa

SEQ ID NO: 591953 - DNA, 20 bp, Artificial Sequence
  chemically synthesized
tagaaacttatctcatggtt

SEQ ID NO: 591954 - DNA, 20 bp, Artificial Sequence
  chemically synthesized
ctaaaacttctaaccatgag

SEQ ID NO: 591955 - DNA, 20 bp, Artificial Sequence
  chemically synthesized
taccctcacacactcaggta

SEQ ID NO: 591956 - DNA, 20 bp, Artificial Sequence
  chemically synthesized
taatgtgaatgaaagagtat

SEQ ID NO: 591957 - DNA, 20 bp, Artificial Sequence
  chemically synthesized
gaaagagtattccggtttgg

SEQ ID NO: 591958 - DNA, 20 bp, Artificial Sequence
  chemically synthesized
tttggatatgattctgaatt

SEQ ID NO: 591959 - DNA, 20 bp, Artificial Sequence
  chemically synthesized
cattgggttggctcacctag

SEQ ID NO: 591960 - DNA, 20 bp, Artificial Sequence
  chemically synthesized
ctcagcattgggttggctca

SEQ ID NO: 591961 - DNA, 20 bp, Artificial Sequence
  chemically synthesized
ggacagaccctggttaaagg

SEQ ID NO: 591962 - DNA, 20 bp, Artificial Sequence
  chemically synthesized
cctctctgaaagctctgctc

SEQ ID NO: 591963 - DNA, 20 bp, Artificial Sequence
  chemically synthesized
ctgaaaattaaacacatgag

SEQ ID NO: 591964 - DNA, 20 bp, Artificial Sequence
  chemically synthesized
aatcataggaaaatgacaga

SEQ ID NO: 591965 - DNA, 20 bp, Artificial Sequence
  chemically synthesized
aagcatgctctgtcattttc

SEQ ID NO: 591966 - DNA, 20 bp, Artificial Sequence
  chemically synthesized
caactaataaataagccagc

SEQ ID NO: 591967 - DNA, 20 bp, Artificial Sequence
  chemically synthesized
agtgctacatttaagccaga

SEQ ID NO: 591968 - DNA, 20 bp, Artificial Sequence
  chemically synthesized
acttgcggcgtagcagcagc

SEQ ID NO: 591969 - DNA, 20 bp, Artificial Sequence
  chemically synthesized
cctgactattagtttatcag

SEQ ID NO: 591970 - DNA, 20 bp, Artificial Sequence
  chemically synthesized
gtgctgataaactaatagtc

SEQ ID NO: 591971 - DNA, 20 bp, Artificial Sequence
  chemically synthesized
ttctgtcaaagctcctgact

SEQ ID NO: 591972 - DNA, 20 bp, Artificial Sequence
  chemically synthesized
ttgacagaatgttaaagaaa

SEQ ID NO: 591973 - DNA, 20 bp, Artificial Sequence
  chemically synthesized
gttaaagaaaagctgatttt

SEQ ID NO: 591974 - DNA, 20 bp, Artificial Sequence
  chemically synthesized
cctgaaaaaaatcgaagaaa

SEQ ID NO: 591975 - DNA, 20 bp, Artificial Sequence
  chemically synthesized
attctctggtgtttcttaga

SEQ ID NO: 591976 - DNA, 20 bp, Artificial Sequence
  chemically synthesized
atgtatctggaagaattctc

SEQ ID NO: 591977 - DNA, 20 bp, Artificial Sequence
  chemically synthesized
cttatcactgaaaaaaatat

SEQ ID NO: 591978 - DNA, 20 bp, Artificial Sequence
  chemically synthesized
atatatttttttcagtgata

SEQ ID NO: 591979 - DNA, 20 bp, Artificial Sequence
  chemically synthesized
atttttttcagtgataagca

SEQ ID NO: 591980 - DNA, 20 bp, Artificial Sequence
  chemically synthesized
ttttatatcttttataatca

SEQ ID NO: 591981 - DNA, 20 bp, Artificial Sequence
  chemically synthesized
aagccatgcttttttatcag

SEQ ID NO: 591982 - DNA, 20 bp, Artificial Sequence
  chemically synthesized
aaacatgactgataaaaaag

SEQ ID NO: 591983 - DNA, 20 bp, Artificial Sequence
  chemically synthesized
atatttactcaacatctaag

SEQ ID NO: 591984 - DNA, 20 bp, Artificial Sequence
  chemically synthesized
tatttattgatgttgagctt

SEQ ID NO: 591985 - DNA, 20 bp, Artificial Sequence
  chemically synthesized
gcttccattatttattgatg

SEQ ID NO: 591986 - DNA, 20 bp, Artificial Sequence
  chemically synthesized
gctcaacatcaataaataat

SEQ ID NO: 591987 - DNA, 20 bp, Artificial Sequence
  chemically synthesized
ttatccagagcattggtttc

SEQ ID NO: 591988 - DNA, 20 bp, Artificial Sequence
  chemically synthesized
atagggatgttatccagagc

SEQ ID NO: 591989 - DNA, 20 bp, Artificial Sequence
  chemically synthesized
tccattctccacaggtgatc

SEQ ID NO: 591990 - DNA, 20 bp, Artificial Sequence
  chemically synthesized
cttgaactaaacctaaagcc

SEQ ID NO: 591991 - DNA, 20 bp, Artificial Sequence
  chemically synthesized
acctggaaaatctgatggct

SEQ ID NO: 591992 - DNA, 20 bp, Artificial Sequence
  chemically synthesized
acctaaagccatcagatttt

SEQ ID NO: 591993 - DNA, 20 bp, Artificial Sequence
  chemically synthesized
gttttaaacctggaaaatct

SEQ ID NO: 591994 - DNA, 20 bp, Artificial Sequence
  chemically synthesized
gattagatgggaccatttta

SEQ ID NO: 591995 - DNA, 20 bp, Artificial Sequence
  chemically synthesized
aaaatggtcccatctaatcc

SEQ ID NO: 591996 - DNA, 20 bp, Artificial Sequence
  chemically synthesized
taactgtaactttaaaaacc

SEQ ID NO: 591997 - DNA, 20 bp, Artificial Sequence
  chemically synthesized
tctagtgtatgttttcagta

SEQ ID NO: 591998 - DNA, 20 bp, Artificial Sequence
  chemically synthesized
ttgataacatttcttctagt

SEQ ID NO: 591999 - DNA, 20 bp, Artificial Sequence
  chemically synthesized
gtgaacatactgatcagtat

SEQ ID NO: 592000 - DNA, 20 bp, Artificial Sequence
  chemically synthesized
actgatcagtataagggctt

SEQ ID NO: 592001 - DNA, 20 bp, Artificial Sequence
  chemically synthesized
aaagtgagatctgataattt

SEQ ID NO: 592002 - DNA, 20 bp, Artificial Sequence
  chemically synthesized
actaacttttctttggtgta

SEQ ID NO: 592003 - DNA, 20 bp, Artificial Sequence
  chemically synthesized
tgtacatggttttcaagaaa

SEQ ID NO: 592004 - DNA, 20 bp, Artificial Sequence
  chemically synthesized
ttaaatgttgaaataatgaa

SEQ ID NO: 592005 - DNA, 20 bp, Artificial Sequence
  chemically synthesized
ccctgacagactggctcatg

SEQ ID NO: 592006 - DNA, 20 bp, Artificial Sequence
  chemically synthesized
ttcggtgtcaggatgaaaag

SEQ ID NO: 592007 - DNA, 20 bp, Artificial Sequence
  chemically synthesized
atgttctgggttcaatttcc

SEQ ID NO: 592008 - DNA, 20 bp, Artificial Sequence
  chemically synthesized
ggttcaatttccagtggttt

SEQ ID NO: 592009 - DNA, 20 bp, Artificial Sequence
  chemically synthesized
tgggagttgcccatgcctct

SEQ ID NO: 592010 - DNA, 20 bp, Artificial Sequence
  chemically synthesized
tttcagatgttaaccaggag

SEQ ID NO: 592011 - DNA, 20 bp, Artificial Sequence
  chemically synthesized
attcacccacaccgtaatcc

SEQ ID NO: 592012 - DNA, 20 bp, Artificial Sequence
  chemically synthesized
tcataaaggtggaataaacc

SEQ ID NO: 592013 - DNA, 20 bp, Artificial Sequence
  chemically synthesized
acagggtggacaaatgtaat

SEQ ID NO: 592014 - DNA, 20 bp, Artificial Sequence
  chemically synthesized
tcctattacatttgtccacc

SEQ ID NO: 592015 - DNA, 20 bp, Artificial Sequence
  chemically synthesized
caccctgtgcttaaagcagc

SEQ ID NO: 592016 - DNA, 20 bp, Artificial Sequence
  chemically synthesized
gtgtccctcttttaagctgt

SEQ ID NO: 592017 - DNA, 20 bp, Artificial Sequence
  chemically synthesized
ataaaaattccatctactgc

SEQ ID NO: 592018 - DNA, 20 bp, Artificial Sequence
  chemically synthesized
tatttgaaacaccaccacta

SEQ ID NO: 592019 - DNA, 20 bp, Artificial Sequence
  chemically synthesized
atctgaaagctatttagtgg

SEQ ID NO: 592020 - DNA, 20 bp, Artificial Sequence
  chemically synthesized
aatagtgcaggggctgggct

SEQ ID NO: 592021 - DNA, 20 bp, Artificial Sequence
  chemically synthesized
catttatttcatttatctat

SEQ ID NO: 592022 - DNA, 20 bp, Artificial Sequence
  chemically synthesized
tgtattgatatattacatta

SEQ ID NO: 592023 - DNA, 20 bp, Artificial Sequence
  chemically synthesized
accaaaatactccactgcat

SEQ ID NO: 592024 - DNA, 20 bp, Artificial Sequence
  chemically synthesized
acagctatgcagtggagtat

SEQ ID NO: 592025 - DNA, 20 bp, Artificial Sequence
  chemically synthesized
tttttttatagaaacacagg

SEQ ID NO: 592026 - DNA, 20 bp, Artificial Sequence
  chemically synthesized
aaataactccaaagccagtc

SEQ ID NO: 592027 - DNA, 20 bp, Artificial Sequence
  chemically synthesized
tttgttacaagaattgtcca

SEQ ID NO: 592028 - DNA, 20 bp, Artificial Sequence
  chemically synthesized
gattttatataattacacct

SEQ ID NO: 592029 - DNA, 20 bp, Artificial Sequence
  chemically synthesized
acaaataagttgcgttttaa

SEQ ID NO: 592030 - DNA, 20 bp, Artificial Sequence
  chemically synthesized
taaaatatagtacaaataag

SEQ ID NO: 592031 - DNA, 20 bp, Artificial Sequence
  chemically synthesized
acttatttgtactatatttt

SEQ ID NO: 592032 - DNA, 20 bp, Artificial Sequence
  chemically synthesized
taagtgaccttacactcatt

SEQ ID NO: 592033 - DNA, 20 bp, Artificial Sequence
  chemically synthesized
tgtactatcaccactactta

SEQ ID NO: 592034 - DNA, 20 bp, Artificial Sequence
  chemically synthesized
tcagctgttaagtattgagt

SEQ ID NO: 592035 - DNA, 20 bp, Artificial Sequence
  chemically synthesized
aacagctgagaagaatatga

SEQ ID NO: 592036 - DNA, 20 bp, Artificial Sequence
  chemically synthesized
atataaattaaagcagcaat

SEQ ID NO: 592037 - DNA, 20 bp, Artificial Sequence
  chemically synthesized
atgtggtatgaaacagaaat

SEQ ID NO: 592038 - DNA, 20 bp, Artificial Sequence
  chemically synthesized
ttttcaattcatccactgat

SEQ ID NO: 592039 - DNA, 20 bp, Artificial Sequence
  chemically synthesized
catccactgatggacgttta

SEQ ID NO: 592040 - DNA, 20 bp, Artificial Sequence
  chemically synthesized
ttgaagagatagctttgttc

SEQ ID NO: 592041 - DNA, 20 bp, Artificial Sequence
  chemically synthesized
gaaatcagtatctttgaaga

SEQ ID NO: 592042 - DNA, 20 bp, Artificial Sequence
  chemically synthesized
caaagctatctcttcaaaga

SEQ ID NO: 592043 - DNA, 20 bp, Artificial Sequence
  chemically synthesized
ctttggataaatgcccagta

SEQ ID NO: 592044 - DNA, 20 bp, Artificial Sequence
  chemically synthesized
ctggatcatctggtagcaat

SEQ ID NO: 592045 - DNA, 20 bp, Artificial Sequence
  chemically synthesized
caattcatgttttattaaga

SEQ ID NO: 592046 - DNA, 20 bp, Artificial Sequence
  chemically synthesized
atagagatagctgaaggctt

SEQ ID NO: 592047 - DNA, 20 bp, Artificial Sequence
  chemically synthesized
ggcattgtatagagatagct

SEQ ID NO: 592048 - DNA, 20 bp, Artificial Sequence
  chemically synthesized
atgccattttaaacaccttt

SEQ ID NO: 592049 - DNA, 20 bp, Artificial Sequence
  chemically synthesized
atattttaataatcttccaa

SEQ ID NO: 592050 - DNA, 20 bp, Artificial Sequence
  chemically synthesized
cctgtcttgctttttaaatt

SEQ ID NO: 592051 - DNA, 20 bp, Artificial Sequence
  chemically synthesized
atctggcctttgttgacctg

SEQ ID NO: 592052 - DNA, 20 bp, Artificial Sequence
  chemically synthesized
agcaagacaggtcaacaaag

SEQ ID NO: 592053 - DNA, 20 bp, Artificial Sequence
  chemically synthesized
attacatcccaaagatttca

SEQ ID NO: 592054 - DNA, 20 bp, Artificial Sequence
  chemically synthesized
tcatgtgttaaattacatcc

SEQ ID NO: 592055 - DNA, 20 bp, Artificial Sequence
  chemically synthesized
tttgggatgtaatttaacac

SEQ ID NO: 592056 - DNA, 20 bp, Artificial Sequence
  chemically synthesized
caaaagtgacatactacata

SEQ ID NO: 592057 - DNA, 20 bp, Artificial Sequence
  chemically synthesized
tactatgtagtatgtcactt

SEQ ID NO: 592058 - DNA, 20 bp, Artificial Sequence
  chemically synthesized
tgctttgagcaaggaacata

SEQ ID NO: 592059 - DNA, 20 bp, Artificial Sequence
  chemically synthesized
ctctatttcagtgggatgaa

SEQ ID NO: 592060 - DNA, 20 bp, Artificial Sequence
  chemically synthesized
gtcttaattctagaggcaca

SEQ ID NO: 592061 - DNA, 20 bp, Artificial Sequence
  chemically synthesized
tatacagagttgaactatct

SEQ ID NO: 592062 - DNA, 20 bp, Artificial Sequence
  chemically synthesized
ctgtataactaacaagaaaa

SEQ ID NO: 592063 - DNA, 20 bp, Artificial Sequence
  chemically synthesized
tttaaccctcctttaaaaaa

SEQ ID NO: 592064 - DNA, 20 bp, Artificial Sequence
  chemically synthesized
gatatctccagtaaatttag

SEQ ID NO: 592065 - DNA, 20 bp, Artificial Sequence
  chemically synthesized
aatgctacataactacaaga

SEQ ID NO: 592066 - DNA, 20 bp, Artificial Sequence
  chemically synthesized
ttataattacaagaggttaa

SEQ ID NO: 592067 - DNA, 20 bp, Artificial Sequence
  chemically synthesized
taaattttacaacttgcaaa

SEQ ID NO: 592068 - DNA, 20 bp, Artificial Sequence
  chemically synthesized
ggaaataatttcaagagtcc

SEQ ID NO: 592069 - DNA, 20 bp, Artificial Sequence
  chemically synthesized
ttaacaggttaaaaaacctt

SEQ ID NO: 592070 - DNA, 20 bp, Artificial Sequence
  chemically synthesized
ttaatgtgttaacaaacgtt

SEQ ID NO: 592071 - DNA, 20 bp, Artificial Sequence
  chemically synthesized
accatggtcacctatacttt

SEQ ID NO: 592072 - DNA, 20 bp, Artificial Sequence
  chemically synthesized
taacaatattgtgtgttcat

SEQ ID NO: 592073 - DNA, 20 bp, Artificial Sequence
  chemically synthesized
ttacatatctaagtgaacac

SEQ ID NO: 592074 - DNA, 20 bp, Artificial Sequence
  chemically synthesized
tcaattatgcaatattgtta

SEQ ID NO: 592075 - DNA, 20 bp, Artificial Sequence
  chemically synthesized
gtaacaatattgcataattg

SEQ ID NO: 592076 - DNA, 20 bp, Artificial Sequence
  chemically synthesized
atgtaatatcaataatgcca

SEQ ID NO: 592077 - DNA, 20 bp, Artificial Sequence
  chemically synthesized
cattaatttatatttctatt

SEQ ID NO: 592078 - DNA, 20 bp, Artificial Sequence
  chemically synthesized
cagataatagaaatataaat

SEQ ID NO: 592079 - DNA, 20 bp, Artificial Sequence
  chemically synthesized
tctataaggaggtcctacac

SEQ ID NO: 592080 - DNA, 20 bp, Artificial Sequence
  chemically synthesized
taaccctatgcaaagtgata

SEQ ID NO: 592081 - DNA, 20 bp, Artificial Sequence
  chemically synthesized
gtgaatacatgacttacaga

SEQ ID NO: 592082 - DNA, 20 bp, Artificial Sequence
  chemically synthesized
taagtcatgtattcacaaaa

SEQ ID NO: 592083 - DNA, 20 bp, Artificial Sequence
  chemically synthesized
gtattcacaaaacgatgctt

SEQ ID NO: 592084 - DNA, 20 bp, Artificial Sequence
  chemically synthesized
tactgccacaagccactaag

SEQ ID NO: 592085 - DNA, 20 bp, Artificial Sequence
  chemically synthesized
gtataggactttcaggaaat

SEQ ID NO: 592086 - DNA, 20 bp, Artificial Sequence
  chemically synthesized
taactgtcctctgatttgtc

SEQ ID NO: 592087 - DNA, 20 bp, Artificial Sequence
  chemically synthesized
aaatgccagcattaactgtc

SEQ ID NO: 592088 - DNA, 20 bp, Artificial Sequence
  chemically synthesized
gaattaccaaaagagtctga

SEQ ID NO: 592089 - DNA, 20 bp, Artificial Sequence
  chemically synthesized
caaaagagtctgaaagggct

SEQ ID NO: 592090 - DNA, 20 bp, Artificial Sequence
  chemically synthesized
aagttatgcaacgactctgg

SEQ ID NO: 592091 - DNA, 20 bp, Artificial Sequence
  chemically synthesized
aagtagctcgaggcagtgga

SEQ ID NO: 592092 - DNA, 20 bp, Artificial Sequence
  chemically synthesized
atagaaaatatctcgttatc

SEQ ID NO: 592093 - DNA, 20 bp, Artificial Sequence
  chemically synthesized
tcgttatccatagtttcaag

SEQ ID NO: 592094 - DNA, 20 bp, Artificial Sequence
  chemically synthesized
tcattctgacttccacaaat

SEQ ID NO: 592095 - DNA, 20 bp, Artificial Sequence
  chemically synthesized
agatttgtggaagtcagaat

SEQ ID NO: 592096 - DNA, 20 bp, Artificial Sequence
  chemically synthesized
tgacagtttcttttaatata

SEQ ID NO: 592097 - DNA, 20 bp, Artificial Sequence
  chemically synthesized
cagacctggtctcgaggaat

SEQ ID NO: 592098 - DNA, 20 bp, Artificial Sequence
  chemically synthesized
atccctttggggaggatttc

SEQ ID NO: 592099 - DNA, 20 bp, Artificial Sequence
  chemically synthesized
ggcattatccatccctttgg

SEQ ID NO: 592100 - DNA, 20 bp, Artificial Sequence
  chemically synthesized
taatgcctttgtctaaatgt

SEQ ID NO: 592101 - DNA, 20 bp, Artificial Sequence
  chemically synthesized
aaaggagcaacaattaaaat

SEQ ID NO: 592102 - DNA, 20 bp, Artificial Sequence
  chemically synthesized
ttcacattaattttacaaaa

SEQ ID NO: 592103 - DNA, 20 bp, Artificial Sequence
  chemically synthesized
ttaattttacaaaaacttgt

SEQ ID NO: 592104 - DNA, 20 bp, Artificial Sequence
  chemically synthesized
tttacaaaaacttgtttctg

SEQ ID NO: 592105 - DNA, 20 bp, Artificial Sequence
  chemically synthesized
catagaaaatcaaatcagaa

SEQ ID NO: 592106 - DNA, 20 bp, Artificial Sequence
  chemically synthesized
ttgtttctgatttgattttc

SEQ ID NO: 592107 - DNA, 20 bp, Artificial Sequence
  chemically synthesized
aatgagcttccaactgcaca

SEQ ID NO: 592108 - DNA, 20 bp, Artificial Sequence
  chemically synthesized
tacagttgtcatgattaata

SEQ ID NO: 592109 - DNA, 20 bp, Artificial Sequence
  chemically synthesized
actagcagccactacagttg

SEQ ID NO: 592110 - DNA, 20 bp, Artificial Sequence
  chemically synthesized
tttagctaggcacatggtat

SEQ ID NO: 592111 - DNA, 20 bp, Artificial Sequence
  chemically synthesized
ctgtagtagaaagagatctg

SEQ ID NO: 592112 - DNA, 20 bp, Artificial Sequence
  chemically synthesized
ttcagatctctttctactac

SEQ ID NO: 592113 - DNA, 20 bp, Artificial Sequence
  chemically synthesized
tctttctactacagttgatt

SEQ ID NO: 592114 - DNA, 20 bp, Artificial Sequence
  chemically synthesized
gtttttttttttattatact

SEQ ID NO: 592115 - DNA, 20 bp, Artificial Sequence
  chemically synthesized
aactcgtcatttaccattag

SEQ ID NO: 592116 - DNA, 20 bp, Artificial Sequence
  chemically synthesized
ggggatttattatttttaaa

SEQ ID NO: 592117 - DNA, 20 bp, Artificial Sequence
  chemically synthesized
ttaatggaaatgtatttggt

SEQ ID NO: 592118 - DNA, 20 bp, Artificial Sequence
  chemically synthesized
taaatatttcacatgagtta

SEQ ID NO: 592119 - DNA, 20 bp, Artificial Sequence
  chemically synthesized
tttgtaaagtgaggtttggg

SEQ ID NO: 592120 - DNA, 20 bp, Artificial Sequence
  chemically synthesized
ttgtttctccatttgtaaag

SEQ ID NO: 592121 - DNA, 20 bp, Artificial Sequence
  chemically synthesized
cactttacaaatggagaaac

SEQ ID NO: 592122 - DNA, 20 bp, Artificial Sequence
  chemically synthesized
gcgtgttacatttgtgaaac

SEQ ID NO: 592123 - DNA, 20 bp, Artificial Sequence
  chemically synthesized
cagatagaaagtggtggagc

SEQ ID NO: 592124 - DNA, 20 bp, Artificial Sequence
  chemically synthesized
atcactgagcataattgaat

SEQ ID NO: 592125 - DNA, 20 bp, Artificial Sequence
  chemically synthesized
aacagccattcaattatgct

SEQ ID NO: 592126 - DNA, 20 bp, Artificial Sequence
  chemically synthesized
attatgctcagtgatttcct

SEQ ID NO: 592127 - DNA, 20 bp, Artificial Sequence
  chemically synthesized
taccaacaaaaaacgggagg

SEQ ID NO: 592128 - DNA, 20 bp, Artificial Sequence
  chemically synthesized
agtgtctcctaagcatggcc

SEQ ID NO: 592129 - DNA, 20 bp, Artificial Sequence
  chemically synthesized
actttaaaaaaattatttat

SEQ ID NO: 592130 - DNA, 20 bp, Artificial Sequence
  chemically synthesized
tttctaacatggtaagagcc

SEQ ID NO: 592131 - DNA, 20 bp, Artificial Sequence
  chemically synthesized
gttagaaaataaacttaaag

SEQ ID NO: 592132 - DNA, 20 bp, Artificial Sequence
  chemically synthesized
tctccagtgaaatctctact

SEQ ID NO: 592133 - DNA, 20 bp, Artificial Sequence
  chemically synthesized
tgcgtatatagtcttatttt

SEQ ID NO: 592134 - DNA, 20 bp, Artificial Sequence
  chemically synthesized
agtcaaccatcattaagaca

SEQ ID NO: 592135 - DNA, 20 bp, Artificial Sequence
  chemically synthesized
catgctaaagtctccgaaaa

SEQ ID NO: 592136 - DNA, 20 bp, Artificial Sequence
  chemically synthesized
atatggcatctgcagagcag

SEQ ID NO: 592137 - DNA, 20 bp, Artificial Sequence
  chemically synthesized
tctgcagatgccatatgtaa

SEQ ID NO: 592138 - DNA, 20 bp, Artificial Sequence
  chemically synthesized
tttctaatgtattcaggtat

SEQ ID NO: 592139 - DNA, 20 bp, Artificial Sequence
  chemically synthesized
attaaagctgtcgttattct

SEQ ID NO: 592140 - DNA, 20 bp, Artificial Sequence
  chemically synthesized
ttaaaatctactagaataac

SEQ ID NO: 592141 - DNA, 20 bp, Artificial Sequence
  chemically synthesized
taacgacagctttaataaaa

SEQ ID NO: 592142 - DNA, 20 bp, Artificial Sequence
  chemically synthesized
ctttaataaaatagagtttg

SEQ ID NO: 592143 - DNA, 20 bp, Artificial Sequence
  chemically synthesized
tcaatagcaaagaaaattct

SEQ ID NO: 592144 - DNA, 20 bp, Artificial Sequence
  chemically synthesized
aatgttcattaatgggggtt

SEQ ID NO: 592145 - DNA, 20 bp, Artificial Sequence
  chemically synthesized
agtatctacagttctttttt

SEQ ID NO: 592146 - DNA, 20 bp, Artificial Sequence
  chemically synthesized
aacaaatctgcacgttctgc

SEQ ID NO: 592147 - DNA, 20 bp, Artificial Sequence
  chemically synthesized
tgggaaacatgtgcagaacg

SEQ ID NO: 592148 - DNA, 20 bp, Artificial Sequence
  chemically synthesized
cataggtacacatgtgccat

SEQ ID NO: 592149 - DNA, 20 bp, Artificial Sequence
  chemically synthesized
tgcacctatgaacccgtcat

SEQ ID NO: 592150 - DNA, 20 bp, Artificial Sequence
  chemically synthesized
ggacaaatacctaatgcatg

SEQ ID NO: 592151 - DNA, 20 bp, Artificial Sequence
  chemically synthesized
tatgagtgagaaaatgcggt

SEQ ID NO: 592152 - DNA, 20 bp, Artificial Sequence
  chemically synthesized
gtctgtttttccattcctgt

SEQ ID NO: 592153 - DNA, 20 bp, Artificial Sequence
  chemically synthesized
tgtgttagtttgctgaggat

SEQ ID NO: 592154 - DNA, 20 bp, Artificial Sequence
  chemically synthesized
gtttgctgaggatgatggct

SEQ ID NO: 592155 - DNA, 20 bp, Artificial Sequence
  chemically synthesized
gacatgaactcgttcttttt

SEQ ID NO: 592156 - DNA, 20 bp, Artificial Sequence
  chemically synthesized
gataagaaagtgatctttat

SEQ ID NO: 592157 - DNA, 20 bp, Artificial Sequence
  chemically synthesized
ccctttaattttatacttag

SEQ ID NO: 592158 - DNA, 20 bp, Artificial Sequence
  chemically synthesized
ctaatgttgacaaagcactt

SEQ ID NO: 592159 - DNA, 20 bp, Artificial Sequence
  chemically synthesized
aaaagaatttgtaaactgtc

SEQ ID NO: 592160 - DNA, 20 bp, Artificial Sequence
  chemically synthesized
gtctgtcacgtaggcatttt

SEQ ID NO: 592161 - DNA, 20 bp, Artificial Sequence
  chemically synthesized
tgcatgttttacagttcaga

SEQ ID NO: 592162 - DNA, 20 bp, Artificial Sequence
  chemically synthesized
ctagcttcagcagtttttag

SEQ ID NO: 592163 - DNA, 20 bp, Artificial Sequence
  chemically synthesized
cagctaaaaactgctgaagc

SEQ ID NO: 592164 - DNA, 20 bp, Artificial Sequence
  chemically synthesized
gatgttcaagccctagcttc

SEQ ID NO: 592165 - DNA, 20 bp, Artificial Sequence
  chemically synthesized
aataagacagatgttcaagc

SEQ ID NO: 592166 - DNA, 20 bp, Artificial Sequence
  chemically synthesized
aaagtcaatatgaaagtcag

SEQ ID NO: 592167 - DNA, 20 bp, Artificial Sequence
  chemically synthesized
atatgaaagtcagtctagat

SEQ ID NO: 592168 - DNA, 20 bp, Artificial Sequence
  chemically synthesized
acatcttctttacaatgcta

SEQ ID NO: 592169 - DNA, 20 bp, Artificial Sequence
  chemically synthesized
tcatgttctttgagtgcttt

SEQ ID NO: 592170 - DNA, 20 bp, Artificial Sequence
  chemically synthesized
aatttatggtcatgttcttt

SEQ ID NO: 592171 - DNA, 20 bp, Artificial Sequence
  chemically synthesized
agcatagcatctgaatttat

SEQ ID NO: 592172 - DNA, 20 bp, Artificial Sequence
  chemically synthesized
ggcacattttcaatacccct

SEQ ID NO: 592173 - DNA, 20 bp, Artificial Sequence
  chemically synthesized
aatttatgtgtatatatgta

SEQ ID NO: 592174 - DNA, 20 bp, Artificial Sequence
  chemically synthesized
ttatttatttctatatattt

SEQ ID NO: 592175 - DNA, 20 bp, Artificial Sequence
  chemically synthesized
ttttgccagaaattatgctt

SEQ ID NO: 592176 - DNA, 20 bp, Artificial Sequence
  chemically synthesized
ctttaattttttgccagaaa

SEQ ID NO: 592177 - DNA, 20 bp, Artificial Sequence
  chemically synthesized
gtccattatacagaaaaagt

SEQ ID NO: 592178 - DNA, 20 bp, Artificial Sequence
  chemically synthesized
aaagtaaaagtttgtcctac

SEQ ID NO: 592179 - DNA, 20 bp, Artificial Sequence
  chemically synthesized
gtttgtcctaccttggattt

SEQ ID NO: 592180 - DNA, 20 bp, Artificial Sequence
  chemically synthesized
tgattataaaatgaaagcac

SEQ ID NO: 592181 - DNA, 20 bp, Artificial Sequence
  chemically synthesized
aaactagaaattttaatcat

SEQ ID NO: 592182 - DNA, 20 bp, Artificial Sequence
  chemically synthesized
aagcacaaatgattaaaatt

SEQ ID NO: 592183 - DNA, 20 bp, Artificial Sequence
  chemically synthesized
ccaccctgtcttgctaatag

SEQ ID NO: 592184 - DNA, 20 bp, Artificial Sequence
  chemically synthesized
agtccagttttcataaacta

SEQ ID NO: 592185 - DNA, 20 bp, Artificial Sequence
  chemically synthesized
aaattctcattttcaaacaa

SEQ ID NO: 592186 - DNA, 20 bp, Artificial Sequence
  chemically synthesized
ggctccacattggaaaacac

SEQ ID NO: 592187 - DNA, 20 bp, Artificial Sequence
  chemically synthesized
ctagaatgagttagaaacat

SEQ ID NO: 592188 - DNA, 20 bp, Artificial Sequence
  chemically synthesized
ttctacccatgtaattttag

SEQ ID NO: 592189 - DNA, 20 bp, Artificial Sequence
  chemically synthesized
agcattgcttgctcctagca

SEQ ID NO: 592190 - DNA, 20 bp, Artificial Sequence
  chemically synthesized
tagcacaatgtttggcacat

SEQ ID NO: 592191 - DNA, 20 bp, Artificial Sequence
  chemically synthesized
tgaatttactgagatgatta

SEQ ID NO: 592192 - DNA, 20 bp, Artificial Sequence
  chemically synthesized
gtatggcactgaatttactg

SEQ ID NO: 592193 - DNA, 20 bp, Artificial Sequence
  chemically synthesized
gtgattttgttttatgagca

SEQ ID NO: 592194 - DNA, 20 bp, Artificial Sequence
  chemically synthesized
aatgctcataaaacaaaatc

SEQ ID NO: 592195 - DNA, 20 bp, Artificial Sequence
  chemically synthesized
aagttgcattaatcaggtga

SEQ ID NO: 592196 - DNA, 20 bp, Artificial Sequence
  chemically synthesized
aaacataagttgcattaatc

SEQ ID NO: 592197 - DNA, 20 bp, Artificial Sequence
  chemically synthesized
aatcacctgattaatgcaac

SEQ ID NO: 592198 - DNA, 20 bp, Artificial Sequence
  chemically synthesized
taatgcaacttatgttttca

SEQ ID NO: 592199 - DNA, 20 bp, Artificial Sequence
  chemically synthesized
tgaagtttaaatcaaaatca

SEQ ID NO: 592200 - DNA, 20 bp, Artificial Sequence
  chemically synthesized
gtttaaatcaaaatcatttg

SEQ ID NO: 592201 - DNA, 20 bp, Artificial Sequence
  chemically synthesized
agatgaaacaaaccaaatga

SEQ ID NO: 592202 - DNA, 20 bp, Artificial Sequence
  chemically synthesized
atgaagagatgaaacaaacc

SEQ ID NO: 592203 - DNA, 20 bp, Artificial Sequence
  chemically synthesized
tcattttaaaacccttttaa

SEQ ID NO: 592204 - DNA, 20 bp, Artificial Sequence
  chemically synthesized
agtagactaatctattttaa

SEQ ID NO: 592205 - DNA, 20 bp, Artificial Sequence
  chemically synthesized
atattaattttaatcattgc

SEQ ID NO: 592206 - DNA, 20 bp, Artificial Sequence
  chemically synthesized
ttaatgaccccaatcattag

SEQ ID NO: 592207 - DNA, 20 bp, Artificial Sequence
  chemically synthesized
tcagagactatttgtaaaga

SEQ ID NO: 592208 - DNA, 20 bp, Artificial Sequence
  chemically synthesized
agtatactgctgtgcatgtt

SEQ ID NO: 592209 - DNA, 20 bp, Artificial Sequence
  chemically synthesized
tcatagggcacactgtaggc

SEQ ID NO: 592210 - DNA, 20 bp, Artificial Sequence
  chemically synthesized
cctacagtgtgccctatgaa

SEQ ID NO: 592211 - DNA, 20 bp, Artificial Sequence
  chemically synthesized
taaattgatgttaagaatgt

SEQ ID NO: 592212 - DNA, 20 bp, Artificial Sequence
  chemically synthesized
ggaacacttttacactgttg

SEQ ID NO: 592213 - DNA, 20 bp, Artificial Sequence
  chemically synthesized
tccccatcctctccagcacc

SEQ ID NO: 592214 - DNA, 20 bp, Artificial Sequence
  chemically synthesized
cctgttgtttcctgactttt

SEQ ID NO: 592215 - DNA, 20 bp, Artificial Sequence
  chemically synthesized
ggtgtgagatggtatctcat

SEQ ID NO: 592216 - DNA, 20 bp, Artificial Sequence
  chemically synthesized
gagatggtatctcattgtgg

SEQ ID NO: 592217 - DNA, 20 bp, Artificial Sequence
  chemically synthesized
gtgatggtgagcattttttc

SEQ ID NO: 592218 - DNA, 20 bp, Artificial Sequence
  chemically synthesized
gttcattgtggaaggcagtg

SEQ ID NO: 592219 - DNA, 20 bp, Artificial Sequence
  chemically synthesized
gtgcacgtgtctttatagca

SEQ ID NO: 592220 - DNA, 20 bp, Artificial Sequence
  chemically synthesized
ctataaagacacgtgcacac

SEQ ID NO: 592221 - DNA, 20 bp, Artificial Sequence
  chemically synthesized
caaatgtccaacaatgatag

SEQ ID NO: 592222 - DNA, 20 bp, Artificial Sequence
  chemically synthesized
gtttactgagaatgatgtat

SEQ ID NO: 592223 - DNA, 20 bp, Artificial Sequence
  chemically synthesized
gtttggttttttgtccttgc

SEQ ID NO: 592224 - DNA, 20 bp, Artificial Sequence
  chemically synthesized
aagagtgagaacatgcgctg

SEQ ID NO: 592225 - DNA, 20 bp, Artificial Sequence
  chemically synthesized
cacctaagagtgagaacatg

SEQ ID NO: 592226 - DNA, 20 bp, Artificial Sequence
  chemically synthesized
tttttttttttaattatact

SEQ ID NO: 592227 - DNA, 20 bp, Artificial Sequence
  chemically synthesized
tgaaattgtctgtgagccag

SEQ ID NO: 592228 - DNA, 20 bp, Artificial Sequence
  chemically synthesized
taaactgaaattgtctgtga

SEQ ID NO: 592229 - DNA, 20 bp, Artificial Sequence
  chemically synthesized
taatctggctcacagacaat

SEQ ID NO: 592230 - DNA, 20 bp, Artificial Sequence
  chemically synthesized
agaagtaacataaaattaga

SEQ ID NO: 592231 - DNA, 20 bp, Artificial Sequence
  chemically synthesized
tgatctaattttatgttact

SEQ ID NO: 592232 - DNA, 20 bp, Artificial Sequence
  chemically synthesized
tttcaggatggaattaacaa

SEQ ID NO: 592233 - DNA, 20 bp, Artificial Sequence
  chemically synthesized
agaagaaactgctattaaag

SEQ ID NO: 592234 - DNA, 20 bp, Artificial Sequence
  chemically synthesized
tttcaaaacttatctttaat

SEQ ID NO: 592235 - DNA, 20 bp, Artificial Sequence
  chemically synthesized
aagataatgtaaggcccttg

SEQ ID NO: 592236 - DNA, 20 bp, Artificial Sequence
  chemically synthesized
ctttcttcctcatttaactg

SEQ ID NO: 592237 - DNA, 20 bp, Artificial Sequence
  chemically synthesized
gagaaaaaagtaggctatct

SEQ ID NO: 592238 - DNA, 20 bp, Artificial Sequence
  chemically synthesized
atatctgggaaaataataca

SEQ ID NO: 592239 - DNA, 20 bp, Artificial Sequence
  chemically synthesized
taaatgcatttatctcacaa

SEQ ID NO: 592240 - DNA, 20 bp, Artificial Sequence
  chemically synthesized
ggaagtttaaagccttggag

SEQ ID NO: 592241 - DNA, 20 bp, Artificial Sequence
  chemically synthesized
taatacagaaaacatggctc

SEQ ID NO: 592242 - DNA, 20 bp, Artificial Sequence
  chemically synthesized
gccatgttttctgtattaac

SEQ ID NO: 592243 - DNA, 20 bp, Artificial Sequence
  chemically synthesized
tctgtattaacacgtgtttt

SEQ ID NO: 592244 - DNA, 20 bp, Artificial Sequence
  chemically synthesized
ttcatcgcttcttcctccac

SEQ ID NO: 592245 - DNA, 20 bp, Artificial Sequence
  chemically synthesized
ttcttcctccacaattgttt

SEQ ID NO: 592246 - DNA, 20 bp, Artificial Sequence
  chemically synthesized
tccacaattgttttttagat

SEQ ID NO: 592247 - DNA, 20 bp, Artificial Sequence
  chemically synthesized
tttttcaaagcataaataac

SEQ ID NO: 592248 - DNA, 20 bp, Artificial Sequence
  chemically synthesized
tgaagacaaactggggttat

SEQ ID NO: 592249 - DNA, 20 bp, Artificial Sequence
  chemically synthesized
agcaagagatatataccatg

SEQ ID NO: 592250 - DNA, 20 bp, Artificial Sequence
  chemically synthesized
tattgttcaccttttctttg

SEQ ID NO: 592251 - DNA, 20 bp, Artificial Sequence
  chemically synthesized
ttcgcctcctctttcctgac

SEQ ID NO: 592252 - DNA, 20 bp, Artificial Sequence
  chemically synthesized
ttgcatcccgtgcatccgtc

SEQ ID NO: 592253 - DNA, 20 bp, Artificial Sequence
  chemically synthesized
tcccgtgcatccgtcaaagg

SEQ ID NO: 592254 - DNA, 20 bp, Artificial Sequence
  chemically synthesized
catccgtcaaaggcttagct

SEQ ID NO: 592255 - DNA, 20 bp, Artificial Sequence
  chemically synthesized
gtcaaaggcttagctttctg

SEQ ID NO: 592256 - DNA, 20 bp, Artificial Sequence
  chemically synthesized
ttgttcaaagcccgcctttt

SEQ ID NO: 592257 - DNA, 20 bp, Artificial Sequence
  chemically synthesized
tgggaccaagctcccaaaag

SEQ ID NO: 592258 - DNA, 20 bp, Artificial Sequence
  chemically synthesized
ttttgggagcttggtcccat

SEQ ID NO: 592259 - DNA, 20 bp, Artificial Sequence
  chemically synthesized
ctatcatctccttctaagca

SEQ ID NO: 592260 - DNA, 20 bp, Artificial Sequence
  chemically synthesized
ctccttctaagcattctgtt

SEQ ID NO: 592261 - DNA, 20 bp, Artificial Sequence
  chemically synthesized
gagatgtgaagctaaaaaca

SEQ ID NO: 592262 - DNA, 20 bp, Artificial Sequence
  chemically synthesized
tagcttcacatctcccttcg

SEQ ID NO: 592263 - DNA, 20 bp, Artificial Sequence
  chemically synthesized
atctcccttcgccatgcttc

SEQ ID NO: 592264 - DNA, 20 bp, Artificial Sequence
  chemically synthesized
caataacgcagcagcaagta

SEQ ID NO: 592265 - DNA, 20 bp, Artificial Sequence
  chemically synthesized
aacgcagcagcaagtacatc

SEQ ID NO: 592266 - DNA, 20 bp, Artificial Sequence
  chemically synthesized
caagtacatcgattgcttta

SEQ ID NO: 592267 - DNA, 20 bp, Artificial Sequence
  chemically synthesized
attcatttgtctttatttct

SEQ ID NO: 592268 - DNA, 20 bp, Artificial Sequence
  chemically synthesized
tacacagctcatcacagaca

SEQ ID NO: 592269 - DNA, 20 bp, Artificial Sequence
  chemically synthesized
atattagtgatattatgtat

SEQ ID NO: 592270 - DNA, 20 bp, Artificial Sequence
  chemically synthesized
attttgttgcagaacatgtt

SEQ ID NO: 592271 - DNA, 20 bp, Artificial Sequence
  chemically synthesized
tctgagttttcttcttttca

SEQ ID NO: 592272 - DNA, 20 bp, Artificial Sequence
  chemically synthesized
ttcttcttttcacctagatt

SEQ ID NO: 592273 - DNA, 20 bp, Artificial Sequence
  chemically synthesized
ttttaatatggagaagcagt

SEQ ID NO: 592274 - DNA, 20 bp, Artificial Sequence
  chemically synthesized
tctgtggtcttttaaaccac

SEQ ID NO: 592275 - DNA, 20 bp, Artificial Sequence
  chemically synthesized
agacaggccagagttcaaat

SEQ ID NO: 592276 - DNA, 20 bp, Artificial Sequence
  chemically synthesized
tagcctctctccagctcaat

SEQ ID NO: 592277 - DNA, 20 bp, Artificial Sequence
  chemically synthesized
cttttccctgtgtgaggttt

SEQ ID NO: 592278 - DNA, 20 bp, Artificial Sequence
  chemically synthesized
ctacatgacttttccctgtg

SEQ ID NO: 592279 - DNA, 20 bp, Artificial Sequence
  chemically synthesized
aaagtcatgtagtgggcata

SEQ ID NO: 592280 - DNA, 20 bp, Artificial Sequence
  chemically synthesized
aatttcacataaactatgaa

SEQ ID NO: 592281 - DNA, 20 bp, Artificial Sequence
  chemically synthesized
tattaagttcaaactggatt

SEQ ID NO: 592282 - DNA, 20 bp, Artificial Sequence
  chemically synthesized
tcaataaatattaagttcaa

SEQ ID NO: 592283 - DNA, 20 bp, Artificial Sequence
  chemically synthesized
tcaagaaatgggaaaattag

SEQ ID NO: 592284 - DNA, 20 bp, Artificial Sequence
  chemically synthesized
gatatatttcagcttattat

SEQ ID NO: 592285 - DNA, 20 bp, Artificial Sequence
  chemically synthesized
cctctaaccaagggatatat

SEQ ID NO: 592286 - DNA, 20 bp, Artificial Sequence
  chemically synthesized
acaattataatcagtaagaa

SEQ ID NO: 592287 - DNA, 20 bp, Artificial Sequence
  chemically synthesized
ttatatagaagcaatgttct

SEQ ID NO: 592288 - DNA, 20 bp, Artificial Sequence
  chemically synthesized
acattttattacaattttgc

SEQ ID NO: 592289 - DNA, 20 bp, Artificial Sequence
  chemically synthesized
cggtgctgccacgttgggga

SEQ ID NO: 592290 - DNA, 20 bp, Artificial Sequence
  chemically synthesized
atctcccggtgctgccacgt

SEQ ID NO: 592291 - DNA, 20 bp, Artificial Sequence
  chemically synthesized
atccccaacgtggcagcacc

SEQ ID NO: 592292 - DNA, 20 bp, Artificial Sequence
  chemically synthesized
cgggagattgtgcctttaag

SEQ ID NO: 592293 - DNA, 20 bp, Artificial Sequence
  chemically synthesized
atgagggctctgcccttatg

SEQ ID NO: 592294 - DNA, 20 bp, Artificial Sequence
  chemically synthesized
gttaatgggttatcatggga

SEQ ID NO: 592295 - DNA, 20 bp, Artificial Sequence
  chemically synthesized
ggttatcatgggagtaggat

SEQ ID NO: 592296 - DNA, 20 bp, Artificial Sequence
  chemically synthesized
ccaagatcagataagagtgg

SEQ ID NO: 592297 - DNA, 20 bp, Artificial Sequence
  chemically synthesized
actaaccaggtcgaacctca

SEQ ID NO: 592298 - DNA, 20 bp, Artificial Sequence
  chemically synthesized
atgggtaatttacaaagaaa

SEQ ID NO: 592299 - DNA, 20 bp, Artificial Sequence
  chemically synthesized
attcgtctaagtccatttgc

SEQ ID NO: 592300 - DNA, 20 bp, Artificial Sequence
  chemically synthesized
tagacgaattctttcacagt

SEQ ID NO: 592301 - DNA, 20 bp, Artificial Sequence
  chemically synthesized
agtgtgttgaataaataaca

SEQ ID NO: 592302 - DNA, 20 bp, Artificial Sequence
  chemically synthesized
ttcatcttttgtaatcaaaa

SEQ ID NO: 592303 - DNA, 20 bp, Artificial Sequence
  chemically synthesized
ggaaactaatacaaacttaa

SEQ ID NO: 592304 - DNA, 20 bp, Artificial Sequence
  chemically synthesized
gtaatcaaaattaagtttgt

SEQ ID NO: 592305 - DNA, 20 bp, Artificial Sequence
  chemically synthesized
atattgcccatttaaataaa

SEQ ID NO: 592306 - DNA, 20 bp, Artificial Sequence
  chemically synthesized
atatttatttaaatgggcaa

SEQ ID NO: 592307 - DNA, 20 bp, Artificial Sequence
  chemically synthesized
atcagaagatgggttcatca

SEQ ID NO: 592308 - DNA, 20 bp, Artificial Sequence
  chemically synthesized
gatcagctccattgccaatt

SEQ ID NO: 592309 - DNA, 20 bp, Artificial Sequence
  chemically synthesized
catgcattcattgaaattaa

SEQ ID NO: 592310 - DNA, 20 bp, Artificial Sequence
  chemically synthesized
taaattctcagtgataagtc

SEQ ID NO: 592311 - DNA, 20 bp, Artificial Sequence
  chemically synthesized
tcgatttctacaaggggata

SEQ ID NO: 592312 - DNA, 20 bp, Artificial Sequence
  chemically synthesized
tatatgttccctaagtttga

SEQ ID NO: 592313 - DNA, 20 bp, Artificial Sequence
  chemically synthesized
ttctctaaattatatgttcc

SEQ ID NO: 592314 - DNA, 20 bp, Artificial Sequence
  chemically synthesized
tgcagctccgttgggttaaa

SEQ ID NO: 592315 - DNA, 20 bp, Artificial Sequence
  chemically synthesized
agctgcatttaggttactcc

SEQ ID NO: 592316 - DNA, 20 bp, Artificial Sequence
  chemically synthesized
tatttggagacaatatcata

SEQ ID NO: 592317 - DNA, 20 bp, Artificial Sequence
  chemically synthesized
ctgtattatattcactggaa

SEQ ID NO: 592318 - DNA, 20 bp, Artificial Sequence
  chemically synthesized
attatagttctcatatctgc

SEQ ID NO: 592319 - DNA, 20 bp, Artificial Sequence
  chemically synthesized
agaactataatgttggaata

SEQ ID NO: 592320 - DNA, 20 bp, Artificial Sequence
  chemically synthesized
caagtgttattccaaccatt

SEQ ID NO: 592321 - DNA, 20 bp, Artificial Sequence
  chemically synthesized
ttatagagtcatcatgtgaa

SEQ ID NO: 592322 - DNA, 20 bp, Artificial Sequence
  chemically synthesized
aggagaggccatttatgcgc

SEQ ID NO: 592323 - DNA, 20 bp, Artificial Sequence
  chemically synthesized
agcttcaggagaggccattt

SEQ ID NO: 592324 - DNA, 20 bp, Artificial Sequence
  chemically synthesized
tcatcagaaggagtgtaaga

SEQ ID NO: 592325 - DNA, 20 bp, Artificial Sequence
  chemically synthesized
aatcgattgtttcgtggagc

SEQ ID NO: 592326 - DNA, 20 bp, Artificial Sequence
  chemically synthesized
aagccgaagctccacgaaac

SEQ ID NO: 592327 - DNA, 20 bp, Artificial Sequence
  chemically synthesized
tttaggaatcgattgtttcg

SEQ ID NO: 592328 - DNA, 20 bp, Artificial Sequence
  chemically synthesized
ttgttagacctttaggaatc

SEQ ID NO: 592329 - DNA, 20 bp, Artificial Sequence
  chemically synthesized
tcaattgttagacctttagg

SEQ ID NO: 592330 - DNA, 20 bp, Artificial Sequence
  chemically synthesized
actgaagtgcctgtaatgac

SEQ ID NO: 592331 - DNA, 20 bp, Artificial Sequence
  chemically synthesized
ctgtaatgactactgtttat

SEQ ID NO: 592332 - DNA, 20 bp, Artificial Sequence
  chemically synthesized
atgactactgtttataaatg

SEQ ID NO: 592333 - DNA, 20 bp, Artificial Sequence
  chemically synthesized
aataaggcacactattaata

SEQ ID NO: 592334 - DNA, 20 bp, Artificial Sequence
  chemically synthesized
aggcacactattaataaaca

SEQ ID NO: 592335 - DNA, 20 bp, Artificial Sequence
  chemically synthesized
gcatttgttctattaaagca

SEQ ID NO: 592336 - DNA, 20 bp, Artificial Sequence
  chemically synthesized
tttgctttaatagaacaaat

SEQ ID NO: 592337 - DNA, 20 bp, Artificial Sequence
  chemically synthesized
cagaccacgactcttcctga

SEQ ID NO: 592338 - DNA, 20 bp, Artificial Sequence
  chemically synthesized
cacgactcttcctgactcag

SEQ ID NO: 592339 - DNA, 20 bp, Artificial Sequence
  chemically synthesized
aaacaggtctctcaacttag

SEQ ID NO: 592340 - DNA, 20 bp, Artificial Sequence
  chemically synthesized
aaacactgctaagttgagag

SEQ ID NO: 592341 - DNA, 20 bp, Artificial Sequence
  chemically synthesized
cacatcattgatctggttgc

SEQ ID NO: 592342 - DNA, 20 bp, Artificial Sequence
  chemically synthesized
ctggggggaaaaaaggttat

SEQ ID NO: 592343 - DNA, 20 bp, Artificial Sequence
  chemically synthesized
atatcctttagaacaaaaga

SEQ ID NO: 592344 - DNA, 20 bp, Artificial Sequence
  chemically synthesized
tgcaacagaacactatgcct

SEQ ID NO: 592345 - DNA, 20 bp, Artificial Sequence
  chemically synthesized
tagtgttctgttgcagtatt

SEQ ID NO: 592346 - DNA, 20 bp, Artificial Sequence
  chemically synthesized
gcagcaaacccctcagagtt

SEQ ID NO: 592347 - DNA, 20 bp, Artificial Sequence
  chemically synthesized
ctcccaagccctgaactctg

SEQ ID NO: 592348 - DNA, 20 bp, Artificial Sequence
  chemically synthesized
ctgaggaggcagagacagag

SEQ ID NO: 592349 - DNA, 20 bp, Artificial Sequence
  chemically synthesized
aaaaaggaagaagaaatcaa

SEQ ID NO: 592350 - DNA, 20 bp, Artificial Sequence
  chemically synthesized
caaggagagaagataatcat

SEQ ID NO: 592351 - DNA, 20 bp, Artificial Sequence
  chemically synthesized
ctgcaactctgttaatttag

SEQ ID NO: 592352 - DNA, 20 bp, Artificial Sequence
  chemically synthesized
tcaacaaatattgcttatca

SEQ ID NO: 592353 - DNA, 20 bp, Artificial Sequence
  chemically synthesized
cagataaaatgctcaacaaa

SEQ ID NO: 592354 - DNA, 20 bp, Artificial Sequence
  chemically synthesized
ttatctgctctaattatgtc

SEQ ID NO: 592355 - DNA, 20 bp, Artificial Sequence
  chemically synthesized
gataaagaactatgaatagc

SEQ ID NO: 592356 - DNA, 20 bp, Artificial Sequence
  chemically synthesized
tgggtgggttgctttacctc

SEQ ID NO: 592357 - DNA, 20 bp, Artificial Sequence
  chemically synthesized
tatgtatatgatgttgggtg

SEQ ID NO: 592358 - DNA, 20 bp, Artificial Sequence
  chemically synthesized
caaatctggcctccagtcct

SEQ ID NO: 592359 - DNA, 20 bp, Artificial Sequence
  chemically synthesized
agaagctgccaggactggag

SEQ ID NO: 592360 - DNA, 20 bp, Artificial Sequence
  chemically synthesized
cctctaatgctaaatgtgca

SEQ ID NO: 592361 - DNA, 20 bp, Artificial Sequence
  chemically synthesized
atggttagatcactgtgcag

SEQ ID NO: 592362 - DNA, 20 bp, Artificial Sequence
  chemically synthesized
ataattcataacacaacaat

SEQ ID NO: 592363 - DNA, 20 bp, Artificial Sequence
  chemically synthesized
taaaatactttgaaacgtgt

SEQ ID NO: 592364 - DNA, 20 bp, Artificial Sequence
  chemically synthesized
gtgtggccatgaaaacattc

SEQ ID NO: 592365 - DNA, 20 bp, Artificial Sequence
  chemically synthesized
tttgaaaaattctacattaa

SEQ ID NO: 592366 - DNA, 20 bp, Artificial Sequence
  chemically synthesized
gagtcgcaaggctattaagt

SEQ ID NO: 592367 - DNA, 20 bp, Artificial Sequence
  chemically synthesized
gcaattatagaacaatttct

SEQ ID NO: 592368 - DNA, 20 bp, Artificial Sequence
  chemically synthesized
cagggagacaggagaggaaa

SEQ ID NO: 592369 - DNA, 20 bp, Artificial Sequence
  chemically synthesized
gtaaaaaacatccacacaaa

SEQ ID NO: 592370 - DNA, 20 bp, Artificial Sequence
  chemically synthesized
acacaaagcgtgttttgtgt

SEQ ID NO: 592371 - DNA, 20 bp, Artificial Sequence
  chemically synthesized
acatccacacaaaacacgct

SEQ ID NO: 592372 - DNA, 20 bp, Artificial Sequence
  chemically synthesized
atttaacatataaacacaaa

SEQ ID NO: 592373 - DNA, 20 bp, Artificial Sequence
  chemically synthesized
cgctttgtgtttatatgtta

SEQ ID NO: 592374 - DNA, 20 bp, Artificial Sequence
  chemically synthesized
taggggaaattaactataaa

SEQ ID NO: 592375 - DNA, 20 bp, Artificial Sequence
  chemically synthesized
cacattcaaatagaggaaaa

SEQ ID NO: 592376 - DNA, 20 bp, Artificial Sequence
  chemically synthesized
tgtgcaggggtatgaggaaa

SEQ ID NO: 592377 - DNA, 20 bp, Artificial Sequence
  chemically synthesized
gactcttcatgatgcgtaaa

SEQ ID NO: 592378 - DNA, 20 bp, Artificial Sequence
  chemically synthesized
ttacgcatcatgaagagtct

SEQ ID NO: 592379 - DNA, 20 bp, Artificial Sequence
  chemically synthesized
acaattcttacctgaggcat

SEQ ID NO: 592380 - DNA, 20 bp, Artificial Sequence
  chemically synthesized
actaatagctaccatttatt

SEQ ID NO: 592381 - DNA, 20 bp, Artificial Sequence
  chemically synthesized
tttatacagaattgctctta

SEQ ID NO: 592382 - DNA, 20 bp, Artificial Sequence
  chemically synthesized
gctcttacaaagcttatatt

SEQ ID NO: 592383 - DNA, 20 bp, Artificial Sequence
  chemically synthesized
tttctgtttaagctgttaat

SEQ ID NO: 592384 - DNA, 20 bp, Artificial Sequence
  chemically synthesized
taagctataaatgttacaat

SEQ ID NO: 592385 - DNA, 20 bp, Artificial Sequence
  chemically synthesized
taaacagaaattgtaacatt

SEQ ID NO: 592386 - DNA, 20 bp, Artificial Sequence
  chemically synthesized
aaatcatttaatgtatcaca

SEQ ID NO: 592387 - DNA, 20 bp, Artificial Sequence
  chemically synthesized
aaagctatgtgtgatacatt

SEQ ID NO: 592388 - DNA, 20 bp, Artificial Sequence
  chemically synthesized
cagttttccacattaattct

SEQ ID NO: 592389 - DNA, 20 bp, Artificial Sequence
  chemically synthesized
tgtaagaattaatgtggaaa

SEQ ID NO: 592390 - DNA, 20 bp, Artificial Sequence
  chemically synthesized
gtgaaataactcaaattaaa

SEQ ID NO: 592391 - DNA, 20 bp, Artificial Sequence
  chemically synthesized
ttgagttatttcacatacac

SEQ ID NO: 592392 - DNA, 20 bp, Artificial Sequence
  chemically synthesized
ttcttctaaaacaatcatat

SEQ ID NO: 592393 - DNA, 20 bp, Artificial Sequence
  chemically synthesized
tttgtttaaatcattaatat

SEQ ID NO: 592394 - DNA, 20 bp, Artificial Sequence
  chemically synthesized
cgtttttgtttaaatcatta

SEQ ID NO: 592395 - DNA, 20 bp, Artificial Sequence
  chemically synthesized
ttaatgatttaaacaaaaac

SEQ ID NO: 592396 - DNA, 20 bp, Artificial Sequence
  chemically synthesized
aatgcatattaaactcacgt

SEQ ID NO: 592397 - DNA, 20 bp, Artificial Sequence
  chemically synthesized
aataataatgcatattaaac

SEQ ID NO: 592398 - DNA, 20 bp, Artificial Sequence
  chemically synthesized
agtttaatatgcattattat

SEQ ID NO: 592399 - DNA, 20 bp, Artificial Sequence
  chemically synthesized
cagttaaatttgaagagatc

SEQ ID NO: 592400 - DNA, 20 bp, Artificial Sequence
  chemically synthesized
tttatagccatgaaaaggaa

SEQ ID NO: 592401 - DNA, 20 bp, Artificial Sequence
  chemically synthesized
acacgatccttttattatat

SEQ ID NO: 592402 - DNA, 20 bp, Artificial Sequence
  chemically synthesized
ttccacaaaaatactattca

SEQ ID NO: 592403 - DNA, 20 bp, Artificial Sequence
  chemically synthesized
gtggaagtagctagactcta

SEQ ID NO: 592404 - DNA, 20 bp, Artificial Sequence
  chemically synthesized
atacaaattattcattatgg

SEQ ID NO: 592405 - DNA, 20 bp, Artificial Sequence
  chemically synthesized
aagtgaaagttctgcggcaa

SEQ ID NO: 592406 - DNA, 20 bp, Artificial Sequence
  chemically synthesized
ccgaaataatgttaataatt

SEQ ID NO: 592407 - DNA, 20 bp, Artificial Sequence
  chemically synthesized
ttttttcctgcaaatttcag

SEQ ID NO: 592408 - DNA, 20 bp, Artificial Sequence
  chemically synthesized
caattttactttaaagtgtt

SEQ ID NO: 592409 - DNA, 20 bp, Artificial Sequence
  chemically synthesized
gaaaacacaattttacttta

SEQ ID NO: 592410 - DNA, 20 bp, Artificial Sequence
  chemically synthesized
tcaaacactttaaagtaaaa

SEQ ID NO: 592411 - DNA, 20 bp, Artificial Sequence
  chemically synthesized
agatctattagacagcataa

SEQ ID NO: 592412 - DNA, 20 bp, Artificial Sequence
  chemically synthesized
taatagatctaaccaagaat

SEQ ID NO: 592413 - DNA, 20 bp, Artificial Sequence
  chemically synthesized
taaccaagaatttctgattc

SEQ ID NO: 592414 - DNA, 20 bp, Artificial Sequence
  chemically synthesized
tttaaaatgaagccatttaa

SEQ ID NO: 592415 - DNA, 20 bp, Artificial Sequence
  chemically synthesized
tacactaaaaatcattttta

SEQ ID NO: 592416 - DNA, 20 bp, Artificial Sequence
  chemically synthesized
tgagggaaataatttaactt

SEQ ID NO: 592417 - DNA, 20 bp, Artificial Sequence
  chemically synthesized
ggttattaaaatagacttga

SEQ ID NO: 592418 - DNA, 20 bp, Artificial Sequence
  chemically synthesized
tttcaatatgaaacactagg

SEQ ID NO: 592419 - DNA, 20 bp, Artificial Sequence
  chemically synthesized
gaagcacagaaagctcatcc

SEQ ID NO: 592420 - DNA, 20 bp, Artificial Sequence
  chemically synthesized
gaaacactaggatgagcttt

SEQ ID NO: 592421 - DNA, 20 bp, Artificial Sequence
  chemically synthesized
ctaggatgagctttctgtgc

SEQ ID NO: 592422 - DNA, 20 bp, Artificial Sequence
  chemically synthesized
aggggaccataagaatccac

SEQ ID NO: 592423 - DNA, 20 bp, Artificial Sequence
  chemically synthesized
tcatagactacagaagctga

SEQ ID NO: 592424 - DNA, 20 bp, Artificial Sequence
  chemically synthesized
atttgtatcaggatctcgaa

SEQ ID NO: 592425 - DNA, 20 bp, Artificial Sequence
  chemically synthesized
acagatatgtagagaaatga

SEQ ID NO: 592426 - DNA, 20 bp, Artificial Sequence
  chemically synthesized
caccatacttaataaaatta

SEQ ID NO: 592427 - DNA, 20 bp, Artificial Sequence
  chemically synthesized
tcatggtaattgtacctgcc

SEQ ID NO: 592428 - DNA, 20 bp, Artificial Sequence
  chemically synthesized
aattaccatgaggcagaggg

SEQ ID NO: 592429 - DNA, 20 bp, Artificial Sequence
  chemically synthesized
gtttcttaggacccaggcaa

SEQ ID NO: 592430 - DNA, 20 bp, Artificial Sequence
  chemically synthesized
tttggcacaaaggaaaataa

SEQ ID NO: 592431 - DNA, 20 bp, Artificial Sequence
  chemically synthesized
aacttggtgtaaaagtacat

SEQ ID NO: 592432 - DNA, 20 bp, Artificial Sequence
  chemically synthesized
tgtacttttacaccaagtta

SEQ ID NO: 592433 - DNA, 20 bp, Artificial Sequence
  chemically synthesized
tgctttctcaaggatcattg

SEQ ID NO: 592434 - DNA, 20 bp, Artificial Sequence
  chemically synthesized
atattagatcccattgactt

SEQ ID NO: 592435 - DNA, 20 bp, Artificial Sequence
  chemically synthesized
aatgcatttgatgaggcagt

SEQ ID NO: 592436 - DNA, 20 bp, Artificial Sequence
  chemically synthesized
ttcctcagtatgtgggagtg

SEQ ID NO: 592437 - DNA, 20 bp, Artificial Sequence
  chemically synthesized
aactaaaaataatttgttca

SEQ ID NO: 592438 - DNA, 20 bp, Artificial Sequence
  chemically synthesized
aatggctatgagttgatcat

SEQ ID NO: 592439 - DNA, 20 bp, Artificial Sequence
  chemically synthesized
ttaggaaaaagagccaggat

SEQ ID NO: 592440 - DNA, 20 bp, Artificial Sequence
  chemically synthesized
tatacatattctcttattcc

SEQ ID NO: 592441 - DNA, 20 bp, Artificial Sequence
  chemically synthesized
gtgtgtgtgtgtgtctctgt

SEQ ID NO: 592442 - DNA, 20 bp, Artificial Sequence
  chemically synthesized
tcagctctctcgggtctcca

SEQ ID NO: 592443 - DNA, 20 bp, Artificial Sequence
  chemically synthesized
actatcagctctctcgggtc

SEQ ID NO: 592444 - DNA, 20 bp, Artificial Sequence
  chemically synthesized
tgtatctcaagtctgctcta

SEQ ID NO: 592445 - DNA, 20 bp, Artificial Sequence
  chemically synthesized
aggcaggaaaaagcccatgt

SEQ ID NO: 592446 - DNA, 20 bp, Artificial Sequence
  chemically synthesized
gactgccttcaaactgggac

SEQ ID NO: 592447 - DNA, 20 bp, Artificial Sequence
  chemically synthesized
agtttgaaggcagtcgggca

SEQ ID NO: 592448 - DNA, 20 bp, Artificial Sequence
  chemically synthesized
ccttttgctcaggggagggt

SEQ ID NO: 592449 - DNA, 20 bp, Artificial Sequence
  chemically synthesized
taaattggtagactgagtaa

SEQ ID NO: 592450 - DNA, 20 bp, Artificial Sequence
  chemically synthesized
ttctgtgcaagtgttatcag

SEQ ID NO: 592451 - DNA, 20 bp, Artificial Sequence
  chemically synthesized
ttgcacagaatcacccagaa

SEQ ID NO: 592452 - DNA, 20 bp, Artificial Sequence
  chemically synthesized
atttggtcaaacattattct

SEQ ID NO: 592453 - DNA, 20 bp, Artificial Sequence
  chemically synthesized
caattccagaaacatattga

SEQ ID NO: 592454 - DNA, 20 bp, Artificial Sequence
  chemically synthesized
tggggcatcaaacccagtca

SEQ ID NO: 592455 - DNA, 20 bp, Artificial Sequence
  chemically synthesized
tcagtacacaaaatgttttt

SEQ ID NO: 592456 - DNA, 20 bp, Artificial Sequence
  chemically synthesized
ctaaatcatttcagtacaca

SEQ ID NO: 592457 - DNA, 20 bp, Artificial Sequence
  chemically synthesized
aaaaaacattttgtgtactg

SEQ ID NO: 592458 - DNA, 20 bp, Artificial Sequence
  chemically synthesized
caccccgtgagttactattt

SEQ ID NO: 592459 - DNA, 20 bp, Artificial Sequence
  chemically synthesized
gaacaaaaagttggctgtca

SEQ ID NO: 592460 - DNA, 20 bp, Artificial Sequence
  chemically synthesized
atgacagccaactttttgtt

SEQ ID NO: 592461 - DNA, 20 bp, Artificial Sequence
  chemically synthesized
agccaactttttgttctttg

SEQ ID NO: 592462 - DNA, 20 bp, Artificial Sequence
  chemically synthesized
ctttttgttctttgttttgt

SEQ ID NO: 592463 - DNA, 20 bp, Artificial Sequence
  chemically synthesized
tttgttttgttttagattct

SEQ ID NO: 592464 - DNA, 20 bp, Artificial Sequence
  chemically synthesized
cttaccttgttgaacatgta

SEQ ID NO: 592465 - DNA, 20 bp, Artificial Sequence
  chemically synthesized
caacttacatgttcaacaag

SEQ ID NO: 592466 - DNA, 20 bp, Artificial Sequence
  chemically synthesized
atagtattttgttgtatttg

SEQ ID NO: 592467 - DNA, 20 bp, Artificial Sequence
  chemically synthesized
caaagaagaatctcatgcta

SEQ ID NO: 592468 - DNA, 20 bp, Artificial Sequence
  chemically synthesized
gtaagagaaatctctgtagc

SEQ ID NO: 592469 - DNA, 20 bp, Artificial Sequence
  chemically synthesized
aattctcatggatagaatgc

SEQ ID NO: 592470 - DNA, 20 bp, Artificial Sequence
  chemically synthesized
aacaatcctgtttctataaa

SEQ ID NO: 592471 - DNA, 20 bp, Artificial Sequence
  chemically synthesized
aggaaacagtatttatagaa

SEQ ID NO: 592472 - DNA, 20 bp, Artificial Sequence
  chemically synthesized
ggcaatttaacgagtaacaa

SEQ ID NO: 592473 - DNA, 20 bp, Artificial Sequence
  chemically synthesized
aaattagaacaagaacaaac

SEQ ID NO: 592474 - DNA, 20 bp, Artificial Sequence
  chemically synthesized
ggcacttttctcttttaagc

SEQ ID NO: 592475 - DNA, 20 bp, Artificial Sequence
  chemically synthesized
gaaaagataccacctttgaa

SEQ ID NO: 592476 - DNA, 20 bp, Artificial Sequence
  chemically synthesized
ggtggtatcttttctctgct

SEQ ID NO: 592477 - DNA, 20 bp, Artificial Sequence
  chemically synthesized
ttttaagtgtagctataggt

SEQ ID NO: 592478 - DNA, 20 bp, Artificial Sequence
  chemically synthesized
taagagaagaggttggggta

SEQ ID NO: 592479 - DNA, 20 bp, Artificial Sequence
  chemically synthesized
cctcttctcttaatggataa

SEQ ID NO: 592480 - DNA, 20 bp, Artificial Sequence
  chemically synthesized
taatggataattatgtttaa

SEQ ID NO: 592481 - DNA, 20 bp, Artificial Sequence
  chemically synthesized
agatggttttttaaataacg

SEQ ID NO: 592482 - DNA, 20 bp, Artificial Sequence
  chemically synthesized
taagatactgctcttttata

SEQ ID NO: 592483 - DNA, 20 bp, Artificial Sequence
  chemically synthesized
ttgccttttcataaacatac

SEQ ID NO: 592484 - DNA, 20 bp, Artificial Sequence
  chemically synthesized
aatatgaattttaaacattc

SEQ ID NO: 592485 - DNA, 20 bp, Artificial Sequence
  chemically synthesized
caggaaaaaagactattagg

SEQ ID NO: 592486 - DNA, 20 bp, Artificial Sequence
  chemically synthesized
aaatgtatcaaaatgttaaa

SEQ ID NO: 592487 - DNA, 20 bp, Artificial Sequence
  chemically synthesized
tttcagaatatgcaaataat

SEQ ID NO: 592488 - DNA, 20 bp, Artificial Sequence
  chemically synthesized
gttagctaaaatttcatgtt

SEQ ID NO: 592489 - DNA, 20 bp, Artificial Sequence
  chemically synthesized
ttcatgttatttgattcaga

SEQ ID NO: 592490 - DNA, 20 bp, Artificial Sequence
  chemically synthesized
ttcagactgtgtttcttctg

SEQ ID NO: 592491 - DNA, 20 bp, Artificial Sequence
  chemically synthesized
gtagctgttgattcttctca

SEQ ID NO: 592492 - DNA, 20 bp, Artificial Sequence
  chemically synthesized
aaaaaaaattgtattgtagc

SEQ ID NO: 592493 - DNA, 20 bp, Artificial Sequence
  chemically synthesized
atagacaaggggctctgata

SEQ ID NO: 592494 - DNA, 20 bp, Artificial Sequence
  chemically synthesized
tttcctgcagcatgttcgat

SEQ ID NO: 592495 - DNA, 20 bp, Artificial Sequence
  chemically synthesized
caggtctctgttggatatcc

SEQ ID NO: 592496 - DNA, 20 bp, Artificial Sequence
  chemically synthesized
gtgatttggtaatttccgca

SEQ ID NO: 592497 - DNA, 20 bp, Artificial Sequence
  chemically synthesized
tcttttccagctctaatatt

SEQ ID NO: 592498 - DNA, 20 bp, Artificial Sequence
  chemically synthesized
acacacaccacgcactccag

SEQ ID NO: 592499 - DNA, 20 bp, Artificial Sequence
  chemically synthesized
gtgcgtggtgtgtgtaatca

SEQ ID NO: 592500 - DNA, 20 bp, Artificial Sequence
  chemically synthesized
ttggcatttaacacaaaact

SEQ ID NO: 592501 - DNA, 20 bp, Artificial Sequence
  chemically synthesized
agaaaaattacaccgctctt

SEQ ID NO: 592502 - DNA, 20 bp, Artificial Sequence
  chemically synthesized
tcctgccctctgcataatta

SEQ ID NO: 592503 - DNA, 20 bp, Artificial Sequence
  chemically synthesized
aaatattttaagaaatgttt

SEQ ID NO: 592504 - DNA, 20 bp, Artificial Sequence
  chemically synthesized
gataaaaaaaatattttaag

SEQ ID NO: 592505 - DNA, 20 bp, Artificial Sequence
  chemically synthesized
tgatgttggtgttatttgac

SEQ ID NO: 592506 - DNA, 20 bp, Artificial Sequence
  chemically synthesized
ttacctcatggatgtgaatg

SEQ ID NO: 592507 - DNA, 20 bp, Artificial Sequence
  chemically synthesized
gaaaaataatgactggttaa

SEQ ID NO: 592508 - DNA, 20 bp, Artificial Sequence
  chemically synthesized
ggctatgacttttataatag

SEQ ID NO: 592509 - DNA, 20 bp, Artificial Sequence
  chemically synthesized
tgacttttataatagtacag

SEQ ID NO: 592510 - DNA, 20 bp, Artificial Sequence
  chemically synthesized
tctatgcatcctcctatatt

SEQ ID NO: 592511 - DNA, 20 bp, Artificial Sequence
  chemically synthesized
ttcagcgttatacattttca

SEQ ID NO: 592512 - DNA, 20 bp, Artificial Sequence
  chemically synthesized
gccagtcaaatttcatttgt

SEQ ID NO: 592513 - DNA, 20 bp, Artificial Sequence
  chemically synthesized
gtcaaatttcatttgttctt

SEQ ID NO: 592514 - DNA, 20 bp, Artificial Sequence
  chemically synthesized
tttgttcttgtttgattggc

SEQ ID NO: 592515 - DNA, 20 bp, Artificial Sequence
  chemically synthesized
tggggagacaacctacacac

SEQ ID NO: 592516 - DNA, 20 bp, Artificial Sequence
  chemically synthesized
cacgaaggttttgccacttt

SEQ ID NO: 592517 - DNA, 20 bp, Artificial Sequence
  chemically synthesized
acgttgcagagtaaaatctt

SEQ ID NO: 592518 - DNA, 20 bp, Artificial Sequence
  chemically synthesized
acttctataggataaatcga

SEQ ID NO: 592519 - DNA, 20 bp, Artificial Sequence
  chemically synthesized
tcttcctcgatttatcctat

SEQ ID NO: 592520 - DNA, 20 bp, Artificial Sequence
  chemically synthesized
caacttgccacactttgagt

SEQ ID NO: 592521 - DNA, 20 bp, Artificial Sequence
  chemically synthesized
tagctccaacttgccacact

SEQ ID NO: 592522 - DNA, 20 bp, Artificial Sequence
  chemically synthesized
taaggctgatcctggaatca

SEQ ID NO: 592523 - DNA, 20 bp, Artificial Sequence
  chemically synthesized
ctttttttactgtggaaact

SEQ ID NO: 592524 - DNA, 20 bp, Artificial Sequence
  chemically synthesized
aaaaaagaatgagaatgaga

SEQ ID NO: 592525 - DNA, 20 bp, Artificial Sequence
  chemically synthesized
ccccacttaaatccaataga

SEQ ID NO: 592526 - DNA, 20 bp, Artificial Sequence
  chemically synthesized
acagagtgaaaactacctct

SEQ ID NO: 592527 - DNA, 20 bp, Artificial Sequence
  chemically synthesized
gaagtcatataaacaagtta

SEQ ID NO: 592528 - DNA, 20 bp, Artificial Sequence
  chemically synthesized
ttaaatgctaaaaccaaata

SEQ ID NO: 592529 - DNA, 20 bp, Artificial Sequence
  chemically synthesized
gaagagaacaatatgggtag

SEQ ID NO: 592530 - DNA, 20 bp, Artificial Sequence
  chemically synthesized
tataggatgaggagctggct

SEQ ID NO: 592531 - DNA, 20 bp, Artificial Sequence
  chemically synthesized
tcggaattttgcttgcagca

SEQ ID NO: 592532 - DNA, 20 bp, Artificial Sequence
  chemically synthesized
ttcttgtgactacatcggaa

SEQ ID NO: 592533 - DNA, 20 bp, Artificial Sequence
  chemically synthesized
ttctatttccttttgaaaaa

SEQ ID NO: 592534 - DNA, 20 bp, Artificial Sequence
  chemically synthesized
cttgggtaaatctggtggta

SEQ ID NO: 592535 - DNA, 20 bp, Artificial Sequence
  chemically synthesized
taggtggtaaactttctacc

SEQ ID NO: 592536 - DNA, 20 bp, Artificial Sequence
  chemically synthesized
agtccagacatttatttggt

SEQ ID NO: 592537 - DNA, 20 bp, Artificial Sequence
  chemically synthesized
aataaatgtctggactgtga

SEQ ID NO: 592538 - DNA, 20 bp, Artificial Sequence
  chemically synthesized
ggactgtgaaacagtttatc

SEQ ID NO: 592539 - DNA, 20 bp, Artificial Sequence
  chemically synthesized
tcttatgtaaacaatggata

SEQ ID NO: 592540 - DNA, 20 bp, Artificial Sequence
  chemically synthesized
attgtttacataagaaataa

SEQ ID NO: 592541 - DNA, 20 bp, Artificial Sequence
  chemically synthesized
tggacctttaaaatatattt

SEQ ID NO: 592542 - DNA, 20 bp, Artificial Sequence
  chemically synthesized
gtgaaaatggaaccttattg

SEQ ID NO: 592543 - DNA, 20 bp, Artificial Sequence
  chemically synthesized
atacagagggatggaaaaaa

SEQ ID NO: 592544 - DNA, 20 bp, Artificial Sequence
  chemically synthesized
agaaacgaaaagaatggaac

SEQ ID NO: 592545 - DNA, 20 bp, Artificial Sequence
  chemically synthesized
agaaacacacgttccattct

SEQ ID NO: 592546 - DNA, 20 bp, Artificial Sequence
  chemically synthesized
ttccattcttttcgtttctc

SEQ ID NO: 592547 - DNA, 20 bp, Artificial Sequence
  chemically synthesized
cttctcccaaagagaaatag

SEQ ID NO: 592548 - DNA, 20 bp, Artificial Sequence
  chemically synthesized
agggatagcgcttataaaaa

SEQ ID NO: 592549 - DNA, 20 bp, Artificial Sequence
  chemically synthesized
tactcaacttcaagaaggga

SEQ ID NO: 592550 - DNA, 20 bp, Artificial Sequence
  chemically synthesized
gagataagccatgtcattct

SEQ ID NO: 592551 - DNA, 20 bp, Artificial Sequence
  chemically synthesized
attataaaccaaaagaatga

SEQ ID NO: 592552 - DNA, 20 bp, Artificial Sequence
  chemically synthesized
tgatagctgcatagactaac

SEQ ID NO: 592553 - DNA, 20 bp, Artificial Sequence
  chemically synthesized
tatagatacagataactgaa

SEQ ID NO: 592554 - DNA, 20 bp, Artificial Sequence
  chemically synthesized
agaatatagatacagataac

SEQ ID NO: 592555 - DNA, 20 bp, Artificial Sequence
  chemically synthesized
tatattctccttaggataag

SEQ ID NO: 592556 - DNA, 20 bp, Artificial Sequence
  chemically synthesized
aagctctaaatttagacaat

SEQ ID NO: 592557 - DNA, 20 bp, Artificial Sequence
  chemically synthesized
aagcctagattgtctaaatt

SEQ ID NO: 592558 - DNA, 20 bp, Artificial Sequence
  chemically synthesized
ttccatacctcacacaatcc

SEQ ID NO: 592559 - DNA, 20 bp, Artificial Sequence
  chemically synthesized
ggtcagagctgatggaatca

SEQ ID NO: 592560 - DNA, 20 bp, Artificial Sequence
  chemically synthesized
ctgaccgaatcataataaac

SEQ ID NO: 592561 - DNA, 20 bp, Artificial Sequence
  chemically synthesized
tcataataaactgttgttta

SEQ ID NO: 592562 - DNA, 20 bp, Artificial Sequence
  chemically synthesized
cttgaagcatcataataaac

SEQ ID NO: 592563 - DNA, 20 bp, Artificial Sequence
  chemically synthesized
taataaacaacagtttatta

SEQ ID NO: 592564 - DNA, 20 bp, Artificial Sequence
  chemically synthesized
tcaagtcccatctctgcagc

SEQ ID NO: 592565 - DNA, 20 bp, Artificial Sequence
  chemically synthesized
tctgcagcaagtgcttctcc

SEQ ID NO: 592566 - DNA, 20 bp, Artificial Sequence
  chemically synthesized
gactggggtttcagatttta

SEQ ID NO: 592567 - DNA, 20 bp, Artificial Sequence
  chemically synthesized
tttaaaatctgaaaccccag

SEQ ID NO: 592568 - DNA, 20 bp, Artificial Sequence
  chemically synthesized
ggcaaaaacgggactggggt

SEQ ID NO: 592569 - DNA, 20 bp, Artificial Sequence
  chemically synthesized
tcaatgggcaaaaacgggac

SEQ ID NO: 592570 - DNA, 20 bp, Artificial Sequence
  chemically synthesized
ttttgcccattgagcagagg

SEQ ID NO: 592571 - DNA, 20 bp, Artificial Sequence
  chemically synthesized
aggatttattatacagagga

SEQ ID NO: 592572 - DNA, 20 bp, Artificial Sequence
  chemically synthesized
atgcccttgaggtatctgaa

SEQ ID NO: 592573 - DNA, 20 bp, Artificial Sequence
  chemically synthesized
ctcaagggcatgaataatat

SEQ ID NO: 592574 - DNA, 20 bp, Artificial Sequence
  chemically synthesized
catgaataatatatttgatt

SEQ ID NO: 592575 - DNA, 20 bp, Artificial Sequence
  chemically synthesized
attggcatagaatgcattta

SEQ ID NO: 592576 - DNA, 20 bp, Artificial Sequence
  chemically synthesized
aaagatgacaaagaaatgtt

SEQ ID NO: 592577 - DNA, 20 bp, Artificial Sequence
  chemically synthesized
ctaggtaatttgatgcacac

SEQ ID NO: 592578 - DNA, 20 bp, Artificial Sequence
  chemically synthesized
ggctgctcatctccactctc

SEQ ID NO: 592579 - DNA, 20 bp, Artificial Sequence
  chemically synthesized
atcctcaggcctcatctcag

SEQ ID NO: 592580 - DNA, 20 bp, Artificial Sequence
  chemically synthesized
atgttgctggtccagcgaaa

SEQ ID NO: 592581 - DNA, 20 bp, Artificial Sequence
  chemically synthesized
agcagcgggaaggtcatatg

SEQ ID NO: 592582 - DNA, 20 bp, Artificial Sequence
  chemically synthesized
caacatggcacttggagacg

SEQ ID NO: 592583 - DNA, 20 bp, Artificial Sequence
  chemically synthesized
ttggagacgaatagattata

SEQ ID NO: 592584 - DNA, 20 bp, Artificial Sequence
  chemically synthesized
tatttacaaatttctgatga

SEQ ID NO: 592585 - DNA, 20 bp, Artificial Sequence
  chemically synthesized
acggagggatgtgatcacac

SEQ ID NO: 592586 - DNA, 20 bp, Artificial Sequence
  chemically synthesized
ggatgtgatcacacctgggc

SEQ ID NO: 592587 - DNA, 20 bp, Artificial Sequence
  chemically synthesized
tgtagacatatcctctgccc

SEQ ID NO: 592588 - DNA, 20 bp, Artificial Sequence
  chemically synthesized
ggcagaggatatgtctacac

SEQ ID NO: 592589 - DNA, 20 bp, Artificial Sequence
  chemically synthesized
ctgatatttagaccacaaag

SEQ ID NO: 592590 - DNA, 20 bp, Artificial Sequence
  chemically synthesized
atttagaccacaaagatgag

SEQ ID NO: 592591 - DNA, 20 bp, Artificial Sequence
  chemically synthesized
tcaacactgagggctaggta

SEQ ID NO: 592592 - DNA, 20 bp, Artificial Sequence
  chemically synthesized
gcttcatatttatggtctgt

SEQ ID NO: 592593 - DNA, 20 bp, Artificial Sequence
  chemically synthesized
gagaggaggtggactggagg

SEQ ID NO: 592594 - DNA, 20 bp, Artificial Sequence
  chemically synthesized
gatgttgatgctatttaata

SEQ ID NO: 592595 - DNA, 20 bp, Artificial Sequence
  chemically synthesized
tagcatcaacatctgaattc

SEQ ID NO: 592596 - DNA, 20 bp, Artificial Sequence
  chemically synthesized
acatctgaattcatgtgttt

SEQ ID NO: 592597 - DNA, 20 bp, Artificial Sequence
  chemically synthesized
ctgataagtaaaattacaac

SEQ ID NO: 592598 - DNA, 20 bp, Artificial Sequence
  chemically synthesized
actttaatttacttaactaa

SEQ ID NO: 592599 - DNA, 20 bp, Artificial Sequence
  chemically synthesized
caatattgagatagttgagc

SEQ ID NO: 592600 - DNA, 20 bp, Artificial Sequence
  chemically synthesized
agagctcaactatctcaata

SEQ ID NO: 592601 - DNA, 20 bp, Artificial Sequence
  chemically synthesized
aaatagttacatttatttat

SEQ ID NO: 592602 - DNA, 20 bp, Artificial Sequence
  chemically synthesized
attgacaacaatatgaatag

SEQ ID NO: 592603 - DNA, 20 bp, Artificial Sequence
  chemically synthesized
caccatcacctatgagacgt

SEQ ID NO: 592604 - DNA, 20 bp, Artificial Sequence
  chemically synthesized
tagtcaccctactggatgca

SEQ ID NO: 592605 - DNA, 20 bp, Artificial Sequence
  chemically synthesized
atagctattttgaaatacaa

SEQ ID NO: 592606 - DNA, 20 bp, Artificial Sequence
  chemically synthesized
tcccaacacaaagcaatggt

SEQ ID NO: 592607 - DNA, 20 bp, Artificial Sequence
  chemically synthesized
ccgtcacctcaaacatttac

SEQ ID NO: 592608 - DNA, 20 bp, Artificial Sequence
  chemically synthesized
tcgaggccctgaaaagtcac

SEQ ID NO: 592609 - DNA, 20 bp, Artificial Sequence
  chemically synthesized
acacaggtgacttttcaggg

SEQ ID NO: 592610 - DNA, 20 bp, Artificial Sequence
  chemically synthesized
ctgtgttagagctgaactct

SEQ ID NO: 592611 - DNA, 20 bp, Artificial Sequence
  chemically synthesized
tttgtgtatatcctttcctt

SEQ ID NO: 592612 - DNA, 20 bp, Artificial Sequence
  chemically synthesized
tcgatttcacaagcaactcc

SEQ ID NO: 592613 - DNA, 20 bp, Artificial Sequence
  chemically synthesized
aaattcctagaatcgtcagg

SEQ ID NO: 592614 - DNA, 20 bp, Artificial Sequence
  chemically synthesized
tttaatttcctgatcatagt

SEQ ID NO: 592615 - DNA, 20 bp, Artificial Sequence
  chemically synthesized
taggaatgagggcatgaggt

SEQ ID NO: 592616 - DNA, 20 bp, Artificial Sequence
  chemically synthesized
ttcagtattctattgtttta

SEQ ID NO: 592617 - DNA, 20 bp, Artificial Sequence
  chemically synthesized
agtaatttaattcagtattc

SEQ ID NO: 592618 - DNA, 20 bp, Artificial Sequence
  chemically synthesized
aaattactacgataatttat

SEQ ID NO: 592619 - DNA, 20 bp, Artificial Sequence
  chemically synthesized
tatcattgtttctaatattt

SEQ ID NO: 592620 - DNA, 20 bp, Artificial Sequence
  chemically synthesized
ggttattgaatagactactt

SEQ ID NO: 592621 - DNA, 20 bp, Artificial Sequence
  chemically synthesized
taaagaaaaatattgtgtga

SEQ ID NO: 592622 - DNA, 20 bp, Artificial Sequence
  chemically synthesized
tatttttctttagctaagaa

SEQ ID NO: 592623 - DNA, 20 bp, Artificial Sequence
  chemically synthesized
atgttgtagctggaagttaa

SEQ ID NO: 592624 - DNA, 20 bp, Artificial Sequence
  chemically synthesized
ttctcacagaataagaatta

SEQ ID NO: 592625 - DNA, 20 bp, Artificial Sequence
  chemically synthesized
ttacattgtttgtatttatc

SEQ ID NO: 592626 - DNA, 20 bp, Artificial Sequence
  chemically synthesized
ccccaaggttgaacaattaa

SEQ ID NO: 592627 - DNA, 20 bp, Artificial Sequence
  chemically synthesized
ttggggaccacataatctac

SEQ ID NO: 592628 - DNA, 20 bp, Artificial Sequence
  chemically synthesized
aaaaacccatagaaatctga

SEQ ID NO: 592629 - DNA, 20 bp, Artificial Sequence
  chemically synthesized
ataatctacatcagatttct

SEQ ID NO: 592630 - DNA, 20 bp, Artificial Sequence
  chemically synthesized
tgggtttttcatgtctctgg

SEQ ID NO: 592631 - DNA, 20 bp, Artificial Sequence
  chemically synthesized
aatgagtaaaagtatatatt

SEQ ID NO: 592632 - DNA, 20 bp, Artificial Sequence
  chemically synthesized
tatgatcgcctgttcctcca

SEQ ID NO: 592633 - DNA, 20 bp, Artificial Sequence
  chemically synthesized
tggaaatattaagaagtctc

SEQ ID NO: 592634 - DNA, 20 bp, Artificial Sequence
  chemically synthesized
agaacatcagaagtgtggac

SEQ ID NO: 592635 - DNA, 20 bp, Artificial Sequence
  chemically synthesized
gatgttctccctctataatg

SEQ ID NO: 592636 - DNA, 20 bp, Artificial Sequence
  chemically synthesized
gctcatctgggaggctgagt

SEQ ID NO: 592637 - DNA, 20 bp, Artificial Sequence
  chemically synthesized
cccagcttcacggagaaggt

SEQ ID NO: 592638 - DNA, 20 bp, Artificial Sequence
  chemically synthesized
ttctccaacagagcgtaaga

SEQ ID NO: 592639 - DNA, 20 bp, Artificial Sequence
  chemically synthesized
ctctgttggagaagagacta

SEQ ID NO: 592640 - DNA, 20 bp, Artificial Sequence
  chemically synthesized
agagactactctgattcctt

SEQ ID NO: 592641 - DNA, 20 bp, Artificial Sequence
  chemically synthesized
gtacctatcttgggatacta

SEQ ID NO: 592642 - DNA, 20 bp, Artificial Sequence
  chemically synthesized
ccattgctaaatagtaacag

SEQ ID NO: 592643 - DNA, 20 bp, Artificial Sequence
  chemically synthesized
ggaggtgaggatatacagac

SEQ ID NO: 592644 - DNA, 20 bp, Artificial Sequence
  chemically synthesized
ctacattttaacctaccaca

SEQ ID NO: 592645 - DNA, 20 bp, Artificial Sequence
  chemically synthesized
accacaaatagttttttgat

SEQ ID NO: 592646 - DNA, 20 bp, Artificial Sequence
  chemically synthesized
aaacacaaaagaatagacca

SEQ ID NO: 592647 - DNA, 20 bp, Artificial Sequence
  chemically synthesized
aaacccaatggtctattctt

SEQ ID NO: 592648 - DNA, 20 bp, Artificial Sequence
  chemically synthesized
attgtattttcaacatttga

SEQ ID NO: 592649 - DNA, 20 bp, Artificial Sequence
  chemically synthesized
ttttcaacatttgacactgt

SEQ ID NO: 592650 - DNA, 20 bp, Artificial Sequence
  chemically synthesized
gactttcttcatcccacttg

SEQ ID NO: 592651 - DNA, 20 bp, Artificial Sequence
  chemically synthesized
ttttctctataaatcacaga

SEQ ID NO: 592652 - DNA, 20 bp, Artificial Sequence
  chemically synthesized
aaaggagacaaaagcaactt

SEQ ID NO: 592653 - DNA, 20 bp, Artificial Sequence
  chemically synthesized
ttgagtattttttttcttcc

SEQ ID NO: 592654 - DNA, 20 bp, Artificial Sequence
  chemically synthesized
tggatgaagtcttctaggag

SEQ ID NO: 592655 - DNA, 20 bp, Artificial Sequence
  chemically synthesized
gtggcagtcataggccctta

SEQ ID NO: 592656 - DNA, 20 bp, Artificial Sequence
  chemically synthesized
ctacaggcatgtgccaccac

SEQ ID NO: 592657 - DNA, 20 bp, Artificial Sequence
  chemically synthesized
tatcctggcctcccaaagtg

SEQ ID NO: 592658 - DNA, 20 bp, Artificial Sequence
  chemically synthesized
ttccagtcacagtatctgtc

SEQ ID NO: 592659 - DNA, 20 bp, Artificial Sequence
  chemically synthesized
actctgataataagagagac

SEQ ID NO: 592660 - DNA, 20 bp, Artificial Sequence
  chemically synthesized
aattcatcacagcaaatcct

SEQ ID NO: 592661 - DNA, 20 bp, Artificial Sequence
  chemically synthesized
acattttaaagacaaagctg

SEQ ID NO: 592662 - DNA, 20 bp, Artificial Sequence
  chemically synthesized
cctctgatgtggactagtaa

SEQ ID NO: 592663 - DNA, 20 bp, Artificial Sequence
  chemically synthesized
tgctatctccctgtattcac

SEQ ID NO: 592664 - DNA, 20 bp, Artificial Sequence
  chemically synthesized
aaatagagtggagatacctg

SEQ ID NO: 592665 - DNA, 20 bp, Artificial Sequence
  chemically synthesized
ttgacctagccaacaaatag

SEQ ID NO: 592666 - DNA, 20 bp, Artificial Sequence
  chemically synthesized
tttgaactcagtgcccttgc

SEQ ID NO: 592667 - DNA, 20 bp, Artificial Sequence
  chemically synthesized
gcccttgtttcctctgcctg

SEQ ID NO: 592668 - DNA, 20 bp, Artificial Sequence
  chemically synthesized
gtttagattgggtggattgg

SEQ ID NO: 592669 - DNA, 20 bp, Artificial Sequence
  chemically synthesized
aggtggacttgtttagattg

SEQ ID NO: 592670 - DNA, 20 bp, Artificial Sequence
  chemically synthesized
tgatattgaaggtggacttg

SEQ ID NO: 592671 - DNA, 20 bp, Artificial Sequence
  chemically synthesized
gaaaatgatattgaaggtgg

SEQ ID NO: 592672 - DNA, 20 bp, Artificial Sequence
  chemically synthesized
tatcattttctattccctta

SEQ ID NO: 592673 - DNA, 20 bp, Artificial Sequence
  chemically synthesized
tatttattatatgcatacac

SEQ ID NO: 592674 - DNA, 20 bp, Artificial Sequence
  chemically synthesized
ttatgccatcgtgatgtaaa

SEQ ID NO: 592675 - DNA, 20 bp, Artificial Sequence
  chemically synthesized
cccgtatctgttgatcctca

SEQ ID NO: 592676 - DNA, 20 bp, Artificial Sequence
  chemically synthesized
gaggatcaacagatacggga

SEQ ID NO: 592677 - DNA, 20 bp, Artificial Sequence
  chemically synthesized
tccccctatctgcctaaaag

SEQ ID NO: 592678 - DNA, 20 bp, Artificial Sequence
  chemically synthesized
agttgaattatttcagaaat

SEQ ID NO: 592679 - DNA, 20 bp, Artificial Sequence
  chemically synthesized
aaagatttctgaaataattc

SEQ ID NO: 592680 - DNA, 20 bp, Artificial Sequence
  chemically synthesized
gttttaaatcctcctttaag

SEQ ID NO: 592681 - DNA, 20 bp, Artificial Sequence
  chemically synthesized
tgcaagaaactttccttaaa

SEQ ID NO: 592682 - DNA, 20 bp, Artificial Sequence
  chemically synthesized
gtaatgtttgttttagtaaa

SEQ ID NO: 592683 - DNA, 20 bp, Artificial Sequence
  chemically synthesized
agaaactaatgaaaggtaat

SEQ ID NO: 592684 - DNA, 20 bp, Artificial Sequence
  chemically synthesized
taaaacaaacattacctttc

SEQ ID NO: 592685 - DNA, 20 bp, Artificial Sequence
  chemically synthesized
tgaaagaaactaatgaaagg

SEQ ID NO: 592686 - DNA, 20 bp, Artificial Sequence
  chemically synthesized
ttcatatttcccaccaactt

SEQ ID NO: 592687 - DNA, 20 bp, Artificial Sequence
  chemically synthesized
ggcttatgtactattttaac

SEQ ID NO: 592688 - DNA, 20 bp, Artificial Sequence
  chemically synthesized
agctcaatgaagttagaatt

SEQ ID NO: 592689 - DNA, 20 bp, Artificial Sequence
  chemically synthesized
caaattctaacttcattgag

SEQ ID NO: 592690 - DNA, 20 bp, Artificial Sequence
  chemically synthesized
tagattggcaatagaaaaga

SEQ ID NO: 592691 - DNA, 20 bp, Artificial Sequence
  chemically synthesized
ctattgccaatctatctgtc

SEQ ID NO: 592692 - DNA, 20 bp, Artificial Sequence
  chemically synthesized
tgcaaattaaactgacgaca

SEQ ID NO: 592693 - DNA, 20 bp, Artificial Sequence
  chemically synthesized
tgaacctaagaggggagtga

SEQ ID NO: 592694 - DNA, 20 bp, Artificial Sequence
  chemically synthesized
aatggacacatcaataaatg

SEQ ID NO: 592695 - DNA, 20 bp, Artificial Sequence
  chemically synthesized
gatagcttgagtaaatttcc

SEQ ID NO: 592696 - DNA, 20 bp, Artificial Sequence
  chemically synthesized
tcaataaaaatgtaatggag

SEQ ID NO: 592697 - DNA, 20 bp, Artificial Sequence
  chemically synthesized
tcagcaaggaggtcccagtg

SEQ ID NO: 592698 - DNA, 20 bp, Artificial Sequence
  chemically synthesized
catttgatacaagcaaaggt

SEQ ID NO: 592699 - DNA, 20 bp, Artificial Sequence
  chemically synthesized
ttagtagaataaacaataac

SEQ ID NO: 592700 - DNA, 20 bp, Artificial Sequence
  chemically synthesized
aagagggggcactgctggga

SEQ ID NO: 592701 - DNA, 20 bp, Artificial Sequence
  chemically synthesized
ctcttagaaggacaagcctc

SEQ ID NO: 592702 - DNA, 20 bp, Artificial Sequence
  chemically synthesized
tgtgaagacttgaaaactag

SEQ ID NO: 592703 - DNA, 20 bp, Artificial Sequence
  chemically synthesized
gaagatttatgaaggatctg

SEQ ID NO: 592704 - DNA, 20 bp, Artificial Sequence
  chemically synthesized
aaaacatgagcatggcagta

SEQ ID NO: 592705 - DNA, 20 bp, Artificial Sequence
  chemically synthesized
aaatcttcttactgccatgc

SEQ ID NO: 592706 - DNA, 20 bp, Artificial Sequence
  chemically synthesized
acctcttcgagctgacatta

SEQ ID NO: 592707 - DNA, 20 bp, Artificial Sequence
  chemically synthesized
tatgcattcatgaaccttct

SEQ ID NO: 592708 - DNA, 20 bp, Artificial Sequence
  chemically synthesized
ttttaggtcaaattcccagg

SEQ ID NO: 592709 - DNA, 20 bp, Artificial Sequence
  chemically synthesized
gccctgtaggcaggcttcct

SEQ ID NO: 592710 - DNA, 20 bp, Artificial Sequence
  chemically synthesized
agattctaagtgccctgtag

SEQ ID NO: 592711 - DNA, 20 bp, Artificial Sequence
  chemically synthesized
ttctccaccgaaggcacttt

SEQ ID NO: 592712 - DNA, 20 bp, Artificial Sequence
  chemically synthesized
gtggagaaaatatttaacca

SEQ ID NO: 592713 - DNA, 20 bp, Artificial Sequence
  chemically synthesized
agaaaatatttaaccaatag

SEQ ID NO: 592714 - DNA, 20 bp, Artificial Sequence
  chemically synthesized
accaataggtttgtttgggg

SEQ ID NO: 592715 - DNA, 20 bp, Artificial Sequence
  chemically synthesized
ggatcttctatatggaccta

SEQ ID NO: 592716 - DNA, 20 bp, Artificial Sequence
  chemically synthesized
tcagttgctccacatgccct

SEQ ID NO: 592717 - DNA, 20 bp, Artificial Sequence
  chemically synthesized
ctgagaagactataaaggca

SEQ ID NO: 592718 - DNA, 20 bp, Artificial Sequence
  chemically synthesized
tttcttacctcaagttcacg

SEQ ID NO: 592719 - DNA, 20 bp, Artificial Sequence
  chemically synthesized
taactgtaaaatcatctatt

SEQ ID NO: 592720 - DNA, 20 bp, Artificial Sequence
  chemically synthesized
ttcatggataatccaaaaat

SEQ ID NO: 592721 - DNA, 20 bp, Artificial Sequence
  chemically synthesized
gaaattctcaatcctaggct

SEQ ID NO: 592722 - DNA, 20 bp, Artificial Sequence
  chemically synthesized
agttgcagaaaactgctagc

SEQ ID NO: 592723 - DNA, 20 bp, Artificial Sequence
  chemically synthesized
cctttgaatgtaggagaggc

SEQ ID NO: 592724 - DNA, 20 bp, Artificial Sequence
  chemically synthesized
cccatgcctctcctacattc

SEQ ID NO: 592725 - DNA, 20 bp, Artificial Sequence
  chemically synthesized
aagtatcctattttacacag

SEQ ID NO: 592726 - DNA, 20 bp, Artificial Sequence
  chemically synthesized
ctattttacacagtaaagtt

SEQ ID NO: 592727 - DNA, 20 bp, Artificial Sequence
  chemically synthesized
tagaacagatcatcagtgat

SEQ ID NO: 592728 - DNA, 20 bp, Artificial Sequence
  chemically synthesized
tgatcactgatgatctgttc

SEQ ID NO: 592729 - DNA, 20 bp, Artificial Sequence
  chemically synthesized
tctatagctttcccaaaacc

SEQ ID NO: 592730 - DNA, 20 bp, Artificial Sequence
  chemically synthesized
ctttcccaaaaccctgtgtt

SEQ ID NO: 592731 - DNA, 20 bp, Artificial Sequence
  chemically synthesized
taattgaaaatccagaaaca

SEQ ID NO: 592732 - DNA, 20 bp, Artificial Sequence
  chemically synthesized
aggggaagagctgccagctc

SEQ ID NO: 592733 - DNA, 20 bp, Artificial Sequence
  chemically synthesized
actgcgaccaccaaaattgc

SEQ ID NO: 592734 - DNA, 20 bp, Artificial Sequence
  chemically synthesized
gaagttccttgggtttagcc

SEQ ID NO: 592735 - DNA, 20 bp, Artificial Sequence
  chemically synthesized
catagagggggagaagttcc

SEQ ID NO: 592736 - DNA, 20 bp, Artificial Sequence
  chemically synthesized
aaggaacttctccccctcta

SEQ ID NO: 592737 - DNA, 20 bp, Artificial Sequence
  chemically synthesized
atattgataaccaaagctga

SEQ ID NO: 592738 - DNA, 20 bp, Artificial Sequence
  chemically synthesized
gctttgataaccaaagcaat

SEQ ID NO: 592739 - DNA, 20 bp, Artificial Sequence
  chemically synthesized
aagttcccaggtcatgctga

SEQ ID NO: 592740 - DNA, 20 bp, Artificial Sequence
  chemically synthesized
ttccaggtgactcattaaaa

SEQ ID NO: 592741 - DNA, 20 bp, Artificial Sequence
  chemically synthesized
ggggattgctgctatagggc

SEQ ID NO: 592742 - DNA, 20 bp, Artificial Sequence
  chemically synthesized
gtctctggtgccgaaaaggt

SEQ ID NO: 592743 - DNA, 20 bp, Artificial Sequence
  chemically synthesized
caaccttttcggcaccagag

SEQ ID NO: 592744 - DNA, 20 bp, Artificial Sequence
  chemically synthesized
gggagaggtgcgtgggaggc

SEQ ID NO: 592745 - DNA, 20 bp, Artificial Sequence
  chemically synthesized
tgcctgaagatctgaggtgc

SEQ ID NO: 592746 - DNA, 20 bp, Artificial Sequence
  chemically synthesized
tgcacctcagatcttcaggc

SEQ ID NO: 592747 - DNA, 20 bp, Artificial Sequence
  chemically synthesized
tctatcagctcagcagcggt

SEQ ID NO: 592748 - DNA, 20 bp, Artificial Sequence
  chemically synthesized
aagtgatctgcccgctttcc

SEQ ID NO: 592749 - DNA, 20 bp, Artificial Sequence
  chemically synthesized
cgcctgacctcaagtgatct

SEQ ID NO: 592750 - DNA, 20 bp, Artificial Sequence
  chemically synthesized
cgggcagatcacttgaggtc

SEQ ID NO: 592751 - DNA, 20 bp, Artificial Sequence
  chemically synthesized
ttttgcatttttagtagaga

SEQ ID NO: 592752 - DNA, 20 bp, Artificial Sequence
  chemically synthesized
tctggcgccaccaggccctg

SEQ ID NO: 592753 - DNA, 20 bp, Artificial Sequence
  chemically synthesized
tgccacagcctcccaagtag

SEQ ID NO: 592754 - DNA, 20 bp, Artificial Sequence
  chemically synthesized
aacctccgcgtcccaggttc

SEQ ID NO: 592755 - DNA, 20 bp, Artificial Sequence
  chemically synthesized
atcacctgaacctgggacgc

SEQ ID NO: 592756 - DNA, 20 bp, Artificial Sequence
  chemically synthesized
cctgggacgcggaggtttca

SEQ ID NO: 592757 - DNA, 20 bp, Artificial Sequence
  chemically synthesized
aaaaaaaaaaaaaaaagcca

SEQ ID NO: 592758 - DNA, 20 bp, Artificial Sequence
  chemically synthesized
atcctctgtgctctaatcct

SEQ ID NO: 592759 - DNA, 20 bp, Artificial Sequence
  chemically synthesized
agccaaaaggattagagcac

SEQ ID NO: 592760 - DNA, 20 bp, Artificial Sequence
  chemically synthesized
gcctaatcttggttttagga

SEQ ID NO: 592761 - DNA, 20 bp, Artificial Sequence
  chemically synthesized
tgctaatcctagtcctaaaa

SEQ ID NO: 592762 - DNA, 20 bp, Artificial Sequence
  chemically synthesized
caagtctgtttttgcctaat

SEQ ID NO: 592763 - DNA, 20 bp, Artificial Sequence
  chemically synthesized
aagattaggcaaaaacagac

SEQ ID NO: 592764 - DNA, 20 bp, Artificial Sequence
  chemically synthesized
ttgactcaaatgaatctcaa

SEQ ID NO: 592765 - DNA, 20 bp, Artificial Sequence
  chemically synthesized
tatgtttgcagtgcttggta

SEQ ID NO: 592766 - DNA, 20 bp, Artificial Sequence
  chemically synthesized
ccttctcagctatatgtttg

SEQ ID NO: 592767 - DNA, 20 bp, Artificial Sequence
  chemically synthesized
ggctgaggaccttctcagct

SEQ ID NO: 592768 - DNA, 20 bp, Artificial Sequence
  chemically synthesized
cagatgtggttaagacaaaa

SEQ ID NO: 592769 - DNA, 20 bp, Artificial Sequence
  chemically synthesized
cttacttttgtcttaaccac

SEQ ID NO: 592770 - DNA, 20 bp, Artificial Sequence
  chemically synthesized
ttgtcttaaccacatctgat

SEQ ID NO: 592771 - DNA, 20 bp, Artificial Sequence
  chemically synthesized
tatctatgggtctttatgcg

SEQ ID NO: 592772 - DNA, 20 bp, Artificial Sequence
  chemically synthesized
cttctttctgaattaccctt

SEQ ID NO: 592773 - DNA, 20 bp, Artificial Sequence
  chemically synthesized
gctttcattcttcattttgg

SEQ ID NO: 592774 - DNA, 20 bp, Artificial Sequence
  chemically synthesized
cagtgcacagtcttgcaatt

SEQ ID NO: 592775 - DNA, 20 bp, Artificial Sequence
  chemically synthesized
tttccttctgaaaatttaat

SEQ ID NO: 592776 - DNA, 20 bp, Artificial Sequence
  chemically synthesized
ttaaattttcagaaggaaaa

SEQ ID NO: 592777 - DNA, 20 bp, Artificial Sequence
  chemically synthesized
gacacatttgtttaaggata

SEQ ID NO: 592778 - DNA, 20 bp, Artificial Sequence
  chemically synthesized
tttatccttaaacaaatgtg

SEQ ID NO: 592779 - DNA, 20 bp, Artificial Sequence
  chemically synthesized
attcttctgaatccagacac

SEQ ID NO: 592780 - DNA, 20 bp, Artificial Sequence
  chemically synthesized
tgagcataaagtcgaaggga

SEQ ID NO: 592781 - DNA, 20 bp, Artificial Sequence
  chemically synthesized
actttatgctcacaaatgtg

SEQ ID NO: 592782 - DNA, 20 bp, Artificial Sequence
  chemically synthesized
catttgccttgtccatgtta

SEQ ID NO: 592783 - DNA, 20 bp, Artificial Sequence
  chemically synthesized
tcttatagcctagctaaagc

SEQ ID NO: 592784 - DNA, 20 bp, Artificial Sequence
  chemically synthesized
cttgatcatgctgtgaaaac

SEQ ID NO: 592785 - DNA, 20 bp, Artificial Sequence
  chemically synthesized
agctggagggtttgctatac

SEQ ID NO: 592786 - DNA, 20 bp, Artificial Sequence
  chemically synthesized
tgtggtatagcaaaccctcc

SEQ ID NO: 592787 - DNA, 20 bp, Artificial Sequence
  chemically synthesized
actcacgtcagaatcagctg

SEQ ID NO: 592788 - DNA, 20 bp, Artificial Sequence
  chemically synthesized
cgtgagtactactggcctag

SEQ ID NO: 592789 - DNA, 20 bp, Artificial Sequence
  chemically synthesized
tcagtgtctgtgtgtgaaga

SEQ ID NO: 592790 - DNA, 20 bp, Artificial Sequence
  chemically synthesized
tctaggtcttcacacacaga

SEQ ID NO: 592791 - DNA, 20 bp, Artificial Sequence
  chemically synthesized
cacacacagacactgattca

SEQ ID NO: 592792 - DNA, 20 bp, Artificial Sequence
  chemically synthesized
acacctttcagcatcatctg

SEQ ID NO: 592793 - DNA, 20 bp, Artificial Sequence
  chemically synthesized
gctgcccagatgatgctgaa

SEQ ID NO: 592794 - DNA, 20 bp, Artificial Sequence
  chemically synthesized
gatgatgctgaaaggtgttt

SEQ ID NO: 592795 - DNA, 20 bp, Artificial Sequence
  chemically synthesized
agcataaagttgaagggaaa

SEQ ID NO: 592796 - DNA, 20 bp, Artificial Sequence
  chemically synthesized
aaatgtttaatgaatttgcc

SEQ ID NO: 592797 - DNA, 20 bp, Artificial Sequence
  chemically synthesized
tggaaaccagctgcttaggg

SEQ ID NO: 592798 - DNA, 20 bp, Artificial Sequence
  chemically synthesized
tataatcaaggccctaagca

SEQ ID NO: 592799 - DNA, 20 bp, Artificial Sequence
  chemically synthesized
ggtaaggttaagtggaaacc

SEQ ID NO: 592800 - DNA, 20 bp, Artificial Sequence
  chemically synthesized
ataatcccaactgaatttgt

SEQ ID NO: 592801 - DNA, 20 bp, Artificial Sequence
  chemically synthesized
ccaaactcatacaaattcag

SEQ ID NO: 592802 - DNA, 20 bp, Artificial Sequence
  chemically synthesized
gtttggttgctattataata

SEQ ID NO: 592803 - DNA, 20 bp, Artificial Sequence
  chemically synthesized
tattataatagcaaccaaac

SEQ ID NO: 592804 - DNA, 20 bp, Artificial Sequence
  chemically synthesized
tagcaaccaaacccttgctt

SEQ ID NO: 592805 - DNA, 20 bp, Artificial Sequence
  chemically synthesized
ggtcagtaaatcagagaagc

SEQ ID NO: 592806 - DNA, 20 bp, Artificial Sequence
  chemically synthesized
agcagccagaatttcagaaa

SEQ ID NO: 592807 - DNA, 20 bp, Artificial Sequence
  chemically synthesized
ctgctcaaatcccaattgca

SEQ ID NO: 592808 - DNA, 20 bp, Artificial Sequence
  chemically synthesized
atgcctcaatcaggttgcaa

SEQ ID NO: 592809 - DNA, 20 bp, Artificial Sequence
  chemically synthesized
gattgaggcattattagtat

SEQ ID NO: 592810 - DNA, 20 bp, Artificial Sequence
  chemically synthesized
tctaacgaacgtttgcactt

SEQ ID NO: 592811 - DNA, 20 bp, Artificial Sequence
  chemically synthesized
acaaatcagtaacttctaac

SEQ ID NO: 592812 - DNA, 20 bp, Artificial Sequence
  chemically synthesized
tgcaaacgttcgttagaagt

SEQ ID NO: 592813 - DNA, 20 bp, Artificial Sequence
  chemically synthesized
ctgatttgtgcagaactctg

SEQ ID NO: 592814 - DNA, 20 bp, Artificial Sequence
  chemically synthesized
ctttgtcaagtaaacataca

SEQ ID NO: 592815 - DNA, 20 bp, Artificial Sequence
  chemically synthesized
ttggaaggagcaaacgtttt

SEQ ID NO: 592816 - DNA, 20 bp, Artificial Sequence
  chemically synthesized
ccattgcaattggaaggagc

SEQ ID NO: 592817 - DNA, 20 bp, Artificial Sequence
  chemically synthesized
aatgtgaatattgaggtctg

SEQ ID NO: 592818 - DNA, 20 bp, Artificial Sequence
  chemically synthesized
tgtaaatttcaaccctccct

SEQ ID NO: 592819 - DNA, 20 bp, Artificial Sequence
  chemically synthesized
agttctccctgcagctggtg

SEQ ID NO: 592820 - DNA, 20 bp, Artificial Sequence
  chemically synthesized
cctgcagctggtgggctgct

SEQ ID NO: 592821 - DNA, 20 bp, Artificial Sequence
  chemically synthesized
aataatgtgggagaagatca

SEQ ID NO: 592822 - DNA, 20 bp, Artificial Sequence
  chemically synthesized
aaaaagtccctcagtaaaag

SEQ ID NO: 592823 - DNA, 20 bp, Artificial Sequence
  chemically synthesized
gactcgattaagtggctaaa

SEQ ID NO: 592824 - DNA, 20 bp, Artificial Sequence
  chemically synthesized
ggctaaataacgtttcctcc

SEQ ID NO: 592825 - DNA, 20 bp, Artificial Sequence
  chemically synthesized
ttgaaaaccttatttgaaaa

SEQ ID NO: 592826 - DNA, 20 bp, Artificial Sequence
  chemically synthesized
ccgaaagctttcttttcaaa

SEQ ID NO: 592827 - DNA, 20 bp, Artificial Sequence
  chemically synthesized
tatatatatatatatatgta

SEQ ID NO: 592828 - DNA, 20 bp, Artificial Sequence
  chemically synthesized
tcaacacatctttttctcct

SEQ ID NO: 592829 - DNA, 20 bp, Artificial Sequence
  chemically synthesized
gatttcaacacatctttttc

SEQ ID NO: 592830 - DNA, 20 bp, Artificial Sequence
  chemically synthesized
ccactgttgtctgtgctctg

SEQ ID NO: 592831 - DNA, 20 bp, Artificial Sequence
  chemically synthesized
gagaattctaaaatgcacac

SEQ ID NO: 592832 - DNA, 20 bp, Artificial Sequence
  chemically synthesized
agggtgtgcattttagaatt

SEQ ID NO: 592833 - DNA, 20 bp, Artificial Sequence
  chemically synthesized
attttagaattctcagattt

SEQ ID NO: 592834 - DNA, 20 bp, Artificial Sequence
  chemically synthesized
tttctcttaccccctcatat

SEQ ID NO: 592835 - DNA, 20 bp, Artificial Sequence
  chemically synthesized
tgagggggtaagagaaaata

SEQ ID NO: 592836 - DNA, 20 bp, Artificial Sequence
  chemically synthesized
gtgaactagggacaaagtcc

SEQ ID NO: 592837 - DNA, 20 bp, Artificial Sequence
  chemically synthesized
cacctttccttggcaagtca

SEQ ID NO: 592838 - DNA, 20 bp, Artificial Sequence
  chemically synthesized
tgatttttaactagctccta

SEQ ID NO: 592839 - DNA, 20 bp, Artificial Sequence
  chemically synthesized
aactagctttcttgtgttag

SEQ ID NO: 592840 - DNA, 20 bp, Artificial Sequence
  chemically synthesized
cccccttctgcagcttggcc

SEQ ID NO: 592841 - DNA, 20 bp, Artificial Sequence
  chemically synthesized
ctataggccaagctgcagaa

SEQ ID NO: 592842 - DNA, 20 bp, Artificial Sequence
  chemically synthesized
aattttagaaagcccccttc

SEQ ID NO: 592843 - DNA, 20 bp, Artificial Sequence
  chemically synthesized
tggccagtataaaagcctta

SEQ ID NO: 592844 - DNA, 20 bp, Artificial Sequence
  chemically synthesized
acgctataggaaaaaccata

SEQ ID NO: 592845 - DNA, 20 bp, Artificial Sequence
  chemically synthesized
tcctatagcgtagctaaagc

SEQ ID NO: 592846 - DNA, 20 bp, Artificial Sequence
  chemically synthesized
cttgatcgtgctttgaaaac

SEQ ID NO: 592847 - DNA, 20 bp, Artificial Sequence
  chemically synthesized
actgatgctgctggccttga

SEQ ID NO: 592848 - DNA, 20 bp, Artificial Sequence
  chemically synthesized
tccagtaactttggtgcagg

SEQ ID NO: 592849 - DNA, 20 bp, Artificial Sequence
  chemically synthesized
agctggagggtttgctatac

SEQ ID NO: 592850 - DNA, 20 bp, Artificial Sequence
  chemically synthesized
tgtggtatagcaaaccctcc

SEQ ID NO: 592851 - DNA, 20 bp, Artificial Sequence
  chemically synthesized
actcacatcagaatcagctg

SEQ ID NO: 592852 - DNA, 20 bp, Artificial Sequence
  chemically synthesized
tgtgagtattactggcctag

SEQ ID NO: 592853 - DNA, 20 bp, Artificial Sequence
  chemically synthesized
tcagtgtctgtgtgtgaaga

SEQ ID NO: 592854 - DNA, 20 bp, Artificial Sequence
  chemically synthesized
tctaggtcttcacacacaga

SEQ ID NO: 592855 - DNA, 20 bp, Artificial Sequence
  chemically synthesized
cacacacagacactgattca

SEQ ID NO: 592856 - DNA, 20 bp, Artificial Sequence
  chemically synthesized
tgggatgaagggtaggagtc

SEQ ID NO: 592857 - DNA, 20 bp, Artificial Sequence
  chemically synthesized
cagcttttatcaagctgccc

SEQ ID NO: 592858 - DNA, 20 bp, Artificial Sequence
  chemically synthesized
acaccttacagaatcatctg

SEQ ID NO: 592859 - DNA, 20 bp, Artificial Sequence
  chemically synthesized
gatgattctgtaaggtgtta

SEQ ID NO: 592860 - DNA, 20 bp, Artificial Sequence
  chemically synthesized
gaactgacacattcctctct

SEQ ID NO: 592861 - DNA, 20 bp, Artificial Sequence
  chemically synthesized
ttgcaatttgtctgccaaag

SEQ ID NO: 592862 - DNA, 20 bp, Artificial Sequence
  chemically synthesized
aagagaaaaaaggttcacat

SEQ ID NO: 592863 - DNA, 20 bp, Artificial Sequence
  chemically synthesized
ctaccactgaagtctgtcag

SEQ ID NO: 592864 - DNA, 20 bp, Artificial Sequence
  chemically synthesized
ctactctgacagacttcagt

SEQ ID NO: 592865 - DNA, 20 bp, Artificial Sequence
  chemically synthesized
tctaagtaaatgtcctgaca

SEQ ID NO: 592866 - DNA, 20 bp, Artificial Sequence
  chemically synthesized
tagccagacttcacccctta

SEQ ID NO: 592867 - DNA, 20 bp, Artificial Sequence
  chemically synthesized
tttctttttgtgttttagaa

SEQ ID NO: 592868 - DNA, 20 bp, Artificial Sequence
  chemically synthesized
aggtgtcatttgttttcttt

SEQ ID NO: 592869 - DNA, 20 bp, Artificial Sequence
  chemically synthesized
aaaatttccatgtaggtgtc

SEQ ID NO: 592870 - DNA, 20 bp, Artificial Sequence
  chemically synthesized
gcgtcttcactgctttcttt

SEQ ID NO: 592871 - DNA, 20 bp, Artificial Sequence
  chemically synthesized
gcagtgaaagaaagcagtga

SEQ ID NO: 592872 - DNA, 20 bp, Artificial Sequence
  chemically synthesized
actcaaggtcaaagcgtctt

SEQ ID NO: 592873 - DNA, 20 bp, Artificial Sequence
  chemically synthesized
tgaagacgctttgaccttga

SEQ ID NO: 592874 - DNA, 20 bp, Artificial Sequence
  chemically synthesized
tactaaaacctagtaaggtg

SEQ ID NO: 592875 - DNA, 20 bp, Artificial Sequence
  chemically synthesized
tcacaaaaccattcacctta

SEQ ID NO: 592876 - DNA, 20 bp, Artificial Sequence
  chemically synthesized
aaaggtccatcctgtaacaa

SEQ ID NO: 592877 - DNA, 20 bp, Artificial Sequence
  chemically synthesized
gtgtgcgttagaattgccta

SEQ ID NO: 592878 - DNA, 20 bp, Artificial Sequence
  chemically synthesized
gggctccactctccaagaat

SEQ ID NO: 592879 - DNA, 20 bp, Artificial Sequence
  chemically synthesized
ttccccctatggagtagagc

SEQ ID NO: 592880 - DNA, 20 bp, Artificial Sequence
  chemically synthesized
aatgtgtcaggaaaaaggtg

SEQ ID NO: 592881 - DNA, 20 bp, Artificial Sequence
  chemically synthesized
tatattctttgtctaacctt

SEQ ID NO: 592882 - DNA, 20 bp, Artificial Sequence
  chemically synthesized
aggtggaatttattttactt

SEQ ID NO: 592883 - DNA, 20 bp, Artificial Sequence
  chemically synthesized
tcttaactatacctataatc

SEQ ID NO: 592884 - DNA, 20 bp, Artificial Sequence
  chemically synthesized
tttaggctggcctgtgaaac

SEQ ID NO: 592885 - DNA, 20 bp, Artificial Sequence
  chemically synthesized
ttatagagttgtctgtgtga

SEQ ID NO: 592886 - DNA, 20 bp, Artificial Sequence
  chemically synthesized
agctcactatatcataagaa

SEQ ID NO: 592887 - DNA, 20 bp, Artificial Sequence
  chemically synthesized
gagctcctttaaacattgtg

SEQ ID NO: 592888 - DNA, 20 bp, Artificial Sequence
  chemically synthesized
aagatgaataaagcatgcca

SEQ ID NO: 592889 - DNA, 20 bp, Artificial Sequence
  chemically synthesized
ttattcatctttatgtctgt

SEQ ID NO: 592890 - DNA, 20 bp, Artificial Sequence
  chemically synthesized
tctaatacttttaacgcaac

SEQ ID NO: 592891 - DNA, 20 bp, Artificial Sequence
  chemically synthesized
aaatagactgtacactttat

SEQ ID NO: 592892 - DNA, 20 bp, Artificial Sequence
  chemically synthesized
aatcaatagtgtaccttacc

SEQ ID NO: 592893 - DNA, 20 bp, Artificial Sequence
  chemically synthesized
aatcctaaggtaaggtacac

SEQ ID NO: 592894 - DNA, 20 bp, Artificial Sequence
  chemically synthesized
gtaaggtacactattgattt

SEQ ID NO: 592895 - DNA, 20 bp, Artificial Sequence
  chemically synthesized
tttaattcattacacatgtg

SEQ ID NO: 592896 - DNA, 20 bp, Artificial Sequence
  chemically synthesized
agtatcacctcacaaaagac

SEQ ID NO: 592897 - DNA, 20 bp, Artificial Sequence
  chemically synthesized
tataaagttttgttaaattg

SEQ ID NO: 592898 - DNA, 20 bp, Artificial Sequence
  chemically synthesized
caatttaacaaaactttata

SEQ ID NO: 592899 - DNA, 20 bp, Artificial Sequence
  chemically synthesized
catgtggtagaagctcaata

SEQ ID NO: 592900 - DNA, 20 bp, Artificial Sequence
  chemically synthesized
atatctaatataatgatgtt

SEQ ID NO: 592901 - DNA, 20 bp, Artificial Sequence
  chemically synthesized
tgatgttaagagcttcaatt

SEQ ID NO: 592902 - DNA, 20 bp, Artificial Sequence
  chemically synthesized
catacaacaggcaatctgca

SEQ ID NO: 592903 - DNA, 20 bp, Artificial Sequence
  chemically synthesized
ataatttgctgtaaacacct

SEQ ID NO: 592904 - DNA, 20 bp, Artificial Sequence
  chemically synthesized
tgcaaggtgtttacagcaaa

SEQ ID NO: 592905 - DNA, 20 bp, Artificial Sequence
  chemically synthesized
catcgcaatacctctacgaa

SEQ ID NO: 592906 - DNA, 20 bp, Artificial Sequence
  chemically synthesized
aagttggctttattagcatc

SEQ ID NO: 592907 - DNA, 20 bp, Artificial Sequence
  chemically synthesized
cagattaaggaagaggaaat

SEQ ID NO: 592908 - DNA, 20 bp, Artificial Sequence
  chemically synthesized
aataaattaatgttttaaag

SEQ ID NO: 592909 - DNA, 20 bp, Artificial Sequence
  chemically synthesized
tttagaataaattaatgttt

SEQ ID NO: 592910 - DNA, 20 bp, Artificial Sequence
  chemically synthesized
ctgtgtgatttagaataaat

SEQ ID NO: 592911 - DNA, 20 bp, Artificial Sequence
  chemically synthesized
ggttccgtcatttcttagct

SEQ ID NO: 592912 - DNA, 20 bp, Artificial Sequence
  chemically synthesized
acagctaagaaatgacggaa

SEQ ID NO: 592913 - DNA, 20 bp, Artificial Sequence
  chemically synthesized
caacgttgtccgaagctaga

SEQ ID NO: 592914 - DNA, 20 bp, Artificial Sequence
  chemically synthesized
cagagctgttgaaagcagac

SEQ ID NO: 592915 - DNA, 20 bp, Artificial Sequence
  chemically synthesized
gtaattgggtctcttttgca

SEQ ID NO: 592916 - DNA, 20 bp, Artificial Sequence
  chemically synthesized
aaagagacccaattactttc

SEQ ID NO: 592917 - DNA, 20 bp, Artificial Sequence
  chemically synthesized
aaacgtaaccctagtttcgc

SEQ ID NO: 592918 - DNA, 20 bp, Artificial Sequence
  chemically synthesized
aaacctgagcgaaactaggg

SEQ ID NO: 592919 - DNA, 20 bp, Artificial Sequence
  chemically synthesized
tggacctaggtaaacgtaac

SEQ ID NO: 592920 - DNA, 20 bp, Artificial Sequence
  chemically synthesized
tacatgttatttgtgtgagg

SEQ ID NO: 592921 - DNA, 20 bp, Artificial Sequence
  chemically synthesized
gtaattacatgttatttgtg

SEQ ID NO: 592922 - DNA, 20 bp, Artificial Sequence
  chemically synthesized
tttcctctcctcatccttaa

SEQ ID NO: 592923 - DNA, 20 bp, Artificial Sequence
  chemically synthesized
atcggttgtcacttgctcag

SEQ ID NO: 592924 - DNA, 20 bp, Artificial Sequence
  chemically synthesized
tctccacccactccacacac

SEQ ID NO: 592925 - DNA, 20 bp, Artificial Sequence
  chemically synthesized
tggagtgggtggagacagtg

SEQ ID NO: 592926 - DNA, 20 bp, Artificial Sequence
  chemically synthesized
tttttcctttgcacgtacta

SEQ ID NO: 592927 - DNA, 20 bp, Artificial Sequence
  chemically synthesized
aatagtacgtgcaaaggaaa

SEQ ID NO: 592928 - DNA, 20 bp, Artificial Sequence
  chemically synthesized
taactttgtttttttttttt

SEQ ID NO: 592929 - DNA, 20 bp, Artificial Sequence
  chemically synthesized
ctgtactccaactacactaa

SEQ ID NO: 592930 - DNA, 20 bp, Artificial Sequence
  chemically synthesized
atagcaaaggacagactatg

SEQ ID NO: 592931 - DNA, 20 bp, Artificial Sequence
  chemically synthesized
tttagccttaaaatggtgtg

SEQ ID NO: 592932 - DNA, 20 bp, Artificial Sequence
  chemically synthesized
gaaggagaaatctagccaag

SEQ ID NO: 592933 - DNA, 20 bp, Artificial Sequence
  chemically synthesized
taaatataaatctagccttg

SEQ ID NO: 592934 - DNA, 20 bp, Artificial Sequence
  chemically synthesized
taattccaatgagagacgat

SEQ ID NO: 592935 - DNA, 20 bp, Artificial Sequence
  chemically synthesized
tttaaccttctcaatatctc

SEQ ID NO: 592936 - DNA, 20 bp, Artificial Sequence
  chemically synthesized
ttaaatctgtcacctggtcc

SEQ ID NO: 592937 - DNA, 20 bp, Artificial Sequence
  chemically synthesized
ttaaatcagtaggaccaggt

SEQ ID NO: 592938 - DNA, 20 bp, Artificial Sequence
  chemically synthesized
gaggaaaaaaaatccagact

SEQ ID NO: 592939 - DNA, 20 bp, Artificial Sequence
  chemically synthesized
aaaaaaaatccagacttttg

SEQ ID NO: 592940 - DNA, 20 bp, Artificial Sequence
  chemically synthesized
ccagttaagcaagccaaaag

SEQ ID NO: 592941 - DNA, 20 bp, Artificial Sequence
  chemically synthesized
tggaggaacctggatgtgta

SEQ ID NO: 592942 - DNA, 20 bp, Artificial Sequence
  chemically synthesized
ttgaaggacaaggtcgaaca

SEQ ID NO: 592943 - DNA, 20 bp, Artificial Sequence
  chemically synthesized
tataagactagcattcaaat

SEQ ID NO: 592944 - DNA, 20 bp, Artificial Sequence
  chemically synthesized
gggctggagatgtaaatatt

SEQ ID NO: 592945 - DNA, 20 bp, Artificial Sequence
  chemically synthesized
taacctaactaatgtttctg

SEQ ID NO: 592946 - DNA, 20 bp, Artificial Sequence
  chemically synthesized
tgttcctgatttaacctaac

SEQ ID NO: 592947 - DNA, 20 bp, Artificial Sequence
  chemically synthesized
aggttaaatcaggaacatag

SEQ ID NO: 592948 - DNA, 20 bp, Artificial Sequence
  chemically synthesized
ctaggtaatcttatctatgt

SEQ ID NO: 592949 - DNA, 20 bp, Artificial Sequence
  chemically synthesized
tgtagtgaatcagaatcaaa

SEQ ID NO: 592950 - DNA, 20 bp, Artificial Sequence
  chemically synthesized
taaaattaaacagggtttga

SEQ ID NO: 592951 - DNA, 20 bp, Artificial Sequence
  chemically synthesized
gtaatttaaaattaaacagg

SEQ ID NO: 592952 - DNA, 20 bp, Artificial Sequence
  chemically synthesized
ctttgtaatttaaaattaaa

SEQ ID NO: 592953 - DNA, 20 bp, Artificial Sequence
  chemically synthesized
tctacacagtgagtggttag

SEQ ID NO: 592954 - DNA, 20 bp, Artificial Sequence
  chemically synthesized
cttcatctacacagtgagtg

SEQ ID NO: 592955 - DNA, 20 bp, Artificial Sequence
  chemically synthesized
atgaagagaactgaagtcct

SEQ ID NO: 592956 - DNA, 20 bp, Artificial Sequence
  chemically synthesized
cctgcgagttttatccattt

SEQ ID NO: 592957 - DNA, 20 bp, Artificial Sequence
  chemically synthesized
cagaagacctgagttcttgc

SEQ ID NO: 592958 - DNA, 20 bp, Artificial Sequence
  chemically synthesized
agaactcaggtcttctgagc

SEQ ID NO: 592959 - DNA, 20 bp, Artificial Sequence
  chemically synthesized
ctgagccctagccatagagc

SEQ ID NO: 592960 - DNA, 20 bp, Artificial Sequence
  chemically synthesized
atgcatctgagccctagcca

SEQ ID NO: 592961 - DNA, 20 bp, Artificial Sequence
  chemically synthesized
cactttgctaacactcagga

SEQ ID NO: 592962 - DNA, 20 bp, Artificial Sequence
  chemically synthesized
tcttctggcacagagtcaag

SEQ ID NO: 592963 - DNA, 20 bp, Artificial Sequence
  chemically synthesized
tgttcttgactctgtgccag

SEQ ID NO: 592964 - DNA, 20 bp, Artificial Sequence
  chemically synthesized
cttctgttgagttcgagagg

SEQ ID NO: 592965 - DNA, 20 bp, Artificial Sequence
  chemically synthesized
acacatgtaccaatgtggtc

SEQ ID NO: 592966 - DNA, 20 bp, Artificial Sequence
  chemically synthesized
gctgtagaccacattggtac

SEQ ID NO: 592967 - DNA, 20 bp, Artificial Sequence
  chemically synthesized
acagaaacggcatgcatgat

SEQ ID NO: 592968 - DNA, 20 bp, Artificial Sequence
  chemically synthesized
ttataaactacaatcatgca

SEQ ID NO: 592969 - DNA, 20 bp, Artificial Sequence
  chemically synthesized
gcaaagcacagaaacggcat

SEQ ID NO: 592970 - DNA, 20 bp, Artificial Sequence
  chemically synthesized
tacaatcatgcatgccgttt

SEQ ID NO: 592971 - DNA, 20 bp, Artificial Sequence
  chemically synthesized
gaaaggacattagcagtcca

SEQ ID NO: 592972 - DNA, 20 bp, Artificial Sequence
  chemically synthesized
gtctgacacagtgaggcaaa

SEQ ID NO: 592973 - DNA, 20 bp, Artificial Sequence
  chemically synthesized
ggttgaaagtgccgtctatg

SEQ ID NO: 592974 - DNA, 20 bp, Artificial Sequence
  chemically synthesized
ggtgtttgtgtcgtgaaaat

SEQ ID NO: 592975 - DNA, 20 bp, Artificial Sequence
  chemically synthesized
tgttctaaagatgtaagtgt

SEQ ID NO: 592976 - DNA, 20 bp, Artificial Sequence
  chemically synthesized
agaacagtctcagcaattct

SEQ ID NO: 592977 - DNA, 20 bp, Artificial Sequence
  chemically synthesized
ggctggaggataatttgcag

SEQ ID NO: 592978 - DNA, 20 bp, Artificial Sequence
  chemically synthesized
ctgcaaattatcctccagcc

SEQ ID NO: 592979 - DNA, 20 bp, Artificial Sequence
  chemically synthesized
cagccatgagatttaaaacc

SEQ ID NO: 592980 - DNA, 20 bp, Artificial Sequence
  chemically synthesized
gatttaaaaccaagagtttc

SEQ ID NO: 592981 - DNA, 20 bp, Artificial Sequence
  chemically synthesized
ggaacaaaacactagaaact

SEQ ID NO: 592982 - DNA, 20 bp, Artificial Sequence
  chemically synthesized
tgaaatatgtaaccttaacc

SEQ ID NO: 592983 - DNA, 20 bp, Artificial Sequence
  chemically synthesized
cacatcaagtgaactattca

SEQ ID NO: 592984 - DNA, 20 bp, Artificial Sequence
  chemically synthesized
ctcttcccctattaaggaag

SEQ ID NO: 592985 - DNA, 20 bp, Artificial Sequence
  chemically synthesized
aggggaagaggggcaaattc

SEQ ID NO: 592986 - DNA, 20 bp, Artificial Sequence
  chemically synthesized
gttgtagagcagagaacgct

SEQ ID NO: 592987 - DNA, 20 bp, Artificial Sequence
  chemically synthesized
tcatgagcacaaagataagt

SEQ ID NO: 592988 - DNA, 20 bp, Artificial Sequence
  chemically synthesized
ttgaggtaaatgctaaacca

SEQ ID NO: 592989 - DNA, 20 bp, Artificial Sequence
  chemically synthesized
gtaaatgctaaaccaaacag

SEQ ID NO: 592990 - DNA, 20 bp, Artificial Sequence
  chemically synthesized
cctgaatacaaactaaactg

SEQ ID NO: 592991 - DNA, 20 bp, Artificial Sequence
  chemically synthesized
actgtcctgaatacaaacta

SEQ ID NO: 592992 - DNA, 20 bp, Artificial Sequence
  chemically synthesized
gtttgtattcaggacagtag

SEQ ID NO: 592993 - DNA, 20 bp, Artificial Sequence
  chemically synthesized
ccagcaacattccttgacca

SEQ ID NO: 592994 - DNA, 20 bp, Artificial Sequence
  chemically synthesized
tccttgaccaatatgcttgt

SEQ ID NO: 592995 - DNA, 20 bp, Artificial Sequence
  chemically synthesized
gaccaatatgcttgtataag

SEQ ID NO: 592996 - DNA, 20 bp, Artificial Sequence
  chemically synthesized
atcctatacacaaaaataaa

SEQ ID NO: 592997 - DNA, 20 bp, Artificial Sequence
  chemically synthesized
agcttagtttatttttgtgt

SEQ ID NO: 592998 - DNA, 20 bp, Artificial Sequence
  chemically synthesized
gtactgatgaaaaaagtatc

SEQ ID NO: 592999 - DNA, 20 bp, Artificial Sequence
  chemically synthesized
gtttagtcaagtcttagtgc

SEQ ID NO: 593000 - DNA, 20 bp, Artificial Sequence
  chemically synthesized
aagacttgactaaactctag

SEQ ID NO: 593001 - DNA, 20 bp, Artificial Sequence
  chemically synthesized
tctggggctagaaaccatac

SEQ ID NO: 593002 - DNA, 20 bp, Artificial Sequence
  chemically synthesized
accctagccttcccttaagt

SEQ ID NO: 593003 - DNA, 20 bp, Artificial Sequence
  chemically synthesized
attaaattttcctggcagca

SEQ ID NO: 593004 - DNA, 20 bp, Artificial Sequence
  chemically synthesized
tcagtgctgccaggaaaatt

SEQ ID NO: 593005 - DNA, 20 bp, Artificial Sequence
  chemically synthesized
tctgttgataggactcttac

SEQ ID NO: 593006 - DNA, 20 bp, Artificial Sequence
  chemically synthesized
ttcttagaacatttactcaa

SEQ ID NO: 593007 - DNA, 20 bp, Artificial Sequence
  chemically synthesized
ggtccttgagtgagagacac

SEQ ID NO: 593008 - DNA, 20 bp, Artificial Sequence
  chemically synthesized
tgatgatgtcatttgaaaag

SEQ ID NO: 593009 - DNA, 20 bp, Artificial Sequence
  chemically synthesized
ttagctggaagttattgaag

SEQ ID NO: 593010 - DNA, 20 bp, Artificial Sequence
  chemically synthesized
caaagggctggacagtgtaa

SEQ ID NO: 593011 - DNA, 20 bp, Artificial Sequence
  chemically synthesized
aatttgtgcagaggcgactt

SEQ ID NO: 593012 - DNA, 20 bp, Artificial Sequence
  chemically synthesized
ttcacgaggtattgaataaa

SEQ ID NO: 593013 - DNA, 20 bp, Artificial Sequence
  chemically synthesized
ctggatattaaagaggtaaa

SEQ ID NO: 593014 - DNA, 20 bp, Artificial Sequence
  chemically synthesized
tttacctctttaatatccag

SEQ ID NO: 593015 - DNA, 20 bp, Artificial Sequence
  chemically synthesized
tgaggaaaatttatttatcg

SEQ ID NO: 593016 - DNA, 20 bp, Artificial Sequence
  chemically synthesized
aacaaagctgatgtatttta

SEQ ID NO: 593017 - DNA, 20 bp, Artificial Sequence
  chemically synthesized
gatcaagcataataaaatac

SEQ ID NO: 593018 - DNA, 20 bp, Artificial Sequence
  chemically synthesized
gtagagttgtttgagtattt

SEQ ID NO: 593019 - DNA, 20 bp, Artificial Sequence
  chemically synthesized
acctcacatactaatggtag

SEQ ID NO: 593020 - DNA, 20 bp, Artificial Sequence
  chemically synthesized
actctaccattagtatgtga

SEQ ID NO: 593021 - DNA, 20 bp, Artificial Sequence
  chemically synthesized
tatatgctatcatagtaaga

SEQ ID NO: 593022 - DNA, 20 bp, Artificial Sequence
  chemically synthesized
tctaaaagaaaatggatggt

SEQ ID NO: 593023 - DNA, 20 bp, Artificial Sequence
  chemically synthesized
ctgtgtcttgcattggacag

SEQ ID NO: 593024 - DNA, 20 bp, Artificial Sequence
  chemically synthesized
actgtaaaacaagtaaaatt

SEQ ID NO: 593025 - DNA, 20 bp, Artificial Sequence
  chemically synthesized
ctttttaatcatataatttt

SEQ ID NO: 593026 - DNA, 20 bp, Artificial Sequence
  chemically synthesized
attatatgattaaaaagaaa

SEQ ID NO: 593027 - DNA, 20 bp, Artificial Sequence
  chemically synthesized
attaaaaagaaaaccagctt

SEQ ID NO: 593028 - DNA, 20 bp, Artificial Sequence
  chemically synthesized
gcattctcaaaatcttagaa

SEQ ID NO: 593029 - DNA, 20 bp, Artificial Sequence
  chemically synthesized
tattgaacagttctttgttg

SEQ ID NO: 593030 - DNA, 20 bp, Artificial Sequence
  chemically synthesized
acaaagaactgttcaataaa

SEQ ID NO: 593031 - DNA, 20 bp, Artificial Sequence
  chemically synthesized
agaactgttcaataaaacat

SEQ ID NO: 593032 - DNA, 20 bp, Artificial Sequence
  chemically synthesized
tccactgattttgtaaacaa

SEQ ID NO: 593033 - DNA, 20 bp, Artificial Sequence
  chemically synthesized
atatttctgaggaagtcttc

SEQ ID NO: 593034 - DNA, 20 bp, Artificial Sequence
  chemically synthesized
aaattttgaaatgccatttt

SEQ ID NO: 593035 - DNA, 20 bp, Artificial Sequence
  chemically synthesized
aataaatatctgatattttt

SEQ ID NO: 593036 - DNA, 20 bp, Artificial Sequence
  chemically synthesized
tatctgatatttttcataga

SEQ ID NO: 593037 - DNA, 20 bp, Artificial Sequence
  chemically synthesized
tcaaatcattaggatttaat

SEQ ID NO: 593038 - DNA, 20 bp, Artificial Sequence
  chemically synthesized
caaaatcatgaattaaatcc

SEQ ID NO: 593039 - DNA, 20 bp, Artificial Sequence
  chemically synthesized
ttaaattatagttcaaatca

SEQ ID NO: 593040 - DNA, 20 bp, Artificial Sequence
  chemically synthesized
tatattccaaatagcaagcc

SEQ ID NO: 593041 - DNA, 20 bp, Artificial Sequence
  chemically synthesized
aagattgtaaatgtcaatcg

SEQ ID NO: 593042 - DNA, 20 bp, Artificial Sequence
  chemically synthesized
atcagaagattgtaaatgtc

SEQ ID NO: 593043 - DNA, 20 bp, Artificial Sequence
  chemically synthesized
attggtactttgcatttatc

SEQ ID NO: 593044 - DNA, 20 bp, Artificial Sequence
  chemically synthesized
aagtaccaattccctaaaca

SEQ ID NO: 593045 - DNA, 20 bp, Artificial Sequence
  chemically synthesized
gaaaaagtcaccataaaacg

SEQ ID NO: 593046 - DNA, 20 bp, Artificial Sequence
  chemically synthesized
ttaggttttacaggcaactc

SEQ ID NO: 593047 - DNA, 20 bp, Artificial Sequence
  chemically synthesized
tgagttgcctgtaaaaccta

SEQ ID NO: 593048 - DNA, 20 bp, Artificial Sequence
  chemically synthesized
agaactaatgttcaagcaat

SEQ ID NO: 593049 - DNA, 20 bp, Artificial Sequence
  chemically synthesized
taaatgttgaatttgacact

SEQ ID NO: 593050 - DNA, 20 bp, Artificial Sequence
  chemically synthesized
ctcagtgtcaaattcaacat

SEQ ID NO: 593051 - DNA, 20 bp, Artificial Sequence
  chemically synthesized
aatggtgataaataccaccc

SEQ ID NO: 593052 - DNA, 20 bp, Artificial Sequence
  chemically synthesized
gcatttatcacataaggaaa

SEQ ID NO: 593053 - DNA, 20 bp, Artificial Sequence
  chemically synthesized
accctgagttcctatttcag

SEQ ID NO: 593054 - DNA, 20 bp, Artificial Sequence
  chemically synthesized
tttaaaccctgagttcctat

SEQ ID NO: 593055 - DNA, 20 bp, Artificial Sequence
  chemically synthesized
gcaaaactgaaataggaact

SEQ ID NO: 593056 - DNA, 20 bp, Artificial Sequence
  chemically synthesized
acgacacaggttataagtag

SEQ ID NO: 593057 - DNA, 20 bp, Artificial Sequence
  chemically synthesized
tttgtgtaaagtctatgacc

SEQ ID NO: 593058 - DNA, 20 bp, Artificial Sequence
  chemically synthesized
tggaaagacaccagatatgg

SEQ ID NO: 593059 - DNA, 20 bp, Artificial Sequence
  chemically synthesized
ctctgttcgatgctttgtta

SEQ ID NO: 593060 - DNA, 20 bp, Artificial Sequence
  chemically synthesized
tttctttcagatcctctgtt

SEQ ID NO: 593061 - DNA, 20 bp, Artificial Sequence
  chemically synthesized
aacagaaactcaatgaaata

SEQ ID NO: 593062 - DNA, 20 bp, Artificial Sequence
  chemically synthesized
ctgataagctagatatttca

SEQ ID NO: 593063 - DNA, 20 bp, Artificial Sequence
  chemically synthesized
gattagaggtggggccttag

SEQ ID NO: 593064 - DNA, 20 bp, Artificial Sequence
  chemically synthesized
tttaatttttggctaaggta

SEQ ID NO: 593065 - DNA, 20 bp, Artificial Sequence
  chemically synthesized
aattaaataccaaggacagt

SEQ ID NO: 593066 - DNA, 20 bp, Artificial Sequence
  chemically synthesized
taaaaatgtatactgtatct

SEQ ID NO: 593067 - DNA, 20 bp, Artificial Sequence
  chemically synthesized
gtcaagagttatgctgcaaa

SEQ ID NO: 593068 - DNA, 20 bp, Artificial Sequence
  chemically synthesized
atatactgacaatcctcaaa

SEQ ID NO: 593069 - DNA, 20 bp, Artificial Sequence
  chemically synthesized
caaagctgaaaaacaaaatt

SEQ ID NO: 593070 - DNA, 20 bp, Artificial Sequence
  chemically synthesized
acaatcctcaaattttgttt

SEQ ID NO: 593071 - DNA, 20 bp, Artificial Sequence
  chemically synthesized
cctcaaattttgtttttcag

SEQ ID NO: 593072 - DNA, 20 bp, Artificial Sequence
  chemically synthesized
ttgtttttcagctttgcttc

SEQ ID NO: 593073 - DNA, 20 bp, Artificial Sequence
  chemically synthesized
tagaatgaggcagtgtcatg

SEQ ID NO: 593074 - DNA, 20 bp, Artificial Sequence
  chemically synthesized
cattggtaactattttttgg

SEQ ID NO: 593075 - DNA, 20 bp, Artificial Sequence
  chemically synthesized
caacaccaaaaaatagttac

SEQ ID NO: 593076 - DNA, 20 bp, Artificial Sequence
  chemically synthesized
gacagtcagaagagtatgag

SEQ ID NO: 593077 - DNA, 20 bp, Artificial Sequence
  chemically synthesized
gagtatgagtaatgtttttc

SEQ ID NO: 593078 - DNA, 20 bp, Artificial Sequence
  chemically synthesized
agagaagctggtattacatt

SEQ ID NO: 593079 - DNA, 20 bp, Artificial Sequence
  chemically synthesized
ttaaaatcctacaatgtaat

SEQ ID NO: 593080 - DNA, 20 bp, Artificial Sequence
  chemically synthesized
ttcctacttaaaggagatca

SEQ ID NO: 593081 - DNA, 20 bp, Artificial Sequence
  chemically synthesized
aggagatcataacgattgaa

SEQ ID NO: 593082 - DNA, 20 bp, Artificial Sequence
  chemically synthesized
attggcttatttgaatgtaa

SEQ ID NO: 593083 - DNA, 20 bp, Artificial Sequence
  chemically synthesized
tctttcatttcacatttgtc

SEQ ID NO: 593084 - DNA, 20 bp, Artificial Sequence
  chemically synthesized
tttctttggcttttaggatg

SEQ ID NO: 593085 - DNA, 20 bp, Artificial Sequence
  chemically synthesized
gtcccttatagcagtttttc

SEQ ID NO: 593086 - DNA, 20 bp, Artificial Sequence
  chemically synthesized
ctgattgagaagtcccttat

SEQ ID NO: 593087 - DNA, 20 bp, Artificial Sequence
  chemically synthesized
taccaattcctatctatagg

SEQ ID NO: 593088 - DNA, 20 bp, Artificial Sequence
  chemically synthesized
ttctacagaaaacattatgt

SEQ ID NO: 593089 - DNA, 20 bp, Artificial Sequence
  chemically synthesized
caaggaaaaaatcttggaca

SEQ ID NO: 593090 - DNA, 20 bp, Artificial Sequence
  chemically synthesized
attatgtccaagattttttc

SEQ ID NO: 593091 - DNA, 20 bp, Artificial Sequence
  chemically synthesized
tccaagattttttccttggc

SEQ ID NO: 593092 - DNA, 20 bp, Artificial Sequence
  chemically synthesized
ggcttctgatttcgaggcca

SEQ ID NO: 593093 - DNA, 20 bp, Artificial Sequence
  chemically synthesized
ctttttatttccaaaggttg

SEQ ID NO: 593094 - DNA, 20 bp, Artificial Sequence
  chemically synthesized
tgagaaaggaaggatagaag

SEQ ID NO: 593095 - DNA, 20 bp, Artificial Sequence
  chemically synthesized
aagccagcttaaaaagactt

SEQ ID NO: 593096 - DNA, 20 bp, Artificial Sequence
  chemically synthesized
aaacctttaagtctttttaa

SEQ ID NO: 593097 - DNA, 20 bp, Artificial Sequence
  chemically synthesized
aaagcgtaagggggaaaaaa

SEQ ID NO: 593098 - DNA, 20 bp, Artificial Sequence
  chemically synthesized
taagctggcttttttccccc

SEQ ID NO: 593099 - DNA, 20 bp, Artificial Sequence
  chemically synthesized
ggcttttttcccccttacgc

SEQ ID NO: 593100 - DNA, 20 bp, Artificial Sequence
  chemically synthesized
aacaagggggtgaggacact

SEQ ID NO: 593101 - DNA, 20 bp, Artificial Sequence
  chemically synthesized
gcaagtggtgcagaaataag

SEQ ID NO: 593102 - DNA, 20 bp, Artificial Sequence
  chemically synthesized
gtgcagaaataagagcagat

SEQ ID NO: 593103 - DNA, 20 bp, Artificial Sequence
  chemically synthesized
tggcttttgctacatatact

SEQ ID NO: 593104 - DNA, 20 bp, Artificial Sequence
  chemically synthesized
tttggatttacagatcaagt

SEQ ID NO: 593105 - DNA, 20 bp, Artificial Sequence
  chemically synthesized
agatcaagtgtaggttttca

SEQ ID NO: 593106 - DNA, 20 bp, Artificial Sequence
  chemically synthesized
cagaattatcaatggataaa

SEQ ID NO: 593107 - DNA, 20 bp, Artificial Sequence
  chemically synthesized
tttattattttctattgaca

SEQ ID NO: 593108 - DNA, 20 bp, Artificial Sequence
  chemically synthesized
atatatatatatatgtgaaa

SEQ ID NO: 593109 - DNA, 20 bp, Artificial Sequence
  chemically synthesized
ttatgggaatttatacagaa

SEQ ID NO: 593110 - DNA, 20 bp, Artificial Sequence
  chemically synthesized
tgatatgatctatagttaaa

SEQ ID NO: 593111 - DNA, 20 bp, Artificial Sequence
  chemically synthesized
ctcctctggttaaaaacccc

SEQ ID NO: 593112 - DNA, 20 bp, Artificial Sequence
  chemically synthesized
taaattaaatgttaagccat

SEQ ID NO: 593113 - DNA, 20 bp, Artificial Sequence
  chemically synthesized
gttgtaaagagttgggcttt

SEQ ID NO: 593114 - DNA, 20 bp, Artificial Sequence
  chemically synthesized
ttccgggacgttgtaaagag

SEQ ID NO: 593115 - DNA, 20 bp, Artificial Sequence
  chemically synthesized
cctacttgaggaaaagtgtg

SEQ ID NO: 593116 - DNA, 20 bp, Artificial Sequence
  chemically synthesized
gctaagttgactatgcaatt

SEQ ID NO: 593117 - DNA, 20 bp, Artificial Sequence
  chemically synthesized
tgactatgcaattgcacgct

SEQ ID NO: 593118 - DNA, 20 bp, Artificial Sequence
  chemically synthesized
tcctcaaacaaaagtccttc

SEQ ID NO: 593119 - DNA, 20 bp, Artificial Sequence
  chemically synthesized
cagagaagccagagaaggac

SEQ ID NO: 593120 - DNA, 20 bp, Artificial Sequence
  chemically synthesized
ctccacggcctcccaaagtg

SEQ ID NO: 593121 - DNA, 20 bp, Artificial Sequence
  chemically synthesized
ttttgtatttttagtagaga

SEQ ID NO: 593122 - DNA, 20 bp, Artificial Sequence
  chemically synthesized
tgcctcagcctaccgagtag

SEQ ID NO: 593123 - DNA, 20 bp, Artificial Sequence
  chemically synthesized
aacctctgcctcccgggttc

SEQ ID NO: 593124 - DNA, 20 bp, Artificial Sequence
  chemically synthesized
agatgttaaaaaataacaat

SEQ ID NO: 593125 - DNA, 20 bp, Artificial Sequence
  chemically synthesized
gatccttgagagtaagaact

SEQ ID NO: 593126 - DNA, 20 bp, Artificial Sequence
  chemically synthesized
tgagagtaagaactttttgc

SEQ ID NO: 593127 - DNA, 20 bp, Artificial Sequence
  chemically synthesized
ttgattatcttctatatgcc

SEQ ID NO: 593128 - DNA, 20 bp, Artificial Sequence
  chemically synthesized
atagaagataatcaatggat

SEQ ID NO: 593129 - DNA, 20 bp, Artificial Sequence
  chemically synthesized
tgtttgttcaatcacctatc

SEQ ID NO: 593130 - DNA, 20 bp, Artificial Sequence
  chemically synthesized
aactcgtacctgtttcaaag

SEQ ID NO: 593131 - DNA, 20 bp, Artificial Sequence
  chemically synthesized
aacagctctttgaaacaggt

SEQ ID NO: 593132 - DNA, 20 bp, Artificial Sequence
  chemically synthesized
aagataacaagaaaactcgt

SEQ ID NO: 593133 - DNA, 20 bp, Artificial Sequence
  chemically synthesized
tcttaaggataaaaaattcc

SEQ ID NO: 593134 - DNA, 20 bp, Artificial Sequence
  chemically synthesized
tggacacattgtgatggagc

SEQ ID NO: 593135 - DNA, 20 bp, Artificial Sequence
  chemically synthesized
ctcataatacatgataatat

SEQ ID NO: 593136 - DNA, 20 bp, Artificial Sequence
  chemically synthesized
ttgaagttatcttagtttta

SEQ ID NO: 593137 - DNA, 20 bp, Artificial Sequence
  chemically synthesized
acccattttcttgaagttat

SEQ ID NO: 593138 - DNA, 20 bp, Artificial Sequence
  chemically synthesized
taaaacagcagcagtagaac

SEQ ID NO: 593139 - DNA, 20 bp, Artificial Sequence
  chemically synthesized
ttaatcctctgttctactgc

SEQ ID NO: 593140 - DNA, 20 bp, Artificial Sequence
  chemically synthesized
cgtattcagtggaaaatatt

SEQ ID NO: 593141 - DNA, 20 bp, Artificial Sequence
  chemically synthesized
ctatacttcacaatatggcc

SEQ ID NO: 593142 - DNA, 20 bp, Artificial Sequence
  chemically synthesized
cagaagacctcagtgccaga

SEQ ID NO: 593143 - DNA, 20 bp, Artificial Sequence
  chemically synthesized
ccttgaggttgatatgacag

SEQ ID NO: 593144 - DNA, 20 bp, Artificial Sequence
  chemically synthesized
atatccctctggcatttaaa

SEQ ID NO: 593145 - DNA, 20 bp, Artificial Sequence
  chemically synthesized
catcattgttatttagggat

SEQ ID NO: 593146 - DNA, 20 bp, Artificial Sequence
  chemically synthesized
aatatatgttactgaacaca

SEQ ID NO: 593147 - DNA, 20 bp, Artificial Sequence
  chemically synthesized
aaatacaatattaatagata

SEQ ID NO: 593148 - DNA, 20 bp, Artificial Sequence
  chemically synthesized
aatgcttacctataaggtca

SEQ ID NO: 593149 - DNA, 20 bp, Artificial Sequence
  chemically synthesized
tcaatttgttttgacctaaa

SEQ ID NO: 593150 - DNA, 20 bp, Artificial Sequence
  chemically synthesized
gtaatttgaccatgatggac

SEQ ID NO: 593151 - DNA, 20 bp, Artificial Sequence
  chemically synthesized
gagatgcataaaatttgatg

SEQ ID NO: 593152 - DNA, 20 bp, Artificial Sequence
  chemically synthesized
tgtggatttaaatgtgtgag

SEQ ID NO: 593153 - DNA, 20 bp, Artificial Sequence
  chemically synthesized
tccctacctcactaggatgt

SEQ ID NO: 593154 - DNA, 20 bp, Artificial Sequence
  chemically synthesized
tgaggcacaaggaggttaat

SEQ ID NO: 593155 - DNA, 20 bp, Artificial Sequence
  chemically synthesized
ccaaccatggttttgctgct

SEQ ID NO: 593156 - DNA, 20 bp, Artificial Sequence
  chemically synthesized
cagggaacctaaattccaac

SEQ ID NO: 593157 - DNA, 20 bp, Artificial Sequence
  chemically synthesized
tctcagtggttgaattagca

SEQ ID NO: 593158 - DNA, 20 bp, Artificial Sequence
  chemically synthesized
aataatacgtggacctgcgc

SEQ ID NO: 593159 - DNA, 20 bp, Artificial Sequence
  chemically synthesized
acgtggacctgcgctggaga

SEQ ID NO: 593160 - DNA, 20 bp, Artificial Sequence
  chemically synthesized
cacattataccactgaatta

SEQ ID NO: 593161 - DNA, 20 bp, Artificial Sequence
  chemically synthesized
catgttatatctaaaaaaat

SEQ ID NO: 593162 - DNA, 20 bp, Artificial Sequence
  chemically synthesized
agtaaaaggagacccaaaat

SEQ ID NO: 593163 - DNA, 20 bp, Artificial Sequence
  chemically synthesized
gtaggttttgaaaatagaac

SEQ ID NO: 593164 - DNA, 20 bp, Artificial Sequence
  chemically synthesized
tttttgaggacaccacacac

SEQ ID NO: 593165 - DNA, 20 bp, Artificial Sequence
  chemically synthesized
gacagaggttgcagtgagcc

SEQ ID NO: 593166 - DNA, 20 bp, Artificial Sequence
  chemically synthesized
tctggaggctgaggcagaag

SEQ ID NO: 593167 - DNA, 20 bp, Artificial Sequence
  chemically synthesized
ttttgtatttttagtagaga

SEQ ID NO: 593168 - DNA, 20 bp, Artificial Sequence
  chemically synthesized
cgcctcggcctcccaaagta

SEQ ID NO: 593169 - DNA, 20 bp, Artificial Sequence
  chemically synthesized
cattccttttcattatcctg

SEQ ID NO: 593170 - DNA, 20 bp, Artificial Sequence
  chemically synthesized
taaggactctaacattaaga

SEQ ID NO: 593171 - DNA, 20 bp, Artificial Sequence
  chemically synthesized
ttagtgatacaatctgatat

SEQ ID NO: 593172 - DNA, 20 bp, Artificial Sequence
  chemically synthesized
ataacatttaaagctgtgat

SEQ ID NO: 593173 - DNA, 20 bp, Artificial Sequence
  chemically synthesized
gttggacgtttaaatttcgg

SEQ ID NO: 593174 - DNA, 20 bp, Artificial Sequence
  chemically synthesized
cagcaaaaaaggtccaggtt

SEQ ID NO: 593175 - DNA, 20 bp, Artificial Sequence
  chemically synthesized
taaagactatagatagaatg

SEQ ID NO: 593176 - DNA, 20 bp, Artificial Sequence
  chemically synthesized
ctatctatagtctttattat

SEQ ID NO: 593177 - DNA, 20 bp, Artificial Sequence
  chemically synthesized
gaatggctccaacgtttttg

SEQ ID NO: 593178 - DNA, 20 bp, Artificial Sequence
  chemically synthesized
aatggagtcatgaatggctc

SEQ ID NO: 593179 - DNA, 20 bp, Artificial Sequence
  chemically synthesized
gtgtttggaagtggggccaa

SEQ ID NO: 593180 - DNA, 20 bp, Artificial Sequence
  chemically synthesized
aagaaatagtcatattctga

SEQ ID NO: 593181 - DNA, 20 bp, Artificial Sequence
  chemically synthesized
aaagagaaaaacgtccttac

SEQ ID NO: 593182 - DNA, 20 bp, Artificial Sequence
  chemically synthesized
gacctttgaagccattgtaa

SEQ ID NO: 593183 - DNA, 20 bp, Artificial Sequence
  chemically synthesized
gctagagtgaagtaagtgag

SEQ ID NO: 593184 - DNA, 20 bp, Artificial Sequence
  chemically synthesized
tcctaagccatcggtttatc

SEQ ID NO: 593185 - DNA, 20 bp, Artificial Sequence
  chemically synthesized
ccccaaacagcagataaacc

SEQ ID NO: 593186 - DNA, 20 bp, Artificial Sequence
  chemically synthesized
caatgcagaattcctaagcc

SEQ ID NO: 593187 - DNA, 20 bp, Artificial Sequence
  chemically synthesized
tggcttaggaattctgcatt

SEQ ID NO: 593188 - DNA, 20 bp, Artificial Sequence
  chemically synthesized
gactgtttactgaacccaaa

SEQ ID NO: 593189 - DNA, 20 bp, Artificial Sequence
  chemically synthesized
tgagtttactgctgatatct

SEQ ID NO: 593190 - DNA, 20 bp, Artificial Sequence
  chemically synthesized
agcagaaaagatgtatgccc

SEQ ID NO: 593191 - DNA, 20 bp, Artificial Sequence
  chemically synthesized
atccagagggcatacatctt

SEQ ID NO: 593192 - DNA, 20 bp, Artificial Sequence
  chemically synthesized
catatgtcagccactactgt

SEQ ID NO: 593193 - DNA, 20 bp, Artificial Sequence
  chemically synthesized
ttcaactgcccagtcacaga

SEQ ID NO: 593194 - DNA, 20 bp, Artificial Sequence
  chemically synthesized
tacatgaacccacttccatt

SEQ ID NO: 593195 - DNA, 20 bp, Artificial Sequence
  chemically synthesized
gatgtctcctttgtttacat

SEQ ID NO: 593196 - DNA, 20 bp, Artificial Sequence
  chemically synthesized
agcatcttcacggatgtctc

SEQ ID NO: 593197 - DNA, 20 bp, Artificial Sequence
  chemically synthesized
acatccgtgaagatgctaat

SEQ ID NO: 593198 - DNA, 20 bp, Artificial Sequence
  chemically synthesized
aaaaaaagataaaataaact

SEQ ID NO: 593199 - DNA, 20 bp, Artificial Sequence
  chemically synthesized
aaccatgtcaccgttaaaca

SEQ ID NO: 593200 - DNA, 20 bp, Artificial Sequence
  chemically synthesized
aactatgtgtttaacggtga

SEQ ID NO: 593201 - DNA, 20 bp, Artificial Sequence
  chemically synthesized
aaaaagtatcctcagagatg

SEQ ID NO: 593202 - DNA, 20 bp, Artificial Sequence
  chemically synthesized
tttgcacccatggaatttat

SEQ ID NO: 593203 - DNA, 20 bp, Artificial Sequence
  chemically synthesized
ttattgcagtaggcttagaa

SEQ ID NO: 593204 - DNA, 20 bp, Artificial Sequence
  chemically synthesized
agagttctaagcctactgca

SEQ ID NO: 593205 - DNA, 20 bp, Artificial Sequence
  chemically synthesized
taaagtcaaatcttattgca

SEQ ID NO: 593206 - DNA, 20 bp, Artificial Sequence
  chemically synthesized
ctgcaataagatttgacttt

SEQ ID NO: 593207 - DNA, 20 bp, Artificial Sequence
  chemically synthesized
tctttcaggaatgaagagat

SEQ ID NO: 593208 - DNA, 20 bp, Artificial Sequence
  chemically synthesized
tgtctaaatctgaaaattaa

SEQ ID NO: 593209 - DNA, 20 bp, Artificial Sequence
  chemically synthesized
ttacagaatccttgttaatt

SEQ ID NO: 593210 - DNA, 20 bp, Artificial Sequence
  chemically synthesized
ttccccaaactaaaaggtat

SEQ ID NO: 593211 - DNA, 20 bp, Artificial Sequence
  chemically synthesized
tcaaataatctaggatacct

SEQ ID NO: 593212 - DNA, 20 bp, Artificial Sequence
  chemically synthesized
ctagattatttgagctatag

SEQ ID NO: 593213 - DNA, 20 bp, Artificial Sequence
  chemically synthesized
gctatagatgtgtttttatg

SEQ ID NO: 593214 - DNA, 20 bp, Artificial Sequence
  chemically synthesized
agtctcagagaactttccat

SEQ ID NO: 593215 - DNA, 20 bp, Artificial Sequence
  chemically synthesized
ggaaagttctctgagactaa

SEQ ID NO: 593216 - DNA, 20 bp, Artificial Sequence
  chemically synthesized
atttacatgcaaatatatgg

SEQ ID NO: 593217 - DNA, 20 bp, Artificial Sequence
  chemically synthesized
tcttaaaacagtaacaaaag

SEQ ID NO: 593218 - DNA, 20 bp, Artificial Sequence
  chemically synthesized
ttttcaaacacaccttttgt

SEQ ID NO: 593219 - DNA, 20 bp, Artificial Sequence
  chemically synthesized
caaaaggtgtgtttgaaaat

SEQ ID NO: 593220 - DNA, 20 bp, Artificial Sequence
  chemically synthesized
aattcatgctttggaagaat

SEQ ID NO: 593221 - DNA, 20 bp, Artificial Sequence
  chemically synthesized
ttcacataatcattctagta

SEQ ID NO: 593222 - DNA, 20 bp, Artificial Sequence
  chemically synthesized
taaaaataaacaacttacta

SEQ ID NO: 593223 - DNA, 20 bp, Artificial Sequence
  chemically synthesized
caccttggcctcccaaaatg

SEQ ID NO: 593224 - DNA, 20 bp, Artificial Sequence
  chemically synthesized
cattttgggaggccaaggtg

SEQ ID NO: 593225 - DNA, 20 bp, Artificial Sequence
  chemically synthesized
ttgggaggccaaggtgggca

SEQ ID NO: 593226 - DNA, 20 bp, Artificial Sequence
  chemically synthesized
tgggcagattgcttgagctc

SEQ ID NO: 593227 - DNA, 20 bp, Artificial Sequence
  chemically synthesized
tttgtatttttttttagaga

SEQ ID NO: 593228 - DNA, 20 bp, Artificial Sequence
  chemically synthesized
acaaagtcttgctctgctgc

SEQ ID NO: 593229 - DNA, 20 bp, Artificial Sequence
  chemically synthesized
taaaatattcaacaacttaa

SEQ ID NO: 593230 - DNA, 20 bp, Artificial Sequence
  chemically synthesized
tttctatttattttgatttg

SEQ ID NO: 593231 - DNA, 20 bp, Artificial Sequence
  chemically synthesized
taatatttgttttctattta

SEQ ID NO: 593232 - DNA, 20 bp, Artificial Sequence
  chemically synthesized
aatgactaaattttattaat

SEQ ID NO: 593233 - DNA, 20 bp, Artificial Sequence
  chemically synthesized
ttttaatacaacgaattcta

SEQ ID NO: 593234 - DNA, 20 bp, Artificial Sequence
  chemically synthesized
gaattcgttgtattaaaaaa

SEQ ID NO: 593235 - DNA, 20 bp, Artificial Sequence
  chemically synthesized
aattccccatgatttatgga

SEQ ID NO: 593236 - DNA, 20 bp, Artificial Sequence
  chemically synthesized
tcattaaaataaaaaattcc

SEQ ID NO: 593237 - DNA, 20 bp, Artificial Sequence
  chemically synthesized
agaaaattgtggaccttaag

SEQ ID NO: 593238 - DNA, 20 bp, Artificial Sequence
  chemically synthesized
tatttaaaaatagctaaaat

SEQ ID NO: 593239 - DNA, 20 bp, Artificial Sequence
  chemically synthesized
aaatattactaaaattaaaa

SEQ ID NO: 593240 - DNA, 20 bp, Artificial Sequence
  chemically synthesized
aaagcatttgatgtttaagg

SEQ ID NO: 593241 - DNA, 20 bp, Artificial Sequence
  chemically synthesized
taagccaacccttaaacatc

SEQ ID NO: 593242 - DNA, 20 bp, Artificial Sequence
  chemically synthesized
atatcccaaaagaaagcatt

SEQ ID NO: 593243 - DNA, 20 bp, Artificial Sequence
  chemically synthesized
cttttcaacttctggttccc

SEQ ID NO: 593244 - DNA, 20 bp, Artificial Sequence
  chemically synthesized
atgccccctgggcaaagaaa

SEQ ID NO: 593245 - DNA, 20 bp, Artificial Sequence
  chemically synthesized
attattctagtataaatgga

SEQ ID NO: 593246 - DNA, 20 bp, Artificial Sequence
  chemically synthesized
gacttcggctgccaggaatg

SEQ ID NO: 593247 - DNA, 20 bp, Artificial Sequence
  chemically synthesized
tgatttgctacctggctatt

SEQ ID NO: 593248 - DNA, 20 bp, Artificial Sequence
  chemically synthesized
atagccaggtagcaaatcaa

SEQ ID NO: 593249 - DNA, 20 bp, Artificial Sequence
  chemically synthesized
tcactttctcttgtaatctg

SEQ ID NO: 593250 - DNA, 20 bp, Artificial Sequence
  chemically synthesized
aagagaaagtgaacaagcaa

SEQ ID NO: 593251 - DNA, 20 bp, Artificial Sequence
  chemically synthesized
gttttgttttgtttaatctc

SEQ ID NO: 593252 - DNA, 20 bp, Artificial Sequence
  chemically synthesized
ttttgttttgttttgttttg

SEQ ID NO: 593253 - DNA, 20 bp, Artificial Sequence
  chemically synthesized
ttttgttttgttttgttttg

SEQ ID NO: 593254 - DNA, 20 bp, Artificial Sequence
  chemically synthesized
ttttgttttgttttgttttg

SEQ ID NO: 593255 - DNA, 20 bp, Artificial Sequence
  chemically synthesized
ttttgttttgttttgttttg

SEQ ID NO: 593256 - DNA, 20 bp, Artificial Sequence
  chemically synthesized
atttgttttgttttgttttg

SEQ ID NO: 593257 - DNA, 20 bp, Artificial Sequence
  chemically synthesized
ctaacatttgttttgttttg

SEQ ID NO: 593258 - DNA, 20 bp, Artificial Sequence
  chemically synthesized
aatctctaacatttgttttg

SEQ ID NO: 593259 - DNA, 20 bp, Artificial Sequence
  chemically synthesized
aaacaaaacaaaacaaatgt

SEQ ID NO: 593260 - DNA, 20 bp, Artificial Sequence
  chemically synthesized
gtcacaatctctaacatttg

SEQ ID NO: 593261 - DNA, 20 bp, Artificial Sequence
  chemically synthesized
ttcaagtcacaatctctaac

SEQ ID NO: 593262 - DNA, 20 bp, Artificial Sequence
  chemically synthesized
tgaatctcacaaaataatga

SEQ ID NO: 593263 - DNA, 20 bp, Artificial Sequence
  chemically synthesized
aaaaacagggtcattatttt

SEQ ID NO: 593264 - DNA, 20 bp, Artificial Sequence
  chemically synthesized
cattattttgtgagattcaa

SEQ ID NO: 593265 - DNA, 20 bp, Artificial Sequence
  chemically synthesized
tgagatgattaattttcaaa

SEQ ID NO: 593266 - DNA, 20 bp, Artificial Sequence
  chemically synthesized
attagaatttgtataccatg

SEQ ID NO: 593267 - DNA, 20 bp, Artificial Sequence
  chemically synthesized
aaagttctacttcatccatc

SEQ ID NO: 593268 - DNA, 20 bp, Artificial Sequence
  chemically synthesized
gatggatgaagtagaacttt

SEQ ID NO: 593269 - DNA, 20 bp, Artificial Sequence
  chemically synthesized
gaagggggagggatagcatt

SEQ ID NO: 593270 - DNA, 20 bp, Artificial Sequence
  chemically synthesized
ctgcacccactaactcgtca

SEQ ID NO: 593271 - DNA, 20 bp, Artificial Sequence
  chemically synthesized
tttaaatttattattatact

SEQ ID NO: 593272 - DNA, 20 bp, Artificial Sequence
  chemically synthesized
aataaacccacatttttaaa

SEQ ID NO: 593273 - DNA, 20 bp, Artificial Sequence
  chemically synthesized
ataaaactttttttaaaaat

SEQ ID NO: 593274 - DNA, 20 bp, Artificial Sequence
  chemically synthesized
ttttaaaaatgtgggtttat

SEQ ID NO: 593275 - DNA, 20 bp, Artificial Sequence
  chemically synthesized
attctagatttttaaatcta

SEQ ID NO: 593276 - DNA, 20 bp, Artificial Sequence
  chemically synthesized
tcagcattctaaataagcct

SEQ ID NO: 593277 - DNA, 20 bp, Artificial Sequence
  chemically synthesized
ggttcttcaagattaacttg

SEQ ID NO: 593278 - DNA, 20 bp, Artificial Sequence
  chemically synthesized
caattccaatatctggttct

SEQ ID NO: 593279 - DNA, 20 bp, Artificial Sequence
  chemically synthesized
tgctctcattaattcctccc

SEQ ID NO: 593280 - DNA, 20 bp, Artificial Sequence
  chemically synthesized
tgtaaaggaggcaccaacta

SEQ ID NO: 593281 - DNA, 20 bp, Artificial Sequence
  chemically synthesized
tattcctctgaccttgtaat

SEQ ID NO: 593282 - DNA, 20 bp, Artificial Sequence
  chemically synthesized
tctatactgttcaaatgggt

SEQ ID NO: 593283 - DNA, 20 bp, Artificial Sequence
  chemically synthesized
taggtttctatactgttcaa

SEQ ID NO: 593284 - DNA, 20 bp, Artificial Sequence
  chemically synthesized
tattagagttttttccatcc

SEQ ID NO: 593285 - DNA, 20 bp, Artificial Sequence
  chemically synthesized
ttcttgtagttttcttctat

SEQ ID NO: 593286 - DNA, 20 bp, Artificial Sequence
  chemically synthesized
tggcttacccctttggttct

SEQ ID NO: 593287 - DNA, 20 bp, Artificial Sequence
  chemically synthesized
attacctttgcagaggttgt

SEQ ID NO: 593288 - DNA, 20 bp, Artificial Sequence
  chemically synthesized
tgctatgtttagtggatgga

SEQ ID NO: 593289 - DNA, 20 bp, Artificial Sequence
  chemically synthesized
catccactaaacatagcatt

SEQ ID NO: 593290 - DNA, 20 bp, Artificial Sequence
  chemically synthesized
gagtgactaaacatataatg

SEQ ID NO: 593291 - DNA, 20 bp, Artificial Sequence
  chemically synthesized
ttcatttgaatacagttctc

SEQ ID NO: 593292 - DNA, 20 bp, Artificial Sequence
  chemically synthesized
gaactgtattcaaatgaaag

SEQ ID NO: 593293 - DNA, 20 bp, Artificial Sequence
  chemically synthesized
ttggactagggagtacctat

SEQ ID NO: 593294 - DNA, 20 bp, Artificial Sequence
  chemically synthesized
gtatgttgcatgatgaaaag

SEQ ID NO: 593295 - DNA, 20 bp, Artificial Sequence
  chemically synthesized
tgcatgatgaaaagcaaagt

SEQ ID NO: 593296 - DNA, 20 bp, Artificial Sequence
  chemically synthesized
caaaaacctgaaatcaaaaa

SEQ ID NO: 593297 - DNA, 20 bp, Artificial Sequence
  chemically synthesized
gaaaagcaaagtttttgatt

SEQ ID NO: 593298 - DNA, 20 bp, Artificial Sequence
  chemically synthesized
catggacagctccgaggcac

SEQ ID NO: 593299 - DNA, 20 bp, Artificial Sequence
  chemically synthesized
ctctaggccctgacttacaa

SEQ ID NO: 593300 - DNA, 20 bp, Artificial Sequence
  chemically synthesized
aaccctgctatgtcccctat

SEQ ID NO: 593301 - DNA, 20 bp, Artificial Sequence
  chemically synthesized
gaaatatttagtactgaaat

SEQ ID NO: 593302 - DNA, 20 bp, Artificial Sequence
  chemically synthesized
tgactaattataacagctct

SEQ ID NO: 593303 - DNA, 20 bp, Artificial Sequence
  chemically synthesized
attcttatgagggactaaag

SEQ ID NO: 593304 - DNA, 20 bp, Artificial Sequence
  chemically synthesized
ccaactggggacgagttggc

SEQ ID NO: 593305 - DNA, 20 bp, Artificial Sequence
  chemically synthesized
gttggagacaagagcagaaa

SEQ ID NO: 593306 - DNA, 20 bp, Artificial Sequence
  chemically synthesized
cagaaattttgattccacaa

SEQ ID NO: 593307 - DNA, 20 bp, Artificial Sequence
  chemically synthesized
aattttgattccacaaagct

SEQ ID NO: 593308 - DNA, 20 bp, Artificial Sequence
  chemically synthesized
atgtatgtgaggcctaatca

SEQ ID NO: 593309 - DNA, 20 bp, Artificial Sequence
  chemically synthesized
atcatctggaatcacacaac

SEQ ID NO: 593310 - DNA, 20 bp, Artificial Sequence
  chemically synthesized
tcataaatgaagcttcagtt

SEQ ID NO: 593311 - DNA, 20 bp, Artificial Sequence
  chemically synthesized
cactgtagcagtgtcataaa

SEQ ID NO: 593312 - DNA, 20 bp, Artificial Sequence
  chemically synthesized
agagatttgaagtaggataa

SEQ ID NO: 593313 - DNA, 20 bp, Artificial Sequence
  chemically synthesized
tgactctaaatatggtgcta

SEQ ID NO: 593314 - DNA, 20 bp, Artificial Sequence
  chemically synthesized
catatttagagtcattcaga

SEQ ID NO: 593315 - DNA, 20 bp, Artificial Sequence
  chemically synthesized
gtgagttgtttcaatgtagt

SEQ ID NO: 593316 - DNA, 20 bp, Artificial Sequence
  chemically synthesized
cttgaatatagggttaagtg

SEQ ID NO: 593317 - DNA, 20 bp, Artificial Sequence
  chemically synthesized
catttgacaggtgaattcat

SEQ ID NO: 593318 - DNA, 20 bp, Artificial Sequence
  chemically synthesized
caaatgaaaaaaataacacc

SEQ ID NO: 593319 - DNA, 20 bp, Artificial Sequence
  chemically synthesized
attttcagggtaatatgaga

SEQ ID NO: 593320 - DNA, 20 bp, Artificial Sequence
  chemically synthesized
taaatgatgcaagaatttaa

SEQ ID NO: 593321 - DNA, 20 bp, Artificial Sequence
  chemically synthesized
ctttatttcatctaatgaac

SEQ ID NO: 593322 - DNA, 20 bp, Artificial Sequence
  chemically synthesized
ttctatcatttgtctcatca

SEQ ID NO: 593323 - DNA, 20 bp, Artificial Sequence
  chemically synthesized
ggcatgacaggagctgtagc

SEQ ID NO: 593324 - DNA, 20 bp, Artificial Sequence
  chemically synthesized
tagtatggcatgacaggagc

SEQ ID NO: 593325 - DNA, 20 bp, Artificial Sequence
  chemically synthesized
gttaatccacataccaggca

SEQ ID NO: 593326 - DNA, 20 bp, Artificial Sequence
  chemically synthesized
cctaagctaagtgcctggta

SEQ ID NO: 593327 - DNA, 20 bp, Artificial Sequence
  chemically synthesized
ctaagtgatagagcaattgg

SEQ ID NO: 593328 - DNA, 20 bp, Artificial Sequence
  chemically synthesized
tccgtccagtggtctaagtt

SEQ ID NO: 593329 - DNA, 20 bp, Artificial Sequence
  chemically synthesized
caatttaggagctgttttct

SEQ ID NO: 593330 - DNA, 20 bp, Artificial Sequence
  chemically synthesized
agcaggtacagcaatttagg

SEQ ID NO: 593331 - DNA, 20 bp, Artificial Sequence
  chemically synthesized
aaattgctgtacctgctctc

SEQ ID NO: 593332 - DNA, 20 bp, Artificial Sequence
  chemically synthesized
attatgtgctggaaaatcgg

SEQ ID NO: 593333 - DNA, 20 bp, Artificial Sequence
  chemically synthesized
gtatgagaatgaataatcgt

SEQ ID NO: 593334 - DNA, 20 bp, Artificial Sequence
  chemically synthesized
gcagatgtcccctgttgggg

SEQ ID NO: 593335 - DNA, 20 bp, Artificial Sequence
  chemically synthesized
ctggatatagaagactcata

SEQ ID NO: 593336 - DNA, 20 bp, Artificial Sequence
  chemically synthesized
gttgagaatagtaagaacag

SEQ ID NO: 593337 - DNA, 20 bp, Artificial Sequence
  chemically synthesized
tttatggtgtcttaaggggc

SEQ ID NO: 593338 - DNA, 20 bp, Artificial Sequence
  chemically synthesized
aatatttatggtgtcttaag

SEQ ID NO: 593339 - DNA, 20 bp, Artificial Sequence
  chemically synthesized
tgactctataaatatattga

SEQ ID NO: 593340 - DNA, 20 bp, Artificial Sequence
  chemically synthesized
tattcatcaactgtaattca

SEQ ID NO: 593341 - DNA, 20 bp, Artificial Sequence
  chemically synthesized
tgtctttcagtgtcataact

SEQ ID NO: 593342 - DNA, 20 bp, Artificial Sequence
  chemically synthesized
gacactgaaagacatgatca

SEQ ID NO: 593343 - DNA, 20 bp, Artificial Sequence
  chemically synthesized
attcctgtgttatatagcaa

SEQ ID NO: 593344 - DNA, 20 bp, Artificial Sequence
  chemically synthesized
tacttgctatataacacagg

SEQ ID NO: 593345 - DNA, 20 bp, Artificial Sequence
  chemically synthesized
tcatcaccacaaagtaactt

SEQ ID NO: 593346 - DNA, 20 bp, Artificial Sequence
  chemically synthesized
ctaccactatcaagataaag

SEQ ID NO: 593347 - DNA, 20 bp, Artificial Sequence
  chemically synthesized
tctatgacattaaccatgtc

SEQ ID NO: 593348 - DNA, 20 bp, Artificial Sequence
  chemically synthesized
gtagaccttacttggatttc

SEQ ID NO: 593349 - DNA, 20 bp, Artificial Sequence
  chemically synthesized
caactagactgtagacctta

SEQ ID NO: 593350 - DNA, 20 bp, Artificial Sequence
  chemically synthesized
ccaagtaaggtctacagtct

SEQ ID NO: 593351 - DNA, 20 bp, Artificial Sequence
  chemically synthesized
gttgattgcactgtgccaat

SEQ ID NO: 593352 - DNA, 20 bp, Artificial Sequence
  chemically synthesized
actgtgccaatgtcagttta

SEQ ID NO: 593353 - DNA, 20 bp, Artificial Sequence
  chemically synthesized
gtatacacaggaaatctctg

SEQ ID NO: 593354 - DNA, 20 bp, Artificial Sequence
  chemically synthesized
aaggagttgcaaaaacagta

SEQ ID NO: 593355 - DNA, 20 bp, Artificial Sequence
  chemically synthesized
tataaagttttaagaatgtt

SEQ ID NO: 593356 - DNA, 20 bp, Artificial Sequence
  chemically synthesized
aaatttctataaagttttaa

SEQ ID NO: 593357 - DNA, 20 bp, Artificial Sequence
  chemically synthesized
gaaggcaggcaaaatttcta

SEQ ID NO: 593358 - DNA, 20 bp, Artificial Sequence
  chemically synthesized
tgtctggctaattcctaata

SEQ ID NO: 593359 - DNA, 20 bp, Artificial Sequence
  chemically synthesized
gttgatatagcaactatgtt

SEQ ID NO: 593360 - DNA, 20 bp, Artificial Sequence
  chemically synthesized
aaatcctgttgatatagcaa

SEQ ID NO: 593361 - DNA, 20 bp, Artificial Sequence
  chemically synthesized
aaaacatagttgctatatca

SEQ ID NO: 593362 - DNA, 20 bp, Artificial Sequence
  chemically synthesized
gaaaagtcattcacaccttc

SEQ ID NO: 593363 - DNA, 20 bp, Artificial Sequence
  chemically synthesized
actaaaattacttgttccac

SEQ ID NO: 593364 - DNA, 20 bp, Artificial Sequence
  chemically synthesized
ttgttccacccttgtttttg

SEQ ID NO: 593365 - DNA, 20 bp, Artificial Sequence
  chemically synthesized
agattagtgactaaatattg

SEQ ID NO: 593366 - DNA, 20 bp, Artificial Sequence
  chemically synthesized
gttttaaattctgtcatagc

SEQ ID NO: 593367 - DNA, 20 bp, Artificial Sequence
  chemically synthesized
gaatctgttttaaattctgt

SEQ ID NO: 593368 - DNA, 20 bp, Artificial Sequence
  chemically synthesized
taagctatgacagaatttaa

SEQ ID NO: 593369 - DNA, 20 bp, Artificial Sequence
  chemically synthesized
aatttaaaacagattcaatg

SEQ ID NO: 593370 - DNA, 20 bp, Artificial Sequence
  chemically synthesized
aattcaaatcatatcattga

SEQ ID NO: 593371 - DNA, 20 bp, Artificial Sequence
  chemically synthesized
agatgtgtgttgtggcatca

SEQ ID NO: 593372 - DNA, 20 bp, Artificial Sequence
  chemically synthesized
cagttccatttgagagaaga

SEQ ID NO: 593373 - DNA, 20 bp, Artificial Sequence
  chemically synthesized
atggaactgagttgttccta

SEQ ID NO: 593374 - DNA, 20 bp, Artificial Sequence
  chemically synthesized
gttcctaagatgtttaacta

SEQ ID NO: 593375 - DNA, 20 bp, Artificial Sequence
  chemically synthesized
aaatgggctgaattataaca

SEQ ID NO: 593376 - DNA, 20 bp, Artificial Sequence
  chemically synthesized
atttgcattgttaatttttt

SEQ ID NO: 593377 - DNA, 20 bp, Artificial Sequence
  chemically synthesized
ctacttttaaaatattttgt

SEQ ID NO: 593378 - DNA, 20 bp, Artificial Sequence
  chemically synthesized
gttaaattttatcccagtgt

SEQ ID NO: 593379 - DNA, 20 bp, Artificial Sequence
  chemically synthesized
cctttggataactgaatttt

SEQ ID NO: 593380 - DNA, 20 bp, Artificial Sequence
  chemically synthesized
ccttatcaactttgaaaagt

SEQ ID NO: 593381 - DNA, 20 bp, Artificial Sequence
  chemically synthesized
cttttcaaagttgataagga

SEQ ID NO: 593382 - DNA, 20 bp, Artificial Sequence
  chemically synthesized
ttatataggttattgtatta

SEQ ID NO: 593383 - DNA, 20 bp, Artificial Sequence
  chemically synthesized
acttgagactgggaagaaaa

SEQ ID NO: 593384 - DNA, 20 bp, Artificial Sequence
  chemically synthesized
gaagtgcctttcacctccca

SEQ ID NO: 593385 - DNA, 20 bp, Artificial Sequence
  chemically synthesized
ttgcgtctccacattttctc

SEQ ID NO: 593386 - DNA, 20 bp, Artificial Sequence
  chemically synthesized
cgagatctgttggttttatc

SEQ ID NO: 593387 - DNA, 20 bp, Artificial Sequence
  chemically synthesized
gaataagtctcacgagatct

SEQ ID NO: 593388 - DNA, 20 bp, Artificial Sequence
  chemically synthesized
cagtatgggggaaaccgccc

SEQ ID NO: 593389 - DNA, 20 bp, Artificial Sequence
  chemically synthesized
gaggtcatttgaatcatggg

SEQ ID NO: 593390 - DNA, 20 bp, Artificial Sequence
  chemically synthesized
ttatgggagtagaattcaag

SEQ ID NO: 593391 - DNA, 20 bp, Artificial Sequence
  chemically synthesized
atttttccttcaataactga

SEQ ID NO: 593392 - DNA, 20 bp, Artificial Sequence
  chemically synthesized
aaaatttggtggtgaaaatg

SEQ ID NO: 593393 - DNA, 20 bp, Artificial Sequence
  chemically synthesized
gcagctgcaggttatatctg

SEQ ID NO: 593394 - DNA, 20 bp, Artificial Sequence
  chemically synthesized
aacctgcagctgcagaacaa

SEQ ID NO: 593395 - DNA, 20 bp, Artificial Sequence
  chemically synthesized
cagctgcagaacaattaggt

SEQ ID NO: 593396 - DNA, 20 bp, Artificial Sequence
  chemically synthesized
caattaggtttatgtttttg

SEQ ID NO: 593397 - DNA, 20 bp, Artificial Sequence
  chemically synthesized
accatgcagagcaatgtatc

SEQ ID NO: 593398 - DNA, 20 bp, Artificial Sequence
  chemically synthesized
cattgctctgcatggtacat

SEQ ID NO: 593399 - DNA, 20 bp, Artificial Sequence
  chemically synthesized
atgttactgcatagggagta

SEQ ID NO: 593400 - DNA, 20 bp, Artificial Sequence
  chemically synthesized
cgactcagcctcccaaagtg

SEQ ID NO: 593401 - DNA, 20 bp, Artificial Sequence
  chemically synthesized
ttttgtatttttagtagaga

SEQ ID NO: 593402 - DNA, 20 bp, Artificial Sequence
  chemically synthesized
gcccacaaccacgccaggct

SEQ ID NO: 593403 - DNA, 20 bp, Artificial Sequence
  chemically synthesized
ttgtgggcgcctctaatccc

SEQ ID NO: 593404 - DNA, 20 bp, Artificial Sequence
  chemically synthesized
tgcctcggcctcccaagcag

SEQ ID NO: 593405 - DNA, 20 bp, Artificial Sequence
  chemically synthesized
aacctccacctcccgggttc

SEQ ID NO: 593406 - DNA, 20 bp, Artificial Sequence
  chemically synthesized
gtttttgtttttgtttttgt

SEQ ID NO: 593407 - DNA, 20 bp, Artificial Sequence
  chemically synthesized
gtttttgtttttgtttttgt

SEQ ID NO: 593408 - DNA, 20 bp, Artificial Sequence
  chemically synthesized
gtttttgtttttgtttttgt

SEQ ID NO: 593409 - DNA, 20 bp, Artificial Sequence
  chemically synthesized
tgttttgtttttgtttttgt

SEQ ID NO: 593410 - DNA, 20 bp, Artificial Sequence
  chemically synthesized
ttaacgtgttttgtttttgt

SEQ ID NO: 593411 - DNA, 20 bp, Artificial Sequence
  chemically synthesized
agagaattaacgtgttttgt

SEQ ID NO: 593412 - DNA, 20 bp, Artificial Sequence
  chemically synthesized
tttagaagagaattaacgtg

SEQ ID NO: 593413 - DNA, 20 bp, Artificial Sequence
  chemically synthesized
ggccatttagaagagaatta

SEQ ID NO: 593414 - DNA, 20 bp, Artificial Sequence
  chemically synthesized
agcaaaggagaataaaaatt

SEQ ID NO: 593415 - DNA, 20 bp, Artificial Sequence
  chemically synthesized
gttctttaaaaataggaata

SEQ ID NO: 593416 - DNA, 20 bp, Artificial Sequence
  chemically synthesized
cactctatattatattgaat

SEQ ID NO: 593417 - DNA, 20 bp, Artificial Sequence
  chemically synthesized
cacacacacacacgatcttg

SEQ ID NO: 593418 - DNA, 20 bp, Artificial Sequence
  chemically synthesized
gttaatttttaaattaaaat

SEQ ID NO: 593419 - DNA, 20 bp, Artificial Sequence
  chemically synthesized
aacagacacaatgaatatgt

SEQ ID NO: 593420 - DNA, 20 bp, Artificial Sequence
  chemically synthesized
catgaaggaaggtatgttgc

SEQ ID NO: 593421 - DNA, 20 bp, Artificial Sequence
  chemically synthesized
tggcaacataccttccttca

SEQ ID NO: 593422 - DNA, 20 bp, Artificial Sequence
  chemically synthesized
ctccttgtttctgtttcctg

SEQ ID NO: 593423 - DNA, 20 bp, Artificial Sequence
  chemically synthesized
tctatagctcagctccttgt

SEQ ID NO: 593424 - DNA, 20 bp, Artificial Sequence
  chemically synthesized
cattattctatagctcagct

SEQ ID NO: 593425 - DNA, 20 bp, Artificial Sequence
  chemically synthesized
ctctccaggactctccttgg

SEQ ID NO: 593426 - DNA, 20 bp, Artificial Sequence
  chemically synthesized
tcgtgtcttctatatagcct

SEQ ID NO: 593427 - DNA, 20 bp, Artificial Sequence
  chemically synthesized
gccctgaggctatatagaag

SEQ ID NO: 593428 - DNA, 20 bp, Artificial Sequence
  chemically synthesized
agcaaatcccccttgatgtg

SEQ ID NO: 593429 - DNA, 20 bp, Artificial Sequence
  chemically synthesized
attaaaacttcccacatcaa

SEQ ID NO: 593430 - DNA, 20 bp, Artificial Sequence
  chemically synthesized
gggggatttgctgactctcc

SEQ ID NO: 593431 - DNA, 20 bp, Artificial Sequence
  chemically synthesized
ttccatcctctgagaaaaag

SEQ ID NO: 593432 - DNA, 20 bp, Artificial Sequence
  chemically synthesized
gaaaaagagaggttttgaca

SEQ ID NO: 593433 - DNA, 20 bp, Artificial Sequence
  chemically synthesized
gaggttttgacaaagggctt

SEQ ID NO: 593434 - DNA, 20 bp, Artificial Sequence
  chemically synthesized
gacaaagggctttaaagttt

SEQ ID NO: 593435 - DNA, 20 bp, Artificial Sequence
  chemically synthesized
ttgcacttgctgagtcccct

SEQ ID NO: 593436 - DNA, 20 bp, Artificial Sequence
  chemically synthesized
gtgcatattcttaaccgtta

SEQ ID NO: 593437 - DNA, 20 bp, Artificial Sequence
  chemically synthesized
atattatcatggacttagtc

SEQ ID NO: 593438 - DNA, 20 bp, Artificial Sequence
  chemically synthesized
tactccatgctacgaccttg

SEQ ID NO: 593439 - DNA, 20 bp, Artificial Sequence
  chemically synthesized
tattggggttcagaatttag

SEQ ID NO: 593440 - DNA, 20 bp, Artificial Sequence
  chemically synthesized
gcttttactttaatgtatcc

SEQ ID NO: 593441 - DNA, 20 bp, Artificial Sequence
  chemically synthesized
cattaaagtaaaagctctgt

SEQ ID NO: 593442 - DNA, 20 bp, Artificial Sequence
  chemically synthesized
gctattctaacaagcatgca

SEQ ID NO: 593443 - DNA, 20 bp, Artificial Sequence
  chemically synthesized
ttcttcaattatgacgatgc

SEQ ID NO: 593444 - DNA, 20 bp, Artificial Sequence
  chemically synthesized
ttgaatgctgagtgaatact

SEQ ID NO: 593445 - DNA, 20 bp, Artificial Sequence
  chemically synthesized
agaaaaccgtgttgagtgaa

SEQ ID NO: 593446 - DNA, 20 bp, Artificial Sequence
  chemically synthesized
acaaatcacccttcactcaa

SEQ ID NO: 593447 - DNA, 20 bp, Artificial Sequence
  chemically synthesized
tagagcccctccatcctatc

SEQ ID NO: 593448 - DNA, 20 bp, Artificial Sequence
  chemically synthesized
cctatctctggatttgcata

SEQ ID NO: 593449 - DNA, 20 bp, Artificial Sequence
  chemically synthesized
aagtaatacatgaacataac

SEQ ID NO: 593450 - DNA, 20 bp, Artificial Sequence
  chemically synthesized
agggttatgttcatgtatta

SEQ ID NO: 593451 - DNA, 20 bp, Artificial Sequence
  chemically synthesized
atggaattaaatgccattgc

SEQ ID NO: 593452 - DNA, 20 bp, Artificial Sequence
  chemically synthesized
gatagtttcttttacacggg

SEQ ID NO: 593453 - DNA, 20 bp, Artificial Sequence
  chemically synthesized
agttgtgtaactaggtaaag

SEQ ID NO: 593454 - DNA, 20 bp, Artificial Sequence
  chemically synthesized
aaatatattacaggattatc

SEQ ID NO: 593455 - DNA, 20 bp, Artificial Sequence
  chemically synthesized
ctgtgctggagaaatatatt

SEQ ID NO: 593456 - DNA, 20 bp, Artificial Sequence
  chemically synthesized
ctagcctcttgctcaatact

SEQ ID NO: 593457 - DNA, 20 bp, Artificial Sequence
  chemically synthesized
agtgttcattatttagattg

SEQ ID NO: 593458 - DNA, 20 bp, Artificial Sequence
  chemically synthesized
catacaattagtgttcatta

SEQ ID NO: 593459 - DNA, 20 bp, Artificial Sequence
  chemically synthesized
aatggcgtgaacccgggagg

SEQ ID NO: 593460 - DNA, 20 bp, Artificial Sequence
  chemically synthesized
tttgtattttttagtagaga

SEQ ID NO: 593461 - DNA, 20 bp, Artificial Sequence
  chemically synthesized
cgcctcggcctcccaaagtg

SEQ ID NO: 593462 - DNA, 20 bp, Artificial Sequence
  chemically synthesized
ccggccacaaatacatcttt

SEQ ID NO: 593463 - DNA, 20 bp, Artificial Sequence
  chemically synthesized
aactaaatccttgtatttca

SEQ ID NO: 593464 - DNA, 20 bp, Artificial Sequence
  chemically synthesized
ctcataatcacattgaaata

SEQ ID NO: 593465 - DNA, 20 bp, Artificial Sequence
  chemically synthesized
tgattatgaggcccaagaaa

SEQ ID NO: 593466 - DNA, 20 bp, Artificial Sequence
  chemically synthesized
gtgggagatgggcaagtctt

SEQ ID NO: 593467 - DNA, 20 bp, Artificial Sequence
  chemically synthesized
gattagaagaattatttgcc

SEQ ID NO: 593468 - DNA, 20 bp, Artificial Sequence
  chemically synthesized
gtaggcaaataattcttcta

SEQ ID NO: 593469 - DNA, 20 bp, Artificial Sequence
  chemically synthesized
tatcttaataaagaaataaa

SEQ ID NO: 593470 - DNA, 20 bp, Artificial Sequence
  chemically synthesized
ccatagaacattgtgacctc

SEQ ID NO: 593471 - DNA, 20 bp, Artificial Sequence
  chemically synthesized
tagattttgccttaggaatt

SEQ ID NO: 593472 - DNA, 20 bp, Artificial Sequence
  chemically synthesized
catcttctataattgtgtca

SEQ ID NO: 593473 - DNA, 20 bp, Artificial Sequence
  chemically synthesized
acaattatagaagatgccgc

SEQ ID NO: 593474 - DNA, 20 bp, Artificial Sequence
  chemically synthesized
atgattctatggcaacagaa

SEQ ID NO: 593475 - DNA, 20 bp, Artificial Sequence
  chemically synthesized
cttcaaagttggcagatttg

SEQ ID NO: 593476 - DNA, 20 bp, Artificial Sequence
  chemically synthesized
aggagttcagcttcaaagtt

SEQ ID NO: 593477 - DNA, 20 bp, Artificial Sequence
  chemically synthesized
atgagtggaatggagaggag

SEQ ID NO: 593478 - DNA, 20 bp, Artificial Sequence
  chemically synthesized
actcctctccattccactca

SEQ ID NO: 593479 - DNA, 20 bp, Artificial Sequence
  chemically synthesized
ccactcatatggattctcac

SEQ ID NO: 593480 - DNA, 20 bp, Artificial Sequence
  chemically synthesized
gaaaaatcagtccatgttct

SEQ ID NO: 593481 - DNA, 20 bp, Artificial Sequence
  chemically synthesized
atttaaactattagaacatg

SEQ ID NO: 593482 - DNA, 20 bp, Artificial Sequence
  chemically synthesized
agaacatggactgatttttc

SEQ ID NO: 593483 - DNA, 20 bp, Artificial Sequence
  chemically synthesized
ggattattaaatgagaaggg

SEQ ID NO: 593484 - DNA, 20 bp, Artificial Sequence
  chemically synthesized
catgctgaggattggtttgt

SEQ ID NO: 593485 - DNA, 20 bp, Artificial Sequence
  chemically synthesized
ctgtaatatacatgctgagg

SEQ ID NO: 593486 - DNA, 20 bp, Artificial Sequence
  chemically synthesized
gttctctgtaatatacatgc

SEQ ID NO: 593487 - DNA, 20 bp, Artificial Sequence
  chemically synthesized
ttttggtaaaattacttaaa

SEQ ID NO: 593488 - DNA, 20 bp, Artificial Sequence
  chemically synthesized
ttagaggcaacttttattca

SEQ ID NO: 593489 - DNA, 20 bp, Artificial Sequence
  chemically synthesized
ttgaataaaagttgcctcta

SEQ ID NO: 593490 - DNA, 20 bp, Artificial Sequence
  chemically synthesized
acggatacaactttaaaaag

SEQ ID NO: 593491 - DNA, 20 bp, Artificial Sequence
  chemically synthesized
tattattatgtcctgttaaa

SEQ ID NO: 593492 - DNA, 20 bp, Artificial Sequence
  chemically synthesized
gccatgacaattttatttat

SEQ ID NO: 593493 - DNA, 20 bp, Artificial Sequence
  chemically synthesized
tttaacatcatgaagactaa

SEQ ID NO: 593494 - DNA, 20 bp, Artificial Sequence
  chemically synthesized
atgtccttgcctaattgcat

SEQ ID NO: 593495 - DNA, 20 bp, Artificial Sequence
  chemically synthesized
gtggctcacgtctggaattc

SEQ ID NO: 593496 - DNA, 20 bp, Artificial Sequence
  chemically synthesized
acctcaggtgatccaccctc

SEQ ID NO: 593497 - DNA, 20 bp, Artificial Sequence
  chemically synthesized
tgcctcagcctccctagtag

SEQ ID NO: 593498 - DNA, 20 bp, Artificial Sequence
  chemically synthesized
tagggaggctgaggcaggag

SEQ ID NO: 593499 - DNA, 20 bp, Artificial Sequence
  chemically synthesized
aacctctaccacccaggttc

SEQ ID NO: 593500 - DNA, 20 bp, Artificial Sequence
  chemically synthesized
gattgactgattcattgaga

SEQ ID NO: 593501 - DNA, 20 bp, Artificial Sequence
  chemically synthesized
gtgaatttgattgattgatt

SEQ ID NO: 593502 - DNA, 20 bp, Artificial Sequence
  chemically synthesized
ttcaaagtgtgaatttgatt

SEQ ID NO: 593503 - DNA, 20 bp, Artificial Sequence
  chemically synthesized
agatttcaaagtgtgaattt

SEQ ID NO: 593504 - DNA, 20 bp, Artificial Sequence
  chemically synthesized
aaatagatttcaaagtgtga

SEQ ID NO: 593505 - DNA, 20 bp, Artificial Sequence
  chemically synthesized
atgattatatactttcaaaa

SEQ ID NO: 593506 - DNA, 20 bp, Artificial Sequence
  chemically synthesized
gggttttgtttggttttcat

SEQ ID NO: 593507 - DNA, 20 bp, Artificial Sequence
  chemically synthesized
tttagccagtgagggttttg

SEQ ID NO: 593508 - DNA, 20 bp, Artificial Sequence
  chemically synthesized
gttgttttagccagtgaggg

SEQ ID NO: 593509 - DNA, 20 bp, Artificial Sequence
  chemically synthesized
atcatgttgttttagccagt

SEQ ID NO: 593510 - DNA, 20 bp, Artificial Sequence
  chemically synthesized
tcacttttatgtttccatca

SEQ ID NO: 593511 - DNA, 20 bp, Artificial Sequence
  chemically synthesized
tgatggaaacataaaagtga

SEQ ID NO: 593512 - DNA, 20 bp, Artificial Sequence
  chemically synthesized
ggtcttaaactttgtcactt

SEQ ID NO: 593513 - DNA, 20 bp, Artificial Sequence
  chemically synthesized
cactgttagaaatttgctgg

SEQ ID NO: 593514 - DNA, 20 bp, Artificial Sequence
  chemically synthesized
gaatgtgttaccactattca

SEQ ID NO: 593515 - DNA, 20 bp, Artificial Sequence
  chemically synthesized
gtggtaacacattcagttat

SEQ ID NO: 593516 - DNA, 20 bp, Artificial Sequence
  chemically synthesized
cttggaaaaaaacagtccca

SEQ ID NO: 593517 - DNA, 20 bp, Artificial Sequence
  chemically synthesized
ttccctttcaaactccttgg

SEQ ID NO: 593518 - DNA, 20 bp, Artificial Sequence
  chemically synthesized
cccaaggagtttgaaaggga

SEQ ID NO: 593519 - DNA, 20 bp, Artificial Sequence
  chemically synthesized
ttgcagcagcaaatgtgtct

SEQ ID NO: 593520 - DNA, 20 bp, Artificial Sequence
  chemically synthesized
tctcacagtgcaacagagca

SEQ ID NO: 593521 - DNA, 20 bp, Artificial Sequence
  chemically synthesized
tcacctcaaatactatattt

SEQ ID NO: 593522 - DNA, 20 bp, Artificial Sequence
  chemically synthesized
ttccttgatttttgagacaa

SEQ ID NO: 593523 - DNA, 20 bp, Artificial Sequence
  chemically synthesized
catttacattttagataata

SEQ ID NO: 593524 - DNA, 20 bp, Artificial Sequence
  chemically synthesized
tgacatgtttgaattcattt

SEQ ID NO: 593525 - DNA, 20 bp, Artificial Sequence
  chemically synthesized
atggtagcttcttcctactg

SEQ ID NO: 593526 - DNA, 20 bp, Artificial Sequence
  chemically synthesized
gtaggaagaagctaccatat

SEQ ID NO: 593527 - DNA, 20 bp, Artificial Sequence
  chemically synthesized
ttttcaagaatctgtaatat

SEQ ID NO: 593528 - DNA, 20 bp, Artificial Sequence
  chemically synthesized
tatcattaggtaatttcaat

SEQ ID NO: 593529 - DNA, 20 bp, Artificial Sequence
  chemically synthesized
caaattgaaattacctaatg

SEQ ID NO: 593530 - DNA, 20 bp, Artificial Sequence
  chemically synthesized
ctaattactgtaaactatcg

SEQ ID NO: 593531 - DNA, 20 bp, Artificial Sequence
  chemically synthesized
cttgctcctataatcctacc

SEQ ID NO: 593532 - DNA, 20 bp, Artificial Sequence
  chemically synthesized
attttacaggttaaatttaa

SEQ ID NO: 593533 - DNA, 20 bp, Artificial Sequence
  chemically synthesized
aaaaataaaaatagtaacct

SEQ ID NO: 593534 - DNA, 20 bp, Artificial Sequence
  chemically synthesized
aaatgaaataacttacatga

SEQ ID NO: 593535 - DNA, 20 bp, Artificial Sequence
  chemically synthesized
aacttacatgaaattgcttt

SEQ ID NO: 593536 - DNA, 20 bp, Artificial Sequence
  chemically synthesized
ttgtaagttttatagggctg

SEQ ID NO: 593537 - DNA, 20 bp, Artificial Sequence
  chemically synthesized
agttttatagggctgccatg

SEQ ID NO: 593538 - DNA, 20 bp, Artificial Sequence
  chemically synthesized
tgtatgatactatgtatccc

SEQ ID NO: 593539 - DNA, 20 bp, Artificial Sequence
  chemically synthesized
ctactgtttaggacatctct

SEQ ID NO: 593540 - DNA, 20 bp, Artificial Sequence
  chemically synthesized
tctttcatatgtgcagagac

SEQ ID NO: 593541 - DNA, 20 bp, Artificial Sequence
  chemically synthesized
tatgtgcagagacctgtgtt

SEQ ID NO: 593542 - DNA, 20 bp, Artificial Sequence
  chemically synthesized
ttataaattacaagactgaa

SEQ ID NO: 593543 - DNA, 20 bp, Artificial Sequence
  chemically synthesized
acttatctatctatcgatgg

SEQ ID NO: 593544 - DNA, 20 bp, Artificial Sequence
  chemically synthesized
ttgtcctattatttaacttc

SEQ ID NO: 593545 - DNA, 20 bp, Artificial Sequence
  chemically synthesized
ataacaagagtacctatctt

SEQ ID NO: 593546 - DNA, 20 bp, Artificial Sequence
  chemically synthesized
tgctgagctcttagtatgtg

SEQ ID NO: 593547 - DNA, 20 bp, Artificial Sequence
  chemically synthesized
aaaactgtatagaaatatgt

SEQ ID NO: 593548 - DNA, 20 bp, Artificial Sequence
  chemically synthesized
gaatctgtcacatatttcta

SEQ ID NO: 593549 - DNA, 20 bp, Artificial Sequence
  chemically synthesized
ttctatacagtttttaaatt

SEQ ID NO: 593550 - DNA, 20 bp, Artificial Sequence
  chemically synthesized
acacatagagggtgcttaat

SEQ ID NO: 593551 - DNA, 20 bp, Artificial Sequence
  chemically synthesized
tctgcgtttagacacataga

SEQ ID NO: 593552 - DNA, 20 bp, Artificial Sequence
  chemically synthesized
ccctctatgtgtctaaacgc

SEQ ID NO: 593553 - DNA, 20 bp, Artificial Sequence
  chemically synthesized
acttacggtatgtaaaacat

SEQ ID NO: 593554 - DNA, 20 bp, Artificial Sequence
  chemically synthesized
gggagagcagtaagtgtctt

SEQ ID NO: 593555 - DNA, 20 bp, Artificial Sequence
  chemically synthesized
gatactctgctgtcagttgt

SEQ ID NO: 593556 - DNA, 20 bp, Artificial Sequence
  chemically synthesized
catgatggtacctatacctc

SEQ ID NO: 593557 - DNA, 20 bp, Artificial Sequence
  chemically synthesized
tctagagtttaaaaataaat

SEQ ID NO: 593558 - DNA, 20 bp, Artificial Sequence
  chemically synthesized
attattattgacttacatca

SEQ ID NO: 593559 - DNA, 20 bp, Artificial Sequence
  chemically synthesized
gatctgcatggtgggtatat

SEQ ID NO: 593560 - DNA, 20 bp, Artificial Sequence
  chemically synthesized
attataaactcaagggccca

SEQ ID NO: 593561 - DNA, 20 bp, Artificial Sequence
  chemically synthesized
agatgaaaccatatgggccc

SEQ ID NO: 593562 - DNA, 20 bp, Artificial Sequence
  chemically synthesized
aagctaggtttaggggtggg

SEQ ID NO: 593563 - DNA, 20 bp, Artificial Sequence
  chemically synthesized
aagcgcaacccacccctaaa

SEQ ID NO: 593564 - DNA, 20 bp, Artificial Sequence
  chemically synthesized
acttgcaaaataatacaaag

SEQ ID NO: 593565 - DNA, 20 bp, Artificial Sequence
  chemically synthesized
gacctaagtgatccttcttt

SEQ ID NO: 593566 - DNA, 20 bp, Artificial Sequence
  chemically synthesized
tagctaataaatcacaaagc

SEQ ID NO: 593567 - DNA, 20 bp, Artificial Sequence
  chemically synthesized
cctattctcaagcaacagct

SEQ ID NO: 593568 - DNA, 20 bp, Artificial Sequence
  chemically synthesized
tgggacacctattctcaagc

SEQ ID NO: 593569 - DNA, 20 bp, Artificial Sequence
  chemically synthesized
gaataggtgtcccaatattg

SEQ ID NO: 593570 - DNA, 20 bp, Artificial Sequence
  chemically synthesized
cattttcattctatgatagg

SEQ ID NO: 593571 - DNA, 20 bp, Artificial Sequence
  chemically synthesized
cagcaaaaaattatatactt

SEQ ID NO: 593572 - DNA, 20 bp, Artificial Sequence
  chemically synthesized
attgacatatgacttctggt

SEQ ID NO: 593573 - DNA, 20 bp, Artificial Sequence
  chemically synthesized
ttctggtgaacgcttaaaat

SEQ ID NO: 593574 - DNA, 20 bp, Artificial Sequence
  chemically synthesized
tgaacgcttaaaatacttga

SEQ ID NO: 593575 - DNA, 20 bp, Artificial Sequence
  chemically synthesized
taataggaatatgggatgat

SEQ ID NO: 593576 - DNA, 20 bp, Artificial Sequence
  chemically synthesized
acacagctgtattattttat

SEQ ID NO: 593577 - DNA, 20 bp, Artificial Sequence
  chemically synthesized
tgtgtatttttgtatgtcat

SEQ ID NO: 593578 - DNA, 20 bp, Artificial Sequence
  chemically synthesized
attttggtgtgtaactttct

SEQ ID NO: 593579 - DNA, 20 bp, Artificial Sequence
  chemically synthesized
ttacacaccaaaatgttaat

SEQ ID NO: 593580 - DNA, 20 bp, Artificial Sequence
  chemically synthesized
attctggtttccaactggca

SEQ ID NO: 593581 - DNA, 20 bp, Artificial Sequence
  chemically synthesized
actggcacttagattttcta

SEQ ID NO: 593582 - DNA, 20 bp, Artificial Sequence
  chemically synthesized
acttagattttctagtatgc

SEQ ID NO: 593583 - DNA, 20 bp, Artificial Sequence
  chemically synthesized
agaaaggtatccttgagtct

SEQ ID NO: 593584 - DNA, 20 bp, Artificial Sequence
  chemically synthesized
ttttatatttttagtagaga

SEQ ID NO: 593585 - DNA, 20 bp, Artificial Sequence
  chemically synthesized
cgcctcggcctcccaaagtg

SEQ ID NO: 593586 - DNA, 20 bp, Artificial Sequence
  chemically synthesized
tgacaggtctaagtaactta

SEQ ID NO: 593587 - DNA, 20 bp, Artificial Sequence
  chemically synthesized
cttattttcaaattctttaa

SEQ ID NO: 593588 - DNA, 20 bp, Artificial Sequence
  chemically synthesized
agaatttgaaaataaggaga

SEQ ID NO: 593589 - DNA, 20 bp, Artificial Sequence
  chemically synthesized
tttgaaaattaattttaaat

SEQ ID NO: 593590 - DNA, 20 bp, Artificial Sequence
  chemically synthesized
aagcttattggaggtgatat

SEQ ID NO: 593591 - DNA, 20 bp, Artificial Sequence
  chemically synthesized
aatccttcatatcacctcca

SEQ ID NO: 593592 - DNA, 20 bp, Artificial Sequence
  chemically synthesized
cttatatttatttatttctc

SEQ ID NO: 593593 - DNA, 20 bp, Artificial Sequence
  chemically synthesized
aataaaaatgcagaataaac

SEQ ID NO: 593594 - DNA, 20 bp, Artificial Sequence
  chemically synthesized
aatgcagaataaactattgt

SEQ ID NO: 593595 - DNA, 20 bp, Artificial Sequence
  chemically synthesized
agaataaactattgtttttg

SEQ ID NO: 593596 - DNA, 20 bp, Artificial Sequence
  chemically synthesized
aaacaaaacaaaacaaaaac

SEQ ID NO: 593597 - DNA, 20 bp, Artificial Sequence
  chemically synthesized
aaactattgtttttgttttg

SEQ ID NO: 593598 - DNA, 20 bp, Artificial Sequence
  chemically synthesized
gttttaccagaatatctccc

SEQ ID NO: 593599 - DNA, 20 bp, Artificial Sequence
  chemically synthesized
ctcccctttgattaaaaaaa

SEQ ID NO: 593600 - DNA, 20 bp, Artificial Sequence
  chemically synthesized
tgtaaaagatgatgctctaa

SEQ ID NO: 593601 - DNA, 20 bp, Artificial Sequence
  chemically synthesized
agttagctatagtatttgta

SEQ ID NO: 593602 - DNA, 20 bp, Artificial Sequence
  chemically synthesized
aaatactatagctaactaag

SEQ ID NO: 593603 - DNA, 20 bp, Artificial Sequence
  chemically synthesized
gtgataacttgtactcattt

SEQ ID NO: 593604 - DNA, 20 bp, Artificial Sequence
  chemically synthesized
aagttattaacttctgaaga

SEQ ID NO: 593605 - DNA, 20 bp, Artificial Sequence
  chemically synthesized
caatttatattcgtcaaatt

SEQ ID NO: 593606 - DNA, 20 bp, Artificial Sequence
  chemically synthesized
agcaattttaccattgctaa

SEQ ID NO: 593607 - DNA, 20 bp, Artificial Sequence
  chemically synthesized
gagtccagcagaaatgtctc

SEQ ID NO: 593608 - DNA, 20 bp, Artificial Sequence
  chemically synthesized
cggttaattaactttttctt

SEQ ID NO: 593609 - DNA, 20 bp, Artificial Sequence
  chemically synthesized
ttaactttttcttctatgct

SEQ ID NO: 593610 - DNA, 20 bp, Artificial Sequence
  chemically synthesized
atattagctgtttttatgag

SEQ ID NO: 593611 - DNA, 20 bp, Artificial Sequence
  chemically synthesized
actcatgctcattaaatatt

SEQ ID NO: 593612 - DNA, 20 bp, Artificial Sequence
  chemically synthesized
tgagcatgagtaattgccaa

SEQ ID NO: 593613 - DNA, 20 bp, Artificial Sequence
  chemically synthesized
cacttggcatatatcatttc

SEQ ID NO: 593614 - DNA, 20 bp, Artificial Sequence
  chemically synthesized
tgagataagtagcattattg

SEQ ID NO: 593615 - DNA, 20 bp, Artificial Sequence
  chemically synthesized
ttctattgacctctctgggc

SEQ ID NO: 593616 - DNA, 20 bp, Artificial Sequence
  chemically synthesized
ccataaaataggcacgtggt

SEQ ID NO: 593617 - DNA, 20 bp, Artificial Sequence
  chemically synthesized
cgtggtaagtgtttgctgac

SEQ ID NO: 593618 - DNA, 20 bp, Artificial Sequence
  chemically synthesized
agacagggaatttggaccca

SEQ ID NO: 593619 - DNA, 20 bp, Artificial Sequence
  chemically synthesized
ggaatttggacccagaaaga

SEQ ID NO: 593620 - DNA, 20 bp, Artificial Sequence
  chemically synthesized
ttatattggccatctactaa

SEQ ID NO: 593621 - DNA, 20 bp, Artificial Sequence
  chemically synthesized
cagtttggaaactttatcaa

SEQ ID NO: 593622 - DNA, 20 bp, Artificial Sequence
  chemically synthesized
taaaatagaaactttattga

SEQ ID NO: 593623 - DNA, 20 bp, Artificial Sequence
  chemically synthesized
gtttctattttagagaatat

SEQ ID NO: 593624 - DNA, 20 bp, Artificial Sequence
  chemically synthesized
cctaaatggaggttctgaga

SEQ ID NO: 593625 - DNA, 20 bp, Artificial Sequence
  chemically synthesized
cccattagatcatttttgca

SEQ ID NO: 593626 - DNA, 20 bp, Artificial Sequence
  chemically synthesized
tgcaaaaatgatctaatggg

SEQ ID NO: 593627 - DNA, 20 bp, Artificial Sequence
  chemically synthesized
ctcacttcattttcccttac

SEQ ID NO: 593628 - DNA, 20 bp, Artificial Sequence
  chemically synthesized
cactggtaagggaaaatgaa

SEQ ID NO: 593629 - DNA, 20 bp, Artificial Sequence
  chemically synthesized
ttatgccatatatgtgtttg

SEQ ID NO: 593630 - DNA, 20 bp, Artificial Sequence
  chemically synthesized
cctgggcttttatgccatat

SEQ ID NO: 593631 - DNA, 20 bp, Artificial Sequence
  chemically synthesized
gtgtgaatggcactgccacc

SEQ ID NO: 593632 - DNA, 20 bp, Artificial Sequence
  chemically synthesized
ggttgcagacacataaatac

SEQ ID NO: 593633 - DNA, 20 bp, Artificial Sequence
  chemically synthesized
atgtgtctgcaaccagcagt

SEQ ID NO: 593634 - DNA, 20 bp, Artificial Sequence
  chemically synthesized
gcaaccagcagtcattgatt

SEQ ID NO: 593635 - DNA, 20 bp, Artificial Sequence
  chemically synthesized
ctcaaggccaccctccaaca

SEQ ID NO: 593636 - DNA, 20 bp, Artificial Sequence
  chemically synthesized
tccgtttaacattttccctg

SEQ ID NO: 593637 - DNA, 20 bp, Artificial Sequence
  chemically synthesized
atccactcatatcctttcac

SEQ ID NO: 593638 - DNA, 20 bp, Artificial Sequence
  chemically synthesized
tgacagcatctctacagaga

SEQ ID NO: 593639 - DNA, 20 bp, Artificial Sequence
  chemically synthesized
taagggctttgaacacatta

SEQ ID NO: 593640 - DNA, 20 bp, Artificial Sequence
  chemically synthesized
tgtgtgccagtgcccaggct

SEQ ID NO: 593641 - DNA, 20 bp, Artificial Sequence
  chemically synthesized
gattggcaatgccagctatc

SEQ ID NO: 593642 - DNA, 20 bp, Artificial Sequence
  chemically synthesized
accggcaactgcaataggaa

SEQ ID NO: 593643 - DNA, 20 bp, Artificial Sequence
  chemically synthesized
atttaactccaaagtctgta

SEQ ID NO: 593644 - DNA, 20 bp, Artificial Sequence
  chemically synthesized
agcaataaagatggtgagaa

SEQ ID NO: 593645 - DNA, 20 bp, Artificial Sequence
  chemically synthesized
gatatttctttcatgatcct

SEQ ID NO: 593646 - DNA, 20 bp, Artificial Sequence
  chemically synthesized
ttttggtagcagaagacact

SEQ ID NO: 593647 - DNA, 20 bp, Artificial Sequence
  chemically synthesized
ctgctaccaaaaatgtgagc

SEQ ID NO: 593648 - DNA, 20 bp, Artificial Sequence
  chemically synthesized
ggctgactttacttacctaa

SEQ ID NO: 593649 - DNA, 20 bp, Artificial Sequence
  chemically synthesized
ctttccctagccttttgctt

SEQ ID NO: 593650 - DNA, 20 bp, Artificial Sequence
  chemically synthesized
atagctctctttccctagcc

SEQ ID NO: 593651 - DNA, 20 bp, Artificial Sequence
  chemically synthesized
agagtgaggagtagcagcac

SEQ ID NO: 593652 - DNA, 20 bp, Artificial Sequence
  chemically synthesized
aatattaacatttaggtgtc

SEQ ID NO: 593653 - DNA, 20 bp, Artificial Sequence
  chemically synthesized
tatttctctatgtgactcca

SEQ ID NO: 593654 - DNA, 20 bp, Artificial Sequence
  chemically synthesized
actttgtgtgtaagataaaa

SEQ ID NO: 593655 - DNA, 20 bp, Artificial Sequence
  chemically synthesized
agttattttagaacagatca

SEQ ID NO: 593656 - DNA, 20 bp, Artificial Sequence
  chemically synthesized
aacagatcaaactgcttatg

SEQ ID NO: 593657 - DNA, 20 bp, Artificial Sequence
  chemically synthesized
aaggtagtaagcctctcata

SEQ ID NO: 593658 - DNA, 20 bp, Artificial Sequence
  chemically synthesized
tactaccttttaaaatatta

SEQ ID NO: 593659 - DNA, 20 bp, Artificial Sequence
  chemically synthesized
tgggtttttaagaatttatt

SEQ ID NO: 593660 - DNA, 20 bp, Artificial Sequence
  chemically synthesized
attttcttttcttaccttgg

SEQ ID NO: 593661 - DNA, 20 bp, Artificial Sequence
  chemically synthesized
cagccaaggtaagaaaagaa

SEQ ID NO: 593662 - DNA, 20 bp, Artificial Sequence
  chemically synthesized
ttagccaatttatgtatact

SEQ ID NO: 593663 - DNA, 20 bp, Artificial Sequence
  chemically synthesized
ggaaaaaggggagtcatcct

SEQ ID NO: 593664 - DNA, 20 bp, Artificial Sequence
  chemically synthesized
ccctttttccagggacaaga

SEQ ID NO: 593665 - DNA, 20 bp, Artificial Sequence
  chemically synthesized
aacaagtatataactagaga

SEQ ID NO: 593666 - DNA, 20 bp, Artificial Sequence
  chemically synthesized
atccagttctctagttatat

SEQ ID NO: 593667 - DNA, 20 bp, Artificial Sequence
  chemically synthesized
gtgaggaagtgatctcctca

SEQ ID NO: 593668 - DNA, 20 bp, Artificial Sequence
  chemically synthesized
gacaaagtgacaatcatcaa

SEQ ID NO: 593669 - DNA, 20 bp, Artificial Sequence
  chemically synthesized
ctcagctgactaaactccct

SEQ ID NO: 593670 - DNA, 20 bp, Artificial Sequence
  chemically synthesized
gggagtttagtcagctgagg

SEQ ID NO: 593671 - DNA, 20 bp, Artificial Sequence
  chemically synthesized
gtcagaccatgaaacaagac

SEQ ID NO: 593672 - DNA, 20 bp, Artificial Sequence
  chemically synthesized
gcatttcctggaagcagtag

SEQ ID NO: 593673 - DNA, 20 bp, Artificial Sequence
  chemically synthesized
cagtggctaaattctgctgc

SEQ ID NO: 593674 - DNA, 20 bp, Artificial Sequence
  chemically synthesized
tatctgtcaataagggtctc

SEQ ID NO: 593675 - DNA, 20 bp, Artificial Sequence
  chemically synthesized
tcaccaacatgccagcgaaa

SEQ ID NO: 593676 - DNA, 20 bp, Artificial Sequence
  chemically synthesized
catgccagcgaaacatggtt

SEQ ID NO: 593677 - DNA, 20 bp, Artificial Sequence
  chemically synthesized
aaaaaacaaaaaacaataaa

SEQ ID NO: 593678 - DNA, 20 bp, Artificial Sequence
  chemically synthesized
gcgaaacatggtttattgtt

SEQ ID NO: 593679 - DNA, 20 bp, Artificial Sequence
  chemically synthesized
ttttgttttttattggctat

SEQ ID NO: 593680 - DNA, 20 bp, Artificial Sequence
  chemically synthesized
atactgacatagtatctaat

SEQ ID NO: 593681 - DNA, 20 bp, Artificial Sequence
  chemically synthesized
ataactgcttctttatatct

SEQ ID NO: 593682 - DNA, 20 bp, Artificial Sequence
  chemically synthesized
cctggcatattcaaataaat

SEQ ID NO: 593683 - DNA, 20 bp, Artificial Sequence
  chemically synthesized
ggataacttcctctataatt

SEQ ID NO: 593684 - DNA, 20 bp, Artificial Sequence
  chemically synthesized
taaagtagacaactgtcgga

SEQ ID NO: 593685 - DNA, 20 bp, Artificial Sequence
  chemically synthesized
gtgggcgttgagtaaatcta

SEQ ID NO: 593686 - DNA, 20 bp, Artificial Sequence
  chemically synthesized
catttgcaatatacaagcat

SEQ ID NO: 593687 - DNA, 20 bp, Artificial Sequence
  chemically synthesized
ccttgagataagagatgctc

SEQ ID NO: 593688 - DNA, 20 bp, Artificial Sequence
  chemically synthesized
aagagatgctcaagggtttc

SEQ ID NO: 593689 - DNA, 20 bp, Artificial Sequence
  chemically synthesized
gaatccaggaacattttcag

SEQ ID NO: 593690 - DNA, 20 bp, Artificial Sequence
  chemically synthesized
aaagccaggctgaaaatgtt

SEQ ID NO: 593691 - DNA, 20 bp, Artificial Sequence
  chemically synthesized
gagcgaaagtgcccttaaac

SEQ ID NO: 593692 - DNA, 20 bp, Artificial Sequence
  chemically synthesized
agtttttatgatcttaaaac

SEQ ID NO: 593693 - DNA, 20 bp, Artificial Sequence
  chemically synthesized
ttttctactttaaaaataac

SEQ ID NO: 593694 - DNA, 20 bp, Artificial Sequence
  chemically synthesized
gattttacaatttcaatatt

SEQ ID NO: 593695 - DNA, 20 bp, Artificial Sequence
  chemically synthesized
tttaaaactattttcttttc

SEQ ID NO: 593696 - DNA, 20 bp, Artificial Sequence
  chemically synthesized
gtaaaatcaagggaaaagaa

SEQ ID NO: 593697 - DNA, 20 bp, Artificial Sequence
  chemically synthesized
ataggacattctttttctta

SEQ ID NO: 593698 - DNA, 20 bp, Artificial Sequence
  chemically synthesized
tcctatttccaatgactctg

SEQ ID NO: 593699 - DNA, 20 bp, Artificial Sequence
  chemically synthesized
attgtttttctaattctttc

SEQ ID NO: 593700 - DNA, 20 bp, Artificial Sequence
  chemically synthesized
aagggtccaaaatatactaa

SEQ ID NO: 593701 - DNA, 20 bp, Artificial Sequence
  chemically synthesized
taaaggtataaaatacatct

SEQ ID NO: 593702 - DNA, 20 bp, Artificial Sequence
  chemically synthesized
ttttaagataatgatatttg

SEQ ID NO: 593703 - DNA, 20 bp, Artificial Sequence
  chemically synthesized
aacgttaactttcctcatta

SEQ ID NO: 593704 - DNA, 20 bp, Artificial Sequence
  chemically synthesized
tctcaggttgttcttatcag

SEQ ID NO: 593705 - DNA, 20 bp, Artificial Sequence
  chemically synthesized
agagacgtcagtaaggaatg

SEQ ID NO: 593706 - DNA, 20 bp, Artificial Sequence
  chemically synthesized
cattccttactgacgtctct

SEQ ID NO: 593707 - DNA, 20 bp, Artificial Sequence
  chemically synthesized
acactccaataataccattc

SEQ ID NO: 593708 - DNA, 20 bp, Artificial Sequence
  chemically synthesized
tattttatatttctcttttt

SEQ ID NO: 593709 - DNA, 20 bp, Artificial Sequence
  chemically synthesized
tatttttattaagggatatt

SEQ ID NO: 593710 - DNA, 20 bp, Artificial Sequence
  chemically synthesized
cacttaaaggtcttcgctaa

SEQ ID NO: 593711 - DNA, 20 bp, Artificial Sequence
  chemically synthesized
ttattttttaccaaatcgta

SEQ ID NO: 593712 - DNA, 20 bp, Artificial Sequence
  chemically synthesized
gcattgtatgtggaagctat

SEQ ID NO: 593713 - DNA, 20 bp, Artificial Sequence
  chemically synthesized
gtatattatctgcagtactg

SEQ ID NO: 593714 - DNA, 20 bp, Artificial Sequence
  chemically synthesized
cagataatatacaggggtac

SEQ ID NO: 593715 - DNA, 20 bp, Artificial Sequence
  chemically synthesized
gtgatttttttaaaaagatt

SEQ ID NO: 593716 - DNA, 20 bp, Artificial Sequence
  chemically synthesized
agattttggtgattttttta

SEQ ID NO: 593717 - DNA, 20 bp, Artificial Sequence
  chemically synthesized
caagattatagctgagattt

SEQ ID NO: 593718 - DNA, 20 bp, Artificial Sequence
  chemically synthesized
ttgtatgatcaagattatag

SEQ ID NO: 593719 - DNA, 20 bp, Artificial Sequence
  chemically synthesized
cctctttttattttgtatga

SEQ ID NO: 593720 - DNA, 20 bp, Artificial Sequence
  chemically synthesized
tgtggattataaattttttt

SEQ ID NO: 593721 - DNA, 20 bp, Artificial Sequence
  chemically synthesized
aaactagatgattgcagtaa

SEQ ID NO: 593722 - DNA, 20 bp, Artificial Sequence
  chemically synthesized
aatccacattactgcaatca

SEQ ID NO: 593723 - DNA, 20 bp, Artificial Sequence
  chemically synthesized
atactcttctttcacaaact

SEQ ID NO: 593724 - DNA, 20 bp, Artificial Sequence
  chemically synthesized
tgtattttaaattaaatcct

SEQ ID NO: 593725 - DNA, 20 bp, Artificial Sequence
  chemically synthesized
aaaacaaaatatcaaatcat

SEQ ID NO: 593726 - DNA, 20 bp, Artificial Sequence
  chemically synthesized
aaatccttaatgatttgata

SEQ ID NO: 593727 - DNA, 20 bp, Artificial Sequence
  chemically synthesized
caagactatcctaaggaatt

SEQ ID NO: 593728 - DNA, 20 bp, Artificial Sequence
  chemically synthesized
ttgagttcaatttcatgcac

SEQ ID NO: 593729 - DNA, 20 bp, Artificial Sequence
  chemically synthesized
gctgacacaatttagatatt

SEQ ID NO: 593730 - DNA, 20 bp, Artificial Sequence
  chemically synthesized
tgggccactggagaagaact

SEQ ID NO: 593731 - DNA, 20 bp, Artificial Sequence
  chemically synthesized
attaatccttcctggctaga

SEQ ID NO: 593732 - DNA, 20 bp, Artificial Sequence
  chemically synthesized
ttgaagctttctctagccag

SEQ ID NO: 593733 - DNA, 20 bp, Artificial Sequence
  chemically synthesized
ttctgccatggaggcagcgt

SEQ ID NO: 593734 - DNA, 20 bp, Artificial Sequence
  chemically synthesized
atttttcaatgcattttcat

SEQ ID NO: 593735 - DNA, 20 bp, Artificial Sequence
  chemically synthesized
tttagatttaattgtagaat

SEQ ID NO: 593736 - DNA, 20 bp, Artificial Sequence
  chemically synthesized
aaagataccaagttttatta

SEQ ID NO: 593737 - DNA, 20 bp, Artificial Sequence
  chemically synthesized
atgtgtggggagaaaagata

SEQ ID NO: 593738 - DNA, 20 bp, Artificial Sequence
  chemically synthesized
gttttaaatttaaatgctgt

SEQ ID NO: 593739 - DNA, 20 bp, Artificial Sequence
  chemically synthesized
aataggctgacattcagctt

SEQ ID NO: 593740 - DNA, 20 bp, Artificial Sequence
  chemically synthesized
tgttcaaaaataggctgaca

SEQ ID NO: 593741 - DNA, 20 bp, Artificial Sequence
  chemically synthesized
ataacctcttttttctcttg

SEQ ID NO: 593742 - DNA, 20 bp, Artificial Sequence
  chemically synthesized
atgtgcaacagagaacccat

SEQ ID NO: 593743 - DNA, 20 bp, Artificial Sequence
  chemically synthesized
tgcatcacttatggtgtatg

SEQ ID NO: 593744 - DNA, 20 bp, Artificial Sequence
  chemically synthesized
acttcaaagcagaggcattt

SEQ ID NO: 593745 - DNA, 20 bp, Artificial Sequence
  chemically synthesized
tgatttaatcattgaaatgc

SEQ ID NO: 593746 - DNA, 20 bp, Artificial Sequence
  chemically synthesized
tttacctttgtacacttcgg

SEQ ID NO: 593747 - DNA, 20 bp, Artificial Sequence
  chemically synthesized
agtgaggttttcctttcagt

SEQ ID NO: 593748 - DNA, 20 bp, Artificial Sequence
  chemically synthesized
tatttttaaaagttattaag

SEQ ID NO: 593749 - DNA, 20 bp, Artificial Sequence
  chemically synthesized
atacggttatgtaaagaaga

SEQ ID NO: 593750 - DNA, 20 bp, Artificial Sequence
  chemically synthesized
ctgcaaaaagtttgatttgt

SEQ ID NO: 593751 - DNA, 20 bp, Artificial Sequence
  chemically synthesized
gaaaaatactactgcaaaaa

SEQ ID NO: 593752 - DNA, 20 bp, Artificial Sequence
  chemically synthesized
ctgagaaaaatactactgca

SEQ ID NO: 593753 - DNA, 20 bp, Artificial Sequence
  chemically synthesized
cactaggttgaacctctata

SEQ ID NO: 593754 - DNA, 20 bp, Artificial Sequence
  chemically synthesized
cacagtatagaggttcaacc

SEQ ID NO: 593755 - DNA, 20 bp, Artificial Sequence
  chemically synthesized
ctgccttccttggaatatca

SEQ ID NO: 593756 - DNA, 20 bp, Artificial Sequence
  chemically synthesized
atgtatatataaactgagaa

SEQ ID NO: 593757 - DNA, 20 bp, Artificial Sequence
  chemically synthesized
tgttttctgaaagcagcctt

SEQ ID NO: 593758 - DNA, 20 bp, Artificial Sequence
  chemically synthesized
tgctttgcttagagaacctt

SEQ ID NO: 593759 - DNA, 20 bp, Artificial Sequence
  chemically synthesized
accctgctttgcttagagaa

SEQ ID NO: 593760 - DNA, 20 bp, Artificial Sequence
  chemically synthesized
tcaaggttctctaagcaaag

SEQ ID NO: 593761 - DNA, 20 bp, Artificial Sequence
  chemically synthesized
aactttatcataaaaccctg

SEQ ID NO: 593762 - DNA, 20 bp, Artificial Sequence
  chemically synthesized
catgaaactttatcataaaa

SEQ ID NO: 593763 - DNA, 20 bp, Artificial Sequence
  chemically synthesized
agcaaagcagggttttatga

SEQ ID NO: 593764 - DNA, 20 bp, Artificial Sequence
  chemically synthesized
tactcacactgaattttaat

SEQ ID NO: 593765 - DNA, 20 bp, Artificial Sequence
  chemically synthesized
ttacattaaattttctctct

SEQ ID NO: 593766 - DNA, 20 bp, Artificial Sequence
  chemically synthesized
cggcaattaacttttagtat

SEQ ID NO: 593767 - DNA, 20 bp, Artificial Sequence
  chemically synthesized
gccgtcttaacacacaggcg

SEQ ID NO: 593768 - DNA, 20 bp, Artificial Sequence
  chemically synthesized
gtgccctcttctgcgtttaa

SEQ ID NO: 593769 - DNA, 20 bp, Artificial Sequence
  chemically synthesized
ttcaaagcttgtgccctctt

SEQ ID NO: 593770 - DNA, 20 bp, Artificial Sequence
  chemically synthesized
ctttaaacgcagaagagggc

SEQ ID NO: 593771 - DNA, 20 bp, Artificial Sequence
  chemically synthesized
aggcaatttttttttttttt

SEQ ID NO: 593772 - DNA, 20 bp, Artificial Sequence
  chemically synthesized
tatactccatcagggaacaa

SEQ ID NO: 593773 - DNA, 20 bp, Artificial Sequence
  chemically synthesized
ttgaagtcttcctacagcca

SEQ ID NO: 593774 - DNA, 20 bp, Artificial Sequence
  chemically synthesized
tctttgagcttctctgttcg

SEQ ID NO: 593775 - DNA, 20 bp, Artificial Sequence
  chemically synthesized
acagagaagctcaaagacct

SEQ ID NO: 593776 - DNA, 20 bp, Artificial Sequence
  chemically synthesized
agcccaaatctgtaaggtct

SEQ ID NO: 593777 - DNA, 20 bp, Artificial Sequence
  chemically synthesized
atttgggctacttgcccttg

SEQ ID NO: 593778 - DNA, 20 bp, Artificial Sequence
  chemically synthesized
ttaatttcccctagaatgaa

SEQ ID NO: 593779 - DNA, 20 bp, Artificial Sequence
  chemically synthesized
taatggaaggatgcattttt

SEQ ID NO: 593780 - DNA, 20 bp, Artificial Sequence
  chemically synthesized
gaaggatgcatttttaaatg

SEQ ID NO: 593781 - DNA, 20 bp, Artificial Sequence
  chemically synthesized
catttttaaatgctttgatt

SEQ ID NO: 593782 - DNA, 20 bp, Artificial Sequence
  chemically synthesized
tggtacttggaatgctgagg

SEQ ID NO: 593783 - DNA, 20 bp, Artificial Sequence
  chemically synthesized
tgtgagcagtgggtgggagg

SEQ ID NO: 593784 - DNA, 20 bp, Artificial Sequence
  chemically synthesized
aagtgctcttctgtgggtct

SEQ ID NO: 593785 - DNA, 20 bp, Artificial Sequence
  chemically synthesized
tttcctctcaacagatgtct

SEQ ID NO: 593786 - DNA, 20 bp, Artificial Sequence
  chemically synthesized
aagcatccgtggggaccgaa

SEQ ID NO: 593787 - DNA, 20 bp, Artificial Sequence
  chemically synthesized
aaacctctttcggtccccac

SEQ ID NO: 593788 - DNA, 20 bp, Artificial Sequence
  chemically synthesized
cagccagcaatgcctccgca

SEQ ID NO: 593789 - DNA, 20 bp, Artificial Sequence
  chemically synthesized
tctcttcacactagcaatgg

SEQ ID NO: 593790 - DNA, 20 bp, Artificial Sequence
  chemically synthesized
tgatccagcagagtttcagc

SEQ ID NO: 593791 - DNA, 20 bp, Artificial Sequence
  chemically synthesized
gggctgaaactctgctggat

SEQ ID NO: 593792 - DNA, 20 bp, Artificial Sequence
  chemically synthesized
gagtccaatccatgatccag

SEQ ID NO: 593793 - DNA, 20 bp, Artificial Sequence
  chemically synthesized
acacagtctgcattacctga

SEQ ID NO: 593794 - DNA, 20 bp, Artificial Sequence
  chemically synthesized
tatttctggaagcacttagg

SEQ ID NO: 593795 - DNA, 20 bp, Artificial Sequence
  chemically synthesized
tttgtagacaaacatgccct

SEQ ID NO: 593796 - DNA, 20 bp, Artificial Sequence
  chemically synthesized
cttccttaaagtatcaggtc

SEQ ID NO: 593797 - DNA, 20 bp, Artificial Sequence
  chemically synthesized
gctccatgagggcctcaatg

SEQ ID NO: 593798 - DNA, 20 bp, Artificial Sequence
  chemically synthesized
tgtaatgaaagtaaaaaatg

SEQ ID NO: 593799 - DNA, 20 bp, Artificial Sequence
  chemically synthesized
tgcctcagcctcccaaagtg

SEQ ID NO: 593800 - DNA, 20 bp, Artificial Sequence
  chemically synthesized
tttttgtatttttagtagag

SEQ ID NO: 593801 - DNA, 20 bp, Artificial Sequence
  chemically synthesized
tacctcagcctcccgagtag

SEQ ID NO: 593802 - DNA, 20 bp, Artificial Sequence
  chemically synthesized
aaccactgcctcccgggttc

SEQ ID NO: 593803 - DNA, 20 bp, Artificial Sequence
  chemically synthesized
gaggcagtggttgcagtgag

SEQ ID NO: 593804 - DNA, 20 bp, Artificial Sequence
  chemically synthesized
aaaataaataaatttgtaaa

SEQ ID NO: 593805 - DNA, 20 bp, Artificial Sequence
  chemically synthesized
ctaagtattgttatcagtgg

SEQ ID NO: 593806 - DNA, 20 bp, Artificial Sequence
  chemically synthesized
ctttctaagtattgttatca

SEQ ID NO: 593807 - DNA, 20 bp, Artificial Sequence
  chemically synthesized
cccactgataacaatactta

SEQ ID NO: 593808 - DNA, 20 bp, Artificial Sequence
  chemically synthesized
tgttgaaaaccgtatgtatt

SEQ ID NO: 593809 - DNA, 20 bp, Artificial Sequence
  chemically synthesized
ggcaataagcaaataataca

SEQ ID NO: 593810 - DNA, 20 bp, Artificial Sequence
  chemically synthesized
tcaccaagccttgcattaaa

SEQ ID NO: 593811 - DNA, 20 bp, Artificial Sequence
  chemically synthesized
tattcaatccaggtttaatg

SEQ ID NO: 593812 - DNA, 20 bp, Artificial Sequence
  chemically synthesized
atgggagtcttttattcaat

SEQ ID NO: 593813 - DNA, 20 bp, Artificial Sequence
  chemically synthesized
tggttccatgccagcttgca

SEQ ID NO: 593814 - DNA, 20 bp, Artificial Sequence
  chemically synthesized
acctctgggcttggttccat

SEQ ID NO: 593815 - DNA, 20 bp, Artificial Sequence
  chemically synthesized
ctagcttcaggaattaacct

SEQ ID NO: 593816 - DNA, 20 bp, Artificial Sequence
  chemically synthesized
ggcactttggaaccttttcc

SEQ ID NO: 593817 - DNA, 20 bp, Artificial Sequence
  chemically synthesized
gtaaataggcgcttggcgga

SEQ ID NO: 593818 - DNA, 20 bp, Artificial Sequence
  chemically synthesized
gcctgtaaataggcgcttgg

SEQ ID NO: 593819 - DNA, 20 bp, Artificial Sequence
  chemically synthesized
acacacctgtgcctgtaaat

SEQ ID NO: 593820 - DNA, 20 bp, Artificial Sequence
  chemically synthesized
atagatgacattctgatgtg

SEQ ID NO: 593821 - DNA, 20 bp, Artificial Sequence
  chemically synthesized
tgatgtggcaggctttattg

SEQ ID NO: 593822 - DNA, 20 bp, Artificial Sequence
  chemically synthesized
gtgctgtttatgacaatatc

SEQ ID NO: 593823 - DNA, 20 bp, Artificial Sequence
  chemically synthesized
gacaatatctgcagattatg

SEQ ID NO: 593824 - DNA, 20 bp, Artificial Sequence
  chemically synthesized
atatctgcagattatgatgt

SEQ ID NO: 593825 - DNA, 20 bp, Artificial Sequence
  chemically synthesized
gttttgtgtgtgcttaatta

SEQ ID NO: 593826 - DNA, 20 bp, Artificial Sequence
  chemically synthesized
aacttcctgttttgttttgt

SEQ ID NO: 593827 - DNA, 20 bp, Artificial Sequence
  chemically synthesized
acttaggtattaacttcctg

SEQ ID NO: 593828 - DNA, 20 bp, Artificial Sequence
  chemically synthesized
gcaccacttaggtattaact

SEQ ID NO: 593829 - DNA, 20 bp, Artificial Sequence
  chemically synthesized
ttaatacctaagtggtgctg

SEQ ID NO: 593830 - DNA, 20 bp, Artificial Sequence
  chemically synthesized
ggagatgtgtgtatacagac

SEQ ID NO: 593831 - DNA, 20 bp, Artificial Sequence
  chemically synthesized
tcttgaagatataaatattg

SEQ ID NO: 593832 - DNA, 20 bp, Artificial Sequence
  chemically synthesized
acataccaatatttatatct

SEQ ID NO: 593833 - DNA, 20 bp, Artificial Sequence
  chemically synthesized
taattttacaggagttgcta

SEQ ID NO: 593834 - DNA, 20 bp, Artificial Sequence
  chemically synthesized
taattggcagttgccttatg

SEQ ID NO: 593835 - DNA, 20 bp, Artificial Sequence
  chemically synthesized
tgtaattctggaactagtta

SEQ ID NO: 593836 - DNA, 20 bp, Artificial Sequence
  chemically synthesized
gcttggcagatgcaaatgta

SEQ ID NO: 593837 - DNA, 20 bp, Artificial Sequence
  chemically synthesized
cttcttcccgactctctaac

SEQ ID NO: 593838 - DNA, 20 bp, Artificial Sequence
  chemically synthesized
tatttataaataaaagttcc

SEQ ID NO: 593839 - DNA, 20 bp, Artificial Sequence
  chemically synthesized
ggatttctatttacaaattg

SEQ ID NO: 593840 - DNA, 20 bp, Artificial Sequence
  chemically synthesized
gctgtgagctgctcagaggg

SEQ ID NO: 593841 - DNA, 20 bp, Artificial Sequence
  chemically synthesized
atccttttgccattcaagat

SEQ ID NO: 593842 - DNA, 20 bp, Artificial Sequence
  chemically synthesized
tttgatccttttgccattca

SEQ ID NO: 593843 - DNA, 20 bp, Artificial Sequence
  chemically synthesized
gtctgagcaatgtttagatg

SEQ ID NO: 593844 - DNA, 20 bp, Artificial Sequence
  chemically synthesized
atatgaacagcaggtctgag

SEQ ID NO: 593845 - DNA, 20 bp, Artificial Sequence
  chemically synthesized
tttcaattctaatttctctt

SEQ ID NO: 593846 - DNA, 20 bp, Artificial Sequence
  chemically synthesized
accttccaaagtgtataata

SEQ ID NO: 593847 - DNA, 20 bp, Artificial Sequence
  chemically synthesized
tttttagcatatttgtccct

SEQ ID NO: 593848 - DNA, 20 bp, Artificial Sequence
  chemically synthesized
ttgtagggcagcagctgaac

SEQ ID NO: 593849 - DNA, 20 bp, Artificial Sequence
  chemically synthesized
tcttggctcaactacctgta

SEQ ID NO: 593850 - DNA, 20 bp, Artificial Sequence
  chemically synthesized
aaatgacttgtacaaggtca

SEQ ID NO: 593851 - DNA, 20 bp, Artificial Sequence
  chemically synthesized
tgtacaagtcatttaaactt

SEQ ID NO: 593852 - DNA, 20 bp, Artificial Sequence
  chemically synthesized
ggatgtggaagttgaagcca

SEQ ID NO: 593853 - DNA, 20 bp, Artificial Sequence
  chemically synthesized
tcacattaaattttgaggag

SEQ ID NO: 593854 - DNA, 20 bp, Artificial Sequence
  chemically synthesized
cacagatgtgagccaccaca

SEQ ID NO: 593855 - DNA, 20 bp, Artificial Sequence
  chemically synthesized
tgggaggatcatttgagctc

SEQ ID NO: 593856 - DNA, 20 bp, Artificial Sequence
  chemically synthesized
ctttcgatgcatttttcttt

SEQ ID NO: 593857 - DNA, 20 bp, Artificial Sequence
  chemically synthesized
acaaatgaccttaaaaaaag

SEQ ID NO: 593858 - DNA, 20 bp, Artificial Sequence
  chemically synthesized
cgcaggtccaatgaattaaa

SEQ ID NO: 593859 - DNA, 20 bp, Artificial Sequence
  chemically synthesized
acagagcagcagtaccactt

SEQ ID NO: 593860 - DNA, 20 bp, Artificial Sequence
  chemically synthesized
actatcatttggaagaataa

SEQ ID NO: 593861 - DNA, 20 bp, Artificial Sequence
  chemically synthesized
tattgccatttttatttggt

SEQ ID NO: 593862 - DNA, 20 bp, Artificial Sequence
  chemically synthesized
ctacccaaccgtcaattact

SEQ ID NO: 593863 - DNA, 20 bp, Artificial Sequence
  chemically synthesized
tgtgcaggacatagatattt

SEQ ID NO: 593864 - DNA, 20 bp, Artificial Sequence
  chemically synthesized
aagacattgccctgtcctca

SEQ ID NO: 593865 - DNA, 20 bp, Artificial Sequence
  chemically synthesized
tcttcattctcacatagatt

SEQ ID NO: 593866 - DNA, 20 bp, Artificial Sequence
  chemically synthesized
gtaagtgatcttcattctca

SEQ ID NO: 593867 - DNA, 20 bp, Artificial Sequence
  chemically synthesized
gaagatcacttaccactaca

SEQ ID NO: 593868 - DNA, 20 bp, Artificial Sequence
  chemically synthesized
gctttggtcctccatgtcca

SEQ ID NO: 593869 - DNA, 20 bp, Artificial Sequence
  chemically synthesized
ctatgtgagcataaggggta

SEQ ID NO: 593870 - DNA, 20 bp, Artificial Sequence
  chemically synthesized
tagctggctgtcgacattaa

SEQ ID NO: 593871 - DNA, 20 bp, Artificial Sequence
  chemically synthesized
ttttttgttgaagagttgat

SEQ ID NO: 593872 - DNA, 20 bp, Artificial Sequence
  chemically synthesized
tattaaggtgtgaactctat

SEQ ID NO: 593873 - DNA, 20 bp, Artificial Sequence
  chemically synthesized
ttggctagaaatcttcactg

SEQ ID NO: 593874 - DNA, 20 bp, Artificial Sequence
  chemically synthesized
gtttggtggaaacagcacag

SEQ ID NO: 593875 - DNA, 20 bp, Artificial Sequence
  chemically synthesized
taaggatcatggtattacaa

SEQ ID NO: 593876 - DNA, 20 bp, Artificial Sequence
  chemically synthesized
ctttcactgtgggggcacaa

SEQ ID NO: 593877 - DNA, 20 bp, Artificial Sequence
  chemically synthesized
agtgaaagaccaatcttaaa

SEQ ID NO: 593878 - DNA, 20 bp, Artificial Sequence
  chemically synthesized
ttgggagtatgaagcttggt

SEQ ID NO: 593879 - DNA, 20 bp, Artificial Sequence
  chemically synthesized
atttcattgggagtatgaag

SEQ ID NO: 593880 - DNA, 20 bp, Artificial Sequence
  chemically synthesized
gttggatttcattgggagta

SEQ ID NO: 593881 - DNA, 20 bp, Artificial Sequence
  chemically synthesized
ttcataaggagaaaggtgag

SEQ ID NO: 593882 - DNA, 20 bp, Artificial Sequence
  chemically synthesized
ttctccttatgaaatactac

SEQ ID NO: 593883 - DNA, 20 bp, Artificial Sequence
  chemically synthesized
aagaaagaccacagcctgga

SEQ ID NO: 593884 - DNA, 20 bp, Artificial Sequence
  chemically synthesized
tgataagacaaagttaaatt

SEQ ID NO: 593885 - DNA, 20 bp, Artificial Sequence
  chemically synthesized
ttatcaacaggttgtattgg

SEQ ID NO: 593886 - DNA, 20 bp, Artificial Sequence
  chemically synthesized
cttatctccttgtaacatac

SEQ ID NO: 593887 - DNA, 20 bp, Artificial Sequence
  chemically synthesized
actgcttatctccttgtaac

SEQ ID NO: 593888 - DNA, 20 bp, Artificial Sequence
  chemically synthesized
tttaatccaccccttggcac

SEQ ID NO: 593889 - DNA, 20 bp, Artificial Sequence
  chemically synthesized
gataagcagtggtgccaagg

SEQ ID NO: 593890 - DNA, 20 bp, Artificial Sequence
  chemically synthesized
gtactgattataattaaatt

SEQ ID NO: 593891 - DNA, 20 bp, Artificial Sequence
  chemically synthesized
aagtttgcagagaaaaaatg

SEQ ID NO: 593892 - DNA, 20 bp, Artificial Sequence
  chemically synthesized
gtacattttttctctgcaaa

SEQ ID NO: 593893 - DNA, 20 bp, Artificial Sequence
  chemically synthesized
ataggggacttgttgttaaa

SEQ ID NO: 593894 - DNA, 20 bp, Artificial Sequence
  chemically synthesized
gatgttatcactggtgccat

SEQ ID NO: 593895 - DNA, 20 bp, Artificial Sequence
  chemically synthesized
tgattgtgataaaatatttg

SEQ ID NO: 593896 - DNA, 20 bp, Artificial Sequence
  chemically synthesized
tttgataagttttatgtcct

SEQ ID NO: 593897 - DNA, 20 bp, Artificial Sequence
  chemically synthesized
atacatgagagtgacattaa

SEQ ID NO: 593898 - DNA, 20 bp, Artificial Sequence
  chemically synthesized
ggtttgacatcacaaccacc

SEQ ID NO: 593899 - DNA, 20 bp, Artificial Sequence
  chemically synthesized
ttctgggcctccatgtagtt

SEQ ID NO: 593900 - DNA, 20 bp, Artificial Sequence
  chemically synthesized
tccctaattctgggcctcca

SEQ ID NO: 593901 - DNA, 20 bp, Artificial Sequence
  chemically synthesized
ttttgagcttttgctccggt

SEQ ID NO: 593902 - DNA, 20 bp, Artificial Sequence
  chemically synthesized
tctctcgctctttccccatt

SEQ ID NO: 593903 - DNA, 20 bp, Artificial Sequence
  chemically synthesized
cataaaagactgtttagacc

SEQ ID NO: 593904 - DNA, 20 bp, Artificial Sequence
  chemically synthesized
ccacttaacttgacataaaa

SEQ ID NO: 593905 - DNA, 20 bp, Artificial Sequence
  chemically synthesized
cagtcttttatgtcaagtta

SEQ ID NO: 593906 - DNA, 20 bp, Artificial Sequence
  chemically synthesized
gcaagtgctcagggttatag

SEQ ID NO: 593907 - DNA, 20 bp, Artificial Sequence
  chemically synthesized
cagtaggtctggggtattgt

SEQ ID NO: 593908 - DNA, 20 bp, Artificial Sequence
  chemically synthesized
ggattttcttaattaactga

SEQ ID NO: 593909 - DNA, 20 bp, Artificial Sequence
  chemically synthesized
agttaattaagaaaatcccc

SEQ ID NO: 593910 - DNA, 20 bp, Artificial Sequence
  chemically synthesized
tgatgtgcatcagaatcacc

SEQ ID NO: 593911 - DNA, 20 bp, Artificial Sequence
  chemically synthesized
caggtgattctgatgcacat

SEQ ID NO: 593912 - DNA, 20 bp, Artificial Sequence
  chemically synthesized
ctccagcatattattttgaa

SEQ ID NO: 593913 - DNA, 20 bp, Artificial Sequence
  chemically synthesized
ggaggctacgggaagctact

SEQ ID NO: 593914 - DNA, 20 bp, Artificial Sequence
  chemically synthesized
ttcccttcttaaaatccttc

SEQ ID NO: 593915 - DNA, 20 bp, Artificial Sequence
  chemically synthesized
tgaatttccagctctaaggt

SEQ ID NO: 593916 - DNA, 20 bp, Artificial Sequence
  chemically synthesized
ggaaattcagcactattttg

SEQ ID NO: 593917 - DNA, 20 bp, Artificial Sequence
  chemically synthesized
cattgaatgaatactgaata

SEQ ID NO: 593918 - DNA, 20 bp, Artificial Sequence
  chemically synthesized
aacatttattgcattccaac

SEQ ID NO: 593919 - DNA, 20 bp, Artificial Sequence
  chemically synthesized
ccaactttggtttttttttt

SEQ ID NO: 593920 - DNA, 20 bp, Artificial Sequence
  chemically synthesized
ggttttttttttttttgttt

SEQ ID NO: 593921 - DNA, 20 bp, Artificial Sequence
  chemically synthesized
ttttttttttttgtttgcgt

SEQ ID NO: 593922 - DNA, 20 bp, Artificial Sequence
  chemically synthesized
tttttgtttgcgtgtttgtt

SEQ ID NO: 593923 - DNA, 20 bp, Artificial Sequence
  chemically synthesized
aacctctgcctcccgagttc

SEQ ID NO: 593924 - DNA, 20 bp, Artificial Sequence
  chemically synthesized
tgcctcaggctcctgagtag

SEQ ID NO: 593925 - DNA, 20 bp, Artificial Sequence
  chemically synthesized
aattagctggcttttgtggt

SEQ ID NO: 593926 - DNA, 20 bp, Artificial Sequence
  chemically synthesized
tactaaaaatacaaaaatta

SEQ ID NO: 593927 - DNA, 20 bp, Artificial Sequence
  chemically synthesized
tttgtatttttagtagagat

SEQ ID NO: 593928 - DNA, 20 bp, Artificial Sequence
  chemically synthesized
tgcctcagcatcccaaagtg

SEQ ID NO: 593929 - DNA, 20 bp, Artificial Sequence
  chemically synthesized
ggcatgaaccaccatgcccc

SEQ ID NO: 593930 - DNA, 20 bp, Artificial Sequence
  chemically synthesized
agcttttggaaaagtcaaat

SEQ ID NO: 593931 - DNA, 20 bp, Artificial Sequence
  chemically synthesized
aactttcatttgacttttcc

SEQ ID NO: 593932 - DNA, 20 bp, Artificial Sequence
  chemically synthesized
ttcatttgacttttccaaaa

SEQ ID NO: 593933 - DNA, 20 bp, Artificial Sequence
  chemically synthesized
agtgtgggattatttccaaa

SEQ ID NO: 593934 - DNA, 20 bp, Artificial Sequence
  chemically synthesized
ttaaaaacatagccatcagt

SEQ ID NO: 593935 - DNA, 20 bp, Artificial Sequence
  chemically synthesized
aaataatcccacactgatgg

SEQ ID NO: 593936 - DNA, 20 bp, Artificial Sequence
  chemically synthesized
gactttgagtacagtatgct

SEQ ID NO: 593937 - DNA, 20 bp, Artificial Sequence
  chemically synthesized
aggctgttggctcaaacatg

SEQ ID NO: 593938 - DNA, 20 bp, Artificial Sequence
  chemically synthesized
aactacatcaaaaaaacctt

SEQ ID NO: 593939 - DNA, 20 bp, Artificial Sequence
  chemically synthesized
aacatgaaaggtttttttga

SEQ ID NO: 593940 - DNA, 20 bp, Artificial Sequence
  chemically synthesized
tagtacaagataccaatcaa

SEQ ID NO: 593941 - DNA, 20 bp, Artificial Sequence
  chemically synthesized
tgttcattaacaaaaaacaa

SEQ ID NO: 593942 - DNA, 20 bp, Artificial Sequence
  chemically synthesized
ttaatgaacaacataagatg

SEQ ID NO: 593943 - DNA, 20 bp, Artificial Sequence
  chemically synthesized
tataatctctaatattaaag

SEQ ID NO: 593944 - DNA, 20 bp, Artificial Sequence
  chemically synthesized
ccaaatctaaactttaatat

SEQ ID NO: 593945 - DNA, 20 bp, Artificial Sequence
  chemically synthesized
gatcctataatctctaatat

SEQ ID NO: 593946 - DNA, 20 bp, Artificial Sequence
  chemically synthesized
cattttttgctaacctatgc

SEQ ID NO: 593947 - DNA, 20 bp, Artificial Sequence
  chemically synthesized
actccacataagtaggaatt

SEQ ID NO: 593948 - DNA, 20 bp, Artificial Sequence
  chemically synthesized
aacaagcataaaataggcta

SEQ ID NO: 593949 - DNA, 20 bp, Artificial Sequence
  chemically synthesized
gacaagctagttagcctatt

SEQ ID NO: 593950 - DNA, 20 bp, Artificial Sequence
  chemically synthesized
agctagttagcctattttat

SEQ ID NO: 593951 - DNA, 20 bp, Artificial Sequence
  chemically synthesized
ctattttatgcttgttttat

SEQ ID NO: 593952 - DNA, 20 bp, Artificial Sequence
  chemically synthesized
tcattgcccgctgtccttca

SEQ ID NO: 593953 - DNA, 20 bp, Artificial Sequence
  chemically synthesized
atgagctcgcacttctattt

SEQ ID NO: 593954 - DNA, 20 bp, Artificial Sequence
  chemically synthesized
gctgcctctaatctaccaag

SEQ ID NO: 593955 - DNA, 20 bp, Artificial Sequence
  chemically synthesized
ccttataataatcctggctt

SEQ ID NO: 593956 - DNA, 20 bp, Artificial Sequence
  chemically synthesized
gttattttccttataataat

SEQ ID NO: 593957 - DNA, 20 bp, Artificial Sequence
  chemically synthesized
ccattaagggtcttagatta

SEQ ID NO: 593958 - DNA, 20 bp, Artificial Sequence
  chemically synthesized
ctgggtaatctaagaccctt

SEQ ID NO: 593959 - DNA, 20 bp, Artificial Sequence
  chemically synthesized
ataagaaaaccattaagggt

SEQ ID NO: 593960 - DNA, 20 bp, Artificial Sequence
  chemically synthesized
atggttttcttatagcctca

SEQ ID NO: 593961 - DNA, 20 bp, Artificial Sequence
  chemically synthesized
ggcaggtgccctggacatct

SEQ ID NO: 593962 - DNA, 20 bp, Artificial Sequence
  chemically synthesized
aacaaaaactcagaagctac

SEQ ID NO: 593963 - DNA, 20 bp, Artificial Sequence
  chemically synthesized
atttcaatctttggtagctt

SEQ ID NO: 593964 - DNA, 20 bp, Artificial Sequence
  chemically synthesized
aagggagtatttcaatcttt

SEQ ID NO: 593965 - DNA, 20 bp, Artificial Sequence
  chemically synthesized
cttcaatacccaccaactag

SEQ ID NO: 593966 - DNA, 20 bp, Artificial Sequence
  chemically synthesized
aggggagcttatacaagacc

SEQ ID NO: 593967 - DNA, 20 bp, Artificial Sequence
  chemically synthesized
tctttgttgtagaattactc

SEQ ID NO: 593968 - DNA, 20 bp, Artificial Sequence
  chemically synthesized
ggggaaaattaatatatatt

SEQ ID NO: 593969 - DNA, 20 bp, Artificial Sequence
  chemically synthesized
ctcagggcttattctttata

SEQ ID NO: 593970 - DNA, 20 bp, Artificial Sequence
  chemically synthesized
taatacacatcctctttact

SEQ ID NO: 593971 - DNA, 20 bp, Artificial Sequence
  chemically synthesized
gaaaagaaggtccaaaaaag

SEQ ID NO: 593972 - DNA, 20 bp, Artificial Sequence
  chemically synthesized
agaaggtccaaaaaaggagg

SEQ ID NO: 593973 - DNA, 20 bp, Artificial Sequence
  chemically synthesized
gtgtcctcatctgcaaaatg

SEQ ID NO: 593974 - DNA, 20 bp, Artificial Sequence
  chemically synthesized
agagttagaacactagcaag

SEQ ID NO: 593975 - DNA, 20 bp, Artificial Sequence
  chemically synthesized
ggattgaaacctagtgaatg

SEQ ID NO: 593976 - DNA, 20 bp, Artificial Sequence
  chemically synthesized
tttttgaagcctctcattca

SEQ ID NO: 593977 - DNA, 20 bp, Artificial Sequence
  chemically synthesized
tcaccttttccctgtgtcca

SEQ ID NO: 593978 - DNA, 20 bp, Artificial Sequence
  chemically synthesized
ggacaaatacctaatgcatg

SEQ ID NO: 593979 - DNA, 20 bp, Artificial Sequence
  chemically synthesized
tgcacccatcaacccgtcat

SEQ ID NO: 593980 - DNA, 20 bp, Artificial Sequence
  chemically synthesized
cataggtatacatttgccac

SEQ ID NO: 593981 - DNA, 20 bp, Artificial Sequence
  chemically synthesized
gggatacacgtgcagaatgt

SEQ ID NO: 593982 - DNA, 20 bp, Artificial Sequence
  chemically synthesized
tatcctgctttcattcttca

SEQ ID NO: 593983 - DNA, 20 bp, Artificial Sequence
  chemically synthesized
tagcgctccctccttcccta

SEQ ID NO: 593984 - DNA, 20 bp, Artificial Sequence
  chemically synthesized
tatgagaggctgagggatgt

SEQ ID NO: 593985 - DNA, 20 bp, Artificial Sequence
  chemically synthesized
tcatggttgtagaggatctt

SEQ ID NO: 593986 - DNA, 20 bp, Artificial Sequence
  chemically synthesized
ctacaaccatgaacatagaa

SEQ ID NO: 593987 - DNA, 20 bp, Artificial Sequence
  chemically synthesized
cttgctgtatcaaagactct

SEQ ID NO: 593988 - DNA, 20 bp, Artificial Sequence
  chemically synthesized
aaaaactgtcactttgacta

SEQ ID NO: 593989 - DNA, 20 bp, Artificial Sequence
  chemically synthesized
agaaacatcgtagtcaaagt

SEQ ID NO: 593990 - DNA, 20 bp, Artificial Sequence
  chemically synthesized
actgacatgaatttgaagca

SEQ ID NO: 593991 - DNA, 20 bp, Artificial Sequence
  chemically synthesized
aaaaaaaaaaaaaaaaagct

SEQ ID NO: 593992 - DNA, 20 bp, Artificial Sequence
  chemically synthesized
aaaaaaaaaaaaaaaaaaaa

SEQ ID NO: 593993 - DNA, 20 bp, Artificial Sequence
  chemically synthesized
ttttttttttttttttgagg

SEQ ID NO: 593994 - DNA, 20 bp, Artificial Sequence
  chemically synthesized
gctgaggcaggagaattgag

SEQ ID NO: 593995 - DNA, 20 bp, Artificial Sequence
  chemically synthesized
tgcctcagcctcccaagtac

SEQ ID NO: 593996 - DNA, 20 bp, Artificial Sequence
  chemically synthesized
tgggtggaacacttgaggtc

SEQ ID NO: 593997 - DNA, 20 bp, Artificial Sequence
  chemically synthesized
cacctcagactcccaaagtg

SEQ ID NO: 593998 - DNA, 20 bp, Artificial Sequence
  chemically synthesized
ttcaggcagggtcttcataa

SEQ ID NO: 593999 - DNA, 20 bp, Artificial Sequence
  chemically synthesized
gaagaagtatgtgctagaga

SEQ ID NO: 594000 - DNA, 20 bp, Artificial Sequence
  chemically synthesized
gagtgcagttggatgaaagt

SEQ ID NO: 594001 - DNA, 20 bp, Artificial Sequence
  chemically synthesized
tgactttactgggatgtcta

SEQ ID NO: 594002 - DNA, 20 bp, Artificial Sequence
  chemically synthesized
ataattttgttttggaattg

SEQ ID NO: 594003 - DNA, 20 bp, Artificial Sequence
  chemically synthesized
taacaattccaaaacaaaat

SEQ ID NO: 594004 - DNA, 20 bp, Artificial Sequence
  chemically synthesized
ggtaaaggtggaagcaataa

SEQ ID NO: 594005 - DNA, 20 bp, Artificial Sequence
  chemically synthesized
atttttggaaggtagcacta

SEQ ID NO: 594006 - DNA, 20 bp, Artificial Sequence
  chemically synthesized
cccagaatccatgtacctct

SEQ ID NO: 594007 - DNA, 20 bp, Artificial Sequence
  chemically synthesized
agtgaaaacaatgagaggta

SEQ ID NO: 594008 - DNA, 20 bp, Artificial Sequence
  chemically synthesized
tacctctcattgttttcact

SEQ ID NO: 594009 - DNA, 20 bp, Artificial Sequence
  chemically synthesized
attgttttcactgaaagctt

SEQ ID NO: 594010 - DNA, 20 bp, Artificial Sequence
  chemically synthesized
ataatggtgattctaaacca

SEQ ID NO: 594011 - DNA, 20 bp, Artificial Sequence
  chemically synthesized
ataattcaaatgagaaataa

SEQ ID NO: 594012 - DNA, 20 bp, Artificial Sequence
  chemically synthesized
tgaattattgcaatgactcc

SEQ ID NO: 594013 - DNA, 20 bp, Artificial Sequence
  chemically synthesized
catctcctttctttccccaa

SEQ ID NO: 594014 - DNA, 20 bp, Artificial Sequence
  chemically synthesized
ctatgattttgtcttttcaa

SEQ ID NO: 594015 - DNA, 20 bp, Artificial Sequence
  chemically synthesized
ccctaatctgttctccatct

SEQ ID NO: 594016 - DNA, 20 bp, Artificial Sequence
  chemically synthesized
acaaaatcatagagatggag

SEQ ID NO: 594017 - DNA, 20 bp, Artificial Sequence
  chemically synthesized
gagaacagattaggggttgc

SEQ ID NO: 594018 - DNA, 20 bp, Artificial Sequence
  chemically synthesized
agtgattcaggaagtagaat

SEQ ID NO: 594019 - DNA, 20 bp, Artificial Sequence
  chemically synthesized
gatgggtgtgacaattaaag

SEQ ID NO: 594020 - DNA, 20 bp, Artificial Sequence
  chemically synthesized
tcattctatgcaattttata

SEQ ID NO: 594021 - DNA, 20 bp, Artificial Sequence
  chemically synthesized
ctatgccttattcagatctc

SEQ ID NO: 594022 - DNA, 20 bp, Artificial Sequence
  chemically synthesized
ctggtgagatctgaataagg

SEQ ID NO: 594023 - DNA, 20 bp, Artificial Sequence
  chemically synthesized
gattgtgttaatatcaattt

SEQ ID NO: 594024 - DNA, 20 bp, Artificial Sequence
  chemically synthesized
gatgtgagatctgaataaag

SEQ ID NO: 594025 - DNA, 20 bp, Artificial Sequence
  chemically synthesized
gaaattgatgttgatacaat

SEQ ID NO: 594026 - DNA, 20 bp, Artificial Sequence
  chemically synthesized
gattgtatcaacatcaattt

SEQ ID NO: 594027 - DNA, 20 bp, Artificial Sequence
  chemically synthesized
caacatcaatttcctggttt

SEQ ID NO: 594028 - DNA, 20 bp, Artificial Sequence
  chemically synthesized
tgtatatgtatttcaaaata

SEQ ID NO: 594029 - DNA, 20 bp, Artificial Sequence
  chemically synthesized
tacacggcattcctcaagac

SEQ ID NO: 594030 - DNA, 20 bp, Artificial Sequence
  chemically synthesized
attcctcaagactacggatt

SEQ ID NO: 594031 - DNA, 20 bp, Artificial Sequence
  chemically synthesized
tggataatttctccccttcc

SEQ ID NO: 594032 - DNA, 20 bp, Artificial Sequence
  chemically synthesized
tttaggggtggaggcaagca

SEQ ID NO: 594033 - DNA, 20 bp, Artificial Sequence
  chemically synthesized
ttaactcctgcgctcaagcg

SEQ ID NO: 594034 - DNA, 20 bp, Artificial Sequence
  chemically synthesized
tgcctattacccagttctaa

SEQ ID NO: 594035 - DNA, 20 bp, Artificial Sequence
  chemically synthesized
aagaagacaggaaaatgtgg

SEQ ID NO: 594036 - DNA, 20 bp, Artificial Sequence
  chemically synthesized
aacttcctagagacttgttg

SEQ ID NO: 594037 - DNA, 20 bp, Artificial Sequence
  chemically synthesized
tgtggaactttgaacttgag

SEQ ID NO: 594038 - DNA, 20 bp, Artificial Sequence
  chemically synthesized
ctgtgacctcttgaatgctt

SEQ ID NO: 594039 - DNA, 20 bp, Artificial Sequence
  chemically synthesized
tttatgctctgtgacctctt

SEQ ID NO: 594040 - DNA, 20 bp, Artificial Sequence
  chemically synthesized
ttcaagaggtcacagagcat

SEQ ID NO: 594041 - DNA, 20 bp, Artificial Sequence
  chemically synthesized
acagccagcctctccagaaa

SEQ ID NO: 594042 - DNA, 20 bp, Artificial Sequence
  chemically synthesized
ccagaggtctaggaggcaaa

SEQ ID NO: 594043 - DNA, 20 bp, Artificial Sequence
  chemically synthesized
ggccaaggtacagttcggac

SEQ ID NO: 594044 - DNA, 20 bp, Artificial Sequence
  chemically synthesized
tgcttcagagggagcaagtc

SEQ ID NO: 594045 - DNA, 20 bp, Artificial Sequence
  chemically synthesized
caacaccacgtggcagttgc

SEQ ID NO: 594046 - DNA, 20 bp, Artificial Sequence
  chemically synthesized
gatacacagaattcaagaat

SEQ ID NO: 594047 - DNA, 20 bp, Artificial Sequence
  chemically synthesized
ttgaagtttgggaacctctg

SEQ ID NO: 594048 - DNA, 20 bp, Artificial Sequence
  chemically synthesized
agacttctgcctggacatcc

SEQ ID NO: 594049 - DNA, 20 bp, Artificial Sequence
  chemically synthesized
cccacaatggtagagcgatc

SEQ ID NO: 594050 - DNA, 20 bp, Artificial Sequence
  chemically synthesized
acaggctggcattgagtgtc

SEQ ID NO: 594051 - DNA, 20 bp, Artificial Sequence
  chemically synthesized
cagggtagagcccctctcct

SEQ ID NO: 594052 - DNA, 20 bp, Artificial Sequence
  chemically synthesized
accctgcaaacccacagggg

SEQ ID NO: 594053 - DNA, 20 bp, Artificial Sequence
  chemically synthesized
tcttggtaagctccacccct

SEQ ID NO: 594054 - DNA, 20 bp, Artificial Sequence
  chemically synthesized
aaggagacaacttcagagct

SEQ ID NO: 594055 - DNA, 20 bp, Artificial Sequence
  chemically synthesized
ctgtaagatttgactgccct

SEQ ID NO: 594056 - DNA, 20 bp, Artificial Sequence
  chemically synthesized
actgccctgatagattttgg

SEQ ID NO: 594057 - DNA, 20 bp, Artificial Sequence
  chemically synthesized
tgggtatatttacccagtgc

SEQ ID NO: 594058 - DNA, 20 bp, Artificial Sequence
  chemically synthesized
ttttatctaggaagtaacta

SEQ ID NO: 594059 - DNA, 20 bp, Artificial Sequence
  chemically synthesized
ctaggaagtaactaacttgc

SEQ ID NO: 594060 - DNA, 20 bp, Artificial Sequence
  chemically synthesized
tttggagtactgttgtcaag

SEQ ID NO: 594061 - DNA, 20 bp, Artificial Sequence
  chemically synthesized
agtactgttgtcaaggcatg

SEQ ID NO: 594062 - DNA, 20 bp, Artificial Sequence
  chemically synthesized
ttttgaaatgtgaaagggac

SEQ ID NO: 594063 - DNA, 20 bp, Artificial Sequence
  chemically synthesized
gaggggccaggagcaaaatg

SEQ ID NO: 594064 - DNA, 20 bp, Artificial Sequence
  chemically synthesized
ccaggagcaaaatgatatgt

SEQ ID NO: 594065 - DNA, 20 bp, Artificial Sequence
  chemically synthesized
tataaggattacaattcaag

SEQ ID NO: 594066 - DNA, 20 bp, Artificial Sequence
  chemically synthesized
cctggggattatggggatta

SEQ ID NO: 594067 - DNA, 20 bp, Artificial Sequence
  chemically synthesized
cctttgacacctggggatta

SEQ ID NO: 594068 - DNA, 20 bp, Artificial Sequence
  chemically synthesized
atagcctctcctttgacacc

SEQ ID NO: 594069 - DNA, 20 bp, Artificial Sequence
  chemically synthesized
ggaggtaattgaatcatggg

SEQ ID NO: 594070 - DNA, 20 bp, Artificial Sequence
  chemically synthesized
cagcatgggggaagccaacc

SEQ ID NO: 594071 - DNA, 20 bp, Artificial Sequence
  chemically synthesized
agtgaattctcccaaaatct

SEQ ID NO: 594072 - DNA, 20 bp, Artificial Sequence
  chemically synthesized
gaagagacccttataaaacc

SEQ ID NO: 594073 - DNA, 20 bp, Artificial Sequence
  chemically synthesized
gccaccttgtgaagaaggtg

SEQ ID NO: 594074 - DNA, 20 bp, Artificial Sequence
  chemically synthesized
cgcttccccttcattttctg

SEQ ID NO: 594075 - DNA, 20 bp, Artificial Sequence
  chemically synthesized
cttcattttctgccatgatt

SEQ ID NO: 594076 - DNA, 20 bp, Artificial Sequence
  chemically synthesized
ttgggtaatttataaaggaa

SEQ ID NO: 594077 - DNA, 20 bp, Artificial Sequence
  chemically synthesized
ataccgctagaaagaactgc

SEQ ID NO: 594078 - DNA, 20 bp, Artificial Sequence
  chemically synthesized
tcaagagagggagtgtatta

SEQ ID NO: 594079 - DNA, 20 bp, Artificial Sequence
  chemically synthesized
gggctaatacactccctctc

SEQ ID NO: 594080 - DNA, 20 bp, Artificial Sequence
  chemically synthesized
ccaccatgcccagccgaaat

SEQ ID NO: 594081 - DNA, 20 bp, Artificial Sequence
  chemically synthesized
ttaggaggtagatgtgggtg

SEQ ID NO: 594082 - DNA, 20 bp, Artificial Sequence
  chemically synthesized
tgtaccacgatacccagcta

SEQ ID NO: 594083 - DNA, 20 bp, Artificial Sequence
  chemically synthesized
ccatgatcacgtcactgcac

SEQ ID NO: 594084 - DNA, 20 bp, Artificial Sequence
  chemically synthesized
gggaaaaagtgacaggaaca

SEQ ID NO: 594085 - DNA, 20 bp, Artificial Sequence
  chemically synthesized
tgtcactttttccctatctt

SEQ ID NO: 594086 - DNA, 20 bp, Artificial Sequence
  chemically synthesized
atatgagctccttgaaagga

SEQ ID NO: 594087 - DNA, 20 bp, Artificial Sequence
  chemically synthesized
tccttgaaaggacagcgttt

SEQ ID NO: 594088 - DNA, 20 bp, Artificial Sequence
  chemically synthesized
tctgcatgactgttccttct

SEQ ID NO: 594089 - DNA, 20 bp, Artificial Sequence
  chemically synthesized
gctagtagaaggaacagtca

SEQ ID NO: 594090 - DNA, 20 bp, Artificial Sequence
  chemically synthesized
tagaaggaacagtcatgcag

SEQ ID NO: 594091 - DNA, 20 bp, Artificial Sequence
  chemically synthesized
tttttaagtactgccaagga

SEQ ID NO: 594092 - DNA, 20 bp, Artificial Sequence
  chemically synthesized
agcaagttttctttttcctt

SEQ ID NO: 594093 - DNA, 20 bp, Artificial Sequence
  chemically synthesized
ggaaaaagaaaacttgctcc

SEQ ID NO: 594094 - DNA, 20 bp, Artificial Sequence
  chemically synthesized
gtatcacagaagcagcagga

SEQ ID NO: 594095 - DNA, 20 bp, Artificial Sequence
  chemically synthesized
caaagaaaaacctcattatt

SEQ ID NO: 594096 - DNA, 20 bp, Artificial Sequence
  chemically synthesized
tttaaaaaaactgctaataa

SEQ ID NO: 594097 - DNA, 20 bp, Artificial Sequence
  chemically synthesized
tgtaatctagggactatctg

SEQ ID NO: 594098 - DNA, 20 bp, Artificial Sequence
  chemically synthesized
aagaatcaatacagatagtc

SEQ ID NO: 594099 - DNA, 20 bp, Artificial Sequence
  chemically synthesized
gttctgcacatttgaaagac

SEQ ID NO: 594100 - DNA, 20 bp, Artificial Sequence
  chemically synthesized
tcctctgttaggtacaggtt

SEQ ID NO: 594101 - DNA, 20 bp, Artificial Sequence
  chemically synthesized
attgaattcctctgttaggt

SEQ ID NO: 594102 - DNA, 20 bp, Artificial Sequence
  chemically synthesized
attatttacactatacttca

SEQ ID NO: 594103 - DNA, 20 bp, Artificial Sequence
  chemically synthesized
tgaagtatagtgtaaataat

SEQ ID NO: 594104 - DNA, 20 bp, Artificial Sequence
  chemically synthesized
ctgcacgttgtaagtaattc

SEQ ID NO: 594105 - DNA, 20 bp, Artificial Sequence
  chemically synthesized
ttcaaggcccacatttcctt

SEQ ID NO: 594106 - DNA, 20 bp, Artificial Sequence
  chemically synthesized
aaggtagcatcagagtgaca

SEQ ID NO: 594107 - DNA, 20 bp, Artificial Sequence
  chemically synthesized
cacaaaggtagcatcagagt

SEQ ID NO: 594108 - DNA, 20 bp, Artificial Sequence
  chemically synthesized
tgctacctttgtgatgttgg

SEQ ID NO: 594109 - DNA, 20 bp, Artificial Sequence
  chemically synthesized
caagtcacagttgaggaaat

SEQ ID NO: 594110 - DNA, 20 bp, Artificial Sequence
  chemically synthesized
atgatcattgagactaccca

SEQ ID NO: 594111 - DNA, 20 bp, Artificial Sequence
  chemically synthesized
tcattgagactacccaccag

SEQ ID NO: 594112 - DNA, 20 bp, Artificial Sequence
  chemically synthesized
gactacccaccaggattgtt

SEQ ID NO: 594113 - DNA, 20 bp, Artificial Sequence
  chemically synthesized
atcagggacgttgttagacc

SEQ ID NO: 594114 - DNA, 20 bp, Artificial Sequence
  chemically synthesized
gaatgaatatttaacaagta

SEQ ID NO: 594115 - DNA, 20 bp, Artificial Sequence
  chemically synthesized
aggacaggcacgaaggcctt

SEQ ID NO: 594116 - DNA, 20 bp, Artificial Sequence
  chemically synthesized
tttgtgagcctatccatcta

SEQ ID NO: 594117 - DNA, 20 bp, Artificial Sequence
  chemically synthesized
taccttctaattctctactc

SEQ ID NO: 594118 - DNA, 20 bp, Artificial Sequence
  chemically synthesized
ttggaattttagggtcaata

SEQ ID NO: 594119 - DNA, 20 bp, Artificial Sequence
  chemically synthesized
ttcattaaaaagaaaagaaa

SEQ ID NO: 594120 - DNA, 20 bp, Artificial Sequence
  chemically synthesized
tcatgcttatcttgtataaa

SEQ ID NO: 594121 - DNA, 20 bp, Artificial Sequence
  chemically synthesized
aagatgcagcagtgaagaag

SEQ ID NO: 594122 - DNA, 20 bp, Artificial Sequence
  chemically synthesized
cactgctgcatctttttgac

SEQ ID NO: 594123 - DNA, 20 bp, Artificial Sequence
  chemically synthesized
gggcaggccccaggctgcag

SEQ ID NO: 594124 - DNA, 20 bp, Artificial Sequence
  chemically synthesized
ttaaagtaattcattggcat

SEQ ID NO: 594125 - DNA, 20 bp, Artificial Sequence
  chemically synthesized
gtaattcattggcatgactg

SEQ ID NO: 594126 - DNA, 20 bp, Artificial Sequence
  chemically synthesized
ggcatgactgcttggtttgt

SEQ ID NO: 594127 - DNA, 20 bp, Artificial Sequence
  chemically synthesized
tggattaatcatctctctca

SEQ ID NO: 594128 - DNA, 20 bp, Artificial Sequence
  chemically synthesized
ggctaaaatctccttgagag

SEQ ID NO: 594129 - DNA, 20 bp, Artificial Sequence
  chemically synthesized
attcctgtgcaagatgccta

SEQ ID NO: 594130 - DNA, 20 bp, Artificial Sequence
  chemically synthesized
cttgtagctagtatcttcat

SEQ ID NO: 594131 - DNA, 20 bp, Artificial Sequence
  chemically synthesized
catggcccctaaacgctgat

SEQ ID NO: 594132 - DNA, 20 bp, Artificial Sequence
  chemically synthesized
gtaaggctgaaagcagatat

SEQ ID NO: 594133 - DNA, 20 bp, Artificial Sequence
  chemically synthesized
gaagatgggtcattcttaac

SEQ ID NO: 594134 - DNA, 20 bp, Artificial Sequence
  chemically synthesized
atgacccatcttccctttgg

SEQ ID NO: 594135 - DNA, 20 bp, Artificial Sequence
  chemically synthesized
cttccctttggaagagttta

SEQ ID NO: 594136 - DNA, 20 bp, Artificial Sequence
  chemically synthesized
ttttttaaagagattatgaa

SEQ ID NO: 594137 - DNA, 20 bp, Artificial Sequence
  chemically synthesized
atgccagtcaaattttttta

SEQ ID NO: 594138 - DNA, 20 bp, Artificial Sequence
  chemically synthesized
tataactgtcattggtcaga

SEQ ID NO: 594139 - DNA, 20 bp, Artificial Sequence
  chemically synthesized
tttttataactgtcattggt

SEQ ID NO: 594140 - DNA, 20 bp, Artificial Sequence
  chemically synthesized
tgagggaatttagttttttt

SEQ ID NO: 594141 - DNA, 20 bp, Artificial Sequence
  chemically synthesized
tcctgttttctctgagggaa

SEQ ID NO: 594142 - DNA, 20 bp, Artificial Sequence
  chemically synthesized
ttaaagttgctcccatactt

SEQ ID NO: 594143 - DNA, 20 bp, Artificial Sequence
  chemically synthesized
taacagtttgttattattcc

SEQ ID NO: 594144 - DNA, 20 bp, Artificial Sequence
  chemically synthesized
agataggttaaatattaagt

SEQ ID NO: 594145 - DNA, 20 bp, Artificial Sequence
  chemically synthesized
tcttttccccgaagggctca

SEQ ID NO: 594146 - DNA, 20 bp, Artificial Sequence
  chemically synthesized
agggctcaagctgattattt

SEQ ID NO: 594147 - DNA, 20 bp, Artificial Sequence
  chemically synthesized
ccgtcaaaagcaagaaaata

SEQ ID NO: 594148 - DNA, 20 bp, Artificial Sequence
  chemically synthesized
tttgtcacctccttgaacta

SEQ ID NO: 594149 - DNA, 20 bp, Artificial Sequence
  chemically synthesized
tgaactattaagttttccct

SEQ ID NO: 594150 - DNA, 20 bp, Artificial Sequence
  chemically synthesized
cacttacacaggtcttgtaa

SEQ ID NO: 594151 - DNA, 20 bp, Artificial Sequence
  chemically synthesized
tgggtctaatagcttttgaa

SEQ ID NO: 594152 - DNA, 20 bp, Artificial Sequence
  chemically synthesized
tgtgtaatttatgtgggtct

SEQ ID NO: 594153 - DNA, 20 bp, Artificial Sequence
  chemically synthesized
acccacataaattacacaaa

SEQ ID NO: 594154 - DNA, 20 bp, Artificial Sequence
  chemically synthesized
gttgatgtggacagacgaac

SEQ ID NO: 594155 - DNA, 20 bp, Artificial Sequence
  chemically synthesized
ccactcccttcttttattat

SEQ ID NO: 594156 - DNA, 20 bp, Artificial Sequence
  chemically synthesized
ctcaaagcaggtgtgaatta

SEQ ID NO: 594157 - DNA, 20 bp, Artificial Sequence
  chemically synthesized
aaataaactgtgtaattcac

SEQ ID NO: 594158 - DNA, 20 bp, Artificial Sequence
  chemically synthesized
tgtaattcacacctgctttg

SEQ ID NO: 594159 - DNA, 20 bp, Artificial Sequence
  chemically synthesized
gagctgattggttgatctgt

SEQ ID NO: 594160 - DNA, 20 bp, Artificial Sequence
  chemically synthesized
atctgtccttgattgtccca

SEQ ID NO: 594161 - DNA, 20 bp, Artificial Sequence
  chemically synthesized
ccaggtggatttattctccc

SEQ ID NO: 594162 - DNA, 20 bp, Artificial Sequence
  chemically synthesized
gaacctgcaggattcctacc

SEQ ID NO: 594163 - DNA, 20 bp, Artificial Sequence
  chemically synthesized
ccttctccaggtatgaacct

SEQ ID NO: 594164 - DNA, 20 bp, Artificial Sequence
  chemically synthesized
atgaacattgcatttaaggc

SEQ ID NO: 594165 - DNA, 20 bp, Artificial Sequence
  chemically synthesized
cttggccatcccataggctg

SEQ ID NO: 594166 - DNA, 20 bp, Artificial Sequence
  chemically synthesized
ggccaagtccttgaaggtga

SEQ ID NO: 594167 - DNA, 20 bp, Artificial Sequence
  chemically synthesized
tgaatgggctatattatagt

SEQ ID NO: 594168 - DNA, 20 bp, Artificial Sequence
  chemically synthesized
tatagttaatgatttgaaat

SEQ ID NO: 594169 - DNA, 20 bp, Artificial Sequence
  chemically synthesized
tctaggcaattatttctaaa

SEQ ID NO: 594170 - DNA, 20 bp, Artificial Sequence
  chemically synthesized
tgatgagaaatatatataat

SEQ ID NO: 594171 - DNA, 20 bp, Artificial Sequence
  chemically synthesized
tcactatgcataatttttat

SEQ ID NO: 594172 - DNA, 20 bp, Artificial Sequence
  chemically synthesized
tgggggactatgagaatgct

SEQ ID NO: 594173 - DNA, 20 bp, Artificial Sequence
  chemically synthesized
tgcctgttgggggactatga

SEQ ID NO: 594174 - DNA, 20 bp, Artificial Sequence
  chemically synthesized
aaaataccccccttttattg

SEQ ID NO: 594175 - DNA, 20 bp, Artificial Sequence
  chemically synthesized
agaagtgtaaattcataaca

SEQ ID NO: 594176 - DNA, 20 bp, Artificial Sequence
  chemically synthesized
gtgtcactattactagaagt

SEQ ID NO: 594177 - DNA, 20 bp, Artificial Sequence
  chemically synthesized
ctagagaaggggtagatggc

SEQ ID NO: 594178 - DNA, 20 bp, Artificial Sequence
  chemically synthesized
ttgtgacatttttttcctcg

SEQ ID NO: 594179 - DNA, 20 bp, Artificial Sequence
  chemically synthesized
cttttaaaattgagaagaca

SEQ ID NO: 594180 - DNA, 20 bp, Artificial Sequence
  chemically synthesized
gcaaggaaaaatgatcagct

SEQ ID NO: 594181 - DNA, 20 bp, Artificial Sequence
  chemically synthesized
ttgtgataagctatttttct

SEQ ID NO: 594182 - DNA, 20 bp, Artificial Sequence
  chemically synthesized
tgtggaaaatcatttagaaa

SEQ ID NO: 594183 - DNA, 20 bp, Artificial Sequence
  chemically synthesized
taaatgattttccacataat

SEQ ID NO: 594184 - DNA, 20 bp, Artificial Sequence
  chemically synthesized
agagaagatctttgctaaag

SEQ ID NO: 594185 - DNA, 20 bp, Artificial Sequence
  chemically synthesized
caaagatcttctcttttttt

SEQ ID NO: 594186 - DNA, 20 bp, Artificial Sequence
  chemically synthesized
cttttttttctagtttccat

SEQ ID NO: 594187 - DNA, 20 bp, Artificial Sequence
  chemically synthesized
cacctcagcctcccaaagtg

SEQ ID NO: 594188 - DNA, 20 bp, Artificial Sequence
  chemically synthesized
gcctgaccaacatggtgaaa

SEQ ID NO: 594189 - DNA, 20 bp, Artificial Sequence
  chemically synthesized
ttttgtatttttggtagaaa

SEQ ID NO: 594190 - DNA, 20 bp, Artificial Sequence
  chemically synthesized
tgcctcagcctcctgaatag

SEQ ID NO: 594191 - DNA, 20 bp, Artificial Sequence
  chemically synthesized
tcaggaggctgaggcaggag

SEQ ID NO: 594192 - DNA, 20 bp, Artificial Sequence
  chemically synthesized
aacctctgcctcccagattc

SEQ ID NO: 594193 - DNA, 20 bp, Artificial Sequence
  chemically synthesized
actcacttcaacctctgcct

SEQ ID NO: 594194 - DNA, 20 bp, Artificial Sequence
  chemically synthesized
gaggcagaggttgaagtgag

SEQ ID NO: 594195 - DNA, 20 bp, Artificial Sequence
  chemically synthesized
attattattattatttgaga

SEQ ID NO: 594196 - DNA, 20 bp, Artificial Sequence
  chemically synthesized
ttattactataagaataaat

SEQ ID NO: 594197 - DNA, 20 bp, Artificial Sequence
  chemically synthesized
tatttttacctaaacgtagt

SEQ ID NO: 594198 - DNA, 20 bp, Artificial Sequence
  chemically synthesized
actgtggcatgaagccacta

SEQ ID NO: 594199 - DNA, 20 bp, Artificial Sequence
  chemically synthesized
caaaggatagtgagatggct

SEQ ID NO: 594200 - DNA, 20 bp, Artificial Sequence
  chemically synthesized
agccatctcactatcctttg

SEQ ID NO: 594201 - DNA, 20 bp, Artificial Sequence
  chemically synthesized
gtaaattccttcttccagac

SEQ ID NO: 594202 - DNA, 20 bp, Artificial Sequence
  chemically synthesized
atacagtggttctcagccag

SEQ ID NO: 594203 - DNA, 20 bp, Artificial Sequence
  chemically synthesized
tacatataacaggtataaat

SEQ ID NO: 594204 - DNA, 20 bp, Artificial Sequence
  chemically synthesized
tatacctgttatatgtaaaa

SEQ ID NO: 594205 - DNA, 20 bp, Artificial Sequence
  chemically synthesized
ttttattgtttaccaatatt

SEQ ID NO: 594206 - DNA, 20 bp, Artificial Sequence
  chemically synthesized
tagtaatattggtaaacaat

SEQ ID NO: 594207 - DNA, 20 bp, Artificial Sequence
  chemically synthesized
tcatttgctgaataagcttt

SEQ ID NO: 594208 - DNA, 20 bp, Artificial Sequence
  chemically synthesized
tcaatatattcatttgctga

SEQ ID NO: 594209 - DNA, 20 bp, Artificial Sequence
  chemically synthesized
taattttggaaaaagtagat

SEQ ID NO: 594210 - DNA, 20 bp, Artificial Sequence
  chemically synthesized
tctgtgtcagccgtattaac

SEQ ID NO: 594211 - DNA, 20 bp, Artificial Sequence
  chemically synthesized
cagaaaaacacagtcagata

SEQ ID NO: 594212 - DNA, 20 bp, Artificial Sequence
  chemically synthesized
ctctaaaactgcctatctga

SEQ ID NO: 594213 - DNA, 20 bp, Artificial Sequence
  chemically synthesized
ccacctcacattatgaacag

SEQ ID NO: 594214 - DNA, 20 bp, Artificial Sequence
  chemically synthesized
gtatttattaatccttcttt

SEQ ID NO: 594215 - DNA, 20 bp, Artificial Sequence
  chemically synthesized
tagcaacagaagcattaaaa

SEQ ID NO: 594216 - DNA, 20 bp, Artificial Sequence
  chemically synthesized
gtccttaccgaatactagtg

SEQ ID NO: 594217 - DNA, 20 bp, Artificial Sequence
  chemically synthesized
ctagtgataggatttataaa

SEQ ID NO: 594218 - DNA, 20 bp, Artificial Sequence
  chemically synthesized
tcactgttatatgagttcaa

SEQ ID NO: 594219 - DNA, 20 bp, Artificial Sequence
  chemically synthesized
tttgttgaactcatataaca

SEQ ID NO: 594220 - DNA, 20 bp, Artificial Sequence
  chemically synthesized
agcattacagagaattctta

SEQ ID NO: 594221 - DNA, 20 bp, Artificial Sequence
  chemically synthesized
atcacactaagaattctctg

SEQ ID NO: 594222 - DNA, 20 bp, Artificial Sequence
  chemically synthesized
atctcttagatgaaattggg

SEQ ID NO: 594223 - DNA, 20 bp, Artificial Sequence
  chemically synthesized
cataatataataactattga

SEQ ID NO: 594224 - DNA, 20 bp, Artificial Sequence
  chemically synthesized
tctttcccatacatttcaga

SEQ ID NO: 594225 - DNA, 20 bp, Artificial Sequence
  chemically synthesized
agataaatattacacttaaa

SEQ ID NO: 594226 - DNA, 20 bp, Artificial Sequence
  chemically synthesized
tttctatgacattaagagga

SEQ ID NO: 594227 - DNA, 20 bp, Artificial Sequence
  chemically synthesized
tcctttatcttaatagagaa

SEQ ID NO: 594228 - DNA, 20 bp, Artificial Sequence
  chemically synthesized
tttatatgagctatgaaaat

SEQ ID NO: 594229 - DNA, 20 bp, Artificial Sequence
  chemically synthesized
gctcatataaagaaatatag

SEQ ID NO: 594230 - DNA, 20 bp, Artificial Sequence
  chemically synthesized
gaaggaacaaatgaaagccc

SEQ ID NO: 594231 - DNA, 20 bp, Artificial Sequence
  chemically synthesized
ctcaaaacactggtaatcta

SEQ ID NO: 594232 - DNA, 20 bp, Artificial Sequence
  chemically synthesized
atgaaagcccagtagattac

SEQ ID NO: 594233 - DNA, 20 bp, Artificial Sequence
  chemically synthesized
ttattcatttcagggaattg

SEQ ID NO: 594234 - DNA, 20 bp, Artificial Sequence
  chemically synthesized
ggcaaatttgaccgttttgt

SEQ ID NO: 594235 - DNA, 20 bp, Artificial Sequence
  chemically synthesized
ccaatcattcaggcaaattt

SEQ ID NO: 594236 - DNA, 20 bp, Artificial Sequence
  chemically synthesized
caaaacggtcaaatttgcct

SEQ ID NO: 594237 - DNA, 20 bp, Artificial Sequence
  chemically synthesized
caaatttgcctgaatgattg

SEQ ID NO: 594238 - DNA, 20 bp, Artificial Sequence
  chemically synthesized
gctgaattagtaaaggatta

SEQ ID NO: 594239 - DNA, 20 bp, Artificial Sequence
  chemically synthesized
taagactttgctgaattagt

SEQ ID NO: 594240 - DNA, 20 bp, Artificial Sequence
  chemically synthesized
aaatagataacaggtcatat

SEQ ID NO: 594241 - DNA, 20 bp, Artificial Sequence
  chemically synthesized
actgatgtttttaaaaagag

SEQ ID NO: 594242 - DNA, 20 bp, Artificial Sequence
  chemically synthesized
acattactctttttaaaaac

SEQ ID NO: 594243 - DNA, 20 bp, Artificial Sequence
  chemically synthesized
tctgtggcatattcggaaac

SEQ ID NO: 594244 - DNA, 20 bp, Artificial Sequence
  chemically synthesized
gaatatgccacagaatctta

SEQ ID NO: 594245 - DNA, 20 bp, Artificial Sequence
  chemically synthesized
gggagggcatttcaatcaaa

SEQ ID NO: 594246 - DNA, 20 bp, Artificial Sequence
  chemically synthesized
ttttgtgttcaatagcaact

SEQ ID NO: 594247 - DNA, 20 bp, Artificial Sequence
  chemically synthesized
ctcccgttgtgggacttgag

SEQ ID NO: 594248 - DNA, 20 bp, Artificial Sequence
  chemically synthesized
tagacttatactctatagtg

SEQ ID NO: 594249 - DNA, 20 bp, Artificial Sequence
  chemically synthesized
aaacagaaaattgaataaca

SEQ ID NO: 594250 - DNA, 20 bp, Artificial Sequence
  chemically synthesized
aaaccatatgttattcaatt

SEQ ID NO: 594251 - DNA, 20 bp, Artificial Sequence
  chemically synthesized
atgtggccagttccttacaa

SEQ ID NO: 594252 - DNA, 20 bp, Artificial Sequence
  chemically synthesized
atataaagaggacattcaca

SEQ ID NO: 594253 - DNA, 20 bp, Artificial Sequence
  chemically synthesized
aattcagctgaaaattttta

SEQ ID NO: 594254 - DNA, 20 bp, Artificial Sequence
  chemically synthesized
cagttatcatgcaaatacct

SEQ ID NO: 594255 - DNA, 20 bp, Artificial Sequence
  chemically synthesized
ctatgatctttgatttgatc

SEQ ID NO: 594256 - DNA, 20 bp, Artificial Sequence
  chemically synthesized
ttccaagatacctctatgat

SEQ ID NO: 594257 - DNA, 20 bp, Artificial Sequence
  chemically synthesized
agaggtatcttggaatacac

SEQ ID NO: 594258 - DNA, 20 bp, Artificial Sequence
  chemically synthesized
ggctaagtatttgttgcagt

SEQ ID NO: 594259 - DNA, 20 bp, Artificial Sequence
  chemically synthesized
gtatttgttgcagtatagga

SEQ ID NO: 594260 - DNA, 20 bp, Artificial Sequence
  chemically synthesized
aaattggactcaattttatt

SEQ ID NO: 594261 - DNA, 20 bp, Artificial Sequence
  chemically synthesized
ttttattttcagcttgtgat

SEQ ID NO: 594262 - DNA, 20 bp, Artificial Sequence
  chemically synthesized
attttcagcagcatgtggca

SEQ ID NO: 594263 - DNA, 20 bp, Artificial Sequence
  chemically synthesized
gatactactgtactcatgag

SEQ ID NO: 594264 - DNA, 20 bp, Artificial Sequence
  chemically synthesized
actcacacatgacataagaa

SEQ ID NO: 594265 - DNA, 20 bp, Artificial Sequence
  chemically synthesized
ctctatgatttttcagtaaa

SEQ ID NO: 594266 - DNA, 20 bp, Artificial Sequence
  chemically synthesized
gttttactgaaaaatcatag

SEQ ID NO: 594267 - DNA, 20 bp, Artificial Sequence
  chemically synthesized
ttgctttactaaaaacacct

SEQ ID NO: 594268 - DNA, 20 bp, Artificial Sequence
  chemically synthesized
aagaaaaagattattttctt

SEQ ID NO: 594269 - DNA, 20 bp, Artificial Sequence
  chemically synthesized
agcatcagaaatatataaga

SEQ ID NO: 594270 - DNA, 20 bp, Artificial Sequence
  chemically synthesized
atctttttcttatatatttc

SEQ ID NO: 594271 - DNA, 20 bp, Artificial Sequence
  chemically synthesized
atgcttcctaaaaattatta

SEQ ID NO: 594272 - DNA, 20 bp, Artificial Sequence
  chemically synthesized
cctaaaaattattattatga

SEQ ID NO: 594273 - DNA, 20 bp, Artificial Sequence
  chemically synthesized
aacctccgcctcccaggttc

SEQ ID NO: 594274 - DNA, 20 bp, Artificial Sequence
  chemically synthesized
tgcctcagcctcccgagtag

SEQ ID NO: 594275 - DNA, 20 bp, Artificial Sequence
  chemically synthesized
ttttgtatttttagtagaga

SEQ ID NO: 594276 - DNA, 20 bp, Artificial Sequence
  chemically synthesized
caccgtgttagccaggatgg

SEQ ID NO: 594277 - DNA, 20 bp, Artificial Sequence
  chemically synthesized
cacctcggcctcccaaagtg

SEQ ID NO: 594278 - DNA, 20 bp, Artificial Sequence
  chemically synthesized
aaatatctttaaaatatttt

SEQ ID NO: 594279 - DNA, 20 bp, Artificial Sequence
  chemically synthesized
atacttccaaatatttatat

SEQ ID NO: 594280 - DNA, 20 bp, Artificial Sequence
  chemically synthesized
tatatgtatgctttaggaaa

SEQ ID NO: 594281 - DNA, 20 bp, Artificial Sequence
  chemically synthesized
agacatctcattttcctgtt

SEQ ID NO: 594282 - DNA, 20 bp, Artificial Sequence
  chemically synthesized
ccttttgtttgtgactttga

SEQ ID NO: 594283 - DNA, 20 bp, Artificial Sequence
  chemically synthesized
tataataatgtggagtcacc

SEQ ID NO: 594284 - DNA, 20 bp, Artificial Sequence
  chemically synthesized
cattttcagaggttgaagtc

SEQ ID NO: 594285 - DNA, 20 bp, Artificial Sequence
  chemically synthesized
aggagaaataagactggaca

SEQ ID NO: 594286 - DNA, 20 bp, Artificial Sequence
  chemically synthesized
actggacaacaggcttccag

SEQ ID NO: 594287 - DNA, 20 bp, Artificial Sequence
  chemically synthesized
tggtgttatagtacctcatt

SEQ ID NO: 594288 - DNA, 20 bp, Artificial Sequence
  chemically synthesized
aacagttgttgtcaggagtc

SEQ ID NO: 594289 - DNA, 20 bp, Artificial Sequence
  chemically synthesized
gctagttacggcttgagggc

SEQ ID NO: 594290 - DNA, 20 bp, Artificial Sequence
  chemically synthesized
aaaaatggcaatgggctagt

SEQ ID NO: 594291 - DNA, 20 bp, Artificial Sequence
  chemically synthesized
cccattgccatttttgtaaa

SEQ ID NO: 594292 - DNA, 20 bp, Artificial Sequence
  chemically synthesized
ttcatttctctattgtctat

SEQ ID NO: 594293 - DNA, 20 bp, Artificial Sequence
  chemically synthesized
cagagagtaaatattttagg

SEQ ID NO: 594294 - DNA, 20 bp, Artificial Sequence
  chemically synthesized
agggccagagagtaaatatt

SEQ ID NO: 594295 - DNA, 20 bp, Artificial Sequence
  chemically synthesized
aatatttactctctggccct

SEQ ID NO: 594296 - DNA, 20 bp, Artificial Sequence
  chemically synthesized
gttttatagtaggggttagc

SEQ ID NO: 594297 - DNA, 20 bp, Artificial Sequence
  chemically synthesized
accatagcttccaaagacaa

SEQ ID NO: 594298 - DNA, 20 bp, Artificial Sequence
  chemically synthesized
ttattctgtttttaatttac

SEQ ID NO: 594299 - DNA, 20 bp, Artificial Sequence
  chemically synthesized
atacgtgagcaatagtttta

SEQ ID NO: 594300 - DNA, 20 bp, Artificial Sequence
  chemically synthesized
aaaataaaatatacgtgagc

SEQ ID NO: 594301 - DNA, 20 bp, Artificial Sequence
  chemically synthesized
tattttttttttttcctgga

SEQ ID NO: 594302 - DNA, 20 bp, Artificial Sequence
  chemically synthesized
tggagtgcttctgcttctgt

SEQ ID NO: 594303 - DNA, 20 bp, Artificial Sequence
  chemically synthesized
aagcacacttattggagtgc

SEQ ID NO: 594304 - DNA, 20 bp, Artificial Sequence
  chemically synthesized
aagcagaagcactccaataa

SEQ ID NO: 594305 - DNA, 20 bp, Artificial Sequence
  chemically synthesized
gtaaccaagcacacttattg

SEQ ID NO: 594306 - DNA, 20 bp, Artificial Sequence
  chemically synthesized
tggttacatgaataacttgt

SEQ ID NO: 594307 - DNA, 20 bp, Artificial Sequence
  chemically synthesized
agtaccaggcagacatattt

SEQ ID NO: 594308 - DNA, 20 bp, Artificial Sequence
  chemically synthesized
gagcctcttttgaaactttg

SEQ ID NO: 594309 - DNA, 20 bp, Artificial Sequence
  chemically synthesized
gaatagaaaataaatctttt

SEQ ID NO: 594310 - DNA, 20 bp, Artificial Sequence
  chemically synthesized
acatgtcttgtcttagggcc

SEQ ID NO: 594311 - DNA, 20 bp, Artificial Sequence
  chemically synthesized
ccaattttatttgcttgttt

SEQ ID NO: 594312 - DNA, 20 bp, Artificial Sequence
  chemically synthesized
tacatttgccaattttattt

SEQ ID NO: 594313 - DNA, 20 bp, Artificial Sequence
  chemically synthesized
aacttacatttgccaatttt

SEQ ID NO: 594314 - DNA, 20 bp, Artificial Sequence
  chemically synthesized
agcaaataaaattggcaaat

SEQ ID NO: 594315 - DNA, 20 bp, Artificial Sequence
  chemically synthesized
ataaaattggcaaatgtaag

SEQ ID NO: 594316 - DNA, 20 bp, Artificial Sequence
  chemically synthesized
cctctcaatagcattaagaa

SEQ ID NO: 594317 - DNA, 20 bp, Artificial Sequence
  chemically synthesized
gggaacttttctgtcttaca

SEQ ID NO: 594318 - DNA, 20 bp, Artificial Sequence
  chemically synthesized
gacgggaaggttcctgattg

SEQ ID NO: 594319 - DNA, 20 bp, Artificial Sequence
  chemically synthesized
ctcttgtaagacgggaaggt

SEQ ID NO: 594320 - DNA, 20 bp, Artificial Sequence
  chemically synthesized
aggaaccttcccgtcttaca

SEQ ID NO: 594321 - DNA, 20 bp, Artificial Sequence
  chemically synthesized
attttacagagcgctgattg

SEQ ID NO: 594322 - DNA, 20 bp, Artificial Sequence
  chemically synthesized
gattggtgcattttacagag

SEQ ID NO: 594323 - DNA, 20 bp, Artificial Sequence
  chemically synthesized
tctgtaaaatgcaccaatca

SEQ ID NO: 594324 - DNA, 20 bp, Artificial Sequence
  chemically synthesized
attggctacttttagaatcc

SEQ ID NO: 594325 - DNA, 20 bp, Artificial Sequence
  chemically synthesized
ctaaaagtagccaatcgtgg

SEQ ID NO: 594326 - DNA, 20 bp, Artificial Sequence
  chemically synthesized
tgcccttttttcaatcctcc

SEQ ID NO: 594327 - DNA, 20 bp, Artificial Sequence
  chemically synthesized
tgccgctgctggcttgggtg

SEQ ID NO: 594328 - DNA, 20 bp, Artificial Sequence
  chemically synthesized
cacccaagccagcagcggca

SEQ ID NO: 594329 - DNA, 20 bp, Artificial Sequence
  chemically synthesized
gacccaagcaggttgccgct

SEQ ID NO: 594330 - DNA, 20 bp, Artificial Sequence
  chemically synthesized
tgggtccccttccacgttgt

SEQ ID NO: 594331 - DNA, 20 bp, Artificial Sequence
  chemically synthesized
tattgtgaagagcaaaagaa

SEQ ID NO: 594332 - DNA, 20 bp, Artificial Sequence
  chemically synthesized
caataaatcttgctgctgct

SEQ ID NO: 594333 - DNA, 20 bp, Artificial Sequence
  chemically synthesized
aacccaaacagcgagcagca

SEQ ID NO: 594334 - DNA, 20 bp, Artificial Sequence
  chemically synthesized
taacagtcaccgcagaggtc

SEQ ID NO: 594335 - DNA, 20 bp, Artificial Sequence
  chemically synthesized
cttccttaaaggttaccttc

SEQ ID NO: 594336 - DNA, 20 bp, Artificial Sequence
  chemically synthesized
ttttgtacatgaaactcaac

SEQ ID NO: 594337 - DNA, 20 bp, Artificial Sequence
  chemically synthesized
cataaaataggaatcaaaag

SEQ ID NO: 594338 - DNA, 20 bp, Artificial Sequence
  chemically synthesized
ctcaacttttgattcctatt

SEQ ID NO: 594339 - DNA, 20 bp, Artificial Sequence
  chemically synthesized
tggctacgtatgtaaacaaa

SEQ ID NO: 594340 - DNA, 20 bp, Artificial Sequence
  chemically synthesized
ctgagtgtcacaaaaacttt

SEQ ID NO: 594341 - DNA, 20 bp, Artificial Sequence
  chemically synthesized
cacattatctcatacttcaa

SEQ ID NO: 594342 - DNA, 20 bp, Artificial Sequence
  chemically synthesized
ctcaattgaagtatgagata

SEQ ID NO: 594343 - DNA, 20 bp, Artificial Sequence
  chemically synthesized
tgcaaagaccttaaaaatga

SEQ ID NO: 594344 - DNA, 20 bp, Artificial Sequence
  chemically synthesized
aaagcattccgggcacaagg

SEQ ID NO: 594345 - DNA, 20 bp, Artificial Sequence
  chemically synthesized
taagctgtcccttgtgcccg

SEQ ID NO: 594346 - DNA, 20 bp, Artificial Sequence
  chemically synthesized
tacatcattacatggctgac

SEQ ID NO: 594347 - DNA, 20 bp, Artificial Sequence
  chemically synthesized
tcttcaatacctcacttgga

SEQ ID NO: 594348 - DNA, 20 bp, Artificial Sequence
  chemically synthesized
gtgaggtattgaagactttt

SEQ ID NO: 594349 - DNA, 20 bp, Artificial Sequence
  chemically synthesized
ataatatttcccactttcta

SEQ ID NO: 594350 - DNA, 20 bp, Artificial Sequence
  chemically synthesized
tttctaaattgttttccttt

SEQ ID NO: 594351 - DNA, 20 bp, Artificial Sequence
  chemically synthesized
tttctcagtttgtatcctat

SEQ ID NO: 594352 - DNA, 20 bp, Artificial Sequence
  chemically synthesized
ctatccctgcttactaaaat

SEQ ID NO: 594353 - DNA, 20 bp, Artificial Sequence
  chemically synthesized
gtttcatgagcacacgggac

SEQ ID NO: 594354 - DNA, 20 bp, Artificial Sequence
  chemically synthesized
actgtggatttaactttcta

SEQ ID NO: 594355 - DNA, 20 bp, Artificial Sequence
  chemically synthesized
taacaccacatctggaccac

SEQ ID NO: 594356 - DNA, 20 bp, Artificial Sequence
  chemically synthesized
tgaaggtagaagatttaggt

SEQ ID NO: 594357 - DNA, 20 bp, Artificial Sequence
  chemically synthesized
attaggagcaccttgaaggt

SEQ ID NO: 594358 - DNA, 20 bp, Artificial Sequence
  chemically synthesized
gttcctcaagtggtataatt

SEQ ID NO: 594359 - DNA, 20 bp, Artificial Sequence
  chemically synthesized
attataccacttgaggaaca

SEQ ID NO: 594360 - DNA, 20 bp, Artificial Sequence
  chemically synthesized
aataaaatgatataataatg

SEQ ID NO: 594361 - DNA, 20 bp, Artificial Sequence
  chemically synthesized
attttaataaaatgatataa

SEQ ID NO: 594362 - DNA, 20 bp, Artificial Sequence
  chemically synthesized
ttagggatgaagcaccaggc

SEQ ID NO: 594363 - DNA, 20 bp, Artificial Sequence
  chemically synthesized
acttgtgacaagcatttgcc

SEQ ID NO: 594364 - DNA, 20 bp, Artificial Sequence
  chemically synthesized
ttgtgacatgaagctgtata

SEQ ID NO: 594365 - DNA, 20 bp, Artificial Sequence
  chemically synthesized
gtcttcctctaagcacgtta

SEQ ID NO: 594366 - DNA, 20 bp, Artificial Sequence
  chemically synthesized
tctgactacccaacccctca

SEQ ID NO: 594367 - DNA, 20 bp, Artificial Sequence
  chemically synthesized
tcaaaattaacacatccaaa

SEQ ID NO: 594368 - DNA, 20 bp, Artificial Sequence
  chemically synthesized
ggaaagtgtcatatatcatt

SEQ ID NO: 594369 - DNA, 20 bp, Artificial Sequence
  chemically synthesized
acgggggttagtgttaagtt

SEQ ID NO: 594370 - DNA, 20 bp, Artificial Sequence
  chemically synthesized
ttacgtctcctgtatttttc

SEQ ID NO: 594371 - DNA, 20 bp, Artificial Sequence
  chemically synthesized
actattttagtcaagaccac

SEQ ID NO: 594372 - DNA, 20 bp, Artificial Sequence
  chemically synthesized
aagaccaccatcgcttcttg

SEQ ID NO: 594373 - DNA, 20 bp, Artificial Sequence
  chemically synthesized
ataataacctcttttgtcca

SEQ ID NO: 594374 - DNA, 20 bp, Artificial Sequence
  chemically synthesized
aacctcttttgtccattcag

SEQ ID NO: 594375 - DNA, 20 bp, Artificial Sequence
  chemically synthesized
ggaaagagtcatgattagag

SEQ ID NO: 594376 - DNA, 20 bp, Artificial Sequence
  chemically synthesized
tgtcaggaaagagtcatgat

SEQ ID NO: 594377 - DNA, 20 bp, Artificial Sequence
  chemically synthesized
acgtggttgtcaggaaagag

SEQ ID NO: 594378 - DNA, 20 bp, Artificial Sequence
  chemically synthesized
ggagttttttctctgcccag

SEQ ID NO: 594379 - DNA, 20 bp, Artificial Sequence
  chemically synthesized
agggtccttcgggtcctgtt

SEQ ID NO: 594380 - DNA, 20 bp, Artificial Sequence
  chemically synthesized
ggttctagccccatctcctc

SEQ ID NO: 594381 - DNA, 20 bp, Artificial Sequence
  chemically synthesized
agaaagaatgtgacagcaga

SEQ ID NO: 594382 - DNA, 20 bp, Artificial Sequence
  chemically synthesized
aggaacagaaagaatgtgac

SEQ ID NO: 594383 - DNA, 20 bp, Artificial Sequence
  chemically synthesized
ttcctttatctctgacactc

SEQ ID NO: 594384 - DNA, 20 bp, Artificial Sequence
  chemically synthesized
aaaatttccaccaccttcac

SEQ ID NO: 594385 - DNA, 20 bp, Artificial Sequence
  chemically synthesized
agtctatatcacttcttcac

SEQ ID NO: 594386 - DNA, 20 bp, Artificial Sequence
  chemically synthesized
gaattagtatctgggtcacc

SEQ ID NO: 594387 - DNA, 20 bp, Artificial Sequence
  chemically synthesized
gagattctgagagagagaga

SEQ ID NO: 594388 - DNA, 20 bp, Artificial Sequence
  chemically synthesized
tctctctctctcagaatctc

SEQ ID NO: 594389 - DNA, 20 bp, Artificial Sequence
  chemically synthesized
aatcaaccatgatgaatctc

SEQ ID NO: 594390 - DNA, 20 bp, Artificial Sequence
  chemically synthesized
aatctcatgagattcatcat

SEQ ID NO: 594391 - DNA, 20 bp, Artificial Sequence
  chemically synthesized
cataaagtctgacatccctg

SEQ ID NO: 594392 - DNA, 20 bp, Artificial Sequence
  chemically synthesized
taaatacttatttgttggat

SEQ ID NO: 594393 - DNA, 20 bp, Artificial Sequence
  chemically synthesized
tctcatcaacattttcaaca

SEQ ID NO: 594394 - DNA, 20 bp, Artificial Sequence
  chemically synthesized
tgttgaaaatgttgatgaga

SEQ ID NO: 594395 - DNA, 20 bp, Artificial Sequence
  chemically synthesized
gttgatgagagccagattat

SEQ ID NO: 594396 - DNA, 20 bp, Artificial Sequence
  chemically synthesized
atatttcagaggctgtgctg

SEQ ID NO: 594397 - DNA, 20 bp, Artificial Sequence
  chemically synthesized
ctgtgctgacaggattttgg

SEQ ID NO: 594398 - DNA, 20 bp, Artificial Sequence
  chemically synthesized
atagggatatatgataactg

SEQ ID NO: 594399 - DNA, 20 bp, Artificial Sequence
  chemically synthesized
ctgcatttcttatattgact

SEQ ID NO: 594400 - DNA, 20 bp, Artificial Sequence
  chemically synthesized
atcctttctaacatccgcaa

SEQ ID NO: 594401 - DNA, 20 bp, Artificial Sequence
  chemically synthesized
aacaatgttgcggatgttag

SEQ ID NO: 594402 - DNA, 20 bp, Artificial Sequence
  chemically synthesized
tgcggatgttagaaaggatt

SEQ ID NO: 594403 - DNA, 20 bp, Artificial Sequence
  chemically synthesized
ttgcctactagatatcttaa

SEQ ID NO: 594404 - DNA, 20 bp, Artificial Sequence
  chemically synthesized
gttctggccataaggtaggt

SEQ ID NO: 594405 - DNA, 20 bp, Artificial Sequence
  chemically synthesized
gagaatgttctggccataag

SEQ ID NO: 594406 - DNA, 20 bp, Artificial Sequence
  chemically synthesized
catttctagtgtacatgaaa

SEQ ID NO: 594407 - DNA, 20 bp, Artificial Sequence
  chemically synthesized
acacatattaggaatgcata

SEQ ID NO: 594408 - DNA, 20 bp, Artificial Sequence
  chemically synthesized
tcagaatatgcattcctaat

SEQ ID NO: 594409 - DNA, 20 bp, Artificial Sequence
  chemically synthesized
ttcaagatttttgataaatg

SEQ ID NO: 594410 - DNA, 20 bp, Artificial Sequence
  chemically synthesized
cagttaataatagtgtgtat

SEQ ID NO: 594411 - DNA, 20 bp, Artificial Sequence
  chemically synthesized
caatgtaggtcataggatac

SEQ ID NO: 594412 - DNA, 20 bp, Artificial Sequence
  chemically synthesized
actaccctgaccctggtaac

SEQ ID NO: 594413 - DNA, 20 bp, Artificial Sequence
  chemically synthesized
tatatttgaccttttttaaa

SEQ ID NO: 594414 - DNA, 20 bp, Artificial Sequence
  chemically synthesized
acaatatttttctttcttgg

SEQ ID NO: 594415 - DNA, 20 bp, Artificial Sequence
  chemically synthesized
gtgtgtgtgtgtgtgtgtac

SEQ ID NO: 594416 - DNA, 20 bp, Artificial Sequence
  chemically synthesized
ttggaccatatttctttgta

SEQ ID NO: 594417 - DNA, 20 bp, Artificial Sequence
  chemically synthesized
agggctaagaatatgtagaa

SEQ ID NO: 594418 - DNA, 20 bp, Artificial Sequence
  chemically synthesized
cttagcccttccatagaaac

SEQ ID NO: 594419 - DNA, 20 bp, Artificial Sequence
  chemically synthesized
agagagagagagagagaatc

SEQ ID NO: 594420 - DNA, 20 bp, Artificial Sequence
  chemically synthesized
tcttattttgtctggtgcca

SEQ ID NO: 594421 - DNA, 20 bp, Artificial Sequence
  chemically synthesized
atgtagcgcctggcttgtat

SEQ ID NO: 594422 - DNA, 20 bp, Artificial Sequence
  chemically synthesized
ggtgttctgtagatgtagcg

SEQ ID NO: 594423 - DNA, 20 bp, Artificial Sequence
  chemically synthesized
tcagaattttctttttgaga

SEQ ID NO: 594424 - DNA, 20 bp, Artificial Sequence
  chemically synthesized
ttcgttactaaaggaagaaa

SEQ ID NO: 594425 - DNA, 20 bp, Artificial Sequence
  chemically synthesized
actcagatcattatgttggc

SEQ ID NO: 594426 - DNA, 20 bp, Artificial Sequence
  chemically synthesized
gatctgagttctgataatga

SEQ ID NO: 594427 - DNA, 20 bp, Artificial Sequence
  chemically synthesized
aagttacctttgattcatgt

SEQ ID NO: 594428 - DNA, 20 bp, Artificial Sequence
  chemically synthesized
tttatacatgttcaagttac

SEQ ID NO: 594429 - DNA, 20 bp, Artificial Sequence
  chemically synthesized
cattccacagccagaaaata

SEQ ID NO: 594430 - DNA, 20 bp, Artificial Sequence
  chemically synthesized
tcctgaattttgcttagagt

SEQ ID NO: 594431 - DNA, 20 bp, Artificial Sequence
  chemically synthesized
tcattgacttaactcctgaa

SEQ ID NO: 594432 - DNA, 20 bp, Artificial Sequence
  chemically synthesized
agtttatttctttgtaagga

SEQ ID NO: 594433 - DNA, 20 bp, Artificial Sequence
  chemically synthesized
ttaccatttaactccaggac

SEQ ID NO: 594434 - DNA, 20 bp, Artificial Sequence
  chemically synthesized
tgatcatccaaataggatga

SEQ ID NO: 594435 - DNA, 20 bp, Artificial Sequence
  chemically synthesized
tatgggagctacaattcaag

SEQ ID NO: 594436 - DNA, 20 bp, Artificial Sequence
  chemically synthesized
caggtcactcccatgacaca

SEQ ID NO: 594437 - DNA, 20 bp, Artificial Sequence
  chemically synthesized
ccctcagcacagaaccatcc

SEQ ID NO: 594438 - DNA, 20 bp, Artificial Sequence
  chemically synthesized
gaataagtctcaggagatct

SEQ ID NO: 594439 - DNA, 20 bp, Artificial Sequence
  chemically synthesized
aggtgaaggggtagcaaagg

SEQ ID NO: 594440 - DNA, 20 bp, Artificial Sequence
  chemically synthesized
tgctaccccttcaccttcca

SEQ ID NO: 594441 - DNA, 20 bp, Artificial Sequence
  chemically synthesized
tgggtaatttataagtaaaa

SEQ ID NO: 594442 - DNA, 20 bp, Artificial Sequence
  chemically synthesized
gtaggaaaatgaactaatac

SEQ ID NO: 594443 - DNA, 20 bp, Artificial Sequence
  chemically synthesized
aaatatacatcaaatataaa

SEQ ID NO: 594444 - DNA, 20 bp, Artificial Sequence
  chemically synthesized
caaatataaaatgtgatttt

SEQ ID NO: 594445 - DNA, 20 bp, Artificial Sequence
  chemically synthesized
tgtgatttttaatgattttt

SEQ ID NO: 594446 - DNA, 20 bp, Artificial Sequence
  chemically synthesized
attgatgtctgatggagact

SEQ ID NO: 594447 - DNA, 20 bp, Artificial Sequence
  chemically synthesized
taatatgaaaacagaactca

SEQ ID NO: 594448 - DNA, 20 bp, Artificial Sequence
  chemically synthesized
gcagaagaaaacaccatgag

SEQ ID NO: 594449 - DNA, 20 bp, Artificial Sequence
  chemically synthesized
tacaagcctggactacacta

SEQ ID NO: 594450 - DNA, 20 bp, Artificial Sequence
  chemically synthesized
ggaaagcaagttagtgtagt

SEQ ID NO: 594451 - DNA, 20 bp, Artificial Sequence
  chemically synthesized
gaaggttacatcgtagggtc

SEQ ID NO: 594452 - DNA, 20 bp, Artificial Sequence
  chemically synthesized
ctctgaaatattacctcctt

SEQ ID NO: 594453 - DNA, 20 bp, Artificial Sequence
  chemically synthesized
cttctaggtttttgatagga

SEQ ID NO: 594454 - DNA, 20 bp, Artificial Sequence
  chemically synthesized
accaggctttcatcataaag

SEQ ID NO: 594455 - DNA, 20 bp, Artificial Sequence
  chemically synthesized
tatttctcaattagagctca

SEQ ID NO: 594456 - DNA, 20 bp, Artificial Sequence
  chemically synthesized
ctctaattgagaaatacaga

SEQ ID NO: 594457 - DNA, 20 bp, Artificial Sequence
  chemically synthesized
ggtttggatactaaatgagt

SEQ ID NO: 594458 - DNA, 20 bp, Artificial Sequence
  chemically synthesized
taggaaaattgagaattctg

SEQ ID NO: 594459 - DNA, 20 bp, Artificial Sequence
  chemically synthesized
cacctctctctgtaaatggg

SEQ ID NO: 594460 - DNA, 20 bp, Artificial Sequence
  chemically synthesized
tttcccatttacagagagag

SEQ ID NO: 594461 - DNA, 20 bp, Artificial Sequence
  chemically synthesized
gtgtctctcagaagtcacag

SEQ ID NO: 594462 - DNA, 20 bp, Artificial Sequence
  chemically synthesized
ctgggtaatttataaaagaa

SEQ ID NO: 594463 - DNA, 20 bp, Artificial Sequence
  chemically synthesized
tctcaccttatgccacgatg

SEQ ID NO: 594464 - DNA, 20 bp, Artificial Sequence
  chemically synthesized
ttcctgccacctgtgaagaa

SEQ ID NO: 594465 - DNA, 20 bp, Artificial Sequence
  chemically synthesized
attgttttataaggggctct

SEQ ID NO: 594466 - DNA, 20 bp, Artificial Sequence
  chemically synthesized
agtgagttctcacaagatct

SEQ ID NO: 594467 - DNA, 20 bp, Artificial Sequence
  chemically synthesized
agtgagtgagttctcacaag

SEQ ID NO: 594468 - DNA, 20 bp, Artificial Sequence
  chemically synthesized
cagcatgggagaaattgctc

SEQ ID NO: 594469 - DNA, 20 bp, Artificial Sequence
  chemically synthesized
ggtctctctcccttgacatg

SEQ ID NO: 594470 - DNA, 20 bp, Artificial Sequence
  chemically synthesized
cccttgacatgtggggattg

SEQ ID NO: 594471 - DNA, 20 bp, Artificial Sequence
  chemically synthesized
tgtggggattacaattcaaa

SEQ ID NO: 594472 - DNA, 20 bp, Artificial Sequence
  chemically synthesized
ggatttgatggatcctatgg

SEQ ID NO: 594473 - DNA, 20 bp, Artificial Sequence
  chemically synthesized
tcctgggatttgatggatcc

SEQ ID NO: 594474 - DNA, 20 bp, Artificial Sequence
  chemically synthesized
ggggatggagaaccatcatc

SEQ ID NO: 594475 - DNA, 20 bp, Artificial Sequence
  chemically synthesized
ctaaagtacagatctttgca

SEQ ID NO: 594476 - DNA, 20 bp, Artificial Sequence
  chemically synthesized
tttcatcttccacgagtgaa

SEQ ID NO: 594477 - DNA, 20 bp, Artificial Sequence
  chemically synthesized
agagtaatgtttttgtttga

SEQ ID NO: 594478 - DNA, 20 bp, Artificial Sequence
  chemically synthesized
gatgcaggtgagagtaatgt

SEQ ID NO: 594479 - DNA, 20 bp, Artificial Sequence
  chemically synthesized
acgtatgatgcaggtgagag

SEQ ID NO: 594480 - DNA, 20 bp, Artificial Sequence
  chemically synthesized
acattactctcacctgcatc

SEQ ID NO: 594481 - DNA, 20 bp, Artificial Sequence
  chemically synthesized
ctggaaattgccccaaccca

SEQ ID NO: 594482 - DNA, 20 bp, Artificial Sequence
  chemically synthesized
agtacctacattctaaggac

SEQ ID NO: 594483 - DNA, 20 bp, Artificial Sequence
  chemically synthesized
cagatagcagtattgcttgg

SEQ ID NO: 594484 - DNA, 20 bp, Artificial Sequence
  chemically synthesized
gcttcctcgtcagatagcag

SEQ ID NO: 594485 - DNA, 20 bp, Artificial Sequence
  chemically synthesized
aatggtccaggttaaagaac

SEQ ID NO: 594486 - DNA, 20 bp, Artificial Sequence
  chemically synthesized
gtttcaaaaagttctcatca

SEQ ID NO: 594487 - DNA, 20 bp, Artificial Sequence
  chemically synthesized
agaactttttgaaactgtag

SEQ ID NO: 594488 - DNA, 20 bp, Artificial Sequence
  chemically synthesized
aatatccatggaagctctgc

SEQ ID NO: 594489 - DNA, 20 bp, Artificial Sequence
  chemically synthesized
tagcagagcttccatggata

SEQ ID NO: 594490 - DNA, 20 bp, Artificial Sequence
  chemically synthesized
gatattctgattggatatat

SEQ ID NO: 594491 - DNA, 20 bp, Artificial Sequence
  chemically synthesized
ggatatatcattgcttcctg

SEQ ID NO: 594492 - DNA, 20 bp, Artificial Sequence
  chemically synthesized
ctactccagacaaaaggatt

SEQ ID NO: 594493 - DNA, 20 bp, Artificial Sequence
  chemically synthesized
ttaaatacctactccagaca

SEQ ID NO: 594494 - DNA, 20 bp, Artificial Sequence
  chemically synthesized
taagtattgtgtattttttc

SEQ ID NO: 594495 - DNA, 20 bp, Artificial Sequence
  chemically synthesized
gaaagacattattacctgaa

SEQ ID NO: 594496 - DNA, 20 bp, Artificial Sequence
  chemically synthesized
atattaccgggttaaaggtc

SEQ ID NO: 594497 - DNA, 20 bp, Artificial Sequence
  chemically synthesized
ttattacttaacctaaaaat

SEQ ID NO: 594498 - DNA, 20 bp, Artificial Sequence
  chemically synthesized
ctattccactgtagatctgc

SEQ ID NO: 594499 - DNA, 20 bp, Artificial Sequence
  chemically synthesized
cttttgaaattggtctggaa

SEQ ID NO: 594500 - DNA, 20 bp, Artificial Sequence
  chemically synthesized
cagaccaatttcaaaagaat

SEQ ID NO: 594501 - DNA, 20 bp, Artificial Sequence
  chemically synthesized
caatttcaaaagaatgatag

SEQ ID NO: 594502 - DNA, 20 bp, Artificial Sequence
  chemically synthesized
gatgtatttcaagtggggga

SEQ ID NO: 594503 - DNA, 20 bp, Artificial Sequence
  chemically synthesized
ttccattatttttgaaaagt

SEQ ID NO: 594504 - DNA, 20 bp, Artificial Sequence
  chemically synthesized
gaattaagttgcatttaatt

SEQ ID NO: 594505 - DNA, 20 bp, Artificial Sequence
  chemically synthesized
gcctgtggctaggctatttt

SEQ ID NO: 594506 - DNA, 20 bp, Artificial Sequence
  chemically synthesized
gccacaggcaaggtgcagct

SEQ ID NO: 594507 - DNA, 20 bp, Artificial Sequence
  chemically synthesized
cattttaggtgtgctgtcat

SEQ ID NO: 594508 - DNA, 20 bp, Artificial Sequence
  chemically synthesized
acacctaaaatgggaggcct

SEQ ID NO: 594509 - DNA, 20 bp, Artificial Sequence
  chemically synthesized
tcagatttgacatatgaagt

SEQ ID NO: 594510 - DNA, 20 bp, Artificial Sequence
  chemically synthesized
tttgacatatgaagtggtgg

SEQ ID NO: 594511 - DNA, 20 bp, Artificial Sequence
  chemically synthesized
agtggtggtttggcttccag

SEQ ID NO: 594512 - DNA, 20 bp, Artificial Sequence
  chemically synthesized
aagagagggagcataatgga

SEQ ID NO: 594513 - DNA, 20 bp, Artificial Sequence
  chemically synthesized
ctctcttgttcacctctccc

SEQ ID NO: 594514 - DNA, 20 bp, Artificial Sequence
  chemically synthesized
tgttatagaaattatgtgaa

SEQ ID NO: 594515 - DNA, 20 bp, Artificial Sequence
  chemically synthesized
cttctatgataatatagtct

SEQ ID NO: 594516 - DNA, 20 bp, Artificial Sequence
  chemically synthesized
aaatctggtgttaaataagg

SEQ ID NO: 594517 - DNA, 20 bp, Artificial Sequence
  chemically synthesized
gaagctagtccttatttaac

SEQ ID NO: 594518 - DNA, 20 bp, Artificial Sequence
  chemically synthesized
gcaatgtggcttgagaagat

SEQ ID NO: 594519 - DNA, 20 bp, Artificial Sequence
  chemically synthesized
gataatactaccatctgcaa

SEQ ID NO: 594520 - DNA, 20 bp, Artificial Sequence
  chemically synthesized
ctcacatcaacatttccttt

SEQ ID NO: 594521 - DNA, 20 bp, Artificial Sequence
  chemically synthesized
caaaaggaaatgttgatgtg

SEQ ID NO: 594522 - DNA, 20 bp, Artificial Sequence
  chemically synthesized
aacaattgatgccatgtatg

SEQ ID NO: 594523 - DNA, 20 bp, Artificial Sequence
  chemically synthesized
ataaccatatatatgtgtgt

SEQ ID NO: 594524 - DNA, 20 bp, Artificial Sequence
  chemically synthesized
tgcgtgtttaaattgtatta

SEQ ID NO: 594525 - DNA, 20 bp, Artificial Sequence
  chemically synthesized
ttctgtttactgatgttttc

SEQ ID NO: 594526 - DNA, 20 bp, Artificial Sequence
  chemically synthesized
gcctgtttttttctgtttac

SEQ ID NO: 594527 - DNA, 20 bp, Artificial Sequence
  chemically synthesized
tgaataaaatgcctgttttt

SEQ ID NO: 594528 - DNA, 20 bp, Artificial Sequence
  chemically synthesized
agaaaaaaacaggcatttta

SEQ ID NO: 594529 - DNA, 20 bp, Artificial Sequence
  chemically synthesized
taaagtaaactgaataaaat

SEQ ID NO: 594530 - DNA, 20 bp, Artificial Sequence
  chemically synthesized
tcagtttactttaatttgag

SEQ ID NO: 594531 - DNA, 20 bp, Artificial Sequence
  chemically synthesized
gacaaaagttagtgctattt

SEQ ID NO: 594532 - DNA, 20 bp, Artificial Sequence
  chemically synthesized
tggtttaaaataatttaatg

SEQ ID NO: 594533 - DNA, 20 bp, Artificial Sequence
  chemically synthesized
ttaatgtgtagttttcccct

SEQ ID NO: 594534 - DNA, 20 bp, Artificial Sequence
  chemically synthesized
ataatttgttcaatcttttg

SEQ ID NO: 594535 - DNA, 20 bp, Artificial Sequence
  chemically synthesized
gactgggaagaaagctacac

SEQ ID NO: 594536 - DNA, 20 bp, Artificial Sequence
  chemically synthesized
gtagagattcaaagatatgt

SEQ ID NO: 594537 - DNA, 20 bp, Artificial Sequence
  chemically synthesized
cctcttttccaggattcctg

SEQ ID NO: 594538 - DNA, 20 bp, Artificial Sequence
  chemically synthesized
ctgcaaaatgatcctctttt

SEQ ID NO: 594539 - DNA, 20 bp, Artificial Sequence
  chemically synthesized
tgcagaaaaaaaacataggc

SEQ ID NO: 594540 - DNA, 20 bp, Artificial Sequence
  chemically synthesized
aggtgttcagaaactctagc

SEQ ID NO: 594541 - DNA, 20 bp, Artificial Sequence
  chemically synthesized
ccttgtcccaaaggtacagc

SEQ ID NO: 594542 - DNA, 20 bp, Artificial Sequence
  chemically synthesized
tatgtttggaattagactga

SEQ ID NO: 594543 - DNA, 20 bp, Artificial Sequence
  chemically synthesized
ttatggtttgaggaaaagat

SEQ ID NO: 594544 - DNA, 20 bp, Artificial Sequence
  chemically synthesized
aatacagttcttgaaaatgt

SEQ ID NO: 594545 - DNA, 20 bp, Artificial Sequence
  chemically synthesized
ttcaacaccatccaagtctt

SEQ ID NO: 594546 - DNA, 20 bp, Artificial Sequence
  chemically synthesized
gaagttccctggtgtgatat

SEQ ID NO: 594547 - DNA, 20 bp, Artificial Sequence
  chemically synthesized
tactcagtacccacctgaat

SEQ ID NO: 594548 - DNA, 20 bp, Artificial Sequence
  chemically synthesized
ctttgaagaaaataaacaag

SEQ ID NO: 594549 - DNA, 20 bp, Artificial Sequence
  chemically synthesized
tacttagctgattaagcttc

SEQ ID NO: 594550 - DNA, 20 bp, Artificial Sequence
  chemically synthesized
ccaaacatttacttagctga

SEQ ID NO: 594551 - DNA, 20 bp, Artificial Sequence
  chemically synthesized
tgaagcttaatcagctaagt

SEQ ID NO: 594552 - DNA, 20 bp, Artificial Sequence
  chemically synthesized
ttttatccaaacatttactt

SEQ ID NO: 594553 - DNA, 20 bp, Artificial Sequence
  chemically synthesized
taaatgtttggataaaaaaa

SEQ ID NO: 594554 - DNA, 20 bp, Artificial Sequence
  chemically synthesized
tgtttggataaaaaaatgaa

SEQ ID NO: 594555 - DNA, 20 bp, Artificial Sequence
  chemically synthesized
aagggctttcccttatttaa

SEQ ID NO: 594556 - DNA, 20 bp, Artificial Sequence
  chemically synthesized
tgagtagatcagagaagaat

SEQ ID NO: 594557 - DNA, 20 bp, Artificial Sequence
  chemically synthesized
ttgagaattagctttatggt

SEQ ID NO: 594558 - DNA, 20 bp, Artificial Sequence
  chemically synthesized
aagaaaacataattttgaga

SEQ ID NO: 594559 - DNA, 20 bp, Artificial Sequence
  chemically synthesized
cataaagctaattctcaaaa

SEQ ID NO: 594560 - DNA, 20 bp, Artificial Sequence
  chemically synthesized
tcttgtcagttagagtattt

SEQ ID NO: 594561 - DNA, 20 bp, Artificial Sequence
  chemically synthesized
aatttcaatttctgcatttt

SEQ ID NO: 594562 - DNA, 20 bp, Artificial Sequence
  chemically synthesized
atctctgatatttgcaaact

SEQ ID NO: 594563 - DNA, 20 bp, Artificial Sequence
  chemically synthesized
tacagtctgtaaatgaagct

SEQ ID NO: 594564 - DNA, 20 bp, Artificial Sequence
  chemically synthesized
agttcccaaactacaactac

SEQ ID NO: 594565 - DNA, 20 bp, Artificial Sequence
  chemically synthesized
gatatttaaacatttgtagt

SEQ ID NO: 594566 - DNA, 20 bp, Artificial Sequence
  chemically synthesized
tttttaaactgagtgtgcat

SEQ ID NO: 594567 - DNA, 20 bp, Artificial Sequence
  chemically synthesized
ataaaaaacattcatgcaca

SEQ ID NO: 594568 - DNA, 20 bp, Artificial Sequence
  chemically synthesized
ataatagtaattattttaaa

SEQ ID NO: 594569 - DNA, 20 bp, Artificial Sequence
  chemically synthesized
gatcagggaactccaaacat

SEQ ID NO: 594570 - DNA, 20 bp, Artificial Sequence
  chemically synthesized
tttaggggatacagaagcaa

SEQ ID NO: 594571 - DNA, 20 bp, Artificial Sequence
  chemically synthesized
ttgaaaaatgagtcaaccct

SEQ ID NO: 594572 - DNA, 20 bp, Artificial Sequence
  chemically synthesized
aatgaaaagtacatttcgaa

SEQ ID NO: 594573 - DNA, 20 bp, Artificial Sequence
  chemically synthesized
cgatatcttaaaactaagat

SEQ ID NO: 594574 - DNA, 20 bp, Artificial Sequence
  chemically synthesized
tttcaggcataaacatatat

SEQ ID NO: 594575 - DNA, 20 bp, Artificial Sequence
  chemically synthesized
aaaagtatactaggtgatca

SEQ ID NO: 594576 - DNA, 20 bp, Artificial Sequence
  chemically synthesized
aaacactcattgtgtataca

SEQ ID NO: 594577 - DNA, 20 bp, Artificial Sequence
  chemically synthesized
aaacagtatgtatacacaat

SEQ ID NO: 594578 - DNA, 20 bp, Artificial Sequence
  chemically synthesized
acaatacctcaattgaaaag

SEQ ID NO: 594579 - DNA, 20 bp, Artificial Sequence
  chemically synthesized
tgtaacaatacctcaattga

SEQ ID NO: 594580 - DNA, 20 bp, Artificial Sequence
  chemically synthesized
caaattttataatatacata

SEQ ID NO: 594581 - DNA, 20 bp, Artificial Sequence
  chemically synthesized
ttttcaataaaattttattt

SEQ ID NO: 594582 - DNA, 20 bp, Artificial Sequence
  chemically synthesized
taaattaattctacaattgg

SEQ ID NO: 594583 - DNA, 20 bp, Artificial Sequence
  chemically synthesized
ctttctactcacctatttga

SEQ ID NO: 594584 - DNA, 20 bp, Artificial Sequence
  chemically synthesized
tgctactataatacaattcc

SEQ ID NO: 594585 - DNA, 20 bp, Artificial Sequence
  chemically synthesized
aaggaattgtattatagtag

SEQ ID NO: 594586 - DNA, 20 bp, Artificial Sequence
  chemically synthesized
atatgccatagcaggagcac

SEQ ID NO: 594587 - DNA, 20 bp, Artificial Sequence
  chemically synthesized
tggcatatgctaaaagtaca

SEQ ID NO: 594588 - DNA, 20 bp, Artificial Sequence
  chemically synthesized
atatgctaaaagtacatgat

SEQ ID NO: 594589 - DNA, 20 bp, Artificial Sequence
  chemically synthesized
cagccgatagatcattaaaa

SEQ ID NO: 594590 - DNA, 20 bp, Artificial Sequence
  chemically synthesized
aagaagagtggttgctaact

SEQ ID NO: 594591 - DNA, 20 bp, Artificial Sequence
  chemically synthesized
tgactttcatgacagggcaa

SEQ ID NO: 594592 - DNA, 20 bp, Artificial Sequence
  chemically synthesized
tgccctgtcatgaaagtcat

SEQ ID NO: 594593 - DNA, 20 bp, Artificial Sequence
  chemically synthesized
atgaaagtcattcatgcttc

SEQ ID NO: 594594 - DNA, 20 bp, Artificial Sequence
  chemically synthesized
tcatccaactctgatcttac

SEQ ID NO: 594595 - DNA, 20 bp, Artificial Sequence
  chemically synthesized
gatcagagttggatgaaata

SEQ ID NO: 594596 - DNA, 20 bp, Artificial Sequence
  chemically synthesized
catctgtagtcaagacctca

SEQ ID NO: 594597 - DNA, 20 bp, Artificial Sequence
  chemically synthesized
tttttttttttttcaggcaa

SEQ ID NO: 594598 - DNA, 20 bp, Artificial Sequence
  chemically synthesized
cattccaaggagtaggcaca

SEQ ID NO: 594599 - DNA, 20 bp, Artificial Sequence
  chemically synthesized
ggttactccactgtgaggac

SEQ ID NO: 594600 - DNA, 20 bp, Artificial Sequence
  chemically synthesized
tttatatttcttgtcacagg

SEQ ID NO: 594601 - DNA, 20 bp, Artificial Sequence
  chemically synthesized
ttatcaggagattctgatgt

SEQ ID NO: 594602 - DNA, 20 bp, Artificial Sequence
  chemically synthesized
aagtggacacacaagttatc

SEQ ID NO: 594603 - DNA, 20 bp, Artificial Sequence
  chemically synthesized
cccccagaactgcaacttct

SEQ ID NO: 594604 - DNA, 20 bp, Artificial Sequence
  chemically synthesized
aactccctcttttctacctt

SEQ ID NO: 594605 - DNA, 20 bp, Artificial Sequence
  chemically synthesized
caagaggcagtcccacatag

SEQ ID NO: 594606 - DNA, 20 bp, Artificial Sequence
  chemically synthesized
cattgaatgagggagccaaa

SEQ ID NO: 594607 - DNA, 20 bp, Artificial Sequence
  chemically synthesized
tggcaatgttgtttctaaat

SEQ ID NO: 594608 - DNA, 20 bp, Artificial Sequence
  chemically synthesized
aatcagatagttactggcaa

SEQ ID NO: 594609 - DNA, 20 bp, Artificial Sequence
  chemically synthesized
aaacaacattgccagtaact

SEQ ID NO: 594610 - DNA, 20 bp, Artificial Sequence
  chemically synthesized
aactatctgattagccttag

SEQ ID NO: 594611 - DNA, 20 bp, Artificial Sequence
  chemically synthesized
aagtttctcaaccttcctga

SEQ ID NO: 594612 - DNA, 20 bp, Artificial Sequence
  chemically synthesized
actgggagttattgtgaaga

SEQ ID NO: 594613 - DNA, 20 bp, Artificial Sequence
  chemically synthesized
caaatccatattcctggggg

SEQ ID NO: 594614 - DNA, 20 bp, Artificial Sequence
  chemically synthesized
ccaagcatcgcccccaggaa

SEQ ID NO: 594615 - DNA, 20 bp, Artificial Sequence
  chemically synthesized
catcgcccccaggaatatgg

SEQ ID NO: 594616 - DNA, 20 bp, Artificial Sequence
  chemically synthesized
ccaggaatatggatttgatt

SEQ ID NO: 594617 - DNA, 20 bp, Artificial Sequence
  chemically synthesized
atgattctaactttgacttt

SEQ ID NO: 594618 - DNA, 20 bp, Artificial Sequence
  chemically synthesized
tttttgaaagactatatgga

SEQ ID NO: 594619 - DNA, 20 bp, Artificial Sequence
  chemically synthesized
tgcctatcatgagcagtgtt

SEQ ID NO: 594620 - DNA, 20 bp, Artificial Sequence
  chemically synthesized
gaatacaataaatgatacat

SEQ ID NO: 594621 - DNA, 20 bp, Artificial Sequence
  chemically synthesized
actttgcatcgtttttgaac

SEQ ID NO: 594622 - DNA, 20 bp, Artificial Sequence
  chemically synthesized
aaattgccctctctactttg

SEQ ID NO: 594623 - DNA, 20 bp, Artificial Sequence
  chemically synthesized
tttattcagtttttttaaat

SEQ ID NO: 594624 - DNA, 20 bp, Artificial Sequence
  chemically synthesized
ggatgtgtctgtgctattta

SEQ ID NO: 594625 - DNA, 20 bp, Artificial Sequence
  chemically synthesized
cagagacacccccaaatttg

SEQ ID NO: 594626 - DNA, 20 bp, Artificial Sequence
  chemically synthesized
ttggtatcctgggtagaatt

SEQ ID NO: 594627 - DNA, 20 bp, Artificial Sequence
  chemically synthesized
gtttgggaaaaagaaaagaa

SEQ ID NO: 594628 - DNA, 20 bp, Artificial Sequence
  chemically synthesized
gtttacttgccttctgaggt

SEQ ID NO: 594629 - DNA, 20 bp, Artificial Sequence
  chemically synthesized
aggtcagtttacttgccttc

SEQ ID NO: 594630 - DNA, 20 bp, Artificial Sequence
  chemically synthesized
agatcttgttcatttaaaag

SEQ ID NO: 594631 - DNA, 20 bp, Artificial Sequence
  chemically synthesized
ttttaaatgaacaagatctg

SEQ ID NO: 594632 - DNA, 20 bp, Artificial Sequence
  chemically synthesized
ggtgaaatctgacacatcac

SEQ ID NO: 594633 - DNA, 20 bp, Artificial Sequence
  chemically synthesized
taacaaaaccagtgtgatgt

SEQ ID NO: 594634 - DNA, 20 bp, Artificial Sequence
  chemically synthesized
cacactggttttgttattat

SEQ ID NO: 594635 - DNA, 20 bp, Artificial Sequence
  chemically synthesized
tcattttttttcttacgagt

SEQ ID NO: 594636 - DNA, 20 bp, Artificial Sequence
  chemically synthesized
aatgagtgtattatatatga

SEQ ID NO: 594637 - DNA, 20 bp, Artificial Sequence
  chemically synthesized
ttttgttaggaaatgtaact

SEQ ID NO: 594638 - DNA, 20 bp, Artificial Sequence
  chemically synthesized
aggaaatgtaactcgctgtt

SEQ ID NO: 594639 - DNA, 20 bp, Artificial Sequence
  chemically synthesized
cacctgatgcaaaatggact

SEQ ID NO: 594640 - DNA, 20 bp, Artificial Sequence
  chemically synthesized
tgatgcaaaatggactacct

SEQ ID NO: 594641 - DNA, 20 bp, Artificial Sequence
  chemically synthesized
tggctaagatttttttagca

SEQ ID NO: 594642 - DNA, 20 bp, Artificial Sequence
  chemically synthesized
tgctaaaaaaatcttagcca

SEQ ID NO: 594643 - DNA, 20 bp, Artificial Sequence
  chemically synthesized
aaaaaaatcttagccagaag

SEQ ID NO: 594644 - DNA, 20 bp, Artificial Sequence
  chemically synthesized
tcaggaagcaatccttctgg

SEQ ID NO: 594645 - DNA, 20 bp, Artificial Sequence
  chemically synthesized
ccagaaggattgcttcctga

SEQ ID NO: 594646 - DNA, 20 bp, Artificial Sequence
  chemically synthesized
tgataagaagtaatcaacaa

SEQ ID NO: 594647 - DNA, 20 bp, Artificial Sequence
  chemically synthesized
tggaaaactagaatcaaaat

SEQ ID NO: 594648 - DNA, 20 bp, Artificial Sequence
  chemically synthesized
aagtaatcaacaattttgat

SEQ ID NO: 594649 - DNA, 20 bp, Artificial Sequence
  chemically synthesized
aattttgattctagttttcc

SEQ ID NO: 594650 - DNA, 20 bp, Artificial Sequence
  chemically synthesized
catggtggatgatacatatc

SEQ ID NO: 594651 - DNA, 20 bp, Artificial Sequence
  chemically synthesized
gcttgaaatatgtgcattgg

SEQ ID NO: 594652 - DNA, 20 bp, Artificial Sequence
  chemically synthesized
ttggggaggttttgttgaat

SEQ ID NO: 594653 - DNA, 20 bp, Artificial Sequence
  chemically synthesized
ggttttgttgaatgctagat

SEQ ID NO: 594654 - DNA, 20 bp, Artificial Sequence
  chemically synthesized
atgctagattgctgttttgc

SEQ ID NO: 594655 - DNA, 20 bp, Artificial Sequence
  chemically synthesized
tagattgctgttttgctgta

SEQ ID NO: 594656 - DNA, 20 bp, Artificial Sequence
  chemically synthesized
ttgatttatttgtgtgagtt

SEQ ID NO: 594657 - DNA, 20 bp, Artificial Sequence
  chemically synthesized
aaaatttgaatatatgatat

SEQ ID NO: 594658 - DNA, 20 bp, Artificial Sequence
  chemically synthesized
ctctgcttctgaaataaata

SEQ ID NO: 594659 - DNA, 20 bp, Artificial Sequence
  chemically synthesized
gcaggtggggaagagagtaa

SEQ ID NO: 594660 - DNA, 20 bp, Artificial Sequence
  chemically synthesized
acaagttctatgtgtatttg

SEQ ID NO: 594661 - DNA, 20 bp, Artificial Sequence
  chemically synthesized
aaattacaagttctatgtgt

SEQ ID NO: 594662 - DNA, 20 bp, Artificial Sequence
  chemically synthesized
gaacttcctttttcaaaatt

SEQ ID NO: 594663 - DNA, 20 bp, Artificial Sequence
  chemically synthesized
ttttttttaaaataaagaag

SEQ ID NO: 594664 - DNA, 20 bp, Artificial Sequence
  chemically synthesized
tttttttcttggatggcccc

SEQ ID NO: 594665 - DNA, 20 bp, Artificial Sequence
  chemically synthesized
acatcgttttatgaaagtgc

SEQ ID NO: 594666 - DNA, 20 bp, Artificial Sequence
  chemically synthesized
tttgtaacatcgttttatga

SEQ ID NO: 594667 - DNA, 20 bp, Artificial Sequence
  chemically synthesized
tctaaaatattgatttgtaa

SEQ ID NO: 594668 - DNA, 20 bp, Artificial Sequence
  chemically synthesized
gatcttcaaagtgtctaaaa

SEQ ID NO: 594669 - DNA, 20 bp, Artificial Sequence
  chemically synthesized
agacactttgaagatcatct

SEQ ID NO: 594670 - DNA, 20 bp, Artificial Sequence
  chemically synthesized
acttccgagacaggggatat

SEQ ID NO: 594671 - DNA, 20 bp, Artificial Sequence
  chemically synthesized
ctttttctaaaataaatcat

SEQ ID NO: 594672 - DNA, 20 bp, Artificial Sequence
  chemically synthesized
tgtaaaagatgctcaatcag

SEQ ID NO: 594673 - DNA, 20 bp, Artificial Sequence
  chemically synthesized
gaaataaagtgcaaaagacg

SEQ ID NO: 594674 - DNA, 20 bp, Artificial Sequence
  chemically synthesized
gatatgagatgttggaaggg

SEQ ID NO: 594675 - DNA, 20 bp, Artificial Sequence
  chemically synthesized
ctgggaaaactttctttatg

SEQ ID NO: 594676 - DNA, 20 bp, Artificial Sequence
  chemically synthesized
tgtgttaatcttttcataaa

SEQ ID NO: 594677 - DNA, 20 bp, Artificial Sequence
  chemically synthesized
ttctttatgaaaagattaac

SEQ ID NO: 594678 - DNA, 20 bp, Artificial Sequence
  chemically synthesized
agggcagtaactgcaaccaa

SEQ ID NO: 594679 - DNA, 20 bp, Artificial Sequence
  chemically synthesized
atttccccatgagcttcaca

SEQ ID NO: 594680 - DNA, 20 bp, Artificial Sequence
  chemically synthesized
tattgtgatgaaatttcccc

SEQ ID NO: 594681 - DNA, 20 bp, Artificial Sequence
  chemically synthesized
ttcttggaggctttatatta

SEQ ID NO: 594682 - DNA, 20 bp, Artificial Sequence
  chemically synthesized
acaagttttctttgtttctt

SEQ ID NO: 594683 - DNA, 20 bp, Artificial Sequence
  chemically synthesized
gcctccaagaaacaaagaaa

SEQ ID NO: 594684 - DNA, 20 bp, Artificial Sequence
  chemically synthesized
aaaaataaaaaacaagtttt

SEQ ID NO: 594685 - DNA, 20 bp, Artificial Sequence
  chemically synthesized
gtcttctgtaaaaataaaaa

SEQ ID NO: 594686 - DNA, 20 bp, Artificial Sequence
  chemically synthesized
aaaaaaaaaataattctggt

SEQ ID NO: 594687 - DNA, 20 bp, Artificial Sequence
  chemically synthesized
aaaaagaaaaaaaaaataat

SEQ ID NO: 594688 - DNA, 20 bp, Artificial Sequence
  chemically synthesized
agaattattttttttttctt

SEQ ID NO: 594689 - DNA, 20 bp, Artificial Sequence
  chemically synthesized
tcttttctccaggaatttga

SEQ ID NO: 594690 - DNA, 20 bp, Artificial Sequence
  chemically synthesized
ttcccatcttttctccagga

SEQ ID NO: 594691 - DNA, 20 bp, Artificial Sequence
  chemically synthesized
cgtgttcgtgctttgtttta

SEQ ID NO: 594692 - DNA, 20 bp, Artificial Sequence
  chemically synthesized
atttaaataccgtgttcgtg

SEQ ID NO: 594693 - DNA, 20 bp, Artificial Sequence
  chemically synthesized
cttggatttaaataccgtgt

SEQ ID NO: 594694 - DNA, 20 bp, Artificial Sequence
  chemically synthesized
cacgaacacggtatttaaat

SEQ ID NO: 594695 - DNA, 20 bp, Artificial Sequence
  chemically synthesized
catttacattttgtggcaaa

SEQ ID NO: 594696 - DNA, 20 bp, Artificial Sequence
  chemically synthesized
tgtatttcagtaaatgttct

SEQ ID NO: 594697 - DNA, 20 bp, Artificial Sequence
  chemically synthesized
aaaagaaataacagcttttc

SEQ ID NO: 594698 - DNA, 20 bp, Artificial Sequence
  chemically synthesized
gttgcagttgtaaaagaaat

SEQ ID NO: 594699 - DNA, 20 bp, Artificial Sequence
  chemically synthesized
accagaaaggtatattatta

SEQ ID NO: 594700 - DNA, 20 bp, Artificial Sequence
  chemically synthesized
aatatagatgttacgcctgc

SEQ ID NO: 594701 - DNA, 20 bp, Artificial Sequence
  chemically synthesized
atgtgtgtagttattactag

SEQ ID NO: 594702 - DNA, 20 bp, Artificial Sequence
  chemically synthesized
gttattactagtggagatta

SEQ ID NO: 594703 - DNA, 20 bp, Artificial Sequence
  chemically synthesized
gtggagattaatatgattta

SEQ ID NO: 594704 - DNA, 20 bp, Artificial Sequence
  chemically synthesized
atttattatgcttataggtc

SEQ ID NO: 594705 - DNA, 20 bp, Artificial Sequence
  chemically synthesized
aaccaagttttaaaatatat

SEQ ID NO: 594706 - DNA, 20 bp, Artificial Sequence
  chemically synthesized
atccattatatattttaaaa

SEQ ID NO: 594707 - DNA, 20 bp, Artificial Sequence
  chemically synthesized
tatatattttaaaacttggt

SEQ ID NO: 594708 - DNA, 20 bp, Artificial Sequence
  chemically synthesized
agagcaaaataaatcataaa

SEQ ID NO: 594709 - DNA, 20 bp, Artificial Sequence
  chemically synthesized
tatgatttattttgctctat

SEQ ID NO: 594710 - DNA, 20 bp, Artificial Sequence
  chemically synthesized
gactgaattaactgatagtt

SEQ ID NO: 594711 - DNA, 20 bp, Artificial Sequence
  chemically synthesized
attggcagactgaattaact

SEQ ID NO: 594712 - DNA, 20 bp, Artificial Sequence
  chemically synthesized
gttaattcagtctgccaatt

SEQ ID NO: 594713 - DNA, 20 bp, Artificial Sequence
  chemically synthesized
aattttatgttttaagtctt

SEQ ID NO: 594714 - DNA, 20 bp, Artificial Sequence
  chemically synthesized
taccaaaaatctgtctccca

SEQ ID NO: 594715 - DNA, 20 bp, Artificial Sequence
  chemically synthesized
actttataagcttcatggga

SEQ ID NO: 594716 - DNA, 20 bp, Artificial Sequence
  chemically synthesized
aaaggaaagtgtaggacttt

SEQ ID NO: 594717 - DNA, 20 bp, Artificial Sequence
  chemically synthesized
taaagtcctacactttcctt

SEQ ID NO: 594718 - DNA, 20 bp, Artificial Sequence
  chemically synthesized
gttagctccttaatctagta

SEQ ID NO: 594719 - DNA, 20 bp, Artificial Sequence
  chemically synthesized
atagaccaaaaaaacgccct

SEQ ID NO: 594720 - DNA, 20 bp, Artificial Sequence
  chemically synthesized
aattgactattcatgtacct

SEQ ID NO: 594721 - DNA, 20 bp, Artificial Sequence
  chemically synthesized
taaaatatccaatcttattt

SEQ ID NO: 594722 - DNA, 20 bp, Artificial Sequence
  chemically synthesized
gagtccaggaaaacatccaa

SEQ ID NO: 594723 - DNA, 20 bp, Artificial Sequence
  chemically synthesized
taaggctagagaaatgggtt

SEQ ID NO: 594724 - DNA, 20 bp, Artificial Sequence
  chemically synthesized
ctagccttatgccagcacac

SEQ ID NO: 594725 - DNA, 20 bp, Artificial Sequence
  chemically synthesized
ttatggcagcaacatacact

SEQ ID NO: 594726 - DNA, 20 bp, Artificial Sequence
  chemically synthesized
aagtgtatgttgctgccata

SEQ ID NO: 594727 - DNA, 20 bp, Artificial Sequence
  chemically synthesized
cataatatgcttattaataa

SEQ ID NO: 594728 - DNA, 20 bp, Artificial Sequence
  chemically synthesized
aaataggcaatgatgtaatt

SEQ ID NO: 594729 - DNA, 20 bp, Artificial Sequence
  chemically synthesized
ttataatcagaatgcttttg

SEQ ID NO: 594730 - DNA, 20 bp, Artificial Sequence
  chemically synthesized
ccccaaacacatcaaaagca

SEQ ID NO: 594731 - DNA, 20 bp, Artificial Sequence
  chemically synthesized
atttaatacagttataatca

SEQ ID NO: 594732 - DNA, 20 bp, Artificial Sequence
  chemically synthesized
atgttaacttggctggtatt

SEQ ID NO: 594733 - DNA, 20 bp, Artificial Sequence
  chemically synthesized
acgtaggattgttttaggat

SEQ ID NO: 594734 - DNA, 20 bp, Artificial Sequence
  chemically synthesized
attgactacgtaggattgtt

SEQ ID NO: 594735 - DNA, 20 bp, Artificial Sequence
  chemically synthesized
agcaaaaattgactacgtag

SEQ ID NO: 594736 - DNA, 20 bp, Artificial Sequence
  chemically synthesized
aaaaagcaaaaattgactac

SEQ ID NO: 594737 - DNA, 20 bp, Artificial Sequence
  chemically synthesized
aacaatcctacgtagtcaat

SEQ ID NO: 594738 - DNA, 20 bp, Artificial Sequence
  chemically synthesized
gctttttcttatgtatattt

SEQ ID NO: 594739 - DNA, 20 bp, Artificial Sequence
  chemically synthesized
tactttatgaatagatacat

SEQ ID NO: 594740 - DNA, 20 bp, Artificial Sequence
  chemically synthesized
aagtatttttaaaattattt

SEQ ID NO: 594741 - DNA, 20 bp, Artificial Sequence
  chemically synthesized
agattttaaaattgagtctc

SEQ ID NO: 594742 - DNA, 20 bp, Artificial Sequence
  chemically synthesized
agaagaaaaattattgttaa

SEQ ID NO: 594743 - DNA, 20 bp, Artificial Sequence
  chemically synthesized
tttcaaagttttcaaatttg

SEQ ID NO: 594744 - DNA, 20 bp, Artificial Sequence
  chemically synthesized
ttatttttcaaagttttcaa

SEQ ID NO: 594745 - DNA, 20 bp, Artificial Sequence
  chemically synthesized
attatcaaatttttattttt

SEQ ID NO: 594746 - DNA, 20 bp, Artificial Sequence
  chemically synthesized
ataatttttaacgttgacaa

SEQ ID NO: 594747 - DNA, 20 bp, Artificial Sequence
  chemically synthesized
aaagttgttttttttttttt

SEQ ID NO: 594748 - DNA, 20 bp, Artificial Sequence
  chemically synthesized
tacaaaaaaaaaaaaaacaa

SEQ ID NO: 594749 - DNA, 20 bp, Artificial Sequence
  chemically synthesized
atacaaagtttgcaaaacaa

SEQ ID NO: 594750 - DNA, 20 bp, Artificial Sequence
  chemically synthesized
tcaataaaattttataaata

SEQ ID NO: 594751 - DNA, 20 bp, Artificial Sequence
  chemically synthesized
acttaaattagtaggtgtgc

SEQ ID NO: 594752 - DNA, 20 bp, Artificial Sequence
  chemically synthesized
ctaatttaagtattgtccat

SEQ ID NO: 594753 - DNA, 20 bp, Artificial Sequence
  chemically synthesized
aaatagtctctgtcacattt

SEQ ID NO: 594754 - DNA, 20 bp, Artificial Sequence
  chemically synthesized
tggggcagatagtaaatatt

SEQ ID NO: 594755 - DNA, 20 bp, Artificial Sequence
  chemically synthesized
ccccattacagaagaaaaaa

SEQ ID NO: 594756 - DNA, 20 bp, Artificial Sequence
  chemically synthesized
actacgcagcaggcatactt

SEQ ID NO: 594757 - DNA, 20 bp, Artificial Sequence
  chemically synthesized
gtgacttagcttattcatgc

SEQ ID NO: 594758 - DNA, 20 bp, Artificial Sequence
  chemically synthesized
acgtgacctttggcaggtga

SEQ ID NO: 594759 - DNA, 20 bp, Artificial Sequence
  chemically synthesized
gcacagttatgaactcatag

SEQ ID NO: 594760 - DNA, 20 bp, Artificial Sequence
  chemically synthesized
ccatagcacttatcatactg

SEQ ID NO: 594761 - DNA, 20 bp, Artificial Sequence
  chemically synthesized
agggtacatgtgcacaacat

SEQ ID NO: 594762 - DNA, 20 bp, Artificial Sequence
  chemically synthesized
ctgtagctatatgtaaacat

SEQ ID NO: 594763 - DNA, 20 bp, Artificial Sequence
  chemically synthesized
agtaacatctaagaaagctg

SEQ ID NO: 594764 - DNA, 20 bp, Artificial Sequence
  chemically synthesized
ataaagacctccccctagac

SEQ ID NO: 594765 - DNA, 20 bp, Artificial Sequence
  chemically synthesized
gaccagtgattttcaactag

SEQ ID NO: 594766 - DNA, 20 bp, Artificial Sequence
  chemically synthesized
tggaaatgtctgggacaaat

SEQ ID NO: 594767 - DNA, 20 bp, Artificial Sequence
  chemically synthesized
ggactgccctgtccactata

SEQ ID NO: 594768 - DNA, 20 bp, Artificial Sequence
  chemically synthesized
atgtatttggctcaaaacgt

SEQ ID NO: 594769 - DNA, 20 bp, Artificial Sequence
  chemically synthesized
cggcaatgtttctcaatctc

SEQ ID NO: 594770 - DNA, 20 bp, Artificial Sequence
  chemically synthesized
agatgacaattgatctacgg

SEQ ID NO: 594771 - DNA, 20 bp, Artificial Sequence
  chemically synthesized
aattgtcatcttctgaactt

SEQ ID NO: 594772 - DNA, 20 bp, Artificial Sequence
  chemically synthesized
ttaacatctgtacacccatt

SEQ ID NO: 594773 - DNA, 20 bp, Artificial Sequence
  chemically synthesized
aaaacatatgtggtctctga

SEQ ID NO: 594774 - DNA, 20 bp, Artificial Sequence
  chemically synthesized
aaaactccatcagagaccac

SEQ ID NO: 594775 - DNA, 20 bp, Artificial Sequence
  chemically synthesized
acagcagacactcattaagt

SEQ ID NO: 594776 - DNA, 20 bp, Artificial Sequence
  chemically synthesized
agttatccactattcactca

SEQ ID NO: 594777 - DNA, 20 bp, Artificial Sequence
  chemically synthesized
tgagtgaatagtggataact

SEQ ID NO: 594778 - DNA, 20 bp, Artificial Sequence
  chemically synthesized
atgggacttgtcaagagtct

SEQ ID NO: 594779 - DNA, 20 bp, Artificial Sequence
  chemically synthesized
ggttagctagaatatgacga

SEQ ID NO: 594780 - DNA, 20 bp, Artificial Sequence
  chemically synthesized
atatatatatatatttcacc

SEQ ID NO: 594781 - DNA, 20 bp, Artificial Sequence
  chemically synthesized
tcaccacaagatttttatgg

SEQ ID NO: 594782 - DNA, 20 bp, Artificial Sequence
  chemically synthesized
tgttctaacctactcgtcag

SEQ ID NO: 594783 - DNA, 20 bp, Artificial Sequence
  chemically synthesized
ggttagaacattcgaaatct

SEQ ID NO: 594784 - DNA, 20 bp, Artificial Sequence
  chemically synthesized
attcgaaatcttcaggtttt

SEQ ID NO: 594785 - DNA, 20 bp, Artificial Sequence
  chemically synthesized
aaaacaaaactatcaaaacc

SEQ ID NO: 594786 - DNA, 20 bp, Artificial Sequence
  chemically synthesized
aaatcttcaggttttgatag

SEQ ID NO: 594787 - DNA, 20 bp, Artificial Sequence
  chemically synthesized
ttgttttacatccgtgttaa

SEQ ID NO: 594788 - DNA, 20 bp, Artificial Sequence
  chemically synthesized
tgaagctaactctatacttc

SEQ ID NO: 594789 - DNA, 20 bp, Artificial Sequence
  chemically synthesized
gcaagcacctgaagtataga

SEQ ID NO: 594790 - DNA, 20 bp, Artificial Sequence
  chemically synthesized
ctgccttccttttcttacct

SEQ ID NO: 594791 - DNA, 20 bp, Artificial Sequence
  chemically synthesized
agagaggtacagagcagaag

SEQ ID NO: 594792 - DNA, 20 bp, Artificial Sequence
  chemically synthesized
tcctgttgtgttctaagagt

SEQ ID NO: 594793 - DNA, 20 bp, Artificial Sequence
  chemically synthesized
tgggaatttgtttatcagtt

SEQ ID NO: 594794 - DNA, 20 bp, Artificial Sequence
  chemically synthesized
cctgggagttatacatggga

SEQ ID NO: 594795 - DNA, 20 bp, Artificial Sequence
  chemically synthesized
aactggtgcctcaattaata

SEQ ID NO: 594796 - DNA, 20 bp, Artificial Sequence
  chemically synthesized
ctattaattgaggcaccagt

SEQ ID NO: 594797 - DNA, 20 bp, Artificial Sequence
  chemically synthesized
tttgaaagttctgatattta

SEQ ID NO: 594798 - DNA, 20 bp, Artificial Sequence
  chemically synthesized
agtcaaatgtcaccccccac

SEQ ID NO: 594799 - DNA, 20 bp, Artificial Sequence
  chemically synthesized
acctcttggaattattcagc

SEQ ID NO: 594800 - DNA, 20 bp, Artificial Sequence
  chemically synthesized
gagagatgatagttgtcttc

SEQ ID NO: 594801 - DNA, 20 bp, Artificial Sequence
  chemically synthesized
ctaggtaatgaaagatctag

SEQ ID NO: 594802 - DNA, 20 bp, Artificial Sequence
  chemically synthesized
ttacctagatgacacagcgt

SEQ ID NO: 594803 - DNA, 20 bp, Artificial Sequence
  chemically synthesized
taacttccaacttttctctg

SEQ ID NO: 594804 - DNA, 20 bp, Artificial Sequence
  chemically synthesized
tgactggtttaaaatctctt

SEQ ID NO: 594805 - DNA, 20 bp, Artificial Sequence
  chemically synthesized
aataaacagtcaaatcttac

SEQ ID NO: 594806 - DNA, 20 bp, Artificial Sequence
  chemically synthesized
taaaatctcttgtaagattt

SEQ ID NO: 594807 - DNA, 20 bp, Artificial Sequence
  chemically synthesized
agctatgctaggtcccggga

SEQ ID NO: 594808 - DNA, 20 bp, Artificial Sequence
  chemically synthesized
acacgattttgggcaaaata

SEQ ID NO: 594809 - DNA, 20 bp, Artificial Sequence
  chemically synthesized
agacagattcctttccctct

SEQ ID NO: 594810 - DNA, 20 bp, Artificial Sequence
  chemically synthesized
aattgtccctcagtatccat

SEQ ID NO: 594811 - DNA, 20 bp, Artificial Sequence
  chemically synthesized
ttatatgtcacttgaacatt

SEQ ID NO: 594812 - DNA, 20 bp, Artificial Sequence
  chemically synthesized
cctatatactttaaaacatc

SEQ ID NO: 594813 - DNA, 20 bp, Artificial Sequence
  chemically synthesized
aagtattataagtaatctag

SEQ ID NO: 594814 - DNA, 20 bp, Artificial Sequence
  chemically synthesized
tataaatacttattacattg

SEQ ID NO: 594815 - DNA, 20 bp, Artificial Sequence
  chemically synthesized
cctctgtactgatgatttat

SEQ ID NO: 594816 - DNA, 20 bp, Artificial Sequence
  chemically synthesized
atgaatgcctacctctgtac

SEQ ID NO: 594817 - DNA, 20 bp, Artificial Sequence
  chemically synthesized
tcagtacagaggtaggcatt

SEQ ID NO: 594818 - DNA, 20 bp, Artificial Sequence
  chemically synthesized
ttttgatgcatggttgcatt

SEQ ID NO: 594819 - DNA, 20 bp, Artificial Sequence
  chemically synthesized
gtacaggggctcttcatatt

SEQ ID NO: 594820 - DNA, 20 bp, Artificial Sequence
  chemically synthesized
tgtaacctcagttttaactg

SEQ ID NO: 594821 - DNA, 20 bp, Artificial Sequence
  chemically synthesized
acacttgtcgtatttgtaac

SEQ ID NO: 594822 - DNA, 20 bp, Artificial Sequence
  chemically synthesized
gcccccttattatatgctct

SEQ ID NO: 594823 - DNA, 20 bp, Artificial Sequence
  chemically synthesized
aatgcatgtttgggtcattg

SEQ ID NO: 594824 - DNA, 20 bp, Artificial Sequence
  chemically synthesized
ctgatatttaaggtgaaaat

SEQ ID NO: 594825 - DNA, 20 bp, Artificial Sequence
  chemically synthesized
tgttaagaatacctgtgcaa

SEQ ID NO: 594826 - DNA, 20 bp, Artificial Sequence
  chemically synthesized
ccctcatagagtgaaggaac

SEQ ID NO: 594827 - DNA, 20 bp, Artificial Sequence
  chemically synthesized
atgagttaagactatgcata

SEQ ID NO: 594828 - DNA, 20 bp, Artificial Sequence
  chemically synthesized
actcatagttccttctgaca

SEQ ID NO: 594829 - DNA, 20 bp, Artificial Sequence
  chemically synthesized
accatgctttctaccacagg

SEQ ID NO: 594830 - DNA, 20 bp, Artificial Sequence
  chemically synthesized
ccttctccccttaactagat

SEQ ID NO: 594831 - DNA, 20 bp, Artificial Sequence
  chemically synthesized
catacatctagttaagggga

SEQ ID NO: 594832 - DNA, 20 bp, Artificial Sequence
  chemically synthesized
tctgtagtccttaaggccat

SEQ ID NO: 594833 - DNA, 20 bp, Artificial Sequence
  chemically synthesized
atggccttaaggactacaga

SEQ ID NO: 594834 - DNA, 20 bp, Artificial Sequence
  chemically synthesized
cggtacacattttgaaagat

SEQ ID NO: 594835 - DNA, 20 bp, Artificial Sequence
  chemically synthesized
caggctgttctcggaatgga

SEQ ID NO: 594836 - DNA, 20 bp, Artificial Sequence
  chemically synthesized
aaaataaaagttaacagtaa

SEQ ID NO: 594837 - DNA, 20 bp, Artificial Sequence
  chemically synthesized
gttactgttaacttttattt

SEQ ID NO: 594838 - DNA, 20 bp, Artificial Sequence
  chemically synthesized
gacacatatccaaatgatat

SEQ ID NO: 594839 - DNA, 20 bp, Artificial Sequence
  chemically synthesized
actgggaattacatttcaag

SEQ ID NO: 594840 - DNA, 20 bp, Artificial Sequence
  chemically synthesized
ggaggtgactggatcatgtg

SEQ ID NO: 594841 - DNA, 20 bp, Artificial Sequence
  chemically synthesized
atgtgtgtggatttctcatg

SEQ ID NO: 594842 - DNA, 20 bp, Artificial Sequence
  chemically synthesized
gagtgagttctctgagatct

SEQ ID NO: 594843 - DNA, 20 bp, Artificial Sequence
  chemically synthesized
ttctgccttctgccacgact

SEQ ID NO: 594844 - DNA, 20 bp, Artificial Sequence
  chemically synthesized
ctccttctgtggaggcttcg

SEQ ID NO: 594845 - DNA, 20 bp, Artificial Sequence
  chemically synthesized
atagcagcatctccttctgt

SEQ ID NO: 594846 - DNA, 20 bp, Artificial Sequence
  chemically synthesized
ctccacagaaggagatgctg

SEQ ID NO: 594847 - DNA, 20 bp, Artificial Sequence
  chemically synthesized
tttctttatagcaatgcaag

SEQ ID NO: 594848 - DNA, 20 bp, Artificial Sequence
  chemically synthesized
attgttttaattagtgtatt

SEQ ID NO: 594849 - DNA, 20 bp, Artificial Sequence
  chemically synthesized
tgttttcttaatgttcaaaa

SEQ ID NO: 594850 - DNA, 20 bp, Artificial Sequence
  chemically synthesized
acattcataaaattacatgg

SEQ ID NO: 594851 - DNA, 20 bp, Artificial Sequence
  chemically synthesized
atgtctttcgtatatccttt

SEQ ID NO: 594852 - DNA, 20 bp, Artificial Sequence
  chemically synthesized
tgtgcattaatttaaaaaat

SEQ ID NO: 594853 - DNA, 20 bp, Artificial Sequence
  chemically synthesized
aatttaaaaaataaaggctt

SEQ ID NO: 594854 - DNA, 20 bp, Artificial Sequence
  chemically synthesized
cacctctgcctgtgtattga

SEQ ID NO: 594855 - DNA, 20 bp, Artificial Sequence
  chemically synthesized
ctgtgtattgatggtgcttt

SEQ ID NO: 594856 - DNA, 20 bp, Artificial Sequence
  chemically synthesized
atttgctttctggcacttgg

SEQ ID NO: 594857 - DNA, 20 bp, Artificial Sequence
  chemically synthesized
tgtgcaaaaaataaagggtt

SEQ ID NO: 594858 - DNA, 20 bp, Artificial Sequence
  chemically synthesized
ctttattttttgcacattta

SEQ ID NO: 594859 - DNA, 20 bp, Artificial Sequence
  chemically synthesized
gtgttcaatcacaataggcc

SEQ ID NO: 594860 - DNA, 20 bp, Artificial Sequence
  chemically synthesized
aatattaatcgaagggccta

SEQ ID NO: 594861 - DNA, 20 bp, Artificial Sequence
  chemically synthesized
ctttaacctggcatctgtgg

SEQ ID NO: 594862 - DNA, 20 bp, Artificial Sequence
  chemically synthesized
gttacattccatttcacagt

SEQ ID NO: 594863 - DNA, 20 bp, Artificial Sequence
  chemically synthesized
gctctgtgttactctaaaac

SEQ ID NO: 594864 - DNA, 20 bp, Artificial Sequence
  chemically synthesized
tgtgttactctaaaacacat

SEQ ID NO: 594865 - DNA, 20 bp, Artificial Sequence
  chemically synthesized
tgtggcatgttgaagcaagc

SEQ ID NO: 594866 - DNA, 20 bp, Artificial Sequence
  chemically synthesized
gccttgatctttaatagctt

SEQ ID NO: 594867 - DNA, 20 bp, Artificial Sequence
  chemically synthesized
gtttatctgccttgatcttt

SEQ ID NO: 594868 - DNA, 20 bp, Artificial Sequence
  chemically synthesized
cacaagaaggctgcataata

SEQ ID NO: 594869 - DNA, 20 bp, Artificial Sequence
  chemically synthesized
tgtatccatcattgatgtat

SEQ ID NO: 594870 - DNA, 20 bp, Artificial Sequence
  chemically synthesized
cttttaaagatttgattcaa

SEQ ID NO: 594871 - DNA, 20 bp, Artificial Sequence
  chemically synthesized
cagttgaaattcttttaaag

SEQ ID NO: 594872 - DNA, 20 bp, Artificial Sequence
  chemically synthesized
atcaacagttgaaattcttt

SEQ ID NO: 594873 - DNA, 20 bp, Artificial Sequence
  chemically synthesized
ttatgcctcaactgaaaaaa

SEQ ID NO: 594874 - DNA, 20 bp, Artificial Sequence
  chemically synthesized
caaattatgcctcaactgaa

SEQ ID NO: 594875 - DNA, 20 bp, Artificial Sequence
  chemically synthesized
ataataaagtgcaaaagtct

SEQ ID NO: 594876 - DNA, 20 bp, Artificial Sequence
  chemically synthesized
aagtctaagtgtttggatgg

SEQ ID NO: 594877 - DNA, 20 bp, Artificial Sequence
  chemically synthesized
tcttaattctattaccgtaa

SEQ ID NO: 594878 - DNA, 20 bp, Artificial Sequence
  chemically synthesized
attaccgtaattgagttttg

SEQ ID NO: 594879 - DNA, 20 bp, Artificial Sequence
  chemically synthesized
tgacattcattcattcatat

SEQ ID NO: 594880 - DNA, 20 bp, Artificial Sequence
  chemically synthesized
ttcatatggttgcttttacc

SEQ ID NO: 594881 - DNA, 20 bp, Artificial Sequence
  chemically synthesized
ctgccgagtaaaattccatt

SEQ ID NO: 594882 - DNA, 20 bp, Artificial Sequence
  chemically synthesized
ccttttctctttgtgtagct

SEQ ID NO: 594883 - DNA, 20 bp, Artificial Sequence
  chemically synthesized
aaacatctcagggcctttgc

SEQ ID NO: 594884 - DNA, 20 bp, Artificial Sequence
  chemically synthesized
aaacacgtgcaaaggccctg

SEQ ID NO: 594885 - DNA, 20 bp, Artificial Sequence
  chemically synthesized
tagaaagtgaggaagcacta

SEQ ID NO: 594886 - DNA, 20 bp, Artificial Sequence
  chemically synthesized
tccatataggataatcatat

SEQ ID NO: 594887 - DNA, 20 bp, Artificial Sequence
  chemically synthesized
gcactaatatgattatccta

SEQ ID NO: 594888 - DNA, 20 bp, Artificial Sequence
  chemically synthesized
atgaacacccaactctttat

SEQ ID NO: 594889 - DNA, 20 bp, Artificial Sequence
  chemically synthesized
atttctgtgcttaaggccct

SEQ ID NO: 594890 - DNA, 20 bp, Artificial Sequence
  chemically synthesized
tcagctagataaaggcattt

SEQ ID NO: 594891 - DNA, 20 bp, Artificial Sequence
  chemically synthesized
aagatccattttgctgcggt

SEQ ID NO: 594892 - DNA, 20 bp, Artificial Sequence
  chemically synthesized
caggtcacctctgccctctt

SEQ ID NO: 594893 - DNA, 20 bp, Artificial Sequence
  chemically synthesized
gacagaagttgcattgcatt

SEQ ID NO: 594894 - DNA, 20 bp, Artificial Sequence
  chemically synthesized
gttgcattgcattacttgct

SEQ ID NO: 594895 - DNA, 20 bp, Artificial Sequence
  chemically synthesized
aaatgatggaatcatgtgga

SEQ ID NO: 594896 - DNA, 20 bp, Artificial Sequence
  chemically synthesized
ttgattggtaagcagagtcc

SEQ ID NO: 594897 - DNA, 20 bp, Artificial Sequence
  chemically synthesized
gtagtatcttcttcttatct

SEQ ID NO: 594898 - DNA, 20 bp, Artificial Sequence
  chemically synthesized
agatgagggctggggaaggg

SEQ ID NO: 594899 - DNA, 20 bp, Artificial Sequence
  chemically synthesized
aattcattggctgccgcaca

SEQ ID NO: 594900 - DNA, 20 bp, Artificial Sequence
  chemically synthesized
tcatatgctcaggtgaacaa

SEQ ID NO: 594901 - DNA, 20 bp, Artificial Sequence
  chemically synthesized
catatttctcttgattccaa

SEQ ID NO: 594902 - DNA, 20 bp, Artificial Sequence
  chemically synthesized
atctttccatcccatatttc

SEQ ID NO: 594903 - DNA, 20 bp, Artificial Sequence
  chemically synthesized
ggagagcgaaaccagaaacc

SEQ ID NO: 594904 - DNA, 20 bp, Artificial Sequence
  chemically synthesized
ataccttcaatcctagggtt

SEQ ID NO: 594905 - DNA, 20 bp, Artificial Sequence
  chemically synthesized
tgagactataccttcaatcc

SEQ ID NO: 594906 - DNA, 20 bp, Artificial Sequence
  chemically synthesized
ttcctcggaggtaggtatgt

SEQ ID NO: 594907 - DNA, 20 bp, Artificial Sequence
  chemically synthesized
gggacacaaaagaaaactgt

SEQ ID NO: 594908 - DNA, 20 bp, Artificial Sequence
  chemically synthesized
caaacacaaatagaagcatt

SEQ ID NO: 594909 - DNA, 20 bp, Artificial Sequence
  chemically synthesized
aaaactgtgaatgcttctat

SEQ ID NO: 594910 - DNA, 20 bp, Artificial Sequence
  chemically synthesized
tttgtgtttgcatttatatt

SEQ ID NO: 594911 - DNA, 20 bp, Artificial Sequence
  chemically synthesized
ttattgatttctattttcac

SEQ ID NO: 594912 - DNA, 20 bp, Artificial Sequence
  chemically synthesized
ttctattttcacatacgttt

SEQ ID NO: 594913 - DNA, 20 bp, Artificial Sequence
  chemically synthesized
acatgcttagtcatattcat

SEQ ID NO: 594914 - DNA, 20 bp, Artificial Sequence
  chemically synthesized
tgtacattttgtgggaagaa

SEQ ID NO: 594915 - DNA, 20 bp, Artificial Sequence
  chemically synthesized
ttgtgggaagaaatgtgctt

SEQ ID NO: 594916 - DNA, 20 bp, Artificial Sequence
  chemically synthesized
ggaagaaatgtgcttataag

SEQ ID NO: 594917 - DNA, 20 bp, Artificial Sequence
  chemically synthesized
aatgctcttcaaaatttcaa

SEQ ID NO: 594918 - DNA, 20 bp, Artificial Sequence
  chemically synthesized
aagctcactggcttcttttc

SEQ ID NO: 594919 - DNA, 20 bp, Artificial Sequence
  chemically synthesized
aaacagctgaaaagaagcca

SEQ ID NO: 594920 - DNA, 20 bp, Artificial Sequence
  chemically synthesized
aataacttctgttgaagctc

SEQ ID NO: 594921 - DNA, 20 bp, Artificial Sequence
  chemically synthesized
cagtgagcttcaacagaagt

SEQ ID NO: 594922 - DNA, 20 bp, Artificial Sequence
  chemically synthesized
agttgtgggaaatgtgaact

SEQ ID NO: 594923 - DNA, 20 bp, Artificial Sequence
  chemically synthesized
tatatatgcttagtcttata

SEQ ID NO: 594924 - DNA, 20 bp, Artificial Sequence
  chemically synthesized
gacttctttggcagccttat

SEQ ID NO: 594925 - DNA, 20 bp, Artificial Sequence
  chemically synthesized
cttctgctggcctgtggtta

SEQ ID NO: 594926 - DNA, 20 bp, Artificial Sequence
  chemically synthesized
aataccatcaaatataaatg

SEQ ID NO: 594927 - DNA, 20 bp, Artificial Sequence
  chemically synthesized
ttgaaacctgacaagtaacc

SEQ ID NO: 594928 - DNA, 20 bp, Artificial Sequence
  chemically synthesized
tgaaatcatcaggttacttg

SEQ ID NO: 594929 - DNA, 20 bp, Artificial Sequence
  chemically synthesized
ccatacttggctataattta

SEQ ID NO: 594930 - DNA, 20 bp, Artificial Sequence
  chemically synthesized
ttcagtaatgtaaagaaata

SEQ ID NO: 594931 - DNA, 20 bp, Artificial Sequence
  chemically synthesized
tgacaacttggataatacat

SEQ ID NO: 594932 - DNA, 20 bp, Artificial Sequence
  chemically synthesized
tatatctggagcaataatgt

SEQ ID NO: 594933 - DNA, 20 bp, Artificial Sequence
  chemically synthesized
tttcaggcttatatctggag

SEQ ID NO: 594934 - DNA, 20 bp, Artificial Sequence
  chemically synthesized
gatataagcctgaaactttc

SEQ ID NO: 594935 - DNA, 20 bp, Artificial Sequence
  chemically synthesized
gtcagaaactcaggaaagtt

SEQ ID NO: 594936 - DNA, 20 bp, Artificial Sequence
  chemically synthesized
ggcaaaagtcagaaactcag

SEQ ID NO: 594937 - DNA, 20 bp, Artificial Sequence
  chemically synthesized
ttacatttgttttaactatt

SEQ ID NO: 594938 - DNA, 20 bp, Artificial Sequence
  chemically synthesized
atataacataaatgccttac

SEQ ID NO: 594939 - DNA, 20 bp, Artificial Sequence
  chemically synthesized
aaagaacctattactgaata

SEQ ID NO: 594940 - DNA, 20 bp, Artificial Sequence
  chemically synthesized
aacctattactgaatattta

SEQ ID NO: 594941 - DNA, 20 bp, Artificial Sequence
  chemically synthesized
tactgaatatttagtttgct

SEQ ID NO: 594942 - DNA, 20 bp, Artificial Sequence
  chemically synthesized
gcttcaggcttcgcaatcat

SEQ ID NO: 594943 - DNA, 20 bp, Artificial Sequence
  chemically synthesized
tatattaaatgtggaatcta

SEQ ID NO: 594944 - DNA, 20 bp, Artificial Sequence
  chemically synthesized
ccacatttaatatatatatg

SEQ ID NO: 594945 - DNA, 20 bp, Artificial Sequence
  chemically synthesized
ctttttctttcaacatgatc

SEQ ID NO: 594946 - DNA, 20 bp, Artificial Sequence
  chemically synthesized
attgatcatgttgaaagaaa

SEQ ID NO: 594947 - DNA, 20 bp, Artificial Sequence
  chemically synthesized
ccaccgtgccaggccacctg

SEQ ID NO: 594948 - DNA, 20 bp, Artificial Sequence
  chemically synthesized
caccttggcctcccaaagtg

SEQ ID NO: 594949 - DNA, 20 bp, Artificial Sequence
  chemically synthesized
ttttgtatttttagtagaga

SEQ ID NO: 594950 - DNA, 20 bp, Artificial Sequence
  chemically synthesized
aatggcgtaaacccgggagg

SEQ ID NO: 594951 - DNA, 20 bp, Artificial Sequence
  chemically synthesized
ctcactgcaagctctgcctc

SEQ ID NO: 594952 - DNA, 20 bp, Artificial Sequence
  chemically synthesized
tgtcttgttttttcttttgt

SEQ ID NO: 594953 - DNA, 20 bp, Artificial Sequence
  chemically synthesized
gtcacctgtcttgttttttc

SEQ ID NO: 594954 - DNA, 20 bp, Artificial Sequence
  chemically synthesized
ttaaaattcaaagtcacctg

SEQ ID NO: 594955 - DNA, 20 bp, Artificial Sequence
  chemically synthesized
gttagaaccctcccccaaca

SEQ ID NO: 594956 - DNA, 20 bp, Artificial Sequence
  chemically synthesized
atgctattactttcggtatg

SEQ ID NO: 594957 - DNA, 20 bp, Artificial Sequence
  chemically synthesized
tgcttatcttaataagtatg

SEQ ID NO: 594958 - DNA, 20 bp, Artificial Sequence
  chemically synthesized
taagtatgatgagcttaaat

SEQ ID NO: 594959 - DNA, 20 bp, Artificial Sequence
  chemically synthesized
atatatttgtagggtacatg

SEQ ID NO: 594960 - DNA, 20 bp, Artificial Sequence
  chemically synthesized
tggataccccgttctccatg

SEQ ID NO: 594961 - DNA, 20 bp, Artificial Sequence
  chemically synthesized
ttgtttgtaacacaaaggag

SEQ ID NO: 594962 - DNA, 20 bp, Artificial Sequence
  chemically synthesized
taactaaaggagtgtgattg

SEQ ID NO: 594963 - DNA, 20 bp, Artificial Sequence
  chemically synthesized
aaaataactaaaggagtgtg

SEQ ID NO: 594964 - DNA, 20 bp, Artificial Sequence
  chemically synthesized
atttaaaaataactaaagga

SEQ ID NO: 594965 - DNA, 20 bp, Artificial Sequence
  chemically synthesized
attattaaccataatcatcc

SEQ ID NO: 594966 - DNA, 20 bp, Artificial Sequence
  chemically synthesized
tttgatctgatcaaacaacg

SEQ ID NO: 594967 - DNA, 20 bp, Artificial Sequence
  chemically synthesized
tgtagaattatttggaaatt

SEQ ID NO: 594968 - DNA, 20 bp, Artificial Sequence
  chemically synthesized
attatttggaaattttctgt

SEQ ID NO: 594969 - DNA, 20 bp, Artificial Sequence
  chemically synthesized
aattttctgtttatgttttc

SEQ ID NO: 594970 - DNA, 20 bp, Artificial Sequence
  chemically synthesized
tgtttatgttttcatgagct

SEQ ID NO: 594971 - DNA, 20 bp, Artificial Sequence
  chemically synthesized
tgtatttaaatattaaacat

SEQ ID NO: 594972 - DNA, 20 bp, Artificial Sequence
  chemically synthesized
tttgatgttaacagaaacaa

SEQ ID NO: 594973 - DNA, 20 bp, Artificial Sequence
  chemically synthesized
accatgagatattttctgtt

SEQ ID NO: 594974 - DNA, 20 bp, Artificial Sequence
  chemically synthesized
tcttttaacagaaaatatct

SEQ ID NO: 594975 - DNA, 20 bp, Artificial Sequence
  chemically synthesized
ttttcgaaaattactaagag

SEQ ID NO: 594976 - DNA, 20 bp, Artificial Sequence
  chemically synthesized
agtgactataattaataata

SEQ ID NO: 594977 - DNA, 20 bp, Artificial Sequence
  chemically synthesized
caacacagcccttttgtatc

SEQ ID NO: 594978 - DNA, 20 bp, Artificial Sequence
  chemically synthesized
tcctttgattttaaaaaagg

SEQ ID NO: 594979 - DNA, 20 bp, Artificial Sequence
  chemically synthesized
caggtcctgaaaatgtcaga

SEQ ID NO: 594980 - DNA, 20 bp, Artificial Sequence
  chemically synthesized
atgtcagactgtgtttccca

SEQ ID NO: 594981 - DNA, 20 bp, Artificial Sequence
  chemically synthesized
atagtagttgatgaacatct

SEQ ID NO: 594982 - DNA, 20 bp, Artificial Sequence
  chemically synthesized
tatgtgctgaatttttatca

SEQ ID NO: 594983 - DNA, 20 bp, Artificial Sequence
  chemically synthesized
atgtttctcctaggcacttt

SEQ ID NO: 594984 - DNA, 20 bp, Artificial Sequence
  chemically synthesized
cttaatttccttaacctttt

SEQ ID NO: 594985 - DNA, 20 bp, Artificial Sequence
  chemically synthesized
gatcatcttttgttttactt

SEQ ID NO: 594986 - DNA, 20 bp, Artificial Sequence
  chemically synthesized
ttgaaacacacacgatcatc

SEQ ID NO: 594987 - DNA, 20 bp, Artificial Sequence
  chemically synthesized
gtaaaacaaaagatgatcgt

SEQ ID NO: 594988 - DNA, 20 bp, Artificial Sequence
  chemically synthesized
gtgtttcaaaataatggtag

SEQ ID NO: 594989 - DNA, 20 bp, Artificial Sequence
  chemically synthesized
gaagctcttgtgagggtgtg

SEQ ID NO: 594990 - DNA, 20 bp, Artificial Sequence
  chemically synthesized
caaactcctcacaccctcac

SEQ ID NO: 594991 - DNA, 20 bp, Artificial Sequence
  chemically synthesized
tttcagagtaaagcaactct

SEQ ID NO: 594992 - DNA, 20 bp, Artificial Sequence
  chemically synthesized
aattaatagtaaacagtaag

SEQ ID NO: 594993 - DNA, 20 bp, Artificial Sequence
  chemically synthesized
taaaaagtcatttacatcat

SEQ ID NO: 594994 - DNA, 20 bp, Artificial Sequence
  chemically synthesized
ccaaaggctgtagggtatca

SEQ ID NO: 594995 - DNA, 20 bp, Artificial Sequence
  chemically synthesized
ttttaaaaaagtattctgga

SEQ ID NO: 594996 - DNA, 20 bp, Artificial Sequence
  chemically synthesized
aattcactcattatagaagc

SEQ ID NO: 594997 - DNA, 20 bp, Artificial Sequence
  chemically synthesized
caaaagagaatacaagaaac

SEQ ID NO: 594998 - DNA, 20 bp, Artificial Sequence
  chemically synthesized
tttcttgtattctcttttga

SEQ ID NO: 594999 - DNA, 20 bp, Artificial Sequence
  chemically synthesized
taaatcatagtgaactcacg

SEQ ID NO: 595000 - DNA, 20 bp, Artificial Sequence
  chemically synthesized
taaaacctaccgtgagttca

SEQ ID NO: 595001 - DNA, 20 bp, Artificial Sequence
  chemically synthesized
cactatgatttacatgaaaa

SEQ ID NO: 595002 - DNA, 20 bp, Artificial Sequence
  chemically synthesized
agcatgtattttttccaatt

SEQ ID NO: 595003 - DNA, 20 bp, Artificial Sequence
  chemically synthesized
acatgctatatgcaaatcta

SEQ ID NO: 595004 - DNA, 20 bp, Artificial Sequence
  chemically synthesized
cctaaggcaacacgaagcta

SEQ ID NO: 595005 - DNA, 20 bp, Artificial Sequence
  chemically synthesized
aactgttttatctttggtgg

SEQ ID NO: 595006 - DNA, 20 bp, Artificial Sequence
  chemically synthesized
tgcaaaactgttttatcttt

SEQ ID NO: 595007 - DNA, 20 bp, Artificial Sequence
  chemically synthesized
atctaagccaccaaagataa

SEQ ID NO: 595008 - DNA, 20 bp, Artificial Sequence
  chemically synthesized
aaaaacactattgattgcaa

SEQ ID NO: 595009 - DNA, 20 bp, Artificial Sequence
  chemically synthesized
taaaacagttttgcaatcaa

SEQ ID NO: 595010 - DNA, 20 bp, Artificial Sequence
  chemically synthesized
gaagagaaaaggaaaaacac

SEQ ID NO: 595011 - DNA, 20 bp, Artificial Sequence
  chemically synthesized
gtatacacatttcatatttc

SEQ ID NO: 595012 - DNA, 20 bp, Artificial Sequence
  chemically synthesized
tgaaatgtgtatacgtattg

SEQ ID NO: 595013 - DNA, 20 bp, Artificial Sequence
  chemically synthesized
gatacctactataatttgaa

SEQ ID NO: 595014 - DNA, 20 bp, Artificial Sequence
  chemically synthesized
ttgaacattgattccctttg

SEQ ID NO: 595015 - DNA, 20 bp, Artificial Sequence
  chemically synthesized
gtcttgatggtgcctcagga

SEQ ID NO: 595016 - DNA, 20 bp, Artificial Sequence
  chemically synthesized
agcaaatgtggagggtgttc

SEQ ID NO: 595017 - DNA, 20 bp, Artificial Sequence
  chemically synthesized
aactacagaacaccctccac

SEQ ID NO: 595018 - DNA, 20 bp, Artificial Sequence
  chemically synthesized
tccacatttgcttcagcact

SEQ ID NO: 595019 - DNA, 20 bp, Artificial Sequence
  chemically synthesized
actccctggtggccaaactc

SEQ ID NO: 595020 - DNA, 20 bp, Artificial Sequence
  chemically synthesized
catttcaaaggtgaaaacaa

SEQ ID NO: 595021 - DNA, 20 bp, Artificial Sequence
  chemically synthesized
tgttttcacctttgaaatga

SEQ ID NO: 595022 - DNA, 20 bp, Artificial Sequence
  chemically synthesized
tcaggaggctgaggcgggaa

SEQ ID NO: 595023 - DNA, 20 bp, Artificial Sequence
  chemically synthesized
ctactcaggaggctgaggcg

SEQ ID NO: 595024 - DNA, 20 bp, Artificial Sequence
  chemically synthesized
tatcagcaagcgccaccacg

SEQ ID NO: 595025 - DNA, 20 bp, Artificial Sequence
  chemically synthesized
cacacaaaagccttgcgtgg

SEQ ID NO: 595026 - DNA, 20 bp, Artificial Sequence
  chemically synthesized
gtgtgtatttttagtagagg

SEQ ID NO: 595027 - DNA, 20 bp, Artificial Sequence
  chemically synthesized
cgagagtattgcttgagccc

SEQ ID NO: 595028 - DNA, 20 bp, Artificial Sequence
  chemically synthesized
ggctcaagcaatactctcgc

SEQ ID NO: 595029 - DNA, 20 bp, Artificial Sequence
  chemically synthesized
ttgggaagctggggcgagag

SEQ ID NO: 595030 - DNA, 20 bp, Artificial Sequence
  chemically synthesized
cgccccagcttcccaaagtg

SEQ ID NO: 595031 - DNA, 20 bp, Artificial Sequence
  chemically synthesized
cttcccaaagtgctgggatt

SEQ ID NO: 595032 - DNA, 20 bp, Artificial Sequence
  chemically synthesized
gggattacaggcttgaacca

SEQ ID NO: 595033 - DNA, 20 bp, Artificial Sequence
  chemically synthesized
catgcttggccaggagcacc

SEQ ID NO: 595034 - DNA, 20 bp, Artificial Sequence
  chemically synthesized
ctgtggaaaggtataggggg

SEQ ID NO: 595035 - DNA, 20 bp, Artificial Sequence
  chemically synthesized
catagccccctatacctttc

SEQ ID NO: 595036 - DNA, 20 bp, Artificial Sequence
  chemically synthesized
taaacagccttaaattttct

SEQ ID NO: 595037 - DNA, 20 bp, Artificial Sequence
  chemically synthesized
aaagcctggagaaaatttaa

SEQ ID NO: 595038 - DNA, 20 bp, Artificial Sequence
  chemically synthesized
aaatttaaggctgtttatat

SEQ ID NO: 595039 - DNA, 20 bp, Artificial Sequence
  chemically synthesized
tgcagagttcacagttggtg

SEQ ID NO: 595040 - DNA, 20 bp, Artificial Sequence
  chemically synthesized
tgctccagctcacttttcca

SEQ ID NO: 595041 - DNA, 20 bp, Artificial Sequence
  chemically synthesized
taaataatgcttattataaa

SEQ ID NO: 595042 - DNA, 20 bp, Artificial Sequence
  chemically synthesized
gacttttgtaggagaataaa

SEQ ID NO: 595043 - DNA, 20 bp, Artificial Sequence
  chemically synthesized
ttattctcctacaaaagtct

SEQ ID NO: 595044 - DNA, 20 bp, Artificial Sequence
  chemically synthesized
tactagttataaaaaactca

SEQ ID NO: 595045 - DNA, 20 bp, Artificial Sequence
  chemically synthesized
accctatttaataaagcatc

SEQ ID NO: 595046 - DNA, 20 bp, Artificial Sequence
  chemically synthesized
caaattacgtattttgttat

SEQ ID NO: 595047 - DNA, 20 bp, Artificial Sequence
  chemically synthesized
ttacatatgtattgttacat

SEQ ID NO: 595048 - DNA, 20 bp, Artificial Sequence
  chemically synthesized
acatatgcacgtgttaggta

SEQ ID NO: 595049 - DNA, 20 bp, Artificial Sequence
  chemically synthesized
gtaactgatgttacatgtga

SEQ ID NO: 595050 - DNA, 20 bp, Artificial Sequence
  chemically synthesized
atatgtgtgtgattacatat

SEQ ID NO: 595051 - DNA, 20 bp, Artificial Sequence
  chemically synthesized
aaatttcaaattatatatgt

SEQ ID NO: 595052 - DNA, 20 bp, Artificial Sequence
  chemically synthesized
atataattaaattgacttca

SEQ ID NO: 595053 - DNA, 20 bp, Artificial Sequence
  chemically synthesized
taaaattatggttttattat

SEQ ID NO: 595054 - DNA, 20 bp, Artificial Sequence
  chemically synthesized
catttattgcatgttaaaat

SEQ ID NO: 595055 - DNA, 20 bp, Artificial Sequence
  chemically synthesized
actgagtataacacacatgc

SEQ ID NO: 595056 - DNA, 20 bp, Artificial Sequence
  chemically synthesized
ctctaaagagagacctcaca

SEQ ID NO: 595057 - DNA, 20 bp, Artificial Sequence
  chemically synthesized
ggcaaatttcaaaattattt

SEQ ID NO: 595058 - DNA, 20 bp, Artificial Sequence
  chemically synthesized
catcactctcactaccaaat

SEQ ID NO: 595059 - DNA, 20 bp, Artificial Sequence
  chemically synthesized
gacatcaacactgaactaat

SEQ ID NO: 595060 - DNA, 20 bp, Artificial Sequence
  chemically synthesized
cattcacacaaataggatac

SEQ ID NO: 595061 - DNA, 20 bp, Artificial Sequence
  chemically synthesized
atatagggctcagtactatc

SEQ ID NO: 595062 - DNA, 20 bp, Artificial Sequence
  chemically synthesized
taaaatttatcacaagtaca

SEQ ID NO: 595063 - DNA, 20 bp, Artificial Sequence
  chemically synthesized
tttataaatttggcgcagtt

SEQ ID NO: 595064 - DNA, 20 bp, Artificial Sequence
  chemically synthesized
tataattgttctatttttat

SEQ ID NO: 595065 - DNA, 20 bp, Artificial Sequence
  chemically synthesized
gagaaagaaagatcacattc

SEQ ID NO: 595066 - DNA, 20 bp, Artificial Sequence
  chemically synthesized
atatccacagttttgctttc

SEQ ID NO: 595067 - DNA, 20 bp, Artificial Sequence
  chemically synthesized
gtggaacaaaatatccacag

SEQ ID NO: 595068 - DNA, 20 bp, Artificial Sequence
  chemically synthesized
cagtggtggaacaaaatatc

SEQ ID NO: 595069 - DNA, 20 bp, Artificial Sequence
  chemically synthesized
actacatcattaccaccatc

SEQ ID NO: 595070 - DNA, 20 bp, Artificial Sequence
  chemically synthesized
ctccttgttggggggggggg

SEQ ID NO: 595071 - DNA, 20 bp, Artificial Sequence
  chemically synthesized
cccccaacaaggaggccata

SEQ ID NO: 595072 - DNA, 20 bp, Artificial Sequence
  chemically synthesized
agtagacttcttatttcatt

SEQ ID NO: 595073 - DNA, 20 bp, Artificial Sequence
  chemically synthesized
actgatcatgcaaacacagc

SEQ ID NO: 595074 - DNA, 20 bp, Artificial Sequence
  chemically synthesized
tttccctagacaatctttgg

SEQ ID NO: 595075 - DNA, 20 bp, Artificial Sequence
  chemically synthesized
tggtaagaaagaagaactat

SEQ ID NO: 595076 - DNA, 20 bp, Artificial Sequence
  chemically synthesized
ggcatctgtcctgtgcccct

SEQ ID NO: 595077 - DNA, 20 bp, Artificial Sequence
  chemically synthesized
acaatgatacaggcaaagtc

SEQ ID NO: 595078 - DNA, 20 bp, Artificial Sequence
  chemically synthesized
acaggcaaagtcattcgctt

SEQ ID NO: 595079 - DNA, 20 bp, Artificial Sequence
  chemically synthesized
aatactcattcagcagtttt

SEQ ID NO: 595080 - DNA, 20 bp, Artificial Sequence
  chemically synthesized
caacacttcaatactcattc

SEQ ID NO: 595081 - DNA, 20 bp, Artificial Sequence
  chemically synthesized
agtattgaagtgttggcagt

SEQ ID NO: 595082 - DNA, 20 bp, Artificial Sequence
  chemically synthesized
ggaactctataagaagccat

SEQ ID NO: 595083 - DNA, 20 bp, Artificial Sequence
  chemically synthesized
agatccagcaatgaaacaag

SEQ ID NO: 595084 - DNA, 20 bp, Artificial Sequence
  chemically synthesized
gttaatttatgtattgagag

SEQ ID NO: 595085 - DNA, 20 bp, Artificial Sequence
  chemically synthesized
ttggcacaattcaaccctct

SEQ ID NO: 595086 - DNA, 20 bp, Artificial Sequence
  chemically synthesized
gtatagtctcctttggcagc

SEQ ID NO: 595087 - DNA, 20 bp, Artificial Sequence
  chemically synthesized
tttggcagcaagagcttaat

SEQ ID NO: 595088 - DNA, 20 bp, Artificial Sequence
  chemically synthesized
agaatgatacgcaaaacagc

SEQ ID NO: 595089 - DNA, 20 bp, Artificial Sequence
  chemically synthesized
aaatatagggaagaaactaa

SEQ ID NO: 595090 - DNA, 20 bp, Artificial Sequence
  chemically synthesized
aaagcagtgaatgcgattaa

SEQ ID NO: 595091 - DNA, 20 bp, Artificial Sequence
  chemically synthesized
aaatccatcttaatcgcatt

SEQ ID NO: 595092 - DNA, 20 bp, Artificial Sequence
  chemically synthesized
aaaagaaaataaagcagtga

SEQ ID NO: 595093 - DNA, 20 bp, Artificial Sequence
  chemically synthesized
ttgggaggctgaggcaggag

SEQ ID NO: 595094 - DNA, 20 bp, Artificial Sequence
  chemically synthesized
tttcatatttttagtagaga

SEQ ID NO: 595095 - DNA, 20 bp, Artificial Sequence
  chemically synthesized
cgccatgttggccaggatgg

SEQ ID NO: 595096 - DNA, 20 bp, Artificial Sequence
  chemically synthesized
tgcctcggcctcccaaagtg

SEQ ID NO: 595097 - DNA, 20 bp, Artificial Sequence
  chemically synthesized
gtgagccaccgcacccagcc

SEQ ID NO: 595098 - DNA, 20 bp, Artificial Sequence
  chemically synthesized
ctgaaggtgttgtgtatgtt

SEQ ID NO: 595099 - DNA, 20 bp, Artificial Sequence
  chemically synthesized
catccatctgaaggtgttgt

SEQ ID NO: 595100 - DNA, 20 bp, Artificial Sequence
  chemically synthesized
tggatgctaaagtagaaata

SEQ ID NO: 595101 - DNA, 20 bp, Artificial Sequence
  chemically synthesized
agtagaaataaactgtttaa

SEQ ID NO: 595102 - DNA, 20 bp, Artificial Sequence
  chemically synthesized
ccacatgacaatcattttta

SEQ ID NO: 595103 - DNA, 20 bp, Artificial Sequence
  chemically synthesized
taacagattttgtgatcctg

SEQ ID NO: 595104 - DNA, 20 bp, Artificial Sequence
  chemically synthesized
atgattggagacagatattt

SEQ ID NO: 595105 - DNA, 20 bp, Artificial Sequence
  chemically synthesized
tgaaagagtgcaacttcaag

SEQ ID NO: 595106 - DNA, 20 bp, Artificial Sequence
  chemically synthesized
ctctttcaagtatgctaaac

SEQ ID NO: 595107 - DNA, 20 bp, Artificial Sequence
  chemically synthesized
tttgaactttaaaggaaaac

SEQ ID NO: 595108 - DNA, 20 bp, Artificial Sequence
  chemically synthesized
ctgggtttttacattataat

SEQ ID NO: 595109 - DNA, 20 bp, Artificial Sequence
  chemically synthesized
tacggtttgctgtatacttc

SEQ ID NO: 595110 - DNA, 20 bp, Artificial Sequence
  chemically synthesized
ttaagtttgtttaggatact

SEQ ID NO: 595111 - DNA, 20 bp, Artificial Sequence
  chemically synthesized
ttgcacttttcaagatttaa

SEQ ID NO: 595112 - DNA, 20 bp, Artificial Sequence
  chemically synthesized
agatttgcacttttcaagat

SEQ ID NO: 595113 - DNA, 20 bp, Artificial Sequence
  chemically synthesized
ggggatgagatttgcacttt

SEQ ID NO: 595114 - DNA, 20 bp, Artificial Sequence
  chemically synthesized
ttgagcaaaggcttttgggg

SEQ ID NO: 595115 - DNA, 20 bp, Artificial Sequence
  chemically synthesized
gttgcagaatgtgtttgagc

SEQ ID NO: 595116 - DNA, 20 bp, Artificial Sequence
  chemically synthesized
ctataaaccacagttgcaga

SEQ ID NO: 595117 - DNA, 20 bp, Artificial Sequence
  chemically synthesized
gctcaaacacattctgcaac

SEQ ID NO: 595118 - DNA, 20 bp, Artificial Sequence
  chemically synthesized
tacacggtacacagacaagt

SEQ ID NO: 595119 - DNA, 20 bp, Artificial Sequence
  chemically synthesized
gtaccgtgtaatgtcctttg

SEQ ID NO: 595120 - DNA, 20 bp, Artificial Sequence
  chemically synthesized
catctggaggcctgggatcc

SEQ ID NO: 595121 - DNA, 20 bp, Artificial Sequence
  chemically synthesized
ggcaaccaatattaagtggc

SEQ ID NO: 595122 - DNA, 20 bp, Artificial Sequence
  chemically synthesized
tattggttgccattctccaa

SEQ ID NO: 595123 - DNA, 20 bp, Artificial Sequence
  chemically synthesized
gatgacctcagtctggaaaa

SEQ ID NO: 595124 - DNA, 20 bp, Artificial Sequence
  chemically synthesized
ttccagactgaggtcatctc

SEQ ID NO: 595125 - DNA, 20 bp, Artificial Sequence
  chemically synthesized
ttccataataactgtatttt

SEQ ID NO: 595126 - DNA, 20 bp, Artificial Sequence
  chemically synthesized
tcaaagttatgatatagcat

SEQ ID NO: 595127 - DNA, 20 bp, Artificial Sequence
  chemically synthesized
attatgctatatcataactt

SEQ ID NO: 595128 - DNA, 20 bp, Artificial Sequence
  chemically synthesized
tctatctctccctgcactag

SEQ ID NO: 595129 - DNA, 20 bp, Artificial Sequence
  chemically synthesized
ggctttcttgagtgctggaa

SEQ ID NO: 595130 - DNA, 20 bp, Artificial Sequence
  chemically synthesized
ttcttgagtgctggaaatat

SEQ ID NO: 595131 - DNA, 20 bp, Artificial Sequence
  chemically synthesized
tagggtcactgcacaagtag

SEQ ID NO: 595132 - DNA, 20 bp, Artificial Sequence
  chemically synthesized
tcaggacagtgctgcagacc

SEQ ID NO: 595133 - DNA, 20 bp, Artificial Sequence
  chemically synthesized
gctcattcaacatagttttc

SEQ ID NO: 595134 - DNA, 20 bp, Artificial Sequence
  chemically synthesized
gccttctttggctcattcaa

SEQ ID NO: 595135 - DNA, 20 bp, Artificial Sequence
  chemically synthesized
aacagtaaattttaaggaaa

SEQ ID NO: 595136 - DNA, 20 bp, Artificial Sequence
  chemically synthesized
acatggttccctacaggcaa

SEQ ID NO: 595137 - DNA, 20 bp, Artificial Sequence
  chemically synthesized
gtagggaaccatgtcttatg

SEQ ID NO: 595138 - DNA, 20 bp, Artificial Sequence
  chemically synthesized
agccctttgaagatcatagc

SEQ ID NO: 595139 - DNA, 20 bp, Artificial Sequence
  chemically synthesized
atccttggctatgatcttca

SEQ ID NO: 595140 - DNA, 20 bp, Artificial Sequence
  chemically synthesized
cttctgccctgtggaaacca

SEQ ID NO: 595141 - DNA, 20 bp, Artificial Sequence
  chemically synthesized
gatggtctctaagaaagcct

SEQ ID NO: 595142 - DNA, 20 bp, Artificial Sequence
  chemically synthesized
gtcaaatggaggacatgagc

SEQ ID NO: 595143 - DNA, 20 bp, Artificial Sequence
  chemically synthesized
gctcatgtcctccatttgac

SEQ ID NO: 595144 - DNA, 20 bp, Artificial Sequence
  chemically synthesized
tctgtttgatatatagattt

SEQ ID NO: 595145 - DNA, 20 bp, Artificial Sequence
  chemically synthesized
cgccaaatctatatatcaaa

SEQ ID NO: 595146 - DNA, 20 bp, Artificial Sequence
  chemically synthesized
atggtaatctctgtttgata

SEQ ID NO: 595147 - DNA, 20 bp, Artificial Sequence
  chemically synthesized
attgttactctcatggtaat

SEQ ID NO: 595148 - DNA, 20 bp, Artificial Sequence
  chemically synthesized
aaggcacttcttaaattatg

SEQ ID NO: 595149 - DNA, 20 bp, Artificial Sequence
  chemically synthesized
tttactgatgacaatataaa

SEQ ID NO: 595150 - DNA, 20 bp, Artificial Sequence
  chemically synthesized
ataacatttttatgaataaa

SEQ ID NO: 595151 - DNA, 20 bp, Artificial Sequence
  chemically synthesized
tcagtggtattattcttttt

SEQ ID NO: 595152 - DNA, 20 bp, Artificial Sequence
  chemically synthesized
tattctttttattagtttcc

SEQ ID NO: 595153 - DNA, 20 bp, Artificial Sequence
  chemically synthesized
tattaggcagagcagtgact

SEQ ID NO: 595154 - DNA, 20 bp, Artificial Sequence
  chemically synthesized
cagagcagtgacttaatgtt

SEQ ID NO: 595155 - DNA, 20 bp, Artificial Sequence
  chemically synthesized
gatgaacagtaaaaaaaata

SEQ ID NO: 595156 - DNA, 20 bp, Artificial Sequence
  chemically synthesized
aaaaaatatggtgtttgaat

SEQ ID NO: 595157 - DNA, 20 bp, Artificial Sequence
  chemically synthesized
aaagctaataaatgaagaat

SEQ ID NO: 595158 - DNA, 20 bp, Artificial Sequence
  chemically synthesized
gaatcccagattcttcattt

SEQ ID NO: 595159 - DNA, 20 bp, Artificial Sequence
  chemically synthesized
agattcttcatttattagct

SEQ ID NO: 595160 - DNA, 20 bp, Artificial Sequence
  chemically synthesized
tagctttatgatttgggata

SEQ ID NO: 595161 - DNA, 20 bp, Artificial Sequence
  chemically synthesized
acaaaaatttcggaaagttt

SEQ ID NO: 595162 - DNA, 20 bp, Artificial Sequence
  chemically synthesized
actcttagacaaaaatttcg

SEQ ID NO: 595163 - DNA, 20 bp, Artificial Sequence
  chemically synthesized
attaccaagaatatgacttc

SEQ ID NO: 595164 - DNA, 20 bp, Artificial Sequence
  chemically synthesized
tttagtgccttgcttttgca

SEQ ID NO: 595165 - DNA, 20 bp, Artificial Sequence
  chemically synthesized
tttataaagttggtttagtg

SEQ ID NO: 595166 - DNA, 20 bp, Artificial Sequence
  chemically synthesized
tcattgcagtaatttataaa

SEQ ID NO: 595167 - DNA, 20 bp, Artificial Sequence
  chemically synthesized
tatacacagaaagatgtaat

SEQ ID NO: 595168 - DNA, 20 bp, Artificial Sequence
  chemically synthesized
ttctgtgtatattcttgtaa

SEQ ID NO: 595169 - DNA, 20 bp, Artificial Sequence
  chemically synthesized
ttgtactattttccaaaagt

SEQ ID NO: 595170 - DNA, 20 bp, Artificial Sequence
  chemically synthesized
caaaagtattagttttctga

SEQ ID NO: 595171 - DNA, 20 bp, Artificial Sequence
  chemically synthesized
tatggtgagtgtaaggaagt

SEQ ID NO: 595172 - DNA, 20 bp, Artificial Sequence
  chemically synthesized
tgtatgtgtatgtgtgtgtt

SEQ ID NO: 595173 - DNA, 20 bp, Artificial Sequence
  chemically synthesized
ataaagaaatacctgaaact

SEQ ID NO: 595174 - DNA, 20 bp, Artificial Sequence
  chemically synthesized
ccccttttctttttaaagca

SEQ ID NO: 595175 - DNA, 20 bp, Artificial Sequence
  chemically synthesized
ctgggtgctttaaaaagaaa

SEQ ID NO: 595176 - DNA, 20 bp, Artificial Sequence
  chemically synthesized
accagaagtagatgccagtg

SEQ ID NO: 595177 - DNA, 20 bp, Artificial Sequence
  chemically synthesized
tacttctggtgagagcctca

SEQ ID NO: 595178 - DNA, 20 bp, Artificial Sequence
  chemically synthesized
agtatgagacctcaaccccc

SEQ ID NO: 595179 - DNA, 20 bp, Artificial Sequence
  chemically synthesized
agttagttcatgctatatgt

SEQ ID NO: 595180 - DNA, 20 bp, Artificial Sequence
  chemically synthesized
ttggaggcagggcctggtag

SEQ ID NO: 595181 - DNA, 20 bp, Artificial Sequence
  chemically synthesized
attggaaatcacatttcaat

SEQ ID NO: 595182 - DNA, 20 bp, Artificial Sequence
  chemically synthesized
cctccgaatcttatattgaa

SEQ ID NO: 595183 - DNA, 20 bp, Artificial Sequence
  chemically synthesized
gagagagagagagatggctt

SEQ ID NO: 595184 - DNA, 20 bp, Artificial Sequence
  chemically synthesized
gagagagagagagagagaga

SEQ ID NO: 595185 - DNA, 20 bp, Artificial Sequence
  chemically synthesized
aaatagatgtttcacagatt

SEQ ID NO: 595186 - DNA, 20 bp, Artificial Sequence
  chemically synthesized
ttcatcacaaatagatgttt

SEQ ID NO: 595187 - DNA, 20 bp, Artificial Sequence
  chemically synthesized
tatcagcattcatcacaaat

SEQ ID NO: 595188 - DNA, 20 bp, Artificial Sequence
  chemically synthesized
atgaatgctgatattttcta

SEQ ID NO: 595189 - DNA, 20 bp, Artificial Sequence
  chemically synthesized
gtttgtggatcaacaccggc

SEQ ID NO: 595190 - DNA, 20 bp, Artificial Sequence
  chemically synthesized
ggccggtgttgatccacaaa

SEQ ID NO: 595191 - DNA, 20 bp, Artificial Sequence
  chemically synthesized
tgttgatccacaaactgagt

SEQ ID NO: 595192 - DNA, 20 bp, Artificial Sequence
  chemically synthesized
tccaaactgtgaatcataaa

SEQ ID NO: 595193 - DNA, 20 bp, Artificial Sequence
  chemically synthesized
cacaaactgagtttatgatt

SEQ ID NO: 595194 - DNA, 20 bp, Artificial Sequence
  chemically synthesized
tggacaatgaacactagcat

SEQ ID NO: 595195 - DNA, 20 bp, Artificial Sequence
  chemically synthesized
attttttattttattgttgg

SEQ ID NO: 595196 - DNA, 20 bp, Artificial Sequence
  chemically synthesized
aggacattttttattttatt

SEQ ID NO: 595197 - DNA, 20 bp, Artificial Sequence
  chemically synthesized
catttctttccatgcatcca

SEQ ID NO: 595198 - DNA, 20 bp, Artificial Sequence
  chemically synthesized
catcttgtcattatcatacc

SEQ ID NO: 595199 - DNA, 20 bp, Artificial Sequence
  chemically synthesized
tttcaactttttctcatttt

SEQ ID NO: 595200 - DNA, 20 bp, Artificial Sequence
  chemically synthesized
ttttcatatcgctctctcta

SEQ ID NO: 595201 - DNA, 20 bp, Artificial Sequence
  chemically synthesized
taactagccagaagaattgg

SEQ ID NO: 595202 - DNA, 20 bp, Artificial Sequence
  chemically synthesized
tatctattagatgctatttt

SEQ ID NO: 595203 - DNA, 20 bp, Artificial Sequence
  chemically synthesized
atttgctaattataccactt

SEQ ID NO: 595204 - DNA, 20 bp, Artificial Sequence
  chemically synthesized
ttataccacttaaatgtttc

SEQ ID NO: 595205 - DNA, 20 bp, Artificial Sequence
  chemically synthesized
gtccatcaatttcagcaaac

SEQ ID NO: 595206 - DNA, 20 bp, Artificial Sequence
  chemically synthesized
taacctattcacatataatc

SEQ ID NO: 595207 - DNA, 20 bp, Artificial Sequence
  chemically synthesized
ttggattatatgtgaatagg

SEQ ID NO: 595208 - DNA, 20 bp, Artificial Sequence
  chemically synthesized
cacagagcagctccaaaagt

SEQ ID NO: 595209 - DNA, 20 bp, Artificial Sequence
  chemically synthesized
tgtcaaagtacacaagatgt

SEQ ID NO: 595210 - DNA, 20 bp, Artificial Sequence
  chemically synthesized
agataaaggtaatctccctg

SEQ ID NO: 595211 - DNA, 20 bp, Artificial Sequence
  chemically synthesized
tgcaggacagaatcacacca

SEQ ID NO: 595212 - DNA, 20 bp, Artificial Sequence
  chemically synthesized
ctttagttcacaaccaaaaa

SEQ ID NO: 595213 - DNA, 20 bp, Artificial Sequence
  chemically synthesized
aacagttatctttaagaacg

SEQ ID NO: 595214 - DNA, 20 bp, Artificial Sequence
  chemically synthesized
ctgcctttgtaactcattgc

SEQ ID NO: 595215 - DNA, 20 bp, Artificial Sequence
  chemically synthesized
agtccaattaaagtaacact

SEQ ID NO: 595216 - DNA, 20 bp, Artificial Sequence
  chemically synthesized
ttgaaaatgtctgtacagcc

SEQ ID NO: 595217 - DNA, 20 bp, Artificial Sequence
  chemically synthesized
tacagcccatggtttccctt

SEQ ID NO: 595218 - DNA, 20 bp, Artificial Sequence
  chemically synthesized
atcgctttccagatatactt

SEQ ID NO: 595219 - DNA, 20 bp, Artificial Sequence
  chemically synthesized
tgctaccacctccaggagca

SEQ ID NO: 595220 - DNA, 20 bp, Artificial Sequence
  chemically synthesized
aatcatcatcttcatcagca

SEQ ID NO: 595221 - DNA, 20 bp, Artificial Sequence
  chemically synthesized
aaacttgctgctgatgaaga

SEQ ID NO: 595222 - DNA, 20 bp, Artificial Sequence
  chemically synthesized
gatgatgattttgatgatga

SEQ ID NO: 595223 - DNA, 20 bp, Artificial Sequence
  chemically synthesized
ttcttcactggcgctttttc

SEQ ID NO: 595224 - DNA, 20 bp, Artificial Sequence
  chemically synthesized
tctcatatagatttcttcac

SEQ ID NO: 595225 - DNA, 20 bp, Artificial Sequence
  chemically synthesized
tttttggctggagtatctca

SEQ ID NO: 595226 - DNA, 20 bp, Artificial Sequence
  chemically synthesized
acggttttgagtcttttcca

SEQ ID NO: 595227 - DNA, 20 bp, Artificial Sequence
  chemically synthesized
gtccttttgatcttggtgtt

SEQ ID NO: 595228 - DNA, 20 bp, Artificial Sequence
  chemically synthesized
taggagtttttccttgtttt

SEQ ID NO: 595229 - DNA, 20 bp, Artificial Sequence
  chemically synthesized
tgggtgttttaggagttttt

SEQ ID NO: 595230 - DNA, 20 bp, Artificial Sequence
  chemically synthesized
ctaggtcctttgggtgtttt

SEQ ID NO: 595231 - DNA, 20 bp, Artificial Sequence
  chemically synthesized
tctacagaactaggtccttt

SEQ ID NO: 595232 - DNA, 20 bp, Artificial Sequence
  chemically synthesized
ttttctatacttgcttgcat

SEQ ID NO: 595233 - DNA, 20 bp, Artificial Sequence
  chemically synthesized
agagaaccacctttttctat

SEQ ID NO: 595234 - DNA, 20 bp, Artificial Sequence
  chemically synthesized
ttcttcacataattcatgaa

SEQ ID NO: 595235 - DNA, 20 bp, Artificial Sequence
  chemically synthesized
agttcatgaattatgtgaag

SEQ ID NO: 595236 - DNA, 20 bp, Artificial Sequence
  chemically synthesized
ggaggaagtctctctaagaa

SEQ ID NO: 595237 - DNA, 20 bp, Artificial Sequence
  chemically synthesized
cagatggaaaatttttaaca

SEQ ID NO: 595238 - DNA, 20 bp, Artificial Sequence
  chemically synthesized
caatttgttaaaaattttcc

SEQ ID NO: 595239 - DNA, 20 bp, Artificial Sequence
  chemically synthesized
gttaaaaattttccatctga

SEQ ID NO: 595240 - DNA, 20 bp, Artificial Sequence
  chemically synthesized
tgtaacagttgatatctggc

SEQ ID NO: 595241 - DNA, 20 bp, Artificial Sequence
  chemically synthesized
cagagtgagaaccttcccta

SEQ ID NO: 595242 - DNA, 20 bp, Artificial Sequence
  chemically synthesized
accatgtttgataaatgttg

SEQ ID NO: 595243 - DNA, 20 bp, Artificial Sequence
  chemically synthesized
aagaatgtgttgtccaaaat

SEQ ID NO: 595244 - DNA, 20 bp, Artificial Sequence
  chemically synthesized
tgtgttgtccaaaatgcctg

SEQ ID NO: 595245 - DNA, 20 bp, Artificial Sequence
  chemically synthesized
tttaaagatggaactccacc

SEQ ID NO: 595246 - DNA, 20 bp, Artificial Sequence
  chemically synthesized
agatggaactccaccctttg

SEQ ID NO: 595247 - DNA, 20 bp, Artificial Sequence
  chemically synthesized
atgataaaggtaatcacatt

SEQ ID NO: 595248 - DNA, 20 bp, Artificial Sequence
  chemically synthesized
cccaagagatgaatcttcta

SEQ ID NO: 595249 - DNA, 20 bp, Artificial Sequence
  chemically synthesized
tgatactgactactaccaca

SEQ ID NO: 595250 - DNA, 20 bp, Artificial Sequence
  chemically synthesized
gtagtagtcagtatcactac

SEQ ID NO: 595251 - DNA, 20 bp, Artificial Sequence
  chemically synthesized
cagtatcactactatggttt

SEQ ID NO: 595252 - DNA, 20 bp, Artificial Sequence
  chemically synthesized
aatggcaattaaatttcaac

SEQ ID NO: 595253 - DNA, 20 bp, Artificial Sequence
  chemically synthesized
ttgtgacagtattaaggggt

SEQ ID NO: 595254 - DNA, 20 bp, Artificial Sequence
  chemically synthesized
taaggggtgggagctttagg

SEQ ID NO: 595255 - DNA, 20 bp, Artificial Sequence
  chemically synthesized
tgggagctttaggaggtgat

SEQ ID NO: 595256 - DNA, 20 bp, Artificial Sequence
  chemically synthesized
tgagggctccaccctcacga

SEQ ID NO: 595257 - DNA, 20 bp, Artificial Sequence
  chemically synthesized
ttgatatgtcatcacatgat

SEQ ID NO: 595258 - DNA, 20 bp, Artificial Sequence
  chemically synthesized
ataagtaggtaactctctta

SEQ ID NO: 595259 - DNA, 20 bp, Artificial Sequence
  chemically synthesized
tttgaaggatagcactggtt

SEQ ID NO: 595260 - DNA, 20 bp, Artificial Sequence
  chemically synthesized
atgaactatcagttgagtga

SEQ ID NO: 595261 - DNA, 20 bp, Artificial Sequence
  chemically synthesized
cttaatggaggcttatgaac

SEQ ID NO: 595262 - DNA, 20 bp, Artificial Sequence
  chemically synthesized
actgtgcagcctggcttaat

SEQ ID NO: 595263 - DNA, 20 bp, Artificial Sequence
  chemically synthesized
gcctccattaagccaggctg

SEQ ID NO: 595264 - DNA, 20 bp, Artificial Sequence
  chemically synthesized
taaaaaaataaactgtgcag

SEQ ID NO: 595265 - DNA, 20 bp, Artificial Sequence
  chemically synthesized
gtttatttttttaacaattg

SEQ ID NO: 595266 - DNA, 20 bp, Artificial Sequence
  chemically synthesized
ttgcattgttttaaagttac

SEQ ID NO: 595267 - DNA, 20 bp, Artificial Sequence
  chemically synthesized
gtgtacttttaaatactagt

SEQ ID NO: 595268 - DNA, 20 bp, Artificial Sequence
  chemically synthesized
aaaatagaaattcaaggata

SEQ ID NO: 595269 - DNA, 20 bp, Artificial Sequence
  chemically synthesized
atgtttgaaaaatgtgttat

SEQ ID NO: 595270 - DNA, 20 bp, Artificial Sequence
  chemically synthesized
tatttaagattagcagtaaa

SEQ ID NO: 595271 - DNA, 20 bp, Artificial Sequence
  chemically synthesized
ttcaaataaatccatgttaa

SEQ ID NO: 595272 - DNA, 20 bp, Artificial Sequence
  chemically synthesized
gtattgtaaatcctagttaa

SEQ ID NO: 595273 - DNA, 20 bp, Artificial Sequence
  chemically synthesized
ctggctttacaactcatagt

SEQ ID NO: 595274 - DNA, 20 bp, Artificial Sequence
  chemically synthesized
ctgtactatgagttgtaaag

SEQ ID NO: 595275 - DNA, 20 bp, Artificial Sequence
  chemically synthesized
ggcagcatagttctcaaaat

SEQ ID NO: 595276 - DNA, 20 bp, Artificial Sequence
  chemically synthesized
ttaatttattataccctatt

SEQ ID NO: 595277 - DNA, 20 bp, Artificial Sequence
  chemically synthesized
ataattttgtcctgttgtac

SEQ ID NO: 595278 - DNA, 20 bp, Artificial Sequence
  chemically synthesized
aagtgttgttgggtcattat

SEQ ID NO: 595279 - DNA, 20 bp, Artificial Sequence
  chemically synthesized
cgtatatcccagaataccaa

SEQ ID NO: 595280 - DNA, 20 bp, Artificial Sequence
  chemically synthesized
atacgaccacggttaatcct

SEQ ID NO: 595281 - DNA, 20 bp, Artificial Sequence
  chemically synthesized
atttgacaagggaaaaacaa

SEQ ID NO: 595282 - DNA, 20 bp, Artificial Sequence
  chemically synthesized
aatgaacagtttgtaatact

SEQ ID NO: 595283 - DNA, 20 bp, Artificial Sequence
  chemically synthesized
ataaccatttgcatgtaatg

SEQ ID NO: 595284 - DNA, 20 bp, Artificial Sequence
  chemically synthesized
aaaaggagccaggctagaag

SEQ ID NO: 595285 - DNA, 20 bp, Artificial Sequence
  chemically synthesized
acttactgtcattagagaaa

SEQ ID NO: 595286 - DNA, 20 bp, Artificial Sequence
  chemically synthesized
tgggaatcagaggcagtctc

SEQ ID NO: 595287 - DNA, 20 bp, Artificial Sequence
  chemically synthesized
atataagcaagagagactgc

SEQ ID NO: 595288 - DNA, 20 bp, Artificial Sequence
  chemically synthesized
actgcctctgattcccaaag

SEQ ID NO: 595289 - DNA, 20 bp, Artificial Sequence
  chemically synthesized
ctggcctaggacaaatggtg

SEQ ID NO: 595290 - DNA, 20 bp, Artificial Sequence
  chemically synthesized
gccagatccagtactttctg

SEQ ID NO: 595291 - DNA, 20 bp, Artificial Sequence
  chemically synthesized
tggagtgtttacttactgcc

SEQ ID NO: 595292 - DNA, 20 bp, Artificial Sequence
  chemically synthesized
tattcctagcagcaagcagt

SEQ ID NO: 595293 - DNA, 20 bp, Artificial Sequence
  chemically synthesized
cctactgtgtgcaaagcaga

SEQ ID NO: 595294 - DNA, 20 bp, Artificial Sequence
  chemically synthesized
gcacacagtaggatcacaat

SEQ ID NO: 595295 - DNA, 20 bp, Artificial Sequence
  chemically synthesized
ccaaaacattctctcttaca

SEQ ID NO: 595296 - DNA, 20 bp, Artificial Sequence
  chemically synthesized
aggaagctcaatgtaagaga

SEQ ID NO: 595297 - DNA, 20 bp, Artificial Sequence
  chemically synthesized
caaatgatccccaagtttgt

SEQ ID NO: 595298 - DNA, 20 bp, Artificial Sequence
  chemically synthesized
ttacctgagacaaatgatcc

SEQ ID NO: 595299 - DNA, 20 bp, Artificial Sequence
  chemically synthesized
tatacctcggtacgtagaaa

SEQ ID NO: 595300 - DNA, 20 bp, Artificial Sequence
  chemically synthesized
tgaaactgtagtatgtgttt

SEQ ID NO: 595301 - DNA, 20 bp, Artificial Sequence
  chemically synthesized
ataaacatgaaaacacatac

SEQ ID NO: 595302 - DNA, 20 bp, Artificial Sequence
  chemically synthesized
tcacttgctgaaactgtagt

SEQ ID NO: 595303 - DNA, 20 bp, Artificial Sequence
  chemically synthesized
aattgaactctttctgggag

SEQ ID NO: 595304 - DNA, 20 bp, Artificial Sequence
  chemically synthesized
gtgtgcatgtgtgcgtacgt

SEQ ID NO: 595305 - DNA, 20 bp, Artificial Sequence
  chemically synthesized
gtacaaaaattctgagaggg

SEQ ID NO: 595306 - DNA, 20 bp, Artificial Sequence
  chemically synthesized
ccagagggctctaccctatc

SEQ ID NO: 595307 - DNA, 20 bp, Artificial Sequence
  chemically synthesized
atgcttgtttctacctttaa

SEQ ID NO: 595308 - DNA, 20 bp, Artificial Sequence
  chemically synthesized
ttcttactgttccctagaat

SEQ ID NO: 595309 - DNA, 20 bp, Artificial Sequence
  chemically synthesized
tcccttcttactgttcccta

SEQ ID NO: 595310 - DNA, 20 bp, Artificial Sequence
  chemically synthesized
tgttccagccatattgatct

SEQ ID NO: 595311 - DNA, 20 bp, Artificial Sequence
  chemically synthesized
aaattgtcatttaatgaaat

SEQ ID NO: 595312 - DNA, 20 bp, Artificial Sequence
  chemically synthesized
acatttcattaaatgacaat

SEQ ID NO: 595313 - DNA, 20 bp, Artificial Sequence
  chemically synthesized
aaatgacaatttctgcttct

SEQ ID NO: 595314 - DNA, 20 bp, Artificial Sequence
  chemically synthesized
ttgcttccagaatgatggtg

SEQ ID NO: 595315 - DNA, 20 bp, Artificial Sequence
  chemically synthesized
tccagaatgatggtgcgcag

SEQ ID NO: 595316 - DNA, 20 bp, Artificial Sequence
  chemically synthesized
aatgatggtgcgcagttttg

SEQ ID NO: 595317 - DNA, 20 bp, Artificial Sequence
  chemically synthesized
actacaaaaaatgagaagaa

SEQ ID NO: 595318 - DNA, 20 bp, Artificial Sequence
  chemically synthesized
atgggaatcccttagggatg

SEQ ID NO: 595319 - DNA, 20 bp, Artificial Sequence
  chemically synthesized
aggataaacatgtcatccct

SEQ ID NO: 595320 - DNA, 20 bp, Artificial Sequence
  chemically synthesized
ctgtagtaaccacggtaaag

SEQ ID NO: 595321 - DNA, 20 bp, Artificial Sequence
  chemically synthesized
accgtggttactacagtaag

SEQ ID NO: 595322 - DNA, 20 bp, Artificial Sequence
  chemically synthesized
agtaagttatgtttttttgt

SEQ ID NO: 595323 - DNA, 20 bp, Artificial Sequence
  chemically synthesized
catggcatgtttaagaagat

SEQ ID NO: 595324 - DNA, 20 bp, Artificial Sequence
  chemically synthesized
gacttccgttgtccagcatg

SEQ ID NO: 595325 - DNA, 20 bp, Artificial Sequence
  chemically synthesized
taaaataattggataatttc

SEQ ID NO: 595326 - DNA, 20 bp, Artificial Sequence
  chemically synthesized
tgaaagatacacttgatggg

SEQ ID NO: 595327 - DNA, 20 bp, Artificial Sequence
  chemically synthesized
taccaggcagaaattccgag

SEQ ID NO: 595328 - DNA, 20 bp, Artificial Sequence
  chemically synthesized
taggggccaaaaagttgcag

SEQ ID NO: 595329 - DNA, 20 bp, Artificial Sequence
  chemically synthesized
aaatattgttacccttttat

SEQ ID NO: 595330 - DNA, 20 bp, Artificial Sequence
  chemically synthesized
tacgcaaggatgaagtgccc

SEQ ID NO: 595331 - DNA, 20 bp, Artificial Sequence
  chemically synthesized
gtgtgggaatacattttaaa

SEQ ID NO: 595332 - DNA, 20 bp, Artificial Sequence
  chemically synthesized
ctcttagcagtaaattttcc

SEQ ID NO: 595333 - DNA, 20 bp, Artificial Sequence
  chemically synthesized
cttctagttacagaaaccag

SEQ ID NO: 595334 - DNA, 20 bp, Artificial Sequence
  chemically synthesized
ttttgtggtcacaaagctat

SEQ ID NO: 595335 - DNA, 20 bp, Artificial Sequence
  chemically synthesized
agtaataaaatttcataaga

SEQ ID NO: 595336 - DNA, 20 bp, Artificial Sequence
  chemically synthesized
cccagcagtaataaaatttc

SEQ ID NO: 595337 - DNA, 20 bp, Artificial Sequence
  chemically synthesized
acgttaagaataattcatac

SEQ ID NO: 595338 - DNA, 20 bp, Artificial Sequence
  chemically synthesized
gatggtagaaatatttactc

SEQ ID NO: 595339 - DNA, 20 bp, Artificial Sequence
  chemically synthesized
tactccagtgatttttccat

SEQ ID NO: 595340 - DNA, 20 bp, Artificial Sequence
  chemically synthesized
gcttcttaacagccacactg

SEQ ID NO: 595341 - DNA, 20 bp, Artificial Sequence
  chemically synthesized
accagctggctgctgagttt

SEQ ID NO: 595342 - DNA, 20 bp, Artificial Sequence
  chemically synthesized
gtgatttcaccagctggctg

SEQ ID NO: 595343 - DNA, 20 bp, Artificial Sequence
  chemically synthesized
ctgtatagtcagtttttaca

SEQ ID NO: 595344 - DNA, 20 bp, Artificial Sequence
  chemically synthesized
acaagtatattttctgtata

SEQ ID NO: 595345 - DNA, 20 bp, Artificial Sequence
  chemically synthesized
tatacagaaaatatacttgt

SEQ ID NO: 595346 - DNA, 20 bp, Artificial Sequence
  chemically synthesized
ttttacatcatatgcctttt

SEQ ID NO: 595347 - DNA, 20 bp, Artificial Sequence
  chemically synthesized
ggtaagtgaatttatattaa

SEQ ID NO: 595348 - DNA, 20 bp, Artificial Sequence
  chemically synthesized
cctatagagttctttgaggc

SEQ ID NO: 595349 - DNA, 20 bp, Artificial Sequence
  chemically synthesized
gacagtatctgctacagaga

SEQ ID NO: 595350 - DNA, 20 bp, Artificial Sequence
  chemically synthesized
aacggcagtacctgttagat

SEQ ID NO: 595351 - DNA, 20 bp, Artificial Sequence
  chemically synthesized
aggttttctcattcttctcg

SEQ ID NO: 595352 - DNA, 20 bp, Artificial Sequence
  chemically synthesized
cctcctcttaatggaaatac

SEQ ID NO: 595353 - DNA, 20 bp, Artificial Sequence
  chemically synthesized
ggaggacggtcttttcatgg

SEQ ID NO: 595354 - DNA, 20 bp, Artificial Sequence
  chemically synthesized
agttggagtgactcctgctc

SEQ ID NO: 595355 - DNA, 20 bp, Artificial Sequence
  chemically synthesized
aaggacccaattctgaagag

SEQ ID NO: 595356 - DNA, 20 bp, Artificial Sequence
  chemically synthesized
ttttaaaggacccaattctg

SEQ ID NO: 595357 - DNA, 20 bp, Artificial Sequence
  chemically synthesized
tcagaattgggtcctttaaa

SEQ ID NO: 595358 - DNA, 20 bp, Artificial Sequence
  chemically synthesized
ctttaccttaccatggttat

SEQ ID NO: 595359 - DNA, 20 bp, Artificial Sequence
  chemically synthesized
agctctccctttagctgctc

SEQ ID NO: 595360 - DNA, 20 bp, Artificial Sequence
  chemically synthesized
agagctgaagagcagctaaa

SEQ ID NO: 595361 - DNA, 20 bp, Artificial Sequence
  chemically synthesized
agagtacaaaaatgtcaaag

SEQ ID NO: 595362 - DNA, 20 bp, Artificial Sequence
  chemically synthesized
gggagaaagaaagagcacac

SEQ ID NO: 595363 - DNA, 20 bp, Artificial Sequence
  chemically synthesized
agggtcaccatgctataact

SEQ ID NO: 595364 - DNA, 20 bp, Artificial Sequence
  chemically synthesized
atagaatatgacgttaaact

SEQ ID NO: 595365 - DNA, 20 bp, Artificial Sequence
  chemically synthesized
ccatcaaatgttgaaaaact

SEQ ID NO: 595366 - DNA, 20 bp, Artificial Sequence
  chemically synthesized
attgagcatacagaagtaaa

SEQ ID NO: 595367 - DNA, 20 bp, Artificial Sequence
  chemically synthesized
tactttcatatcacaaagta

SEQ ID NO: 595368 - DNA, 20 bp, Artificial Sequence
  chemically synthesized
tgtaaagaaatgtaataaaa

SEQ ID NO: 595369 - DNA, 20 bp, Artificial Sequence
  chemically synthesized
tggtatcttttgcaatgtta

SEQ ID NO: 595370 - DNA, 20 bp, Artificial Sequence
  chemically synthesized
caaaagataccagaaaacca

SEQ ID NO: 595371 - DNA, 20 bp, Artificial Sequence
  chemically synthesized
gtcttgttaaggttaagcta

SEQ ID NO: 595372 - DNA, 20 bp, Artificial Sequence
  chemically synthesized
tatattttttccctaaaaac

SEQ ID NO: 595373 - DNA, 20 bp, Artificial Sequence
  chemically synthesized
ttattctgacatgaataaac

SEQ ID NO: 595374 - DNA, 20 bp, Artificial Sequence
  chemically synthesized
ttcatgtcagaataacacac

SEQ ID NO: 595375 - DNA, 20 bp, Artificial Sequence
  chemically synthesized
actggtgtttcgctccccat

SEQ ID NO: 595376 - DNA, 20 bp, Artificial Sequence
  chemically synthesized
ccccatgtctgcttaacatt

SEQ ID NO: 595377 - DNA, 20 bp, Artificial Sequence
  chemically synthesized
tattgtttagatgaaatttt

SEQ ID NO: 595378 - DNA, 20 bp, Artificial Sequence
  chemically synthesized
taagacattaacagtagtgg

SEQ ID NO: 595379 - DNA, 20 bp, Artificial Sequence
  chemically synthesized
cactactgttaatgtcttaa

SEQ ID NO: 595380 - DNA, 20 bp, Artificial Sequence
  chemically synthesized
tcgatttcaaatggaatacc

SEQ ID NO: 595381 - DNA, 20 bp, Artificial Sequence
  chemically synthesized
taccttaagattttagggtc

SEQ ID NO: 595382 - DNA, 20 bp, Artificial Sequence
  chemically synthesized
tttttattaatggaaatggc

SEQ ID NO: 595383 - DNA, 20 bp, Artificial Sequence
  chemically synthesized
tccattaataaaaatattca

SEQ ID NO: 595384 - DNA, 20 bp, Artificial Sequence
  chemically synthesized
tagaaacaataacaattacc

SEQ ID NO: 595385 - DNA, 20 bp, Artificial Sequence
  chemically synthesized
cttaatctaatggtaattgt

SEQ ID NO: 595386 - DNA, 20 bp, Artificial Sequence
  chemically synthesized
ctatgatagaatgagatgga

SEQ ID NO: 595387 - DNA, 20 bp, Artificial Sequence
  chemically synthesized
ccatctcattctatcatagc

SEQ ID NO: 595388 - DNA, 20 bp, Artificial Sequence
  chemically synthesized
ttcttggagactaggaaaaa

SEQ ID NO: 595389 - DNA, 20 bp, Artificial Sequence
  chemically synthesized
ttcctagtctccaagaacat

SEQ ID NO: 595390 - DNA, 20 bp, Artificial Sequence
  chemically synthesized
tatattgacagggtgaattt

SEQ ID NO: 595391 - DNA, 20 bp, Artificial Sequence
  chemically synthesized
tgtcactttccttcatggtg

SEQ ID NO: 595392 - DNA, 20 bp, Artificial Sequence
  chemically synthesized
taacaagaagaaatgttaat

SEQ ID NO: 595393 - DNA, 20 bp, Artificial Sequence
  chemically synthesized
gtgtcagctatctgaaacag

SEQ ID NO: 595394 - DNA, 20 bp, Artificial Sequence
  chemically synthesized
attccaattcagccaaacgc

SEQ ID NO: 595395 - DNA, 20 bp, Artificial Sequence
  chemically synthesized
aattcctaatccaagagccc

SEQ ID NO: 595396 - DNA, 20 bp, Artificial Sequence
  chemically synthesized
cttctcaaagcataagggct

SEQ ID NO: 595397 - DNA, 20 bp, Artificial Sequence
  chemically synthesized
gaaattatactacataaaaa

SEQ ID NO: 595398 - DNA, 20 bp, Artificial Sequence
  chemically synthesized
aggttttatgaaatttccag

SEQ ID NO: 595399 - DNA, 20 bp, Artificial Sequence
  chemically synthesized
ggttggtttttctgcagtgt

SEQ ID NO: 595400 - DNA, 20 bp, Artificial Sequence
  chemically synthesized
cgataattcagtaaataagt

SEQ ID NO: 595401 - DNA, 20 bp, Artificial Sequence
  chemically synthesized
atgaactaatcacttataaa

SEQ ID NO: 595402 - DNA, 20 bp, Artificial Sequence
  chemically synthesized
tataactaatcactctttat

SEQ ID NO: 595403 - DNA, 20 bp, Artificial Sequence
  chemically synthesized
aaagagtgattagttataat

SEQ ID NO: 595404 - DNA, 20 bp, Artificial Sequence
  chemically synthesized
ttgtgcaaaatgctattcca

SEQ ID NO: 595405 - DNA, 20 bp, Artificial Sequence
  chemically synthesized
tatcttaattcttttcatgt

SEQ ID NO: 595406 - DNA, 20 bp, Artificial Sequence
  chemically synthesized
aaaagaattaagatattttc

SEQ ID NO: 595407 - DNA, 20 bp, Artificial Sequence
  chemically synthesized
caactattaagctaaaggac

SEQ ID NO: 595408 - DNA, 20 bp, Artificial Sequence
  chemically synthesized
tggattcaaatcccaggtcc

SEQ ID NO: 595409 - DNA, 20 bp, Artificial Sequence
  chemically synthesized
taaatgctggactcagaaag

SEQ ID NO: 595410 - DNA, 20 bp, Artificial Sequence
  chemically synthesized
gtggttaaatgctggactca

SEQ ID NO: 595411 - DNA, 20 bp, Artificial Sequence
  chemically synthesized
aatccacatgaggctctaat

SEQ ID NO: 595412 - DNA, 20 bp, Artificial Sequence
  chemically synthesized
aaacttctattagagcctca

SEQ ID NO: 595413 - DNA, 20 bp, Artificial Sequence
  chemically synthesized
tagagcctcatgtggattgt

SEQ ID NO: 595414 - DNA, 20 bp, Artificial Sequence
  chemically synthesized
gcagtaattgagtgcatata

SEQ ID NO: 595415 - DNA, 20 bp, Artificial Sequence
  chemically synthesized
actttgtatatgcactcaat

SEQ ID NO: 595416 - DNA, 20 bp, Artificial Sequence
  chemically synthesized
tgtatatgcactcaattact

SEQ ID NO: 595417 - DNA, 20 bp, Artificial Sequence
  chemically synthesized
tcatgttatatgccactcaa

SEQ ID NO: 595418 - DNA, 20 bp, Artificial Sequence
  chemically synthesized
acaaaattaagtacatgaat

SEQ ID NO: 595419 - DNA, 20 bp, Artificial Sequence
  chemically synthesized
aaaaaatagagttgcatgga

SEQ ID NO: 595420 - DNA, 20 bp, Artificial Sequence
  chemically synthesized
tcactttaaagaagagaatt

SEQ ID NO: 595421 - DNA, 20 bp, Artificial Sequence
  chemically synthesized
tttgatcaaaatacataggg

SEQ ID NO: 595422 - DNA, 20 bp, Artificial Sequence
  chemically synthesized
caagtttacaacatatatct

SEQ ID NO: 595423 - DNA, 20 bp, Artificial Sequence
  chemically synthesized
tttactgaaaattgtacata

SEQ ID NO: 595424 - DNA, 20 bp, Artificial Sequence
  chemically synthesized
atatgaggcttcagactcca

SEQ ID NO: 595425 - DNA, 20 bp, Artificial Sequence
  chemically synthesized
agactccaacgtgcttctgc

SEQ ID NO: 595426 - DNA, 20 bp, Artificial Sequence
  chemically synthesized
tccaacgtgcttctgcgtgt

SEQ ID NO: 595427 - DNA, 20 bp, Artificial Sequence
  chemically synthesized
gtgtgtttgtttaatatatg

SEQ ID NO: 595428 - DNA, 20 bp, Artificial Sequence
  chemically synthesized
gtttaatatatgggctgctt

SEQ ID NO: 595429 - DNA, 20 bp, Artificial Sequence
  chemically synthesized
gacagtggctgttagcaggc

SEQ ID NO: 595430 - DNA, 20 bp, Artificial Sequence
  chemically synthesized
gactaataatgaataagaga

SEQ ID NO: 595431 - DNA, 20 bp, Artificial Sequence
  chemically synthesized
atttctgctatcttggcctt

SEQ ID NO: 595432 - DNA, 20 bp, Artificial Sequence
  chemically synthesized
gccaagatagcagaaattac

SEQ ID NO: 595433 - DNA, 20 bp, Artificial Sequence
  chemically synthesized
gatagcagaaattaccaaag

SEQ ID NO: 595434 - DNA, 20 bp, Artificial Sequence
  chemically synthesized
ccttcatcgataaggcaaat

SEQ ID NO: 595435 - DNA, 20 bp, Artificial Sequence
  chemically synthesized
tcgatgaaggtatcttacgg

SEQ ID NO: 595436 - DNA, 20 bp, Artificial Sequence
  chemically synthesized
gtgtgtgcacatgttcatat

SEQ ID NO: 595437 - DNA, 20 bp, Artificial Sequence
  chemically synthesized
aaccaggaaagaaatacctt

SEQ ID NO: 595438 - DNA, 20 bp, Artificial Sequence
  chemically synthesized
agaaataccttaactgtttg

SEQ ID NO: 595439 - DNA, 20 bp, Artificial Sequence
  chemically synthesized
aatttttccttggacatcta

SEQ ID NO: 595440 - DNA, 20 bp, Artificial Sequence
  chemically synthesized
atgatttttcttatctcatc

SEQ ID NO: 595441 - DNA, 20 bp, Artificial Sequence
  chemically synthesized
tgtctcagcctcccaaagtg

SEQ ID NO: 595442 - DNA, 20 bp, Artificial Sequence
  chemically synthesized
tttttgtatttttagtagag

SEQ ID NO: 595443 - DNA, 20 bp, Artificial Sequence
  chemically synthesized
tgccttagcctcccgagtag

SEQ ID NO: 595444 - DNA, 20 bp, Artificial Sequence
  chemically synthesized
tcgggaggctaaggcaggag

SEQ ID NO: 595445 - DNA, 20 bp, Artificial Sequence
  chemically synthesized
gctcactgcaacctctgcct

SEQ ID NO: 595446 - DNA, 20 bp, Artificial Sequence
  chemically synthesized
tttttttttttgagatggaa

SEQ ID NO: 595447 - DNA, 20 bp, Artificial Sequence
  chemically synthesized
aaaagtatccaattgagggg

SEQ ID NO: 595448 - DNA, 20 bp, Artificial Sequence
  chemically synthesized
aaagttttgataaaatgttc

SEQ ID NO: 595449 - DNA, 20 bp, Artificial Sequence
  chemically synthesized
tggtcctcatttcttgacag

SEQ ID NO: 595450 - DNA, 20 bp, Artificial Sequence
  chemically synthesized
aaaagatcaaattacatcaa

SEQ ID NO: 595451 - DNA, 20 bp, Artificial Sequence
  chemically synthesized
gatcaaattacatcaaaata

SEQ ID NO: 595452 - DNA, 20 bp, Artificial Sequence
  chemically synthesized
atcaaaatagtttgttttgg

SEQ ID NO: 595453 - DNA, 20 bp, Artificial Sequence
  chemically synthesized
gtgtttcaggtgtttcaggc

SEQ ID NO: 595454 - DNA, 20 bp, Artificial Sequence
  chemically synthesized
tttttttttttaagtgtttc

SEQ ID NO: 595455 - DNA, 20 bp, Artificial Sequence
  chemically synthesized
tttttttttttttttttttt

SEQ ID NO: 595456 - DNA, 20 bp, Artificial Sequence
  chemically synthesized
aaagacaaaatatatgctac

SEQ ID NO: 595457 - DNA, 20 bp, Artificial Sequence
  chemically synthesized
aaggacagtgatccttgcca

SEQ ID NO: 595458 - DNA, 20 bp, Artificial Sequence
  chemically synthesized
ttttgttaaaagatgaagct

SEQ ID NO: 595459 - DNA, 20 bp, Artificial Sequence
  chemically synthesized
agccttgggctgctgaaact

SEQ ID NO: 595460 - DNA, 20 bp, Artificial Sequence
  chemically synthesized
tatatacacagaggaaattt

SEQ ID NO: 595461 - DNA, 20 bp, Artificial Sequence
  chemically synthesized
ggaaattttggagatttgta

SEQ ID NO: 595462 - DNA, 20 bp, Artificial Sequence
  chemically synthesized
gactcagatgaagaataaaa

SEQ ID NO: 595463 - DNA, 20 bp, Artificial Sequence
  chemically synthesized
aagttctttccttagctttg

SEQ ID NO: 595464 - DNA, 20 bp, Artificial Sequence
  chemically synthesized
ttcttttgtgaagttctttc

SEQ ID NO: 595465 - DNA, 20 bp, Artificial Sequence
  chemically synthesized
agccacgtgtgagctctggt

SEQ ID NO: 595466 - DNA, 20 bp, Artificial Sequence
  chemically synthesized
tactagccacgtgtgagctc

SEQ ID NO: 595467 - DNA, 20 bp, Artificial Sequence
  chemically synthesized
acatcagagagagtactcag

SEQ ID NO: 595468 - DNA, 20 bp, Artificial Sequence
  chemically synthesized
tttgttatgaccagaacagt

SEQ ID NO: 595469 - DNA, 20 bp, Artificial Sequence
  chemically synthesized
ggtcataacaaagcataaaa

SEQ ID NO: 595470 - DNA, 20 bp, Artificial Sequence
  chemically synthesized
atcttttgagaatcttcctt

SEQ ID NO: 595471 - DNA, 20 bp, Artificial Sequence
  chemically synthesized
ggaagattctcaaaagatca

SEQ ID NO: 595472 - DNA, 20 bp, Artificial Sequence
  chemically synthesized
gaattaactgtgttccagaa

SEQ ID NO: 595473 - DNA, 20 bp, Artificial Sequence
  chemically synthesized
attgtgaattttaacttagc

SEQ ID NO: 595474 - DNA, 20 bp, Artificial Sequence
  chemically synthesized
cctcattaagtgtgttgttt

SEQ ID NO: 595475 - DNA, 20 bp, Artificial Sequence
  chemically synthesized
atttttctcctcattaagtg

SEQ ID NO: 595476 - DNA, 20 bp, Artificial Sequence
  chemically synthesized
gtctattctgggttaattta

SEQ ID NO: 595477 - DNA, 20 bp, Artificial Sequence
  chemically synthesized
atgttaaaaatatatactac

SEQ ID NO: 595478 - DNA, 20 bp, Artificial Sequence
  chemically synthesized
atatactacatgggattagc

SEQ ID NO: 595479 - DNA, 20 bp, Artificial Sequence
  chemically synthesized
agccatagattagactttga

SEQ ID NO: 595480 - DNA, 20 bp, Artificial Sequence
  chemically synthesized
aagattagtcaatttgacaa

SEQ ID NO: 595481 - DNA, 20 bp, Artificial Sequence
  chemically synthesized
tggtctctcttttctctgta

SEQ ID NO: 595482 - DNA, 20 bp, Artificial Sequence
  chemically synthesized
tcactgatgttatgttcatt

SEQ ID NO: 595483 - DNA, 20 bp, Artificial Sequence
  chemically synthesized
tttttttaaaaaaatggttg

SEQ ID NO: 595484 - DNA, 20 bp, Artificial Sequence
  chemically synthesized
atttgatgaaatgttaaatg

SEQ ID NO: 595485 - DNA, 20 bp, Artificial Sequence
  chemically synthesized
aatgttaaatgcacagattc

SEQ ID NO: 595486 - DNA, 20 bp, Artificial Sequence
  chemically synthesized
gtaacttggtgtagttttct

SEQ ID NO: 595487 - DNA, 20 bp, Artificial Sequence
  chemically synthesized
tttgttttgatgtaacttgg

SEQ ID NO: 595488 - DNA, 20 bp, Artificial Sequence
  chemically synthesized
caccaagttacatcaaaaca

SEQ ID NO: 595489 - DNA, 20 bp, Artificial Sequence
  chemically synthesized
agtacttttacgatgaagca

SEQ ID NO: 595490 - DNA, 20 bp, Artificial Sequence
  chemically synthesized
catacaaatctccattttac

SEQ ID NO: 595491 - DNA, 20 bp, Artificial Sequence
  chemically synthesized
cttggaaagccattgtaaaa

SEQ ID NO: 595492 - DNA, 20 bp, Artificial Sequence
  chemically synthesized
attttgctacatatttcagg

SEQ ID NO: 595493 - DNA, 20 bp, Artificial Sequence
  chemically synthesized
cttttacaaatttctatgtt

SEQ ID NO: 595494 - DNA, 20 bp, Artificial Sequence
  chemically synthesized
ggatatcattgaaaatggca

SEQ ID NO: 595495 - DNA, 20 bp, Artificial Sequence
  chemically synthesized
aaacatattagagttatata

SEQ ID NO: 595496 - DNA, 20 bp, Artificial Sequence
  chemically synthesized
aaacattttatataactcta

SEQ ID NO: 595497 - DNA, 20 bp, Artificial Sequence
  chemically synthesized
tttgggctaatgtagcataa

SEQ ID NO: 595498 - DNA, 20 bp, Artificial Sequence
  chemically synthesized
aaatgtatcttctatattaa

SEQ ID NO: 595499 - DNA, 20 bp, Artificial Sequence
  chemically synthesized
aggaaatgtatggattccca

SEQ ID NO: 595500 - DNA, 20 bp, Artificial Sequence
  chemically synthesized
atttgtatagagaggaaatg

SEQ ID NO: 595501 - DNA, 20 bp, Artificial Sequence
  chemically synthesized
atgccaacgctggtgtgcat

SEQ ID NO: 595502 - DNA, 20 bp, Artificial Sequence
  chemically synthesized
caacgctggtgtgcatgcaa

SEQ ID NO: 595503 - DNA, 20 bp, Artificial Sequence
  chemically synthesized
ttgatacacatataattaca

SEQ ID NO: 595504 - DNA, 20 bp, Artificial Sequence
  chemically synthesized
caaggttttaaaaatatttt

SEQ ID NO: 595505 - DNA, 20 bp, Artificial Sequence
  chemically synthesized
aaaaatattttctgtgttta

SEQ ID NO: 595506 - DNA, 20 bp, Artificial Sequence
  chemically synthesized
aaatagcttatcatataaat

SEQ ID NO: 595507 - DNA, 20 bp, Artificial Sequence
  chemically synthesized
tatcatataaataggtgttt

SEQ ID NO: 595508 - DNA, 20 bp, Artificial Sequence
  chemically synthesized
ttacaagtcttcattctcaa

SEQ ID NO: 595509 - DNA, 20 bp, Artificial Sequence
  chemically synthesized
acttgtaaagtcaaatgtga

SEQ ID NO: 595510 - DNA, 20 bp, Artificial Sequence
  chemically synthesized
tactttagatatttcaaaat

SEQ ID NO: 595511 - DNA, 20 bp, Artificial Sequence
  chemically synthesized
aaagtatttaataaactact

SEQ ID NO: 595512 - DNA, 20 bp, Artificial Sequence
  chemically synthesized
gatgagggcaaaaaacaccc

SEQ ID NO: 595513 - DNA, 20 bp, Artificial Sequence
  chemically synthesized
caatttttaatgccagaaaa

SEQ ID NO: 595514 - DNA, 20 bp, Artificial Sequence
  chemically synthesized
attggctacaattcaaatcc

SEQ ID NO: 595515 - DNA, 20 bp, Artificial Sequence
  chemically synthesized
catgttgcaatagtcaatca

SEQ ID NO: 595516 - DNA, 20 bp, Artificial Sequence
  chemically synthesized
aagtcttcgtgtaataaaca

SEQ ID NO: 595517 - DNA, 20 bp, Artificial Sequence
  chemically synthesized
tagtttaggcataagaaaca

SEQ ID NO: 595518 - DNA, 20 bp, Artificial Sequence
  chemically synthesized
ataatttggttgctaaatta

SEQ ID NO: 595519 - DNA, 20 bp, Artificial Sequence
  chemically synthesized
gaatatgcaggtaaagatag

SEQ ID NO: 595520 - DNA, 20 bp, Artificial Sequence
  chemically synthesized
cctttgaatatgcaggtaaa

SEQ ID NO: 595521 - DNA, 20 bp, Artificial Sequence
  chemically synthesized
catatggatgataaccagtg

SEQ ID NO: 595522 - DNA, 20 bp, Artificial Sequence
  chemically synthesized
cacactggttatcatccata

SEQ ID NO: 595523 - DNA, 20 bp, Artificial Sequence
  chemically synthesized
gttggtacttattgacattt

SEQ ID NO: 595524 - DNA, 20 bp, Artificial Sequence
  chemically synthesized
agtaccaacaattaactctg

SEQ ID NO: 595525 - DNA, 20 bp, Artificial Sequence
  chemically synthesized
ccatcatgataaaattacag

SEQ ID NO: 595526 - DNA, 20 bp, Artificial Sequence
  chemically synthesized
ggctttggggcagtgtgtat

SEQ ID NO: 595527 - DNA, 20 bp, Artificial Sequence
  chemically synthesized
atcgtaacagcaaggtgttt

SEQ ID NO: 595528 - DNA, 20 bp, Artificial Sequence
  chemically synthesized
agggaagcatcgtaacagca

SEQ ID NO: 595529 - DNA, 20 bp, Artificial Sequence
  chemically synthesized
cacaaaacaccttgctgtta

SEQ ID NO: 595530 - DNA, 20 bp, Artificial Sequence
  chemically synthesized
gttacgatgcttccctctgt

SEQ ID NO: 595531 - DNA, 20 bp, Artificial Sequence
  chemically synthesized
tcacagattcaattatattt

SEQ ID NO: 595532 - DNA, 20 bp, Artificial Sequence
  chemically synthesized
agagagtttgcctggacgga

SEQ ID NO: 595533 - DNA, 20 bp, Artificial Sequence
  chemically synthesized
gactttttgtgtcaggatga

SEQ ID NO: 595534 - DNA, 20 bp, Artificial Sequence
  chemically synthesized
tatcttaaggtaagtctttg

SEQ ID NO: 595535 - DNA, 20 bp, Artificial Sequence
  chemically synthesized
aatggtatcttaaggtaagt

SEQ ID NO: 595536 - DNA, 20 bp, Artificial Sequence
  chemically synthesized
tgtgtctttctgagaaactg

SEQ ID NO: 595537 - DNA, 20 bp, Artificial Sequence
  chemically synthesized
tcagtggctaacagaagctg

SEQ ID NO: 595538 - DNA, 20 bp, Artificial Sequence
  chemically synthesized
actgttcagcttctgttagc

SEQ ID NO: 595539 - DNA, 20 bp, Artificial Sequence
  chemically synthesized
acagatctgttgagaaatgg

SEQ ID NO: 595540 - DNA, 20 bp, Artificial Sequence
  chemically synthesized
atccatatgcttttacctgc

SEQ ID NO: 595541 - DNA, 20 bp, Artificial Sequence
  chemically synthesized
ccatctatttttcttgatcc

SEQ ID NO: 595542 - DNA, 20 bp, Artificial Sequence
  chemically synthesized
catatggatcaagaaaaata

SEQ ID NO: 595543 - DNA, 20 bp, Artificial Sequence
  chemically synthesized
aaaatagatggattatgtaa

SEQ ID NO: 595544 - DNA, 20 bp, Artificial Sequence
  chemically synthesized
atatacgctatatctctata

SEQ ID NO: 595545 - DNA, 20 bp, Artificial Sequence
  chemically synthesized
actgacaaagatatcactct

SEQ ID NO: 595546 - DNA, 20 bp, Artificial Sequence
  chemically synthesized
ctgatagtttcctgcatttg

SEQ ID NO: 595547 - DNA, 20 bp, Artificial Sequence
  chemically synthesized
agtttcctgcatttgcagag

SEQ ID NO: 595548 - DNA, 20 bp, Artificial Sequence
  chemically synthesized
aaaaaaatactcaatataaa

SEQ ID NO: 595549 - DNA, 20 bp, Artificial Sequence
  chemically synthesized
attgcaaccttccatttaaa

SEQ ID NO: 595550 - DNA, 20 bp, Artificial Sequence
  chemically synthesized
ccctttaaaatgaatatatt

SEQ ID NO: 595551 - DNA, 20 bp, Artificial Sequence
  chemically synthesized
aaatgccaatagtccaaaat

SEQ ID NO: 595552 - DNA, 20 bp, Artificial Sequence
  chemically synthesized
aaatattttgaaagggaata

SEQ ID NO: 595553 - DNA, 20 bp, Artificial Sequence
  chemically synthesized
ctcctttcagttgatgaaca

SEQ ID NO: 595554 - DNA, 20 bp, Artificial Sequence
  chemically synthesized
tctcaccacagagaaattat

SEQ ID NO: 595555 - DNA, 20 bp, Artificial Sequence
  chemically synthesized
ggctatggatctgccaagaa

SEQ ID NO: 595556 - DNA, 20 bp, Artificial Sequence
  chemically synthesized
ttcattgtgtaatgatcaaa

SEQ ID NO: 595557 - DNA, 20 bp, Artificial Sequence
  chemically synthesized
tacagtgtgacgtttcagtg

SEQ ID NO: 595558 - DNA, 20 bp, Artificial Sequence
  chemically synthesized
tgtatttatggggtacagtg

SEQ ID NO: 595559 - DNA, 20 bp, Artificial Sequence
  chemically synthesized
tggtattttagttatatttt

SEQ ID NO: 595560 - DNA, 20 bp, Artificial Sequence
  chemically synthesized
ctttaatgatagtgacgaat

SEQ ID NO: 595561 - DNA, 20 bp, Artificial Sequence
  chemically synthesized
caataattcgtcactatcat

SEQ ID NO: 595562 - DNA, 20 bp, Artificial Sequence
  chemically synthesized
agtttagtatatcggttatt

SEQ ID NO: 595563 - DNA, 20 bp, Artificial Sequence
  chemically synthesized
aaggattaaagaaggcatcg

SEQ ID NO: 595564 - DNA, 20 bp, Artificial Sequence
  chemically synthesized
tagtgactacaataaaataa

SEQ ID NO: 595565 - DNA, 20 bp, Artificial Sequence
  chemically synthesized
tttattgtagtcactaaaat

SEQ ID NO: 595566 - DNA, 20 bp, Artificial Sequence
  chemically synthesized
tgactggaaggtgaccaaat

SEQ ID NO: 595567 - DNA, 20 bp, Artificial Sequence
  chemically synthesized
tttatgactggaaggtgacc

SEQ ID NO: 595568 - DNA, 20 bp, Artificial Sequence
  chemically synthesized
aaataatatgaaccagggct

SEQ ID NO: 595569 - DNA, 20 bp, Artificial Sequence
  chemically synthesized
tgctgtgttttaaatgcccc

SEQ ID NO: 595570 - DNA, 20 bp, Artificial Sequence
  chemically synthesized
ctgtttggttattgttgttg

SEQ ID NO: 595571 - DNA, 20 bp, Artificial Sequence
  chemically synthesized
ctggaatggagccccaggat

SEQ ID NO: 595572 - DNA, 20 bp, Artificial Sequence
  chemically synthesized
cagtgtccaacctccagaaa

SEQ ID NO: 595573 - DNA, 20 bp, Artificial Sequence
  chemically synthesized
tgttatttttcaaagcatcc

SEQ ID NO: 595574 - DNA, 20 bp, Artificial Sequence
  chemically synthesized
actgtacattgaaatcacct

SEQ ID NO: 595575 - DNA, 20 bp, Artificial Sequence
  chemically synthesized
gtgaaaaacactgccgtaaa

SEQ ID NO: 595576 - DNA, 20 bp, Artificial Sequence
  chemically synthesized
tttcaaatcttactttacgg

SEQ ID NO: 595577 - DNA, 20 bp, Artificial Sequence
  chemically synthesized
aagtaagatttgaaatctta

SEQ ID NO: 595578 - DNA, 20 bp, Artificial Sequence
  chemically synthesized
tctggtagactgtaagccca

SEQ ID NO: 595579 - DNA, 20 bp, Artificial Sequence
  chemically synthesized
tcttactgggcttacagtct

SEQ ID NO: 595580 - DNA, 20 bp, Artificial Sequence
  chemically synthesized
ttggttttgtgctcacaaat

SEQ ID NO: 595581 - DNA, 20 bp, Artificial Sequence
  chemically synthesized
gctattggttttgtgctcac

SEQ ID NO: 595582 - DNA, 20 bp, Artificial Sequence
  chemically synthesized
cggtaatctgtaggatggct

SEQ ID NO: 595583 - DNA, 20 bp, Artificial Sequence
  chemically synthesized
cacaaaaccaatagccatcc

SEQ ID NO: 595584 - DNA, 20 bp, Artificial Sequence
  chemically synthesized
cctcagagtacaggaatctg

SEQ ID NO: 595585 - DNA, 20 bp, Artificial Sequence
  chemically synthesized
aatagagttcagaaaagctt

SEQ ID NO: 595586 - DNA, 20 bp, Artificial Sequence
  chemically synthesized
ttcttaagaatagagttcag

SEQ ID NO: 595587 - DNA, 20 bp, Artificial Sequence
  chemically synthesized
tggtattcaaaagtatgatc

SEQ ID NO: 595588 - DNA, 20 bp, Artificial Sequence
  chemically synthesized
caggaatttaaagtaacact

SEQ ID NO: 595589 - DNA, 20 bp, Artificial Sequence
  chemically synthesized
cccggtgcctggctattagt

SEQ ID NO: 595590 - DNA, 20 bp, Artificial Sequence
  chemically synthesized
taatagccaggcaccgggct

SEQ ID NO: 595591 - DNA, 20 bp, Artificial Sequence
  chemically synthesized
cttttggcaaattacttggc

SEQ ID NO: 595592 - DNA, 20 bp, Artificial Sequence
  chemically synthesized
aatggtattaaatagtagag

SEQ ID NO: 595593 - DNA, 20 bp, Artificial Sequence
  chemically synthesized
aggcttctaacccaaatatc

SEQ ID NO: 595594 - DNA, 20 bp, Artificial Sequence
  chemically synthesized
gtgaaattatttttccaaga

SEQ ID NO: 595595 - DNA, 20 bp, Artificial Sequence
  chemically synthesized
taattgtttaactgataaag

SEQ ID NO: 595596 - DNA, 20 bp, Artificial Sequence
  chemically synthesized
cctctagaactatcactttt

SEQ ID NO: 595597 - DNA, 20 bp, Artificial Sequence
  chemically synthesized
caattaaaagtgatagttct

SEQ ID NO: 595598 - DNA, 20 bp, Artificial Sequence
  chemically synthesized
attgtatttaatgaataatt

SEQ ID NO: 595599 - DNA, 20 bp, Artificial Sequence
  chemically synthesized
accaaaatgctgtctgtttt

SEQ ID NO: 595600 - DNA, 20 bp, Artificial Sequence
  chemically synthesized
ttttatgctaccaaaatgct

SEQ ID NO: 595601 - DNA, 20 bp, Artificial Sequence
  chemically synthesized
aaaaataagaatgttgcctt

SEQ ID NO: 595602 - DNA, 20 bp, Artificial Sequence
  chemically synthesized
ccacaacaaaatgatcttgc

SEQ ID NO: 595603 - DNA, 20 bp, Artificial Sequence
  chemically synthesized
atgatcttgccaatgttttt

SEQ ID NO: 595604 - DNA, 20 bp, Artificial Sequence
  chemically synthesized
aaatgacctatgaatatatc

SEQ ID NO: 595605 - DNA, 20 bp, Artificial Sequence
  chemically synthesized
ttgcatcactggagtcaaag

SEQ ID NO: 595606 - DNA, 20 bp, Artificial Sequence
  chemically synthesized
ctaactatgttgcatagatt

SEQ ID NO: 595607 - DNA, 20 bp, Artificial Sequence
  chemically synthesized
gaacaatgctaactatgttg

SEQ ID NO: 595608 - DNA, 20 bp, Artificial Sequence
  chemically synthesized
tatttttcaatttgtctaca

SEQ ID NO: 595609 - DNA, 20 bp, Artificial Sequence
  chemically synthesized
ctgtgctctggttagctgct

SEQ ID NO: 595610 - DNA, 20 bp, Artificial Sequence
  chemically synthesized
agcaaccatcagtctccact

SEQ ID NO: 595611 - DNA, 20 bp, Artificial Sequence
  chemically synthesized
atcagtctccactcttggtt

SEQ ID NO: 595612 - DNA, 20 bp, Artificial Sequence
  chemically synthesized
tgttggcaaaagtatagttc

SEQ ID NO: 595613 - DNA, 20 bp, Artificial Sequence
  chemically synthesized
acttttagctactaggaggt

SEQ ID NO: 595614 - DNA, 20 bp, Artificial Sequence
  chemically synthesized
tttcaggatcctgtacacct

SEQ ID NO: 595615 - DNA, 20 bp, Artificial Sequence
  chemically synthesized
atcctgtacacctcaaagat

SEQ ID NO: 595616 - DNA, 20 bp, Artificial Sequence
  chemically synthesized
atttcaaacctgttgcacag

SEQ ID NO: 595617 - DNA, 20 bp, Artificial Sequence
  chemically synthesized
ttgagaaacaagtctgtgca

SEQ ID NO: 595618 - DNA, 20 bp, Artificial Sequence
  chemically synthesized
atggcaattaccaatatgat

SEQ ID NO: 595619 - DNA, 20 bp, Artificial Sequence
  chemically synthesized
gaaaagaattcagggtgaga

SEQ ID NO: 595620 - DNA, 20 bp, Artificial Sequence
  chemically synthesized
ttcctttttacaagttatct

SEQ ID NO: 595621 - DNA, 20 bp, Artificial Sequence
  chemically synthesized
tgagcaagtgtatgaaccct

SEQ ID NO: 595622 - DNA, 20 bp, Artificial Sequence
  chemically synthesized
ggtccttgaggatgcaaaag

SEQ ID NO: 595623 - DNA, 20 bp, Artificial Sequence
  chemically synthesized
tattaggtccttgaggatgc

SEQ ID NO: 595624 - DNA, 20 bp, Artificial Sequence
  chemically synthesized
aaatcaactttacagttttc

SEQ ID NO: 595625 - DNA, 20 bp, Artificial Sequence
  chemically synthesized
taaacctttgaaaactgtaa

SEQ ID NO: 595626 - DNA, 20 bp, Artificial Sequence
  chemically synthesized
taataaaattaaatcaactt

SEQ ID NO: 595627 - DNA, 20 bp, Artificial Sequence
  chemically synthesized
catgattttattctttaata

SEQ ID NO: 595628 - DNA, 20 bp, Artificial Sequence
  chemically synthesized
aaatattaaagaataaaatc

SEQ ID NO: 595629 - DNA, 20 bp, Artificial Sequence
  chemically synthesized
agtgtcatcacatgtaaagc

SEQ ID NO: 595630 - DNA, 20 bp, Artificial Sequence
  chemically synthesized
gtgtattttaaaattttatg

SEQ ID NO: 595631 - DNA, 20 bp, Artificial Sequence
  chemically synthesized
ttttacgtagtaaattcaag

SEQ ID NO: 595632 - DNA, 20 bp, Artificial Sequence
  chemically synthesized
tggaattttccttggtggaa

SEQ ID NO: 595633 - DNA, 20 bp, Artificial Sequence
  chemically synthesized
aaaaatatatatatattttt

SEQ ID NO: 595634 - DNA, 20 bp, Artificial Sequence
  chemically synthesized
attttttctggttttacaaa

SEQ ID NO: 595635 - DNA, 20 bp, Artificial Sequence
  chemically synthesized
acttgtttctcattgttacc

SEQ ID NO: 595636 - DNA, 20 bp, Artificial Sequence
  chemically synthesized
atgctatttttgatgtctct

SEQ ID NO: 595637 - DNA, 20 bp, Artificial Sequence
  chemically synthesized
ttacagaaggcaaaaattat

SEQ ID NO: 595638 - DNA, 20 bp, Artificial Sequence
  chemically synthesized
tctgtaatatttctaggaaa

SEQ ID NO: 595639 - DNA, 20 bp, Artificial Sequence
  chemically synthesized
aatcacttgatttattatcc

SEQ ID NO: 595640 - DNA, 20 bp, Artificial Sequence
  chemically synthesized
aaacataaggataataaatc

SEQ ID NO: 595641 - DNA, 20 bp, Artificial Sequence
  chemically synthesized
atttgcaaaattctaaaatc

SEQ ID NO: 595642 - DNA, 20 bp, Artificial Sequence
  chemically synthesized
accggtatttaaaattacac

SEQ ID NO: 595643 - DNA, 20 bp, Artificial Sequence
  chemically synthesized
tgatgttctaaatcaagtta

SEQ ID NO: 595644 - DNA, 20 bp, Artificial Sequence
  chemically synthesized
gcttgagaataatctgacta

SEQ ID NO: 595645 - DNA, 20 bp, Artificial Sequence
  chemically synthesized
aattactccctaaatgtaat

SEQ ID NO: 595646 - DNA, 20 bp, Artificial Sequence
  chemically synthesized
ggtggtagtaaattccatga

SEQ ID NO: 595647 - DNA, 20 bp, Artificial Sequence
  chemically synthesized
tagacttctgacatatccat

SEQ ID NO: 595648 - DNA, 20 bp, Artificial Sequence
  chemically synthesized
aaataatcagcagtccaatg

SEQ ID NO: 595649 - DNA, 20 bp, Artificial Sequence
  chemically synthesized
ctggaaactcagcattggac

SEQ ID NO: 595650 - DNA, 20 bp, Artificial Sequence
  chemically synthesized
tcccatcccacatatttcat

SEQ ID NO: 595651 - DNA, 20 bp, Artificial Sequence
  chemically synthesized
ctaacttatttattcgcaca

SEQ ID NO: 595652 - DNA, 20 bp, Artificial Sequence
  chemically synthesized
tggggagaagtagcaaggta

SEQ ID NO: 595653 - DNA, 20 bp, Artificial Sequence
  chemically synthesized
ttttacatcttttattttat

SEQ ID NO: 595654 - DNA, 20 bp, Artificial Sequence
  chemically synthesized
ttcaatagtctttggaatac

SEQ ID NO: 595655 - DNA, 20 bp, Artificial Sequence
  chemically synthesized
ggtgacacgtgcactaaaat

SEQ ID NO: 595656 - DNA, 20 bp, Artificial Sequence
  chemically synthesized
ataagtgagaacatacagta

SEQ ID NO: 595657 - DNA, 20 bp, Artificial Sequence
  chemically synthesized
tcaaaaagacacttgcacgc

SEQ ID NO: 595658 - DNA, 20 bp, Artificial Sequence
  chemically synthesized
ctctaggtacataatcggta

SEQ ID NO: 595659 - DNA, 20 bp, Artificial Sequence
  chemically synthesized
atttgatctggaaatctcac

SEQ ID NO: 595660 - DNA, 20 bp, Artificial Sequence
  chemically synthesized
agttctttaagaaatcttca

SEQ ID NO: 595661 - DNA, 20 bp, Artificial Sequence
  chemically synthesized
aacctacatggaaaacagta

SEQ ID NO: 595662 - DNA, 20 bp, Artificial Sequence
  chemically synthesized
acggaacatttgtacactgc

SEQ ID NO: 595663 - DNA, 20 bp, Artificial Sequence
  chemically synthesized
tcaccagcagtgtacaaatg

SEQ ID NO: 595664 - DNA, 20 bp, Artificial Sequence
  chemically synthesized
gctgtatcccagaggttttg

SEQ ID NO: 595665 - DNA, 20 bp, Artificial Sequence
  chemically synthesized
ccttgcttttgctgtatccc

SEQ ID NO: 595666 - DNA, 20 bp, Artificial Sequence
  chemically synthesized
gctagaaaatttcctcttag

SEQ ID NO: 595667 - DNA, 20 bp, Artificial Sequence
  chemically synthesized
gagctttgtgttggctttgt

SEQ ID NO: 595668 - DNA, 20 bp, Artificial Sequence
  chemically synthesized
cttttcttctggagctttgt

SEQ ID NO: 595669 - DNA, 20 bp, Artificial Sequence
  chemically synthesized
ctttgttatttcttttcttc

SEQ ID NO: 595670 - DNA, 20 bp, Artificial Sequence
  chemically synthesized
gtttcattgatcttttatat

SEQ ID NO: 595671 - DNA, 20 bp, Artificial Sequence
  chemically synthesized
aaaagatcaatgaaacaaaa

SEQ ID NO: 595672 - DNA, 20 bp, Artificial Sequence
  chemically synthesized
atcttttcaaagaatcaaca

SEQ ID NO: 595673 - DNA, 20 bp, Artificial Sequence
  chemically synthesized
gtaaaattgatagaccagta

SEQ ID NO: 595674 - DNA, 20 bp, Artificial Sequence
  chemically synthesized
attaaccaagaaaaaaagag

SEQ ID NO: 595675 - DNA, 20 bp, Artificial Sequence
  chemically synthesized
atttgcattttcatttgtaa

SEQ ID NO: 595676 - DNA, 20 bp, Artificial Sequence
  chemically synthesized
acttgtggaacactgccaga

SEQ ID NO: 595677 - DNA, 20 bp, Artificial Sequence
  chemically synthesized
tcattattagtgtacctcta

SEQ ID NO: 595678 - DNA, 20 bp, Artificial Sequence
  chemically synthesized
ccagagagacactagcatgg

SEQ ID NO: 595679 - DNA, 20 bp, Artificial Sequence
  chemically synthesized
attctatgctgaaataatga

SEQ ID NO: 595680 - DNA, 20 bp, Artificial Sequence
  chemically synthesized
ccatggattctatgctgaaa

SEQ ID NO: 595681 - DNA, 20 bp, Artificial Sequence
  chemically synthesized
cagggataggcatggccaac

SEQ ID NO: 595682 - DNA, 20 bp, Artificial Sequence
  chemically synthesized
attacatatatttacttttt

SEQ ID NO: 595683 - DNA, 20 bp, Artificial Sequence
  chemically synthesized
tatatgaatggttccctata

SEQ ID NO: 595684 - DNA, 20 bp, Artificial Sequence
  chemically synthesized
tggtctgggtgatggtcacc

SEQ ID NO: 595685 - DNA, 20 bp, Artificial Sequence
  chemically synthesized
gagtgttccatttggctgct

SEQ ID NO: 595686 - DNA, 20 bp, Artificial Sequence
  chemically synthesized
ccaaatggaacactctatat

SEQ ID NO: 595687 - DNA, 20 bp, Artificial Sequence
  chemically synthesized
gaacactctatatcatagtt

SEQ ID NO: 595688 - DNA, 20 bp, Artificial Sequence
  chemically synthesized
gtttcaagattaatctacct

SEQ ID NO: 595689 - DNA, 20 bp, Artificial Sequence
  chemically synthesized
caacaactaataagcaaaga

SEQ ID NO: 595690 - DNA, 20 bp, Artificial Sequence
  chemically synthesized
ctacctctttgcttattagt

SEQ ID NO: 595691 - DNA, 20 bp, Artificial Sequence
  chemically synthesized
ttgttgattaatttctcact

SEQ ID NO: 595692 - DNA, 20 bp, Artificial Sequence
  chemically synthesized
ctcactgtatgattgtctta

SEQ ID NO: 595693 - DNA, 20 bp, Artificial Sequence
  chemically synthesized
aaggcttcacgcagcattca

SEQ ID NO: 595694 - DNA, 20 bp, Artificial Sequence
  chemically synthesized
tgactgaatgctgcgtgaag

SEQ ID NO: 595695 - DNA, 20 bp, Artificial Sequence
  chemically synthesized
aaaaataagacccttataaa

SEQ ID NO: 595696 - DNA, 20 bp, Artificial Sequence
  chemically synthesized
taagaggtagggtgtttaag

SEQ ID NO: 595697 - DNA, 20 bp, Artificial Sequence
  chemically synthesized
tgtgctagtactaagaggta

SEQ ID NO: 595698 - DNA, 20 bp, Artificial Sequence
  chemically synthesized
ttattaatagtaaaatttgc

SEQ ID NO: 595699 - DNA, 20 bp, Artificial Sequence
  chemically synthesized
ttactattaataaatactga

SEQ ID NO: 595700 - DNA, 20 bp, Artificial Sequence
  chemically synthesized
ttaataaatactgaagtagt

SEQ ID NO: 595701 - DNA, 20 bp, Artificial Sequence
  chemically synthesized
atatgttcatattccaggag

SEQ ID NO: 595702 - DNA, 20 bp, Artificial Sequence
  chemically synthesized
gaatttactaaatagtgcca

SEQ ID NO: 595703 - DNA, 20 bp, Artificial Sequence
  chemically synthesized
atagaagtgtaaaattacac

SEQ ID NO: 595704 - DNA, 20 bp, Artificial Sequence
  chemically synthesized
attgtcagacttataaattt

SEQ ID NO: 595705 - DNA, 20 bp, Artificial Sequence
  chemically synthesized
ttaaaactaaaatgaaatat

SEQ ID NO: 595706 - DNA, 20 bp, Artificial Sequence
  chemically synthesized
ggtaagcagtgatatttcat

SEQ ID NO: 595707 - DNA, 20 bp, Artificial Sequence
  chemically synthesized
aaattctttatatatttatt

SEQ ID NO: 595708 - DNA, 20 bp, Artificial Sequence
  chemically synthesized
ctttatatatttattggccg

SEQ ID NO: 595709 - DNA, 20 bp, Artificial Sequence
  chemically synthesized
ttttatgcatcatagtaacg

SEQ ID NO: 595710 - DNA, 20 bp, Artificial Sequence
  chemically synthesized
cactttatagtaaataacta

SEQ ID NO: 595711 - DNA, 20 bp, Artificial Sequence
  chemically synthesized
aaagtgaaccatggcacaaa

SEQ ID NO: 595712 - DNA, 20 bp, Artificial Sequence
  chemically synthesized
agaacttttcccatttttct

SEQ ID NO: 595713 - DNA, 20 bp, Artificial Sequence
  chemically synthesized
tggattatctgttcttttct

SEQ ID NO: 595714 - DNA, 20 bp, Artificial Sequence
  chemically synthesized
caaataatttatcctactct

SEQ ID NO: 595715 - DNA, 20 bp, Artificial Sequence
  chemically synthesized
gtccactttattatttttat

SEQ ID NO: 595716 - DNA, 20 bp, Artificial Sequence
  chemically synthesized
ttattatttttattcatgat

SEQ ID NO: 595717 - DNA, 20 bp, Artificial Sequence
  chemically synthesized
attaatatagggtaagaaaa

SEQ ID NO: 595718 - DNA, 20 bp, Artificial Sequence
  chemically synthesized
attctcctctattttactgt

SEQ ID NO: 595719 - DNA, 20 bp, Artificial Sequence
  chemically synthesized
ttactgtaaaagctttatca

SEQ ID NO: 595720 - DNA, 20 bp, Artificial Sequence
  chemically synthesized
atgagaaaaaaacaaattga

SEQ ID NO: 595721 - DNA, 20 bp, Artificial Sequence
  chemically synthesized
tcaatttgtttttttctcat

SEQ ID NO: 595722 - DNA, 20 bp, Artificial Sequence
  chemically synthesized
tcatgtcagtttttagtcac

SEQ ID NO: 595723 - DNA, 20 bp, Artificial Sequence
  chemically synthesized
cctgggattttatttttgta

SEQ ID NO: 595724 - DNA, 20 bp, Artificial Sequence
  chemically synthesized
gcttaggaaaaaagtatata

SEQ ID NO: 595725 - DNA, 20 bp, Artificial Sequence
  chemically synthesized
taaaaaattaaaatggagtc

SEQ ID NO: 595726 - DNA, 20 bp, Artificial Sequence
  chemically synthesized
tgcattatcttgtacagtgc

SEQ ID NO: 595727 - DNA, 20 bp, Artificial Sequence
  chemically synthesized
gagcagatcaaaattgggac

SEQ ID NO: 595728 - DNA, 20 bp, Artificial Sequence
  chemically synthesized
gagactatcattttatatca

SEQ ID NO: 595729 - DNA, 20 bp, Artificial Sequence
  chemically synthesized
ataaaatgatagtctcctca

SEQ ID NO: 595730 - DNA, 20 bp, Artificial Sequence
  chemically synthesized
atagtctcctcattcagttt

SEQ ID NO: 595731 - DNA, 20 bp, Artificial Sequence
  chemically synthesized
aatgctgatatttttacaac

SEQ ID NO: 595732 - DNA, 20 bp, Artificial Sequence
  chemically synthesized
gaacaaggctcacaacctag

SEQ ID NO: 595733 - DNA, 20 bp, Artificial Sequence
  chemically synthesized
ctaggttgtgagccttgttc

SEQ ID NO: 595734 - DNA, 20 bp, Artificial Sequence
  chemically synthesized
gccttgttctcaggcttcaa

SEQ ID NO: 595735 - DNA, 20 bp, Artificial Sequence
  chemically synthesized
caaatacgtttggagtcata

SEQ ID NO: 595736 - DNA, 20 bp, Artificial Sequence
  chemically synthesized
tttggagtcatactttgatt

SEQ ID NO: 595737 - DNA, 20 bp, Artificial Sequence
  chemically synthesized
ctttgattttaagtttctca

SEQ ID NO: 595738 - DNA, 20 bp, Artificial Sequence
  chemically synthesized
tctcacagtgtttataatac

SEQ ID NO: 595739 - DNA, 20 bp, Artificial Sequence
  chemically synthesized
ggtcaaagaaaatttatctt

SEQ ID NO: 595740 - DNA, 20 bp, Artificial Sequence
  chemically synthesized
cattataggggactcttcta

SEQ ID NO: 595741 - DNA, 20 bp, Artificial Sequence
  chemically synthesized
tgtgttcccctcaaaggaat

SEQ ID NO: 595742 - DNA, 20 bp, Artificial Sequence
  chemically synthesized
gtgtccatacaagacattta

SEQ ID NO: 595743 - DNA, 20 bp, Artificial Sequence
  chemically synthesized
acactgccttatgaaacctc

SEQ ID NO: 595744 - DNA, 20 bp, Artificial Sequence
  chemically synthesized
gttgaagctttgaaagcaaa

SEQ ID NO: 595745 - DNA, 20 bp, Artificial Sequence
  chemically synthesized
tatgaaacctcatttgcttt

SEQ ID NO: 595746 - DNA, 20 bp, Artificial Sequence
  chemically synthesized
tacctgctgtagatgttagt

SEQ ID NO: 595747 - DNA, 20 bp, Artificial Sequence
  chemically synthesized
gttctcaagatctttatcta

SEQ ID NO: 595748 - DNA, 20 bp, Artificial Sequence
  chemically synthesized
agatcttgagaacaaatatt

SEQ ID NO: 595749 - DNA, 20 bp, Artificial Sequence
  chemically synthesized
atttcaggctttgtgggccg

SEQ ID NO: 595750 - DNA, 20 bp, Artificial Sequence
  chemically synthesized
attgaatcccagccatatcc

SEQ ID NO: 595751 - DNA, 20 bp, Artificial Sequence
  chemically synthesized
gcataagcaaatggatatgg

SEQ ID NO: 595752 - DNA, 20 bp, Artificial Sequence
  chemically synthesized
atgggccaattacacccacc

SEQ ID NO: 595753 - DNA, 20 bp, Artificial Sequence
  chemically synthesized
ggtgtaattggcccatgggc

SEQ ID NO: 595754 - DNA, 20 bp, Artificial Sequence
  chemically synthesized
gattattgactcttaatcta

SEQ ID NO: 595755 - DNA, 20 bp, Artificial Sequence
  chemically synthesized
tggagctatgtcataatcag

SEQ ID NO: 595756 - DNA, 20 bp, Artificial Sequence
  chemically synthesized
ttttcccatgcaagtctttg

SEQ ID NO: 595757 - DNA, 20 bp, Artificial Sequence
  chemically synthesized
attggggattacaatttaat

SEQ ID NO: 595758 - DNA, 20 bp, Artificial Sequence
  chemically synthesized
ccaggccccacctccaacat

SEQ ID NO: 595759 - DNA, 20 bp, Artificial Sequence
  chemically synthesized
agaggtgactggatcatcag

SEQ ID NO: 595760 - DNA, 20 bp, Artificial Sequence
  chemically synthesized
ggatcatcagggtggtttct

SEQ ID NO: 595761 - DNA, 20 bp, Artificial Sequence
  chemically synthesized
gagtgagttctccaagatct

SEQ ID NO: 595762 - DNA, 20 bp, Artificial Sequence
  chemically synthesized
ccccaccaccaactctctct

SEQ ID NO: 595763 - DNA, 20 bp, Artificial Sequence
  chemically synthesized
ctgtttctggggaggcctca

SEQ ID NO: 595764 - DNA, 20 bp, Artificial Sequence
  chemically synthesized
ctccccagaaacagatgttg

SEQ ID NO: 595765 - DNA, 20 bp, Artificial Sequence
  chemically synthesized
tctacaggaagcatagcaac

SEQ ID NO: 595766 - DNA, 20 bp, Artificial Sequence
  chemically synthesized
agtaaagaggtttaattggc

SEQ ID NO: 595767 - DNA, 20 bp, Artificial Sequence
  chemically synthesized
actgggtgtttataaagtaa

SEQ ID NO: 595768 - DNA, 20 bp, Artificial Sequence
  chemically synthesized
ataaagaaatacctgagact

SEQ ID NO: 595769 - DNA, 20 bp, Artificial Sequence
  chemically synthesized
aagaatggcctaatccagtc

SEQ ID NO: 595770 - DNA, 20 bp, Artificial Sequence
  chemically synthesized
gactaaaattaaaactaagg

SEQ ID NO: 595771 - DNA, 20 bp, Artificial Sequence
  chemically synthesized
tccttagttttaattttagt

SEQ ID NO: 595772 - DNA, 20 bp, Artificial Sequence
  chemically synthesized
taaacgatggtctcaagatt

SEQ ID NO: 595773 - DNA, 20 bp, Artificial Sequence
  chemically synthesized
caagctagaaatcttgagac

SEQ ID NO: 595774 - DNA, 20 bp, Artificial Sequence
  chemically synthesized
tcgagaagtaaacgatggtc

SEQ ID NO: 595775 - DNA, 20 bp, Artificial Sequence
  chemically synthesized
acttctcgacttctttctta

SEQ ID NO: 595776 - DNA, 20 bp, Artificial Sequence
  chemically synthesized
ggctaaattaaagagtcatt

SEQ ID NO: 595777 - DNA, 20 bp, Artificial Sequence
  chemically synthesized
tatgctgaggaaaagttatt

SEQ ID NO: 595778 - DNA, 20 bp, Artificial Sequence
  chemically synthesized
ccaactcatctctccctatt

SEQ ID NO: 595779 - DNA, 20 bp, Artificial Sequence
  chemically synthesized
gtatacatggtgggctatgt

SEQ ID NO: 595780 - DNA, 20 bp, Artificial Sequence
  chemically synthesized
tatgaaaattttcagatttt

SEQ ID NO: 595781 - DNA, 20 bp, Artificial Sequence
  chemically synthesized
ttttggttgttatgaaaatt

SEQ ID NO: 595782 - DNA, 20 bp, Artificial Sequence
  chemically synthesized
tctaaaatgtcactattcca

SEQ ID NO: 595783 - DNA, 20 bp, Artificial Sequence
  chemically synthesized
ggaattagttacttcataag

SEQ ID NO: 595784 - DNA, 20 bp, Artificial Sequence
  chemically synthesized
tacttcataagacaagcttc

SEQ ID NO: 595785 - DNA, 20 bp, Artificial Sequence
  chemically synthesized
agaggttttcacaaagctgt

SEQ ID NO: 595786 - DNA, 20 bp, Artificial Sequence
  chemically synthesized
acatgaagtagtatgttaat

SEQ ID NO: 595787 - DNA, 20 bp, Artificial Sequence
  chemically synthesized
ttctaattatgtatttacaa

SEQ ID NO: 595788 - DNA, 20 bp, Artificial Sequence
  chemically synthesized
tgtacctcttagaataagga

SEQ ID NO: 595789 - DNA, 20 bp, Artificial Sequence
  chemically synthesized
catttatcatgtaccaggaa

SEQ ID NO: 595790 - DNA, 20 bp, Artificial Sequence
  chemically synthesized
gctcttaaatggaagatata

SEQ ID NO: 595791 - DNA, 20 bp, Artificial Sequence
  chemically synthesized
atcttccatttaagagccat

SEQ ID NO: 595792 - DNA, 20 bp, Artificial Sequence
  chemically synthesized
atgaggtaggcagtattatt

SEQ ID NO: 595793 - DNA, 20 bp, Artificial Sequence
  chemically synthesized
gaataatactgcctacctca

SEQ ID NO: 595794 - DNA, 20 bp, Artificial Sequence
  chemically synthesized
ctgtgtcggtattaaaaatt

SEQ ID NO: 595795 - DNA, 20 bp, Artificial Sequence
  chemically synthesized
ggaaaatgatttctgatgta

SEQ ID NO: 595796 - DNA, 20 bp, Artificial Sequence
  chemically synthesized
atttggaaaatgatttctga

SEQ ID NO: 595797 - DNA, 20 bp, Artificial Sequence
  chemically synthesized
tgattgctgatatatttgga

SEQ ID NO: 595798 - DNA, 20 bp, Artificial Sequence
  chemically synthesized
tatatcagcaatcacataat

SEQ ID NO: 595799 - DNA, 20 bp, Artificial Sequence
  chemically synthesized
tattaatgaaaacaacaatt

SEQ ID NO: 595800 - DNA, 20 bp, Artificial Sequence
  chemically synthesized
cattaataaaagacacaaaa

SEQ ID NO: 595801 - DNA, 20 bp, Artificial Sequence
  chemically synthesized
gactgtgactcttttaaggt

SEQ ID NO: 595802 - DNA, 20 bp, Artificial Sequence
  chemically synthesized
gtgaattttatcaatattgt

SEQ ID NO: 595803 - DNA, 20 bp, Artificial Sequence
  chemically synthesized
tttagggtgaattttatcaa

SEQ ID NO: 595804 - DNA, 20 bp, Artificial Sequence
  chemically synthesized
caatagcattatttaaaaac

SEQ ID NO: 595805 - DNA, 20 bp, Artificial Sequence
  chemically synthesized
cacatattctttatccaatc

SEQ ID NO: 595806 - DNA, 20 bp, Artificial Sequence
  chemically synthesized
gtattccattgtgtgtctat

SEQ ID NO: 595807 - DNA, 20 bp, Artificial Sequence
  chemically synthesized
atatatatatatatatatat

SEQ ID NO: 595808 - DNA, 20 bp, Artificial Sequence
  chemically synthesized
atttttcattgtgtatatga

SEQ ID NO: 595809 - DNA, 20 bp, Artificial Sequence
  chemically synthesized
gacatgatttcattctttac

SEQ ID NO: 595810 - DNA, 20 bp, Artificial Sequence
  chemically synthesized
catccatgttgctgcaaaag

SEQ ID NO: 595811 - DNA, 20 bp, Artificial Sequence
  chemically synthesized
agaacatgcaatatttgact

SEQ ID NO: 595812 - DNA, 20 bp, Artificial Sequence
  chemically synthesized
gtgcgcatgtgtacacatta

SEQ ID NO: 595813 - DNA, 20 bp, Artificial Sequence
  chemically synthesized
gatgggggcgaaggatagga

SEQ ID NO: 595814 - DNA, 20 bp, Artificial Sequence
  chemically synthesized
tatattgcagagtggcgaag

SEQ ID NO: 595815 - DNA, 20 bp, Artificial Sequence
  chemically synthesized
tttaagtaattttattattt

SEQ ID NO: 595816 - DNA, 20 bp, Artificial Sequence
  chemically synthesized
aaataataaaattacttaaa

SEQ ID NO: 595817 - DNA, 20 bp, Artificial Sequence
  chemically synthesized
atagtcttagtgataacctg

SEQ ID NO: 595818 - DNA, 20 bp, Artificial Sequence
  chemically synthesized
taaaataaatcttaaaattc

SEQ ID NO: 595819 - DNA, 20 bp, Artificial Sequence
  chemically synthesized
ctttagaaatctaaagaatt

SEQ ID NO: 595820 - DNA, 20 bp, Artificial Sequence
  chemically synthesized
aattctttagatttctaaag

SEQ ID NO: 595821 - DNA, 20 bp, Artificial Sequence
  chemically synthesized
taagcccaataagagtccag

SEQ ID NO: 595822 - DNA, 20 bp, Artificial Sequence
  chemically synthesized
taaactttgctggactctta

SEQ ID NO: 595823 - DNA, 20 bp, Artificial Sequence
  chemically synthesized
cctccacagatctgcctgtc

SEQ ID NO: 595824 - DNA, 20 bp, Artificial Sequence
  chemically synthesized
aagcaatttcagcttattga

SEQ ID NO: 595825 - DNA, 20 bp, Artificial Sequence
  chemically synthesized
aagcctcatcaataagctga

SEQ ID NO: 595826 - DNA, 20 bp, Artificial Sequence
  chemically synthesized
cctcgtttatctaaagcaat

SEQ ID NO: 595827 - DNA, 20 bp, Artificial Sequence
  chemically synthesized
gcactttcagatcaaaaagt

SEQ ID NO: 595828 - DNA, 20 bp, Artificial Sequence
  chemically synthesized
acatatcagaaacttggcct

SEQ ID NO: 595829 - DNA, 20 bp, Artificial Sequence
  chemically synthesized
ccccctaaaaatcactcagg

SEQ ID NO: 595830 - DNA, 20 bp, Artificial Sequence
  chemically synthesized
accttaattaagcactctat

SEQ ID NO: 595831 - DNA, 20 bp, Artificial Sequence
  chemically synthesized
ttttcccctaagccaaaata

SEQ ID NO: 595832 - DNA, 20 bp, Artificial Sequence
  chemically synthesized
atttatctcaaggatattta

SEQ ID NO: 595833 - DNA, 20 bp, Artificial Sequence
  chemically synthesized
ttgataagtactcaaatagt

SEQ ID NO: 595834 - DNA, 20 bp, Artificial Sequence
  chemically synthesized
ttagagattcatttctttac

SEQ ID NO: 595835 - DNA, 20 bp, Artificial Sequence
  chemically synthesized
tttctttacctatgcttggt

SEQ ID NO: 595836 - DNA, 20 bp, Artificial Sequence
  chemically synthesized
aatagtaatatcagggacac

SEQ ID NO: 595837 - DNA, 20 bp, Artificial Sequence
  chemically synthesized
tggaacattatattgtgtca

SEQ ID NO: 595838 - DNA, 20 bp, Artificial Sequence
  chemically synthesized
ttcagggtgtactattcctg

SEQ ID NO: 595839 - DNA, 20 bp, Artificial Sequence
  chemically synthesized
cactgcttctgaaaaaatat

SEQ ID NO: 595840 - DNA, 20 bp, Artificial Sequence
  chemically synthesized
aaaattatgcaatttcaatg

SEQ ID NO: 595841 - DNA, 20 bp, Artificial Sequence
  chemically synthesized
aaaatacccaaagtagcaga

SEQ ID NO: 595842 - DNA, 20 bp, Artificial Sequence
  chemically synthesized
cctgctgagtcagtttctgt

SEQ ID NO: 595843 - DNA, 20 bp, Artificial Sequence
  chemically synthesized
tatttaacttagcctgctga

SEQ ID NO: 595844 - DNA, 20 bp, Artificial Sequence
  chemically synthesized
taaataatttaaatttctta

SEQ ID NO: 595845 - DNA, 20 bp, Artificial Sequence
  chemically synthesized
atcaaatcctcagagagtat

SEQ ID NO: 595846 - DNA, 20 bp, Artificial Sequence
  chemically synthesized
gtttaaactgacatactctc

SEQ ID NO: 595847 - DNA, 20 bp, Artificial Sequence
  chemically synthesized
gaggatatggtgttagacat

SEQ ID NO: 595848 - DNA, 20 bp, Artificial Sequence
  chemically synthesized
agacatcctagcttccaagt

SEQ ID NO: 595849 - DNA, 20 bp, Artificial Sequence
  chemically synthesized
ctacacctattatatatgtt

SEQ ID NO: 595850 - DNA, 20 bp, Artificial Sequence
  chemically synthesized
aaagttcctacacctattat

SEQ ID NO: 595851 - DNA, 20 bp, Artificial Sequence
  chemically synthesized
agtgcatagcatatatttgt

SEQ ID NO: 595852 - DNA, 20 bp, Artificial Sequence
  chemically synthesized
ctatgcactctaattaaaac

SEQ ID NO: 595853 - DNA, 20 bp, Artificial Sequence
  chemically synthesized
atttaatcatgtacttaatc

SEQ ID NO: 595854 - DNA, 20 bp, Artificial Sequence
  chemically synthesized
attaaaacttcagattaagt

SEQ ID NO: 595855 - DNA, 20 bp, Artificial Sequence
  chemically synthesized
acaagttagactcccaaagt

SEQ ID NO: 595856 - DNA, 20 bp, Artificial Sequence
  chemically synthesized
agactttgggagtctaactt

SEQ ID NO: 595857 - DNA, 20 bp, Artificial Sequence
  chemically synthesized
gctatgttattgtcttgcat

SEQ ID NO: 595858 - DNA, 20 bp, Artificial Sequence
  chemically synthesized
caataacatagctgaataag

SEQ ID NO: 595859 - DNA, 20 bp, Artificial Sequence
  chemically synthesized
gaataaggatagcttatagt

SEQ ID NO: 595860 - DNA, 20 bp, Artificial Sequence
  chemically synthesized
gatagcttatagtgtatgtt

SEQ ID NO: 595861 - DNA, 20 bp, Artificial Sequence
  chemically synthesized
tatagtgtatgttttttgtt

SEQ ID NO: 595862 - DNA, 20 bp, Artificial Sequence
  chemically synthesized
tcacaagctaatacagtgtt

SEQ ID NO: 595863 - DNA, 20 bp, Artificial Sequence
  chemically synthesized
tttgaatcagtaaacactgt

SEQ ID NO: 595864 - DNA, 20 bp, Artificial Sequence
  chemically synthesized
ttctctttcacaagctaata

SEQ ID NO: 595865 - DNA, 20 bp, Artificial Sequence
  chemically synthesized
gatagtatattataggagaa

SEQ ID NO: 595866 - DNA, 20 bp, Artificial Sequence
  chemically synthesized
agtgtaactatccaataaca

SEQ ID NO: 595867 - DNA, 20 bp, Artificial Sequence
  chemically synthesized
gttattggatagttacactc

SEQ ID NO: 595868 - DNA, 20 bp, Artificial Sequence
  chemically synthesized
tgaaatttatatttcaaagg

SEQ ID NO: 595869 - DNA, 20 bp, Artificial Sequence
  chemically synthesized
aatatgttattttgagcaaa

SEQ ID NO: 595870 - DNA, 20 bp, Artificial Sequence
  chemically synthesized
aaaaatcaagagaaattcca

SEQ ID NO: 595871 - DNA, 20 bp, Artificial Sequence
  chemically synthesized
tcaaatcaaaatggaatttc

SEQ ID NO: 595872 - DNA, 20 bp, Artificial Sequence
  chemically synthesized
aaaagatgaagaaccaccaa

SEQ ID NO: 595873 - DNA, 20 bp, Artificial Sequence
  chemically synthesized
tccttggtggttcttcatct

SEQ ID NO: 595874 - DNA, 20 bp, Artificial Sequence
  chemically synthesized
ttcttcatcttttggtttat

SEQ ID NO: 595875 - DNA, 20 bp, Artificial Sequence
  chemically synthesized
tattccttttcttaaagtat

SEQ ID NO: 595876 - DNA, 20 bp, Artificial Sequence
  chemically synthesized
aagagtgttattaaagaggg

SEQ ID NO: 595877 - DNA, 20 bp, Artificial Sequence
  chemically synthesized
taataacactctttttatta

SEQ ID NO: 595878 - DNA, 20 bp, Artificial Sequence
  chemically synthesized
tttattagggtgattatttt

SEQ ID NO: 595879 - DNA, 20 bp, Artificial Sequence
  chemically synthesized
tttgtaaccaccttaatgaa

SEQ ID NO: 595880 - DNA, 20 bp, Artificial Sequence
  chemically synthesized
atatatatatgtaaaatatg

SEQ ID NO: 595881 - DNA, 20 bp, Artificial Sequence
  chemically synthesized
atatatatatatatatctca

SEQ ID NO: 595882 - DNA, 20 bp, Artificial Sequence
  chemically synthesized
tatatatatatataaaatca

SEQ ID NO: 595883 - DNA, 20 bp, Artificial Sequence
  chemically synthesized
tgtatacttattcccaaact

SEQ ID NO: 595884 - DNA, 20 bp, Artificial Sequence
  chemically synthesized
tttatagccttcatggtggc

SEQ ID NO: 595885 - DNA, 20 bp, Artificial Sequence
  chemically synthesized
gaaattttgagtgatgacag

SEQ ID NO: 595886 - DNA, 20 bp, Artificial Sequence
  chemically synthesized
actggtggtaagaacacaac

SEQ ID NO: 595887 - DNA, 20 bp, Artificial Sequence
  chemically synthesized
atagtgcctatagctaataa

SEQ ID NO: 595888 - DNA, 20 bp, Artificial Sequence
  chemically synthesized
aaaaggagtgttaaagacta

SEQ ID NO: 595889 - DNA, 20 bp, Artificial Sequence
  chemically synthesized
agtctttaacactccttttg

SEQ ID NO: 595890 - DNA, 20 bp, Artificial Sequence
  chemically synthesized
tacccttagggagcatttag

SEQ ID NO: 595891 - DNA, 20 bp, Artificial Sequence
  chemically synthesized
aggtaaaaatggtgattcaa

SEQ ID NO: 595892 - DNA, 20 bp, Artificial Sequence
  chemically synthesized
cctgttataggaggtaaaaa

SEQ ID NO: 595893 - DNA, 20 bp, Artificial Sequence
  chemically synthesized
ataatgttgcacttaatttt

SEQ ID NO: 595894 - DNA, 20 bp, Artificial Sequence
  chemically synthesized
gtataccttctgaaaagaaa

SEQ ID NO: 595895 - DNA, 20 bp, Artificial Sequence
  chemically synthesized
ctgaaaagaaacatggtttt

SEQ ID NO: 595896 - DNA, 20 bp, Artificial Sequence
  chemically synthesized
acaaaacaaaacaaaaaaaa

SEQ ID NO: 595897 - DNA, 20 bp, Artificial Sequence
  chemically synthesized
aagaaacatggttttttttg

SEQ ID NO: 595898 - DNA, 20 bp, Artificial Sequence
  chemically synthesized
acatggttttttttgttttg

SEQ ID NO: 595899 - DNA, 20 bp, Artificial Sequence
  chemically synthesized
gttttttttgttttgttttg

SEQ ID NO: 595900 - DNA, 20 bp, Artificial Sequence
  chemically synthesized
aaaggcgtgaacctgggagg

SEQ ID NO: 595901 - DNA, 20 bp, Artificial Sequence
  chemically synthesized
ggttcacgcctttctcccgc

SEQ ID NO: 595902 - DNA, 20 bp, Artificial Sequence
  chemically synthesized
tttgtattttttagtagaga

SEQ ID NO: 595903 - DNA, 20 bp, Artificial Sequence
  chemically synthesized
tgcctcggcctcccaaagtg

SEQ ID NO: 595904 - DNA, 20 bp, Artificial Sequence
  chemically synthesized
tactttgggagttctaaaga

SEQ ID NO: 595905 - DNA, 20 bp, Artificial Sequence
  chemically synthesized
caaagtatcatcttttagta

SEQ ID NO: 595906 - DNA, 20 bp, Artificial Sequence
  chemically synthesized
ttttgtatgctgtacaacct

SEQ ID NO: 595907 - DNA, 20 bp, Artificial Sequence
  chemically synthesized
caaattttgtatgctgtaca

SEQ ID NO: 595908 - DNA, 20 bp, Artificial Sequence
  chemically synthesized
aaatttgaagacaagcaaac

SEQ ID NO: 595909 - DNA, 20 bp, Artificial Sequence
  chemically synthesized
aaacagaatttcaaactcac

SEQ ID NO: 595910 - DNA, 20 bp, Artificial Sequence
  chemically synthesized
aataaaacagaatttcaaac

SEQ ID NO: 595911 - DNA, 20 bp, Artificial Sequence
  chemically synthesized
aagcaaacgtgagtttgaaa

SEQ ID NO: 595912 - DNA, 20 bp, Artificial Sequence
  chemically synthesized
aattctgttttattgcctaa

SEQ ID NO: 595913 - DNA, 20 bp, Artificial Sequence
  chemically synthesized
agtgctttgtaaacttcagc

SEQ ID NO: 595914 - DNA, 20 bp, Artificial Sequence
  chemically synthesized
caggaaattaaatcacttgc

SEQ ID NO: 595915 - DNA, 20 bp, Artificial Sequence
  chemically synthesized
cttcagcaagtgatttaatt

SEQ ID NO: 595916 - DNA, 20 bp, Artificial Sequence
  chemically synthesized
aagaattaaaaataatacag

SEQ ID NO: 595917 - DNA, 20 bp, Artificial Sequence
  chemically synthesized
actgtatatatatttggata

SEQ ID NO: 595918 - DNA, 20 bp, Artificial Sequence
  chemically synthesized
tgaatgaggaaaatatgtat

SEQ ID NO: 595919 - DNA, 20 bp, Artificial Sequence
  chemically synthesized
aaaatcatttacacatagta

SEQ ID NO: 595920 - DNA, 20 bp, Artificial Sequence
  chemically synthesized
tcaaacattttactatgtgt

SEQ ID NO: 595921 - DNA, 20 bp, Artificial Sequence
  chemically synthesized
attccatttactgtaattgt

SEQ ID NO: 595922 - DNA, 20 bp, Artificial Sequence
  chemically synthesized
catatgattccatttactgt

SEQ ID NO: 595923 - DNA, 20 bp, Artificial Sequence
  chemically synthesized
cagtaaatggaatcatatgt

SEQ ID NO: 595924 - DNA, 20 bp, Artificial Sequence
  chemically synthesized
gttgagaacgaaacaaagac

SEQ ID NO: 595925 - DNA, 20 bp, Artificial Sequence
  chemically synthesized
tgccattcgttttaaaataa

SEQ ID NO: 595926 - DNA, 20 bp, Artificial Sequence
  chemically synthesized
cattttattttaaaacgaat

SEQ ID NO: 595927 - DNA, 20 bp, Artificial Sequence
  chemically synthesized
attttaaaacgaatggcaga

SEQ ID NO: 595928 - DNA, 20 bp, Artificial Sequence
  chemically synthesized
cctcgaaatcaaaatctgcc

SEQ ID NO: 595929 - DNA, 20 bp, Artificial Sequence
  chemically synthesized
agctgatctcaagtggtgta

SEQ ID NO: 595930 - DNA, 20 bp, Artificial Sequence
  chemically synthesized
atcaaaatacaccacttgag

SEQ ID NO: 595931 - DNA, 20 bp, Artificial Sequence
  chemically synthesized
tttctttggccataaaaaat

SEQ ID NO: 595932 - DNA, 20 bp, Artificial Sequence
  chemically synthesized
ctaagtaaaaagtgaattgt

SEQ ID NO: 595933 - DNA, 20 bp, Artificial Sequence
  chemically synthesized
ataaagctaagtaaaaagtg

SEQ ID NO: 595934 - DNA, 20 bp, Artificial Sequence
  chemically synthesized
ctgaaacaattcacttttta

SEQ ID NO: 595935 - DNA, 20 bp, Artificial Sequence
  chemically synthesized
gtaagagagaaaatagaatt

SEQ ID NO: 595936 - DNA, 20 bp, Artificial Sequence
  chemically synthesized
ggcaccattaccttccacaa

SEQ ID NO: 595937 - DNA, 20 bp, Artificial Sequence
  chemically synthesized
acaagagcctatacacacat

SEQ ID NO: 595938 - DNA, 20 bp, Artificial Sequence
  chemically synthesized
tagtaaacattaagaaaaat

SEQ ID NO: 595939 - DNA, 20 bp, Artificial Sequence
  chemically synthesized
tatcaagctatcatttttct

SEQ ID NO: 595940 - DNA, 20 bp, Artificial Sequence
  chemically synthesized
atcatttttcttaatgttta

SEQ ID NO: 595941 - DNA, 20 bp, Artificial Sequence
  chemically synthesized
taaatgctgcaacctttgag

SEQ ID NO: 595942 - DNA, 20 bp, Artificial Sequence
  chemically synthesized
ttttttaaatgctgcaacct

SEQ ID NO: 595943 - DNA, 20 bp, Artificial Sequence
  chemically synthesized
tatatatacacacaaatata

SEQ ID NO: 595944 - DNA, 20 bp, Artificial Sequence
  chemically synthesized
acaaatatagtatgatttgt

SEQ ID NO: 595945 - DNA, 20 bp, Artificial Sequence
  chemically synthesized
aaaattagttctgaaattat

SEQ ID NO: 595946 - DNA, 20 bp, Artificial Sequence
  chemically synthesized
gcatttcaactagaaattat

SEQ ID NO: 595947 - DNA, 20 bp, Artificial Sequence
  chemically synthesized
cttatgacctcttatagcct

SEQ ID NO: 595948 - DNA, 20 bp, Artificial Sequence
  chemically synthesized
gatacagtaattaatttcaa

SEQ ID NO: 595949 - DNA, 20 bp, Artificial Sequence
  chemically synthesized
taattaatttcaaggcagat

SEQ ID NO: 595950 - DNA, 20 bp, Artificial Sequence
  chemically synthesized
aaggggcccctggcatattt

SEQ ID NO: 595951 - DNA, 20 bp, Artificial Sequence
  chemically synthesized
agtatggctgtaaggctaat

SEQ ID NO: 595952 - DNA, 20 bp, Artificial Sequence
  chemically synthesized
ctcttaatgtttatggtgtc

SEQ ID NO: 595953 - DNA, 20 bp, Artificial Sequence
  chemically synthesized
tactgacaccataaacatta

SEQ ID NO: 595954 - DNA, 20 bp, Artificial Sequence
  chemically synthesized
gagtgggggtgaaatcctct

SEQ ID NO: 595955 - DNA, 20 bp, Artificial Sequence
  chemically synthesized
cttagagctgctatacttgg

SEQ ID NO: 595956 - DNA, 20 bp, Artificial Sequence
  chemically synthesized
agaacatttccctcgtgcac

SEQ ID NO: 595957 - DNA, 20 bp, Artificial Sequence
  chemically synthesized
agaaaaaatttaatgaatgt

SEQ ID NO: 595958 - DNA, 20 bp, Artificial Sequence
  chemically synthesized
cacatgtctaaacctgtagg

SEQ ID NO: 595959 - DNA, 20 bp, Artificial Sequence
  chemically synthesized
taaataataaagcaacccct

SEQ ID NO: 595960 - DNA, 20 bp, Artificial Sequence
  chemically synthesized
ttgctttattatttaattag

SEQ ID NO: 595961 - DNA, 20 bp, Artificial Sequence
  chemically synthesized
agattcttttctatcatttt

SEQ ID NO: 595962 - DNA, 20 bp, Artificial Sequence
  chemically synthesized
atcattttaggtgtttcatc

SEQ ID NO: 595963 - DNA, 20 bp, Artificial Sequence
  chemically synthesized
ttttaggtgtttcatctaaa

SEQ ID NO: 595964 - DNA, 20 bp, Artificial Sequence
  chemically synthesized
tttattttttaaaatgttgc

SEQ ID NO: 595965 - DNA, 20 bp, Artificial Sequence
  chemically synthesized
ttattctttattttttaaaa

SEQ ID NO: 595966 - DNA, 20 bp, Artificial Sequence
  chemically synthesized
atatccacaaagctcactag

SEQ ID NO: 595967 - DNA, 20 bp, Artificial Sequence
  chemically synthesized
acgtttaggaagcatttcta

SEQ ID NO: 595968 - DNA, 20 bp, Artificial Sequence
  chemically synthesized
tacaaacacatacgcttcat

SEQ ID NO: 595969 - DNA, 20 bp, Artificial Sequence
  chemically synthesized
cctaaacgtgtatgaagcgt

SEQ ID NO: 595970 - DNA, 20 bp, Artificial Sequence
  chemically synthesized
gaaataaaatgtacaaacac

SEQ ID NO: 595971 - DNA, 20 bp, Artificial Sequence
  chemically synthesized
gtttgtacattttatttcac

SEQ ID NO: 595972 - DNA, 20 bp, Artificial Sequence
  chemically synthesized
gcgctcaataaatgtttatc

SEQ ID NO: 595973 - DNA, 20 bp, Artificial Sequence
  chemically synthesized
tcttttgataaacatttatt

SEQ ID NO: 595974 - DNA, 20 bp, Artificial Sequence
  chemically synthesized
ctcaggactaagcgctcaat

SEQ ID NO: 595975 - DNA, 20 bp, Artificial Sequence
  chemically synthesized
ttgatagagatagtatcttt

SEQ ID NO: 595976 - DNA, 20 bp, Artificial Sequence
  chemically synthesized
atctctatcaatgggcaatt

SEQ ID NO: 595977 - DNA, 20 bp, Artificial Sequence
  chemically synthesized
gcctttccatttcaaaatac

SEQ ID NO: 595978 - DNA, 20 bp, Artificial Sequence
  chemically synthesized
ttgacttccaaatgccagca

SEQ ID NO: 595979 - DNA, 20 bp, Artificial Sequence
  chemically synthesized
gcatcagacctctgcaacca

SEQ ID NO: 595980 - DNA, 20 bp, Artificial Sequence
  chemically synthesized
ttatgaaggttcatgaatat

SEQ ID NO: 595981 - DNA, 20 bp, Artificial Sequence
  chemically synthesized
tttgagttcatttatgcaga

SEQ ID NO: 595982 - DNA, 20 bp, Artificial Sequence
  chemically synthesized
ctatatattctccccctcca

SEQ ID NO: 595983 - DNA, 20 bp, Artificial Sequence
  chemically synthesized
aaaaagaaattgtaccagga

SEQ ID NO: 595984 - DNA, 20 bp, Artificial Sequence
  chemically synthesized
tatttatttatttattgaga

SEQ ID NO: 595985 - DNA, 20 bp, Artificial Sequence
  chemically synthesized
aacctatgcctccagggtgg

SEQ ID NO: 595986 - DNA, 20 bp, Artificial Sequence
  chemically synthesized
aattttgtattttaagtaga

SEQ ID NO: 595987 - DNA, 20 bp, Artificial Sequence
  chemically synthesized
caccttggtctctcaaagtg

SEQ ID NO: 595988 - DNA, 20 bp, Artificial Sequence
  chemically synthesized
acccagcccggtacaatttc

SEQ ID NO: 595989 - DNA, 20 bp, Artificial Sequence
  chemically synthesized
tatatgtaagctatacttca

SEQ ID NO: 595990 - DNA, 20 bp, Artificial Sequence
  chemically synthesized
taatggaaaacatggtgaag

SEQ ID NO: 595991 - DNA, 20 bp, Artificial Sequence
  chemically synthesized
gttttccattaaccctacaa

SEQ ID NO: 595992 - DNA, 20 bp, Artificial Sequence
  chemically synthesized
aaccctacaactgcgatttc

SEQ ID NO: 595993 - DNA, 20 bp, Artificial Sequence
  chemically synthesized
caactgcgatttcggcagct

SEQ ID NO: 595994 - DNA, 20 bp, Artificial Sequence
  chemically synthesized
gctgtctatttggtggacca

SEQ ID NO: 595995 - DNA, 20 bp, Artificial Sequence
  chemically synthesized
gtctatagctactcttgtct

SEQ ID NO: 595996 - DNA, 20 bp, Artificial Sequence
  chemically synthesized
gttcattttcgccttgaaag

SEQ ID NO: 595997 - DNA, 20 bp, Artificial Sequence
  chemically synthesized
tgggttattatttattgcct

SEQ ID NO: 595998 - DNA, 20 bp, Artificial Sequence
  chemically synthesized
cttcaagaactgattagact

SEQ ID NO: 595999 - DNA, 20 bp, Artificial Sequence
  chemically synthesized
tttcactttccttcttcaag

SEQ ID NO: 596000 - DNA, 20 bp, Artificial Sequence
  chemically synthesized
cttctcaccacccccttctt

SEQ ID NO: 596001 - DNA, 20 bp, Artificial Sequence
  chemically synthesized
gggtggtgagaagttagaat

SEQ ID NO: 596002 - DNA, 20 bp, Artificial Sequence
  chemically synthesized
ttggatgactccattgtaca

SEQ ID NO: 596003 - DNA, 20 bp, Artificial Sequence
  chemically synthesized
aaaaaaaaaatacaccagag

SEQ ID NO: 596004 - DNA, 20 bp, Artificial Sequence
  chemically synthesized
atacaccagagatctgattc

SEQ ID NO: 596005 - DNA, 20 bp, Artificial Sequence
  chemically synthesized
ttacaagtgatatctatata

SEQ ID NO: 596006 - DNA, 20 bp, Artificial Sequence
  chemically synthesized
caccatgaacattttactat

SEQ ID NO: 596007 - DNA, 20 bp, Artificial Sequence
  chemically synthesized
tggatatgcatcaaaaatat

SEQ ID NO: 596008 - DNA, 20 bp, Artificial Sequence
  chemically synthesized
tacctggatatgcatcaaaa

SEQ ID NO: 596009 - DNA, 20 bp, Artificial Sequence
  chemically synthesized
aggtgaatgatactgatgtc

SEQ ID NO: 596010 - DNA, 20 bp, Artificial Sequence
  chemically synthesized
atatcactgaatagaattca

SEQ ID NO: 596011 - DNA, 20 bp, Artificial Sequence
  chemically synthesized
agttattacttagaaggaaa

SEQ ID NO: 596012 - DNA, 20 bp, Artificial Sequence
  chemically synthesized
catgggaagtaaaaggtaga

SEQ ID NO: 596013 - DNA, 20 bp, Artificial Sequence
  chemically synthesized
aaggtagagttggattcaaa

SEQ ID NO: 596014 - DNA, 20 bp, Artificial Sequence
  chemically synthesized
gttttatgggataagtgaaa

SEQ ID NO: 596015 - DNA, 20 bp, Artificial Sequence
  chemically synthesized
gtgccaaaagggtcagggac

SEQ ID NO: 596016 - DNA, 20 bp, Artificial Sequence
  chemically synthesized
ctgacccttttggcaccagg

SEQ ID NO: 596017 - DNA, 20 bp, Artificial Sequence
  chemically synthesized
ttccgtggaccgggttggag

SEQ ID NO: 596018 - DNA, 20 bp, Artificial Sequence
  chemically synthesized
cgggttggaggatggtttcc

SEQ ID NO: 596019 - DNA, 20 bp, Artificial Sequence
  chemically synthesized
aattatacaactcaccataa

SEQ ID NO: 596020 - DNA, 20 bp, Artificial Sequence
  chemically synthesized
atgtagattcagtgggagcc

SEQ ID NO: 596021 - DNA, 20 bp, Artificial Sequence
  chemically synthesized
acagtgacagatcatgcagc

SEQ ID NO: 596022 - DNA, 20 bp, Artificial Sequence
  chemically synthesized
cttgcatgagtagttcacaa

SEQ ID NO: 596023 - DNA, 20 bp, Artificial Sequence
  chemically synthesized
ggagcagctgtaaatacaga

SEQ ID NO: 596024 - DNA, 20 bp, Artificial Sequence
  chemically synthesized
agcagcagcgggctagggaa

SEQ ID NO: 596025 - DNA, 20 bp, Artificial Sequence
  chemically synthesized
ctagcccgctgctgctcacc

SEQ ID NO: 596026 - DNA, 20 bp, Artificial Sequence
  chemically synthesized
caatccgttgcctgttaggg

SEQ ID NO: 596027 - DNA, 20 bp, Artificial Sequence
  chemically synthesized
gaatcgggtccctaacaggc

SEQ ID NO: 596028 - DNA, 20 bp, Artificial Sequence
  chemically synthesized
agaggccaaaagggggtgta

SEQ ID NO: 596029 - DNA, 20 bp, Artificial Sequence
  chemically synthesized
gtaaataaaagtggccttca

SEQ ID NO: 596030 - DNA, 20 bp, Artificial Sequence
  chemically synthesized
ttcatcttataatgccttaa

SEQ ID NO: 596031 - DNA, 20 bp, Artificial Sequence
  chemically synthesized
tctgttaatgacaaatttaa

SEQ ID NO: 596032 - DNA, 20 bp, Artificial Sequence
  chemically synthesized
taaatttgtcattaacagac

SEQ ID NO: 596033 - DNA, 20 bp, Artificial Sequence
  chemically synthesized
tgtcattaacagactattgt

SEQ ID NO: 596034 - DNA, 20 bp, Artificial Sequence
  chemically synthesized
acagactattgttttagttt

SEQ ID NO: 596035 - DNA, 20 bp, Artificial Sequence
  chemically synthesized
tgtgagggtggaatggtatg

SEQ ID NO: 596036 - DNA, 20 bp, Artificial Sequence
  chemically synthesized
tatattttcattttatttta

SEQ ID NO: 596037 - DNA, 20 bp, Artificial Sequence
  chemically synthesized
ataagatagtatttgaggtg

SEQ ID NO: 596038 - DNA, 20 bp, Artificial Sequence
  chemically synthesized
accggtctttaaatgattat

SEQ ID NO: 596039 - DNA, 20 bp, Artificial Sequence
  chemically synthesized
tcagcacttcaccggtcttt

SEQ ID NO: 596040 - DNA, 20 bp, Artificial Sequence
  chemically synthesized
gattttcacattgtaatttt

SEQ ID NO: 596041 - DNA, 20 bp, Artificial Sequence
  chemically synthesized
aaaatagacttgtttcctct

SEQ ID NO: 596042 - DNA, 20 bp, Artificial Sequence
  chemically synthesized
ttggcattcctttaaaatag

SEQ ID NO: 596043 - DNA, 20 bp, Artificial Sequence
  chemically synthesized
tgaagatagcatgattgttc

SEQ ID NO: 596044 - DNA, 20 bp, Artificial Sequence
  chemically synthesized
agttaatcacattgaagata

SEQ ID NO: 596045 - DNA, 20 bp, Artificial Sequence
  chemically synthesized
gaacaatcatgctatcttca

SEQ ID NO: 596046 - DNA, 20 bp, Artificial Sequence
  chemically synthesized
ttcaatgtgattaactggaa

SEQ ID NO: 596047 - DNA, 20 bp, Artificial Sequence
  chemically synthesized
gtttggtaggacatgccatc

SEQ ID NO: 596048 - DNA, 20 bp, Artificial Sequence
  chemically synthesized
gacatgccatcctcagttta

SEQ ID NO: 596049 - DNA, 20 bp, Artificial Sequence
  chemically synthesized
acttaaatttctacaagaat

SEQ ID NO: 596050 - DNA, 20 bp, Artificial Sequence
  chemically synthesized
tggaacaagtaaaaaataaa

SEQ ID NO: 596051 - DNA, 20 bp, Artificial Sequence
  chemically synthesized
cgttatctcacttagtacga

SEQ ID NO: 596052 - DNA, 20 bp, Artificial Sequence
  chemically synthesized
acaacatgtaggaattcaag

SEQ ID NO: 596053 - DNA, 20 bp, Artificial Sequence
  chemically synthesized
agcatgggaaggacctgccc

SEQ ID NO: 596054 - DNA, 20 bp, Artificial Sequence
  chemically synthesized
aaattagtctcatgagatct

SEQ ID NO: 596055 - DNA, 20 bp, Artificial Sequence
  chemically synthesized
ttgctcctccttgccttctg

SEQ ID NO: 596056 - DNA, 20 bp, Artificial Sequence
  chemically synthesized
ctgggtcatttatacaggaa

SEQ ID NO: 596057 - DNA, 20 bp, Artificial Sequence
  chemically synthesized
ggaaaaattacttcatatta

SEQ ID NO: 596058 - DNA, 20 bp, Artificial Sequence
  chemically synthesized
acctaacaggaaaatatttt

SEQ ID NO: 596059 - DNA, 20 bp, Artificial Sequence
  chemically synthesized
aaattatgacataaatcctt

SEQ ID NO: 596060 - DNA, 20 bp, Artificial Sequence
  chemically synthesized
atttgcaatactaaaacaat

SEQ ID NO: 596061 - DNA, 20 bp, Artificial Sequence
  chemically synthesized
tatctgagcctatgtctttt

SEQ ID NO: 596062 - DNA, 20 bp, Artificial Sequence
  chemically synthesized
ttatgaagtctttgcattgt

SEQ ID NO: 596063 - DNA, 20 bp, Artificial Sequence
  chemically synthesized
tatgtctttttctttacaat

SEQ ID NO: 596064 - DNA, 20 bp, Artificial Sequence
  chemically synthesized
ttacaatttttgctttgtgc

SEQ ID NO: 596065 - DNA, 20 bp, Artificial Sequence
  chemically synthesized
caaaatatttttatatattt

SEQ ID NO: 596066 - DNA, 20 bp, Artificial Sequence
  chemically synthesized
atattttaatgctttgcctt

SEQ ID NO: 596067 - DNA, 20 bp, Artificial Sequence
  chemically synthesized
aaacataaaaatggtaaatt

SEQ ID NO: 596068 - DNA, 20 bp, Artificial Sequence
  chemically synthesized
aatccatcaatttaccattt

SEQ ID NO: 596069 - DNA, 20 bp, Artificial Sequence
  chemically synthesized
gtgagatagggatctaattc

SEQ ID NO: 596070 - DNA, 20 bp, Artificial Sequence
  chemically synthesized
ctctcaatacattcgaatac

SEQ ID NO: 596071 - DNA, 20 bp, Artificial Sequence
  chemically synthesized
tattttcttctccaatctgt

SEQ ID NO: 596072 - DNA, 20 bp, Artificial Sequence
  chemically synthesized
cagttgtagagagaaacctg

SEQ ID NO: 596073 - DNA, 20 bp, Artificial Sequence
  chemically synthesized
tcttcctcccacgttgggtt

SEQ ID NO: 596074 - DNA, 20 bp, Artificial Sequence
  chemically synthesized
ggttctctgttttccggatc

SEQ ID NO: 596075 - DNA, 20 bp, Artificial Sequence
  chemically synthesized
cttacctctcttaaaaatat

SEQ ID NO: 596076 - DNA, 20 bp, Artificial Sequence
  chemically synthesized
atgcctaactctgaggggac

SEQ ID NO: 596077 - DNA, 20 bp, Artificial Sequence
  chemically synthesized
ctacatagaggcatgtaaga

SEQ ID NO: 596078 - DNA, 20 bp, Artificial Sequence
  chemically synthesized
ttgactgacatggtgaacgc

SEQ ID NO: 596079 - DNA, 20 bp, Artificial Sequence
  chemically synthesized
atcattctaccgtaacaata

SEQ ID NO: 596080 - DNA, 20 bp, Artificial Sequence
  chemically synthesized
gatagaatactagagactga

SEQ ID NO: 596081 - DNA, 20 bp, Artificial Sequence
  chemically synthesized
aatactagagactgaatcag

SEQ ID NO: 596082 - DNA, 20 bp, Artificial Sequence
  chemically synthesized
tgtagtcactcaggaatcta

SEQ ID NO: 596083 - DNA, 20 bp, Artificial Sequence
  chemically synthesized
caaagatacaaaatcaacct

SEQ ID NO: 596084 - DNA, 20 bp, Artificial Sequence
  chemically synthesized
ttagtggctagaaacacaaa

SEQ ID NO: 596085 - DNA, 20 bp, Artificial Sequence
  chemically synthesized
tctagccactaatattttgg

SEQ ID NO: 596086 - DNA, 20 bp, Artificial Sequence
  chemically synthesized
tcagaaggagagtgttttag

SEQ ID NO: 596087 - DNA, 20 bp, Artificial Sequence
  chemically synthesized
gtgattggagatcagaagga

SEQ ID NO: 596088 - DNA, 20 bp, Artificial Sequence
  chemically synthesized
gaaagacaaagaatgtttag

SEQ ID NO: 596089 - DNA, 20 bp, Artificial Sequence
  chemically synthesized
aagaaaccaagaaagacaaa

SEQ ID NO: 596090 - DNA, 20 bp, Artificial Sequence
  chemically synthesized
actaaacattctttgtcttt

SEQ ID NO: 596091 - DNA, 20 bp, Artificial Sequence
  chemically synthesized
tggtagagtatatttttgaa

SEQ ID NO: 596092 - DNA, 20 bp, Artificial Sequence
  chemically synthesized
aaaatagatttctggggaaa

SEQ ID NO: 596093 - DNA, 20 bp, Artificial Sequence
  chemically synthesized
attattttctccgcacaatt

SEQ ID NO: 596094 - DNA, 20 bp, Artificial Sequence
  chemically synthesized
aacaagtcattccaaaattt

SEQ ID NO: 596095 - DNA, 20 bp, Artificial Sequence
  chemically synthesized
atttagcagcttaaaaacaa

SEQ ID NO: 596096 - DNA, 20 bp, Artificial Sequence
  chemically synthesized
aactgccaaataataaacat

SEQ ID NO: 596097 - DNA, 20 bp, Artificial Sequence
  chemically synthesized
aacaaaaatgtttattattt

SEQ ID NO: 596098 - DNA, 20 bp, Artificial Sequence
  chemically synthesized
ctgaaggtcaagaatctgag

SEQ ID NO: 596099 - DNA, 20 bp, Artificial Sequence
  chemically synthesized
tcccaccctgctaagccact

SEQ ID NO: 596100 - DNA, 20 bp, Artificial Sequence
  chemically synthesized
gcttagcagggtgggactgg

SEQ ID NO: 596101 - DNA, 20 bp, Artificial Sequence
  chemically synthesized
ggttgtagttaagctgttgt

SEQ ID NO: 596102 - DNA, 20 bp, Artificial Sequence
  chemically synthesized
gagaggctgcaagcatagac

SEQ ID NO: 596103 - DNA, 20 bp, Artificial Sequence
  chemically synthesized
ttgtctatgcttgcagcctc

SEQ ID NO: 596104 - DNA, 20 bp, Artificial Sequence
  chemically synthesized
tcctgcaaagagccacaaga

SEQ ID NO: 596105 - DNA, 20 bp, Artificial Sequence
  chemically synthesized
tgtggctctttgcaggaggc

SEQ ID NO: 596106 - DNA, 20 bp, Artificial Sequence
  chemically synthesized
ctctctctctctctctcatg

SEQ ID NO: 596107 - DNA, 20 bp, Artificial Sequence
  chemically synthesized
agtgtaggttgtagaaagac

SEQ ID NO: 596108 - DNA, 20 bp, Artificial Sequence
  chemically synthesized
gtccctgtcattgagtgtgg

SEQ ID NO: 596109 - DNA, 20 bp, Artificial Sequence
  chemically synthesized
ctaggaataattaactttgg

SEQ ID NO: 596110 - DNA, 20 bp, Artificial Sequence
  chemically synthesized
aacttctaggaataattaac

SEQ ID NO: 596111 - DNA, 20 bp, Artificial Sequence
  chemically synthesized
agccaaagttaattattcct

SEQ ID NO: 596112 - DNA, 20 bp, Artificial Sequence
  chemically synthesized
tgctgaaaagtccaaagcca

SEQ ID NO: 596113 - DNA, 20 bp, Artificial Sequence
  chemically synthesized
gttcacagatcagaaatcag

SEQ ID NO: 596114 - DNA, 20 bp, Artificial Sequence
  chemically synthesized
atctgtgaacttctctttgt

SEQ ID NO: 596115 - DNA, 20 bp, Artificial Sequence
  chemically synthesized
tttatgatgatgagccttgg

SEQ ID NO: 596116 - DNA, 20 bp, Artificial Sequence
  chemically synthesized
aaaatgagtgtccaggttta

SEQ ID NO: 596117 - DNA, 20 bp, Artificial Sequence
  chemically synthesized
gaactgaagaaaatgagtgt

SEQ ID NO: 596118 - DNA, 20 bp, Artificial Sequence
  chemically synthesized
attatcaaagaagtgacaac

SEQ ID NO: 596119 - DNA, 20 bp, Artificial Sequence
  chemically synthesized
tctctccacagttgcctctc

SEQ ID NO: 596120 - DNA, 20 bp, Artificial Sequence
  chemically synthesized
ttaacatctattatttgaat

SEQ ID NO: 596121 - DNA, 20 bp, Artificial Sequence
  chemically synthesized
gaatgttggattacatagaa

SEQ ID NO: 596122 - DNA, 20 bp, Artificial Sequence
  chemically synthesized
tttcaaagtgtcaatagtgt

SEQ ID NO: 596123 - DNA, 20 bp, Artificial Sequence
  chemically synthesized
tactcatttcaaagtgtcaa

SEQ ID NO: 596124 - DNA, 20 bp, Artificial Sequence
  chemically synthesized
aggtgattttgtcctgcaga

SEQ ID NO: 596125 - DNA, 20 bp, Artificial Sequence
  chemically synthesized
ggtaagtgtttcacaaatag

SEQ ID NO: 596126 - DNA, 20 bp, Artificial Sequence
  chemically synthesized
cttagaagatcattctaggt

SEQ ID NO: 596127 - DNA, 20 bp, Artificial Sequence
  chemically synthesized
cacttacctagaatgatctt

SEQ ID NO: 596128 - DNA, 20 bp, Artificial Sequence
  chemically synthesized
ttcttatactctcccatttt

SEQ ID NO: 596129 - DNA, 20 bp, Artificial Sequence
  chemically synthesized
tccatgcttttggctattta

SEQ ID NO: 596130 - DNA, 20 bp, Artificial Sequence
  chemically synthesized
ctgctcttcatttttaatag

SEQ ID NO: 596131 - DNA, 20 bp, Artificial Sequence
  chemically synthesized
cgattttgctataaatgtaa

SEQ ID NO: 596132 - DNA, 20 bp, Artificial Sequence
  chemically synthesized
gggaaatctctgtactttcc

SEQ ID NO: 596133 - DNA, 20 bp, Artificial Sequence
  chemically synthesized
gcaaaatcgaggggaaagta

SEQ ID NO: 596134 - DNA, 20 bp, Artificial Sequence
  chemically synthesized
tatcattaacactcgaagtc

SEQ ID NO: 596135 - DNA, 20 bp, Artificial Sequence
  chemically synthesized
tcgaagtccatagtttacat

SEQ ID NO: 596136 - DNA, 20 bp, Artificial Sequence
  chemically synthesized
agtccatagtttacattaga

SEQ ID NO: 596137 - DNA, 20 bp, Artificial Sequence
  chemically synthesized
cttgtgatgttgtatcttct

SEQ ID NO: 596138 - DNA, 20 bp, Artificial Sequence
  chemically synthesized
accattatagtatcacacag

SEQ ID NO: 596139 - DNA, 20 bp, Artificial Sequence
  chemically synthesized
ataacatacatggtatgcat

SEQ ID NO: 596140 - DNA, 20 bp, Artificial Sequence
  chemically synthesized
atattttatagtggtgaagg

SEQ ID NO: 596141 - DNA, 20 bp, Artificial Sequence
  chemically synthesized
taaattaatagtatagcagg

SEQ ID NO: 596142 - DNA, 20 bp, Artificial Sequence
  chemically synthesized
taattttatagctatcttta

SEQ ID NO: 596143 - DNA, 20 bp, Artificial Sequence
  chemically synthesized
atgccttgtctctctttctg

SEQ ID NO: 596144 - DNA, 20 bp, Artificial Sequence
  chemically synthesized
gtctctctttctgcagagat

SEQ ID NO: 596145 - DNA, 20 bp, Artificial Sequence
  chemically synthesized
ttctgtttcatttatgtggc

SEQ ID NO: 596146 - DNA, 20 bp, Artificial Sequence
  chemically synthesized
tattgtttttttcccaatat

SEQ ID NO: 596147 - DNA, 20 bp, Artificial Sequence
  chemically synthesized
tttttcccaatatttctgct

SEQ ID NO: 596148 - DNA, 20 bp, Artificial Sequence
  chemically synthesized
tttctgctttttgtttttat

SEQ ID NO: 596149 - DNA, 20 bp, Artificial Sequence
  chemically synthesized
atgttcaaatatctggaaat

SEQ ID NO: 596150 - DNA, 20 bp, Artificial Sequence
  chemically synthesized
cctcagttttaagagacaat

SEQ ID NO: 596151 - DNA, 20 bp, Artificial Sequence
  chemically synthesized
tctcttaaaactgaggcatt

SEQ ID NO: 596152 - DNA, 20 bp, Artificial Sequence
  chemically synthesized
tttccaaaagcatttaatgc

SEQ ID NO: 596153 - DNA, 20 bp, Artificial Sequence
  chemically synthesized
ggaaattccttgtgcgtatg

SEQ ID NO: 596154 - DNA, 20 bp, Artificial Sequence
  chemically synthesized
gtatgtagggcttatacttg

SEQ ID NO: 596155 - DNA, 20 bp, Artificial Sequence
  chemically synthesized
taatgtcatcaccttgaggg

SEQ ID NO: 596156 - DNA, 20 bp, Artificial Sequence
  chemically synthesized
agggtactattctcattctg

SEQ ID NO: 596157 - DNA, 20 bp, Artificial Sequence
  chemically synthesized
ttacagtgagaagacaggaa

SEQ ID NO: 596158 - DNA, 20 bp, Artificial Sequence
  chemically synthesized
agttcaagatcaaggcactg

SEQ ID NO: 596159 - DNA, 20 bp, Artificial Sequence
  chemically synthesized
aacggtgagaaataaaggtc

SEQ ID NO: 596160 - DNA, 20 bp, Artificial Sequence
  chemically synthesized
agcaataaaacttgactaaa

SEQ ID NO: 596161 - DNA, 20 bp, Artificial Sequence
  chemically synthesized
aatacgaaaactatttttag

SEQ ID NO: 596162 - DNA, 20 bp, Artificial Sequence
  chemically synthesized
taagtttctatcctctgggc

SEQ ID NO: 596163 - DNA, 20 bp, Artificial Sequence
  chemically synthesized
cctcttcaccttcttggctc

SEQ ID NO: 596164 - DNA, 20 bp, Artificial Sequence
  chemically synthesized
agagccaccatactgaaaat

SEQ ID NO: 596165 - DNA, 20 bp, Artificial Sequence
  chemically synthesized
caacttttggcatttggaca

SEQ ID NO: 596166 - DNA, 20 bp, Artificial Sequence
  chemically synthesized
cctgttgtccaaatgccaaa

SEQ ID NO: 596167 - DNA, 20 bp, Artificial Sequence
  chemically synthesized
ccagcagacgtgagtgagtg

SEQ ID NO: 596168 - DNA, 20 bp, Artificial Sequence
  chemically synthesized
catcccagcagacgtgagtg

SEQ ID NO: 596169 - DNA, 20 bp, Artificial Sequence
  chemically synthesized
gaaatgtaattgcccctttt

SEQ ID NO: 596170 - DNA, 20 bp, Artificial Sequence
  chemically synthesized
agaggggctggaaataaagg

SEQ ID NO: 596171 - DNA, 20 bp, Artificial Sequence
  chemically synthesized
acttgtggattgaagacgct

SEQ ID NO: 596172 - DNA, 20 bp, Artificial Sequence
  chemically synthesized
acacctagcgtcttcaatcc

SEQ ID NO: 596173 - DNA, 20 bp, Artificial Sequence
  chemically synthesized
ttcaggatcccagaaaaact

SEQ ID NO: 596174 - DNA, 20 bp, Artificial Sequence
  chemically synthesized
tctgggatcctgaaaaacaa

SEQ ID NO: 596175 - DNA, 20 bp, Artificial Sequence
  chemically synthesized
aaattaggacaagtaagcca

SEQ ID NO: 596176 - DNA, 20 bp, Artificial Sequence
  chemically synthesized
tatttgtcattttatgactg

SEQ ID NO: 596177 - DNA, 20 bp, Artificial Sequence
  chemically synthesized
tctctctctcccaaattgtt

SEQ ID NO: 596178 - DNA, 20 bp, Artificial Sequence
  chemically synthesized
gggagagagagaagataaat

SEQ ID NO: 596179 - DNA, 20 bp, Artificial Sequence
  chemically synthesized
gagagaagataaatgtatgt

SEQ ID NO: 596180 - DNA, 20 bp, Artificial Sequence
  chemically synthesized
tttctattggaggtccatgt

SEQ ID NO: 596181 - DNA, 20 bp, Artificial Sequence
  chemically synthesized
gtggtctccagccacccctt

SEQ ID NO: 596182 - DNA, 20 bp, Artificial Sequence
  chemically synthesized
atctgttctcttgcttgatg

SEQ ID NO: 596183 - DNA, 20 bp, Artificial Sequence
  chemically synthesized
gaactgtgttgcatctgttc

SEQ ID NO: 596184 - DNA, 20 bp, Artificial Sequence
  chemically synthesized
tcttacacctacataggccc

SEQ ID NO: 596185 - DNA, 20 bp, Artificial Sequence
  chemically synthesized
ttcaggctgtagcctgacgc

SEQ ID NO: 596186 - DNA, 20 bp, Artificial Sequence
  chemically synthesized
cctgaagaagcactttttcc

SEQ ID NO: 596187 - DNA, 20 bp, Artificial Sequence
  chemically synthesized
tgaaagaaaacctggggaaa

SEQ ID NO: 596188 - DNA, 20 bp, Artificial Sequence
  chemically synthesized
caaaaccagaggctgggctg

SEQ ID NO: 596189 - DNA, 20 bp, Artificial Sequence
  chemically synthesized
gcaagcaccacagcccagcc

SEQ ID NO: 596190 - DNA, 20 bp, Artificial Sequence
  chemically synthesized
ccagcctctggttttgaata

SEQ ID NO: 596191 - DNA, 20 bp, Artificial Sequence
  chemically synthesized
agtttgtctccagttccaca

SEQ ID NO: 596192 - DNA, 20 bp, Artificial Sequence
  chemically synthesized
tgcgggatagttgggattaa

SEQ ID NO: 596193 - DNA, 20 bp, Artificial Sequence
  chemically synthesized
atttggatgctgcgggatag

SEQ ID NO: 596194 - DNA, 20 bp, Artificial Sequence
  chemically synthesized
tatcccgcagcatccaaatt

SEQ ID NO: 596195 - DNA, 20 bp, Artificial Sequence
  chemically synthesized
tccaaattcctggcttccac

SEQ ID NO: 596196 - DNA, 20 bp, Artificial Sequence
  chemically synthesized
tcagggacttccgccccatt

SEQ ID NO: 596197 - DNA, 20 bp, Artificial Sequence
  chemically synthesized
tatatttctgtaaatacaca

SEQ ID NO: 596198 - DNA, 20 bp, Artificial Sequence
  chemically synthesized
cacatcatgatttgatatgt

SEQ ID NO: 596199 - DNA, 20 bp, Artificial Sequence
  chemically synthesized
gggagcagatgaggataaca

SEQ ID NO: 596200 - DNA, 20 bp, Artificial Sequence
  chemically synthesized
aaaaaccaatgcaaaatgat

SEQ ID NO: 596201 - DNA, 20 bp, Artificial Sequence
  chemically synthesized
gaaatctctaatcattttgc

SEQ ID NO: 596202 - DNA, 20 bp, Artificial Sequence
  chemically synthesized
ctattataaaaaccaatgca

SEQ ID NO: 596203 - DNA, 20 bp, Artificial Sequence
  chemically synthesized
gagacacatatgtctcataa

SEQ ID NO: 596204 - DNA, 20 bp, Artificial Sequence
  chemically synthesized
tctcaacccagccggttcta

SEQ ID NO: 596205 - DNA, 20 bp, Artificial Sequence
  chemically synthesized
ccccagagagacccaagata

SEQ ID NO: 596206 - DNA, 20 bp, Artificial Sequence
  chemically synthesized
cagttaccaaggaaatttgg

SEQ ID NO: 596207 - DNA, 20 bp, Artificial Sequence
  chemically synthesized
tgtaacattacacagcactc

SEQ ID NO: 596208 - DNA, 20 bp, Artificial Sequence
  chemically synthesized
ggcccagagtgatccttgtt

SEQ ID NO: 596209 - DNA, 20 bp, Artificial Sequence
  chemically synthesized
gttattagtaccaaggacac

SEQ ID NO: 596210 - DNA, 20 bp, Artificial Sequence
  chemically synthesized
agcatatgcagaatgattct

SEQ ID NO: 596211 - DNA, 20 bp, Artificial Sequence
  chemically synthesized
agccaatagaatcattctgc

SEQ ID NO: 596212 - DNA, 20 bp, Artificial Sequence
  chemically synthesized
caggtaataaagcatatgca

SEQ ID NO: 596213 - DNA, 20 bp, Artificial Sequence
  chemically synthesized
taataatgccatttcccttc

SEQ ID NO: 596214 - DNA, 20 bp, Artificial Sequence
  chemically synthesized
aatggcattattatgtacac

SEQ ID NO: 596215 - DNA, 20 bp, Artificial Sequence
  chemically synthesized
tccatgtgattttatagggt

SEQ ID NO: 596216 - DNA, 20 bp, Artificial Sequence
  chemically synthesized
atttttaaccaaaatgttcc

SEQ ID NO: 596217 - DNA, 20 bp, Artificial Sequence
  chemically synthesized
acatggaacattttggttaa

SEQ ID NO: 596218 - DNA, 20 bp, Artificial Sequence
  chemically synthesized
cctcaagaaatgaagtatta

SEQ ID NO: 596219 - DNA, 20 bp, Artificial Sequence
  chemically synthesized
taatacttcatttcttgagg

SEQ ID NO: 596220 - DNA, 20 bp, Artificial Sequence
  chemically synthesized
cctcatttcacggacccata

SEQ ID NO: 596221 - DNA, 20 bp, Artificial Sequence
  chemically synthesized
gtagcaatatttttgttatt

SEQ ID NO: 596222 - DNA, 20 bp, Artificial Sequence
  chemically synthesized
ttgctttccttgctttcttc

SEQ ID NO: 596223 - DNA, 20 bp, Artificial Sequence
  chemically synthesized
tcctttgctttccttgcttt

SEQ ID NO: 596224 - DNA, 20 bp, Artificial Sequence
  chemically synthesized
cctttgcgttcctttgcttt

SEQ ID NO: 596225 - DNA, 20 bp, Artificial Sequence
  chemically synthesized
tttccttttcctttgcgttc

SEQ ID NO: 596226 - DNA, 20 bp, Artificial Sequence
  chemically synthesized
ttctgctttcctttcctttc

SEQ ID NO: 596227 - DNA, 20 bp, Artificial Sequence
  chemically synthesized
tttttctttcttttctttac

SEQ ID NO: 596228 - DNA, 20 bp, Artificial Sequence
  chemically synthesized
tctgcctgtctgcctgcttg

SEQ ID NO: 596229 - DNA, 20 bp, Artificial Sequence
  chemically synthesized
gcctgtctgcctgtctgcct

SEQ ID NO: 596230 - DNA, 20 bp, Artificial Sequence
  chemically synthesized
gcctgcctgtctgcctgtct

SEQ ID NO: 596231 - DNA, 20 bp, Artificial Sequence
  chemically synthesized
caggcaagcaagctagttaa

SEQ ID NO: 596232 - DNA, 20 bp, Artificial Sequence
  chemically synthesized
tctaaaatcttacttaacta

SEQ ID NO: 596233 - DNA, 20 bp, Artificial Sequence
  chemically synthesized
cttatctaaaatcttactta

SEQ ID NO: 596234 - DNA, 20 bp, Artificial Sequence
  chemically synthesized
atttttattattacgctaca

SEQ ID NO: 596235 - DNA, 20 bp, Artificial Sequence
  chemically synthesized
aataataaaaataacttcaa

SEQ ID NO: 596236 - DNA, 20 bp, Artificial Sequence
  chemically synthesized
ttgggttgatgatagcctga

SEQ ID NO: 596237 - DNA, 20 bp, Artificial Sequence
  chemically synthesized
ttgatgatagcctgacaagg

SEQ ID NO: 596238 - DNA, 20 bp, Artificial Sequence
  chemically synthesized
taaagacagctggtctagaa

SEQ ID NO: 596239 - DNA, 20 bp, Artificial Sequence
  chemically synthesized
ttactgtagcatcatgtgaa

SEQ ID NO: 596240 - DNA, 20 bp, Artificial Sequence
  chemically synthesized
taggttttaatacttgcttt

SEQ ID NO: 596241 - DNA, 20 bp, Artificial Sequence
  chemically synthesized
tttgttccttaggttttaat

SEQ ID NO: 596242 - DNA, 20 bp, Artificial Sequence
  chemically synthesized
atcacaggagagtttgttcc

SEQ ID NO: 596243 - DNA, 20 bp, Artificial Sequence
  chemically synthesized
tgagccagtaaatatcacag

SEQ ID NO: 596244 - DNA, 20 bp, Artificial Sequence
  chemically synthesized
tatgtccttcctctcagggg

SEQ ID NO: 596245 - DNA, 20 bp, Artificial Sequence
  chemically synthesized
gacatatttgaatattccca

SEQ ID NO: 596246 - DNA, 20 bp, Artificial Sequence
  chemically synthesized
atgtttggtgacattataat

SEQ ID NO: 596247 - DNA, 20 bp, Artificial Sequence
  chemically synthesized
ataatggtgtagtgctaact

SEQ ID NO: 596248 - DNA, 20 bp, Artificial Sequence
  chemically synthesized
attatatttcactattatct

SEQ ID NO: 596249 - DNA, 20 bp, Artificial Sequence
  chemically synthesized
aatttaatttttgataatgg

SEQ ID NO: 596250 - DNA, 20 bp, Artificial Sequence
  chemically synthesized
cacatcgactcaagttaaac

SEQ ID NO: 596251 - DNA, 20 bp, Artificial Sequence
  chemically synthesized
ttgtgtacattgtgataaac

SEQ ID NO: 596252 - DNA, 20 bp, Artificial Sequence
  chemically synthesized
ttttcctattcttctcaggt

SEQ ID NO: 596253 - DNA, 20 bp, Artificial Sequence
  chemically synthesized
aggtattagtttatataaaa

SEQ ID NO: 596254 - DNA, 20 bp, Artificial Sequence
  chemically synthesized
ttttttttttttattatact

SEQ ID NO: 596255 - DNA, 20 bp, Artificial Sequence
  chemically synthesized
cacctatgagtgagaatatg

SEQ ID NO: 596256 - DNA, 20 bp, Artificial Sequence
  chemically synthesized
atgagtgagaatatgcagtg

SEQ ID NO: 596257 - DNA, 20 bp, Artificial Sequence
  chemically synthesized
gtttggttttttgttcttgc

SEQ ID NO: 596258 - DNA, 20 bp, Artificial Sequence
  chemically synthesized
tgcgatagtttactgagaat

SEQ ID NO: 596259 - DNA, 20 bp, Artificial Sequence
  chemically synthesized
gtttactgagaatgacggtt

SEQ ID NO: 596260 - DNA, 20 bp, Artificial Sequence
  chemically synthesized
caaatgtccaacaatgatag

SEQ ID NO: 596261 - DNA, 20 bp, Artificial Sequence
  chemically synthesized
ctataaagacacatgcacac

SEQ ID NO: 596262 - DNA, 20 bp, Artificial Sequence
  chemically synthesized
gtgcatgtgtctttatagca

SEQ ID NO: 596263 - DNA, 20 bp, Artificial Sequence
  chemically synthesized
aaccattgtggaagtcagtg

SEQ ID NO: 596264 - DNA, 20 bp, Artificial Sequence
  chemically synthesized
ctgacttccacaatggttga

SEQ ID NO: 596265 - DNA, 20 bp, Artificial Sequence
  chemically synthesized
tccacatcctctccagcacc

SEQ ID NO: 596266 - DNA, 20 bp, Artificial Sequence
  chemically synthesized
cctgttgtttcctgactttt

SEQ ID NO: 596267 - DNA, 20 bp, Artificial Sequence
  chemically synthesized
ggtgtgagatgatatctcat

SEQ ID NO: 596268 - DNA, 20 bp, Artificial Sequence
  chemically synthesized
gagatgatatctcatagtgg

SEQ ID NO: 596269 - DNA, 20 bp, Artificial Sequence
  chemically synthesized
actctgatggccagtgatgg

SEQ ID NO: 596270 - DNA, 20 bp, Artificial Sequence
  chemically synthesized
gtgatggtgaggattttttc

SEQ ID NO: 596271 - DNA, 20 bp, Artificial Sequence
  chemically synthesized
cttcgctcactttttgatgg

SEQ ID NO: 596272 - DNA, 20 bp, Artificial Sequence
  chemically synthesized
gctcactttttgatggggtt

SEQ ID NO: 596273 - DNA, 20 bp, Artificial Sequence
  chemically synthesized
tgtttgtttttttcttgtaa

SEQ ID NO: 596274 - DNA, 20 bp, Artificial Sequence
  chemically synthesized
gtaaatttgtttgagttcat

SEQ ID NO: 596275 - DNA, 20 bp, Artificial Sequence
  chemically synthesized
ggttccctgttcactctgat

SEQ ID NO: 596276 - DNA, 20 bp, Artificial Sequence
  chemically synthesized
cttttgctgtgcagaagctc

SEQ ID NO: 596277 - DNA, 20 bp, Artificial Sequence
  chemically synthesized
aatgggatctaattaaacta

SEQ ID NO: 596278 - DNA, 20 bp, Artificial Sequence
  chemically synthesized
attagatcccatttgtcaat

SEQ ID NO: 596279 - DNA, 20 bp, Artificial Sequence
  chemically synthesized
tcaattttggcttttgttgc

SEQ ID NO: 596280 - DNA, 20 bp, Artificial Sequence
  chemically synthesized
gcttttgttgccattgcttt

SEQ ID NO: 596281 - DNA, 20 bp, Artificial Sequence
  chemically synthesized
tatgtcctgaatggtaatgc

SEQ ID NO: 596282 - DNA, 20 bp, Artificial Sequence
  chemically synthesized
gtaatgcctaggttttcttc

SEQ ID NO: 596283 - DNA, 20 bp, Artificial Sequence
  chemically synthesized
aggttttcttctagggtttt

SEQ ID NO: 596284 - DNA, 20 bp, Artificial Sequence
  chemically synthesized
ggtttttatggttttaggtc

SEQ ID NO: 596285 - DNA, 20 bp, Artificial Sequence
  chemically synthesized
aaaatcaattcaagatggat

SEQ ID NO: 596286 - DNA, 20 bp, Artificial Sequence
  chemically synthesized
taaatctttaatccatcttg

SEQ ID NO: 596287 - DNA, 20 bp, Artificial Sequence
  chemically synthesized
ttatacaaaaatcaattcaa

SEQ ID NO: 596288 - DNA, 20 bp, Artificial Sequence
  chemically synthesized
tataaggtgtaaggaaggga

SEQ ID NO: 596289 - DNA, 20 bp, Artificial Sequence
  chemically synthesized
gtgtaaggaagggatccagt

SEQ ID NO: 596290 - DNA, 20 bp, Artificial Sequence
  chemically synthesized
taaatagggaatcctttccc

SEQ ID NO: 596291 - DNA, 20 bp, Artificial Sequence
  chemically synthesized
tagggaatcctttccccatt

SEQ ID NO: 596292 - DNA, 20 bp, Artificial Sequence
  chemically synthesized
gaggaaaacaagcaatgggg

SEQ ID NO: 596293 - DNA, 20 bp, Artificial Sequence
  chemically synthesized
ttccccattgcttgttttcc

SEQ ID NO: 596294 - DNA, 20 bp, Artificial Sequence
  chemically synthesized
tctgttccattgatctatat

SEQ ID NO: 596295 - DNA, 20 bp, Artificial Sequence
  chemically synthesized
ctgttttggtaccagtacca

SEQ ID NO: 596296 - DNA, 20 bp, Artificial Sequence
  chemically synthesized
tggttactgtagccttgtag

SEQ ID NO: 596297 - DNA, 20 bp, Artificial Sequence
  chemically synthesized
aagtcagctagtgtgatgcc

SEQ ID NO: 596298 - DNA, 20 bp, Artificial Sequence
  chemically synthesized
gatgcctccagctttgttct

SEQ ID NO: 596299 - DNA, 20 bp, Artificial Sequence
  chemically synthesized
tccagctttgttcttttggc

SEQ ID NO: 596300 - DNA, 20 bp, Artificial Sequence
  chemically synthesized
tggttccatatgaactttaa

SEQ ID NO: 596301 - DNA, 20 bp, Artificial Sequence
  chemically synthesized
attctgtgaagaaaggcatt

SEQ ID NO: 596302 - DNA, 20 bp, Artificial Sequence
  chemically synthesized
ccatactgcccaaggtgatt

SEQ ID NO: 596303 - DNA, 20 bp, Artificial Sequence
  chemically synthesized
gaaaatggccatactgccca

SEQ ID NO: 596304 - DNA, 20 bp, Artificial Sequence
  chemically synthesized
cagtatggccattttcacga

SEQ ID NO: 596305 - DNA, 20 bp, Artificial Sequence
  chemically synthesized
tgagcatggaatgttcttcc

SEQ ID NO: 596306 - DNA, 20 bp, Artificial Sequence
  chemically synthesized
cctcttttatttccttgagc

SEQ ID NO: 596307 - DNA, 20 bp, Artificial Sequence
  chemically synthesized
gtccttcacatcccttgtaa

SEQ ID NO: 596308 - DNA, 20 bp, Artificial Sequence
  chemically synthesized
atgagtgaactcccattcac

SEQ ID NO: 596309 - DNA, 20 bp, Artificial Sequence
  chemically synthesized
aattgtgaatgggagttcac

SEQ ID NO: 596310 - DNA, 20 bp, Artificial Sequence
  chemically synthesized
agttcactcatgatttggct

SEQ ID NO: 596311 - DNA, 20 bp, Artificial Sequence
  chemically synthesized
tgtctgttgttggtgtataa

SEQ ID NO: 596312 - DNA, 20 bp, Artificial Sequence
  chemically synthesized
ttgttggtgtataagaatgc

SEQ ID NO: 596313 - DNA, 20 bp, Artificial Sequence
  chemically synthesized
gaatgcttgtgatttctgta

SEQ ID NO: 596314 - DNA, 20 bp, Artificial Sequence
  chemically synthesized
gtatcctgagactttgctga

SEQ ID NO: 596315 - DNA, 20 bp, Artificial Sequence
  chemically synthesized
agactttgctgaagttgctt

SEQ ID NO: 596316 - DNA, 20 bp, Artificial Sequence
  chemically synthesized
tgaagttgcttatcagctta

SEQ ID NO: 596317 - DNA, 20 bp, Artificial Sequence
  chemically synthesized
gagattttgggctgagacga

SEQ ID NO: 596318 - DNA, 20 bp, Artificial Sequence
  chemically synthesized
tccctgtttgcagacgacat

SEQ ID NO: 596319 - DNA, 20 bp, Artificial Sequence
  chemically synthesized
attgtccctgtttgcagacg

SEQ ID NO: 596320 - DNA, 20 bp, Artificial Sequence
  chemically synthesized
aaaagaggaagtcaaattgt

SEQ ID NO: 596321 - DNA, 20 bp, Artificial Sequence
  chemically synthesized
accttttatttccttctcct

SEQ ID NO: 596322 - DNA, 20 bp, Artificial Sequence
  chemically synthesized
agagggcatccctgtcttgt

SEQ ID NO: 596323 - DNA, 20 bp, Artificial Sequence
  chemically synthesized
cttgtgccagttttcaaagg

SEQ ID NO: 596324 - DNA, 20 bp, Artificial Sequence
  chemically synthesized
cagttttcaaagggaatgct

SEQ ID NO: 596325 - DNA, 20 bp, Artificial Sequence
  chemically synthesized
cattcagtatgatattggct

SEQ ID NO: 596326 - DNA, 20 bp, Artificial Sequence
  chemically synthesized
ccatcaatacctaatttatt

SEQ ID NO: 596327 - DNA, 20 bp, Artificial Sequence
  chemically synthesized
aagggttgttgaattttgtc

SEQ ID NO: 596328 - DNA, 20 bp, Artificial Sequence
  chemically synthesized
tgcatctattgagataatca

SEQ ID NO: 596329 - DNA, 20 bp, Artificial Sequence
  chemically synthesized
cagagccaaagacaaaaacc

SEQ ID NO: 596330 - DNA, 20 bp, Artificial Sequence
  chemically synthesized
catgtggtttttgtctttgg

SEQ ID NO: 596331 - DNA, 20 bp, Artificial Sequence
  chemically synthesized
gtctttggctctgtttatat

SEQ ID NO: 596332 - DNA, 20 bp, Artificial Sequence
  chemically synthesized
tttatatgctggattacatt

SEQ ID NO: 596333 - DNA, 20 bp, Artificial Sequence
  chemically synthesized
agcttatccaccatgatcaa

SEQ ID NO: 596334 - DNA, 20 bp, Artificial Sequence
  chemically synthesized
agcccacttgatcatggtgg

SEQ ID NO: 596335 - DNA, 20 bp, Artificial Sequence
  chemically synthesized
ccgaatccagcagcacatca

SEQ ID NO: 596336 - DNA, 20 bp, Artificial Sequence
  chemically synthesized
gataagctttttgatgtgct

SEQ ID NO: 596337 - DNA, 20 bp, Artificial Sequence
  chemically synthesized
tcggtatgccagtattttat

SEQ ID NO: 596338 - DNA, 20 bp, Artificial Sequence
  chemically synthesized
cttttttggttgtgtctctg

SEQ ID NO: 596339 - DNA, 20 bp, Artificial Sequence
  chemically synthesized
ggcctcataaaatgagttag

SEQ ID NO: 596340 - DNA, 20 bp, Artificial Sequence
  chemically synthesized
gggaggattccctctttttc

SEQ ID NO: 596341 - DNA, 20 bp, Artificial Sequence
  chemically synthesized
cctctttttctattgattgg

SEQ ID NO: 596342 - DNA, 20 bp, Artificial Sequence
  chemically synthesized
ccaaaaagagtccaggacca

SEQ ID NO: 596343 - DNA, 20 bp, Artificial Sequence
  chemically synthesized
actctttttggttggtaagc

SEQ ID NO: 596344 - DNA, 20 bp, Artificial Sequence
  chemically synthesized
ctgaaattgtggcaataatc

SEQ ID NO: 596345 - DNA, 20 bp, Artificial Sequence
  chemically synthesized
gctcctgttattggtctatt

SEQ ID NO: 596346 - DNA, 20 bp, Artificial Sequence
  chemically synthesized
attcagagattcaacttctt

SEQ ID NO: 596347 - DNA, 20 bp, Artificial Sequence
  chemically synthesized
cgaggaatgtatccatttct

SEQ ID NO: 596348 - DNA, 20 bp, Artificial Sequence
  chemically synthesized
tatccatttcttctagattt

SEQ ID NO: 596349 - DNA, 20 bp, Artificial Sequence
  chemically synthesized
tttctagtttatttgtgtag

SEQ ID NO: 596350 - DNA, 20 bp, Artificial Sequence
  chemically synthesized
tgtttgtagtattctctgac

SEQ ID NO: 596351 - DNA, 20 bp, Artificial Sequence
  chemically synthesized
gctggttgtgagccatgatt

SEQ ID NO: 596352 - DNA, 20 bp, Artificial Sequence
  chemically synthesized
taggtggtgctggttgtgag

SEQ ID NO: 596353 - DNA, 20 bp, Artificial Sequence
  chemically synthesized
ttgcatatgtagagcccaga

SEQ ID NO: 596354 - DNA, 20 bp, Artificial Sequence
  chemically synthesized
ggtgtgtgggtgtgtgtgca

SEQ ID NO: 596355 - DNA, 20 bp, Artificial Sequence
  chemically synthesized
atttaaattcagttgttgaa

SEQ ID NO: 596356 - DNA, 20 bp, Artificial Sequence
  chemically synthesized
agttgttgaaccaagtttga

SEQ ID NO: 596357 - DNA, 20 bp, Artificial Sequence
  chemically synthesized
gtaatacctctttctttgac

SEQ ID NO: 596358 - DNA, 20 bp, Artificial Sequence
  chemically synthesized
agaaagaggtattactgtaa

SEQ ID NO: 596359 - DNA, 20 bp, Artificial Sequence
  chemically synthesized
tctttacttatatatgtctt

SEQ ID NO: 596360 - DNA, 20 bp, Artificial Sequence
  chemically synthesized
caattatcaacatttgcgaa

SEQ ID NO: 596361 - DNA, 20 bp, Artificial Sequence
  chemically synthesized
gagcaatggaggaagattaa

SEQ ID NO: 596362 - DNA, 20 bp, Artificial Sequence
  chemically synthesized
ttaatataaagagcaatgga

SEQ ID NO: 596363 - DNA, 20 bp, Artificial Sequence
  chemically synthesized
atattaaaaataatttcctt

SEQ ID NO: 596364 - DNA, 20 bp, Artificial Sequence
  chemically synthesized
gaagtaatgtgattcgtggg

SEQ ID NO: 596365 - DNA, 20 bp, Artificial Sequence
  chemically synthesized
caggtgaagtaatgtgattc

SEQ ID NO: 596366 - DNA, 20 bp, Artificial Sequence
  chemically synthesized
aagtattttcaggtgaagta

SEQ ID NO: 596367 - DNA, 20 bp, Artificial Sequence
  chemically synthesized
ttggcatttattgctactat

SEQ ID NO: 596368 - DNA, 20 bp, Artificial Sequence
  chemically synthesized
caatatttaaaagaaatact

SEQ ID NO: 596369 - DNA, 20 bp, Artificial Sequence
  chemically synthesized
aattaaaaaataattgtcac

SEQ ID NO: 596370 - DNA, 20 bp, Artificial Sequence
  chemically synthesized
ttttatcttacataaagcca

SEQ ID NO: 596371 - DNA, 20 bp, Artificial Sequence
  chemically synthesized
caaatgtgtctctgaatcta

SEQ ID NO: 596372 - DNA, 20 bp, Artificial Sequence
  chemically synthesized
cactatttatatgtcaagga

SEQ ID NO: 596373 - DNA, 20 bp, Artificial Sequence
  chemically synthesized
ctttgtccttgacatataaa

SEQ ID NO: 596374 - DNA, 20 bp, Artificial Sequence
  chemically synthesized
gagaaattaaccagataatg

SEQ ID NO: 596375 - DNA, 20 bp, Artificial Sequence
  chemically synthesized
gagaaattatccagataatg

SEQ ID NO: 596376 - DNA, 20 bp, Artificial Sequence
  chemically synthesized
accaaagcaggactgtctaa

SEQ ID NO: 596377 - DNA, 20 bp, Artificial Sequence
  chemically synthesized
ccccaaactgtgttagacag

SEQ ID NO: 596378 - DNA, 20 bp, Artificial Sequence
  chemically synthesized
acagaaaggaattatgaact

SEQ ID NO: 596379 - DNA, 20 bp, Artificial Sequence
  chemically synthesized
gtatatataaatacagaaat

SEQ ID NO: 596380 - DNA, 20 bp, Artificial Sequence
  chemically synthesized
aaaactgaataacatataaa

SEQ ID NO: 596381 - DNA, 20 bp, Artificial Sequence
  chemically synthesized
aaatcagggtttatatgtta

SEQ ID NO: 596382 - DNA, 20 bp, Artificial Sequence
  chemically synthesized
caaagattagtgtgacccta

SEQ ID NO: 596383 - DNA, 20 bp, Artificial Sequence
  chemically synthesized
tagactcattattcattcaa

SEQ ID NO: 596384 - DNA, 20 bp, Artificial Sequence
  chemically synthesized
gaataatgagtctatgaatg

SEQ ID NO: 596385 - DNA, 20 bp, Artificial Sequence
  chemically synthesized
tctatgaatgaccagtttga

SEQ ID NO: 596386 - DNA, 20 bp, Artificial Sequence
  chemically synthesized
tgaagatgtatatttaaatg

SEQ ID NO: 596387 - DNA, 20 bp, Artificial Sequence
  chemically synthesized
gtggtcataattatgaaagt

SEQ ID NO: 596388 - DNA, 20 bp, Artificial Sequence
  chemically synthesized
cactttcataattatgacca

SEQ ID NO: 596389 - DNA, 20 bp, Artificial Sequence
  chemically synthesized
aattatgaccacattgattt

SEQ ID NO: 596390 - DNA, 20 bp, Artificial Sequence
  chemically synthesized
gaggttatactaattatttg

SEQ ID NO: 596391 - DNA, 20 bp, Artificial Sequence
  chemically synthesized
tttgagctgtttcttttcat

SEQ ID NO: 596392 - DNA, 20 bp, Artificial Sequence
  chemically synthesized
ttaatctttcttcgtagcat

SEQ ID NO: 596393 - DNA, 20 bp, Artificial Sequence
  chemically synthesized
ttaaacaatgatgctacgaa

SEQ ID NO: 596394 - DNA, 20 bp, Artificial Sequence
  chemically synthesized
tgaaggactggcaggtttgg

SEQ ID NO: 596395 - DNA, 20 bp, Artificial Sequence
  chemically synthesized
agtgaaaccatgaaggactg

SEQ ID NO: 596396 - DNA, 20 bp, Artificial Sequence
  chemically synthesized
ccccaaacctgccagtcctt

SEQ ID NO: 596397 - DNA, 20 bp, Artificial Sequence
  chemically synthesized
agaacggcattttcattaaa

SEQ ID NO: 596398 - DNA, 20 bp, Artificial Sequence
  chemically synthesized
ttatctcatatttgtggtag

SEQ ID NO: 596399 - DNA, 20 bp, Artificial Sequence
  chemically synthesized
ttatttaacaacagttgtat

SEQ ID NO: 596400 - DNA, 20 bp, Artificial Sequence
  chemically synthesized
ataaataactatatgacttc

SEQ ID NO: 596401 - DNA, 20 bp, Artificial Sequence
  chemically synthesized
tccaaaaaagaatatgataa

SEQ ID NO: 596402 - DNA, 20 bp, Artificial Sequence
  chemically synthesized
cttatcatattcttttttgg

SEQ ID NO: 596403 - DNA, 20 bp, Artificial Sequence
  chemically synthesized
acaattttaatttcttagtt

SEQ ID NO: 596404 - DNA, 20 bp, Artificial Sequence
  chemically synthesized
tataaagtgggtttctgagt

SEQ ID NO: 596405 - DNA, 20 bp, Artificial Sequence
  chemically synthesized
agaatataaagtgggtttct

SEQ ID NO: 596406 - DNA, 20 bp, Artificial Sequence
  chemically synthesized
actcagaaacccactttata

SEQ ID NO: 596407 - DNA, 20 bp, Artificial Sequence
  chemically synthesized
taatagaaacagaatataaa

SEQ ID NO: 596408 - DNA, 20 bp, Artificial Sequence
  chemically synthesized
atgagttaattactttgttt

SEQ ID NO: 596409 - DNA, 20 bp, Artificial Sequence
  chemically synthesized
tgtttgcaatgagttaatta

SEQ ID NO: 596410 - DNA, 20 bp, Artificial Sequence
  chemically synthesized
aggagttaaaattaatagta

SEQ ID NO: 596411 - DNA, 20 bp, Artificial Sequence
  chemically synthesized
ttatgaatggataattacaa

SEQ ID NO: 596412 - DNA, 20 bp, Artificial Sequence
  chemically synthesized
accttgtttttctagaatta

SEQ ID NO: 596413 - DNA, 20 bp, Artificial Sequence
  chemically synthesized
ctttaccttcattattattt

SEQ ID NO: 596414 - DNA, 20 bp, Artificial Sequence
  chemically synthesized
atgaacatcctattatttca

SEQ ID NO: 596415 - DNA, 20 bp, Artificial Sequence
  chemically synthesized
atcctttgttaacttatttg

SEQ ID NO: 596416 - DNA, 20 bp, Artificial Sequence
  chemically synthesized
gattcatcctttgttaactt

SEQ ID NO: 596417 - DNA, 20 bp, Artificial Sequence
  chemically synthesized
gaatatatatcattatatat

SEQ ID NO: 596418 - DNA, 20 bp, Artificial Sequence
  chemically synthesized
aggccaattcttagttagac

SEQ ID NO: 596419 - DNA, 20 bp, Artificial Sequence
  chemically synthesized
ataaccaaaataggttcagc

SEQ ID NO: 596420 - DNA, 20 bp, Artificial Sequence
  chemically synthesized
tttactgttgtgttcacatt

SEQ ID NO: 596421 - DNA, 20 bp, Artificial Sequence
  chemically synthesized
tgtgaacacaacagtaaaac

SEQ ID NO: 596422 - DNA, 20 bp, Artificial Sequence
  chemically synthesized
acacaacagtaaaacatatg

SEQ ID NO: 596423 - DNA, 20 bp, Artificial Sequence
  chemically synthesized
aaaattgatgaaaacaaaac

SEQ ID NO: 596424 - DNA, 20 bp, Artificial Sequence
  chemically synthesized
gtcagaactgcccaactgaa

SEQ ID NO: 596425 - DNA, 20 bp, Artificial Sequence
  chemically synthesized
tgaataaagttttgtaaaca

SEQ ID NO: 596426 - DNA, 20 bp, Artificial Sequence
  chemically synthesized
atttaaggaactataaagct

SEQ ID NO: 596427 - DNA, 20 bp, Artificial Sequence
  chemically synthesized
gctttgaaaattagagtaga

SEQ ID NO: 596428 - DNA, 20 bp, Artificial Sequence
  chemically synthesized
ttttgtgctttgaaaattag

SEQ ID NO: 596429 - DNA, 20 bp, Artificial Sequence
  chemically synthesized
tttcaaagcacaaaaaaata

SEQ ID NO: 596430 - DNA, 20 bp, Artificial Sequence
  chemically synthesized
ttgataagctttgtattttt

SEQ ID NO: 596431 - DNA, 20 bp, Artificial Sequence
  chemically synthesized
acattttagtaggatatttg

SEQ ID NO: 596432 - DNA, 20 bp, Artificial Sequence
  chemically synthesized
ctttgaatctatggtctccc

SEQ ID NO: 596433 - DNA, 20 bp, Artificial Sequence
  chemically synthesized
tcaccaaacaaatgggagac

SEQ ID NO: 596434 - DNA, 20 bp, Artificial Sequence
  chemically synthesized
cacttttccactttgttatt

SEQ ID NO: 596435 - DNA, 20 bp, Artificial Sequence
  chemically synthesized
cttgaaataacaaagtggaa

SEQ ID NO: 596436 - DNA, 20 bp, Artificial Sequence
  chemically synthesized
gtaaaataggcataatacag

SEQ ID NO: 596437 - DNA, 20 bp, Artificial Sequence
  chemically synthesized
tctgattgtgtgaatttttg

SEQ ID NO: 596438 - DNA, 20 bp, Artificial Sequence
  chemically synthesized
ttgccaaaaattcacacaat

SEQ ID NO: 596439 - DNA, 20 bp, Artificial Sequence
  chemically synthesized
tgaatcgtggctccatcaat

SEQ ID NO: 596440 - DNA, 20 bp, Artificial Sequence
  chemically synthesized
acaatcagagattgatggag

SEQ ID NO: 596441 - DNA, 20 bp, Artificial Sequence
  chemically synthesized
ggctttggaattagattgac

SEQ ID NO: 596442 - DNA, 20 bp, Artificial Sequence
  chemically synthesized
gttaagagcttggctttgga

SEQ ID NO: 596443 - DNA, 20 bp, Artificial Sequence
  chemically synthesized
gtctcagacacagttaagag

SEQ ID NO: 596444 - DNA, 20 bp, Artificial Sequence
  chemically synthesized
agtgagtctcagacacagtt

SEQ ID NO: 596445 - DNA, 20 bp, Artificial Sequence
  chemically synthesized
atccctggaaaagctacaaa

SEQ ID NO: 596446 - DNA, 20 bp, Artificial Sequence
  chemically synthesized
tgacaggagaaagccagatt

SEQ ID NO: 596447 - DNA, 20 bp, Artificial Sequence
  chemically synthesized
tcgaatattgacaggagaaa

SEQ ID NO: 596448 - DNA, 20 bp, Artificial Sequence
  chemically synthesized
atgaaggcaacctttataca

SEQ ID NO: 596449 - DNA, 20 bp, Artificial Sequence
  chemically synthesized
ccaggataacctgtcctcag

SEQ ID NO: 596450 - DNA, 20 bp, Artificial Sequence
  chemically synthesized
tatggtatggttctagggtt

SEQ ID NO: 596451 - DNA, 20 bp, Artificial Sequence
  chemically synthesized
cataccaaacttccttcatt

SEQ ID NO: 596452 - DNA, 20 bp, Artificial Sequence
  chemically synthesized
agttttaatcagaaaatgaa

SEQ ID NO: 596453 - DNA, 20 bp, Artificial Sequence
  chemically synthesized
aagtgggacattatgtacaa

SEQ ID NO: 596454 - DNA, 20 bp, Artificial Sequence
  chemically synthesized
cttgtgtacttaatggttca

SEQ ID NO: 596455 - DNA, 20 bp, Artificial Sequence
  chemically synthesized
tcatcttgttcttagaaagt

SEQ ID NO: 596456 - DNA, 20 bp, Artificial Sequence
  chemically synthesized
tagcagaaataataatactt

SEQ ID NO: 596457 - DNA, 20 bp, Artificial Sequence
  chemically synthesized
ttttatagaatcttctcaat

SEQ ID NO: 596458 - DNA, 20 bp, Artificial Sequence
  chemically synthesized
ctcctaaaaatcctccattg

SEQ ID NO: 596459 - DNA, 20 bp, Artificial Sequence
  chemically synthesized
cttctcaatggaggattttt

SEQ ID NO: 596460 - DNA, 20 bp, Artificial Sequence
  chemically synthesized
taggagcttcacatgtatat

SEQ ID NO: 596461 - DNA, 20 bp, Artificial Sequence
  chemically synthesized
catgtatattactgattgcg

SEQ ID NO: 596462 - DNA, 20 bp, Artificial Sequence
  chemically synthesized
tctcagtgggagtattggaa

SEQ ID NO: 596463 - DNA, 20 bp, Artificial Sequence
  chemically synthesized
ttaaaaaatcccacttcctc

SEQ ID NO: 596464 - DNA, 20 bp, Artificial Sequence
  chemically synthesized
gattgtaagcagaagaggaa

SEQ ID NO: 596465 - DNA, 20 bp, Artificial Sequence
  chemically synthesized
ttatcactttgaagacagag

SEQ ID NO: 596466 - DNA, 20 bp, Artificial Sequence
  chemically synthesized
ccacatttaccatttttatt

SEQ ID NO: 596467 - DNA, 20 bp, Artificial Sequence
  chemically synthesized
cacataataaaaatggtaaa

SEQ ID NO: 596468 - DNA, 20 bp, Artificial Sequence
  chemically synthesized
ttaatagaaaagagagaaaa

SEQ ID NO: 596469 - DNA, 20 bp, Artificial Sequence
  chemically synthesized
aatattttctctcttttcta

SEQ ID NO: 596470 - DNA, 20 bp, Artificial Sequence
  chemically synthesized
tttctattaagctttatttg

SEQ ID NO: 596471 - DNA, 20 bp, Artificial Sequence
  chemically synthesized
aacctgctaaactaggcaaa

SEQ ID NO: 596472 - DNA, 20 bp, Artificial Sequence
  chemically synthesized
agctttatttgcctagttta

SEQ ID NO: 596473 - DNA, 20 bp, Artificial Sequence
  chemically synthesized
tttagcaggttttatttttc

SEQ ID NO: 596474 - DNA, 20 bp, Artificial Sequence
  chemically synthesized
tcaaaaggaaattaatgagc

SEQ ID NO: 596475 - DNA, 20 bp, Artificial Sequence
  chemically synthesized
gcagaactgtgtaccaagaa

SEQ ID NO: 596476 - DNA, 20 bp, Artificial Sequence
  chemically synthesized
ggtacacagttctgcctccc

SEQ ID NO: 596477 - DNA, 20 bp, Artificial Sequence
  chemically synthesized
tcccatctcctattgctttt

SEQ ID NO: 596478 - DNA, 20 bp, Artificial Sequence
  chemically synthesized
caatgccttctcccatctcc

SEQ ID NO: 596479 - DNA, 20 bp, Artificial Sequence
  chemically synthesized
attggaagtggctgaccata

SEQ ID NO: 596480 - DNA, 20 bp, Artificial Sequence
  chemically synthesized
catatggtcagccacttcca

SEQ ID NO: 596481 - DNA, 20 bp, Artificial Sequence
  chemically synthesized
tgaacactatcactgctgtc

SEQ ID NO: 596482 - DNA, 20 bp, Artificial Sequence
  chemically synthesized
ggacagtaatggacaccagc

SEQ ID NO: 596483 - DNA, 20 bp, Artificial Sequence
  chemically synthesized
ggtgtccattactgtccact

SEQ ID NO: 596484 - DNA, 20 bp, Artificial Sequence
  chemically synthesized
tgctttgtgaaactacatct

SEQ ID NO: 596485 - DNA, 20 bp, Artificial Sequence
  chemically synthesized
gtatgaagaaagccaggaga

SEQ ID NO: 596486 - DNA, 20 bp, Artificial Sequence
  chemically synthesized
cctggctttcttcatacctc

SEQ ID NO: 596487 - DNA, 20 bp, Artificial Sequence
  chemically synthesized
ctgcaaaggacatgaagtca

SEQ ID NO: 596488 - DNA, 20 bp, Artificial Sequence
  chemically synthesized
gtttgctaagaatgatggtt

SEQ ID NO: 596489 - DNA, 20 bp, Artificial Sequence
  chemically synthesized
tgtgttagtttgctaagaat

SEQ ID NO: 596490 - DNA, 20 bp, Artificial Sequence
  chemically synthesized
gtttcattttctgttcctgt

SEQ ID NO: 596491 - DNA, 20 bp, Artificial Sequence
  chemically synthesized
cacttacgagtgagtccatg

SEQ ID NO: 596492 - DNA, 20 bp, Artificial Sequence
  chemically synthesized
cataggtatacacgtgctat

SEQ ID NO: 596493 - DNA, 20 bp, Artificial Sequence
  chemically synthesized
gggatacaggtgcagaacgt

SEQ ID NO: 596494 - DNA, 20 bp, Artificial Sequence
  chemically synthesized
aattaaaaaaaaaagttcct

SEQ ID NO: 596495 - DNA, 20 bp, Artificial Sequence
  chemically synthesized
cctaaagagagactgtaggt

SEQ ID NO: 596496 - DNA, 20 bp, Artificial Sequence
  chemically synthesized
cttggtcacagatatttcat

SEQ ID NO: 596497 - DNA, 20 bp, Artificial Sequence
  chemically synthesized
atttcatccacgtttcatgt

SEQ ID NO: 596498 - DNA, 20 bp, Artificial Sequence
  chemically synthesized
gatttggaggtggagacctt

SEQ ID NO: 596499 - DNA, 20 bp, Artificial Sequence
  chemically synthesized
ctggagaacagaaaagaagg

SEQ ID NO: 596500 - DNA, 20 bp, Artificial Sequence
  chemically synthesized
agctattagtagcaactttt

SEQ ID NO: 596501 - DNA, 20 bp, Artificial Sequence
  chemically synthesized
cattaacataagtatcaaag

SEQ ID NO: 596502 - DNA, 20 bp, Artificial Sequence
  chemically synthesized
ttccacttccattgccatct

SEQ ID NO: 596503 - DNA, 20 bp, Artificial Sequence
  chemically synthesized
ttgccatctcaaggcttggt

SEQ ID NO: 596504 - DNA, 20 bp, Artificial Sequence
  chemically synthesized
tttggtattctaagtggcca

SEQ ID NO: 596505 - DNA, 20 bp, Artificial Sequence
  chemically synthesized
cagggaggttccctaaagta

SEQ ID NO: 596506 - DNA, 20 bp, Artificial Sequence
  chemically synthesized
tacattgttttcagcaaaaa

SEQ ID NO: 596507 - DNA, 20 bp, Artificial Sequence
  chemically synthesized
cagcaaggtagtgacataat

SEQ ID NO: 596508 - DNA, 20 bp, Artificial Sequence
  chemically synthesized
cgcctcatcctcttaaaatg

SEQ ID NO: 596509 - DNA, 20 bp, Artificial Sequence
  chemically synthesized
cattttaagaggatgaggcg

SEQ ID NO: 596510 - DNA, 20 bp, Artificial Sequence
  chemically synthesized
ttaagaggatgaggcgggag

SEQ ID NO: 596511 - DNA, 20 bp, Artificial Sequence
  chemically synthesized
tctaagtttctaaggctgat

SEQ ID NO: 596512 - DNA, 20 bp, Artificial Sequence
  chemically synthesized
gacagggtcttgttacgttt

SEQ ID NO: 596513 - DNA, 20 bp, Artificial Sequence
  chemically synthesized
tttgaagagacagggtcttg

SEQ ID NO: 596514 - DNA, 20 bp, Artificial Sequence
  chemically synthesized
agaccctgtctcttcaaaat

SEQ ID NO: 596515 - DNA, 20 bp, Artificial Sequence
  chemically synthesized
ctcccatatcaccctcctac

SEQ ID NO: 596516 - DNA, 20 bp, Artificial Sequence
  chemically synthesized
tgaggtaggagggtgatatg

SEQ ID NO: 596517 - DNA, 20 bp, Artificial Sequence
  chemically synthesized
gtaggagggtgatatgggag

SEQ ID NO: 596518 - DNA, 20 bp, Artificial Sequence
  chemically synthesized
actccagcctgggcaacaga

SEQ ID NO: 596519 - DNA, 20 bp, Artificial Sequence
  chemically synthesized
tttattttttgattcttaaa

SEQ ID NO: 596520 - DNA, 20 bp, Artificial Sequence
  chemically synthesized
aaaaccattacaagtttatt

SEQ ID NO: 596521 - DNA, 20 bp, Artificial Sequence
  chemically synthesized
gaatcaaaaaataaacttgt

SEQ ID NO: 596522 - DNA, 20 bp, Artificial Sequence
  chemically synthesized
aagtgcaacggaaaaccatt

SEQ ID NO: 596523 - DNA, 20 bp, Artificial Sequence
  chemically synthesized
ttgtaggccacaaaaataag

SEQ ID NO: 596524 - DNA, 20 bp, Artificial Sequence
  chemically synthesized
ggtgagagagggagagcgtg

SEQ ID NO: 596525 - DNA, 20 bp, Artificial Sequence
  chemically synthesized
tctcaccataccccatacac

SEQ ID NO: 596526 - DNA, 20 bp, Artificial Sequence
  chemically synthesized
ctctttactgagttgcaggt

SEQ ID NO: 596527 - DNA, 20 bp, Artificial Sequence
  chemically synthesized
ttttcattcatagcacctac

SEQ ID NO: 596528 - DNA, 20 bp, Artificial Sequence
  chemically synthesized
ttgtaaatatacactcatgt

SEQ ID NO: 596529 - DNA, 20 bp, Artificial Sequence
  chemically synthesized
gtttctgcctttttggagct

SEQ ID NO: 596530 - DNA, 20 bp, Artificial Sequence
  chemically synthesized
acagaaattaacaaagaaca

SEQ ID NO: 596531 - DNA, 20 bp, Artificial Sequence
  chemically synthesized
gtgttctttgttaatttctg

SEQ ID NO: 596532 - DNA, 20 bp, Artificial Sequence
  chemically synthesized
aatgaatacagaaataaaaa

SEQ ID NO: 596533 - DNA, 20 bp, Artificial Sequence
  chemically synthesized
atatttatatatttatttat

SEQ ID NO: 596534 - DNA, 20 bp, Artificial Sequence
  chemically synthesized
ataaatatatataaatatat

SEQ ID NO: 596535 - DNA, 20 bp, Artificial Sequence
  chemically synthesized
tatatttatattcaacggta

SEQ ID NO: 596536 - DNA, 20 bp, Artificial Sequence
  chemically synthesized
atggtttataaaactttccc

SEQ ID NO: 596537 - DNA, 20 bp, Artificial Sequence
  chemically synthesized
accaatacttaatcgatcgg

SEQ ID NO: 596538 - DNA, 20 bp, Artificial Sequence
  chemically synthesized
gagtcagagaagtgagggaa

SEQ ID NO: 596539 - DNA, 20 bp, Artificial Sequence
  chemically synthesized
atctcaaagatggtagataa

SEQ ID NO: 596540 - DNA, 20 bp, Artificial Sequence
  chemically synthesized
accatctttgagatatcatg

SEQ ID NO: 596541 - DNA, 20 bp, Artificial Sequence
  chemically synthesized
catggtgagatttaaggata

SEQ ID NO: 596542 - DNA, 20 bp, Artificial Sequence
  chemically synthesized
gtctttaagaacctcataga

SEQ ID NO: 596543 - DNA, 20 bp, Artificial Sequence
  chemically synthesized
atgaaaaaattgaggcggcc

SEQ ID NO: 596544 - DNA, 20 bp, Artificial Sequence
  chemically synthesized
ttgaggcggccaagggtttg

SEQ ID NO: 596545 - DNA, 20 bp, Artificial Sequence
  chemically synthesized
atcgacactaagagaataga

SEQ ID NO: 596546 - DNA, 20 bp, Artificial Sequence
  chemically synthesized
ctggtcacttagctgactga

SEQ ID NO: 596547 - DNA, 20 bp, Artificial Sequence
  chemically synthesized
aaacttcctacaaagagaga

SEQ ID NO: 596548 - DNA, 20 bp, Artificial Sequence
  chemically synthesized
aaacagcttctctctttgta

SEQ ID NO: 596549 - DNA, 20 bp, Artificial Sequence
  chemically synthesized
tcgttctgccatatgcccta

SEQ ID NO: 596550 - DNA, 20 bp, Artificial Sequence
  chemically synthesized
agaacgatgtaaagtgcaga

SEQ ID NO: 596551 - DNA, 20 bp, Artificial Sequence
  chemically synthesized
aagtgcagaatatgcttagc

SEQ ID NO: 596552 - DNA, 20 bp, Artificial Sequence
  chemically synthesized
attgtcccaaagctcttggg

SEQ ID NO: 596553 - DNA, 20 bp, Artificial Sequence
  chemically synthesized
tcaccaaataaacatctccc

SEQ ID NO: 596554 - DNA, 20 bp, Artificial Sequence
  chemically synthesized
gggctgacaatataaagtga

SEQ ID NO: 596555 - DNA, 20 bp, Artificial Sequence
  chemically synthesized
cttactcatcagggtctgat

SEQ ID NO: 596556 - DNA, 20 bp, Artificial Sequence
  chemically synthesized
ttatctctatatcaatctaa

SEQ ID NO: 596557 - DNA, 20 bp, Artificial Sequence
  chemically synthesized
aaaaaaaagattaaatcaat

SEQ ID NO: 596558 - DNA, 20 bp, Artificial Sequence
  chemically synthesized
tacatctcaaaaaaaaaaaa

SEQ ID NO: 596559 - DNA, 20 bp, Artificial Sequence
  chemically synthesized
aacctccgcctgctgggttc

SEQ ID NO: 596560 - DNA, 20 bp, Artificial Sequence
  chemically synthesized
actaaaaatacaaaaattag

SEQ ID NO: 596561 - DNA, 20 bp, Artificial Sequence
  chemically synthesized
ttttgtatttttagtagaga

SEQ ID NO: 596562 - DNA, 20 bp, Artificial Sequence
  chemically synthesized
gggtttcaccatattggcta

SEQ ID NO: 596563 - DNA, 20 bp, Artificial Sequence
  chemically synthesized
cactttgggaggctgagacg

SEQ ID NO: 596564 - DNA, 20 bp, Artificial Sequence
  chemically synthesized
cgtctcagcctcccaaagtg

SEQ ID NO: 596565 - DNA, 20 bp, Artificial Sequence
  chemically synthesized
gtgagccaccacgcctggtc

SEQ ID NO: 596566 - DNA, 20 bp, Artificial Sequence
  chemically synthesized
atcctcatcttctttttcct

SEQ ID NO: 596567 - DNA, 20 bp, Artificial Sequence
  chemically synthesized
aaatgaaaactcttctgcaa

SEQ ID NO: 596568 - DNA, 20 bp, Artificial Sequence
  chemically synthesized
tttaataaactcttttgcag

SEQ ID NO: 596569 - DNA, 20 bp, Artificial Sequence
  chemically synthesized
tcttctgcaaaagagtttat

SEQ ID NO: 596570 - DNA, 20 bp, Artificial Sequence
  chemically synthesized
tttattaaagcttatttatt

SEQ ID NO: 596571 - DNA, 20 bp, Artificial Sequence
  chemically synthesized
caaaaacaaacaaagaataa

SEQ ID NO: 596572 - DNA, 20 bp, Artificial Sequence
  chemically synthesized
ttaaagcttatttattcttt

SEQ ID NO: 596573 - DNA, 20 bp, Artificial Sequence
  chemically synthesized
aacctccgcctcctgggttc

SEQ ID NO: 596574 - DNA, 20 bp, Artificial Sequence
  chemically synthesized
tgcctcagcctcccaagtag

SEQ ID NO: 596575 - DNA, 20 bp, Artificial Sequence
  chemically synthesized
aattggccaggcgtgttggc

SEQ ID NO: 596576 - DNA, 20 bp, Artificial Sequence
  chemically synthesized
ttttgtatttttagcagaga

SEQ ID NO: 596577 - DNA, 20 bp, Artificial Sequence
  chemically synthesized
cacctcggcctctcaaattg

SEQ ID NO: 596578 - DNA, 20 bp, Artificial Sequence
  chemically synthesized
accacacctggcctattctt

SEQ ID NO: 596579 - DNA, 20 bp, Artificial Sequence
  chemically synthesized
gtggtgtggtagagataaga

SEQ ID NO: 596580 - DNA, 20 bp, Artificial Sequence
  chemically synthesized
atacattattcacttgctag

SEQ ID NO: 596581 - DNA, 20 bp, Artificial Sequence
  chemically synthesized
tacattttcgttacttgatt

SEQ ID NO: 596582 - DNA, 20 bp, Artificial Sequence
  chemically synthesized
atgacagttacattttcgtt

SEQ ID NO: 596583 - DNA, 20 bp, Artificial Sequence
  chemically synthesized
aaagaagttcacagtgtgta

SEQ ID NO: 596584 - DNA, 20 bp, Artificial Sequence
  chemically synthesized
gaggtgagagagatggagaa

SEQ ID NO: 596585 - DNA, 20 bp, Artificial Sequence
  chemically synthesized
aagtacacaaataacaaata

SEQ ID NO: 596586 - DNA, 20 bp, Artificial Sequence
  chemically synthesized
aacatgattcataatgtgaa

SEQ ID NO: 596587 - DNA, 20 bp, Artificial Sequence
  chemically synthesized
tattagtgagcagtaatgag

SEQ ID NO: 596588 - DNA, 20 bp, Artificial Sequence
  chemically synthesized
ttactgctcactaataggaa

SEQ ID NO: 596589 - DNA, 20 bp, Artificial Sequence
  chemically synthesized
tatatcagcaatttgggcac

SEQ ID NO: 596590 - DNA, 20 bp, Artificial Sequence
  chemically synthesized
gttttggagatagatggtgg

SEQ ID NO: 596591 - DNA, 20 bp, Artificial Sequence
  chemically synthesized
agtttcagtttagaaagatg

SEQ ID NO: 596592 - DNA, 20 bp, Artificial Sequence
  chemically synthesized
ttgtgtcattggtatagagt

SEQ ID NO: 596593 - DNA, 20 bp, Artificial Sequence
  chemically synthesized
cagttcttgtgtcattggta

SEQ ID NO: 596594 - DNA, 20 bp, Artificial Sequence
  chemically synthesized
atccatacagcagaacagta

SEQ ID NO: 596595 - DNA, 20 bp, Artificial Sequence
  chemically synthesized
tgttctgctgtatggataca

SEQ ID NO: 596596 - DNA, 20 bp, Artificial Sequence
  chemically synthesized
tgctgtatggatacaccacg

SEQ ID NO: 596597 - DNA, 20 bp, Artificial Sequence
  chemically synthesized
ggtcagtgtacacagtgtac

SEQ ID NO: 596598 - DNA, 20 bp, Artificial Sequence
  chemically synthesized
gtacaaatatctgtgtgaat

SEQ ID NO: 596599 - DNA, 20 bp, Artificial Sequence
  chemically synthesized
tttattttaagaactagtct

SEQ ID NO: 596600 - DNA, 20 bp, Artificial Sequence
  chemically synthesized
ctagtcttgtagtttaaaaa

SEQ ID NO: 596601 - DNA, 20 bp, Artificial Sequence
  chemically synthesized
gacaatatgtaaatgaatga

SEQ ID NO: 596602 - DNA, 20 bp, Artificial Sequence
  chemically synthesized
ttcatttacatattgtctat

SEQ ID NO: 596603 - DNA, 20 bp, Artificial Sequence
  chemically synthesized
gcaaaaaaaaaaaaaaatgg

SEQ ID NO: 596604 - DNA, 20 bp, Artificial Sequence
  chemically synthesized
ggaacaagatagtaaatatt

SEQ ID NO: 596605 - DNA, 20 bp, Artificial Sequence
  chemically synthesized
actatcttgttccttacaga

SEQ ID NO: 596606 - DNA, 20 bp, Artificial Sequence
  chemically synthesized
caaaattgcagtagcaattc

SEQ ID NO: 596607 - DNA, 20 bp, Artificial Sequence
  chemically synthesized
tcttttaactgtttgaagac

SEQ ID NO: 596608 - DNA, 20 bp, Artificial Sequence
  chemically synthesized
cccaacatgaaaggtctttt

SEQ ID NO: 596609 - DNA, 20 bp, Artificial Sequence
  chemically synthesized
gtaggccgagaataaaatta

SEQ ID NO: 596610 - DNA, 20 bp, Artificial Sequence
  chemically synthesized
catgtggcattcagcacttt

SEQ ID NO: 596611 - DNA, 20 bp, Artificial Sequence
  chemically synthesized
taatattggattaacttcct

SEQ ID NO: 596612 - DNA, 20 bp, Artificial Sequence
  chemically synthesized
aatgaggtctggatattaat

SEQ ID NO: 596613 - DNA, 20 bp, Artificial Sequence
  chemically synthesized
aactctgtgatttgtgatga

SEQ ID NO: 596614 - DNA, 20 bp, Artificial Sequence
  chemically synthesized
tataaagaagtaaaataact

SEQ ID NO: 596615 - DNA, 20 bp, Artificial Sequence
  chemically synthesized
ttgatatagggaaagtatat

SEQ ID NO: 596616 - DNA, 20 bp, Artificial Sequence
  chemically synthesized
atactttccctatatcaatg

SEQ ID NO: 596617 - DNA, 20 bp, Artificial Sequence
  chemically synthesized
ccctatatcaatgcgatgtt

SEQ ID NO: 596618 - DNA, 20 bp, Artificial Sequence
  chemically synthesized
tgtgaaatcatttgtcctcc

SEQ ID NO: 596619 - DNA, 20 bp, Artificial Sequence
  chemically synthesized
aatccaagcttttggaggac

SEQ ID NO: 596620 - DNA, 20 bp, Artificial Sequence
  chemically synthesized
aatcatttgtcctccaaaag

SEQ ID NO: 596621 - DNA, 20 bp, Artificial Sequence
  chemically synthesized
gaatctgttatattttaaat

SEQ ID NO: 596622 - DNA, 20 bp, Artificial Sequence
  chemically synthesized
aaagcttggatttaaaatat

SEQ ID NO: 596623 - DNA, 20 bp, Artificial Sequence
  chemically synthesized
atctttaacattccaggcaa

SEQ ID NO: 596624 - DNA, 20 bp, Artificial Sequence
  chemically synthesized
ttttatactccactgtcaat

SEQ ID NO: 596625 - DNA, 20 bp, Artificial Sequence
  chemically synthesized
ctctttgtaggtctctagga

SEQ ID NO: 596626 - DNA, 20 bp, Artificial Sequence
  chemically synthesized
atgcacccaatacaggagca

SEQ ID NO: 596627 - DNA, 20 bp, Artificial Sequence
  chemically synthesized
ctttgtctttcttgatcttt

SEQ ID NO: 596628 - DNA, 20 bp, Artificial Sequence
  chemically synthesized
ttgatctttgttggtttaaa

SEQ ID NO: 596629 - DNA, 20 bp, Artificial Sequence
  chemically synthesized
aaagtctgttttatcagaga

SEQ ID NO: 596630 - DNA, 20 bp, Artificial Sequence
  chemically synthesized
tcagagactaggattgtaac

SEQ ID NO: 596631 - DNA, 20 bp, Artificial Sequence
  chemically synthesized
ttttttttaattttttattt

SEQ ID NO: 596632 - DNA, 20 bp, Artificial Sequence
  chemically synthesized
tttttatttttttgctttcc

SEQ ID NO: 596633 - DNA, 20 bp, Artificial Sequence
  chemically synthesized
tggaaaatattccgccatcc

SEQ ID NO: 596634 - DNA, 20 bp, Artificial Sequence
  chemically synthesized
cctttgctttgagcctatgt

SEQ ID NO: 596635 - DNA, 20 bp, Artificial Sequence
  chemically synthesized
ttattttgcctgttagttga

SEQ ID NO: 596636 - DNA, 20 bp, Artificial Sequence
  chemically synthesized
tcgatggtctttacaatttg

SEQ ID NO: 596637 - DNA, 20 bp, Artificial Sequence
  chemically synthesized
tgtttctctcagtggctggt

SEQ ID NO: 596638 - DNA, 20 bp, Artificial Sequence
  chemically synthesized
ctggtaccggtttttccttt

SEQ ID NO: 596639 - DNA, 20 bp, Artificial Sequence
  chemically synthesized
cggtttttcctttccatgtt

SEQ ID NO: 596640 - DNA, 20 bp, Artificial Sequence
  chemically synthesized
gtgattttgtcaccaccagg

SEQ ID NO: 596641 - DNA, 20 bp, Artificial Sequence
  chemically synthesized
tggtgacaaaatcactcagc

SEQ ID NO: 596642 - DNA, 20 bp, Artificial Sequence
  chemically synthesized
tttacagacaagcaaatgct

SEQ ID NO: 596643 - DNA, 20 bp, Artificial Sequence
  chemically synthesized
ctcagcatttgcttgtctgt

SEQ ID NO: 596644 - DNA, 20 bp, Artificial Sequence
  chemically synthesized
tgtaaaggattttatttctc

SEQ ID NO: 596645 - DNA, 20 bp, Artificial Sequence
  chemically synthesized
tttctcctttgcttatgaaa

SEQ ID NO: 596646 - DNA, 20 bp, Artificial Sequence
  chemically synthesized
gaatttcatatccagccaaa

SEQ ID NO: 596647 - DNA, 20 bp, Artificial Sequence
  chemically synthesized
aatattggcacccactctct

SEQ ID NO: 596648 - DNA, 20 bp, Artificial Sequence
  chemically synthesized
acccactctcttctagcttg

SEQ ID NO: 596649 - DNA, 20 bp, Artificial Sequence
  chemically synthesized
agtgatccactgttagtctg

SEQ ID NO: 596650 - DNA, 20 bp, Artificial Sequence
  chemically synthesized
gaatgcttgtgatcttttca

SEQ ID NO: 596651 - DNA, 20 bp, Artificial Sequence
  chemically synthesized
tgtctattcttggtgtatag

SEQ ID NO: 596652 - DNA, 20 bp, Artificial Sequence
  chemically synthesized
agttcacccacgatttggct

SEQ ID NO: 596653 - DNA, 20 bp, Artificial Sequence
  chemically synthesized
aattgtgaataggagttcac

SEQ ID NO: 596654 - DNA, 20 bp, Artificial Sequence
  chemically synthesized
cctttcgtattttcttgaac

SEQ ID NO: 596655 - DNA, 20 bp, Artificial Sequence
  chemically synthesized
gagcatgaaatgttttttcc

SEQ ID NO: 596656 - DNA, 20 bp, Artificial Sequence
  chemically synthesized
tcttcctaaccacgagcatg

SEQ ID NO: 596657 - DNA, 20 bp, Artificial Sequence
  chemically synthesized
cagtatggccattttcactc

SEQ ID NO: 596658 - DNA, 20 bp, Artificial Sequence
  chemically synthesized
ccatactgtccaaattaatt

SEQ ID NO: 596659 - DNA, 20 bp, Artificial Sequence
  chemically synthesized
catttcagatggaaccaaaa

SEQ ID NO: 596660 - DNA, 20 bp, Artificial Sequence
  chemically synthesized
tccagctttgttcattttac

SEQ ID NO: 596661 - DNA, 20 bp, Artificial Sequence
  chemically synthesized
aagtcaggtagcatgatgcc

SEQ ID NO: 596662 - DNA, 20 bp, Artificial Sequence
  chemically synthesized
tgcttactgtagccttgtag

SEQ ID NO: 596663 - DNA, 20 bp, Artificial Sequence
  chemically synthesized
ttgctaccagtaccagtctg

SEQ ID NO: 596664 - DNA, 20 bp, Artificial Sequence
  chemically synthesized
ctgttttgctaccagtacca

SEQ ID NO: 596665 - DNA, 20 bp, Artificial Sequence
  chemically synthesized
tctgttccattggtctatat

SEQ ID NO: 596666 - DNA, 20 bp, Artificial Sequence
  chemically synthesized
ttccccgttgcttgtttttg

SEQ ID NO: 596667 - DNA, 20 bp, Artificial Sequence
  chemically synthesized
gacaaaaacaagcaacgggg

SEQ ID NO: 596668 - DNA, 20 bp, Artificial Sequence
  chemically synthesized
tagggaatcctttccccgtt

SEQ ID NO: 596669 - DNA, 20 bp, Artificial Sequence
  chemically synthesized
taaatagggaatcctttccc

SEQ ID NO: 596670 - DNA, 20 bp, Artificial Sequence
  chemically synthesized
ccgttttctgcatatgacta

SEQ ID NO: 596671 - DNA, 20 bp, Artificial Sequence
  chemically synthesized
gggtaaggaaggggtccagt

SEQ ID NO: 596672 - DNA, 20 bp, Artificial Sequence
  chemically synthesized
tataaggggtaaggaagggg

SEQ ID NO: 596673 - DNA, 20 bp, Artificial Sequence
  chemically synthesized
taagtctttaatgcatcttg

SEQ ID NO: 596674 - DNA, 20 bp, Artificial Sequence
  chemically synthesized
ggttttgatggttttcggtt

SEQ ID NO: 596675 - DNA, 20 bp, Artificial Sequence
  chemically synthesized
cttctagggttttgatggtt

SEQ ID NO: 596676 - DNA, 20 bp, Artificial Sequence
  chemically synthesized
aggttttcttctagggtttt

SEQ ID NO: 596677 - DNA, 20 bp, Artificial Sequence
  chemically synthesized
gtattgcctaggttttcttc

SEQ ID NO: 596678 - DNA, 20 bp, Artificial Sequence
  chemically synthesized
tgtgtcctgaatggtattgc

SEQ ID NO: 596679 - DNA, 20 bp, Artificial Sequence
  chemically synthesized
gcttttgttgctgttgcttt

SEQ ID NO: 596680 - DNA, 20 bp, Artificial Sequence
  chemically synthesized
tcaattttggcttttgttgc

SEQ ID NO: 596681 - DNA, 20 bp, Artificial Sequence
  chemically synthesized
attagatcccatttgtcaat

SEQ ID NO: 596682 - DNA, 20 bp, Artificial Sequence
  chemically synthesized
aatgggatctaatgaaacta

SEQ ID NO: 596683 - DNA, 20 bp, Artificial Sequence
  chemically synthesized
cttttgcagtgtagaagctc

SEQ ID NO: 596684 - DNA, 20 bp, Artificial Sequence
  chemically synthesized
gtttgcctgttcactctcat

SEQ ID NO: 596685 - DNA, 20 bp, Artificial Sequence
  chemically synthesized
atgagagtgaacaggcaaac

SEQ ID NO: 596686 - DNA, 20 bp, Artificial Sequence
  chemically synthesized
gcaaaaattttctcccaatc

SEQ ID NO: 596687 - DNA, 20 bp, Artificial Sequence
  chemically synthesized
tattagccctttgtcagatg

SEQ ID NO: 596688 - DNA, 20 bp, Artificial Sequence
  chemically synthesized
gtaaatttgtttaagttcct

SEQ ID NO: 596689 - DNA, 20 bp, Artificial Sequence
  chemically synthesized
ggtttttttttttcttgtaa

SEQ ID NO: 596690 - DNA, 20 bp, Artificial Sequence
  chemically synthesized
tatccttagcccactttctg

SEQ ID NO: 596691 - DNA, 20 bp, Artificial Sequence
  chemically synthesized
gtttgctggctgcataaatg

SEQ ID NO: 596692 - DNA, 20 bp, Artificial Sequence
  chemically synthesized
gtgataatgagctttttttg

SEQ ID NO: 596693 - DNA, 20 bp, Artificial Sequence
  chemically synthesized
tcctctaatgaccagtgata

SEQ ID NO: 596694 - DNA, 20 bp, Artificial Sequence
  chemically synthesized
gagatggtatctcattgtgg

SEQ ID NO: 596695 - DNA, 20 bp, Artificial Sequence
  chemically synthesized
ggtgtgagatggtatctcat

SEQ ID NO: 596696 - DNA, 20 bp, Artificial Sequence
  chemically synthesized
gagaggatgtggagaaaaag

SEQ ID NO: 596697 - DNA, 20 bp, Artificial Sequence
  chemically synthesized
ctgtcttccacaatggttga

SEQ ID NO: 596698 - DNA, 20 bp, Artificial Sequence
  chemically synthesized
aaccattgtggaagacagtg

SEQ ID NO: 596699 - DNA, 20 bp, Artificial Sequence
  chemically synthesized
ctttgggtatatatgcagta

SEQ ID NO: 596700 - DNA, 20 bp, Artificial Sequence
  chemically synthesized
gtgcatgtgtctttatagga

SEQ ID NO: 596701 - DNA, 20 bp, Artificial Sequence
  chemically synthesized
ctataaagacacatgcacac

SEQ ID NO: 596702 - DNA, 20 bp, Artificial Sequence
  chemically synthesized
gtttgctgagaatgatggtt

SEQ ID NO: 596703 - DNA, 20 bp, Artificial Sequence
  chemically synthesized
tgtgttagtttgctgagaat

SEQ ID NO: 596704 - DNA, 20 bp, Artificial Sequence
  chemically synthesized
gtttggttttctgttcctgt

SEQ ID NO: 596705 - DNA, 20 bp, Artificial Sequence
  chemically synthesized
atgggtgagaatatgtggtg

SEQ ID NO: 596706 - DNA, 20 bp, Artificial Sequence
  chemically synthesized
cacttatgggtgagaatatg

SEQ ID NO: 596707 - DNA, 20 bp, Artificial Sequence
  chemically synthesized
cataggtgtacacgttccat

SEQ ID NO: 596708 - DNA, 20 bp, Artificial Sequence
  chemically synthesized
gggacacacgtgcagaacgg

SEQ ID NO: 596709 - DNA, 20 bp, Artificial Sequence
  chemically synthesized
cagggtaaaatatattttgt

SEQ ID NO: 596710 - DNA, 20 bp, Artificial Sequence
  chemically synthesized
cacaacttaaatagaaaaat

SEQ ID NO: 596711 - DNA, 20 bp, Artificial Sequence
  chemically synthesized
tttggctgtttgtacctgag

SEQ ID NO: 596712 - DNA, 20 bp, Artificial Sequence
  chemically synthesized
taatttcattgaattatttt

SEQ ID NO: 596713 - DNA, 20 bp, Artificial Sequence
  chemically synthesized
gcatcatatctgatataaat

SEQ ID NO: 596714 - DNA, 20 bp, Artificial Sequence
  chemically synthesized
atggagaagaaatacatgct

SEQ ID NO: 596715 - DNA, 20 bp, Artificial Sequence
  chemically synthesized
tcatcttatggagaagaaat

SEQ ID NO: 596716 - DNA, 20 bp, Artificial Sequence
  chemically synthesized
tttcttctccataagatgaa

SEQ ID NO: 596717 - DNA, 20 bp, Artificial Sequence
  chemically synthesized
acttaagataacatactaaa

SEQ ID NO: 596718 - DNA, 20 bp, Artificial Sequence
  chemically synthesized
gcagaagctacactggcaaa

SEQ ID NO: 596719 - DNA, 20 bp, Artificial Sequence
  chemically synthesized
actaaatcttgttttgccag

SEQ ID NO: 596720 - DNA, 20 bp, Artificial Sequence
  chemically synthesized
tcttgttttgccagtgtagc

SEQ ID NO: 596721 - DNA, 20 bp, Artificial Sequence
  chemically synthesized
atattttagggtccaaaatt

SEQ ID NO: 596722 - DNA, 20 bp, Artificial Sequence
  chemically synthesized
gtcgctatatgatatggcta

SEQ ID NO: 596723 - DNA, 20 bp, Artificial Sequence
  chemically synthesized
atgaaaaatatttcacactt

SEQ ID NO: 596724 - DNA, 20 bp, Artificial Sequence
  chemically synthesized
attaaaatacatttcataga

SEQ ID NO: 596725 - DNA, 20 bp, Artificial Sequence
  chemically synthesized
aaatataccaataattttat

SEQ ID NO: 596726 - DNA, 20 bp, Artificial Sequence
  chemically synthesized
tttactttgtactaaatgta

SEQ ID NO: 596727 - DNA, 20 bp, Artificial Sequence
  chemically synthesized
ataagtaaacattgagtaag

SEQ ID NO: 596728 - DNA, 20 bp, Artificial Sequence
  chemically synthesized
ttcttaaaacatttcttact

SEQ ID NO: 596729 - DNA, 20 bp, Artificial Sequence
  chemically synthesized
atcgagttcgttgcgatgaa

SEQ ID NO: 596730 - DNA, 20 bp, Artificial Sequence
  chemically synthesized
tttagaaaaaatactaatac

SEQ ID NO: 596731 - DNA, 20 bp, Artificial Sequence
  chemically synthesized
tgctatgtattgaaggtcta

SEQ ID NO: 596732 - DNA, 20 bp, Artificial Sequence
  chemically synthesized
acttttgatcaccgtcccat

SEQ ID NO: 596733 - DNA, 20 bp, Artificial Sequence
  chemically synthesized
tattccttattagacaaatt

SEQ ID NO: 596734 - DNA, 20 bp, Artificial Sequence
  chemically synthesized
gtactctttggatatcttgg

SEQ ID NO: 596735 - DNA, 20 bp, Artificial Sequence
  chemically synthesized
atatcttggtattgatttca

SEQ ID NO: 596736 - DNA, 20 bp, Artificial Sequence
  chemically synthesized
ttatgtttctcatgttccct

SEQ ID NO: 596737 - DNA, 20 bp, Artificial Sequence
  chemically synthesized
ttgaggtttcgtgagtgcaa

SEQ ID NO: 596738 - DNA, 20 bp, Artificial Sequence
  chemically synthesized
ttcctacactttcccacttt

SEQ ID NO: 596739 - DNA, 20 bp, Artificial Sequence
  chemically synthesized
ctctcctttgtcaatacctc

SEQ ID NO: 596740 - DNA, 20 bp, Artificial Sequence
  chemically synthesized
cacagtgactcagggaccta

SEQ ID NO: 596741 - DNA, 20 bp, Artificial Sequence
  chemically synthesized
agtcactgtgaaggaatgct

SEQ ID NO: 596742 - DNA, 20 bp, Artificial Sequence
  chemically synthesized
tgaaatcaaagtggcctaat

SEQ ID NO: 596743 - DNA, 20 bp, Artificial Sequence
  chemically synthesized
aataagcattcattaggcca

SEQ ID NO: 596744 - DNA, 20 bp, Artificial Sequence
  chemically synthesized
taggccactttgatttcagg

SEQ ID NO: 596745 - DNA, 20 bp, Artificial Sequence
  chemically synthesized
ccactctttggtgaatggta

SEQ ID NO: 596746 - DNA, 20 bp, Artificial Sequence
  chemically synthesized
tttatagagtttacagagca

SEQ ID NO: 596747 - DNA, 20 bp, Artificial Sequence
  chemically synthesized
gaacttgtcccaccagttta

SEQ ID NO: 596748 - DNA, 20 bp, Artificial Sequence
  chemically synthesized
ataaattaggaacttgtccc

SEQ ID NO: 596749 - DNA, 20 bp, Artificial Sequence
  chemically synthesized
ctgactctacctttctcaat

SEQ ID NO: 596750 - DNA, 20 bp, Artificial Sequence
  chemically synthesized
ggatgctgtcattaaaatgc

SEQ ID NO: 596751 - DNA, 20 bp, Artificial Sequence
  chemically synthesized
ctttttggatgctgtcatta

SEQ ID NO: 596752 - DNA, 20 bp, Artificial Sequence
  chemically synthesized
aactatacattatccctcca

SEQ ID NO: 596753 - DNA, 20 bp, Artificial Sequence
  chemically synthesized
tttcacttcagttaaatgga

SEQ ID NO: 596754 - DNA, 20 bp, Artificial Sequence
  chemically synthesized
ttcagttaaatggagatggc

SEQ ID NO: 596755 - DNA, 20 bp, Artificial Sequence
  chemically synthesized
tggcttctgcttcttcgaat

SEQ ID NO: 596756 - DNA, 20 bp, Artificial Sequence
  chemically synthesized
ttcttcgaatcaaagcttcc

SEQ ID NO: 596757 - DNA, 20 bp, Artificial Sequence
  chemically synthesized
cacctgtaaacattaggaag

SEQ ID NO: 596758 - DNA, 20 bp, Artificial Sequence
  chemically synthesized
ctcaccacctgtaaacatta

SEQ ID NO: 596759 - DNA, 20 bp, Artificial Sequence
  chemically synthesized
acaagtgacagaagctaagt

SEQ ID NO: 596760 - DNA, 20 bp, Artificial Sequence
  chemically synthesized
ctggcacttataaaccctaa

SEQ ID NO: 596761 - DNA, 20 bp, Artificial Sequence
  chemically synthesized
cccacgtgtcccctgaaggc

SEQ ID NO: 596762 - DNA, 20 bp, Artificial Sequence
  chemically synthesized
gcacttattgctatactttc

SEQ ID NO: 596763 - DNA, 20 bp, Artificial Sequence
  chemically synthesized
agactggactgatcaacacc

SEQ ID NO: 596764 - DNA, 20 bp, Artificial Sequence
  chemically synthesized
gttgatcagtccagtctctg

SEQ ID NO: 596765 - DNA, 20 bp, Artificial Sequence
  chemically synthesized
ggatatgttttgcttggctg

SEQ ID NO: 596766 - DNA, 20 bp, Artificial Sequence
  chemically synthesized
ctgaaggatatgttttgctt

SEQ ID NO: 596767 - DNA, 20 bp, Artificial Sequence
  chemically synthesized
aaagagagctgaaggatatg

SEQ ID NO: 596768 - DNA, 20 bp, Artificial Sequence
  chemically synthesized
ggagaaaagagagctgaagg

SEQ ID NO: 596769 - DNA, 20 bp, Artificial Sequence
  chemically synthesized
ctctcttttctcctggggct

SEQ ID NO: 596770 - DNA, 20 bp, Artificial Sequence
  chemically synthesized
cagtgtttctctgttgatag

SEQ ID NO: 596771 - DNA, 20 bp, Artificial Sequence
  chemically synthesized
accttcagtgtttctctgtt

SEQ ID NO: 596772 - DNA, 20 bp, Artificial Sequence
  chemically synthesized
tttcccagcacaggaacctt

SEQ ID NO: 596773 - DNA, 20 bp, Artificial Sequence
  chemically synthesized
tgggaaatgtgaagcaggag

SEQ ID NO: 596774 - DNA, 20 bp, Artificial Sequence
  chemically synthesized
taacctttctgaagcagcac

SEQ ID NO: 596775 - DNA, 20 bp, Artificial Sequence
  chemically synthesized
gttaactctttcaaaagaaa

SEQ ID NO: 596776 - DNA, 20 bp, Artificial Sequence
  chemically synthesized
agatctctctccacccaaat

SEQ ID NO: 596777 - DNA, 20 bp, Artificial Sequence
  chemically synthesized
cttacaaggtatctactgac

SEQ ID NO: 596778 - DNA, 20 bp, Artificial Sequence
  chemically synthesized
tactggattctgtacacttt

SEQ ID NO: 596779 - DNA, 20 bp, Artificial Sequence
  chemically synthesized
aattgaatattttgccattt

SEQ ID NO: 596780 - DNA, 20 bp, Artificial Sequence
  chemically synthesized
aggtataaagaaaggacaac

SEQ ID NO: 596781 - DNA, 20 bp, Artificial Sequence
  chemically synthesized
ccattatttcttataatgtc

SEQ ID NO: 596782 - DNA, 20 bp, Artificial Sequence
  chemically synthesized
tcctataacctgtgacttag

SEQ ID NO: 596783 - DNA, 20 bp, Artificial Sequence
  chemically synthesized
ccaagtcaatagcaccacca

SEQ ID NO: 596784 - DNA, 20 bp, Artificial Sequence
  chemically synthesized
cacagaagttatacaggcta

SEQ ID NO: 596785 - DNA, 20 bp, Artificial Sequence
  chemically synthesized
aaatggttgcactcaagaga

SEQ ID NO: 596786 - DNA, 20 bp, Artificial Sequence
  chemically synthesized
actcaagagagaatgtttgc

SEQ ID NO: 596787 - DNA, 20 bp, Artificial Sequence
  chemically synthesized
ggtaataatacactcaagag

SEQ ID NO: 596788 - DNA, 20 bp, Artificial Sequence
  chemically synthesized
aatacactcaagagacatgt

SEQ ID NO: 596789 - DNA, 20 bp, Artificial Sequence
  chemically synthesized
aatttaatattataatttac

SEQ ID NO: 596790 - DNA, 20 bp, Artificial Sequence
  chemically synthesized
acagaaaaagaacatattca

SEQ ID NO: 596791 - DNA, 20 bp, Artificial Sequence
  chemically synthesized
tccactaattacccaaaaat

SEQ ID NO: 596792 - DNA, 20 bp, Artificial Sequence
  chemically synthesized
ttttgggtaattagtggaag

SEQ ID NO: 596793 - DNA, 20 bp, Artificial Sequence
  chemically synthesized
tagtggaaggtgagcttata

SEQ ID NO: 596794 - DNA, 20 bp, Artificial Sequence
  chemically synthesized
aaccctggagttgaggcagt

SEQ ID NO: 596795 - DNA, 20 bp, Artificial Sequence
  chemically synthesized
tatttaaagatactatcatg

SEQ ID NO: 596796 - DNA, 20 bp, Artificial Sequence
  chemically synthesized
ttatgtatttaaagatacta

SEQ ID NO: 596797 - DNA, 20 bp, Artificial Sequence
  chemically synthesized
cattgtaatttgattccgat

SEQ ID NO: 596798 - DNA, 20 bp, Artificial Sequence
  chemically synthesized
ctagtatcggaatcaaatta

SEQ ID NO: 596799 - DNA, 20 bp, Artificial Sequence
  chemically synthesized
aagtcaataaaaacattgta

SEQ ID NO: 596800 - DNA, 20 bp, Artificial Sequence
  chemically synthesized
ttgtgaataatatgatctcc

SEQ ID NO: 596801 - DNA, 20 bp, Artificial Sequence
  chemically synthesized
ttattcacaaaatgaaagtt

SEQ ID NO: 596802 - DNA, 20 bp, Artificial Sequence
  chemically synthesized
ccagaaataaggtacatact

SEQ ID NO: 596803 - DNA, 20 bp, Artificial Sequence
  chemically synthesized
gactggcattatagataagt

SEQ ID NO: 596804 - DNA, 20 bp, Artificial Sequence
  chemically synthesized
gatgctgactggcattatag

SEQ ID NO: 596805 - DNA, 20 bp, Artificial Sequence
  chemically synthesized
atcactctctcctgcccctc

SEQ ID NO: 596806 - DNA, 20 bp, Artificial Sequence
  chemically synthesized
atcaagggaggggcaggaga

SEQ ID NO: 596807 - DNA, 20 bp, Artificial Sequence
  chemically synthesized
catatccaatatcctcacaa

SEQ ID NO: 596808 - DNA, 20 bp, Artificial Sequence
  chemically synthesized
cagacttgtgaggatattgg

SEQ ID NO: 596809 - DNA, 20 bp, Artificial Sequence
  chemically synthesized
tttattatcttgactgtgct

SEQ ID NO: 596810 - DNA, 20 bp, Artificial Sequence
  chemically synthesized
catttaaatagtacaatttg

SEQ ID NO: 596811 - DNA, 20 bp, Artificial Sequence
  chemically synthesized
caaattgtactatttaaatg

SEQ ID NO: 596812 - DNA, 20 bp, Artificial Sequence
  chemically synthesized
tatcatttataccacaatga

SEQ ID NO: 596813 - DNA, 20 bp, Artificial Sequence
  chemically synthesized
tgaaattgtttccaaaaagg

SEQ ID NO: 596814 - DNA, 20 bp, Artificial Sequence
  chemically synthesized
ctaaatgcattactaggtat

SEQ ID NO: 596815 - DNA, 20 bp, Artificial Sequence
  chemically synthesized
tttatacttattgagacata

SEQ ID NO: 596816 - DNA, 20 bp, Artificial Sequence
  chemically synthesized
aatatatgtctcaataagta

SEQ ID NO: 596817 - DNA, 20 bp, Artificial Sequence
  chemically synthesized
gcgaacactgtggtgtgcca

SEQ ID NO: 596818 - DNA, 20 bp, Artificial Sequence
  chemically synthesized
atcccagcaactgggagaat

SEQ ID NO: 596819 - DNA, 20 bp, Artificial Sequence
  chemically synthesized
agcattcattctcccagttg

SEQ ID NO: 596820 - DNA, 20 bp, Artificial Sequence
  chemically synthesized
tgctgagagaaatttcttgg

SEQ ID NO: 596821 - DNA, 20 bp, Artificial Sequence
  chemically synthesized
tagatgtgagcctcccaact

SEQ ID NO: 596822 - DNA, 20 bp, Artificial Sequence
  chemically synthesized
gaggctcacatctaatgact

SEQ ID NO: 596823 - DNA, 20 bp, Artificial Sequence
  chemically synthesized
gggatacaatggtccacctt

SEQ ID NO: 596824 - DNA, 20 bp, Artificial Sequence
  chemically synthesized
cctgggagggagtaaaggca

SEQ ID NO: 596825 - DNA, 20 bp, Artificial Sequence
  chemically synthesized
catgcagatggtttcttagt

SEQ ID NO: 596826 - DNA, 20 bp, Artificial Sequence
  chemically synthesized
aagacagagatttccatgca

SEQ ID NO: 596827 - DNA, 20 bp, Artificial Sequence
  chemically synthesized
ctaagacatagactctaaga

SEQ ID NO: 596828 - DNA, 20 bp, Artificial Sequence
  chemically synthesized
atattaggttgttatcttag

SEQ ID NO: 596829 - DNA, 20 bp, Artificial Sequence
  chemically synthesized
tcaacatattaggttgttat

SEQ ID NO: 596830 - DNA, 20 bp, Artificial Sequence
  chemically synthesized
tgattacttcagatatgtat

SEQ ID NO: 596831 - DNA, 20 bp, Artificial Sequence
  chemically synthesized
acattttcataatgttattt

SEQ ID NO: 596832 - DNA, 20 bp, Artificial Sequence
  chemically synthesized
cattatatacaatgatacaa

SEQ ID NO: 596833 - DNA, 20 bp, Artificial Sequence
  chemically synthesized
tatcatttcttcaacttact

SEQ ID NO: 596834 - DNA, 20 bp, Artificial Sequence
  chemically synthesized
caatcagccatatctccttc

SEQ ID NO: 596835 - DNA, 20 bp, Artificial Sequence
  chemically synthesized
aaagctcaagaaggagatat

SEQ ID NO: 596836 - DNA, 20 bp, Artificial Sequence
  chemically synthesized
gtcaactattgaggacgctg

SEQ ID NO: 596837 - DNA, 20 bp, Artificial Sequence
  chemically synthesized
tgaaatgctgaatggattta

SEQ ID NO: 596838 - DNA, 20 bp, Artificial Sequence
  chemically synthesized
catgttattctgaaatgctg

SEQ ID NO: 596839 - DNA, 20 bp, Artificial Sequence
  chemically synthesized
ctatcaagaacttggcaaaa

SEQ ID NO: 596840 - DNA, 20 bp, Artificial Sequence
  chemically synthesized
ttaactatatgctaactgta

SEQ ID NO: 596841 - DNA, 20 bp, Artificial Sequence
  chemically synthesized
agacagaattgtcacggcta

SEQ ID NO: 596842 - DNA, 20 bp, Artificial Sequence
  chemically synthesized
gcattttccatgaaaatctg

SEQ ID NO: 596843 - DNA, 20 bp, Artificial Sequence
  chemically synthesized
ctttagatagtgaaaatcaa

SEQ ID NO: 596844 - DNA, 20 bp, Artificial Sequence
  chemically synthesized
ttgtcgtccagagctagcat

SEQ ID NO: 596845 - DNA, 20 bp, Artificial Sequence
  chemically synthesized
taagggttgtagttaacgga

SEQ ID NO: 596846 - DNA, 20 bp, Artificial Sequence
  chemically synthesized
accctcatttatccctcagc

SEQ ID NO: 596847 - DNA, 20 bp, Artificial Sequence
  chemically synthesized
agagcagtagtctcttggaa

SEQ ID NO: 596848 - DNA, 20 bp, Artificial Sequence
  chemically synthesized
catttgttttttattctctt

SEQ ID NO: 596849 - DNA, 20 bp, Artificial Sequence
  chemically synthesized
cattgaagaaatttgtagac

SEQ ID NO: 596850 - DNA, 20 bp, Artificial Sequence
  chemically synthesized
cactgcctttaagatctatg

SEQ ID NO: 596851 - DNA, 20 bp, Artificial Sequence
  chemically synthesized
atagatcttaaaggcagtga

SEQ ID NO: 596852 - DNA, 20 bp, Artificial Sequence
  chemically synthesized
tatgggaactgcaattcaag

SEQ ID NO: 596853 - DNA, 20 bp, Artificial Sequence
  chemically synthesized
tggatccctcccatgacatc

SEQ ID NO: 596854 - DNA, 20 bp, Artificial Sequence
  chemically synthesized
agcacgggagtgaccacccc

SEQ ID NO: 596855 - DNA, 20 bp, Artificial Sequence
  chemically synthesized
agtgagctctcatgagagct

SEQ ID NO: 596856 - DNA, 20 bp, Artificial Sequence
  chemically synthesized
tgagagctgatggtttcata

SEQ ID NO: 596857 - DNA, 20 bp, Artificial Sequence
  chemically synthesized
ttgccatcatgtgacaaagg

SEQ ID NO: 596858 - DNA, 20 bp, Artificial Sequence
  chemically synthesized
catcatgtgacaaaggatgt

SEQ ID NO: 596859 - DNA, 20 bp, Artificial Sequence
  chemically synthesized
gtgacaaaggatgtgtttgc

SEQ ID NO: 596860 - DNA, 20 bp, Artificial Sequence
  chemically synthesized
tgtgtttgcttctgcttcca

SEQ ID NO: 596861 - DNA, 20 bp, Artificial Sequence
  chemically synthesized
cttctgcttccacagtgatt

SEQ ID NO: 596862 - DNA, 20 bp, Artificial Sequence
  chemically synthesized
gaacgaggtttaattgactc

SEQ ID NO: 596863 - DNA, 20 bp, Artificial Sequence
  chemically synthesized
ctgggtaatttataaaggaa

SEQ ID NO: 596864 - DNA, 20 bp, Artificial Sequence
  chemically synthesized
ccaaagttgcttccacattt

SEQ ID NO: 596865 - DNA, 20 bp, Artificial Sequence
  chemically synthesized
tgcctgttacccagttccaa

SEQ ID NO: 596866 - DNA, 20 bp, Artificial Sequence
  chemically synthesized
gtcttcttctgagtcctccc

SEQ ID NO: 596867 - DNA, 20 bp, Artificial Sequence
  chemically synthesized
tccaattctctaggaagttc

SEQ ID NO: 596868 - DNA, 20 bp, Artificial Sequence
  chemically synthesized
cagaagacaggaagatgtgg

SEQ ID NO: 596869 - DNA, 20 bp, Artificial Sequence
  chemically synthesized
aacttcctagagacttgttg

SEQ ID NO: 596870 - DNA, 20 bp, Artificial Sequence
  chemically synthesized
gacctttactacagttacca

SEQ ID NO: 596871 - DNA, 20 bp, Artificial Sequence
  chemically synthesized
tgtagtaaaggtcacttttg

SEQ ID NO: 596872 - DNA, 20 bp, Artificial Sequence
  chemically synthesized
tacgctttagcaaagagact

SEQ ID NO: 596873 - DNA, 20 bp, Artificial Sequence
  chemically synthesized
tggaattttgaacatgagag

SEQ ID NO: 596874 - DNA, 20 bp, Artificial Sequence
  chemically synthesized
atttctaaacagcaaagtgt

SEQ ID NO: 596875 - DNA, 20 bp, Artificial Sequence
  chemically synthesized
aagtcaaatcttgaacactt

SEQ ID NO: 596876 - DNA, 20 bp, Artificial Sequence
  chemically synthesized
cttgggtgctgttaaaagca

SEQ ID NO: 596877 - DNA, 20 bp, Artificial Sequence
  chemically synthesized
ctttgtggatacataaaact

SEQ ID NO: 596878 - DNA, 20 bp, Artificial Sequence
  chemically synthesized
gttttatgtatccacaaaga

SEQ ID NO: 596879 - DNA, 20 bp, Artificial Sequence
  chemically synthesized
atatggtttggaattggaaa

SEQ ID NO: 596880 - DNA, 20 bp, Artificial Sequence
  chemically synthesized
aaattttctgaacttttatg

SEQ ID NO: 596881 - DNA, 20 bp, Artificial Sequence
  chemically synthesized
attgaatttctcctcagaaa

SEQ ID NO: 596882 - DNA, 20 bp, Artificial Sequence
  chemically synthesized
tacatatgcaaatttctgta

SEQ ID NO: 596883 - DNA, 20 bp, Artificial Sequence
  chemically synthesized
agacaattttcccattgcct

SEQ ID NO: 596884 - DNA, 20 bp, Artificial Sequence
  chemically synthesized
aattgtctccaggaaatgcc

SEQ ID NO: 596885 - DNA, 20 bp, Artificial Sequence
  chemically synthesized
ccagaggcctaggaaggcaa

SEQ ID NO: 596886 - DNA, 20 bp, Artificial Sequence
  chemically synthesized
ggctacagagggtgcaagcc

SEQ ID NO: 596887 - DNA, 20 bp, Artificial Sequence
  chemically synthesized
gggtgcaagccccaagattt

SEQ ID NO: 596888 - DNA, 20 bp, Artificial Sequence
  chemically synthesized
acatggaagctgccaaatct

SEQ ID NO: 596889 - DNA, 20 bp, Artificial Sequence
  chemically synthesized
gggtacacagaagtcaagaa

SEQ ID NO: 596890 - DNA, 20 bp, Artificial Sequence
  chemically synthesized
ctgagctttgggaacttcta

SEQ ID NO: 596891 - DNA, 20 bp, Artificial Sequence
  chemically synthesized
aaatgtctagatatccaggc

SEQ ID NO: 596892 - DNA, 20 bp, Artificial Sequence
  chemically synthesized
gcctagtagagctgtgagaa

SEQ ID NO: 596893 - DNA, 20 bp, Artificial Sequence
  chemically synthesized
cagggtacagcccccttcct

SEQ ID NO: 596894 - DNA, 20 bp, Artificial Sequence
  chemically synthesized
gatgtgagacacagagtcaa

SEQ ID NO: 596895 - DNA, 20 bp, Artificial Sequence
  chemically synthesized
agagtcaaaggagattatct

SEQ ID NO: 596896 - DNA, 20 bp, Artificial Sequence
  chemically synthesized
aaggagattatcttggagct

SEQ ID NO: 596897 - DNA, 20 bp, Artificial Sequence
  chemically synthesized
taagatttaattactgcctc

SEQ ID NO: 596898 - DNA, 20 bp, Artificial Sequence
  chemically synthesized
atgcatggagcctggagccc

SEQ ID NO: 596899 - DNA, 20 bp, Artificial Sequence
  chemically synthesized
ttgtacctagaaagtaacta

SEQ ID NO: 596900 - DNA, 20 bp, Artificial Sequence
  chemically synthesized
ctagaaagtaactaacttgc

SEQ ID NO: 596901 - DNA, 20 bp, Artificial Sequence
  chemically synthesized
tgactgttgggaaggcatta

SEQ ID NO: 596902 - DNA, 20 bp, Artificial Sequence
  chemically synthesized
aggggccagggatgaaatga

SEQ ID NO: 596903 - DNA, 20 bp, Artificial Sequence
  chemically synthesized
tacaggaactacaattcaga

SEQ ID NO: 596904 - DNA, 20 bp, Artificial Sequence
  chemically synthesized
tgggtccctcacatgacaca

SEQ ID NO: 596905 - DNA, 20 bp, Artificial Sequence
  chemically synthesized
agtgagttctcatgagatcc

SEQ ID NO: 596906 - DNA, 20 bp, Artificial Sequence
  chemically synthesized
tgagatccaatggttttata

SEQ ID NO: 596907 - DNA, 20 bp, Artificial Sequence
  chemically synthesized
ctgccaccatatgaagaagg

SEQ ID NO: 596908 - DNA, 20 bp, Artificial Sequence
  chemically synthesized
caccatatgaagaaggatgt

SEQ ID NO: 596909 - DNA, 20 bp, Artificial Sequence
  chemically synthesized
cttccccttctggcatggtt

SEQ ID NO: 596910 - DNA, 20 bp, Artificial Sequence
  chemically synthesized
ctgaataatttataaaggac

SEQ ID NO: 596911 - DNA, 20 bp, Artificial Sequence
  chemically synthesized
tgatcaatatattttacttt

SEQ ID NO: 596912 - DNA, 20 bp, Artificial Sequence
  chemically synthesized
caaaagtaaaaaggtaaaaa

SEQ ID NO: 596913 - DNA, 20 bp, Artificial Sequence
  chemically synthesized
ctgcaagtgtacagaactta

SEQ ID NO: 596914 - DNA, 20 bp, Artificial Sequence
  chemically synthesized
tacacttgcagtatttgatc

SEQ ID NO: 596915 - DNA, 20 bp, Artificial Sequence
  chemically synthesized
tttccattaaataattctgt

SEQ ID NO: 596916 - DNA, 20 bp, Artificial Sequence
  chemically synthesized
ttacagaattatttaatgga

SEQ ID NO: 596917 - DNA, 20 bp, Artificial Sequence
  chemically synthesized
atgaaaatatattaaatatg

SEQ ID NO: 596918 - DNA, 20 bp, Artificial Sequence
  chemically synthesized
atatgttgtacatgtaagaa

SEQ ID NO: 596919 - DNA, 20 bp, Artificial Sequence
  chemically synthesized
ctcttatcaatggccataaa

SEQ ID NO: 596920 - DNA, 20 bp, Artificial Sequence
  chemically synthesized
atacatttctgtctttttat

SEQ ID NO: 596921 - DNA, 20 bp, Artificial Sequence
  chemically synthesized
aataataaagttatgataat

SEQ ID NO: 596922 - DNA, 20 bp, Artificial Sequence
  chemically synthesized
ataataaatgtttatacctt

SEQ ID NO: 596923 - DNA, 20 bp, Artificial Sequence
  chemically synthesized
caaatgcaaaggaactatga

SEQ ID NO: 596924 - DNA, 20 bp, Artificial Sequence
  chemically synthesized
ttttaactggtctcagtgca

SEQ ID NO: 596925 - DNA, 20 bp, Artificial Sequence
  chemically synthesized
gcatagctaaaggggagaat

SEQ ID NO: 596926 - DNA, 20 bp, Artificial Sequence
  chemically synthesized
ttacttccagccccattttt

SEQ ID NO: 596927 - DNA, 20 bp, Artificial Sequence
  chemically synthesized
aatggggctggaagtaattc

SEQ ID NO: 596928 - DNA, 20 bp, Artificial Sequence
  chemically synthesized
aaaggaaattaaattgtaga

SEQ ID NO: 596929 - DNA, 20 bp, Artificial Sequence
  chemically synthesized
ggtcacaaaggaaattaaat

SEQ ID NO: 596930 - DNA, 20 bp, Artificial Sequence
  chemically synthesized
tggtggaacttctataacag

SEQ ID NO: 596931 - DNA, 20 bp, Artificial Sequence
  chemically synthesized
agttccaccattcctaatgc

SEQ ID NO: 596932 - DNA, 20 bp, Artificial Sequence
  chemically synthesized
taatgccccagatttgccac

SEQ ID NO: 596933 - DNA, 20 bp, Artificial Sequence
  chemically synthesized
aaggtttttgttttactttg

SEQ ID NO: 596934 - DNA, 20 bp, Artificial Sequence
  chemically synthesized
atgtgaaggtttttgtttta

SEQ ID NO: 596935 - DNA, 20 bp, Artificial Sequence
  chemically synthesized
actcaaaattatgtgaaggt

SEQ ID NO: 596936 - DNA, 20 bp, Artificial Sequence
  chemically synthesized
aagagaactcaaaattatgt

SEQ ID NO: 596937 - DNA, 20 bp, Artificial Sequence
  chemically synthesized
tctctttcttctcagtaagg

SEQ ID NO: 596938 - DNA, 20 bp, Artificial Sequence
  chemically synthesized
gagacatgaacaaggctgga

SEQ ID NO: 596939 - DNA, 20 bp, Artificial Sequence
  chemically synthesized
cttttgaaatgtataaagaa

SEQ ID NO: 596940 - DNA, 20 bp, Artificial Sequence
  chemically synthesized
ctttcttctttatacatttc

SEQ ID NO: 596941 - DNA, 20 bp, Artificial Sequence
  chemically synthesized
attagatgacagaaaaagag

SEQ ID NO: 596942 - DNA, 20 bp, Artificial Sequence
  chemically synthesized
tctagtgaaaactaatttat

SEQ ID NO: 596943 - DNA, 20 bp, Artificial Sequence
  chemically synthesized
cctagagaaagcaagaataa

SEQ ID NO: 596944 - DNA, 20 bp, Artificial Sequence
  chemically synthesized
ttgaagcagctgactttatg

SEQ ID NO: 596945 - DNA, 20 bp, Artificial Sequence
  chemically synthesized
ccaaaactgtgcataaagtc

SEQ ID NO: 596946 - DNA, 20 bp, Artificial Sequence
  chemically synthesized
aattgctggaggcttctatg

SEQ ID NO: 596947 - DNA, 20 bp, Artificial Sequence
  chemically synthesized
tctttggtcacagaattgct

SEQ ID NO: 596948 - DNA, 20 bp, Artificial Sequence
  chemically synthesized
aacaaaactttatttttgtg

SEQ ID NO: 596949 - DNA, 20 bp, Artificial Sequence
  chemically synthesized
aaaaaatcttcacacaaaaa

SEQ ID NO: 596950 - DNA, 20 bp, Artificial Sequence
  chemically synthesized
tttgggggtatttctcaaag

SEQ ID NO: 596951 - DNA, 20 bp, Artificial Sequence
  chemically synthesized
tattttatgtcgttcaagaa

SEQ ID NO: 596952 - DNA, 20 bp, Artificial Sequence
  chemically synthesized
cgttcaagaaattggcttgt

SEQ ID NO: 596953 - DNA, 20 bp, Artificial Sequence
  chemically synthesized
agccatggtttgttttttaa

SEQ ID NO: 596954 - DNA, 20 bp, Artificial Sequence
  chemically synthesized
ttaaaaagatcatagccatg

SEQ ID NO: 596955 - DNA, 20 bp, Artificial Sequence
  chemically synthesized
agctttaaaaagatcatagc

SEQ ID NO: 596956 - DNA, 20 bp, Artificial Sequence
  chemically synthesized
tgaattattgagtcttgctt

SEQ ID NO: 596957 - DNA, 20 bp, Artificial Sequence
  chemically synthesized
tagctctgtgaattattgag

SEQ ID NO: 596958 - DNA, 20 bp, Artificial Sequence
  chemically synthesized
tatcaaaggtatacattagc

SEQ ID NO: 596959 - DNA, 20 bp, Artificial Sequence
  chemically synthesized
tatttcttccttattgactt

SEQ ID NO: 596960 - DNA, 20 bp, Artificial Sequence
  chemically synthesized
caccatcagcttttgtattc

SEQ ID NO: 596961 - DNA, 20 bp, Artificial Sequence
  chemically synthesized
cctctggatcctgattcacc

SEQ ID NO: 596962 - DNA, 20 bp, Artificial Sequence
  chemically synthesized
gactcctgcattcctctgga

SEQ ID NO: 596963 - DNA, 20 bp, Artificial Sequence
  chemically synthesized
atagactttaggctaagaca

SEQ ID NO: 596964 - DNA, 20 bp, Artificial Sequence
  chemically synthesized
tcctcttgcaactacttcca

SEQ ID NO: 596965 - DNA, 20 bp, Artificial Sequence
  chemically synthesized
tagacaaggtgcaggagctg

SEQ ID NO: 596966 - DNA, 20 bp, Artificial Sequence
  chemically synthesized
gtctaagataactctgagac

SEQ ID NO: 596967 - DNA, 20 bp, Artificial Sequence
  chemically synthesized
ccaaacaccactgtgagaac

SEQ ID NO: 596968 - DNA, 20 bp, Artificial Sequence
  chemically synthesized
ttaagccctagttctcacag

SEQ ID NO: 596969 - DNA, 20 bp, Artificial Sequence
  chemically synthesized
ccctagttctcacagtggtg

SEQ ID NO: 596970 - DNA, 20 bp, Artificial Sequence
  chemically synthesized
ttgataacatactctttaca

SEQ ID NO: 596971 - DNA, 20 bp, Artificial Sequence
  chemically synthesized
tcacaactccaacatcctac

SEQ ID NO: 596972 - DNA, 20 bp, Artificial Sequence
  chemically synthesized
gttcaaatagtttctttggg

SEQ ID NO: 596973 - DNA, 20 bp, Artificial Sequence
  chemically synthesized
gagacaaggatgtgagttca

SEQ ID NO: 596974 - DNA, 20 bp, Artificial Sequence
  chemically synthesized
tttgaactcacatccttgtc

SEQ ID NO: 596975 - DNA, 20 bp, Artificial Sequence
  chemically synthesized
actcacatccttgtctcagg

SEQ ID NO: 596976 - DNA, 20 bp, Artificial Sequence
  chemically synthesized
aattcttgcattatgagtgt

SEQ ID NO: 596977 - DNA, 20 bp, Artificial Sequence
  chemically synthesized
tcaaactagccatgcttaag

SEQ ID NO: 596978 - DNA, 20 bp, Artificial Sequence
  chemically synthesized
agaatcaatccttaagcatg

SEQ ID NO: 596979 - DNA, 20 bp, Artificial Sequence
  chemically synthesized
agtgtcaaactagccatgct

SEQ ID NO: 596980 - DNA, 20 bp, Artificial Sequence
  chemically synthesized
tatgtagagtgtcaaactag

SEQ ID NO: 596981 - DNA, 20 bp, Artificial Sequence
  chemically synthesized
gtgaattttctgctccagtt

SEQ ID NO: 596982 - DNA, 20 bp, Artificial Sequence
  chemically synthesized
accaattattattttaaaga

SEQ ID NO: 596983 - DNA, 20 bp, Artificial Sequence
  chemically synthesized
agctgctgatcaccaatttc

SEQ ID NO: 596984 - DNA, 20 bp, Artificial Sequence
  chemically synthesized
aacacctgaaattggtgatc

SEQ ID NO: 596985 - DNA, 20 bp, Artificial Sequence
  chemically synthesized
gaggtgttcccttaccagtc

SEQ ID NO: 596986 - DNA, 20 bp, Artificial Sequence
  chemically synthesized
gtcctgtttgaactttgatt

SEQ ID NO: 596987 - DNA, 20 bp, Artificial Sequence
  chemically synthesized
tattaagtgtcctgtttgaa

SEQ ID NO: 596988 - DNA, 20 bp, Artificial Sequence
  chemically synthesized
gcgacttgagatattaagtg

SEQ ID NO: 596989 - DNA, 20 bp, Artificial Sequence
  chemically synthesized
atttcctttcatttctgctc

SEQ ID NO: 596990 - DNA, 20 bp, Artificial Sequence
  chemically synthesized
gcaagtgttagagcaggaat

SEQ ID NO: 596991 - DNA, 20 bp, Artificial Sequence
  chemically synthesized
ttaaggttgctgaagacccg

SEQ ID NO: 596992 - DNA, 20 bp, Artificial Sequence
  chemically synthesized
tgagtattagggttcaaagg

SEQ ID NO: 596993 - DNA, 20 bp, Artificial Sequence
  chemically synthesized
ttaagagatttacatttcat

SEQ ID NO: 596994 - DNA, 20 bp, Artificial Sequence
  chemically synthesized
ttattttaattctttatatt

SEQ ID NO: 596995 - DNA, 20 bp, Artificial Sequence
  chemically synthesized
aattaaaataatatccaagt

SEQ ID NO: 596996 - DNA, 20 bp, Artificial Sequence
  chemically synthesized
ttagatacagtcttgtaata

SEQ ID NO: 596997 - DNA, 20 bp, Artificial Sequence
  chemically synthesized
aagactgtatctaatcacaa

SEQ ID NO: 596998 - DNA, 20 bp, Artificial Sequence
  chemically synthesized
aaaacaaaataaaaacctgt

SEQ ID NO: 596999 - DNA, 20 bp, Artificial Sequence
  chemically synthesized
taatcacaaacaggttttta

SEQ ID NO: 597000 - DNA, 20 bp, Artificial Sequence
  chemically synthesized
aaaaacaaaacaaaataaaa

SEQ ID NO: 597001 - DNA, 20 bp, Artificial Sequence
  chemically synthesized
acaaacaggtttttattttg

SEQ ID NO: 597002 - DNA, 20 bp, Artificial Sequence
  chemically synthesized
gactccattaaatttgtttc

SEQ ID NO: 597003 - DNA, 20 bp, Artificial Sequence
  chemically synthesized
tgagggaaggactccattaa

SEQ ID NO: 597004 - DNA, 20 bp, Artificial Sequence
  chemically synthesized
cttccctcatcactgaattc

SEQ ID NO: 597005 - DNA, 20 bp, Artificial Sequence
  chemically synthesized
ttctttcagttgtaagaaaa

SEQ ID NO: 597006 - DNA, 20 bp, Artificial Sequence
  chemically synthesized
aatgctttccttttgaagat

SEQ ID NO: 597007 - DNA, 20 bp, Artificial Sequence
  chemically synthesized
tttccttttgaagatgttgg

SEQ ID NO: 597008 - DNA, 20 bp, Artificial Sequence
  chemically synthesized
gatgttggcttggattagaa

SEQ ID NO: 597009 - DNA, 20 bp, Artificial Sequence
  chemically synthesized
ctgtctagctgtggtaaata

SEQ ID NO: 597010 - DNA, 20 bp, Artificial Sequence
  chemically synthesized
tctttcttactttgtcatgc

SEQ ID NO: 597011 - DNA, 20 bp, Artificial Sequence
  chemically synthesized
tcttactttgtcatgcagct

SEQ ID NO: 597012 - DNA, 20 bp, Artificial Sequence
  chemically synthesized
ggtttatgtctcttggcaaa

SEQ ID NO: 597013 - DNA, 20 bp, Artificial Sequence
  chemically synthesized
gatacccttgaagaagacca

SEQ ID NO: 597014 - DNA, 20 bp, Artificial Sequence
  chemically synthesized
gtatcctgtgagctgtgata

SEQ ID NO: 597015 - DNA, 20 bp, Artificial Sequence
  chemically synthesized
agctgtgatagtcagcttat

SEQ ID NO: 597016 - DNA, 20 bp, Artificial Sequence
  chemically synthesized
gtgcttcagcacacttggta

SEQ ID NO: 597017 - DNA, 20 bp, Artificial Sequence
  chemically synthesized
accaagtgtgctgaagcaca

SEQ ID NO: 597018 - DNA, 20 bp, Artificial Sequence
  chemically synthesized
ttactgacttgagaatctcc

SEQ ID NO: 597019 - DNA, 20 bp, Artificial Sequence
  chemically synthesized
taaataataaaattgtgact

SEQ ID NO: 597020 - DNA, 20 bp, Artificial Sequence
  chemically synthesized
taataaaattgtgacttaaa

SEQ ID NO: 597021 - DNA, 20 bp, Artificial Sequence
  chemically synthesized
ttttacagggggcattaact

SEQ ID NO: 597022 - DNA, 20 bp, Artificial Sequence
  chemically synthesized
agaaagaaaacttgtgaaaa

SEQ ID NO: 597023 - DNA, 20 bp, Artificial Sequence
  chemically synthesized
tattctgaatccattttttc

SEQ ID NO: 597024 - DNA, 20 bp, Artificial Sequence
  chemically synthesized
tgggatcaacaaattgtaag

SEQ ID NO: 597025 - DNA, 20 bp, Artificial Sequence
  chemically synthesized
gggctttctaacagagttgt

SEQ ID NO: 597026 - DNA, 20 bp, Artificial Sequence
  chemically synthesized
agttgtctgtgttttatcaa

SEQ ID NO: 597027 - DNA, 20 bp, Artificial Sequence
  chemically synthesized
tttcaagttgcaagtctcag

SEQ ID NO: 597028 - DNA, 20 bp, Artificial Sequence
  chemically synthesized
atctttggatatgccacgtg

SEQ ID NO: 597029 - DNA, 20 bp, Artificial Sequence
  chemically synthesized
acacatgatggttcttaaga

SEQ ID NO: 597030 - DNA, 20 bp, Artificial Sequence
  chemically synthesized
tctgggtcttaagaaccatc

SEQ ID NO: 597031 - DNA, 20 bp, Artificial Sequence
  chemically synthesized
tcttaagaaccatcatgtgt

SEQ ID NO: 597032 - DNA, 20 bp, Artificial Sequence
  chemically synthesized
ccccaaatatctactgccat

SEQ ID NO: 597033 - DNA, 20 bp, Artificial Sequence
  chemically synthesized
gaatgagacacatagatcag

SEQ ID NO: 597034 - DNA, 20 bp, Artificial Sequence
  chemically synthesized
acatgtttggtcaacctaca

SEQ ID NO: 597035 - DNA, 20 bp, Artificial Sequence
  chemically synthesized
cctacagtcagattctgaat

SEQ ID NO: 597036 - DNA, 20 bp, Artificial Sequence
  chemically synthesized
acaggcctactttgagtaat

SEQ ID NO: 597037 - DNA, 20 bp, Artificial Sequence
  chemically synthesized
aggcctgtgaatatgaggat

SEQ ID NO: 597038 - DNA, 20 bp, Artificial Sequence
  chemically synthesized
gtgcttattgttcttttggg

SEQ ID NO: 597039 - DNA, 20 bp, Artificial Sequence
  chemically synthesized
ttgtggttgtagctgactaa

SEQ ID NO: 597040 - DNA, 20 bp, Artificial Sequence
  chemically synthesized
atgtaggagtgacccaaggt

SEQ ID NO: 597041 - DNA, 20 bp, Artificial Sequence
  chemically synthesized
aaattccagaattatatctc

SEQ ID NO: 597042 - DNA, 20 bp, Artificial Sequence
  chemically synthesized
aggatggtccagtctgtgtc

SEQ ID NO: 597043 - DNA, 20 bp, Artificial Sequence
  chemically synthesized
aggacacagactggaccatc

SEQ ID NO: 597044 - DNA, 20 bp, Artificial Sequence
  chemically synthesized
tgtttgtcttgaaatgcttt

SEQ ID NO: 597045 - DNA, 20 bp, Artificial Sequence
  chemically synthesized
aattttgtctgtttgtcttg

SEQ ID NO: 597046 - DNA, 20 bp, Artificial Sequence
  chemically synthesized
ttcataaaaaggcaaatttt

SEQ ID NO: 597047 - DNA, 20 bp, Artificial Sequence
  chemically synthesized
tttgcctttttatgaacaaa

SEQ ID NO: 597048 - DNA, 20 bp, Artificial Sequence
  chemically synthesized
tcttagcctttgagtaattt

SEQ ID NO: 597049 - DNA, 20 bp, Artificial Sequence
  chemically synthesized
acaagttttaaaatattctt

SEQ ID NO: 597050 - DNA, 20 bp, Artificial Sequence
  chemically synthesized
gagagatttctgcctgaaat

SEQ ID NO: 597051 - DNA, 20 bp, Artificial Sequence
  chemically synthesized
agccacagatgtggtttttt

SEQ ID NO: 597052 - DNA, 20 bp, Artificial Sequence
  chemically synthesized
atctctcaaaaaaccacatc

SEQ ID NO: 597053 - DNA, 20 bp, Artificial Sequence
  chemically synthesized
tgcccattacaagccacaga

SEQ ID NO: 597054 - DNA, 20 bp, Artificial Sequence
  chemically synthesized
cacatctgtggcttgtaatg

SEQ ID NO: 597055 - DNA, 20 bp, Artificial Sequence
  chemically synthesized
agaattattttcatattagt

SEQ ID NO: 597056 - DNA, 20 bp, Artificial Sequence
  chemically synthesized
ttcacaagaattattttcat

SEQ ID NO: 597057 - DNA, 20 bp, Artificial Sequence
  chemically synthesized
tttgcaactttcatagggta

SEQ ID NO: 597058 - DNA, 20 bp, Artificial Sequence
  chemically synthesized
gaaattctaacgctttaaaa

SEQ ID NO: 597059 - DNA, 20 bp, Artificial Sequence
  chemically synthesized
ttgtcacaattatgaaattc

SEQ ID NO: 597060 - DNA, 20 bp, Artificial Sequence
  chemically synthesized
tttcaccttctattctagga

SEQ ID NO: 597061 - DNA, 20 bp, Artificial Sequence
  chemically synthesized
gcttgcttgtctgcttactt

SEQ ID NO: 597062 - DNA, 20 bp, Artificial Sequence
  chemically synthesized
gcttgcttgcttgtctgctt

SEQ ID NO: 597063 - DNA, 20 bp, Artificial Sequence
  chemically synthesized
aaaggtttgcttgcttgctt

SEQ ID NO: 597064 - DNA, 20 bp, Artificial Sequence
  chemically synthesized
ttctggtgaaaggtttgctt

SEQ ID NO: 597065 - DNA, 20 bp, Artificial Sequence
  chemically synthesized
aacattctggtgaaaggttt

SEQ ID NO: 597066 - DNA, 20 bp, Artificial Sequence
  chemically synthesized
gtataacattctggtgaaag

SEQ ID NO: 597067 - DNA, 20 bp, Artificial Sequence
  chemically synthesized
gtcagtataacattctggtg

SEQ ID NO: 597068 - DNA, 20 bp, Artificial Sequence
  chemically synthesized
aaataatctaagacctggat

SEQ ID NO: 597069 - DNA, 20 bp, Artificial Sequence
  chemically synthesized
agaaaaacatatatccaggt

SEQ ID NO: 597070 - DNA, 20 bp, Artificial Sequence
  chemically synthesized
gctgtatccacacctaaaag

SEQ ID NO: 597071 - DNA, 20 bp, Artificial Sequence
  chemically synthesized
tgaatacactatgatggaaa

SEQ ID NO: 597072 - DNA, 20 bp, Artificial Sequence
  chemically synthesized
aatggagattctgttaacca

SEQ ID NO: 597073 - DNA, 20 bp, Artificial Sequence
  chemically synthesized
gctgtaatattctagaatga

SEQ ID NO: 597074 - DNA, 20 bp, Artificial Sequence
  chemically synthesized
acttattcattctagaatat

SEQ ID NO: 597075 - DNA, 20 bp, Artificial Sequence
  chemically synthesized
aatattacagcttttgagtg

SEQ ID NO: 597076 - DNA, 20 bp, Artificial Sequence
  chemically synthesized
tgagcccttaaatgtatata

SEQ ID NO: 597077 - DNA, 20 bp, Artificial Sequence
  chemically synthesized
cacccctaagtggaatgcag

SEQ ID NO: 597078 - DNA, 20 bp, Artificial Sequence
  chemically synthesized
tgagtttatatgtcttacat

SEQ ID NO: 597079 - DNA, 20 bp, Artificial Sequence
  chemically synthesized
ttatcttacaggttattatc

SEQ ID NO: 597080 - DNA, 20 bp, Artificial Sequence
  chemically synthesized
ttgtctggattcatagaact

SEQ ID NO: 597081 - DNA, 20 bp, Artificial Sequence
  chemically synthesized
cttgatcaattattccattg

SEQ ID NO: 597082 - DNA, 20 bp, Artificial Sequence
  chemically synthesized
aataattgatcaagaacaga

SEQ ID NO: 597083 - DNA, 20 bp, Artificial Sequence
  chemically synthesized
aagtggtaaaggattttctg

SEQ ID NO: 597084 - DNA, 20 bp, Artificial Sequence
  chemically synthesized
catcagaaaatcctttacca

SEQ ID NO: 597085 - DNA, 20 bp, Artificial Sequence
  chemically synthesized
gcttagcaaagccaagtggt

SEQ ID NO: 597086 - DNA, 20 bp, Artificial Sequence
  chemically synthesized
atggattgtaattcattaca

SEQ ID NO: 597087 - DNA, 20 bp, Artificial Sequence
  chemically synthesized
tgttcgagatcagtagcaga

SEQ ID NO: 597088 - DNA, 20 bp, Artificial Sequence
  chemically synthesized
aagaccaaagtactttaaaa

SEQ ID NO: 597089 - DNA, 20 bp, Artificial Sequence
  chemically synthesized
aaagtcattatacgtatttg

SEQ ID NO: 597090 - DNA, 20 bp, Artificial Sequence
  chemically synthesized
cacataggatttcttatgct

SEQ ID NO: 597091 - DNA, 20 bp, Artificial Sequence
  chemically synthesized
ctgcctccatggcatttcac

SEQ ID NO: 597092 - DNA, 20 bp, Artificial Sequence
  chemically synthesized
ctctggcacatacttcatgt

SEQ ID NO: 597093 - DNA, 20 bp, Artificial Sequence
  chemically synthesized
aattttagagacgaataatt

SEQ ID NO: 597094 - DNA, 20 bp, Artificial Sequence
  chemically synthesized
atggaccttgcataagataa

SEQ ID NO: 597095 - DNA, 20 bp, Artificial Sequence
  chemically synthesized
tttcagtacattgtcataat

SEQ ID NO: 597096 - DNA, 20 bp, Artificial Sequence
  chemically synthesized
tatcagctttaaacttaggt

SEQ ID NO: 597097 - DNA, 20 bp, Artificial Sequence
  chemically synthesized
aaccactataaaacaaggac

SEQ ID NO: 597098 - DNA, 20 bp, Artificial Sequence
  chemically synthesized
acctaaatttaattagcaag

SEQ ID NO: 597099 - DNA, 20 bp, Artificial Sequence
  chemically synthesized
aagttacctaaatttaatta

SEQ ID NO: 597100 - DNA, 20 bp, Artificial Sequence
  chemically synthesized
agcgctcctacttagagggc

SEQ ID NO: 597101 - DNA, 20 bp, Artificial Sequence
  chemically synthesized
atttctcacatttcctaagc

SEQ ID NO: 597102 - DNA, 20 bp, Artificial Sequence
  chemically synthesized
tgtctgacttagatttaagc

SEQ ID NO: 597103 - DNA, 20 bp, Artificial Sequence
  chemically synthesized
attcatcaacttttgtctga

SEQ ID NO: 597104 - DNA, 20 bp, Artificial Sequence
  chemically synthesized
atttccctaggtacctactc

SEQ ID NO: 597105 - DNA, 20 bp, Artificial Sequence
  chemically synthesized
aattctgccaatataagagt

SEQ ID NO: 597106 - DNA, 20 bp, Artificial Sequence
  chemically synthesized
tgattcagcccgcatcttac

SEQ ID NO: 597107 - DNA, 20 bp, Artificial Sequence
  chemically synthesized
ttctttcctaattttatgaa

SEQ ID NO: 597108 - DNA, 20 bp, Artificial Sequence
  chemically synthesized
tcctgttttgttttgttttg

SEQ ID NO: 597109 - DNA, 20 bp, Artificial Sequence
  chemically synthesized
ccggctcctgttttgttttg

SEQ ID NO: 597110 - DNA, 20 bp, Artificial Sequence
  chemically synthesized
tgcacccggctcctgttttg

SEQ ID NO: 597111 - DNA, 20 bp, Artificial Sequence
  chemically synthesized
accactgcacccggctcctg

SEQ ID NO: 597112 - DNA, 20 bp, Artificial Sequence
  chemically synthesized
ggcacaccactgcacccggc

SEQ ID NO: 597113 - DNA, 20 bp, Artificial Sequence
  chemically synthesized
cacctcagccttctgagaag

SEQ ID NO: 597114 - DNA, 20 bp, Artificial Sequence
  chemically synthesized
cttctcagaaggctgaggtg

SEQ ID NO: 597115 - DNA, 20 bp, Artificial Sequence
  chemically synthesized
tgggaggattacttcatcca

SEQ ID NO: 597116 - DNA, 20 bp, Artificial Sequence
  chemically synthesized
ttttttttttttcatgactg

SEQ ID NO: 597117 - DNA, 20 bp, Artificial Sequence
  chemically synthesized
gctgcaagtggggctgggaa

SEQ ID NO: 597118 - DNA, 20 bp, Artificial Sequence
  chemically synthesized
acacatttcccagccccact

SEQ ID NO: 597119 - DNA, 20 bp, Artificial Sequence
  chemically synthesized
ctgccatgttatatttccac

SEQ ID NO: 597120 - DNA, 20 bp, Artificial Sequence
  chemically synthesized
gcataccaattgtcttttag

SEQ ID NO: 597121 - DNA, 20 bp, Artificial Sequence
  chemically synthesized
gatatgttggccccgctcat

SEQ ID NO: 597122 - DNA, 20 bp, Artificial Sequence
  chemically synthesized
ctgccttggctgcaaacttc

SEQ ID NO: 597123 - DNA, 20 bp, Artificial Sequence
  chemically synthesized
tctttctcctgaaaaaccct

SEQ ID NO: 597124 - DNA, 20 bp, Artificial Sequence
  chemically synthesized
gggtttttcaggagaaagaa

SEQ ID NO: 597125 - DNA, 20 bp, Artificial Sequence
  chemically synthesized
ttatttaagtcatttctacc

SEQ ID NO: 597126 - DNA, 20 bp, Artificial Sequence
  chemically synthesized
tctttattttatcaattata

SEQ ID NO: 597127 - DNA, 20 bp, Artificial Sequence
  chemically synthesized
attataattgataaaataaa

SEQ ID NO: 597128 - DNA, 20 bp, Artificial Sequence
  chemically synthesized
tctgggaaaagtacatttag

SEQ ID NO: 597129 - DNA, 20 bp, Artificial Sequence
  chemically synthesized
tttttctctacctggaatag

SEQ ID NO: 597130 - DNA, 20 bp, Artificial Sequence
  chemically synthesized
actttattcattgtgtattt

SEQ ID NO: 597131 - DNA, 20 bp, Artificial Sequence
  chemically synthesized
ttttcctttgacaataataa

SEQ ID NO: 597132 - DNA, 20 bp, Artificial Sequence
  chemically synthesized
tatatgaggggactgtattt

SEQ ID NO: 597133 - DNA, 20 bp, Artificial Sequence
  chemically synthesized
agcattttcatcctcaccat

SEQ ID NO: 597134 - DNA, 20 bp, Artificial Sequence
  chemically synthesized
atcatctatggtgaggatga

SEQ ID NO: 597135 - DNA, 20 bp, Artificial Sequence
  chemically synthesized
ttctcaaagtaattgaacat

SEQ ID NO: 597136 - DNA, 20 bp, Artificial Sequence
  chemically synthesized
atattgatctatggctaact

SEQ ID NO: 597137 - DNA, 20 bp, Artificial Sequence
  chemically synthesized
tagtcaatttcttatctgaa

SEQ ID NO: 597138 - DNA, 20 bp, Artificial Sequence
  chemically synthesized
tcttcacagttcacttagag

SEQ ID NO: 597139 - DNA, 20 bp, Artificial Sequence
  chemically synthesized
actaacctctaagtgaactg

SEQ ID NO: 597140 - DNA, 20 bp, Artificial Sequence
  chemically synthesized
tgccttatatcttcaacatt

SEQ ID NO: 597141 - DNA, 20 bp, Artificial Sequence
  chemically synthesized
agtgatttgctttttatgat

SEQ ID NO: 597142 - DNA, 20 bp, Artificial Sequence
  chemically synthesized
cacttaagagttgcagagtg

SEQ ID NO: 597143 - DNA, 20 bp, Artificial Sequence
  chemically synthesized
caaagcacttaagagttgca

SEQ ID NO: 597144 - DNA, 20 bp, Artificial Sequence
  chemically synthesized
caaatcactctgcaactctt

SEQ ID NO: 597145 - DNA, 20 bp, Artificial Sequence
  chemically synthesized
atagaagtttgtttctgccc

SEQ ID NO: 597146 - DNA, 20 bp, Artificial Sequence
  chemically synthesized
ttgaaatgcattaaatagaa

SEQ ID NO: 597147 - DNA, 20 bp, Artificial Sequence
  chemically synthesized
ctttttgaaatgcattaaat

SEQ ID NO: 597148 - DNA, 20 bp, Artificial Sequence
  chemically synthesized
ttgttgtatttattaagtga

SEQ ID NO: 597149 - DNA, 20 bp, Artificial Sequence
  chemically synthesized
ccttcatttacatttccttg

SEQ ID NO: 597150 - DNA, 20 bp, Artificial Sequence
  chemically synthesized
actagccttcatttacattt

SEQ ID NO: 597151 - DNA, 20 bp, Artificial Sequence
  chemically synthesized
acaaggaaatgtaaatgaag

SEQ ID NO: 597152 - DNA, 20 bp, Artificial Sequence
  chemically synthesized
ggtatagtgtgctgaatggt

SEQ ID NO: 597153 - DNA, 20 bp, Artificial Sequence
  chemically synthesized
tgaatggttcatgtttttta

SEQ ID NO: 597154 - DNA, 20 bp, Artificial Sequence
  chemically synthesized
aagaatattattcattgata

SEQ ID NO: 597155 - DNA, 20 bp, Artificial Sequence
  chemically synthesized
ataattggtttgttgtaagg

SEQ ID NO: 597156 - DNA, 20 bp, Artificial Sequence
  chemically synthesized
actatatggggttaatcttt

SEQ ID NO: 597157 - DNA, 20 bp, Artificial Sequence
  chemically synthesized
ggggttaatcttttgcagtt

SEQ ID NO: 597158 - DNA, 20 bp, Artificial Sequence
  chemically synthesized
gaggcaaagctttaaactgc

SEQ ID NO: 597159 - DNA, 20 bp, Artificial Sequence
  chemically synthesized
ggaagttttactaccagagg

SEQ ID NO: 597160 - DNA, 20 bp, Artificial Sequence
  chemically synthesized
actattgatgccaattacat

SEQ ID NO: 597161 - DNA, 20 bp, Artificial Sequence
  chemically synthesized
ccagcaacccaaaatgaatt

SEQ ID NO: 597162 - DNA, 20 bp, Artificial Sequence
  chemically synthesized
tgtgagccaaatagaggaga

SEQ ID NO: 597163 - DNA, 20 bp, Artificial Sequence
  chemically synthesized
agtgattgtgagccaaatag

SEQ ID NO: 597164 - DNA, 20 bp, Artificial Sequence
  chemically synthesized
cattttgcacaccactgaga

SEQ ID NO: 597165 - DNA, 20 bp, Artificial Sequence
  chemically synthesized
tgaatgatatttacaatagc

SEQ ID NO: 597166 - DNA, 20 bp, Artificial Sequence
  chemically synthesized
ttacaatagctagggattat

SEQ ID NO: 597167 - DNA, 20 bp, Artificial Sequence
  chemically synthesized
acactgctctgttcaagtgt

SEQ ID NO: 597168 - DNA, 20 bp, Artificial Sequence
  chemically synthesized
tatttcacactgctctgttc

SEQ ID NO: 597169 - DNA, 20 bp, Artificial Sequence
  chemically synthesized
tcttcttgtatatttcagat

SEQ ID NO: 597170 - DNA, 20 bp, Artificial Sequence
  chemically synthesized
gtaagtttcttcttgtatat

SEQ ID NO: 597171 - DNA, 20 bp, Artificial Sequence
  chemically synthesized
tactgtcttttttgccatat

SEQ ID NO: 597172 - DNA, 20 bp, Artificial Sequence
  chemically synthesized
aaaaagacagtatatagagg

SEQ ID NO: 597173 - DNA, 20 bp, Artificial Sequence
  chemically synthesized
tagaggctacgcttgatgga

SEQ ID NO: 597174 - DNA, 20 bp, Artificial Sequence
  chemically synthesized
ggagggagattataataaat

SEQ ID NO: 597175 - DNA, 20 bp, Artificial Sequence
  chemically synthesized
ataaatgacagattaatgag

SEQ ID NO: 597176 - DNA, 20 bp, Artificial Sequence
  chemically synthesized
ttaatgagacttgtttttct

SEQ ID NO: 597177 - DNA, 20 bp, Artificial Sequence
  chemically synthesized
ttgtttttctcgaagtttat

SEQ ID NO: 597178 - DNA, 20 bp, Artificial Sequence
  chemically synthesized
ccattattatcatcaagtcg

SEQ ID NO: 597179 - DNA, 20 bp, Artificial Sequence
  chemically synthesized
atatatacaagcaaaattca

SEQ ID NO: 597180 - DNA, 20 bp, Artificial Sequence
  chemically synthesized
aatgtcagaaaccacctgaa

SEQ ID NO: 597181 - DNA, 20 bp, Artificial Sequence
  chemically synthesized
accaataaaataaatcagac

SEQ ID NO: 597182 - DNA, 20 bp, Artificial Sequence
  chemically synthesized
acatatgtctacaatctttg

SEQ ID NO: 597183 - DNA, 20 bp, Artificial Sequence
  chemically synthesized
taaaaatttatttttaacct

SEQ ID NO: 597184 - DNA, 20 bp, Artificial Sequence
  chemically synthesized
aataaatttttaaatacttt

SEQ ID NO: 597185 - DNA, 20 bp, Artificial Sequence
  chemically synthesized
cagtgtttaggtgaactggt

SEQ ID NO: 597186 - DNA, 20 bp, Artificial Sequence
  chemically synthesized
actggtaagtgttttggtgt

SEQ ID NO: 597187 - DNA, 20 bp, Artificial Sequence
  chemically synthesized
ggtgtgtcagtttataagaa

SEQ ID NO: 597188 - DNA, 20 bp, Artificial Sequence
  chemically synthesized
ccaactagttacttagtaaa

SEQ ID NO: 597189 - DNA, 20 bp, Artificial Sequence
  chemically synthesized
ctcaagatcttctttgaaaa

SEQ ID NO: 597190 - DNA, 20 bp, Artificial Sequence
  chemically synthesized
tttatggggaaatgttctgt

SEQ ID NO: 597191 - DNA, 20 bp, Artificial Sequence
  chemically synthesized
cagaacatttccccataaac

SEQ ID NO: 597192 - DNA, 20 bp, Artificial Sequence
  chemically synthesized
cttttttgaattgttgaaac

SEQ ID NO: 597193 - DNA, 20 bp, Artificial Sequence
  chemically synthesized
cagtgagggagattagttat

SEQ ID NO: 597194 - DNA, 20 bp, Artificial Sequence
  chemically synthesized
acaatttgatgtttcagtga

SEQ ID NO: 597195 - DNA, 20 bp, Artificial Sequence
  chemically synthesized
tgctcatagttgttacaatt

SEQ ID NO: 597196 - DNA, 20 bp, Artificial Sequence
  chemically synthesized
ctggtttttggttctggtga

SEQ ID NO: 597197 - DNA, 20 bp, Artificial Sequence
  chemically synthesized
ccaggtaccatgattccgta

SEQ ID NO: 597198 - DNA, 20 bp, Artificial Sequence
  chemically synthesized
ccaggtacggaatcatggta

SEQ ID NO: 597199 - DNA, 20 bp, Artificial Sequence
  chemically synthesized
gatgaagttaaaaccaggta

SEQ ID NO: 597200 - DNA, 20 bp, Artificial Sequence
  chemically synthesized
tgattgggaaggtgtggtgt

SEQ ID NO: 597201 - DNA, 20 bp, Artificial Sequence
  chemically synthesized
tgcactgcacgtccagtgct

SEQ ID NO: 597202 - DNA, 20 bp, Artificial Sequence
  chemically synthesized
tactgtcccttccaaaagtg

SEQ ID NO: 597203 - DNA, 20 bp, Artificial Sequence
  chemically synthesized
caggcactgactgaggccag

SEQ ID NO: 597204 - DNA, 20 bp, Artificial Sequence
  chemically synthesized
tgagttctgactgctgggat

SEQ ID NO: 597205 - DNA, 20 bp, Artificial Sequence
  chemically synthesized
cccatcccagcagtcagaac

SEQ ID NO: 597206 - DNA, 20 bp, Artificial Sequence
  chemically synthesized
agcactttggcccacaatgg

SEQ ID NO: 597207 - DNA, 20 bp, Artificial Sequence
  chemically synthesized
cgtgtgtcccagactgcctc

SEQ ID NO: 597208 - DNA, 20 bp, Artificial Sequence
  chemically synthesized
accagctggcatggctaagg

SEQ ID NO: 597209 - DNA, 20 bp, Artificial Sequence
  chemically synthesized
acttttgttactgtgggctg

SEQ ID NO: 597210 - DNA, 20 bp, Artificial Sequence
  chemically synthesized
taacaaaagtgactccttac

SEQ ID NO: 597211 - DNA, 20 bp, Artificial Sequence
  chemically synthesized
gagaggagagtgaaaagtaa

SEQ ID NO: 597212 - DNA, 20 bp, Artificial Sequence
  chemically synthesized
ttctgtcttgcatcttggat

SEQ ID NO: 597213 - DNA, 20 bp, Artificial Sequence
  chemically synthesized
tggtcgagacactgtatctc

SEQ ID NO: 597214 - DNA, 20 bp, Artificial Sequence
  chemically synthesized
tacttcggcctcccaaagtg

SEQ ID NO: 597215 - DNA, 20 bp, Artificial Sequence
  chemically synthesized
ttttgtatttttagtagagt

SEQ ID NO: 597216 - DNA, 20 bp, Artificial Sequence
  chemically synthesized
aaaatacaaaaattagccac

SEQ ID NO: 597217 - DNA, 20 bp, Artificial Sequence
  chemically synthesized
tgccttagccccccaagagg

SEQ ID NO: 597218 - DNA, 20 bp, Artificial Sequence
  chemically synthesized
aacctccgcctcctgggttc

SEQ ID NO: 597219 - DNA, 20 bp, Artificial Sequence
  chemically synthesized
tgtgtagctttataggtgaa

SEQ ID NO: 597220 - DNA, 20 bp, Artificial Sequence
  chemically synthesized
ccctttatttccagtctgtg

SEQ ID NO: 597221 - DNA, 20 bp, Artificial Sequence
  chemically synthesized
tagagctagtccagctatgt

SEQ ID NO: 597222 - DNA, 20 bp, Artificial Sequence
  chemically synthesized
tataagtagagctagtccag

SEQ ID NO: 597223 - DNA, 20 bp, Artificial Sequence
  chemically synthesized
tcttacagtttttgtcctga

SEQ ID NO: 597224 - DNA, 20 bp, Artificial Sequence
  chemically synthesized
tgaccttctttgtctcttct

SEQ ID NO: 597225 - DNA, 20 bp, Artificial Sequence
  chemically synthesized
tactccagtgttgtatatat

SEQ ID NO: 597226 - DNA, 20 bp, Artificial Sequence
  chemically synthesized
ctctcctgagctcgaataat

SEQ ID NO: 597227 - DNA, 20 bp, Artificial Sequence
  chemically synthesized
gtccaatgttactactttgg

SEQ ID NO: 597228 - DNA, 20 bp, Artificial Sequence
  chemically synthesized
tagatccatttattctatag

SEQ ID NO: 597229 - DNA, 20 bp, Artificial Sequence
  chemically synthesized
acacattcttcttctcagca

SEQ ID NO: 597230 - DNA, 20 bp, Artificial Sequence
  chemically synthesized
cattgttactgaatttttaa

SEQ ID NO: 597231 - DNA, 20 bp, Artificial Sequence
  chemically synthesized
cattccattgtggtcagaga

SEQ ID NO: 597232 - DNA, 20 bp, Artificial Sequence
  chemically synthesized
tagcttccaaaattcctcat

SEQ ID NO: 597233 - DNA, 20 bp, Artificial Sequence
  chemically synthesized
gtttaacttccatgtgtttg

SEQ ID NO: 597234 - DNA, 20 bp, Artificial Sequence
  chemically synthesized
tagcatattgtttaacttcc

SEQ ID NO: 597235 - DNA, 20 bp, Artificial Sequence
  chemically synthesized
ccagtggtcatttagtagca

SEQ ID NO: 597236 - DNA, 20 bp, Artificial Sequence
  chemically synthesized
gtatcccataggttttggta

SEQ ID NO: 597237 - DNA, 20 bp, Artificial Sequence
  chemically synthesized
tactagttttgctgtatccc

SEQ ID NO: 597238 - DNA, 20 bp, Artificial Sequence
  chemically synthesized
ctgtaaatttctctcttagt

SEQ ID NO: 597239 - DNA, 20 bp, Artificial Sequence
  chemically synthesized
agagagaaatttacagctgt

SEQ ID NO: 597240 - DNA, 20 bp, Artificial Sequence
  chemically synthesized
gcattgttaggtgatttatt

SEQ ID NO: 597241 - DNA, 20 bp, Artificial Sequence
  chemically synthesized
ggtctttaagttgcattgtt

SEQ ID NO: 597242 - DNA, 20 bp, Artificial Sequence
  chemically synthesized
taattttgggttcgatttgc

SEQ ID NO: 597243 - DNA, 20 bp, Artificial Sequence
  chemically synthesized
ctttcttccactaattttgg

SEQ ID NO: 597244 - DNA, 20 bp, Artificial Sequence
  chemically synthesized
tttcgttttgttgacttttt

SEQ ID NO: 597245 - DNA, 20 bp, Artificial Sequence
  chemically synthesized
aaaagtcaacaaaacgaaaa

SEQ ID NO: 597246 - DNA, 20 bp, Artificial Sequence
  chemically synthesized
accttttcaataaaccaact

SEQ ID NO: 597247 - DNA, 20 bp, Artificial Sequence
  chemically synthesized
tctggctcaagatttgtcaa

SEQ ID NO: 597248 - DNA, 20 bp, Artificial Sequence
  chemically synthesized
tttttcttcattagtctggc

SEQ ID NO: 597249 - DNA, 20 bp, Artificial Sequence
  chemically synthesized
tgtaatatctcctttctcat

SEQ ID NO: 597250 - DNA, 20 bp, Artificial Sequence
  chemically synthesized
ctaggaatttatccattacc

SEQ ID NO: 597251 - DNA, 20 bp, Artificial Sequence
  chemically synthesized
tcctagacacatacaaccta

SEQ ID NO: 597252 - DNA, 20 bp, Artificial Sequence
  chemically synthesized
gttcaggttttggatttctt

SEQ ID NO: 597253 - DNA, 20 bp, Artificial Sequence
  chemically synthesized
cgttactggtccgttcaggt

SEQ ID NO: 597254 - DNA, 20 bp, Artificial Sequence
  chemically synthesized
gttactcgttactggtccgt

SEQ ID NO: 597255 - DNA, 20 bp, Artificial Sequence
  chemically synthesized
tctttactgggagagtttac

SEQ ID NO: 597256 - DNA, 20 bp, Artificial Sequence
  chemically synthesized
cccaagcttttctttactgg

SEQ ID NO: 597257 - DNA, 20 bp, Artificial Sequence
  chemically synthesized
agtaaactctcccagtaaag

SEQ ID NO: 597258 - DNA, 20 bp, Artificial Sequence
  chemically synthesized
agcagtgcagccatcgggtc

SEQ ID NO: 597259 - DNA, 20 bp, Artificial Sequence
  chemically synthesized
gtacgtttgtttgagttcat

SEQ ID NO: 597260 - DNA, 20 bp, Artificial Sequence
  chemically synthesized
tgtttgtttttttcttgtac

SEQ ID NO: 597261 - DNA, 20 bp, Artificial Sequence
  chemically synthesized
gggttgtttgtttttttctt

SEQ ID NO: 597262 - DNA, 20 bp, Artificial Sequence
  chemically synthesized
acccactttttgatggggtt

SEQ ID NO: 597263 - DNA, 20 bp, Artificial Sequence
  chemically synthesized
cttcacccactttttgatgg

SEQ ID NO: 597264 - DNA, 20 bp, Artificial Sequence
  chemically synthesized
gtgatggtgagcattttttc

SEQ ID NO: 597265 - DNA, 20 bp, Artificial Sequence
  chemically synthesized
atcagagaactgcaaatcaa

SEQ ID NO: 597266 - DNA, 20 bp, Artificial Sequence
  chemically synthesized
agattttagtcgttaatcca

SEQ ID NO: 597267 - DNA, 20 bp, Artificial Sequence
  chemically synthesized
gtagtttcttagtttgaggt

SEQ ID NO: 597268 - DNA, 20 bp, Artificial Sequence
  chemically synthesized
atgtttccttgtagtagttt

SEQ ID NO: 597269 - DNA, 20 bp, Artificial Sequence
  chemically synthesized
tttctccaatgtttccttgt

SEQ ID NO: 597270 - DNA, 20 bp, Artificial Sequence
  chemically synthesized
gatatcctggagagtttctc

SEQ ID NO: 597271 - DNA, 20 bp, Artificial Sequence
  chemically synthesized
ttacccagacagatatcctg

SEQ ID NO: 597272 - DNA, 20 bp, Artificial Sequence
  chemically synthesized
cttataggatattactcaag

SEQ ID NO: 597273 - DNA, 20 bp, Artificial Sequence
  chemically synthesized
ctgtgcttataggatattac

SEQ ID NO: 597274 - DNA, 20 bp, Artificial Sequence
  chemically synthesized
tctatttttgcttttgttgc

SEQ ID NO: 597275 - DNA, 20 bp, Artificial Sequence
  chemically synthesized
gatgtgatccatttgtctat

SEQ ID NO: 597276 - DNA, 20 bp, Artificial Sequence
  chemically synthesized
tattgattgtttcactgcgg

SEQ ID NO: 597277 - DNA, 20 bp, Artificial Sequence
  chemically synthesized
ggttgtctcttcactttatt

SEQ ID NO: 597278 - DNA, 20 bp, Artificial Sequence
  chemically synthesized
tgttggttgtctcttcactt

SEQ ID NO: 597279 - DNA, 20 bp, Artificial Sequence
  chemically synthesized
ttgcaaattacccatctcac

SEQ ID NO: 597280 - DNA, 20 bp, Artificial Sequence
  chemically synthesized
tattagactttttcctatag

SEQ ID NO: 597281 - DNA, 20 bp, Artificial Sequence
  chemically synthesized
aattagatcagaaaatagac

SEQ ID NO: 597282 - DNA, 20 bp, Artificial Sequence
  chemically synthesized
tgctgagcatattttgatac

SEQ ID NO: 597283 - DNA, 20 bp, Artificial Sequence
  chemically synthesized
agttttgctttgtatttctg

SEQ ID NO: 597284 - DNA, 20 bp, Artificial Sequence
  chemically synthesized
gagagaatatcccattgtag

SEQ ID NO: 597285 - DNA, 20 bp, Artificial Sequence
  chemically synthesized
ggggtgagagaatatcccat

SEQ ID NO: 597286 - DNA, 20 bp, Artificial Sequence
  chemically synthesized
aattgcctgtcttttggata

SEQ ID NO: 597287 - DNA, 20 bp, Artificial Sequence
  chemically synthesized
ttagtacaaccaaaatggag

SEQ ID NO: 597288 - DNA, 20 bp, Artificial Sequence
  chemically synthesized
gatcatatggtagccctgtt

SEQ ID NO: 597289 - DNA, 20 bp, Artificial Sequence
  chemically synthesized
attgctggatcatatggtag

SEQ ID NO: 597290 - DNA, 20 bp, Artificial Sequence
  chemically synthesized
tttgggatatatacccagca

SEQ ID NO: 597291 - DNA, 20 bp, Artificial Sequence
  chemically synthesized
gatatctctttgatatactg

SEQ ID NO: 597292 - DNA, 20 bp, Artificial Sequence
  chemically synthesized
gtacagatatctctttgata

SEQ ID NO: 597293 - DNA, 20 bp, Artificial Sequence
  chemically synthesized
tcaaagagatatctgtactc

SEQ ID NO: 597294 - DNA, 20 bp, Artificial Sequence
  chemically synthesized
caaatcttggctattatgaa

SEQ ID NO: 597295 - DNA, 20 bp, Artificial Sequence
  chemically synthesized
tgaagcactgttcataatag

SEQ ID NO: 597296 - DNA, 20 bp, Artificial Sequence
  chemically synthesized
catctcttgatggacgctca

SEQ ID NO: 597297 - DNA, 20 bp, Artificial Sequence
  chemically synthesized
gtgatgtttgtctttctgtg

SEQ ID NO: 597298 - DNA, 20 bp, Artificial Sequence
  chemically synthesized
cacaaataaatgagaacgtg

SEQ ID NO: 597299 - DNA, 20 bp, Artificial Sequence
  chemically synthesized
tatctccaagtgttcagttg

SEQ ID NO: 597300 - DNA, 20 bp, Artificial Sequence
  chemically synthesized
ccctctatctccaagtgttc

SEQ ID NO: 597301 - DNA, 20 bp, Artificial Sequence
  chemically synthesized
tgtttaaaaatgtacaatta

SEQ ID NO: 597302 - DNA, 20 bp, Artificial Sequence
  chemically synthesized
cagtaaaattgtattttttt

SEQ ID NO: 597303 - DNA, 20 bp, Artificial Sequence
  chemically synthesized
caattaaaaaaatacaattt

SEQ ID NO: 597304 - DNA, 20 bp, Artificial Sequence
  chemically synthesized
ctgtttgtaaaacaaagaat

SEQ ID NO: 597305 - DNA, 20 bp, Artificial Sequence
  chemically synthesized
catcccctcaagcaattatt

SEQ ID NO: 597306 - DNA, 20 bp, Artificial Sequence
  chemically synthesized
atatatatatggggtacatg

SEQ ID NO: 597307 - DNA, 20 bp, Artificial Sequence
  chemically synthesized
ataaacatatactatatata

SEQ ID NO: 597308 - DNA, 20 bp, Artificial Sequence
  chemically synthesized
taaatctatttatatatagt

SEQ ID NO: 597309 - DNA, 20 bp, Artificial Sequence
  chemically synthesized
tatagtatatatttatatat

SEQ ID NO: 597310 - DNA, 20 bp, Artificial Sequence
  chemically synthesized
ttatctttaaatgttatttt

SEQ ID NO: 597311 - DNA, 20 bp, Artificial Sequence
  chemically synthesized
ttgtccccatgactgaatcc

SEQ ID NO: 597312 - DNA, 20 bp, Artificial Sequence
  chemically synthesized
tgactggaagaaaggaatcc

SEQ ID NO: 597313 - DNA, 20 bp, Artificial Sequence
  chemically synthesized
ttcatatcctattccatggc

SEQ ID NO: 597314 - DNA, 20 bp, Artificial Sequence
  chemically synthesized
acaactttcttaagttcagg

SEQ ID NO: 597315 - DNA, 20 bp, Artificial Sequence
  chemically synthesized
ctttcttaagttcaggactt

SEQ ID NO: 597316 - DNA, 20 bp, Artificial Sequence
  chemically synthesized
aaaatacttactgttggttt

SEQ ID NO: 597317 - DNA, 20 bp, Artificial Sequence
  chemically synthesized
gccaatacaaaatacttact

SEQ ID NO: 597318 - DNA, 20 bp, Artificial Sequence
  chemically synthesized
ataaaaatcttcaaatatgg

SEQ ID NO: 597319 - DNA, 20 bp, Artificial Sequence
  chemically synthesized
gaattaatctctaccatatt

SEQ ID NO: 597320 - DNA, 20 bp, Artificial Sequence
  chemically synthesized
acaggatgctgacaactcac

SEQ ID NO: 597321 - DNA, 20 bp, Artificial Sequence
  chemically synthesized
gtgagttgtcagcatcctgt

SEQ ID NO: 597322 - DNA, 20 bp, Artificial Sequence
  chemically synthesized
taatctgggagcttttccag

SEQ ID NO: 597323 - DNA, 20 bp, Artificial Sequence
  chemically synthesized
caaacaattctggaaaagct

SEQ ID NO: 597324 - DNA, 20 bp, Artificial Sequence
  chemically synthesized
gagggacagatgcataatct

SEQ ID NO: 597325 - DNA, 20 bp, Artificial Sequence
  chemically synthesized
ccagattatgcatctgtccc

SEQ ID NO: 597326 - DNA, 20 bp, Artificial Sequence
  chemically synthesized
aaaattctatagtgataacg

SEQ ID NO: 597327 - DNA, 20 bp, Artificial Sequence
  chemically synthesized
atttattgaatgtctcagta

SEQ ID NO: 597328 - DNA, 20 bp, Artificial Sequence
  chemically synthesized
atcagaaactcacattagga

SEQ ID NO: 597329 - DNA, 20 bp, Artificial Sequence
  chemically synthesized
tctgcaagcccattcctaat

SEQ ID NO: 597330 - DNA, 20 bp, Artificial Sequence
  chemically synthesized
tccctactgtctgaatacag

SEQ ID NO: 597331 - DNA, 20 bp, Artificial Sequence
  chemically synthesized
attagggactttctcttcga

SEQ ID NO: 597332 - DNA, 20 bp, Artificial Sequence
  chemically synthesized
ttctcttcgaatctgattta

SEQ ID NO: 597333 - DNA, 20 bp, Artificial Sequence
  chemically synthesized
caggagtagaaaccaaataa

SEQ ID NO: 597334 - DNA, 20 bp, Artificial Sequence
  chemically synthesized
ctgatttatttggtttctac

SEQ ID NO: 597335 - DNA, 20 bp, Artificial Sequence
  chemically synthesized
tctactcctgttttctctcc

SEQ ID NO: 597336 - DNA, 20 bp, Artificial Sequence
  chemically synthesized
aaatggcagccagagcctgt

SEQ ID NO: 597337 - DNA, 20 bp, Artificial Sequence
  chemically synthesized
cctgtgagtgctttaatgct

SEQ ID NO: 597338 - DNA, 20 bp, Artificial Sequence
  chemically synthesized
aatggagaaatccctgggga

SEQ ID NO: 597339 - DNA, 20 bp, Artificial Sequence
  chemically synthesized
acagttggaagctgcttccc

SEQ ID NO: 597340 - DNA, 20 bp, Artificial Sequence
  chemically synthesized
ctgagggtgggacagttgga

SEQ ID NO: 597341 - DNA, 20 bp, Artificial Sequence
  chemically synthesized
tcagataaatatgtgggcac

SEQ ID NO: 597342 - DNA, 20 bp, Artificial Sequence
  chemically synthesized
gccaaaaatagaacaatgcg

SEQ ID NO: 597343 - DNA, 20 bp, Artificial Sequence
  chemically synthesized
aattgttttaataaagaagg

SEQ ID NO: 597344 - DNA, 20 bp, Artificial Sequence
  chemically synthesized
caccttctttattaaaacaa

SEQ ID NO: 597345 - DNA, 20 bp, Artificial Sequence
  chemically synthesized
acaggagggacataaatcat

SEQ ID NO: 597346 - DNA, 20 bp, Artificial Sequence
  chemically synthesized
cattgatgtgtttcctttag

SEQ ID NO: 597347 - DNA, 20 bp, Artificial Sequence
  chemically synthesized
tgtggatgctgcttgcattg

SEQ ID NO: 597348 - DNA, 20 bp, Artificial Sequence
  chemically synthesized
gttttgtttcttgatgtgga

SEQ ID NO: 597349 - DNA, 20 bp, Artificial Sequence
  chemically synthesized
cttctagggactgggtaatg

SEQ ID NO: 597350 - DNA, 20 bp, Artificial Sequence
  chemically synthesized
gcaggcttctagggactggg

SEQ ID NO: 597351 - DNA, 20 bp, Artificial Sequence
  chemically synthesized
acattacccagtccctagaa

SEQ ID NO: 597352 - DNA, 20 bp, Artificial Sequence
  chemically synthesized
tgtgattaacaagggctgaa

SEQ ID NO: 597353 - DNA, 20 bp, Artificial Sequence
  chemically synthesized
ataggagttacctttgtgag

SEQ ID NO: 597354 - DNA, 20 bp, Artificial Sequence
  chemically synthesized
aactaaaaaattaggcactt

SEQ ID NO: 597355 - DNA, 20 bp, Artificial Sequence
  chemically synthesized
aactccaaagtgcctaattt

SEQ ID NO: 597356 - DNA, 20 bp, Artificial Sequence
  chemically synthesized
ctaattttttagtttcatat

SEQ ID NO: 597357 - DNA, 20 bp, Artificial Sequence
  chemically synthesized
gaaatattattaataagaac

SEQ ID NO: 597358 - DNA, 20 bp, Artificial Sequence
  chemically synthesized
cttctttctctaattttttt

SEQ ID NO: 597359 - DNA, 20 bp, Artificial Sequence
  chemically synthesized
tagttaaattcaagatggtt

SEQ ID NO: 597360 - DNA, 20 bp, Artificial Sequence
  chemically synthesized
gtagaattccaagaaggaaa

SEQ ID NO: 597361 - DNA, 20 bp, Artificial Sequence
  chemically synthesized
attttaaaacattactttct

SEQ ID NO: 597362 - DNA, 20 bp, Artificial Sequence
  chemically synthesized
cctgtcaaacatcaagaaag

SEQ ID NO: 597363 - DNA, 20 bp, Artificial Sequence
  chemically synthesized
aatgctatcatcaaaatgaa

SEQ ID NO: 597364 - DNA, 20 bp, Artificial Sequence
  chemically synthesized
aaaagtgggaaacactcact

SEQ ID NO: 597365 - DNA, 20 bp, Artificial Sequence
  chemically synthesized
ctatcctgtaagccattagt

SEQ ID NO: 597366 - DNA, 20 bp, Artificial Sequence
  chemically synthesized
agatgttatactctattgtc

SEQ ID NO: 597367 - DNA, 20 bp, Artificial Sequence
  chemically synthesized
agtgttcattgaaagaagaa

SEQ ID NO: 597368 - DNA, 20 bp, Artificial Sequence
  chemically synthesized
tcattgaaagaagaaaagag

SEQ ID NO: 597369 - DNA, 20 bp, Artificial Sequence
  chemically synthesized
agaatttacataagatctat

SEQ ID NO: 597370 - DNA, 20 bp, Artificial Sequence
  chemically synthesized
agatagatcttatgtaaatt

SEQ ID NO: 597371 - DNA, 20 bp, Artificial Sequence
  chemically synthesized
tatgtaaattctttgttttt

SEQ ID NO: 597372 - DNA, 20 bp, Artificial Sequence
  chemically synthesized
tgattttcgggtgggtaact

SEQ ID NO: 597373 - DNA, 20 bp, Artificial Sequence
  chemically synthesized
ttactgctaaattcagtttt

SEQ ID NO: 597374 - DNA, 20 bp, Artificial Sequence
  chemically synthesized
aaattaatattactgctaaa

SEQ ID NO: 597375 - DNA, 20 bp, Artificial Sequence
  chemically synthesized
atggatagatatgcctatat

SEQ ID NO: 597376 - DNA, 20 bp, Artificial Sequence
  chemically synthesized
catatctatccatacgttca

SEQ ID NO: 597377 - DNA, 20 bp, Artificial Sequence
  chemically synthesized
atccatacgttcatggtgct

SEQ ID NO: 597378 - DNA, 20 bp, Artificial Sequence
  chemically synthesized
aagccttattttcacggaca

SEQ ID NO: 597379 - DNA, 20 bp, Artificial Sequence
  chemically synthesized
aatcagaatgtccgtgaaaa

SEQ ID NO: 597380 - DNA, 20 bp, Artificial Sequence
  chemically synthesized
gctcattcattatctaacat

SEQ ID NO: 597381 - DNA, 20 bp, Artificial Sequence
  chemically synthesized
aatgagcagtcataaattag

SEQ ID NO: 597382 - DNA, 20 bp, Artificial Sequence
  chemically synthesized
gttctcatctaaagcgtaat

SEQ ID NO: 597383 - DNA, 20 bp, Artificial Sequence
  chemically synthesized
gtcataaggtaaaacagaca

SEQ ID NO: 597384 - DNA, 20 bp, Artificial Sequence
  chemically synthesized
acgcagatgtactatttagt

SEQ ID NO: 597385 - DNA, 20 bp, Artificial Sequence
  chemically synthesized
gtcacataacatctttgaaa

SEQ ID NO: 597386 - DNA, 20 bp, Artificial Sequence
  chemically synthesized
aaaatgccttagtggttttg

SEQ ID NO: 597387 - DNA, 20 bp, Artificial Sequence
  chemically synthesized
ttacagctagaaaatgcctt

SEQ ID NO: 597388 - DNA, 20 bp, Artificial Sequence
  chemically synthesized
tagttaataatttataacag

SEQ ID NO: 597389 - DNA, 20 bp, Artificial Sequence
  chemically synthesized
gagatagttaataatttata

SEQ ID NO: 597390 - DNA, 20 bp, Artificial Sequence
  chemically synthesized
tactttctcattctattgat

SEQ ID NO: 597391 - DNA, 20 bp, Artificial Sequence
  chemically synthesized
atgtcagatttggcaacgta

SEQ ID NO: 597392 - DNA, 20 bp, Artificial Sequence
  chemically synthesized
ctcctgtgaagttcactgac

SEQ ID NO: 597393 - DNA, 20 bp, Artificial Sequence
  chemically synthesized
agaggccatgagtgttcttg

SEQ ID NO: 597394 - DNA, 20 bp, Artificial Sequence
  chemically synthesized
catgagtgttcttgggaggt

SEQ ID NO: 597395 - DNA, 20 bp, Artificial Sequence
  chemically synthesized
cctaagatgaagggtcagtg

SEQ ID NO: 597396 - DNA, 20 bp, Artificial Sequence
  chemically synthesized
agctaggttccatgatgcat

SEQ ID NO: 597397 - DNA, 20 bp, Artificial Sequence
  chemically synthesized
tactaacccacatcttgaag

SEQ ID NO: 597398 - DNA, 20 bp, Artificial Sequence
  chemically synthesized
agctgggcttggccgggaag

SEQ ID NO: 597399 - DNA, 20 bp, Artificial Sequence
  chemically synthesized
ttgtaccttgactgactcag

SEQ ID NO: 597400 - DNA, 20 bp, Artificial Sequence
  chemically synthesized
tgaaaacaacaggcatttct

SEQ ID NO: 597401 - DNA, 20 bp, Artificial Sequence
  chemically synthesized
cctaaacagccagaaatgcc

SEQ ID NO: 597402 - DNA, 20 bp, Artificial Sequence
  chemically synthesized
ttttcagtcagcaagttcta

SEQ ID NO: 597403 - DNA, 20 bp, Artificial Sequence
  chemically synthesized
ttcttactagctcaaattta

SEQ ID NO: 597404 - DNA, 20 bp, Artificial Sequence
  chemically synthesized
tttattttgatttaacccaa

SEQ ID NO: 597405 - DNA, 20 bp, Artificial Sequence
  chemically synthesized
attggcttactaaaaaactc

SEQ ID NO: 597406 - DNA, 20 bp, Artificial Sequence
  chemically synthesized
gtgttctcaacaaaaatctg

SEQ ID NO: 597407 - DNA, 20 bp, Artificial Sequence
  chemically synthesized
catttgtgtattcaggaatg

SEQ ID NO: 597408 - DNA, 20 bp, Artificial Sequence
  chemically synthesized
gcatagcttctaaatctctc

SEQ ID NO: 597409 - DNA, 20 bp, Artificial Sequence
  chemically synthesized
ggtagattcttgaatccttg

SEQ ID NO: 597410 - DNA, 20 bp, Artificial Sequence
  chemically synthesized
cctactaagtcccatacaat

SEQ ID NO: 597411 - DNA, 20 bp, Artificial Sequence
  chemically synthesized
ttgatgactgctgttacaat

SEQ ID NO: 597412 - DNA, 20 bp, Artificial Sequence
  chemically synthesized
ggctggaattgctgatgggc

SEQ ID NO: 597413 - DNA, 20 bp, Artificial Sequence
  chemically synthesized
ctgccatctgccttggtaaa

SEQ ID NO: 597414 - DNA, 20 bp, Artificial Sequence
  chemically synthesized
tatataaatggatggacatg

SEQ ID NO: 597415 - DNA, 20 bp, Artificial Sequence
  chemically synthesized
ccatccatttatatattata

SEQ ID NO: 597416 - DNA, 20 bp, Artificial Sequence
  chemically synthesized
ctgtcacaactactcaactc

SEQ ID NO: 597417 - DNA, 20 bp, Artificial Sequence
  chemically synthesized
atatccatcctctgactatc

SEQ ID NO: 597418 - DNA, 20 bp, Artificial Sequence
  chemically synthesized
aggagcaccattgcactgga

SEQ ID NO: 597419 - DNA, 20 bp, Artificial Sequence
  chemically synthesized
tttgctgtcatgccagagtc

SEQ ID NO: 597420 - DNA, 20 bp, Artificial Sequence
  chemically synthesized
ctggcatgacagcaaaataa

SEQ ID NO: 597421 - DNA, 20 bp, Artificial Sequence
  chemically synthesized
aaaataattcagatttacct

SEQ ID NO: 597422 - DNA, 20 bp, Artificial Sequence
  chemically synthesized
tgcctagcctgctcttcctt

SEQ ID NO: 597423 - DNA, 20 bp, Artificial Sequence
  chemically synthesized
cccattgttaaacctagctc

SEQ ID NO: 597424 - DNA, 20 bp, Artificial Sequence
  chemically synthesized
tcaataggaaagcctgagag

SEQ ID NO: 597425 - DNA, 20 bp, Artificial Sequence
  chemically synthesized
acctagctctcaggctttcc

SEQ ID NO: 597426 - DNA, 20 bp, Artificial Sequence
  chemically synthesized
ttattccccattcttagtaa

SEQ ID NO: 597427 - DNA, 20 bp, Artificial Sequence
  chemically synthesized
tagactcagtccctgctttg

SEQ ID NO: 597428 - DNA, 20 bp, Artificial Sequence
  chemically synthesized
agagaagaattagactcagt

SEQ ID NO: 597429 - DNA, 20 bp, Artificial Sequence
  chemically synthesized
atatctgttaattcattctt

SEQ ID NO: 597430 - DNA, 20 bp, Artificial Sequence
  chemically synthesized
caaccttaactgagccatta

SEQ ID NO: 597431 - DNA, 20 bp, Artificial Sequence
  chemically synthesized
tatatgtggggagcttagtg

SEQ ID NO: 597432 - DNA, 20 bp, Artificial Sequence
  chemically synthesized
tatctgacacaatatatgtg

SEQ ID NO: 597433 - DNA, 20 bp, Artificial Sequence
  chemically synthesized
tctatgtcacagggttgtta

SEQ ID NO: 597434 - DNA, 20 bp, Artificial Sequence
  chemically synthesized
acatcagaaatgtatggagc

SEQ ID NO: 597435 - DNA, 20 bp, Artificial Sequence
  chemically synthesized
gcacaggctctagagttcca

SEQ ID NO: 597436 - DNA, 20 bp, Artificial Sequence
  chemically synthesized
acgggttggaactctagagc

SEQ ID NO: 597437 - DNA, 20 bp, Artificial Sequence
  chemically synthesized
gcttataagcaattacttaa

SEQ ID NO: 597438 - DNA, 20 bp, Artificial Sequence
  chemically synthesized
agatacaaactgttttaagt

SEQ ID NO: 597439 - DNA, 20 bp, Artificial Sequence
  chemically synthesized
ttacttaaaacagtttgtat

SEQ ID NO: 597440 - DNA, 20 bp, Artificial Sequence
  chemically synthesized
ttagtacaatctcagataca

SEQ ID NO: 597441 - DNA, 20 bp, Artificial Sequence
  chemically synthesized
tttctggttttgacaaagga

SEQ ID NO: 597442 - DNA, 20 bp, Artificial Sequence
  chemically synthesized
accccaactctgaggacttt

SEQ ID NO: 597443 - DNA, 20 bp, Artificial Sequence
  chemically synthesized
gaaaagtcctcagagttggg

SEQ ID NO: 597444 - DNA, 20 bp, Artificial Sequence
  chemically synthesized
ccctctctgtggaatggcgt

SEQ ID NO: 597445 - DNA, 20 bp, Artificial Sequence
  chemically synthesized
ctgtggaatggcgttagtgt

SEQ ID NO: 597446 - DNA, 20 bp, Artificial Sequence
  chemically synthesized
ggtcatatggacatttccct

SEQ ID NO: 597447 - DNA, 20 bp, Artificial Sequence
  chemically synthesized
tctgctttttgaggtttctc

SEQ ID NO: 597448 - DNA, 20 bp, Artificial Sequence
  chemically synthesized
aaataacgctttctgctttt

SEQ ID NO: 597449 - DNA, 20 bp, Artificial Sequence
  chemically synthesized
actaaagtagaaataacgct

SEQ ID NO: 597450 - DNA, 20 bp, Artificial Sequence
  chemically synthesized
gttttgcactaaagtagaaa

SEQ ID NO: 597451 - DNA, 20 bp, Artificial Sequence
  chemically synthesized
ctgtgcttctatatacacct

SEQ ID NO: 597452 - DNA, 20 bp, Artificial Sequence
  chemically synthesized
tcttggatagccagtgatta

SEQ ID NO: 597453 - DNA, 20 bp, Artificial Sequence
  chemically synthesized
gttgaggtttcttggatagc

SEQ ID NO: 597454 - DNA, 20 bp, Artificial Sequence
  chemically synthesized
caccatcccctaaggaccgt

SEQ ID NO: 597455 - DNA, 20 bp, Artificial Sequence
  chemically synthesized
gggatggtgtgggtggccta

SEQ ID NO: 597456 - DNA, 20 bp, Artificial Sequence
  chemically synthesized
ctggtttgtcttcttatagt

SEQ ID NO: 597457 - DNA, 20 bp, Artificial Sequence
  chemically synthesized
tcttgggaagttcttccccc

SEQ ID NO: 597458 - DNA, 20 bp, Artificial Sequence
  chemically synthesized
ctgcgggctactccaatgat

SEQ ID NO: 597459 - DNA, 20 bp, Artificial Sequence
  chemically synthesized
aagtacaccatggtggcgat

SEQ ID NO: 597460 - DNA, 20 bp, Artificial Sequence
  chemically synthesized
gaattcaaggctgccacgag

SEQ ID NO: 597461 - DNA, 20 bp, Artificial Sequence
  chemically synthesized
tgcctcagcctcccaaagca

SEQ ID NO: 597462 - DNA, 20 bp, Artificial Sequence
  chemically synthesized
gtggctcatgcctgtaatcc

SEQ ID NO: 597463 - DNA, 20 bp, Artificial Sequence
  chemically synthesized
caggcatgagccaccatttt

SEQ ID NO: 597464 - DNA, 20 bp, Artificial Sequence
  chemically synthesized
tgagccaccattttataagt

SEQ ID NO: 597465 - DNA, 20 bp, Artificial Sequence
  chemically synthesized
gtagcatatacacagagtgg

SEQ ID NO: 597466 - DNA, 20 bp, Artificial Sequence
  chemically synthesized
gtttctttgcctttatcaag

SEQ ID NO: 597467 - DNA, 20 bp, Artificial Sequence
  chemically synthesized
tggtcccacagtatccaaag

SEQ ID NO: 597468 - DNA, 20 bp, Artificial Sequence
  chemically synthesized
tttcaaggaagttgagataa

SEQ ID NO: 597469 - DNA, 20 bp, Artificial Sequence
  chemically synthesized
aagttgagataaatctgttt

SEQ ID NO: 597470 - DNA, 20 bp, Artificial Sequence
  chemically synthesized
gagataaatctgtttttttg

SEQ ID NO: 597471 - DNA, 20 bp, Artificial Sequence
  chemically synthesized
aaaacaaaacaaaacaaaaa

SEQ ID NO: 597472 - DNA, 20 bp, Artificial Sequence
  chemically synthesized
aaatctgtttttttgttttg

SEQ ID NO: 597473 - DNA, 20 bp, Artificial Sequence
  chemically synthesized
tgtttttttgttttgttttg

SEQ ID NO: 597474 - DNA, 20 bp, Artificial Sequence
  chemically synthesized
cacccaggctggaatgcagt

SEQ ID NO: 597475 - DNA, 20 bp, Artificial Sequence
  chemically synthesized
agcctctgcctcctgggttc

SEQ ID NO: 597476 - DNA, 20 bp, Artificial Sequence
  chemically synthesized
aatgacctgtgcgtggtggc

SEQ ID NO: 597477 - DNA, 20 bp, Artificial Sequence
  chemically synthesized
ttttgtatttttaatggaga

SEQ ID NO: 597478 - DNA, 20 bp, Artificial Sequence
  chemically synthesized
cgccttggactcccaaagtg

SEQ ID NO: 597479 - DNA, 20 bp, Artificial Sequence
  chemically synthesized
atttcccctttggatagtct

SEQ ID NO: 597480 - DNA, 20 bp, Artificial Sequence
  chemically synthesized
tatccaaaggggaaatattc

SEQ ID NO: 597481 - DNA, 20 bp, Artificial Sequence
  chemically synthesized
atattctcaggtttcggaga

SEQ ID NO: 597482 - DNA, 20 bp, Artificial Sequence
  chemically synthesized
aagctccttatagaaaaggg

SEQ ID NO: 597483 - DNA, 20 bp, Artificial Sequence
  chemically synthesized
aaacatagcccttttctata

SEQ ID NO: 597484 - DNA, 20 bp, Artificial Sequence
  chemically synthesized
gggaggcagaaaagtaaaca

SEQ ID NO: 597485 - DNA, 20 bp, Artificial Sequence
  chemically synthesized
aacctaacacatagtaatca

SEQ ID NO: 597486 - DNA, 20 bp, Artificial Sequence
  chemically synthesized
aacaaattgattactatgtg

SEQ ID NO: 597487 - DNA, 20 bp, Artificial Sequence
  chemically synthesized
tggaaaatttacaaatgcat

SEQ ID NO: 597488 - DNA, 20 bp, Artificial Sequence
  chemically synthesized
attaaatgatgaaacaatat

SEQ ID NO: 597489 - DNA, 20 bp, Artificial Sequence
  chemically synthesized
ctaacatctggaaacttgga

SEQ ID NO: 597490 - DNA, 20 bp, Artificial Sequence
  chemically synthesized
tccagatgttaggagcgact

SEQ ID NO: 597491 - DNA, 20 bp, Artificial Sequence
  chemically synthesized
gttaggagcgactaatagtt

SEQ ID NO: 597492 - DNA, 20 bp, Artificial Sequence
  chemically synthesized
aaatcaatttgcagatgccc

SEQ ID NO: 597493 - DNA, 20 bp, Artificial Sequence
  chemically synthesized
aaaacacttgggcatctgca

SEQ ID NO: 597494 - DNA, 20 bp, Artificial Sequence
  chemically synthesized
tatcgctagaacataattgg

SEQ ID NO: 597495 - DNA, 20 bp, Artificial Sequence
  chemically synthesized
caaaattatctggtcagcct

SEQ ID NO: 597496 - DNA, 20 bp, Artificial Sequence
  chemically synthesized
attttgcacaattaaggagt

SEQ ID NO: 597497 - DNA, 20 bp, Artificial Sequence
  chemically synthesized
agggtttcattctcaaggga

SEQ ID NO: 597498 - DNA, 20 bp, Artificial Sequence
  chemically synthesized
ccgtcatttttctaaagtgt

SEQ ID NO: 597499 - DNA, 20 bp, Artificial Sequence
  chemically synthesized
gagataatcacttgagacaa

SEQ ID NO: 597500 - DNA, 20 bp, Artificial Sequence
  chemically synthesized
gcattaatctcagttgtctc

SEQ ID NO: 597501 - DNA, 20 bp, Artificial Sequence
  chemically synthesized
tactacatcaggcacctaaa

SEQ ID NO: 597502 - DNA, 20 bp, Artificial Sequence
  chemically synthesized
tctttactcctattttagtt

SEQ ID NO: 597503 - DNA, 20 bp, Artificial Sequence
  chemically synthesized
gttccctataattattagac

SEQ ID NO: 597504 - DNA, 20 bp, Artificial Sequence
  chemically synthesized
ctataattattagacgaatg

SEQ ID NO: 597505 - DNA, 20 bp, Artificial Sequence
  chemically synthesized
cagaagtctttatcctcaag

SEQ ID NO: 597506 - DNA, 20 bp, Artificial Sequence
  chemically synthesized
taaagttctctaacagctta

SEQ ID NO: 597507 - DNA, 20 bp, Artificial Sequence
  chemically synthesized
taaaagtaataaagttctct

SEQ ID NO: 597508 - DNA, 20 bp, Artificial Sequence
  chemically synthesized
attactctttcttttacatt

SEQ ID NO: 597509 - DNA, 20 bp, Artificial Sequence
  chemically synthesized
tttagcttcacatcacaaga

SEQ ID NO: 597510 - DNA, 20 bp, Artificial Sequence
  chemically synthesized
gcagaaattcaattacatta

SEQ ID NO: 597511 - DNA, 20 bp, Artificial Sequence
  chemically synthesized
ttcaattaagataaaaagaa

SEQ ID NO: 597512 - DNA, 20 bp, Artificial Sequence
  chemically synthesized
tttgttaagttgatttaaaa

SEQ ID NO: 597513 - DNA, 20 bp, Artificial Sequence
  chemically synthesized
ttgccatggggaatttgtta

SEQ ID NO: 597514 - DNA, 20 bp, Artificial Sequence
  chemically synthesized
atactacctatcaataaaaa

SEQ ID NO: 597515 - DNA, 20 bp, Artificial Sequence
  chemically synthesized
ggagtttgatacttagatta

SEQ ID NO: 597516 - DNA, 20 bp, Artificial Sequence
  chemically synthesized
aaatttataggagtttgata

SEQ ID NO: 597517 - DNA, 20 bp, Artificial Sequence
  chemically synthesized
atctgtatctacaaatttat

SEQ ID NO: 597518 - DNA, 20 bp, Artificial Sequence
  chemically synthesized
aactcctataaatttgtaga

SEQ ID NO: 597519 - DNA, 20 bp, Artificial Sequence
  chemically synthesized
ataaatatgttatatcgaac

SEQ ID NO: 597520 - DNA, 20 bp, Artificial Sequence
  chemically synthesized
tatagcacctcaatgcccca

SEQ ID NO: 597521 - DNA, 20 bp, Artificial Sequence
  chemically synthesized
cctcaatgccccaatctgat

SEQ ID NO: 597522 - DNA, 20 bp, Artificial Sequence
  chemically synthesized
aaaatttcaggtaatcgtaa

SEQ ID NO: 597523 - DNA, 20 bp, Artificial Sequence
  chemically synthesized
acctgaaattttagaagata

SEQ ID NO: 597524 - DNA, 20 bp, Artificial Sequence
  chemically synthesized
tcttgatacttgcagaaatg

SEQ ID NO: 597525 - DNA, 20 bp, Artificial Sequence
  chemically synthesized
atttttcttgatacttgcag

SEQ ID NO: 597526 - DNA, 20 bp, Artificial Sequence
  chemically synthesized
cattggaaatcaagctggga

SEQ ID NO: 597527 - DNA, 20 bp, Artificial Sequence
  chemically synthesized
ctacaggaagctctctccca

SEQ ID NO: 597528 - DNA, 20 bp, Artificial Sequence
  chemically synthesized
gaagctacaggaagctctct

SEQ ID NO: 597529 - DNA, 20 bp, Artificial Sequence
  chemically synthesized
caagctgggagagagcttcc

SEQ ID NO: 597530 - DNA, 20 bp, Artificial Sequence
  chemically synthesized
atgaataatgtcaatccgac

SEQ ID NO: 597531 - DNA, 20 bp, Artificial Sequence
  chemically synthesized
tagtctacaacaaagctcag

SEQ ID NO: 597532 - DNA, 20 bp, Artificial Sequence
  chemically synthesized
agacagctaattcatttttt

SEQ ID NO: 597533 - DNA, 20 bp, Artificial Sequence
  chemically synthesized
tgcaacaccatttgctacct

SEQ ID NO: 597534 - DNA, 20 bp, Artificial Sequence
  chemically synthesized
ccactctctcaggatgaggt

SEQ ID NO: 597535 - DNA, 20 bp, Artificial Sequence
  chemically synthesized
acatcttaaaactgccttca

SEQ ID NO: 597536 - DNA, 20 bp, Artificial Sequence
  chemically synthesized
ggatacagaagccaaatgaa

SEQ ID NO: 597537 - DNA, 20 bp, Artificial Sequence
  chemically synthesized
ggcttctgtatcctgacctc

SEQ ID NO: 597538 - DNA, 20 bp, Artificial Sequence
  chemically synthesized
aaaattatgagaacaaatgg

SEQ ID NO: 597539 - DNA, 20 bp, Artificial Sequence
  chemically synthesized
ctggagttcggaggagatgt

SEQ ID NO: 597540 - DNA, 20 bp, Artificial Sequence
  chemically synthesized
agaattttgtttgcgtcata

SEQ ID NO: 597541 - DNA, 20 bp, Artificial Sequence
  chemically synthesized
ttaggaaatgcagttcagaa

SEQ ID NO: 597542 - DNA, 20 bp, Artificial Sequence
  chemically synthesized
tttcctaatccttctcatcc

SEQ ID NO: 597543 - DNA, 20 bp, Artificial Sequence
  chemically synthesized
tgagggaatctatgggatga

SEQ ID NO: 597544 - DNA, 20 bp, Artificial Sequence
  chemically synthesized
tcatttcagtaaatggcaat

SEQ ID NO: 597545 - DNA, 20 bp, Artificial Sequence
  chemically synthesized
agtaattcaattaacaatta

SEQ ID NO: 597546 - DNA, 20 bp, Artificial Sequence
  chemically synthesized
cagtattcaaattattgggc

SEQ ID NO: 597547 - DNA, 20 bp, Artificial Sequence
  chemically synthesized
tcaaattattgggcaaatgt

SEQ ID NO: 597548 - DNA, 20 bp, Artificial Sequence
  chemically synthesized
tcaggacatatgcagaattt

SEQ ID NO: 597549 - DNA, 20 bp, Artificial Sequence
  chemically synthesized
taacccagatgagagacaat

SEQ ID NO: 597550 - DNA, 20 bp, Artificial Sequence
  chemically synthesized
actacctatctaaatggtcc

SEQ ID NO: 597551 - DNA, 20 bp, Artificial Sequence
  chemically synthesized
aattctccacacaagagccg

SEQ ID NO: 597552 - DNA, 20 bp, Artificial Sequence
  chemically synthesized
gaggagtgatatgatcccaa

SEQ ID NO: 597553 - DNA, 20 bp, Artificial Sequence
  chemically synthesized
ctctgtgatgaagagccacc

SEQ ID NO: 597554 - DNA, 20 bp, Artificial Sequence
  chemically synthesized
atgtaggcttttgaaattgg

SEQ ID NO: 597555 - DNA, 20 bp, Artificial Sequence
  chemically synthesized
caagaataattatttttcat

SEQ ID NO: 597556 - DNA, 20 bp, Artificial Sequence
  chemically synthesized
gatttgctttattatacttg

SEQ ID NO: 597557 - DNA, 20 bp, Artificial Sequence
  chemically synthesized
gatggatcatcataggactg

SEQ ID NO: 597558 - DNA, 20 bp, Artificial Sequence
  chemically synthesized
ctaaagatggatcatcatag

SEQ ID NO: 597559 - DNA, 20 bp, Artificial Sequence
  chemically synthesized
agactggagagagaaaaaaa

SEQ ID NO: 597560 - DNA, 20 bp, Artificial Sequence
  chemically synthesized
cacctgttattagtctcgtc

SEQ ID NO: 597561 - DNA, 20 bp, Artificial Sequence
  chemically synthesized
attagtctcgtcagctgttt

SEQ ID NO: 597562 - DNA, 20 bp, Artificial Sequence
  chemically synthesized
tttcctgcaatatagactga

SEQ ID NO: 597563 - DNA, 20 bp, Artificial Sequence
  chemically synthesized
gtttttatattacccatcct

SEQ ID NO: 597564 - DNA, 20 bp, Artificial Sequence
  chemically synthesized
cccagaattagaatactgat

SEQ ID NO: 597565 - DNA, 20 bp, Artificial Sequence
  chemically synthesized
caaagtgatgtggggctgct

SEQ ID NO: 597566 - DNA, 20 bp, Artificial Sequence
  chemically synthesized
gttcacggaaagccttctaa

SEQ ID NO: 597567 - DNA, 20 bp, Artificial Sequence
  chemically synthesized
atcccaagtaaactaaatta

SEQ ID NO: 597568 - DNA, 20 bp, Artificial Sequence
  chemically synthesized
acttgggataattttactta

SEQ ID NO: 597569 - DNA, 20 bp, Artificial Sequence
  chemically synthesized
ttactgttgtggaatatatt

SEQ ID NO: 597570 - DNA, 20 bp, Artificial Sequence
  chemically synthesized
tttttgtataggaatgcaga

SEQ ID NO: 597571 - DNA, 20 bp, Artificial Sequence
  chemically synthesized
gaatgcagaataagcttact

SEQ ID NO: 597572 - DNA, 20 bp, Artificial Sequence
  chemically synthesized
tcaatctaagaaaacattga

SEQ ID NO: 597573 - DNA, 20 bp, Artificial Sequence
  chemically synthesized
ataagcttactcaatgtttt

SEQ ID NO: 597574 - DNA, 20 bp, Artificial Sequence
  chemically synthesized
tggtgatatctggaagatta

SEQ ID NO: 597575 - DNA, 20 bp, Artificial Sequence
  chemically synthesized
actgataaatggtgatatct

SEQ ID NO: 597576 - DNA, 20 bp, Artificial Sequence
  chemically synthesized
atgaatggccctcaccaagc

SEQ ID NO: 597577 - DNA, 20 bp, Artificial Sequence
  chemically synthesized
gaggagctcagtcagcaagc

SEQ ID NO: 597578 - DNA, 20 bp, Artificial Sequence
  chemically synthesized
taagggtagtagagttaccc

SEQ ID NO: 597579 - DNA, 20 bp, Artificial Sequence
  chemically synthesized
taagggtaactctactaccc

SEQ ID NO: 597580 - DNA, 20 bp, Artificial Sequence
  chemically synthesized
tgactagcttatttacagca

SEQ ID NO: 597581 - DNA, 20 bp, Artificial Sequence
  chemically synthesized
cttggttttggtgggttttg

SEQ ID NO: 597582 - DNA, 20 bp, Artificial Sequence
  chemically synthesized
ttttcaccagcttggttttg

SEQ ID NO: 597583 - DNA, 20 bp, Artificial Sequence
  chemically synthesized
gaggtcacttttttcaccag

SEQ ID NO: 597584 - DNA, 20 bp, Artificial Sequence
  chemically synthesized
gaccagaggtcacttttttc

SEQ ID NO: 597585 - DNA, 20 bp, Artificial Sequence
  chemically synthesized
agtcagcaattcctagaact

SEQ ID NO: 597586 - DNA, 20 bp, Artificial Sequence
  chemically synthesized
aaacaaggggtggattattc

SEQ ID NO: 597587 - DNA, 20 bp, Artificial Sequence
  chemically synthesized
aaactcatgaataatccacc

SEQ ID NO: 597588 - DNA, 20 bp, Artificial Sequence
  chemically synthesized
tgattatatgctaaacaagg

SEQ ID NO: 597589 - DNA, 20 bp, Artificial Sequence
  chemically synthesized
tcaggatacttgtagttatt

SEQ ID NO: 597590 - DNA, 20 bp, Artificial Sequence
  chemically synthesized
gtaggcagtgcagtggcatg

SEQ ID NO: 597591 - DNA, 20 bp, Artificial Sequence
  chemically synthesized
ttcctttactttcttaataa

SEQ ID NO: 597592 - DNA, 20 bp, Artificial Sequence
  chemically synthesized
cttttttaaaaaaagtaaaa

SEQ ID NO: 597593 - DNA, 20 bp, Artificial Sequence
  chemically synthesized
tttataggtcatagtgaaga

SEQ ID NO: 597594 - DNA, 20 bp, Artificial Sequence
  chemically synthesized
tagagatttataggtcatag

SEQ ID NO: 597595 - DNA, 20 bp, Artificial Sequence
  chemically synthesized
tagtatacaaccaagtcatg

SEQ ID NO: 597596 - DNA, 20 bp, Artificial Sequence
  chemically synthesized
tatgaagagactgggaagag

SEQ ID NO: 597597 - DNA, 20 bp, Artificial Sequence
  chemically synthesized
tccacaacacttcaccctca

SEQ ID NO: 597598 - DNA, 20 bp, Artificial Sequence
  chemically synthesized
cttgagtataacaactacat

SEQ ID NO: 597599 - DNA, 20 bp, Artificial Sequence
  chemically synthesized
ataacaactacattcttgct

SEQ ID NO: 597600 - DNA, 20 bp, Artificial Sequence
  chemically synthesized
ttgctgttctacctgccaaa

SEQ ID NO: 597601 - DNA, 20 bp, Artificial Sequence
  chemically synthesized
agagtaatgccaggaataaa

SEQ ID NO: 597602 - DNA, 20 bp, Artificial Sequence
  chemically synthesized
gataacaacatccctgtagt

SEQ ID NO: 597603 - DNA, 20 bp, Artificial Sequence
  chemically synthesized
tacagggatgttgttatctg

SEQ ID NO: 597604 - DNA, 20 bp, Artificial Sequence
  chemically synthesized
tgggcttccaaagctcaaac

SEQ ID NO: 597605 - DNA, 20 bp, Artificial Sequence
  chemically synthesized
atcatgtgccaagcacaggt

SEQ ID NO: 597606 - DNA, 20 bp, Artificial Sequence
  chemically synthesized
ccatctatcatgtgccaagc

SEQ ID NO: 597607 - DNA, 20 bp, Artificial Sequence
  chemically synthesized
cttggcacatgatagatggc

SEQ ID NO: 597608 - DNA, 20 bp, Artificial Sequence
  chemically synthesized
tctattcatttattcaacaa

SEQ ID NO: 597609 - DNA, 20 bp, Artificial Sequence
  chemically synthesized
ggtcccataaatttaatcca

SEQ ID NO: 597610 - DNA, 20 bp, Artificial Sequence
  chemically synthesized
cataaatttaatccataatg

SEQ ID NO: 597611 - DNA, 20 bp, Artificial Sequence
  chemically synthesized
atagaatataaacaaaacat

SEQ ID NO: 597612 - DNA, 20 bp, Artificial Sequence
  chemically synthesized
ccgtataacccatttgtggt

SEQ ID NO: 597613 - DNA, 20 bp, Artificial Sequence
  chemically synthesized
ttcttcccgtataacccatt

SEQ ID NO: 597614 - DNA, 20 bp, Artificial Sequence
  chemically synthesized
atttattgagaataaatatg

SEQ ID NO: 597615 - DNA, 20 bp, Artificial Sequence
  chemically synthesized
agcaaatttattgagaataa

SEQ ID NO: 597616 - DNA, 20 bp, Artificial Sequence
  chemically synthesized
actaggaagaatagccagaa

SEQ ID NO: 597617 - DNA, 20 bp, Artificial Sequence
  chemically synthesized
ctaaactgtgtttcacccac

SEQ ID NO: 597618 - DNA, 20 bp, Artificial Sequence
  chemically synthesized
agaaacaaaggtgggtgaaa

SEQ ID NO: 597619 - DNA, 20 bp, Artificial Sequence
  chemically synthesized
caaaggtgggtgaaacacag

SEQ ID NO: 597620 - DNA, 20 bp, Artificial Sequence
  chemically synthesized
cttcttaaaggcaaactaaa

SEQ ID NO: 597621 - DNA, 20 bp, Artificial Sequence
  chemically synthesized
cacagtttagtttgccttta

SEQ ID NO: 597622 - DNA, 20 bp, Artificial Sequence
  chemically synthesized
ttgcctttaagaagttttaa

SEQ ID NO: 597623 - DNA, 20 bp, Artificial Sequence
  chemically synthesized
attgtagtagtaagaaagga

SEQ ID NO: 597624 - DNA, 20 bp, Artificial Sequence
  chemically synthesized
atccagctaaggcttctata

SEQ ID NO: 597625 - DNA, 20 bp, Artificial Sequence
  chemically synthesized
cttccttcttctcatccagc

SEQ ID NO: 597626 - DNA, 20 bp, Artificial Sequence
  chemically synthesized
tgttttctctaacttctaga

SEQ ID NO: 597627 - DNA, 20 bp, Artificial Sequence
  chemically synthesized
cctatgaccaaatatatgat

SEQ ID NO: 597628 - DNA, 20 bp, Artificial Sequence
  chemically synthesized
aaatatgactgcgcttgtta

SEQ ID NO: 597629 - DNA, 20 bp, Artificial Sequence
  chemically synthesized
gaaaaggcagccaaatatga

SEQ ID NO: 597630 - DNA, 20 bp, Artificial Sequence
  chemically synthesized
ggctgccttttcagtaacat

SEQ ID NO: 597631 - DNA, 20 bp, Artificial Sequence
  chemically synthesized
gtttcatgccccatcttccc

SEQ ID NO: 597632 - DNA, 20 bp, Artificial Sequence
  chemically synthesized
cattattgaacatcctcagc

SEQ ID NO: 597633 - DNA, 20 bp, Artificial Sequence
  chemically synthesized
gaggctgaggatgttcaata

SEQ ID NO: 597634 - DNA, 20 bp, Artificial Sequence
  chemically synthesized
agtacaggcagaattttctg

SEQ ID NO: 597635 - DNA, 20 bp, Artificial Sequence
  chemically synthesized
cttcagtagctaatggggaa

SEQ ID NO: 597636 - DNA, 20 bp, Artificial Sequence
  chemically synthesized
ttttaaaaagttatcattat

SEQ ID NO: 597637 - DNA, 20 bp, Artificial Sequence
  chemically synthesized
atggagtcataacagttggc

SEQ ID NO: 597638 - DNA, 20 bp, Artificial Sequence
  chemically synthesized
tctagttgaagaggtgagtg

SEQ ID NO: 597639 - DNA, 20 bp, Artificial Sequence
  chemically synthesized
tccacccactcacctcttca

SEQ ID NO: 597640 - DNA, 20 bp, Artificial Sequence
  chemically synthesized
atggagaaaataatatatca

SEQ ID NO: 597641 - DNA, 20 bp, Artificial Sequence
  chemically synthesized
atttatggagaaaataatat

SEQ ID NO: 597642 - DNA, 20 bp, Artificial Sequence
  chemically synthesized
aatgtgaatagcaactagat

SEQ ID NO: 597643 - DNA, 20 bp, Artificial Sequence
  chemically synthesized
catttgagctgaagtgggaa

SEQ ID NO: 597644 - DNA, 20 bp, Artificial Sequence
  chemically synthesized
acagtcactgaattctgctg

SEQ ID NO: 597645 - DNA, 20 bp, Artificial Sequence
  chemically synthesized
ggtatctggcctgggcatcc

SEQ ID NO: 597646 - DNA, 20 bp, Artificial Sequence
  chemically synthesized
atttgtggtgtcattgggta

SEQ ID NO: 597647 - DNA, 20 bp, Artificial Sequence
  chemically synthesized
gatgaagaggttccatggtt

SEQ ID NO: 597648 - DNA, 20 bp, Artificial Sequence
  chemically synthesized
catctacagtttgatgcctc

SEQ ID NO: 597649 - DNA, 20 bp, Artificial Sequence
  chemically synthesized
tcaactgcctctggaacatc

SEQ ID NO: 597650 - DNA, 20 bp, Artificial Sequence
  chemically synthesized
atgttccagaggcagttgaa

SEQ ID NO: 597651 - DNA, 20 bp, Artificial Sequence
  chemically synthesized
atcttactcctcttctcaaa

SEQ ID NO: 597652 - DNA, 20 bp, Artificial Sequence
  chemically synthesized
tgagaagaggagtaagatgg

SEQ ID NO: 597653 - DNA, 20 bp, Artificial Sequence
  chemically synthesized
ttcacatttggatacatgga

SEQ ID NO: 597654 - DNA, 20 bp, Artificial Sequence
  chemically synthesized
actgaatggcaagcgtacct

SEQ ID NO: 597655 - DNA, 20 bp, Artificial Sequence
  chemically synthesized
gcaatgcactaaactccaag

SEQ ID NO: 597656 - DNA, 20 bp, Artificial Sequence
  chemically synthesized
gagtttagtgcattgctctg

SEQ ID NO: 597657 - DNA, 20 bp, Artificial Sequence
  chemically synthesized
atcaaagggctcttggagat

SEQ ID NO: 597658 - DNA, 20 bp, Artificial Sequence
  chemically synthesized
aacttttatctccaagagcc

SEQ ID NO: 597659 - DNA, 20 bp, Artificial Sequence
  chemically synthesized
aaaaataatagacctagatc

SEQ ID NO: 597660 - DNA, 20 bp, Artificial Sequence
  chemically synthesized
aatcccagaattgtggatct

SEQ ID NO: 597661 - DNA, 20 bp, Artificial Sequence
  chemically synthesized
aatctccaagatccacaatt

SEQ ID NO: 597662 - DNA, 20 bp, Artificial Sequence
  chemically synthesized
cagataaacatcttgccctg

SEQ ID NO: 597663 - DNA, 20 bp, Artificial Sequence
  chemically synthesized
ctcaaaagcatctcagggca

SEQ ID NO: 597664 - DNA, 20 bp, Artificial Sequence
  chemically synthesized
tattctctcatccagagatc

SEQ ID NO: 597665 - DNA, 20 bp, Artificial Sequence
  chemically synthesized
ctcactgcaagctccgcctc

SEQ ID NO: 597666 - DNA, 20 bp, Artificial Sequence
  chemically synthesized
gtgtaagtaaacccgggagg

SEQ ID NO: 597667 - DNA, 20 bp, Artificial Sequence
  chemically synthesized
ttttgtatctttagtagaga

SEQ ID NO: 597668 - DNA, 20 bp, Artificial Sequence
  chemically synthesized
aaaataggcaagaatattcc

SEQ ID NO: 597669 - DNA, 20 bp, Artificial Sequence
  chemically synthesized
ctccaacttacaaatgatta

SEQ ID NO: 597670 - DNA, 20 bp, Artificial Sequence
  chemically synthesized
taacacagtctccaacttac

SEQ ID NO: 597671 - DNA, 20 bp, Artificial Sequence
  chemically synthesized
ggagtgactgctgctgatcg

SEQ ID NO: 597672 - DNA, 20 bp, Artificial Sequence
  chemically synthesized
cctgtttccctctctgattg

SEQ ID NO: 597673 - DNA, 20 bp, Artificial Sequence
  chemically synthesized
aacttctttcctgtttccct

SEQ ID NO: 597674 - DNA, 20 bp, Artificial Sequence
  chemically synthesized
agttttattgttaacttctt

SEQ ID NO: 597675 - DNA, 20 bp, Artificial Sequence
  chemically synthesized
agaagttaacaataaaactt

SEQ ID NO: 597676 - DNA, 20 bp, Artificial Sequence
  chemically synthesized
agaataaggcagaaaatcct

SEQ ID NO: 597677 - DNA, 20 bp, Artificial Sequence
  chemically synthesized
agaggattttctgccttatt

SEQ ID NO: 597678 - DNA, 20 bp, Artificial Sequence
  chemically synthesized
ttctgccttattctaagatt

SEQ ID NO: 597679 - DNA, 20 bp, Artificial Sequence
  chemically synthesized
tctgtagtctcacctgcctc

SEQ ID NO: 597680 - DNA, 20 bp, Artificial Sequence
  chemically synthesized
cagttgtaaaaggtaaaagt

SEQ ID NO: 597681 - DNA, 20 bp, Artificial Sequence
  chemically synthesized
taaataagacacgagaacac

SEQ ID NO: 597682 - DNA, 20 bp, Artificial Sequence
  chemically synthesized
gagtgaatttcagagaaaga

SEQ ID NO: 597683 - DNA, 20 bp, Artificial Sequence
  chemically synthesized
tctatgtacaccttgtgatg

SEQ ID NO: 597684 - DNA, 20 bp, Artificial Sequence
  chemically synthesized
tgcgaaacaaaagaaataat

SEQ ID NO: 597685 - DNA, 20 bp, Artificial Sequence
  chemically synthesized
tggaaagctttcattatttc

SEQ ID NO: 597686 - DNA, 20 bp, Artificial Sequence
  chemically synthesized
aattctcagattgtttctgt

SEQ ID NO: 597687 - DNA, 20 bp, Artificial Sequence
  chemically synthesized
tccagataagtaaattctca

SEQ ID NO: 597688 - DNA, 20 bp, Artificial Sequence
  chemically synthesized
ttcctccagataagtaaatt

SEQ ID NO: 597689 - DNA, 20 bp, Artificial Sequence
  chemically synthesized
tctatgtgaaattgctaaaa

SEQ ID NO: 597690 - DNA, 20 bp, Artificial Sequence
  chemically synthesized
gttgaataagactagggatg

SEQ ID NO: 597691 - DNA, 20 bp, Artificial Sequence
  chemically synthesized
atggtcagattgctcaggaa

SEQ ID NO: 597692 - DNA, 20 bp, Artificial Sequence
  chemically synthesized
tactcatctccttcctctgc

SEQ ID NO: 597693 - DNA, 20 bp, Artificial Sequence
  chemically synthesized
acagtctggtctgcctacat

SEQ ID NO: 597694 - DNA, 20 bp, Artificial Sequence
  chemically synthesized
tctttcactataaaatagaa

SEQ ID NO: 597695 - DNA, 20 bp, Artificial Sequence
  chemically synthesized
agtatgctgtatttgacatc

SEQ ID NO: 597696 - DNA, 20 bp, Artificial Sequence
  chemically synthesized
tgctgtatttgacatcagag

SEQ ID NO: 597697 - DNA, 20 bp, Artificial Sequence
  chemically synthesized
cagaggcttgcttattgaag

SEQ ID NO: 597698 - DNA, 20 bp, Artificial Sequence
  chemically synthesized
agtttctgttttattatgag

SEQ ID NO: 597699 - DNA, 20 bp, Artificial Sequence
  chemically synthesized
ccaacagtttctgttttatt

SEQ ID NO: 597700 - DNA, 20 bp, Artificial Sequence
  chemically synthesized
tgagcatagtatccaacagt

SEQ ID NO: 597701 - DNA, 20 bp, Artificial Sequence
  chemically synthesized
aggcagtgagcatagtatcc

SEQ ID NO: 597702 - DNA, 20 bp, Artificial Sequence
  chemically synthesized
catggatatattgtttgatg

SEQ ID NO: 597703 - DNA, 20 bp, Artificial Sequence
  chemically synthesized
gcaggtttgttacatggata

SEQ ID NO: 597704 - DNA, 20 bp, Artificial Sequence
  chemically synthesized
ttagattcaggaatacatgt

SEQ ID NO: 597705 - DNA, 20 bp, Artificial Sequence
  chemically synthesized
tattataatttcaagtgtat

SEQ ID NO: 597706 - DNA, 20 bp, Artificial Sequence
  chemically synthesized
ctagagatacgcttgagttc

SEQ ID NO: 597707 - DNA, 20 bp, Artificial Sequence
  chemically synthesized
gtaaagaaataatactagag

SEQ ID NO: 597708 - DNA, 20 bp, Artificial Sequence
  chemically synthesized
taaacattccacccaagact

SEQ ID NO: 597709 - DNA, 20 bp, Artificial Sequence
  chemically synthesized
caagcctggagtcttgggtg

SEQ ID NO: 597710 - DNA, 20 bp, Artificial Sequence
  chemically synthesized
tgtttagggctactccgcta

SEQ ID NO: 597711 - DNA, 20 bp, Artificial Sequence
  chemically synthesized
agccaagaagatatgttggt

SEQ ID NO: 597712 - DNA, 20 bp, Artificial Sequence
  chemically synthesized
gtgcaccaacatatcttctt

SEQ ID NO: 597713 - DNA, 20 bp, Artificial Sequence
  chemically synthesized
taacttgcctgacctgggca

SEQ ID NO: 597714 - DNA, 20 bp, Artificial Sequence
  chemically synthesized
ggcagcctgatttcacaagt

SEQ ID NO: 597715 - DNA, 20 bp, Artificial Sequence
  chemically synthesized
taagtcactgtctccatcat

SEQ ID NO: 597716 - DNA, 20 bp, Artificial Sequence
  chemically synthesized
aagactccagctgaatgaaa

SEQ ID NO: 597717 - DNA, 20 bp, Artificial Sequence
  chemically synthesized
ggcctgctatgtactaacaa

SEQ ID NO: 597718 - DNA, 20 bp, Artificial Sequence
  chemically synthesized
tgcttacagctatgcattta

SEQ ID NO: 597719 - DNA, 20 bp, Artificial Sequence
  chemically synthesized
ccttgaatgtttttctccat

SEQ ID NO: 597720 - DNA, 20 bp, Artificial Sequence
  chemically synthesized
gatcctttatctcttccctt

SEQ ID NO: 597721 - DNA, 20 bp, Artificial Sequence
  chemically synthesized
gcatataaaagttatccagt

SEQ ID NO: 597722 - DNA, 20 bp, Artificial Sequence
  chemically synthesized
atggctttgatatggtatgc

SEQ ID NO: 597723 - DNA, 20 bp, Artificial Sequence
  chemically synthesized
gtgtgtgtatgtatactctc

SEQ ID NO: 597724 - DNA, 20 bp, Artificial Sequence
  chemically synthesized
tatgtatactctctgaggat

SEQ ID NO: 597725 - DNA, 20 bp, Artificial Sequence
  chemically synthesized
tctctgaggatttgagcttg

SEQ ID NO: 597726 - DNA, 20 bp, Artificial Sequence
  chemically synthesized
ggatttgagcttgcaaagct

SEQ ID NO: 597727 - DNA, 20 bp, Artificial Sequence
  chemically synthesized
agagactcagattaaaatca

SEQ ID NO: 597728 - DNA, 20 bp, Artificial Sequence
  chemically synthesized
aattggtagctccccagaga

SEQ ID NO: 597729 - DNA, 20 bp, Artificial Sequence
  chemically synthesized
ttgctcagcatcaagttatg

SEQ ID NO: 597730 - DNA, 20 bp, Artificial Sequence
  chemically synthesized
tgcttttctcctttaagata

SEQ ID NO: 597731 - DNA, 20 bp, Artificial Sequence
  chemically synthesized
cccctgccccagtttttgct

SEQ ID NO: 597732 - DNA, 20 bp, Artificial Sequence
  chemically synthesized
gtgacatcccctgccccagt

SEQ ID NO: 597733 - DNA, 20 bp, Artificial Sequence
  chemically synthesized
gggagtgtgacatcccctgc

SEQ ID NO: 597734 - DNA, 20 bp, Artificial Sequence
  chemically synthesized
gaaaatgctgtagcactttc

SEQ ID NO: 597735 - DNA, 20 bp, Artificial Sequence
  chemically synthesized
ctctgatagtattttactat

SEQ ID NO: 597736 - DNA, 20 bp, Artificial Sequence
  chemically synthesized
gtctagaaataagtgatctt

SEQ ID NO: 597737 - DNA, 20 bp, Artificial Sequence
  chemically synthesized
ccatagcaactacaagggac

SEQ ID NO: 597738 - DNA, 20 bp, Artificial Sequence
  chemically synthesized
atattctatagtgattctag

SEQ ID NO: 597739 - DNA, 20 bp, Artificial Sequence
  chemically synthesized
aatagaaatgctatattcta

SEQ ID NO: 597740 - DNA, 20 bp, Artificial Sequence
  chemically synthesized
aggggcatgtcaaaattaag

SEQ ID NO: 597741 - DNA, 20 bp, Artificial Sequence
  chemically synthesized
tattccgctgaaattctgta

SEQ ID NO: 597742 - DNA, 20 bp, Artificial Sequence
  chemically synthesized
ttaaaataggatatttgcat

SEQ ID NO: 597743 - DNA, 20 bp, Artificial Sequence
  chemically synthesized
ctccaataagttaaagaaga

SEQ ID NO: 597744 - DNA, 20 bp, Artificial Sequence
  chemically synthesized
gcttttccttactttaggta

SEQ ID NO: 597745 - DNA, 20 bp, Artificial Sequence
  chemically synthesized
aagccacatggcttatagat

SEQ ID NO: 597746 - DNA, 20 bp, Artificial Sequence
  chemically synthesized
aagcagaaatctataagcca

SEQ ID NO: 597747 - DNA, 20 bp, Artificial Sequence
  chemically synthesized
tgaattgaagccacatggct

SEQ ID NO: 597748 - DNA, 20 bp, Artificial Sequence
  chemically synthesized
agataaatgaattgaagcca

SEQ ID NO: 597749 - DNA, 20 bp, Artificial Sequence
  chemically synthesized
catgtggcttcaattcattt

SEQ ID NO: 597750 - DNA, 20 bp, Artificial Sequence
  chemically synthesized
tcaattcatttatctgtttg

SEQ ID NO: 597751 - DNA, 20 bp, Artificial Sequence
  chemically synthesized
atttatctgtttgaaaagct

SEQ ID NO: 597752 - DNA, 20 bp, Artificial Sequence
  chemically synthesized
aataaacacttatttaaaca

SEQ ID NO: 597753 - DNA, 20 bp, Artificial Sequence
  chemically synthesized
gaaaagcttattgtttaaat

SEQ ID NO: 597754 - DNA, 20 bp, Artificial Sequence
  chemically synthesized
gtctctcccttaagaagata

SEQ ID NO: 597755 - DNA, 20 bp, Artificial Sequence
  chemically synthesized
cagaaataatttgaacataa

SEQ ID NO: 597756 - DNA, 20 bp, Artificial Sequence
  chemically synthesized
ataatttgaacataaaaatg

SEQ ID NO: 597757 - DNA, 20 bp, Artificial Sequence
  chemically synthesized
tagataaattttctgtattc

SEQ ID NO: 597758 - DNA, 20 bp, Artificial Sequence
  chemically synthesized
agttggcaaataggtccctt

SEQ ID NO: 597759 - DNA, 20 bp, Artificial Sequence
  chemically synthesized
gattagttggcaaataggtc

SEQ ID NO: 597760 - DNA, 20 bp, Artificial Sequence
  chemically synthesized
agggacctatttgccaacta

SEQ ID NO: 597761 - DNA, 20 bp, Artificial Sequence
  chemically synthesized
tgcttcatacctttatctta

SEQ ID NO: 597762 - DNA, 20 bp, Artificial Sequence
  chemically synthesized
aagaatggagcatagttaag

SEQ ID NO: 597763 - DNA, 20 bp, Artificial Sequence
  chemically synthesized
tatcataagggatagacttc

SEQ ID NO: 597764 - DNA, 20 bp, Artificial Sequence
  chemically synthesized
taagggatagacttctactg

SEQ ID NO: 597765 - DNA, 20 bp, Artificial Sequence
  chemically synthesized
gacaactactcccttgctgt

SEQ ID NO: 597766 - DNA, 20 bp, Artificial Sequence
  chemically synthesized
ctactttgacatttatacac

SEQ ID NO: 597767 - DNA, 20 bp, Artificial Sequence
  chemically synthesized
tttaagtttactttcatcaa

SEQ ID NO: 597768 - DNA, 20 bp, Artificial Sequence
  chemically synthesized
taaaacttcagtaaattatt

SEQ ID NO: 597769 - DNA, 20 bp, Artificial Sequence
  chemically synthesized
gtaaacttaaaataatttac

SEQ ID NO: 597770 - DNA, 20 bp, Artificial Sequence
  chemically synthesized
tttgtacctatagcaaagct

SEQ ID NO: 597771 - DNA, 20 bp, Artificial Sequence
  chemically synthesized
ttcacagtattcgggaagca

SEQ ID NO: 597772 - DNA, 20 bp, Artificial Sequence
  chemically synthesized
tacctcggcctcccaaagtg

SEQ ID NO: 597773 - DNA, 20 bp, Artificial Sequence
  chemically synthesized
gtttgtatttttagtagaga

SEQ ID NO: 597774 - DNA, 20 bp, Artificial Sequence
  chemically synthesized
cgcccaccgccacacctggt

SEQ ID NO: 597775 - DNA, 20 bp, Artificial Sequence
  chemically synthesized
taccttagcctcccaagtag

SEQ ID NO: 597776 - DNA, 20 bp, Artificial Sequence
  chemically synthesized
aacctccgcttcctggggtc

SEQ ID NO: 597777 - DNA, 20 bp, Artificial Sequence
  chemically synthesized
cagtctcggctcactgcaac

SEQ ID NO: 597778 - DNA, 20 bp, Artificial Sequence
  chemically synthesized
tgtttaattgtttattgaga

SEQ ID NO: 597779 - DNA, 20 bp, Artificial Sequence
  chemically synthesized
tgatgtttgtttgtttgttt

SEQ ID NO: 597780 - DNA, 20 bp, Artificial Sequence
  chemically synthesized
agaggaagtgatgtttgttt

SEQ ID NO: 597781 - DNA, 20 bp, Artificial Sequence
  chemically synthesized
ggacagaggaagtgatgttt

SEQ ID NO: 597782 - DNA, 20 bp, Artificial Sequence
  chemically synthesized
gacgggacagaggaagtgat

SEQ ID NO: 597783 - DNA, 20 bp, Artificial Sequence
  chemically synthesized
cagagacgggacagaggaag

SEQ ID NO: 597784 - DNA, 20 bp, Artificial Sequence
  chemically synthesized
gtagatttgtgaaggtatat

SEQ ID NO: 597785 - DNA, 20 bp, Artificial Sequence
  chemically synthesized
tcacaaatctacaactcttt

SEQ ID NO: 597786 - DNA, 20 bp, Artificial Sequence
  chemically synthesized
tttaaaatcttggaaagagt

SEQ ID NO: 597787 - DNA, 20 bp, Artificial Sequence
  chemically synthesized
cagaagacaaattagccaat

SEQ ID NO: 597788 - DNA, 20 bp, Artificial Sequence
  chemically synthesized
cattaattggctaatttgtc

SEQ ID NO: 597789 - DNA, 20 bp, Artificial Sequence
  chemically synthesized
ggctaatttgtcttctgttt

SEQ ID NO: 597790 - DNA, 20 bp, Artificial Sequence
  chemically synthesized
atattatcttatattttaac

SEQ ID NO: 597791 - DNA, 20 bp, Artificial Sequence
  chemically synthesized
aatataagataatatgaaat

SEQ ID NO: 597792 - DNA, 20 bp, Artificial Sequence
  chemically synthesized
cttcagtatttcgatgatat

SEQ ID NO: 597793 - DNA, 20 bp, Artificial Sequence
  chemically synthesized
ttttttaaaagaagtgataa

SEQ ID NO: 597794 - DNA, 20 bp, Artificial Sequence
  chemically synthesized
aagtgataaaattgctttct

SEQ ID NO: 597795 - DNA, 20 bp, Artificial Sequence
  chemically synthesized
aaattgctttctaatggttt

SEQ ID NO: 597796 - DNA, 20 bp, Artificial Sequence
  chemically synthesized
tggttaaaaatgtgaattat

SEQ ID NO: 597797 - DNA, 20 bp, Artificial Sequence
  chemically synthesized
ttcctattcactcacttagt

SEQ ID NO: 597798 - DNA, 20 bp, Artificial Sequence
  chemically synthesized
atttcatctttccctccttg

SEQ ID NO: 597799 - DNA, 20 bp, Artificial Sequence
  chemically synthesized
caggattcagtacagttagg

SEQ ID NO: 597800 - DNA, 20 bp, Artificial Sequence
  chemically synthesized
catcatacagacctagccac

SEQ ID NO: 597801 - DNA, 20 bp, Artificial Sequence
  chemically synthesized
ttaactagtaatactatctt

SEQ ID NO: 597802 - DNA, 20 bp, Artificial Sequence
  chemically synthesized
taaaatatgactgtctcatg

SEQ ID NO: 597803 - DNA, 20 bp, Artificial Sequence
  chemically synthesized
gaggtggaggttgcagtgaa

SEQ ID NO: 597804 - DNA, 20 bp, Artificial Sequence
  chemically synthesized
tcgggaggctgaggcaggag

SEQ ID NO: 597805 - DNA, 20 bp, Artificial Sequence
  chemically synthesized
tgcctcagcctcccgagtag

SEQ ID NO: 597806 - DNA, 20 bp, Artificial Sequence
  chemically synthesized
cgccttggcctcccaaagtg

SEQ ID NO: 597807 - DNA, 20 bp, Artificial Sequence
  chemically synthesized
gagattccagagagcggggc

SEQ ID NO: 597808 - DNA, 20 bp, Artificial Sequence
  chemically synthesized
gaaggtgagattccagagag

SEQ ID NO: 597809 - DNA, 20 bp, Artificial Sequence
  chemically synthesized
actttattctcctgtagaag

SEQ ID NO: 597810 - DNA, 20 bp, Artificial Sequence
  chemically synthesized
tatagtttagtcatttctct

SEQ ID NO: 597811 - DNA, 20 bp, Artificial Sequence
  chemically synthesized
aaccactatctaactgagta

SEQ ID NO: 597812 - DNA, 20 bp, Artificial Sequence
  chemically synthesized
ttcatttcttccttccctgc

SEQ ID NO: 597813 - DNA, 20 bp, Artificial Sequence
  chemically synthesized
ttatccttcatttcttcctt

SEQ ID NO: 597814 - DNA, 20 bp, Artificial Sequence
  chemically synthesized
ggggaagaccttaccaggaa

SEQ ID NO: 597815 - DNA, 20 bp, Artificial Sequence
  chemically synthesized
acctgtctggaatattattc

SEQ ID NO: 597816 - DNA, 20 bp, Artificial Sequence
  chemically synthesized
tccagtgtcagggcccttat

SEQ ID NO: 597817 - DNA, 20 bp, Artificial Sequence
  chemically synthesized
gtggccaaggaacatggagg

SEQ ID NO: 597818 - DNA, 20 bp, Artificial Sequence
  chemically synthesized
acttatgaacataaggactt

SEQ ID NO: 597819 - DNA, 20 bp, Artificial Sequence
  chemically synthesized
tgagggggatggggagcatt

SEQ ID NO: 597820 - DNA, 20 bp, Artificial Sequence
  chemically synthesized
aagtcagattatatccccct

SEQ ID NO: 597821 - DNA, 20 bp, Artificial Sequence
  chemically synthesized
gatacctatttaaatggaaa

SEQ ID NO: 597822 - DNA, 20 bp, Artificial Sequence
  chemically synthesized
atgattgcagttgtctatta

SEQ ID NO: 597823 - DNA, 20 bp, Artificial Sequence
  chemically synthesized
agcaccatcatctccagcat

SEQ ID NO: 597824 - DNA, 20 bp, Artificial Sequence
  chemically synthesized
atcatccatgctggagatga

SEQ ID NO: 597825 - DNA, 20 bp, Artificial Sequence
  chemically synthesized
acattgtaaaggcagaatcc

SEQ ID NO: 597826 - DNA, 20 bp, Artificial Sequence
  chemically synthesized
tgtaattggccaccaaatcc

SEQ ID NO: 597827 - DNA, 20 bp, Artificial Sequence
  chemically synthesized
acaccctaaccttatcctcc

SEQ ID NO: 597828 - DNA, 20 bp, Artificial Sequence
  chemically synthesized
caggaggataaggttagggt

SEQ ID NO: 597829 - DNA, 20 bp, Artificial Sequence
  chemically synthesized
attttaacatgctaaattta

SEQ ID NO: 597830 - DNA, 20 bp, Artificial Sequence
  chemically synthesized
aaaaggcatatatatatatg

SEQ ID NO: 597831 - DNA, 20 bp, Artificial Sequence
  chemically synthesized
tctcaaatttatatctctag

SEQ ID NO: 597832 - DNA, 20 bp, Artificial Sequence
  chemically synthesized
tattttctgagcaagtttgg

SEQ ID NO: 597833 - DNA, 20 bp, Artificial Sequence
  chemically synthesized
aaaacatcagtattttctga

SEQ ID NO: 597834 - DNA, 20 bp, Artificial Sequence
  chemically synthesized
caaacttgctcagaaaatac

SEQ ID NO: 597835 - DNA, 20 bp, Artificial Sequence
  chemically synthesized
ggctaagattgtctacaggg

SEQ ID NO: 597836 - DNA, 20 bp, Artificial Sequence
  chemically synthesized
gatttaagtgatagaaatgg

SEQ ID NO: 597837 - DNA, 20 bp, Artificial Sequence
  chemically synthesized
taaaattcctttgtgtcaaa

SEQ ID NO: 597838 - DNA, 20 bp, Artificial Sequence
  chemically synthesized
taaataaaattcctttgtgt

SEQ ID NO: 597839 - DNA, 20 bp, Artificial Sequence
  chemically synthesized
gaaaaatgtcaagttgggag

SEQ ID NO: 597840 - DNA, 20 bp, Artificial Sequence
  chemically synthesized
gagggagttagccctttgat

SEQ ID NO: 597841 - DNA, 20 bp, Artificial Sequence
  chemically synthesized
gttagccctttgatggttga

SEQ ID NO: 597842 - DNA, 20 bp, Artificial Sequence
  chemically synthesized
ttctgcttaaggctacatca

SEQ ID NO: 597843 - DNA, 20 bp, Artificial Sequence
  chemically synthesized
cctgtactttcttctagctt

SEQ ID NO: 597844 - DNA, 20 bp, Artificial Sequence
  chemically synthesized
attttttccctgtactttct

SEQ ID NO: 597845 - DNA, 20 bp, Artificial Sequence
  chemically synthesized
ctcttggttctgttgccatg

SEQ ID NO: 597846 - DNA, 20 bp, Artificial Sequence
  chemically synthesized
aatactctgattggttaagg

SEQ ID NO: 597847 - DNA, 20 bp, Artificial Sequence
  chemically synthesized
tctatctagttaaataaata

SEQ ID NO: 597848 - DNA, 20 bp, Artificial Sequence
  chemically synthesized
tgtgttagtgcaaaatgtgg

SEQ ID NO: 597849 - DNA, 20 bp, Artificial Sequence
  chemically synthesized
tacagctactgaatcaaggg

SEQ ID NO: 597850 - DNA, 20 bp, Artificial Sequence
  chemically synthesized
gaccgatttataaaccatac

SEQ ID NO: 597851 - DNA, 20 bp, Artificial Sequence
  chemically synthesized
atttgtgttcagcatagctg

SEQ ID NO: 597852 - DNA, 20 bp, Artificial Sequence
  chemically synthesized
aacacaaatatctccttact

SEQ ID NO: 597853 - DNA, 20 bp, Artificial Sequence
  chemically synthesized
tccaatttatcctgccattt

SEQ ID NO: 597854 - DNA, 20 bp, Artificial Sequence
  chemically synthesized
aaaagctatatgtcatcatg

SEQ ID NO: 597855 - DNA, 20 bp, Artificial Sequence
  chemically synthesized
aaaatccatccatgatgaca

SEQ ID NO: 597856 - DNA, 20 bp, Artificial Sequence
  chemically synthesized
aaaaaaagatgggctaaaag

SEQ ID NO: 597857 - DNA, 20 bp, Artificial Sequence
  chemically synthesized
tccaggaaaaaaaagaaaaa

SEQ ID NO: 597858 - DNA, 20 bp, Artificial Sequence
  chemically synthesized
aaaaaagaaaaaactggatt

SEQ ID NO: 597859 - DNA, 20 bp, Artificial Sequence
  chemically synthesized
agttggataaaaactgtgaa

SEQ ID NO: 597860 - DNA, 20 bp, Artificial Sequence
  chemically synthesized
ggattcacagtttttatcca

SEQ ID NO: 597861 - DNA, 20 bp, Artificial Sequence
  chemically synthesized
ttttatccaacttgatttcc

SEQ ID NO: 597862 - DNA, 20 bp, Artificial Sequence
  chemically synthesized
atccttcactttgttattca

SEQ ID NO: 597863 - DNA, 20 bp, Artificial Sequence
  chemically synthesized
atcaaagtgaataacaaagt

SEQ ID NO: 597864 - DNA, 20 bp, Artificial Sequence
  chemically synthesized
gatgtgtctgaagaataaca

SEQ ID NO: 597865 - DNA, 20 bp, Artificial Sequence
  chemically synthesized
atacagtttcttgatgcaga

SEQ ID NO: 597866 - DNA, 20 bp, Artificial Sequence
  chemically synthesized
catcaagaaactgtatagcg

SEQ ID NO: 597867 - DNA, 20 bp, Artificial Sequence
  chemically synthesized
tgctcttaagcactacgcta

SEQ ID NO: 597868 - DNA, 20 bp, Artificial Sequence
  chemically synthesized
gtgcttaagagcagaaactc

SEQ ID NO: 597869 - DNA, 20 bp, Artificial Sequence
  chemically synthesized
cactctggatgttcaagctc

SEQ ID NO: 597870 - DNA, 20 bp, Artificial Sequence
  chemically synthesized
gtcacttaactgctcaggac

SEQ ID NO: 597871 - DNA, 20 bp, Artificial Sequence
  chemically synthesized
atgaccatacaagttactct

SEQ ID NO: 597872 - DNA, 20 bp, Artificial Sequence
  chemically synthesized
ataactgtcagctattacat

SEQ ID NO: 597873 - DNA, 20 bp, Artificial Sequence
  chemically synthesized
gctattacattcaagattag

SEQ ID NO: 597874 - DNA, 20 bp, Artificial Sequence
  chemically synthesized
gttatattcacacctcaagc

SEQ ID NO: 597875 - DNA, 20 bp, Artificial Sequence
  chemically synthesized
aattttatagaggaggaatc

SEQ ID NO: 597876 - DNA, 20 bp, Artificial Sequence
  chemically synthesized
tcctcctctataaaattcct

SEQ ID NO: 597877 - DNA, 20 bp, Artificial Sequence
  chemically synthesized
tctataaaattcctcctagt

SEQ ID NO: 597878 - DNA, 20 bp, Artificial Sequence
  chemically synthesized
ctcctagtttctgctttttg

SEQ ID NO: 597879 - DNA, 20 bp, Artificial Sequence
  chemically synthesized
tttgtgctgctttcttcttt

SEQ ID NO: 597880 - DNA, 20 bp, Artificial Sequence
  chemically synthesized
tacactcatgtcttatatat

SEQ ID NO: 597881 - DNA, 20 bp, Artificial Sequence
  chemically synthesized
aatgtctttattactctcta

SEQ ID NO: 597882 - DNA, 20 bp, Artificial Sequence
  chemically synthesized
tgttatcaactaccagagta

SEQ ID NO: 597883 - DNA, 20 bp, Artificial Sequence
  chemically synthesized
atttattaatgctacaagtg

SEQ ID NO: 597884 - DNA, 20 bp, Artificial Sequence
  chemically synthesized
gaagtaaaaagttgagttga

SEQ ID NO: 597885 - DNA, 20 bp, Artificial Sequence
  chemically synthesized
ggttcaatgattgaattcaa

SEQ ID NO: 597886 - DNA, 20 bp, Artificial Sequence
  chemically synthesized
tgaattcaatcattgaacct

SEQ ID NO: 597887 - DNA, 20 bp, Artificial Sequence
  chemically synthesized
agtaacaaatcttagaggtt

SEQ ID NO: 597888 - DNA, 20 bp, Artificial Sequence
  chemically synthesized
cgtgagctattcaggtaatt

SEQ ID NO: 597889 - DNA, 20 bp, Artificial Sequence
  chemically synthesized
agtccacatgcatttcctgg

SEQ ID NO: 597890 - DNA, 20 bp, Artificial Sequence
  chemically synthesized
atttcctggctgagtttcct

SEQ ID NO: 597891 - DNA, 20 bp, Artificial Sequence
  chemically synthesized
acacttggatcagtaaagtg

SEQ ID NO: 597892 - DNA, 20 bp, Artificial Sequence
  chemically synthesized
accctgcactttactgatcc

SEQ ID NO: 597893 - DNA, 20 bp, Artificial Sequence
  chemically synthesized
atccaagtgtttctcagata

SEQ ID NO: 597894 - DNA, 20 bp, Artificial Sequence
  chemically synthesized
tatcataaaaggactggtaa

SEQ ID NO: 597895 - DNA, 20 bp, Artificial Sequence
  chemically synthesized
ttctatttggattttctgta

SEQ ID NO: 597896 - DNA, 20 bp, Artificial Sequence
  chemically synthesized
catgtgagtcaatttttcta

SEQ ID NO: 597897 - DNA, 20 bp, Artificial Sequence
  chemically synthesized
tgactcacatgcatggcaaa

SEQ ID NO: 597898 - DNA, 20 bp, Artificial Sequence
  chemically synthesized
ccaaatttcttagagtcagg

SEQ ID NO: 597899 - DNA, 20 bp, Artificial Sequence
  chemically synthesized
actcagcagaggagggccag

SEQ ID NO: 597900 - DNA, 20 bp, Artificial Sequence
  chemically synthesized
gaggttttcttggattgttg

SEQ ID NO: 597901 - DNA, 20 bp, Artificial Sequence
  chemically synthesized
tcatcagtttttgaggtttt

SEQ ID NO: 597902 - DNA, 20 bp, Artificial Sequence
  chemically synthesized
cattggtgatcatcagtttt

SEQ ID NO: 597903 - DNA, 20 bp, Artificial Sequence
  chemically synthesized
tattccattcattggtgatc

SEQ ID NO: 597904 - DNA, 20 bp, Artificial Sequence
  chemically synthesized
gatgatcaccaatgaatgga

SEQ ID NO: 597905 - DNA, 20 bp, Artificial Sequence
  chemically synthesized
ttatcaaaataataagatgc

SEQ ID NO: 597906 - DNA, 20 bp, Artificial Sequence
  chemically synthesized
gataaatgaaaatttagtat

SEQ ID NO: 597907 - DNA, 20 bp, Artificial Sequence
  chemically synthesized
tgtatggtagctacctatga

SEQ ID NO: 597908 - DNA, 20 bp, Artificial Sequence
  chemically synthesized
atcaatattaatttttgcag

SEQ ID NO: 597909 - DNA, 20 bp, Artificial Sequence
  chemically synthesized
tgtcatcaatattaattttt

SEQ ID NO: 597910 - DNA, 20 bp, Artificial Sequence
  chemically synthesized
tatgttttctgttttaccaa

SEQ ID NO: 597911 - DNA, 20 bp, Artificial Sequence
  chemically synthesized
ataatattaccaaatatgtt

SEQ ID NO: 597912 - DNA, 20 bp, Artificial Sequence
  chemically synthesized
aacgggcataatattaccaa

SEQ ID NO: 597913 - DNA, 20 bp, Artificial Sequence
  chemically synthesized
aacatatttggtaatattat

SEQ ID NO: 597914 - DNA, 20 bp, Artificial Sequence
  chemically synthesized
atacttctgatgttggggaa

SEQ ID NO: 597915 - DNA, 20 bp, Artificial Sequence
  chemically synthesized
gggaaatgtgctttccatca

SEQ ID NO: 597916 - DNA, 20 bp, Artificial Sequence
  chemically synthesized
acaattgtatgaaagagcga

SEQ ID NO: 597917 - DNA, 20 bp, Artificial Sequence
  chemically synthesized
tacagaacaattgtatgaaa

SEQ ID NO: 597918 - DNA, 20 bp, Artificial Sequence
  chemically synthesized
tcctgctcccatatcatgcc

SEQ ID NO: 597919 - DNA, 20 bp, Artificial Sequence
  chemically synthesized
aggtaaacattgagtagagt

SEQ ID NO: 597920 - DNA, 20 bp, Artificial Sequence
  chemically synthesized
caggaagctaacactctact

SEQ ID NO: 597921 - DNA, 20 bp, Artificial Sequence
  chemically synthesized
gtttacctttttggaagctc

SEQ ID NO: 597922 - DNA, 20 bp, Artificial Sequence
  chemically synthesized
gttatcagtaaggaaatcta

SEQ ID NO: 597923 - DNA, 20 bp, Artificial Sequence
  chemically synthesized
aacactatttaatttttgcc

SEQ ID NO: 597924 - DNA, 20 bp, Artificial Sequence
  chemically synthesized
aattggtgtctgttaatcat

SEQ ID NO: 597925 - DNA, 20 bp, Artificial Sequence
  chemically synthesized
aactttctgttgtaaatcac

SEQ ID NO: 597926 - DNA, 20 bp, Artificial Sequence
  chemically synthesized
cgtgatttacaacagaaagt

SEQ ID NO: 597927 - DNA, 20 bp, Artificial Sequence
  chemically synthesized
ttcttgttttttttccatca

SEQ ID NO: 597928 - DNA, 20 bp, Artificial Sequence
  chemically synthesized
atacaatgacttgtacccaa

SEQ ID NO: 597929 - DNA, 20 bp, Artificial Sequence
  chemically synthesized
tttaaatattggcaatatct

SEQ ID NO: 597930 - DNA, 20 bp, Artificial Sequence
  chemically synthesized
atgaattgtcaagtctttca

SEQ ID NO: 597931 - DNA, 20 bp, Artificial Sequence
  chemically synthesized
ttcctttgccatttaaaaaa

SEQ ID NO: 597932 - DNA, 20 bp, Artificial Sequence
  chemically synthesized
ggagtcttgaaatttgcttt

SEQ ID NO: 597933 - DNA, 20 bp, Artificial Sequence
  chemically synthesized
ttttgctttggagtcttgaa

SEQ ID NO: 597934 - DNA, 20 bp, Artificial Sequence
  chemically synthesized
cagtagtgtttttttctctt

SEQ ID NO: 597935 - DNA, 20 bp, Artificial Sequence
  chemically synthesized
caaaaaagagaaaaaaacac

SEQ ID NO: 597936 - DNA, 20 bp, Artificial Sequence
  chemically synthesized
gcaaagaatgatttaatcag

SEQ ID NO: 597937 - DNA, 20 bp, Artificial Sequence
  chemically synthesized
acactactgattaaatcatt

SEQ ID NO: 597938 - DNA, 20 bp, Artificial Sequence
  chemically synthesized
tgattaaatcattctttgct

SEQ ID NO: 597939 - DNA, 20 bp, Artificial Sequence
  chemically synthesized
atattgaaactctaagcaaa

SEQ ID NO: 597940 - DNA, 20 bp, Artificial Sequence
  chemically synthesized
ctgaactcacaattagaaca

SEQ ID NO: 597941 - DNA, 20 bp, Artificial Sequence
  chemically synthesized
tttagtttctttatgaaatg

SEQ ID NO: 597942 - DNA, 20 bp, Artificial Sequence
  chemically synthesized
attgttgttttattttgggc

SEQ ID NO: 597943 - DNA, 20 bp, Artificial Sequence
  chemically synthesized
gttttaattgttgttttatt

SEQ ID NO: 597944 - DNA, 20 bp, Artificial Sequence
  chemically synthesized
ttttctagcttggttttaat

SEQ ID NO: 597945 - DNA, 20 bp, Artificial Sequence
  chemically synthesized
aagaggatgctgttttctag

SEQ ID NO: 597946 - DNA, 20 bp, Artificial Sequence
  chemically synthesized
ccaagaagaggatgctgttt

SEQ ID NO: 597947 - DNA, 20 bp, Artificial Sequence
  chemically synthesized
aacttttaccaagaagagga

SEQ ID NO: 597948 - DNA, 20 bp, Artificial Sequence
  chemically synthesized
aaatgcaactctaaattatt

SEQ ID NO: 597949 - DNA, 20 bp, Artificial Sequence
  chemically synthesized
aatatacaataaagtgagtt

SEQ ID NO: 597950 - DNA, 20 bp, Artificial Sequence
  chemically synthesized
tacacatggcccccgtctta

SEQ ID NO: 597951 - DNA, 20 bp, Artificial Sequence
  chemically synthesized
cgtcttataatgtttctact

SEQ ID NO: 597952 - DNA, 20 bp, Artificial Sequence
  chemically synthesized
tagtgaatactatactgaag

SEQ ID NO: 597953 - DNA, 20 bp, Artificial Sequence
  chemically synthesized
ggttaacataggtgttcaga

SEQ ID NO: 597954 - DNA, 20 bp, Artificial Sequence
  chemically synthesized
caccaaatatcatggtttag

SEQ ID NO: 597955 - DNA, 20 bp, Artificial Sequence
  chemically synthesized
acacttaacccaccaaatat

SEQ ID NO: 597956 - DNA, 20 bp, Artificial Sequence
  chemically synthesized
tacaaaattctcaacttaca

SEQ ID NO: 597957 - DNA, 20 bp, Artificial Sequence
  chemically synthesized
tacaatagaagaatatgatc

SEQ ID NO: 597958 - DNA, 20 bp, Artificial Sequence
  chemically synthesized
aagtttgtaagatcctctaa

SEQ ID NO: 597959 - DNA, 20 bp, Artificial Sequence
  chemically synthesized
aagattttgtcaaaagcaaa

SEQ ID NO: 597960 - DNA, 20 bp, Artificial Sequence
  chemically synthesized
tttgtcaaaagcaaacgtgg

SEQ ID NO: 597961 - DNA, 20 bp, Artificial Sequence
  chemically synthesized
atacatacaagctaagccac

SEQ ID NO: 597962 - DNA, 20 bp, Artificial Sequence
  chemically synthesized
gagaatacatacaagctaag

SEQ ID NO: 597963 - DNA, 20 bp, Artificial Sequence
  chemically synthesized
ttgtatgtattctcttattt

SEQ ID NO: 597964 - DNA, 20 bp, Artificial Sequence
  chemically synthesized
ttctcttattttaaagtttt

SEQ ID NO: 597965 - DNA, 20 bp, Artificial Sequence
  chemically synthesized
tatgtggttaacattttatt

SEQ ID NO: 597966 - DNA, 20 bp, Artificial Sequence
  chemically synthesized
gatataaatatgcaatttta

SEQ ID NO: 597967 - DNA, 20 bp, Artificial Sequence
  chemically synthesized
ttaacacattcttaaaggta

SEQ ID NO: 597968 - DNA, 20 bp, Artificial Sequence
  chemically synthesized
tataactttcttagaatttg

SEQ ID NO: 597969 - DNA, 20 bp, Artificial Sequence
  chemically synthesized
ttcaagatttgtaaaatgca

SEQ ID NO: 597970 - DNA, 20 bp, Artificial Sequence
  chemically synthesized
aatgtataattatataaatt

SEQ ID NO: 597971 - DNA, 20 bp, Artificial Sequence
  chemically synthesized
gaattttcctacacagtcgt

SEQ ID NO: 597972 - DNA, 20 bp, Artificial Sequence
  chemically synthesized
taggcaggggcagttattat

SEQ ID NO: 597973 - DNA, 20 bp, Artificial Sequence
  chemically synthesized
aagtaacataagatatttag

SEQ ID NO: 597974 - DNA, 20 bp, Artificial Sequence
  chemically synthesized
gaaaagcttagaaagattta

SEQ ID NO: 597975 - DNA, 20 bp, Artificial Sequence
  chemically synthesized
aacaatcaggttaaatcttt

SEQ ID NO: 597976 - DNA, 20 bp, Artificial Sequence
  chemically synthesized
attggaacctgaaaagctta

SEQ ID NO: 597977 - DNA, 20 bp, Artificial Sequence
  chemically synthesized
aagtactgtattggaacctg

SEQ ID NO: 597978 - DNA, 20 bp, Artificial Sequence
  chemically synthesized
ctttgctaaactctctactc

SEQ ID NO: 597979 - DNA, 20 bp, Artificial Sequence
  chemically synthesized
ttatgataagcagtagagta

SEQ ID NO: 597980 - DNA, 20 bp, Artificial Sequence
  chemically synthesized
actaacatttttccacatca

SEQ ID NO: 597981 - DNA, 20 bp, Artificial Sequence
  chemically synthesized
ctgatgtggaaaaatgttag

SEQ ID NO: 597982 - DNA, 20 bp, Artificial Sequence
  chemically synthesized
tccctgtcacacattttcat

SEQ ID NO: 597983 - DNA, 20 bp, Artificial Sequence
  chemically synthesized
tgtcacacattttcataaat

SEQ ID NO: 597984 - DNA, 20 bp, Artificial Sequence
  chemically synthesized
acattttcataaatgattgt

SEQ ID NO: 597985 - DNA, 20 bp, Artificial Sequence
  chemically synthesized
ataagcatgaagaaattgtt

SEQ ID NO: 597986 - DNA, 20 bp, Artificial Sequence
  chemically synthesized
acaaacctagaacaatttct

SEQ ID NO: 597987 - DNA, 20 bp, Artificial Sequence
  chemically synthesized
tttcttcatgcttatatgca

SEQ ID NO: 597988 - DNA, 20 bp, Artificial Sequence
  chemically synthesized
tttgtagaatgcacatgtct

SEQ ID NO: 597989 - DNA, 20 bp, Artificial Sequence
  chemically synthesized
acaatataaaaagaagtaaa

SEQ ID NO: 597990 - DNA, 20 bp, Artificial Sequence
  chemically synthesized
ttggttttctcttttagtac

SEQ ID NO: 597991 - DNA, 20 bp, Artificial Sequence
  chemically synthesized
agaaaaattagtatcttgtt

SEQ ID NO: 597992 - DNA, 20 bp, Artificial Sequence
  chemically synthesized
accaggaagaaaaattagta

SEQ ID NO: 597993 - DNA, 20 bp, Artificial Sequence
  chemically synthesized
catatacttaaatgcatgta

SEQ ID NO: 597994 - DNA, 20 bp, Artificial Sequence
  chemically synthesized
aatatgacgacaatagtgcc

SEQ ID NO: 597995 - DNA, 20 bp, Artificial Sequence
  chemically synthesized
tattttgggaaggtgaaaat

SEQ ID NO: 597996 - DNA, 20 bp, Artificial Sequence
  chemically synthesized
aggtgaaaataatagcttta

SEQ ID NO: 597997 - DNA, 20 bp, Artificial Sequence
  chemically synthesized
aaggcatttctgatacctaa

SEQ ID NO: 597998 - DNA, 20 bp, Artificial Sequence
  chemically synthesized
taactttcatttctaagaaa

SEQ ID NO: 597999 - DNA, 20 bp, Artificial Sequence
  chemically synthesized
cgctgtcacaacagttacta

SEQ ID NO: 598000 - DNA, 20 bp, Artificial Sequence
  chemically synthesized
tccagagagtgaaaatgaac

SEQ ID NO: 598001 - DNA, 20 bp, Artificial Sequence
  chemically synthesized
gggatgtgaagagtgtaaga

SEQ ID NO: 598002 - DNA, 20 bp, Artificial Sequence
  chemically synthesized
ttaataagtactttaatgcc

SEQ ID NO: 598003 - DNA, 20 bp, Artificial Sequence
  chemically synthesized
ggcattaaagtacttattaa

SEQ ID NO: 598004 - DNA, 20 bp, Artificial Sequence
  chemically synthesized
tacttattaactaggtttta

SEQ ID NO: 598005 - DNA, 20 bp, Artificial Sequence
  chemically synthesized
tgaccttttaattttttctt

SEQ ID NO: 598006 - DNA, 20 bp, Artificial Sequence
  chemically synthesized
aatacgtagctgtgtttaga

SEQ ID NO: 598007 - DNA, 20 bp, Artificial Sequence
  chemically synthesized
attttggtccaaatacgtag

SEQ ID NO: 598008 - DNA, 20 bp, Artificial Sequence
  chemically synthesized
ttttatgtgtgatatataat

SEQ ID NO: 598009 - DNA, 20 bp, Artificial Sequence
  chemically synthesized
tgtgcttcgaccagttataa

SEQ ID NO: 598010 - DNA, 20 bp, Artificial Sequence
  chemically synthesized
gacattataactggtcgaag

SEQ ID NO: 598011 - DNA, 20 bp, Artificial Sequence
  chemically synthesized
actggtcgaagcacagcttc

SEQ ID NO: 598012 - DNA, 20 bp, Artificial Sequence
  chemically synthesized
ttattcacaaacggttgaag

SEQ ID NO: 598013 - DNA, 20 bp, Artificial Sequence
  chemically synthesized
aagttgcagttaagttgtgg

SEQ ID NO: 598014 - DNA, 20 bp, Artificial Sequence
  chemically synthesized
cttcaaaatttctaccagcc

SEQ ID NO: 598015 - DNA, 20 bp, Artificial Sequence
  chemically synthesized
ttctaccagcctcatgattt

SEQ ID NO: 598016 - DNA, 20 bp, Artificial Sequence
  chemically synthesized
tgatttgtaagttttaatat

SEQ ID NO: 598017 - DNA, 20 bp, Artificial Sequence
  chemically synthesized
gtaagttttaatatggaagt

SEQ ID NO: 598018 - DNA, 20 bp, Artificial Sequence
  chemically synthesized
gctttctacactttacacga

SEQ ID NO: 598019 - DNA, 20 bp, Artificial Sequence
  chemically synthesized
tccttccattctcccagcag

SEQ ID NO: 598020 - DNA, 20 bp, Artificial Sequence
  chemically synthesized
tagtcaaggtaggacaactg

SEQ ID NO: 598021 - DNA, 20 bp, Artificial Sequence
  chemically synthesized
gaatggataatttcctacaa

SEQ ID NO: 598022 - DNA, 20 bp, Artificial Sequence
  chemically synthesized
catatttatatgtgcttcgg

SEQ ID NO: 598023 - DNA, 20 bp, Artificial Sequence
  chemically synthesized
catgcccagctcatatttat

SEQ ID NO: 598024 - DNA, 20 bp, Artificial Sequence
  chemically synthesized
aaaagatttgtactatagag

SEQ ID NO: 598025 - DNA, 20 bp, Artificial Sequence
  chemically synthesized
tttttcatttgtattatatg

SEQ ID NO: 598026 - DNA, 20 bp, Artificial Sequence
  chemically synthesized
gtactatggaaataatttaa

SEQ ID NO: 598027 - DNA, 20 bp, Artificial Sequence
  chemically synthesized
atcattaactgtagtttaaa

SEQ ID NO: 598028 - DNA, 20 bp, Artificial Sequence
  chemically synthesized
agcatgatttaaactacagt

SEQ ID NO: 598029 - DNA, 20 bp, Artificial Sequence
  chemically synthesized
ttcaaatattaatcattaac

SEQ ID NO: 598030 - DNA, 20 bp, Artificial Sequence
  chemically synthesized
atatgacttgggatttattt

SEQ ID NO: 598031 - DNA, 20 bp, Artificial Sequence
  chemically synthesized
gcttatatgacttgggattt

SEQ ID NO: 598032 - DNA, 20 bp, Artificial Sequence
  chemically synthesized
tcttcaacagcttatatgac

SEQ ID NO: 598033 - DNA, 20 bp, Artificial Sequence
  chemically synthesized
taaatataatttgtttcttc

SEQ ID NO: 598034 - DNA, 20 bp, Artificial Sequence
  chemically synthesized
tttatttggttataaatata

SEQ ID NO: 598035 - DNA, 20 bp, Artificial Sequence
  chemically synthesized
agtggtttctcttagaaaaa

SEQ ID NO: 598036 - DNA, 20 bp, Artificial Sequence
  chemically synthesized
acatttgcaataatgtgatc

SEQ ID NO: 598037 - DNA, 20 bp, Artificial Sequence
  chemically synthesized
accactgatcacattattgc

SEQ ID NO: 598038 - DNA, 20 bp, Artificial Sequence
  chemically synthesized
gtttatgtatagttcaaaag

SEQ ID NO: 598039 - DNA, 20 bp, Artificial Sequence
  chemically synthesized
aacagtttaatgcgtggaaa

SEQ ID NO: 598040 - DNA, 20 bp, Artificial Sequence
  chemically synthesized
tctaatagtttaatagttct

SEQ ID NO: 598041 - DNA, 20 bp, Artificial Sequence
  chemically synthesized
gaattcgagttgaattttct

SEQ ID NO: 598042 - DNA, 20 bp, Artificial Sequence
  chemically synthesized
tcaaagcaaaatttgtttgc

SEQ ID NO: 598043 - DNA, 20 bp, Artificial Sequence
  chemically synthesized
aaaaagcatttgcaaacaaa

SEQ ID NO: 598044 - DNA, 20 bp, Artificial Sequence
  chemically synthesized
atataaaatttcaaagcaaa

SEQ ID NO: 598045 - DNA, 20 bp, Artificial Sequence
  chemically synthesized
gctttgaaattttatatgat

SEQ ID NO: 598046 - DNA, 20 bp, Artificial Sequence
  chemically synthesized
tgtaatacaggggcatatta

SEQ ID NO: 598047 - DNA, 20 bp, Artificial Sequence
  chemically synthesized
ctgaaggaaaataaaagaac

SEQ ID NO: 598048 - DNA, 20 bp, Artificial Sequence
  chemically synthesized
atatctgaaggaaaataaaa

SEQ ID NO: 598049 - DNA, 20 bp, Artificial Sequence
  chemically synthesized
cttttattttccttcagata

SEQ ID NO: 598050 - DNA, 20 bp, Artificial Sequence
  chemically synthesized
attttccttcagatattttg

SEQ ID NO: 598051 - DNA, 20 bp, Artificial Sequence
  chemically synthesized
aattatgccatgagcaaagt

SEQ ID NO: 598052 - DNA, 20 bp, Artificial Sequence
  chemically synthesized
ttttgccttcatttaactaa

SEQ ID NO: 598053 - DNA, 20 bp, Artificial Sequence
  chemically synthesized
actaattgggattattaaat

SEQ ID NO: 598054 - DNA, 20 bp, Artificial Sequence
  chemically synthesized
tttgtgcttaagagctgtga

SEQ ID NO: 598055 - DNA, 20 bp, Artificial Sequence
  chemically synthesized
taagatctttctcctctgga

SEQ ID NO: 598056 - DNA, 20 bp, Artificial Sequence
  chemically synthesized
agggacaaaagtactggcaa

SEQ ID NO: 598057 - DNA, 20 bp, Artificial Sequence
  chemically synthesized
atttcttctcatattttagt

SEQ ID NO: 598058 - DNA, 20 bp, Artificial Sequence
  chemically synthesized
cagaagatcccttgagagat

SEQ ID NO: 598059 - DNA, 20 bp, Artificial Sequence
  chemically synthesized
atctctcaagggatcttctg

SEQ ID NO: 598060 - DNA, 20 bp, Artificial Sequence
  chemically synthesized
cagccccaagtcggccgaga

SEQ ID NO: 598061 - DNA, 20 bp, Artificial Sequence
  chemically synthesized
gagaatgggttttcatagac

SEQ ID NO: 598062 - DNA, 20 bp, Artificial Sequence
  chemically synthesized
gggttttcatagacacatgc

SEQ ID NO: 598063 - DNA, 20 bp, Artificial Sequence
  chemically synthesized
ttggtcggtagtgagagaat

SEQ ID NO: 598064 - DNA, 20 bp, Artificial Sequence
  chemically synthesized
agagttgaaaaagagatgct

SEQ ID NO: 598065 - DNA, 20 bp, Artificial Sequence
  chemically synthesized
agcatctctttttcaactct

SEQ ID NO: 598066 - DNA, 20 bp, Artificial Sequence
  chemically synthesized
tcatgttttaaaaggatcac

SEQ ID NO: 598067 - DNA, 20 bp, Artificial Sequence
  chemically synthesized
gccagtgtgatccttttaaa

SEQ ID NO: 598068 - DNA, 20 bp, Artificial Sequence
  chemically synthesized
gttgagtggcatgatctcaa

SEQ ID NO: 598069 - DNA, 20 bp, Artificial Sequence
  chemically synthesized
taaatgagatgagagcaatt

SEQ ID NO: 598070 - DNA, 20 bp, Artificial Sequence
  chemically synthesized
ggcctttggggccattgtaa

SEQ ID NO: 598071 - DNA, 20 bp, Artificial Sequence
  chemically synthesized
ggatatgggagttgtgagtg

SEQ ID NO: 598072 - DNA, 20 bp, Artificial Sequence
  chemically synthesized
tcatctctttctacccttcc

SEQ ID NO: 598073 - DNA, 20 bp, Artificial Sequence
  chemically synthesized
ctctttctacccttccactg

SEQ ID NO: 598074 - DNA, 20 bp, Artificial Sequence
  chemically synthesized
tctacccttccactggcttg

SEQ ID NO: 598075 - DNA, 20 bp, Artificial Sequence
  chemically synthesized
agccactttggccttcttgt

SEQ ID NO: 598076 - DNA, 20 bp, Artificial Sequence
  chemically synthesized
actttggccttcttgttggt

SEQ ID NO: 598077 - DNA, 20 bp, Artificial Sequence
  chemically synthesized
gtagaggcccaaatgtggga

SEQ ID NO: 598078 - DNA, 20 bp, Artificial Sequence
  chemically synthesized
gggtagaaatgacctttgag

SEQ ID NO: 598079 - DNA, 20 bp, Artificial Sequence
  chemically synthesized
tagtggtcctatatcccctt

SEQ ID NO: 598080 - DNA, 20 bp, Artificial Sequence
  chemically synthesized
cctatatccccttaacagat

SEQ ID NO: 598081 - DNA, 20 bp, Artificial Sequence
  chemically synthesized
aatatttacttatcattttt

SEQ ID NO: 598082 - DNA, 20 bp, Artificial Sequence
  chemically synthesized
tttacttatcatttttcttt

SEQ ID NO: 598083 - DNA, 20 bp, Artificial Sequence
  chemically synthesized
cttatcatttttctttgttt

SEQ ID NO: 598084 - DNA, 20 bp, Artificial Sequence
  chemically synthesized
taataaaagctgaatgaggg

SEQ ID NO: 598085 - DNA, 20 bp, Artificial Sequence
  chemically synthesized
ctaacgaatctttgccctca

SEQ ID NO: 598086 - DNA, 20 bp, Artificial Sequence
  chemically synthesized
aaagattcgttagtcttttt

SEQ ID NO: 598087 - DNA, 20 bp, Artificial Sequence
  chemically synthesized
tatgtaccacacactattct

SEQ ID NO: 598088 - DNA, 20 bp, Artificial Sequence
  chemically synthesized
aatagtgtgtggtacatact

SEQ ID NO: 598089 - DNA, 20 bp, Artificial Sequence
  chemically synthesized
aatatacgaatccacattcc

SEQ ID NO: 598090 - DNA, 20 bp, Artificial Sequence
  chemically synthesized
ggacaagtaaacctaaggaa

SEQ ID NO: 598091 - DNA, 20 bp, Artificial Sequence
  chemically synthesized
gtttacttgtcctaacaatt

SEQ ID NO: 598092 - DNA, 20 bp, Artificial Sequence
  chemically synthesized
tcgttcaagtcctcttgagt

SEQ ID NO: 598093 - DNA, 20 bp, Artificial Sequence
  chemically synthesized
actcaagaggacttgaacga

SEQ ID NO: 598094 - DNA, 20 bp, Artificial Sequence
  chemically synthesized
cgacctggcttcacactatc

SEQ ID NO: 598095 - DNA, 20 bp, Artificial Sequence
  chemically synthesized
ctttggcttataagctcact

SEQ ID NO: 598096 - DNA, 20 bp, Artificial Sequence
  chemically synthesized
accacaagggaaagctggta

SEQ ID NO: 598097 - DNA, 20 bp, Artificial Sequence
  chemically synthesized
aggagacatggtggtcctaa

SEQ ID NO: 598098 - DNA, 20 bp, Artificial Sequence
  chemically synthesized
gaccaccatgtctcctaccc

SEQ ID NO: 598099 - DNA, 20 bp, Artificial Sequence
  chemically synthesized
cgtgagctttcttcatatgg

SEQ ID NO: 598100 - DNA, 20 bp, Artificial Sequence
  chemically synthesized
aaccaattatagtacagatg

SEQ ID NO: 598101 - DNA, 20 bp, Artificial Sequence
  chemically synthesized
aacaaggcatctgtactata

SEQ ID NO: 598102 - DNA, 20 bp, Artificial Sequence
  chemically synthesized
tttccttccatttatttcct

SEQ ID NO: 598103 - DNA, 20 bp, Artificial Sequence
  chemically synthesized
cccttccttcctcctccttt

SEQ ID NO: 598104 - DNA, 20 bp, Artificial Sequence
  chemically synthesized
ttcaatattccacattgcac

SEQ ID NO: 598105 - DNA, 20 bp, Artificial Sequence
  chemically synthesized
aaagaataatattagctgta

SEQ ID NO: 598106 - DNA, 20 bp, Artificial Sequence
  chemically synthesized
gcttataataagaatgacaa

SEQ ID NO: 598107 - DNA, 20 bp, Artificial Sequence
  chemically synthesized
ttttaggacaaaaataagaa

SEQ ID NO: 598108 - DNA, 20 bp, Artificial Sequence
  chemically synthesized
ccaaggcctaattgaacagc

SEQ ID NO: 598109 - DNA, 20 bp, Artificial Sequence
  chemically synthesized
cctttggagtggaattcttc

SEQ ID NO: 598110 - DNA, 20 bp, Artificial Sequence
  chemically synthesized
ctagatagagttcccctata

SEQ ID NO: 598111 - DNA, 20 bp, Artificial Sequence
  chemically synthesized
aagacatcccttgtcttcga

SEQ ID NO: 598112 - DNA, 20 bp, Artificial Sequence
  chemically synthesized
agtgaaatgtatcctatgag

SEQ ID NO: 598113 - DNA, 20 bp, Artificial Sequence
  chemically synthesized
ctctgacccaaaattctgtt

SEQ ID NO: 598114 - DNA, 20 bp, Artificial Sequence
  chemically synthesized
attttgggtcagagcataaa

SEQ ID NO: 598115 - DNA, 20 bp, Artificial Sequence
  chemically synthesized
tcagttagggtaactctgaa

SEQ ID NO: 598116 - DNA, 20 bp, Artificial Sequence
  chemically synthesized
aaaagttatttgttattggt

SEQ ID NO: 598117 - DNA, 20 bp, Artificial Sequence
  chemically synthesized
actttaactacctgacactc

SEQ ID NO: 598118 - DNA, 20 bp, Artificial Sequence
  chemically synthesized
aactacctgacactcatgag

SEQ ID NO: 598119 - DNA, 20 bp, Artificial Sequence
  chemically synthesized
tgccagatccaagtgtctct

SEQ ID NO: 598120 - DNA, 20 bp, Artificial Sequence
  chemically synthesized
tgatatgggtgacatcccaa

SEQ ID NO: 598121 - DNA, 20 bp, Artificial Sequence
  chemically synthesized
gtttcatcctccaataaaac

SEQ ID NO: 598122 - DNA, 20 bp, Artificial Sequence
  chemically synthesized
tgcctaattttactgaaagc

SEQ ID NO: 598123 - DNA, 20 bp, Artificial Sequence
  chemically synthesized
ccacttaaaagacttaactg

SEQ ID NO: 598124 - DNA, 20 bp, Artificial Sequence
  chemically synthesized
aagtcttttaagtggatcat

SEQ ID NO: 598125 - DNA, 20 bp, Artificial Sequence
  chemically synthesized
ggatcatttctgcttttagg

SEQ ID NO: 598126 - DNA, 20 bp, Artificial Sequence
  chemically synthesized
ctggagagagttaaatattt

SEQ ID NO: 598127 - DNA, 20 bp, Artificial Sequence
  chemically synthesized
tcgtaagttttaaattacca

SEQ ID NO: 598128 - DNA, 20 bp, Artificial Sequence
  chemically synthesized
acacagaatttcttagcatc

SEQ ID NO: 598129 - DNA, 20 bp, Artificial Sequence
  chemically synthesized
gatgctaagaaattctgtgt

SEQ ID NO: 598130 - DNA, 20 bp, Artificial Sequence
  chemically synthesized
ttcatatgagatactttaag

SEQ ID NO: 598131 - DNA, 20 bp, Artificial Sequence
  chemically synthesized
gatactttaaggcaggattt

SEQ ID NO: 598132 - DNA, 20 bp, Artificial Sequence
  chemically synthesized
tttggaaaattttatcatga

SEQ ID NO: 598133 - DNA, 20 bp, Artificial Sequence
  chemically synthesized
tagaagaattgcaatttttt

SEQ ID NO: 598134 - DNA, 20 bp, Artificial Sequence
  chemically synthesized
attaacagttaattgattgt

SEQ ID NO: 598135 - DNA, 20 bp, Artificial Sequence
  chemically synthesized
caatattaacagttaattga

SEQ ID NO: 598136 - DNA, 20 bp, Artificial Sequence
  chemically synthesized
cagagccaatattaacagtt

SEQ ID NO: 598137 - DNA, 20 bp, Artificial Sequence
  chemically synthesized
aaagaaaatattacttatgt

SEQ ID NO: 598138 - DNA, 20 bp, Artificial Sequence
  chemically synthesized
ttctctagctctgccttagc

SEQ ID NO: 598139 - DNA, 20 bp, Artificial Sequence
  chemically synthesized
ctagtgtttttgctattaaa

SEQ ID NO: 598140 - DNA, 20 bp, Artificial Sequence
  chemically synthesized
atatatatatacgtatatat

SEQ ID NO: 598141 - DNA, 20 bp, Artificial Sequence
  chemically synthesized
atatacgtatatatatatgt

SEQ ID NO: 598142 - DNA, 20 bp, Artificial Sequence
  chemically synthesized
tatctgcatagtctctgtca

SEQ ID NO: 598143 - DNA, 20 bp, Artificial Sequence
  chemically synthesized
agtctctgtcaacatgatta

SEQ ID NO: 598144 - DNA, 20 bp, Artificial Sequence
  chemically synthesized
aatacaactaaaatagcacg

SEQ ID NO: 598145 - DNA, 20 bp, Artificial Sequence
  chemically synthesized
tacgtgctattttagttgta

SEQ ID NO: 598146 - DNA, 20 bp, Artificial Sequence
  chemically synthesized
cagaactatagtaagtattg

SEQ ID NO: 598147 - DNA, 20 bp, Artificial Sequence
  chemically synthesized
atacttactatagttctgta

SEQ ID NO: 598148 - DNA, 20 bp, Artificial Sequence
  chemically synthesized
ttgggaaggtttgaaattgt

SEQ ID NO: 598149 - DNA, 20 bp, Artificial Sequence
  chemically synthesized
attgtacagctgctggttgg

SEQ ID NO: 598150 - DNA, 20 bp, Artificial Sequence
  chemically synthesized
cagcagctgtacaatttatg

SEQ ID NO: 598151 - DNA, 20 bp, Artificial Sequence
  chemically synthesized
cattgacttttttgaagggg

SEQ ID NO: 598152 - DNA, 20 bp, Artificial Sequence
  chemically synthesized
aacaaatctccagcaggtga

SEQ ID NO: 598153 - DNA, 20 bp, Artificial Sequence
  chemically synthesized
taggaagcccattcacctgc

SEQ ID NO: 598154 - DNA, 20 bp, Artificial Sequence
  chemically synthesized
cccataagatacagttgtgg

SEQ ID NO: 598155 - DNA, 20 bp, Artificial Sequence
  chemically synthesized
atgcccacaactgtatctta

SEQ ID NO: 598156 - DNA, 20 bp, Artificial Sequence
  chemically synthesized
ggtttataatatggtattat

SEQ ID NO: 598157 - DNA, 20 bp, Artificial Sequence
  chemically synthesized
atcgtaatagtattgattac

SEQ ID NO: 598158 - DNA, 20 bp, Artificial Sequence
  chemically synthesized
aaccgcagtaatcaatacta

SEQ ID NO: 598159 - DNA, 20 bp, Artificial Sequence
  chemically synthesized
gctgatgtcaatcgtaatag

SEQ ID NO: 598160 - DNA, 20 bp, Artificial Sequence
  chemically synthesized
ttaaatagatcaggatgaac

SEQ ID NO: 598161 - DNA, 20 bp, Artificial Sequence
  chemically synthesized
taactaagttctcatggcag

SEQ ID NO: 598162 - DNA, 20 bp, Artificial Sequence
  chemically synthesized
aatgacaggaattctggcat

SEQ ID NO: 598163 - DNA, 20 bp, Artificial Sequence
  chemically synthesized
catgtcagctttattttatt

SEQ ID NO: 598164 - DNA, 20 bp, Artificial Sequence
  chemically synthesized
agctttattttattaactga

SEQ ID NO: 598165 - DNA, 20 bp, Artificial Sequence
  chemically synthesized
cttttcttcattgtaccaat

SEQ ID NO: 598166 - DNA, 20 bp, Artificial Sequence
  chemically synthesized
cagtgtggcactgtttctta

SEQ ID NO: 598167 - DNA, 20 bp, Artificial Sequence
  chemically synthesized
ttccatccatgtcagtgtgg

SEQ ID NO: 598168 - DNA, 20 bp, Artificial Sequence
  chemically synthesized
ataaaattacacagtaaaat

SEQ ID NO: 598169 - DNA, 20 bp, Artificial Sequence
  chemically synthesized
cttattttactgtgtaattt

SEQ ID NO: 598170 - DNA, 20 bp, Artificial Sequence
  chemically synthesized
agtcactgaagatactgcaa

SEQ ID NO: 598171 - DNA, 20 bp, Artificial Sequence
  chemically synthesized
accgatttccaaaacaaaca

SEQ ID NO: 598172 - DNA, 20 bp, Artificial Sequence
  chemically synthesized
acaaatggataaagctattt

SEQ ID NO: 598173 - DNA, 20 bp, Artificial Sequence
  chemically synthesized
atatacaaatggataaagct

SEQ ID NO: 598174 - DNA, 20 bp, Artificial Sequence
  chemically synthesized
aggcaaatgtgtgatataga

SEQ ID NO: 598175 - DNA, 20 bp, Artificial Sequence
  chemically synthesized
gctaaagtattttatactca

SEQ ID NO: 598176 - DNA, 20 bp, Artificial Sequence
  chemically synthesized
tatgtgattataggcaaaag

SEQ ID NO: 598177 - DNA, 20 bp, Artificial Sequence
  chemically synthesized
atcttttgcctataatcaca

SEQ ID NO: 598178 - DNA, 20 bp, Artificial Sequence
  chemically synthesized
tattttcaaatgcaaacagt

SEQ ID NO: 598179 - DNA, 20 bp, Artificial Sequence
  chemically synthesized
atgaaatattatagtatacc

SEQ ID NO: 598180 - DNA, 20 bp, Artificial Sequence
  chemically synthesized
gaatttagtaacttgctgtt

SEQ ID NO: 598181 - DNA, 20 bp, Artificial Sequence
  chemically synthesized
ctgttggtggtttgaaaaca

SEQ ID NO: 598182 - DNA, 20 bp, Artificial Sequence
  chemically synthesized
aaaggctaccaacaaaatcc

SEQ ID NO: 598183 - DNA, 20 bp, Artificial Sequence
  chemically synthesized
cagttataaagaaaatattt

SEQ ID NO: 598184 - DNA, 20 bp, Artificial Sequence
  chemically synthesized
ttatatgtaatgtatattgt

SEQ ID NO: 598185 - DNA, 20 bp, Artificial Sequence
  chemically synthesized
tttcatttatatgtaatgta

SEQ ID NO: 598186 - DNA, 20 bp, Artificial Sequence
  chemically synthesized
ttcattttccaaaaagggaa

SEQ ID NO: 598187 - DNA, 20 bp, Artificial Sequence
  chemically synthesized
attcctagttaatggatgac

SEQ ID NO: 598188 - DNA, 20 bp, Artificial Sequence
  chemically synthesized
ggaataaactgttcttccat

SEQ ID NO: 598189 - DNA, 20 bp, Artificial Sequence
  chemically synthesized
taaataaactttgatggaag

SEQ ID NO: 598190 - DNA, 20 bp, Artificial Sequence
  chemically synthesized
agaaaatgtattttacaata

SEQ ID NO: 598191 - DNA, 20 bp, Artificial Sequence
  chemically synthesized
tctaacttatgtctttctac

SEQ ID NO: 598192 - DNA, 20 bp, Artificial Sequence
  chemically synthesized
taaaaatacttgatagtgtg

SEQ ID NO: 598193 - DNA, 20 bp, Artificial Sequence
  chemically synthesized
accttgtaaaatacgaatga

SEQ ID NO: 598194 - DNA, 20 bp, Artificial Sequence
  chemically synthesized
taaaatacgaatgaaagtgc

SEQ ID NO: 598195 - DNA, 20 bp, Artificial Sequence
  chemically synthesized
gttttaccttcagagactcc

SEQ ID NO: 598196 - DNA, 20 bp, Artificial Sequence
  chemically synthesized
agaagttgttccacttctaa

SEQ ID NO: 598197 - DNA, 20 bp, Artificial Sequence
  chemically synthesized
taatagggcttgtgagacat

SEQ ID NO: 598198 - DNA, 20 bp, Artificial Sequence
  chemically synthesized
atgtcttcagtcatcaccat

SEQ ID NO: 598199 - DNA, 20 bp, Artificial Sequence
  chemically synthesized
tatacaaaagaacaattttt

SEQ ID NO: 598200 - DNA, 20 bp, Artificial Sequence
  chemically synthesized
taacagtgaaacctcctcca

SEQ ID NO: 598201 - DNA, 20 bp, Artificial Sequence
  chemically synthesized
acctatataaacttaatgga

SEQ ID NO: 598202 - DNA, 20 bp, Artificial Sequence
  chemically synthesized
aatccattttcagcccagtt

SEQ ID NO: 598203 - DNA, 20 bp, Artificial Sequence
  chemically synthesized
aatctacaaactgggctgaa

SEQ ID NO: 598204 - DNA, 20 bp, Artificial Sequence
  chemically synthesized
ggttttgaatccattttcag

SEQ ID NO: 598205 - DNA, 20 bp, Artificial Sequence
  chemically synthesized
ttttactagacttaccatcg

SEQ ID NO: 598206 - DNA, 20 bp, Artificial Sequence
  chemically synthesized
cgatggtaagtctagtaaaa

SEQ ID NO: 598207 - DNA, 20 bp, Artificial Sequence
  chemically synthesized
taggtatataattaataaat

SEQ ID NO: 598208 - DNA, 20 bp, Artificial Sequence
  chemically synthesized
tgtgtgtgtcacttattatg

SEQ ID NO: 598209 - DNA, 20 bp, Artificial Sequence
  chemically synthesized
gaccatgaggtcataaggag

SEQ ID NO: 598210 - DNA, 20 bp, Artificial Sequence
  chemically synthesized
gtagttttatcctaagaaaa

SEQ ID NO: 598211 - DNA, 20 bp, Artificial Sequence
  chemically synthesized
attttcctggaaatctagat

SEQ ID NO: 598212 - DNA, 20 bp, Artificial Sequence
  chemically synthesized
ccccctcacccaatcccata

SEQ ID NO: 598213 - DNA, 20 bp, Artificial Sequence
  chemically synthesized
attgggtgagggggactcat

SEQ ID NO: 598214 - DNA, 20 bp, Artificial Sequence
  chemically synthesized
gtctagaatttggaggagaa

SEQ ID NO: 598215 - DNA, 20 bp, Artificial Sequence
  chemically synthesized
tccaaattctagacattagc

SEQ ID NO: 598216 - DNA, 20 bp, Artificial Sequence
  chemically synthesized
gctcatatagcagcttcatt

SEQ ID NO: 598217 - DNA, 20 bp, Artificial Sequence
  chemically synthesized
gcagtcagttctgctcatat

SEQ ID NO: 598218 - DNA, 20 bp, Artificial Sequence
  chemically synthesized
ttccagctccagagtccttt

SEQ ID NO: 598219 - DNA, 20 bp, Artificial Sequence
  chemically synthesized
gcctgttgatgaggtcacct

SEQ ID NO: 598220 - DNA, 20 bp, Artificial Sequence
  chemically synthesized
aatggctacgttagcatgct

SEQ ID NO: 598221 - DNA, 20 bp, Artificial Sequence
  chemically synthesized
agtaataaatggctacgtta

SEQ ID NO: 598222 - DNA, 20 bp, Artificial Sequence
  chemically synthesized
aaatttacaagctggtcact

SEQ ID NO: 598223 - DNA, 20 bp, Artificial Sequence
  chemically synthesized
taaaaacaaaacataaagtg

SEQ ID NO: 598224 - DNA, 20 bp, Artificial Sequence
  chemically synthesized
tacaagctggtcactttatg

SEQ ID NO: 598225 - DNA, 20 bp, Artificial Sequence
  chemically synthesized
ttgtttttaatttctctgac

SEQ ID NO: 598226 - DNA, 20 bp, Artificial Sequence
  chemically synthesized
ataattataccttttacaac

SEQ ID NO: 598227 - DNA, 20 bp, Artificial Sequence
  chemically synthesized
gaacatgaaggaatgtgtgc

SEQ ID NO: 598228 - DNA, 20 bp, Artificial Sequence
  chemically synthesized
aggatattagaaacttgagc

SEQ ID NO: 598229 - DNA, 20 bp, Artificial Sequence
  chemically synthesized
tttatttatcaaactctggc

SEQ ID NO: 598230 - DNA, 20 bp, Artificial Sequence
  chemically synthesized
ataaataaaattcagaattt

SEQ ID NO: 598231 - DNA, 20 bp, Artificial Sequence
  chemically synthesized
atttttcttttaaatgtgta

SEQ ID NO: 598232 - DNA, 20 bp, Artificial Sequence
  chemically synthesized
gttacttgtgctattgattc

SEQ ID NO: 598233 - DNA, 20 bp, Artificial Sequence
  chemically synthesized
caagcttgtgttacttgtgc

SEQ ID NO: 598234 - DNA, 20 bp, Artificial Sequence
  chemically synthesized
gaatcaatagcacaagtaac

SEQ ID NO: 598235 - DNA, 20 bp, Artificial Sequence
  chemically synthesized
atagcacaagtaacacaagc

SEQ ID NO: 598236 - DNA, 20 bp, Artificial Sequence
  chemically synthesized
caatgtaatgcgtgcaaaac

SEQ ID NO: 598237 - DNA, 20 bp, Artificial Sequence
  chemically synthesized
aactaacgtgaataagaaag

SEQ ID NO: 598238 - DNA, 20 bp, Artificial Sequence
  chemically synthesized
gctataacccctgcagtaaa

SEQ ID NO: 598239 - DNA, 20 bp, Artificial Sequence
  chemically synthesized
ataagtattataagaaatac

SEQ ID NO: 598240 - DNA, 20 bp, Artificial Sequence
  chemically synthesized
ttaaataagtattataagaa

SEQ ID NO: 598241 - DNA, 20 bp, Artificial Sequence
  chemically synthesized
gtgtaaaatgtatcattaaa

SEQ ID NO: 598242 - DNA, 20 bp, Artificial Sequence
  chemically synthesized
taatgatacattttacacct

SEQ ID NO: 598243 - DNA, 20 bp, Artificial Sequence
  chemically synthesized
cctgtaagtttttggaaaac

SEQ ID NO: 598244 - DNA, 20 bp, Artificial Sequence
  chemically synthesized
ctgttcctgataacaaaaac

SEQ ID NO: 598245 - DNA, 20 bp, Artificial Sequence
  chemically synthesized
agagtaagtagaagacaagt

SEQ ID NO: 598246 - DNA, 20 bp, Artificial Sequence
  chemically synthesized
agtttttcatttatttatta

SEQ ID NO: 598247 - DNA, 20 bp, Artificial Sequence
  chemically synthesized
atttatttattaatttgttt

SEQ ID NO: 598248 - DNA, 20 bp, Artificial Sequence
  chemically synthesized
ttttgttgtttaatcaaggg

SEQ ID NO: 598249 - DNA, 20 bp, Artificial Sequence
  chemically synthesized
gtccaattctgaaacaactc

SEQ ID NO: 598250 - DNA, 20 bp, Artificial Sequence
  chemically synthesized
cactgcttttgttaaggcca

SEQ ID NO: 598251 - DNA, 20 bp, Artificial Sequence
  chemically synthesized
tcaaaacttttctgaattcc

SEQ ID NO: 598252 - DNA, 20 bp, Artificial Sequence
  chemically synthesized
caaaagcagtgggaattcag

SEQ ID NO: 598253 - DNA, 20 bp, Artificial Sequence
  chemically synthesized
ttaaaagaaaaataattcta

SEQ ID NO: 598254 - DNA, 20 bp, Artificial Sequence
  chemically synthesized
ctaagatgtttttatctatt

SEQ ID NO: 598255 - DNA, 20 bp, Artificial Sequence
  chemically synthesized
tttctgattcttctttgata

SEQ ID NO: 598256 - DNA, 20 bp, Artificial Sequence
  chemically synthesized
cagctatcttaaattcatat

SEQ ID NO: 598257 - DNA, 20 bp, Artificial Sequence
  chemically synthesized
tgcttaataaatatagtaat

SEQ ID NO: 598258 - DNA, 20 bp, Artificial Sequence
  chemically synthesized
cattatatttgaccatacag

SEQ ID NO: 598259 - DNA, 20 bp, Artificial Sequence
  chemically synthesized
aataccaaaatagtcaaaat

SEQ ID NO: 598260 - DNA, 20 bp, Artificial Sequence
  chemically synthesized
gaaaggaacgttaaataaaa

SEQ ID NO: 598261 - DNA, 20 bp, Artificial Sequence
  chemically synthesized
atcttttcaaaagaccagct

SEQ ID NO: 598262 - DNA, 20 bp, Artificial Sequence
  chemically synthesized
atccaggagctggtcttttg

SEQ ID NO: 598263 - DNA, 20 bp, Artificial Sequence
  chemically synthesized
tatcattttttattgtgcct

SEQ ID NO: 598264 - DNA, 20 bp, Artificial Sequence
  chemically synthesized
tgttgatagtattctctgat

SEQ ID NO: 598265 - DNA, 20 bp, Artificial Sequence
  chemically synthesized
tatccattttttctagattt

SEQ ID NO: 598266 - DNA, 20 bp, Artificial Sequence
  chemically synthesized
ccaggaatttatccattttt

SEQ ID NO: 598267 - DNA, 20 bp, Artificial Sequence
  chemically synthesized
attcagggattcaacttctt

SEQ ID NO: 598268 - DNA, 20 bp, Artificial Sequence
  chemically synthesized
gaacttgttattggtctatt

SEQ ID NO: 598269 - DNA, 20 bp, Artificial Sequence
  chemically synthesized
aaaaaaaaagcccaggacca

SEQ ID NO: 598270 - DNA, 20 bp, Artificial Sequence
  chemically synthesized
agctgtgaatccgtctggtc

SEQ ID NO: 598271 - DNA, 20 bp, Artificial Sequence
  chemically synthesized
ttttcttttgtattgcttgg

SEQ ID NO: 598272 - DNA, 20 bp, Artificial Sequence
  chemically synthesized
gaagaatttattttcttttg

SEQ ID NO: 598273 - DNA, 20 bp, Artificial Sequence
  chemically synthesized
tcttttttgttgtgtctttg

SEQ ID NO: 598274 - DNA, 20 bp, Artificial Sequence
  chemically synthesized
ttggtttgccagtattttat

SEQ ID NO: 598275 - DNA, 20 bp, Artificial Sequence
  chemically synthesized
ctttttaatgtgctactgga

SEQ ID NO: 598276 - DNA, 20 bp, Artificial Sequence
  chemically synthesized
gatatgctttttaatgtgct

SEQ ID NO: 598277 - DNA, 20 bp, Artificial Sequence
  chemically synthesized
agcctacttgattgtgatgg

SEQ ID NO: 598278 - DNA, 20 bp, Artificial Sequence
  chemically synthesized
agcatatccatcacaatcaa

SEQ ID NO: 598279 - DNA, 20 bp, Artificial Sequence
  chemically synthesized
gcatcccagggatgaagcct

SEQ ID NO: 598280 - DNA, 20 bp, Artificial Sequence
  chemically synthesized
tattgatttgcgtatgttga

SEQ ID NO: 598281 - DNA, 20 bp, Artificial Sequence
  chemically synthesized
tttatgtgatgggttacatt

SEQ ID NO: 598282 - DNA, 20 bp, Artificial Sequence
  chemically synthesized
gtggtttttttggtcattgg

SEQ ID NO: 598283 - DNA, 20 bp, Artificial Sequence
  chemically synthesized
aaccaatgaccaaaaaaacc

SEQ ID NO: 598284 - DNA, 20 bp, Artificial Sequence
  chemically synthesized
tgcatctattgagataatca

SEQ ID NO: 598285 - DNA, 20 bp, Artificial Sequence
  chemically synthesized
ccatcaataactagtttatt

SEQ ID NO: 598286 - DNA, 20 bp, Artificial Sequence
  chemically synthesized
tgagatttgtcccatcaata

SEQ ID NO: 598287 - DNA, 20 bp, Artificial Sequence
  chemically synthesized
cataaatagctcttaatatt

SEQ ID NO: 598288 - DNA, 20 bp, Artificial Sequence
  chemically synthesized
cattcagtatgatactggct

SEQ ID NO: 598289 - DNA, 20 bp, Artificial Sequence
  chemically synthesized
cagttttcaaagggaatgct

SEQ ID NO: 598290 - DNA, 20 bp, Artificial Sequence
  chemically synthesized
cttgtgccagttttcaaagg

SEQ ID NO: 598291 - DNA, 20 bp, Artificial Sequence
  chemically synthesized
agagggcatccttgtcttgt

SEQ ID NO: 598292 - DNA, 20 bp, Artificial Sequence
  chemically synthesized
tatctttctttctttctctt

SEQ ID NO: 598293 - DNA, 20 bp, Artificial Sequence
  chemically synthesized
aagagaggaagtcaaattat

SEQ ID NO: 598294 - DNA, 20 bp, Artificial Sequence
  chemically synthesized
attatctctgtttgcagatg

SEQ ID NO: 598295 - DNA, 20 bp, Artificial Sequence
  chemically synthesized
gagtttttgggctgagacga

SEQ ID NO: 598296 - DNA, 20 bp, Artificial Sequence
  chemically synthesized
tgaagttgcttatcagctta

SEQ ID NO: 598297 - DNA, 20 bp, Artificial Sequence
  chemically synthesized
agactttgctgaagttgctt

SEQ ID NO: 598298 - DNA, 20 bp, Artificial Sequence
  chemically synthesized
gtatcctgagactttgctga

SEQ ID NO: 598299 - DNA, 20 bp, Artificial Sequence
  chemically synthesized
gaatgcttgtgatttttgca

SEQ ID NO: 598300 - DNA, 20 bp, Artificial Sequence
  chemically synthesized
ttattggtttataggaatgc

SEQ ID NO: 598301 - DNA, 20 bp, Artificial Sequence
  chemically synthesized
tgtctgttattggtttatag

SEQ ID NO: 598302 - DNA, 20 bp, Artificial Sequence
  chemically synthesized
tatttggctctctgtctgtt

SEQ ID NO: 598303 - DNA, 20 bp, Artificial Sequence
  chemically synthesized
cctctcttatttccttgagc

SEQ ID NO: 598304 - DNA, 20 bp, Artificial Sequence
  chemically synthesized
taagcatggaatgtttttcc

SEQ ID NO: 598305 - DNA, 20 bp, Artificial Sequence
  chemically synthesized
caaacaaatggaaaaacatt

SEQ ID NO: 598306 - DNA, 20 bp, Artificial Sequence
  chemically synthesized
tcttcctttccataagcatg

SEQ ID NO: 598307 - DNA, 20 bp, Artificial Sequence
  chemically synthesized
cgctatggccattttcatgt

SEQ ID NO: 598308 - DNA, 20 bp, Artificial Sequence
  chemically synthesized
ccatagcgcccaaagtaatt

SEQ ID NO: 598309 - DNA, 20 bp, Artificial Sequence
  chemically synthesized
attctgtgaagaaagtcaat

SEQ ID NO: 598310 - DNA, 20 bp, Artificial Sequence
  chemically synthesized
tggttccatatgaaatgtaa

SEQ ID NO: 598311 - DNA, 20 bp, Artificial Sequence
  chemically synthesized
tccagctttgttattcttgc

SEQ ID NO: 598312 - DNA, 20 bp, Artificial Sequence
  chemically synthesized
gatgcctccagctttgttat

SEQ ID NO: 598313 - DNA, 20 bp, Artificial Sequence
  chemically synthesized
aagtcaggtagcgtgatgcc

SEQ ID NO: 598314 - DNA, 20 bp, Artificial Sequence
  chemically synthesized
tggttactgtagcattatag

SEQ ID NO: 598315 - DNA, 20 bp, Artificial Sequence
  chemically synthesized
tataatgctacagtaaccaa

SEQ ID NO: 598316 - DNA, 20 bp, Artificial Sequence
  chemically synthesized
tctgttttgctatcagtata

SEQ ID NO: 598317 - DNA, 20 bp, Artificial Sequence
  chemically synthesized
tctgttccgttggtctatat

SEQ ID NO: 598318 - DNA, 20 bp, Artificial Sequence
  chemically synthesized
ttccacattgcttgtttttg

SEQ ID NO: 598319 - DNA, 20 bp, Artificial Sequence
  chemically synthesized
gacaaaaacaagcaatgtgg

SEQ ID NO: 598320 - DNA, 20 bp, Artificial Sequence
  chemically synthesized
tagggaatcttttccacatt

SEQ ID NO: 598321 - DNA, 20 bp, Artificial Sequence
  chemically synthesized
taaatagggaatcttttcca

SEQ ID NO: 598322 - DNA, 20 bp, Artificial Sequence
  chemically synthesized
ccgttttctgcatatggcca

SEQ ID NO: 598323 - DNA, 20 bp, Artificial Sequence
  chemically synthesized
gtgtaagaaaggggtctagt

SEQ ID NO: 598324 - DNA, 20 bp, Artificial Sequence
  chemically synthesized
tataaggtgtaagaaagggg

SEQ ID NO: 598325 - DNA, 20 bp, Artificial Sequence
  chemically synthesized
ttatacaaaaattaactcat

SEQ ID NO: 598326 - DNA, 20 bp, Artificial Sequence
  chemically synthesized
agtttttatggtttcaggtc

SEQ ID NO: 598327 - DNA, 20 bp, Artificial Sequence
  chemically synthesized
aggttttcttctagagtttt

SEQ ID NO: 598328 - DNA, 20 bp, Artificial Sequence
  chemically synthesized
gtattgcctaggttttcttc

SEQ ID NO: 598329 - DNA, 20 bp, Artificial Sequence
  chemically synthesized
tgtatcctgaatggtattgc

SEQ ID NO: 598330 - DNA, 20 bp, Artificial Sequence
  chemically synthesized
gcttttgttgctgttgcttt

SEQ ID NO: 598331 - DNA, 20 bp, Artificial Sequence
  chemically synthesized
tcaattttggcttttgttgc

SEQ ID NO: 598332 - DNA, 20 bp, Artificial Sequence
  chemically synthesized
attagatcccatttgtcaat

SEQ ID NO: 598333 - DNA, 20 bp, Artificial Sequence
  chemically synthesized
tagggtcttttgctgtgctc

SEQ ID NO: 598334 - DNA, 20 bp, Artificial Sequence
  chemically synthesized
ttgtcagatggatagattgc

SEQ ID NO: 598335 - DNA, 20 bp, Artificial Sequence
  chemically synthesized
taatagccctttgtcagatg

SEQ ID NO: 598336 - DNA, 20 bp, Artificial Sequence
  chemically synthesized
gtaaatttgtttaagttcct

SEQ ID NO: 598337 - DNA, 20 bp, Artificial Sequence
  chemically synthesized
gggtcttttttttcttgtaa

SEQ ID NO: 598338 - DNA, 20 bp, Artificial Sequence
  chemically synthesized
gtgatgatgaggtttttttc

SEQ ID NO: 598339 - DNA, 20 bp, Artificial Sequence
  chemically synthesized
tctctaatgaccagtgatga

SEQ ID NO: 598340 - DNA, 20 bp, Artificial Sequence
  chemically synthesized
ggtgtgagatgctatctcgt

SEQ ID NO: 598341 - DNA, 20 bp, Artificial Sequence
  chemically synthesized
tccacatcttctccagcatc

SEQ ID NO: 598342 - DNA, 20 bp, Artificial Sequence
  chemically synthesized
caccattgtggaagacagtg

SEQ ID NO: 598343 - DNA, 20 bp, Artificial Sequence
  chemically synthesized
ctttgggtatatatccagta

SEQ ID NO: 598344 - DNA, 20 bp, Artificial Sequence
  chemically synthesized
ccattactggatatataccc

SEQ ID NO: 598345 - DNA, 20 bp, Artificial Sequence
  chemically synthesized
gtgcatgtgtctttatagta

SEQ ID NO: 598346 - DNA, 20 bp, Artificial Sequence
  chemically synthesized
ctataaagacacatgcacac

SEQ ID NO: 598347 - DNA, 20 bp, Artificial Sequence
  chemically synthesized
gtttgctgagaatgacggtt

SEQ ID NO: 598348 - DNA, 20 bp, Artificial Sequence
  chemically synthesized
tgtgttagtttgctgagaat

SEQ ID NO: 598349 - DNA, 20 bp, Artificial Sequence
  chemically synthesized
gtttggttttctgttcctgt

SEQ ID NO: 598350 - DNA, 20 bp, Artificial Sequence
  chemically synthesized
atcagtgagaacatgcagtg

SEQ ID NO: 598351 - DNA, 20 bp, Artificial Sequence
  chemically synthesized
ccattatcagtgagaacatg

SEQ ID NO: 598352 - DNA, 20 bp, Artificial Sequence
  chemically synthesized
gccaacaggcccctgcggcc

SEQ ID NO: 598353 - DNA, 20 bp, Artificial Sequence
  chemically synthesized
cataggtatacatgttccgt

SEQ ID NO: 598354 - DNA, 20 bp, Artificial Sequence
  chemically synthesized
gggatacatgtacagaacgt

SEQ ID NO: 598355 - DNA, 20 bp, Artificial Sequence
  chemically synthesized
ttattttatccagtgtcact

SEQ ID NO: 598356 - DNA, 20 bp, Artificial Sequence
  chemically synthesized
tgacactggataaaataaaa

SEQ ID NO: 598357 - DNA, 20 bp, Artificial Sequence
  chemically synthesized
ctttaagccctggtttagga

SEQ ID NO: 598358 - DNA, 20 bp, Artificial Sequence
  chemically synthesized
tgttaatcatagtcctaaac

SEQ ID NO: 598359 - DNA, 20 bp, Artificial Sequence
  chemically synthesized
gctgcctacattctttaagc

SEQ ID NO: 598360 - DNA, 20 bp, Artificial Sequence
  chemically synthesized
atgtaggcagcacaccatac

SEQ ID NO: 598361 - DNA, 20 bp, Artificial Sequence
  chemically synthesized
ataccctggcttctcatctg

SEQ ID NO: 598362 - DNA, 20 bp, Artificial Sequence
  chemically synthesized
acacatggggtcaggtggag

SEQ ID NO: 598363 - DNA, 20 bp, Artificial Sequence
  chemically synthesized
acctgaccccatgtgtctac

SEQ ID NO: 598364 - DNA, 20 bp, Artificial Sequence
  chemically synthesized
gtctaccatagattattata

SEQ ID NO: 598365 - DNA, 20 bp, Artificial Sequence
  chemically synthesized
aaagataggtgaaaatggtt

SEQ ID NO: 598366 - DNA, 20 bp, Artificial Sequence
  chemically synthesized
ttctttgaaagataggtgaa

SEQ ID NO: 598367 - DNA, 20 bp, Artificial Sequence
  chemically synthesized
gccacataacactcttctaa

SEQ ID NO: 598368 - DNA, 20 bp, Artificial Sequence
  chemically synthesized
ctcttgtacagagagtaaaa

SEQ ID NO: 598369 - DNA, 20 bp, Artificial Sequence
  chemically synthesized
attatttaaaagtttgtaaa

SEQ ID NO: 598370 - DNA, 20 bp, Artificial Sequence
  chemically synthesized
taagagcttcttcattattt

SEQ ID NO: 598371 - DNA, 20 bp, Artificial Sequence
  chemically synthesized
agtatttcgatcaggttaat

SEQ ID NO: 598372 - DNA, 20 bp, Artificial Sequence
  chemically synthesized
atgctctaataatatgcata

SEQ ID NO: 598373 - DNA, 20 bp, Artificial Sequence
  chemically synthesized
tatgcatattgtgattattt

SEQ ID NO: 598374 - DNA, 20 bp, Artificial Sequence
  chemically synthesized
tgtattgacactggttgctc

SEQ ID NO: 598375 - DNA, 20 bp, Artificial Sequence
  chemically synthesized
tcatgccatggctgagcatg

SEQ ID NO: 598376 - DNA, 20 bp, Artificial Sequence
  chemically synthesized
gaacataatcaataaaaagg

SEQ ID NO: 598377 - DNA, 20 bp, Artificial Sequence
  chemically synthesized
agtaataaactatacctttt

SEQ ID NO: 598378 - DNA, 20 bp, Artificial Sequence
  chemically synthesized
gatagaaatgatttttctca

SEQ ID NO: 598379 - DNA, 20 bp, Artificial Sequence
  chemically synthesized
ttatcagtagttgaggatag

SEQ ID NO: 598380 - DNA, 20 bp, Artificial Sequence
  chemically synthesized
taatggaaagaaaaattttt

SEQ ID NO: 598381 - DNA, 20 bp, Artificial Sequence
  chemically synthesized
tagaatacctgtaatttcta

SEQ ID NO: 598382 - DNA, 20 bp, Artificial Sequence
  chemically synthesized
ttaatgaagacggatctatt

SEQ ID NO: 598383 - DNA, 20 bp, Artificial Sequence
  chemically synthesized
gaaagttcacaggatcaacc

SEQ ID NO: 598384 - DNA, 20 bp, Artificial Sequence
  chemically synthesized
aattttctagaaaatgagtt

SEQ ID NO: 598385 - DNA, 20 bp, Artificial Sequence
  chemically synthesized
ttctagaaaattccgtgtta

SEQ ID NO: 598386 - DNA, 20 bp, Artificial Sequence
  chemically synthesized
tattaaacattattgtatat

SEQ ID NO: 598387 - DNA, 20 bp, Artificial Sequence
  chemically synthesized
tagcaatctgatatatacaa

SEQ ID NO: 598388 - DNA, 20 bp, Artificial Sequence
  chemically synthesized
tctcttttgattcaatttct

SEQ ID NO: 598389 - DNA, 20 bp, Artificial Sequence
  chemically synthesized
tctccaaatgtctggttctc

SEQ ID NO: 598390 - DNA, 20 bp, Artificial Sequence
  chemically synthesized
gagaaccagacatttggaga

SEQ ID NO: 598391 - DNA, 20 bp, Artificial Sequence
  chemically synthesized
aatggatgtagttttctcat

SEQ ID NO: 598392 - DNA, 20 bp, Artificial Sequence
  chemically synthesized
actgaaagtcattcaatgga

SEQ ID NO: 598393 - DNA, 20 bp, Artificial Sequence
  chemically synthesized
actacatccattgaatgact

SEQ ID NO: 598394 - DNA, 20 bp, Artificial Sequence
  chemically synthesized
atccattgaatgactttcag

SEQ ID NO: 598395 - DNA, 20 bp, Artificial Sequence
  chemically synthesized
gaacatgatatttctaatta

SEQ ID NO: 598396 - DNA, 20 bp, Artificial Sequence
  chemically synthesized
atgcaaaatccaggtactca

SEQ ID NO: 598397 - DNA, 20 bp, Artificial Sequence
  chemically synthesized
aggattaatctgaatgagta

SEQ ID NO: 598398 - DNA, 20 bp, Artificial Sequence
  chemically synthesized
agttaatgaaattcaaatga

SEQ ID NO: 598399 - DNA, 20 bp, Artificial Sequence
  chemically synthesized
gttgattttcaaaaggttag

SEQ ID NO: 598400 - DNA, 20 bp, Artificial Sequence
  chemically synthesized
gtctaaccttttgaaaatca

SEQ ID NO: 598401 - DNA, 20 bp, Artificial Sequence
  chemically synthesized
aaagaacattaacaaaagca

SEQ ID NO: 598402 - DNA, 20 bp, Artificial Sequence
  chemically synthesized
attagcaaggaaatgctata

SEQ ID NO: 598403 - DNA, 20 bp, Artificial Sequence
  chemically synthesized
caaagaaataaaatgaatta

SEQ ID NO: 598404 - DNA, 20 bp, Artificial Sequence
  chemically synthesized
gattaattcattttatttct

SEQ ID NO: 598405 - DNA, 20 bp, Artificial Sequence
  chemically synthesized
atggtttctttcacatatct

SEQ ID NO: 598406 - DNA, 20 bp, Artificial Sequence
  chemically synthesized
ttaaataaaaataggcattt

SEQ ID NO: 598407 - DNA, 20 bp, Artificial Sequence
  chemically synthesized
ttaaaaatgaaaagttcgat

SEQ ID NO: 598408 - DNA, 20 bp, Artificial Sequence
  chemically synthesized
atgactattatagaacacaa

SEQ ID NO: 598409 - DNA, 20 bp, Artificial Sequence
  chemically synthesized
tgatctaaacttaaagtcaa

SEQ ID NO: 598410 - DNA, 20 bp, Artificial Sequence
  chemically synthesized
atcttaaaactgttttgact

SEQ ID NO: 598411 - DNA, 20 bp, Artificial Sequence
  chemically synthesized
aacttaaagtcaaaacagtt

SEQ ID NO: 598412 - DNA, 20 bp, Artificial Sequence
  chemically synthesized
tacacagctcagaatcttaa

SEQ ID NO: 598413 - DNA, 20 bp, Artificial Sequence
  chemically synthesized
ataggcacaggtatcactca

SEQ ID NO: 598414 - DNA, 20 bp, Artificial Sequence
  chemically synthesized
aatgaaaagaatgtgataac

SEQ ID NO: 598415 - DNA, 20 bp, Artificial Sequence
  chemically synthesized
cattcttttcattacataaa

SEQ ID NO: 598416 - DNA, 20 bp, Artificial Sequence
  chemically synthesized
actgcaaaggataaaagcaa

SEQ ID NO: 598417 - DNA, 20 bp, Artificial Sequence
  chemically synthesized
caccatttgtttcaaaacag

SEQ ID NO: 598418 - DNA, 20 bp, Artificial Sequence
  chemically synthesized
aatgcaccatttgtttcaaa

SEQ ID NO: 598419 - DNA, 20 bp, Artificial Sequence
  chemically synthesized
aaacctagacataatgcacc

SEQ ID NO: 598420 - DNA, 20 bp, Artificial Sequence
  chemically synthesized
aaacaaatggtgcattatgt

SEQ ID NO: 598421 - DNA, 20 bp, Artificial Sequence
  chemically synthesized
tatgtctaggtttttaaaca

SEQ ID NO: 598422 - DNA, 20 bp, Artificial Sequence
  chemically synthesized
ttaaatcatggaggaaaaca

SEQ ID NO: 598423 - DNA, 20 bp, Artificial Sequence
  chemically synthesized
tttaaacaaaatgttttcct

SEQ ID NO: 598424 - DNA, 20 bp, Artificial Sequence
  chemically synthesized
catatagcacatttttcttc

SEQ ID NO: 598425 - DNA, 20 bp, Artificial Sequence
  chemically synthesized
agaaaaatgtgctatatgac

SEQ ID NO: 598426 - DNA, 20 bp, Artificial Sequence
  chemically synthesized
aaaaggctccatcactattt

SEQ ID NO: 598427 - DNA, 20 bp, Artificial Sequence
  chemically synthesized
aaaataagcaaatcctcaaa

SEQ ID NO: 598428 - DNA, 20 bp, Artificial Sequence
  chemically synthesized
taataaatcttactttgagg

SEQ ID NO: 598429 - DNA, 20 bp, Artificial Sequence
  chemically synthesized
atcattaataaatcttactt

SEQ ID NO: 598430 - DNA, 20 bp, Artificial Sequence
  chemically synthesized
atcctcaaagtaagatttat

SEQ ID NO: 598431 - DNA, 20 bp, Artificial Sequence
  chemically synthesized
catactttcatattatggct

SEQ ID NO: 598432 - DNA, 20 bp, Artificial Sequence
  chemically synthesized
gagccataatatgaaagtat

SEQ ID NO: 598433 - DNA, 20 bp, Artificial Sequence
  chemically synthesized
atgaaagtatgtcagtttgt

SEQ ID NO: 598434 - DNA, 20 bp, Artificial Sequence
  chemically synthesized
aaagggacattcttaaatat

SEQ ID NO: 598435 - DNA, 20 bp, Artificial Sequence
  chemically synthesized
cttaaagcctgcagtcctat

SEQ ID NO: 598436 - DNA, 20 bp, Artificial Sequence
  chemically synthesized
tgtaaatccaaaataggact

SEQ ID NO: 598437 - DNA, 20 bp, Artificial Sequence
  chemically synthesized
ccacaagtcttcagagaaag

SEQ ID NO: 598438 - DNA, 20 bp, Artificial Sequence
  chemically synthesized
ctcaactttgtttattactg

SEQ ID NO: 598439 - DNA, 20 bp, Artificial Sequence
  chemically synthesized
ttacagtaataaacaaagtt

SEQ ID NO: 598440 - DNA, 20 bp, Artificial Sequence
  chemically synthesized
ataaataaaaaatctctcaa

SEQ ID NO: 598441 - DNA, 20 bp, Artificial Sequence
  chemically synthesized
tttgtttgtgatttgcattt

SEQ ID NO: 598442 - DNA, 20 bp, Artificial Sequence
  chemically synthesized
aatatttttgcctaatttgt

SEQ ID NO: 598443 - DNA, 20 bp, Artificial Sequence
  chemically synthesized
caatacaatatttttgccta

SEQ ID NO: 598444 - DNA, 20 bp, Artificial Sequence
  chemically synthesized
aaaaatattgtattggtcca

SEQ ID NO: 598445 - DNA, 20 bp, Artificial Sequence
  chemically synthesized
tgtttttatgctttattgtt

SEQ ID NO: 598446 - DNA, 20 bp, Artificial Sequence
  chemically synthesized
gttgttttgtttttatgctt

SEQ ID NO: 598447 - DNA, 20 bp, Artificial Sequence
  chemically synthesized
tgcatcatgttgttttgttt

SEQ ID NO: 598448 - DNA, 20 bp, Artificial Sequence
  chemically synthesized
gtctcacctgcatcatgttg

SEQ ID NO: 598449 - DNA, 20 bp, Artificial Sequence
  chemically synthesized
tacccgtctcacctgcatca

SEQ ID NO: 598450 - DNA, 20 bp, Artificial Sequence
  chemically synthesized
catgatgcaggtgagacggg

SEQ ID NO: 598451 - DNA, 20 bp, Artificial Sequence
  chemically synthesized
atggttttaatctgcgttgt

SEQ ID NO: 598452 - DNA, 20 bp, Artificial Sequence
  chemically synthesized
tgtatccaaaacagtgacaa

SEQ ID NO: 598453 - DNA, 20 bp, Artificial Sequence
  chemically synthesized
ataacagcattctgacagta

SEQ ID NO: 598454 - DNA, 20 bp, Artificial Sequence
  chemically synthesized
ttctgacagtacttcgtttt

SEQ ID NO: 598455 - DNA, 20 bp, Artificial Sequence
  chemically synthesized
caatatgcttagactcatta

SEQ ID NO: 598456 - DNA, 20 bp, Artificial Sequence
  chemically synthesized
taaccaatatgcttagactc

SEQ ID NO: 598457 - DNA, 20 bp, Artificial Sequence
  chemically synthesized
tctatgcacggtcataacca

SEQ ID NO: 598458 - DNA, 20 bp, Artificial Sequence
  chemically synthesized
tagaaaaaatagcaatgaga

SEQ ID NO: 598459 - DNA, 20 bp, Artificial Sequence
  chemically synthesized
atgagagagtgtttgctctt

SEQ ID NO: 598460 - DNA, 20 bp, Artificial Sequence
  chemically synthesized
tcctattgcatcatctaaaa

SEQ ID NO: 598461 - DNA, 20 bp, Artificial Sequence
  chemically synthesized
acaggccctttttttggtta

SEQ ID NO: 598462 - DNA, 20 bp, Artificial Sequence
  chemically synthesized
aacaaagggggtaaattgtt

SEQ ID NO: 598463 - DNA, 20 bp, Artificial Sequence
  chemically synthesized
atcaatgaacaatttacccc

SEQ ID NO: 598464 - DNA, 20 bp, Artificial Sequence
  chemically synthesized
tgactattttgtgtatgtta

SEQ ID NO: 598465 - DNA, 20 bp, Artificial Sequence
  chemically synthesized
ataaataatatgggcataaa

SEQ ID NO: 598466 - DNA, 20 bp, Artificial Sequence
  chemically synthesized
tctttttcgctgacagcctg

SEQ ID NO: 598467 - DNA, 20 bp, Artificial Sequence
  chemically synthesized
gaaaaagatatgcagatgat

SEQ ID NO: 598468 - DNA, 20 bp, Artificial Sequence
  chemically synthesized
tttgccagtctttaaataca

SEQ ID NO: 598469 - DNA, 20 bp, Artificial Sequence
  chemically synthesized
ctgctcattgacctgcctca

SEQ ID NO: 598470 - DNA, 20 bp, Artificial Sequence
  chemically synthesized
tcagcttaatttgatagtaa

SEQ ID NO: 598471 - DNA, 20 bp, Artificial Sequence
  chemically synthesized
acattttccagattcagttt

SEQ ID NO: 598472 - DNA, 20 bp, Artificial Sequence
  chemically synthesized
ccattaacacattttccaga

SEQ ID NO: 598473 - DNA, 20 bp, Artificial Sequence
  chemically synthesized
tataagccattaacacattt

SEQ ID NO: 598474 - DNA, 20 bp, Artificial Sequence
  chemically synthesized
ctgaatctggaaaatgtgtt

SEQ ID NO: 598475 - DNA, 20 bp, Artificial Sequence
  chemically synthesized
aaaatgtgttaatggcttat

SEQ ID NO: 598476 - DNA, 20 bp, Artificial Sequence
  chemically synthesized
gcttatagtggtttaaagtc

SEQ ID NO: 598477 - DNA, 20 bp, Artificial Sequence
  chemically synthesized
ggacaacatttgcattttta

SEQ ID NO: 598478 - DNA, 20 bp, Artificial Sequence
  chemically synthesized
ctgtgagagaagagaaagaa

SEQ ID NO: 598479 - DNA, 20 bp, Artificial Sequence
  chemically synthesized
gattgttggtgcttatatat

SEQ ID NO: 598480 - DNA, 20 bp, Artificial Sequence
  chemically synthesized
acaaagcaggccatgattgt

SEQ ID NO: 598481 - DNA, 20 bp, Artificial Sequence
  chemically synthesized
tataagcaccaacaatcatg

SEQ ID NO: 598482 - DNA, 20 bp, Artificial Sequence
  chemically synthesized
agatggttttacaaagcagg

SEQ ID NO: 598483 - DNA, 20 bp, Artificial Sequence
  chemically synthesized
tttataggttattttttgga

SEQ ID NO: 598484 - DNA, 20 bp, Artificial Sequence
  chemically synthesized
aattatcctgttaagttgat

SEQ ID NO: 598485 - DNA, 20 bp, Artificial Sequence
  chemically synthesized
tagatatgtggttacaattg

SEQ ID NO: 598486 - DNA, 20 bp, Artificial Sequence
  chemically synthesized
ttataaaatgaagaaaatat

SEQ ID NO: 598487 - DNA, 20 bp, Artificial Sequence
  chemically synthesized
tataatgcaatctttattgt

SEQ ID NO: 598488 - DNA, 20 bp, Artificial Sequence
  chemically synthesized
accttttaaatctatgacaa

SEQ ID NO: 598489 - DNA, 20 bp, Artificial Sequence
  chemically synthesized
gtcatagatttaaaaggtat

SEQ ID NO: 598490 - DNA, 20 bp, Artificial Sequence
  chemically synthesized
agctacatgctattgtacat

SEQ ID NO: 598491 - DNA, 20 bp, Artificial Sequence
  chemically synthesized
tttgtattcaagtataatga

SEQ ID NO: 598492 - DNA, 20 bp, Artificial Sequence
  chemically synthesized
tcattacctcaaataattgc

SEQ ID NO: 598493 - DNA, 20 bp, Artificial Sequence
  chemically synthesized
tatatgtcattacctcaaat

SEQ ID NO: 598494 - DNA, 20 bp, Artificial Sequence
  chemically synthesized
atatagacgatattaagata

SEQ ID NO: 598495 - DNA, 20 bp, Artificial Sequence
  chemically synthesized
cgatattaagatatactgat

SEQ ID NO: 598496 - DNA, 20 bp, Artificial Sequence
  chemically synthesized
ggaagagttatcaaaggtta

SEQ ID NO: 598497 - DNA, 20 bp, Artificial Sequence
  chemically synthesized
tcttcccaaactcttctcat

SEQ ID NO: 598498 - DNA, 20 bp, Artificial Sequence
  chemically synthesized
taaacgaaaacttttatgag

SEQ ID NO: 598499 - DNA, 20 bp, Artificial Sequence
  chemically synthesized
caaactcttctcataaaagt

SEQ ID NO: 598500 - DNA, 20 bp, Artificial Sequence
  chemically synthesized
attttaagctattccaaaat

SEQ ID NO: 598501 - DNA, 20 bp, Artificial Sequence
  chemically synthesized
ttcccaagctgaaattttgg

SEQ ID NO: 598502 - DNA, 20 bp, Artificial Sequence
  chemically synthesized
gatttgcttgtcaacataca

SEQ ID NO: 598503 - DNA, 20 bp, Artificial Sequence
  chemically synthesized
tgaggtggagggagggttcg

SEQ ID NO: 598504 - DNA, 20 bp, Artificial Sequence
  chemically synthesized
gtgtgtgaggtggagggagg

SEQ ID NO: 598505 - DNA, 20 bp, Artificial Sequence
  chemically synthesized
agttatatttcaccctccta

SEQ ID NO: 598506 - DNA, 20 bp, Artificial Sequence
  chemically synthesized
cttgtggatctgtcaacttg

SEQ ID NO: 598507 - DNA, 20 bp, Artificial Sequence
  chemically synthesized
tgtaatatagaaataaaagt

SEQ ID NO: 598508 - DNA, 20 bp, Artificial Sequence
  chemically synthesized
cagaaaatgtggacactatc

SEQ ID NO: 598509 - DNA, 20 bp, Artificial Sequence
  chemically synthesized
taaatatgcatgtgtcataa

SEQ ID NO: 598510 - DNA, 20 bp, Artificial Sequence
  chemically synthesized
ttgtatttgcttttaaataa

SEQ ID NO: 598511 - DNA, 20 bp, Artificial Sequence
  chemically synthesized
tgtactaagtttttaattgt

SEQ ID NO: 598512 - DNA, 20 bp, Artificial Sequence
  chemically synthesized
tacaattaaaaacttagtac

SEQ ID NO: 598513 - DNA, 20 bp, Artificial Sequence
  chemically synthesized
ggctagtaaaaacagatgta

SEQ ID NO: 598514 - DNA, 20 bp, Artificial Sequence
  chemically synthesized
agtacatctgtttttactag

SEQ ID NO: 598515 - DNA, 20 bp, Artificial Sequence
  chemically synthesized
aataaaatgtattgtcattc

SEQ ID NO: 598516 - DNA, 20 bp, Artificial Sequence
  chemically synthesized
aataccaaagtatgttctgt

SEQ ID NO: 598517 - DNA, 20 bp, Artificial Sequence
  chemically synthesized
cagagactgagtagaataaa

SEQ ID NO: 598518 - DNA, 20 bp, Artificial Sequence
  chemically synthesized
aatggcaatcatacaagaaa

SEQ ID NO: 598519 - DNA, 20 bp, Artificial Sequence
  chemically synthesized
gaaacaaatctttctttctt

SEQ ID NO: 598520 - DNA, 20 bp, Artificial Sequence
  chemically synthesized
caatcatacaagaaagaaag

SEQ ID NO: 598521 - DNA, 20 bp, Artificial Sequence
  chemically synthesized
aaagatttgtttctttttca

SEQ ID NO: 598522 - DNA, 20 bp, Artificial Sequence
  chemically synthesized
tattttaaataatgtgaaaa

SEQ ID NO: 598523 - DNA, 20 bp, Artificial Sequence
  chemically synthesized
attagaattattcatataat

SEQ ID NO: 598524 - DNA, 20 bp, Artificial Sequence
  chemically synthesized
ctatcagaaaatacttgtag

SEQ ID NO: 598525 - DNA, 20 bp, Artificial Sequence
  chemically synthesized
ttcaccttgtgacattttag

SEQ ID NO: 598526 - DNA, 20 bp, Artificial Sequence
  chemically synthesized
gagttttcaccttgtgacat

SEQ ID NO: 598527 - DNA, 20 bp, Artificial Sequence
  chemically synthesized
atagaataataacaaattag

SEQ ID NO: 598528 - DNA, 20 bp, Artificial Sequence
  chemically synthesized
tttgttattattctatatcc

SEQ ID NO: 598529 - DNA, 20 bp, Artificial Sequence
  chemically synthesized
tgaattgctaatacactgta

SEQ ID NO: 598530 - DNA, 20 bp, Artificial Sequence
  chemically synthesized
cagagttgagtgagattact

SEQ ID NO: 598531 - DNA, 20 bp, Artificial Sequence
  chemically synthesized
ttaattatcttcagagttga

SEQ ID NO: 598532 - DNA, 20 bp, Artificial Sequence
  chemically synthesized
attatgtataattcacaata

SEQ ID NO: 598533 - DNA, 20 bp, Artificial Sequence
  chemically synthesized
atttgcattatttatatggt

SEQ ID NO: 598534 - DNA, 20 bp, Artificial Sequence
  chemically synthesized
catgtgcatatatataatta

SEQ ID NO: 598535 - DNA, 20 bp, Artificial Sequence
  chemically synthesized
atgggtaaatcacatcgtag

SEQ ID NO: 598536 - DNA, 20 bp, Artificial Sequence
  chemically synthesized
aaacagaaaacatatctacg

SEQ ID NO: 598537 - DNA, 20 bp, Artificial Sequence
  chemically synthesized
aatcacatcgtagatatgtt

SEQ ID NO: 598538 - DNA, 20 bp, Artificial Sequence
  chemically synthesized
ttctaaattgtagcagttag

SEQ ID NO: 598539 - DNA, 20 bp, Artificial Sequence
  chemically synthesized
gagacagaaatgatggatct

SEQ ID NO: 598540 - DNA, 20 bp, Artificial Sequence
  chemically synthesized
tggaatgatctgttggagac

SEQ ID NO: 598541 - DNA, 20 bp, Artificial Sequence
  chemically synthesized
gagaccattgatttaaggag

SEQ ID NO: 598542 - DNA, 20 bp, Artificial Sequence
  chemically synthesized
taagaagggggtcagtacct

SEQ ID NO: 598543 - DNA, 20 bp, Artificial Sequence
  chemically synthesized
aagggggtcagtacctgcta

SEQ ID NO: 598544 - DNA, 20 bp, Artificial Sequence
  chemically synthesized
ccccttgtccatgagatcag

SEQ ID NO: 598545 - DNA, 20 bp, Artificial Sequence
  chemically synthesized
cccatatgtaaattttgtga

SEQ ID NO: 598546 - DNA, 20 bp, Artificial Sequence
  chemically synthesized
tgtaaattttgtgaataggt

SEQ ID NO: 598547 - DNA, 20 bp, Artificial Sequence
  chemically synthesized
ggaagttttgttgttgttgt

SEQ ID NO: 598548 - DNA, 20 bp, Artificial Sequence
  chemically synthesized
tgagaagcaacatggatact

SEQ ID NO: 598549 - DNA, 20 bp, Artificial Sequence
  chemically synthesized
aacaaaacttccagtatcca

SEQ ID NO: 598550 - DNA, 20 bp, Artificial Sequence
  chemically synthesized
ttgatattttgatgcatagt

SEQ ID NO: 598551 - DNA, 20 bp, Artificial Sequence
  chemically synthesized
ggttttgatattttgatgca

SEQ ID NO: 598552 - DNA, 20 bp, Artificial Sequence
  chemically synthesized
tgtcttggcgcaaatgcagt

SEQ ID NO: 598553 - DNA, 20 bp, Artificial Sequence
  chemically synthesized
ggcatgagagaaaataaagc

SEQ ID NO: 598554 - DNA, 20 bp, Artificial Sequence
  chemically synthesized
cttgtgtcttctgaaaaagc

SEQ ID NO: 598555 - DNA, 20 bp, Artificial Sequence
  chemically synthesized
gtatactacttgtatggact

SEQ ID NO: 598556 - DNA, 20 bp, Artificial Sequence
  chemically synthesized
gtgctctaatgttaaccttt

SEQ ID NO: 598557 - DNA, 20 bp, Artificial Sequence
  chemically synthesized
agagcacagaaagcctgtta

SEQ ID NO: 598558 - DNA, 20 bp, Artificial Sequence
  chemically synthesized
tgttatttaaaaactaggta

SEQ ID NO: 598559 - DNA, 20 bp, Artificial Sequence
  chemically synthesized
cttattttttcactattaat

SEQ ID NO: 598560 - DNA, 20 bp, Artificial Sequence
  chemically synthesized
tttctcattctggtacttat

SEQ ID NO: 598561 - DNA, 20 bp, Artificial Sequence
  chemically synthesized
aatgagaaaaaagaagagat

SEQ ID NO: 598562 - DNA, 20 bp, Artificial Sequence
  chemically synthesized
tctggaaaattttctattat

SEQ ID NO: 598563 - DNA, 20 bp, Artificial Sequence
  chemically synthesized
tagctctggaaaattttcta

SEQ ID NO: 598564 - DNA, 20 bp, Artificial Sequence
  chemically synthesized
aattcttttttgcacttggg

SEQ ID NO: 598565 - DNA, 20 bp, Artificial Sequence
  chemically synthesized
cacctcagcctcctaaagtg

SEQ ID NO: 598566 - DNA, 20 bp, Artificial Sequence
  chemically synthesized
cactttaggaggctgaggtg

SEQ ID NO: 598567 - DNA, 20 bp, Artificial Sequence
  chemically synthesized
gaggctgaggtgagaagatt

SEQ ID NO: 598568 - DNA, 20 bp, Artificial Sequence
  chemically synthesized
gacacatcatctctacaaac

SEQ ID NO: 598569 - DNA, 20 bp, Artificial Sequence
  chemically synthesized
gactggctaatttttaaaac

SEQ ID NO: 598570 - DNA, 20 bp, Artificial Sequence
  chemically synthesized
gagttggtggctgcagtgag

SEQ ID NO: 598571 - DNA, 20 bp, Artificial Sequence
  chemically synthesized
ctatgattgcatcgcggcac

SEQ ID NO: 598572 - DNA, 20 bp, Artificial Sequence
  chemically synthesized
tattattttattttatttta

SEQ ID NO: 598573 - DNA, 20 bp, Artificial Sequence
  chemically synthesized
ttaaatgtttctaaatgtgt

SEQ ID NO: 598574 - DNA, 20 bp, Artificial Sequence
  chemically synthesized
tttcattaagatataatttt

SEQ ID NO: 598575 - DNA, 20 bp, Artificial Sequence
  chemically synthesized
gatgggacagacagcaactt

SEQ ID NO: 598576 - DNA, 20 bp, Artificial Sequence
  chemically synthesized
actattgtttccagtgtaaa

SEQ ID NO: 598577 - DNA, 20 bp, Artificial Sequence
  chemically synthesized
gactttacactggaaacaat

SEQ ID NO: 598578 - DNA, 20 bp, Artificial Sequence
  chemically synthesized
ttcaactatcttcaagctac

SEQ ID NO: 598579 - DNA, 20 bp, Artificial Sequence
  chemically synthesized
tcttccagtttccattgttt

SEQ ID NO: 598580 - DNA, 20 bp, Artificial Sequence
  chemically synthesized
aacaattgtcttccagtttc

SEQ ID NO: 598581 - DNA, 20 bp, Artificial Sequence
  chemically synthesized
taggttatgaacaattgtct

SEQ ID NO: 598582 - DNA, 20 bp, Artificial Sequence
  chemically synthesized
ctttgctttgcagtcatcat

SEQ ID NO: 598583 - DNA, 20 bp, Artificial Sequence
  chemically synthesized
ccttgcattttcgaaatgat

SEQ ID NO: 598584 - DNA, 20 bp, Artificial Sequence
  chemically synthesized
caaagatcatttcgaaaatg

SEQ ID NO: 598585 - DNA, 20 bp, Artificial Sequence
  chemically synthesized
tttcgaaaatgcaaggttta

SEQ ID NO: 598586 - DNA, 20 bp, Artificial Sequence
  chemically synthesized
gtttacaaagtttacatcct

SEQ ID NO: 598587 - DNA, 20 bp, Artificial Sequence
  chemically synthesized
atacagagggccaactgtac

SEQ ID NO: 598588 - DNA, 20 bp, Artificial Sequence
  chemically synthesized
gtatccatgggttccacatt

SEQ ID NO: 598589 - DNA, 20 bp, Artificial Sequence
  chemically synthesized
tgtaaatagttgttatgcag

SEQ ID NO: 598590 - DNA, 20 bp, Artificial Sequence
  chemically synthesized
cctgaacacttcatatcatc

SEQ ID NO: 598591 - DNA, 20 bp, Artificial Sequence
  chemically synthesized
attatttatataaaatggca

SEQ ID NO: 598592 - DNA, 20 bp, Artificial Sequence
  chemically synthesized
tccttcagtgtctgtggggc

SEQ ID NO: 598593 - DNA, 20 bp, Artificial Sequence
  chemically synthesized
actgaaggatgactgtgtaa

SEQ ID NO: 598594 - DNA, 20 bp, Artificial Sequence
  chemically synthesized
tttttgtaccgtttatttct

SEQ ID NO: 598595 - DNA, 20 bp, Artificial Sequence
  chemically synthesized
ttcctgtcactgtttttttg

SEQ ID NO: 598596 - DNA, 20 bp, Artificial Sequence
  chemically synthesized
acacaaggtgtatttcctgt

SEQ ID NO: 598597 - DNA, 20 bp, Artificial Sequence
  chemically synthesized
gtgacaggaaatacaccttg

SEQ ID NO: 598598 - DNA, 20 bp, Artificial Sequence
  chemically synthesized
taattttatttcctggctac

SEQ ID NO: 598599 - DNA, 20 bp, Artificial Sequence
  chemically synthesized
attataaattatttcttttt

SEQ ID NO: 598600 - DNA, 20 bp, Artificial Sequence
  chemically synthesized
ttctttttaaaggattttgc

SEQ ID NO: 598601 - DNA, 20 bp, Artificial Sequence
  chemically synthesized
gaacaatgccctcatcacca

SEQ ID NO: 598602 - DNA, 20 bp, Artificial Sequence
  chemically synthesized
cagaaatataggcataaaat

SEQ ID NO: 598603 - DNA, 20 bp, Artificial Sequence
  chemically synthesized
ttgtactatcattttactag

SEQ ID NO: 598604 - DNA, 20 bp, Artificial Sequence
  chemically synthesized
acaataactcttataactgt

SEQ ID NO: 598605 - DNA, 20 bp, Artificial Sequence
  chemically synthesized
aatcacatattcttaccaat

SEQ ID NO: 598606 - DNA, 20 bp, Artificial Sequence
  chemically synthesized
aagcacgtattggtaagaat

SEQ ID NO: 598607 - DNA, 20 bp, Artificial Sequence
  chemically synthesized
aggtgggcggaatgggtgaa

SEQ ID NO: 598608 - DNA, 20 bp, Artificial Sequence
  chemically synthesized
tgcatagaaagagtaagtgc

SEQ ID NO: 598609 - DNA, 20 bp, Artificial Sequence
  chemically synthesized
ttttgagagatacaatatat

SEQ ID NO: 598610 - DNA, 20 bp, Artificial Sequence
  chemically synthesized
tgctacatgcatagaatgta

SEQ ID NO: 598611 - DNA, 20 bp, Artificial Sequence
  chemically synthesized
aagttaaaaagacaaaatta

SEQ ID NO: 598612 - DNA, 20 bp, Artificial Sequence
  chemically synthesized
aaatgcacactccatctata

SEQ ID NO: 598613 - DNA, 20 bp, Artificial Sequence
  chemically synthesized
agcattgtgaccttgtattt

SEQ ID NO: 598614 - DNA, 20 bp, Artificial Sequence
  chemically synthesized
aggtcacaatgctgcgttaa

SEQ ID NO: 598615 - DNA, 20 bp, Artificial Sequence
  chemically synthesized
gtgactttcactttttaaaa

SEQ ID NO: 598616 - DNA, 20 bp, Artificial Sequence
  chemically synthesized
agcattgtgaccttgtattt

SEQ ID NO: 598617 - DNA, 20 bp, Artificial Sequence
  chemically synthesized
aggtcacaatgctgcgttaa

SEQ ID NO: 598618 - DNA, 20 bp, Artificial Sequence
  chemically synthesized
ttgactttcactttttaaaa

SEQ ID NO: 598619 - DNA, 20 bp, Artificial Sequence
  chemically synthesized
atggttctctgagacccatt

SEQ ID NO: 598620 - DNA, 20 bp, Artificial Sequence
  chemically synthesized
ctactgtgctttgggaagaa

SEQ ID NO: 598621 - DNA, 20 bp, Artificial Sequence
  chemically synthesized
ggcatagcaattaatgacta

SEQ ID NO: 598622 - DNA, 20 bp, Artificial Sequence
  chemically synthesized
accttatgtagaatgcaccc

SEQ ID NO: 598623 - DNA, 20 bp, Artificial Sequence
  chemically synthesized
atgtaaggtaccaactacag

SEQ ID NO: 598624 - DNA, 20 bp, Artificial Sequence
  chemically synthesized
atacaactcttctgtaattt

SEQ ID NO: 598625 - DNA, 20 bp, Artificial Sequence
  chemically synthesized
aaataaaaaacaagaataga

SEQ ID NO: 598626 - DNA, 20 bp, Artificial Sequence
  chemically synthesized
cggttttaaaccacctctat

SEQ ID NO: 598627 - DNA, 20 bp, Artificial Sequence
  chemically synthesized
atacggattaaatttagctt

SEQ ID NO: 598628 - DNA, 20 bp, Artificial Sequence
  chemically synthesized
tgcacaaaatacggattaaa

SEQ ID NO: 598629 - DNA, 20 bp, Artificial Sequence
  chemically synthesized
tttttccagtgtgcacaaaa

SEQ ID NO: 598630 - DNA, 20 bp, Artificial Sequence
  chemically synthesized
tgtcccaagtaaataggaga

SEQ ID NO: 598631 - DNA, 20 bp, Artificial Sequence
  chemically synthesized
tctttctttttgatgctttt

SEQ ID NO: 598632 - DNA, 20 bp, Artificial Sequence
  chemically synthesized
acttttaaaagcatcaaaaa

SEQ ID NO: 598633 - DNA, 20 bp, Artificial Sequence
  chemically synthesized
gcctatcaaatctttctttt

SEQ ID NO: 598634 - DNA, 20 bp, Artificial Sequence
  chemically synthesized
tacatttctggattattata

SEQ ID NO: 598635 - DNA, 20 bp, Artificial Sequence
  chemically synthesized
ttctattattcttctacatt

SEQ ID NO: 598636 - DNA, 20 bp, Artificial Sequence
  chemically synthesized
tagaagaataatagaataca

SEQ ID NO: 598637 - DNA, 20 bp, Artificial Sequence
  chemically synthesized
tctatatacattacctggga

SEQ ID NO: 598638 - DNA, 20 bp, Artificial Sequence
  chemically synthesized
tattttacttttttaaaaaa

SEQ ID NO: 598639 - DNA, 20 bp, Artificial Sequence
  chemically synthesized
aatttagtctttaaaaagtc

SEQ ID NO: 598640 - DNA, 20 bp, Artificial Sequence
  chemically synthesized
gactaaattgtagacttttt

SEQ ID NO: 598641 - DNA, 20 bp, Artificial Sequence
  chemically synthesized
tactcttcatttcttcattc

SEQ ID NO: 598642 - DNA, 20 bp, Artificial Sequence
  chemically synthesized
aatgaagaaatgaagagtag

SEQ ID NO: 598643 - DNA, 20 bp, Artificial Sequence
  chemically synthesized
ctttaatcaattaatacaaa

SEQ ID NO: 598644 - DNA, 20 bp, Artificial Sequence
  chemically synthesized
ccttaatctacctttgtatt

SEQ ID NO: 598645 - DNA, 20 bp, Artificial Sequence
  chemically synthesized
tagtgctagttcagagctct

SEQ ID NO: 598646 - DNA, 20 bp, Artificial Sequence
  chemically synthesized
aaagagtagatgcaaataga

SEQ ID NO: 598647 - DNA, 20 bp, Artificial Sequence
  chemically synthesized
attagtagtacatgccttcc

SEQ ID NO: 598648 - DNA, 20 bp, Artificial Sequence
  chemically synthesized
cttctgaattttgtcttagt

SEQ ID NO: 598649 - DNA, 20 bp, Artificial Sequence
  chemically synthesized
gatgatgtgaaattgtttca

SEQ ID NO: 598650 - DNA, 20 bp, Artificial Sequence
  chemically synthesized
ggttttaggtgatgatgtga

SEQ ID NO: 598651 - DNA, 20 bp, Artificial Sequence
  chemically synthesized
tatgcagtgaggggcaccaa

SEQ ID NO: 598652 - DNA, 20 bp, Artificial Sequence
  chemically synthesized
agagaattatttttaggtgc

SEQ ID NO: 598653 - DNA, 20 bp, Artificial Sequence
  chemically synthesized
tgttgcccaggctggagtgc

SEQ ID NO: 598654 - DNA, 20 bp, Artificial Sequence
  chemically synthesized
tataaattgaacctgggaag

SEQ ID NO: 598655 - DNA, 20 bp, Artificial Sequence
  chemically synthesized
ttagtgatacttatttaatt

SEQ ID NO: 598656 - DNA, 20 bp, Artificial Sequence
  chemically synthesized
atccttagctaaatgtttac

SEQ ID NO: 598657 - DNA, 20 bp, Artificial Sequence
  chemically synthesized
ggattacaatatccttagct

SEQ ID NO: 598658 - DNA, 20 bp, Artificial Sequence
  chemically synthesized
caaacaaaaagttgtatttt

SEQ ID NO: 598659 - DNA, 20 bp, Artificial Sequence
  chemically synthesized
taatccataaaaatacaact

SEQ ID NO: 598660 - DNA, 20 bp, Artificial Sequence
  chemically synthesized
tttttgtttgcatttgaaat

SEQ ID NO: 598661 - DNA, 20 bp, Artificial Sequence
  chemically synthesized
gaagtcactttgctaagctg

SEQ ID NO: 598662 - DNA, 20 bp, Artificial Sequence
  chemically synthesized
caggccaaagaggaaaactt

SEQ ID NO: 598663 - DNA, 20 bp, Artificial Sequence
  chemically synthesized
atctgacctaattccaaata

SEQ ID NO: 598664 - DNA, 20 bp, Artificial Sequence
  chemically synthesized
aaagttgtgtttttttaact

SEQ ID NO: 598665 - DNA, 20 bp, Artificial Sequence
  chemically synthesized
ttttagtcgagttcctaaag

SEQ ID NO: 598666 - DNA, 20 bp, Artificial Sequence
  chemically synthesized
gcctgctgaactcatcaaga

SEQ ID NO: 598667 - DNA, 20 bp, Artificial Sequence
  chemically synthesized
aaaaatgcctgctgaactca

SEQ ID NO: 598668 - DNA, 20 bp, Artificial Sequence
  chemically synthesized
ttacttagcaaaatatgtcc

SEQ ID NO: 598669 - DNA, 20 bp, Artificial Sequence
  chemically synthesized
tgtattcatatatgttacac

SEQ ID NO: 598670 - DNA, 20 bp, Artificial Sequence
  chemically synthesized
agttagctggtggcagtggt

SEQ ID NO: 598671 - DNA, 20 bp, Artificial Sequence
  chemically synthesized
tacataatgccatatggcat

SEQ ID NO: 598672 - DNA, 20 bp, Artificial Sequence
  chemically synthesized
aatatcttacctatgtgcaa

SEQ ID NO: 598673 - DNA, 20 bp, Artificial Sequence
  chemically synthesized
tgcctcggcctcccaaagtg

SEQ ID NO: 598674 - DNA, 20 bp, Artificial Sequence
  chemically synthesized
acagggtttcaccatgttgt

SEQ ID NO: 598675 - DNA, 20 bp, Artificial Sequence
  chemically synthesized
ttttatttttttagtacaga

SEQ ID NO: 598676 - DNA, 20 bp, Artificial Sequence
  chemically synthesized
tgcctcaacctccagagttg

SEQ ID NO: 598677 - DNA, 20 bp, Artificial Sequence
  chemically synthesized
accctctgtctcccaggttc

SEQ ID NO: 598678 - DNA, 20 bp, Artificial Sequence
  chemically synthesized
tactttttttttttttttga

SEQ ID NO: 598679 - DNA, 20 bp, Artificial Sequence
  chemically synthesized
atggataatttaattatttc

SEQ ID NO: 598680 - DNA, 20 bp, Artificial Sequence
  chemically synthesized
agagagagagaacagataat

SEQ ID NO: 598681 - DNA, 20 bp, Artificial Sequence
  chemically synthesized
agaacctatatatatggact

SEQ ID NO: 598682 - DNA, 20 bp, Artificial Sequence
  chemically synthesized
tcgaggctgcagctattatc

SEQ ID NO: 598683 - DNA, 20 bp, Artificial Sequence
  chemically synthesized
ctttttttttttgtgcccct

SEQ ID NO: 598684 - DNA, 20 bp, Artificial Sequence
  chemically synthesized
acaaaaaaaaaaagagataa

SEQ ID NO: 598685 - DNA, 20 bp, Artificial Sequence
  chemically synthesized
gagattttttaaaaattttg

SEQ ID NO: 598686 - DNA, 20 bp, Artificial Sequence
  chemically synthesized
ttttggagattttttaaaaa

SEQ ID NO: 598687 - DNA, 20 bp, Artificial Sequence
  chemically synthesized
atttttaaaaaatctccaaa

SEQ ID NO: 598688 - DNA, 20 bp, Artificial Sequence
  chemically synthesized
tgaatttccaaatccttttt

SEQ ID NO: 598689 - DNA, 20 bp, Artificial Sequence
  chemically synthesized
catttcataatgaaatataa

SEQ ID NO: 598690 - DNA, 20 bp, Artificial Sequence
  chemically synthesized
ataatgaaatataagtaagc

SEQ ID NO: 598691 - DNA, 20 bp, Artificial Sequence
  chemically synthesized
tttttaaggttcatgaaatc

SEQ ID NO: 598692 - DNA, 20 bp, Artificial Sequence
  chemically synthesized
aaaggcctctcgattcccaa

SEQ ID NO: 598693 - DNA, 20 bp, Artificial Sequence
  chemically synthesized
atggagtagaacaaaaggcc

SEQ ID NO: 598694 - DNA, 20 bp, Artificial Sequence
  chemically synthesized
gtaatctttggtaagagaaa

SEQ ID NO: 598695 - DNA, 20 bp, Artificial Sequence
  chemically synthesized
gaaaaccatttttctcttac

SEQ ID NO: 598696 - DNA, 20 bp, Artificial Sequence
  chemically synthesized
attacgctcaattctttttt

SEQ ID NO: 598697 - DNA, 20 bp, Artificial Sequence
  chemically synthesized
tttgtgaatttaatgacacc

SEQ ID NO: 598698 - DNA, 20 bp, Artificial Sequence
  chemically synthesized
gtgctctactttacaatcca

SEQ ID NO: 598699 - DNA, 20 bp, Artificial Sequence
  chemically synthesized
agctattttaggagaaacta

SEQ ID NO: 598700 - DNA, 20 bp, Artificial Sequence
  chemically synthesized
atccagatagtttctcctaa

SEQ ID NO: 598701 - DNA, 20 bp, Artificial Sequence
  chemically synthesized
gtcattgtattatcctatgg

SEQ ID NO: 598702 - DNA, 20 bp, Artificial Sequence
  chemically synthesized
ctattctgtccagaaaattt

SEQ ID NO: 598703 - DNA, 20 bp, Artificial Sequence
  chemically synthesized
tgaaaattgattgtgtcaat

SEQ ID NO: 598704 - DNA, 20 bp, Artificial Sequence
  chemically synthesized
atgatctaaaatggagtgaa

SEQ ID NO: 598705 - DNA, 20 bp, Artificial Sequence
  chemically synthesized
ctgttgtagctgcttttaca

SEQ ID NO: 598706 - DNA, 20 bp, Artificial Sequence
  chemically synthesized
aaatactttatttctgttgt

SEQ ID NO: 598707 - DNA, 20 bp, Artificial Sequence
  chemically synthesized
ccaattaaatttgtattctg

SEQ ID NO: 598708 - DNA, 20 bp, Artificial Sequence
  chemically synthesized
cttttcagaatacaaattta

SEQ ID NO: 598709 - DNA, 20 bp, Artificial Sequence
  chemically synthesized
ctaataattaacataattat

SEQ ID NO: 598710 - DNA, 20 bp, Artificial Sequence
  chemically synthesized
aaatgcgttaatgttattat

SEQ ID NO: 598711 - DNA, 20 bp, Artificial Sequence
  chemically synthesized
aataacattaacgcattttg

SEQ ID NO: 598712 - DNA, 20 bp, Artificial Sequence
  chemically synthesized
ttaagtttttgatcttgatg

SEQ ID NO: 598713 - DNA, 20 bp, Artificial Sequence
  chemically synthesized
aaggacagaaaatgtaatac

SEQ ID NO: 598714 - DNA, 20 bp, Artificial Sequence
  chemically synthesized
acttctgttttgaattaatt

SEQ ID NO: 598715 - DNA, 20 bp, Artificial Sequence
  chemically synthesized
atatcaccaaaacaaacaaa

SEQ ID NO: 598716 - DNA, 20 bp, Artificial Sequence
  chemically synthesized
ctggatttgaatctgttttt

SEQ ID NO: 598717 - DNA, 20 bp, Artificial Sequence
  chemically synthesized
tcctctggatttgaatctgt

SEQ ID NO: 598718 - DNA, 20 bp, Artificial Sequence
  chemically synthesized
ttttcatcctctggatttga

SEQ ID NO: 598719 - DNA, 20 bp, Artificial Sequence
  chemically synthesized
gtgtataaatattttcatcc

SEQ ID NO: 598720 - DNA, 20 bp, Artificial Sequence
  chemically synthesized
actcttttttgtgtattttg

SEQ ID NO: 598721 - DNA, 20 bp, Artificial Sequence
  chemically synthesized
gataactgttatggggccag

SEQ ID NO: 598722 - DNA, 20 bp, Artificial Sequence
  chemically synthesized
aggccatacatataggaggt

SEQ ID NO: 598723 - DNA, 20 bp, Artificial Sequence
  chemically synthesized
catataggaggtgatggttt

SEQ ID NO: 598724 - DNA, 20 bp, Artificial Sequence
  chemically synthesized
aagtttctatattggttgct

SEQ ID NO: 598725 - DNA, 20 bp, Artificial Sequence
  chemically synthesized
tcctgctaagtttctatatt

SEQ ID NO: 598726 - DNA, 20 bp, Artificial Sequence
  chemically synthesized
atgaaggaataccattcctg

SEQ ID NO: 598727 - DNA, 20 bp, Artificial Sequence
  chemically synthesized
taaataaatttatctaagtt

SEQ ID NO: 598728 - DNA, 20 bp, Artificial Sequence
  chemically synthesized
gaacttttgtgatgttccct

SEQ ID NO: 598729 - DNA, 20 bp, Artificial Sequence
  chemically synthesized
ctttcaaaattatgggtttc

SEQ ID NO: 598730 - DNA, 20 bp, Artificial Sequence
  chemically synthesized
ttgtcctttctttcaaaatt

SEQ ID NO: 598731 - DNA, 20 bp, Artificial Sequence
  chemically synthesized
acaattcttgcattaaaaaa

SEQ ID NO: 598732 - DNA, 20 bp, Artificial Sequence
  chemically synthesized
ttatttagcttttcataaag

SEQ ID NO: 598733 - DNA, 20 bp, Artificial Sequence
  chemically synthesized
aaaaaaagagcaatttttta

SEQ ID NO: 598734 - DNA, 20 bp, Artificial Sequence
  chemically synthesized
atgccagtctgccatggtcc

SEQ ID NO: 598735 - DNA, 20 bp, Artificial Sequence
  chemically synthesized
aacaaccaactctgaaactg

SEQ ID NO: 598736 - DNA, 20 bp, Artificial Sequence
  chemically synthesized
catcttcctgtggaaatccc

SEQ ID NO: 598737 - DNA, 20 bp, Artificial Sequence
  chemically synthesized
ttaatgaaagtatgtggaat

SEQ ID NO: 598738 - DNA, 20 bp, Artificial Sequence
  chemically synthesized
gcctattctatcttgttagt

SEQ ID NO: 598739 - DNA, 20 bp, Artificial Sequence
  chemically synthesized
ttgtctgctatcattagaat

SEQ ID NO: 598740 - DNA, 20 bp, Artificial Sequence
  chemically synthesized
aatgttacctttgcatgttt

SEQ ID NO: 598741 - DNA, 20 bp, Artificial Sequence
  chemically synthesized
aatctgcaaatgttaccttt

SEQ ID NO: 598742 - DNA, 20 bp, Artificial Sequence
  chemically synthesized
aaacatgcaaaggtaacatt

SEQ ID NO: 598743 - DNA, 20 bp, Artificial Sequence
  chemically synthesized
catgctctagaacatcagct

SEQ ID NO: 598744 - DNA, 20 bp, Artificial Sequence
  chemically synthesized
tctacctcaggtcattgcaa

SEQ ID NO: 598745 - DNA, 20 bp, Artificial Sequence
  chemically synthesized
ctgaggtagaagacatcttg

SEQ ID NO: 598746 - DNA, 20 bp, Artificial Sequence
  chemically synthesized
ttggcaagtttaaagaagag

SEQ ID NO: 598747 - DNA, 20 bp, Artificial Sequence
  chemically synthesized
aaagaagaggagggctttgt

SEQ ID NO: 598748 - DNA, 20 bp, Artificial Sequence
  chemically synthesized
tcggtcactatattttcatt

SEQ ID NO: 598749 - DNA, 20 bp, Artificial Sequence
  chemically synthesized
aatatagtgaccgatattat

SEQ ID NO: 598750 - DNA, 20 bp, Artificial Sequence
  chemically synthesized
cgatattattcatgtttcat

SEQ ID NO: 598751 - DNA, 20 bp, Artificial Sequence
  chemically synthesized
tattcatgtttcatgtgtgt

SEQ ID NO: 598752 - DNA, 20 bp, Artificial Sequence
  chemically synthesized
tactaaccagttaacacatt

SEQ ID NO: 598753 - DNA, 20 bp, Artificial Sequence
  chemically synthesized
ccataattttccataataat

SEQ ID NO: 598754 - DNA, 20 bp, Artificial Sequence
  chemically synthesized
gataatttggaggcattgtt

SEQ ID NO: 598755 - DNA, 20 bp, Artificial Sequence
  chemically synthesized
ctccaaattatctgaacatc

SEQ ID NO: 598756 - DNA, 20 bp, Artificial Sequence
  chemically synthesized
agtttgtacagatatgggca

SEQ ID NO: 598757 - DNA, 20 bp, Artificial Sequence
  chemically synthesized
taatccatggatgaaagatg

SEQ ID NO: 598758 - DNA, 20 bp, Artificial Sequence
  chemically synthesized
taatccatgcatctttcatc

SEQ ID NO: 598759 - DNA, 20 bp, Artificial Sequence
  chemically synthesized
atggattagtcaccactaaa

SEQ ID NO: 598760 - DNA, 20 bp, Artificial Sequence
  chemically synthesized
caccactaaatatagctttc

SEQ ID NO: 598761 - DNA, 20 bp, Artificial Sequence
  chemically synthesized
ttaggaattttaaaaactgc

SEQ ID NO: 598762 - DNA, 20 bp, Artificial Sequence
  chemically synthesized
caccatatgctataatcatg

SEQ ID NO: 598763 - DNA, 20 bp, Artificial Sequence
  chemically synthesized
gagaactaaatggaagtccg

SEQ ID NO: 598764 - DNA, 20 bp, Artificial Sequence
  chemically synthesized
atgggtgctaaactatactc

SEQ ID NO: 598765 - DNA, 20 bp, Artificial Sequence
  chemically synthesized
cctttatttaatcttttgag

SEQ ID NO: 598766 - DNA, 20 bp, Artificial Sequence
  chemically synthesized
aataaagggtaaaaatgata

SEQ ID NO: 598767 - DNA, 20 bp, Artificial Sequence
  chemically synthesized
gccttgatgttataacataa

SEQ ID NO: 598768 - DNA, 20 bp, Artificial Sequence
  chemically synthesized
taattaaggtttgtttaaaa

SEQ ID NO: 598769 - DNA, 20 bp, Artificial Sequence
  chemically synthesized
ttgcttttgaaataattaag

SEQ ID NO: 598770 - DNA, 20 bp, Artificial Sequence
  chemically synthesized
ccagttgcttttgaaataat

SEQ ID NO: 598771 - DNA, 20 bp, Artificial Sequence
  chemically synthesized
cctgccctcctttatgatcc

SEQ ID NO: 598772 - DNA, 20 bp, Artificial Sequence
  chemically synthesized
actttgattttcacaaaata

SEQ ID NO: 598773 - DNA, 20 bp, Artificial Sequence
  chemically synthesized
caagtgtatattgttttcca

SEQ ID NO: 598774 - DNA, 20 bp, Artificial Sequence
  chemically synthesized
ataaaatctattcaagtgta

SEQ ID NO: 598775 - DNA, 20 bp, Artificial Sequence
  chemically synthesized
tggaaaacaatatacacttg

SEQ ID NO: 598776 - DNA, 20 bp, Artificial Sequence
  chemically synthesized
tgtgaatcattctgattctt

SEQ ID NO: 598777 - DNA, 20 bp, Artificial Sequence
  chemically synthesized
aagtaatcattgaagaatca

SEQ ID NO: 598778 - DNA, 20 bp, Artificial Sequence
  chemically synthesized
cttgcaccatctgtgaatca

SEQ ID NO: 598779 - DNA, 20 bp, Artificial Sequence
  chemically synthesized
gaatgattcacagatggtgc

SEQ ID NO: 598780 - DNA, 20 bp, Artificial Sequence
  chemically synthesized
accagctggaagggagctca

SEQ ID NO: 598781 - DNA, 20 bp, Artificial Sequence
  chemically synthesized
ttccatattttcaaagcaaa

SEQ ID NO: 598782 - DNA, 20 bp, Artificial Sequence
  chemically synthesized
tgtaattttctccaatctaa

SEQ ID NO: 598783 - DNA, 20 bp, Artificial Sequence
  chemically synthesized
tttatacacagcaatttgac

SEQ ID NO: 598784 - DNA, 20 bp, Artificial Sequence
  chemically synthesized
tatcaaatatcacgtctttt

SEQ ID NO: 598785 - DNA, 20 bp, Artificial Sequence
  chemically synthesized
cacgtcttttgtatgattgc

SEQ ID NO: 598786 - DNA, 20 bp, Artificial Sequence
  chemically synthesized
atggatttgccaatggtatt

SEQ ID NO: 598787 - DNA, 20 bp, Artificial Sequence
  chemically synthesized
gcacttaggaggcactagat

SEQ ID NO: 598788 - DNA, 20 bp, Artificial Sequence
  chemically synthesized
gtgtgagtctagaaataaat

SEQ ID NO: 598789 - DNA, 20 bp, Artificial Sequence
  chemically synthesized
tcgtggtattgttttattac

SEQ ID NO: 598790 - DNA, 20 bp, Artificial Sequence
  chemically synthesized
gatgggggtagtgatcgtgg

SEQ ID NO: 598791 - DNA, 20 bp, Artificial Sequence
  chemically synthesized
gaattaacacagagttttgt

SEQ ID NO: 598792 - DNA, 20 bp, Artificial Sequence
  chemically synthesized
ttttacttattgaattaaca

SEQ ID NO: 598793 - DNA, 20 bp, Artificial Sequence
  chemically synthesized
acagggttccagcatcaaga

SEQ ID NO: 598794 - DNA, 20 bp, Artificial Sequence
  chemically synthesized
attttataggatcttaggaa

SEQ ID NO: 598795 - DNA, 20 bp, Artificial Sequence
  chemically synthesized
aaaaggtgaaaatttgtcaa

SEQ ID NO: 598796 - DNA, 20 bp, Artificial Sequence
  chemically synthesized
gaaatgattacagatatcag

SEQ ID NO: 598797 - DNA, 20 bp, Artificial Sequence
  chemically synthesized
cccttttcttagcatagtgg

SEQ ID NO: 598798 - DNA, 20 bp, Artificial Sequence
  chemically synthesized
atttgatagaactatttggg

SEQ ID NO: 598799 - DNA, 20 bp, Artificial Sequence
  chemically synthesized
ataatactaactttagtgaa

SEQ ID NO: 598800 - DNA, 20 bp, Artificial Sequence
  chemically synthesized
agtgatgaattattgatatg

SEQ ID NO: 598801 - DNA, 20 bp, Artificial Sequence
  chemically synthesized
tttctgaaaaatatattaat

SEQ ID NO: 598802 - DNA, 20 bp, Artificial Sequence
  chemically synthesized
ggaaatattgactgcaaaat

SEQ ID NO: 598803 - DNA, 20 bp, Artificial Sequence
  chemically synthesized
aaatttgacacagtatatta

SEQ ID NO: 598804 - DNA, 20 bp, Artificial Sequence
  chemically synthesized
gtatattactatgttttttc

SEQ ID NO: 598805 - DNA, 20 bp, Artificial Sequence
  chemically synthesized
tgttagatatacaattttat

SEQ ID NO: 598806 - DNA, 20 bp, Artificial Sequence
  chemically synthesized
ctattcacaattattttata

SEQ ID NO: 598807 - DNA, 20 bp, Artificial Sequence
  chemically synthesized
aaataattgtgaatagtaag

SEQ ID NO: 598808 - DNA, 20 bp, Artificial Sequence
  chemically synthesized
cttgaatattgtctcaaatg

SEQ ID NO: 598809 - DNA, 20 bp, Artificial Sequence
  chemically synthesized
taagcaaatttaccatttat

SEQ ID NO: 598810 - DNA, 20 bp, Artificial Sequence
  chemically synthesized
aaatcacgtataaatggtaa

SEQ ID NO: 598811 - DNA, 20 bp, Artificial Sequence
  chemically synthesized
aattacagtttaatattctt

SEQ ID NO: 598812 - DNA, 20 bp, Artificial Sequence
  chemically synthesized
gtataaaataagatgttaat

SEQ ID NO: 598813 - DNA, 20 bp, Artificial Sequence
  chemically synthesized
catcttattttatacatagt

SEQ ID NO: 598814 - DNA, 20 bp, Artificial Sequence
  chemically synthesized
aactatatgaacataggatt

SEQ ID NO: 598815 - DNA, 20 bp, Artificial Sequence
  chemically synthesized
aacacaaaatcctatgttca

SEQ ID NO: 598816 - DNA, 20 bp, Artificial Sequence
  chemically synthesized
tagtaagaaactatatgaac

SEQ ID NO: 598817 - DNA, 20 bp, Artificial Sequence
  chemically synthesized
ttcaattaatgttcttaaac

SEQ ID NO: 598818 - DNA, 20 bp, Artificial Sequence
  chemically synthesized
aaataatccaaatagaaaac

SEQ ID NO: 598819 - DNA, 20 bp, Artificial Sequence
  chemically synthesized
tcttaaacctcagttttcta

SEQ ID NO: 598820 - DNA, 20 bp, Artificial Sequence
  chemically synthesized
ctcagttttctatttggatt

SEQ ID NO: 598821 - DNA, 20 bp, Artificial Sequence
  chemically synthesized
tggattatttgctttaactt

SEQ ID NO: 598822 - DNA, 20 bp, Artificial Sequence
  chemically synthesized
attcaaaaattgtatacttc

SEQ ID NO: 598823 - DNA, 20 bp, Artificial Sequence
  chemically synthesized
attgtatacttctatcgatt

SEQ ID NO: 598824 - DNA, 20 bp, Artificial Sequence
  chemically synthesized
taacacgcacaagaaatttt

SEQ ID NO: 598825 - DNA, 20 bp, Artificial Sequence
  chemically synthesized
aagcaattttaagattctct

SEQ ID NO: 598826 - DNA, 20 bp, Artificial Sequence
  chemically synthesized
aagcactaagagaatcttaa

SEQ ID NO: 598827 - DNA, 20 bp, Artificial Sequence
  chemically synthesized
caataatgaataaagcaatt

SEQ ID NO: 598828 - DNA, 20 bp, Artificial Sequence
  chemically synthesized
cttaaaattgctttattcat

SEQ ID NO: 598829 - DNA, 20 bp, Artificial Sequence
  chemically synthesized
tgactaggtacacagtatat

SEQ ID NO: 598830 - DNA, 20 bp, Artificial Sequence
  chemically synthesized
atatatactgtgtacctagt

SEQ ID NO: 598831 - DNA, 20 bp, Artificial Sequence
  chemically synthesized
cacacacacacactttttat

SEQ ID NO: 598832 - DNA, 20 bp, Artificial Sequence
  chemically synthesized
tggtgtatgtgcacacatga

SEQ ID NO: 598833 - DNA, 20 bp, Artificial Sequence
  chemically synthesized
gccttaacttctttactcaa

SEQ ID NO: 598834 - DNA, 20 bp, Artificial Sequence
  chemically synthesized
ccgtttctccatgtggctct

SEQ ID NO: 598835 - DNA, 20 bp, Artificial Sequence
  chemically synthesized
gagccacatggagaaacggg

SEQ ID NO: 598836 - DNA, 20 bp, Artificial Sequence
  chemically synthesized
ctctgcctaaaataatcctc

SEQ ID NO: 598837 - DNA, 20 bp, Artificial Sequence
  chemically synthesized
acctatgttgacccctttgc

SEQ ID NO: 598838 - DNA, 20 bp, Artificial Sequence
  chemically synthesized
gatatcccttgaaattcatg

SEQ ID NO: 598839 - DNA, 20 bp, Artificial Sequence
  chemically synthesized
ccttgaaattcatgaagagt

SEQ ID NO: 598840 - DNA, 20 bp, Artificial Sequence
  chemically synthesized
aaaatagatgggaattcatt

SEQ ID NO: 598841 - DNA, 20 bp, Artificial Sequence
  chemically synthesized
gaattcattgaaggattatg

SEQ ID NO: 598842 - DNA, 20 bp, Artificial Sequence
  chemically synthesized
ggattatgatcagatttaaa

SEQ ID NO: 598843 - DNA, 20 bp, Artificial Sequence
  chemically synthesized
gataggctaaagaaagcatg

SEQ ID NO: 598844 - DNA, 20 bp, Artificial Sequence
  chemically synthesized
agagaaaaaaaaaaatctac

SEQ ID NO: 598845 - DNA, 20 bp, Artificial Sequence
  chemically synthesized
tctctgaaaatttgaaagaa

SEQ ID NO: 598846 - DNA, 20 bp, Artificial Sequence
  chemically synthesized
atttgaggggaaaagaataa

SEQ ID NO: 598847 - DNA, 20 bp, Artificial Sequence
  chemically synthesized
tgttttcatccagcctcgtg

SEQ ID NO: 598848 - DNA, 20 bp, Artificial Sequence
  chemically synthesized
tatttattctatatatgtct

SEQ ID NO: 598849 - DNA, 20 bp, Artificial Sequence
  chemically synthesized
tacctttctatgtattgttt

SEQ ID NO: 598850 - DNA, 20 bp, Artificial Sequence
  chemically synthesized
ttacctgctacctttctatg

SEQ ID NO: 598851 - DNA, 20 bp, Artificial Sequence
  chemically synthesized
gaaggtggttaagtttttca

SEQ ID NO: 598852 - DNA, 20 bp, Artificial Sequence
  chemically synthesized
aatgaaacatgagaaggtgg

SEQ ID NO: 598853 - DNA, 20 bp, Artificial Sequence
  chemically synthesized
tgaaaaacttaaccaccttc

SEQ ID NO: 598854 - DNA, 20 bp, Artificial Sequence
  chemically synthesized
ttcattgatgtccagcattt

SEQ ID NO: 598855 - DNA, 20 bp, Artificial Sequence
  chemically synthesized
tagacactttcatacacggt

SEQ ID NO: 598856 - DNA, 20 bp, Artificial Sequence
  chemically synthesized
ctttgcacatcattttcttt

SEQ ID NO: 598857 - DNA, 20 bp, Artificial Sequence
  chemically synthesized
gcaggagaaagatacaagat

SEQ ID NO: 598858 - DNA, 20 bp, Artificial Sequence
  chemically synthesized
tcttccatcttgtatctttc

SEQ ID NO: 598859 - DNA, 20 bp, Artificial Sequence
  chemically synthesized
aaaattccctttagaggacg

SEQ ID NO: 598860 - DNA, 20 bp, Artificial Sequence
  chemically synthesized
aagggaattttatgctagta

SEQ ID NO: 598861 - DNA, 20 bp, Artificial Sequence
  chemically synthesized
gatcttttcagacacacaga

SEQ ID NO: 598862 - DNA, 20 bp, Artificial Sequence
  chemically synthesized
tttcaatgttattcctgaaa

SEQ ID NO: 598863 - DNA, 20 bp, Artificial Sequence
  chemically synthesized
ttcctacgtggatgttcttt

SEQ ID NO: 598864 - DNA, 20 bp, Artificial Sequence
  chemically synthesized
aaaatattattctaccgtct

SEQ ID NO: 598865 - DNA, 20 bp, Artificial Sequence
  chemically synthesized
tagtgacacttaaaatggta

SEQ ID NO: 598866 - DNA, 20 bp, Artificial Sequence
  chemically synthesized
agcagtatttaaaattattt

SEQ ID NO: 598867 - DNA, 20 bp, Artificial Sequence
  chemically synthesized
aaaattatttctttgctttt

SEQ ID NO: 598868 - DNA, 20 bp, Artificial Sequence
  chemically synthesized
tctttgctttttttggattc

SEQ ID NO: 598869 - DNA, 20 bp, Artificial Sequence
  chemically synthesized
ttcttttttttaataatctt

SEQ ID NO: 598870 - DNA, 20 bp, Artificial Sequence
  chemically synthesized
tttttaataatcttttctgc

SEQ ID NO: 598871 - DNA, 20 bp, Artificial Sequence
  chemically synthesized
actgagcaaatctgaagcag

SEQ ID NO: 598872 - DNA, 20 bp, Artificial Sequence
  chemically synthesized
tcttttctgcttcagatttg

SEQ ID NO: 598873 - DNA, 20 bp, Artificial Sequence
  chemically synthesized
acttaatagaaattccaata

SEQ ID NO: 598874 - DNA, 20 bp, Artificial Sequence
  chemically synthesized
tcggagtattggaatttcta

SEQ ID NO: 598875 - DNA, 20 bp, Artificial Sequence
  chemically synthesized
ttatctgtagtgataatagc

SEQ ID NO: 598876 - DNA, 20 bp, Artificial Sequence
  chemically synthesized
gaggcattatctgtagtgat

SEQ ID NO: 598877 - DNA, 20 bp, Artificial Sequence
  chemically synthesized
atgcctcttctccattgtgg

SEQ ID NO: 598878 - DNA, 20 bp, Artificial Sequence
  chemically synthesized
tccttaaagtctgaattttc

SEQ ID NO: 598879 - DNA, 20 bp, Artificial Sequence
  chemically synthesized
tgaaaattcagactttaagg

SEQ ID NO: 598880 - DNA, 20 bp, Artificial Sequence
  chemically synthesized
tgagagcctaatggctagga

SEQ ID NO: 598881 - DNA, 20 bp, Artificial Sequence
  chemically synthesized
cattaggctctcaatccagg

SEQ ID NO: 598882 - DNA, 20 bp, Artificial Sequence
  chemically synthesized
tcatcttacgtgaaactgaa

SEQ ID NO: 598883 - DNA, 20 bp, Artificial Sequence
  chemically synthesized
tccaggttcagtttcacgta

SEQ ID NO: 598884 - DNA, 20 bp, Artificial Sequence
  chemically synthesized
ctgaataaaatataattttt

SEQ ID NO: 598885 - DNA, 20 bp, Artificial Sequence
  chemically synthesized
tagaggcatgttcagcgagt

SEQ ID NO: 598886 - DNA, 20 bp, Artificial Sequence
  chemically synthesized
atgcctctacttaaccatta

SEQ ID NO: 598887 - DNA, 20 bp, Artificial Sequence
  chemically synthesized
gtgtctagttgtgtagcata

SEQ ID NO: 598888 - DNA, 20 bp, Artificial Sequence
  chemically synthesized
agtggttataaatatttgta

SEQ ID NO: 598889 - DNA, 20 bp, Artificial Sequence
  chemically synthesized
tagctaacattttatgtttt

SEQ ID NO: 598890 - DNA, 20 bp, Artificial Sequence
  chemically synthesized
aaaagaaattagctaacatt

SEQ ID NO: 598891 - DNA, 20 bp, Artificial Sequence
  chemically synthesized
attttgtaattaacatatta

SEQ ID NO: 598892 - DNA, 20 bp, Artificial Sequence
  chemically synthesized
gaaatgttgcaccaggatgt

SEQ ID NO: 598893 - DNA, 20 bp, Artificial Sequence
  chemically synthesized
cttggagaatttgggaagat

SEQ ID NO: 598894 - DNA, 20 bp, Artificial Sequence
  chemically synthesized
tctttgccttgaaataacaa

SEQ ID NO: 598895 - DNA, 20 bp, Artificial Sequence
  chemically synthesized
ttgtctttgcataattgcca

SEQ ID NO: 598896 - DNA, 20 bp, Artificial Sequence
  chemically synthesized
ctaattttattctcaaaatg

SEQ ID NO: 598897 - DNA, 20 bp, Artificial Sequence
  chemically synthesized
tatgtaaaataatgtctgag

SEQ ID NO: 598898 - DNA, 20 bp, Artificial Sequence
  chemically synthesized
tacaagaaaagtaataacag

SEQ ID NO: 598899 - DNA, 20 bp, Artificial Sequence
  chemically synthesized
ttattacttttcttgtacat

SEQ ID NO: 598900 - DNA, 20 bp, Artificial Sequence
  chemically synthesized
tatcattattcttctgttgt

SEQ ID NO: 598901 - DNA, 20 bp, Artificial Sequence
  chemically synthesized
tcaccgtatcattattcttc

SEQ ID NO: 598902 - DNA, 20 bp, Artificial Sequence
  chemically synthesized
aatttgatttcagattgatg

SEQ ID NO: 598903 - DNA, 20 bp, Artificial Sequence
  chemically synthesized
gtagaaaagggaaatttgat

SEQ ID NO: 598904 - DNA, 20 bp, Artificial Sequence
  chemically synthesized
agttgcagtagaaaagggaa

SEQ ID NO: 598905 - DNA, 20 bp, Artificial Sequence
  chemically synthesized
ttatgactttctatgaaggg

SEQ ID NO: 598906 - DNA, 20 bp, Artificial Sequence
  chemically synthesized
ctagtgcgtttgatatgcta

SEQ ID NO: 598907 - DNA, 20 bp, Artificial Sequence
  chemically synthesized
ccttactctataactttcta

SEQ ID NO: 598908 - DNA, 20 bp, Artificial Sequence
  chemically synthesized
ctagaaagttatagagtaag

SEQ ID NO: 598909 - DNA, 20 bp, Artificial Sequence
  chemically synthesized
aaagttatagagtaaggaaa

SEQ ID NO: 598910 - DNA, 20 bp, Artificial Sequence
  chemically synthesized
taaggaaagtttgcttaatc

SEQ ID NO: 598911 - DNA, 20 bp, Artificial Sequence
  chemically synthesized
tttaaacaattttggtaaac

SEQ ID NO: 598912 - DNA, 20 bp, Artificial Sequence
  chemically synthesized
cttaatctactgtttaccaa

SEQ ID NO: 598913 - DNA, 20 bp, Artificial Sequence
  chemically synthesized
ataaaaaaggaaaaaagttt

SEQ ID NO: 598914 - DNA, 20 bp, Artificial Sequence
  chemically synthesized
agttattaataaaaaaggaa

SEQ ID NO: 598915 - DNA, 20 bp, Artificial Sequence
  chemically synthesized
ttttttattaataactccca

SEQ ID NO: 598916 - DNA, 20 bp, Artificial Sequence
  chemically synthesized
tgttttggaaagcagtgagt

SEQ ID NO: 598917 - DNA, 20 bp, Artificial Sequence
  chemically synthesized
gaagacgccaaacttgaact

SEQ ID NO: 598918 - DNA, 20 bp, Artificial Sequence
  chemically synthesized
aaattagcataaatgaggtt

SEQ ID NO: 598919 - DNA, 20 bp, Artificial Sequence
  chemically synthesized
acaaagagttttcacatgca

SEQ ID NO: 598920 - DNA, 20 bp, Artificial Sequence
  chemically synthesized
aatagtattatacattcaca

SEQ ID NO: 598921 - DNA, 20 bp, Artificial Sequence
  chemically synthesized
tttgtgaatgtataatacta

SEQ ID NO: 598922 - DNA, 20 bp, Artificial Sequence
  chemically synthesized
tttttccactaactttttta

SEQ ID NO: 598923 - DNA, 20 bp, Artificial Sequence
  chemically synthesized
gaaaaatattcacaatatat

SEQ ID NO: 598924 - DNA, 20 bp, Artificial Sequence
  chemically synthesized
cactgcactacagcctgggc

SEQ ID NO: 598925 - DNA, 20 bp, Artificial Sequence
  chemically synthesized
gctgactgtaacctctgtct

SEQ ID NO: 598926 - DNA, 20 bp, Artificial Sequence
  chemically synthesized
ctcagaggctgaggcatgag

SEQ ID NO: 598927 - DNA, 20 bp, Artificial Sequence
  chemically synthesized
ttctcatgcctcagcctctg

SEQ ID NO: 598928 - DNA, 20 bp, Artificial Sequence
  chemically synthesized
atgcctcagcctctgagaag

SEQ ID NO: 598929 - DNA, 20 bp, Artificial Sequence
  chemically synthesized
tgctggcagttgcttgtaat

SEQ ID NO: 598930 - DNA, 20 bp, Artificial Sequence
  chemically synthesized
aattagccaggcttgctggc

SEQ ID NO: 598931 - DNA, 20 bp, Artificial Sequence
  chemically synthesized
tgttttatatataaaattag

SEQ ID NO: 598932 - DNA, 20 bp, Artificial Sequence
  chemically synthesized
atgttatatatatgtattat

SEQ ID NO: 598933 - DNA, 20 bp, Artificial Sequence
  chemically synthesized
acatatacacgttatatata

SEQ ID NO: 598934 - DNA, 20 bp, Artificial Sequence
  chemically synthesized
tatataacatgtttgtttta

SEQ ID NO: 598935 - DNA, 20 bp, Artificial Sequence
  chemically synthesized
atatgttatgtatataacat

SEQ ID NO: 598936 - DNA, 20 bp, Artificial Sequence
  chemically synthesized
atgtatatgttatgtatata

SEQ ID NO: 598937 - DNA, 20 bp, Artificial Sequence
  chemically synthesized
tataacatgttatacatata

SEQ ID NO: 598938 - DNA, 20 bp, Artificial Sequence
  chemically synthesized
cacctcggcctcacaaagag

SEQ ID NO: 598939 - DNA, 20 bp, Artificial Sequence
  chemically synthesized
gatagaaaattaaccttgtt

SEQ ID NO: 598940 - DNA, 20 bp, Artificial Sequence
  chemically synthesized
gaaggctgatagaaaattaa

SEQ ID NO: 598941 - DNA, 20 bp, Artificial Sequence
  chemically synthesized
tacaatattgtattgcaatg

SEQ ID NO: 598942 - DNA, 20 bp, Artificial Sequence
  chemically synthesized
gtaggcatactaaggaaaga

SEQ ID NO: 598943 - DNA, 20 bp, Artificial Sequence
  chemically synthesized
taagactgctcgttcagaac

SEQ ID NO: 598944 - DNA, 20 bp, Artificial Sequence
  chemically synthesized
tatacttatgtatgcaaatt

SEQ ID NO: 598945 - DNA, 20 bp, Artificial Sequence
  chemically synthesized
aatgtagtagtttctgttat

SEQ ID NO: 598946 - DNA, 20 bp, Artificial Sequence
  chemically synthesized
ataatctggttatgtaatgt

SEQ ID NO: 598947 - DNA, 20 bp, Artificial Sequence
  chemically synthesized
agaaactactacattacata

SEQ ID NO: 598948 - DNA, 20 bp, Artificial Sequence
  chemically synthesized
tgatatggaaatgaaattgg

SEQ ID NO: 598949 - DNA, 20 bp, Artificial Sequence
  chemically synthesized
ttctgctaacatagaggcct

SEQ ID NO: 598950 - DNA, 20 bp, Artificial Sequence
  chemically synthesized
gctacatcatatagcggatc

SEQ ID NO: 598951 - DNA, 20 bp, Artificial Sequence
  chemically synthesized
tacaagattattatctctca

SEQ ID NO: 598952 - DNA, 20 bp, Artificial Sequence
  chemically synthesized
cagatgagagataataatct

SEQ ID NO: 598953 - DNA, 20 bp, Artificial Sequence
  chemically synthesized
tgttatggaagtgctaatct

SEQ ID NO: 598954 - DNA, 20 bp, Artificial Sequence
  chemically synthesized
cttccataacagatacggag

SEQ ID NO: 598955 - DNA, 20 bp, Artificial Sequence
  chemically synthesized
aaaagaatcatgaaggatgt

SEQ ID NO: 598956 - DNA, 20 bp, Artificial Sequence
  chemically synthesized
gtcagaaacctagacatcct

SEQ ID NO: 598957 - DNA, 20 bp, Artificial Sequence
  chemically synthesized
ttatttttcacttggctatt

SEQ ID NO: 598958 - DNA, 20 bp, Artificial Sequence
  chemically synthesized
aaataccaagtatatgatct

SEQ ID NO: 598959 - DNA, 20 bp, Artificial Sequence
  chemically synthesized
atttctttttcttcactgaa

SEQ ID NO: 598960 - DNA, 20 bp, Artificial Sequence
  chemically synthesized
catgtatgtatacatatttc

SEQ ID NO: 598961 - DNA, 20 bp, Artificial Sequence
  chemically synthesized
atgtaaattattaccaatta

SEQ ID NO: 598962 - DNA, 20 bp, Artificial Sequence
  chemically synthesized
cgagataatggcaacaaata

SEQ ID NO: 598963 - DNA, 20 bp, Artificial Sequence
  chemically synthesized
ttgccattatctcgaataag

SEQ ID NO: 598964 - DNA, 20 bp, Artificial Sequence
  chemically synthesized
ggatatgcaataagtcttct

SEQ ID NO: 598965 - DNA, 20 bp, Artificial Sequence
  chemically synthesized
cacagaatactaggagaatg

SEQ ID NO: 598966 - DNA, 20 bp, Artificial Sequence
  chemically synthesized
cactgcattctcctagtatt

SEQ ID NO: 598967 - DNA, 20 bp, Artificial Sequence
  chemically synthesized
ttggtggcactgaccaaatt

SEQ ID NO: 598968 - DNA, 20 bp, Artificial Sequence
  chemically synthesized
actgaccaaattttaggatt

SEQ ID NO: 598969 - DNA, 20 bp, Artificial Sequence
  chemically synthesized
taaataagaacatttattaa

SEQ ID NO: 598970 - DNA, 20 bp, Artificial Sequence
  chemically synthesized
ttacagagaaaacaatttta

SEQ ID NO: 598971 - DNA, 20 bp, Artificial Sequence
  chemically synthesized
agcgatgtaaagctgtataa

SEQ ID NO: 598972 - DNA, 20 bp, Artificial Sequence
  chemically synthesized
tacatcgctgtctccttcct

SEQ ID NO: 598973 - DNA, 20 bp, Artificial Sequence
  chemically synthesized
cattttattttacacaaata

SEQ ID NO: 598974 - DNA, 20 bp, Artificial Sequence
  chemically synthesized
aaaactaagaatttcttgtc

SEQ ID NO: 598975 - DNA, 20 bp, Artificial Sequence
  chemically synthesized
aaatctatagacaagaaatt

SEQ ID NO: 598976 - DNA, 20 bp, Artificial Sequence
  chemically synthesized
aaaatattctcagacataca

SEQ ID NO: 598977 - DNA, 20 bp, Artificial Sequence
  chemically synthesized
attttgccttaattcttgaa

SEQ ID NO: 598978 - DNA, 20 bp, Artificial Sequence
  chemically synthesized
attttcaaataccaggtaaa

SEQ ID NO: 598979 - DNA, 20 bp, Artificial Sequence
  chemically synthesized
agtaacccttaatgatacct

SEQ ID NO: 598980 - DNA, 20 bp, Artificial Sequence
  chemically synthesized
cctttttgattactgatgct

SEQ ID NO: 598981 - DNA, 20 bp, Artificial Sequence
  chemically synthesized
cattcagagctagctggtag

SEQ ID NO: 598982 - DNA, 20 bp, Artificial Sequence
  chemically synthesized
tggttgacctttattgaatt

SEQ ID NO: 598983 - DNA, 20 bp, Artificial Sequence
  chemically synthesized
aagtttcaagttgaaaaaaa

SEQ ID NO: 598984 - DNA, 20 bp, Artificial Sequence
  chemically synthesized
acttgaaacttatttcacgc

SEQ ID NO: 598985 - DNA, 20 bp, Artificial Sequence
  chemically synthesized
ccctcaaacatctgcgtgaa

SEQ ID NO: 598986 - DNA, 20 bp, Artificial Sequence
  chemically synthesized
cttatttcacgcagatgttt

SEQ ID NO: 598987 - DNA, 20 bp, Artificial Sequence
  chemically synthesized
attatattttcatttccaga

SEQ ID NO: 598988 - DNA, 20 bp, Artificial Sequence
  chemically synthesized
cagactttgttttttcaaat

SEQ ID NO: 598989 - DNA, 20 bp, Artificial Sequence
  chemically synthesized
gccattatataaagtgaaaa

SEQ ID NO: 598990 - DNA, 20 bp, Artificial Sequence
  chemically synthesized
atgttcaaaaataaaaatta

SEQ ID NO: 598991 - DNA, 20 bp, Artificial Sequence
  chemically synthesized
aaaaattacttaatatcctt

SEQ ID NO: 598992 - DNA, 20 bp, Artificial Sequence
  chemically synthesized
tcaggtatacattctccttt

SEQ ID NO: 598993 - DNA, 20 bp, Artificial Sequence
  chemically synthesized
taacgtttggcatctgataa

SEQ ID NO: 598994 - DNA, 20 bp, Artificial Sequence
  chemically synthesized
ttttccacaataatcataat

SEQ ID NO: 598995 - DNA, 20 bp, Artificial Sequence
  chemically synthesized
cataagcttacaaactaaaa

SEQ ID NO: 598996 - DNA, 20 bp, Artificial Sequence
  chemically synthesized
aataatcataattttagttt

SEQ ID NO: 598997 - DNA, 20 bp, Artificial Sequence
  chemically synthesized
tttgtaagcttatgttcctt

SEQ ID NO: 598998 - DNA, 20 bp, Artificial Sequence
  chemically synthesized
atgtgaaactgctaaggaac

SEQ ID NO: 598999 - DNA, 20 bp, Artificial Sequence
  chemically synthesized
ggtatcttcattgtataatt

SEQ ID NO: 599000 - DNA, 20 bp, Artificial Sequence
  chemically synthesized
aatgctacaatgatgtgagg

SEQ ID NO: 599001 - DNA, 20 bp, Artificial Sequence
  chemically synthesized
ctgatgactgccaagaaagg

SEQ ID NO: 599002 - DNA, 20 bp, Artificial Sequence
  chemically synthesized
catgccctttcttggcagtc

SEQ ID NO: 599003 - DNA, 20 bp, Artificial Sequence
  chemically synthesized
tcagatttgtgtgatatttc

SEQ ID NO: 599004 - DNA, 20 bp, Artificial Sequence
  chemically synthesized
ctgtgaatctagagaaaagt

SEQ ID NO: 599005 - DNA, 20 bp, Artificial Sequence
  chemically synthesized
tatataagcagatacttttc

SEQ ID NO: 599006 - DNA, 20 bp, Artificial Sequence
  chemically synthesized
aagagaattaagtacgcagc

SEQ ID NO: 599007 - DNA, 20 bp, Artificial Sequence
  chemically synthesized
tatgaaaatattttaaaaat

SEQ ID NO: 599008 - DNA, 20 bp, Artificial Sequence
  chemically synthesized
gttatgcaggctcaatgcat

SEQ ID NO: 599009 - DNA, 20 bp, Artificial Sequence
  chemically synthesized
ttgagcctgcataacgcagc

SEQ ID NO: 599010 - DNA, 20 bp, Artificial Sequence
  chemically synthesized
aatagagataaggatgtttc

SEQ ID NO: 599011 - DNA, 20 bp, Artificial Sequence
  chemically synthesized
catctgtacaatagagataa

SEQ ID NO: 599012 - DNA, 20 bp, Artificial Sequence
  chemically synthesized
tacagatgaagtaaatgaga

SEQ ID NO: 599013 - DNA, 20 bp, Artificial Sequence
  chemically synthesized
tcatacagcactcaaagtca

SEQ ID NO: 599014 - DNA, 20 bp, Artificial Sequence
  chemically synthesized
tcactgggattcatattcaa

SEQ ID NO: 599015 - DNA, 20 bp, Artificial Sequence
  chemically synthesized
ctatagaactatcccttttc

SEQ ID NO: 599016 - DNA, 20 bp, Artificial Sequence
  chemically synthesized
ccttttcctcagtttacagt

SEQ ID NO: 599017 - DNA, 20 bp, Artificial Sequence
  chemically synthesized
gcttggtcttaactgaggaa

SEQ ID NO: 599018 - DNA, 20 bp, Artificial Sequence
  chemically synthesized
tcatttctaatatatttcct

SEQ ID NO: 599019 - DNA, 20 bp, Artificial Sequence
  chemically synthesized
accaacaggaaatatattag

SEQ ID NO: 599020 - DNA, 20 bp, Artificial Sequence
  chemically synthesized
tgcctctttctttatcatct

SEQ ID NO: 599021 - DNA, 20 bp, Artificial Sequence
  chemically synthesized
caatttgcagataccctcta

SEQ ID NO: 599022 - DNA, 20 bp, Artificial Sequence
  chemically synthesized
ctgtgtggctgggcgctgcc

SEQ ID NO: 599023 - DNA, 20 bp, Artificial Sequence
  chemically synthesized
ctcaaagtctcagtcctttt

SEQ ID NO: 599024 - DNA, 20 bp, Artificial Sequence
  chemically synthesized
gcttagtatgtgagagctga

SEQ ID NO: 599025 - DNA, 20 bp, Artificial Sequence
  chemically synthesized
catactaagcattttaagag

SEQ ID NO: 599026 - DNA, 20 bp, Artificial Sequence
  chemically synthesized
aatagtaagcggtactctta

SEQ ID NO: 599027 - DNA, 20 bp, Artificial Sequence
  chemically synthesized
tgaaagatgaactttaagcc

SEQ ID NO: 599028 - DNA, 20 bp, Artificial Sequence
  chemically synthesized
tgtttttctagatataaact

SEQ ID NO: 599029 - DNA, 20 bp, Artificial Sequence
  chemically synthesized
tacttttcctaactgtccct

SEQ ID NO: 599030 - DNA, 20 bp, Artificial Sequence
  chemically synthesized
tatattctccttctctaatt

SEQ ID NO: 599031 - DNA, 20 bp, Artificial Sequence
  chemically synthesized
cccctatattctccttctct

SEQ ID NO: 599032 - DNA, 20 bp, Artificial Sequence
  chemically synthesized
ggctctgatgcagcatatgc

SEQ ID NO: 599033 - DNA, 20 bp, Artificial Sequence
  chemically synthesized
tcatttgtgatagtcacagt

SEQ ID NO: 599034 - DNA, 20 bp, Artificial Sequence
  chemically synthesized
aaaactaatttcactgtggc

SEQ ID NO: 599035 - DNA, 20 bp, Artificial Sequence
  chemically synthesized
taatcagtggccacagtgaa

SEQ ID NO: 599036 - DNA, 20 bp, Artificial Sequence
  chemically synthesized
caaatataactgcaatatta

SEQ ID NO: 599037 - DNA, 20 bp, Artificial Sequence
  chemically synthesized
attaaattgattattcttca

SEQ ID NO: 599038 - DNA, 20 bp, Artificial Sequence
  chemically synthesized
ttgattattcttcatacaga

SEQ ID NO: 599039 - DNA, 20 bp, Artificial Sequence
  chemically synthesized
atatataaaacttaagaata

SEQ ID NO: 599040 - DNA, 20 bp, Artificial Sequence
  chemically synthesized
tcctcataaacgatttattc

SEQ ID NO: 599041 - DNA, 20 bp, Artificial Sequence
  chemically synthesized
ctgggatatattttcctcat

SEQ ID NO: 599042 - DNA, 20 bp, Artificial Sequence
  chemically synthesized
aaaaatatatactggttcac

SEQ ID NO: 599043 - DNA, 20 bp, Artificial Sequence
  chemically synthesized
acataatggcattttaagta

SEQ ID NO: 599044 - DNA, 20 bp, Artificial Sequence
  chemically synthesized
cattttaagtaagtggttta

SEQ ID NO: 599045 - DNA, 20 bp, Artificial Sequence
  chemically synthesized
ttagccataaagcattagca

SEQ ID NO: 599046 - DNA, 20 bp, Artificial Sequence
  chemically synthesized
ttacaaactaatcaagttgc

SEQ ID NO: 599047 - DNA, 20 bp, Artificial Sequence
  chemically synthesized
cataaagcattagcaacttg

SEQ ID NO: 599048 - DNA, 20 bp, Artificial Sequence
  chemically synthesized
ggtcttgacacacccaatat

SEQ ID NO: 599049 - DNA, 20 bp, Artificial Sequence
  chemically synthesized
agatcattcaagggggagtc

SEQ ID NO: 599050 - DNA, 20 bp, Artificial Sequence
  chemically synthesized
caaaaagaaaattctaataa

SEQ ID NO: 599051 - DNA, 20 bp, Artificial Sequence
  chemically synthesized
ctattttattagaattttct

SEQ ID NO: 599052 - DNA, 20 bp, Artificial Sequence
  chemically synthesized
tctttttgattgccttaatc

SEQ ID NO: 599053 - DNA, 20 bp, Artificial Sequence
  chemically synthesized
ctgcagatgcaaaatgaagc

SEQ ID NO: 599054 - DNA, 20 bp, Artificial Sequence
  chemically synthesized
ttcattttgcatctgcagac

SEQ ID NO: 599055 - DNA, 20 bp, Artificial Sequence
  chemically synthesized
aagtctaattccacctggct

SEQ ID NO: 599056 - DNA, 20 bp, Artificial Sequence
  chemically synthesized
gaattagacttcacatgcaa

SEQ ID NO: 599057 - DNA, 20 bp, Artificial Sequence
  chemically synthesized
ctgctattaaactttagggt

SEQ ID NO: 599058 - DNA, 20 bp, Artificial Sequence
  chemically synthesized
ttctgttaaatctaataccc

SEQ ID NO: 599059 - DNA, 20 bp, Artificial Sequence
  chemically synthesized
ttcaagaaaattaataaata

SEQ ID NO: 599060 - DNA, 20 bp, Artificial Sequence
  chemically synthesized
atatgcaacatacttccctt

SEQ ID NO: 599061 - DNA, 20 bp, Artificial Sequence
  chemically synthesized
ttataaaattaagttatggt

SEQ ID NO: 599062 - DNA, 20 bp, Artificial Sequence
  chemically synthesized
atagggcaaaatggttgagt

SEQ ID NO: 599063 - DNA, 20 bp, Artificial Sequence
  chemically synthesized
ggcaaaatggttgagtatct

SEQ ID NO: 599064 - DNA, 20 bp, Artificial Sequence
  chemically synthesized
acctaacttaactataaaga

SEQ ID NO: 599065 - DNA, 20 bp, Artificial Sequence
  chemically synthesized
ttaactataaagacttagtt

SEQ ID NO: 599066 - DNA, 20 bp, Artificial Sequence
  chemically synthesized
tagtttccagattttgacat

SEQ ID NO: 599067 - DNA, 20 bp, Artificial Sequence
  chemically synthesized
tgtacctgtcagaaaacctc

SEQ ID NO: 599068 - DNA, 20 bp, Artificial Sequence
  chemically synthesized
ttgtagtaggtataaaccat

SEQ ID NO: 599069 - DNA, 20 bp, Artificial Sequence
  chemically synthesized
taaaaaggcgattcagaatt

SEQ ID NO: 599070 - DNA, 20 bp, Artificial Sequence
  chemically synthesized
gtatggttctctctttaaaa

SEQ ID NO: 599071 - DNA, 20 bp, Artificial Sequence
  chemically synthesized
gaaccatacactttccattc

SEQ ID NO: 599072 - DNA, 20 bp, Artificial Sequence
  chemically synthesized
aaagaagagcagtcactcct

SEQ ID NO: 599073 - DNA, 20 bp, Artificial Sequence
  chemically synthesized
taagatggttgctaattgat

SEQ ID NO: 599074 - DNA, 20 bp, Artificial Sequence
  chemically synthesized
tgcctagtaagatggttgct

SEQ ID NO: 599075 - DNA, 20 bp, Artificial Sequence
  chemically synthesized
ttaagtagttaaaccaggtg

SEQ ID NO: 599076 - DNA, 20 bp, Artificial Sequence
  chemically synthesized
ataatagcttaatcctcaca

SEQ ID NO: 599077 - DNA, 20 bp, Artificial Sequence
  chemically synthesized
atctcattgacttgaagaat

SEQ ID NO: 599078 - DNA, 20 bp, Artificial Sequence
  chemically synthesized
attcttcaagtcaatgagat

SEQ ID NO: 599079 - DNA, 20 bp, Artificial Sequence
  chemically synthesized
gctttcctgagatcatccca

SEQ ID NO: 599080 - DNA, 20 bp, Artificial Sequence
  chemically synthesized
caggaaagcaatacatattt

SEQ ID NO: 599081 - DNA, 20 bp, Artificial Sequence
  chemically synthesized
tgtctaatccaaaaaatatg

SEQ ID NO: 599082 - DNA, 20 bp, Artificial Sequence
  chemically synthesized
atgtattttcatttttgata

SEQ ID NO: 599083 - DNA, 20 bp, Artificial Sequence
  chemically synthesized
actttgggcttctgtaacac

SEQ ID NO: 599084 - DNA, 20 bp, Artificial Sequence
  chemically synthesized
agtgagtggtttccctcact

SEQ ID NO: 599085 - DNA, 20 bp, Artificial Sequence
  chemically synthesized
taatgtacattctgaaagtg

SEQ ID NO: 599086 - DNA, 20 bp, Artificial Sequence
  chemically synthesized
tcactttcagaatgtacatt

SEQ ID NO: 599087 - DNA, 20 bp, Artificial Sequence
  chemically synthesized
attagaagtttaaaactgta

SEQ ID NO: 599088 - DNA, 20 bp, Artificial Sequence
  chemically synthesized
aaagagacaaaaaatctggg

SEQ ID NO: 599089 - DNA, 20 bp, Artificial Sequence
  chemically synthesized
tagtagttgcaaacacatac

SEQ ID NO: 599090 - DNA, 20 bp, Artificial Sequence
  chemically synthesized
tgttactggcaaacccacgt

SEQ ID NO: 599091 - DNA, 20 bp, Artificial Sequence
  chemically synthesized
ggaaattgagagcaaatttg

SEQ ID NO: 599092 - DNA, 20 bp, Artificial Sequence
  chemically synthesized
atttgctctcaatttcccgc

SEQ ID NO: 599093 - DNA, 20 bp, Artificial Sequence
  chemically synthesized
gccccatcctcagacaagcc

SEQ ID NO: 599094 - DNA, 20 bp, Artificial Sequence
  chemically synthesized
atgcagtgcgtaggcaagct

SEQ ID NO: 599095 - DNA, 20 bp, Artificial Sequence
  chemically synthesized
ctaactgccctgggccctgt

SEQ ID NO: 599096 - DNA, 20 bp, Artificial Sequence
  chemically synthesized
gaaattttgagagaagtatt

SEQ ID NO: 599097 - DNA, 20 bp, Artificial Sequence
  chemically synthesized
gtccctttattgtcatcctt

SEQ ID NO: 599098 - DNA, 20 bp, Artificial Sequence
  chemically synthesized
tattatttcagttatccttt

SEQ ID NO: 599099 - DNA, 20 bp, Artificial Sequence
  chemically synthesized
tttcagttatcctttgaatg

SEQ ID NO: 599100 - DNA, 20 bp, Artificial Sequence
  chemically synthesized
ttctaaattcctctggtgtc

SEQ ID NO: 599101 - DNA, 20 bp, Artificial Sequence
  chemically synthesized
aataatgagttatcactcca

SEQ ID NO: 599102 - DNA, 20 bp, Artificial Sequence
  chemically synthesized
aagttatttatttccttttt

SEQ ID NO: 599103 - DNA, 20 bp, Artificial Sequence
  chemically synthesized
ttattattttacacttttta

SEQ ID NO: 599104 - DNA, 20 bp, Artificial Sequence
  chemically synthesized
tttatttgcatattgtctaa

SEQ ID NO: 599105 - DNA, 20 bp, Artificial Sequence
  chemically synthesized
acacatcagtgttcactctc

SEQ ID NO: 599106 - DNA, 20 bp, Artificial Sequence
  chemically synthesized
aaagtgatttaagaaatgtg

SEQ ID NO: 599107 - DNA, 20 bp, Artificial Sequence
  chemically synthesized
aaaatgttttagactatgta

SEQ ID NO: 599108 - DNA, 20 bp, Artificial Sequence
  chemically synthesized
gacgtaatgttgaatgaata

SEQ ID NO: 599109 - DNA, 20 bp, Artificial Sequence
  chemically synthesized
atgcatttccttgtattgtg

SEQ ID NO: 599110 - DNA, 20 bp, Artificial Sequence
  chemically synthesized
cttgtttctattaacgttct

SEQ ID NO: 599111 - DNA, 20 bp, Artificial Sequence
  chemically synthesized
catatttaaaatgttgatgt

SEQ ID NO: 599112 - DNA, 20 bp, Artificial Sequence
  chemically synthesized
gtcaataccagattttatta

SEQ ID NO: 599113 - DNA, 20 bp, Artificial Sequence
  chemically synthesized
tgttgttttagaatgtcaat

SEQ ID NO: 599114 - DNA, 20 bp, Artificial Sequence
  chemically synthesized
tgaaaggaaaataaaggtaa

SEQ ID NO: 599115 - DNA, 20 bp, Artificial Sequence
  chemically synthesized
ggcaggctgatgatctcctg

SEQ ID NO: 599116 - DNA, 20 bp, Artificial Sequence
  chemically synthesized
taataatgtctgcaccatga

SEQ ID NO: 599117 - DNA, 20 bp, Artificial Sequence
  chemically synthesized
tttgtatattttgcatttaa

SEQ ID NO: 599118 - DNA, 20 bp, Artificial Sequence
  chemically synthesized
taagtgtgttattcaggttt

SEQ ID NO: 599119 - DNA, 20 bp, Artificial Sequence
  chemically synthesized
aaatactttaagtgtgttat

SEQ ID NO: 599120 - DNA, 20 bp, Artificial Sequence
  chemically synthesized
ttttctcttagcatgttcaa

SEQ ID NO: 599121 - DNA, 20 bp, Artificial Sequence
  chemically synthesized
gaatgtgacaaaatttttaa

SEQ ID NO: 599122 - DNA, 20 bp, Artificial Sequence
  chemically synthesized
tcttaatgagctaactgttg

SEQ ID NO: 599123 - DNA, 20 bp, Artificial Sequence
  chemically synthesized
ctgttgtgtagtttatgtgc

SEQ ID NO: 599124 - DNA, 20 bp, Artificial Sequence
  chemically synthesized
gatacaaactcacaaaccta

SEQ ID NO: 599125 - DNA, 20 bp, Artificial Sequence
  chemically synthesized
gatacaaactcactaggttt

SEQ ID NO: 599126 - DNA, 20 bp, Artificial Sequence
  chemically synthesized
ttaagtcagatacaaactca

SEQ ID NO: 599127 - DNA, 20 bp, Artificial Sequence
  chemically synthesized
atgtatattggttgagtaca

SEQ ID NO: 599128 - DNA, 20 bp, Artificial Sequence
  chemically synthesized
tgtactcaaccaatatacat

SEQ ID NO: 599129 - DNA, 20 bp, Artificial Sequence
  chemically synthesized
gtttttagaaatgcctacat

SEQ ID NO: 599130 - DNA, 20 bp, Artificial Sequence
  chemically synthesized
tttcataggccattaatatt

SEQ ID NO: 599131 - DNA, 20 bp, Artificial Sequence
  chemically synthesized
acagtttataagacaactaa

SEQ ID NO: 599132 - DNA, 20 bp, Artificial Sequence
  chemically synthesized
cttctacacatacagcttgg

SEQ ID NO: 599133 - DNA, 20 bp, Artificial Sequence
  chemically synthesized
agtggtgacacttctacaca

SEQ ID NO: 599134 - DNA, 20 bp, Artificial Sequence
  chemically synthesized
aataaaaaattatgtgagat

SEQ ID NO: 599135 - DNA, 20 bp, Artificial Sequence
  chemically synthesized
gagataaatgcttctccttc

SEQ ID NO: 599136 - DNA, 20 bp, Artificial Sequence
  chemically synthesized
ttaattgttttgcatttaga

SEQ ID NO: 599137 - DNA, 20 bp, Artificial Sequence
  chemically synthesized
ttttcttttttcaaatagtt

SEQ ID NO: 599138 - DNA, 20 bp, Artificial Sequence
  chemically synthesized
gaaaaaagaaaacagcaagt

SEQ ID NO: 599139 - DNA, 20 bp, Artificial Sequence
  chemically synthesized
ttgatttgaaagcatgcact

SEQ ID NO: 599140 - DNA, 20 bp, Artificial Sequence
  chemically synthesized
ttattaaattagtcttatca

SEQ ID NO: 599141 - DNA, 20 bp, Artificial Sequence
  chemically synthesized
gatgactgatttcctcccat

SEQ ID NO: 599142 - DNA, 20 bp, Artificial Sequence
  chemically synthesized
gtgcttgtaaagagcatgat

SEQ ID NO: 599143 - DNA, 20 bp, Artificial Sequence
  chemically synthesized
ttaatcacagaagatattga

SEQ ID NO: 599144 - DNA, 20 bp, Artificial Sequence
  chemically synthesized
acaagcacactcaatatctt

SEQ ID NO: 599145 - DNA, 20 bp, Artificial Sequence
  chemically synthesized
atgggaacataagctctgca

SEQ ID NO: 599146 - DNA, 20 bp, Artificial Sequence
  chemically synthesized
gtagaaatgaaagctgcatg

SEQ ID NO: 599147 - DNA, 20 bp, Artificial Sequence
  chemically synthesized
tttctacagaaagtagcaat

SEQ ID NO: 599148 - DNA, 20 bp, Artificial Sequence
  chemically synthesized
tagcaattagggttttattc

SEQ ID NO: 599149 - DNA, 20 bp, Artificial Sequence
  chemically synthesized
accagaattggaactatttg

SEQ ID NO: 599150 - DNA, 20 bp, Artificial Sequence
  chemically synthesized
aaagttattgaatatgttgg

SEQ ID NO: 599151 - DNA, 20 bp, Artificial Sequence
  chemically synthesized
tattgaatatgttggtatag

SEQ ID NO: 599152 - DNA, 20 bp, Artificial Sequence
  chemically synthesized
attggtttggcgagtagtgt

SEQ ID NO: 599153 - DNA, 20 bp, Artificial Sequence
  chemically synthesized
ttggcgagtagtgttgacga

SEQ ID NO: 599154 - DNA, 20 bp, Artificial Sequence
  chemically synthesized
ttcttgcaaatacaggctat

SEQ ID NO: 599155 - DNA, 20 bp, Artificial Sequence
  chemically synthesized
gaatgaactacatttcatta

SEQ ID NO: 599156 - DNA, 20 bp, Artificial Sequence
  chemically synthesized
gaactacatttcattatcta

SEQ ID NO: 599157 - DNA, 20 bp, Artificial Sequence
  chemically synthesized
aatttaaaccttgctgtact

SEQ ID NO: 599158 - DNA, 20 bp, Artificial Sequence
  chemically synthesized
acataaaacataaagtacag

SEQ ID NO: 599159 - DNA, 20 bp, Artificial Sequence
  chemically synthesized
gcgttcgatctgactcctca

SEQ ID NO: 599160 - DNA, 20 bp, Artificial Sequence
  chemically synthesized
ttctgaggagtcagatcgaa

SEQ ID NO: 599161 - DNA, 20 bp, Artificial Sequence
  chemically synthesized
ctcacatctttgccaggaga

SEQ ID NO: 599162 - DNA, 20 bp, Artificial Sequence
  chemically synthesized
gcttaggaaatgaaagatgt

SEQ ID NO: 599163 - DNA, 20 bp, Artificial Sequence
  chemically synthesized
ctttgtgcttaggaaatgaa

SEQ ID NO: 599164 - DNA, 20 bp, Artificial Sequence
  chemically synthesized
tttacatattatacatcact

SEQ ID NO: 599165 - DNA, 20 bp, Artificial Sequence
  chemically synthesized
taaaatatttagagatgtca

SEQ ID NO: 599166 - DNA, 20 bp, Artificial Sequence
  chemically synthesized
gtgtgtgtcctactgaatag

SEQ ID NO: 599167 - DNA, 20 bp, Artificial Sequence
  chemically synthesized
cgaccagtgtagatacttct

SEQ ID NO: 599168 - DNA, 20 bp, Artificial Sequence
  chemically synthesized
tcacacccttccaactgtga

SEQ ID NO: 599169 - DNA, 20 bp, Artificial Sequence
  chemically synthesized
agggtgtgagttacatagcg

SEQ ID NO: 599170 - DNA, 20 bp, Artificial Sequence
  chemically synthesized
gattttctagacacattatg

SEQ ID NO: 599171 - DNA, 20 bp, Artificial Sequence
  chemically synthesized
tccctcgaggaagaggcctt

SEQ ID NO: 599172 - DNA, 20 bp, Artificial Sequence
  chemically synthesized
ctggccaattagactttcct

SEQ ID NO: 599173 - DNA, 20 bp, Artificial Sequence
  chemically synthesized
ttgtgtaattacattctcag

SEQ ID NO: 599174 - DNA, 20 bp, Artificial Sequence
  chemically synthesized
atttggttgactataggggg

SEQ ID NO: 599175 - DNA, 20 bp, Artificial Sequence
  chemically synthesized
ccacctagcaggtagatgga

SEQ ID NO: 599176 - DNA, 20 bp, Artificial Sequence
  chemically synthesized
cataactacatagctcaaaa

SEQ ID NO: 599177 - DNA, 20 bp, Artificial Sequence
  chemically synthesized
ttttctaatacttttaattg

SEQ ID NO: 599178 - DNA, 20 bp, Artificial Sequence
  chemically synthesized
taatcactatttgcatgcat

SEQ ID NO: 599179 - DNA, 20 bp, Artificial Sequence
  chemically synthesized
aaatcagccatgcatgcaaa

SEQ ID NO: 599180 - DNA, 20 bp, Artificial Sequence
  chemically synthesized
ttgcaaagcatatacaaaaa

SEQ ID NO: 599181 - DNA, 20 bp, Artificial Sequence
  chemically synthesized
ttgtgaaactttttttttgt

SEQ ID NO: 599182 - DNA, 20 bp, Artificial Sequence
  chemically synthesized
ttcttgagactagacatgtg

SEQ ID NO: 599183 - DNA, 20 bp, Artificial Sequence
  chemically synthesized
tagatattattatagaaaaa

SEQ ID NO: 599184 - DNA, 20 bp, Artificial Sequence
  chemically synthesized
tcaagtccccaggtgactca

SEQ ID NO: 599185 - DNA, 20 bp, Artificial Sequence
  chemically synthesized
ggacttgaagccatacacta

SEQ ID NO: 599186 - DNA, 20 bp, Artificial Sequence
  chemically synthesized
tcatattaagcagtgtagtg

SEQ ID NO: 599187 - DNA, 20 bp, Artificial Sequence
  chemically synthesized
gcagttcttattcaagggca

SEQ ID NO: 599188 - DNA, 20 bp, Artificial Sequence
  chemically synthesized
aagggcactaagattatttt

SEQ ID NO: 599189 - DNA, 20 bp, Artificial Sequence
  chemically synthesized
tgactttcttaaaggcataa

SEQ ID NO: 599190 - DNA, 20 bp, Artificial Sequence
  chemically synthesized
taaaaataaataaaagaatc

SEQ ID NO: 599191 - DNA, 20 bp, Artificial Sequence
  chemically synthesized
ctgatacttgtttaataagc

SEQ ID NO: 599192 - DNA, 20 bp, Artificial Sequence
  chemically synthesized
caattttttggtaacctgat

SEQ ID NO: 599193 - DNA, 20 bp, Artificial Sequence
  chemically synthesized
tgctttctttacttaattga

SEQ ID NO: 599194 - DNA, 20 bp, Artificial Sequence
  chemically synthesized
tattcctgctttctttactt

SEQ ID NO: 599195 - DNA, 20 bp, Artificial Sequence
  chemically synthesized
gatctacatgtatccattat

SEQ ID NO: 599196 - DNA, 20 bp, Artificial Sequence
  chemically synthesized
tcggttattctggcagttag

SEQ ID NO: 599197 - DNA, 20 bp, Artificial Sequence
  chemically synthesized
cttatacatttaattttcta

SEQ ID NO: 599198 - DNA, 20 bp, Artificial Sequence
  chemically synthesized
acgatgtgttgcttaaaagt

SEQ ID NO: 599199 - DNA, 20 bp, Artificial Sequence
  chemically synthesized
gtatttgattttgaacgatg

SEQ ID NO: 599200 - DNA, 20 bp, Artificial Sequence
  chemically synthesized
atttaacatttttgagtggt

SEQ ID NO: 599201 - DNA, 20 bp, Artificial Sequence
  chemically synthesized
tcactttttctgttcaatgt

SEQ ID NO: 599202 - DNA, 20 bp, Artificial Sequence
  chemically synthesized
atacacattgaacagaaaaa

SEQ ID NO: 599203 - DNA, 20 bp, Artificial Sequence
  chemically synthesized
tttctgatgactaagtctga

SEQ ID NO: 599204 - DNA, 20 bp, Artificial Sequence
  chemically synthesized
atataatgtgcattaataaa

SEQ ID NO: 599205 - DNA, 20 bp, Artificial Sequence
  chemically synthesized
aaattataatataccttgcc

SEQ ID NO: 599206 - DNA, 20 bp, Artificial Sequence
  chemically synthesized
gctctaataccttgagagca

SEQ ID NO: 599207 - DNA, 20 bp, Artificial Sequence
  chemically synthesized
tatgttttgtctgtaacagc

SEQ ID NO: 599208 - DNA, 20 bp, Artificial Sequence
  chemically synthesized
gctgttttatctttatttcc

SEQ ID NO: 599209 - DNA, 20 bp, Artificial Sequence
  chemically synthesized
ttcctctcgctttctctcat

SEQ ID NO: 599210 - DNA, 20 bp, Artificial Sequence
  chemically synthesized
accaaaatgaagactgtact

SEQ ID NO: 599211 - DNA, 20 bp, Artificial Sequence
  chemically synthesized
acaacaagtacagtcttcat

SEQ ID NO: 599212 - DNA, 20 bp, Artificial Sequence
  chemically synthesized
tattatctctgttaacaatg

SEQ ID NO: 599213 - DNA, 20 bp, Artificial Sequence
  chemically synthesized
gttttaaattggatttttgt

SEQ ID NO: 599214 - DNA, 20 bp, Artificial Sequence
  chemically synthesized
gcattccatgaaagttttaa

SEQ ID NO: 599215 - DNA, 20 bp, Artificial Sequence
  chemically synthesized
atcttataatagcattccat

SEQ ID NO: 599216 - DNA, 20 bp, Artificial Sequence
  chemically synthesized
tttcttttacatttggtact

SEQ ID NO: 599217 - DNA, 20 bp, Artificial Sequence
  chemically synthesized
ttggtacttgaggtttcaaa

SEQ ID NO: 599218 - DNA, 20 bp, Artificial Sequence
  chemically synthesized
aattactgtgaaagtattct

SEQ ID NO: 599219 - DNA, 20 bp, Artificial Sequence
  chemically synthesized
ataactttagctcatttctc

SEQ ID NO: 599220 - DNA, 20 bp, Artificial Sequence
  chemically synthesized
tgtagttgtgtgttaatatt

SEQ ID NO: 599221 - DNA, 20 bp, Artificial Sequence
  chemically synthesized
cacacaactacatgaaaata

SEQ ID NO: 599222 - DNA, 20 bp, Artificial Sequence
  chemically synthesized
actaattcctatctaataac

SEQ ID NO: 599223 - DNA, 20 bp, Artificial Sequence
  chemically synthesized
ctcctattaatattgagcat

SEQ ID NO: 599224 - DNA, 20 bp, Artificial Sequence
  chemically synthesized
ttatttgatggtaacttagc

SEQ ID NO: 599225 - DNA, 20 bp, Artificial Sequence
  chemically synthesized
tactaaaatatggactggaa

SEQ ID NO: 599226 - DNA, 20 bp, Artificial Sequence
  chemically synthesized
aggaacaaaatacccattga

SEQ ID NO: 599227 - DNA, 20 bp, Artificial Sequence
  chemically synthesized
attttctttacttagaaata

SEQ ID NO: 599228 - DNA, 20 bp, Artificial Sequence
  chemically synthesized
atatagtcgcatatatgacc

SEQ ID NO: 599229 - DNA, 20 bp, Artificial Sequence
  chemically synthesized
tgaccatgtgatttttcacc

SEQ ID NO: 599230 - DNA, 20 bp, Artificial Sequence
  chemically synthesized
caatgtgagactacttgata

SEQ ID NO: 599231 - DNA, 20 bp, Artificial Sequence
  chemically synthesized
tgtgacttttgaaatttatt

SEQ ID NO: 599232 - DNA, 20 bp, Artificial Sequence
  chemically synthesized
gcgtgttgaagtttatgcat

SEQ ID NO: 599233 - DNA, 20 bp, Artificial Sequence
  chemically synthesized
atcagtcctcagttgcgtgt

SEQ ID NO: 599234 - DNA, 20 bp, Artificial Sequence
  chemically synthesized
aacttcaacacgcaactgag

SEQ ID NO: 599235 - DNA, 20 bp, Artificial Sequence
  chemically synthesized
gattcattttgtatggggga

SEQ ID NO: 599236 - DNA, 20 bp, Artificial Sequence
  chemically synthesized
tatattatgccgtatgtttc

SEQ ID NO: 599237 - DNA, 20 bp, Artificial Sequence
  chemically synthesized
taatgtgtctatattatgcc

SEQ ID NO: 599238 - DNA, 20 bp, Artificial Sequence
  chemically synthesized
aagtgggttttttaattttt

SEQ ID NO: 599239 - DNA, 20 bp, Artificial Sequence
  chemically synthesized
ggtatagggaaagaagtgaa

SEQ ID NO: 599240 - DNA, 20 bp, Artificial Sequence
  chemically synthesized
ggcaccaagatgaaaaaaag

SEQ ID NO: 599241 - DNA, 20 bp, Artificial Sequence
  chemically synthesized
tttttttcatcttggtgccc

SEQ ID NO: 599242 - DNA, 20 bp, Artificial Sequence
  chemically synthesized
gtttcttctttgacctgaag

SEQ ID NO: 599243 - DNA, 20 bp, Artificial Sequence
  chemically synthesized
tcagcttgtggaaagacgga

SEQ ID NO: 599244 - DNA, 20 bp, Artificial Sequence
  chemically synthesized
gggtttggtggccttgccaa

SEQ ID NO: 599245 - DNA, 20 bp, Artificial Sequence
  chemically synthesized
caatcaatactccccatgta

SEQ ID NO: 599246 - DNA, 20 bp, Artificial Sequence
  chemically synthesized
caaaccccatacatggggag

SEQ ID NO: 599247 - DNA, 20 bp, Artificial Sequence
  chemically synthesized
gcagctccaggaagtgggaa

SEQ ID NO: 599248 - DNA, 20 bp, Artificial Sequence
  chemically synthesized
attggtgggaatagttctcc

SEQ ID NO: 599249 - DNA, 20 bp, Artificial Sequence
  chemically synthesized
agtgctagagccttctcaga

SEQ ID NO: 599250 - DNA, 20 bp, Artificial Sequence
  chemically synthesized
aagtatctactacatttctc

SEQ ID NO: 599251 - DNA, 20 bp, Artificial Sequence
  chemically synthesized
agtagatactttgaaattag

SEQ ID NO: 599252 - DNA, 20 bp, Artificial Sequence
  chemically synthesized
ctaaaatgtgtataaattca

SEQ ID NO: 599253 - DNA, 20 bp, Artificial Sequence
  chemically synthesized
acaaagttgttttaccaaat

SEQ ID NO: 599254 - DNA, 20 bp, Artificial Sequence
  chemically synthesized
tttattacaatttcccacaa

SEQ ID NO: 599255 - DNA, 20 bp, Artificial Sequence
  chemically synthesized
tgactgacattttgtatcag

SEQ ID NO: 599256 - DNA, 20 bp, Artificial Sequence
  chemically synthesized
gttgagtattttattaaatt

SEQ ID NO: 599257 - DNA, 20 bp, Artificial Sequence
  chemically synthesized
tattaaatttttagtttatt

SEQ ID NO: 599258 - DNA, 20 bp, Artificial Sequence
  chemically synthesized
tatggtaatataggagcact

SEQ ID NO: 599259 - DNA, 20 bp, Artificial Sequence
  chemically synthesized
cagagcacatattacacatt

SEQ ID NO: 599260 - DNA, 20 bp, Artificial Sequence
  chemically synthesized
ctttattgaagtcttcctct

SEQ ID NO: 599261 - DNA, 20 bp, Artificial Sequence
  chemically synthesized
gtttaactcagatatacaaa

SEQ ID NO: 599262 - DNA, 20 bp, Artificial Sequence
  chemically synthesized
cattcctttgaaggaattgg

SEQ ID NO: 599263 - DNA, 20 bp, Artificial Sequence
  chemically synthesized
atgtttctaataaaaagtaa

SEQ ID NO: 599264 - DNA, 20 bp, Artificial Sequence
  chemically synthesized
ataaatgtatttcttttggt

SEQ ID NO: 599265 - DNA, 20 bp, Artificial Sequence
  chemically synthesized
ggttgaataaatgtatttct

SEQ ID NO: 599266 - DNA, 20 bp, Artificial Sequence
  chemically synthesized
atggaaacataatgcatgtg

SEQ ID NO: 599267 - DNA, 20 bp, Artificial Sequence
  chemically synthesized
tgctaaactaatcacatgca

SEQ ID NO: 599268 - DNA, 20 bp, Artificial Sequence
  chemically synthesized
ataatatggaaacataatgc

SEQ ID NO: 599269 - DNA, 20 bp, Artificial Sequence
  chemically synthesized
acatgcattatgtttccata

SEQ ID NO: 599270 - DNA, 20 bp, Artificial Sequence
  chemically synthesized
tttccatattatgttttatg

SEQ ID NO: 599271 - DNA, 20 bp, Artificial Sequence
  chemically synthesized
tgttcagctctggtgatgtg

SEQ ID NO: 599272 - DNA, 20 bp, Artificial Sequence
  chemically synthesized
aacatctgagcagattgcca

SEQ ID NO: 599273 - DNA, 20 bp, Artificial Sequence
  chemically synthesized
aactacatggcaatctgctc

SEQ ID NO: 599274 - DNA, 20 bp, Artificial Sequence
  chemically synthesized
aatgtcatttaaaacatctg

SEQ ID NO: 599275 - DNA, 20 bp, Artificial Sequence
  chemically synthesized
tgctcttctaagacaatgcc

SEQ ID NO: 599276 - DNA, 20 bp, Artificial Sequence
  chemically synthesized
tgccattagcttgccttagg

SEQ ID NO: 599277 - DNA, 20 bp, Artificial Sequence
  chemically synthesized
atgtgaaatatattaggttc

SEQ ID NO: 599278 - DNA, 20 bp, Artificial Sequence
  chemically synthesized
atatatttcacataaagaat

SEQ ID NO: 599279 - DNA, 20 bp, Artificial Sequence
  chemically synthesized
atgtttacaaggttgaaaag

SEQ ID NO: 599280 - DNA, 20 bp, Artificial Sequence
  chemically synthesized
tgcttttcaaccttgtaaac

SEQ ID NO: 599281 - DNA, 20 bp, Artificial Sequence
  chemically synthesized
cagttcaaaagtaaagaaac

SEQ ID NO: 599282 - DNA, 20 bp, Artificial Sequence
  chemically synthesized
tttagaaagtcaagagattt

SEQ ID NO: 599283 - DNA, 20 bp, Artificial Sequence
  chemically synthesized
agggttttgtttagaaagtc

SEQ ID NO: 599284 - DNA, 20 bp, Artificial Sequence
  chemically synthesized
ttatcactccttttcaaggg

SEQ ID NO: 599285 - DNA, 20 bp, Artificial Sequence
  chemically synthesized
ttcacttatcactccttttc

SEQ ID NO: 599286 - DNA, 20 bp, Artificial Sequence
  chemically synthesized
gcccacttttttgaatatat

SEQ ID NO: 599287 - DNA, 20 bp, Artificial Sequence
  chemically synthesized
tatatattcaaaaaagtggg

SEQ ID NO: 599288 - DNA, 20 bp, Artificial Sequence
  chemically synthesized
aaagtgggcaaggtttagtt

SEQ ID NO: 599289 - DNA, 20 bp, Artificial Sequence
  chemically synthesized
taatggaaagaaatacagca

SEQ ID NO: 599290 - DNA, 20 bp, Artificial Sequence
  chemically synthesized
atcccatataaaatatgttc

SEQ ID NO: 599291 - DNA, 20 bp, Artificial Sequence
  chemically synthesized
cagatttctgtatgtcatct

SEQ ID NO: 599292 - DNA, 20 bp, Artificial Sequence
  chemically synthesized
cccatagatgacatacagaa

SEQ ID NO: 599293 - DNA, 20 bp, Artificial Sequence
  chemically synthesized
tgttttagctctgaaagaaa

SEQ ID NO: 599294 - DNA, 20 bp, Artificial Sequence
  chemically synthesized
gaattggttttacaaaagta

SEQ ID NO: 599295 - DNA, 20 bp, Artificial Sequence
  chemically synthesized
gacacgggggtcattcctga

SEQ ID NO: 599296 - DNA, 20 bp, Artificial Sequence
  chemically synthesized
gacccccgtgtcttttgcca

SEQ ID NO: 599297 - DNA, 20 bp, Artificial Sequence
  chemically synthesized
tgccaagacgattacattca

SEQ ID NO: 599298 - DNA, 20 bp, Artificial Sequence
  chemically synthesized
cagattattacctttagata

SEQ ID NO: 599299 - DNA, 20 bp, Artificial Sequence
  chemically synthesized
ttattcacttcttcaatagt

SEQ ID NO: 599300 - DNA, 20 bp, Artificial Sequence
  chemically synthesized
atcatgtcatcatgaataga

SEQ ID NO: 599301 - DNA, 20 bp, Artificial Sequence
  chemically synthesized
atcaaattctattcatgatg

SEQ ID NO: 599302 - DNA, 20 bp, Artificial Sequence
  chemically synthesized
aggtacttctacacacccct

SEQ ID NO: 599303 - DNA, 20 bp, Artificial Sequence
  chemically synthesized
tttaagtgacctattacagt

SEQ ID NO: 599304 - DNA, 20 bp, Artificial Sequence
  chemically synthesized
tttcaaatggcaaatgatca

SEQ ID NO: 599305 - DNA, 20 bp, Artificial Sequence
  chemically synthesized
tcataagttatttgaaccag

SEQ ID NO: 599306 - DNA, 20 bp, Artificial Sequence
  chemically synthesized
atagattggtagtggtacaa

SEQ ID NO: 599307 - DNA, 20 bp, Artificial Sequence
  chemically synthesized
ggtagtggtacaaacatgct

SEQ ID NO: 599308 - DNA, 20 bp, Artificial Sequence
  chemically synthesized
tacagacattgaaactttaa

SEQ ID NO: 599309 - DNA, 20 bp, Artificial Sequence
  chemically synthesized
tacggtacaataaaatcata

SEQ ID NO: 599310 - DNA, 20 bp, Artificial Sequence
  chemically synthesized
tttaccgtcatctaaacagt

SEQ ID NO: 599311 - DNA, 20 bp, Artificial Sequence
  chemically synthesized
tttagatgacggtaaaagta

SEQ ID NO: 599312 - DNA, 20 bp, Artificial Sequence
  chemically synthesized
ccaaattgataattgtatag

SEQ ID NO: 599313 - DNA, 20 bp, Artificial Sequence
  chemically synthesized
aatgaaagcaactatgttct

SEQ ID NO: 599314 - DNA, 20 bp, Artificial Sequence
  chemically synthesized
cacaaaatcacatagaacat

SEQ ID NO: 599315 - DNA, 20 bp, Artificial Sequence
  chemically synthesized
agaacataggtctatttaca

SEQ ID NO: 599316 - DNA, 20 bp, Artificial Sequence
  chemically synthesized
gtctatttacagtcagattt

SEQ ID NO: 599317 - DNA, 20 bp, Artificial Sequence
  chemically synthesized
agatttacctgttttattcc

SEQ ID NO: 599318 - DNA, 20 bp, Artificial Sequence
  chemically synthesized
tgggaattcaaaagtcagat

SEQ ID NO: 599319 - DNA, 20 bp, Artificial Sequence
  chemically synthesized
tagccagctgaattttcacc

SEQ ID NO: 599320 - DNA, 20 bp, Artificial Sequence
  chemically synthesized
agcacattatctttcccgca

SEQ ID NO: 599321 - DNA, 20 bp, Artificial Sequence
  chemically synthesized
ctagggaagttagtattgta

SEQ ID NO: 599322 - DNA, 20 bp, Artificial Sequence
  chemically synthesized
atgttcaaaaatagcatgac

SEQ ID NO: 599323 - DNA, 20 bp, Artificial Sequence
  chemically synthesized
caattgacttgctatgatcc

SEQ ID NO: 599324 - DNA, 20 bp, Artificial Sequence
  chemically synthesized
ccttacacaaaactaaggca

SEQ ID NO: 599325 - DNA, 20 bp, Artificial Sequence
  chemically synthesized
atcttttcaaagcttattgc

SEQ ID NO: 599326 - DNA, 20 bp, Artificial Sequence
  chemically synthesized
aaggagattttacatctttt

SEQ ID NO: 599327 - DNA, 20 bp, Artificial Sequence
  chemically synthesized
ctggaactggtttgactgaa

SEQ ID NO: 599328 - DNA, 20 bp, Artificial Sequence
  chemically synthesized
atcattgggcacaggctgga

SEQ ID NO: 599329 - DNA, 20 bp, Artificial Sequence
  chemically synthesized
gttccagcctgtgcccaatg

SEQ ID NO: 599330 - DNA, 20 bp, Artificial Sequence
  chemically synthesized
tgtgcccaatgatcagctta

SEQ ID NO: 599331 - DNA, 20 bp, Artificial Sequence
  chemically synthesized
aataaatagcataatgaaag

SEQ ID NO: 599332 - DNA, 20 bp, Artificial Sequence
  chemically synthesized
ccaacctccagcacagtagt

SEQ ID NO: 599333 - DNA, 20 bp, Artificial Sequence
  chemically synthesized
aaggctggcaagtctttggg

SEQ ID NO: 599334 - DNA, 20 bp, Artificial Sequence
  chemically synthesized
caatctatgcattttcatac

SEQ ID NO: 599335 - DNA, 20 bp, Artificial Sequence
  chemically synthesized
taaacttctgtatgaaaatg

SEQ ID NO: 599336 - DNA, 20 bp, Artificial Sequence
  chemically synthesized
tcagctagtaaatggtagag

SEQ ID NO: 599337 - DNA, 20 bp, Artificial Sequence
  chemically synthesized
gttatttatcctcattgaac

SEQ ID NO: 599338 - DNA, 20 bp, Artificial Sequence
  chemically synthesized
aatggtgtctggtatataat

SEQ ID NO: 599339 - DNA, 20 bp, Artificial Sequence
  chemically synthesized
aaaataatagtcaacattta

SEQ ID NO: 599340 - DNA, 20 bp, Artificial Sequence
  chemically synthesized
tttatattggatggacacat

SEQ ID NO: 599341 - DNA, 20 bp, Artificial Sequence
  chemically synthesized
tgagaggatcaaaataagac

SEQ ID NO: 599342 - DNA, 20 bp, Artificial Sequence
  chemically synthesized
tgacctgagccaatggatga

SEQ ID NO: 599343 - DNA, 20 bp, Artificial Sequence
  chemically synthesized
agggcttgacctgagccaat

SEQ ID NO: 599344 - DNA, 20 bp, Artificial Sequence
  chemically synthesized
accatagatttcaaaggagg

SEQ ID NO: 599345 - DNA, 20 bp, Artificial Sequence
  chemically synthesized
gcccttcctcctttgaaatc

SEQ ID NO: 599346 - DNA, 20 bp, Artificial Sequence
  chemically synthesized
tgtattttatcctttaaaac

SEQ ID NO: 599347 - DNA, 20 bp, Artificial Sequence
  chemically synthesized
atggttttaaaggataaaat

SEQ ID NO: 599348 - DNA, 20 bp, Artificial Sequence
  chemically synthesized
taatgagtctttattttacc

SEQ ID NO: 599349 - DNA, 20 bp, Artificial Sequence
  chemically synthesized
ccatgttcaccattacaatg

SEQ ID NO: 599350 - DNA, 20 bp, Artificial Sequence
  chemically synthesized
aacattgtaatggtgaacat

SEQ ID NO: 599351 - DNA, 20 bp, Artificial Sequence
  chemically synthesized
taatggtgaacatggaggat

SEQ ID NO: 599352 - DNA, 20 bp, Artificial Sequence
  chemically synthesized
gaacatggaggattttagat

SEQ ID NO: 599353 - DNA, 20 bp, Artificial Sequence
  chemically synthesized
ttaatctgtagttttgttct

SEQ ID NO: 599354 - DNA, 20 bp, Artificial Sequence
  chemically synthesized
ataatcctgaagaacaaaac

SEQ ID NO: 599355 - DNA, 20 bp, Artificial Sequence
  chemically synthesized
ttgccgcagataaattaatc

SEQ ID NO: 599356 - DNA, 20 bp, Artificial Sequence
  chemically synthesized
agtgatatcacagccttgca

SEQ ID NO: 599357 - DNA, 20 bp, Artificial Sequence
  chemically synthesized
cttgcatttagtttacaggg

SEQ ID NO: 599358 - DNA, 20 bp, Artificial Sequence
  chemically synthesized
cttttctgtctccaaataat

SEQ ID NO: 599359 - DNA, 20 bp, Artificial Sequence
  chemically synthesized
tccctagacatcctatggag

SEQ ID NO: 599360 - DNA, 20 bp, Artificial Sequence
  chemically synthesized
gggccaaaatagacatttca

SEQ ID NO: 599361 - DNA, 20 bp, Artificial Sequence
  chemically synthesized
gtgtttacctggtggtatca

SEQ ID NO: 599362 - DNA, 20 bp, Artificial Sequence
  chemically synthesized
ttttacatcttccccctttt

SEQ ID NO: 599363 - DNA, 20 bp, Artificial Sequence
  chemically synthesized
aaaaagggggaagatgtaaa

SEQ ID NO: 599364 - DNA, 20 bp, Artificial Sequence
  chemically synthesized
cttgcctgaataattagcac

SEQ ID NO: 599365 - DNA, 20 bp, Artificial Sequence
  chemically synthesized
acacattgaactaaagaagt

SEQ ID NO: 599366 - DNA, 20 bp, Artificial Sequence
  chemically synthesized
caatgaaagactaccgtgca

SEQ ID NO: 599367 - DNA, 20 bp, Artificial Sequence
  chemically synthesized
cattttgtttaaaaaaatta

SEQ ID NO: 599368 - DNA, 20 bp, Artificial Sequence
  chemically synthesized
ttaggaagattaagaatttg

SEQ ID NO: 599369 - DNA, 20 bp, Artificial Sequence
  chemically synthesized
atttgagtagttttattttg

SEQ ID NO: 599370 - DNA, 20 bp, Artificial Sequence
  chemically synthesized
ttttattttgtgtagtttca

SEQ ID NO: 599371 - DNA, 20 bp, Artificial Sequence
  chemically synthesized
ggctccaaataatttttgcc

SEQ ID NO: 599372 - DNA, 20 bp, Artificial Sequence
  chemically synthesized
aattatttggagcctaaatt

SEQ ID NO: 599373 - DNA, 20 bp, Artificial Sequence
  chemically synthesized
gactgcaatttttttaaaaa

SEQ ID NO: 599374 - DNA, 20 bp, Artificial Sequence
  chemically synthesized
atttagcattacttgaaaat

SEQ ID NO: 599375 - DNA, 20 bp, Artificial Sequence
  chemically synthesized
actgattttcaagtaatgct

SEQ ID NO: 599376 - DNA, 20 bp, Artificial Sequence
  chemically synthesized
tgaatacatcctcatctagt

SEQ ID NO: 599377 - DNA, 20 bp, Artificial Sequence
  chemically synthesized
ttaagaaaatgtctgtgtga

SEQ ID NO: 599378 - DNA, 20 bp, Artificial Sequence
  chemically synthesized
taaaattaattttatctgtt

SEQ ID NO: 599379 - DNA, 20 bp, Artificial Sequence
  chemically synthesized
aaatcagtaaaattaatttt

SEQ ID NO: 599380 - DNA, 20 bp, Artificial Sequence
  chemically synthesized
aaaacagataaaattaattt

SEQ ID NO: 599381 - DNA, 20 bp, Artificial Sequence
  chemically synthesized
ttcatatttttgtattgatt

SEQ ID NO: 599382 - DNA, 20 bp, Artificial Sequence
  chemically synthesized
gtaaaatattcatatttttg

SEQ ID NO: 599383 - DNA, 20 bp, Artificial Sequence
  chemically synthesized
taaataagtgtaaaatatgt

SEQ ID NO: 599384 - DNA, 20 bp, Artificial Sequence
  chemically synthesized
agaaatttggctactccatg

SEQ ID NO: 599385 - DNA, 20 bp, Artificial Sequence
  chemically synthesized
tcatgaaccacatgtggcca

SEQ ID NO: 599386 - DNA, 20 bp, Artificial Sequence
  chemically synthesized
aattactttgaataaaatag

SEQ ID NO: 599387 - DNA, 20 bp, Artificial Sequence
  chemically synthesized
ctttgaataaaatagtaatg

SEQ ID NO: 599388 - DNA, 20 bp, Artificial Sequence
  chemically synthesized
tgtttataacttgtggtgaa

SEQ ID NO: 599389 - DNA, 20 bp, Artificial Sequence
  chemically synthesized
gtataggaaaaattacggga

SEQ ID NO: 599390 - DNA, 20 bp, Artificial Sequence
  chemically synthesized
tgggattgacctgttatttc

SEQ ID NO: 599391 - DNA, 20 bp, Artificial Sequence
  chemically synthesized
ctattctcatttatgtgtat

SEQ ID NO: 599392 - DNA, 20 bp, Artificial Sequence
  chemically synthesized
gtgtatctcagcttgtgttg

SEQ ID NO: 599393 - DNA, 20 bp, Artificial Sequence
  chemically synthesized
tagacaggaatataatatta

SEQ ID NO: 599394 - DNA, 20 bp, Artificial Sequence
  chemically synthesized
attatttggctttcaaagat

SEQ ID NO: 599395 - DNA, 20 bp, Artificial Sequence
  chemically synthesized
ttcctgtataaaataaaagg

SEQ ID NO: 599396 - DNA, 20 bp, Artificial Sequence
  chemically synthesized
cttttattttatacaggaaa

SEQ ID NO: 599397 - DNA, 20 bp, Artificial Sequence
  chemically synthesized
aggtgcttattatatcaatc

SEQ ID NO: 599398 - DNA, 20 bp, Artificial Sequence
  chemically synthesized
tatataggtagttctaaaac

SEQ ID NO: 599399 - DNA, 20 bp, Artificial Sequence
  chemically synthesized
tggttataaaattggtcact

SEQ ID NO: 599400 - DNA, 20 bp, Artificial Sequence
  chemically synthesized
tgaccaattttataaccaaa

SEQ ID NO: 599401 - DNA, 20 bp, Artificial Sequence
  chemically synthesized
caaaataagtttatcaaacc

SEQ ID NO: 599402 - DNA, 20 bp, Artificial Sequence
  chemically synthesized
ccaataacatagctaaaaca

SEQ ID NO: 599403 - DNA, 20 bp, Artificial Sequence
  chemically synthesized
gcaccagccatttgacagcc

SEQ ID NO: 599404 - DNA, 20 bp, Artificial Sequence
  chemically synthesized
acaaagagatgaaaaaaatt

SEQ ID NO: 599405 - DNA, 20 bp, Artificial Sequence
  chemically synthesized
taattgggtgggaaagtgtt

SEQ ID NO: 599406 - DNA, 20 bp, Artificial Sequence
  chemically synthesized
agaattttaattgggtggga

SEQ ID NO: 599407 - DNA, 20 bp, Artificial Sequence
  chemically synthesized
aaaggaaacatgtaataaga

SEQ ID NO: 599408 - DNA, 20 bp, Artificial Sequence
  chemically synthesized
attataaacgctttcttatt

SEQ ID NO: 599409 - DNA, 20 bp, Artificial Sequence
  chemically synthesized
agaatgagctgttaaattat

SEQ ID NO: 599410 - DNA, 20 bp, Artificial Sequence
  chemically synthesized
aaaagcaggcatgatatact

SEQ ID NO: 599411 - DNA, 20 bp, Artificial Sequence
  chemically synthesized
taaaacacaaagtatatcat

SEQ ID NO: 599412 - DNA, 20 bp, Artificial Sequence
  chemically synthesized
atttatcagccattgctttc

SEQ ID NO: 599413 - DNA, 20 bp, Artificial Sequence
  chemically synthesized
aattaagatgatttatcagc

SEQ ID NO: 599414 - DNA, 20 bp, Artificial Sequence
  chemically synthesized
agtaacttacccaataatta

SEQ ID NO: 599415 - DNA, 20 bp, Artificial Sequence
  chemically synthesized
tctaacattgtgtgatttaa

SEQ ID NO: 599416 - DNA, 20 bp, Artificial Sequence
  chemically synthesized
tgtgtgcactgtctaacatt

SEQ ID NO: 599417 - DNA, 20 bp, Artificial Sequence
  chemically synthesized
tgttagacagtgcacacaaa

SEQ ID NO: 599418 - DNA, 20 bp, Artificial Sequence
  chemically synthesized
catgcaatattataactttt

SEQ ID NO: 599419 - DNA, 20 bp, Artificial Sequence
  chemically synthesized
ttctcatgcaatattataac

SEQ ID NO: 599420 - DNA, 20 bp, Artificial Sequence
  chemically synthesized
tgagaaagtgtataccaagc

SEQ ID NO: 599421 - DNA, 20 bp, Artificial Sequence
  chemically synthesized
aaattaaaagtgtccaaaac

SEQ ID NO: 599422 - DNA, 20 bp, Artificial Sequence
  chemically synthesized
tttacttaccttttcatttt

SEQ ID NO: 599423 - DNA, 20 bp, Artificial Sequence
  chemically synthesized
gaaaacaaagtgttgtcttt

SEQ ID NO: 599424 - DNA, 20 bp, Artificial Sequence
  chemically synthesized
agaaaccgagaaagacaaca

SEQ ID NO: 599425 - DNA, 20 bp, Artificial Sequence
  chemically synthesized
gaaagacaacactttgtttt

SEQ ID NO: 599426 - DNA, 20 bp, Artificial Sequence
  chemically synthesized
ctttgttttccttgattttt

SEQ ID NO: 599427 - DNA, 20 bp, Artificial Sequence
  chemically synthesized
cttgattttttaatgtttca

SEQ ID NO: 599428 - DNA, 20 bp, Artificial Sequence
  chemically synthesized
aattgcttaacaactattaa

SEQ ID NO: 599429 - DNA, 20 bp, Artificial Sequence
  chemically synthesized
acaactattaattgtgcttt

SEQ ID NO: 599430 - DNA, 20 bp, Artificial Sequence
  chemically synthesized
ttgtgctttgttggattatt

SEQ ID NO: 599431 - DNA, 20 bp, Artificial Sequence
  chemically synthesized
atttaaggattaatgaaatt

SEQ ID NO: 599432 - DNA, 20 bp, Artificial Sequence
  chemically synthesized
aatgaaatttaaggctttgt

SEQ ID NO: 599433 - DNA, 20 bp, Artificial Sequence
  chemically synthesized
tttgttaacttgttataaaa

SEQ ID NO: 599434 - DNA, 20 bp, Artificial Sequence
  chemically synthesized
atgaatcagtttgtaattga

SEQ ID NO: 599435 - DNA, 20 bp, Artificial Sequence
  chemically synthesized
gaaaagcaagatcaattaca

SEQ ID NO: 599436 - DNA, 20 bp, Artificial Sequence
  chemically synthesized
atgctttcaatttacaatga

SEQ ID NO: 599437 - DNA, 20 bp, Artificial Sequence
  chemically synthesized
aagtgtatctgagtaatttt

SEQ ID NO: 599438 - DNA, 20 bp, Artificial Sequence
  chemically synthesized
aaattactcagatacacttt

SEQ ID NO: 599439 - DNA, 20 bp, Artificial Sequence
  chemically synthesized
cactttattagttttaaaat

SEQ ID NO: 599440 - DNA, 20 bp, Artificial Sequence
  chemically synthesized
caaagtaatatttaaccaag

SEQ ID NO: 599441 - DNA, 20 bp, Artificial Sequence
  chemically synthesized
atacactagcataataacga

SEQ ID NO: 599442 - DNA, 20 bp, Artificial Sequence
  chemically synthesized
attccatagtccagattaac

SEQ ID NO: 599443 - DNA, 20 bp, Artificial Sequence
  chemically synthesized
tgattattaagattccatag

SEQ ID NO: 599444 - DNA, 20 bp, Artificial Sequence
  chemically synthesized
gtggtaatttatcatgatta

SEQ ID NO: 599445 - DNA, 20 bp, Artificial Sequence
  chemically synthesized
ttgaatatagtggtaattta

SEQ ID NO: 599446 - DNA, 20 bp, Artificial Sequence
  chemically synthesized
tattttcaatttaggtttta

SEQ ID NO: 599447 - DNA, 20 bp, Artificial Sequence
  chemically synthesized
ttggattatttattttcaat

SEQ ID NO: 599448 - DNA, 20 bp, Artificial Sequence
  chemically synthesized
aaaataaataatccaagtgc

SEQ ID NO: 599449 - DNA, 20 bp, Artificial Sequence
  chemically synthesized
ttttaaaccaatctgtagca

SEQ ID NO: 599450 - DNA, 20 bp, Artificial Sequence
  chemically synthesized
aaataatccaagtgctacag

SEQ ID NO: 599451 - DNA, 20 bp, Artificial Sequence
  chemically synthesized
agtgctacagattggtttaa

SEQ ID NO: 599452 - DNA, 20 bp, Artificial Sequence
  chemically synthesized
cagaatggaaaaaggagact

SEQ ID NO: 599453 - DNA, 20 bp, Artificial Sequence
  chemically synthesized
tcagtctcctttttccattc

SEQ ID NO: 599454 - DNA, 20 bp, Artificial Sequence
  chemically synthesized
ttgtccttgaaatttttcat

SEQ ID NO: 599455 - DNA, 20 bp, Artificial Sequence
  chemically synthesized
agtatctttccaatacactt

SEQ ID NO: 599456 - DNA, 20 bp, Artificial Sequence
  chemically synthesized
atactacatctatgctagaa

SEQ ID NO: 599457 - DNA, 20 bp, Artificial Sequence
  chemically synthesized
agaagaaagattatttaaaa

SEQ ID NO: 599458 - DNA, 20 bp, Artificial Sequence
  chemically synthesized
attttaaaataatagaataa

SEQ ID NO: 599459 - DNA, 20 bp, Artificial Sequence
  chemically synthesized
aaataatatttcttacattt

SEQ ID NO: 599460 - DNA, 20 bp, Artificial Sequence
  chemically synthesized
cttttgagaatagataaagt

SEQ ID NO: 599461 - DNA, 20 bp, Artificial Sequence
  chemically synthesized
ataaagtactggtttacctt

SEQ ID NO: 599462 - DNA, 20 bp, Artificial Sequence
  chemically synthesized
ctaattagaggatattaccc

SEQ ID NO: 599463 - DNA, 20 bp, Artificial Sequence
  chemically synthesized
gatattacccagtagatttc

SEQ ID NO: 599464 - DNA, 20 bp, Artificial Sequence
  chemically synthesized
ttgtatggatgaggttaatt

SEQ ID NO: 599465 - DNA, 20 bp, Artificial Sequence
  chemically synthesized
acccacgaatatattttgca

SEQ ID NO: 599466 - DNA, 20 bp, Artificial Sequence
  chemically synthesized
aatatattcgtgggtcaaga

SEQ ID NO: 599467 - DNA, 20 bp, Artificial Sequence
  chemically synthesized
ataaaaggtcgacagtagga

SEQ ID NO: 599468 - DNA, 20 bp, Artificial Sequence
  chemically synthesized
ttcctactgtcgacctttta

SEQ ID NO: 599469 - DNA, 20 bp, Artificial Sequence
  chemically synthesized
acttagaatattgccctatt

SEQ ID NO: 599470 - DNA, 20 bp, Artificial Sequence
  chemically synthesized
cccccatacattttagagtt

SEQ ID NO: 599471 - DNA, 20 bp, Artificial Sequence
  chemically synthesized
atacaaaattgcttaaagtg

SEQ ID NO: 599472 - DNA, 20 bp, Artificial Sequence
  chemically synthesized
aaagaaagtttaaaatacaa

SEQ ID NO: 599473 - DNA, 20 bp, Artificial Sequence
  chemically synthesized
acaacctaagtaaatgaaaa

SEQ ID NO: 599474 - DNA, 20 bp, Artificial Sequence
  chemically synthesized
actttcttttcatttactta

SEQ ID NO: 599475 - DNA, 20 bp, Artificial Sequence
  chemically synthesized
ttcatttacttaggttgttt

SEQ ID NO: 599476 - DNA, 20 bp, Artificial Sequence
  chemically synthesized
acccaatttcacttcaaata

SEQ ID NO: 599477 - DNA, 20 bp, Artificial Sequence
  chemically synthesized
tgtatttgaagtgaaattgg

SEQ ID NO: 599478 - DNA, 20 bp, Artificial Sequence
  chemically synthesized
tgcctctatttatgtcataa

SEQ ID NO: 599479 - DNA, 20 bp, Artificial Sequence
  chemically synthesized
acttcaatacactgactcag

SEQ ID NO: 599480 - DNA, 20 bp, Artificial Sequence
  chemically synthesized
gcaaatactagatctcagtc

SEQ ID NO: 599481 - DNA, 20 bp, Artificial Sequence
  chemically synthesized
aagtctctggtccaaagcaa

SEQ ID NO: 599482 - DNA, 20 bp, Artificial Sequence
  chemically synthesized
tgtcagtagatgtaaagcaa

SEQ ID NO: 599483 - DNA, 20 bp, Artificial Sequence
  chemically synthesized
cctttatcaaaggagaacaa

SEQ ID NO: 599484 - DNA, 20 bp, Artificial Sequence
  chemically synthesized
agaacaatcaagattcacca

SEQ ID NO: 599485 - DNA, 20 bp, Artificial Sequence
  chemically synthesized
aattaaagctatttggtgaa

SEQ ID NO: 599486 - DNA, 20 bp, Artificial Sequence
  chemically synthesized
tgttatgctaacaagaccca

SEQ ID NO: 599487 - DNA, 20 bp, Artificial Sequence
  chemically synthesized
tttttaaagtagatgtgtaa

SEQ ID NO: 599488 - DNA, 20 bp, Artificial Sequence
  chemically synthesized
aatattttacatggttacca

SEQ ID NO: 599489 - DNA, 20 bp, Artificial Sequence
  chemically synthesized
ttaccaaagggatttattag

SEQ ID NO: 599490 - DNA, 20 bp, Artificial Sequence
  chemically synthesized
cctaacaacataattcttat

SEQ ID NO: 599491 - DNA, 20 bp, Artificial Sequence
  chemically synthesized
atgttgttaggttcatattt

SEQ ID NO: 599492 - DNA, 20 bp, Artificial Sequence
  chemically synthesized
aataaaatttgcagatatta

SEQ ID NO: 599493 - DNA, 20 bp, Artificial Sequence
  chemically synthesized
caatatttacaagtcttcat

SEQ ID NO: 599494 - DNA, 20 bp, Artificial Sequence
  chemically synthesized
acaagtcttcatctcagttt

SEQ ID NO: 599495 - DNA, 20 bp, Artificial Sequence
  chemically synthesized
ttaaagcttaattttctgta

SEQ ID NO: 599496 - DNA, 20 bp, Artificial Sequence
  chemically synthesized
ataaatctgactacagaaaa

SEQ ID NO: 599497 - DNA, 20 bp, Artificial Sequence
  chemically synthesized
ttggattgaaaatttttaat

SEQ ID NO: 599498 - DNA, 20 bp, Artificial Sequence
  chemically synthesized
agaaggtccaatgaagatgt

SEQ ID NO: 599499 - DNA, 20 bp, Artificial Sequence
  chemically synthesized
atgcatcatttatttcccac

SEQ ID NO: 599500 - DNA, 20 bp, Artificial Sequence
  chemically synthesized
gagagccaaaataattaaat

SEQ ID NO: 599501 - DNA, 20 bp, Artificial Sequence
  chemically synthesized
atgtgtggaaaataattaag

SEQ ID NO: 599502 - DNA, 20 bp, Artificial Sequence
  chemically synthesized
cacatagaaccatattttaa

SEQ ID NO: 599503 - DNA, 20 bp, Artificial Sequence
  chemically synthesized
aagatagattaggcccaatc

SEQ ID NO: 599504 - DNA, 20 bp, Artificial Sequence
  chemically synthesized
aatatataagaaaaagaaac

SEQ ID NO: 599505 - DNA, 20 bp, Artificial Sequence
  chemically synthesized
tctttggataagagactttc

SEQ ID NO: 599506 - DNA, 20 bp, Artificial Sequence
  chemically synthesized
gtgaaagtctcttatccaaa

SEQ ID NO: 599507 - DNA, 20 bp, Artificial Sequence
  chemically synthesized
gctgcaataattgtaaatta

SEQ ID NO: 599508 - DNA, 20 bp, Artificial Sequence
  chemically synthesized
caaatacttaaatattcatt

SEQ ID NO: 599509 - DNA, 20 bp, Artificial Sequence
  chemically synthesized
gcatcaaatacttaaatatt

SEQ ID NO: 599510 - DNA, 20 bp, Artificial Sequence
  chemically synthesized
tgaatatttaagtatttgat

SEQ ID NO: 599511 - DNA, 20 bp, Artificial Sequence
  chemically synthesized
atatgtattacaactgtaat

SEQ ID NO: 599512 - DNA, 20 bp, Artificial Sequence
  chemically synthesized
attgctgctaaaattcatgt

SEQ ID NO: 599513 - DNA, 20 bp, Artificial Sequence
  chemically synthesized
ttgcttagattgtatttttc

SEQ ID NO: 599514 - DNA, 20 bp, Artificial Sequence
  chemically synthesized
taatttctacataaaatttg

SEQ ID NO: 599515 - DNA, 20 bp, Artificial Sequence
  chemically synthesized
ttatgtaatttctacataaa

SEQ ID NO: 599516 - DNA, 20 bp, Artificial Sequence
  chemically synthesized
ctttattaatatgacacacc

SEQ ID NO: 599517 - DNA, 20 bp, Artificial Sequence
  chemically synthesized
attaatatgacacacctaaa

SEQ ID NO: 599518 - DNA, 20 bp, Artificial Sequence
  chemically synthesized
accccagcctgggcgacaga

SEQ ID NO: 599519 - DNA, 20 bp, Artificial Sequence
  chemically synthesized
cttgggaggctgaggaggga

SEQ ID NO: 599520 - DNA, 20 bp, Artificial Sequence
  chemically synthesized
ctcctcagcctcccaagtag

SEQ ID NO: 599521 - DNA, 20 bp, Artificial Sequence
  chemically synthesized
ttttgtatttttagtagaga

SEQ ID NO: 599522 - DNA, 20 bp, Artificial Sequence
  chemically synthesized
tgcagcggcctcccaaagtg

SEQ ID NO: 599523 - DNA, 20 bp, Artificial Sequence
  chemically synthesized
aaaaatgactccaaatttaa

SEQ ID NO: 599524 - DNA, 20 bp, Artificial Sequence
  chemically synthesized
tgatgctgaaggtctaggga

SEQ ID NO: 599525 - DNA, 20 bp, Artificial Sequence
  chemically synthesized
catttctaacatttttctag

SEQ ID NO: 599526 - DNA, 20 bp, Artificial Sequence
  chemically synthesized
ctaggtctggagtggagcac

SEQ ID NO: 599527 - DNA, 20 bp, Artificial Sequence
  chemically synthesized
agtgtgctgggccccacact

SEQ ID NO: 599528 - DNA, 20 bp, Artificial Sequence
  chemically synthesized
ctgagtgtggggcccagcac

SEQ ID NO: 599529 - DNA, 20 bp, Artificial Sequence
  chemically synthesized
caattcacccaagtgcatac

SEQ ID NO: 599530 - DNA, 20 bp, Artificial Sequence
  chemically synthesized
ttgcatactgaattaagcat

SEQ ID NO: 599531 - DNA, 20 bp, Artificial Sequence
  chemically synthesized
tggacagccagactaatcat

SEQ ID NO: 599532 - DNA, 20 bp, Artificial Sequence
  chemically synthesized
ttagttgtggatgataaggc

SEQ ID NO: 599533 - DNA, 20 bp, Artificial Sequence
  chemically synthesized
ttcagccttatcatccacaa

SEQ ID NO: 599534 - DNA, 20 bp, Artificial Sequence
  chemically synthesized
ttcaatgaagagtgagttcc

SEQ ID NO: 599535 - DNA, 20 bp, Artificial Sequence
  chemically synthesized
attgaacacactgtatgctc

SEQ ID NO: 599536 - DNA, 20 bp, Artificial Sequence
  chemically synthesized
gtatgctcctaagctttctc

SEQ ID NO: 599537 - DNA, 20 bp, Artificial Sequence
  chemically synthesized
aattcggcataaacatatga

SEQ ID NO: 599538 - DNA, 20 bp, Artificial Sequence
  chemically synthesized
tgagagtgagtgcatggtaa

SEQ ID NO: 599539 - DNA, 20 bp, Artificial Sequence
  chemically synthesized
ggcaagatgtgttcatggat

SEQ ID NO: 599540 - DNA, 20 bp, Artificial Sequence
  chemically synthesized
tacgatggattcaaggagct

SEQ ID NO: 599541 - DNA, 20 bp, Artificial Sequence
  chemically synthesized
ggtaaaatacgatggattca

SEQ ID NO: 599542 - DNA, 20 bp, Artificial Sequence
  chemically synthesized
tctattgctaggtaaaatac

SEQ ID NO: 599543 - DNA, 20 bp, Artificial Sequence
  chemically synthesized
catatattattttccgataa

SEQ ID NO: 599544 - DNA, 20 bp, Artificial Sequence
  chemically synthesized
atatggttggtgagaattca

SEQ ID NO: 599545 - DNA, 20 bp, Artificial Sequence
  chemically synthesized
aatgagtgaagacttgagaa

SEQ ID NO: 599546 - DNA, 20 bp, Artificial Sequence
  chemically synthesized
tttctcaagtcttcactcat

SEQ ID NO: 599547 - DNA, 20 bp, Artificial Sequence
  chemically synthesized
tgctgactccccttctccaa

SEQ ID NO: 599548 - DNA, 20 bp, Artificial Sequence
  chemically synthesized
ataattaatatgaataaata

SEQ ID NO: 599549 - DNA, 20 bp, Artificial Sequence
  chemically synthesized
ggcatgggaagacaaaaata

SEQ ID NO: 599550 - DNA, 20 bp, Artificial Sequence
  chemically synthesized
agactccttgtctcaactgt

SEQ ID NO: 599551 - DNA, 20 bp, Artificial Sequence
  chemically synthesized
tgagacaaggagtctctcct

SEQ ID NO: 599552 - DNA, 20 bp, Artificial Sequence
  chemically synthesized
actcagggttctaatattat

SEQ ID NO: 599553 - DNA, 20 bp, Artificial Sequence
  chemically synthesized
tgaaatcaatgtgaggaaat

SEQ ID NO: 599554 - DNA, 20 bp, Artificial Sequence
  chemically synthesized
ttaaaactgccatttcctca

SEQ ID NO: 599555 - DNA, 20 bp, Artificial Sequence
  chemically synthesized
atttcctcacattgatttca

SEQ ID NO: 599556 - DNA, 20 bp, Artificial Sequence
  chemically synthesized
ttcacatagattacgaaaaa

SEQ ID NO: 599557 - DNA, 20 bp, Artificial Sequence
  chemically synthesized
atccaatgactttgaaaaaa

SEQ ID NO: 599558 - DNA, 20 bp, Artificial Sequence
  chemically synthesized
atttaagaactactaaggag

SEQ ID NO: 599559 - DNA, 20 bp, Artificial Sequence
  chemically synthesized
ttgtcatgaaaatagcaaag

SEQ ID NO: 599560 - DNA, 20 bp, Artificial Sequence
  chemically synthesized
agacacgattttctgactcc

SEQ ID NO: 599561 - DNA, 20 bp, Artificial Sequence
  chemically synthesized
atggaaaaaaatgaaagaat

SEQ ID NO: 599562 - DNA, 20 bp, Artificial Sequence
  chemically synthesized
caattctttcatttttttcc

SEQ ID NO: 599563 - DNA, 20 bp, Artificial Sequence
  chemically synthesized
atcagtttttgtctcaaccc

SEQ ID NO: 599564 - DNA, 20 bp, Artificial Sequence
  chemically synthesized
ttaaccatttcatatctata

SEQ ID NO: 599565 - DNA, 20 bp, Artificial Sequence
  chemically synthesized
ctgattaatacattttaaat

SEQ ID NO: 599566 - DNA, 20 bp, Artificial Sequence
  chemically synthesized
atttgatcctcattacaatc

SEQ ID NO: 599567 - DNA, 20 bp, Artificial Sequence
  chemically synthesized
atgcctgttttattttaatc

SEQ ID NO: 599568 - DNA, 20 bp, Artificial Sequence
  chemically synthesized
tacaaaataagggagatgat

SEQ ID NO: 599569 - DNA, 20 bp, Artificial Sequence
  chemically synthesized
tagctgagcacattactact

SEQ ID NO: 599570 - DNA, 20 bp, Artificial Sequence
  chemically synthesized
ccttaacttcaagacacaag

SEQ ID NO: 599571 - DNA, 20 bp, Artificial Sequence
  chemically synthesized
gtgagtaaagggatcctcag

SEQ ID NO: 599572 - DNA, 20 bp, Artificial Sequence
  chemically synthesized
gaactgaggatccctttact

SEQ ID NO: 599573 - DNA, 20 bp, Artificial Sequence
  chemically synthesized
atccctttactcactgcttt

SEQ ID NO: 599574 - DNA, 20 bp, Artificial Sequence
  chemically synthesized
atgctgaaaattcactggtg

SEQ ID NO: 599575 - DNA, 20 bp, Artificial Sequence
  chemically synthesized
tctaaaggctatactgaaat

SEQ ID NO: 599576 - DNA, 20 bp, Artificial Sequence
  chemically synthesized
atggtgataaaaaaagtaga

SEQ ID NO: 599577 - DNA, 20 bp, Artificial Sequence
  chemically synthesized
aatactatggtgataaaaaa

SEQ ID NO: 599578 - DNA, 20 bp, Artificial Sequence
  chemically synthesized
ttctatggttgagtctatgt

SEQ ID NO: 599579 - DNA, 20 bp, Artificial Sequence
  chemically synthesized
aggataatattaggttagaa

SEQ ID NO: 599580 - DNA, 20 bp, Artificial Sequence
  chemically synthesized
ataacccctactataaagaa

SEQ ID NO: 599581 - DNA, 20 bp, Artificial Sequence
  chemically synthesized
ggtagcctttgatctcaaaa

SEQ ID NO: 599582 - DNA, 20 bp, Artificial Sequence
  chemically synthesized
tagggaagtgctgaagtgct

SEQ ID NO: 599583 - DNA, 20 bp, Artificial Sequence
  chemically synthesized
gaaaacatttaatgtcttgt

SEQ ID NO: 599584 - DNA, 20 bp, Artificial Sequence
  chemically synthesized
gcaaacacacacaagacatt

SEQ ID NO: 599585 - DNA, 20 bp, Artificial Sequence
  chemically synthesized
aatttcttattgtaatcaac

SEQ ID NO: 599586 - DNA, 20 bp, Artificial Sequence
  chemically synthesized
ttggctattcagtaatcttt

SEQ ID NO: 599587 - DNA, 20 bp, Artificial Sequence
  chemically synthesized
tagccaaattttagaacgag

SEQ ID NO: 599588 - DNA, 20 bp, Artificial Sequence
  chemically synthesized
acatggtttgaaatttctaa

SEQ ID NO: 599589 - DNA, 20 bp, Artificial Sequence
  chemically synthesized
tataaattatgctcatagaa

SEQ ID NO: 599590 - DNA, 20 bp, Artificial Sequence
  chemically synthesized
ccattttatctttctccttc

SEQ ID NO: 599591 - DNA, 20 bp, Artificial Sequence
  chemically synthesized
tattaatttaattttaaata

SEQ ID NO: 599592 - DNA, 20 bp, Artificial Sequence
  chemically synthesized
ataataatattttgggcagg

SEQ ID NO: 599593 - DNA, 20 bp, Artificial Sequence
  chemically synthesized
atttttctgcatatccattt

SEQ ID NO: 599594 - DNA, 20 bp, Artificial Sequence
  chemically synthesized
ttttcagtagtagccagaat

SEQ ID NO: 599595 - DNA, 20 bp, Artificial Sequence
  chemically synthesized
aaaacagtggatttagaaga

SEQ ID NO: 599596 - DNA, 20 bp, Artificial Sequence
  chemically synthesized
aaatctcaatcttctaaatc

SEQ ID NO: 599597 - DNA, 20 bp, Artificial Sequence
  chemically synthesized
ccagagaaaacagtggattt

SEQ ID NO: 599598 - DNA, 20 bp, Artificial Sequence
  chemically synthesized
gtaatctcaccagagaaaac

SEQ ID NO: 599599 - DNA, 20 bp, Artificial Sequence
  chemically synthesized
taaatccactgttttctctg

SEQ ID NO: 599600 - DNA, 20 bp, Artificial Sequence
  chemically synthesized
atgatctcggcagagagaac

SEQ ID NO: 599601 - DNA, 20 bp, Artificial Sequence
  chemically synthesized
gaattagtgttaaacatatt

SEQ ID NO: 599602 - DNA, 20 bp, Artificial Sequence
  chemically synthesized
atacttagtataatcataaa

SEQ ID NO: 599603 - DNA, 20 bp, Artificial Sequence
  chemically synthesized
tgattatactaagtattcat

SEQ ID NO: 599604 - DNA, 20 bp, Artificial Sequence
  chemically synthesized
aagatccttgcttaagaaat

SEQ ID NO: 599605 - DNA, 20 bp, Artificial Sequence
  chemically synthesized
agatacaagggtataaagat

SEQ ID NO: 599606 - DNA, 20 bp, Artificial Sequence
  chemically synthesized
ggattgagcttccattgtgt

SEQ ID NO: 599607 - DNA, 20 bp, Artificial Sequence
  chemically synthesized
cattgcatcagctaatggga

SEQ ID NO: 599608 - DNA, 20 bp, Artificial Sequence
  chemically synthesized
tatattcattgcatcagcta

SEQ ID NO: 599609 - DNA, 20 bp, Artificial Sequence
  chemically synthesized
atatataagcaaagtgtcag

SEQ ID NO: 599610 - DNA, 20 bp, Artificial Sequence
  chemically synthesized
gaaataaagcatatctgaca

SEQ ID NO: 599611 - DNA, 20 bp, Artificial Sequence
  chemically synthesized
gtgtcagatatgctttattt

SEQ ID NO: 599612 - DNA, 20 bp, Artificial Sequence
  chemically synthesized
acatgtttgcttttcaaagt

SEQ ID NO: 599613 - DNA, 20 bp, Artificial Sequence
  chemically synthesized
aaatactttgaaaagcaaac

SEQ ID NO: 599614 - DNA, 20 bp, Artificial Sequence
  chemically synthesized
aattaacaaaataatcacat

SEQ ID NO: 599615 - DNA, 20 bp, Artificial Sequence
  chemically synthesized
tgttaattaacaaaataatc

SEQ ID NO: 599616 - DNA, 20 bp, Artificial Sequence
  chemically synthesized
cgtgaaccactgtgcctggc

SEQ ID NO: 599617 - DNA, 20 bp, Artificial Sequence
  chemically synthesized
ctggggccaggcacagtggt

SEQ ID NO: 599618 - DNA, 20 bp, Artificial Sequence
  chemically synthesized
tgcctgggcctctcaaagtg

SEQ ID NO: 599619 - DNA, 20 bp, Artificial Sequence
  chemically synthesized
tttttgtattttggcagaga

SEQ ID NO: 599620 - DNA, 20 bp, Artificial Sequence
  chemically synthesized
tgcctcagcctcccaagtag

SEQ ID NO: 599621 - DNA, 20 bp, Artificial Sequence
  chemically synthesized
gaggctgaggcaggagaatc

SEQ ID NO: 599622 - DNA, 20 bp, Artificial Sequence
  chemically synthesized
aacctctgcctcctggaatc

SEQ ID NO: 599623 - DNA, 20 bp, Artificial Sequence
  chemically synthesized
cactggaaatttcttatgcc

SEQ ID NO: 599624 - DNA, 20 bp, Artificial Sequence
  chemically synthesized
catagagtggatcactttat

SEQ ID NO: 599625 - DNA, 20 bp, Artificial Sequence
  chemically synthesized
tttgtgaccaagacaagttt

SEQ ID NO: 599626 - DNA, 20 bp, Artificial Sequence
  chemically synthesized
aatacaagtttgtgaccaag

SEQ ID NO: 599627 - DNA, 20 bp, Artificial Sequence
  chemically synthesized
atgtgacagacccagccaat

SEQ ID NO: 599628 - DNA, 20 bp, Artificial Sequence
  chemically synthesized
atctttggataaattgtgtt

SEQ ID NO: 599629 - DNA, 20 bp, Artificial Sequence
  chemically synthesized
ttattttctcttaaatattc

SEQ ID NO: 599630 - DNA, 20 bp, Artificial Sequence
  chemically synthesized
ctcttaaatattctatagct

SEQ ID NO: 599631 - DNA, 20 bp, Artificial Sequence
  chemically synthesized
aatgaagtagtagcattttt

SEQ ID NO: 599632 - DNA, 20 bp, Artificial Sequence
  chemically synthesized
tgtaataacaagacaatgaa

SEQ ID NO: 599633 - DNA, 20 bp, Artificial Sequence
  chemically synthesized
tttttacttctaaagatatc

SEQ ID NO: 599634 - DNA, 20 bp, Artificial Sequence
  chemically synthesized
gtattgttacttacaaagac

SEQ ID NO: 599635 - DNA, 20 bp, Artificial Sequence
  chemically synthesized
gacaggctcttaaaattgat

SEQ ID NO: 599636 - DNA, 20 bp, Artificial Sequence
  chemically synthesized
aaaatgtgacaggctcttaa

SEQ ID NO: 599637 - DNA, 20 bp, Artificial Sequence
  chemically synthesized
ccttcccaaattaaaaagtt

SEQ ID NO: 599638 - DNA, 20 bp, Artificial Sequence
  chemically synthesized
acatgataaattctaaatag

SEQ ID NO: 599639 - DNA, 20 bp, Artificial Sequence
  chemically synthesized
atgtgacatgataaattcta

SEQ ID NO: 599640 - DNA, 20 bp, Artificial Sequence
  chemically synthesized
atataatagtacatatttaa

SEQ ID NO: 599641 - DNA, 20 bp, Artificial Sequence
  chemically synthesized
atataagcaaccagtaatag

SEQ ID NO: 599642 - DNA, 20 bp, Artificial Sequence
  chemically synthesized
tgtgaaaccatgctattact

SEQ ID NO: 599643 - DNA, 20 bp, Artificial Sequence
  chemically synthesized
gatgcagtatgtcaggtaag

SEQ ID NO: 599644 - DNA, 20 bp, Artificial Sequence
  chemically synthesized
atattttctcataaatactc

SEQ ID NO: 599645 - DNA, 20 bp, Artificial Sequence
  chemically synthesized
tactccaatgtttttttcat

SEQ ID NO: 599646 - DNA, 20 bp, Artificial Sequence
  chemically synthesized
tctatatacctaaatacata

SEQ ID NO: 599647 - DNA, 20 bp, Artificial Sequence
  chemically synthesized
tattgattttatatacattt

SEQ ID NO: 599648 - DNA, 20 bp, Artificial Sequence
  chemically synthesized
gataaatttcaatatatatg

SEQ ID NO: 599649 - DNA, 20 bp, Artificial Sequence
  chemically synthesized
ttacctagaaatttatatac

SEQ ID NO: 599650 - DNA, 20 bp, Artificial Sequence
  chemically synthesized
tatagaatttcagctctttg

SEQ ID NO: 599651 - DNA, 20 bp, Artificial Sequence
  chemically synthesized
agagaaagtcttatttaata

SEQ ID NO: 599652 - DNA, 20 bp, Artificial Sequence
  chemically synthesized
gtgatagactttatatttgt

SEQ ID NO: 599653 - DNA, 20 bp, Artificial Sequence
  chemically synthesized
ttttatatgcctatttatat

SEQ ID NO: 599654 - DNA, 20 bp, Artificial Sequence
  chemically synthesized
aattacaaaaattaggatat

SEQ ID NO: 599655 - DNA, 20 bp, Artificial Sequence
  chemically synthesized
attaggatatgtaagctttg

SEQ ID NO: 599656 - DNA, 20 bp, Artificial Sequence
  chemically synthesized
gatatgtaagctttgcaatg

SEQ ID NO: 599657 - DNA, 20 bp, Artificial Sequence
  chemically synthesized
gccatgaaaacaaatcattg

SEQ ID NO: 599658 - DNA, 20 bp, Artificial Sequence
  chemically synthesized
tgtgcaagtgtgtttgttta

SEQ ID NO: 599659 - DNA, 20 bp, Artificial Sequence
  chemically synthesized
tttactggttgtgcaagtgt

SEQ ID NO: 599660 - DNA, 20 bp, Artificial Sequence
  chemically synthesized
cctctttactggttgtgcaa

SEQ ID NO: 599661 - DNA, 20 bp, Artificial Sequence
  chemically synthesized
tacatcttctgcacggtcta

SEQ ID NO: 599662 - DNA, 20 bp, Artificial Sequence
  chemically synthesized
caaaagcagtactgatacaa

SEQ ID NO: 599663 - DNA, 20 bp, Artificial Sequence
  chemically synthesized
tacaagcaatattgtatcag

SEQ ID NO: 599664 - DNA, 20 bp, Artificial Sequence
  chemically synthesized
cttttggcaaaatttatcgg

SEQ ID NO: 599665 - DNA, 20 bp, Artificial Sequence
  chemically synthesized
tttatgttgatggatgactt

SEQ ID NO: 599666 - DNA, 20 bp, Artificial Sequence
  chemically synthesized
tgatggatgacttgtgtgct

SEQ ID NO: 599667 - DNA, 20 bp, Artificial Sequence
  chemically synthesized
tctaggactgcattctatgc

SEQ ID NO: 599668 - DNA, 20 bp, Artificial Sequence
  chemically synthesized
gagacagagacggggaggag

SEQ ID NO: 599669 - DNA, 20 bp, Artificial Sequence
  chemically synthesized
tgtatttaaggaaattttac

SEQ ID NO: 599670 - DNA, 20 bp, Artificial Sequence
  chemically synthesized
ggggcaagtagaccccacag

SEQ ID NO: 599671 - DNA, 20 bp, Artificial Sequence
  chemically synthesized
ttcgcaagagaccatttagc

SEQ ID NO: 599672 - DNA, 20 bp, Artificial Sequence
  chemically synthesized
cccaaatctcagagctcaac

SEQ ID NO: 599673 - DNA, 20 bp, Artificial Sequence
  chemically synthesized
tgcaaatcgatggttgagct

SEQ ID NO: 599674 - DNA, 20 bp, Artificial Sequence
  chemically synthesized
taatttcctgcagtggtcac

SEQ ID NO: 599675 - DNA, 20 bp, Artificial Sequence
  chemically synthesized
gtggtcaccgcggtttgcca

SEQ ID NO: 599676 - DNA, 20 bp, Artificial Sequence
  chemically synthesized
ccgcggtttgccatcaagtt

SEQ ID NO: 599677 - DNA, 20 bp, Artificial Sequence
  chemically synthesized
tatctcttgctcatggaata

SEQ ID NO: 599678 - DNA, 20 bp, Artificial Sequence
  chemically synthesized
ctcgctcacttgctcactcg

SEQ ID NO: 599679 - DNA, 20 bp, Artificial Sequence
  chemically synthesized
tctccctttgtattttctgc

SEQ ID NO: 599680 - DNA, 20 bp, Artificial Sequence
  chemically synthesized
tagtcctgttttatggaagt

SEQ ID NO: 599681 - DNA, 20 bp, Artificial Sequence
  chemically synthesized
cacacgcattttcattttag

SEQ ID NO: 599682 - DNA, 20 bp, Artificial Sequence
  chemically synthesized
caggactaaaatgaaaatgc

SEQ ID NO: 599683 - DNA, 20 bp, Artificial Sequence
  chemically synthesized
agaaaaatagatcaccgtcc

SEQ ID NO: 599684 - DNA, 20 bp, Artificial Sequence
  chemically synthesized
gtttgatgcatgtctattta

SEQ ID NO: 599685 - DNA, 20 bp, Artificial Sequence
  chemically synthesized
tttagtccgaggaaggacag

SEQ ID NO: 599686 - DNA, 20 bp, Artificial Sequence
  chemically synthesized
attgagtgtcataagaaaaa

SEQ ID NO: 599687 - DNA, 20 bp, Artificial Sequence
  chemically synthesized
atcttatggtgaatttcctt

SEQ ID NO: 599688 - DNA, 20 bp, Artificial Sequence
  chemically synthesized
caatacagatccacatcaaa

SEQ ID NO: 599689 - DNA, 20 bp, Artificial Sequence
  chemically synthesized
aacacatttatgccattgtc

SEQ ID NO: 599690 - DNA, 20 bp, Artificial Sequence
  chemically synthesized
agcttcagacaatggcataa

SEQ ID NO: 599691 - DNA, 20 bp, Artificial Sequence
  chemically synthesized
gggatagcctggaatgaatt

SEQ ID NO: 599692 - DNA, 20 bp, Artificial Sequence
  chemically synthesized
tttatgcctctgatattttc

SEQ ID NO: 599693 - DNA, 20 bp, Artificial Sequence
  chemically synthesized
catagaaagaaacataattt

SEQ ID NO: 599694 - DNA, 20 bp, Artificial Sequence
  chemically synthesized
atttaaagaaaactcaaaaa

SEQ ID NO: 599695 - DNA, 20 bp, Artificial Sequence
  chemically synthesized
gtttgataaatttattgatt

SEQ ID NO: 599696 - DNA, 20 bp, Artificial Sequence
  chemically synthesized
gctgcaatgtttgataaatt

SEQ ID NO: 599697 - DNA, 20 bp, Artificial Sequence
  chemically synthesized
ttttttattttgttttgctg

SEQ ID NO: 599698 - DNA, 20 bp, Artificial Sequence
  chemically synthesized
ttgcagcaaaacaaaataaa

SEQ ID NO: 599699 - DNA, 20 bp, Artificial Sequence
  chemically synthesized
ttttcaataaacatttttta

SEQ ID NO: 599700 - DNA, 20 bp, Artificial Sequence
  chemically synthesized
aatataccttatagacacta

SEQ ID NO: 599701 - DNA, 20 bp, Artificial Sequence
  chemically synthesized
atcggaatcattttttaaag

SEQ ID NO: 599702 - DNA, 20 bp, Artificial Sequence
  chemically synthesized
aacttaatcttttctttaaa

SEQ ID NO: 599703 - DNA, 20 bp, Artificial Sequence
  chemically synthesized
gaagacagggcatcctaaca

SEQ ID NO: 599704 - DNA, 20 bp, Artificial Sequence
  chemically synthesized
ctaaaagaaagaacccaaag

SEQ ID NO: 599705 - DNA, 20 bp, Artificial Sequence
  chemically synthesized
catttttaactacatgtaaa

SEQ ID NO: 599706 - DNA, 20 bp, Artificial Sequence
  chemically synthesized
atgtagttaaaaatgaaaac

SEQ ID NO: 599707 - DNA, 20 bp, Artificial Sequence
  chemically synthesized
atgttgggcttatgtaaagc

SEQ ID NO: 599708 - DNA, 20 bp, Artificial Sequence
  chemically synthesized
cttggtaattagtcttaatg

SEQ ID NO: 599709 - DNA, 20 bp, Artificial Sequence
  chemically synthesized
cccaacattaagactaatta

SEQ ID NO: 599710 - DNA, 20 bp, Artificial Sequence
  chemically synthesized
ataggcaaaaaaatcagctg

SEQ ID NO: 599711 - DNA, 20 bp, Artificial Sequence
  chemically synthesized
tgaacacctgaaatccagtc

SEQ ID NO: 599712 - DNA, 20 bp, Artificial Sequence
  chemically synthesized
tgggctaaatgaatgatagt

SEQ ID NO: 599713 - DNA, 20 bp, Artificial Sequence
  chemically synthesized
gacaaaggcagaaatttgca

SEQ ID NO: 599714 - DNA, 20 bp, Artificial Sequence
  chemically synthesized
actccgttcagaaagatatt

SEQ ID NO: 599715 - DNA, 20 bp, Artificial Sequence
  chemically synthesized
tcttggaatatctttctgaa

SEQ ID NO: 599716 - DNA, 20 bp, Artificial Sequence
  chemically synthesized
ttgggtataattaactgagt

SEQ ID NO: 599717 - DNA, 20 bp, Artificial Sequence
  chemically synthesized
gtgatggatttgaacagaaa

SEQ ID NO: 599718 - DNA, 20 bp, Artificial Sequence
  chemically synthesized
ttccccctttgaatggaaat

SEQ ID NO: 599719 - DNA, 20 bp, Artificial Sequence
  chemically synthesized
ggaaagataaaggaaggaag

SEQ ID NO: 599720 - DNA, 20 bp, Artificial Sequence
  chemically synthesized
agataaaggaaggaagaaag

SEQ ID NO: 599721 - DNA, 20 bp, Artificial Sequence
  chemically synthesized
cttagtatcttttaggacaa

SEQ ID NO: 599722 - DNA, 20 bp, Artificial Sequence
  chemically synthesized
gaaaccccagcaaaaagaag

SEQ ID NO: 599723 - DNA, 20 bp, Artificial Sequence
  chemically synthesized
taagcacgtcttctttttgc

SEQ ID NO: 599724 - DNA, 20 bp, Artificial Sequence
  chemically synthesized
ttttgctggggtttcttttt

SEQ ID NO: 599725 - DNA, 20 bp, Artificial Sequence
  chemically synthesized
atgtggtccacattctggtc

SEQ ID NO: 599726 - DNA, 20 bp, Artificial Sequence
  chemically synthesized
cattctggtcaaaagtttcc

SEQ ID NO: 599727 - DNA, 20 bp, Artificial Sequence
  chemically synthesized
agaatttttcctatgttcta

SEQ ID NO: 599728 - DNA, 20 bp, Artificial Sequence
  chemically synthesized
aaatgtttaaaagacaacaa

SEQ ID NO: 599729 - DNA, 20 bp, Artificial Sequence
  chemically synthesized
aagacaacaataaagtttca

SEQ ID NO: 599730 - DNA, 20 bp, Artificial Sequence
  chemically synthesized
aacaataaagtttcattgag

SEQ ID NO: 599731 - DNA, 20 bp, Artificial Sequence
  chemically synthesized
ataagtgaccagtaacaatt

SEQ ID NO: 599732 - DNA, 20 bp, Artificial Sequence
  chemically synthesized
ctcgtgacagagaagggtgt

SEQ ID NO: 599733 - DNA, 20 bp, Artificial Sequence
  chemically synthesized
tgttggtaagagaaaaggct

SEQ ID NO: 599734 - DNA, 20 bp, Artificial Sequence
  chemically synthesized
tagccttttctcttaccaac

SEQ ID NO: 599735 - DNA, 20 bp, Artificial Sequence
  chemically synthesized
tccagttactattcagaaga

SEQ ID NO: 599736 - DNA, 20 bp, Artificial Sequence
  chemically synthesized
aacgtctccttcttgcccaa

SEQ ID NO: 599737 - DNA, 20 bp, Artificial Sequence
  chemically synthesized
gaggtaggagaggccttgaa

SEQ ID NO: 599738 - DNA, 20 bp, Artificial Sequence
  chemically synthesized
tgatactcttcaggtgcacc

SEQ ID NO: 599739 - DNA, 20 bp, Artificial Sequence
  chemically synthesized
cttttcacaggctactcaaa

SEQ ID NO: 599740 - DNA, 20 bp, Artificial Sequence
  chemically synthesized
tcaagtaatgtcttgtagtc

SEQ ID NO: 599741 - DNA, 20 bp, Artificial Sequence
  chemically synthesized
tgtcttgtagtcttaagatt

SEQ ID NO: 599742 - DNA, 20 bp, Artificial Sequence
  chemically synthesized
ttaagatttaatgcttatga

SEQ ID NO: 599743 - DNA, 20 bp, Artificial Sequence
  chemically synthesized
atcatagtaaccatacagaa

SEQ ID NO: 599744 - DNA, 20 bp, Artificial Sequence
  chemically synthesized
aacggctttctgtatggtta

SEQ ID NO: 599745 - DNA, 20 bp, Artificial Sequence
  chemically synthesized
gtatggttactatgattctg

SEQ ID NO: 599746 - DNA, 20 bp, Artificial Sequence
  chemically synthesized
tgattcattaatacatagtt

SEQ ID NO: 599747 - DNA, 20 bp, Artificial Sequence
  chemically synthesized
cagtatatatggtatggttt

SEQ ID NO: 599748 - DNA, 20 bp, Artificial Sequence
  chemically synthesized
tgaagcttcagtatatatgg

SEQ ID NO: 599749 - DNA, 20 bp, Artificial Sequence
  chemically synthesized
gaaaaccataccatatatac

SEQ ID NO: 599750 - DNA, 20 bp, Artificial Sequence
  chemically synthesized
tgttcatagttacccaacaa

SEQ ID NO: 599751 - DNA, 20 bp, Artificial Sequence
  chemically synthesized
aatgaaaaataagacatgaa

SEQ ID NO: 599752 - DNA, 20 bp, Artificial Sequence
  chemically synthesized
tatatttagttgaacaatat

SEQ ID NO: 599753 - DNA, 20 bp, Artificial Sequence
  chemically synthesized
agggcagtttcttatttgtg

SEQ ID NO: 599754 - DNA, 20 bp, Artificial Sequence
  chemically synthesized
atactgtagaattttctaag

SEQ ID NO: 599755 - DNA, 20 bp, Artificial Sequence
  chemically synthesized
gtgctactgtatttctgcag

SEQ ID NO: 599756 - DNA, 20 bp, Artificial Sequence
  chemically synthesized
tggatctttttggcatctgt

SEQ ID NO: 599757 - DNA, 20 bp, Artificial Sequence
  chemically synthesized
attattatgagaatgggttt

SEQ ID NO: 599758 - DNA, 20 bp, Artificial Sequence
  chemically synthesized
ttaaaagcattattatgaga

SEQ ID NO: 599759 - DNA, 20 bp, Artificial Sequence
  chemically synthesized
ttaaaaacccattctcataa

SEQ ID NO: 599760 - DNA, 20 bp, Artificial Sequence
  chemically synthesized
aaatgcataaaacaaaatac

SEQ ID NO: 599761 - DNA, 20 bp, Artificial Sequence
  chemically synthesized
ttcatttaaaatcctatgta

SEQ ID NO: 599762 - DNA, 20 bp, Artificial Sequence
  chemically synthesized
tgcacattgtatttcagtat

SEQ ID NO: 599763 - DNA, 20 bp, Artificial Sequence
  chemically synthesized
aatatttgtgatgtagtaat

SEQ ID NO: 599764 - DNA, 20 bp, Artificial Sequence
  chemically synthesized
gtcatgggtatctctattgc

SEQ ID NO: 599765 - DNA, 20 bp, Artificial Sequence
  chemically synthesized
gctcacattttaactgaaaa

SEQ ID NO: 599766 - DNA, 20 bp, Artificial Sequence
  chemically synthesized
aactgaaaaaactgcttact

SEQ ID NO: 599767 - DNA, 20 bp, Artificial Sequence
  chemically synthesized
ttcaattaaaaccaaaagta

SEQ ID NO: 599768 - DNA, 20 bp, Artificial Sequence
  chemically synthesized
taattgaatacaaataaaga

SEQ ID NO: 599769 - DNA, 20 bp, Artificial Sequence
  chemically synthesized
atagaaataaggtctgtgaa

SEQ ID NO: 599770 - DNA, 20 bp, Artificial Sequence
  chemically synthesized
ggaaatagtggtattctctt

SEQ ID NO: 599771 - DNA, 20 bp, Artificial Sequence
  chemically synthesized
gaataccactatttcctaag

SEQ ID NO: 599772 - DNA, 20 bp, Artificial Sequence
  chemically synthesized
catgttaaatgtgattgttt

SEQ ID NO: 599773 - DNA, 20 bp, Artificial Sequence
  chemically synthesized
tcttttttcatgttaaatgt

SEQ ID NO: 599774 - DNA, 20 bp, Artificial Sequence
  chemically synthesized
tctatcttttttcatgttaa

SEQ ID NO: 599775 - DNA, 20 bp, Artificial Sequence
  chemically synthesized
ggaaaaagtgatcttagtac

SEQ ID NO: 599776 - DNA, 20 bp, Artificial Sequence
  chemically synthesized
gccgtgccatgtaccaggaa

SEQ ID NO: 599777 - DNA, 20 bp, Artificial Sequence
  chemically synthesized
aaggttaacagatacagaga

SEQ ID NO: 599778 - DNA, 20 bp, Artificial Sequence
  chemically synthesized
agacatcagctccactcgca

SEQ ID NO: 599779 - DNA, 20 bp, Artificial Sequence
  chemically synthesized
ttttgttttgctttggcttt

SEQ ID NO: 599780 - DNA, 20 bp, Artificial Sequence
  chemically synthesized
tctcaatgattttgttttgc

SEQ ID NO: 599781 - DNA, 20 bp, Artificial Sequence
  chemically synthesized
gctgtttctcaatgattttg

SEQ ID NO: 599782 - DNA, 20 bp, Artificial Sequence
  chemically synthesized
ttattgctgtttctcaatga

SEQ ID NO: 599783 - DNA, 20 bp, Artificial Sequence
  chemically synthesized
ttcctgttattgctgtttct

SEQ ID NO: 599784 - DNA, 20 bp, Artificial Sequence
  chemically synthesized
tttctccactttcctgttat

SEQ ID NO: 599785 - DNA, 20 bp, Artificial Sequence
  chemically synthesized
ctgctccttgtgtgtttatt

SEQ ID NO: 599786 - DNA, 20 bp, Artificial Sequence
  chemically synthesized
gcattacagagctgctcctt

SEQ ID NO: 599787 - DNA, 20 bp, Artificial Sequence
  chemically synthesized
accaaaacagaaagtatgag

SEQ ID NO: 599788 - DNA, 20 bp, Artificial Sequence
  chemically synthesized
tcgaaatcacttctcatact

SEQ ID NO: 599789 - DNA, 20 bp, Artificial Sequence
  chemically synthesized
tcacttctcatactttctgt

SEQ ID NO: 599790 - DNA, 20 bp, Artificial Sequence
  chemically synthesized
attgtttcctcatttatttc

SEQ ID NO: 599791 - DNA, 20 bp, Artificial Sequence
  chemically synthesized
cttgcataaaaatttttata

SEQ ID NO: 599792 - DNA, 20 bp, Artificial Sequence
  chemically synthesized
atttttatgcaagacaaaaa

SEQ ID NO: 599793 - DNA, 20 bp, Artificial Sequence
  chemically synthesized
atatcttagaattgaagaaa

SEQ ID NO: 599794 - DNA, 20 bp, Artificial Sequence
  chemically synthesized
ctgtttcttcaattctaaga

SEQ ID NO: 599795 - DNA, 20 bp, Artificial Sequence
  chemically synthesized
attaagtaccttaatttcag

SEQ ID NO: 599796 - DNA, 20 bp, Artificial Sequence
  chemically synthesized
gtgctatttgttgcacacag

SEQ ID NO: 599797 - DNA, 20 bp, Artificial Sequence
  chemically synthesized
ttacgattgataaatgaaga

SEQ ID NO: 599798 - DNA, 20 bp, Artificial Sequence
  chemically synthesized
aataggagctcaggcaacac

SEQ ID NO: 599799 - DNA, 20 bp, Artificial Sequence
  chemically synthesized
aatatattgaggagaattac

SEQ ID NO: 599800 - DNA, 20 bp, Artificial Sequence
  chemically synthesized
aattctcctcaatatattct

SEQ ID NO: 599801 - DNA, 20 bp, Artificial Sequence
  chemically synthesized
ttgggtagatacagaccctt

SEQ ID NO: 599802 - DNA, 20 bp, Artificial Sequence
  chemically synthesized
taacttcagagtagacatag

SEQ ID NO: 599803 - DNA, 20 bp, Artificial Sequence
  chemically synthesized
ttgaaggatggggacttctc

SEQ ID NO: 599804 - DNA, 20 bp, Artificial Sequence
  chemically synthesized
tgacaaactcatacttggat

SEQ ID NO: 599805 - DNA, 20 bp, Artificial Sequence
  chemically synthesized
tcaaaaacttatatccaagt

SEQ ID NO: 599806 - DNA, 20 bp, Artificial Sequence
  chemically synthesized
gtctactggcatctcgctgt

SEQ ID NO: 599807 - DNA, 20 bp, Artificial Sequence
  chemically synthesized
aaggtaacccttcacaaagt

SEQ ID NO: 599808 - DNA, 20 bp, Artificial Sequence
  chemically synthesized
aagttgaagcttaatttata

SEQ ID NO: 599809 - DNA, 20 bp, Artificial Sequence
  chemically synthesized
attagtaatccaaatataaa

SEQ ID NO: 599810 - DNA, 20 bp, Artificial Sequence
  chemically synthesized
atgtaaaaagttattgtgta

SEQ ID NO: 599811 - DNA, 20 bp, Artificial Sequence
  chemically synthesized
aaagttattgtgtacataga

SEQ ID NO: 599812 - DNA, 20 bp, Artificial Sequence
  chemically synthesized
aattccattgcctttaattg

SEQ ID NO: 599813 - DNA, 20 bp, Artificial Sequence
  chemically synthesized
caaaacttttgtgatctctt

SEQ ID NO: 599814 - DNA, 20 bp, Artificial Sequence
  chemically synthesized
caaaactcagaagagatcac

SEQ ID NO: 599815 - DNA, 20 bp, Artificial Sequence
  chemically synthesized
ttggccagatgttgacacat

SEQ ID NO: 599816 - DNA, 20 bp, Artificial Sequence
  chemically synthesized
atcaactgaacatcactgga

SEQ ID NO: 599817 - DNA, 20 bp, Artificial Sequence
  chemically synthesized
tggtgataaattgaacatct

SEQ ID NO: 599818 - DNA, 20 bp, Artificial Sequence
  chemically synthesized
gaaaaaagcagtgatatgat

SEQ ID NO: 599819 - DNA, 20 bp, Artificial Sequence
  chemically synthesized
gttataaaccaccatcatat

SEQ ID NO: 599820 - DNA, 20 bp, Artificial Sequence
  chemically synthesized
ttataactgctaatggtcaa

SEQ ID NO: 599821 - DNA, 20 bp, Artificial Sequence
  chemically synthesized
tattgttgaatagcatacat

SEQ ID NO: 599822 - DNA, 20 bp, Artificial Sequence
  chemically synthesized
tattcaatcatttgtataca

SEQ ID NO: 599823 - DNA, 20 bp, Artificial Sequence
  chemically synthesized
acccaaaacagcatgtatac

SEQ ID NO: 599824 - DNA, 20 bp, Artificial Sequence
  chemically synthesized
gccttaaatttttccctcaa

SEQ ID NO: 599825 - DNA, 20 bp, Artificial Sequence
  chemically synthesized
tcttatttcttaagtcatat

SEQ ID NO: 599826 - DNA, 20 bp, Artificial Sequence
  chemically synthesized
cttagcctttaaatactatg

SEQ ID NO: 599827 - DNA, 20 bp, Artificial Sequence
  chemically synthesized
gcctttaaatactatgctga

SEQ ID NO: 599828 - DNA, 20 bp, Artificial Sequence
  chemically synthesized
catgattagagtgaggtttg

SEQ ID NO: 599829 - DNA, 20 bp, Artificial Sequence
  chemically synthesized
cactgtaggcatgattagag

SEQ ID NO: 599830 - DNA, 20 bp, Artificial Sequence
  chemically synthesized
cctctgcagctacactgtag

SEQ ID NO: 599831 - DNA, 20 bp, Artificial Sequence
  chemically synthesized
cctacagtgtagctgcagag

SEQ ID NO: 599832 - DNA, 20 bp, Artificial Sequence
  chemically synthesized
atcaaattgttttattgcat

SEQ ID NO: 599833 - DNA, 20 bp, Artificial Sequence
  chemically synthesized
ttttttctagtatgatatca

SEQ ID NO: 599834 - DNA, 20 bp, Artificial Sequence
  chemically synthesized
tcatctgtttccaaaaaaaa

SEQ ID NO: 599835 - DNA, 20 bp, Artificial Sequence
  chemically synthesized
gcttattccagccatggctc

SEQ ID NO: 599836 - DNA, 20 bp, Artificial Sequence
  chemically synthesized
cacctttcccttgtagtcat

SEQ ID NO: 599837 - DNA, 20 bp, Artificial Sequence
  chemically synthesized
tgaaggcggagtgtgcatgg

SEQ ID NO: 599838 - DNA, 20 bp, Artificial Sequence
  chemically synthesized
gcggagtgtgcatgggatgg

SEQ ID NO: 599839 - DNA, 20 bp, Artificial Sequence
  chemically synthesized
ttctaactttcataccttct

SEQ ID NO: 599840 - DNA, 20 bp, Artificial Sequence
  chemically synthesized
aacctcatcaaatgtattct

SEQ ID NO: 599841 - DNA, 20 bp, Artificial Sequence
  chemically synthesized
gaaccattttctctggctct

SEQ ID NO: 599842 - DNA, 20 bp, Artificial Sequence
  chemically synthesized
aggaaatgccatatcttttc

SEQ ID NO: 599843 - DNA, 20 bp, Artificial Sequence
  chemically synthesized
atttcctccttttcaaaagc

SEQ ID NO: 599844 - DNA, 20 bp, Artificial Sequence
  chemically synthesized
aggcatgtatgctgagaatc

SEQ ID NO: 599845 - DNA, 20 bp, Artificial Sequence
  chemically synthesized
taaattataactcagacact

SEQ ID NO: 599846 - DNA, 20 bp, Artificial Sequence
  chemically synthesized
ggtttttcagtcatgtagta

SEQ ID NO: 599847 - DNA, 20 bp, Artificial Sequence
  chemically synthesized
agtaatgtgattgctgctag

SEQ ID NO: 599848 - DNA, 20 bp, Artificial Sequence
  chemically synthesized
attttagggctgaagaaaaa

SEQ ID NO: 599849 - DNA, 20 bp, Artificial Sequence
  chemically synthesized
ttaaaactgagtgtacacaa

SEQ ID NO: 599850 - DNA, 20 bp, Artificial Sequence
  chemically synthesized
aaaaagcaagattgtgtaca

SEQ ID NO: 599851 - DNA, 20 bp, Artificial Sequence
  chemically synthesized
cagttttaacttgacctatg

SEQ ID NO: 599852 - DNA, 20 bp, Artificial Sequence
  chemically synthesized
atgattgtaagtccaccttc

SEQ ID NO: 599853 - DNA, 20 bp, Artificial Sequence
  chemically synthesized
aaaacccttagtgccaagta

SEQ ID NO: 599854 - DNA, 20 bp, Artificial Sequence
  chemically synthesized
caaactatatacttggcact

SEQ ID NO: 599855 - DNA, 20 bp, Artificial Sequence
  chemically synthesized
ttgtgagaatttatagttta

SEQ ID NO: 599856 - DNA, 20 bp, Artificial Sequence
  chemically synthesized
tgttagacattgtgagaatt

SEQ ID NO: 599857 - DNA, 20 bp, Artificial Sequence
  chemically synthesized
caaatactaagcactaactt

SEQ ID NO: 599858 - DNA, 20 bp, Artificial Sequence
  chemically synthesized
ttgtttgaaatcatggaagt

SEQ ID NO: 599859 - DNA, 20 bp, Artificial Sequence
  chemically synthesized
ggctaagaagtagacagcaa

SEQ ID NO: 599860 - DNA, 20 bp, Artificial Sequence
  chemically synthesized
tgggaaggatgaagaataca

SEQ ID NO: 599861 - DNA, 20 bp, Artificial Sequence
  chemically synthesized
ttccccatatctacaagtat

SEQ ID NO: 599862 - DNA, 20 bp, Artificial Sequence
  chemically synthesized
aatcagcagagaccaatgga

SEQ ID NO: 599863 - DNA, 20 bp, Artificial Sequence
  chemically synthesized
aaaccttctccattggtctc

SEQ ID NO: 599864 - DNA, 20 bp, Artificial Sequence
  chemically synthesized
aaaggtgttcctataggacc

SEQ ID NO: 599865 - DNA, 20 bp, Artificial Sequence
  chemically synthesized
atttctttacccctgaaggg

SEQ ID NO: 599866 - DNA, 20 bp, Artificial Sequence
  chemically synthesized
tccacccatttcgtattttc

SEQ ID NO: 599867 - DNA, 20 bp, Artificial Sequence
  chemically synthesized
acaagttttccagtaccttc

SEQ ID NO: 599868 - DNA, 20 bp, Artificial Sequence
  chemically synthesized
gagactcttaagataataaa

SEQ ID NO: 599869 - DNA, 20 bp, Artificial Sequence
  chemically synthesized
cttaagagtctcctgttctc

SEQ ID NO: 599870 - DNA, 20 bp, Artificial Sequence
  chemically synthesized
acgtaggtaaataaatgtgg

SEQ ID NO: 599871 - DNA, 20 bp, Artificial Sequence
  chemically synthesized
gtaccttaacatcatttcct

SEQ ID NO: 599872 - DNA, 20 bp, Artificial Sequence
  chemically synthesized
cttctcaagatgccttttat

SEQ ID NO: 599873 - DNA, 20 bp, Artificial Sequence
  chemically synthesized
gatgtgcatttgtcacattt

SEQ ID NO: 599874 - DNA, 20 bp, Artificial Sequence
  chemically synthesized
attgagatgtaacatacaat

SEQ ID NO: 599875 - DNA, 20 bp, Artificial Sequence
  chemically synthesized
aaggtttaccttgaaagtgg

SEQ ID NO: 599876 - DNA, 20 bp, Artificial Sequence
  chemically synthesized
gattgtgtgatgcaccattg

SEQ ID NO: 599877 - DNA, 20 bp, Artificial Sequence
  chemically synthesized
tttcctcatgtttaagacat

SEQ ID NO: 599878 - DNA, 20 bp, Artificial Sequence
  chemically synthesized
gcaattagcatctcatttcc

SEQ ID NO: 599879 - DNA, 20 bp, Artificial Sequence
  chemically synthesized
acatgaggaaatgagatgct

SEQ ID NO: 599880 - DNA, 20 bp, Artificial Sequence
  chemically synthesized
aaaattactctatcatggct

SEQ ID NO: 599881 - DNA, 20 bp, Artificial Sequence
  chemically synthesized
aagaacataaagcattaaat

SEQ ID NO: 599882 - DNA, 20 bp, Artificial Sequence
  chemically synthesized
ttgctatagaatccactatt

SEQ ID NO: 599883 - DNA, 20 bp, Artificial Sequence
  chemically synthesized
ttgactttttaataacactg

SEQ ID NO: 599884 - DNA, 20 bp, Artificial Sequence
  chemically synthesized
tgttatttctgttcagttca

SEQ ID NO: 599885 - DNA, 20 bp, Artificial Sequence
  chemically synthesized
tgttctattttctaagtaac

SEQ ID NO: 599886 - DNA, 20 bp, Artificial Sequence
  chemically synthesized
aaagagatctggtttctggt

SEQ ID NO: 599887 - DNA, 20 bp, Artificial Sequence
  chemically synthesized
gatttcacagtttaaagaga

SEQ ID NO: 599888 - DNA, 20 bp, Artificial Sequence
  chemically synthesized
tttttataacagtaagattt

SEQ ID NO: 599889 - DNA, 20 bp, Artificial Sequence
  chemically synthesized
tatatatattttttataaca

SEQ ID NO: 599890 - DNA, 20 bp, Artificial Sequence
  chemically synthesized
ctgaatttaggctctcgtca

SEQ ID NO: 599891 - DNA, 20 bp, Artificial Sequence
  chemically synthesized
ggatcttgtatcacattatc

SEQ ID NO: 599892 - DNA, 20 bp, Artificial Sequence
  chemically synthesized
ttggggcccacttccagaga

SEQ ID NO: 599893 - DNA, 20 bp, Artificial Sequence
  chemically synthesized
caatgtttggggcccacttc

SEQ ID NO: 599894 - DNA, 20 bp, Artificial Sequence
  chemically synthesized
gagaaacttgaaaagtatcc

SEQ ID NO: 599895 - DNA, 20 bp, Artificial Sequence
  chemically synthesized
cccaaacattgggatacttt

SEQ ID NO: 599896 - DNA, 20 bp, Artificial Sequence
  chemically synthesized
ggatacttttcaagtttctc

SEQ ID NO: 599897 - DNA, 20 bp, Artificial Sequence
  chemically synthesized
aatgcatctttctgtttgcc

SEQ ID NO: 599898 - DNA, 20 bp, Artificial Sequence
  chemically synthesized
taaaaactcagaatgcatct

SEQ ID NO: 599899 - DNA, 20 bp, Artificial Sequence
  chemically synthesized
ggcaaacagaaagatgcatt

SEQ ID NO: 599900 - DNA, 20 bp, Artificial Sequence
  chemically synthesized
cattggttgctcaattatcc

SEQ ID NO: 599901 - DNA, 20 bp, Artificial Sequence
  chemically synthesized
ccaaaggataattgagcaac

SEQ ID NO: 599902 - DNA, 20 bp, Artificial Sequence
  chemically synthesized
tgaggttaaatattataaaa

SEQ ID NO: 599903 - DNA, 20 bp, Artificial Sequence
  chemically synthesized
tttcacgtttattttggaaa

SEQ ID NO: 599904 - DNA, 20 bp, Artificial Sequence
  chemically synthesized
ttaacaaattaccgtgtttt

SEQ ID NO: 599905 - DNA, 20 bp, Artificial Sequence
  chemically synthesized
gccacttgtttaacaaatta

SEQ ID NO: 599906 - DNA, 20 bp, Artificial Sequence
  chemically synthesized
taatctatgtctaaatagcc

SEQ ID NO: 599907 - DNA, 20 bp, Artificial Sequence
  chemically synthesized
taaacaagtggctatttaga

SEQ ID NO: 599908 - DNA, 20 bp, Artificial Sequence
  chemically synthesized
ttaataccatttgtgtgcgt

SEQ ID NO: 599909 - DNA, 20 bp, Artificial Sequence
  chemically synthesized
tatagtatgttcatcctacc

SEQ ID NO: 599910 - DNA, 20 bp, Artificial Sequence
  chemically synthesized
ctgaaagttcaaatggtaga

SEQ ID NO: 599911 - DNA, 20 bp, Artificial Sequence
  chemically synthesized
agatgacaccatggatattt

SEQ ID NO: 599912 - DNA, 20 bp, Artificial Sequence
  chemically synthesized
tttaactgagttggaatctt

SEQ ID NO: 599913 - DNA, 20 bp, Artificial Sequence
  chemically synthesized
tctaattttgttttaagcat

SEQ ID NO: 599914 - DNA, 20 bp, Artificial Sequence
  chemically synthesized
cactaacattttatttctaa

SEQ ID NO: 599915 - DNA, 20 bp, Artificial Sequence
  chemically synthesized
caaaattagaaataaaatgt

SEQ ID NO: 599916 - DNA, 20 bp, Artificial Sequence
  chemically synthesized
gtgattaaatcagaaaatca

SEQ ID NO: 599917 - DNA, 20 bp, Artificial Sequence
  chemically synthesized
aaagtctaatctatatgatt

SEQ ID NO: 599918 - DNA, 20 bp, Artificial Sequence
  chemically synthesized
gctttgacaaagtctaatct

SEQ ID NO: 599919 - DNA, 20 bp, Artificial Sequence
  chemically synthesized
tcatatagattagactttgt

SEQ ID NO: 599920 - DNA, 20 bp, Artificial Sequence
  chemically synthesized
gatcattatgtttgggaaat

SEQ ID NO: 599921 - DNA, 20 bp, Artificial Sequence
  chemically synthesized
gtttacttccctgaagatca

SEQ ID NO: 599922 - DNA, 20 bp, Artificial Sequence
  chemically synthesized
aaatatgtatgtgattaatt

SEQ ID NO: 599923 - DNA, 20 bp, Artificial Sequence
  chemically synthesized
ccataggaaagtaaatatgt

SEQ ID NO: 599924 - DNA, 20 bp, Artificial Sequence
  chemically synthesized
acatatttactttcctatgg

SEQ ID NO: 599925 - DNA, 20 bp, Artificial Sequence
  chemically synthesized
aacatcccattactggccaa

SEQ ID NO: 599926 - DNA, 20 bp, Artificial Sequence
  chemically synthesized
tattggccagtaatgggatg

SEQ ID NO: 599927 - DNA, 20 bp, Artificial Sequence
  chemically synthesized
ggccagtaatgggatgttca

SEQ ID NO: 599928 - DNA, 20 bp, Artificial Sequence
  chemically synthesized
ttgttagtatcttaatatca

SEQ ID NO: 599929 - DNA, 20 bp, Artificial Sequence
  chemically synthesized
ttgtgattttagatttcaaa

SEQ ID NO: 599930 - DNA, 20 bp, Artificial Sequence
  chemically synthesized
tctgtccccactgttgtgat

SEQ ID NO: 599931 - DNA, 20 bp, Artificial Sequence
  chemically synthesized
tctgtagtctgtccccactg

SEQ ID NO: 599932 - DNA, 20 bp, Artificial Sequence
  chemically synthesized
gtagtaggtgatagatacac

SEQ ID NO: 599933 - DNA, 20 bp, Artificial Sequence
  chemically synthesized
ttctgcacttgaaatttagc

SEQ ID NO: 599934 - DNA, 20 bp, Artificial Sequence
  chemically synthesized
gcacttgaaatttagccatg

SEQ ID NO: 599935 - DNA, 20 bp, Artificial Sequence
  chemically synthesized
aaatttagccatggtttgtt

SEQ ID NO: 599936 - DNA, 20 bp, Artificial Sequence
  chemically synthesized
tttcatgcttattgtgaata

SEQ ID NO: 599937 - DNA, 20 bp, Artificial Sequence
  chemically synthesized
ataagtagctttttgttatt

SEQ ID NO: 599938 - DNA, 20 bp, Artificial Sequence
  chemically synthesized
tagctttttgttattttaag

SEQ ID NO: 599939 - DNA, 20 bp, Artificial Sequence
  chemically synthesized
tctagtaattttaaagtaat

SEQ ID NO: 599940 - DNA, 20 bp, Artificial Sequence
  chemically synthesized
gtaatactatgcctgatttc

SEQ ID NO: 599941 - DNA, 20 bp, Artificial Sequence
  chemically synthesized
gttgaaatcaggcatagtat

SEQ ID NO: 599942 - DNA, 20 bp, Artificial Sequence
  chemically synthesized
tagcaaaactgtaatactat

SEQ ID NO: 599943 - DNA, 20 bp, Artificial Sequence
  chemically synthesized
ataatcacctgatcaaatgt

SEQ ID NO: 599944 - DNA, 20 bp, Artificial Sequence
  chemically synthesized
taaaacgggaacatttgatc

SEQ ID NO: 599945 - DNA, 20 bp, Artificial Sequence
  chemically synthesized
acatttgatcaggtgattat

SEQ ID NO: 599946 - DNA, 20 bp, Artificial Sequence
  chemically synthesized
tgatttacatttaaaattgt

SEQ ID NO: 599947 - DNA, 20 bp, Artificial Sequence
  chemically synthesized
ttcttgagagaagagaaaaa

SEQ ID NO: 599948 - DNA, 20 bp, Artificial Sequence
  chemically synthesized
catttttctcttctctcaag

SEQ ID NO: 599949 - DNA, 20 bp, Artificial Sequence
  chemically synthesized
tgcaactcttaatttgcaag

SEQ ID NO: 599950 - DNA, 20 bp, Artificial Sequence
  chemically synthesized
ataggacatactcatgaaat

SEQ ID NO: 599951 - DNA, 20 bp, Artificial Sequence
  chemically synthesized
actggaactgcacaagttcc

SEQ ID NO: 599952 - DNA, 20 bp, Artificial Sequence
  chemically synthesized
caggagattactagcacctg

SEQ ID NO: 599953 - DNA, 20 bp, Artificial Sequence
  chemically synthesized
ttcaggtgctagtaatctcc

SEQ ID NO: 599954 - DNA, 20 bp, Artificial Sequence
  chemically synthesized
gaaatggcaaggcaatctac

SEQ ID NO: 599955 - DNA, 20 bp, Artificial Sequence
  chemically synthesized
catctctattctacagctat

SEQ ID NO: 599956 - DNA, 20 bp, Artificial Sequence
  chemically synthesized
tgtctggaccatgcagctag

SEQ ID NO: 599957 - DNA, 20 bp, Artificial Sequence
  chemically synthesized
taaagagggtaaaattaatg

SEQ ID NO: 599958 - DNA, 20 bp, Artificial Sequence
  chemically synthesized
ttttaccctctttaatacta

SEQ ID NO: 599959 - DNA, 20 bp, Artificial Sequence
  chemically synthesized
agaatattaacaaatgagat

SEQ ID NO: 599960 - DNA, 20 bp, Artificial Sequence
  chemically synthesized
ctcatttgttaatattctca

SEQ ID NO: 599961 - DNA, 20 bp, Artificial Sequence
  chemically synthesized
tatattttaaaagtattcca

SEQ ID NO: 599962 - DNA, 20 bp, Artificial Sequence
  chemically synthesized
tgtgtccccttaccctgtga

SEQ ID NO: 599963 - DNA, 20 bp, Artificial Sequence
  chemically synthesized
cacagggtaaggggacacag

SEQ ID NO: 599964 - DNA, 20 bp, Artificial Sequence
  chemically synthesized
agtagtgaggatgtggtcag

SEQ ID NO: 599965 - DNA, 20 bp, Artificial Sequence
  chemically synthesized
gtggtgcgtgacacaattta

SEQ ID NO: 599966 - DNA, 20 bp, Artificial Sequence
  chemically synthesized
gggctatgcattctagtatc

SEQ ID NO: 599967 - DNA, 20 bp, Artificial Sequence
  chemically synthesized
tcctaaatagaatgattcat

SEQ ID NO: 599968 - DNA, 20 bp, Artificial Sequence
  chemically synthesized
gaattggtctttcctaaata

SEQ ID NO: 599969 - DNA, 20 bp, Artificial Sequence
  chemically synthesized
cttcttcttgaatgagtatc

SEQ ID NO: 599970 - DNA, 20 bp, Artificial Sequence
  chemically synthesized
aattctatggtcaaacaggg

SEQ ID NO: 599971 - DNA, 20 bp, Artificial Sequence
  chemically synthesized
aagctaatatagaagcagca

SEQ ID NO: 599972 - DNA, 20 bp, Artificial Sequence
  chemically synthesized
aaacagggtgctgcttctat

SEQ ID NO: 599973 - DNA, 20 bp, Artificial Sequence
  chemically synthesized
tattagctttcctctagttc

SEQ ID NO: 599974 - DNA, 20 bp, Artificial Sequence
  chemically synthesized
atggccacatagtagttgtt

SEQ ID NO: 599975 - DNA, 20 bp, Artificial Sequence
  chemically synthesized
ctgtcacaattactcaactc

SEQ ID NO: 599976 - DNA, 20 bp, Artificial Sequence
  chemically synthesized
tatatttgtttattttttct

SEQ ID NO: 599977 - DNA, 20 bp, Artificial Sequence
  chemically synthesized
attgaagtgtatcaatttat

SEQ ID NO: 599978 - DNA, 20 bp, Artificial Sequence
  chemically synthesized
cctgaagtatctagttcttc

SEQ ID NO: 599979 - DNA, 20 bp, Artificial Sequence
  chemically synthesized
tgtacagcccatgggctgaa

SEQ ID NO: 599980 - DNA, 20 bp, Artificial Sequence
  chemically synthesized
tgtacaaaagaaggtggctg

SEQ ID NO: 599981 - DNA, 20 bp, Artificial Sequence
  chemically synthesized
aatggattaggcctaccaat

SEQ ID NO: 599982 - DNA, 20 bp, Artificial Sequence
  chemically synthesized
tatcaattctagccaacttc

SEQ ID NO: 599983 - DNA, 20 bp, Artificial Sequence
  chemically synthesized
tgggtccaggatcctcaata

SEQ ID NO: 599984 - DNA, 20 bp, Artificial Sequence
  chemically synthesized
ttgtaatagtcattcactcc

SEQ ID NO: 599985 - DNA, 20 bp, Artificial Sequence
  chemically synthesized
tgattgctttcatagggtga

SEQ ID NO: 599986 - DNA, 20 bp, Artificial Sequence
  chemically synthesized
gtcagaaaataacggatgtt

SEQ ID NO: 599987 - DNA, 20 bp, Artificial Sequence
  chemically synthesized
aaaagtcagaaaataacgga

SEQ ID NO: 599988 - DNA, 20 bp, Artificial Sequence
  chemically synthesized
taccatctcacaccagtctg

SEQ ID NO: 599989 - DNA, 20 bp, Artificial Sequence
  chemically synthesized
gtgtgagatggtatcttatt

SEQ ID NO: 599990 - DNA, 20 bp, Artificial Sequence
  chemically synthesized
gggtttaattggcatctctc

SEQ ID NO: 599991 - DNA, 20 bp, Artificial Sequence
  chemically synthesized
tctctgatgattagtgatat

SEQ ID NO: 599992 - DNA, 20 bp, Artificial Sequence
  chemically synthesized
gattttttaatatgctcatt

SEQ ID NO: 599993 - DNA, 20 bp, Artificial Sequence
  chemically synthesized
gtgtctattcacgttctttg

SEQ ID NO: 599994 - DNA, 20 bp, Artificial Sequence
  chemically synthesized
cgttctttgtcctgttttta

SEQ ID NO: 599995 - DNA, 20 bp, Artificial Sequence
  chemically synthesized
tcaacaagaaattaaaaaaa

SEQ ID NO: 599996 - DNA, 20 bp, Artificial Sequence
  chemically synthesized
ttttttttaatttcttgttg

SEQ ID NO: 599997 - DNA, 20 bp, Artificial Sequence
  chemically synthesized
gttgacaagtttaagttcct

SEQ ID NO: 599998 - DNA, 20 bp, Artificial Sequence
  chemically synthesized
tattattcttttgtcagatg

SEQ ID NO: 599999 - DNA, 20 bp, Artificial Sequence
  chemically synthesized
tttctcccattcaggaggtt

SEQ ID NO: 600000 - DNA, 20 bp, Artificial Sequence
  chemically synthesized
aggaggttatctgtttactg

SEQ ID NO: 600001 - DNA, 20 bp, Artificial Sequence
  chemically synthesized
ggttatctgtttactgtgtt

SEQ ID NO: 600002 - DNA, 20 bp, Artificial Sequence
  chemically synthesized
gattgtttctttttctgtac

SEQ ID NO: 600003 - DNA, 20 bp, Artificial Sequence
  chemically synthesized
caaatgagagttaattaaat

SEQ ID NO: 600004 - DNA, 20 bp, Artificial Sequence
  chemically synthesized
attaactctcatttgtcaat

SEQ ID NO: 600005 - DNA, 20 bp, Artificial Sequence
  chemically synthesized
taggaaaagttcttctggac

SEQ ID NO: 600006 - DNA, 20 bp, Artificial Sequence
  chemically synthesized
agtgtccagaagaacttttc

SEQ ID NO: 600007 - DNA, 20 bp, Artificial Sequence
  chemically synthesized
aacttttcctaggttttatt

SEQ ID NO: 600008 - DNA, 20 bp, Artificial Sequence
  chemically synthesized
ggttttattctaggattttt

SEQ ID NO: 600009 - DNA, 20 bp, Artificial Sequence
  chemically synthesized
tctaggatttttagtagttt

SEQ ID NO: 600010 - DNA, 20 bp, Artificial Sequence
  chemically synthesized
atatacaaaaattaactcaa

SEQ ID NO: 600011 - DNA, 20 bp, Artificial Sequence
  chemically synthesized
tgaataaggtgtcccttctc

SEQ ID NO: 600012 - DNA, 20 bp, Artificial Sequence
  chemically synthesized
aaagctgcacacctacaacc

SEQ ID NO: 600013 - DNA, 20 bp, Artificial Sequence
  chemically synthesized
aaatcagttggttgtaggtg

SEQ ID NO: 600014 - DNA, 20 bp, Artificial Sequence
  chemically synthesized
ctatatctgtaatagtatta

SEQ ID NO: 600015 - DNA, 20 bp, Artificial Sequence
  chemically synthesized
tattatgctgtttgcgttac

SEQ ID NO: 600016 - DNA, 20 bp, Artificial Sequence
  chemically synthesized
aatgccctcaactttgttct

SEQ ID NO: 600017 - DNA, 20 bp, Artificial Sequence
  chemically synthesized
ctcaactttgttcttttggc

SEQ ID NO: 600018 - DNA, 20 bp, Artificial Sequence
  chemically synthesized
actttgttcttttggcttag

SEQ ID NO: 600019 - DNA, 20 bp, Artificial Sequence
  chemically synthesized
tagattcaggggttacatgt

SEQ ID NO: 600020 - DNA, 20 bp, Artificial Sequence
  chemically synthesized
tactttctttttaaaattac

SEQ ID NO: 600021 - DNA, 20 bp, Artificial Sequence
  chemically synthesized
tccatatccctttctctgtt

SEQ ID NO: 600022 - DNA, 20 bp, Artificial Sequence
  chemically synthesized
aaaaagctccatatcccttt

SEQ ID NO: 600023 - DNA, 20 bp, Artificial Sequence
  chemically synthesized
gagaaacagagaaagggata

SEQ ID NO: 600024 - DNA, 20 bp, Artificial Sequence
  chemically synthesized
aagggatatggagctttttg

SEQ ID NO: 600025 - DNA, 20 bp, Artificial Sequence
  chemically synthesized
tggagctttttgcacagttt

SEQ ID NO: 600026 - DNA, 20 bp, Artificial Sequence
  chemically synthesized
tacagatctgtcctctctaa

SEQ ID NO: 600027 - DNA, 20 bp, Artificial Sequence
  chemically synthesized
caaaagttagcctgtgtatg

SEQ ID NO: 600028 - DNA, 20 bp, Artificial Sequence
  chemically synthesized
tttgatgaaaattctcagtt

SEQ ID NO: 600029 - DNA, 20 bp, Artificial Sequence
  chemically synthesized
tgcgctattcattcccttga

SEQ ID NO: 600030 - DNA, 20 bp, Artificial Sequence
  chemically synthesized
catgatcgacagattcttat

SEQ ID NO: 600031 - DNA, 20 bp, Artificial Sequence
  chemically synthesized
cattgataagaatctgtcga

SEQ ID NO: 600032 - DNA, 20 bp, Artificial Sequence
  chemically synthesized
atctacattgaagcatgatc

SEQ ID NO: 600033 - DNA, 20 bp, Artificial Sequence
  chemically synthesized
gtttttaaagaggatgtttc

SEQ ID NO: 600034 - DNA, 20 bp, Artificial Sequence
  chemically synthesized
gtctttccagtttttaaaga

SEQ ID NO: 600035 - DNA, 20 bp, Artificial Sequence
  chemically synthesized
tgaataaggaacattgtctt

SEQ ID NO: 600036 - DNA, 20 bp, Artificial Sequence
  chemically synthesized
gagcaacaggacaggaacct

SEQ ID NO: 600037 - DNA, 20 bp, Artificial Sequence
  chemically synthesized
gcattggccaaagattctcc

SEQ ID NO: 600038 - DNA, 20 bp, Artificial Sequence
  chemically synthesized
tcagcaggagaatctttggc

SEQ ID NO: 600039 - DNA, 20 bp, Artificial Sequence
  chemically synthesized
cggtttgcctaagcattggc

SEQ ID NO: 600040 - DNA, 20 bp, Artificial Sequence
  chemically synthesized
aagagcatggccactgttca

SEQ ID NO: 600041 - DNA, 20 bp, Artificial Sequence
  chemically synthesized
acacccacttcgtgagtatt

SEQ ID NO: 600042 - DNA, 20 bp, Artificial Sequence
  chemically synthesized
actagccaggttctgtaaga

SEQ ID NO: 600043 - DNA, 20 bp, Artificial Sequence
  chemically synthesized
atcttacagaacctggctag

SEQ ID NO: 600044 - DNA, 20 bp, Artificial Sequence
  chemically synthesized
caaaaggaaaaatcccaagc

SEQ ID NO: 600045 - DNA, 20 bp, Artificial Sequence
  chemically synthesized
aaacatacaaaagcaaatgc

SEQ ID NO: 600046 - DNA, 20 bp, Artificial Sequence
  chemically synthesized
aatcccaagcatttgctttt

SEQ ID NO: 600047 - DNA, 20 bp, Artificial Sequence
  chemically synthesized
ataagaaaacatacaaaagc

SEQ ID NO: 600048 - DNA, 20 bp, Artificial Sequence
  chemically synthesized
atgttttcttatgttcttat

SEQ ID NO: 600049 - DNA, 20 bp, Artificial Sequence
  chemically synthesized
atgagttatgcatacagaag

SEQ ID NO: 600050 - DNA, 20 bp, Artificial Sequence
  chemically synthesized
gagatagctcttgttctgta

SEQ ID NO: 600051 - DNA, 20 bp, Artificial Sequence
  chemically synthesized
atattaattcccaaacatct

SEQ ID NO: 600052 - DNA, 20 bp, Artificial Sequence
  chemically synthesized
aatatatagtaaaagcagaa

SEQ ID NO: 600053 - DNA, 20 bp, Artificial Sequence
  chemically synthesized
gtaacacactgcaacattta

SEQ ID NO: 600054 - DNA, 20 bp, Artificial Sequence
  chemically synthesized
caattttactatatttctca

SEQ ID NO: 600055 - DNA, 20 bp, Artificial Sequence
  chemically synthesized
tttactatatttctcaagaa

SEQ ID NO: 600056 - DNA, 20 bp, Artificial Sequence
  chemically synthesized
tgaaagagatgttataaaaa

SEQ ID NO: 600057 - DNA, 20 bp, Artificial Sequence
  chemically synthesized
gatttttataacatctcttt

SEQ ID NO: 600058 - DNA, 20 bp, Artificial Sequence
  chemically synthesized
ggcttagggggcaattcacc

SEQ ID NO: 600059 - DNA, 20 bp, Artificial Sequence
  chemically synthesized
aattgccccctaagcctatg

SEQ ID NO: 600060 - DNA, 20 bp, Artificial Sequence
  chemically synthesized
atgttctttataaacttggc

SEQ ID NO: 600061 - DNA, 20 bp, Artificial Sequence
  chemically synthesized
gagtcaccacacccggccag

SEQ ID NO: 600062 - DNA, 20 bp, Artificial Sequence
  chemically synthesized
tgcctcggcctcccaaagtg

SEQ ID NO: 600063 - DNA, 20 bp, Artificial Sequence
  chemically synthesized
ttttgtgttttcggtagagt

SEQ ID NO: 600064 - DNA, 20 bp, Artificial Sequence
  chemically synthesized
caccataccctgctaatttt

SEQ ID NO: 600065 - DNA, 20 bp, Artificial Sequence
  chemically synthesized
tgccccagcctcccgggtag

SEQ ID NO: 600066 - DNA, 20 bp, Artificial Sequence
  chemically synthesized
ccgggaggctggggcaggag

SEQ ID NO: 600067 - DNA, 20 bp, Artificial Sequence
  chemically synthesized
accaaatagataccgaaaga

SEQ ID NO: 600068 - DNA, 20 bp, Artificial Sequence
  chemically synthesized
actctttctttcggtatcta

SEQ ID NO: 600069 - DNA, 20 bp, Artificial Sequence
  chemically synthesized
gaattttggtggtactggaa

SEQ ID NO: 600070 - DNA, 20 bp, Artificial Sequence
  chemically synthesized
agggccatagtccatgtgca

SEQ ID NO: 600071 - DNA, 20 bp, Artificial Sequence
  chemically synthesized
ttgctgttccttcatttctt

SEQ ID NO: 600072 - DNA, 20 bp, Artificial Sequence
  chemically synthesized
aaggaacagcaagaatgcct

SEQ ID NO: 600073 - DNA, 20 bp, Artificial Sequence
  chemically synthesized
gctgctttggtggtcaccaa

SEQ ID NO: 600074 - DNA, 20 bp, Artificial Sequence
  chemically synthesized
ttttatgagaaaaaaaaaaa

SEQ ID NO: 600075 - DNA, 20 bp, Artificial Sequence
  chemically synthesized
cttccacaatgatctaacac

SEQ ID NO: 600076 - DNA, 20 bp, Artificial Sequence
  chemically synthesized
taagtgttagatcattgtgg

SEQ ID NO: 600077 - DNA, 20 bp, Artificial Sequence
  chemically synthesized
tgttagatcattgtggaagg

SEQ ID NO: 600078 - DNA, 20 bp, Artificial Sequence
  chemically synthesized
aagggcttgatttgatatga

SEQ ID NO: 600079 - DNA, 20 bp, Artificial Sequence
  chemically synthesized
tactgtattcatgtcaccaa

SEQ ID NO: 600080 - DNA, 20 bp, Artificial Sequence
  chemically synthesized
acatgaatacagtaagccag

SEQ ID NO: 600081 - DNA, 20 bp, Artificial Sequence
  chemically synthesized
gaatacagtaagccagacca

SEQ ID NO: 600082 - DNA, 20 bp, Artificial Sequence
  chemically synthesized
taaaatcaaaagcaatctgg

SEQ ID NO: 600083 - DNA, 20 bp, Artificial Sequence
  chemically synthesized
agtaagccagaccagattgc

SEQ ID NO: 600084 - DNA, 20 bp, Artificial Sequence
  chemically synthesized
agattgcttttgattttaat

SEQ ID NO: 600085 - DNA, 20 bp, Artificial Sequence
  chemically synthesized
ttaatgttagattcattttt

SEQ ID NO: 600086 - DNA, 20 bp, Artificial Sequence
  chemically synthesized
taagcatatttaaagttcaa

SEQ ID NO: 600087 - DNA, 20 bp, Artificial Sequence
  chemically synthesized
aaaactgaattgaactttaa

SEQ ID NO: 600088 - DNA, 20 bp, Artificial Sequence
  chemically synthesized
taatttaggataggaaattt

SEQ ID NO: 600089 - DNA, 20 bp, Artificial Sequence
  chemically synthesized
tgacacaaaagttttagggt

SEQ ID NO: 600090 - DNA, 20 bp, Artificial Sequence
  chemically synthesized
ttcatgtgacacaaaagttt

SEQ ID NO: 600091 - DNA, 20 bp, Artificial Sequence
  chemically synthesized
ataaagtcttcatgtgacac

SEQ ID NO: 600092 - DNA, 20 bp, Artificial Sequence
  chemically synthesized
ctttatgaaatatatattac

SEQ ID NO: 600093 - DNA, 20 bp, Artificial Sequence
  chemically synthesized
ctatagattagtaaaatctg

SEQ ID NO: 600094 - DNA, 20 bp, Artificial Sequence
  chemically synthesized
agaagtcaccttaaaaacaa

SEQ ID NO: 600095 - DNA, 20 bp, Artificial Sequence
  chemically synthesized
tgtattgtttttaaggtgac

SEQ ID NO: 600096 - DNA, 20 bp, Artificial Sequence
  chemically synthesized
tttgatcttgaaaagtgaat

SEQ ID NO: 600097 - DNA, 20 bp, Artificial Sequence
  chemically synthesized
ataatactgagtctaaatgt

SEQ ID NO: 600098 - DNA, 20 bp, Artificial Sequence
  chemically synthesized
gcatttaaaaggtgaagtga

SEQ ID NO: 600099 - DNA, 20 bp, Artificial Sequence
  chemically synthesized
catcaagtaagagagtacta

SEQ ID NO: 600100 - DNA, 20 bp, Artificial Sequence
  chemically synthesized
tactactgagctttattttc

SEQ ID NO: 600101 - DNA, 20 bp, Artificial Sequence
  chemically synthesized
cagctaaagtaatagcccaa

SEQ ID NO: 600102 - DNA, 20 bp, Artificial Sequence
  chemically synthesized
ttcaaataaatacattcact

SEQ ID NO: 600103 - DNA, 20 bp, Artificial Sequence
  chemically synthesized
catattttgagttgtcgatg

SEQ ID NO: 600104 - DNA, 20 bp, Artificial Sequence
  chemically synthesized
ggtgagttttctttcttcaa

SEQ ID NO: 600105 - DNA, 20 bp, Artificial Sequence
  chemically synthesized
atttttgctaacatagagtt

SEQ ID NO: 600106 - DNA, 20 bp, Artificial Sequence
  chemically synthesized
gctaaaaatttttgctaaca

SEQ ID NO: 600107 - DNA, 20 bp, Artificial Sequence
  chemically synthesized
atgtgtatgtcatagtacta

SEQ ID NO: 600108 - DNA, 20 bp, Artificial Sequence
  chemically synthesized
acatacacatgaatatgaag

SEQ ID NO: 600109 - DNA, 20 bp, Artificial Sequence
  chemically synthesized
ccctatatctaattggaaag

SEQ ID NO: 600110 - DNA, 20 bp, Artificial Sequence
  chemically synthesized
gtgttctcagttagaaacaa

SEQ ID NO: 600111 - DNA, 20 bp, Artificial Sequence
  chemically synthesized
tttttcctggaaagaagcca

SEQ ID NO: 600112 - DNA, 20 bp, Artificial Sequence
  chemically synthesized
tatctttttcctggaaagaa

SEQ ID NO: 600113 - DNA, 20 bp, Artificial Sequence
  chemically synthesized
ttttaagtagaattagacat

SEQ ID NO: 600114 - DNA, 20 bp, Artificial Sequence
  chemically synthesized
gtgaatatgctttcctgcaa

SEQ ID NO: 600115 - DNA, 20 bp, Artificial Sequence
  chemically synthesized
catcatgtaaccttctgtga

SEQ ID NO: 600116 - DNA, 20 bp, Artificial Sequence
  chemically synthesized
ctagcaattgttttcagatt

SEQ ID NO: 600117 - DNA, 20 bp, Artificial Sequence
  chemically synthesized
aaagtagtctagcaattgtt

SEQ ID NO: 600118 - DNA, 20 bp, Artificial Sequence
  chemically synthesized
gaagtctaaagtagtctagc

SEQ ID NO: 600119 - DNA, 20 bp, Artificial Sequence
  chemically synthesized
aatattttttcctctcatag

SEQ ID NO: 600120 - DNA, 20 bp, Artificial Sequence
  chemically synthesized
tagaaaaaaataaacattct

SEQ ID NO: 600121 - DNA, 20 bp, Artificial Sequence
  chemically synthesized
attcttataataaacaataa

SEQ ID NO: 600122 - DNA, 20 bp, Artificial Sequence
  chemically synthesized
gggtcataaaggtgataaca

SEQ ID NO: 600123 - DNA, 20 bp, Artificial Sequence
  chemically synthesized
tttaactttactagtagtat

SEQ ID NO: 600124 - DNA, 20 bp, Artificial Sequence
  chemically synthesized
gtaaacatatttttgagacc

SEQ ID NO: 600125 - DNA, 20 bp, Artificial Sequence
  chemically synthesized
ggaaactttgggtctcaaaa

SEQ ID NO: 600126 - DNA, 20 bp, Artificial Sequence
  chemically synthesized
tctcaaaaatatgtttactt

SEQ ID NO: 600127 - DNA, 20 bp, Artificial Sequence
  chemically synthesized
cttcttggttttgtctttta

SEQ ID NO: 600128 - DNA, 20 bp, Artificial Sequence
  chemically synthesized
tttaaagccacaaattggcg

SEQ ID NO: 600129 - DNA, 20 bp, Artificial Sequence
  chemically synthesized
taggaagcttggcgccaatt

SEQ ID NO: 600130 - DNA, 20 bp, Artificial Sequence
  chemically synthesized
tctactataattttcctttt

SEQ ID NO: 600131 - DNA, 20 bp, Artificial Sequence
  chemically synthesized
ttcctagttttccaatttat

SEQ ID NO: 600132 - DNA, 20 bp, Artificial Sequence
  chemically synthesized
attccagaaaaattatttag

SEQ ID NO: 600133 - DNA, 20 bp, Artificial Sequence
  chemically synthesized
attgactatagttaaatagt

SEQ ID NO: 600134 - DNA, 20 bp, Artificial Sequence
  chemically synthesized
tatagtcaatgtacttgaaa

SEQ ID NO: 600135 - DNA, 20 bp, Artificial Sequence
  chemically synthesized
tcaatgtacttgaaattatg

SEQ ID NO: 600136 - DNA, 20 bp, Artificial Sequence
  chemically synthesized
catgaagtgattttttgacc

SEQ ID NO: 600137 - DNA, 20 bp, Artificial Sequence
  chemically synthesized
aaaaatgtcaattactcatg

SEQ ID NO: 600138 - DNA, 20 bp, Artificial Sequence
  chemically synthesized
cgtatgaaagtatttgaaca

SEQ ID NO: 600139 - DNA, 20 bp, Artificial Sequence
  chemically synthesized
ttgcatttaaatgaatttaa

SEQ ID NO: 600140 - DNA, 20 bp, Artificial Sequence
  chemically synthesized
ttcaagctataagtttcatc

SEQ ID NO: 600141 - DNA, 20 bp, Artificial Sequence
  chemically synthesized
ttgaaacagcagatgaaact

SEQ ID NO: 600142 - DNA, 20 bp, Artificial Sequence
  chemically synthesized
tggagagcttaattcaagct

SEQ ID NO: 600143 - DNA, 20 bp, Artificial Sequence
  chemically synthesized
tcatggtttcttggtaggtg

SEQ ID NO: 600144 - DNA, 20 bp, Artificial Sequence
  chemically synthesized
ttgagtacattctcatttct

SEQ ID NO: 600145 - DNA, 20 bp, Artificial Sequence
  chemically synthesized
gagaatgtactcaatagtca

SEQ ID NO: 600146 - DNA, 20 bp, Artificial Sequence
  chemically synthesized
agtcacggggtttcatatat

SEQ ID NO: 600147 - DNA, 20 bp, Artificial Sequence
  chemically synthesized
aattttatgttaaaatatta

SEQ ID NO: 600148 - DNA, 20 bp, Artificial Sequence
  chemically synthesized
gaatgattatcataaatgtg

SEQ ID NO: 600149 - DNA, 20 bp, Artificial Sequence
  chemically synthesized
tctgcagggcatatattctt

SEQ ID NO: 600150 - DNA, 20 bp, Artificial Sequence
  chemically synthesized
atatactttatttgacaact

SEQ ID NO: 600151 - DNA, 20 bp, Artificial Sequence
  chemically synthesized
agattttagagtatgtcatt

SEQ ID NO: 600152 - DNA, 20 bp, Artificial Sequence
  chemically synthesized
agagtatgtcattaacagct

SEQ ID NO: 600153 - DNA, 20 bp, Artificial Sequence
  chemically synthesized
tataaagaaagaaaataaat

SEQ ID NO: 600154 - DNA, 20 bp, Artificial Sequence
  chemically synthesized
agaaaataaatgccagtttt

SEQ ID NO: 600155 - DNA, 20 bp, Artificial Sequence
  chemically synthesized
gagatctagtaggaaaaaaa

SEQ ID NO: 600156 - DNA, 20 bp, Artificial Sequence
  chemically synthesized
tttttcctactagatctcac

SEQ ID NO: 600157 - DNA, 20 bp, Artificial Sequence
  chemically synthesized
gttatgaaaaatactttcca

SEQ ID NO: 600158 - DNA, 20 bp, Artificial Sequence
  chemically synthesized
cttgaatagtctggagaatt

SEQ ID NO: 600159 - DNA, 20 bp, Artificial Sequence
  chemically synthesized
taggttatccttctcatata

SEQ ID NO: 600160 - DNA, 20 bp, Artificial Sequence
  chemically synthesized
tataaggtaatgacctttgc

SEQ ID NO: 600161 - DNA, 20 bp, Artificial Sequence
  chemically synthesized
gtcattaccttataacattt

SEQ ID NO: 600162 - DNA, 20 bp, Artificial Sequence
  chemically synthesized
atgcaaaaatacctcaagta

SEQ ID NO: 600163 - DNA, 20 bp, Artificial Sequence
  chemically synthesized
taagaaaaaataaggctaat

SEQ ID NO: 600164 - DNA, 20 bp, Artificial Sequence
  chemically synthesized
atagttattcaggatcatac

SEQ ID NO: 600165 - DNA, 20 bp, Artificial Sequence
  chemically synthesized
aaataaatagtagggaatta

SEQ ID NO: 600166 - DNA, 20 bp, Artificial Sequence
  chemically synthesized
gttctctgaatctacataaa

SEQ ID NO: 600167 - DNA, 20 bp, Artificial Sequence
  chemically synthesized
caaactgaaaactgtcttta

SEQ ID NO: 600168 - DNA, 20 bp, Artificial Sequence
  chemically synthesized
gaatctacataaagacagtt

SEQ ID NO: 600169 - DNA, 20 bp, Artificial Sequence
  chemically synthesized
tttcagtttgggtctcattt

SEQ ID NO: 600170 - DNA, 20 bp, Artificial Sequence
  chemically synthesized
tgggtctcatttatacgatt

SEQ ID NO: 600171 - DNA, 20 bp, Artificial Sequence
  chemically synthesized
tttttaattcaatgtggcta

SEQ ID NO: 600172 - DNA, 20 bp, Artificial Sequence
  chemically synthesized
ccaaattaactagatgtata

SEQ ID NO: 600173 - DNA, 20 bp, Artificial Sequence
  chemically synthesized
ttaggccatttacacccact

SEQ ID NO: 600174 - DNA, 20 bp, Artificial Sequence
  chemically synthesized
gaaaatagctgatattgata

SEQ ID NO: 600175 - DNA, 20 bp, Artificial Sequence
  chemically synthesized
ttttttactgtttattcatt

SEQ ID NO: 600176 - DNA, 20 bp, Artificial Sequence
  chemically synthesized
tagcttagtatttttttttt

SEQ ID NO: 600177 - DNA, 20 bp, Artificial Sequence
  chemically synthesized
tagaacttagtcaagagact

SEQ ID NO: 600178 - DNA, 20 bp, Artificial Sequence
  chemically synthesized
actaagttctaagcagcatg

SEQ ID NO: 600179 - DNA, 20 bp, Artificial Sequence
  chemically synthesized
tctgatggccaatcatttca

SEQ ID NO: 600180 - DNA, 20 bp, Artificial Sequence
  chemically synthesized
aagggcaagaatttaacggc

SEQ ID NO: 600181 - DNA, 20 bp, Artificial Sequence
  chemically synthesized
atagcccctgcatagacacc

SEQ ID NO: 600182 - DNA, 20 bp, Artificial Sequence
  chemically synthesized
agttgggctggacaggactt

SEQ ID NO: 600183 - DNA, 20 bp, Artificial Sequence
  chemically synthesized
ccatgaagagggcaaggaca

SEQ ID NO: 600184 - DNA, 20 bp, Artificial Sequence
  chemically synthesized
tccttgccctcttcatggct

SEQ ID NO: 600185 - DNA, 20 bp, Artificial Sequence
  chemically synthesized
gagatgagatcctataatgt

SEQ ID NO: 600186 - DNA, 20 bp, Artificial Sequence
  chemically synthesized
cataatttactgaactctaa

SEQ ID NO: 600187 - DNA, 20 bp, Artificial Sequence
  chemically synthesized
gctttagcaggagtctctcc

SEQ ID NO: 600188 - DNA, 20 bp, Artificial Sequence
  chemically synthesized
gcttttggagagactcctgc

SEQ ID NO: 600189 - DNA, 20 bp, Artificial Sequence
  chemically synthesized
gactcctgctaaagcttacc

SEQ ID NO: 600190 - DNA, 20 bp, Artificial Sequence
  chemically synthesized
ggaccatgataaaaccaatg

SEQ ID NO: 600191 - DNA, 20 bp, Artificial Sequence
  chemically synthesized
tttatcatggtcctgaaaag

SEQ ID NO: 600192 - DNA, 20 bp, Artificial Sequence
  chemically synthesized
tccctttcttaaaaattaat

SEQ ID NO: 600193 - DNA, 20 bp, Artificial Sequence
  chemically synthesized
aatagcattataaatattaa

SEQ ID NO: 600194 - DNA, 20 bp, Artificial Sequence
  chemically synthesized
cttccttacaaaatcatatt

SEQ ID NO: 600195 - DNA, 20 bp, Artificial Sequence
  chemically synthesized
aacatacgtgaaaacacata

SEQ ID NO: 600196 - DNA, 20 bp, Artificial Sequence
  chemically synthesized
tcaaaataaccttcagtgat

SEQ ID NO: 600197 - DNA, 20 bp, Artificial Sequence
  chemically synthesized
gttgaaggaatgcctagtaa

SEQ ID NO: 600198 - DNA, 20 bp, Artificial Sequence
  chemically synthesized
atttcaagcatttctccaac

SEQ ID NO: 600199 - DNA, 20 bp, Artificial Sequence
  chemically synthesized
aaagaaagcaacagttggag

SEQ ID NO: 600200 - DNA, 20 bp, Artificial Sequence
  chemically synthesized
agaattataatgaaatgtaa

SEQ ID NO: 600201 - DNA, 20 bp, Artificial Sequence
  chemically synthesized
tttaaaataactattttctt

SEQ ID NO: 600202 - DNA, 20 bp, Artificial Sequence
  chemically synthesized
tcactcttaatattcagaat

SEQ ID NO: 600203 - DNA, 20 bp, Artificial Sequence
  chemically synthesized
aaacgatgtcatctgcccta

SEQ ID NO: 600204 - DNA, 20 bp, Artificial Sequence
  chemically synthesized
aaactgtctagggcagatga

SEQ ID NO: 600205 - DNA, 20 bp, Artificial Sequence
  chemically synthesized
tatcttagagaaaaattcgt

SEQ ID NO: 600206 - DNA, 20 bp, Artificial Sequence
  chemically synthesized
tctctaagataatttatagc

SEQ ID NO: 600207 - DNA, 20 bp, Artificial Sequence
  chemically synthesized
agtgagaaatgagttttatc

SEQ ID NO: 600208 - DNA, 20 bp, Artificial Sequence
  chemically synthesized
cagtaagttttcagtgagaa

SEQ ID NO: 600209 - DNA, 20 bp, Artificial Sequence
  chemically synthesized
catattattgacacatgaca

SEQ ID NO: 600210 - DNA, 20 bp, Artificial Sequence
  chemically synthesized
atgtgtcaataatatggcaa

SEQ ID NO: 600211 - DNA, 20 bp, Artificial Sequence
  chemically synthesized
agctagtctcacttgtatat

SEQ ID NO: 600212 - DNA, 20 bp, Artificial Sequence
  chemically synthesized
taaggaatcaaaatgaagat

SEQ ID NO: 600213 - DNA, 20 bp, Artificial Sequence
  chemically synthesized
gaattaatcttctatcttca

SEQ ID NO: 600214 - DNA, 20 bp, Artificial Sequence
  chemically synthesized
aggaagtgacctattcactg

SEQ ID NO: 600215 - DNA, 20 bp, Artificial Sequence
  chemically synthesized
gtccctattggatggcaaaa

SEQ ID NO: 600216 - DNA, 20 bp, Artificial Sequence
  chemically synthesized
caggagcacaggatcaagta

SEQ ID NO: 600217 - DNA, 20 bp, Artificial Sequence
  chemically synthesized
tgatcctgtgctcctgttct

SEQ ID NO: 600218 - DNA, 20 bp, Artificial Sequence
  chemically synthesized
cttatgtgagaatatggata

SEQ ID NO: 600219 - DNA, 20 bp, Artificial Sequence
  chemically synthesized
ctgagaaggtggtggagaaa

SEQ ID NO: 600220 - DNA, 20 bp, Artificial Sequence
  chemically synthesized
tcagatgtgcctatattttg

SEQ ID NO: 600221 - DNA, 20 bp, Artificial Sequence
  chemically synthesized
tttgttaagattttcagttg

SEQ ID NO: 600222 - DNA, 20 bp, Artificial Sequence
  chemically synthesized
gcctttagtagaaagagatg

SEQ ID NO: 600223 - DNA, 20 bp, Artificial Sequence
  chemically synthesized
gtaatttatctggcttttgt

SEQ ID NO: 600224 - DNA, 20 bp, Artificial Sequence
  chemically synthesized
ctttaagaaattgtaattta

SEQ ID NO: 600225 - DNA, 20 bp, Artificial Sequence
  chemically synthesized
atctaaagatgtgtgaggca

SEQ ID NO: 600226 - DNA, 20 bp, Artificial Sequence
  chemically synthesized
atcttcttgcctcacacatc

SEQ ID NO: 600227 - DNA, 20 bp, Artificial Sequence
  chemically synthesized
acaaagaaaggtctcactaa

SEQ ID NO: 600228 - DNA, 20 bp, Artificial Sequence
  chemically synthesized
tatattttctaacttgtaat

SEQ ID NO: 600229 - DNA, 20 bp, Artificial Sequence
  chemically synthesized
taactggtagaatttacata

SEQ ID NO: 600230 - DNA, 20 bp, Artificial Sequence
  chemically synthesized
ttatactcttacaagttgct

SEQ ID NO: 600231 - DNA, 20 bp, Artificial Sequence
  chemically synthesized
ctggttttcttttctttggt

SEQ ID NO: 600232 - DNA, 20 bp, Artificial Sequence
  chemically synthesized
tcccaggcttcatgacagac

SEQ ID NO: 600233 - DNA, 20 bp, Artificial Sequence
  chemically synthesized
tatatctattgttcagattc

SEQ ID NO: 600234 - DNA, 20 bp, Artificial Sequence
  chemically synthesized
ccaaatatttatatctattg

SEQ ID NO: 600235 - DNA, 20 bp, Artificial Sequence
  chemically synthesized
aacatacttacattccatca

SEQ ID NO: 600236 - DNA, 20 bp, Artificial Sequence
  chemically synthesized
gtagtggactctcgacttga

SEQ ID NO: 600237 - DNA, 20 bp, Artificial Sequence
  chemically synthesized
tttctcaacacatctgtcaa

SEQ ID NO: 600238 - DNA, 20 bp, Artificial Sequence
  chemically synthesized
ttgcgagggtaaaggcagac

SEQ ID NO: 600239 - DNA, 20 bp, Artificial Sequence
  chemically synthesized
gtaaataatgagaataaagg

SEQ ID NO: 600240 - DNA, 20 bp, Artificial Sequence
  chemically synthesized
ttttgctctatacattcagg

SEQ ID NO: 600241 - DNA, 20 bp, Artificial Sequence
  chemically synthesized
tgtgcctgaatgtatagagc

SEQ ID NO: 600242 - DNA, 20 bp, Artificial Sequence
  chemically synthesized
ggtagtaaaataaatgtaaa

SEQ ID NO: 600243 - DNA, 20 bp, Artificial Sequence
  chemically synthesized
tacaggtaaataaaacatgg

SEQ ID NO: 600244 - DNA, 20 bp, Artificial Sequence
  chemically synthesized
taaataaaacatggacaaga

SEQ ID NO: 600245 - DNA, 20 bp, Artificial Sequence
  chemically synthesized
caacaaaagccaaatcttgt

SEQ ID NO: 600246 - DNA, 20 bp, Artificial Sequence
  chemically synthesized
aattaatctggagtctacct

SEQ ID NO: 600247 - DNA, 20 bp, Artificial Sequence
  chemically synthesized
aagaaatctgaaaggtagac

SEQ ID NO: 600248 - DNA, 20 bp, Artificial Sequence
  chemically synthesized
taacgcacttgtggtggtgg

SEQ ID NO: 600249 - DNA, 20 bp, Artificial Sequence
  chemically synthesized
gtatcagtcagtggtgccta

SEQ ID NO: 600250 - DNA, 20 bp, Artificial Sequence
  chemically synthesized
ttgtgtttttcttgcttata

SEQ ID NO: 600251 - DNA, 20 bp, Artificial Sequence
  chemically synthesized
atttttatcttttgtgtttt

SEQ ID NO: 600252 - DNA, 20 bp, Artificial Sequence
  chemically synthesized
tttatacatatttttatctt

SEQ ID NO: 600253 - DNA, 20 bp, Artificial Sequence
  chemically synthesized
tatttcgattgtagcatttt

SEQ ID NO: 600254 - DNA, 20 bp, Artificial Sequence
  chemically synthesized
tcaaggttccagaatattta

SEQ ID NO: 600255 - DNA, 20 bp, Artificial Sequence
  chemically synthesized
aatttacagcctcagcaact

SEQ ID NO: 600256 - DNA, 20 bp, Artificial Sequence
  chemically synthesized
ggctgtaaattcatttttta

SEQ ID NO: 600257 - DNA, 20 bp, Artificial Sequence
  chemically synthesized
aaaaaaaaatagaagggaaa

SEQ ID NO: 600258 - DNA, 20 bp, Artificial Sequence
  chemically synthesized
attcttgcagtcaaaagggc

SEQ ID NO: 600259 - DNA, 20 bp, Artificial Sequence
  chemically synthesized
gagggaaaatatactttatg

SEQ ID NO: 600260 - DNA, 20 bp, Artificial Sequence
  chemically synthesized
cctatgcattattggtagaa

SEQ ID NO: 600261 - DNA, 20 bp, Artificial Sequence
  chemically synthesized
attattggtagaaaaatgat

SEQ ID NO: 600262 - DNA, 20 bp, Artificial Sequence
  chemically synthesized
tcttcccagagctaatgcag

SEQ ID NO: 600263 - DNA, 20 bp, Artificial Sequence
  chemically synthesized
attgatttttatttatttca

SEQ ID NO: 600264 - DNA, 20 bp, Artificial Sequence
  chemically synthesized
ttccttaagatggcagtgtc

SEQ ID NO: 600265 - DNA, 20 bp, Artificial Sequence
  chemically synthesized
cactgccatcttaaggaaaa

SEQ ID NO: 600266 - DNA, 20 bp, Artificial Sequence
  chemically synthesized
tgtgtgtatgcgaggaatgg

SEQ ID NO: 600267 - DNA, 20 bp, Artificial Sequence
  chemically synthesized
acacaatgccacctgcagta

SEQ ID NO: 600268 - DNA, 20 bp, Artificial Sequence
  chemically synthesized
cagtaaaatgttttagtagt

SEQ ID NO: 600269 - DNA, 20 bp, Artificial Sequence
  chemically synthesized
cccctttttatttctctatg

SEQ ID NO: 600270 - DNA, 20 bp, Artificial Sequence
  chemically synthesized
ggtattattacatcaatggt

SEQ ID NO: 600271 - DNA, 20 bp, Artificial Sequence
  chemically synthesized
tgatccatttcattcctgag

SEQ ID NO: 600272 - DNA, 20 bp, Artificial Sequence
  chemically synthesized
cacttgcagaaatcaattta

SEQ ID NO: 600273 - DNA, 20 bp, Artificial Sequence
  chemically synthesized
acaataaaataaactaggta

SEQ ID NO: 600274 - DNA, 20 bp, Artificial Sequence
  chemically synthesized
tattgtgttatggcagccag

SEQ ID NO: 600275 - DNA, 20 bp, Artificial Sequence
  chemically synthesized
aataacatttcctttgttgc

SEQ ID NO: 600276 - DNA, 20 bp, Artificial Sequence
  chemically synthesized
ctcaaaatattttcaacagc

SEQ ID NO: 600277 - DNA, 20 bp, Artificial Sequence
  chemically synthesized
gcctgagaataaaaatattg

SEQ ID NO: 600278 - DNA, 20 bp, Artificial Sequence
  chemically synthesized
atacatgatcccttagtcac

SEQ ID NO: 600279 - DNA, 20 bp, Artificial Sequence
  chemically synthesized
tcaatatttacttcaaaaat

SEQ ID NO: 600280 - DNA, 20 bp, Artificial Sequence
  chemically synthesized
ttcaaaaataaatgtttggc

SEQ ID NO: 600281 - DNA, 20 bp, Artificial Sequence
  chemically synthesized
tgtgatactattaaagttaa

SEQ ID NO: 600282 - DNA, 20 bp, Artificial Sequence
  chemically synthesized
gatttcttcatacactttta

SEQ ID NO: 600283 - DNA, 20 bp, Artificial Sequence
  chemically synthesized
gaaaatacatatctgagagc

SEQ ID NO: 600284 - DNA, 20 bp, Artificial Sequence
  chemically synthesized
attcctgaaaatacatatct

SEQ ID NO: 600285 - DNA, 20 bp, Artificial Sequence
  chemically synthesized
tatgtattttcaggaataaa

SEQ ID NO: 600286 - DNA, 20 bp, Artificial Sequence
  chemically synthesized
gttgattattattcagaaat

SEQ ID NO: 600287 - DNA, 20 bp, Artificial Sequence
  chemically synthesized
agacgaataatagtgccctg

SEQ ID NO: 600288 - DNA, 20 bp, Artificial Sequence
  chemically synthesized
tattcgtctaatgtcacttt

SEQ ID NO: 600289 - DNA, 20 bp, Artificial Sequence
  chemically synthesized
ctttcattgctttaaattct

SEQ ID NO: 600290 - DNA, 20 bp, Artificial Sequence
  chemically synthesized
ttatgttaaatttactcttg

SEQ ID NO: 600291 - DNA, 20 bp, Artificial Sequence
  chemically synthesized
aaaatagaggttttttgtgt

SEQ ID NO: 600292 - DNA, 20 bp, Artificial Sequence
  chemically synthesized
ctcagtttactttttaaaat

SEQ ID NO: 600293 - DNA, 20 bp, Artificial Sequence
  chemically synthesized
gttttggtaaaggggagttt

SEQ ID NO: 600294 - DNA, 20 bp, Artificial Sequence
  chemically synthesized
aaatatatgttttggtaaag

SEQ ID NO: 600295 - DNA, 20 bp, Artificial Sequence
  chemically synthesized
attttttaaattaagaaaat

SEQ ID NO: 600296 - DNA, 20 bp, Artificial Sequence
  chemically synthesized
atagttataaattacaaatt

SEQ ID NO: 600297 - DNA, 20 bp, Artificial Sequence
  chemically synthesized
cagcttcagttctggagata

SEQ ID NO: 600298 - DNA, 20 bp, Artificial Sequence
  chemically synthesized
ccagaactgaagctgtagca

SEQ ID NO: 600299 - DNA, 20 bp, Artificial Sequence
  chemically synthesized
tctaatattaatcctaatgc

SEQ ID NO: 600300 - DNA, 20 bp, Artificial Sequence
  chemically synthesized
tgtagcattaggattaatat

SEQ ID NO: 600301 - DNA, 20 bp, Artificial Sequence
  chemically synthesized
atctctagtctcaaatgtat

SEQ ID NO: 600302 - DNA, 20 bp, Artificial Sequence
  chemically synthesized
atctctaatacatttgagac

SEQ ID NO: 600303 - DNA, 20 bp, Artificial Sequence
  chemically synthesized
ctgcacttgataccttattc

SEQ ID NO: 600304 - DNA, 20 bp, Artificial Sequence
  chemically synthesized
tatcctctagagaaatttat

SEQ ID NO: 600305 - DNA, 20 bp, Artificial Sequence
  chemically synthesized
cagttgaaatgtattttatt

SEQ ID NO: 600306 - DNA, 20 bp, Artificial Sequence
  chemically synthesized
attttatttcaagattatca

SEQ ID NO: 600307 - DNA, 20 bp, Artificial Sequence
  chemically synthesized
ctttcccatcaattgagtat

SEQ ID NO: 600308 - DNA, 20 bp, Artificial Sequence
  chemically synthesized
tatgacaaaagattctccta

SEQ ID NO: 600309 - DNA, 20 bp, Artificial Sequence
  chemically synthesized
gtttgttgccatcctatgac

SEQ ID NO: 600310 - DNA, 20 bp, Artificial Sequence
  chemically synthesized
ttgtcataggatggcaacaa

SEQ ID NO: 600311 - DNA, 20 bp, Artificial Sequence
  chemically synthesized
taatatttgttatgttttaa

SEQ ID NO: 600312 - DNA, 20 bp, Artificial Sequence
  chemically synthesized
aaccctctaattaatatttg

SEQ ID NO: 600313 - DNA, 20 bp, Artificial Sequence
  chemically synthesized
aacataacaaatattaatta

SEQ ID NO: 600314 - DNA, 20 bp, Artificial Sequence
  chemically synthesized
taatcatttttcttagatag

SEQ ID NO: 600315 - DNA, 20 bp, Artificial Sequence
  chemically synthesized
aaaacaagactatctaagaa

SEQ ID NO: 600316 - DNA, 20 bp, Artificial Sequence
  chemically synthesized
atctaagaaaaatgattact

SEQ ID NO: 600317 - DNA, 20 bp, Artificial Sequence
  chemically synthesized
ttcttgcatctcagcctgaa

SEQ ID NO: 600318 - DNA, 20 bp, Artificial Sequence
  chemically synthesized
ttagacagaaatatgaatgt

SEQ ID NO: 600319 - DNA, 20 bp, Artificial Sequence
  chemically synthesized
atttttggaaatactaagat

SEQ ID NO: 600320 - DNA, 20 bp, Artificial Sequence
  chemically synthesized
atggaaagatatcccatatt

SEQ ID NO: 600321 - DNA, 20 bp, Artificial Sequence
  chemically synthesized
gggattgcattaagtctgta

SEQ ID NO: 600322 - DNA, 20 bp, Artificial Sequence
  chemically synthesized
aaatgtcactggaattttaa

SEQ ID NO: 600323 - DNA, 20 bp, Artificial Sequence
  chemically synthesized
tttgttgttcaaaatgaaat

SEQ ID NO: 600324 - DNA, 20 bp, Artificial Sequence
  chemically synthesized
gcttcgttcttttggcttaa

SEQ ID NO: 600325 - DNA, 20 bp, Artificial Sequence
  chemically synthesized
tccagcttcgttcttttggc

SEQ ID NO: 600326 - DNA, 20 bp, Artificial Sequence
  chemically synthesized
gatacctccagcttcgttct

SEQ ID NO: 600327 - DNA, 20 bp, Artificial Sequence
  chemically synthesized
aatcaggtaattatgatacc

SEQ ID NO: 600328 - DNA, 20 bp, Artificial Sequence
  chemically synthesized
aagctggaggtatcataatt

SEQ ID NO: 600329 - DNA, 20 bp, Artificial Sequence
  chemically synthesized
tctgttcctttggtctatat

SEQ ID NO: 600330 - DNA, 20 bp, Artificial Sequence
  chemically synthesized
tgatcagttgatcataaata

SEQ ID NO: 600331 - DNA, 20 bp, Artificial Sequence
  chemically synthesized
aagtcttgagtccattttga

SEQ ID NO: 600332 - DNA, 20 bp, Artificial Sequence
  chemically synthesized
acttaaaacctgaacctata

SEQ ID NO: 600333 - DNA, 20 bp, Artificial Sequence
  chemically synthesized
cttcaaatcattttataggt

SEQ ID NO: 600334 - DNA, 20 bp, Artificial Sequence
  chemically synthesized
atgatttgaagaaaacagga

SEQ ID NO: 600335 - DNA, 20 bp, Artificial Sequence
  chemically synthesized
aacaatgtcaggaagctttt

SEQ ID NO: 600336 - DNA, 20 bp, Artificial Sequence
  chemically synthesized
gtttgcccagaacaatgtca

SEQ ID NO: 600337 - DNA, 20 bp, Artificial Sequence
  chemically synthesized
ttgggagtcagatccaaaaa

SEQ ID NO: 600338 - DNA, 20 bp, Artificial Sequence
  chemically synthesized
tctagttttcctcttgttgc

SEQ ID NO: 600339 - DNA, 20 bp, Artificial Sequence
  chemically synthesized
ggttgatgcgataacagtcg

SEQ ID NO: 600340 - DNA, 20 bp, Artificial Sequence
  chemically synthesized
actgttatcgcatcaaccta

SEQ ID NO: 600341 - DNA, 20 bp, Artificial Sequence
  chemically synthesized
gattgtttgttttgctgagc

SEQ ID NO: 600342 - DNA, 20 bp, Artificial Sequence
  chemically synthesized
gtctcttcactctgttgatt

SEQ ID NO: 600343 - DNA, 20 bp, Artificial Sequence
  chemically synthesized
agtagtctcttcactctgtt

SEQ ID NO: 600344 - DNA, 20 bp, Artificial Sequence
  chemically synthesized
agtaagtagtctcttcactc

SEQ ID NO: 600345 - DNA, 20 bp, Artificial Sequence
  chemically synthesized
cgctcaactcaaatattctg

SEQ ID NO: 600346 - DNA, 20 bp, Artificial Sequence
  chemically synthesized
ctatcttattagccaagtgt

SEQ ID NO: 600347 - DNA, 20 bp, Artificial Sequence
  chemically synthesized
catattccacagagaccaca

SEQ ID NO: 600348 - DNA, 20 bp, Artificial Sequence
  chemically synthesized
tagacctacatataaataga

SEQ ID NO: 600349 - DNA, 20 bp, Artificial Sequence
  chemically synthesized
ggtccatcagatagctctaa

SEQ ID NO: 600350 - DNA, 20 bp, Artificial Sequence
  chemically synthesized
gaaaaatacgtaacgctcag

SEQ ID NO: 600351 - DNA, 20 bp, Artificial Sequence
  chemically synthesized
aatcagtgaggctctgctta

SEQ ID NO: 600352 - DNA, 20 bp, Artificial Sequence
  chemically synthesized
aatctgaataagcagagcct

SEQ ID NO: 600353 - DNA, 20 bp, Artificial Sequence
  chemically synthesized
acaataattaatcagtgagg

SEQ ID NO: 600354 - DNA, 20 bp, Artificial Sequence
  chemically synthesized
gcagagcctcactgattaat

SEQ ID NO: 600355 - DNA, 20 bp, Artificial Sequence
  chemically synthesized
ttccacatcgaaatatgtgt

SEQ ID NO: 600356 - DNA, 20 bp, Artificial Sequence
  chemically synthesized
acatatacatagagagagag

SEQ ID NO: 600357 - DNA, 20 bp, Artificial Sequence
  chemically synthesized
agcaacgggcaataaattat

SEQ ID NO: 600358 - DNA, 20 bp, Artificial Sequence
  chemically synthesized
atcatacataatttattgcc

SEQ ID NO: 600359 - DNA, 20 bp, Artificial Sequence
  chemically synthesized
tttataaggaaagtggaaag

SEQ ID NO: 600360 - DNA, 20 bp, Artificial Sequence
  chemically synthesized
aaagaacttgatgaaagagt

SEQ ID NO: 600361 - DNA, 20 bp, Artificial Sequence
  chemically synthesized
ttactctttcatcaagttct

SEQ ID NO: 600362 - DNA, 20 bp, Artificial Sequence
  chemically synthesized
caagttctttgggattttcc

SEQ ID NO: 600363 - DNA, 20 bp, Artificial Sequence
  chemically synthesized
aatggtgataaagactggac

SEQ ID NO: 600364 - DNA, 20 bp, Artificial Sequence
  chemically synthesized
ctcagacttttatacaagtt

SEQ ID NO: 600365 - DNA, 20 bp, Artificial Sequence
  chemically synthesized
actgattatcatgttttgtt

SEQ ID NO: 600366 - DNA, 20 bp, Artificial Sequence
  chemically synthesized
taactctactgattatcatg

SEQ ID NO: 600367 - DNA, 20 bp, Artificial Sequence
  chemically synthesized
taatttaactctactgatta

SEQ ID NO: 600368 - DNA, 20 bp, Artificial Sequence
  chemically synthesized
attatgaaataatttaactc

SEQ ID NO: 600369 - DNA, 20 bp, Artificial Sequence
  chemically synthesized
agatccccttaattgctatt

SEQ ID NO: 600370 - DNA, 20 bp, Artificial Sequence
  chemically synthesized
ttttgcagcggtggtcaata

SEQ ID NO: 600371 - DNA, 20 bp, Artificial Sequence
  chemically synthesized
tatctagcttttgcattttc

SEQ ID NO: 600372 - DNA, 20 bp, Artificial Sequence
  chemically synthesized
acacatatatatgattaact

SEQ ID NO: 600373 - DNA, 20 bp, Artificial Sequence
  chemically synthesized
acagagagttaatcatatat

SEQ ID NO: 600374 - DNA, 20 bp, Artificial Sequence
  chemically synthesized
atatatcacaaaacacatat

SEQ ID NO: 600375 - DNA, 20 bp, Artificial Sequence
  chemically synthesized
tcagaattgacatttatgtt

SEQ ID NO: 600376 - DNA, 20 bp, Artificial Sequence
  chemically synthesized
ttcccagtgattcaaatact

SEQ ID NO: 600377 - DNA, 20 bp, Artificial Sequence
  chemically synthesized
tttggccaccactgacttcc

SEQ ID NO: 600378 - DNA, 20 bp, Artificial Sequence
  chemically synthesized
atgagaacaatagtgaatgt

SEQ ID NO: 600379 - DNA, 20 bp, Artificial Sequence
  chemically synthesized
aaattatgatgtagaaattt

SEQ ID NO: 600380 - DNA, 20 bp, Artificial Sequence
  chemically synthesized
ttgtcaataatatttttata

SEQ ID NO: 600381 - DNA, 20 bp, Artificial Sequence
  chemically synthesized
acaaatataaagcacacaca

SEQ ID NO: 600382 - DNA, 20 bp, Artificial Sequence
  chemically synthesized
tgttttgtgaaaccgtatgt

SEQ ID NO: 600383 - DNA, 20 bp, Artificial Sequence
  chemically synthesized
tgatgcttttttatagcaac

SEQ ID NO: 600384 - DNA, 20 bp, Artificial Sequence
  chemically synthesized
aagttatgacacttgtctta

SEQ ID NO: 600385 - DNA, 20 bp, Artificial Sequence
  chemically synthesized
aacaccacttgatgtcttaa

SEQ ID NO: 600386 - DNA, 20 bp, Artificial Sequence
  chemically synthesized
ttgatgtcttaattttgctt

SEQ ID NO: 600387 - DNA, 20 bp, Artificial Sequence
  chemically synthesized
atacgtatacacgtatatat

SEQ ID NO: 600388 - DNA, 20 bp, Artificial Sequence
  chemically synthesized
taatagtttacattatgtat

SEQ ID NO: 600389 - DNA, 20 bp, Artificial Sequence
  chemically synthesized
cattatgtatctctgcttta

SEQ ID NO: 600390 - DNA, 20 bp, Artificial Sequence
  chemically synthesized
actaaaataagtactgatag

SEQ ID NO: 600391 - DNA, 20 bp, Artificial Sequence
  chemically synthesized
ataaaaacaattacctactg

SEQ ID NO: 600392 - DNA, 20 bp, Artificial Sequence
  chemically synthesized
aaataaacctgacagtaggt

SEQ ID NO: 600393 - DNA, 20 bp, Artificial Sequence
  chemically synthesized
ttatggaattagaacaaaaa

SEQ ID NO: 600394 - DNA, 20 bp, Artificial Sequence
  chemically synthesized
aattgggtttaatttctctt

SEQ ID NO: 600395 - DNA, 20 bp, Artificial Sequence
  chemically synthesized
ataattgtccagcctttaca

SEQ ID NO: 600396 - DNA, 20 bp, Artificial Sequence
  chemically synthesized
atgttaacatcatttgtcaa

SEQ ID NO: 600397 - DNA, 20 bp, Artificial Sequence
  chemically synthesized
ctaataattatgacttttgt

SEQ ID NO: 600398 - DNA, 20 bp, Artificial Sequence
  chemically synthesized
tccaacataataattaattt

SEQ ID NO: 600399 - DNA, 20 bp, Artificial Sequence
  chemically synthesized
ctctgattccaaattagcat

SEQ ID NO: 600400 - DNA, 20 bp, Artificial Sequence
  chemically synthesized
caacgatgctaatttggaat

SEQ ID NO: 600401 - DNA, 20 bp, Artificial Sequence
  chemically synthesized
agtaaataatttagaaaaat

SEQ ID NO: 600402 - DNA, 20 bp, Artificial Sequence
  chemically synthesized
ctctgaacttcaaaaaatat

SEQ ID NO: 600403 - DNA, 20 bp, Artificial Sequence
  chemically synthesized
aaggtaccgttagccattaa

SEQ ID NO: 600404 - DNA, 20 bp, Artificial Sequence
  chemically synthesized
atataaataatatttctccc

SEQ ID NO: 600405 - DNA, 20 bp, Artificial Sequence
  chemically synthesized
atcatagtcttgccttcaag

SEQ ID NO: 600406 - DNA, 20 bp, Artificial Sequence
  chemically synthesized
aacatgtcttgaaggcaaga

SEQ ID NO: 600407 - DNA, 20 bp, Artificial Sequence
  chemically synthesized
tttagttttttcattgttta

SEQ ID NO: 600408 - DNA, 20 bp, Artificial Sequence
  chemically synthesized
cttacactgtttagtttttt

SEQ ID NO: 600409 - DNA, 20 bp, Artificial Sequence
  chemically synthesized
ataagaatatccttacactg

SEQ ID NO: 600410 - DNA, 20 bp, Artificial Sequence
  chemically synthesized
ctttcataagaatatcctta

SEQ ID NO: 600411 - DNA, 20 bp, Artificial Sequence
  chemically synthesized
taaggatattcttatgaaag

SEQ ID NO: 600412 - DNA, 20 bp, Artificial Sequence
  chemically synthesized
ttgctcaattggtttctggt

SEQ ID NO: 600413 - DNA, 20 bp, Artificial Sequence
  chemically synthesized
ctgctcaaggcatttgctca

SEQ ID NO: 600414 - DNA, 20 bp, Artificial Sequence
  chemically synthesized
ccaattgagcaaatgccttg

SEQ ID NO: 600415 - DNA, 20 bp, Artificial Sequence
  chemically synthesized
gtactgacgcagggcacagt

SEQ ID NO: 600416 - DNA, 20 bp, Artificial Sequence
  chemically synthesized
acagtcacagcttgacacag

SEQ ID NO: 600417 - DNA, 20 bp, Artificial Sequence
  chemically synthesized
tcacagcttgacacaggtga

SEQ ID NO: 600418 - DNA, 20 bp, Artificial Sequence
  chemically synthesized
tttataaggtaacattagag

SEQ ID NO: 600419 - DNA, 20 bp, Artificial Sequence
  chemically synthesized
gaataaggcacttgggtcat

SEQ ID NO: 600420 - DNA, 20 bp, Artificial Sequence
  chemically synthesized
tactttctatcatttctatt

SEQ ID NO: 600421 - DNA, 20 bp, Artificial Sequence
  chemically synthesized
aagtaattataccactaaaa

SEQ ID NO: 600422 - DNA, 20 bp, Artificial Sequence
  chemically synthesized
actacgatgtatctgaagga

SEQ ID NO: 600423 - DNA, 20 bp, Artificial Sequence
  chemically synthesized
ttagtacttgatattttaag

SEQ ID NO: 600424 - DNA, 20 bp, Artificial Sequence
  chemically synthesized
aaatatcaagtactaaatag

SEQ ID NO: 600425 - DNA, 20 bp, Artificial Sequence
  chemically synthesized
gttttccctttaataacatt

SEQ ID NO: 600426 - DNA, 20 bp, Artificial Sequence
  chemically synthesized
tcgagtagatgcaatcatac

SEQ ID NO: 600427 - DNA, 20 bp, Artificial Sequence
  chemically synthesized
tagatgcaatcatacctcag

SEQ ID NO: 600428 - DNA, 20 bp, Artificial Sequence
  chemically synthesized
cctctgaaaacaaagctgag

SEQ ID NO: 600429 - DNA, 20 bp, Artificial Sequence
  chemically synthesized
cagaggaatcatctcagttg

SEQ ID NO: 600430 - DNA, 20 bp, Artificial Sequence
  chemically synthesized
tattggaaactcaccaactg

SEQ ID NO: 600431 - DNA, 20 bp, Artificial Sequence
  chemically synthesized
taggacaccgttcaatatta

SEQ ID NO: 600432 - DNA, 20 bp, Artificial Sequence
  chemically synthesized
ttcaatattataaagtttaa

SEQ ID NO: 600433 - DNA, 20 bp, Artificial Sequence
  chemically synthesized
acaaatagcctaaagtataa

SEQ ID NO: 600434 - DNA, 20 bp, Artificial Sequence
  chemically synthesized
tttcactgtatatccagtac

SEQ ID NO: 600435 - DNA, 20 bp, Artificial Sequence
  chemically synthesized
ggtgtttaaaggaaagttat

SEQ ID NO: 600436 - DNA, 20 bp, Artificial Sequence
  chemically synthesized
taagagtacctgaattggaa

SEQ ID NO: 600437 - DNA, 20 bp, Artificial Sequence
  chemically synthesized
aacagctggtgaatggcaaa

SEQ ID NO: 600438 - DNA, 20 bp, Artificial Sequence
  chemically synthesized
atcttgctttgccattcacc

SEQ ID NO: 600439 - DNA, 20 bp, Artificial Sequence
  chemically synthesized
tcacctttaattcttaaggc

SEQ ID NO: 600440 - DNA, 20 bp, Artificial Sequence
  chemically synthesized
aaggtgacttctgtatgtca

SEQ ID NO: 600441 - DNA, 20 bp, Artificial Sequence
  chemically synthesized
atccattatttctgaagttg

SEQ ID NO: 600442 - DNA, 20 bp, Artificial Sequence
  chemically synthesized
ctactgttgttgttactatt

SEQ ID NO: 600443 - DNA, 20 bp, Artificial Sequence
  chemically synthesized
ttagattaatatatttcctt

SEQ ID NO: 600444 - DNA, 20 bp, Artificial Sequence
  chemically synthesized
atgttgcttgtgtttaattt

SEQ ID NO: 600445 - DNA, 20 bp, Artificial Sequence
  chemically synthesized
agaatataaaaggatgttgc

SEQ ID NO: 600446 - DNA, 20 bp, Artificial Sequence
  chemically synthesized
ctgtgcagaatataaaagga

SEQ ID NO: 600447 - DNA, 20 bp, Artificial Sequence
  chemically synthesized
aataattatactatgtaatt

SEQ ID NO: 600448 - DNA, 20 bp, Artificial Sequence
  chemically synthesized
actgctcttttataagagag

SEQ ID NO: 600449 - DNA, 20 bp, Artificial Sequence
  chemically synthesized
caccagaaatacataccaca

SEQ ID NO: 600450 - DNA, 20 bp, Artificial Sequence
  chemically synthesized
actacttcctgttccacact

SEQ ID NO: 600451 - DNA, 20 bp, Artificial Sequence
  chemically synthesized
gcagcgtctacaagaaagta

SEQ ID NO: 600452 - DNA, 20 bp, Artificial Sequence
  chemically synthesized
gtagacgctgctcaaaattg

SEQ ID NO: 600453 - DNA, 20 bp, Artificial Sequence
  chemically synthesized
tacaagatgtctccatgaag

SEQ ID NO: 600454 - DNA, 20 bp, Artificial Sequence
  chemically synthesized
aaaattacaagatgtctcca

SEQ ID NO: 600455 - DNA, 20 bp, Artificial Sequence
  chemically synthesized
gtaaggacagtgtaaaaagg

SEQ ID NO: 600456 - DNA, 20 bp, Artificial Sequence
  chemically synthesized
tcaataaaaataggaccagt

SEQ ID NO: 600457 - DNA, 20 bp, Artificial Sequence
  chemically synthesized
aatggaaaaatactgcttta

SEQ ID NO: 600458 - DNA, 20 bp, Artificial Sequence
  chemically synthesized
gtgttggatgaatggaaaaa

SEQ ID NO: 600459 - DNA, 20 bp, Artificial Sequence
  chemically synthesized
actgaatcattctcccaaat

SEQ ID NO: 600460 - DNA, 20 bp, Artificial Sequence
  chemically synthesized
aggaaaacatacatttggga

SEQ ID NO: 600461 - DNA, 20 bp, Artificial Sequence
  chemically synthesized
tacatttgggagaatgattc

SEQ ID NO: 600462 - DNA, 20 bp, Artificial Sequence
  chemically synthesized
aatgtagagagcaaaacact

SEQ ID NO: 600463 - DNA, 20 bp, Artificial Sequence
  chemically synthesized
taatttgatgtctaaacaat

SEQ ID NO: 600464 - DNA, 20 bp, Artificial Sequence
  chemically synthesized
tcattgtttagacatcaaat

SEQ ID NO: 600465 - DNA, 20 bp, Artificial Sequence
  chemically synthesized
acaacttgattattggcaag

SEQ ID NO: 600466 - DNA, 20 bp, Artificial Sequence
  chemically synthesized
attggacaacttgattattg

SEQ ID NO: 600467 - DNA, 20 bp, Artificial Sequence
  chemically synthesized
actccagtctatattggaca

SEQ ID NO: 600468 - DNA, 20 bp, Artificial Sequence
  chemically synthesized
tgcccaacgaaaacacgttc

SEQ ID NO: 600469 - DNA, 20 bp, Artificial Sequence
  chemically synthesized
gttatttcagaaactaagga

SEQ ID NO: 600470 - DNA, 20 bp, Artificial Sequence
  chemically synthesized
ggctgcccaaagagtcctgt

SEQ ID NO: 600471 - DNA, 20 bp, Artificial Sequence
  chemically synthesized
ctctttgggcagcctccttc

SEQ ID NO: 600472 - DNA, 20 bp, Artificial Sequence
  chemically synthesized
gggcagcctccttcccctga

SEQ ID NO: 600473 - DNA, 20 bp, Artificial Sequence
  chemically synthesized
ctgatttgacaagtcatgag

SEQ ID NO: 600474 - DNA, 20 bp, Artificial Sequence
  chemically synthesized
ctgatctcatgacttgtcaa

SEQ ID NO: 600475 - DNA, 20 bp, Artificial Sequence
  chemically synthesized
ctcatgacttgtcaaatcag

SEQ ID NO: 600476 - DNA, 20 bp, Artificial Sequence
  chemically synthesized
tcctcccaacagaaaatcca

SEQ ID NO: 600477 - DNA, 20 bp, Artificial Sequence
  chemically synthesized
acatggtagaggtggttgag

SEQ ID NO: 600478 - DNA, 20 bp, Artificial Sequence
  chemically synthesized
ctcctcaaccacctctacca

SEQ ID NO: 600479 - DNA, 20 bp, Artificial Sequence
  chemically synthesized
tgcctcgacctcccaaagtg

SEQ ID NO: 600480 - DNA, 20 bp, Artificial Sequence
  chemically synthesized
tttcataaattatccaagtg

SEQ ID NO: 600481 - DNA, 20 bp, Artificial Sequence
  chemically synthesized
aatcccatagggaagaaata

SEQ ID NO: 600482 - DNA, 20 bp, Artificial Sequence
  chemically synthesized
aaacgatttatttcttccct

SEQ ID NO: 600483 - DNA, 20 bp, Artificial Sequence
  chemically synthesized
tgatattgactcaaaatgat

SEQ ID NO: 600484 - DNA, 20 bp, Artificial Sequence
  chemically synthesized
aaatagttgatattgactca

SEQ ID NO: 600485 - DNA, 20 bp, Artificial Sequence
  chemically synthesized
atatattatatgtagaattg

SEQ ID NO: 600486 - DNA, 20 bp, Artificial Sequence
  chemically synthesized
agattaacatcatgtctttg

SEQ ID NO: 600487 - DNA, 20 bp, Artificial Sequence
  chemically synthesized
caaagacatgatgttaatct

SEQ ID NO: 600488 - DNA, 20 bp, Artificial Sequence
  chemically synthesized
tgtcacagttggctgaatct

SEQ ID NO: 600489 - DNA, 20 bp, Artificial Sequence
  chemically synthesized
caggagaattgcttaagacc

SEQ ID NO: 600490 - DNA, 20 bp, Artificial Sequence
  chemically synthesized
gtgggaggctgagacaggag

SEQ ID NO: 600491 - DNA, 20 bp, Artificial Sequence
  chemically synthesized
tgtctcagcctcccacagag

SEQ ID NO: 600492 - DNA, 20 bp, Artificial Sequence
  chemically synthesized
tgacttccatttcttagatt

SEQ ID NO: 600493 - DNA, 20 bp, Artificial Sequence
  chemically synthesized
ggggcatttgacttccattt

SEQ ID NO: 600494 - DNA, 20 bp, Artificial Sequence
  chemically synthesized
tctatcagacaaatagcaat

SEQ ID NO: 600495 - DNA, 20 bp, Artificial Sequence
  chemically synthesized
tatttgtctgatagatattt

SEQ ID NO: 600496 - DNA, 20 bp, Artificial Sequence
  chemically synthesized
atttgatggcttccggcaga

SEQ ID NO: 600497 - DNA, 20 bp, Artificial Sequence
  chemically synthesized
tattgaatatataaatattg

SEQ ID NO: 600498 - DNA, 20 bp, Artificial Sequence
  chemically synthesized
ttgaccgctagctgattttg

SEQ ID NO: 600499 - DNA, 20 bp, Artificial Sequence
  chemically synthesized
attagaatgatttgaccgct

SEQ ID NO: 600500 - DNA, 20 bp, Artificial Sequence
  chemically synthesized
aatgactgaattttaaatta

SEQ ID NO: 600501 - DNA, 20 bp, Artificial Sequence
  chemically synthesized
taatttaaaattcagtcatt

SEQ ID NO: 600502 - DNA, 20 bp, Artificial Sequence
  chemically synthesized
ttatgggcactctggtataa

SEQ ID NO: 600503 - DNA, 20 bp, Artificial Sequence
  chemically synthesized
acatatcattagaagataac

SEQ ID NO: 600504 - DNA, 20 bp, Artificial Sequence
  chemically synthesized
tcattagaagataacatcag

SEQ ID NO: 600505 - DNA, 20 bp, Artificial Sequence
  chemically synthesized
agataacatcagttttgctt

SEQ ID NO: 600506 - DNA, 20 bp, Artificial Sequence
  chemically synthesized
ttgatttgcctctataattg

SEQ ID NO: 600507 - DNA, 20 bp, Artificial Sequence
  chemically synthesized
taactatttaggtaattcat

SEQ ID NO: 600508 - DNA, 20 bp, Artificial Sequence
  chemically synthesized
ttatatgcgtatttgctctc

SEQ ID NO: 600509 - DNA, 20 bp, Artificial Sequence
  chemically synthesized
accttgtgtgagaaatattg

SEQ ID NO: 600510 - DNA, 20 bp, Artificial Sequence
  chemically synthesized
cacctagatggatccctact

SEQ ID NO: 600511 - DNA, 20 bp, Artificial Sequence
  chemically synthesized
atccaattttatagattctg

SEQ ID NO: 600512 - DNA, 20 bp, Artificial Sequence
  chemically synthesized
tgcatacttccatccaattt

SEQ ID NO: 600513 - DNA, 20 bp, Artificial Sequence
  chemically synthesized
tggaagtatgcagggtggag

SEQ ID NO: 600514 - DNA, 20 bp, Artificial Sequence
  chemically synthesized
aaagcatctgttactcccag

SEQ ID NO: 600515 - DNA, 20 bp, Artificial Sequence
  chemically synthesized
taagcattgctgggagtaac

SEQ ID NO: 600516 - DNA, 20 bp, Artificial Sequence
  chemically synthesized
ttactggcccacctttttga

SEQ ID NO: 600517 - DNA, 20 bp, Artificial Sequence
  chemically synthesized
atgggtgatcagaatacaca

SEQ ID NO: 600518 - DNA, 20 bp, Artificial Sequence
  chemically synthesized
taattttctgagagagattc

SEQ ID NO: 600519 - DNA, 20 bp, Artificial Sequence
  chemically synthesized
tgtcaattctaattttctga

SEQ ID NO: 600520 - DNA, 20 bp, Artificial Sequence
  chemically synthesized
gaagagtctggtcaaactgt

SEQ ID NO: 600521 - DNA, 20 bp, Artificial Sequence
  chemically synthesized
gtgacacaattcgaagcact

SEQ ID NO: 600522 - DNA, 20 bp, Artificial Sequence
  chemically synthesized
gtgtcacatatactagcaaa

SEQ ID NO: 600523 - DNA, 20 bp, Artificial Sequence
  chemically synthesized
caaattgtgcttacgaagtc

SEQ ID NO: 600524 - DNA, 20 bp, Artificial Sequence
  chemically synthesized
acgaagtccctagtttgcag

SEQ ID NO: 600525 - DNA, 20 bp, Artificial Sequence
  chemically synthesized
gaggtggtaacaaaaacact

SEQ ID NO: 600526 - DNA, 20 bp, Artificial Sequence
  chemically synthesized
cataccgcattggaagccat

SEQ ID NO: 600527 - DNA, 20 bp, Artificial Sequence
  chemically synthesized
actgatggcttccaatgcgg

SEQ ID NO: 600528 - DNA, 20 bp, Artificial Sequence
  chemically synthesized
ttatttatttagttagttat

SEQ ID NO: 600529 - DNA, 20 bp, Artificial Sequence
  chemically synthesized
gttccagcctgggtgacaga

SEQ ID NO: 600530 - DNA, 20 bp, Artificial Sequence
  chemically synthesized
aacctccgcctcccaggttc

SEQ ID NO: 600531 - DNA, 20 bp, Artificial Sequence
  chemically synthesized
ttggttggctgaggcaggag

SEQ ID NO: 600532 - DNA, 20 bp, Artificial Sequence
  chemically synthesized
tgcctcagccaaccaagtag

SEQ ID NO: 600533 - DNA, 20 bp, Artificial Sequence
  chemically synthesized
tttatattttttagtagcga

SEQ ID NO: 600534 - DNA, 20 bp, Artificial Sequence
  chemically synthesized
acctcaggtgatccacctgc

SEQ ID NO: 600535 - DNA, 20 bp, Artificial Sequence
  chemically synthesized
tgcctcggcttcccaaagtg

SEQ ID NO: 600536 - DNA, 20 bp, Artificial Sequence
  chemically synthesized
accactccctcaacaagagg

SEQ ID NO: 600537 - DNA, 20 bp, Artificial Sequence
  chemically synthesized
caaagcagtcaaagagtcaa

SEQ ID NO: 600538 - DNA, 20 bp, Artificial Sequence
  chemically synthesized
taaatctgggttgactcttt

SEQ ID NO: 600539 - DNA, 20 bp, Artificial Sequence
  chemically synthesized
caaaagtccttaagtggcct

SEQ ID NO: 600540 - DNA, 20 bp, Artificial Sequence
  chemically synthesized
tctcagagcataatatgttg

SEQ ID NO: 600541 - DNA, 20 bp, Artificial Sequence
  chemically synthesized
tccatggcctttcgatgtta

SEQ ID NO: 600542 - DNA, 20 bp, Artificial Sequence
  chemically synthesized
aacatcgaaaggccatggat

SEQ ID NO: 600543 - DNA, 20 bp, Artificial Sequence
  chemically synthesized
tgcttcagcaacaatcacaa

SEQ ID NO: 600544 - DNA, 20 bp, Artificial Sequence
  chemically synthesized
gttgttggctgaaagccttg

SEQ ID NO: 600545 - DNA, 20 bp, Artificial Sequence
  chemically synthesized
gttctcttttgtggtttctt

SEQ ID NO: 600546 - DNA, 20 bp, Artificial Sequence
  chemically synthesized
tcacctggatggttctcttt

SEQ ID NO: 600547 - DNA, 20 bp, Artificial Sequence
  chemically synthesized
cacaaaagagaaccatccag

SEQ ID NO: 600548 - DNA, 20 bp, Artificial Sequence
  chemically synthesized
agccatttattattcccact

SEQ ID NO: 600549 - DNA, 20 bp, Artificial Sequence
  chemically synthesized
actcaagaagggactaatgc

SEQ ID NO: 600550 - DNA, 20 bp, Artificial Sequence
  chemically synthesized
atagaatccaagggcagtaa

SEQ ID NO: 600551 - DNA, 20 bp, Artificial Sequence
  chemically synthesized
gtcaaaactttattactgcc

SEQ ID NO: 600552 - DNA, 20 bp, Artificial Sequence
  chemically synthesized
ccttggattctatgacacat

SEQ ID NO: 600553 - DNA, 20 bp, Artificial Sequence
  chemically synthesized
atgaaaaacctttctctctc

SEQ ID NO: 600554 - DNA, 20 bp, Artificial Sequence
  chemically synthesized
aagcaaaacaaatgagagag

SEQ ID NO: 600555 - DNA, 20 bp, Artificial Sequence
  chemically synthesized
aaacctttctctctcatttg

SEQ ID NO: 600556 - DNA, 20 bp, Artificial Sequence
  chemically synthesized
ctctcttcaaccagaaatgc

SEQ ID NO: 600557 - DNA, 20 bp, Artificial Sequence
  chemically synthesized
ccttgtctctcttcaaccag

SEQ ID NO: 600558 - DNA, 20 bp, Artificial Sequence
  chemically synthesized
acagggcactgaagagcata

SEQ ID NO: 600559 - DNA, 20 bp, Artificial Sequence
  chemically synthesized
gggacataaagttatttaat

SEQ ID NO: 600560 - DNA, 20 bp, Artificial Sequence
  chemically synthesized
tgatcataatcacagataac

SEQ ID NO: 600561 - DNA, 20 bp, Artificial Sequence
  chemically synthesized
agcaataaaactactgttat

SEQ ID NO: 600562 - DNA, 20 bp, Artificial Sequence
  chemically synthesized
gcaaactcacttcaacatac

SEQ ID NO: 600563 - DNA, 20 bp, Artificial Sequence
  chemically synthesized
taaatcagcagtatgttgaa

SEQ ID NO: 600564 - DNA, 20 bp, Artificial Sequence
  chemically synthesized
tctctctgtacagacacaca

SEQ ID NO: 600565 - DNA, 20 bp, Artificial Sequence
  chemically synthesized
atacatattatacaaatgta

SEQ ID NO: 600566 - DNA, 20 bp, Artificial Sequence
  chemically synthesized
ttgtataatatgtatttttt

SEQ ID NO: 600567 - DNA, 20 bp, Artificial Sequence
  chemically synthesized
tctctctttctgctttcctc

SEQ ID NO: 600568 - DNA, 20 bp, Artificial Sequence
  chemically synthesized
gttctctctttgttctctct

SEQ ID NO: 600569 - DNA, 20 bp, Artificial Sequence
  chemically synthesized
gactgttctttctctttatt

SEQ ID NO: 600570 - DNA, 20 bp, Artificial Sequence
  chemically synthesized
aaattctcacatcaattgat

SEQ ID NO: 600571 - DNA, 20 bp, Artificial Sequence
  chemically synthesized
gagagagagaggtcaacagt

SEQ ID NO: 600572 - DNA, 20 bp, Artificial Sequence
  chemically synthesized
gtcattgacgagctcatgta

SEQ ID NO: 600573 - DNA, 20 bp, Artificial Sequence
  chemically synthesized
aatcaggccagcccttgaaa

SEQ ID NO: 600574 - DNA, 20 bp, Artificial Sequence
  chemically synthesized
aatcgtattttcaagggctg

SEQ ID NO: 600575 - DNA, 20 bp, Artificial Sequence
  chemically synthesized
tcaaggagcactctaataaa

SEQ ID NO: 600576 - DNA, 20 bp, Artificial Sequence
  chemically synthesized
tagccttaaagtatgttcaa

SEQ ID NO: 600577 - DNA, 20 bp, Artificial Sequence
  chemically synthesized
atgaaagaagccaacacata

SEQ ID NO: 600578 - DNA, 20 bp, Artificial Sequence
  chemically synthesized
taaaaaaaatcactttatgt

SEQ ID NO: 600579 - DNA, 20 bp, Artificial Sequence
  chemically synthesized
ttttaaatgtaagaagataa

SEQ ID NO: 600580 - DNA, 20 bp, Artificial Sequence
  chemically synthesized
ttaaacaggtttttttaaaa

SEQ ID NO: 600581 - DNA, 20 bp, Artificial Sequence
  chemically synthesized
ataaacttgattttaaaaaa

SEQ ID NO: 600582 - DNA, 20 bp, Artificial Sequence
  chemically synthesized
ctctggttttcttgctttaa

SEQ ID NO: 600583 - DNA, 20 bp, Artificial Sequence
  chemically synthesized
tttgtgcttcactctggttt

SEQ ID NO: 600584 - DNA, 20 bp, Artificial Sequence
  chemically synthesized
ccctgagctttgtgcttcac

SEQ ID NO: 600585 - DNA, 20 bp, Artificial Sequence
  chemically synthesized
ttttccgttggccctgagct

SEQ ID NO: 600586 - DNA, 20 bp, Artificial Sequence
  chemically synthesized
gttgatattttccgttggcc

SEQ ID NO: 600587 - DNA, 20 bp, Artificial Sequence
  chemically synthesized
cttgcgtcttcacatcttac

SEQ ID NO: 600588 - DNA, 20 bp, Artificial Sequence
  chemically synthesized
atgtgaagacgcaagaagtt

SEQ ID NO: 600589 - DNA, 20 bp, Artificial Sequence
  chemically synthesized
ttaaatcctggttactgtta

SEQ ID NO: 600590 - DNA, 20 bp, Artificial Sequence
  chemically synthesized
tgaaatcatgttaacagtaa

SEQ ID NO: 600591 - DNA, 20 bp, Artificial Sequence
  chemically synthesized
aatcaaggttcagaacatgt

SEQ ID NO: 600592 - DNA, 20 bp, Artificial Sequence
  chemically synthesized
aagcatcaacatgttctgaa

SEQ ID NO: 600593 - DNA, 20 bp, Artificial Sequence
  chemically synthesized
tgataatagcaagccagcaa

SEQ ID NO: 600594 - DNA, 20 bp, Artificial Sequence
  chemically synthesized
tcagataagaaaacttcatt

SEQ ID NO: 600595 - DNA, 20 bp, Artificial Sequence
  chemically synthesized
tttcttcagtagtcaactac

SEQ ID NO: 600596 - DNA, 20 bp, Artificial Sequence
  chemically synthesized
ctcagcagatacctagggtt

SEQ ID NO: 600597 - DNA, 20 bp, Artificial Sequence
  chemically synthesized
tctcatcctcagcagatacc

SEQ ID NO: 600598 - DNA, 20 bp, Artificial Sequence
  chemically synthesized
tcactttgatttaaattcca

SEQ ID NO: 600599 - DNA, 20 bp, Artificial Sequence
  chemically synthesized
ttgctattgaacttttatca

SEQ ID NO: 600600 - DNA, 20 bp, Artificial Sequence
  chemically synthesized
ttgtggagactgtgaaagga

SEQ ID NO: 600601 - DNA, 20 bp, Artificial Sequence
  chemically synthesized
gtgtattcttatttttttaa

SEQ ID NO: 600602 - DNA, 20 bp, Artificial Sequence
  chemically synthesized
ttttaaatacatgtacacag

SEQ ID NO: 600603 - DNA, 20 bp, Artificial Sequence
  chemically synthesized
atatctgtgtacatgtattt

SEQ ID NO: 600604 - DNA, 20 bp, Artificial Sequence
  chemically synthesized
ttttttttttttttttgttt

SEQ ID NO: 600605 - DNA, 20 bp, Artificial Sequence
  chemically synthesized
tcttttcttttttttttttt

SEQ ID NO: 600606 - DNA, 20 bp, Artificial Sequence
  chemically synthesized
tgtggtggtgaggatactga

SEQ ID NO: 600607 - DNA, 20 bp, Artificial Sequence
  chemically synthesized
gatgataaatacttatgtta

SEQ ID NO: 600608 - DNA, 20 bp, Artificial Sequence
  chemically synthesized
ttatgttaccttgggcatgt

SEQ ID NO: 600609 - DNA, 20 bp, Artificial Sequence
  chemically synthesized
agtataattgttagagggca

SEQ ID NO: 600610 - DNA, 20 bp, Artificial Sequence
  chemically synthesized
caattatactgcctctttaa

SEQ ID NO: 600611 - DNA, 20 bp, Artificial Sequence
  chemically synthesized
taaatgctatcaacatacga

SEQ ID NO: 600612 - DNA, 20 bp, Artificial Sequence
  chemically synthesized
caatttaattcaacaaatcg

SEQ ID NO: 600613 - DNA, 20 bp, Artificial Sequence
  chemically synthesized
ggaattgagtagtagaagct

SEQ ID NO: 600614 - DNA, 20 bp, Artificial Sequence
  chemically synthesized
ctacagtctgcctcttaaaa

SEQ ID NO: 600615 - DNA, 20 bp, Artificial Sequence
  chemically synthesized
ttctattacattgcatatat

SEQ ID NO: 600616 - DNA, 20 bp, Artificial Sequence
  chemically synthesized
gacaggccctggtgtgtgat

SEQ ID NO: 600617 - DNA, 20 bp, Artificial Sequence
  chemically synthesized
agggtacgtgtgcacaacat

SEQ ID NO: 600618 - DNA, 20 bp, Artificial Sequence
  chemically synthesized
tgatcacagagcatgggttt

SEQ ID NO: 600619 - DNA, 20 bp, Artificial Sequence
  chemically synthesized
tatctttctgatcacagagc

SEQ ID NO: 600620 - DNA, 20 bp, Artificial Sequence
  chemically synthesized
ttaatatctgctgtataatc

SEQ ID NO: 600621 - DNA, 20 bp, Artificial Sequence
  chemically synthesized
atgtaaatttcctaaaaatc

SEQ ID NO: 600622 - DNA, 20 bp, Artificial Sequence
  chemically synthesized
tggtgatttttaggaaattt

SEQ ID NO: 600623 - DNA, 20 bp, Artificial Sequence
  chemically synthesized
taactagcatatggctgaga

SEQ ID NO: 600624 - DNA, 20 bp, Artificial Sequence
  chemically synthesized
ggctgtaggaaacaagctag

SEQ ID NO: 600625 - DNA, 20 bp, Artificial Sequence
  chemically synthesized
cccaagcctaatctttgcta

SEQ ID NO: 600626 - DNA, 20 bp, Artificial Sequence
  chemically synthesized
aggaaacaagctagcaaaga

SEQ ID NO: 600627 - DNA, 20 bp, Artificial Sequence
  chemically synthesized
atgccccaagcctaatcttt

SEQ ID NO: 600628 - DNA, 20 bp, Artificial Sequence
  chemically synthesized
gcttggggcatgcagagtgt

SEQ ID NO: 600629 - DNA, 20 bp, Artificial Sequence
  chemically synthesized
tagtatgaagctacagaacc

SEQ ID NO: 600630 - DNA, 20 bp, Artificial Sequence
  chemically synthesized
ggcactgaaacttaaggttc

SEQ ID NO: 600631 - DNA, 20 bp, Artificial Sequence
  chemically synthesized
ttataaatagaaaattaaat

SEQ ID NO: 600632 - DNA, 20 bp, Artificial Sequence
  chemically synthesized
ctttgctttgctttgtaatg

SEQ ID NO: 600633 - DNA, 20 bp, Artificial Sequence
  chemically synthesized
gatcacttacgctatctttg

SEQ ID NO: 600634 - DNA, 20 bp, Artificial Sequence
  chemically synthesized
gcagtgatcacttacgctat

SEQ ID NO: 600635 - DNA, 20 bp, Artificial Sequence
  chemically synthesized
tcataaataataggaacaac

SEQ ID NO: 600636 - DNA, 20 bp, Artificial Sequence
  chemically synthesized
cctgccaacagataaaagtc

SEQ ID NO: 600637 - DNA, 20 bp, Artificial Sequence
  chemically synthesized
tgtatatttcaaattccatg

SEQ ID NO: 600638 - DNA, 20 bp, Artificial Sequence
  chemically synthesized
agttagaaaaactgttgagg

SEQ ID NO: 600639 - DNA, 20 bp, Artificial Sequence
  chemically synthesized
aaacacagaagctcatcctc

SEQ ID NO: 600640 - DNA, 20 bp, Artificial Sequence
  chemically synthesized
aaactgttgaggatgagctt

SEQ ID NO: 600641 - DNA, 20 bp, Artificial Sequence
  chemically synthesized
cacttttatatgatgttcaa

SEQ ID NO: 600642 - DNA, 20 bp, Artificial Sequence
  chemically synthesized
atatttgtagtactgttcca

SEQ ID NO: 600643 - DNA, 20 bp, Artificial Sequence
  chemically synthesized
aaaattttctttatgcattg

SEQ ID NO: 600644 - DNA, 20 bp, Artificial Sequence
  chemically synthesized
gttcatcttcaatttccaaa

SEQ ID NO: 600645 - DNA, 20 bp, Artificial Sequence
  chemically synthesized
gataacatctacaaagtgtt

SEQ ID NO: 600646 - DNA, 20 bp, Artificial Sequence
  chemically synthesized
acactttgtagatgttatcc

SEQ ID NO: 600647 - DNA, 20 bp, Artificial Sequence
  chemically synthesized
ttgccagagtgcatcataca

SEQ ID NO: 600648 - DNA, 20 bp, Artificial Sequence
  chemically synthesized
taaaatgtctttatatttcc

SEQ ID NO: 600649 - DNA, 20 bp, Artificial Sequence
  chemically synthesized
aatatgtgtcatgcatgttt

SEQ ID NO: 600650 - DNA, 20 bp, Artificial Sequence
  chemically synthesized
tgctggcaaatatgtgtcat

SEQ ID NO: 600651 - DNA, 20 bp, Artificial Sequence
  chemically synthesized
catttaaattgtaattaact

SEQ ID NO: 600652 - DNA, 20 bp, Artificial Sequence
  chemically synthesized
tctggaaccacataagtaaa

SEQ ID NO: 600653 - DNA, 20 bp, Artificial Sequence
  chemically synthesized
aaaatgcttagcactttagc

SEQ ID NO: 600654 - DNA, 20 bp, Artificial Sequence
  chemically synthesized
cataggagattgttcttccc

SEQ ID NO: 600655 - DNA, 20 bp, Artificial Sequence
  chemically synthesized
tttatgagtgatttttacat

SEQ ID NO: 600656 - DNA, 20 bp, Artificial Sequence
  chemically synthesized
attacattgtctttttttat

SEQ ID NO: 600657 - DNA, 20 bp, Artificial Sequence
  chemically synthesized
tctcataatgtcaaaaaaga

SEQ ID NO: 600658 - DNA, 20 bp, Artificial Sequence
  chemically synthesized
tggaagaaaacattggggat

SEQ ID NO: 600659 - DNA, 20 bp, Artificial Sequence
  chemically synthesized
cagattgaatcttctatccc

SEQ ID NO: 600660 - DNA, 20 bp, Artificial Sequence
  chemically synthesized
aagtagagagatcattttcc

SEQ ID NO: 600661 - DNA, 20 bp, Artificial Sequence
  chemically synthesized
aatgatctctctacttgtct

SEQ ID NO: 600662 - DNA, 20 bp, Artificial Sequence
  chemically synthesized
ttggcttatttgttttcttc

SEQ ID NO: 600663 - DNA, 20 bp, Artificial Sequence
  chemically synthesized
tagttgtatgtggttggctt

SEQ ID NO: 600664 - DNA, 20 bp, Artificial Sequence
  chemically synthesized
cacaagaatagttgtatgtg

SEQ ID NO: 600665 - DNA, 20 bp, Artificial Sequence
  chemically synthesized
tattcttgtgaaattatcag

SEQ ID NO: 600666 - DNA, 20 bp, Artificial Sequence
  chemically synthesized
actttgtttccattagagtt

SEQ ID NO: 600667 - DNA, 20 bp, Artificial Sequence
  chemically synthesized
tcctctcactttgtttccat

SEQ ID NO: 600668 - DNA, 20 bp, Artificial Sequence
  chemically synthesized
tgatttgctatgtcctctca

SEQ ID NO: 600669 - DNA, 20 bp, Artificial Sequence
  chemically synthesized
gtgagtgttcacatcagtat

SEQ ID NO: 600670 - DNA, 20 bp, Artificial Sequence
  chemically synthesized
atctagtgattctgaaaggt

SEQ ID NO: 600671 - DNA, 20 bp, Artificial Sequence
  chemically synthesized
atccagtacctttcagaatc

SEQ ID NO: 600672 - DNA, 20 bp, Artificial Sequence
  chemically synthesized
tgactttgatgaagaaaatc

SEQ ID NO: 600673 - DNA, 20 bp, Artificial Sequence
  chemically synthesized
tataatggaaagatgatata

SEQ ID NO: 600674 - DNA, 20 bp, Artificial Sequence
  chemically synthesized
cattatattaaaaaagacat

SEQ ID NO: 600675 - DNA, 20 bp, Artificial Sequence
  chemically synthesized
aaaatggttaattcgatttc

SEQ ID NO: 600676 - DNA, 20 bp, Artificial Sequence
  chemically synthesized
attcaatggaaaaatggtta

SEQ ID NO: 600677 - DNA, 20 bp, Artificial Sequence
  chemically synthesized
ttaaaatgtgattaatgttt

SEQ ID NO: 600678 - DNA, 20 bp, Artificial Sequence
  chemically synthesized
tcctatatttaaaatgtgat

SEQ ID NO: 600679 - DNA, 20 bp, Artificial Sequence
  chemically synthesized
tgtaaagtcctatatttaaa

SEQ ID NO: 600680 - DNA, 20 bp, Artificial Sequence
  chemically synthesized
gttaactgagcagagagcag

SEQ ID NO: 600681 - DNA, 20 bp, Artificial Sequence
  chemically synthesized
gagcagggctgtttttaaaa

SEQ ID NO: 600682 - DNA, 20 bp, Artificial Sequence
  chemically synthesized
gaatggtttgatgaggtaaa

SEQ ID NO: 600683 - DNA, 20 bp, Artificial Sequence
  chemically synthesized
tctgttactatatatatgag

SEQ ID NO: 600684 - DNA, 20 bp, Artificial Sequence
  chemically synthesized
aaatgatatcaaataattat

SEQ ID NO: 600685 - DNA, 20 bp, Artificial Sequence
  chemically synthesized
aaaatacttcatgttgagac

SEQ ID NO: 600686 - DNA, 20 bp, Artificial Sequence
  chemically synthesized
tgatggaggaacgtaccact

SEQ ID NO: 600687 - DNA, 20 bp, Artificial Sequence
  chemically synthesized
cttttgatatattttgtttc

SEQ ID NO: 600688 - DNA, 20 bp, Artificial Sequence
  chemically synthesized
cgaaagaaacaaaatatatc

SEQ ID NO: 600689 - DNA, 20 bp, Artificial Sequence
  chemically synthesized
atcccaaatcttttgatata

SEQ ID NO: 600690 - DNA, 20 bp, Artificial Sequence
  chemically synthesized
ttcatagaaaaaaaatgttg

SEQ ID NO: 600691 - DNA, 20 bp, Artificial Sequence
  chemically synthesized
gtaaaaaaagaagaaattca

SEQ ID NO: 600692 - DNA, 20 bp, Artificial Sequence
  chemically synthesized
aagtaactctacttgggggg

SEQ ID NO: 600693 - DNA, 20 bp, Artificial Sequence
  chemically synthesized
aattaaattttgtcagctaa

SEQ ID NO: 600694 - DNA, 20 bp, Artificial Sequence
  chemically synthesized
gtaggggagacactgaaata

SEQ ID NO: 600695 - DNA, 20 bp, Artificial Sequence
  chemically synthesized
cctacattgttccttgacat

SEQ ID NO: 600696 - DNA, 20 bp, Artificial Sequence
  chemically synthesized
tttctggaggaaaaagtgtc

SEQ ID NO: 600697 - DNA, 20 bp, Artificial Sequence
  chemically synthesized
ttttttgtattttcaaaaat

SEQ ID NO: 600698 - DNA, 20 bp, Artificial Sequence
  chemically synthesized
tatatgctttacttctctgc

SEQ ID NO: 600699 - DNA, 20 bp, Artificial Sequence
  chemically synthesized
aagattacgcagaaaaattt

SEQ ID NO: 600700 - DNA, 20 bp, Artificial Sequence
  chemically synthesized
ctgcgtaatcttgaccacag

SEQ ID NO: 600701 - DNA, 20 bp, Artificial Sequence
  chemically synthesized
atttttaaacggttctgtgg

SEQ ID NO: 600702 - DNA, 20 bp, Artificial Sequence
  chemically synthesized
aatatacctgagaaacgatg

SEQ ID NO: 600703 - DNA, 20 bp, Artificial Sequence
  chemically synthesized
gttattatgactaagcgtaa

SEQ ID NO: 600704 - DNA, 20 bp, Artificial Sequence
  chemically synthesized
cagttccatataaattttaa

SEQ ID NO: 600705 - DNA, 20 bp, Artificial Sequence
  chemically synthesized
gctgcagttccatataaatt

SEQ ID NO: 600706 - DNA, 20 bp, Artificial Sequence
  chemically synthesized
attcctccagtttcattctt

SEQ ID NO: 600707 - DNA, 20 bp, Artificial Sequence
  chemically synthesized
aagttaggtaaagtgattcc

SEQ ID NO: 600708 - DNA, 20 bp, Artificial Sequence
  chemically synthesized
gtataatttaaagttaggta

SEQ ID NO: 600709 - DNA, 20 bp, Artificial Sequence
  chemically synthesized
agtaaccgaaacagcatggt

SEQ ID NO: 600710 - DNA, 20 bp, Artificial Sequence
  chemically synthesized
ttgcgcttaagccagtacca

SEQ ID NO: 600711 - DNA, 20 bp, Artificial Sequence
  chemically synthesized
tgttctattgggctgtgtgt

SEQ ID NO: 600712 - DNA, 20 bp, Artificial Sequence
  chemically synthesized
ctattctgttctattgggct

SEQ ID NO: 600713 - DNA, 20 bp, Artificial Sequence
  chemically synthesized
aaattaggtccctgtagatg

SEQ ID NO: 600714 - DNA, 20 bp, Artificial Sequence
  chemically synthesized
tatacggttcaagatagagg

SEQ ID NO: 600715 - DNA, 20 bp, Artificial Sequence
  chemically synthesized
gtatacagaaatcaaatcaa

SEQ ID NO: 600716 - DNA, 20 bp, Artificial Sequence
  chemically synthesized
taagtatttaatccattttg

SEQ ID NO: 600717 - DNA, 20 bp, Artificial Sequence
  chemically synthesized
agatttaagtatttaatcca

SEQ ID NO: 600718 - DNA, 20 bp, Artificial Sequence
  chemically synthesized
gtagtttcataatttgaggt

SEQ ID NO: 600719 - DNA, 20 bp, Artificial Sequence
  chemically synthesized
ttctcccaaagttttcttgt

SEQ ID NO: 600720 - DNA, 20 bp, Artificial Sequence
  chemically synthesized
aatgttctggaggtttctcc

SEQ ID NO: 600721 - DNA, 20 bp, Artificial Sequence
  chemically synthesized
cttgcctagaccaatgttct

SEQ ID NO: 600722 - DNA, 20 bp, Artificial Sequence
  chemically synthesized
tccatttttgctttggttgc

SEQ ID NO: 600723 - DNA, 20 bp, Artificial Sequence
  chemically synthesized
gtgtgttaccatttgtccat

SEQ ID NO: 600724 - DNA, 20 bp, Artificial Sequence
  chemically synthesized
ggttgtatgctttgttgtga

SEQ ID NO: 600725 - DNA, 20 bp, Artificial Sequence
  chemically synthesized
gtctcttcactttgtgggtt

SEQ ID NO: 600726 - DNA, 20 bp, Artificial Sequence
  chemically synthesized
tattgatcccttgtcagatg

SEQ ID NO: 600727 - DNA, 20 bp, Artificial Sequence
  chemically synthesized
ttattagttttttcctatag

SEQ ID NO: 600728 - DNA, 20 bp, Artificial Sequence
  chemically synthesized
tctataggaaaaaactaata

SEQ ID NO: 600729 - DNA, 20 bp, Artificial Sequence
  chemically synthesized
tgcccatttttaatcagatt

SEQ ID NO: 600730 - DNA, 20 bp, Artificial Sequence
  chemically synthesized
agatattttgcccattttta

SEQ ID NO: 600731 - DNA, 20 bp, Artificial Sequence
  chemically synthesized
tattgagacccttttcatat

SEQ ID NO: 600732 - DNA, 20 bp, Artificial Sequence
  chemically synthesized
gagattatatctcactgtgg

SEQ ID NO: 600733 - DNA, 20 bp, Artificial Sequence
  chemically synthesized
gaagtgagattatatctcac

SEQ ID NO: 600734 - DNA, 20 bp, Artificial Sequence
  chemically synthesized
ataaaaccatttgagttgaa

SEQ ID NO: 600735 - DNA, 20 bp, Artificial Sequence
  chemically synthesized
tataatctcacttcaactca

SEQ ID NO: 600736 - DNA, 20 bp, Artificial Sequence
  chemically synthesized
cctcgccaacatttgttatt

SEQ ID NO: 600737 - DNA, 20 bp, Artificial Sequence
  chemically synthesized
atatcctcgccaacatttgt

SEQ ID NO: 600738 - DNA, 20 bp, Artificial Sequence
  chemically synthesized
ttgttttccatagtggttgt

SEQ ID NO: 600739 - DNA, 20 bp, Artificial Sequence
  chemically synthesized
tagtacaaccactatggaaa

SEQ ID NO: 600740 - DNA, 20 bp, Artificial Sequence
  chemically synthesized
accactatggaaaacaagtt

SEQ ID NO: 600741 - DNA, 20 bp, Artificial Sequence
  chemically synthesized
gttttttgaggaatctcaaa

SEQ ID NO: 600742 - DNA, 20 bp, Artificial Sequence
  chemically synthesized
gattgtatggtagctctgtt

SEQ ID NO: 600743 - DNA, 20 bp, Artificial Sequence
  chemically synthesized
attgctggattgtatggtag

SEQ ID NO: 600744 - DNA, 20 bp, Artificial Sequence
  chemically synthesized
atatacacagcagtgggatt

SEQ ID NO: 600745 - DNA, 20 bp, Artificial Sequence
  chemically synthesized
ttttgggtatatacacagca

SEQ ID NO: 600746 - DNA, 20 bp, Artificial Sequence
  chemically synthesized
gtacagatatttcttcagtg

SEQ ID NO: 600747 - DNA, 20 bp, Artificial Sequence
  chemically synthesized
ctgaagaaatatctgtactc

SEQ ID NO: 600748 - DNA, 20 bp, Artificial Sequence
  chemically synthesized
tgcggcactgttcacaaaag

SEQ ID NO: 600749 - DNA, 20 bp, Artificial Sequence
  chemically synthesized
cgttttttaatggacattta

SEQ ID NO: 600750 - DNA, 20 bp, Artificial Sequence
  chemically synthesized
aaaccatattttctttatcc

SEQ ID NO: 600751 - DNA, 20 bp, Artificial Sequence
  chemically synthesized
aaacgaatggataaagaaaa

SEQ ID NO: 600752 - DNA, 20 bp, Artificial Sequence
  chemically synthesized
attgtccctgtttgcagatg

SEQ ID NO: 600753 - DNA, 20 bp, Artificial Sequence
  chemically synthesized
aaaagaggaagtcaaattgt

SEQ ID NO: 600754 - DNA, 20 bp, Artificial Sequence
  chemically synthesized
gacaatttgacttcctcttt

SEQ ID NO: 600755 - DNA, 20 bp, Artificial Sequence
  chemically synthesized
agagggcatccctgtcttgt

SEQ ID NO: 600756 - DNA, 20 bp, Artificial Sequence
  chemically synthesized
cttgtgccagttttcaaagg

SEQ ID NO: 600757 - DNA, 20 bp, Artificial Sequence
  chemically synthesized
cagttttcaaagggaatgct

SEQ ID NO: 600758 - DNA, 20 bp, Artificial Sequence
  chemically synthesized
cattcagtatgatattggct

SEQ ID NO: 600759 - DNA, 20 bp, Artificial Sequence
  chemically synthesized
aagcctttgacaaaattcaa

SEQ ID NO: 600760 - DNA, 20 bp, Artificial Sequence
  chemically synthesized
aagcgttgttgaattttgtc

SEQ ID NO: 600761 - DNA, 20 bp, Artificial Sequence
  chemically synthesized
tgcatctattgagataatca

SEQ ID NO: 600762 - DNA, 20 bp, Artificial Sequence
  chemically synthesized
cagagccaaagacaaaaacc

SEQ ID NO: 600763 - DNA, 20 bp, Artificial Sequence
  chemically synthesized
catgtggtttttgtctttgg

SEQ ID NO: 600764 - DNA, 20 bp, Artificial Sequence
  chemically synthesized
gtctttggctctgtttagat

SEQ ID NO: 600765 - DNA, 20 bp, Artificial Sequence
  chemically synthesized
tttagatgctggattacatt

SEQ ID NO: 600766 - DNA, 20 bp, Artificial Sequence
  chemically synthesized
agcttatccaccatgatcaa

SEQ ID NO: 600767 - DNA, 20 bp, Artificial Sequence
  chemically synthesized
agcccacttgatcatggtgg

SEQ ID NO: 600768 - DNA, 20 bp, Artificial Sequence
  chemically synthesized
acgaatccagcagcacatca

SEQ ID NO: 600769 - DNA, 20 bp, Artificial Sequence
  chemically synthesized
gataagctttttgatgtgct

SEQ ID NO: 600770 - DNA, 20 bp, Artificial Sequence
  chemically synthesized
gctttttgatgtgctgctgg

SEQ ID NO: 600771 - DNA, 20 bp, Artificial Sequence
  chemically synthesized
tcgttttgcaagtattttat

SEQ ID NO: 600772 - DNA, 20 bp, Artificial Sequence
  chemically synthesized
cttttttggttgtgtctctg

SEQ ID NO: 600773 - DNA, 20 bp, Artificial Sequence
  chemically synthesized
ggcctcataaaatgagttag

SEQ ID NO: 600774 - DNA, 20 bp, Artificial Sequence
  chemically synthesized
gggaggattccctctttttc

SEQ ID NO: 600775 - DNA, 20 bp, Artificial Sequence
  chemically synthesized
cctctttttctatggattgg

SEQ ID NO: 600776 - DNA, 20 bp, Artificial Sequence
  chemically synthesized
gtgatgatgagcattttttc

SEQ ID NO: 600777 - DNA, 20 bp, Artificial Sequence
  chemically synthesized
gagatggtatctcattgtgg

SEQ ID NO: 600778 - DNA, 20 bp, Artificial Sequence
  chemically synthesized
ggtgtgagatggtatctcat

SEQ ID NO: 600779 - DNA, 20 bp, Artificial Sequence
  chemically synthesized
cctgttgtttcctgactttt

SEQ ID NO: 600780 - DNA, 20 bp, Artificial Sequence
  chemically synthesized
tccacatcctctccagcacc

SEQ ID NO: 600781 - DNA, 20 bp, Artificial Sequence
  chemically synthesized
ctgacttccacaatggttga

SEQ ID NO: 600782 - DNA, 20 bp, Artificial Sequence
  chemically synthesized
aaccattgtggaagtcagtg

SEQ ID NO: 600783 - DNA, 20 bp, Artificial Sequence
  chemically synthesized
gtgcatgtgtctttatagca

SEQ ID NO: 600784 - DNA, 20 bp, Artificial Sequence
  chemically synthesized
ctataaagacacatgcacac

SEQ ID NO: 600785 - DNA, 20 bp, Artificial Sequence
  chemically synthesized
caaatgtctcacaatgatac

SEQ ID NO: 600786 - DNA, 20 bp, Artificial Sequence
  chemically synthesized
gtttgctgagaatggtggtt

SEQ ID NO: 600787 - DNA, 20 bp, Artificial Sequence
  chemically synthesized
tgagatagtttgctgagaat

SEQ ID NO: 600788 - DNA, 20 bp, Artificial Sequence
  chemically synthesized
gtttggttttttgtccttga

SEQ ID NO: 600789 - DNA, 20 bp, Artificial Sequence
  chemically synthesized
atgagtgagaacatgcagtg

SEQ ID NO: 600790 - DNA, 20 bp, Artificial Sequence
  chemically synthesized
cacctatgagtgagaacatg

SEQ ID NO: 600791 - DNA, 20 bp, Artificial Sequence
  chemically synthesized
cttttttttattattatact

SEQ ID NO: 600792 - DNA, 20 bp, Artificial Sequence
  chemically synthesized
gggatgtttgtctttctgtg

SEQ ID NO: 600793 - DNA, 20 bp, Artificial Sequence
  chemically synthesized
cacaaataactgagaacatg

SEQ ID NO: 600794 - DNA, 20 bp, Artificial Sequence
  chemically synthesized
aaaaaattcagttgtactct

SEQ ID NO: 600795 - DNA, 20 bp, Artificial Sequence
  chemically synthesized
ttttttatatcacaaaggat

SEQ ID NO: 600796 - DNA, 20 bp, Artificial Sequence
  chemically synthesized
ggtgatagacaccccattta

SEQ ID NO: 600797 - DNA, 20 bp, Artificial Sequence
  chemically synthesized
tagacaccccatttaccctg

SEQ ID NO: 600798 - DNA, 20 bp, Artificial Sequence
  chemically synthesized
ctgtatcaaaatatctcatg

SEQ ID NO: 600799 - DNA, 20 bp, Artificial Sequence
  chemically synthesized
aaatacgttatttctatttt

SEQ ID NO: 600800 - DNA, 20 bp, Artificial Sequence
  chemically synthesized
attccaaaatgttccctaga

SEQ ID NO: 600801 - DNA, 20 bp, Artificial Sequence
  chemically synthesized
cagcattccaaaatgttccc

SEQ ID NO: 600802 - DNA, 20 bp, Artificial Sequence
  chemically synthesized
aatgctgcctagaaataatt

SEQ ID NO: 600803 - DNA, 20 bp, Artificial Sequence
  chemically synthesized
aagctgatattttaactcag

SEQ ID NO: 600804 - DNA, 20 bp, Artificial Sequence
  chemically synthesized
aagcagatctgagttaaaat

SEQ ID NO: 600805 - DNA, 20 bp, Artificial Sequence
  chemically synthesized
taaaatatcagcttcagtaa

SEQ ID NO: 600806 - DNA, 20 bp, Artificial Sequence
  chemically synthesized
tagtaatatcataatgttcc

SEQ ID NO: 600807 - DNA, 20 bp, Artificial Sequence
  chemically synthesized
ttgatatattctctattcaa

SEQ ID NO: 600808 - DNA, 20 bp, Artificial Sequence
  chemically synthesized
gtatgtaaattgtacctcaa

SEQ ID NO: 600809 - DNA, 20 bp, Artificial Sequence
  chemically synthesized
tttcctattgttcattgact

SEQ ID NO: 600810 - DNA, 20 bp, Artificial Sequence
  chemically synthesized
ttaataaaaaatgtcctaaa

SEQ ID NO: 600811 - DNA, 20 bp, Artificial Sequence
  chemically synthesized
atgtgaatgaaaatggacac

SEQ ID NO: 600812 - DNA, 20 bp, Artificial Sequence
  chemically synthesized
ccatgcctcaaccattcatc

SEQ ID NO: 600813 - DNA, 20 bp, Artificial Sequence
  chemically synthesized
agcctaatgaagtataaaag

SEQ ID NO: 600814 - DNA, 20 bp, Artificial Sequence
  chemically synthesized
ctgtaattaccaaataacgt

SEQ ID NO: 600815 - DNA, 20 bp, Artificial Sequence
  chemically synthesized
tttatgtattacctagtttt

SEQ ID NO: 600816 - DNA, 20 bp, Artificial Sequence
  chemically synthesized
tttagcctctttatgtatta

SEQ ID NO: 600817 - DNA, 20 bp, Artificial Sequence
  chemically synthesized
tactattcaaagtattttgg

SEQ ID NO: 600818 - DNA, 20 bp, Artificial Sequence
  chemically synthesized
aagtattttggaaaggtttt

SEQ ID NO: 600819 - DNA, 20 bp, Artificial Sequence
  chemically synthesized
agacttcttgtcataatgcc

SEQ ID NO: 600820 - DNA, 20 bp, Artificial Sequence
  chemically synthesized
atttagaaattgctggccac

SEQ ID NO: 600821 - DNA, 20 bp, Artificial Sequence
  chemically synthesized
gcaagatggcaaggaccacg

SEQ ID NO: 600822 - DNA, 20 bp, Artificial Sequence
  chemically synthesized
gcaaatttattgaattccac

SEQ ID NO: 600823 - DNA, 20 bp, Artificial Sequence
  chemically synthesized
tgtaagaccgtgggccaccc

SEQ ID NO: 600824 - DNA, 20 bp, Artificial Sequence
  chemically synthesized
aaaatttttaaaaagcaaat

SEQ ID NO: 600825 - DNA, 20 bp, Artificial Sequence
  chemically synthesized
tcgtgattgttaaatctttt

SEQ ID NO: 600826 - DNA, 20 bp, Artificial Sequence
  chemically synthesized
tatttttctttcagcgttta

SEQ ID NO: 600827 - DNA, 20 bp, Artificial Sequence
  chemically synthesized
actatgttttatttttcttt

SEQ ID NO: 600828 - DNA, 20 bp, Artificial Sequence
  chemically synthesized
ataacacttagcataacata

SEQ ID NO: 600829 - DNA, 20 bp, Artificial Sequence
  chemically synthesized
tagactggtgcaaaagtaat

SEQ ID NO: 600830 - DNA, 20 bp, Artificial Sequence
  chemically synthesized
ccttatatgtagaatttgta

SEQ ID NO: 600831 - DNA, 20 bp, Artificial Sequence
  chemically synthesized
agatttttacaaaagcatac

SEQ ID NO: 600832 - DNA, 20 bp, Artificial Sequence
  chemically synthesized
aagactgcaattaaactata

SEQ ID NO: 600833 - DNA, 20 bp, Artificial Sequence
  chemically synthesized
cactggctatatgataaaga

SEQ ID NO: 600834 - DNA, 20 bp, Artificial Sequence
  chemically synthesized
agtacagtcagtgacgtgtg

SEQ ID NO: 600835 - DNA, 20 bp, Artificial Sequence
  chemically synthesized
tattttacatttcctacaac

SEQ ID NO: 600836 - DNA, 20 bp, Artificial Sequence
  chemically synthesized
ttcctacaacttgtgtttat

SEQ ID NO: 600837 - DNA, 20 bp, Artificial Sequence
  chemically synthesized
aagaataacttgttagtttc

SEQ ID NO: 600838 - DNA, 20 bp, Artificial Sequence
  chemically synthesized
tctccatttaagaataactt

SEQ ID NO: 600839 - DNA, 20 bp, Artificial Sequence
  chemically synthesized
gggtggcctttcaatgttag

SEQ ID NO: 600840 - DNA, 20 bp, Artificial Sequence
  chemically synthesized
cagattcaaaattaaatgca

SEQ ID NO: 600841 - DNA, 20 bp, Artificial Sequence
  chemically synthesized
aagtctacatctatggctag

SEQ ID NO: 600842 - DNA, 20 bp, Artificial Sequence
  chemically synthesized
aaaaaaatggagaactaacc

SEQ ID NO: 600843 - DNA, 20 bp, Artificial Sequence
  chemically synthesized
taccacataaattccccttt

SEQ ID NO: 600844 - DNA, 20 bp, Artificial Sequence
  chemically synthesized
tgtaactttacagtctgctt

SEQ ID NO: 600845 - DNA, 20 bp, Artificial Sequence
  chemically synthesized
tggaacagtgtaactttaca

SEQ ID NO: 600846 - DNA, 20 bp, Artificial Sequence
  chemically synthesized
tgtaaagttacactgttcca

SEQ ID NO: 600847 - DNA, 20 bp, Artificial Sequence
  chemically synthesized
cttatagtgtaaataggcat

SEQ ID NO: 600848 - DNA, 20 bp, Artificial Sequence
  chemically synthesized
tgcctatttacactataaga

SEQ ID NO: 600849 - DNA, 20 bp, Artificial Sequence
  chemically synthesized
tttggtctatcagattgagc

SEQ ID NO: 600850 - DNA, 20 bp, Artificial Sequence
  chemically synthesized
gcagattttggtctatcaga

SEQ ID NO: 600851 - DNA, 20 bp, Artificial Sequence
  chemically synthesized
ataactgcagattttggtct

SEQ ID NO: 600852 - DNA, 20 bp, Artificial Sequence
  chemically synthesized
cttaaaaataaagatataac

SEQ ID NO: 600853 - DNA, 20 bp, Artificial Sequence
  chemically synthesized
ttatatctttatttttaagc

SEQ ID NO: 600854 - DNA, 20 bp, Artificial Sequence
  chemically synthesized
atttttaagccattgatttt

SEQ ID NO: 600855 - DNA, 20 bp, Artificial Sequence
  chemically synthesized
cattccaagctatcaaaatc

SEQ ID NO: 600856 - DNA, 20 bp, Artificial Sequence
  chemically synthesized
gaatgttaacatttaaagat

SEQ ID NO: 600857 - DNA, 20 bp, Artificial Sequence
  chemically synthesized
gattatatttaatgtgagtt

SEQ ID NO: 600858 - DNA, 20 bp, Artificial Sequence
  chemically synthesized
atttaatgtgagttataaga

SEQ ID NO: 600859 - DNA, 20 bp, Artificial Sequence
  chemically synthesized
tagcttctttgataaacacg

SEQ ID NO: 600860 - DNA, 20 bp, Artificial Sequence
  chemically synthesized
aattcgtaattgcaatcttc

SEQ ID NO: 600861 - DNA, 20 bp, Artificial Sequence
  chemically synthesized
cttaaagtgcatttaacgta

SEQ ID NO: 600862 - DNA, 20 bp, Artificial Sequence
  chemically synthesized
taacgtaattagtttaaatt

SEQ ID NO: 600863 - DNA, 20 bp, Artificial Sequence
  chemically synthesized
tagtttaaattaatagcttt

SEQ ID NO: 600864 - DNA, 20 bp, Artificial Sequence
  chemically synthesized
gtgagtacaatttagaaaag

SEQ ID NO: 600865 - DNA, 20 bp, Artificial Sequence
  chemically synthesized
gactctggaacacctgacgt

SEQ ID NO: 600866 - DNA, 20 bp, Artificial Sequence
  chemically synthesized
taaatattgaaaaatactgc

SEQ ID NO: 600867 - DNA, 20 bp, Artificial Sequence
  chemically synthesized
ggcactcttctttgaaggta

SEQ ID NO: 600868 - DNA, 20 bp, Artificial Sequence
  chemically synthesized
tgtaacctcgtgtcccacat

SEQ ID NO: 600869 - DNA, 20 bp, Artificial Sequence
  chemically synthesized
tccagtagctttactgttct

SEQ ID NO: 600870 - DNA, 20 bp, Artificial Sequence
  chemically synthesized
agttgcttagcagtggctcc

SEQ ID NO: 600871 - DNA, 20 bp, Artificial Sequence
  chemically synthesized
ccactgctaagcaactccgc

SEQ ID NO: 600872 - DNA, 20 bp, Artificial Sequence
  chemically synthesized
attactgcaagcaagagcgg

SEQ ID NO: 600873 - DNA, 20 bp, Artificial Sequence
  chemically synthesized
cagtaatttaagcaacaggg

SEQ ID NO: 600874 - DNA, 20 bp, Artificial Sequence
  chemically synthesized
tgtaggggaaaacatggccc

SEQ ID NO: 600875 - DNA, 20 bp, Artificial Sequence
  chemically synthesized
gttgggttgttcttacatat

SEQ ID NO: 600876 - DNA, 20 bp, Artificial Sequence
  chemically synthesized
ttttttccttttctactaat

SEQ ID NO: 600877 - DNA, 20 bp, Artificial Sequence
  chemically synthesized
ttacaaagatactttcacat

SEQ ID NO: 600878 - DNA, 20 bp, Artificial Sequence
  chemically synthesized
attttaggggacagtgacaa

SEQ ID NO: 600879 - DNA, 20 bp, Artificial Sequence
  chemically synthesized
atagttgtcactgtccccta

SEQ ID NO: 600880 - DNA, 20 bp, Artificial Sequence
  chemically synthesized
atgtttgaggctgaactctg

SEQ ID NO: 600881 - DNA, 20 bp, Artificial Sequence
  chemically synthesized
tatagatgtttgaggctgaa

SEQ ID NO: 600882 - DNA, 20 bp, Artificial Sequence
  chemically synthesized
acaaaaagaatgttcaatat

SEQ ID NO: 600883 - DNA, 20 bp, Artificial Sequence
  chemically synthesized
actggtgagattctctccta

SEQ ID NO: 600884 - DNA, 20 bp, Artificial Sequence
  chemically synthesized
aaataggagagaatctcacc

SEQ ID NO: 600885 - DNA, 20 bp, Artificial Sequence
  chemically synthesized
aggagagaatctcaccagta

SEQ ID NO: 600886 - DNA, 20 bp, Artificial Sequence
  chemically synthesized
gagtggcaatcaaactactg

SEQ ID NO: 600887 - DNA, 20 bp, Artificial Sequence
  chemically synthesized
attctcttctatgactgtgt

SEQ ID NO: 600888 - DNA, 20 bp, Artificial Sequence
  chemically synthesized
cattttctatcactcttcta

SEQ ID NO: 600889 - DNA, 20 bp, Artificial Sequence
  chemically synthesized
taatgtgtagctaattggag

SEQ ID NO: 600890 - DNA, 20 bp, Artificial Sequence
  chemically synthesized
ctacacattagaatgaataa

SEQ ID NO: 600891 - DNA, 20 bp, Artificial Sequence
  chemically synthesized
ttctgaagaccaaatccacc

SEQ ID NO: 600892 - DNA, 20 bp, Artificial Sequence
  chemically synthesized
aagaccaaatccacctaaag

SEQ ID NO: 600893 - DNA, 20 bp, Artificial Sequence
  chemically synthesized
gcaatcaaatcaaatcttta

SEQ ID NO: 600894 - DNA, 20 bp, Artificial Sequence
  chemically synthesized
caaatccacctaaagatttg

SEQ ID NO: 600895 - DNA, 20 bp, Artificial Sequence
  chemically synthesized
tggttacttagactgttgct

SEQ ID NO: 600896 - DNA, 20 bp, Artificial Sequence
  chemically synthesized
ttaggtgccaaaactaaact

SEQ ID NO: 600897 - DNA, 20 bp, Artificial Sequence
  chemically synthesized
ctatatattgaagcacagag

SEQ ID NO: 600898 - DNA, 20 bp, Artificial Sequence
  chemically synthesized
cagaactatatattgaagca

SEQ ID NO: 600899 - DNA, 20 bp, Artificial Sequence
  chemically synthesized
taaatgactaaatttgttcc

SEQ ID NO: 600900 - DNA, 20 bp, Artificial Sequence
  chemically synthesized
ttctttgcagtcacacaatt

SEQ ID NO: 600901 - DNA, 20 bp, Artificial Sequence
  chemically synthesized
ctaggattatttccaaagta

SEQ ID NO: 600902 - DNA, 20 bp, Artificial Sequence
  chemically synthesized
catagtactttggaaataat

SEQ ID NO: 600903 - DNA, 20 bp, Artificial Sequence
  chemically synthesized
actttggaaataatcctagt

SEQ ID NO: 600904 - DNA, 20 bp, Artificial Sequence
  chemically synthesized
tatatcttagaaaacagaaa

SEQ ID NO: 600905 - DNA, 20 bp, Artificial Sequence
  chemically synthesized
agatatatttccatatctag

SEQ ID NO: 600906 - DNA, 20 bp, Artificial Sequence
  chemically synthesized
tatctagaagagttttcccc

SEQ ID NO: 600907 - DNA, 20 bp, Artificial Sequence
  chemically synthesized
agttttccccatttgcttta

SEQ ID NO: 600908 - DNA, 20 bp, Artificial Sequence
  chemically synthesized
tattaaagtacaaaattaag

SEQ ID NO: 600909 - DNA, 20 bp, Artificial Sequence
  chemically synthesized
ccagtgtcagctcatttaat

SEQ ID NO: 600910 - DNA, 20 bp, Artificial Sequence
  chemically synthesized
cattaaatgagctgacactg

SEQ ID NO: 600911 - DNA, 20 bp, Artificial Sequence
  chemically synthesized
agactgtggtaccagtacca

SEQ ID NO: 600912 - DNA, 20 bp, Artificial Sequence
  chemically synthesized
aagtcaggtagcatgatgac

SEQ ID NO: 600913 - DNA, 20 bp, Artificial Sequence
  chemically synthesized
gatgactccagctttattct

SEQ ID NO: 600914 - DNA, 20 bp, Artificial Sequence
  chemically synthesized
tccagctttattcttttggc

SEQ ID NO: 600915 - DNA, 20 bp, Artificial Sequence
  chemically synthesized
tggttccatatgaactttaa

SEQ ID NO: 600916 - DNA, 20 bp, Artificial Sequence
  chemically synthesized
attctctgaagaaaggcatt

SEQ ID NO: 600917 - DNA, 20 bp, Artificial Sequence
  chemically synthesized
ccatactgcccaaggtaatt

SEQ ID NO: 600918 - DNA, 20 bp, Artificial Sequence
  chemically synthesized
tgagcatggaatgttcttcc

SEQ ID NO: 600919 - DNA, 20 bp, Artificial Sequence
  chemically synthesized
cctcttttatttcattgagc

SEQ ID NO: 600920 - DNA, 20 bp, Artificial Sequence
  chemically synthesized
gtccttcacatcccttgtaa

SEQ ID NO: 600921 - DNA, 20 bp, Artificial Sequence
  chemically synthesized
atgagtgaactcccattcgc

SEQ ID NO: 600922 - DNA, 20 bp, Artificial Sequence
  chemically synthesized
aattgcgaatgggagttcac

SEQ ID NO: 600923 - DNA, 20 bp, Artificial Sequence
  chemically synthesized
agttcactcatgatttggct

SEQ ID NO: 600924 - DNA, 20 bp, Artificial Sequence
  chemically synthesized
tgtctgttattggtgtataa

SEQ ID NO: 600925 - DNA, 20 bp, Artificial Sequence
  chemically synthesized
ttattggtgtataagaatgc

SEQ ID NO: 600926 - DNA, 20 bp, Artificial Sequence
  chemically synthesized
gaatgcttgtgatttttgca

SEQ ID NO: 600927 - DNA, 20 bp, Artificial Sequence
  chemically synthesized
gcatgctgagactttgctga

SEQ ID NO: 600928 - DNA, 20 bp, Artificial Sequence
  chemically synthesized
agactttgctgaagttgctt

SEQ ID NO: 600929 - DNA, 20 bp, Artificial Sequence
  chemically synthesized
tgaagttgcttatcagctta

SEQ ID NO: 600930 - DNA, 20 bp, Artificial Sequence
  chemically synthesized
gagattttgggctgagacaa

SEQ ID NO: 600931 - DNA, 20 bp, Artificial Sequence
  chemically synthesized
attgttcctgtttgcagatg

SEQ ID NO: 600932 - DNA, 20 bp, Artificial Sequence
  chemically synthesized
aaaagaggaagtcaaattgt

SEQ ID NO: 600933 - DNA, 20 bp, Artificial Sequence
  chemically synthesized
aacaatttgacttcctcttt

SEQ ID NO: 600934 - DNA, 20 bp, Artificial Sequence
  chemically synthesized
agagggcacccctgtcttgt

SEQ ID NO: 600935 - DNA, 20 bp, Artificial Sequence
  chemically synthesized
cttgtgccagttttcaaagg

SEQ ID NO: 600936 - DNA, 20 bp, Artificial Sequence
  chemically synthesized
cagttttcaaagggaatgct

SEQ ID NO: 600937 - DNA, 20 bp, Artificial Sequence
  chemically synthesized
catagatagctcttattatt

SEQ ID NO: 600938 - DNA, 20 bp, Artificial Sequence
  chemically synthesized
ttgagataatcatgtggtat

SEQ ID NO: 600939 - DNA, 20 bp, Artificial Sequence
  chemically synthesized
cagaaccaatcacaaatacc

SEQ ID NO: 600940 - DNA, 20 bp, Artificial Sequence
  chemically synthesized
catgtggtatttgtgattgg

SEQ ID NO: 600941 - DNA, 20 bp, Artificial Sequence
  chemically synthesized
gtgattggttctgtttatat

SEQ ID NO: 600942 - DNA, 20 bp, Artificial Sequence
  chemically synthesized
ggttctgtttatatgctgga

SEQ ID NO: 600943 - DNA, 20 bp, Artificial Sequence
  chemically synthesized
tttatatgctggattacgtt

SEQ ID NO: 600944 - DNA, 20 bp, Artificial Sequence
  chemically synthesized
agcttatgcaccatgaccaa

SEQ ID NO: 600945 - DNA, 20 bp, Artificial Sequence
  chemically synthesized
agcccacttggtcatggtgc

SEQ ID NO: 600946 - DNA, 20 bp, Artificial Sequence
  chemically synthesized
ccgaatccagcagcacatca

SEQ ID NO: 600947 - DNA, 20 bp, Artificial Sequence
  chemically synthesized
cataagctttttgatgtgct

SEQ ID NO: 600948 - DNA, 20 bp, Artificial Sequence
  chemically synthesized
ctttttgatgtgctgctgga

SEQ ID NO: 600949 - DNA, 20 bp, Artificial Sequence
  chemically synthesized
tcggtttgccagtattttat

SEQ ID NO: 600950 - DNA, 20 bp, Artificial Sequence
  chemically synthesized
ctgttttggtaccagtacca

SEQ ID NO: 600951 - DNA, 20 bp, Artificial Sequence
  chemically synthesized
tctgttccattgatctatat

SEQ ID NO: 600952 - DNA, 20 bp, Artificial Sequence
  chemically synthesized
agatatgtggcattatttat

SEQ ID NO: 600953 - DNA, 20 bp, Artificial Sequence
  chemically synthesized
ttccccatttcttgtttttg

SEQ ID NO: 600954 - DNA, 20 bp, Artificial Sequence
  chemically synthesized
cacaaaaacaagaaatgggg

SEQ ID NO: 600955 - DNA, 20 bp, Artificial Sequence
  chemically synthesized
tagggaatcgtttccccatt

SEQ ID NO: 600956 - DNA, 20 bp, Artificial Sequence
  chemically synthesized
gcaccatttattaaataggg

SEQ ID NO: 600957 - DNA, 20 bp, Artificial Sequence
  chemically synthesized
cagctttctacatatggcta

SEQ ID NO: 600958 - DNA, 20 bp, Artificial Sequence
  chemically synthesized
gtgtaaggaagggatccagt

SEQ ID NO: 600959 - DNA, 20 bp, Artificial Sequence
  chemically synthesized
tataaggtgtaaggaaggga

SEQ ID NO: 600960 - DNA, 20 bp, Artificial Sequence
  chemically synthesized
ttatacaaaaattaactcaa

SEQ ID NO: 600961 - DNA, 20 bp, Artificial Sequence
  chemically synthesized
aggttttcttctagggtttt

SEQ ID NO: 600962 - DNA, 20 bp, Artificial Sequence
  chemically synthesized
gtaatgcctaggttttcttc

SEQ ID NO: 600963 - DNA, 20 bp, Artificial Sequence
  chemically synthesized
tatgtcctgaatggtaatgc

SEQ ID NO: 600964 - DNA, 20 bp, Artificial Sequence
  chemically synthesized
gcttttgttgccattgcttt

SEQ ID NO: 600965 - DNA, 20 bp, Artificial Sequence
  chemically synthesized
tcaattttggcttttgttgc

SEQ ID NO: 600966 - DNA, 20 bp, Artificial Sequence
  chemically synthesized
attagatcccatttgtcaat

SEQ ID NO: 600967 - DNA, 20 bp, Artificial Sequence
  chemically synthesized
aatgggatctaattaaacta

SEQ ID NO: 600968 - DNA, 20 bp, Artificial Sequence
  chemically synthesized
cttttgctgtgcagaagctc

SEQ ID NO: 600969 - DNA, 20 bp, Artificial Sequence
  chemically synthesized
ggttgcctgttcactctgat

SEQ ID NO: 600970 - DNA, 20 bp, Artificial Sequence
  chemically synthesized
caggcaacctacagaatggg

SEQ ID NO: 600971 - DNA, 20 bp, Artificial Sequence
  chemically synthesized
gtacatttgtttgagttcat

SEQ ID NO: 600972 - DNA, 20 bp, Artificial Sequence
  chemically synthesized
tgtttgcttttttcttgtac

SEQ ID NO: 600973 - DNA, 20 bp, Artificial Sequence
  chemically synthesized
acccacttgttgatggggtt

SEQ ID NO: 600974 - DNA, 20 bp, Artificial Sequence
  chemically synthesized
cttcacccacttgttgatgg

SEQ ID NO: 600975 - DNA, 20 bp, Artificial Sequence
  chemically synthesized
tgtgagatggtatctcgttg

SEQ ID NO: 600976 - DNA, 20 bp, Artificial Sequence
  chemically synthesized
actggtgtgagatggtatct

SEQ ID NO: 600977 - DNA, 20 bp, Artificial Sequence
  chemically synthesized
tccacatcctctccagcacc

SEQ ID NO: 600978 - DNA, 20 bp, Artificial Sequence
  chemically synthesized
gtgacttccacaatggttga

SEQ ID NO: 600979 - DNA, 20 bp, Artificial Sequence
  chemically synthesized
aaccattgtggaagtcactg

SEQ ID NO: 600980 - DNA, 20 bp, Artificial Sequence
  chemically synthesized
ccgttactgggtatataccc

SEQ ID NO: 600981 - DNA, 20 bp, Artificial Sequence
  chemically synthesized
gtgcatgtgtctttatagca

SEQ ID NO: 600982 - DNA, 20 bp, Artificial Sequence
  chemically synthesized
ctataaagacacatgcacac

SEQ ID NO: 600983 - DNA, 20 bp, Artificial Sequence
  chemically synthesized
caaatgtctcacaatgatac

SEQ ID NO: 600984 - DNA, 20 bp, Artificial Sequence
  chemically synthesized
gtttgctgagaatgatggtt

SEQ ID NO: 600985 - DNA, 20 bp, Artificial Sequence
  chemically synthesized
tgcgatagtttgctgagaat

SEQ ID NO: 600986 - DNA, 20 bp, Artificial Sequence
  chemically synthesized
gtttggttttttgtccttgc

SEQ ID NO: 600987 - DNA, 20 bp, Artificial Sequence
  chemically synthesized
atgagtgagaacatgcggtg

SEQ ID NO: 600988 - DNA, 20 bp, Artificial Sequence
  chemically synthesized
cacctatgagtgagaacatg

SEQ ID NO: 600989 - DNA, 20 bp, Artificial Sequence
  chemically synthesized
cagtctttttttttaatact

SEQ ID NO: 600990 - DNA, 20 bp, Artificial Sequence
  chemically synthesized
gctgttacatcctggcagca

SEQ ID NO: 600991 - DNA, 20 bp, Artificial Sequence
  chemically synthesized
cagctttattttctaaaagt

SEQ ID NO: 600992 - DNA, 20 bp, Artificial Sequence
  chemically synthesized
ttattttctaaaagtgtaag

SEQ ID NO: 600993 - DNA, 20 bp, Artificial Sequence
  chemically synthesized
catgagcttacctacagaag

SEQ ID NO: 600994 - DNA, 20 bp, Artificial Sequence
  chemically synthesized
atgttacttattttagtgac

SEQ ID NO: 600995 - DNA, 20 bp, Artificial Sequence
  chemically synthesized
tctgggccctcagattctga

SEQ ID NO: 600996 - DNA, 20 bp, Artificial Sequence
  chemically synthesized
atcagttatttctctgggcc

SEQ ID NO: 600997 - DNA, 20 bp, Artificial Sequence
  chemically synthesized
ataaaagtagatgtagatca

SEQ ID NO: 600998 - DNA, 20 bp, Artificial Sequence
  chemically synthesized
agtatgcatttccttagtgc

SEQ ID NO: 600999 - DNA, 20 bp, Artificial Sequence
  chemically synthesized
ttattttttctgcattttaa

SEQ ID NO: 601000 - DNA, 20 bp, Artificial Sequence
  chemically synthesized
tgcagaaaaaataatgctct

SEQ ID NO: 601001 - DNA, 20 bp, Artificial Sequence
  chemically synthesized
actccaccgtgtggtgcact

SEQ ID NO: 601002 - DNA, 20 bp, Artificial Sequence
  chemically synthesized
tttctgtcatatactggtca

SEQ ID NO: 601003 - DNA, 20 bp, Artificial Sequence
  chemically synthesized
agtcctctttgaaatacctg

SEQ ID NO: 601004 - DNA, 20 bp, Artificial Sequence
  chemically synthesized
tggtaacttcatacattttt

SEQ ID NO: 601005 - DNA, 20 bp, Artificial Sequence
  chemically synthesized
cttttctcataaatggtata

SEQ ID NO: 601006 - DNA, 20 bp, Artificial Sequence
  chemically synthesized
aatgcattgtattaacaaaa

SEQ ID NO: 601007 - DNA, 20 bp, Artificial Sequence
  chemically synthesized
ggtggatagatggatggatg

SEQ ID NO: 601008 - DNA, 20 bp, Artificial Sequence
  chemically synthesized
tggatccttcatcttacaca

SEQ ID NO: 601009 - DNA, 20 bp, Artificial Sequence
  chemically synthesized
tttatttcatgggaatttcg

SEQ ID NO: 601010 - DNA, 20 bp, Artificial Sequence
  chemically synthesized
tcaggtactcagatttgctt

SEQ ID NO: 601011 - DNA, 20 bp, Artificial Sequence
  chemically synthesized
cagagttctcaggtactcag

SEQ ID NO: 601012 - DNA, 20 bp, Artificial Sequence
  chemically synthesized
tagaacagagttctcaggta

SEQ ID NO: 601013 - DNA, 20 bp, Artificial Sequence
  chemically synthesized
ttttaatatggcagtaagtg

SEQ ID NO: 601014 - DNA, 20 bp, Artificial Sequence
  chemically synthesized
cttaaaacattcttctgctc

SEQ ID NO: 601015 - DNA, 20 bp, Artificial Sequence
  chemically synthesized
aataaaaccctggagcagaa

SEQ ID NO: 601016 - DNA, 20 bp, Artificial Sequence
  chemically synthesized
ctggagcagaagaatgtttt

SEQ ID NO: 601017 - DNA, 20 bp, Artificial Sequence
  chemically synthesized
gaatgttttaagagctttca

SEQ ID NO: 601018 - DNA, 20 bp, Artificial Sequence
  chemically synthesized
gtgacctgaaatgcatggaa

SEQ ID NO: 601019 - DNA, 20 bp, Artificial Sequence
  chemically synthesized
atttcagatctacttcaaga

SEQ ID NO: 601020 - DNA, 20 bp, Artificial Sequence
  chemically synthesized
ttcataatttatctgtgttc

SEQ ID NO: 601021 - DNA, 20 bp, Artificial Sequence
  chemically synthesized
tttaatagcaaaatattttg

SEQ ID NO: 601022 - DNA, 20 bp, Artificial Sequence
  chemically synthesized
ttgtttttaatagcaaaata

SEQ ID NO: 601023 - DNA, 20 bp, Artificial Sequence
  chemically synthesized
attttgctattaaaaacaag

SEQ ID NO: 601024 - DNA, 20 bp, Artificial Sequence
  chemically synthesized
ttcaggattttataaacatt

SEQ ID NO: 601025 - DNA, 20 bp, Artificial Sequence
  chemically synthesized
tttcttatttagaaatggat

SEQ ID NO: 601026 - DNA, 20 bp, Artificial Sequence
  chemically synthesized
tgtgttttttcttatttaga

SEQ ID NO: 601027 - DNA, 20 bp, Artificial Sequence
  chemically synthesized
aggttgtgataaggggcact

SEQ ID NO: 601028 - DNA, 20 bp, Artificial Sequence
  chemically synthesized
atcacaacctgttcaactaa

SEQ ID NO: 601029 - DNA, 20 bp, Artificial Sequence
  chemically synthesized
tattgtctttcaaggaaaat

SEQ ID NO: 601030 - DNA, 20 bp, Artificial Sequence
  chemically synthesized
tccttgaaagacaatagtat

SEQ ID NO: 601031 - DNA, 20 bp, Artificial Sequence
  chemically synthesized
gaatactagacattaatatt

SEQ ID NO: 601032 - DNA, 20 bp, Artificial Sequence
  chemically synthesized
ttgaaggaatgtttgattaa

SEQ ID NO: 601033 - DNA, 20 bp, Artificial Sequence
  chemically synthesized
gacatgagttttgaaggaat

SEQ ID NO: 601034 - DNA, 20 bp, Artificial Sequence
  chemically synthesized
taatgacatgagttttgaag

SEQ ID NO: 601035 - DNA, 20 bp, Artificial Sequence
  chemically synthesized
attccttcaaaactcatgtc

SEQ ID NO: 601036 - DNA, 20 bp, Artificial Sequence
  chemically synthesized
ctttcatttaaactaatgac

SEQ ID NO: 601037 - DNA, 20 bp, Artificial Sequence
  chemically synthesized
ataaatgaaatacagagtag

SEQ ID NO: 601038 - DNA, 20 bp, Artificial Sequence
  chemically synthesized
aatgcatgataggaatgagt

SEQ ID NO: 601039 - DNA, 20 bp, Artificial Sequence
  chemically synthesized
atttagtgtgtctaccacgg

SEQ ID NO: 601040 - DNA, 20 bp, Artificial Sequence
  chemically synthesized
ccagtttgagtcataatgaa

SEQ ID NO: 601041 - DNA, 20 bp, Artificial Sequence
  chemically synthesized
ttaactattcctaagtccgt

SEQ ID NO: 601042 - DNA, 20 bp, Artificial Sequence
  chemically synthesized
gaatagttaattctagagaa

SEQ ID NO: 601043 - DNA, 20 bp, Artificial Sequence
  chemically synthesized
ttctagagaacctggcttgt

SEQ ID NO: 601044 - DNA, 20 bp, Artificial Sequence
  chemically synthesized
tgaaaaatatatatactgga

SEQ ID NO: 601045 - DNA, 20 bp, Artificial Sequence
  chemically synthesized
tattttagagggtaagtgtg

SEQ ID NO: 601046 - DNA, 20 bp, Artificial Sequence
  chemically synthesized
ttttaatttgtcttgatata

SEQ ID NO: 601047 - DNA, 20 bp, Artificial Sequence
  chemically synthesized
attaaaaattgaatcctcaa

SEQ ID NO: 601048 - DNA, 20 bp, Artificial Sequence
  chemically synthesized
gggataatagtaaacatact

SEQ ID NO: 601049 - DNA, 20 bp, Artificial Sequence
  chemically synthesized
tgcccagtggaaaactatga

SEQ ID NO: 601050 - DNA, 20 bp, Artificial Sequence
  chemically synthesized
cctgatgataaaatcctcat

SEQ ID NO: 601051 - DNA, 20 bp, Artificial Sequence
  chemically synthesized
ctatgatgaggattttatca

SEQ ID NO: 601052 - DNA, 20 bp, Artificial Sequence
  chemically synthesized
gcagagtataggtagttttg

SEQ ID NO: 601053 - DNA, 20 bp, Artificial Sequence
  chemically synthesized
ataatatgtggcagagtata

SEQ ID NO: 601054 - DNA, 20 bp, Artificial Sequence
  chemically synthesized
ttgcccagaacacctattaa

SEQ ID NO: 601055 - DNA, 20 bp, Artificial Sequence
  chemically synthesized
aatgaatttgggggtgatat

SEQ ID NO: 601056 - DNA, 20 bp, Artificial Sequence
  chemically synthesized
tgccagttggtgaagatgtc

SEQ ID NO: 601057 - DNA, 20 bp, Artificial Sequence
  chemically synthesized
tcttcaccaactggcaggga

SEQ ID NO: 601058 - DNA, 20 bp, Artificial Sequence
  chemically synthesized
caactggcagggagaaggct

SEQ ID NO: 601059 - DNA, 20 bp, Artificial Sequence
  chemically synthesized
ctctcatcatagcatggact

SEQ ID NO: 601060 - DNA, 20 bp, Artificial Sequence
  chemically synthesized
attgggttcacaacatgtat

SEQ ID NO: 601061 - DNA, 20 bp, Artificial Sequence
  chemically synthesized
tgtgtgatcgcaattactag

SEQ ID NO: 601062 - DNA, 20 bp, Artificial Sequence
  chemically synthesized
aatacctatgataacttcac

SEQ ID NO: 601063 - DNA, 20 bp, Artificial Sequence
  chemically synthesized
tttactcatttaaaagtcaa

SEQ ID NO: 601064 - DNA, 20 bp, Artificial Sequence
  chemically synthesized
cattctagaaaaacaggtaa

SEQ ID NO: 601065 - DNA, 20 bp, Artificial Sequence
  chemically synthesized
cgaaaatataaaacgtgttt

SEQ ID NO: 601066 - DNA, 20 bp, Artificial Sequence
  chemically synthesized
caggtaaacacgttttatat

SEQ ID NO: 601067 - DNA, 20 bp, Artificial Sequence
  chemically synthesized
cattcaaacgaaaatataaa

SEQ ID NO: 601068 - DNA, 20 bp, Artificial Sequence
  chemically synthesized
atagctacatgcactcactc

SEQ ID NO: 601069 - DNA, 20 bp, Artificial Sequence
  chemically synthesized
atcgataattttgtgttact

SEQ ID NO: 601070 - DNA, 20 bp, Artificial Sequence
  chemically synthesized
tcgtttagtcacatggtcta

SEQ ID NO: 601071 - DNA, 20 bp, Artificial Sequence
  chemically synthesized
atagaccatgtgactaaacg

SEQ ID NO: 601072 - DNA, 20 bp, Artificial Sequence
  chemically synthesized
caaacattttattataaact

SEQ ID NO: 601073 - DNA, 20 bp, Artificial Sequence
  chemically synthesized
taaacgaggagtttataata

SEQ ID NO: 601074 - DNA, 20 bp, Artificial Sequence
  chemically synthesized
gtttataataaaatgtttga

SEQ ID NO: 601075 - DNA, 20 bp, Artificial Sequence
  chemically synthesized
gaggcggaggttgcagtgag

SEQ ID NO: 601076 - DNA, 20 bp, Artificial Sequence
  chemically synthesized
aacctccgcctcccgtgttc

SEQ ID NO: 601077 - DNA, 20 bp, Artificial Sequence
  chemically synthesized
tgcctcagcctcccgagtag

SEQ ID NO: 601078 - DNA, 20 bp, Artificial Sequence
  chemically synthesized
actaaaaatacaaaaattag

SEQ ID NO: 601079 - DNA, 20 bp, Artificial Sequence
  chemically synthesized
ttttgtatttttagtagaga

SEQ ID NO: 601080 - DNA, 20 bp, Artificial Sequence
  chemically synthesized
ctggtcttgaactcctgaca

SEQ ID NO: 601081 - DNA, 20 bp, Artificial Sequence
  chemically synthesized
ggcctcagcatcccaaaggg

SEQ ID NO: 601082 - DNA, 20 bp, Artificial Sequence
  chemically synthesized
aggatagtaaatggtaaaga

SEQ ID NO: 601083 - DNA, 20 bp, Artificial Sequence
  chemically synthesized
ttctttaccatttactatcc

SEQ ID NO: 601084 - DNA, 20 bp, Artificial Sequence
  chemically synthesized
ttactatcctatggttttac

SEQ ID NO: 601085 - DNA, 20 bp, Artificial Sequence
  chemically synthesized
ggttttactctagcttttag

SEQ ID NO: 601086 - DNA, 20 bp, Artificial Sequence
  chemically synthesized
aagacaggagcaatacgttc

SEQ ID NO: 601087 - DNA, 20 bp, Artificial Sequence
  chemically synthesized
agggggtctagatcattagt

SEQ ID NO: 601088 - DNA, 20 bp, Artificial Sequence
  chemically synthesized
tccatggggttgttttgatt

SEQ ID NO: 601089 - DNA, 20 bp, Artificial Sequence
  chemically synthesized
actagttttccatggggttg

SEQ ID NO: 601090 - DNA, 20 bp, Artificial Sequence
  chemically synthesized
attcaactagttttccatgg

SEQ ID NO: 601091 - DNA, 20 bp, Artificial Sequence
  chemically synthesized
tctaactttaaatttattca

SEQ ID NO: 601092 - DNA, 20 bp, Artificial Sequence
  chemically synthesized
attacttcaacaaaatgttg

SEQ ID NO: 601093 - DNA, 20 bp, Artificial Sequence
  chemically synthesized
aataaaaacaaaagaatgga

SEQ ID NO: 601094 - DNA, 20 bp, Artificial Sequence
  chemically synthesized
ctgggaatcagcttccattc

SEQ ID NO: 601095 - DNA, 20 bp, Artificial Sequence
  chemically synthesized
ccaggcaagtacatctggga

SEQ ID NO: 601096 - DNA, 20 bp, Artificial Sequence
  chemically synthesized
tgattcccagatgtacttgc

SEQ ID NO: 601097 - DNA, 20 bp, Artificial Sequence
  chemically synthesized
tgtctgcaatataagctgcc

SEQ ID NO: 601098 - DNA, 20 bp, Artificial Sequence
  chemically synthesized
acattcattgacaagcagtt

SEQ ID NO: 601099 - DNA, 20 bp, Artificial Sequence
  chemically synthesized
gtcaatgaatgtgagggact

SEQ ID NO: 601100 - DNA, 20 bp, Artificial Sequence
  chemically synthesized
agggactcctggattaagtg

SEQ ID NO: 601101 - DNA, 20 bp, Artificial Sequence
  chemically synthesized
ttaggctgtaaggaggcaaa

SEQ ID NO: 601102 - DNA, 20 bp, Artificial Sequence
  chemically synthesized
ggaataagagtgtatcagtt

SEQ ID NO: 601103 - DNA, 20 bp, Artificial Sequence
  chemically synthesized
tcagttaaatgtttactctt

SEQ ID NO: 601104 - DNA, 20 bp, Artificial Sequence
  chemically synthesized
gaatcttcatttattgttca

SEQ ID NO: 601105 - DNA, 20 bp, Artificial Sequence
  chemically synthesized
taatcctgctgaacaataaa

SEQ ID NO: 601106 - DNA, 20 bp, Artificial Sequence
  chemically synthesized
gcgaaatctgtcttacaaaa

SEQ ID NO: 601107 - DNA, 20 bp, Artificial Sequence
  chemically synthesized
ccacaatcacctttttgtaa

SEQ ID NO: 601108 - DNA, 20 bp, Artificial Sequence
  chemically synthesized
cctttttgtaagacagattt

SEQ ID NO: 601109 - DNA, 20 bp, Artificial Sequence
  chemically synthesized
agagatccctgatcctatag

SEQ ID NO: 601110 - DNA, 20 bp, Artificial Sequence
  chemically synthesized
catgcagagatccctgatcc

SEQ ID NO: 601111 - DNA, 20 bp, Artificial Sequence
  chemically synthesized
cttaatgtacgtgatattgt

SEQ ID NO: 601112 - DNA, 20 bp, Artificial Sequence
  chemically synthesized
tttccttaatgtacgtgata

SEQ ID NO: 601113 - DNA, 20 bp, Artificial Sequence
  chemically synthesized
aagacagattgcaatgactg

SEQ ID NO: 601114 - DNA, 20 bp, Artificial Sequence
  chemically synthesized
ggaacattcgacctgagaaa

SEQ ID NO: 601115 - DNA, 20 bp, Artificial Sequence
  chemically synthesized
ctgatctcattatatagttc

SEQ ID NO: 601116 - DNA, 20 bp, Artificial Sequence
  chemically synthesized
tcattatatagttcaagaga

SEQ ID NO: 601117 - DNA, 20 bp, Artificial Sequence
  chemically synthesized
tatatagttcaagagatttg

SEQ ID NO: 601118 - DNA, 20 bp, Artificial Sequence
  chemically synthesized
aagcagattatctgtcttga

SEQ ID NO: 601119 - DNA, 20 bp, Artificial Sequence
  chemically synthesized
aatccaattcaagacagata

SEQ ID NO: 601120 - DNA, 20 bp, Artificial Sequence
  chemically synthesized
acatgtatctcactggtgga

SEQ ID NO: 601121 - DNA, 20 bp, Artificial Sequence
  chemically synthesized
ttgacaaggagctgattctg

SEQ ID NO: 601122 - DNA, 20 bp, Artificial Sequence
  chemically synthesized
aaattctgtttttgacaagg

SEQ ID NO: 601123 - DNA, 20 bp, Artificial Sequence
  chemically synthesized
aaccagactgttatctaaaa

SEQ ID NO: 601124 - DNA, 20 bp, Artificial Sequence
  chemically synthesized
attttagataacagtctggt

SEQ ID NO: 601125 - DNA, 20 bp, Artificial Sequence
  chemically synthesized
ttattttgaatactatttca

SEQ ID NO: 601126 - DNA, 20 bp, Artificial Sequence
  chemically synthesized
ctccctactttctttcacaa

SEQ ID NO: 601127 - DNA, 20 bp, Artificial Sequence
  chemically synthesized
ttcacaatttggattacaga

SEQ ID NO: 601128 - DNA, 20 bp, Artificial Sequence
  chemically synthesized
tacagaaattgtttgtacaa

SEQ ID NO: 601129 - DNA, 20 bp, Artificial Sequence
  chemically synthesized
caagattaattgcagctata

SEQ ID NO: 601130 - DNA, 20 bp, Artificial Sequence
  chemically synthesized
cctaatatagctgcaattaa

SEQ ID NO: 601131 - DNA, 20 bp, Artificial Sequence
  chemically synthesized
aatcatacttatagttacaa

SEQ ID NO: 601132 - DNA, 20 bp, Artificial Sequence
  chemically synthesized
aatcttgattgtaactataa

SEQ ID NO: 601133 - DNA, 20 bp, Artificial Sequence
  chemically synthesized
caagtataaataccatgctg

SEQ ID NO: 601134 - DNA, 20 bp, Artificial Sequence
  chemically synthesized
ccttaatatacaatgtaaag

SEQ ID NO: 601135 - DNA, 20 bp, Artificial Sequence
  chemically synthesized
tctttcccacagagcatgac

SEQ ID NO: 601136 - DNA, 20 bp, Artificial Sequence
  chemically synthesized
gactgaggttttaagatgat

SEQ ID NO: 601137 - DNA, 20 bp, Artificial Sequence
  chemically synthesized
ttacataaatactatacttt

SEQ ID NO: 601138 - DNA, 20 bp, Artificial Sequence
  chemically synthesized
aatgacatcactaatatttt

SEQ ID NO: 601139 - DNA, 20 bp, Artificial Sequence
  chemically synthesized
tcagtgaagccagcctataa

SEQ ID NO: 601140 - DNA, 20 bp, Artificial Sequence
  chemically synthesized
tgggcaaagctgtgttatag

SEQ ID NO: 601141 - DNA, 20 bp, Artificial Sequence
  chemically synthesized
ttagtctagatgcctttaac

SEQ ID NO: 601142 - DNA, 20 bp, Artificial Sequence
  chemically synthesized
tagactaaggcaaaagaaca

SEQ ID NO: 601143 - DNA, 20 bp, Artificial Sequence
  chemically synthesized
agtgatgctgcaggaagagg

SEQ ID NO: 601144 - DNA, 20 bp, Artificial Sequence
  chemically synthesized
taccataaattttgactcca

SEQ ID NO: 601145 - DNA, 20 bp, Artificial Sequence
  chemically synthesized
gactccattaagattttatc

SEQ ID NO: 601146 - DNA, 20 bp, Artificial Sequence
  chemically synthesized
aggagttcatgtgtgggagt

SEQ ID NO: 601147 - DNA, 20 bp, Artificial Sequence
  chemically synthesized
acctacttctcaactcccca

SEQ ID NO: 601148 - DNA, 20 bp, Artificial Sequence
  chemically synthesized
tcctccttctctgtattttt

SEQ ID NO: 601149 - DNA, 20 bp, Artificial Sequence
  chemically synthesized
cggtttcagcgaaaaacaaa

SEQ ID NO: 601150 - DNA, 20 bp, Artificial Sequence
  chemically synthesized
atctaataaagggaatcatt

SEQ ID NO: 601151 - DNA, 20 bp, Artificial Sequence
  chemically synthesized
ataataaataattagtgatt

SEQ ID NO: 601152 - DNA, 20 bp, Artificial Sequence
  chemically synthesized
tagaaggtataataaataat

SEQ ID NO: 601153 - DNA, 20 bp, Artificial Sequence
  chemically synthesized
tattataccttctaaatagt

SEQ ID NO: 601154 - DNA, 20 bp, Artificial Sequence
  chemically synthesized
aagacaatggagagagagag

SEQ ID NO: 601155 - DNA, 20 bp, Artificial Sequence
  chemically synthesized
atatttgaggtaagatatag

SEQ ID NO: 601156 - DNA, 20 bp, Artificial Sequence
  chemically synthesized
tatcttacctcaaatatgct

SEQ ID NO: 601157 - DNA, 20 bp, Artificial Sequence
  chemically synthesized
ttattgagagaacacattgc

SEQ ID NO: 601158 - DNA, 20 bp, Artificial Sequence
  chemically synthesized
gtgttctctcaataacgaat

SEQ ID NO: 601159 - DNA, 20 bp, Artificial Sequence
  chemically synthesized
gcttcctgtctaaaattctc

SEQ ID NO: 601160 - DNA, 20 bp, Artificial Sequence
  chemically synthesized
aaaaaaaaaaaaaaaaagaa

SEQ ID NO: 601161 - DNA, 20 bp, Artificial Sequence
  chemically synthesized
gaggcagaggttgcagtgag

SEQ ID NO: 601162 - DNA, 20 bp, Artificial Sequence
  chemically synthesized
aacctctgcctccctggttc

SEQ ID NO: 601163 - DNA, 20 bp, Artificial Sequence
  chemically synthesized
tgcctcagcctctcaagtag

SEQ ID NO: 601164 - DNA, 20 bp, Artificial Sequence
  chemically synthesized
ttttgtatttttagtagaga

SEQ ID NO: 601165 - DNA, 20 bp, Artificial Sequence
  chemically synthesized
tgggtggatcatcttaggtc

SEQ ID NO: 601166 - DNA, 20 bp, Artificial Sequence
  chemically synthesized
cacctcggcctccctaagtg

SEQ ID NO: 601167 - DNA, 20 bp, Artificial Sequence
  chemically synthesized
gtgagacattgcgcgcagcc

SEQ ID NO: 601168 - DNA, 20 bp, Artificial Sequence
  chemically synthesized
gccaaaagctttatccttaa

SEQ ID NO: 601169 - DNA, 20 bp, Artificial Sequence
  chemically synthesized
cttttaagccacattaagga

SEQ ID NO: 601170 - DNA, 20 bp, Artificial Sequence
  chemically synthesized
cccaacctacactgtggccc

SEQ ID NO: 601171 - DNA, 20 bp, Artificial Sequence
  chemically synthesized
tatgccagtaaaagggaaca

SEQ ID NO: 601172 - DNA, 20 bp, Artificial Sequence
  chemically synthesized
ccaataaaaggaagtcagaa

SEQ ID NO: 601173 - DNA, 20 bp, Artificial Sequence
  chemically synthesized
gttctttgaattttgtattt

SEQ ID NO: 601174 - DNA, 20 bp, Artificial Sequence
  chemically synthesized
tcaagttagagcacgtaaca

SEQ ID NO: 601175 - DNA, 20 bp, Artificial Sequence
  chemically synthesized
gtcatgtgagggaatgcata

SEQ ID NO: 601176 - DNA, 20 bp, Artificial Sequence
  chemically synthesized
agtaaatgcagaccattaat

SEQ ID NO: 601177 - DNA, 20 bp, Artificial Sequence
  chemically synthesized
actatcaactctaatgagtt

SEQ ID NO: 601178 - DNA, 20 bp, Artificial Sequence
  chemically synthesized
cagttcctagaatgaagccc

SEQ ID NO: 601179 - DNA, 20 bp, Artificial Sequence
  chemically synthesized
cccagtcataaataaagcta

SEQ ID NO: 601180 - DNA, 20 bp, Artificial Sequence
  chemically synthesized
gtctttgactatttaaagtt

SEQ ID NO: 601181 - DNA, 20 bp, Artificial Sequence
  chemically synthesized
cattttcgtctttgactatt

SEQ ID NO: 601182 - DNA, 20 bp, Artificial Sequence
  chemically synthesized
tttaaatagtcaaagacgaa

SEQ ID NO: 601183 - DNA, 20 bp, Artificial Sequence
  chemically synthesized
catctctgagcagtggtgac

SEQ ID NO: 601184 - DNA, 20 bp, Artificial Sequence
  chemically synthesized
atcttttggacaataaatct

SEQ ID NO: 601185 - DNA, 20 bp, Artificial Sequence
  chemically synthesized
acacttttaatacaaaaaca

SEQ ID NO: 601186 - DNA, 20 bp, Artificial Sequence
  chemically synthesized
ggatacagaattttaataga

SEQ ID NO: 601187 - DNA, 20 bp, Artificial Sequence
  chemically synthesized
tttctattaaaattctgtat

SEQ ID NO: 601188 - DNA, 20 bp, Artificial Sequence
  chemically synthesized
ctgtatccaagattggtgac

SEQ ID NO: 601189 - DNA, 20 bp, Artificial Sequence
  chemically synthesized
gccctatattccaattcaaa

SEQ ID NO: 601190 - DNA, 20 bp, Artificial Sequence
  chemically synthesized
tgactgagaacaaaaggaag

SEQ ID NO: 601191 - DNA, 20 bp, Artificial Sequence
  chemically synthesized
agtctcctctgcaatagagg

SEQ ID NO: 601192 - DNA, 20 bp, Artificial Sequence
  chemically synthesized
aattattacacgctgtgatt

SEQ ID NO: 601193 - DNA, 20 bp, Artificial Sequence
  chemically synthesized
ggctaggcaattattacacg

SEQ ID NO: 601194 - DNA, 20 bp, Artificial Sequence
  chemically synthesized
cagatgtgccttgtagagta

SEQ ID NO: 601195 - DNA, 20 bp, Artificial Sequence
  chemically synthesized
tgtactctacaaggcacatc

SEQ ID NO: 601196 - DNA, 20 bp, Artificial Sequence
  chemically synthesized
aagaattttgaggctagata

SEQ ID NO: 601197 - DNA, 20 bp, Artificial Sequence
  chemically synthesized
aatctcatgaatagaaaaag

SEQ ID NO: 601198 - DNA, 20 bp, Artificial Sequence
  chemically synthesized
aaacctaactttttctattc

SEQ ID NO: 601199 - DNA, 20 bp, Artificial Sequence
  chemically synthesized
ctatgagctgaaaggaacag

SEQ ID NO: 601200 - DNA, 20 bp, Artificial Sequence
  chemically synthesized
gcctgacagtcaataagaga

SEQ ID NO: 601201 - DNA, 20 bp, Artificial Sequence
  chemically synthesized
caataagagaggctgattta

SEQ ID NO: 601202 - DNA, 20 bp, Artificial Sequence
  chemically synthesized
gaggctgatttacacagatt

SEQ ID NO: 601203 - DNA, 20 bp, Artificial Sequence
  chemically synthesized
tgaaaagacctcatgtcaat

SEQ ID NO: 601204 - DNA, 20 bp, Artificial Sequence
  chemically synthesized
tgactagttgaaagaattct

SEQ ID NO: 601205 - DNA, 20 bp, Artificial Sequence
  chemically synthesized
tcagatgtttagaaatagaa

SEQ ID NO: 601206 - DNA, 20 bp, Artificial Sequence
  chemically synthesized
gctgccttctatttctaaac

SEQ ID NO: 601207 - DNA, 20 bp, Artificial Sequence
  chemically synthesized
ccatcagggtgcgcctaatc

SEQ ID NO: 601208 - DNA, 20 bp, Artificial Sequence
  chemically synthesized
aggcgcaccctgatggaatg

SEQ ID NO: 601209 - DNA, 20 bp, Artificial Sequence
  chemically synthesized
tatgaattttctgactttct

SEQ ID NO: 601210 - DNA, 20 bp, Artificial Sequence
  chemically synthesized
acctgtgctgtctcattgaa

SEQ ID NO: 601211 - DNA, 20 bp, Artificial Sequence
  chemically synthesized
gtagaaagtcttcaaccata

SEQ ID NO: 601212 - DNA, 20 bp, Artificial Sequence
  chemically synthesized
ttctggaacaacaacaaaaa

SEQ ID NO: 601213 - DNA, 20 bp, Artificial Sequence
  chemically synthesized
gttccagaatactgttccgc

SEQ ID NO: 601214 - DNA, 20 bp, Artificial Sequence
  chemically synthesized
tataattcctcttactgcta

SEQ ID NO: 601215 - DNA, 20 bp, Artificial Sequence
  chemically synthesized
tttctaactttccttatatt

SEQ ID NO: 601216 - DNA, 20 bp, Artificial Sequence
  chemically synthesized
ttcttggtaaccattactag

SEQ ID NO: 601217 - DNA, 20 bp, Artificial Sequence
  chemically synthesized
gtttttcttggtaaccatta

SEQ ID NO: 601218 - DNA, 20 bp, Artificial Sequence
  chemically synthesized
aaactgggttaaaatatatt

SEQ ID NO: 601219 - DNA, 20 bp, Artificial Sequence
  chemically synthesized
aaacacataatatattttaa

SEQ ID NO: 601220 - DNA, 20 bp, Artificial Sequence
  chemically synthesized
ttaatttgtgttaactttta

SEQ ID NO: 601221 - DNA, 20 bp, Artificial Sequence
  chemically synthesized
aagtactatggaaatataaa

SEQ ID NO: 601222 - DNA, 20 bp, Artificial Sequence
  chemically synthesized
aatataaaataagtttaaga

SEQ ID NO: 601223 - DNA, 20 bp, Artificial Sequence
  chemically synthesized
taagtttaagaaaaagtttt

SEQ ID NO: 601224 - DNA, 20 bp, Artificial Sequence
  chemically synthesized
gaaaaagttttaagagttta

SEQ ID NO: 601225 - DNA, 20 bp, Artificial Sequence
  chemically synthesized
agtcatctctacaatgaatt

SEQ ID NO: 601226 - DNA, 20 bp, Artificial Sequence
  chemically synthesized
gacatgctacactttgattt

SEQ ID NO: 601227 - DNA, 20 bp, Artificial Sequence
  chemically synthesized
agtttcttagacatgctaca

SEQ ID NO: 601228 - DNA, 20 bp, Artificial Sequence
  chemically synthesized
acatgcagagttttctcttc

SEQ ID NO: 601229 - DNA, 20 bp, Artificial Sequence
  chemically synthesized
tcggttttttatttcacatg

SEQ ID NO: 601230 - DNA, 20 bp, Artificial Sequence
  chemically synthesized
tacattttttggtttcaata

SEQ ID NO: 601231 - DNA, 20 bp, Artificial Sequence
  chemically synthesized
ttcatatgttaaatacattt

SEQ ID NO: 601232 - DNA, 20 bp, Artificial Sequence
  chemically synthesized
aatgtatttaacatatgaat

SEQ ID NO: 601233 - DNA, 20 bp, Artificial Sequence
  chemically synthesized
ttaaatgattttttttctaa

SEQ ID NO: 601234 - DNA, 20 bp, Artificial Sequence
  chemically synthesized
gttttttgtaaaatattatt

SEQ ID NO: 601235 - DNA, 20 bp, Artificial Sequence
  chemically synthesized
atacctagctcctttaatga

SEQ ID NO: 601236 - DNA, 20 bp, Artificial Sequence
  chemically synthesized
cagtaaaattgctttttgta

SEQ ID NO: 601237 - DNA, 20 bp, Artificial Sequence
  chemically synthesized
tcacctcataaatgcagtaa

SEQ ID NO: 601238 - DNA, 20 bp, Artificial Sequence
  chemically synthesized
ctgcatttatgaggtgatgg

SEQ ID NO: 601239 - DNA, 20 bp, Artificial Sequence
  chemically synthesized
ttatgaggtgatgggtaagc

SEQ ID NO: 601240 - DNA, 20 bp, Artificial Sequence
  chemically synthesized
tgggtaagcttatgcttgca

SEQ ID NO: 601241 - DNA, 20 bp, Artificial Sequence
  chemically synthesized
ttcttaatccatttgcaagc

SEQ ID NO: 601242 - DNA, 20 bp, Artificial Sequence
  chemically synthesized
atggattaagaatgtgggtg

SEQ ID NO: 601243 - DNA, 20 bp, Artificial Sequence
  chemically synthesized
aataaaagtgtcttattacg

SEQ ID NO: 601244 - DNA, 20 bp, Artificial Sequence
  chemically synthesized
taataagacacttttatttt

SEQ ID NO: 601245 - DNA, 20 bp, Artificial Sequence
  chemically synthesized
tttaaaactgctggaaattg

SEQ ID NO: 601246 - DNA, 20 bp, Artificial Sequence
  chemically synthesized
tgtaaaacatttcaatttcc

SEQ ID NO: 601247 - DNA, 20 bp, Artificial Sequence
  chemically synthesized
aatattttcttctgagtaaa

SEQ ID NO: 601248 - DNA, 20 bp, Artificial Sequence
  chemically synthesized
ctaaaatcactcataaaaat

SEQ ID NO: 601249 - DNA, 20 bp, Artificial Sequence
  chemically synthesized
aataaagccctcatttttat

SEQ ID NO: 601250 - DNA, 20 bp, Artificial Sequence
  chemically synthesized
atttgaattggaatttggga

SEQ ID NO: 601251 - DNA, 20 bp, Artificial Sequence
  chemically synthesized
tgctttatttgaattggaat

SEQ ID NO: 601252 - DNA, 20 bp, Artificial Sequence
  chemically synthesized
acttcaagactttgtcgttg

SEQ ID NO: 601253 - DNA, 20 bp, Artificial Sequence
  chemically synthesized
cagaaacttcaagactttgt

SEQ ID NO: 601254 - DNA, 20 bp, Artificial Sequence
  chemically synthesized
gcaaagcaacgacaaagtct

SEQ ID NO: 601255 - DNA, 20 bp, Artificial Sequence
  chemically synthesized
caacgacaaagtcttgaagt

SEQ ID NO: 601256 - DNA, 20 bp, Artificial Sequence
  chemically synthesized
agaaagtagagcaatatgga

SEQ ID NO: 601257 - DNA, 20 bp, Artificial Sequence
  chemically synthesized
gaagggcaggttgagtagga

SEQ ID NO: 601258 - DNA, 20 bp, Artificial Sequence
  chemically synthesized
gtttctgaagggcaggttga

SEQ ID NO: 601259 - DNA, 20 bp, Artificial Sequence
  chemically synthesized
gtcctctcatgggtctccac

SEQ ID NO: 601260 - DNA, 20 bp, Artificial Sequence
  chemically synthesized
agtgaagcgtggttgtcaaa

SEQ ID NO: 601261 - DNA, 20 bp, Artificial Sequence
  chemically synthesized
cattaatctccatttgacaa

SEQ ID NO: 601262 - DNA, 20 bp, Artificial Sequence
  chemically synthesized
gacaaccacgcttcacttca

SEQ ID NO: 601263 - DNA, 20 bp, Artificial Sequence
  chemically synthesized
cacttcacagagtttaccag

SEQ ID NO: 601264 - DNA, 20 bp, Artificial Sequence
  chemically synthesized
acttcagtggaccaagcaac

SEQ ID NO: 601265 - DNA, 20 bp, Artificial Sequence
  chemically synthesized
gcttgatccactgaagcaag

SEQ ID NO: 601266 - DNA, 20 bp, Artificial Sequence
  chemically synthesized
aaatagttggaccactgaac

SEQ ID NO: 601267 - DNA, 20 bp, Artificial Sequence
  chemically synthesized
gtggtccaactatttccttt

SEQ ID NO: 601268 - DNA, 20 bp, Artificial Sequence
  chemically synthesized
gaagagttaggtcaggagga

SEQ ID NO: 601269 - DNA, 20 bp, Artificial Sequence
  chemically synthesized
aatgcattcatatccatagt

SEQ ID NO: 601270 - DNA, 20 bp, Artificial Sequence
  chemically synthesized
gagacttattacttgttatt

SEQ ID NO: 601271 - DNA, 20 bp, Artificial Sequence
  chemically synthesized
ggaaatagcagggcatagca

SEQ ID NO: 601272 - DNA, 20 bp, Artificial Sequence
  chemically synthesized
ggtggagcaacaaaggcagg

SEQ ID NO: 601273 - DNA, 20 bp, Artificial Sequence
  chemically synthesized
cacttatactaaaactctct

SEQ ID NO: 601274 - DNA, 20 bp, Artificial Sequence
  chemically synthesized
gattctttctaaaaccttca

SEQ ID NO: 601275 - DNA, 20 bp, Artificial Sequence
  chemically synthesized
tctgggccatgaattcagaa

SEQ ID NO: 601276 - DNA, 20 bp, Artificial Sequence
  chemically synthesized
gggagagtagggatggctcc

SEQ ID NO: 601277 - DNA, 20 bp, Artificial Sequence
  chemically synthesized
ggatgacacctaattaccaa

SEQ ID NO: 601278 - DNA, 20 bp, Artificial Sequence
  chemically synthesized
ccaactctgcttctgaagat

SEQ ID NO: 601279 - DNA, 20 bp, Artificial Sequence
  chemically synthesized
ggggggcagcctgtactccc

SEQ ID NO: 601280 - DNA, 20 bp, Artificial Sequence
  chemically synthesized
tccccagtgcttggtgtggc

SEQ ID NO: 601281 - DNA, 20 bp, Artificial Sequence
  chemically synthesized
cgttcacttgacctattgag

SEQ ID NO: 601282 - DNA, 20 bp, Artificial Sequence
  chemically synthesized
gtgaacgtggaagaagacag

SEQ ID NO: 601283 - DNA, 20 bp, Artificial Sequence
  chemically synthesized
gcaagagtacctcaggatca

SEQ ID NO: 601284 - DNA, 20 bp, Artificial Sequence
  chemically synthesized
ctcaggatcaagaggcttga

SEQ ID NO: 601285 - DNA, 20 bp, Artificial Sequence
  chemically synthesized
cttaaagatggggaaaacaa

SEQ ID NO: 601286 - DNA, 20 bp, Artificial Sequence
  chemically synthesized
aagaagtcttgcagaagctc

SEQ ID NO: 601287 - DNA, 20 bp, Artificial Sequence
  chemically synthesized
gtgtaacagagatacaaagt

SEQ ID NO: 601288 - DNA, 20 bp, Artificial Sequence
  chemically synthesized
agctatttgtagctttgagt

SEQ ID NO: 601289 - DNA, 20 bp, Artificial Sequence
  chemically synthesized
ttaactagctatttgtagct

SEQ ID NO: 601290 - DNA, 20 bp, Artificial Sequence
  chemically synthesized
tctcctgttaactagctatt

SEQ ID NO: 601291 - DNA, 20 bp, Artificial Sequence
  chemically synthesized
ttctctggaaggcaagtgtg

SEQ ID NO: 601292 - DNA, 20 bp, Artificial Sequence
  chemically synthesized
ccagagaaagtcttttagac

SEQ ID NO: 601293 - DNA, 20 bp, Artificial Sequence
  chemically synthesized
aaagtcttttagaccatggc

SEQ ID NO: 601294 - DNA, 20 bp, Artificial Sequence
  chemically synthesized
tatgcttccttgtttccagc

SEQ ID NO: 601295 - DNA, 20 bp, Artificial Sequence
  chemically synthesized
atatttaatttaatatgctt

SEQ ID NO: 601296 - DNA, 20 bp, Artificial Sequence
  chemically synthesized
tcaatgtcatatttaattta

SEQ ID NO: 601297 - DNA, 20 bp, Artificial Sequence
  chemically synthesized
atattaaattaaatatgaca

SEQ ID NO: 601298 - DNA, 20 bp, Artificial Sequence
  chemically synthesized
gagattttaagctgaaccca

SEQ ID NO: 601299 - DNA, 20 bp, Artificial Sequence
  chemically synthesized
aagacttaaatctaattggg

SEQ ID NO: 601300 - DNA, 20 bp, Artificial Sequence
  chemically synthesized
atggcgccatgaatagatcc

SEQ ID NO: 601301 - DNA, 20 bp, Artificial Sequence
  chemically synthesized
ctggatgatgtaaaagcatt

SEQ ID NO: 601302 - DNA, 20 bp, Artificial Sequence
  chemically synthesized
ccagatagatcagaaacatg

SEQ ID NO: 601303 - DNA, 20 bp, Artificial Sequence
  chemically synthesized
actgtgttagtagtttgatg

SEQ ID NO: 601304 - DNA, 20 bp, Artificial Sequence
  chemically synthesized
ctgaattcgtggactgtgtt

SEQ ID NO: 601305 - DNA, 20 bp, Artificial Sequence
  chemically synthesized
tgtctatcattctcctttgc

SEQ ID NO: 601306 - DNA, 20 bp, Artificial Sequence
  chemically synthesized
tggtccagcagaagacagaa

SEQ ID NO: 601307 - DNA, 20 bp, Artificial Sequence
  chemically synthesized
tggagcattatagtagtatc

SEQ ID NO: 601308 - DNA, 20 bp, Artificial Sequence
  chemically synthesized
aaaagcatcaacatatctat

SEQ ID NO: 601309 - DNA, 20 bp, Artificial Sequence
  chemically synthesized
aaaagctaagatagatatgt

SEQ ID NO: 601310 - DNA, 20 bp, Artificial Sequence
  chemically synthesized
gtctcatgcaactgcaagtt

SEQ ID NO: 601311 - DNA, 20 bp, Artificial Sequence
  chemically synthesized
gacaggagcaatagttttca

SEQ ID NO: 601312 - DNA, 20 bp, Artificial Sequence
  chemically synthesized
ttgttgcatttgacaggagc

SEQ ID NO: 601313 - DNA, 20 bp, Artificial Sequence
  chemically synthesized
gtcaaatgcaacaacttgcc

SEQ ID NO: 601314 - DNA, 20 bp, Artificial Sequence
  chemically synthesized
cttctttaaagaccttagaa

SEQ ID NO: 601315 - DNA, 20 bp, Artificial Sequence
  chemically synthesized
taattcctgatacttttatg

SEQ ID NO: 601316 - DNA, 20 bp, Artificial Sequence
  chemically synthesized
aattggttcttacaattttt

SEQ ID NO: 601317 - DNA, 20 bp, Artificial Sequence
  chemically synthesized
ggtttcaccgtgtcagccag

SEQ ID NO: 601318 - DNA, 20 bp, Artificial Sequence
  chemically synthesized
tcctggctgacacggtgaaa

SEQ ID NO: 601319 - DNA, 20 bp, Artificial Sequence
  chemically synthesized
ttttgtatttttagtagaaa

SEQ ID NO: 601320 - DNA, 20 bp, Artificial Sequence
  chemically synthesized
atacaatgtgtgcttcaagt

SEQ ID NO: 601321 - DNA, 20 bp, Artificial Sequence
  chemically synthesized
tttcaagtgtacaatacaat

SEQ ID NO: 601322 - DNA, 20 bp, Artificial Sequence
  chemically synthesized
attgtacacttgaaaaatct

SEQ ID NO: 601323 - DNA, 20 bp, Artificial Sequence
  chemically synthesized
tacacttgaaaaatctttga

SEQ ID NO: 601324 - DNA, 20 bp, Artificial Sequence
  chemically synthesized
tgttcctatctaatcaatct

SEQ ID NO: 601325 - DNA, 20 bp, Artificial Sequence
  chemically synthesized
aaaaatttccagatgtctag

SEQ ID NO: 601326 - DNA, 20 bp, Artificial Sequence
  chemically synthesized
agatgtctagatatgcttat

SEQ ID NO: 601327 - DNA, 20 bp, Artificial Sequence
  chemically synthesized
atgcttataccagcttaatg

SEQ ID NO: 601328 - DNA, 20 bp, Artificial Sequence
  chemically synthesized
gttttccaaaaagaatagag

SEQ ID NO: 601329 - DNA, 20 bp, Artificial Sequence
  chemically synthesized
attttgaaaagggaattaaa

SEQ ID NO: 601330 - DNA, 20 bp, Artificial Sequence
  chemically synthesized
tgtaaattatcctcttctcc

SEQ ID NO: 601331 - DNA, 20 bp, Artificial Sequence
  chemically synthesized
accaatgctcatagctcatc

SEQ ID NO: 601332 - DNA, 20 bp, Artificial Sequence
  chemically synthesized
gctcatcacaagattcactt

SEQ ID NO: 601333 - DNA, 20 bp, Artificial Sequence
  chemically synthesized
aagattcactttgttgcttt

SEQ ID NO: 601334 - DNA, 20 bp, Artificial Sequence
  chemically synthesized
gactaagtaaattaaaacca

SEQ ID NO: 601335 - DNA, 20 bp, Artificial Sequence
  chemically synthesized
tttaaagtgggttaaagcaa

SEQ ID NO: 601336 - DNA, 20 bp, Artificial Sequence
  chemically synthesized
ctttaaatataactcttgtg

SEQ ID NO: 601337 - DNA, 20 bp, Artificial Sequence
  chemically synthesized
cttgtgaggggctttggtac

SEQ ID NO: 601338 - DNA, 20 bp, Artificial Sequence
  chemically synthesized
agaaggttacattattcacg

SEQ ID NO: 601339 - DNA, 20 bp, Artificial Sequence
  chemically synthesized
tacattattcacgaaaggct

SEQ ID NO: 601340 - DNA, 20 bp, Artificial Sequence
  chemically synthesized
ttcacgaaaggcttctagat

SEQ ID NO: 601341 - DNA, 20 bp, Artificial Sequence
  chemically synthesized
tttatgttttgttaatgtca

SEQ ID NO: 601342 - DNA, 20 bp, Artificial Sequence
  chemically synthesized
gagctccatgctcacggctt

SEQ ID NO: 601343 - DNA, 20 bp, Artificial Sequence
  chemically synthesized
aattataggagctccatgct

SEQ ID NO: 601344 - DNA, 20 bp, Artificial Sequence
  chemically synthesized
ttcctattaaccatgacacc

SEQ ID NO: 601345 - DNA, 20 bp, Artificial Sequence
  chemically synthesized
tcatggttaataggaacttc

SEQ ID NO: 601346 - DNA, 20 bp, Artificial Sequence
  chemically synthesized
taataggaacttcacctgtt

SEQ ID NO: 601347 - DNA, 20 bp, Artificial Sequence
  chemically synthesized
gaaggaagcatacttgaaag

SEQ ID NO: 601348 - DNA, 20 bp, Artificial Sequence
  chemically synthesized
ttcccaaacgttactttcaa

SEQ ID NO: 601349 - DNA, 20 bp, Artificial Sequence
  chemically synthesized
gatgtcaagttccattgata

SEQ ID NO: 601350 - DNA, 20 bp, Artificial Sequence
  chemically synthesized
ttgaccattctatcaatgct

SEQ ID NO: 601351 - DNA, 20 bp, Artificial Sequence
  chemically synthesized
agtaatatatctaagacatt

SEQ ID NO: 601352 - DNA, 20 bp, Artificial Sequence
  chemically synthesized
ctgccctgacaggagcaaac

SEQ ID NO: 601353 - DNA, 20 bp, Artificial Sequence
  chemically synthesized
ggagcaaactgatgctttat

SEQ ID NO: 601354 - DNA, 20 bp, Artificial Sequence
  chemically synthesized
ttttgaagcttaaataaagc

SEQ ID NO: 601355 - DNA, 20 bp, Artificial Sequence
  chemically synthesized
tgcttcattcactttctttt

SEQ ID NO: 601356 - DNA, 20 bp, Artificial Sequence
  chemically synthesized
cttattttatgtttactgaa

SEQ ID NO: 601357 - DNA, 20 bp, Artificial Sequence
  chemically synthesized
atgaatcctgtagacttatt

SEQ ID NO: 601358 - DNA, 20 bp, Artificial Sequence
  chemically synthesized
agtaaacataaaataagtct

SEQ ID NO: 601359 - DNA, 20 bp, Artificial Sequence
  chemically synthesized
gtctacaggattcatcatat

SEQ ID NO: 601360 - DNA, 20 bp, Artificial Sequence
  chemically synthesized
ggctcctgaaggtaccttga

SEQ ID NO: 601361 - DNA, 20 bp, Artificial Sequence
  chemically synthesized
tcaataaattattcactgcc

SEQ ID NO: 601362 - DNA, 20 bp, Artificial Sequence
  chemically synthesized
atatggaatagtgagacaga

SEQ ID NO: 601363 - DNA, 20 bp, Artificial Sequence
  chemically synthesized
ctgaccaagtcatccctaga

SEQ ID NO: 601364 - DNA, 20 bp, Artificial Sequence
  chemically synthesized
ccacatgttcaagcaaaata

SEQ ID NO: 601365 - DNA, 20 bp, Artificial Sequence
  chemically synthesized
tctcatgtataaactttata

SEQ ID NO: 601366 - DNA, 20 bp, Artificial Sequence
  chemically synthesized
ttttccaacttgattttatc

SEQ ID NO: 601367 - DNA, 20 bp, Artificial Sequence
  chemically synthesized
ttgacttctcatcttttcca

SEQ ID NO: 601368 - DNA, 20 bp, Artificial Sequence
  chemically synthesized
aaaattagaaaaaatgtagc

SEQ ID NO: 601369 - DNA, 20 bp, Artificial Sequence
  chemically synthesized
tggctaattaacctatacca

SEQ ID NO: 601370 - DNA, 20 bp, Artificial Sequence
  chemically synthesized
agttcatctacattgtaagg

SEQ ID NO: 601371 - DNA, 20 bp, Artificial Sequence
  chemically synthesized
agaaagccagagatgctgtg

SEQ ID NO: 601372 - DNA, 20 bp, Artificial Sequence
  chemically synthesized
aagaaactcaacacagcatc

SEQ ID NO: 601373 - DNA, 20 bp, Artificial Sequence
  chemically synthesized
tataaaaggaagtgtgatga

SEQ ID NO: 601374 - DNA, 20 bp, Artificial Sequence
  chemically synthesized
cacaggttgcctatgaataa

SEQ ID NO: 601375 - DNA, 20 bp, Artificial Sequence
  chemically synthesized
tgtatttcacactgcttgac

SEQ ID NO: 601376 - DNA, 20 bp, Artificial Sequence
  chemically synthesized
gttatcaaggctgtatttca

SEQ ID NO: 601377 - DNA, 20 bp, Artificial Sequence
  chemically synthesized
acagccttgataactagaaa

SEQ ID NO: 601378 - DNA, 20 bp, Artificial Sequence
  chemically synthesized
gatgtgcattagagatctct

SEQ ID NO: 601379 - DNA, 20 bp, Artificial Sequence
  chemically synthesized
gttctcttggactacagtgc

SEQ ID NO: 601380 - DNA, 20 bp, Artificial Sequence
  chemically synthesized
tttcatcctacccaattaca

SEQ ID NO: 601381 - DNA, 20 bp, Artificial Sequence
  chemically synthesized
ttatttatcacaaatactcc

SEQ ID NO: 601382 - DNA, 20 bp, Artificial Sequence
  chemically synthesized
aagttgatgtgcaaggcaca

SEQ ID NO: 601383 - DNA, 20 bp, Artificial Sequence
  chemically synthesized
tgtgcaaggcacagtatgct

SEQ ID NO: 601384 - DNA, 20 bp, Artificial Sequence
  chemically synthesized
attgtgtcctaaggttatta

SEQ ID NO: 601385 - DNA, 20 bp, Artificial Sequence
  chemically synthesized
gttgttaggatagacaagac

SEQ ID NO: 601386 - DNA, 20 bp, Artificial Sequence
  chemically synthesized
taccaggatctttggctctg

SEQ ID NO: 601387 - DNA, 20 bp, Artificial Sequence
  chemically synthesized
aggaacatggtgtatggaac

SEQ ID NO: 601388 - DNA, 20 bp, Artificial Sequence
  chemically synthesized
tatggaacagctgcttttcc

SEQ ID NO: 601389 - DNA, 20 bp, Artificial Sequence
  chemically synthesized
tgctttcgaaacattctgta

SEQ ID NO: 601390 - DNA, 20 bp, Artificial Sequence
  chemically synthesized
tactcctaaagcactataca

SEQ ID NO: 601391 - DNA, 20 bp, Artificial Sequence
  chemically synthesized
ggagtgcagaaagatgactc

SEQ ID NO: 601392 - DNA, 20 bp, Artificial Sequence
  chemically synthesized
attgtaatgcatcattctgc

SEQ ID NO: 601393 - DNA, 20 bp, Artificial Sequence
  chemically synthesized
ctggcagaatgatgcattac

SEQ ID NO: 601394 - DNA, 20 bp, Artificial Sequence
  chemically synthesized
gaccctagtctgtaacaagg

SEQ ID NO: 601395 - DNA, 20 bp, Artificial Sequence
  chemically synthesized
caaaatgttcttacaataca

SEQ ID NO: 601396 - DNA, 20 bp, Artificial Sequence
  chemically synthesized
accagtttatttctatttca

SEQ ID NO: 601397 - DNA, 20 bp, Artificial Sequence
  chemically synthesized
gagaagagaggaagtttgga

SEQ ID NO: 601398 - DNA, 20 bp, Artificial Sequence
  chemically synthesized
gtgaggacatagagaagaga

SEQ ID NO: 601399 - DNA, 20 bp, Artificial Sequence
  chemically synthesized
tgccaaataattccagcacg

SEQ ID NO: 601400 - DNA, 20 bp, Artificial Sequence
  chemically synthesized
ttggcatgggagaagaataa

SEQ ID NO: 601401 - DNA, 20 bp, Artificial Sequence
  chemically synthesized
gttaaagcgtcacaccggaa

SEQ ID NO: 601402 - DNA, 20 bp, Artificial Sequence
  chemically synthesized
gaataaacaggtttccggtg

SEQ ID NO: 601403 - DNA, 20 bp, Artificial Sequence
  chemically synthesized
ccggtgtgacgctttaactt

SEQ ID NO: 601404 - DNA, 20 bp, Artificial Sequence
  chemically synthesized
tcagctatatctgaggtatg

SEQ ID NO: 601405 - DNA, 20 bp, Artificial Sequence
  chemically synthesized
tgtcatacctcagatatagc

SEQ ID NO: 601406 - DNA, 20 bp, Artificial Sequence
  chemically synthesized
caatgcctacagccatgcag

SEQ ID NO: 601407 - DNA, 20 bp, Artificial Sequence
  chemically synthesized
ccgtgtcatcaaaaatctgc

SEQ ID NO: 601408 - DNA, 20 bp, Artificial Sequence
  chemically synthesized
aacgctttctaggaaactgc

SEQ ID NO: 601409 - DNA, 20 bp, Artificial Sequence
  chemically synthesized
gttccctgctgaagtagaat

SEQ ID NO: 601410 - DNA, 20 bp, Artificial Sequence
  chemically synthesized
tgaaggaaaaccactttttc

SEQ ID NO: 601411 - DNA, 20 bp, Artificial Sequence
  chemically synthesized
ctaaaccaagcagaggaaaa

SEQ ID NO: 601412 - DNA, 20 bp, Artificial Sequence
  chemically synthesized
gaaaaccactttttcctctg

SEQ ID NO: 601413 - DNA, 20 bp, Artificial Sequence
  chemically synthesized
tagttgttgaggaattggaa

SEQ ID NO: 601414 - DNA, 20 bp, Artificial Sequence
  chemically synthesized
aagttcattctgatgattat

SEQ ID NO: 601415 - DNA, 20 bp, Artificial Sequence
  chemically synthesized
gtatttggaaaagttcattc

SEQ ID NO: 601416 - DNA, 20 bp, Artificial Sequence
  chemically synthesized
tccctctgattttctaattt

SEQ ID NO: 601417 - DNA, 20 bp, Artificial Sequence
  chemically synthesized
acatacccacttttgactcc

SEQ ID NO: 601418 - DNA, 20 bp, Artificial Sequence
  chemically synthesized
aggtaagaaaatgcaatcag

SEQ ID NO: 601419 - DNA, 20 bp, Artificial Sequence
  chemically synthesized
ctcttttttgctgtaagccc

SEQ ID NO: 601420 - DNA, 20 bp, Artificial Sequence
  chemically synthesized
tccttactgtttctacctca

SEQ ID NO: 601421 - DNA, 20 bp, Artificial Sequence
  chemically synthesized
agaaaattggagaatttcct

SEQ ID NO: 601422 - DNA, 20 bp, Artificial Sequence
  chemically synthesized
tactaataaatatatgcatt

SEQ ID NO: 601423 - DNA, 20 bp, Artificial Sequence
  chemically synthesized
tggaatacactgcaaagaaa

SEQ ID NO: 601424 - DNA, 20 bp, Artificial Sequence
  chemically synthesized
tattcaggccaaatttctga

SEQ ID NO: 601425 - DNA, 20 bp, Artificial Sequence
  chemically synthesized
atttggcctgaatattaaat

SEQ ID NO: 601426 - DNA, 20 bp, Artificial Sequence
  chemically synthesized
gcctgaatattaaataacag

SEQ ID NO: 601427 - DNA, 20 bp, Artificial Sequence
  chemically synthesized
gcaagctacttcatagattc

SEQ ID NO: 601428 - DNA, 20 bp, Artificial Sequence
  chemically synthesized
tcaatctcaagaatctatga

SEQ ID NO: 601429 - DNA, 20 bp, Artificial Sequence
  chemically synthesized
gttttctttgcaagctactt

SEQ ID NO: 601430 - DNA, 20 bp, Artificial Sequence
  chemically synthesized
atgaagtagcttgcaaagaa

SEQ ID NO: 601431 - DNA, 20 bp, Artificial Sequence
  chemically synthesized
taccactctcaactttttaa

SEQ ID NO: 601432 - DNA, 20 bp, Artificial Sequence
  chemically synthesized
attcatctctctctttcatc

SEQ ID NO: 601433 - DNA, 20 bp, Artificial Sequence
  chemically synthesized
tcaataactttaattatcta

SEQ ID NO: 601434 - DNA, 20 bp, Artificial Sequence
  chemically synthesized
atagataattaaagttattg

SEQ ID NO: 601435 - DNA, 20 bp, Artificial Sequence
  chemically synthesized
taccttttcagaaaaattcc

SEQ ID NO: 601436 - DNA, 20 bp, Artificial Sequence
  chemically synthesized
tttggattgaagtttctctt

SEQ ID NO: 601437 - DNA, 20 bp, Artificial Sequence
  chemically synthesized
ttagtgataaatttttggat

SEQ ID NO: 601438 - DNA, 20 bp, Artificial Sequence
  chemically synthesized
tagcattttagtgataaatt

SEQ ID NO: 601439 - DNA, 20 bp, Artificial Sequence
  chemically synthesized
gctactttatcaatccatac

SEQ ID NO: 601440 - DNA, 20 bp, Artificial Sequence
  chemically synthesized
ttatcaatccatactactga

SEQ ID NO: 601441 - DNA, 20 bp, Artificial Sequence
  chemically synthesized
tgtaaaagctaaatcagtag

SEQ ID NO: 601442 - DNA, 20 bp, Artificial Sequence
  chemically synthesized
actactgatttagcttttac

SEQ ID NO: 601443 - DNA, 20 bp, Artificial Sequence
  chemically synthesized
tgatttagcttttacaactg

SEQ ID NO: 601444 - DNA, 20 bp, Artificial Sequence
  chemically synthesized
ctgattagtttttcggcctt

SEQ ID NO: 601445 - DNA, 20 bp, Artificial Sequence
  chemically synthesized
gttatttcttctgaagttgg

SEQ ID NO: 601446 - DNA, 20 bp, Artificial Sequence
  chemically synthesized
taatattcactctagacaaa

SEQ ID NO: 601447 - DNA, 20 bp, Artificial Sequence
  chemically synthesized
atcatgtactgcatttcaat

SEQ ID NO: 601448 - DNA, 20 bp, Artificial Sequence
  chemically synthesized
atcatatattgaaatgcagt

SEQ ID NO: 601449 - DNA, 20 bp, Artificial Sequence
  chemically synthesized
acatgattatatgtatacat

SEQ ID NO: 601450 - DNA, 20 bp, Artificial Sequence
  chemically synthesized
aaatacatgcaagtatatat

SEQ ID NO: 601451 - DNA, 20 bp, Artificial Sequence
  chemically synthesized
gacgaacaaaaacatttaac

SEQ ID NO: 601452 - DNA, 20 bp, Artificial Sequence
  chemically synthesized
tattatataaaacagtagtt

SEQ ID NO: 601453 - DNA, 20 bp, Artificial Sequence
  chemically synthesized
atgactgtccaaggaaacat

SEQ ID NO: 601454 - DNA, 20 bp, Artificial Sequence
  chemically synthesized
atttaccctacttcaatcaa

SEQ ID NO: 601455 - DNA, 20 bp, Artificial Sequence
  chemically synthesized
actacttacaaagaaaaaat

SEQ ID NO: 601456 - DNA, 20 bp, Artificial Sequence
  chemically synthesized
aagaaaaaatccatgattca

SEQ ID NO: 601457 - DNA, 20 bp, Artificial Sequence
  chemically synthesized
ttattttaatcaccatgaat

SEQ ID NO: 601458 - DNA, 20 bp, Artificial Sequence
  chemically synthesized
cacaaaagggtctgtggtga

SEQ ID NO: 601459 - DNA, 20 bp, Artificial Sequence
  chemically synthesized
attgtgtgagttaccttgat

SEQ ID NO: 601460 - DNA, 20 bp, Artificial Sequence
  chemically synthesized
accatcaattgtgtgagtta

SEQ ID NO: 601461 - DNA, 20 bp, Artificial Sequence
  chemically synthesized
tcttcttttgttatttgaga

SEQ ID NO: 601462 - DNA, 20 bp, Artificial Sequence
  chemically synthesized
cattaaagaggtctgggcta

SEQ ID NO: 601463 - DNA, 20 bp, Artificial Sequence
  chemically synthesized
tatgtgtaaatattacacaa

SEQ ID NO: 601464 - DNA, 20 bp, Artificial Sequence
  chemically synthesized
ttaattgaataaatggtcaa

SEQ ID NO: 601465 - DNA, 20 bp, Artificial Sequence
  chemically synthesized
cacagaggtctgccataata

SEQ ID NO: 601466 - DNA, 20 bp, Artificial Sequence
  chemically synthesized
tgcaatttttatataaagac

SEQ ID NO: 601467 - DNA, 20 bp, Artificial Sequence
  chemically synthesized
agcattcaacctaggagaag

SEQ ID NO: 601468 - DNA, 20 bp, Artificial Sequence
  chemically synthesized
atctttccatactttgaatt

SEQ ID NO: 601469 - DNA, 20 bp, Artificial Sequence
  chemically synthesized
gttaataatggatatagctt

SEQ ID NO: 601470 - DNA, 20 bp, Artificial Sequence
  chemically synthesized
cttagtgtgttaataatgga

SEQ ID NO: 601471 - DNA, 20 bp, Artificial Sequence
  chemically synthesized
ccattattaacacactaaga

SEQ ID NO: 601472 - DNA, 20 bp, Artificial Sequence
  chemically synthesized
gaggataattaattaacaat

SEQ ID NO: 601473 - DNA, 20 bp, Artificial Sequence
  chemically synthesized
taacaatttaggctcacttt

SEQ ID NO: 601474 - DNA, 20 bp, Artificial Sequence
  chemically synthesized
tacacctgaaatgcttttga

SEQ ID NO: 601475 - DNA, 20 bp, Artificial Sequence
  chemically synthesized
tttggttatttgtacacctg

SEQ ID NO: 601476 - DNA, 20 bp, Artificial Sequence
  chemically synthesized
tgtataagatgacacccgaa

SEQ ID NO: 601477 - DNA, 20 bp, Artificial Sequence
  chemically synthesized
ctgcataactgcacaggttg

SEQ ID NO: 601478 - DNA, 20 bp, Artificial Sequence
  chemically synthesized
ctgtgcagttatgcagtaac

SEQ ID NO: 601479 - DNA, 20 bp, Artificial Sequence
  chemically synthesized
taactcatgcttaggagagc

SEQ ID NO: 601480 - DNA, 20 bp, Artificial Sequence
  chemically synthesized
catgcttaggagagcccatg

SEQ ID NO: 601481 - DNA, 20 bp, Artificial Sequence
  chemically synthesized
gctctgctgttgccatctta

SEQ ID NO: 601482 - DNA, 20 bp, Artificial Sequence
  chemically synthesized
atgtcagtcttttagctgtt

SEQ ID NO: 601483 - DNA, 20 bp, Artificial Sequence
  chemically synthesized
ctctaacttaaccaatttaa

SEQ ID NO: 601484 - DNA, 20 bp, Artificial Sequence
  chemically synthesized
gaattaaattggttaagtta

SEQ ID NO: 601485 - DNA, 20 bp, Artificial Sequence
  chemically synthesized
atacttcagactagaatcct

SEQ ID NO: 601486 - DNA, 20 bp, Artificial Sequence
  chemically synthesized
ttgattatattctgaaacaa

SEQ ID NO: 601487 - DNA, 20 bp, Artificial Sequence
  chemically synthesized
gattagcatctccaggttgt

SEQ ID NO: 601488 - DNA, 20 bp, Artificial Sequence
  chemically synthesized
gggatttttctttgcgttat

SEQ ID NO: 601489 - DNA, 20 bp, Artificial Sequence
  chemically synthesized
gataacgcaaagaaaaatcc

SEQ ID NO: 601490 - DNA, 20 bp, Artificial Sequence
  chemically synthesized
gcaaagaaaaatcccttcgc

SEQ ID NO: 601491 - DNA, 20 bp, Artificial Sequence
  chemically synthesized
cgcatagaaaatcaaaagcg

SEQ ID NO: 601492 - DNA, 20 bp, Artificial Sequence
  chemically synthesized
attacgggagaaagtcagat

SEQ ID NO: 601493 - DNA, 20 bp, Artificial Sequence
  chemically synthesized
atattattctctaacacttc

SEQ ID NO: 601494 - DNA, 20 bp, Artificial Sequence
  chemically synthesized
ggagctcttttgttttaaag

SEQ ID NO: 601495 - DNA, 20 bp, Artificial Sequence
  chemically synthesized
gaataggagctcttttgttt

SEQ ID NO: 601496 - DNA, 20 bp, Artificial Sequence
  chemically synthesized
agtatttggaataggagctc

SEQ ID NO: 601497 - DNA, 20 bp, Artificial Sequence
  chemically synthesized
agtaggtaactctgttttca

SEQ ID NO: 601498 - DNA, 20 bp, Artificial Sequence
  chemically synthesized
tatccctgagaagtaggtaa

SEQ ID NO: 601499 - DNA, 20 bp, Artificial Sequence
  chemically synthesized
gtggagagtagtaagtttga

SEQ ID NO: 601500 - DNA, 20 bp, Artificial Sequence
  chemically synthesized
aggttctgaggtggagagta

SEQ ID NO: 601501 - DNA, 20 bp, Artificial Sequence
  chemically synthesized
atacacgagcaaaaaaaatg

SEQ ID NO: 601502 - DNA, 20 bp, Artificial Sequence
  chemically synthesized
gatcttcccttatactacaa

SEQ ID NO: 601503 - DNA, 20 bp, Artificial Sequence
  chemically synthesized
tcaggataataaaaatttaa

SEQ ID NO: 601504 - DNA, 20 bp, Artificial Sequence
  chemically synthesized
atagggcagaaaagatgtgt

SEQ ID NO: 601505 - DNA, 20 bp, Artificial Sequence
  chemically synthesized
ctttctcattttttcatcat

SEQ ID NO: 601506 - DNA, 20 bp, Artificial Sequence
  chemically synthesized
gaggaggaacaactgtgaga

SEQ ID NO: 601507 - DNA, 20 bp, Artificial Sequence
  chemically synthesized
caaagtgaggaggaacaact

SEQ ID NO: 601508 - DNA, 20 bp, Artificial Sequence
  chemically synthesized
tggttactgtagcactgtag

SEQ ID NO: 601509 - DNA, 20 bp, Artificial Sequence
  chemically synthesized
ctgtttttgtaccagtactg

SEQ ID NO: 601510 - DNA, 20 bp, Artificial Sequence
  chemically synthesized
tctgtttcattggtctatgt

SEQ ID NO: 601511 - DNA, 20 bp, Artificial Sequence
  chemically synthesized
cattatttctgggctttcca

SEQ ID NO: 601512 - DNA, 20 bp, Artificial Sequence
  chemically synthesized
ataggtgtgtggcattattt

SEQ ID NO: 601513 - DNA, 20 bp, Artificial Sequence
  chemically synthesized
tttcctcattgcttgctttt

SEQ ID NO: 601514 - DNA, 20 bp, Artificial Sequence
  chemically synthesized
tagggagtcctttcctcatt

SEQ ID NO: 601515 - DNA, 20 bp, Artificial Sequence
  chemically synthesized
ggaatagggagtcctttcct

SEQ ID NO: 601516 - DNA, 20 bp, Artificial Sequence
  chemically synthesized
gttgatttttgtatatggtg

SEQ ID NO: 601517 - DNA, 20 bp, Artificial Sequence
  chemically synthesized
taagtctttcattcatcttg

SEQ ID NO: 601518 - DNA, 20 bp, Artificial Sequence
  chemically synthesized
atcctccagggtttttaaag

SEQ ID NO: 601519 - DNA, 20 bp, Artificial Sequence
  chemically synthesized
aggttatcctccagggtttt

SEQ ID NO: 601520 - DNA, 20 bp, Artificial Sequence
  chemically synthesized
gtattgcctaggttatcctc

SEQ ID NO: 601521 - DNA, 20 bp, Artificial Sequence
  chemically synthesized
tcagtgtttgcttttgttgc

SEQ ID NO: 601522 - DNA, 20 bp, Artificial Sequence
  chemically synthesized
attaggtctcatttgtcagt

SEQ ID NO: 601523 - DNA, 20 bp, Artificial Sequence
  chemically synthesized
tttaattaggtctcatttgt

SEQ ID NO: 601524 - DNA, 20 bp, Artificial Sequence
  chemically synthesized
tttctcccgttctgtagttt

SEQ ID NO: 601525 - DNA, 20 bp, Artificial Sequence
  chemically synthesized
gcaaaatatttctcccgttc

SEQ ID NO: 601526 - DNA, 20 bp, Artificial Sequence
  chemically synthesized
tgttaaacctttatcagatt

SEQ ID NO: 601527 - DNA, 20 bp, Artificial Sequence
  chemically synthesized
ttgcaaactgtgaatctgat

SEQ ID NO: 601528 - DNA, 20 bp, Artificial Sequence
  chemically synthesized
attctggatgttaaaccttt

SEQ ID NO: 601529 - DNA, 20 bp, Artificial Sequence
  chemically synthesized
ataaatttgtttaagttact

SEQ ID NO: 601530 - DNA, 20 bp, Artificial Sequence
  chemically synthesized
gagtagagtttttaaaataa

SEQ ID NO: 601531 - DNA, 20 bp, Artificial Sequence
  chemically synthesized
tttgcccatttttaatggag

SEQ ID NO: 601532 - DNA, 20 bp, Artificial Sequence
  chemically synthesized
ggtgcgagatggcatcttat

SEQ ID NO: 601533 - DNA, 20 bp, Artificial Sequence
  chemically synthesized
ccaccagcagtgtataaatg

SEQ ID NO: 601534 - DNA, 20 bp, Artificial Sequence
  chemically synthesized
ttagttgagcccttgtggaa

SEQ ID NO: 601535 - DNA, 20 bp, Artificial Sequence
  chemically synthesized
ttctgtttttagctctgcca

SEQ ID NO: 601536 - DNA, 20 bp, Artificial Sequence
  chemically synthesized
ccggtaatggggttgctgtg

SEQ ID NO: 601537 - DNA, 20 bp, Artificial Sequence
  chemically synthesized
tctaccatggagggcattta

SEQ ID NO: 601538 - DNA, 20 bp, Artificial Sequence
  chemically synthesized
atttagttgtctgttcctgc

SEQ ID NO: 601539 - DNA, 20 bp, Artificial Sequence
  chemically synthesized
gaaaaaatacctatcaggta

SEQ ID NO: 601540 - DNA, 20 bp, Artificial Sequence
  chemically synthesized
tgtgtcatggggggttggtg

SEQ ID NO: 601541 - DNA, 20 bp, Artificial Sequence
  chemically synthesized
tacaccaaccccccatgaca

SEQ ID NO: 601542 - DNA, 20 bp, Artificial Sequence
  chemically synthesized
tttatgttctgggtatatat

SEQ ID NO: 601543 - DNA, 20 bp, Artificial Sequence
  chemically synthesized
atggtctcaacagatctagc

SEQ ID NO: 601544 - DNA, 20 bp, Artificial Sequence
  chemically synthesized
accaaaacttttaaaatgaa

SEQ ID NO: 601545 - DNA, 20 bp, Artificial Sequence
  chemically synthesized
caagaatcaaagttcatttt

SEQ ID NO: 601546 - DNA, 20 bp, Artificial Sequence
  chemically synthesized
aggtggagaaaacggtgttg

SEQ ID NO: 601547 - DNA, 20 bp, Artificial Sequence
  chemically synthesized
ctcctatcaaagctacccaa

SEQ ID NO: 601548 - DNA, 20 bp, Artificial Sequence
  chemically synthesized
ggagctgtcatctgagtatg

SEQ ID NO: 601549 - DNA, 20 bp, Artificial Sequence
  chemically synthesized
tataatactttatgcagtgt

SEQ ID NO: 601550 - DNA, 20 bp, Artificial Sequence
  chemically synthesized
tagaaaggaaagggagaaca

SEQ ID NO: 601551 - DNA, 20 bp, Artificial Sequence
  chemically synthesized
gggagaacattaagcttaaa

SEQ ID NO: 601552 - DNA, 20 bp, Artificial Sequence
  chemically synthesized
aagtgtgtatgaaacagtgt

SEQ ID NO: 601553 - DNA, 20 bp, Artificial Sequence
  chemically synthesized
ggatccaagtgtgtatgaaa

SEQ ID NO: 601554 - DNA, 20 bp, Artificial Sequence
  chemically synthesized
ttggatccagttggccaata

SEQ ID NO: 601555 - DNA, 20 bp, Artificial Sequence
  chemically synthesized
atttatgactgaaattggca

SEQ ID NO: 601556 - DNA, 20 bp, Artificial Sequence
  chemically synthesized
aattggcatggggttttcct

SEQ ID NO: 601557 - DNA, 20 bp, Artificial Sequence
  chemically synthesized
ttccttcctgtttcattttt

SEQ ID NO: 601558 - DNA, 20 bp, Artificial Sequence
  chemically synthesized
atattgccttgtatgttcta

SEQ ID NO: 601559 - DNA, 20 bp, Artificial Sequence
  chemically synthesized
tttgtaggaagacttttaat

SEQ ID NO: 601560 - DNA, 20 bp, Artificial Sequence
  chemically synthesized
gtgattaaatttctgtctcc

SEQ ID NO: 601561 - DNA, 20 bp, Artificial Sequence
  chemically synthesized
tagaaattcatccatttcat

SEQ ID NO: 601562 - DNA, 20 bp, Artificial Sequence
  chemically synthesized
taagtttctaaacttatttg

SEQ ID NO: 601563 - DNA, 20 bp, Artificial Sequence
  chemically synthesized
aaatactaaaagctatgcaa

SEQ ID NO: 601564 - DNA, 20 bp, Artificial Sequence
  chemically synthesized
tagttataacattttcatcc

SEQ ID NO: 601565 - DNA, 20 bp, Artificial Sequence
  chemically synthesized
tttcatccttaagattttat

SEQ ID NO: 601566 - DNA, 20 bp, Artificial Sequence
  chemically synthesized
tttgtttttacttccctctc

SEQ ID NO: 601567 - DNA, 20 bp, Artificial Sequence
  chemically synthesized
taaaatttaaatgcccatat

SEQ ID NO: 601568 - DNA, 20 bp, Artificial Sequence
  chemically synthesized
gaatatgggcatttaaattt

SEQ ID NO: 601569 - DNA, 20 bp, Artificial Sequence
  chemically synthesized
tttaaattttattgattcca

SEQ ID NO: 601570 - DNA, 20 bp, Artificial Sequence
  chemically synthesized
ttgagatgggcagttagctc

SEQ ID NO: 601571 - DNA, 20 bp, Artificial Sequence
  chemically synthesized
acaaaaattaacaggaacca

SEQ ID NO: 601572 - DNA, 20 bp, Artificial Sequence
  chemically synthesized
ccacaaattatttactttag

SEQ ID NO: 601573 - DNA, 20 bp, Artificial Sequence
  chemically synthesized
tactttagtcaagtttttac

SEQ ID NO: 601574 - DNA, 20 bp, Artificial Sequence
  chemically synthesized
gtcaagtttttactattgat

SEQ ID NO: 601575 - DNA, 20 bp, Artificial Sequence
  chemically synthesized
tacttcagatgaaatttaca

SEQ ID NO: 601576 - DNA, 20 bp, Artificial Sequence
  chemically synthesized
acaaaagttagtgaagatag

SEQ ID NO: 601577 - DNA, 20 bp, Artificial Sequence
  chemically synthesized
cacaactatatcagcatggt

SEQ ID NO: 601578 - DNA, 20 bp, Artificial Sequence
  chemically synthesized
tgtatttcttcttgttattc

SEQ ID NO: 601579 - DNA, 20 bp, Artificial Sequence
  chemically synthesized
cttcttgttattctgtggat

SEQ ID NO: 601580 - DNA, 20 bp, Artificial Sequence
  chemically synthesized
attctgtggatttttgcttt

SEQ ID NO: 601581 - DNA, 20 bp, Artificial Sequence
  chemically synthesized
aggtattttcccaggtatgt

SEQ ID NO: 601582 - DNA, 20 bp, Artificial Sequence
  chemically synthesized
cccaggtatgtacgagattt

SEQ ID NO: 601583 - DNA, 20 bp, Artificial Sequence
  chemically synthesized
gaggcagaggttgcagtgag

SEQ ID NO: 601584 - DNA, 20 bp, Artificial Sequence
  chemically synthesized
gctcactgcaacctctgcct

SEQ ID NO: 601585 - DNA, 20 bp, Artificial Sequence
  chemically synthesized
ttgggaggctgaggtgggag

SEQ ID NO: 601586 - DNA, 20 bp, Artificial Sequence
  chemically synthesized
tggtgcacgcctgtagtccc

SEQ ID NO: 601587 - DNA, 20 bp, Artificial Sequence
  chemically synthesized
ttttgtatttttagcagaga

SEQ ID NO: 601588 - DNA, 20 bp, Artificial Sequence
  chemically synthesized
gacggggtttcaccatgctg

SEQ ID NO: 601589 - DNA, 20 bp, Artificial Sequence
  chemically synthesized
cacctcggcctctcaaagtg

SEQ ID NO: 601590 - DNA, 20 bp, Artificial Sequence
  chemically synthesized
ccatgcccggccaggtatgt

SEQ ID NO: 601591 - DNA, 20 bp, Artificial Sequence
  chemically synthesized
gctggaaataaattaggtgt

SEQ ID NO: 601592 - DNA, 20 bp, Artificial Sequence
  chemically synthesized
aattaggtgtctaagctttt

SEQ ID NO: 601593 - DNA, 20 bp, Artificial Sequence
  chemically synthesized
ccgaaaaggattaatcaata

SEQ ID NO: 601594 - DNA, 20 bp, Artificial Sequence
  chemically synthesized
tgattaatccttttcggaaa

SEQ ID NO: 601595 - DNA, 20 bp, Artificial Sequence
  chemically synthesized
aatggaaacagattttccga

SEQ ID NO: 601596 - DNA, 20 bp, Artificial Sequence
  chemically synthesized
acacatatatcgaaaatgga

SEQ ID NO: 601597 - DNA, 20 bp, Artificial Sequence
  chemically synthesized
aagcatcaaaattcaaaata

SEQ ID NO: 601598 - DNA, 20 bp, Artificial Sequence
  chemically synthesized
aaacaatgtattttgaattt

SEQ ID NO: 601599 - DNA, 20 bp, Artificial Sequence
  chemically synthesized
ttttttttttttttttgagg

SEQ ID NO: 601600 - DNA, 20 bp, Artificial Sequence
  chemically synthesized
aacttccgttccctgggttc

SEQ ID NO: 601601 - DNA, 20 bp, Artificial Sequence
  chemically synthesized
tgtctcagcctcccgagtag

SEQ ID NO: 601602 - DNA, 20 bp, Artificial Sequence
  chemically synthesized
aaaaacccaaaaaaaagtat

SEQ ID NO: 601603 - DNA, 20 bp, Artificial Sequence
  chemically synthesized
ccaagcctggatactttttt

SEQ ID NO: 601604 - DNA, 20 bp, Artificial Sequence
  chemically synthesized
tgccttggcctcccaaagtg

SEQ ID NO: 601605 - DNA, 20 bp, Artificial Sequence
  chemically synthesized
tttatgctcatctcacattt

SEQ ID NO: 601606 - DNA, 20 bp, Artificial Sequence
  chemically synthesized
gctcatctcacatttttctg

SEQ ID NO: 601607 - DNA, 20 bp, Artificial Sequence
  chemically synthesized
tctgttttgttttccttctt

SEQ ID NO: 601608 - DNA, 20 bp, Artificial Sequence
  chemically synthesized
ttctttcttgctttactgcg

SEQ ID NO: 601609 - DNA, 20 bp, Artificial Sequence
  chemically synthesized
gaactgttccttttatcatt

SEQ ID NO: 601610 - DNA, 20 bp, Artificial Sequence
  chemically synthesized
tgttccttttatcattcttt

SEQ ID NO: 601611 - DNA, 20 bp, Artificial Sequence
  chemically synthesized
atttagaaagagggtagaga

SEQ ID NO: 601612 - DNA, 20 bp, Artificial Sequence
  chemically synthesized
tctaccctctttctaaataa

SEQ ID NO: 601613 - DNA, 20 bp, Artificial Sequence
  chemically synthesized
gtggctgtaactcccctcca

SEQ ID NO: 601614 - DNA, 20 bp, Artificial Sequence
  chemically synthesized
aaataatgttgatctaaaat

SEQ ID NO: 601615 - DNA, 20 bp, Artificial Sequence
  chemically synthesized
aacaaatgccttttgtattt

SEQ ID NO: 601616 - DNA, 20 bp, Artificial Sequence
  chemically synthesized
taagtatgatgaaaaaatag

SEQ ID NO: 601617 - DNA, 20 bp, Artificial Sequence
  chemically synthesized
gtagtagaaaaataagtttt

SEQ ID NO: 601618 - DNA, 20 bp, Artificial Sequence
  chemically synthesized
gaattagaagtagtagaaaa

SEQ ID NO: 601619 - DNA, 20 bp, Artificial Sequence
  chemically synthesized
aatatcttgaaaatattttc

SEQ ID NO: 601620 - DNA, 20 bp, Artificial Sequence
  chemically synthesized
tctaatgacagcctaaattt

SEQ ID NO: 601621 - DNA, 20 bp, Artificial Sequence
  chemically synthesized
gctgctaatataaatttgtc

SEQ ID NO: 601622 - DNA, 20 bp, Artificial Sequence
  chemically synthesized
gcactttcactgtgatatgt

SEQ ID NO: 601623 - DNA, 20 bp, Artificial Sequence
  chemically synthesized
ttcactgtgatatgtctgag

SEQ ID NO: 601624 - DNA, 20 bp, Artificial Sequence
  chemically synthesized
tttactttgcctgttatata

SEQ ID NO: 601625 - DNA, 20 bp, Artificial Sequence
  chemically synthesized
tgcctgttatataatgtgct

SEQ ID NO: 601626 - DNA, 20 bp, Artificial Sequence
  chemically synthesized
tataatgtgctttctgttta

SEQ ID NO: 601627 - DNA, 20 bp, Artificial Sequence
  chemically synthesized
atatatgaaggatattaaag

SEQ ID NO: 601628 - DNA, 20 bp, Artificial Sequence
  chemically synthesized
acttgtgtatgttaattata

SEQ ID NO: 601629 - DNA, 20 bp, Artificial Sequence
  chemically synthesized
taattaacatacacaagttg

SEQ ID NO: 601630 - DNA, 20 bp, Artificial Sequence
  chemically synthesized
gtttatgtcatagattgagg

SEQ ID NO: 601631 - DNA, 20 bp, Artificial Sequence
  chemically synthesized
gatgatgaataggtttatgt

SEQ ID NO: 601632 - DNA, 20 bp, Artificial Sequence
  chemically synthesized
gaaagttttggagatgatga

SEQ ID NO: 601633 - DNA, 20 bp, Artificial Sequence
  chemically synthesized
taataatattagaataggag

SEQ ID NO: 601634 - DNA, 20 bp, Artificial Sequence
  chemically synthesized
cataaggtctatcctcttag

SEQ ID NO: 601635 - DNA, 20 bp, Artificial Sequence
  chemically synthesized
aaatagactaactataggca

SEQ ID NO: 601636 - DNA, 20 bp, Artificial Sequence
  chemically synthesized
gagatatttgtaaaagggta

SEQ ID NO: 601637 - DNA, 20 bp, Artificial Sequence
  chemically synthesized
actaatggaaggagaatgtg

SEQ ID NO: 601638 - DNA, 20 bp, Artificial Sequence
  chemically synthesized
gcattccacattctccttcc

SEQ ID NO: 601639 - DNA, 20 bp, Artificial Sequence
  chemically synthesized
ccttccattagtttgactgt

SEQ ID NO: 601640 - DNA, 20 bp, Artificial Sequence
  chemically synthesized
ttgactgtattagattcata

SEQ ID NO: 601641 - DNA, 20 bp, Artificial Sequence
  chemically synthesized
gtattatttgtctttctatg

SEQ ID NO: 601642 - DNA, 20 bp, Artificial Sequence
  chemically synthesized
ttcatgtagcataatgtcct

SEQ ID NO: 601643 - DNA, 20 bp, Artificial Sequence
  chemically synthesized
catgttgttacagcgaaatg

SEQ ID NO: 601644 - DNA, 20 bp, Artificial Sequence
  chemically synthesized
tgttacagcgaaatggtagg

SEQ ID NO: 601645 - DNA, 20 bp, Artificial Sequence
  chemically synthesized
caaggagattatctgcactc

SEQ ID NO: 601646 - DNA, 20 bp, Artificial Sequence
  chemically synthesized
atagagtgcagataatctcc

SEQ ID NO: 601647 - DNA, 20 bp, Artificial Sequence
  chemically synthesized
gaaattgaatgagaatcaca

SEQ ID NO: 601648 - DNA, 20 bp, Artificial Sequence
  chemically synthesized
ttttttttgaggaatctcca

SEQ ID NO: 601649 - DNA, 20 bp, Artificial Sequence
  chemically synthesized
tgacactatggaaaacagta

SEQ ID NO: 601650 - DNA, 20 bp, Artificial Sequence
  chemically synthesized
ttcttgccaaacttgtcatc

SEQ ID NO: 601651 - DNA, 20 bp, Artificial Sequence
  chemically synthesized
aaaaagaaaatcaagagatg

SEQ ID NO: 601652 - DNA, 20 bp, Artificial Sequence
  chemically synthesized
gatgtgaagacatatatcat

SEQ ID NO: 601653 - DNA, 20 bp, Artificial Sequence
  chemically synthesized
gaagacatatatcattgtgg

SEQ ID NO: 601654 - DNA, 20 bp, Artificial Sequence
  chemically synthesized
ggttttgatttacatagccc

SEQ ID NO: 601655 - DNA, 20 bp, Artificial Sequence
  chemically synthesized
ttacatagccctgatgatta

SEQ ID NO: 601656 - DNA, 20 bp, Artificial Sequence
  chemically synthesized
aaagaggagaataaagaaaa

SEQ ID NO: 601657 - DNA, 20 bp, Artificial Sequence
  chemically synthesized
aacatataacttatctcaat

SEQ ID NO: 601658 - DNA, 20 bp, Artificial Sequence
  chemically synthesized
ttgttcacatcttccacctc

SEQ ID NO: 601659 - DNA, 20 bp, Artificial Sequence
  chemically synthesized
acacagtctgtacattctct

SEQ ID NO: 601660 - DNA, 20 bp, Artificial Sequence
  chemically synthesized
ataaacatattagttgaaag

SEQ ID NO: 601661 - DNA, 20 bp, Artificial Sequence
  chemically synthesized
taaatcatttctttcaacta

SEQ ID NO: 601662 - DNA, 20 bp, Artificial Sequence
  chemically synthesized
attttctaatttttaattgt

SEQ ID NO: 601663 - DNA, 20 bp, Artificial Sequence
  chemically synthesized
ttttaattgtagttgtttaa

SEQ ID NO: 601664 - DNA, 20 bp, Artificial Sequence
  chemically synthesized
atttctttattccattttta

SEQ ID NO: 601665 - DNA, 20 bp, Artificial Sequence
  chemically synthesized
gtcagcctatacaacgaacg

SEQ ID NO: 601666 - DNA, 20 bp, Artificial Sequence
  chemically synthesized
ccgttcgttgtataggctga

SEQ ID NO: 601667 - DNA, 20 bp, Artificial Sequence
  chemically synthesized
ataggctgactgtgcttcat

SEQ ID NO: 601668 - DNA, 20 bp, Artificial Sequence
  chemically synthesized
gagtgagtgtgtgtatgtct

SEQ ID NO: 601669 - DNA, 20 bp, Artificial Sequence
  chemically synthesized
tatgatgagctcaagttccc

SEQ ID NO: 601670 - DNA, 20 bp, Artificial Sequence
  chemically synthesized
aaaagtgccctcagtgtcct

SEQ ID NO: 601671 - DNA, 20 bp, Artificial Sequence
  chemically synthesized
tttcatggtaaacaatttgc

SEQ ID NO: 601672 - DNA, 20 bp, Artificial Sequence
  chemically synthesized
attagttagaagcaaatgca

SEQ ID NO: 601673 - DNA, 20 bp, Artificial Sequence
  chemically synthesized
ggtgctaccctgacttaatc

SEQ ID NO: 601674 - DNA, 20 bp, Artificial Sequence
  chemically synthesized
gggtaaagaaatatccaaac

SEQ ID NO: 601675 - DNA, 20 bp, Artificial Sequence
  chemically synthesized
gtgagaagacagatgtcttt

SEQ ID NO: 601676 - DNA, 20 bp, Artificial Sequence
  chemically synthesized
cattatcttactgatagaac

SEQ ID NO: 601677 - DNA, 20 bp, Artificial Sequence
  chemically synthesized
accccagttttatgtggaat

SEQ ID NO: 601678 - DNA, 20 bp, Artificial Sequence
  chemically synthesized
acgaaaatggtggagctaaa

SEQ ID NO: 601679 - DNA, 20 bp, Artificial Sequence
  chemically synthesized
ctaaaattggggttcccagt

SEQ ID NO: 601680 - DNA, 20 bp, Artificial Sequence
  chemically synthesized
taggcatgttacggcatgac

SEQ ID NO: 601681 - DNA, 20 bp, Artificial Sequence
  chemically synthesized
tacggcatgacttcagtttc

SEQ ID NO: 601682 - DNA, 20 bp, Artificial Sequence
  chemically synthesized
tgatttttttcctagccttt

SEQ ID NO: 601683 - DNA, 20 bp, Artificial Sequence
  chemically synthesized
tgtctagtagttgtatttta

SEQ ID NO: 601684 - DNA, 20 bp, Artificial Sequence
  chemically synthesized
ctagacattttccagcatcc

SEQ ID NO: 601685 - DNA, 20 bp, Artificial Sequence
  chemically synthesized
tgctttatgaaatagatttg

SEQ ID NO: 601686 - DNA, 20 bp, Artificial Sequence
  chemically synthesized
acatttgctttatgaaatag

SEQ ID NO: 601687 - DNA, 20 bp, Artificial Sequence
  chemically synthesized
atcccacatttgctttatga

SEQ ID NO: 601688 - DNA, 20 bp, Artificial Sequence
  chemically synthesized
atctatttcataaagcaaat

SEQ ID NO: 601689 - DNA, 20 bp, Artificial Sequence
  chemically synthesized
tcataaagcaaatgtgggat

SEQ ID NO: 601690 - DNA, 20 bp, Artificial Sequence
  chemically synthesized
acatcaaacttaaatcccac

SEQ ID NO: 601691 - DNA, 20 bp, Artificial Sequence
  chemically synthesized
aatgtgggatttaagtttga

SEQ ID NO: 601692 - DNA, 20 bp, Artificial Sequence
  chemically synthesized
ttaagtttgatgttgcttct

SEQ ID NO: 601693 - DNA, 20 bp, Artificial Sequence
  chemically synthesized
aaaagccattactttttgag

SEQ ID NO: 601694 - DNA, 20 bp, Artificial Sequence
  chemically synthesized
taaaactgtgctcaaaaagt

SEQ ID NO: 601695 - DNA, 20 bp, Artificial Sequence
  chemically synthesized
tatgctttattaatttgtca

SEQ ID NO: 601696 - DNA, 20 bp, Artificial Sequence
  chemically synthesized
ctaggaaaataagtggcata

SEQ ID NO: 601697 - DNA, 20 bp, Artificial Sequence
  chemically synthesized
cataatatgccacttatttt

SEQ ID NO: 601698 - DNA, 20 bp, Artificial Sequence
  chemically synthesized
gatagaccagaacggaagaa

SEQ ID NO: 601699 - DNA, 20 bp, Artificial Sequence
  chemically synthesized
attacagaagaattaaccaa

SEQ ID NO: 601700 - DNA, 20 bp, Artificial Sequence
  chemically synthesized
agtgattatttcacctcttt

SEQ ID NO: 601701 - DNA, 20 bp, Artificial Sequence
  chemically synthesized
cctttaccacttctcttgat

SEQ ID NO: 601702 - DNA, 20 bp, Artificial Sequence
  chemically synthesized
cactcatcaagagaagtggt

SEQ ID NO: 601703 - DNA, 20 bp, Artificial Sequence
  chemically synthesized
cagccataatacttttaagg

SEQ ID NO: 601704 - DNA, 20 bp, Artificial Sequence
  chemically synthesized
aatacttttaaggccatgtt

SEQ ID NO: 601705 - DNA, 20 bp, Artificial Sequence
  chemically synthesized
cgagtttccccgtttttaag

SEQ ID NO: 601706 - DNA, 20 bp, Artificial Sequence
  chemically synthesized
atatggcaattaacgagttt

SEQ ID NO: 601707 - DNA, 20 bp, Artificial Sequence
  chemically synthesized
ataagtgaatatggcaatta

SEQ ID NO: 601708 - DNA, 20 bp, Artificial Sequence
  chemically synthesized
ttgccatattcacttattag

SEQ ID NO: 601709 - DNA, 20 bp, Artificial Sequence
  chemically synthesized
ttaatatatgaaaagggtca

SEQ ID NO: 601710 - DNA, 20 bp, Artificial Sequence
  chemically synthesized
gtagccaaatggtcacgtgc

SEQ ID NO: 601711 - DNA, 20 bp, Artificial Sequence
  chemically synthesized
agagatgggtctaaatgctc

SEQ ID NO: 601712 - DNA, 20 bp, Artificial Sequence
  chemically synthesized
gccaccgcatccggccgata

SEQ ID NO: 601713 - DNA, 20 bp, Artificial Sequence
  chemically synthesized
ccgcccgcctcggcctccca

SEQ ID NO: 601714 - DNA, 20 bp, Artificial Sequence
  chemically synthesized
cgggcggataacctgaggtc

SEQ ID NO: 601715 - DNA, 20 bp, Artificial Sequence
  chemically synthesized
ttttgtatttttagtagaga

SEQ ID NO: 601716 - DNA, 20 bp, Artificial Sequence
  chemically synthesized
tgcctcagcctcccgagtag

SEQ ID NO: 601717 - DNA, 20 bp, Artificial Sequence
  chemically synthesized
tcgggaggctgaggcaagat

SEQ ID NO: 601718 - DNA, 20 bp, Artificial Sequence
  chemically synthesized
aacctcctcctcccgggttc

SEQ ID NO: 601719 - DNA, 20 bp, Artificial Sequence
  chemically synthesized
gaggaggaggttgcagtgag

SEQ ID NO: 601720 - DNA, 20 bp, Artificial Sequence
  chemically synthesized
tgatacatggtggtttttgt

SEQ ID NO: 601721 - DNA, 20 bp, Artificial Sequence
  chemically synthesized
gccttatgatacatggtggt

SEQ ID NO: 601722 - DNA, 20 bp, Artificial Sequence
  chemically synthesized
acaatagccttatgatacat

SEQ ID NO: 601723 - DNA, 20 bp, Artificial Sequence
  chemically synthesized
tgtattactaaatcatcttc

SEQ ID NO: 601724 - DNA, 20 bp, Artificial Sequence
  chemically synthesized
cagggtaaccaagcagcaga

SEQ ID NO: 601725 - DNA, 20 bp, Artificial Sequence
  chemically synthesized
atcatttttacaactattgt

SEQ ID NO: 601726 - DNA, 20 bp, Artificial Sequence
  chemically synthesized
ttacaatagttgtaaaaatg

SEQ ID NO: 601727 - DNA, 20 bp, Artificial Sequence
  chemically synthesized
tacgtctgttggagatgttg

SEQ ID NO: 601728 - DNA, 20 bp, Artificial Sequence
  chemically synthesized
actatattttctactcacag

SEQ ID NO: 601729 - DNA, 20 bp, Artificial Sequence
  chemically synthesized
tgagtagaaaatatagtgct

SEQ ID NO: 601730 - DNA, 20 bp, Artificial Sequence
  chemically synthesized
cccatccctaatttcagagt

SEQ ID NO: 601731 - DNA, 20 bp, Artificial Sequence
  chemically synthesized
tattgcctatgaatatttaa

SEQ ID NO: 601732 - DNA, 20 bp, Artificial Sequence
  chemically synthesized
ttcataggcaataaaagtct

SEQ ID NO: 601733 - DNA, 20 bp, Artificial Sequence
  chemically synthesized
caataaaagtctggctgttt

SEQ ID NO: 601734 - DNA, 20 bp, Artificial Sequence
  chemically synthesized
aggtttttatatcacctacc

SEQ ID NO: 601735 - DNA, 20 bp, Artificial Sequence
  chemically synthesized
gtgcctatgtcagaggtttg

SEQ ID NO: 601736 - DNA, 20 bp, Artificial Sequence
  chemically synthesized
atcaattaagtgcctatgtc

SEQ ID NO: 601737 - DNA, 20 bp, Artificial Sequence
  chemically synthesized
aacctctgacataggcactt

SEQ ID NO: 601738 - DNA, 20 bp, Artificial Sequence
  chemically synthesized
catcttcaaattaaaaggca

SEQ ID NO: 601739 - DNA, 20 bp, Artificial Sequence
  chemically synthesized
caagcaattctcctgcctca

SEQ ID NO: 601740 - DNA, 20 bp, Artificial Sequence
  chemically synthesized
aaatctggctgaggcaggag

SEQ ID NO: 601741 - DNA, 20 bp, Artificial Sequence
  chemically synthesized
tcgtgccattgcactccagc

SEQ ID NO: 601742 - DNA, 20 bp, Artificial Sequence
  chemically synthesized
taaccacaaaataaaaactt

SEQ ID NO: 601743 - DNA, 20 bp, Artificial Sequence
  chemically synthesized
atttttggttggttaaacaa

SEQ ID NO: 601744 - DNA, 20 bp, Artificial Sequence
  chemically synthesized
tttgttttaggccatgattc

SEQ ID NO: 601745 - DNA, 20 bp, Artificial Sequence
  chemically synthesized
aattctgaatttgttttagg

SEQ ID NO: 601746 - DNA, 20 bp, Artificial Sequence
  chemically synthesized
gcctaaaacaaattcagaat

SEQ ID NO: 601747 - DNA, 20 bp, Artificial Sequence
  chemically synthesized
gttataatcaagaattctga

SEQ ID NO: 601748 - DNA, 20 bp, Artificial Sequence
  chemically synthesized
tgtacaacaagaatttttta

SEQ ID NO: 601749 - DNA, 20 bp, Artificial Sequence
  chemically synthesized
aaacaaaatgattacagtaa

SEQ ID NO: 601750 - DNA, 20 bp, Artificial Sequence
  chemically synthesized
aaactcagttactgtaatca

SEQ ID NO: 601751 - DNA, 20 bp, Artificial Sequence
  chemically synthesized
tctgagaggctgaagaaaca

SEQ ID NO: 601752 - DNA, 20 bp, Artificial Sequence
  chemically synthesized
gcctctcagataatttatcc

SEQ ID NO: 601753 - DNA, 20 bp, Artificial Sequence
  chemically synthesized
cactatctagttaaaaagac

SEQ ID NO: 601754 - DNA, 20 bp, Artificial Sequence
  chemically synthesized
actagatagtggaaatatcc

SEQ ID NO: 601755 - DNA, 20 bp, Artificial Sequence
  chemically synthesized
gatagtggaaatatccaaag

SEQ ID NO: 601756 - DNA, 20 bp, Artificial Sequence
  chemically synthesized
aggtgtgtcttttttaccta

SEQ ID NO: 601757 - DNA, 20 bp, Artificial Sequence
  chemically synthesized
taataggacttttgtatttc

SEQ ID NO: 601758 - DNA, 20 bp, Artificial Sequence
  chemically synthesized
acaaaagtcctattactaca

SEQ ID NO: 601759 - DNA, 20 bp, Artificial Sequence
  chemically synthesized
cattgtatctttcaggtcta

SEQ ID NO: 601760 - DNA, 20 bp, Artificial Sequence
  chemically synthesized
tgttgtatcagcctgtgata

SEQ ID NO: 601761 - DNA, 20 bp, Artificial Sequence
  chemically synthesized
aacagaatttgagaaggata

SEQ ID NO: 601762 - DNA, 20 bp, Artificial Sequence
  chemically synthesized
ggatattatgtttaacatga

SEQ ID NO: 601763 - DNA, 20 bp, Artificial Sequence
  chemically synthesized
aataaagcatatttagtttt

SEQ ID NO: 601764 - DNA, 20 bp, Artificial Sequence
  chemically synthesized
atgaaagccgtaaaaactaa

SEQ ID NO: 601765 - DNA, 20 bp, Artificial Sequence
  chemically synthesized
gacaatgaaaataaagcata

SEQ ID NO: 601766 - DNA, 20 bp, Artificial Sequence
  chemically synthesized
gaaactattatcagtcctag

SEQ ID NO: 601767 - DNA, 20 bp, Artificial Sequence
  chemically synthesized
taaacacagctaggactgat

SEQ ID NO: 601768 - DNA, 20 bp, Artificial Sequence
  chemically synthesized
agctaggactgataatagtt

SEQ ID NO: 601769 - DNA, 20 bp, Artificial Sequence
  chemically synthesized
atagtttcaagtttacttat

SEQ ID NO: 601770 - DNA, 20 bp, Artificial Sequence
  chemically synthesized
gatttattgttattttaaca

SEQ ID NO: 601771 - DNA, 20 bp, Artificial Sequence
  chemically synthesized
gaagctctccacttgtacct

SEQ ID NO: 601772 - DNA, 20 bp, Artificial Sequence
  chemically synthesized
taatcattgaggtacaagtg

SEQ ID NO: 601773 - DNA, 20 bp, Artificial Sequence
  chemically synthesized
ttgaggtacaagtggagagc

SEQ ID NO: 601774 - DNA, 20 bp, Artificial Sequence
  chemically synthesized
taaaatgtgaagacagataa

SEQ ID NO: 601775 - DNA, 20 bp, Artificial Sequence
  chemically synthesized
tatatatatcccactgaggg

SEQ ID NO: 601776 - DNA, 20 bp, Artificial Sequence
  chemically synthesized
agccctcaaaaattgtgtgt

SEQ ID NO: 601777 - DNA, 20 bp, Artificial Sequence
  chemically synthesized
tttcctcatcctgtttcata

SEQ ID NO: 601778 - DNA, 20 bp, Artificial Sequence
  chemically synthesized
tttaaacttacgtttcctca

SEQ ID NO: 601779 - DNA, 20 bp, Artificial Sequence
  chemically synthesized
atgaaacaggatgaggaaac

SEQ ID NO: 601780 - DNA, 20 bp, Artificial Sequence
  chemically synthesized
tttgagtaacagttttaaac

SEQ ID NO: 601781 - DNA, 20 bp, Artificial Sequence
  chemically synthesized
ctggctatgtgattttgagt

SEQ ID NO: 601782 - DNA, 20 bp, Artificial Sequence
  chemically synthesized
ccctctgtaattcactggct

SEQ ID NO: 601783 - DNA, 20 bp, Artificial Sequence
  chemically synthesized
cacatagccagtgaattaca

SEQ ID NO: 601784 - DNA, 20 bp, Artificial Sequence
  chemically synthesized
ttttttgcctttcaacatga

SEQ ID NO: 601785 - DNA, 20 bp, Artificial Sequence
  chemically synthesized
ggagtgacaatgggggaggt

SEQ ID NO: 601786 - DNA, 20 bp, Artificial Sequence
  chemically synthesized
gtagaggtttgtctgtccca

SEQ ID NO: 601787 - DNA, 20 bp, Artificial Sequence
  chemically synthesized
ccataggccagcccagagtc

SEQ ID NO: 601788 - DNA, 20 bp, Artificial Sequence
  chemically synthesized
actttcagcaacactatggg

SEQ ID NO: 601789 - DNA, 20 bp, Artificial Sequence
  chemically synthesized
ggatttgccacccatcctca

SEQ ID NO: 601790 - DNA, 20 bp, Artificial Sequence
  chemically synthesized
ggatgggtggcaaatccata

SEQ ID NO: 601791 - DNA, 20 bp, Artificial Sequence
  chemically synthesized
tggggctccaggaagctgcc

SEQ ID NO: 601792 - DNA, 20 bp, Artificial Sequence
  chemically synthesized
tggagccccacctcatttcc

SEQ ID NO: 601793 - DNA, 20 bp, Artificial Sequence
  chemically synthesized
gtttagtagcatccactaca

SEQ ID NO: 601794 - DNA, 20 bp, Artificial Sequence
  chemically synthesized
catgtccaatgaatacacca

SEQ ID NO: 601795 - DNA, 20 bp, Artificial Sequence
  chemically synthesized
ccctccaatattctcttcac

SEQ ID NO: 601796 - DNA, 20 bp, Artificial Sequence
  chemically synthesized
ctcactggctatagacttgt

SEQ ID NO: 601797 - DNA, 20 bp, Artificial Sequence
  chemically synthesized
tgcctcccatgggatgacag

SEQ ID NO: 601798 - DNA, 20 bp, Artificial Sequence
  chemically synthesized
ggcagacacacactttctaa

SEQ ID NO: 601799 - DNA, 20 bp, Artificial Sequence
  chemically synthesized
agataggagctcaacccaag

SEQ ID NO: 601800 - DNA, 20 bp, Artificial Sequence
  chemically synthesized
cctatctttccatattagtt

SEQ ID NO: 601801 - DNA, 20 bp, Artificial Sequence
  chemically synthesized
ccttgtttgtgtactattcc

SEQ ID NO: 601802 - DNA, 20 bp, Artificial Sequence
  chemically synthesized
acttatttgtgttaaaccat

SEQ ID NO: 601803 - DNA, 20 bp, Artificial Sequence
  chemically synthesized
cactcagtcacttaaacaga

SEQ ID NO: 601804 - DNA, 20 bp, Artificial Sequence
  chemically synthesized
catctctgtttaagtgactg

SEQ ID NO: 601805 - DNA, 20 bp, Artificial Sequence
  chemically synthesized
atacaaggtgttattctagc

SEQ ID NO: 601806 - DNA, 20 bp, Artificial Sequence
  chemically synthesized
tttcaagtattttcttattc

SEQ ID NO: 601807 - DNA, 20 bp, Artificial Sequence
  chemically synthesized
gtattttcttattcaaaagt

SEQ ID NO: 601808 - DNA, 20 bp, Artificial Sequence
  chemically synthesized
gtattatcttattttctgga

SEQ ID NO: 601809 - DNA, 20 bp, Artificial Sequence
  chemically synthesized
taattcatttcagcaacata

SEQ ID NO: 601810 - DNA, 20 bp, Artificial Sequence
  chemically synthesized
tttttctttgggggaaatgt

SEQ ID NO: 601811 - DNA, 20 bp, Artificial Sequence
  chemically synthesized
tacttataaccttctatttt

SEQ ID NO: 601812 - DNA, 20 bp, Artificial Sequence
  chemically synthesized
ctttaaaatagaaggttata

SEQ ID NO: 601813 - DNA, 20 bp, Artificial Sequence
  chemically synthesized
ataagtagttttgtgttaat

SEQ ID NO: 601814 - DNA, 20 bp, Artificial Sequence
  chemically synthesized
tcatctattctgtccttagg

SEQ ID NO: 601815 - DNA, 20 bp, Artificial Sequence
  chemically synthesized
acctggccaagatccaactt

SEQ ID NO: 601816 - DNA, 20 bp, Artificial Sequence
  chemically synthesized
ttgggaggccaaggcaagtg

SEQ ID NO: 601817 - DNA, 20 bp, Artificial Sequence
  chemically synthesized
tgtgtgtgtgtgtgtggaaa

SEQ ID NO: 601818 - DNA, 20 bp, Artificial Sequence
  chemically synthesized
cttttcacagctaagccaag

SEQ ID NO: 601819 - DNA, 20 bp, Artificial Sequence
  chemically synthesized
aaagtcattgtgaaactgac

SEQ ID NO: 601820 - DNA, 20 bp, Artificial Sequence
  chemically synthesized
ggttgtgatatggaattgga

SEQ ID NO: 601821 - DNA, 20 bp, Artificial Sequence
  chemically synthesized
gtgcaacaatgatgaaggac

SEQ ID NO: 601822 - DNA, 20 bp, Artificial Sequence
  chemically synthesized
aacaatgatgaaggaccaga

SEQ ID NO: 601823 - DNA, 20 bp, Artificial Sequence
  chemically synthesized
tccaaatcaacataaggaat

SEQ ID NO: 601824 - DNA, 20 bp, Artificial Sequence
  chemically synthesized
ttccaatccccaattcctta

SEQ ID NO: 601825 - DNA, 20 bp, Artificial Sequence
  chemically synthesized
ataaaatatggatatgccac

SEQ ID NO: 601826 - DNA, 20 bp, Artificial Sequence
  chemically synthesized
tcttcagaattggatagaga

SEQ ID NO: 601827 - DNA, 20 bp, Artificial Sequence
  chemically synthesized
cggggaccttttgacatgct

SEQ ID NO: 601828 - DNA, 20 bp, Artificial Sequence
  chemically synthesized
tcaatgtcggggaccttttg

SEQ ID NO: 601829 - DNA, 20 bp, Artificial Sequence
  chemically synthesized
tattcaataagtcattagtc

SEQ ID NO: 601830 - DNA, 20 bp, Artificial Sequence
  chemically synthesized
ttctcttcatacgttatatt

SEQ ID NO: 601831 - DNA, 20 bp, Artificial Sequence
  chemically synthesized
ttggttagttaaggaagagt

SEQ ID NO: 601832 - DNA, 20 bp, Artificial Sequence
  chemically synthesized
gtaactcttccttaactaac

SEQ ID NO: 601833 - DNA, 20 bp, Artificial Sequence
  chemically synthesized
ctacatgtgagatatggttc

SEQ ID NO: 601834 - DNA, 20 bp, Artificial Sequence
  chemically synthesized
aaacccattttataatgatg

SEQ ID NO: 601835 - DNA, 20 bp, Artificial Sequence
  chemically synthesized
aaactaaacatcattataaa

SEQ ID NO: 601836 - DNA, 20 bp, Artificial Sequence
  chemically synthesized
gaagaaaacccattttataa

SEQ ID NO: 601837 - DNA, 20 bp, Artificial Sequence
  chemically synthesized
tttgcatactatctcctaag

SEQ ID NO: 601838 - DNA, 20 bp, Artificial Sequence
  chemically synthesized
aatagcaaatttctcctagt

SEQ ID NO: 601839 - DNA, 20 bp, Artificial Sequence
  chemically synthesized
tgactaggagaaatttgcta

SEQ ID NO: 601840 - DNA, 20 bp, Artificial Sequence
  chemically synthesized
ggagaaatttgctattttgt

SEQ ID NO: 601841 - DNA, 20 bp, Artificial Sequence
  chemically synthesized
aatttgctattttgttttag

SEQ ID NO: 601842 - DNA, 20 bp, Artificial Sequence
  chemically synthesized
attttcatatatcacacatg

SEQ ID NO: 601843 - DNA, 20 bp, Artificial Sequence
  chemically synthesized
acagaattgcatgtattatt

SEQ ID NO: 601844 - DNA, 20 bp, Artificial Sequence
  chemically synthesized
cttttaagaatcctaactta

SEQ ID NO: 601845 - DNA, 20 bp, Artificial Sequence
  chemically synthesized
tttcacaaaaacattgtaag

SEQ ID NO: 601846 - DNA, 20 bp, Artificial Sequence
  chemically synthesized
ctttacatgtgtattatagc

SEQ ID NO: 601847 - DNA, 20 bp, Artificial Sequence
  chemically synthesized
gaatttacccagtgtctggc

SEQ ID NO: 601848 - DNA, 20 bp, Artificial Sequence
  chemically synthesized
tttaaatattagctcagctt

SEQ ID NO: 601849 - DNA, 20 bp, Artificial Sequence
  chemically synthesized
agcaatagtttaaatattag

SEQ ID NO: 601850 - DNA, 20 bp, Artificial Sequence
  chemically synthesized
gcctctcagataaaatgagc

SEQ ID NO: 601851 - DNA, 20 bp, Artificial Sequence
  chemically synthesized
tctgctatacattaatgcaa

SEQ ID NO: 601852 - DNA, 20 bp, Artificial Sequence
  chemically synthesized
cattaatgcaaattagatta

SEQ ID NO: 601853 - DNA, 20 bp, Artificial Sequence
  chemically synthesized
attaaatgtctcaagttcct

SEQ ID NO: 601854 - DNA, 20 bp, Artificial Sequence
  chemically synthesized
gggtctgtgccaatatgcga

SEQ ID NO: 601855 - DNA, 20 bp, Artificial Sequence
  chemically synthesized
acattcagaggataacccaa

SEQ ID NO: 601856 - DNA, 20 bp, Artificial Sequence
  chemically synthesized
agaaatagtaattattgcaa

SEQ ID NO: 601857 - DNA, 20 bp, Artificial Sequence
  chemically synthesized
ctccttttttttctaaatac

SEQ ID NO: 601858 - DNA, 20 bp, Artificial Sequence
  chemically synthesized
atcagcaaatgctcagtatc

SEQ ID NO: 601859 - DNA, 20 bp, Artificial Sequence
  chemically synthesized
cccaattaaaatttgcttta

SEQ ID NO: 601860 - DNA, 20 bp, Artificial Sequence
  chemically synthesized
caatttaaagcaaattttaa

SEQ ID NO: 601861 - DNA, 20 bp, Artificial Sequence
  chemically synthesized
tgtttttaatcccaattaaa

SEQ ID NO: 601862 - DNA, 20 bp, Artificial Sequence
  chemically synthesized
tttgaagcaaaaatgctcct

SEQ ID NO: 601863 - DNA, 20 bp, Artificial Sequence
  chemically synthesized
ttaaaaacaccaaggagcat

SEQ ID NO: 601864 - DNA, 20 bp, Artificial Sequence
  chemically synthesized
gtcattctatatgaatcttc

SEQ ID NO: 601865 - DNA, 20 bp, Artificial Sequence
  chemically synthesized
gcaacactgtcataatccca

SEQ ID NO: 601866 - DNA, 20 bp, Artificial Sequence
  chemically synthesized
ttgcggactgagaacttaaa

SEQ ID NO: 601867 - DNA, 20 bp, Artificial Sequence
  chemically synthesized
aggaaaaaggtggttgtgaa

SEQ ID NO: 601868 - DNA, 20 bp, Artificial Sequence
  chemically synthesized
aaatttagtgttttacctct

SEQ ID NO: 601869 - DNA, 20 bp, Artificial Sequence
  chemically synthesized
atcagagaagttgagaaatt

SEQ ID NO: 601870 - DNA, 20 bp, Artificial Sequence
  chemically synthesized
gcaaaaaagtaggaagggca

SEQ ID NO: 601871 - DNA, 20 bp, Artificial Sequence
  chemically synthesized
gtcattgcctcccagtgcaa

SEQ ID NO: 601872 - DNA, 20 bp, Artificial Sequence
  chemically synthesized
tggtgagaaaagatcatttt

SEQ ID NO: 601873 - DNA, 20 bp, Artificial Sequence
  chemically synthesized
ttttgtgagcttaaaccgtt

SEQ ID NO: 601874 - DNA, 20 bp, Artificial Sequence
  chemically synthesized
tacgtaacagagaatcagac

SEQ ID NO: 601875 - DNA, 20 bp, Artificial Sequence
  chemically synthesized
tttctggcatgcctatgaca

SEQ ID NO: 601876 - DNA, 20 bp, Artificial Sequence
  chemically synthesized
tcataggcatgccagaaaac

SEQ ID NO: 601877 - DNA, 20 bp, Artificial Sequence
  chemically synthesized
cagtaagatgaaattgaatc

SEQ ID NO: 601878 - DNA, 20 bp, Artificial Sequence
  chemically synthesized
gcccatcacttattttatag

SEQ ID NO: 601879 - DNA, 20 bp, Artificial Sequence
  chemically synthesized
tctcacaaatttattaaatc

SEQ ID NO: 601880 - DNA, 20 bp, Artificial Sequence
  chemically synthesized
tttattaaatcttctgtttt

SEQ ID NO: 601881 - DNA, 20 bp, Artificial Sequence
  chemically synthesized
ttttttaaaacaaggaaaac

SEQ ID NO: 601882 - DNA, 20 bp, Artificial Sequence
  chemically synthesized
aaaaattacaaatatgtatt

SEQ ID NO: 601883 - DNA, 20 bp, Artificial Sequence
  chemically synthesized
caatacatatttgtaatttt

SEQ ID NO: 601884 - DNA, 20 bp, Artificial Sequence
  chemically synthesized
aaacttaataggacaatgta

SEQ ID NO: 601885 - DNA, 20 bp, Artificial Sequence
  chemically synthesized
aaactcaatacattgtccta

SEQ ID NO: 601886 - DNA, 20 bp, Artificial Sequence
  chemically synthesized
ttaaagtattttacaggtta

SEQ ID NO: 601887 - DNA, 20 bp, Artificial Sequence
  chemically synthesized
attgttctactcaaaaattt

SEQ ID NO: 601888 - DNA, 20 bp, Artificial Sequence
  chemically synthesized
tcaaatttttgagtagaaca

SEQ ID NO: 601889 - DNA, 20 bp, Artificial Sequence
  chemically synthesized
gcaaataaatatttacaaaa

SEQ ID NO: 601890 - DNA, 20 bp, Artificial Sequence
  chemically synthesized
ctgatcccttaattttgctt

SEQ ID NO: 601891 - DNA, 20 bp, Artificial Sequence
  chemically synthesized
atttataactgatcccttaa

SEQ ID NO: 601892 - DNA, 20 bp, Artificial Sequence
  chemically synthesized
gcaagaaaacctagaagtcg

SEQ ID NO: 601893 - DNA, 20 bp, Artificial Sequence
  chemically synthesized
atagaaaaactgcacgactt

SEQ ID NO: 601894 - DNA, 20 bp, Artificial Sequence
  chemically synthesized
tggctctttggtagtgttgc

SEQ ID NO: 601895 - DNA, 20 bp, Artificial Sequence
  chemically synthesized
gcactcgcaattttcctcct

SEQ ID NO: 601896 - DNA, 20 bp, Artificial Sequence
  chemically synthesized
taaaatagtaaatagtaatg

SEQ ID NO: 601897 - DNA, 20 bp, Artificial Sequence
  chemically synthesized
tagtaaatagtaatggtaag

SEQ ID NO: 601898 - DNA, 20 bp, Artificial Sequence
  chemically synthesized
cttttctaaatgctcttcat

SEQ ID NO: 601899 - DNA, 20 bp, Artificial Sequence
  chemically synthesized
acattcctttgtgaacatgc

SEQ ID NO: 601900 - DNA, 20 bp, Artificial Sequence
  chemically synthesized
ccatgctaaattcttgctct

SEQ ID NO: 601901 - DNA, 20 bp, Artificial Sequence
  chemically synthesized
aatttagcatggtgctccat

SEQ ID NO: 601902 - DNA, 20 bp, Artificial Sequence
  chemically synthesized
ttctagaacatgtaacacat

SEQ ID NO: 601903 - DNA, 20 bp, Artificial Sequence
  chemically synthesized
acacattgctgattcacaag

SEQ ID NO: 601904 - DNA, 20 bp, Artificial Sequence
  chemically synthesized
cattgtactttaatatcttt

SEQ ID NO: 601905 - DNA, 20 bp, Artificial Sequence
  chemically synthesized
taggtgtctactctgatgtt

SEQ ID NO: 601906 - DNA, 20 bp, Artificial Sequence
  chemically synthesized
ataatttatgctccttattt

SEQ ID NO: 601907 - DNA, 20 bp, Artificial Sequence
  chemically synthesized
tacagaggggctatactact

SEQ ID NO: 601908 - DNA, 20 bp, Artificial Sequence
  chemically synthesized
ttatctatatgtaatgaata

SEQ ID NO: 601909 - DNA, 20 bp, Artificial Sequence
  chemically synthesized
caaaagtacactaaaatgca

SEQ ID NO: 601910 - DNA, 20 bp, Artificial Sequence
  chemically synthesized
cactaaaatgcatagagctt

SEQ ID NO: 601911 - DNA, 20 bp, Artificial Sequence
  chemically synthesized
ttaaatgtcagaagttaaag

SEQ ID NO: 601912 - DNA, 20 bp, Artificial Sequence
  chemically synthesized
tggagactttcaataattaa

SEQ ID NO: 601913 - DNA, 20 bp, Artificial Sequence
  chemically synthesized
cataaaatgtaagtacattt

SEQ ID NO: 601914 - DNA, 20 bp, Artificial Sequence
  chemically synthesized
tgttttgagttattaaatgg

SEQ ID NO: 601915 - DNA, 20 bp, Artificial Sequence
  chemically synthesized
tcacaaatttacaccttacg

SEQ ID NO: 601916 - DNA, 20 bp, Artificial Sequence
  chemically synthesized
acattccgtaaggtgtaaat

SEQ ID NO: 601917 - DNA, 20 bp, Artificial Sequence
  chemically synthesized
ataggttccaattcaatacg

SEQ ID NO: 601918 - DNA, 20 bp, Artificial Sequence
  chemically synthesized
tgataatatgaaatattatt

SEQ ID NO: 601919 - DNA, 20 bp, Artificial Sequence
  chemically synthesized
aataatatttcatattatca

SEQ ID NO: 601920 - DNA, 20 bp, Artificial Sequence
  chemically synthesized
tcccgattagccctaaagca

SEQ ID NO: 601921 - DNA, 20 bp, Artificial Sequence
  chemically synthesized
gattagccctaaagcagtga

SEQ ID NO: 601922 - DNA, 20 bp, Artificial Sequence
  chemically synthesized
acagtgtgaataaacaaact

SEQ ID NO: 601923 - DNA, 20 bp, Artificial Sequence
  chemically synthesized
tgtttattcacactgtcttt

SEQ ID NO: 601924 - DNA, 20 bp, Artificial Sequence
  chemically synthesized
tatatcactaagttctacat

SEQ ID NO: 601925 - DNA, 20 bp, Artificial Sequence
  chemically synthesized
aagattttgcaaagggttta

SEQ ID NO: 601926 - DNA, 20 bp, Artificial Sequence
  chemically synthesized
ctaggtcacaagattttgca

SEQ ID NO: 601927 - DNA, 20 bp, Artificial Sequence
  chemically synthesized
ccctaataaccttctaggtc

SEQ ID NO: 601928 - DNA, 20 bp, Artificial Sequence
  chemically synthesized
agaaggttattagggggaac

SEQ ID NO: 601929 - DNA, 20 bp, Artificial Sequence
  chemically synthesized
atagtaattatactctcttg

SEQ ID NO: 601930 - DNA, 20 bp, Artificial Sequence
  chemically synthesized
tactctcttgggttgttttc

SEQ ID NO: 601931 - DNA, 20 bp, Artificial Sequence
  chemically synthesized
ctgcatataaattatcatca

SEQ ID NO: 601932 - DNA, 20 bp, Artificial Sequence
  chemically synthesized
acaacttacatctagcacct

SEQ ID NO: 601933 - DNA, 20 bp, Artificial Sequence
  chemically synthesized
gatttcctcagctccgccag

SEQ ID NO: 601934 - DNA, 20 bp, Artificial Sequence
  chemically synthesized
gctccgccaggaatgttttc

SEQ ID NO: 601935 - DNA, 20 bp, Artificial Sequence
  chemically synthesized
caggaatgttttcagtggtt

SEQ ID NO: 601936 - DNA, 20 bp, Artificial Sequence
  chemically synthesized
aaattctacttcatttagcc

SEQ ID NO: 601937 - DNA, 20 bp, Artificial Sequence
  chemically synthesized
tctacttcatttagccactt

SEQ ID NO: 601938 - DNA, 20 bp, Artificial Sequence
  chemically synthesized
tgatatatatttctttctta

SEQ ID NO: 601939 - DNA, 20 bp, Artificial Sequence
  chemically synthesized
cctaagaaagaaatatatat

SEQ ID NO: 601940 - DNA, 20 bp, Artificial Sequence
  chemically synthesized
atacaaagtgttatattttc

SEQ ID NO: 601941 - DNA, 20 bp, Artificial Sequence
  chemically synthesized
ggtaattcaaaatgcagcta

SEQ ID NO: 601942 - DNA, 20 bp, Artificial Sequence
  chemically synthesized
taaaatgttttcttaatgac

SEQ ID NO: 601943 - DNA, 20 bp, Artificial Sequence
  chemically synthesized
tattcattattcatgtaata

SEQ ID NO: 601944 - DNA, 20 bp, Artificial Sequence
  chemically synthesized
tgtttcccagactgcaatgt

SEQ ID NO: 601945 - DNA, 20 bp, Artificial Sequence
  chemically synthesized
ttttacatatgcttttattt

SEQ ID NO: 601946 - DNA, 20 bp, Artificial Sequence
  chemically synthesized
atttacatatgcatttttac

SEQ ID NO: 601947 - DNA, 20 bp, Artificial Sequence
  chemically synthesized
taacagtgatgtgtgaggga

SEQ ID NO: 601948 - DNA, 20 bp, Artificial Sequence
  chemically synthesized
atttgatagttaaaatttaa

SEQ ID NO: 601949 - DNA, 20 bp, Artificial Sequence
  chemically synthesized
atacagaaaatggtatgata

SEQ ID NO: 601950 - DNA, 20 bp, Artificial Sequence
  chemically synthesized
tagagccactttaaagaagt

SEQ ID NO: 601951 - DNA, 20 bp, Artificial Sequence
  chemically synthesized
cttctttaaagtggctctat

SEQ ID NO: 601952 - DNA, 20 bp, Artificial Sequence
  chemically synthesized
ctttttttagatagactact

SEQ ID NO: 601953 - DNA, 20 bp, Artificial Sequence
  chemically synthesized
tttagatagactacttttag

SEQ ID NO: 601954 - DNA, 20 bp, Artificial Sequence
  chemically synthesized
aaaatagtccatattcacga

SEQ ID NO: 601955 - DNA, 20 bp, Artificial Sequence
  chemically synthesized
ggaaatattaccactaattc

SEQ ID NO: 601956 - DNA, 20 bp, Artificial Sequence
  chemically synthesized
atattaccactaattcaaag

SEQ ID NO: 601957 - DNA, 20 bp, Artificial Sequence
  chemically synthesized
gccattaatttgtattatga

SEQ ID NO: 601958 - DNA, 20 bp, Artificial Sequence
  chemically synthesized
atgagtacttctgtgtataa

SEQ ID NO: 601959 - DNA, 20 bp, Artificial Sequence
  chemically synthesized
ttcttgtagaaattttaaag

SEQ ID NO: 601960 - DNA, 20 bp, Artificial Sequence
  chemically synthesized
ttcatctcttttttcttacg

SEQ ID NO: 601961 - DNA, 20 bp, Artificial Sequence
  chemically synthesized
gttgttttcttctattttga

SEQ ID NO: 601962 - DNA, 20 bp, Artificial Sequence
  chemically synthesized
ttatgtgttacagatgttgc

SEQ ID NO: 601963 - DNA, 20 bp, Artificial Sequence
  chemically synthesized
ggttcaggttttcttttcat

SEQ ID NO: 601964 - DNA, 20 bp, Artificial Sequence
  chemically synthesized
tttctctttaagattttggt

SEQ ID NO: 601965 - DNA, 20 bp, Artificial Sequence
  chemically synthesized
atgtatatacatatttctct

SEQ ID NO: 601966 - DNA, 20 bp, Artificial Sequence
  chemically synthesized
taatgagattgaacatatct

SEQ ID NO: 601967 - DNA, 20 bp, Artificial Sequence
  chemically synthesized
ctacatgtccttgattacta

SEQ ID NO: 601968 - DNA, 20 bp, Artificial Sequence
  chemically synthesized
tgtaatcctggcctacatgt

SEQ ID NO: 601969 - DNA, 20 bp, Artificial Sequence
  chemically synthesized
agtaatcaaggacatgtagg

SEQ ID NO: 601970 - DNA, 20 bp, Artificial Sequence
  chemically synthesized
aggattacaatgagatacca

SEQ ID NO: 601971 - DNA, 20 bp, Artificial Sequence
  chemically synthesized
catgttgattgacacaaatg

SEQ ID NO: 601972 - DNA, 20 bp, Artificial Sequence
  chemically synthesized
tcaccttattgagaataaca

SEQ ID NO: 601973 - DNA, 20 bp, Artificial Sequence
  chemically synthesized
gatatgtgcatcctcagaga

SEQ ID NO: 601974 - DNA, 20 bp, Artificial Sequence
  chemically synthesized
cagtcttgttatccatgtta

SEQ ID NO: 601975 - DNA, 20 bp, Artificial Sequence
  chemically synthesized
agtggacattatttcctttt

SEQ ID NO: 601976 - DNA, 20 bp, Artificial Sequence
  chemically synthesized
ttcattgtcacgtctgtatt

SEQ ID NO: 601977 - DNA, 20 bp, Artificial Sequence
  chemically synthesized
cattcttatggttctttttg

SEQ ID NO: 601978 - DNA, 20 bp, Artificial Sequence
  chemically synthesized
ttcacccaacatatttgtgt

SEQ ID NO: 601979 - DNA, 20 bp, Artificial Sequence
  chemically synthesized
aaactataatatagtttttt

SEQ ID NO: 601980 - DNA, 20 bp, Artificial Sequence
  chemically synthesized
aagccctaaaaaaactatat

SEQ ID NO: 601981 - DNA, 20 bp, Artificial Sequence
  chemically synthesized
acagtaatggtaaactataa

SEQ ID NO: 601982 - DNA, 20 bp, Artificial Sequence
  chemically synthesized
gtaatactgaaattaagcac

SEQ ID NO: 601983 - DNA, 20 bp, Artificial Sequence
  chemically synthesized
acatatgagtgaaaaaacaa

SEQ ID NO: 601984 - DNA, 20 bp, Artificial Sequence
  chemically synthesized
tgttttttcactcatatgtg

SEQ ID NO: 601985 - DNA, 20 bp, Artificial Sequence
  chemically synthesized
gaaagctacctttgttattc

SEQ ID NO: 601986 - DNA, 20 bp, Artificial Sequence
  chemically synthesized
ttaaacaaaggaataacaaa

SEQ ID NO: 601987 - DNA, 20 bp, Artificial Sequence
  chemically synthesized
aacaaaggtagctttctaga

SEQ ID NO: 601988 - DNA, 20 bp, Artificial Sequence
  chemically synthesized
tgtaacaacggtcattttct

SEQ ID NO: 601989 - DNA, 20 bp, Artificial Sequence
  chemically synthesized
aagtggtgatgattgctgca

SEQ ID NO: 601990 - DNA, 20 bp, Artificial Sequence
  chemically synthesized
gggcaggtggtagtaagtgg

SEQ ID NO: 601991 - DNA, 20 bp, Artificial Sequence
  chemically synthesized
gcctcactaccaccaaaatt

SEQ ID NO: 601992 - DNA, 20 bp, Artificial Sequence
  chemically synthesized
ccaaaattaaaggcttgaaa

SEQ ID NO: 601993 - DNA, 20 bp, Artificial Sequence
  chemically synthesized
cagaaggatctaaaaaatta

SEQ ID NO: 601994 - DNA, 20 bp, Artificial Sequence
  chemically synthesized
aacatagagaactttgggaa

SEQ ID NO: 601995 - DNA, 20 bp, Artificial Sequence
  chemically synthesized
tgatgaaaagtatcagtctc

SEQ ID NO: 601996 - DNA, 20 bp, Artificial Sequence
  chemically synthesized
caagcaggtatgaaaggttg

SEQ ID NO: 601997 - DNA, 20 bp, Artificial Sequence
  chemically synthesized
caaacgtaccaacctttcat

SEQ ID NO: 601998 - DNA, 20 bp, Artificial Sequence
  chemically synthesized
tacctgcttgatatcttatg

SEQ ID NO: 601999 - DNA, 20 bp, Artificial Sequence
  chemically synthesized
ttattgcaaaaagtgaaatt

SEQ ID NO: 602000 - DNA, 20 bp, Artificial Sequence
  chemically synthesized
gcaaaaagtgaaattaagtg

SEQ ID NO: 602001 - DNA, 20 bp, Artificial Sequence
  chemically synthesized
gagctggaaatgacccagat

SEQ ID NO: 602002 - DNA, 20 bp, Artificial Sequence
  chemically synthesized
ccagcaggagctggaaatga

SEQ ID NO: 602003 - DNA, 20 bp, Artificial Sequence
  chemically synthesized
ttaaatacccgagggtacct

SEQ ID NO: 602004 - DNA, 20 bp, Artificial Sequence
  chemically synthesized
agagctttgaagacaaggag

SEQ ID NO: 602005 - DNA, 20 bp, Artificial Sequence
  chemically synthesized
atgtgtcttattaactttgg

SEQ ID NO: 602006 - DNA, 20 bp, Artificial Sequence
  chemically synthesized
attgaggtaatgaactacct

SEQ ID NO: 602007 - DNA, 20 bp, Artificial Sequence
  chemically synthesized
ctgatttaactgtcagaatg

SEQ ID NO: 602008 - DNA, 20 bp, Artificial Sequence
  chemically synthesized
cagctggagaggctgaatgt

SEQ ID NO: 602009 - DNA, 20 bp, Artificial Sequence
  chemically synthesized
aagtggcttttagctccaat

SEQ ID NO: 602010 - DNA, 20 bp, Artificial Sequence
  chemically synthesized
taagcttaacagttattcta

SEQ ID NO: 602011 - DNA, 20 bp, Artificial Sequence
  chemically synthesized
aaagccacttagaataactg

SEQ ID NO: 602012 - DNA, 20 bp, Artificial Sequence
  chemically synthesized
ttagaataactgttaagctt

SEQ ID NO: 602013 - DNA, 20 bp, Artificial Sequence
  chemically synthesized
taattttaagatccaaactg

SEQ ID NO: 602014 - DNA, 20 bp, Artificial Sequence
  chemically synthesized
tttgaaatcacagaatccaa

SEQ ID NO: 602015 - DNA, 20 bp, Artificial Sequence
  chemically synthesized
cttcaaagccactttggatt

SEQ ID NO: 602016 - DNA, 20 bp, Artificial Sequence
  chemically synthesized
gtactttccttcaaagccac

SEQ ID NO: 602017 - DNA, 20 bp, Artificial Sequence
  chemically synthesized
tctactattttgaacagaag

SEQ ID NO: 602018 - DNA, 20 bp, Artificial Sequence
  chemically synthesized
ctccatctactattttgaac

SEQ ID NO: 602019 - DNA, 20 bp, Artificial Sequence
  chemically synthesized
atgaggtaactcccaacata

SEQ ID NO: 602020 - DNA, 20 bp, Artificial Sequence
  chemically synthesized
acagatcagctatgaattaa

SEQ ID NO: 602021 - DNA, 20 bp, Artificial Sequence
  chemically synthesized
tcacacctgaggttctatat

SEQ ID NO: 602022 - DNA, 20 bp, Artificial Sequence
  chemically synthesized
tgaaagtagaaagtggaaaa

SEQ ID NO: 602023 - DNA, 20 bp, Artificial Sequence
  chemically synthesized
atacgccagtatttttataa

SEQ ID NO: 602024 - DNA, 20 bp, Artificial Sequence
  chemically synthesized
tctgatacgccagtattttt

SEQ ID NO: 602025 - DNA, 20 bp, Artificial Sequence
  chemically synthesized
ctcaagttagtgttaaatgc

SEQ ID NO: 602026 - DNA, 20 bp, Artificial Sequence
  chemically synthesized
gcttcattctttcccatttc

SEQ ID NO: 602027 - DNA, 20 bp, Artificial Sequence
  chemically synthesized
tccttacagggtggatggca

SEQ ID NO: 602028 - DNA, 20 bp, Artificial Sequence
  chemically synthesized
catccctagccattggaata

SEQ ID NO: 602029 - DNA, 20 bp, Artificial Sequence
  chemically synthesized
ttagcaaggaaactattgtt

SEQ ID NO: 602030 - DNA, 20 bp, Artificial Sequence
  chemically synthesized
tcagcccaaaatcccccaac

SEQ ID NO: 602031 - DNA, 20 bp, Artificial Sequence
  chemically synthesized
cacccataacaaacggaaac

SEQ ID NO: 602032 - DNA, 20 bp, Artificial Sequence
  chemically synthesized
tgtgtgatacaagcttaagt

SEQ ID NO: 602033 - DNA, 20 bp, Artificial Sequence
  chemically synthesized
ccctcatgtgtgatacaagc

SEQ ID NO: 602034 - DNA, 20 bp, Artificial Sequence
  chemically synthesized
gctctgccctcatgtgtgat

SEQ ID NO: 602035 - DNA, 20 bp, Artificial Sequence
  chemically synthesized
tattgttgccatcaggattg

SEQ ID NO: 602036 - DNA, 20 bp, Artificial Sequence
  chemically synthesized
gagtttttgtattgttgcca

SEQ ID NO: 602037 - DNA, 20 bp, Artificial Sequence
  chemically synthesized
ctttttttttctctgggcta

SEQ ID NO: 602038 - DNA, 20 bp, Artificial Sequence
  chemically synthesized
agtaaggtttttgtttgttt

SEQ ID NO: 602039 - DNA, 20 bp, Artificial Sequence
  chemically synthesized
atgtggctagtaaggttttt

SEQ ID NO: 602040 - DNA, 20 bp, Artificial Sequence
  chemically synthesized
ccccatgtggctagtaaggt

SEQ ID NO: 602041 - DNA, 20 bp, Artificial Sequence
  chemically synthesized
gaatttccccatgtggctag

SEQ ID NO: 602042 - DNA, 20 bp, Artificial Sequence
  chemically synthesized
attatctttatgtcataagg

SEQ ID NO: 602043 - DNA, 20 bp, Artificial Sequence
  chemically synthesized
aatatgcctagcctcatggt

SEQ ID NO: 602044 - DNA, 20 bp, Artificial Sequence
  chemically synthesized
ctcatggtgtatgtttccca

SEQ ID NO: 602045 - DNA, 20 bp, Artificial Sequence
  chemically synthesized
gtatgtttcccatagagttt

SEQ ID NO: 602046 - DNA, 20 bp, Artificial Sequence
  chemically synthesized
tggaattcacacctaagaaa

SEQ ID NO: 602047 - DNA, 20 bp, Artificial Sequence
  chemically synthesized
attttgggagatcatctctt

SEQ ID NO: 602048 - DNA, 20 bp, Artificial Sequence
  chemically synthesized
tctttcttgttttcacaagc

SEQ ID NO: 602049 - DNA, 20 bp, Artificial Sequence
  chemically synthesized
tcagctctctctgtttaaac

SEQ ID NO: 602050 - DNA, 20 bp, Artificial Sequence
  chemically synthesized
ctcaagtctccgtcagctct

SEQ ID NO: 602051 - DNA, 20 bp, Artificial Sequence
  chemically synthesized
cttgaggggagtgaggtgaa

SEQ ID NO: 602052 - DNA, 20 bp, Artificial Sequence
  chemically synthesized
ctgtaaataaaatgattcag

SEQ ID NO: 602053 - DNA, 20 bp, Artificial Sequence
  chemically synthesized
tgttttagatcctgtaaata

SEQ ID NO: 602054 - DNA, 20 bp, Artificial Sequence
  chemically synthesized
tccacccagtagatgagtgg

SEQ ID NO: 602055 - DNA, 20 bp, Artificial Sequence
  chemically synthesized
atatatccacccagtagatg

SEQ ID NO: 602056 - DNA, 20 bp, Artificial Sequence
  chemically synthesized
gagaagtttgaaagagttgt

SEQ ID NO: 602057 - DNA, 20 bp, Artificial Sequence
  chemically synthesized
aggaatgagaagtttgaaag

SEQ ID NO: 602058 - DNA, 20 bp, Artificial Sequence
  chemically synthesized
ctccgtacctttcaggaatg

SEQ ID NO: 602059 - DNA, 20 bp, Artificial Sequence
  chemically synthesized
gaatattatgtctttttaac

SEQ ID NO: 602060 - DNA, 20 bp, Artificial Sequence
  chemically synthesized
aaaaagacataatattcaag

SEQ ID NO: 602061 - DNA, 20 bp, Artificial Sequence
  chemically synthesized
gtgtaaagctgttgacaagc

SEQ ID NO: 602062 - DNA, 20 bp, Artificial Sequence
  chemically synthesized
atttcaagctgacgcttgtc

SEQ ID NO: 602063 - DNA, 20 bp, Artificial Sequence
  chemically synthesized
gtttaacaagaatttcaagc

SEQ ID NO: 602064 - DNA, 20 bp, Artificial Sequence
  chemically synthesized
taggcttttatagtacctcg

SEQ ID NO: 602065 - DNA, 20 bp, Artificial Sequence
  chemically synthesized
aaccccccaaaaaagatctc

SEQ ID NO: 602066 - DNA, 20 bp, Artificial Sequence
  chemically synthesized
tccagattggccttattcat

SEQ ID NO: 602067 - DNA, 20 bp, Artificial Sequence
  chemically synthesized
ttgattcgctctgttgagga

SEQ ID NO: 602068 - DNA, 20 bp, Artificial Sequence
  chemically synthesized
acctggctcgttctctatag

SEQ ID NO: 602069 - DNA, 20 bp, Artificial Sequence
  chemically synthesized
actaggcattatagatgtgt

SEQ ID NO: 602070 - DNA, 20 bp, Artificial Sequence
  chemically synthesized
ctcacagtctcctcctccat

SEQ ID NO: 602071 - DNA, 20 bp, Artificial Sequence
  chemically synthesized
tctgtataaattgctgaagc

SEQ ID NO: 602072 - DNA, 20 bp, Artificial Sequence
  chemically synthesized
ttcacaagtttagattaatc

SEQ ID NO: 602073 - DNA, 20 bp, Artificial Sequence
  chemically synthesized
ttaatcaaatatttcacaag

SEQ ID NO: 602074 - DNA, 20 bp, Artificial Sequence
  chemically synthesized
ttaatctaaacttgtgaaat

SEQ ID NO: 602075 - DNA, 20 bp, Artificial Sequence
  chemically synthesized
ataacttaatcaaatatttc

SEQ ID NO: 602076 - DNA, 20 bp, Artificial Sequence
  chemically synthesized
atttcaccttctgcctggta

SEQ ID NO: 602077 - DNA, 20 bp, Artificial Sequence
  chemically synthesized
attggaaaaataagacggtg

SEQ ID NO: 602078 - DNA, 20 bp, Artificial Sequence
  chemically synthesized
agataccatctgtttgactg

SEQ ID NO: 602079 - DNA, 20 bp, Artificial Sequence
  chemically synthesized
atttcagtcaaacagatggt

SEQ ID NO: 602080 - DNA, 20 bp, Artificial Sequence
  chemically synthesized
aaacaacttaaacagatacc

SEQ ID NO: 602081 - DNA, 20 bp, Artificial Sequence
  chemically synthesized
aaacagatggtatctgttta

SEQ ID NO: 602082 - DNA, 20 bp, Artificial Sequence
  chemically synthesized
tgttatggttttcttctttt

SEQ ID NO: 602083 - DNA, 20 bp, Artificial Sequence
  chemically synthesized
agaagaaaaccataacaaag

SEQ ID NO: 602084 - DNA, 20 bp, Artificial Sequence
  chemically synthesized
ttcacaaatctgttctttgt

SEQ ID NO: 602085 - DNA, 20 bp, Artificial Sequence
  chemically synthesized
catttctcaatattttattg

SEQ ID NO: 602086 - DNA, 20 bp, Artificial Sequence
  chemically synthesized
aaaatattgagaaatggaaa

SEQ ID NO: 602087 - DNA, 20 bp, Artificial Sequence
  chemically synthesized
atctctctacatttatgtat

SEQ ID NO: 602088 - DNA, 20 bp, Artificial Sequence
  chemically synthesized
ctgtcttccaactctcaaat

SEQ ID NO: 602089 - DNA, 20 bp, Artificial Sequence
  chemically synthesized
cgagaatttgagagttggaa

SEQ ID NO: 602090 - DNA, 20 bp, Artificial Sequence
  chemically synthesized
ccccttcttatattccagtt

SEQ ID NO: 602091 - DNA, 20 bp, Artificial Sequence
  chemically synthesized
gatagtcttaatagctctaa

SEQ ID NO: 602092 - DNA, 20 bp, Artificial Sequence
  chemically synthesized
ttttcccttaggaaggaatg

SEQ ID NO: 602093 - DNA, 20 bp, Artificial Sequence
  chemically synthesized
gtggttctgcattgtctttg

SEQ ID NO: 602094 - DNA, 20 bp, Artificial Sequence
  chemically synthesized
tcaactttgtctgtgtgtaa

SEQ ID NO: 602095 - DNA, 20 bp, Artificial Sequence
  chemically synthesized
tttcaccctattttgtcttc

SEQ ID NO: 602096 - DNA, 20 bp, Artificial Sequence
  chemically synthesized
tctcttcgtcctgtctgctc

SEQ ID NO: 602097 - DNA, 20 bp, Artificial Sequence
  chemically synthesized
taaagaaacaataacttgac

SEQ ID NO: 602098 - DNA, 20 bp, Artificial Sequence
  chemically synthesized
taggaaatctgctgtcaagt

SEQ ID NO: 602099 - DNA, 20 bp, Artificial Sequence
  chemically synthesized
gagcaggaaattatgtaagg

SEQ ID NO: 602100 - DNA, 20 bp, Artificial Sequence
  chemically synthesized
gagtgtgagtagcaaatgtg

SEQ ID NO: 602101 - DNA, 20 bp, Artificial Sequence
  chemically synthesized
ttcttccctttgcttctgtg

SEQ ID NO: 602102 - DNA, 20 bp, Artificial Sequence
  chemically synthesized
gttttgccttttgttcttcc

SEQ ID NO: 602103 - DNA, 20 bp, Artificial Sequence
  chemically synthesized
ctattttcccagtttttgtg

SEQ ID NO: 602104 - DNA, 20 bp, Artificial Sequence
  chemically synthesized
agatttaccgatgctatttt

SEQ ID NO: 602105 - DNA, 20 bp, Artificial Sequence
  chemically synthesized
actatttcatataatattta

SEQ ID NO: 602106 - DNA, 20 bp, Artificial Sequence
  chemically synthesized
ataattgctgttgctgctgc

SEQ ID NO: 602107 - DNA, 20 bp, Artificial Sequence
  chemically synthesized
tttaactctgaacctacctc

SEQ ID NO: 602108 - DNA, 20 bp, Artificial Sequence
  chemically synthesized
ggttcagagttaaactatgc

SEQ ID NO: 602109 - DNA, 20 bp, Artificial Sequence
  chemically synthesized
taatatggtggaaacattag

SEQ ID NO: 602110 - DNA, 20 bp, Artificial Sequence
  chemically synthesized
ttccattttagtcctttttc

SEQ ID NO: 602111 - DNA, 20 bp, Artificial Sequence
  chemically synthesized
caaacttttcaagaccaatt

SEQ ID NO: 602112 - DNA, 20 bp, Artificial Sequence
  chemically synthesized
taatccaataattggtcttg

SEQ ID NO: 602113 - DNA, 20 bp, Artificial Sequence
  chemically synthesized
cattttccgaagggattttc

SEQ ID NO: 602114 - DNA, 20 bp, Artificial Sequence
  chemically synthesized
atattggagtacattttccg

SEQ ID NO: 602115 - DNA, 20 bp, Artificial Sequence
  chemically synthesized
ttgttcatttaaatgatact

SEQ ID NO: 602116 - DNA, 20 bp, Artificial Sequence
  chemically synthesized
acatgaataatagggaacaa

SEQ ID NO: 602117 - DNA, 20 bp, Artificial Sequence
  chemically synthesized
gaacataagaaagtaatagt

SEQ ID NO: 602118 - DNA, 20 bp, Artificial Sequence
  chemically synthesized
acccaggaaatgctttctga

SEQ ID NO: 602119 - DNA, 20 bp, Artificial Sequence
  chemically synthesized
agggactttttgtacccagg

SEQ ID NO: 602120 - DNA, 20 bp, Artificial Sequence
  chemically synthesized
taacatgttagtgaattaat

SEQ ID NO: 602121 - DNA, 20 bp, Artificial Sequence
  chemically synthesized
ttctatatgtcaggaaatat

SEQ ID NO: 602122 - DNA, 20 bp, Artificial Sequence
  chemically synthesized
aagaataaggatgagtaaag

SEQ ID NO: 602123 - DNA, 20 bp, Artificial Sequence
  chemically synthesized
ttccaattgtaaaatgtgat

SEQ ID NO: 602124 - DNA, 20 bp, Artificial Sequence
  chemically synthesized
ggtttgatatttaaagaaag

SEQ ID NO: 602125 - DNA, 20 bp, Artificial Sequence
  chemically synthesized
tttagtttgcttcctatgtt

SEQ ID NO: 602126 - DNA, 20 bp, Artificial Sequence
  chemically synthesized
aacataggaagcaaactaaa

SEQ ID NO: 602127 - DNA, 20 bp, Artificial Sequence
  chemically synthesized
cttttgaaaaacattattta

SEQ ID NO: 602128 - DNA, 20 bp, Artificial Sequence
  chemically synthesized
tttacttttgaaaaacatta

SEQ ID NO: 602129 - DNA, 20 bp, Artificial Sequence
  chemically synthesized
actcagtctgtgtgagggaa

SEQ ID NO: 602130 - DNA, 20 bp, Artificial Sequence
  chemically synthesized
gcatcagcatttgtagtgga

SEQ ID NO: 602131 - DNA, 20 bp, Artificial Sequence
  chemically synthesized
agtattttcataagaaaggt

SEQ ID NO: 602132 - DNA, 20 bp, Artificial Sequence
  chemically synthesized
acatggccatcatttgaggc

SEQ ID NO: 602133 - DNA, 20 bp, Artificial Sequence
  chemically synthesized
gatgggccttactgtctaga

SEQ ID NO: 602134 - DNA, 20 bp, Artificial Sequence
  chemically synthesized
tttatggatgggccttactg

SEQ ID NO: 602135 - DNA, 20 bp, Artificial Sequence
  chemically synthesized
tatttatgtattatcacaac

SEQ ID NO: 602136 - DNA, 20 bp, Artificial Sequence
  chemically synthesized
taaccagctctatatttttt

SEQ ID NO: 602137 - DNA, 20 bp, Artificial Sequence
  chemically synthesized
gaaaagcattctgtagagaa

SEQ ID NO: 602138 - DNA, 20 bp, Artificial Sequence
  chemically synthesized
taaaaacatacttctctaca

SEQ ID NO: 602139 - DNA, 20 bp, Artificial Sequence
  chemically synthesized
ttttccccaaagatacttaa

SEQ ID NO: 602140 - DNA, 20 bp, Artificial Sequence
  chemically synthesized
ataaaatcctataaattttc

SEQ ID NO: 602141 - DNA, 20 bp, Artificial Sequence
  chemically synthesized
tataaatctggagaaaattt

SEQ ID NO: 602142 - DNA, 20 bp, Artificial Sequence
  chemically synthesized
tactcaatatatgtgagtag

SEQ ID NO: 602143 - DNA, 20 bp, Artificial Sequence
  chemically synthesized
atatattgagtactaggcta

SEQ ID NO: 602144 - DNA, 20 bp, Artificial Sequence
  chemically synthesized
attatgtattatgtctagtt

SEQ ID NO: 602145 - DNA, 20 bp, Artificial Sequence
  chemically synthesized
gtctagttgacagattgaaa

SEQ ID NO: 602146 - DNA, 20 bp, Artificial Sequence
  chemically synthesized
catttgcttaacttgtgtaa

SEQ ID NO: 602147 - DNA, 20 bp, Artificial Sequence
  chemically synthesized
aagttgtatgactttgggcc

SEQ ID NO: 602148 - DNA, 20 bp, Artificial Sequence
  chemically synthesized
gaatgaggaattcaagccaa

SEQ ID NO: 602149 - DNA, 20 bp, Artificial Sequence
  chemically synthesized
ggataccagtgcaaaacaac

SEQ ID NO: 602150 - DNA, 20 bp, Artificial Sequence
  chemically synthesized
aatgcaagactttggaagtc

SEQ ID NO: 602151 - DNA, 20 bp, Artificial Sequence
  chemically synthesized
agccactggtagttggtggt

SEQ ID NO: 602152 - DNA, 20 bp, Artificial Sequence
  chemically synthesized
aaggcctcttgtgctacagg

SEQ ID NO: 602153 - DNA, 20 bp, Artificial Sequence
  chemically synthesized
cactatttacagactcagta

SEQ ID NO: 602154 - DNA, 20 bp, Artificial Sequence
  chemically synthesized
gactcagtaaggagtttcac

SEQ ID NO: 602155 - DNA, 20 bp, Artificial Sequence
  chemically synthesized
gatgttgtgagaaagaaatt

SEQ ID NO: 602156 - DNA, 20 bp, Artificial Sequence
  chemically synthesized
tggaagagactggagttcat

SEQ ID NO: 602157 - DNA, 20 bp, Artificial Sequence
  chemically synthesized
ctccagtctcttccataaat

SEQ ID NO: 602158 - DNA, 20 bp, Artificial Sequence
  chemically synthesized
aaaagtagtctgcatggagg

SEQ ID NO: 602159 - DNA, 20 bp, Artificial Sequence
  chemically synthesized
atacacattgatataaatac

SEQ ID NO: 602160 - DNA, 20 bp, Artificial Sequence
  chemically synthesized
aacctagttaatattgaaat

SEQ ID NO: 602161 - DNA, 20 bp, Artificial Sequence
  chemically synthesized
tattcatccaagtaatttat

SEQ ID NO: 602162 - DNA, 20 bp, Artificial Sequence
  chemically synthesized
acttaaataatgatatttgt

SEQ ID NO: 602163 - DNA, 20 bp, Artificial Sequence
  chemically synthesized
aggaacatattttgataaaa

SEQ ID NO: 602164 - DNA, 20 bp, Artificial Sequence
  chemically synthesized
ttttggtttctctttctctc

SEQ ID NO: 602165 - DNA, 20 bp, Artificial Sequence
  chemically synthesized
ctgatatcagcagctccttt

SEQ ID NO: 602166 - DNA, 20 bp, Artificial Sequence
  chemically synthesized
aaggcatagctgggtgtcag

SEQ ID NO: 602167 - DNA, 20 bp, Artificial Sequence
  chemically synthesized
gtcttctcaagtggaaaata

SEQ ID NO: 602168 - DNA, 20 bp, Artificial Sequence
  chemically synthesized
ccaatgttgaaattctgtga

SEQ ID NO: 602169 - DNA, 20 bp, Artificial Sequence
  chemically synthesized
ttcaacattggaaaaggcca

SEQ ID NO: 602170 - DNA, 20 bp, Artificial Sequence
  chemically synthesized
atgtttttgtctggattcag

SEQ ID NO: 602171 - DNA, 20 bp, Artificial Sequence
  chemically synthesized
gggtaatgttgatgtttttg

SEQ ID NO: 602172 - DNA, 20 bp, Artificial Sequence
  chemically synthesized
ttttgtggtttgggtaatgt

SEQ ID NO: 602173 - DNA, 20 bp, Artificial Sequence
  chemically synthesized
taggagagtgttgggcgttt

SEQ ID NO: 602174 - DNA, 20 bp, Artificial Sequence
  chemically synthesized
aaccaggataggagagtgtt

SEQ ID NO: 602175 - DNA, 20 bp, Artificial Sequence
  chemically synthesized
tcctggttaatatgaacgaa

SEQ ID NO: 602176 - DNA, 20 bp, Artificial Sequence
  chemically synthesized
taatgacaagcaatccaaag

SEQ ID NO: 602177 - DNA, 20 bp, Artificial Sequence
  chemically synthesized
ggtttaaaagctttactttg

SEQ ID NO: 602178 - DNA, 20 bp, Artificial Sequence
  chemically synthesized
ggagggtttaaaagctttac

SEQ ID NO: 602179 - DNA, 20 bp, Artificial Sequence
  chemically synthesized
ggggatttgagggagggttt

SEQ ID NO: 602180 - DNA, 20 bp, Artificial Sequence
  chemically synthesized
ttgtgttaggggatttgagg

SEQ ID NO: 602181 - DNA, 20 bp, Artificial Sequence
  chemically synthesized
gtaggatttgtgcttgtgtt

SEQ ID NO: 602182 - DNA, 20 bp, Artificial Sequence
  chemically synthesized
taacacaagcacaaatccta

SEQ ID NO: 602183 - DNA, 20 bp, Artificial Sequence
  chemically synthesized
aaaaaaaaacattgtaggat

SEQ ID NO: 602184 - DNA, 20 bp, Artificial Sequence
  chemically synthesized
tgaaaaaaaaaaaaaacatt

SEQ ID NO: 602185 - DNA, 20 bp, Artificial Sequence
  chemically synthesized
aagatacagtgtgtatgtgt

SEQ ID NO: 602186 - DNA, 20 bp, Artificial Sequence
  chemically synthesized
ctccaggggtcaaacctgac

SEQ ID NO: 602187 - DNA, 20 bp, Artificial Sequence
  chemically synthesized
cttatatttgaaagctaatg

SEQ ID NO: 602188 - DNA, 20 bp, Artificial Sequence
  chemically synthesized
gacattagctttcaaatata

SEQ ID NO: 602189 - DNA, 20 bp, Artificial Sequence
  chemically synthesized
ctagtcattaacagtgtttg

SEQ ID NO: 602190 - DNA, 20 bp, Artificial Sequence
  chemically synthesized
gattaaactctagtcattaa

SEQ ID NO: 602191 - DNA, 20 bp, Artificial Sequence
  chemically synthesized
cagcaaacactgttaatgac

SEQ ID NO: 602192 - DNA, 20 bp, Artificial Sequence
  chemically synthesized
atatttctcagggctttcta

SEQ ID NO: 602193 - DNA, 20 bp, Artificial Sequence
  chemically synthesized
acccgcaggcatatatttct

SEQ ID NO: 602194 - DNA, 20 bp, Artificial Sequence
  chemically synthesized
cccacttttgcacttgtgtg

SEQ ID NO: 602195 - DNA, 20 bp, Artificial Sequence
  chemically synthesized
cctaccacacaagtgcaaaa

SEQ ID NO: 602196 - DNA, 20 bp, Artificial Sequence
  chemically synthesized
gaacctgagttcctttactt

SEQ ID NO: 602197 - DNA, 20 bp, Artificial Sequence
  chemically synthesized
tacaatgcggtggttaaggt

SEQ ID NO: 602198 - DNA, 20 bp, Artificial Sequence
  chemically synthesized
cagcataatcaccctactcc

SEQ ID NO: 602199 - DNA, 20 bp, Artificial Sequence
  chemically synthesized
ggactaaatccaaaggagta

SEQ ID NO: 602200 - DNA, 20 bp, Artificial Sequence
  chemically synthesized
gcattatgtcagaaaatgca

SEQ ID NO: 602201 - DNA, 20 bp, Artificial Sequence
  chemically synthesized
tgcaaattgttttgtctata

SEQ ID NO: 602202 - DNA, 20 bp, Artificial Sequence
  chemically synthesized
gtctatagaatgcttaactt

SEQ ID NO: 602203 - DNA, 20 bp, Artificial Sequence
  chemically synthesized
tgcttaacttcaccgatttt

SEQ ID NO: 602204 - DNA, 20 bp, Artificial Sequence
  chemically synthesized
atttatttagaatattgaac

SEQ ID NO: 602205 - DNA, 20 bp, Artificial Sequence
  chemically synthesized
tagttcaatattctaaataa

SEQ ID NO: 602206 - DNA, 20 bp, Artificial Sequence
  chemically synthesized
tatgctcagtgatgccaaaa

SEQ ID NO: 602207 - DNA, 20 bp, Artificial Sequence
  chemically synthesized
ctttttggcatcactgagca

SEQ ID NO: 602208 - DNA, 20 bp, Artificial Sequence
  chemically synthesized
ttggcatcactgagcataga

SEQ ID NO: 602209 - DNA, 20 bp, Artificial Sequence
  chemically synthesized
tagtaattatagtataatca

SEQ ID NO: 602210 - DNA, 20 bp, Artificial Sequence
  chemically synthesized
aattatagtataatcaacaa

SEQ ID NO: 602211 - DNA, 20 bp, Artificial Sequence
  chemically synthesized
tgatgaatggtaatcaaact

SEQ ID NO: 602212 - DNA, 20 bp, Artificial Sequence
  chemically synthesized
ctttacccaaaccttctcgg

SEQ ID NO: 602213 - DNA, 20 bp, Artificial Sequence
  chemically synthesized
aggtaacaaaacacatccga

SEQ ID NO: 602214 - DNA, 20 bp, Artificial Sequence
  chemically synthesized
cattagaaaactgaggttca

SEQ ID NO: 602215 - DNA, 20 bp, Artificial Sequence
  chemically synthesized
tttccttaaactctctgaac

SEQ ID NO: 602216 - DNA, 20 bp, Artificial Sequence
  chemically synthesized
aagagaggatataactctga

SEQ ID NO: 602217 - DNA, 20 bp, Artificial Sequence
  chemically synthesized
gagttatatcctctctttct

SEQ ID NO: 602218 - DNA, 20 bp, Artificial Sequence
  chemically synthesized
cagctcatggaacatttgag

SEQ ID NO: 602219 - DNA, 20 bp, Artificial Sequence
  chemically synthesized
ttcattctacatttttatat

SEQ ID NO: 602220 - DNA, 20 bp, Artificial Sequence
  chemically synthesized
gaatgaagaacacttctttc

SEQ ID NO: 602221 - DNA, 20 bp, Artificial Sequence
  chemically synthesized
gtttttagacttcatatatt

SEQ ID NO: 602222 - DNA, 20 bp, Artificial Sequence
  chemically synthesized
gtacctggattaataaattt

SEQ ID NO: 602223 - DNA, 20 bp, Artificial Sequence
  chemically synthesized
atcttctttcctcatatgta

SEQ ID NO: 602224 - DNA, 20 bp, Artificial Sequence
  chemically synthesized
gtagaaagctaaatgactgg

SEQ ID NO: 602225 - DNA, 20 bp, Artificial Sequence
  chemically synthesized
tatagaaactgtaccagtca

SEQ ID NO: 602226 - DNA, 20 bp, Artificial Sequence
  chemically synthesized
aacaagagccaccgttttta

SEQ ID NO: 602227 - DNA, 20 bp, Artificial Sequence
  chemically synthesized
atcctcataaaaacggtggc

SEQ ID NO: 602228 - DNA, 20 bp, Artificial Sequence
  chemically synthesized
tcatggaaagaaacaagagc

SEQ ID NO: 602229 - DNA, 20 bp, Artificial Sequence
  chemically synthesized
agatggcagagcatatcata

SEQ ID NO: 602230 - DNA, 20 bp, Artificial Sequence
  chemically synthesized
tgctctgccatctttcattg

SEQ ID NO: 602231 - DNA, 20 bp, Artificial Sequence
  chemically synthesized
tcattgctaggatttcacac

SEQ ID NO: 602232 - DNA, 20 bp, Artificial Sequence
  chemically synthesized
ataccaaagaacaagttgca

SEQ ID NO: 602233 - DNA, 20 bp, Artificial Sequence
  chemically synthesized
gtttttcatttttaacaagt

SEQ ID NO: 602234 - DNA, 20 bp, Artificial Sequence
  chemically synthesized
cctgtagtttttcattttta

SEQ ID NO: 602235 - DNA, 20 bp, Artificial Sequence
  chemically synthesized
agtgagtcttgggtgaggcc

SEQ ID NO: 602236 - DNA, 20 bp, Artificial Sequence
  chemically synthesized
ctgggccctgaccccagaat

SEQ ID NO: 602237 - DNA, 20 bp, Artificial Sequence
  chemically synthesized
gtgtattaaacaagacttcc

SEQ ID NO: 602238 - DNA, 20 bp, Artificial Sequence
  chemically synthesized
acatcagaatcacctggaag

SEQ ID NO: 602239 - DNA, 20 bp, Artificial Sequence
  chemically synthesized
agatgcaggaatcactgctg

SEQ ID NO: 602240 - DNA, 20 bp, Artificial Sequence
  chemically synthesized
aatttgtataatcactacag

SEQ ID NO: 602241 - DNA, 20 bp, Artificial Sequence
  chemically synthesized
ctctattataactctagtac

SEQ ID NO: 602242 - DNA, 20 bp, Artificial Sequence
  chemically synthesized
aacactctggaaagttatta

SEQ ID NO: 602243 - DNA, 20 bp, Artificial Sequence
  chemically synthesized
aaccagttaataactttcca

SEQ ID NO: 602244 - DNA, 20 bp, Artificial Sequence
  chemically synthesized
actttccagagtgtttttca

SEQ ID NO: 602245 - DNA, 20 bp, Artificial Sequence
  chemically synthesized
tttttcaaagggttttagta

SEQ ID NO: 602246 - DNA, 20 bp, Artificial Sequence
  chemically synthesized
tagtataaagttttaccata

SEQ ID NO: 602247 - DNA, 20 bp, Artificial Sequence
  chemically synthesized
tagtgattgctgatctccat

SEQ ID NO: 602248 - DNA, 20 bp, Artificial Sequence
  chemically synthesized
ataaaagttttaaagtcaga

SEQ ID NO: 602249 - DNA, 20 bp, Artificial Sequence
  chemically synthesized
tgacataaaagaacccaggg

SEQ ID NO: 602250 - DNA, 20 bp, Artificial Sequence
  chemically synthesized
cttatttttcccctgaaaag

SEQ ID NO: 602251 - DNA, 20 bp, Artificial Sequence
  chemically synthesized
gttttacctgaaaatggaag

SEQ ID NO: 602252 - DNA, 20 bp, Artificial Sequence
  chemically synthesized
ccttctgtttatgttctttc

SEQ ID NO: 602253 - DNA, 20 bp, Artificial Sequence
  chemically synthesized
gaagaaatagagaccccccc

SEQ ID NO: 602254 - DNA, 20 bp, Artificial Sequence
  chemically synthesized
gttttcagcctgctactcaa

SEQ ID NO: 602255 - DNA, 20 bp, Artificial Sequence
  chemically synthesized
tggcaggaagatttcatttc

SEQ ID NO: 602256 - DNA, 20 bp, Artificial Sequence
  chemically synthesized
aaccactggaagagttggca

SEQ ID NO: 602257 - DNA, 20 bp, Artificial Sequence
  chemically synthesized
ctcttccagtggttgttgcc

SEQ ID NO: 602258 - DNA, 20 bp, Artificial Sequence
  chemically synthesized
tggttgttgccagaggcttc

SEQ ID NO: 602259 - DNA, 20 bp, Artificial Sequence
  chemically synthesized
ataattggtctagctacaaa

SEQ ID NO: 602260 - DNA, 20 bp, Artificial Sequence
  chemically synthesized
aaatttgtctacattgattg

SEQ ID NO: 602261 - DNA, 20 bp, Artificial Sequence
  chemically synthesized
tgttccaacaaatttgtcta

SEQ ID NO: 602262 - DNA, 20 bp, Artificial Sequence
  chemically synthesized
gttggaacactcatttcaag

SEQ ID NO: 602263 - DNA, 20 bp, Artificial Sequence
  chemically synthesized
ttcaaattttaaaaatttga

SEQ ID NO: 602264 - DNA, 20 bp, Artificial Sequence
  chemically synthesized
gccctcttccctctccctat

SEQ ID NO: 602265 - DNA, 20 bp, Artificial Sequence
  chemically synthesized
gagtcatttgtgttcagctg

SEQ ID NO: 602266 - DNA, 20 bp, Artificial Sequence
  chemically synthesized
ctttatttgtggtagagccc

SEQ ID NO: 602267 - DNA, 20 bp, Artificial Sequence
  chemically synthesized
ctgcaattcccagataggtc

SEQ ID NO: 602268 - DNA, 20 bp, Artificial Sequence
  chemically synthesized
catttgacctatctgggaat

SEQ ID NO: 602269 - DNA, 20 bp, Artificial Sequence
  chemically synthesized
tgtgtaattcacacttctct

SEQ ID NO: 602270 - DNA, 20 bp, Artificial Sequence
  chemically synthesized
gagagagaagtgtgaattac

SEQ ID NO: 602271 - DNA, 20 bp, Artificial Sequence
  chemically synthesized
ttctagctctcacattctga

SEQ ID NO: 602272 - DNA, 20 bp, Artificial Sequence
  chemically synthesized
ttggtcttttgaaatactcc

SEQ ID NO: 602273 - DNA, 20 bp, Artificial Sequence
  chemically synthesized
aacgggttttgttagagtat

SEQ ID NO: 602274 - DNA, 20 bp, Artificial Sequence
  chemically synthesized
aactgtgatactctaacaaa

SEQ ID NO: 602275 - DNA, 20 bp, Artificial Sequence
  chemically synthesized
gggcaaatatctgttaacaa

SEQ ID NO: 602276 - DNA, 20 bp, Artificial Sequence
  chemically synthesized
atcccattttccttccttca

SEQ ID NO: 602277 - DNA, 20 bp, Artificial Sequence
  chemically synthesized
cagatttctttctcttccca

SEQ ID NO: 602278 - DNA, 20 bp, Artificial Sequence
  chemically synthesized
aacacattctattcagagag

SEQ ID NO: 602279 - DNA, 20 bp, Artificial Sequence
  chemically synthesized
agctatgctctctgaataga

SEQ ID NO: 602280 - DNA, 20 bp, Artificial Sequence
  chemically synthesized
ctgaatagaatgtgtttcca

SEQ ID NO: 602281 - DNA, 20 bp, Artificial Sequence
  chemically synthesized
cataaagatttttttaagtg

SEQ ID NO: 602282 - DNA, 20 bp, Artificial Sequence
  chemically synthesized
tttaagtggttggcttttcc

SEQ ID NO: 602283 - DNA, 20 bp, Artificial Sequence
  chemically synthesized
cttcataaatgctctataag

SEQ ID NO: 602284 - DNA, 20 bp, Artificial Sequence
  chemically synthesized
caagaatgaataatgttcag

SEQ ID NO: 602285 - DNA, 20 bp, Artificial Sequence
  chemically synthesized
cctgcctgaacattattcat

SEQ ID NO: 602286 - DNA, 20 bp, Artificial Sequence
  chemically synthesized
ttcattcttgatttcaaaat

SEQ ID NO: 602287 - DNA, 20 bp, Artificial Sequence
  chemically synthesized
ataatttgcctagaagtaaa

SEQ ID NO: 602288 - DNA, 20 bp, Artificial Sequence
  chemically synthesized
gtttacttctaggcaaatta

SEQ ID NO: 602289 - DNA, 20 bp, Artificial Sequence
  chemically synthesized
ctctatattcagtagccaga

SEQ ID NO: 602290 - DNA, 20 bp, Artificial Sequence
  chemically synthesized
tggcacacagtaagtatgca

SEQ ID NO: 602291 - DNA, 20 bp, Artificial Sequence
  chemically synthesized
tagttgataaatatgctatt

SEQ ID NO: 602292 - DNA, 20 bp, Artificial Sequence
  chemically synthesized
attgctagattagaataatt

SEQ ID NO: 602293 - DNA, 20 bp, Artificial Sequence
  chemically synthesized
ctgtgtttttaatactctag

SEQ ID NO: 602294 - DNA, 20 bp, Artificial Sequence
  chemically synthesized
tatactaattttttcttcat

SEQ ID NO: 602295 - DNA, 20 bp, Artificial Sequence
  chemically synthesized
acatttgactaaagccgtat

SEQ ID NO: 602296 - DNA, 20 bp, Artificial Sequence
  chemically synthesized
tttaaatatcgaatctgtca

SEQ ID NO: 602297 - DNA, 20 bp, Artificial Sequence
  chemically synthesized
cagattcgatatttaaacat

SEQ ID NO: 602298 - DNA, 20 bp, Artificial Sequence
  chemically synthesized
agtaactcacatgaaaactc

SEQ ID NO: 602299 - DNA, 20 bp, Artificial Sequence
  chemically synthesized
aatttcatatttcatccctc

SEQ ID NO: 602300 - DNA, 20 bp, Artificial Sequence
  chemically synthesized
tgtgaactgggtatcagaat

SEQ ID NO: 602301 - DNA, 20 bp, Artificial Sequence
  chemically synthesized
gagcttactgagccaaattc

SEQ ID NO: 602302 - DNA, 20 bp, Artificial Sequence
  chemically synthesized
tataaattggggtgagttac

SEQ ID NO: 602303 - DNA, 20 bp, Artificial Sequence
  chemically synthesized
acagttggcatggggccgaa

SEQ ID NO: 602304 - DNA, 20 bp, Artificial Sequence
  chemically synthesized
atcaatgtggagccagatac

SEQ ID NO: 602305 - DNA, 20 bp, Artificial Sequence
  chemically synthesized
aactcaagtatctggctcca

SEQ ID NO: 602306 - DNA, 20 bp, Artificial Sequence
  chemically synthesized
ctgtagatctttttttggtt

SEQ ID NO: 602307 - DNA, 20 bp, Artificial Sequence
  chemically synthesized
ctagcacataaaaataataa

SEQ ID NO: 602308 - DNA, 20 bp, Artificial Sequence
  chemically synthesized
cctcacttgaatgtatgaac

SEQ ID NO: 602309 - DNA, 20 bp, Artificial Sequence
  chemically synthesized
tgatataaacatgataaaac

SEQ ID NO: 602310 - DNA, 20 bp, Artificial Sequence
  chemically synthesized
caatataatcctctgtttta

SEQ ID NO: 602311 - DNA, 20 bp, Artificial Sequence
  chemically synthesized
atataatagtcaatataatc

SEQ ID NO: 602312 - DNA, 20 bp, Artificial Sequence
  chemically synthesized
gccactatgtaggttcaagt

SEQ ID NO: 602313 - DNA, 20 bp, Artificial Sequence
  chemically synthesized
aactggtatgtagtatgtag

SEQ ID NO: 602314 - DNA, 20 bp, Artificial Sequence
  chemically synthesized
atccatactacatactacat

SEQ ID NO: 602315 - DNA, 20 bp, Artificial Sequence
  chemically synthesized
gtcaatgttatattttgtcc

SEQ ID NO: 602316 - DNA, 20 bp, Artificial Sequence
  chemically synthesized
tttaatatggatagaaagga

SEQ ID NO: 602317 - DNA, 20 bp, Artificial Sequence
  chemically synthesized
aggctacgggttcaaatatt

SEQ ID NO: 602318 - DNA, 20 bp, Artificial Sequence
  chemically synthesized
ccttcaaactaccaaattaa

SEQ ID NO: 602319 - DNA, 20 bp, Artificial Sequence
  chemically synthesized
tcaacaaactgtgttaattt

SEQ ID NO: 602320 - DNA, 20 bp, Artificial Sequence
  chemically synthesized
tcttttcaagaatacttttg

SEQ ID NO: 602321 - DNA, 20 bp, Artificial Sequence
  chemically synthesized
tacagacagttaatgaaatg

SEQ ID NO: 602322 - DNA, 20 bp, Artificial Sequence
  chemically synthesized
gattctgctctcttaatact

SEQ ID NO: 602323 - DNA, 20 bp, Artificial Sequence
  chemically synthesized
actacatgatttcaagggaa

SEQ ID NO: 602324 - DNA, 20 bp, Artificial Sequence
  chemically synthesized
caagggaaaattgtttcaaa

SEQ ID NO: 602325 - DNA, 20 bp, Artificial Sequence
  chemically synthesized
accacaatgcattaaaatta

SEQ ID NO: 602326 - DNA, 20 bp, Artificial Sequence
  chemically synthesized
tatacattttaacaacctta

SEQ ID NO: 602327 - DNA, 20 bp, Artificial Sequence
  chemically synthesized
ttaataattttaatttagct

SEQ ID NO: 602328 - DNA, 20 bp, Artificial Sequence
  chemically synthesized
tttttaattaataattttaa

SEQ ID NO: 602329 - DNA, 20 bp, Artificial Sequence
  chemically synthesized
ttcctggttctaagagaaga

SEQ ID NO: 602330 - DNA, 20 bp, Artificial Sequence
  chemically synthesized
ggaaaaagaaagaaatgcaa

SEQ ID NO: 602331 - DNA, 20 bp, Artificial Sequence
  chemically synthesized
tttctttttccatttatttc

SEQ ID NO: 602332 - DNA, 20 bp, Artificial Sequence
  chemically synthesized
catttatttcctttgtttta

SEQ ID NO: 602333 - DNA, 20 bp, Artificial Sequence
  chemically synthesized
ttttttaccttcatctcttc

SEQ ID NO: 602334 - DNA, 20 bp, Artificial Sequence
  chemically synthesized
actgctttctgtaattcatc

SEQ ID NO: 602335 - DNA, 20 bp, Artificial Sequence
  chemically synthesized
gctgaagaagagtatcttga

SEQ ID NO: 602336 - DNA, 20 bp, Artificial Sequence
  chemically synthesized
tctctctcaagatactcttc

SEQ ID NO: 602337 - DNA, 20 bp, Artificial Sequence
  chemically synthesized
catctctgatagatctttct

SEQ ID NO: 602338 - DNA, 20 bp, Artificial Sequence
  chemically synthesized
gatagatctttctggaggct

SEQ ID NO: 602339 - DNA, 20 bp, Artificial Sequence
  chemically synthesized
ccagaaaggaggccttgaag

SEQ ID NO: 602340 - DNA, 20 bp, Artificial Sequence
  chemically synthesized
ccacaaaacaaacaaacaaa

SEQ ID NO: 602341 - DNA, 20 bp, Artificial Sequence
  chemically synthesized
tcaataatcgtgttttgttt

SEQ ID NO: 602342 - DNA, 20 bp, Artificial Sequence
  chemically synthesized
actgtcaataatcgtgtttt

SEQ ID NO: 602343 - DNA, 20 bp, Artificial Sequence
  chemically synthesized
catcactgtcaataatcgtg

SEQ ID NO: 602344 - DNA, 20 bp, Artificial Sequence
  chemically synthesized
tgtttcatcactgtcaataa

SEQ ID NO: 602345 - DNA, 20 bp, Artificial Sequence
  chemically synthesized
ctgatgaaataatataataa

SEQ ID NO: 602346 - DNA, 20 bp, Artificial Sequence
  chemically synthesized
tcatcagtatgtaaataaca

SEQ ID NO: 602347 - DNA, 20 bp, Artificial Sequence
  chemically synthesized
tacttctttatcattactat

SEQ ID NO: 602348 - DNA, 20 bp, Artificial Sequence
  chemically synthesized
atagtaatgataaagaagta

SEQ ID NO: 602349 - DNA, 20 bp, Artificial Sequence
  chemically synthesized
tgagttattttcttatgcat

SEQ ID NO: 602350 - DNA, 20 bp, Artificial Sequence
  chemically synthesized
taagtgtgaaaataagacat

SEQ ID NO: 602351 - DNA, 20 bp, Artificial Sequence
  chemically synthesized
ttgcccgatgatgataattc

SEQ ID NO: 602352 - DNA, 20 bp, Artificial Sequence
  chemically synthesized
taattcagctgtttgtgtga

SEQ ID NO: 602353 - DNA, 20 bp, Artificial Sequence
  chemically synthesized
tttctgtgaatggagaaaaa

SEQ ID NO: 602354 - DNA, 20 bp, Artificial Sequence
  chemically synthesized
aaacatattattttaaaaag

SEQ ID NO: 602355 - DNA, 20 bp, Artificial Sequence
  chemically synthesized
aaacaaggctttttaaaata

SEQ ID NO: 602356 - DNA, 20 bp, Artificial Sequence
  chemically synthesized
ttattctttgtgttctttca

SEQ ID NO: 602357 - DNA, 20 bp, Artificial Sequence
  chemically synthesized
ttatgagagtttctgtagat

SEQ ID NO: 602358 - DNA, 20 bp, Artificial Sequence
  chemically synthesized
gttttttctttttaatttat

SEQ ID NO: 602359 - DNA, 20 bp, Artificial Sequence
  chemically synthesized
caaactacgttttatgcact

SEQ ID NO: 602360 - DNA, 20 bp, Artificial Sequence
  chemically synthesized
aaaacgaaaagtgcataaaa

SEQ ID NO: 602361 - DNA, 20 bp, Artificial Sequence
  chemically synthesized
cttctttgtgaattgccaaa

SEQ ID NO: 602362 - DNA, 20 bp, Artificial Sequence
  chemically synthesized
ttctaataccatttatagtt

SEQ ID NO: 602363 - DNA, 20 bp, Artificial Sequence
  chemically synthesized
tgtgaaaatgcattaattca

SEQ ID NO: 602364 - DNA, 20 bp, Artificial Sequence
  chemically synthesized
gggcagggatgtgggaaaat

SEQ ID NO: 602365 - DNA, 20 bp, Artificial Sequence
  chemically synthesized
tccctcaacaagtataaaaa

SEQ ID NO: 602366 - DNA, 20 bp, Artificial Sequence
  chemically synthesized
tcgtggacattaacattttt

SEQ ID NO: 602367 - DNA, 20 bp, Artificial Sequence
  chemically synthesized
tcaaaaaatggagcagttga

SEQ ID NO: 602368 - DNA, 20 bp, Artificial Sequence
  chemically synthesized
tagtctctacactttggttg

SEQ ID NO: 602369 - DNA, 20 bp, Artificial Sequence
  chemically synthesized
ctaacatgtacaatatttaa

SEQ ID NO: 602370 - DNA, 20 bp, Artificial Sequence
  chemically synthesized
cacctttgggtttgttttca

SEQ ID NO: 602371 - DNA, 20 bp, Artificial Sequence
  chemically synthesized
catcttgaaaacaaacccaa

SEQ ID NO: 602372 - DNA, 20 bp, Artificial Sequence
  chemically synthesized
tctcatgaaagcacctttgg

SEQ ID NO: 602373 - DNA, 20 bp, Artificial Sequence
  chemically synthesized
aatctctcatgaaagcacct

SEQ ID NO: 602374 - DNA, 20 bp, Artificial Sequence
  chemically synthesized
aaacccaaaggtgctttcat

SEQ ID NO: 602375 - DNA, 20 bp, Artificial Sequence
  chemically synthesized
aaatgaaaagtggctcaata

SEQ ID NO: 602376 - DNA, 20 bp, Artificial Sequence
  chemically synthesized
tgcgtgaggctttaaatagc

SEQ ID NO: 602377 - DNA, 20 bp, Artificial Sequence
  chemically synthesized
ttttagttttcaaaaatgcg

SEQ ID NO: 602378 - DNA, 20 bp, Artificial Sequence
  chemically synthesized
tggagtccattgtagaaagt

SEQ ID NO: 602379 - DNA, 20 bp, Artificial Sequence
  chemically synthesized
gagtaatggagtccattgta

SEQ ID NO: 602380 - DNA, 20 bp, Artificial Sequence
  chemically synthesized
atgattttcttttagatgtt

SEQ ID NO: 602381 - DNA, 20 bp, Artificial Sequence
  chemically synthesized
aaggtgtatgattttctttt

SEQ ID NO: 602382 - DNA, 20 bp, Artificial Sequence
  chemically synthesized
agagtgccttgtaacaaggt

SEQ ID NO: 602383 - DNA, 20 bp, Artificial Sequence
  chemically synthesized
agtattacaatcattataca

SEQ ID NO: 602384 - DNA, 20 bp, Artificial Sequence
  chemically synthesized
taaagtaaaagcactatgta

SEQ ID NO: 602385 - DNA, 20 bp, Artificial Sequence
  chemically synthesized
ctgttacttaaaatgtataa

SEQ ID NO: 602386 - DNA, 20 bp, Artificial Sequence
  chemically synthesized
acattatacattttaagtaa

SEQ ID NO: 602387 - DNA, 20 bp, Artificial Sequence
  chemically synthesized
catagtattaatatataatg

SEQ ID NO: 602388 - DNA, 20 bp, Artificial Sequence
  chemically synthesized
tatgtgtagaatcactatcg

SEQ ID NO: 602389 - DNA, 20 bp, Artificial Sequence
  chemically synthesized
tataaggaaaatcaatgcga

SEQ ID NO: 602390 - DNA, 20 bp, Artificial Sequence
  chemically synthesized
tgatctactacaatgtaaat

SEQ ID NO: 602391 - DNA, 20 bp, Artificial Sequence
  chemically synthesized
aaaaatagcagcatgttttc

SEQ ID NO: 602392 - DNA, 20 bp, Artificial Sequence
  chemically synthesized
ataaaatagcaaaaatagca

SEQ ID NO: 602393 - DNA, 20 bp, Artificial Sequence
  chemically synthesized
ttctaagtagaaatttagca

SEQ ID NO: 602394 - DNA, 20 bp, Artificial Sequence
  chemically synthesized
cttaaaagattataacagag

SEQ ID NO: 602395 - DNA, 20 bp, Artificial Sequence
  chemically synthesized
gtagcttcaccaactgcctt

SEQ ID NO: 602396 - DNA, 20 bp, Artificial Sequence
  chemically synthesized
attagtccctctaatatttt

SEQ ID NO: 602397 - DNA, 20 bp, Artificial Sequence
  chemically synthesized
acaaagtatgtatgtgaatg

SEQ ID NO: 602398 - DNA, 20 bp, Artificial Sequence
  chemically synthesized
tcaaatctatcaccaaatgc

SEQ ID NO: 602399 - DNA, 20 bp, Artificial Sequence
  chemically synthesized
caaaaacgacagcatttggt

SEQ ID NO: 602400 - DNA, 20 bp, Artificial Sequence
  chemically synthesized
ataggagacaagaaaatctc

SEQ ID NO: 602401 - DNA, 20 bp, Artificial Sequence
  chemically synthesized
gacaagaaaatctcgtggga

SEQ ID NO: 602402 - DNA, 20 bp, Artificial Sequence
  chemically synthesized
acttattcaagccaaatccc

SEQ ID NO: 602403 - DNA, 20 bp, Artificial Sequence
  chemically synthesized
actggggtatacatcaggaa

SEQ ID NO: 602404 - DNA, 20 bp, Artificial Sequence
  chemically synthesized
caggaattttgttttaacat

SEQ ID NO: 602405 - DNA, 20 bp, Artificial Sequence
  chemically synthesized
tctaggatcattagaaaggg

SEQ ID NO: 602406 - DNA, 20 bp, Artificial Sequence
  chemically synthesized
atctgtaagttgttcctgct

SEQ ID NO: 602407 - DNA, 20 bp, Artificial Sequence
  chemically synthesized
aacttacagcaggaacaact

SEQ ID NO: 602408 - DNA, 20 bp, Artificial Sequence
  chemically synthesized
acagattacatttaaaacta

SEQ ID NO: 602409 - DNA, 20 bp, Artificial Sequence
  chemically synthesized
cgggtcaacttatcaagctc

SEQ ID NO: 602410 - DNA, 20 bp, Artificial Sequence
  chemically synthesized
tcattctttcttaattatct

SEQ ID NO: 602411 - DNA, 20 bp, Artificial Sequence
  chemically synthesized
acacagaagccaactgaatt

SEQ ID NO: 602412 - DNA, 20 bp, Artificial Sequence
  chemically synthesized
ttactaaatcgctaaattca

SEQ ID NO: 602413 - DNA, 20 bp, Artificial Sequence
  chemically synthesized
tcactgatgaccctgacaaa

SEQ ID NO: 602414 - DNA, 20 bp, Artificial Sequence
  chemically synthesized
tatcctcactattctattaa

SEQ ID NO: 602415 - DNA, 20 bp, Artificial Sequence
  chemically synthesized
tttaatagaatagtgaggat

SEQ ID NO: 602416 - DNA, 20 bp, Artificial Sequence
  chemically synthesized
atagaatagtgaggataaca

SEQ ID NO: 602417 - DNA, 20 bp, Artificial Sequence
  chemically synthesized
ctctctagcaacctctccat

SEQ ID NO: 602418 - DNA, 20 bp, Artificial Sequence
  chemically synthesized
cgggaatggagaggttgcta

SEQ ID NO: 602419 - DNA, 20 bp, Artificial Sequence
  chemically synthesized
tagagagattgttgtccaat

SEQ ID NO: 602420 - DNA, 20 bp, Artificial Sequence
  chemically synthesized
tttctgtgcttttgtctaag

SEQ ID NO: 602421 - DNA, 20 bp, Artificial Sequence
  chemically synthesized
tgtttacatagatgaacttt

SEQ ID NO: 602422 - DNA, 20 bp, Artificial Sequence
  chemically synthesized
gctcacagactctactttcc

SEQ ID NO: 602423 - DNA, 20 bp, Artificial Sequence
  chemically synthesized
acaaagggaaagtagagtct

SEQ ID NO: 602424 - DNA, 20 bp, Artificial Sequence
  chemically synthesized
tgggagtactgcaacttcta

SEQ ID NO: 602425 - DNA, 20 bp, Artificial Sequence
  chemically synthesized
agtactgcaacttctattct

SEQ ID NO: 602426 - DNA, 20 bp, Artificial Sequence
  chemically synthesized
ttttctcggtaaaacaagaa

SEQ ID NO: 602427 - DNA, 20 bp, Artificial Sequence
  chemically synthesized
ctttctgcaaaaaactagct

SEQ ID NO: 602428 - DNA, 20 bp, Artificial Sequence
  chemically synthesized
tttccatctttctgcaaaaa

SEQ ID NO: 602429 - DNA, 20 bp, Artificial Sequence
  chemically synthesized
ctttcgtcagatctctaaca

SEQ ID NO: 602430 - DNA, 20 bp, Artificial Sequence
  chemically synthesized
ggttacgtggatgtctttct

SEQ ID NO: 602431 - DNA, 20 bp, Artificial Sequence
  chemically synthesized
tagtaaatagttatcaataa

SEQ ID NO: 602432 - DNA, 20 bp, Artificial Sequence
  chemically synthesized
ggttatatattttaattatt

SEQ ID NO: 602433 - DNA, 20 bp, Artificial Sequence
  chemically synthesized
attatttacttagaaagtat

SEQ ID NO: 602434 - DNA, 20 bp, Artificial Sequence
  chemically synthesized
tgttttataattctatatat

SEQ ID NO: 602435 - DNA, 20 bp, Artificial Sequence
  chemically synthesized
ttctatatatgtaggtttct

SEQ ID NO: 602436 - DNA, 20 bp, Artificial Sequence
  chemically synthesized
ttctatctaacaaacatgta

SEQ ID NO: 602437 - DNA, 20 bp, Artificial Sequence
  chemically synthesized
taacctagattaatcactgt

SEQ ID NO: 602438 - DNA, 20 bp, Artificial Sequence
  chemically synthesized
gtgtatagagcctcatctaa

SEQ ID NO: 602439 - DNA, 20 bp, Artificial Sequence
  chemically synthesized
gtattaatatcatcacattt

SEQ ID NO: 602440 - DNA, 20 bp, Artificial Sequence
  chemically synthesized
agaaaagttgtttaaccttt

SEQ ID NO: 602441 - DNA, 20 bp, Artificial Sequence
  chemically synthesized
tgcctgtgtgattctagaaa

SEQ ID NO: 602442 - DNA, 20 bp, Artificial Sequence
  chemically synthesized
aacttttctagaatcacaca

SEQ ID NO: 602443 - DNA, 20 bp, Artificial Sequence
  chemically synthesized
atccacatcataaactgcct

SEQ ID NO: 602444 - DNA, 20 bp, Artificial Sequence
  chemically synthesized
aagctctgagatcagatcgc

SEQ ID NO: 602445 - DNA, 20 bp, Artificial Sequence
  chemically synthesized
aaacccaggcgatctgatct

SEQ ID NO: 602446 - DNA, 20 bp, Artificial Sequence
  chemically synthesized
ccagtatttgaccgcgtgtg

SEQ ID NO: 602447 - DNA, 20 bp, Artificial Sequence
  chemically synthesized
atgcatataacggaatatta

SEQ ID NO: 602448 - DNA, 20 bp, Artificial Sequence
  chemically synthesized
tattccgttatatgcatata

SEQ ID NO: 602449 - DNA, 20 bp, Artificial Sequence
  chemically synthesized
tatttatttgacaatataca

SEQ ID NO: 602450 - DNA, 20 bp, Artificial Sequence
  chemically synthesized
tatttgacaatatacattta

SEQ ID NO: 602451 - DNA, 20 bp, Artificial Sequence
  chemically synthesized
tcaaggaggtatctgcaccc

SEQ ID NO: 602452 - DNA, 20 bp, Artificial Sequence
  chemically synthesized
gtgcagatacctccttgaga

SEQ ID NO: 602453 - DNA, 20 bp, Artificial Sequence
  chemically synthesized
ctttggatatatatccagaa

SEQ ID NO: 602454 - DNA, 20 bp, Artificial Sequence
  chemically synthesized
attcccatttgattcaccaa

SEQ ID NO: 602455 - DNA, 20 bp, Artificial Sequence
  chemically synthesized
aaattacaaatagaattccc

SEQ ID NO: 602456 - DNA, 20 bp, Artificial Sequence
  chemically synthesized
ttggtgcagccatttgggag

SEQ ID NO: 602457 - DNA, 20 bp, Artificial Sequence
  chemically synthesized
tcttgccaacacttagtatc

SEQ ID NO: 602458 - DNA, 20 bp, Artificial Sequence
  chemically synthesized
ccaacacttagtatcttttg

SEQ ID NO: 602459 - DNA, 20 bp, Artificial Sequence
  chemically synthesized
aacaggtatgaagaggttct

SEQ ID NO: 602460 - DNA, 20 bp, Artificial Sequence
  chemically synthesized
ggcttttaactgcatttttc

SEQ ID NO: 602461 - DNA, 20 bp, Artificial Sequence
  chemically synthesized
catttttaatcaggttattt

SEQ ID NO: 602462 - DNA, 20 bp, Artificial Sequence
  chemically synthesized
aaaaataaaactgaaaaata

SEQ ID NO: 602463 - DNA, 20 bp, Artificial Sequence
  chemically synthesized
atattaatcatttgccagac

SEQ ID NO: 602464 - DNA, 20 bp, Artificial Sequence
  chemically synthesized
tcacaaatcatatgtctggc

SEQ ID NO: 602465 - DNA, 20 bp, Artificial Sequence
  chemically synthesized
agttctgtgagtttgactat

SEQ ID NO: 602466 - DNA, 20 bp, Artificial Sequence
  chemically synthesized
ctattctactctctagttct

SEQ ID NO: 602467 - DNA, 20 bp, Artificial Sequence
  chemically synthesized
acagaactagagagtagaat

SEQ ID NO: 602468 - DNA, 20 bp, Artificial Sequence
  chemically synthesized
aaaatgatgcccaaaggata

SEQ ID NO: 602469 - DNA, 20 bp, Artificial Sequence
  chemically synthesized
gctaattcatcttgcataac

SEQ ID NO: 602470 - DNA, 20 bp, Artificial Sequence
  chemically synthesized
ccccttaatttatttatttt

SEQ ID NO: 602471 - DNA, 20 bp, Artificial Sequence
  chemically synthesized
taaacttacctatcacctcc

SEQ ID NO: 602472 - DNA, 20 bp, Artificial Sequence
  chemically synthesized
gaaacttttggaggtgatag

SEQ ID NO: 602473 - DNA, 20 bp, Artificial Sequence
  chemically synthesized
tggtaataagtctcatgggt

SEQ ID NO: 602474 - DNA, 20 bp, Artificial Sequence
  chemically synthesized
tatttaatttatacaacttg

SEQ ID NO: 602475 - DNA, 20 bp, Artificial Sequence
  chemically synthesized
gtacatatttaatttataca

SEQ ID NO: 602476 - DNA, 20 bp, Artificial Sequence
  chemically synthesized
agttgtataaattaaatatg

SEQ ID NO: 602477 - DNA, 20 bp, Artificial Sequence
  chemically synthesized
tgtcagtcatacctcaacaa

SEQ ID NO: 602478 - DNA, 20 bp, Artificial Sequence
  chemically synthesized
aacaaagtggtttaaacaaa

SEQ ID NO: 602479 - DNA, 20 bp, Artificial Sequence
  chemically synthesized
agagatggaagagaatctat

SEQ ID NO: 602480 - DNA, 20 bp, Artificial Sequence
  chemically synthesized
atagattctcttccatctct

SEQ ID NO: 602481 - DNA, 20 bp, Artificial Sequence
  chemically synthesized
tccccatgctcccatcccta

SEQ ID NO: 602482 - DNA, 20 bp, Artificial Sequence
  chemically synthesized
atactgtttcttgcctattg

SEQ ID NO: 602483 - DNA, 20 bp, Artificial Sequence
  chemically synthesized
aagataacatgtatataaga

SEQ ID NO: 602484 - DNA, 20 bp, Artificial Sequence
  chemically synthesized
gttatctttatttttatgta

SEQ ID NO: 602485 - DNA, 20 bp, Artificial Sequence
  chemically synthesized
ttatgtacctcgtttatatg

SEQ ID NO: 602486 - DNA, 20 bp, Artificial Sequence
  chemically synthesized
tacttgacttccagatacat

SEQ ID NO: 602487 - DNA, 20 bp, Artificial Sequence
  chemically synthesized
ctaagagaagaacaaaatgg

SEQ ID NO: 602488 - DNA, 20 bp, Artificial Sequence
  chemically synthesized
atgagctacattgtaggtca

SEQ ID NO: 602489 - DNA, 20 bp, Artificial Sequence
  chemically synthesized
cagaaatatatctgaaaaca

SEQ ID NO: 602490 - DNA, 20 bp, Artificial Sequence
  chemically synthesized
gaagaatgagggaagaatca

SEQ ID NO: 602491 - DNA, 20 bp, Artificial Sequence
  chemically synthesized
tggcagtacttgctgaagga

SEQ ID NO: 602492 - DNA, 20 bp, Artificial Sequence
  chemically synthesized
ttgcaaactactcatccaac

SEQ ID NO: 602493 - DNA, 20 bp, Artificial Sequence
  chemically synthesized
tactaatcctctgttggatg

SEQ ID NO: 602494 - DNA, 20 bp, Artificial Sequence
  chemically synthesized
gcaaatattttttcccattc

SEQ ID NO: 602495 - DNA, 20 bp, Artificial Sequence
  chemically synthesized
ttctgtggattgtcttttca

SEQ ID NO: 602496 - DNA, 20 bp, Artificial Sequence
  chemically synthesized
gattgtcttttcattctgtt

SEQ ID NO: 602497 - DNA, 20 bp, Artificial Sequence
  chemically synthesized
ctttttatgatatctgagtt

SEQ ID NO: 602498 - DNA, 20 bp, Artificial Sequence
  chemically synthesized
tatttttctttttatgatat

SEQ ID NO: 602499 - DNA, 20 bp, Artificial Sequence
  chemically synthesized
agatatcataaaaagaaaaa

SEQ ID NO: 602500 - DNA, 20 bp, Artificial Sequence
  chemically synthesized
catcacatccacatatgata

SEQ ID NO: 602501 - DNA, 20 bp, Artificial Sequence
  chemically synthesized
tcatatcatatgtggatgtg

SEQ ID NO: 602502 - DNA, 20 bp, Artificial Sequence
  chemically synthesized
tcttcttttggaaataactg

SEQ ID NO: 602503 - DNA, 20 bp, Artificial Sequence
  chemically synthesized
ggttttggtttgcatttatt

SEQ ID NO: 602504 - DNA, 20 bp, Artificial Sequence
  chemically synthesized
aggtgatacctcattgtggt

SEQ ID NO: 602505 - DNA, 20 bp, Artificial Sequence
  chemically synthesized
ggggtgaggtgatacctcat

SEQ ID NO: 602506 - DNA, 20 bp, Artificial Sequence
  chemically synthesized
aaggggatatttgtggatat

SEQ ID NO: 602507 - DNA, 20 bp, Artificial Sequence
  chemically synthesized
acaaatatcccctttttcct

SEQ ID NO: 602508 - DNA, 20 bp, Artificial Sequence
  chemically synthesized
cctggacaattgcaatccct

SEQ ID NO: 602509 - DNA, 20 bp, Artificial Sequence
  chemically synthesized
agggctgaagtggaagcagg

SEQ ID NO: 602510 - DNA, 20 bp, Artificial Sequence
  chemically synthesized
acctgcttccacttcagccc

SEQ ID NO: 602511 - DNA, 20 bp, Artificial Sequence
  chemically synthesized
tttcatttaaaatggttgtt

SEQ ID NO: 602512 - DNA, 20 bp, Artificial Sequence
  chemically synthesized
catttcatttcatttaaaat

SEQ ID NO: 602513 - DNA, 20 bp, Artificial Sequence
  chemically synthesized
gaaatgaaatgatgccactc

SEQ ID NO: 602514 - DNA, 20 bp, Artificial Sequence
  chemically synthesized
cataatgactaaatcatcac

SEQ ID NO: 602515 - DNA, 20 bp, Artificial Sequence
  chemically synthesized
aaggaatatggaagccacag

SEQ ID NO: 602516 - DNA, 20 bp, Artificial Sequence
  chemically synthesized
cattttcccactctttttct

SEQ ID NO: 602517 - DNA, 20 bp, Artificial Sequence
  chemically synthesized
ctgaggcaagagagggctta

SEQ ID NO: 602518 - DNA, 20 bp, Artificial Sequence
  chemically synthesized
agaaaacatctgaggcaaga

SEQ ID NO: 602519 - DNA, 20 bp, Artificial Sequence
  chemically synthesized
gctaagccctctcttgcctc

SEQ ID NO: 602520 - DNA, 20 bp, Artificial Sequence
  chemically synthesized
caagttcctactactcgggt

SEQ ID NO: 602521 - DNA, 20 bp, Artificial Sequence
  chemically synthesized
tttctattgggtagtcagta

SEQ ID NO: 602522 - DNA, 20 bp, Artificial Sequence
  chemically synthesized
ctactgactacccaatagaa

SEQ ID NO: 602523 - DNA, 20 bp, Artificial Sequence
  chemically synthesized
caacaatgtcttgtttgaag

SEQ ID NO: 602524 - DNA, 20 bp, Artificial Sequence
  chemically synthesized
aacacattatcacaacaatg

SEQ ID NO: 602525 - DNA, 20 bp, Artificial Sequence
  chemically synthesized
gtagttaccttcacggagat

SEQ ID NO: 602526 - DNA, 20 bp, Artificial Sequence
  chemically synthesized
ttttttagaaatagctagaa

SEQ ID NO: 602527 - DNA, 20 bp, Artificial Sequence
  chemically synthesized
tatgtatataagtttaaaaa

SEQ ID NO: 602528 - DNA, 20 bp, Artificial Sequence
  chemically synthesized
aaattttaaagggtatgtat

SEQ ID NO: 602529 - DNA, 20 bp, Artificial Sequence
  chemically synthesized
caaatatctgatacatttga

SEQ ID NO: 602530 - DNA, 20 bp, Artificial Sequence
  chemically synthesized
tgtatcagatatttggacaa

SEQ ID NO: 602531 - DNA, 20 bp, Artificial Sequence
  chemically synthesized
acaattttgtttcaaattat

SEQ ID NO: 602532 - DNA, 20 bp, Artificial Sequence
  chemically synthesized
ctgtagatatttctgtaatg

SEQ ID NO: 602533 - DNA, 20 bp, Artificial Sequence
  chemically synthesized
aattggtaacaatattcaca

SEQ ID NO: 602534 - DNA, 20 bp, Artificial Sequence
  chemically synthesized
acaatattcacatatggctt

SEQ ID NO: 602535 - DNA, 20 bp, Artificial Sequence
  chemically synthesized
tcttagaatattatatgtat

SEQ ID NO: 602536 - DNA, 20 bp, Artificial Sequence
  chemically synthesized
gcacagatacatataatatt

SEQ ID NO: 602537 - DNA, 20 bp, Artificial Sequence
  chemically synthesized
ttagaaaatggagatcagaa

SEQ ID NO: 602538 - DNA, 20 bp, Artificial Sequence
  chemically synthesized
atcagaacatagcttggatc

SEQ ID NO: 602539 - DNA, 20 bp, Artificial Sequence
  chemically synthesized
ttttgctatgcaacagatga

SEQ ID NO: 602540 - DNA, 20 bp, Artificial Sequence
  chemically synthesized
taaaggctctctaaaaatgt

SEQ ID NO: 602541 - DNA, 20 bp, Artificial Sequence
  chemically synthesized
cctgtaaaatgtaaaaacct

SEQ ID NO: 602542 - DNA, 20 bp, Artificial Sequence
  chemically synthesized
caacaatattactaaaacct

SEQ ID NO: 602543 - DNA, 20 bp, Artificial Sequence
  chemically synthesized
cttgaggttttagtaatatt

SEQ ID NO: 602544 - DNA, 20 bp, Artificial Sequence
  chemically synthesized
ttatactttttttttttggc

SEQ ID NO: 602545 - DNA, 20 bp, Artificial Sequence
  chemically synthesized
cagtgtgaaaggtatttgtt

SEQ ID NO: 602546 - DNA, 20 bp, Artificial Sequence
  chemically synthesized
ggaaggccagtgtgaaaggt

SEQ ID NO: 602547 - DNA, 20 bp, Artificial Sequence
  chemically synthesized
taaataatagattataccat

SEQ ID NO: 602548 - DNA, 20 bp, Artificial Sequence
  chemically synthesized
aaaaaaaatattacttaaat

SEQ ID NO: 602549 - DNA, 20 bp, Artificial Sequence
  chemically synthesized
aagtaagtcagtgctagaag

SEQ ID NO: 602550 - DNA, 20 bp, Artificial Sequence
  chemically synthesized
cagaaccaatgaacacttgt

SEQ ID NO: 602551 - DNA, 20 bp, Artificial Sequence
  chemically synthesized
tgtcagtgattgtattagct

SEQ ID NO: 602552 - DNA, 20 bp, Artificial Sequence
  chemically synthesized
ttttttttttcattttcaaa

SEQ ID NO: 602553 - DNA, 20 bp, Artificial Sequence
  chemically synthesized
cattacttcttttctatttt

SEQ ID NO: 602554 - DNA, 20 bp, Artificial Sequence
  chemically synthesized
tacctttttggaaattaata

SEQ ID NO: 602555 - DNA, 20 bp, Artificial Sequence
  chemically synthesized
atatagggttaggtatcatc

SEQ ID NO: 602556 - DNA, 20 bp, Artificial Sequence
  chemically synthesized
tgatacctaaccctatatac

SEQ ID NO: 602557 - DNA, 20 bp, Artificial Sequence
  chemically synthesized
atttataaattaggcatagt

SEQ ID NO: 602558 - DNA, 20 bp, Artificial Sequence
  chemically synthesized
atatcttattttactgtgct

SEQ ID NO: 602559 - DNA, 20 bp, Artificial Sequence
  chemically synthesized
ttttactgtgctcaccgatt

SEQ ID NO: 602560 - DNA, 20 bp, Artificial Sequence
  chemically synthesized
gttttgctttccctggtttc

SEQ ID NO: 602561 - DNA, 20 bp, Artificial Sequence
  chemically synthesized
tcatctgcagttttgctttc

SEQ ID NO: 602562 - DNA, 20 bp, Artificial Sequence
  chemically synthesized
tagtccccgatcatctgcag

SEQ ID NO: 602563 - DNA, 20 bp, Artificial Sequence
  chemically synthesized
tacattagtccccgatcatc

SEQ ID NO: 602564 - DNA, 20 bp, Artificial Sequence
  chemically synthesized
ttggtgaacttaaaagtatt

SEQ ID NO: 602565 - DNA, 20 bp, Artificial Sequence
  chemically synthesized
aaatgactgtacactcatat

SEQ ID NO: 602566 - DNA, 20 bp, Artificial Sequence
  chemically synthesized
tgagtgtacagtcattttgt

SEQ ID NO: 602567 - DNA, 20 bp, Artificial Sequence
  chemically synthesized
catctagttttaaataacaa

SEQ ID NO: 602568 - DNA, 20 bp, Artificial Sequence
  chemically synthesized
gttaccacacctggctgaca

SEQ ID NO: 602569 - DNA, 20 bp, Artificial Sequence
  chemically synthesized
ttgggaggccaaggaaagag

SEQ ID NO: 602570 - DNA, 20 bp, Artificial Sequence
  chemically synthesized
ggtcttgctgtgtttcccag

SEQ ID NO: 602571 - DNA, 20 bp, Artificial Sequence
  chemically synthesized
ttggtagagacagggtcttg

SEQ ID NO: 602572 - DNA, 20 bp, Artificial Sequence
  chemically synthesized
tgtggggactgagatgggag

SEQ ID NO: 602573 - DNA, 20 bp, Artificial Sequence
  chemically synthesized
ataactttcgattaacattt

SEQ ID NO: 602574 - DNA, 20 bp, Artificial Sequence
  chemically synthesized
ataggataaataattataac

SEQ ID NO: 602575 - DNA, 20 bp, Artificial Sequence
  chemically synthesized
aacataaatgtataataata

SEQ ID NO: 602576 - DNA, 20 bp, Artificial Sequence
  chemically synthesized
catttatgttctgaagaaaa

SEQ ID NO: 602577 - DNA, 20 bp, Artificial Sequence
  chemically synthesized
tcttagtcattatttccaat

SEQ ID NO: 602578 - DNA, 20 bp, Artificial Sequence
  chemically synthesized
attggaaataatgactaaga

SEQ ID NO: 602579 - DNA, 20 bp, Artificial Sequence
  chemically synthesized
aatatttagatatgctagaa

SEQ ID NO: 602580 - DNA, 20 bp, Artificial Sequence
  chemically synthesized
gattaatttgtcagaattaa

SEQ ID NO: 602581 - DNA, 20 bp, Artificial Sequence
  chemically synthesized
ttaaggctttgttcctatgt

SEQ ID NO: 602582 - DNA, 20 bp, Artificial Sequence
  chemically synthesized
ttttggttaaggctttgttc

SEQ ID NO: 602583 - DNA, 20 bp, Artificial Sequence
  chemically synthesized
ccttcaccgttacttttggt

SEQ ID NO: 602584 - DNA, 20 bp, Artificial Sequence
  chemically synthesized
gcttgcctcaacgtacttaa

SEQ ID NO: 602585 - DNA, 20 bp, Artificial Sequence
  chemically synthesized
gttgaggcaagccacagtga

SEQ ID NO: 602586 - DNA, 20 bp, Artificial Sequence
  chemically synthesized
gtatagacaatctctttcac

SEQ ID NO: 602587 - DNA, 20 bp, Artificial Sequence
  chemically synthesized
agtctcgaagcaaactctgg

SEQ ID NO: 602588 - DNA, 20 bp, Artificial Sequence
  chemically synthesized
aagaatgaagcagagccaga

SEQ ID NO: 602589 - DNA, 20 bp, Artificial Sequence
  chemically synthesized
gataaagaatgaagcagagc

SEQ ID NO: 602590 - DNA, 20 bp, Artificial Sequence
  chemically synthesized
cttctgcccaccttcattga

SEQ ID NO: 602591 - DNA, 20 bp, Artificial Sequence
  chemically synthesized
ggcttaaattgatttatttt

SEQ ID NO: 602592 - DNA, 20 bp, Artificial Sequence
  chemically synthesized
aatttttttcagctggctta

SEQ ID NO: 602593 - DNA, 20 bp, Artificial Sequence
  chemically synthesized
tgtggcagtaatttttttca

SEQ ID NO: 602594 - DNA, 20 bp, Artificial Sequence
  chemically synthesized
cccaattttacattttctag

SEQ ID NO: 602595 - DNA, 20 bp, Artificial Sequence
  chemically synthesized
ttgggactgatggcattgca

SEQ ID NO: 602596 - DNA, 20 bp, Artificial Sequence
  chemically synthesized
ctatatcaatatctctgtat

SEQ ID NO: 602597 - DNA, 20 bp, Artificial Sequence
  chemically synthesized
tagaatacaaataattcccc

SEQ ID NO: 602598 - DNA, 20 bp, Artificial Sequence
  chemically synthesized
gaaatattaaatttatttcc

SEQ ID NO: 602599 - DNA, 20 bp, Artificial Sequence
  chemically synthesized
tagaaaaatgtgtgaaaatg

SEQ ID NO: 602600 - DNA, 20 bp, Artificial Sequence
  chemically synthesized
taaacaatttctgcagtatc

SEQ ID NO: 602601 - DNA, 20 bp, Artificial Sequence
  chemically synthesized
caaacacaggatactgcaga

SEQ ID NO: 602602 - DNA, 20 bp, Artificial Sequence
  chemically synthesized
ggtgtgaaggttatttgtga

SEQ ID NO: 602603 - DNA, 20 bp, Artificial Sequence
  chemically synthesized
gaaggttatttgtgaggtgg

SEQ ID NO: 602604 - DNA, 20 bp, Artificial Sequence
  chemically synthesized
ttgtgaggtggatttgcttt

SEQ ID NO: 602605 - DNA, 20 bp, Artificial Sequence
  chemically synthesized
taaaaaaatttccttaaaga

SEQ ID NO: 602606 - DNA, 20 bp, Artificial Sequence
  chemically synthesized
aaaatttccttaaagagcaa

SEQ ID NO: 602607 - DNA, 20 bp, Artificial Sequence
  chemically synthesized
taagaaataacaagtagctc

SEQ ID NO: 602608 - DNA, 20 bp, Artificial Sequence
  chemically synthesized
aaatgaggttgagtacaagg

SEQ ID NO: 602609 - DNA, 20 bp, Artificial Sequence
  chemically synthesized
agttcctcatttactcaacc

SEQ ID NO: 602610 - DNA, 20 bp, Artificial Sequence
  chemically synthesized
aacattggcactagtgacat

SEQ ID NO: 602611 - DNA, 20 bp, Artificial Sequence
  chemically synthesized
tttttaatgtttctagacgt

SEQ ID NO: 602612 - DNA, 20 bp, Artificial Sequence
  chemically synthesized
ggattttttttaatgtttct

SEQ ID NO: 602613 - DNA, 20 bp, Artificial Sequence
  chemically synthesized
tctccccagtggattttttt

SEQ ID NO: 602614 - DNA, 20 bp, Artificial Sequence
  chemically synthesized
gattttgctctcctctcccc

SEQ ID NO: 602615 - DNA, 20 bp, Artificial Sequence
  chemically synthesized
gatcagtgttttacagctgg

SEQ ID NO: 602616 - DNA, 20 bp, Artificial Sequence
  chemically synthesized
tgaatattatttggttagat

SEQ ID NO: 602617 - DNA, 20 bp, Artificial Sequence
  chemically synthesized
catataaaaatcttactctg

SEQ ID NO: 602618 - DNA, 20 bp, Artificial Sequence
  chemically synthesized
agcagctgaaacagtgcaga

SEQ ID NO: 602619 - DNA, 20 bp, Artificial Sequence
  chemically synthesized
atcttactctgcactgtttc

SEQ ID NO: 602620 - DNA, 20 bp, Artificial Sequence
  chemically synthesized
aaggaggaatggcctgccct

SEQ ID NO: 602621 - DNA, 20 bp, Artificial Sequence
  chemically synthesized
aagaaatggatggctgaagt

SEQ ID NO: 602622 - DNA, 20 bp, Artificial Sequence
  chemically synthesized
acttcagccatccatttctt

SEQ ID NO: 602623 - DNA, 20 bp, Artificial Sequence
  chemically synthesized
tccatttcttcagggtttgt

SEQ ID NO: 602624 - DNA, 20 bp, Artificial Sequence
  chemically synthesized
cagtaatgccttataacggg

SEQ ID NO: 602625 - DNA, 20 bp, Artificial Sequence
  chemically synthesized
gttataaggcattactggtg

SEQ ID NO: 602626 - DNA, 20 bp, Artificial Sequence
  chemically synthesized
catgggaattgtttttgggc

SEQ ID NO: 602627 - DNA, 20 bp, Artificial Sequence
  chemically synthesized
cacaggcccaaaaacaattc

SEQ ID NO: 602628 - DNA, 20 bp, Artificial Sequence
  chemically synthesized
agacatcctttaaacatggg

SEQ ID NO: 602629 - DNA, 20 bp, Artificial Sequence
  chemically synthesized
aatacaaaattactaccaaa

SEQ ID NO: 602630 - DNA, 20 bp, Artificial Sequence
  chemically synthesized
taaaatttctctagaggggg

SEQ ID NO: 602631 - DNA, 20 bp, Artificial Sequence
  chemically synthesized
acatttttagtattctcatg

SEQ ID NO: 602632 - DNA, 20 bp, Artificial Sequence
  chemically synthesized
cattgagtttattgttcata

SEQ ID NO: 602633 - DNA, 20 bp, Artificial Sequence
  chemically synthesized
attacattgagtttattgtt

SEQ ID NO: 602634 - DNA, 20 bp, Artificial Sequence
  chemically synthesized
gctataaagacaccattaca

SEQ ID NO: 602635 - DNA, 20 bp, Artificial Sequence
  chemically synthesized
agaaaataatttgtgaaagt

SEQ ID NO: 602636 - DNA, 20 bp, Artificial Sequence
  chemically synthesized
acaaattattttctacagat

SEQ ID NO: 602637 - DNA, 20 bp, Artificial Sequence
  chemically synthesized
tattttgtcatcttcaaaga

SEQ ID NO: 602638 - DNA, 20 bp, Artificial Sequence
  chemically synthesized
gtcatcttcaaagacagagc

SEQ ID NO: 602639 - DNA, 20 bp, Artificial Sequence
  chemically synthesized
tatttataaatgataaaaga

SEQ ID NO: 602640 - DNA, 20 bp, Artificial Sequence
  chemically synthesized
aaatagccagtatctctcac

SEQ ID NO: 602641 - DNA, 20 bp, Artificial Sequence
  chemically synthesized
tcccgtattacctttttttc

SEQ ID NO: 602642 - DNA, 20 bp, Artificial Sequence
  chemically synthesized
tgttttgccacttctaaaaa

SEQ ID NO: 602643 - DNA, 20 bp, Artificial Sequence
  chemically synthesized
tgtctacatgtgttattttc

SEQ ID NO: 602644 - DNA, 20 bp, Artificial Sequence
  chemically synthesized
ttgaaaatatgtgctccaca

SEQ ID NO: 602645 - DNA, 20 bp, Artificial Sequence
  chemically synthesized
cacagaaagtttccccttta

SEQ ID NO: 602646 - DNA, 20 bp, Artificial Sequence
  chemically synthesized
tcttgaagttctcttagata

SEQ ID NO: 602647 - DNA, 20 bp, Artificial Sequence
  chemically synthesized
ccttgttcaggtcttttttt

SEQ ID NO: 602648 - DNA, 20 bp, Artificial Sequence
  chemically synthesized
gttcaggtcttttttttttt

SEQ ID NO: 602649 - DNA, 20 bp, Artificial Sequence
  chemically synthesized
tctttttttttttgtttgtt

SEQ ID NO: 602650 - DNA, 20 bp, Artificial Sequence
  chemically synthesized
gaggtggaggctgcagtgag

SEQ ID NO: 602651 - DNA, 20 bp, Artificial Sequence
  chemically synthesized
tgcctcagcctcccaagtag

SEQ ID NO: 602652 - DNA, 20 bp, Artificial Sequence
  chemically synthesized
ctaccatgcccagctaattt

SEQ ID NO: 602653 - DNA, 20 bp, Artificial Sequence
  chemically synthesized
ttttgtgtttttagtagaga

SEQ ID NO: 602654 - DNA, 20 bp, Artificial Sequence
  chemically synthesized
tgcctcagctgcccagagtg

SEQ ID NO: 602655 - DNA, 20 bp, Artificial Sequence
  chemically synthesized
gtgactccattaatgcactg

SEQ ID NO: 602656 - DNA, 20 bp, Artificial Sequence
  chemically synthesized
aagatgagaggaaggaggag

SEQ ID NO: 602657 - DNA, 20 bp, Artificial Sequence
  chemically synthesized
cctccttcctctcatcttgg

SEQ ID NO: 602658 - DNA, 20 bp, Artificial Sequence
  chemically synthesized
gggaaataatatgattccac

SEQ ID NO: 602659 - DNA, 20 bp, Artificial Sequence
  chemically synthesized
attggttaaagagggaaata

SEQ ID NO: 602660 - DNA, 20 bp, Artificial Sequence
  chemically synthesized
tatttccctctttaaccaat

SEQ ID NO: 602661 - DNA, 20 bp, Artificial Sequence
  chemically synthesized
ccaatagcagttttttctta

SEQ ID NO: 602662 - DNA, 20 bp, Artificial Sequence
  chemically synthesized
ttattatcagtcccatcacc

SEQ ID NO: 602663 - DNA, 20 bp, Artificial Sequence
  chemically synthesized
ccatcaccactagattaaaa

SEQ ID NO: 602664 - DNA, 20 bp, Artificial Sequence
  chemically synthesized
tggatgctatgttttacaat

SEQ ID NO: 602665 - DNA, 20 bp, Artificial Sequence
  chemically synthesized
acagtgaatgtccttggatg

SEQ ID NO: 602666 - DNA, 20 bp, Artificial Sequence
  chemically synthesized
cattcactgtctactctcaa

SEQ ID NO: 602667 - DNA, 20 bp, Artificial Sequence
  chemically synthesized
taaaatattatggttggaaa

SEQ ID NO: 602668 - DNA, 20 bp, Artificial Sequence
  chemically synthesized
cactgggtagacaatatata

SEQ ID NO: 602669 - DNA, 20 bp, Artificial Sequence
  chemically synthesized
tcatttaactgaaaatgctg

SEQ ID NO: 602670 - DNA, 20 bp, Artificial Sequence
  chemically synthesized
ggaacataggttgtctctgc

SEQ ID NO: 602671 - DNA, 20 bp, Artificial Sequence
  chemically synthesized
aatatttcataatccttttt

SEQ ID NO: 602672 - DNA, 20 bp, Artificial Sequence
  chemically synthesized
aatccaacataaactaggaa

SEQ ID NO: 602673 - DNA, 20 bp, Artificial Sequence
  chemically synthesized
aatcctttttcctagtttat

SEQ ID NO: 602674 - DNA, 20 bp, Artificial Sequence
  chemically synthesized
tactgtgacaacctttccca

SEQ ID NO: 602675 - DNA, 20 bp, Artificial Sequence
  chemically synthesized
ggtaatatactcacaggttt

SEQ ID NO: 602676 - DNA, 20 bp, Artificial Sequence
  chemically synthesized
tcctttctggtaatatactc

SEQ ID NO: 602677 - DNA, 20 bp, Artificial Sequence
  chemically synthesized
taccagaaaggactttgcag

SEQ ID NO: 602678 - DNA, 20 bp, Artificial Sequence
  chemically synthesized
ctttgcagatgtgattacat

SEQ ID NO: 602679 - DNA, 20 bp, Artificial Sequence
  chemically synthesized
acattaaggattctgagatg

SEQ ID NO: 602680 - DNA, 20 bp, Artificial Sequence
  chemically synthesized
cttccttttaattaggacct

SEQ ID NO: 602681 - DNA, 20 bp, Artificial Sequence
  chemically synthesized
ggatggggacatgagacaag

SEQ ID NO: 602682 - DNA, 20 bp, Artificial Sequence
  chemically synthesized
gagtctgttttattggcatt

SEQ ID NO: 602683 - DNA, 20 bp, Artificial Sequence
  chemically synthesized
tttggaggctttgcgacaga

SEQ ID NO: 602684 - DNA, 20 bp, Artificial Sequence
  chemically synthesized
agcaggactttgtctgtttt

SEQ ID NO: 602685 - DNA, 20 bp, Artificial Sequence
  chemically synthesized
taaggtgtcagcaggacttt

SEQ ID NO: 602686 - DNA, 20 bp, Artificial Sequence
  chemically synthesized
gagttctggaagtcaaaagt

SEQ ID NO: 602687 - DNA, 20 bp, Artificial Sequence
  chemically synthesized
ccagaactctaataaatttg

SEQ ID NO: 602688 - DNA, 20 bp, Artificial Sequence
  chemically synthesized
acataggtatgcatgtacac

SEQ ID NO: 602689 - DNA, 20 bp, Artificial Sequence
  chemically synthesized
aagaaatgctatgcattaaa

SEQ ID NO: 602690 - DNA, 20 bp, Artificial Sequence
  chemically synthesized
gctatgcattaaaaaatgtt

SEQ ID NO: 602691 - DNA, 20 bp, Artificial Sequence
  chemically synthesized
tgcattaaaaaatgttttag

SEQ ID NO: 602692 - DNA, 20 bp, Artificial Sequence
  chemically synthesized
aaaaatgttttaggtttgct

SEQ ID NO: 602693 - DNA, 20 bp, Artificial Sequence
  chemically synthesized
gttttaggtttgcttagtgc

SEQ ID NO: 602694 - DNA, 20 bp, Artificial Sequence
  chemically synthesized
ccagtctagctgcttagttt

SEQ ID NO: 602695 - DNA, 20 bp, Artificial Sequence
  chemically synthesized
tttaaatcccagtctagctg

SEQ ID NO: 602696 - DNA, 20 bp, Artificial Sequence
  chemically synthesized
acaaaaactaagcagctaga

SEQ ID NO: 602697 - DNA, 20 bp, Artificial Sequence
  chemically synthesized
ctggatttaaatcccagtct

SEQ ID NO: 602698 - DNA, 20 bp, Artificial Sequence
  chemically synthesized
aaacattgcaacaatatgct

SEQ ID NO: 602699 - DNA, 20 bp, Artificial Sequence
  chemically synthesized
aatccaggagcatattgttg

SEQ ID NO: 602700 - DNA, 20 bp, Artificial Sequence
  chemically synthesized
aatgtttttccatcatacca

SEQ ID NO: 602701 - DNA, 20 bp, Artificial Sequence
  chemically synthesized
tacttaccttattgaatatt

SEQ ID NO: 602702 - DNA, 20 bp, Artificial Sequence
  chemically synthesized
ttttagaccttaatgcaatt

SEQ ID NO: 602703 - DNA, 20 bp, Artificial Sequence
  chemically synthesized
ccttaatgcaattgttggtt

SEQ ID NO: 602704 - DNA, 20 bp, Artificial Sequence
  chemically synthesized
ttgttggtttactgtttttc

SEQ ID NO: 602705 - DNA, 20 bp, Artificial Sequence
  chemically synthesized
aaccaaattcccttgactta

SEQ ID NO: 602706 - DNA, 20 bp, Artificial Sequence
  chemically synthesized
aacaaattaagtcaagggaa

SEQ ID NO: 602707 - DNA, 20 bp, Artificial Sequence
  chemically synthesized
accatatcgaatttgtaatt

SEQ ID NO: 602708 - DNA, 20 bp, Artificial Sequence
  chemically synthesized
gaatgtgtgttattggcatt

SEQ ID NO: 602709 - DNA, 20 bp, Artificial Sequence
  chemically synthesized
taaggtgttagcagaactgt

SEQ ID NO: 602710 - DNA, 20 bp, Artificial Sequence
  chemically synthesized
aacaccttaattttagccca

SEQ ID NO: 602711 - DNA, 20 bp, Artificial Sequence
  chemically synthesized
acagtaatgtaataaatttg

SEQ ID NO: 602712 - DNA, 20 bp, Artificial Sequence
  chemically synthesized
taagaaattagcagaaattt

SEQ ID NO: 602713 - DNA, 20 bp, Artificial Sequence
  chemically synthesized
cctatattacctttcatttc

SEQ ID NO: 602714 - DNA, 20 bp, Artificial Sequence
  chemically synthesized
atatataatgtatagtatgt

SEQ ID NO: 602715 - DNA, 20 bp, Artificial Sequence
  chemically synthesized
tactatacattatatatata

SEQ ID NO: 602716 - DNA, 20 bp, Artificial Sequence
  chemically synthesized
cttttttctagtcataagct

SEQ ID NO: 602717 - DNA, 20 bp, Artificial Sequence
  chemically synthesized
ttttaagatacgggtaatca

SEQ ID NO: 602718 - DNA, 20 bp, Artificial Sequence
  chemically synthesized
aaaagacaaccagactaaat

SEQ ID NO: 602719 - DNA, 20 bp, Artificial Sequence
  chemically synthesized
acaaccagactaaatggatg

SEQ ID NO: 602720 - DNA, 20 bp, Artificial Sequence
  chemically synthesized
tgaaaattattaaactaaaa

SEQ ID NO: 602721 - DNA, 20 bp, Artificial Sequence
  chemically synthesized
caataggaattaaacatgtt

SEQ ID NO: 602722 - DNA, 20 bp, Artificial Sequence
  chemically synthesized
ccattaccaataggaattaa

SEQ ID NO: 602723 - DNA, 20 bp, Artificial Sequence
  chemically synthesized
gaaaagaataggagttttct

SEQ ID NO: 602724 - DNA, 20 bp, Artificial Sequence
  chemically synthesized
attccttctaggaaaagaat

SEQ ID NO: 602725 - DNA, 20 bp, Artificial Sequence
  chemically synthesized
gtcttttacaaaggatggcg

SEQ ID NO: 602726 - DNA, 20 bp, Artificial Sequence
  chemically synthesized
catgagtcttttacaaagga

SEQ ID NO: 602727 - DNA, 20 bp, Artificial Sequence
  chemically synthesized
tttgaaagatgctgaaggtc

SEQ ID NO: 602728 - DNA, 20 bp, Artificial Sequence
  chemically synthesized
gtcaaatgcttatgtacctt

SEQ ID NO: 602729 - DNA, 20 bp, Artificial Sequence
  chemically synthesized
ttctaccctcatttttattt

SEQ ID NO: 602730 - DNA, 20 bp, Artificial Sequence
  chemically synthesized
ctccgaaaaattcaggtaat

SEQ ID NO: 602731 - DNA, 20 bp, Artificial Sequence
  chemically synthesized
cttgaattacctgaattttt

SEQ ID NO: 602732 - DNA, 20 bp, Artificial Sequence
  chemically synthesized
ggagtttattcatttgctcc

SEQ ID NO: 602733 - DNA, 20 bp, Artificial Sequence
  chemically synthesized
aatgctcaaccagctgggag

SEQ ID NO: 602734 - DNA, 20 bp, Artificial Sequence
  chemically synthesized
cgtccctcaatttcttcaaa

SEQ ID NO: 602735 - DNA, 20 bp, Artificial Sequence
  chemically synthesized
tatttccggctaatttcaga

SEQ ID NO: 602736 - DNA, 20 bp, Artificial Sequence
  chemically synthesized
tgtatttaaaaaattgtttt

SEQ ID NO: 602737 - DNA, 20 bp, Artificial Sequence
  chemically synthesized
tagggtaaatgtatttaaaa

SEQ ID NO: 602738 - DNA, 20 bp, Artificial Sequence
  chemically synthesized
taattgatgaataataattg

SEQ ID NO: 602739 - DNA, 20 bp, Artificial Sequence
  chemically synthesized
attaactgtacttgaaatct

SEQ ID NO: 602740 - DNA, 20 bp, Artificial Sequence
  chemically synthesized
ttgtttacatgtttgaatca

SEQ ID NO: 602741 - DNA, 20 bp, Artificial Sequence
  chemically synthesized
gaagatcatctactttgttt

SEQ ID NO: 602742 - DNA, 20 bp, Artificial Sequence
  chemically synthesized
aactgatagaagatcatcta

SEQ ID NO: 602743 - DNA, 20 bp, Artificial Sequence
  chemically synthesized
gtaaaatttaaattaccact

SEQ ID NO: 602744 - DNA, 20 bp, Artificial Sequence
  chemically synthesized
aactttttggctctgtaaga

SEQ ID NO: 602745 - DNA, 20 bp, Artificial Sequence
  chemically synthesized
aactatatcttacagagcca

SEQ ID NO: 602746 - DNA, 20 bp, Artificial Sequence
  chemically synthesized
tggagttgaaattaattata

SEQ ID NO: 602747 - DNA, 20 bp, Artificial Sequence
  chemically synthesized
ttattagctatagttttatg

SEQ ID NO: 602748 - DNA, 20 bp, Artificial Sequence
  chemically synthesized
catatatcaatattattagc

SEQ ID NO: 602749 - DNA, 20 bp, Artificial Sequence
  chemically synthesized
ttaagtacatagattgttca

SEQ ID NO: 602750 - DNA, 20 bp, Artificial Sequence
  chemically synthesized
ttttgaaaatatattaagta

SEQ ID NO: 602751 - DNA, 20 bp, Artificial Sequence
  chemically synthesized
ttctgttatgtagtattatg

SEQ ID NO: 602752 - DNA, 20 bp, Artificial Sequence
  chemically synthesized
gtattatggtgggattcaag

SEQ ID NO: 602753 - DNA, 20 bp, Artificial Sequence
  chemically synthesized
ttatataaagtactagtagt

SEQ ID NO: 602754 - DNA, 20 bp, Artificial Sequence
  chemically synthesized
cacattataggggaaagaat

SEQ ID NO: 602755 - DNA, 20 bp, Artificial Sequence
  chemically synthesized
acccaaaatttgtcaaatat

SEQ ID NO: 602756 - DNA, 20 bp, Artificial Sequence
  chemically synthesized
tttgtcaaatatctaagttt

SEQ ID NO: 602757 - DNA, 20 bp, Artificial Sequence
  chemically synthesized
tgcctatttggtggtactta

SEQ ID NO: 602758 - DNA, 20 bp, Artificial Sequence
  chemically synthesized
tgtttttttactttactttt

SEQ ID NO: 602759 - DNA, 20 bp, Artificial Sequence
  chemically synthesized
ttttcaaattgttcccctat

SEQ ID NO: 602760 - DNA, 20 bp, Artificial Sequence
  chemically synthesized
atataactacactttgagct

SEQ ID NO: 602761 - DNA, 20 bp, Artificial Sequence
  chemically synthesized
ttttcaaaaacaaaaattgt

SEQ ID NO: 602762 - DNA, 20 bp, Artificial Sequence
  chemically synthesized
actagaaaagccattacaat

SEQ ID NO: 602763 - DNA, 20 bp, Artificial Sequence
  chemically synthesized
attagttctacacattcatt

SEQ ID NO: 602764 - DNA, 20 bp, Artificial Sequence
  chemically synthesized
tagttttccactcctgtaaa

SEQ ID NO: 602765 - DNA, 20 bp, Artificial Sequence
  chemically synthesized
gattgattgagggatggatg

SEQ ID NO: 602766 - DNA, 20 bp, Artificial Sequence
  chemically synthesized
ctggagatagataggatatt

SEQ ID NO: 602767 - DNA, 20 bp, Artificial Sequence
  chemically synthesized
ggaactggagatagatagga

SEQ ID NO: 602768 - DNA, 20 bp, Artificial Sequence
  chemically synthesized
catttacatctttgagtgta

SEQ ID NO: 602769 - DNA, 20 bp, Artificial Sequence
  chemically synthesized
ttctgattatttccatcaga

SEQ ID NO: 602770 - DNA, 20 bp, Artificial Sequence
  chemically synthesized
aatttaagttacaattattc

SEQ ID NO: 602771 - DNA, 20 bp, Artificial Sequence
  chemically synthesized
cttccttactcacagaaaaa

SEQ ID NO: 602772 - DNA, 20 bp, Artificial Sequence
  chemically synthesized
tatttctttaaaattgtctc

SEQ ID NO: 602773 - DNA, 20 bp, Artificial Sequence
  chemically synthesized
aattgtctctggtgttttta

SEQ ID NO: 602774 - DNA, 20 bp, Artificial Sequence
  chemically synthesized
ctctggtgtttttacaatgt

SEQ ID NO: 602775 - DNA, 20 bp, Artificial Sequence
  chemically synthesized
ggtgtttttacaatgtttgt

SEQ ID NO: 602776 - DNA, 20 bp, Artificial Sequence
  chemically synthesized
acaatgtttgtgattgtttc

SEQ ID NO: 602777 - DNA, 20 bp, Artificial Sequence
  chemically synthesized
gtgattgtttccatcgattt

SEQ ID NO: 602778 - DNA, 20 bp, Artificial Sequence
  chemically synthesized
ttttaaatattttccaaaat

SEQ ID NO: 602779 - DNA, 20 bp, Artificial Sequence
  chemically synthesized
tttttgaacattttattgta

SEQ ID NO: 602780 - DNA, 20 bp, Artificial Sequence
  chemically synthesized
gctcatctaactgccttttc

SEQ ID NO: 602781 - DNA, 20 bp, Artificial Sequence
  chemically synthesized
attcttgcacatttttattc

SEQ ID NO: 602782 - DNA, 20 bp, Artificial Sequence
  chemically synthesized
acatttttattcttatgttt

SEQ ID NO: 602783 - DNA, 20 bp, Artificial Sequence
  chemically synthesized
gtggtttttaatgcttggca

SEQ ID NO: 602784 - DNA, 20 bp, Artificial Sequence
  chemically synthesized
tttccttttgttgtggtttt

SEQ ID NO: 602785 - DNA, 20 bp, Artificial Sequence
  chemically synthesized
ccttttttgtttccttttgt

SEQ ID NO: 602786 - DNA, 20 bp, Artificial Sequence
  chemically synthesized
aatggtagctgtttcacctt

SEQ ID NO: 602787 - DNA, 20 bp, Artificial Sequence
  chemically synthesized
ctactacaataccaaatggt

SEQ ID NO: 602788 - DNA, 20 bp, Artificial Sequence
  chemically synthesized
ataggacaatacataatgaa

SEQ ID NO: 602789 - DNA, 20 bp, Artificial Sequence
  chemically synthesized
ccaaaaaaaattctatgtga

SEQ ID NO: 602790 - DNA, 20 bp, Artificial Sequence
  chemically synthesized
taatatgtgcattttaagaa

SEQ ID NO: 602791 - DNA, 20 bp, Artificial Sequence
  chemically synthesized
tcttaaaatgcacatattat

SEQ ID NO: 602792 - DNA, 20 bp, Artificial Sequence
  chemically synthesized
tcagcttctaaatataacta

SEQ ID NO: 602793 - DNA, 20 bp, Artificial Sequence
  chemically synthesized
tgcctcagcctcccaaagtg

SEQ ID NO: 602794 - DNA, 20 bp, Artificial Sequence
  chemically synthesized
caggcagatcatctgaggtc

SEQ ID NO: 602795 - DNA, 20 bp, Artificial Sequence
  chemically synthesized
ttgtatttttaaagtaaaga

SEQ ID NO: 602796 - DNA, 20 bp, Artificial Sequence
  chemically synthesized
tgccttagcctcctgagtag

SEQ ID NO: 602797 - DNA, 20 bp, Artificial Sequence
  chemically synthesized
aacctacgcctcccgggttc

SEQ ID NO: 602798 - DNA, 20 bp, Artificial Sequence
  chemically synthesized
tactttattttatttttaga

SEQ ID NO: 602799 - DNA, 20 bp, Artificial Sequence
  chemically synthesized
aaatgaaagaaataatttgt

SEQ ID NO: 602800 - DNA, 20 bp, Artificial Sequence
  chemically synthesized
ctcattacattacagaaaat

SEQ ID NO: 602801 - DNA, 20 bp, Artificial Sequence
  chemically synthesized
gggctggctatatttataaa

SEQ ID NO: 602802 - DNA, 20 bp, Artificial Sequence
  chemically synthesized
tatagccagccctccatatt

SEQ ID NO: 602803 - DNA, 20 bp, Artificial Sequence
  chemically synthesized
atatttgtggattctgaatg

SEQ ID NO: 602804 - DNA, 20 bp, Artificial Sequence
  chemically synthesized
agtgacaatgaaaaagtctt

SEQ ID NO: 602805 - DNA, 20 bp, Artificial Sequence
  chemically synthesized
cccatatactttaactcatc

SEQ ID NO: 602806 - DNA, 20 bp, Artificial Sequence
  chemically synthesized
gatacgaagggatgactgta

SEQ ID NO: 602807 - DNA, 20 bp, Artificial Sequence
  chemically synthesized
actgtacactgattttaccc

SEQ ID NO: 602808 - DNA, 20 bp, Artificial Sequence
  chemically synthesized
accattgttttattccccac

SEQ ID NO: 602809 - DNA, 20 bp, Artificial Sequence
  chemically synthesized
gcaaaggtggggaataaaac

SEQ ID NO: 602810 - DNA, 20 bp, Artificial Sequence
  chemically synthesized
attttgattattagaaaaac

SEQ ID NO: 602811 - DNA, 20 bp, Artificial Sequence
  chemically synthesized
tgcattttcagatgtattga

SEQ ID NO: 602812 - DNA, 20 bp, Artificial Sequence
  chemically synthesized
ttagcatgcattttcagatg

SEQ ID NO: 602813 - DNA, 20 bp, Artificial Sequence
  chemically synthesized
acttcataaatagatcatac

SEQ ID NO: 602814 - DNA, 20 bp, Artificial Sequence
  chemically synthesized
tatgtatgggcatatataca

SEQ ID NO: 602815 - DNA, 20 bp, Artificial Sequence
  chemically synthesized
taagtcattctgacaagtat

SEQ ID NO: 602816 - DNA, 20 bp, Artificial Sequence
  chemically synthesized
tttaaaggttatatcaatgt

SEQ ID NO: 602817 - DNA, 20 bp, Artificial Sequence
  chemically synthesized
tcaatgtgaatgcttgataa

SEQ ID NO: 602818 - DNA, 20 bp, Artificial Sequence
  chemically synthesized
aatgcttgataagcgtgctt

SEQ ID NO: 602819 - DNA, 20 bp, Artificial Sequence
  chemically synthesized
ttgaatgtcaaaacaataaa

SEQ ID NO: 602820 - DNA, 20 bp, Artificial Sequence
  chemically synthesized
caattccccgagtctctgct

SEQ ID NO: 602821 - DNA, 20 bp, Artificial Sequence
  chemically synthesized
tgacactaagttgaggtatg

SEQ ID NO: 602822 - DNA, 20 bp, Artificial Sequence
  chemically synthesized
ctaagttgaggtatggagag

SEQ ID NO: 602823 - DNA, 20 bp, Artificial Sequence
  chemically synthesized
cattcttttttcccttttga

SEQ ID NO: 602824 - DNA, 20 bp, Artificial Sequence
  chemically synthesized
aaaaagaatgagaatcactt

SEQ ID NO: 602825 - DNA, 20 bp, Artificial Sequence
  chemically synthesized
tggcaaagtgtgaaacaatt

SEQ ID NO: 602826 - DNA, 20 bp, Artificial Sequence
  chemically synthesized
cttaattgtttcacactttg

SEQ ID NO: 602827 - DNA, 20 bp, Artificial Sequence
  chemically synthesized
tcagcaaactcaattatatt

SEQ ID NO: 602828 - DNA, 20 bp, Artificial Sequence
  chemically synthesized
atttgaaactagtaatataa

SEQ ID NO: 602829 - DNA, 20 bp, Artificial Sequence
  chemically synthesized
taatcatattaaatatattt

SEQ ID NO: 602830 - DNA, 20 bp, Artificial Sequence
  chemically synthesized
aaatctgaaaaatatattta

SEQ ID NO: 602831 - DNA, 20 bp, Artificial Sequence
  chemically synthesized
tgaacaatatagattttaca

SEQ ID NO: 602832 - DNA, 20 bp, Artificial Sequence
  chemically synthesized
tgtaaaatctatattgttca

SEQ ID NO: 602833 - DNA, 20 bp, Artificial Sequence
  chemically synthesized
ttataaaacgaattgaacaa

SEQ ID NO: 602834 - DNA, 20 bp, Artificial Sequence
  chemically synthesized
tttcctgcccttatctgttt

SEQ ID NO: 602835 - DNA, 20 bp, Artificial Sequence
  chemically synthesized
tttttctgtttcctgccctt

SEQ ID NO: 602836 - DNA, 20 bp, Artificial Sequence
  chemically synthesized
tttacttagcttctctgttt

SEQ ID NO: 602837 - DNA, 20 bp, Artificial Sequence
  chemically synthesized
ttgggcaatttacttagctt

SEQ ID NO: 602838 - DNA, 20 bp, Artificial Sequence
  chemically synthesized
gtatcaccttgggcaattta

SEQ ID NO: 602839 - DNA, 20 bp, Artificial Sequence
  chemically synthesized
tcagatacaattggaccctg

SEQ ID NO: 602840 - DNA, 20 bp, Artificial Sequence
  chemically synthesized
atagtatcattatccgaaga

SEQ ID NO: 602841 - DNA, 20 bp, Artificial Sequence
  chemically synthesized
ctgaaagaacacccatgtac

SEQ ID NO: 602842 - DNA, 20 bp, Artificial Sequence
  chemically synthesized
attaacaatgtatatgtctc

SEQ ID NO: 602843 - DNA, 20 bp, Artificial Sequence
  chemically synthesized
gcctgttttctcaattgcaa

SEQ ID NO: 602844 - DNA, 20 bp, Artificial Sequence
  chemically synthesized
acacatatgcctctttaata

SEQ ID NO: 602845 - DNA, 20 bp, Artificial Sequence
  chemically synthesized
tatacagtatgtatatacaa

SEQ ID NO: 602846 - DNA, 20 bp, Artificial Sequence
  chemically synthesized
atgtatatacaaacaagttt

SEQ ID NO: 602847 - DNA, 20 bp, Artificial Sequence
  chemically synthesized
acatactttaaaacgtataa

SEQ ID NO: 602848 - DNA, 20 bp, Artificial Sequence
  chemically synthesized
tctttcaatatagtccatgt

SEQ ID NO: 602849 - DNA, 20 bp, Artificial Sequence
  chemically synthesized
agccacatggactatattga

SEQ ID NO: 602850 - DNA, 20 bp, Artificial Sequence
  chemically synthesized
tatattgaaagagattagac

SEQ ID NO: 602851 - DNA, 20 bp, Artificial Sequence
  chemically synthesized
aaaatatgttatgtcctttt

SEQ ID NO: 602852 - DNA, 20 bp, Artificial Sequence
  chemically synthesized
tttttaattctagaatttct

SEQ ID NO: 602853 - DNA, 20 bp, Artificial Sequence
  chemically synthesized
gaaaaataagaattaagtgc

SEQ ID NO: 602854 - DNA, 20 bp, Artificial Sequence
  chemically synthesized
aaatagaaaattactaaatc

SEQ ID NO: 602855 - DNA, 20 bp, Artificial Sequence
  chemically synthesized
caggtatttccttctgaatc

SEQ ID NO: 602856 - DNA, 20 bp, Artificial Sequence
  chemically synthesized
ttctctatctttttgtgtct

SEQ ID NO: 602857 - DNA, 20 bp, Artificial Sequence
  chemically synthesized
tctgggatgcatatatatta

SEQ ID NO: 602858 - DNA, 20 bp, Artificial Sequence
  chemically synthesized
ttagccattatctgtttaaa

SEQ ID NO: 602859 - DNA, 20 bp, Artificial Sequence
  chemically synthesized
tagaaacattattagccatt

SEQ ID NO: 602860 - DNA, 20 bp, Artificial Sequence
  chemically synthesized
tttaaacagataatggctaa

SEQ ID NO: 602861 - DNA, 20 bp, Artificial Sequence
  chemically synthesized
atataaaccaggactttgca

SEQ ID NO: 602862 - DNA, 20 bp, Artificial Sequence
  chemically synthesized
atgaaatcacactgcaaagt

SEQ ID NO: 602863 - DNA, 20 bp, Artificial Sequence
  chemically synthesized
atatcccagcaattaaaata

SEQ ID NO: 602864 - DNA, 20 bp, Artificial Sequence
  chemically synthesized
atccattgccaacacactct

SEQ ID NO: 602865 - DNA, 20 bp, Artificial Sequence
  chemically synthesized
gaaatggataatttttttca

SEQ ID NO: 602866 - DNA, 20 bp, Artificial Sequence
  chemically synthesized
tgggaactcataaaaatgtt

SEQ ID NO: 602867 - DNA, 20 bp, Artificial Sequence
  chemically synthesized
attatatttaatctgagcac

SEQ ID NO: 602868 - DNA, 20 bp, Artificial Sequence
  chemically synthesized
ttaataagaaatcagaagtg

SEQ ID NO: 602869 - DNA, 20 bp, Artificial Sequence
  chemically synthesized
agatatttgtagtacttaaa

SEQ ID NO: 602870 - DNA, 20 bp, Artificial Sequence
  chemically synthesized
atattatttatgtaaattaa

SEQ ID NO: 602871 - DNA, 20 bp, Artificial Sequence
  chemically synthesized
tgttttaatttacataaata

SEQ ID NO: 602872 - DNA, 20 bp, Artificial Sequence
  chemically synthesized
tacatgagtaagttctttag

SEQ ID NO: 602873 - DNA, 20 bp, Artificial Sequence
  chemically synthesized
aagttctttagtggtgattt

SEQ ID NO: 602874 - DNA, 20 bp, Artificial Sequence
  chemically synthesized
tacaaatagggtacagtgta

SEQ ID NO: 602875 - DNA, 20 bp, Artificial Sequence
  chemically synthesized
ttctaatgcctgtgtgtcct

SEQ ID NO: 602876 - DNA, 20 bp, Artificial Sequence
  chemically synthesized
cacatatcagtgagaacata

SEQ ID NO: 602877 - DNA, 20 bp, Artificial Sequence
  chemically synthesized
atcagtgagaacatacaatg

SEQ ID NO: 602878 - DNA, 20 bp, Artificial Sequence
  chemically synthesized
cagcatttgcagtgacctga

SEQ ID NO: 602879 - DNA, 20 bp, Artificial Sequence
  chemically synthesized
acacacacacacacactcac

SEQ ID NO: 602880 - DNA, 20 bp, Artificial Sequence
  chemically synthesized
cactcattcagtgatgggca

SEQ ID NO: 602881 - DNA, 20 bp, Artificial Sequence
  chemically synthesized
gatgggcatttggattggtt

SEQ ID NO: 602882 - DNA, 20 bp, Artificial Sequence
  chemically synthesized
caaaaaagatacttgcacat

SEQ ID NO: 602883 - DNA, 20 bp, Artificial Sequence
  chemically synthesized
ctctgggtagatacccagta

SEQ ID NO: 602884 - DNA, 20 bp, Artificial Sequence
  chemically synthesized
agccactatggaaaagagtg

SEQ ID NO: 602885 - DNA, 20 bp, Artificial Sequence
  chemically synthesized
ctcttttccatagtggctgt

SEQ ID NO: 602886 - DNA, 20 bp, Artificial Sequence
  chemically synthesized
taacacttctacactgctga

SEQ ID NO: 602887 - DNA, 20 bp, Artificial Sequence
  chemically synthesized
tcaaaaaaattttaaaaagt

SEQ ID NO: 602888 - DNA, 20 bp, Artificial Sequence
  chemically synthesized
acatgtactttttaaaattt

SEQ ID NO: 602889 - DNA, 20 bp, Artificial Sequence
  chemically synthesized
agagtaaggtggtatcacat

SEQ ID NO: 602890 - DNA, 20 bp, Artificial Sequence
  chemically synthesized
aaggtggtatcacatggtgg

SEQ ID NO: 602891 - DNA, 20 bp, Artificial Sequence
  chemically synthesized
cataatgttagcattttttc

SEQ ID NO: 602892 - DNA, 20 bp, Artificial Sequence
  chemically synthesized
tgtccttagcccactttttg

SEQ ID NO: 602893 - DNA, 20 bp, Artificial Sequence
  chemically synthesized
tgatgggattgtatttttct

SEQ ID NO: 602894 - DNA, 20 bp, Artificial Sequence
  chemically synthesized
attgtatttttcttactgat

SEQ ID NO: 602895 - DNA, 20 bp, Artificial Sequence
  chemically synthesized
tcttactgatttgagtttgt

SEQ ID NO: 602896 - DNA, 20 bp, Artificial Sequence
  chemically synthesized
tattagtcctttgtcagatg

SEQ ID NO: 602897 - DNA, 20 bp, Artificial Sequence
  chemically synthesized
tttgtcagatgtatagattg

SEQ ID NO: 602898 - DNA, 20 bp, Artificial Sequence
  chemically synthesized
tttatcccactccatgggtt

SEQ ID NO: 602899 - DNA, 20 bp, Artificial Sequence
  chemically synthesized
catgggttgcctgtttgctg

SEQ ID NO: 602900 - DNA, 20 bp, Artificial Sequence
  chemically synthesized
gattgttccttttgctgtgc

SEQ ID NO: 602901 - DNA, 20 bp, Artificial Sequence
  chemically synthesized
ctggtacctaatttaaatta

SEQ ID NO: 602902 - DNA, 20 bp, Artificial Sequence
  chemically synthesized
attaggtaccagctatttat

SEQ ID NO: 602903 - DNA, 20 bp, Artificial Sequence
  chemically synthesized
tttatctttgtttttattac

SEQ ID NO: 602904 - DNA, 20 bp, Artificial Sequence
  chemically synthesized
tttctagacattggcttagg

SEQ ID NO: 602905 - DNA, 20 bp, Artificial Sequence
  chemically synthesized
cttgcctaagccaatgtcta

SEQ ID NO: 602906 - DNA, 20 bp, Artificial Sequence
  chemically synthesized
ttggaaaaaactttctagac

SEQ ID NO: 602907 - DNA, 20 bp, Artificial Sequence
  chemically synthesized
atgttatcttctagaatttt

SEQ ID NO: 602908 - DNA, 20 bp, Artificial Sequence
  chemically synthesized
aatttttatagtttcaggtc

SEQ ID NO: 602909 - DNA, 20 bp, Artificial Sequence
  chemically synthesized
aagtctttaaaccatcttta

SEQ ID NO: 602910 - DNA, 20 bp, Artificial Sequence
  chemically synthesized
ttatacaaaaaccaactaaa

SEQ ID NO: 602911 - DNA, 20 bp, Artificial Sequence
  chemically synthesized
aagggtgtcctttctttact

SEQ ID NO: 602912 - DNA, 20 bp, Artificial Sequence
  chemically synthesized
gtcctttctttactgtatgt

SEQ ID NO: 602913 - DNA, 20 bp, Artificial Sequence
  chemically synthesized
tttctttactgtatgttttt

SEQ ID NO: 602914 - DNA, 20 bp, Artificial Sequence
  chemically synthesized
ttttgtttgctttgttgaag

SEQ ID NO: 602915 - DNA, 20 bp, Artificial Sequence
  chemically synthesized
agatcagtttgtgtaagtat

SEQ ID NO: 602916 - DNA, 20 bp, Artificial Sequence
  chemically synthesized
ctatatttataccagtacca

SEQ ID NO: 602917 - DNA, 20 bp, Artificial Sequence
  chemically synthesized
tggtgactatggccttatag

SEQ ID NO: 602918 - DNA, 20 bp, Artificial Sequence
  chemically synthesized
aaatctggaggcatcacact

SEQ ID NO: 602919 - DNA, 20 bp, Artificial Sequence
  chemically synthesized
aaatcaggtagtgtgatgcc

SEQ ID NO: 602920 - DNA, 20 bp, Artificial Sequence
  chemically synthesized
gatgcctccagatttgttct

SEQ ID NO: 602921 - DNA, 20 bp, Artificial Sequence
  chemically synthesized
gatttgttctttttgcttag

SEQ ID NO: 602922 - DNA, 20 bp, Artificial Sequence
  chemically synthesized
gaatgatgctgttattttga

SEQ ID NO: 602923 - DNA, 20 bp, Artificial Sequence
  chemically synthesized
gatggggattgcactgaatt

SEQ ID NO: 602924 - DNA, 20 bp, Artificial Sequence
  chemically synthesized
cagtatggtcattttcacaa

SEQ ID NO: 602925 - DNA, 20 bp, Artificial Sequence
  chemically synthesized
tacccatccacgactatggg

SEQ ID NO: 602926 - DNA, 20 bp, Artificial Sequence
  chemically synthesized
cgactatgggatgtgttttc

SEQ ID NO: 602927 - DNA, 20 bp, Artificial Sequence
  chemically synthesized
ttttcatttgtttgtgtcat

SEQ ID NO: 602928 - DNA, 20 bp, Artificial Sequence
  chemically synthesized
tcatctatgatttctttcag

SEQ ID NO: 602929 - DNA, 20 bp, Artificial Sequence
  chemically synthesized
gatttctttcagcagtgttt

SEQ ID NO: 602930 - DNA, 20 bp, Artificial Sequence
  chemically synthesized
ctccttggttaggtatattc

SEQ ID NO: 602931 - DNA, 20 bp, Artificial Sequence
  chemically synthesized
taaaaggggttgagttctta

SEQ ID NO: 602932 - DNA, 20 bp, Artificial Sequence
  chemically synthesized
gttgagttcttaatttgatt

SEQ ID NO: 602933 - DNA, 20 bp, Artificial Sequence
  chemically synthesized
ttgttggtatacagaagagc

SEQ ID NO: 602934 - DNA, 20 bp, Artificial Sequence
  chemically synthesized
attcagcaacatttccagat

SEQ ID NO: 602935 - DNA, 20 bp, Artificial Sequence
  chemically synthesized
aaaccctaaggattcctcca

SEQ ID NO: 602936 - DNA, 20 bp, Artificial Sequence
  chemically synthesized
aaactttctggaggaatcct

SEQ ID NO: 602937 - DNA, 20 bp, Artificial Sequence
  chemically synthesized
atcatttaccttcaaaaccc

SEQ ID NO: 602938 - DNA, 20 bp, Artificial Sequence
  chemically synthesized
tcatatagtcggcaaacact

SEQ ID NO: 602939 - DNA, 20 bp, Artificial Sequence
  chemically synthesized
taaagaggaagtcaaactgt

SEQ ID NO: 602940 - DNA, 20 bp, Artificial Sequence
  chemically synthesized
tgacagtttgacttcctctt

SEQ ID NO: 602941 - DNA, 20 bp, Artificial Sequence
  chemically synthesized
tatgcatttatttgaattct

SEQ ID NO: 602942 - DNA, 20 bp, Artificial Sequence
  chemically synthesized
tttataaggtcccttttgga

SEQ ID NO: 602943 - DNA, 20 bp, Artificial Sequence
  chemically synthesized
ctgctatttataaggtccct

SEQ ID NO: 602944 - DNA, 20 bp, Artificial Sequence
  chemically synthesized
gtatttagttacaatgaagc

SEQ ID NO: 602945 - DNA, 20 bp, Artificial Sequence
  chemically synthesized
atgacatctcagacacaatc

SEQ ID NO: 602946 - DNA, 20 bp, Artificial Sequence
  chemically synthesized
ggcggtatgttggatgaatc

SEQ ID NO: 602947 - DNA, 20 bp, Artificial Sequence
  chemically synthesized
taaaccaaattttatgaagc

SEQ ID NO: 602948 - DNA, 20 bp, Artificial Sequence
  chemically synthesized
gaatcataagcttcataaaa

SEQ ID NO: 602949 - DNA, 20 bp, Artificial Sequence
  chemically synthesized
ttcaattaaaccaaatttta

SEQ ID NO: 602950 - DNA, 20 bp, Artificial Sequence
  chemically synthesized
ctttaacttctttctggtct

SEQ ID NO: 602951 - DNA, 20 bp, Artificial Sequence
  chemically synthesized
taattcagagactgaagtgt

SEQ ID NO: 602952 - DNA, 20 bp, Artificial Sequence
  chemically synthesized
gatcaataattcagagactg

SEQ ID NO: 602953 - DNA, 20 bp, Artificial Sequence
  chemically synthesized
accaatatgaagtgattcct

SEQ ID NO: 602954 - DNA, 20 bp, Artificial Sequence
  chemically synthesized
aattatagtttaccaatatg

SEQ ID NO: 602955 - DNA, 20 bp, Artificial Sequence
  chemically synthesized
taaaatatgcatgttttaat

SEQ ID NO: 602956 - DNA, 20 bp, Artificial Sequence
  chemically synthesized
gcaaggaggaattaaaatat

SEQ ID NO: 602957 - DNA, 20 bp, Artificial Sequence
  chemically synthesized
ccttgcattccaaccctcat

SEQ ID NO: 602958 - DNA, 20 bp, Artificial Sequence
  chemically synthesized
agattagattttttgaaatg

SEQ ID NO: 602959 - DNA, 20 bp, Artificial Sequence
  chemically synthesized
tacaaaagaatttccaagag

SEQ ID NO: 602960 - DNA, 20 bp, Artificial Sequence
  chemically synthesized
aaagctacaaaagaatttcc

SEQ ID NO: 602961 - DNA, 20 bp, Artificial Sequence
  chemically synthesized
taatctcttggaaattcttt

SEQ ID NO: 602962 - DNA, 20 bp, Artificial Sequence
  chemically synthesized
agctttaagaaataaacttc

SEQ ID NO: 602963 - DNA, 20 bp, Artificial Sequence
  chemically synthesized
taagaaataaacttccaaag

SEQ ID NO: 602964 - DNA, 20 bp, Artificial Sequence
  chemically synthesized
aagttcccaaaccaatcttt

SEQ ID NO: 602965 - DNA, 20 bp, Artificial Sequence
  chemically synthesized
ttgggaacttgtccatctaa

SEQ ID NO: 602966 - DNA, 20 bp, Artificial Sequence
  chemically synthesized
agtaggtgtgtatttttttt

SEQ ID NO: 602967 - DNA, 20 bp, Artificial Sequence
  chemically synthesized
ataaatatcacaatttcttt

SEQ ID NO: 602968 - DNA, 20 bp, Artificial Sequence
  chemically synthesized
aattgctatcaaggttcagg

SEQ ID NO: 602969 - DNA, 20 bp, Artificial Sequence
  chemically synthesized
cactggcattccctggcctg

SEQ ID NO: 602970 - DNA, 20 bp, Artificial Sequence
  chemically synthesized
atgccagtgaagaattctaa

SEQ ID NO: 602971 - DNA, 20 bp, Artificial Sequence
  chemically synthesized
ttttctttcttcttatctga

SEQ ID NO: 602972 - DNA, 20 bp, Artificial Sequence
  chemically synthesized
ctgtgtttgcccttgggtac

SEQ ID NO: 602973 - DNA, 20 bp, Artificial Sequence
  chemically synthesized
agtaggtggggcagctcata

SEQ ID NO: 602974 - DNA, 20 bp, Artificial Sequence
  chemically synthesized
tctacataaaaggaaaaaaa

SEQ ID NO: 602975 - DNA, 20 bp, Artificial Sequence
  chemically synthesized
tttttccttttatgtagaaa

SEQ ID NO: 602976 - DNA, 20 bp, Artificial Sequence
  chemically synthesized
agagattaataatccaacag

SEQ ID NO: 602977 - DNA, 20 bp, Artificial Sequence
  chemically synthesized
cagtaaagataaacttatct

SEQ ID NO: 602978 - DNA, 20 bp, Artificial Sequence
  chemically synthesized
atggtaggttattagattgg

SEQ ID NO: 602979 - DNA, 20 bp, Artificial Sequence
  chemically synthesized
gtcttttaagatggtaggtt

SEQ ID NO: 602980 - DNA, 20 bp, Artificial Sequence
  chemically synthesized
gactcaggaaaaatatggcc

SEQ ID NO: 602981 - DNA, 20 bp, Artificial Sequence
  chemically synthesized
aaaaatatggcctgaagatt

SEQ ID NO: 602982 - DNA, 20 bp, Artificial Sequence
  chemically synthesized
gatttaacgtttagccaata

SEQ ID NO: 602983 - DNA, 20 bp, Artificial Sequence
  chemically synthesized
tctaaagaaagtattcctat

SEQ ID NO: 602984 - DNA, 20 bp, Artificial Sequence
  chemically synthesized
tttaaaaatgcagatatctt

SEQ ID NO: 602985 - DNA, 20 bp, Artificial Sequence
  chemically synthesized
aacaaaatgaaaatcaatat

SEQ ID NO: 602986 - DNA, 20 bp, Artificial Sequence
  chemically synthesized
tccaagcttgcaatcactta

SEQ ID NO: 602987 - DNA, 20 bp, Artificial Sequence
  chemically synthesized
gaaaatcaatataagtgatt

SEQ ID NO: 602988 - DNA, 20 bp, Artificial Sequence
  chemically synthesized
ataatttacagcacgtgctt

SEQ ID NO: 602989 - DNA, 20 bp, Artificial Sequence
  chemically synthesized
ttttcccaataatttacagc

SEQ ID NO: 602990 - DNA, 20 bp, Artificial Sequence
  chemically synthesized
taagggctcctatcctgcac

SEQ ID NO: 602991 - DNA, 20 bp, Artificial Sequence
  chemically synthesized
cctttactataattttagat

SEQ ID NO: 602992 - DNA, 20 bp, Artificial Sequence
  chemically synthesized
atagtaaaggaatacaaaaa

SEQ ID NO: 602993 - DNA, 20 bp, Artificial Sequence
  chemically synthesized
aaaaagaagttttctgcacc

SEQ ID NO: 602994 - DNA, 20 bp, Artificial Sequence
  chemically synthesized
ttctgcaccttttgtttaaa

SEQ ID NO: 602995 - DNA, 20 bp, Artificial Sequence
  chemically synthesized
tcttttaagagttaaagaca

SEQ ID NO: 602996 - DNA, 20 bp, Artificial Sequence
  chemically synthesized
gacagaccaagagaggcaaa

SEQ ID NO: 602997 - DNA, 20 bp, Artificial Sequence
  chemically synthesized
cttttgttatcacaaaagaa

SEQ ID NO: 602998 - DNA, 20 bp, Artificial Sequence
  chemically synthesized
ttactttgctttccagttaa

SEQ ID NO: 602999 - DNA, 20 bp, Artificial Sequence
  chemically synthesized
tcaatatacttctctgttta

SEQ ID NO: 603000 - DNA, 20 bp, Artificial Sequence
  chemically synthesized
tcagaattttcaatatactt

SEQ ID NO: 603001 - DNA, 20 bp, Artificial Sequence
  chemically synthesized
ttcagtaaagtgttatatat

SEQ ID NO: 603002 - DNA, 20 bp, Artificial Sequence
  chemically synthesized
gtagttctatttttcaagag

SEQ ID NO: 603003 - DNA, 20 bp, Artificial Sequence
  chemically synthesized
tctctctattgtacattctc

SEQ ID NO: 603004 - DNA, 20 bp, Artificial Sequence
  chemically synthesized
actcaaactggccacgtttc

SEQ ID NO: 603005 - DNA, 20 bp, Artificial Sequence
  chemically synthesized
cgttaagcacttgaaacgtg

SEQ ID NO: 603006 - DNA, 20 bp, Artificial Sequence
  chemically synthesized
aacatctcaactcaaactgg

SEQ ID NO: 603007 - DNA, 20 bp, Artificial Sequence
  chemically synthesized
aacgtggccagtttgagttg

SEQ ID NO: 603008 - DNA, 20 bp, Artificial Sequence
  chemically synthesized
ttaaaattttaaaatgtgga

SEQ ID NO: 603009 - DNA, 20 bp, Artificial Sequence
  chemically synthesized
aggtaaaagtcatttgaaaa

SEQ ID NO: 603010 - DNA, 20 bp, Artificial Sequence
  chemically synthesized
tttacctgttgatctgttaa

SEQ ID NO: 603011 - DNA, 20 bp, Artificial Sequence
  chemically synthesized
cacattatttttctgttgga

SEQ ID NO: 603012 - DNA, 20 bp, Artificial Sequence
  chemically synthesized
tggattacatgggtgccttt

SEQ ID NO: 603013 - DNA, 20 bp, Artificial Sequence
  chemically synthesized
atcatctctttctcccccta

SEQ ID NO: 603014 - DNA, 20 bp, Artificial Sequence
  chemically synthesized
catattcacaacaggacttc

SEQ ID NO: 603015 - DNA, 20 bp, Artificial Sequence
  chemically synthesized
taatggggaattcaaattgg

SEQ ID NO: 603016 - DNA, 20 bp, Artificial Sequence
  chemically synthesized
aagtaggtatatgtcattag

SEQ ID NO: 603017 - DNA, 20 bp, Artificial Sequence
  chemically synthesized
gattgcattatctccttgac

SEQ ID NO: 603018 - DNA, 20 bp, Artificial Sequence
  chemically synthesized
ttaataaagtttggagcctt

SEQ ID NO: 603019 - DNA, 20 bp, Artificial Sequence
  chemically synthesized
tcatggtctatgttatttaa

SEQ ID NO: 603020 - DNA, 20 bp, Artificial Sequence
  chemically synthesized
tcagtgttcacattttagag

SEQ ID NO: 603021 - DNA, 20 bp, Artificial Sequence
  chemically synthesized
caggacccatgcatgatata

SEQ ID NO: 603022 - DNA, 20 bp, Artificial Sequence
  chemically synthesized
atttctaatgtcaatatata

SEQ ID NO: 603023 - DNA, 20 bp, Artificial Sequence
  chemically synthesized
gtcaatatataagttgtttc

SEQ ID NO: 603024 - DNA, 20 bp, Artificial Sequence
  chemically synthesized
agtttgaaatacaaggatct

SEQ ID NO: 603025 - DNA, 20 bp, Artificial Sequence
  chemically synthesized
gataggaaattgggctaaaa

SEQ ID NO: 603026 - DNA, 20 bp, Artificial Sequence
  chemically synthesized
attttgactggaggatagaa

SEQ ID NO: 603027 - DNA, 20 bp, Artificial Sequence
  chemically synthesized
cttttaattacttcacgcct

SEQ ID NO: 603028 - DNA, 20 bp, Artificial Sequence
  chemically synthesized
gtctgacatgagtgaaatag

SEQ ID NO: 603029 - DNA, 20 bp, Artificial Sequence
  chemically synthesized
ttatctaagatcaccataga

SEQ ID NO: 603030 - DNA, 20 bp, Artificial Sequence
  chemically synthesized
cccaatttcagttggttcat

SEQ ID NO: 603031 - DNA, 20 bp, Artificial Sequence
  chemically synthesized
ctattattcacctcctggac

SEQ ID NO: 603032 - DNA, 20 bp, Artificial Sequence
  chemically synthesized
aataaatatttctgtagtgt

SEQ ID NO: 603033 - DNA, 20 bp, Artificial Sequence
  chemically synthesized
agaaatatttattagaattt

SEQ ID NO: 603034 - DNA, 20 bp, Artificial Sequence
  chemically synthesized
taggattgctaagtggatag

SEQ ID NO: 603035 - DNA, 20 bp, Artificial Sequence
  chemically synthesized
tttaacatgatattttgaaa

SEQ ID NO: 603036 - DNA, 20 bp, Artificial Sequence
  chemically synthesized
tatttgttagttaaatatga

SEQ ID NO: 603037 - DNA, 20 bp, Artificial Sequence
  chemically synthesized
tgtatttatggggtatcatg

SEQ ID NO: 603038 - DNA, 20 bp, Artificial Sequence
  chemically synthesized
caaaaaaagataagttggtg

SEQ ID NO: 603039 - DNA, 20 bp, Artificial Sequence
  chemically synthesized
tgtttcaaaattggtaaaag

SEQ ID NO: 603040 - DNA, 20 bp, Artificial Sequence
  chemically synthesized
ttcttttaccaattttgaaa

SEQ ID NO: 603041 - DNA, 20 bp, Artificial Sequence
  chemically synthesized
tggacacagttaataaaaat

SEQ ID NO: 603042 - DNA, 20 bp, Artificial Sequence
  chemically synthesized
aaggtgttgatcaaatgata

SEQ ID NO: 603043 - DNA, 20 bp, Artificial Sequence
  chemically synthesized
ctggtaactacctttctatt

SEQ ID NO: 603044 - DNA, 20 bp, Artificial Sequence
  chemically synthesized
tttctataatttgacttttt

SEQ ID NO: 603045 - DNA, 20 bp, Artificial Sequence
  chemically synthesized
tgcatagtggtagatatata

SEQ ID NO: 603046 - DNA, 20 bp, Artificial Sequence
  chemically synthesized
cgtcctgtaatagacattta

SEQ ID NO: 603047 - DNA, 20 bp, Artificial Sequence
  chemically synthesized
atgcaatctaatttgtctat

SEQ ID NO: 603048 - DNA, 20 bp, Artificial Sequence
  chemically synthesized
acaaaagcaaaaatagacaa

SEQ ID NO: 603049 - DNA, 20 bp, Artificial Sequence
  chemically synthesized
cctttcctgtgcaggagctt

SEQ ID NO: 603050 - DNA, 20 bp, Artificial Sequence
  chemically synthesized
aatagtttcctttcctgtgc

SEQ ID NO: 603051 - DNA, 20 bp, Artificial Sequence
  chemically synthesized
agctgcctcttcactctgtt

SEQ ID NO: 603052 - DNA, 20 bp, Artificial Sequence
  chemically synthesized
tattaactccttaccagata

SEQ ID NO: 603053 - DNA, 20 bp, Artificial Sequence
  chemically synthesized
tttcttgctgttgagttttt

SEQ ID NO: 603054 - DNA, 20 bp, Artificial Sequence
  chemically synthesized
ggttatttgttttcttgctg

SEQ ID NO: 603055 - DNA, 20 bp, Artificial Sequence
  chemically synthesized
caacagcaagaaaacaaata

SEQ ID NO: 603056 - DNA, 20 bp, Artificial Sequence
  chemically synthesized
gcccatttttaaatcaggtt

SEQ ID NO: 603057 - DNA, 20 bp, Artificial Sequence
  chemically synthesized
ttgtggttttcacatttttc

SEQ ID NO: 603058 - DNA, 20 bp, Artificial Sequence
  chemically synthesized
tgtgtaaggtgacacatcat

SEQ ID NO: 603059 - DNA, 20 bp, Artificial Sequence
  chemically synthesized
tacatacacagtatgtgtct

SEQ ID NO: 603060 - DNA, 20 bp, Artificial Sequence
  chemically synthesized
agcgtgtgtatatatatatg

SEQ ID NO: 603061 - DNA, 20 bp, Artificial Sequence
  chemically synthesized
tagctttaacttggcattta

SEQ ID NO: 603062 - DNA, 20 bp, Artificial Sequence
  chemically synthesized
ttggcatttagcgagttttc

SEQ ID NO: 603063 - DNA, 20 bp, Artificial Sequence
  chemically synthesized
cttttatctcacaataagca

SEQ ID NO: 603064 - DNA, 20 bp, Artificial Sequence
  chemically synthesized
tatctcacaataagcacata

SEQ ID NO: 603065 - DNA, 20 bp, Artificial Sequence
  chemically synthesized
catgtttatttaagcaagct

SEQ ID NO: 603066 - DNA, 20 bp, Artificial Sequence
  chemically synthesized
tgcttaaataaacatgtctg

SEQ ID NO: 603067 - DNA, 20 bp, Artificial Sequence
  chemically synthesized
atcaagagcaagcatagcag

SEQ ID NO: 603068 - DNA, 20 bp, Artificial Sequence
  chemically synthesized
ttttaaaaggaacatttaca

SEQ ID NO: 603069 - DNA, 20 bp, Artificial Sequence
  chemically synthesized
gaacatttacaaacagttta

SEQ ID NO: 603070 - DNA, 20 bp, Artificial Sequence
  chemically synthesized
ttcactccagaaactaggta

SEQ ID NO: 603071 - DNA, 20 bp, Artificial Sequence
  chemically synthesized
ctggagtgaaggagcaatgc

SEQ ID NO: 603072 - DNA, 20 bp, Artificial Sequence
  chemically synthesized
tttaatacatctaggcaaag

SEQ ID NO: 603073 - DNA, 20 bp, Artificial Sequence
  chemically synthesized
aagagttacctcacatcaaa

SEQ ID NO: 603074 - DNA, 20 bp, Artificial Sequence
  chemically synthesized
gctgagactgggaattaaaa

SEQ ID NO: 603075 - DNA, 20 bp, Artificial Sequence
  chemically synthesized
ggaggggtagagactaacca

SEQ ID NO: 603076 - DNA, 20 bp, Artificial Sequence
  chemically synthesized
catcacctcttcaagggttg

SEQ ID NO: 603077 - DNA, 20 bp, Artificial Sequence
  chemically synthesized
tttctttatcttatcacaac

SEQ ID NO: 603078 - DNA, 20 bp, Artificial Sequence
  chemically synthesized
gctattctttccacaagtct

SEQ ID NO: 603079 - DNA, 20 bp, Artificial Sequence
  chemically synthesized
cttcacataccagctagagg

SEQ ID NO: 603080 - DNA, 20 bp, Artificial Sequence
  chemically synthesized
tatagaacttctataacagg

SEQ ID NO: 603081 - DNA, 20 bp, Artificial Sequence
  chemically synthesized
gctcttatagaacttctata

SEQ ID NO: 603082 - DNA, 20 bp, Artificial Sequence
  chemically synthesized
ctcatcttgtcctaatcttt

SEQ ID NO: 603083 - DNA, 20 bp, Artificial Sequence
  chemically synthesized
ctggaatgtaacaaatcaat

SEQ ID NO: 603084 - DNA, 20 bp, Artificial Sequence
  chemically synthesized
aattgccaaaggtgaagaat

SEQ ID NO: 603085 - DNA, 20 bp, Artificial Sequence
  chemically synthesized
cattcttcacctttggcaat

SEQ ID NO: 603086 - DNA, 20 bp, Artificial Sequence
  chemically synthesized
agctggcacctgcacattct

SEQ ID NO: 603087 - DNA, 20 bp, Artificial Sequence
  chemically synthesized
taacatcatctccccagaat

SEQ ID NO: 603088 - DNA, 20 bp, Artificial Sequence
  chemically synthesized
aattactttggcgtctgaaa

SEQ ID NO: 603089 - DNA, 20 bp, Artificial Sequence
  chemically synthesized
attgaatatctgaatattat

SEQ ID NO: 603090 - DNA, 20 bp, Artificial Sequence
  chemically synthesized
tcaagagcaatatgtcttca

SEQ ID NO: 603091 - DNA, 20 bp, Artificial Sequence
  chemically synthesized
gctccatgaagacatattgc

SEQ ID NO: 603092 - DNA, 20 bp, Artificial Sequence
  chemically synthesized
tcttctgttctacaccatta

SEQ ID NO: 603093 - DNA, 20 bp, Artificial Sequence
  chemically synthesized
attctcttctgttctacacc

SEQ ID NO: 603094 - DNA, 20 bp, Artificial Sequence
  chemically synthesized
ttgactgttctaaagtttca

SEQ ID NO: 603095 - DNA, 20 bp, Artificial Sequence
  chemically synthesized
agccagtgttttgactgttc

SEQ ID NO: 603096 - DNA, 20 bp, Artificial Sequence
  chemically synthesized
aactttagaacagtcaaaac

SEQ ID NO: 603097 - DNA, 20 bp, Artificial Sequence
  chemically synthesized
attattagttatgacaaagc

SEQ ID NO: 603098 - DNA, 20 bp, Artificial Sequence
  chemically synthesized
tagggattttattggtttgg

SEQ ID NO: 603099 - DNA, 20 bp, Artificial Sequence
  chemically synthesized
attattagggattttattgg

SEQ ID NO: 603100 - DNA, 20 bp, Artificial Sequence
  chemically synthesized
aaataattattagggatttt

SEQ ID NO: 603101 - DNA, 20 bp, Artificial Sequence
  chemically synthesized
aatcatgttaaaataattat

SEQ ID NO: 603102 - DNA, 20 bp, Artificial Sequence
  chemically synthesized
aatccctaataattatttta

SEQ ID NO: 603103 - DNA, 20 bp, Artificial Sequence
  chemically synthesized
aaaaagattggtcatataat

SEQ ID NO: 603104 - DNA, 20 bp, Artificial Sequence
  chemically synthesized
tttcttaatgtaaagaagga

SEQ ID NO: 603105 - DNA, 20 bp, Artificial Sequence
  chemically synthesized
tccttctttacattaagaaa

SEQ ID NO: 603106 - DNA, 20 bp, Artificial Sequence
  chemically synthesized
gcatctagtctgttgtagat

SEQ ID NO: 603107 - DNA, 20 bp, Artificial Sequence
  chemically synthesized
tatctacaacagactagatg

SEQ ID NO: 603108 - DNA, 20 bp, Artificial Sequence
  chemically synthesized
atattcatctagcatataac

SEQ ID NO: 603109 - DNA, 20 bp, Artificial Sequence
  chemically synthesized
ctagcatataacatgagttt

SEQ ID NO: 603110 - DNA, 20 bp, Artificial Sequence
  chemically synthesized
ctgggaggatgagggggtgg

SEQ ID NO: 603111 - DNA, 20 bp, Artificial Sequence
  chemically synthesized
gcaaatctgtacaggcagaa

SEQ ID NO: 603112 - DNA, 20 bp, Artificial Sequence
  chemically synthesized
actaatcttatttctgcctg

SEQ ID NO: 603113 - DNA, 20 bp, Artificial Sequence
  chemically synthesized
ataacatatgatcttttgtg

SEQ ID NO: 603114 - DNA, 20 bp, Artificial Sequence
  chemically synthesized
agtcatcactggatggacat

SEQ ID NO: 603115 - DNA, 20 bp, Artificial Sequence
  chemically synthesized
gatggacatgtgggtttctt

SEQ ID NO: 603116 - DNA, 20 bp, Artificial Sequence
  chemically synthesized
gttcttacagcatcccatat

SEQ ID NO: 603117 - DNA, 20 bp, Artificial Sequence
  chemically synthesized
cttttagttattcaaacccc

SEQ ID NO: 603118 - DNA, 20 bp, Artificial Sequence
  chemically synthesized
ctatatcacaagtaagctaa

SEQ ID NO: 603119 - DNA, 20 bp, Artificial Sequence
  chemically synthesized
gttgtaataacaaatactca

SEQ ID NO: 603120 - DNA, 20 bp, Artificial Sequence
  chemically synthesized
ttagttatgcatagagtaaa

SEQ ID NO: 603121 - DNA, 20 bp, Artificial Sequence
  chemically synthesized
ctgatagtatattttaaaag

SEQ ID NO: 603122 - DNA, 20 bp, Artificial Sequence
  chemically synthesized
cttgctttttcacacaaaaa

SEQ ID NO: 603123 - DNA, 20 bp, Artificial Sequence
  chemically synthesized
ccaggtttttgtgtgaaaaa

SEQ ID NO: 603124 - DNA, 20 bp, Artificial Sequence
  chemically synthesized
tttcctctttacttttttaa

SEQ ID NO: 603125 - DNA, 20 bp, Artificial Sequence
  chemically synthesized
actgtggaggaatacaagaa

SEQ ID NO: 603126 - DNA, 20 bp, Artificial Sequence
  chemically synthesized
agcatatgaaattacatagc

SEQ ID NO: 603127 - DNA, 20 bp, Artificial Sequence
  chemically synthesized
tcacccttttggaatgcttg

SEQ ID NO: 603128 - DNA, 20 bp, Artificial Sequence
  chemically synthesized
ttttactattcacccttttg

SEQ ID NO: 603129 - DNA, 20 bp, Artificial Sequence
  chemically synthesized
ctacagtggaagtggggaca

SEQ ID NO: 603130 - DNA, 20 bp, Artificial Sequence
  chemically synthesized
taatagcagtgaaaaagtta

SEQ ID NO: 603131 - DNA, 20 bp, Artificial Sequence
  chemically synthesized
taggaagttttataaacaat

SEQ ID NO: 603132 - DNA, 20 bp, Artificial Sequence
  chemically synthesized
atttcatacctacaaacgat

SEQ ID NO: 603133 - DNA, 20 bp, Artificial Sequence
  chemically synthesized
ttaaatttcatacctacaaa

SEQ ID NO: 603134 - DNA, 20 bp, Artificial Sequence
  chemically synthesized
agaatagcaatgtttgataa

SEQ ID NO: 603135 - DNA, 20 bp, Artificial Sequence
  chemically synthesized
tttaaagatgttcagaatag

SEQ ID NO: 603136 - DNA, 20 bp, Artificial Sequence
  chemically synthesized
tgataaaaagttgaacttta

SEQ ID NO: 603137 - DNA, 20 bp, Artificial Sequence
  chemically synthesized
taatatgattaagaggtata

SEQ ID NO: 603138 - DNA, 20 bp, Artificial Sequence
  chemically synthesized
tgggaaaatattttaaatgt

SEQ ID NO: 603139 - DNA, 20 bp, Artificial Sequence
  chemically synthesized
acatttaaaatattttccca

SEQ ID NO: 603140 - DNA, 20 bp, Artificial Sequence
  chemically synthesized
aaatagtatcagctccctct

SEQ ID NO: 603141 - DNA, 20 bp, Artificial Sequence
  chemically synthesized
gagggagctgatactattta

SEQ ID NO: 603142 - DNA, 20 bp, Artificial Sequence
  chemically synthesized
cttcagagtcgtttttgcta

SEQ ID NO: 603143 - DNA, 20 bp, Artificial Sequence
  chemically synthesized
tttttttttttgtacttcag

SEQ ID NO: 603144 - DNA, 20 bp, Artificial Sequence
  chemically synthesized
aaaaaaaaaaagtatttatc

SEQ ID NO: 603145 - DNA, 20 bp, Artificial Sequence
  chemically synthesized
acacaacgcttttctcattt

SEQ ID NO: 603146 - DNA, 20 bp, Artificial Sequence
  chemically synthesized
agaattaatgtagtgataca

SEQ ID NO: 603147 - DNA, 20 bp, Artificial Sequence
  chemically synthesized
agttggaaaatatattatcc

SEQ ID NO: 603148 - DNA, 20 bp, Artificial Sequence
  chemically synthesized
taatatattttccaactaat

SEQ ID NO: 603149 - DNA, 20 bp, Artificial Sequence
  chemically synthesized
tgagaagcacaggaacatgt

SEQ ID NO: 603150 - DNA, 20 bp, Artificial Sequence
  chemically synthesized
tagtaaacaaacacatgttc

SEQ ID NO: 603151 - DNA, 20 bp, Artificial Sequence
  chemically synthesized
gtcatgagaagcacaggaac

SEQ ID NO: 603152 - DNA, 20 bp, Artificial Sequence
  chemically synthesized
ttctcatgacaaatttggga

SEQ ID NO: 603153 - DNA, 20 bp, Artificial Sequence
  chemically synthesized
ttttatcttaatgccttcaa

SEQ ID NO: 603154 - DNA, 20 bp, Artificial Sequence
  chemically synthesized
aaaggaattattgagtaaaa

SEQ ID NO: 603155 - DNA, 20 bp, Artificial Sequence
  chemically synthesized
ttaagaaatagtaaatgggg

SEQ ID NO: 603156 - DNA, 20 bp, Artificial Sequence
  chemically synthesized
cacctttaagaaatagtaaa

SEQ ID NO: 603157 - DNA, 20 bp, Artificial Sequence
  chemically synthesized
aaaatatctctactcatcaa

SEQ ID NO: 603158 - DNA, 20 bp, Artificial Sequence
  chemically synthesized
gtttcttttgtctcttcctg

SEQ ID NO: 603159 - DNA, 20 bp, Artificial Sequence
  chemically synthesized
tgcgactagcaaatttttca

SEQ ID NO: 603160 - DNA, 20 bp, Artificial Sequence
  chemically synthesized
ttttatcatcaaaggaaaaa

SEQ ID NO: 603161 - DNA, 20 bp, Artificial Sequence
  chemically synthesized
aaagaataatttgtcctttg

SEQ ID NO: 603162 - DNA, 20 bp, Artificial Sequence
  chemically synthesized
tcaatttatctgaagagtat

SEQ ID NO: 603163 - DNA, 20 bp, Artificial Sequence
  chemically synthesized
ttttcttctatattcaaaac

SEQ ID NO: 603164 - DNA, 20 bp, Artificial Sequence
  chemically synthesized
ggattgtagatttcaaaatc

SEQ ID NO: 603165 - DNA, 20 bp, Artificial Sequence
  chemically synthesized
atagcttctccttgggggat

SEQ ID NO: 603166 - DNA, 20 bp, Artificial Sequence
  chemically synthesized
tatgggaatagcttctcctt

SEQ ID NO: 603167 - DNA, 20 bp, Artificial Sequence
  chemically synthesized
caaaacatgttttgtatggg

SEQ ID NO: 603168 - DNA, 20 bp, Artificial Sequence
  chemically synthesized
agaagctattcccatacaaa

SEQ ID NO: 603169 - DNA, 20 bp, Artificial Sequence
  chemically synthesized
ctattcccatacaaaacatg

SEQ ID NO: 603170 - DNA, 20 bp, Artificial Sequence
  chemically synthesized
ttgtgactttgagaaacaaa

SEQ ID NO: 603171 - DNA, 20 bp, Artificial Sequence
  chemically synthesized
tgaggacaaaaaaatctaca

SEQ ID NO: 603172 - DNA, 20 bp, Artificial Sequence
  chemically synthesized
ggtgtaacagataagctgtc

SEQ ID NO: 603173 - DNA, 20 bp, Artificial Sequence
  chemically synthesized
atggttccatttacagaaat

SEQ ID NO: 603174 - DNA, 20 bp, Artificial Sequence
  chemically synthesized
attgtttcatgttagtacct

SEQ ID NO: 603175 - DNA, 20 bp, Artificial Sequence
  chemically synthesized
aaaatgtcaagttagccatt

SEQ ID NO: 603176 - DNA, 20 bp, Artificial Sequence
  chemically synthesized
tggcctgcacatcagaaaag

SEQ ID NO: 603177 - DNA, 20 bp, Artificial Sequence
  chemically synthesized
catcagaaaagacttgctta

SEQ ID NO: 603178 - DNA, 20 bp, Artificial Sequence
  chemically synthesized
ttgtcctttctctttcaggg

SEQ ID NO: 603179 - DNA, 20 bp, Artificial Sequence
  chemically synthesized
caggtcttcaacctcaaatt

SEQ ID NO: 603180 - DNA, 20 bp, Artificial Sequence
  chemically synthesized
tagagtatggaaagtaagta

SEQ ID NO: 603181 - DNA, 20 bp, Artificial Sequence
  chemically synthesized
aggtattaaaaagcagtaag

SEQ ID NO: 603182 - DNA, 20 bp, Artificial Sequence
  chemically synthesized
ttaaaaagcagtaaggcaag

SEQ ID NO: 603183 - DNA, 20 bp, Artificial Sequence
  chemically synthesized
gtattaagctaaacttgcct

SEQ ID NO: 603184 - DNA, 20 bp, Artificial Sequence
  chemically synthesized
aggcttgtctatactgtcat

SEQ ID NO: 603185 - DNA, 20 bp, Artificial Sequence
  chemically synthesized
ttaaatgtatggctggtgat

SEQ ID NO: 603186 - DNA, 20 bp, Artificial Sequence
  chemically synthesized
cacctatatttgatttatgg

SEQ ID NO: 603187 - DNA, 20 bp, Artificial Sequence
  chemically synthesized
cctttccataaatcaaatat

SEQ ID NO: 603188 - DNA, 20 bp, Artificial Sequence
  chemically synthesized
gggtgcagccaaacacctat

SEQ ID NO: 603189 - DNA, 20 bp, Artificial Sequence
  chemically synthesized
ccctcttatatcaaaatgat

SEQ ID NO: 603190 - DNA, 20 bp, Artificial Sequence
  chemically synthesized
cttatatcaaaatgatgtgc

SEQ ID NO: 603191 - DNA, 20 bp, Artificial Sequence
  chemically synthesized
gagaaaatattgttcattga

SEQ ID NO: 603192 - DNA, 20 bp, Artificial Sequence
  chemically synthesized
aatatattttgatacaatta

SEQ ID NO: 603193 - DNA, 20 bp, Artificial Sequence
  chemically synthesized
atacatatgtataagtatta

SEQ ID NO: 603194 - DNA, 20 bp, Artificial Sequence
  chemically synthesized
aaaaatatatctataatctt

SEQ ID NO: 603195 - DNA, 20 bp, Artificial Sequence
  chemically synthesized
aatgagaccatacaaaacat

SEQ ID NO: 603196 - DNA, 20 bp, Artificial Sequence
  chemically synthesized
ctcctgaccaaacaggcaac

SEQ ID NO: 603197 - DNA, 20 bp, Artificial Sequence
  chemically synthesized
aaaaaaaaaaagcagtggtt

SEQ ID NO: 603198 - DNA, 20 bp, Artificial Sequence
  chemically synthesized
aaccttcacattccaggttc

SEQ ID NO: 603199 - DNA, 20 bp, Artificial Sequence
  chemically synthesized
tcaggaggctgaggcagaag

SEQ ID NO: 603200 - DNA, 20 bp, Artificial Sequence
  chemically synthesized
tgcctcagcctcctgagtag

SEQ ID NO: 603201 - DNA, 20 bp, Artificial Sequence
  chemically synthesized
ttttttatttttagtagaga

SEQ ID NO: 603202 - DNA, 20 bp, Artificial Sequence
  chemically synthesized
ggtgggtggatcatgaggtc

SEQ ID NO: 603203 - DNA, 20 bp, Artificial Sequence
  chemically synthesized
caccttggcctcccaaagtg

SEQ ID NO: 603204 - DNA, 20 bp, Artificial Sequence
  chemically synthesized
ttttaaattacggtggctgt

SEQ ID NO: 603205 - DNA, 20 bp, Artificial Sequence
  chemically synthesized
tggcataattattagtagca

SEQ ID NO: 603206 - DNA, 20 bp, Artificial Sequence
  chemically synthesized
tgtttcactctcagtagtac

SEQ ID NO: 603207 - DNA, 20 bp, Artificial Sequence
  chemically synthesized
gtgacagtacagcagtgttc

SEQ ID NO: 603208 - DNA, 20 bp, Artificial Sequence
  chemically synthesized
agatgcatgaaattaccaaa

SEQ ID NO: 603209 - DNA, 20 bp, Artificial Sequence
  chemically synthesized
taccaaaatatgtttaattc

SEQ ID NO: 603210 - DNA, 20 bp, Artificial Sequence
  chemically synthesized
aaaaactttgagattatgtt

SEQ ID NO: 603211 - DNA, 20 bp, Artificial Sequence
  chemically synthesized
aaaagctaagaacataatct

SEQ ID NO: 603212 - DNA, 20 bp, Artificial Sequence
  chemically synthesized
gtaatcagtatttaaaaact

SEQ ID NO: 603213 - DNA, 20 bp, Artificial Sequence
  chemically synthesized
ataatctcaaagtttttaaa

SEQ ID NO: 603214 - DNA, 20 bp, Artificial Sequence
  chemically synthesized
tcaatagtacattttattta

SEQ ID NO: 603215 - DNA, 20 bp, Artificial Sequence
  chemically synthesized
atgtactattgaaattcaat

SEQ ID NO: 603216 - DNA, 20 bp, Artificial Sequence
  chemically synthesized
gtttctttttcctttcctaa

SEQ ID NO: 603217 - DNA, 20 bp, Artificial Sequence
  chemically synthesized
agaccattttaaattacata

SEQ ID NO: 603218 - DNA, 20 bp, Artificial Sequence
  chemically synthesized
tggttccatatgaactttaa

SEQ ID NO: 603219 - DNA, 20 bp, Artificial Sequence
  chemically synthesized
tccagctttgtcctgttggc

SEQ ID NO: 603220 - DNA, 20 bp, Artificial Sequence
  chemically synthesized
gatgcctccagctttgtcct

SEQ ID NO: 603221 - DNA, 20 bp, Artificial Sequence
  chemically synthesized
aagtcaggtagtgtgatgcc

SEQ ID NO: 603222 - DNA, 20 bp, Artificial Sequence
  chemically synthesized
tggttactgtagccttgtag

SEQ ID NO: 603223 - DNA, 20 bp, Artificial Sequence
  chemically synthesized
ctgttttggtaccagtacca

SEQ ID NO: 603224 - DNA, 20 bp, Artificial Sequence
  chemically synthesized
tctgttccattgatctatat

SEQ ID NO: 603225 - DNA, 20 bp, Artificial Sequence
  chemically synthesized
ttccccattgcttgtttttg

SEQ ID NO: 603226 - DNA, 20 bp, Artificial Sequence
  chemically synthesized
gacaaaaacaagcaatgggg

SEQ ID NO: 603227 - DNA, 20 bp, Artificial Sequence
  chemically synthesized
tagggaatcctttccccatt

SEQ ID NO: 603228 - DNA, 20 bp, Artificial Sequence
  chemically synthesized
taaatagggaatcctttccc

SEQ ID NO: 603229 - DNA, 20 bp, Artificial Sequence
  chemically synthesized
cagctttctacatatggcta

SEQ ID NO: 603230 - DNA, 20 bp, Artificial Sequence
  chemically synthesized
ttgtaaggaagggatccagt

SEQ ID NO: 603231 - DNA, 20 bp, Artificial Sequence
  chemically synthesized
tataagttgtaaggaaggga

SEQ ID NO: 603232 - DNA, 20 bp, Artificial Sequence
  chemically synthesized
ttatacaaaaatcaattcaa

SEQ ID NO: 603233 - DNA, 20 bp, Artificial Sequence
  chemically synthesized
taaatctttaatccatcttg

SEQ ID NO: 603234 - DNA, 20 bp, Artificial Sequence
  chemically synthesized
aaaatcaattcaagatggat

SEQ ID NO: 603235 - DNA, 20 bp, Artificial Sequence
  chemically synthesized
ggtttttatggttttaggtc

SEQ ID NO: 603236 - DNA, 20 bp, Artificial Sequence
  chemically synthesized
aggttttcttctagggtttt

SEQ ID NO: 603237 - DNA, 20 bp, Artificial Sequence
  chemically synthesized
gtattgcctaggttttcttc

SEQ ID NO: 603238 - DNA, 20 bp, Artificial Sequence
  chemically synthesized
tatgccctgaatggtattgc

SEQ ID NO: 603239 - DNA, 20 bp, Artificial Sequence
  chemically synthesized
tcttttgttgccattgcttt

SEQ ID NO: 603240 - DNA, 20 bp, Artificial Sequence
  chemically synthesized
gtcaatttgtcttttgttgc

SEQ ID NO: 603241 - DNA, 20 bp, Artificial Sequence
  chemically synthesized
aatgggatctaattaaacta

SEQ ID NO: 603242 - DNA, 20 bp, Artificial Sequence
  chemically synthesized
cttttgctgtgcagaagctc

SEQ ID NO: 603243 - DNA, 20 bp, Artificial Sequence
  chemically synthesized
ggttgcctgttcactctgat

SEQ ID NO: 603244 - DNA, 20 bp, Artificial Sequence
  chemically synthesized
gtaaatttttttgagttcgt

SEQ ID NO: 603245 - DNA, 20 bp, Artificial Sequence
  chemically synthesized
gcccactttttgatggggtt

SEQ ID NO: 603246 - DNA, 20 bp, Artificial Sequence
  chemically synthesized
cttcgcccactttttgatgg

SEQ ID NO: 603247 - DNA, 20 bp, Artificial Sequence
  chemically synthesized
gggcatgctattctctacat

SEQ ID NO: 603248 - DNA, 20 bp, Artificial Sequence
  chemically synthesized
ctacataaatgttttcatgt

SEQ ID NO: 603249 - DNA, 20 bp, Artificial Sequence
  chemically synthesized
cttgtttccagtgaagttgg

SEQ ID NO: 603250 - DNA, 20 bp, Artificial Sequence
  chemically synthesized
atacatatataatttgaact

SEQ ID NO: 603251 - DNA, 20 bp, Artificial Sequence
  chemically synthesized
tttaaaagtgttattatcat

SEQ ID NO: 603252 - DNA, 20 bp, Artificial Sequence
  chemically synthesized
aattctgaacgaattgaaat

SEQ ID NO: 603253 - DNA, 20 bp, Artificial Sequence
  chemically synthesized
tcactttgattttcaggaag

SEQ ID NO: 603254 - DNA, 20 bp, Artificial Sequence
  chemically synthesized
actttttttttgccttttca

SEQ ID NO: 603255 - DNA, 20 bp, Artificial Sequence
  chemically synthesized
tctcattaaaaaaacataaa

SEQ ID NO: 603256 - DNA, 20 bp, Artificial Sequence
  chemically synthesized
cattcctctgaaagctgtat

SEQ ID NO: 603257 - DNA, 20 bp, Artificial Sequence
  chemically synthesized
taaatacagctttcagagga

SEQ ID NO: 603258 - DNA, 20 bp, Artificial Sequence
  chemically synthesized
tatgtggttataatggtatg

SEQ ID NO: 603259 - DNA, 20 bp, Artificial Sequence
  chemically synthesized
gattcaggtaaaataatctc

SEQ ID NO: 603260 - DNA, 20 bp, Artificial Sequence
  chemically synthesized
aaaataatctctgacgattc

SEQ ID NO: 603261 - DNA, 20 bp, Artificial Sequence
  chemically synthesized
caccaaaacgattgaatcgt

SEQ ID NO: 603262 - DNA, 20 bp, Artificial Sequence
  chemically synthesized
gattcaatcgttttggtggg

SEQ ID NO: 603263 - DNA, 20 bp, Artificial Sequence
  chemically synthesized
tctttaatcttcacccacca

SEQ ID NO: 603264 - DNA, 20 bp, Artificial Sequence
  chemically synthesized
ttttggtgggtgaagattaa

SEQ ID NO: 603265 - DNA, 20 bp, Artificial Sequence
  chemically synthesized
aactttctagcactggtttg

SEQ ID NO: 603266 - DNA, 20 bp, Artificial Sequence
  chemically synthesized
atatataccaactttctagc

SEQ ID NO: 603267 - DNA, 20 bp, Artificial Sequence
  chemically synthesized
tatatacaaataatttgtat

SEQ ID NO: 603268 - DNA, 20 bp, Artificial Sequence
  chemically synthesized
tctactgtgaaccattaaga

SEQ ID NO: 603269 - DNA, 20 bp, Artificial Sequence
  chemically synthesized
tttattagtttcaaagtccc

SEQ ID NO: 603270 - DNA, 20 bp, Artificial Sequence
  chemically synthesized
aacatttgcccaaatgtttt

SEQ ID NO: 603271 - DNA, 20 bp, Artificial Sequence
  chemically synthesized
tctcaactgaacatttgccc

SEQ ID NO: 603272 - DNA, 20 bp, Artificial Sequence
  chemically synthesized
tcagttgaaaagtatctctt

SEQ ID NO: 603273 - DNA, 20 bp, Artificial Sequence
  chemically synthesized
tacttttcaactgaagtatt

SEQ ID NO: 603274 - DNA, 20 bp, Artificial Sequence
  chemically synthesized
aattagccattatttccata

SEQ ID NO: 603275 - DNA, 20 bp, Artificial Sequence
  chemically synthesized
ccattatttccataaaagga

SEQ ID NO: 603276 - DNA, 20 bp, Artificial Sequence
  chemically synthesized
gagtatggtatctcctttga

SEQ ID NO: 603277 - DNA, 20 bp, Artificial Sequence
  chemically synthesized
tctgtttattctttaaaatt

SEQ ID NO: 603278 - DNA, 20 bp, Artificial Sequence
  chemically synthesized
aaattatatgcttatctcat

SEQ ID NO: 603279 - DNA, 20 bp, Artificial Sequence
  chemically synthesized
ccctttcctgtgaaaaatac

SEQ ID NO: 603280 - DNA, 20 bp, Artificial Sequence
  chemically synthesized
atattctaatgatcggcaga

SEQ ID NO: 603281 - DNA, 20 bp, Artificial Sequence
  chemically synthesized
cagcgttttattttatttgg

SEQ ID NO: 603282 - DNA, 20 bp, Artificial Sequence
  chemically synthesized
ataaattataacatgtttct

SEQ ID NO: 603283 - DNA, 20 bp, Artificial Sequence
  chemically synthesized
tgataggtaaataaattata

SEQ ID NO: 603284 - DNA, 20 bp, Artificial Sequence
  chemically synthesized
caaatatatatactgttctg

SEQ ID NO: 603285 - DNA, 20 bp, Artificial Sequence
  chemically synthesized
ttgcccttgtatgaataata

SEQ ID NO: 603286 - DNA, 20 bp, Artificial Sequence
  chemically synthesized
taggtaaaatatttagcaag

SEQ ID NO: 603287 - DNA, 20 bp, Artificial Sequence
  chemically synthesized
cttgctaaatattttaccta

SEQ ID NO: 603288 - DNA, 20 bp, Artificial Sequence
  chemically synthesized
aggaacaaatggagatcacc

SEQ ID NO: 603289 - DNA, 20 bp, Artificial Sequence
  chemically synthesized
gggacctgctagtatcttgg

SEQ ID NO: 603290 - DNA, 20 bp, Artificial Sequence
  chemically synthesized
actagcaggtcccagaagtc

SEQ ID NO: 603291 - DNA, 20 bp, Artificial Sequence
  chemically synthesized
ggtttgtctcctatatacct

SEQ ID NO: 603292 - DNA, 20 bp, Artificial Sequence
  chemically synthesized
ctcctatatacctgactgat

SEQ ID NO: 603293 - DNA, 20 bp, Artificial Sequence
  chemically synthesized
atttacaatggtcttcattc

SEQ ID NO: 603294 - DNA, 20 bp, Artificial Sequence
  chemically synthesized
catgttccttctgcctggaa

SEQ ID NO: 603295 - DNA, 20 bp, Artificial Sequence
  chemically synthesized
ttaggtaagagaacagttaa

SEQ ID NO: 603296 - DNA, 20 bp, Artificial Sequence
  chemically synthesized
gcccttggtggctgtatcag

SEQ ID NO: 603297 - DNA, 20 bp, Artificial Sequence
  chemically synthesized
ttccctgttactcattctcc

SEQ ID NO: 603298 - DNA, 20 bp, Artificial Sequence
  chemically synthesized
attctcccaaagctttgcat

SEQ ID NO: 603299 - DNA, 20 bp, Artificial Sequence
  chemically synthesized
cagtggtttaaactaagatg

SEQ ID NO: 603300 - DNA, 20 bp, Artificial Sequence
  chemically synthesized
ttaaatttcctgctaggaac

SEQ ID NO: 603301 - DNA, 20 bp, Artificial Sequence
  chemically synthesized
cctagcaggaaatttaaaaa

SEQ ID NO: 603302 - DNA, 20 bp, Artificial Sequence
  chemically synthesized
aaatttaaaaatattgattc

SEQ ID NO: 603303 - DNA, 20 bp, Artificial Sequence
  chemically synthesized
cattgtttcatatctctctt

SEQ ID NO: 603304 - DNA, 20 bp, Artificial Sequence
  chemically synthesized
ttagagtgggcattcatgga

SEQ ID NO: 603305 - DNA, 20 bp, Artificial Sequence
  chemically synthesized
acacaattcagcccatagca

SEQ ID NO: 603306 - DNA, 20 bp, Artificial Sequence
  chemically synthesized
ataggacttttaagaggtaa

SEQ ID NO: 603307 - DNA, 20 bp, Artificial Sequence
  chemically synthesized
ggggtggggggctaatccct

SEQ ID NO: 603308 - DNA, 20 bp, Artificial Sequence
  chemically synthesized
gggctaatcccttagggatt

SEQ ID NO: 603309 - DNA, 20 bp, Artificial Sequence
  chemically synthesized
ttataaagccaccaatccct

SEQ ID NO: 603310 - DNA, 20 bp, Artificial Sequence
  chemically synthesized
aacttctcactctgtcctca

SEQ ID NO: 603311 - DNA, 20 bp, Artificial Sequence
  chemically synthesized
cttctggtgaaggctgtctt

SEQ ID NO: 603312 - DNA, 20 bp, Artificial Sequence
  chemically synthesized
aggatcaaggtttggtaggg

SEQ ID NO: 603313 - DNA, 20 bp, Artificial Sequence
  chemically synthesized
agtgagagaaagtccaggat

SEQ ID NO: 603314 - DNA, 20 bp, Artificial Sequence
  chemically synthesized
actctcagaaaataaacctg

SEQ ID NO: 603315 - DNA, 20 bp, Artificial Sequence
  chemically synthesized
gactcggtggcttaaacaac

SEQ ID NO: 603316 - DNA, 20 bp, Artificial Sequence
  chemically synthesized
acaataaataccacagactc

SEQ ID NO: 603317 - DNA, 20 bp, Artificial Sequence
  chemically synthesized
gtatttattgtggcagactc

SEQ ID NO: 603318 - DNA, 20 bp, Artificial Sequence
  chemically synthesized
atatacattaagtgtctcta

SEQ ID NO: 603319 - DNA, 20 bp, Artificial Sequence
  chemically synthesized
gatgttaccttatccgattc

SEQ ID NO: 603320 - DNA, 20 bp, Artificial Sequence
  chemically synthesized
caaaaatctgatgttacctt

SEQ ID NO: 603321 - DNA, 20 bp, Artificial Sequence
  chemically synthesized
caagaatcggataaggtaac

SEQ ID NO: 603322 - DNA, 20 bp, Artificial Sequence
  chemically synthesized
ttgtggcaagaaataatgta

SEQ ID NO: 603323 - DNA, 20 bp, Artificial Sequence
  chemically synthesized
ataatgtatttggattattc

SEQ ID NO: 603324 - DNA, 20 bp, Artificial Sequence
  chemically synthesized
taatttaagaatagaaccaa

SEQ ID NO: 603325 - DNA, 20 bp, Artificial Sequence
  chemically synthesized
tttatccaaaagtatacttt

SEQ ID NO: 603326 - DNA, 20 bp, Artificial Sequence
  chemically synthesized
attaggttttctgttcttgt

SEQ ID NO: 603327 - DNA, 20 bp, Artificial Sequence
  chemically synthesized
atatcggacctgtagcatta

SEQ ID NO: 603328 - DNA, 20 bp, Artificial Sequence
  chemically synthesized
gaagaaccattaagtccttc

SEQ ID NO: 603329 - DNA, 20 bp, Artificial Sequence
  chemically synthesized
tcaattgtttttctcttcaa

SEQ ID NO: 603330 - DNA, 20 bp, Artificial Sequence
  chemically synthesized
tagacatggaaaggtgacaa

SEQ ID NO: 603331 - DNA, 20 bp, Artificial Sequence
  chemically synthesized
atttgcatactgtaaaaaag

SEQ ID NO: 603332 - DNA, 20 bp, Artificial Sequence
  chemically synthesized
ttaatacaaaaggcaaggag

SEQ ID NO: 603333 - DNA, 20 bp, Artificial Sequence
  chemically synthesized
gaacgtttagtgatagatcg

SEQ ID NO: 603334 - DNA, 20 bp, Artificial Sequence
  chemically synthesized
tcactaaacgttcatcctgg

SEQ ID NO: 603335 - DNA, 20 bp, Artificial Sequence
  chemically synthesized
gactaaaacgtttccaggat

SEQ ID NO: 603336 - DNA, 20 bp, Artificial Sequence
  chemically synthesized
actgattagaggatggacta

SEQ ID NO: 603337 - DNA, 20 bp, Artificial Sequence
  chemically synthesized
acgttttagtccatcctcta

SEQ ID NO: 603338 - DNA, 20 bp, Artificial Sequence
  chemically synthesized
gcttttcgcggggaatgaga

SEQ ID NO: 603339 - DNA, 20 bp, Artificial Sequence
  chemically synthesized
tttcattgttactatgagct

SEQ ID NO: 603340 - DNA, 20 bp, Artificial Sequence
  chemically synthesized
tagctcatagtaacaatgaa

SEQ ID NO: 603341 - DNA, 20 bp, Artificial Sequence
  chemically synthesized
ataataatgaaaatagccta

SEQ ID NO: 603342 - DNA, 20 bp, Artificial Sequence
  chemically synthesized
tattttcattattatacagc

SEQ ID NO: 603343 - DNA, 20 bp, Artificial Sequence
  chemically synthesized
aagggcctgagaaagagatg

SEQ ID NO: 603344 - DNA, 20 bp, Artificial Sequence
  chemically synthesized
ggcccttttgtccacttaca

SEQ ID NO: 603345 - DNA, 20 bp, Artificial Sequence
  chemically synthesized
acggttccttgtcctttgtc

SEQ ID NO: 603346 - DNA, 20 bp, Artificial Sequence
  chemically synthesized
ccttgtcctttgtcttacga

SEQ ID NO: 603347 - DNA, 20 bp, Artificial Sequence
  chemically synthesized
ttagtcagtgaggagccctg

SEQ ID NO: 603348 - DNA, 20 bp, Artificial Sequence
  chemically synthesized
gcagggaaaaaagtgaagtg

SEQ ID NO: 603349 - DNA, 20 bp, Artificial Sequence
  chemically synthesized
tttgtctgactccatttcta

SEQ ID NO: 603350 - DNA, 20 bp, Artificial Sequence
  chemically synthesized
aggattccttaagccggcca

SEQ ID NO: 603351 - DNA, 20 bp, Artificial Sequence
  chemically synthesized
ctcatggtaaaagcagcatg

SEQ ID NO: 603352 - DNA, 20 bp, Artificial Sequence
  chemically synthesized
gaggatctgactgtctcctt

SEQ ID NO: 603353 - DNA, 20 bp, Artificial Sequence
  chemically synthesized
tcaaattacgataatttgag

SEQ ID NO: 603354 - DNA, 20 bp, Artificial Sequence
  chemically synthesized
tatcgtaatttgagaggtcc

SEQ ID NO: 603355 - DNA, 20 bp, Artificial Sequence
  chemically synthesized
tgtatctagttatactgcat

SEQ ID NO: 603356 - DNA, 20 bp, Artificial Sequence
  chemically synthesized
catccaagcttgttgttgac

SEQ ID NO: 603357 - DNA, 20 bp, Artificial Sequence
  chemically synthesized
gttagaaacacgggtcaaca

SEQ ID NO: 603358 - DNA, 20 bp, Artificial Sequence
  chemically synthesized
cccgtgtttctaactatttc

SEQ ID NO: 603359 - DNA, 20 bp, Artificial Sequence
  chemically synthesized
attccactttttcaaaatga

SEQ ID NO: 603360 - DNA, 20 bp, Artificial Sequence
  chemically synthesized
gccattttttacaggataca

SEQ ID NO: 603361 - DNA, 20 bp, Artificial Sequence
  chemically synthesized
ttccacactcctaaactgcc

SEQ ID NO: 603362 - DNA, 20 bp, Artificial Sequence
  chemically synthesized
gtcggtttgcgtaagcatga

SEQ ID NO: 603363 - DNA, 20 bp, Artificial Sequence
  chemically synthesized
acacagcgctaattgattgt

SEQ ID NO: 603364 - DNA, 20 bp, Artificial Sequence
  chemically synthesized
tggcgtagttacacagcgct

SEQ ID NO: 603365 - DNA, 20 bp, Artificial Sequence
  chemically synthesized
aaatatgtaagacgtagata

SEQ ID NO: 603366 - DNA, 20 bp, Artificial Sequence
  chemically synthesized
atctacgtcttacatattta

SEQ ID NO: 603367 - DNA, 20 bp, Artificial Sequence
  chemically synthesized
tacatatttaaacagatttc

SEQ ID NO: 603368 - DNA, 20 bp, Artificial Sequence
  chemically synthesized
tcaaaatgtaagcaacagaa

SEQ ID NO: 603369 - DNA, 20 bp, Artificial Sequence
  chemically synthesized
tgcttacattttgaacttta

SEQ ID NO: 603370 - DNA, 20 bp, Artificial Sequence
  chemically synthesized
tagctaaatccttagaaggt

SEQ ID NO: 603371 - DNA, 20 bp, Artificial Sequence
  chemically synthesized
gtaatgaaacgttcaccttc

SEQ ID NO: 603372 - DNA, 20 bp, Artificial Sequence
  chemically synthesized
ggaaattgccaagaaatacc

SEQ ID NO: 603373 - DNA, 20 bp, Artificial Sequence
  chemically synthesized
tatgctccaaatggaaggag

SEQ ID NO: 603374 - DNA, 20 bp, Artificial Sequence
  chemically synthesized
tggctctgatggggtggtgg

SEQ ID NO: 603375 - DNA, 20 bp, Artificial Sequence
  chemically synthesized
ggtggtgggttggattttca

SEQ ID NO: 603376 - DNA, 20 bp, Artificial Sequence
  chemically synthesized
tcatctgctccaattgttgt

SEQ ID NO: 603377 - DNA, 20 bp, Artificial Sequence
  chemically synthesized
ctggagtatcagaacaacat

SEQ ID NO: 603378 - DNA, 20 bp, Artificial Sequence
  chemically synthesized
caccggctgttcagttgttc

SEQ ID NO: 603379 - DNA, 20 bp, Artificial Sequence
  chemically synthesized
ggctgttcagttgttctgag

SEQ ID NO: 603380 - DNA, 20 bp, Artificial Sequence
  chemically synthesized
tacttttataattaggatgt

SEQ ID NO: 603381 - DNA, 20 bp, Artificial Sequence
  chemically synthesized
tataaaagtattcaccacat

SEQ ID NO: 603382 - DNA, 20 bp, Artificial Sequence
  chemically synthesized
atatcttagaaaataattga

SEQ ID NO: 603383 - DNA, 20 bp, Artificial Sequence
  chemically synthesized
tctaagatataaatgtgtaa

SEQ ID NO: 603384 - DNA, 20 bp, Artificial Sequence
  chemically synthesized
tataaatgtgtaaatatgat

SEQ ID NO: 603385 - DNA, 20 bp, Artificial Sequence
  chemically synthesized
ttgagcacttttgtttttat

SEQ ID NO: 603386 - DNA, 20 bp, Artificial Sequence
  chemically synthesized
cccatcagagctttgagcac

SEQ ID NO: 603387 - DNA, 20 bp, Artificial Sequence
  chemically synthesized
tgcagccttccagctcccat

SEQ ID NO: 603388 - DNA, 20 bp, Artificial Sequence
  chemically synthesized
gcatgaacaagtaacatttt

SEQ ID NO: 603389 - DNA, 20 bp, Artificial Sequence
  chemically synthesized
ttttaaaattaaaaatgtaa

SEQ ID NO: 603390 - DNA, 20 bp, Artificial Sequence
  chemically synthesized
ttacatttttaattttaaaa

SEQ ID NO: 603391 - DNA, 20 bp, Artificial Sequence
  chemically synthesized
ttttaaaaatgggcttggaa

SEQ ID NO: 603392 - DNA, 20 bp, Artificial Sequence
  chemically synthesized
attagtttaaatagtatttt

SEQ ID NO: 603393 - DNA, 20 bp, Artificial Sequence
  chemically synthesized
ttaaaaagaggaaaaaaaat

SEQ ID NO: 603394 - DNA, 20 bp, Artificial Sequence
  chemically synthesized
taaatgaaataaagaataat

SEQ ID NO: 603395 - DNA, 20 bp, Artificial Sequence
  chemically synthesized
ttattctttatttcatttac

SEQ ID NO: 603396 - DNA, 20 bp, Artificial Sequence
  chemically synthesized
tttacagaagattagaaata

SEQ ID NO: 603397 - DNA, 20 bp, Artificial Sequence
  chemically synthesized
gccaccgtgcccagccgaca

SEQ ID NO: 603398 - DNA, 20 bp, Artificial Sequence
  chemically synthesized
ttttgtatttttagtagaga

SEQ ID NO: 603399 - DNA, 20 bp, Artificial Sequence
  chemically synthesized
aatggcgtgaacccgggagg

SEQ ID NO: 603400 - DNA, 20 bp, Artificial Sequence
  chemically synthesized
gaaagattatttttcctagt

SEQ ID NO: 603401 - DNA, 20 bp, Artificial Sequence
  chemically synthesized
tttaaaaatgtttcacatta

SEQ ID NO: 603402 - DNA, 20 bp, Artificial Sequence
  chemically synthesized
ttctacatttataaatttaa

SEQ ID NO: 603403 - DNA, 20 bp, Artificial Sequence
  chemically synthesized
ataaatgtagaagttgatct

SEQ ID NO: 603404 - DNA, 20 bp, Artificial Sequence
  chemically synthesized
tctgggtttggtattactac

SEQ ID NO: 603405 - DNA, 20 bp, Artificial Sequence
  chemically synthesized
ttttcccttgataaagtttt

SEQ ID NO: 603406 - DNA, 20 bp, Artificial Sequence
  chemically synthesized
tgtttccatttttcccttga

SEQ ID NO: 603407 - DNA, 20 bp, Artificial Sequence
  chemically synthesized
taatggtgataatgatatgc

SEQ ID NO: 603408 - DNA, 20 bp, Artificial Sequence
  chemically synthesized
gaatggtaatggtgataatg

SEQ ID NO: 603409 - DNA, 20 bp, Artificial Sequence
  chemically synthesized
catagcacagcgtgatgttg

SEQ ID NO: 603410 - DNA, 20 bp, Artificial Sequence
  chemically synthesized
aaatattcaaactctctaaa

SEQ ID NO: 603411 - DNA, 20 bp, Artificial Sequence
  chemically synthesized
aattttgtaaactaacttta

SEQ ID NO: 603412 - DNA, 20 bp, Artificial Sequence
  chemically synthesized
gtttacaaaatttagacttt

SEQ ID NO: 603413 - DNA, 20 bp, Artificial Sequence
  chemically synthesized
atttagactttcttagattt

SEQ ID NO: 603414 - DNA, 20 bp, Artificial Sequence
  chemically synthesized
ttcttagatttattagctta

SEQ ID NO: 603415 - DNA, 20 bp, Artificial Sequence
  chemically synthesized
agttatcagtgctaatgtag

SEQ ID NO: 603416 - DNA, 20 bp, Artificial Sequence
  chemically synthesized
tttggaaatactgaatattt

SEQ ID NO: 603417 - DNA, 20 bp, Artificial Sequence
  chemically synthesized
cctagagaaagaaccttaca

SEQ ID NO: 603418 - DNA, 20 bp, Artificial Sequence
  chemically synthesized
aaatacctaaaagttcgaag

SEQ ID NO: 603419 - DNA, 20 bp, Artificial Sequence
  chemically synthesized
gtaaaatgaacatttataaa

SEQ ID NO: 603420 - DNA, 20 bp, Artificial Sequence
  chemically synthesized
ttcttcagactttttaagaa

SEQ ID NO: 603421 - DNA, 20 bp, Artificial Sequence
  chemically synthesized
gtctctagaaacataaggcc

SEQ ID NO: 603422 - DNA, 20 bp, Artificial Sequence
  chemically synthesized
agttagcaaaaccacaggcc

SEQ ID NO: 603423 - DNA, 20 bp, Artificial Sequence
  chemically synthesized
gtttcaaatgaattgaggga

SEQ ID NO: 603424 - DNA, 20 bp, Artificial Sequence
  chemically synthesized
tgaaattagtgaagttacag

SEQ ID NO: 603425 - DNA, 20 bp, Artificial Sequence
  chemically synthesized
caccgccatcctgagtagca

SEQ ID NO: 603426 - DNA, 20 bp, Artificial Sequence
  chemically synthesized
atagttgacgataatatttg

SEQ ID NO: 603427 - DNA, 20 bp, Artificial Sequence
  chemically synthesized
tacatattctaatatcctcc

SEQ ID NO: 603428 - DNA, 20 bp, Artificial Sequence
  chemically synthesized
ttaaggaagcaattgtgaca

SEQ ID NO: 603429 - DNA, 20 bp, Artificial Sequence
  chemically synthesized
gatcaaaaacagcatgtcac

SEQ ID NO: 603430 - DNA, 20 bp, Artificial Sequence
  chemically synthesized
gtgacatgctgtttttgatc

SEQ ID NO: 603431 - DNA, 20 bp, Artificial Sequence
  chemically synthesized
accaaaatatttgttaagcg

SEQ ID NO: 603432 - DNA, 20 bp, Artificial Sequence
  chemically synthesized
taacaacagttacttaatcg

SEQ ID NO: 603433 - DNA, 20 bp, Artificial Sequence
  chemically synthesized
aaacggagtgctcatacgat

SEQ ID NO: 603434 - DNA, 20 bp, Artificial Sequence
  chemically synthesized
aaacttcaatcgtatgagca

SEQ ID NO: 603435 - DNA, 20 bp, Artificial Sequence
  chemically synthesized
ttttttcaaacggagtgctc

SEQ ID NO: 603436 - DNA, 20 bp, Artificial Sequence
  chemically synthesized
tttttattttccagaaatgt

SEQ ID NO: 603437 - DNA, 20 bp, Artificial Sequence
  chemically synthesized
ttcacccttcatggacttct

SEQ ID NO: 603438 - DNA, 20 bp, Artificial Sequence
  chemically synthesized
gtttaatacctggttcatgt

SEQ ID NO: 603439 - DNA, 20 bp, Artificial Sequence
  chemically synthesized
taatttagcatttctttttt

SEQ ID NO: 603440 - DNA, 20 bp, Artificial Sequence
  chemically synthesized
aaagggaccgatagactgat

SEQ ID NO: 603441 - DNA, 20 bp, Artificial Sequence
  chemically synthesized
tgacctttctcagggacaca

SEQ ID NO: 603442 - DNA, 20 bp, Artificial Sequence
  chemically synthesized
tagtttcattttttcatttg

SEQ ID NO: 603443 - DNA, 20 bp, Artificial Sequence
  chemically synthesized
aatgaaaaaatgaaactata

SEQ ID NO: 603444 - DNA, 20 bp, Artificial Sequence
  chemically synthesized
atccatattgaaaatcaact

SEQ ID NO: 603445 - DNA, 20 bp, Artificial Sequence
  chemically synthesized
agagcctattggtacttcac

SEQ ID NO: 603446 - DNA, 20 bp, Artificial Sequence
  chemically synthesized
gtatccgttaaaatctaggg

SEQ ID NO: 603447 - DNA, 20 bp, Artificial Sequence
  chemically synthesized
atgactcattaaaacctgtc

SEQ ID NO: 603448 - DNA, 20 bp, Artificial Sequence
  chemically synthesized
gttgatcattacacaaaact

SEQ ID NO: 603449 - DNA, 20 bp, Artificial Sequence
  chemically synthesized
attttttggggggcaaaaca

SEQ ID NO: 603450 - DNA, 20 bp, Artificial Sequence
  chemically synthesized
aatttaaatggtgaagaaaa

SEQ ID NO: 603451 - DNA, 20 bp, Artificial Sequence
  chemically synthesized
agttacttaatttcactgga

SEQ ID NO: 603452 - DNA, 20 bp, Artificial Sequence
  chemically synthesized
tgtttttctcatccatgaaa

SEQ ID NO: 603453 - DNA, 20 bp, Artificial Sequence
  chemically synthesized
ctttggtaagtatcctatga

SEQ ID NO: 603454 - DNA, 20 bp, Artificial Sequence
  chemically synthesized
ttcacacaagagagctggtc

SEQ ID NO: 603455 - DNA, 20 bp, Artificial Sequence
  chemically synthesized
ttattaactttttatacatg

SEQ ID NO: 603456 - DNA, 20 bp, Artificial Sequence
  chemically synthesized
tgtatttatacattttttaa

SEQ ID NO: 603457 - DNA, 20 bp, Artificial Sequence
  chemically synthesized
gagttcgaggctgcactgag

SEQ ID NO: 603458 - DNA, 20 bp, Artificial Sequence
  chemically synthesized
ccaactaaaataaaaataaa

SEQ ID NO: 603459 - DNA, 20 bp, Artificial Sequence
  chemically synthesized
tataaatgtggcagaatatt

SEQ ID NO: 603460 - DNA, 20 bp, Artificial Sequence
  chemically synthesized
tctgccacatttataatcat

SEQ ID NO: 603461 - DNA, 20 bp, Artificial Sequence
  chemically synthesized
ttctttataacttcaatctc

SEQ ID NO: 603462 - DNA, 20 bp, Artificial Sequence
  chemically synthesized
ccacgttttttttgaaatgt

SEQ ID NO: 603463 - DNA, 20 bp, Artificial Sequence
  chemically synthesized
aaatttccacgttttttttg

SEQ ID NO: 603464 - DNA, 20 bp, Artificial Sequence
  chemically synthesized
ctagtaacatctagaaattt

SEQ ID NO: 603465 - DNA, 20 bp, Artificial Sequence
  chemically synthesized
caaatccttcatagcaagac

SEQ ID NO: 603466 - DNA, 20 bp, Artificial Sequence
  chemically synthesized
aaaatcagaagtcttgctat

SEQ ID NO: 603467 - DNA, 20 bp, Artificial Sequence
  chemically synthesized
atattcacaatgaattaata

SEQ ID NO: 603468 - DNA, 20 bp, Artificial Sequence
  chemically synthesized
aggagtttatagtttagaag

SEQ ID NO: 603469 - DNA, 20 bp, Artificial Sequence
  chemically synthesized
agacatttcctataggagtt

SEQ ID NO: 603470 - DNA, 20 bp, Artificial Sequence
  chemically synthesized
ccagtggagacatttcctat

SEQ ID NO: 603471 - DNA, 20 bp, Artificial Sequence
  chemically synthesized
tggcagtatctaatagaatt

SEQ ID NO: 603472 - DNA, 20 bp, Artificial Sequence
  chemically synthesized
tatattcatatagagtacac

SEQ ID NO: 603473 - DNA, 20 bp, Artificial Sequence
  chemically synthesized
gtgcttgtttgtgtatggct

SEQ ID NO: 603474 - DNA, 20 bp, Artificial Sequence
  chemically synthesized
agattgtgtgcttgtttgtg

SEQ ID NO: 603475 - DNA, 20 bp, Artificial Sequence
  chemically synthesized
tgatacaagagagattgtgt

SEQ ID NO: 603476 - DNA, 20 bp, Artificial Sequence
  chemically synthesized
aatttgatacaagagagatt

SEQ ID NO: 603477 - DNA, 20 bp, Artificial Sequence
  chemically synthesized
ttaaagcaaatttgatacaa

SEQ ID NO: 603478 - DNA, 20 bp, Artificial Sequence
  chemically synthesized
cacaatctctcttgtatcaa

SEQ ID NO: 603479 - DNA, 20 bp, Artificial Sequence
  chemically synthesized
catctaaatgccagaactac

SEQ ID NO: 603480 - DNA, 20 bp, Artificial Sequence
  chemically synthesized
tgaaccctttttcattctag

SEQ ID NO: 603481 - DNA, 20 bp, Artificial Sequence
  chemically synthesized
tatgcaaatatttacttgga

SEQ ID NO: 603482 - DNA, 20 bp, Artificial Sequence
  chemically synthesized
tatccaagtaaatatttgca

SEQ ID NO: 603483 - DNA, 20 bp, Artificial Sequence
  chemically synthesized
tggattttattattatatat

SEQ ID NO: 603484 - DNA, 20 bp, Artificial Sequence
  chemically synthesized
tggaaaattttaacttttct

SEQ ID NO: 603485 - DNA, 20 bp, Artificial Sequence
  chemically synthesized
tttgtaagtgtaaatatctg

SEQ ID NO: 603486 - DNA, 20 bp, Artificial Sequence
  chemically synthesized
taagtatcaatcatctgagc

SEQ ID NO: 603487 - DNA, 20 bp, Artificial Sequence
  chemically synthesized
aaattagaaaacagatgctc

SEQ ID NO: 603488 - DNA, 20 bp, Artificial Sequence
  chemically synthesized
attctaatgtgctacaacaa

SEQ ID NO: 603489 - DNA, 20 bp, Artificial Sequence
  chemically synthesized
tggattatgatccattatcc

SEQ ID NO: 603490 - DNA, 20 bp, Artificial Sequence
  chemically synthesized
tgtttagaatatgagatgtg

SEQ ID NO: 603491 - DNA, 20 bp, Artificial Sequence
  chemically synthesized
tattcacagactatttcagg

SEQ ID NO: 603492 - DNA, 20 bp, Artificial Sequence
  chemically synthesized
cttgttttgtgttattctac

SEQ ID NO: 603493 - DNA, 20 bp, Artificial Sequence
  chemically synthesized
agggtagaataacacaaaac

SEQ ID NO: 603494 - DNA, 20 bp, Artificial Sequence
  chemically synthesized
aattcaagagctctggaaac

SEQ ID NO: 603495 - DNA, 20 bp, Artificial Sequence
  chemically synthesized
tgtttattagcagctttatt

SEQ ID NO: 603496 - DNA, 20 bp, Artificial Sequence
  chemically synthesized
aaaataggagactgtttatt

SEQ ID NO: 603497 - DNA, 20 bp, Artificial Sequence
  chemically synthesized
aaagttcagcaaaaatagga

SEQ ID NO: 603498 - DNA, 20 bp, Artificial Sequence
  chemically synthesized
tagcctcagaacttgtcttc

SEQ ID NO: 603499 - DNA, 20 bp, Artificial Sequence
  chemically synthesized
aagttctgaggctaaatttt

SEQ ID NO: 603500 - DNA, 20 bp, Artificial Sequence
  chemically synthesized
tgaccacactgacttaaagt

SEQ ID NO: 603501 - DNA, 20 bp, Artificial Sequence
  chemically synthesized
attttactaatatagccctt

SEQ ID NO: 603502 - DNA, 20 bp, Artificial Sequence
  chemically synthesized
tctgactttttttaatttta

SEQ ID NO: 603503 - DNA, 20 bp, Artificial Sequence
  chemically synthesized
acatcataaaattaaaaaaa

SEQ ID NO: 603504 - DNA, 20 bp, Artificial Sequence
  chemically synthesized
aaagtcagatttttactcat

SEQ ID NO: 603505 - DNA, 20 bp, Artificial Sequence
  chemically synthesized
cccacagaggctcttccttt

SEQ ID NO: 603506 - DNA, 20 bp, Artificial Sequence
  chemically synthesized
taattgacaggcacattttt

SEQ ID NO: 603507 - DNA, 20 bp, Artificial Sequence
  chemically synthesized
acacagagttcacattcaat

SEQ ID NO: 603508 - DNA, 20 bp, Artificial Sequence
  chemically synthesized
tccttcctcagtactgggca

SEQ ID NO: 603509 - DNA, 20 bp, Artificial Sequence
  chemically synthesized
ttattccttcctcagtactg

SEQ ID NO: 603510 - DNA, 20 bp, Artificial Sequence
  chemically synthesized
atatgtcttgccattaaaat

SEQ ID NO: 603511 - DNA, 20 bp, Artificial Sequence
  chemically synthesized
ttagaagacttgctgctact

SEQ ID NO: 603512 - DNA, 20 bp, Artificial Sequence
  chemically synthesized
aaagtttttccagtgatcat

SEQ ID NO: 603513 - DNA, 20 bp, Artificial Sequence
  chemically synthesized
tttccagtgatcatgagagt

SEQ ID NO: 603514 - DNA, 20 bp, Artificial Sequence
  chemically synthesized
ttttgtcagatgggtgaggg

SEQ ID NO: 603515 - DNA, 20 bp, Artificial Sequence
  chemically synthesized
tatgttatttgaggtgggca

SEQ ID NO: 603516 - DNA, 20 bp, Artificial Sequence
  chemically synthesized
attccctgagtgctagatta

SEQ ID NO: 603517 - DNA, 20 bp, Artificial Sequence
  chemically synthesized
aaaactatcattccctgagt

SEQ ID NO: 603518 - DNA, 20 bp, Artificial Sequence
  chemically synthesized
taatctagcactcagggaat

SEQ ID NO: 603519 - DNA, 20 bp, Artificial Sequence
  chemically synthesized
taaggacagtcacatcaagg

SEQ ID NO: 603520 - DNA, 20 bp, Artificial Sequence
  chemically synthesized
attcattttcaatttctatt

SEQ ID NO: 603521 - DNA, 20 bp, Artificial Sequence
  chemically synthesized
atgtaatagggttagttaaa

SEQ ID NO: 603522 - DNA, 20 bp, Artificial Sequence
  chemically synthesized
agaacctgagctacgcctac

SEQ ID NO: 603523 - DNA, 20 bp, Artificial Sequence
  chemically synthesized
gcctacatatgttttcaaat

SEQ ID NO: 603524 - DNA, 20 bp, Artificial Sequence
  chemically synthesized
tttcagtattaatatggaaa

SEQ ID NO: 603525 - DNA, 20 bp, Artificial Sequence
  chemically synthesized
aaaaagcctagtttagataa

SEQ ID NO: 603526 - DNA, 20 bp, Artificial Sequence
  chemically synthesized
ggaaaaccagtttatctaaa

SEQ ID NO: 603527 - DNA, 20 bp, Artificial Sequence
  chemically synthesized
tcaggcataacacaaaaaag

SEQ ID NO: 603528 - DNA, 20 bp, Artificial Sequence
  chemically synthesized
actaggcttttttgtgttat

SEQ ID NO: 603529 - DNA, 20 bp, Artificial Sequence
  chemically synthesized
tgtatgtactcatgcgagaa

SEQ ID NO: 603530 - DNA, 20 bp, Artificial Sequence
  chemically synthesized
gcgagaacactgttttacaa

SEQ ID NO: 603531 - DNA, 20 bp, Artificial Sequence
  chemically synthesized
atatgtctgtttttatctat

SEQ ID NO: 603532 - DNA, 20 bp, Artificial Sequence
  chemically synthesized
ctaaatagataaaaacagac

SEQ ID NO: 603533 - DNA, 20 bp, Artificial Sequence
  chemically synthesized
atgattatacctaaacatat

SEQ ID NO: 603534 - DNA, 20 bp, Artificial Sequence
  chemically synthesized
ctagggctaaaataatatac

SEQ ID NO: 603535 - DNA, 20 bp, Artificial Sequence
  chemically synthesized
tcagtgtattattgagattg

SEQ ID NO: 603536 - DNA, 20 bp, Artificial Sequence
  chemically synthesized
caaggcctttcagtgtatta

SEQ ID NO: 603537 - DNA, 20 bp, Artificial Sequence
  chemically synthesized
aggccttggtcatgaaaggc

SEQ ID NO: 603538 - DNA, 20 bp, Artificial Sequence
  chemically synthesized
tgctaactaataatggtttt

SEQ ID NO: 603539 - DNA, 20 bp, Artificial Sequence
  chemically synthesized
taataatattgctaactaat

SEQ ID NO: 603540 - DNA, 20 bp, Artificial Sequence
  chemically synthesized
gcaatattattaaagcatta

SEQ ID NO: 603541 - DNA, 20 bp, Artificial Sequence
  chemically synthesized
aatatagtaagtaatctttc

SEQ ID NO: 603542 - DNA, 20 bp, Artificial Sequence
  chemically synthesized
agaaagatgtgatataactt

SEQ ID NO: 603543 - DNA, 20 bp, Artificial Sequence
  chemically synthesized
gtagctgtgcatattgaaaa

SEQ ID NO: 603544 - DNA, 20 bp, Artificial Sequence
  chemically synthesized
tcacttgccctcattaagtt

SEQ ID NO: 603545 - DNA, 20 bp, Artificial Sequence
  chemically synthesized
ctgagaccagggttatgatc

SEQ ID NO: 603546 - DNA, 20 bp, Artificial Sequence
  chemically synthesized
atgcagcttaccgtcaatat

SEQ ID NO: 603547 - DNA, 20 bp, Artificial Sequence
  chemically synthesized
ttggatagctgtaattttca

SEQ ID NO: 603548 - DNA, 20 bp, Artificial Sequence
  chemically synthesized
atctctatcttagctgtatt

SEQ ID NO: 603549 - DNA, 20 bp, Artificial Sequence
  chemically synthesized
gaaattttggtataattttt

SEQ ID NO: 603550 - DNA, 20 bp, Artificial Sequence
  chemically synthesized
ttcatgccaaaatgccagaa

SEQ ID NO: 603551 - DNA, 20 bp, Artificial Sequence
  chemically synthesized
gtgttaactaaaaaaaaaaa

SEQ ID NO: 603552 - DNA, 20 bp, Artificial Sequence
  chemically synthesized
ttagttaacactctcctttt

SEQ ID NO: 603553 - DNA, 20 bp, Artificial Sequence
  chemically synthesized
ccataaggaaaacgtccatg

SEQ ID NO: 603554 - DNA, 20 bp, Artificial Sequence
  chemically synthesized
cctgctttaaaactatacat

SEQ ID NO: 603555 - DNA, 20 bp, Artificial Sequence
  chemically synthesized
atgagttggccaaattcctt

SEQ ID NO: 603556 - DNA, 20 bp, Artificial Sequence
  chemically synthesized
attaagagtttattgaccgt

SEQ ID NO: 603557 - DNA, 20 bp, Artificial Sequence
  chemically synthesized
acagcaataatttgtatatt

SEQ ID NO: 603558 - DNA, 20 bp, Artificial Sequence
  chemically synthesized
ttaatgatatggttaatatt

SEQ ID NO: 603559 - DNA, 20 bp, Artificial Sequence
  chemically synthesized
acagtttttcagtgtcacat

SEQ ID NO: 603560 - DNA, 20 bp, Artificial Sequence
  chemically synthesized
agtatgtctagtaacatatg

SEQ ID NO: 603561 - DNA, 20 bp, Artificial Sequence
  chemically synthesized
tgtacatatgttactagaca

SEQ ID NO: 603562 - DNA, 20 bp, Artificial Sequence
  chemically synthesized
atactgtttctagaacgtac

SEQ ID NO: 603563 - DNA, 20 bp, Artificial Sequence
  chemically synthesized
aacaaattgccttcaggaca

SEQ ID NO: 603564 - DNA, 20 bp, Artificial Sequence
  chemically synthesized
ttgccttcaggacaaacaga

SEQ ID NO: 603565 - DNA, 20 bp, Artificial Sequence
  chemically synthesized
taagtaatgcagaaaacaaa

SEQ ID NO: 603566 - DNA, 20 bp, Artificial Sequence
  chemically synthesized
cttaagtgatgttgaatctt

SEQ ID NO: 603567 - DNA, 20 bp, Artificial Sequence
  chemically synthesized
tctaaatgtctatgaagcat

SEQ ID NO: 603568 - DNA, 20 bp, Artificial Sequence
  chemically synthesized
catatttccaaatgatttct

SEQ ID NO: 603569 - DNA, 20 bp, Artificial Sequence
  chemically synthesized
ggtacatcagacatatttcc

SEQ ID NO: 603570 - DNA, 20 bp, Artificial Sequence
  chemically synthesized
tctcataacttaaattttac

SEQ ID NO: 603571 - DNA, 20 bp, Artificial Sequence
  chemically synthesized
aataattttgtaattcatca

SEQ ID NO: 603572 - DNA, 20 bp, Artificial Sequence
  chemically synthesized
ttagaataattttgtaattc

SEQ ID NO: 603573 - DNA, 20 bp, Artificial Sequence
  chemically synthesized
attattctaaatttttaaaa

SEQ ID NO: 603574 - DNA, 20 bp, Artificial Sequence
  chemically synthesized
tctacttaaaataatttgcc

SEQ ID NO: 603575 - DNA, 20 bp, Artificial Sequence
  chemically synthesized
aaattattttaagtagaaaa

SEQ ID NO: 603576 - DNA, 20 bp, Artificial Sequence
  chemically synthesized
aatagcataagtatagctat

SEQ ID NO: 603577 - DNA, 20 bp, Artificial Sequence
  chemically synthesized
tatatatttataaatttgat

SEQ ID NO: 603578 - DNA, 20 bp, Artificial Sequence
  chemically synthesized
attagtggcataataatatg

SEQ ID NO: 603579 - DNA, 20 bp, Artificial Sequence
  chemically synthesized
ggctgttcctcttaaccacg

SEQ ID NO: 603580 - DNA, 20 bp, Artificial Sequence
  chemically synthesized
atgaggtcctaaatgaagca

SEQ ID NO: 603581 - DNA, 20 bp, Artificial Sequence
  chemically synthesized
ggaaaatgagagctgaatca

SEQ ID NO: 603582 - DNA, 20 bp, Artificial Sequence
  chemically synthesized
tgtatgtgtcttacgtggtt

SEQ ID NO: 603583 - DNA, 20 bp, Artificial Sequence
  chemically synthesized
atttattatatctccatagc

SEQ ID NO: 603584 - DNA, 20 bp, Artificial Sequence
  chemically synthesized
ccatagcctaagcttgggaa

SEQ ID NO: 603585 - DNA, 20 bp, Artificial Sequence
  chemically synthesized
taagtccagaatcttccttc

SEQ ID NO: 603586 - DNA, 20 bp, Artificial Sequence
  chemically synthesized
gattctggacttataaattt

SEQ ID NO: 603587 - DNA, 20 bp, Artificial Sequence
  chemically synthesized
aatgcaataattgctggact

SEQ ID NO: 603588 - DNA, 20 bp, Artificial Sequence
  chemically synthesized
tgctggactcctagtttaca

SEQ ID NO: 603589 - DNA, 20 bp, Artificial Sequence
  chemically synthesized
acagaaagcttcatttgtct

SEQ ID NO: 603590 - DNA, 20 bp, Artificial Sequence
  chemically synthesized
tcatgaagctgaaagacaaa

SEQ ID NO: 603591 - DNA, 20 bp, Artificial Sequence
  chemically synthesized
gctctatactaaaggagcta

SEQ ID NO: 603592 - DNA, 20 bp, Artificial Sequence
  chemically synthesized
cttcaggcacttaatatgtg

SEQ ID NO: 603593 - DNA, 20 bp, Artificial Sequence
  chemically synthesized
aattgcataatatttatttt

SEQ ID NO: 603594 - DNA, 20 bp, Artificial Sequence
  chemically synthesized
tattctaacttatctatttg

SEQ ID NO: 603595 - DNA, 20 bp, Artificial Sequence
  chemically synthesized
actacttaaaatgaccatag

SEQ ID NO: 603596 - DNA, 20 bp, Artificial Sequence
  chemically synthesized
gaactgatacgtcattaggc

SEQ ID NO: 603597 - DNA, 20 bp, Artificial Sequence
  chemically synthesized
gaacaaaagggtagcataaa

SEQ ID NO: 603598 - DNA, 20 bp, Artificial Sequence
  chemically synthesized
aggggtgtgatttgagacat

SEQ ID NO: 603599 - DNA, 20 bp, Artificial Sequence
  chemically synthesized
gggaacactggggggtaggg

SEQ ID NO: 603600 - DNA, 20 bp, Artificial Sequence
  chemically synthesized
aaagttagcattttccttca

SEQ ID NO: 603601 - DNA, 20 bp, Artificial Sequence
  chemically synthesized
tacctcaacgactgccttaa

SEQ ID NO: 603602 - DNA, 20 bp, Artificial Sequence
  chemically synthesized
gtaaatattaattgaccaga

SEQ ID NO: 603603 - DNA, 20 bp, Artificial Sequence
  chemically synthesized
tgcttagtaaatattaattg

SEQ ID NO: 603604 - DNA, 20 bp, Artificial Sequence
  chemically synthesized
gaaaagtcaggacacatagt

SEQ ID NO: 603605 - DNA, 20 bp, Artificial Sequence
  chemically synthesized
actagtgagaatattaattt

SEQ ID NO: 603606 - DNA, 20 bp, Artificial Sequence
  chemically synthesized
acgatcatttaaatcctgca

SEQ ID NO: 603607 - DNA, 20 bp, Artificial Sequence
  chemically synthesized
tttggtaagtaaaactacat

SEQ ID NO: 603608 - DNA, 20 bp, Artificial Sequence
  chemically synthesized
taaacatttagaaattacgg

SEQ ID NO: 603609 - DNA, 20 bp, Artificial Sequence
  chemically synthesized
aaatcattcccgtaatttct

SEQ ID NO: 603610 - DNA, 20 bp, Artificial Sequence
  chemically synthesized
tttctaaatgtttaaattat

SEQ ID NO: 603611 - DNA, 20 bp, Artificial Sequence
  chemically synthesized
ttctgattaattcagtgtag

SEQ ID NO: 603612 - DNA, 20 bp, Artificial Sequence
  chemically synthesized
tctcatgtcatagttatata

SEQ ID NO: 603613 - DNA, 20 bp, Artificial Sequence
  chemically synthesized
atttaaagtatagctcttgc

SEQ ID NO: 603614 - DNA, 20 bp, Artificial Sequence
  chemically synthesized
ttaaaatgaaaaagtgataa

SEQ ID NO: 603615 - DNA, 20 bp, Artificial Sequence
  chemically synthesized
tagatttttatttagatgta

SEQ ID NO: 603616 - DNA, 20 bp, Artificial Sequence
  chemically synthesized
gaacaggtaatgaaaatacc

SEQ ID NO: 603617 - DNA, 20 bp, Artificial Sequence
  chemically synthesized
aacaggtgagacttgagtga

SEQ ID NO: 603618 - DNA, 20 bp, Artificial Sequence
  chemically synthesized
actcaagtctcacctgttat

SEQ ID NO: 603619 - DNA, 20 bp, Artificial Sequence
  chemically synthesized
aagtctcacctgttatattt

SEQ ID NO: 603620 - DNA, 20 bp, Artificial Sequence
  chemically synthesized
ctcattagaagaagaaaatg

SEQ ID NO: 603621 - DNA, 20 bp, Artificial Sequence
  chemically synthesized
aatttatgccccaaaatgca

SEQ ID NO: 603622 - DNA, 20 bp, Artificial Sequence
  chemically synthesized
caaatgtttttgttgtgcat

SEQ ID NO: 603623 - DNA, 20 bp, Artificial Sequence
  chemically synthesized
acatcataaataaatacaac

SEQ ID NO: 603624 - DNA, 20 bp, Artificial Sequence
  chemically synthesized
attatttttcattttgtaga

SEQ ID NO: 603625 - DNA, 20 bp, Artificial Sequence
  chemically synthesized
agggataatgctatttccaa

SEQ ID NO: 603626 - DNA, 20 bp, Artificial Sequence
  chemically synthesized
ttatttggaaatagcattat

SEQ ID NO: 603627 - DNA, 20 bp, Artificial Sequence
  chemically synthesized
gcaatgataatttgaaagaa

SEQ ID NO: 603628 - DNA, 20 bp, Artificial Sequence
  chemically synthesized
tttgaggcactgagtattag

SEQ ID NO: 603629 - DNA, 20 bp, Artificial Sequence
  chemically synthesized
aaaagaaagacaaaaacttg

SEQ ID NO: 603630 - DNA, 20 bp, Artificial Sequence
  chemically synthesized
agacaaaaacttggctagct

SEQ ID NO: 603631 - DNA, 20 bp, Artificial Sequence
  chemically synthesized
agataaaagcacaaagctag

SEQ ID NO: 603632 - DNA, 20 bp, Artificial Sequence
  chemically synthesized
atggaatgttttaccgtcat

SEQ ID NO: 603633 - DNA, 20 bp, Artificial Sequence
  chemically synthesized
ccaaacactaaaattatatg

SEQ ID NO: 603634 - DNA, 20 bp, Artificial Sequence
  chemically synthesized
taaaacattccatataattt

SEQ ID NO: 603635 - DNA, 20 bp, Artificial Sequence
  chemically synthesized
tttggaaaaacatattgcaa

SEQ ID NO: 603636 - DNA, 20 bp, Artificial Sequence
  chemically synthesized
gattttaaatcatttttgca

SEQ ID NO: 603637 - DNA, 20 bp, Artificial Sequence
  chemically synthesized
tgatttaaaatcagatgatg

SEQ ID NO: 603638 - DNA, 20 bp, Artificial Sequence
  chemically synthesized
tatgtgtaaaactgatcatc

SEQ ID NO: 603639 - DNA, 20 bp, Artificial Sequence
  chemically synthesized
tacacatataacatgactgt

SEQ ID NO: 603640 - DNA, 20 bp, Artificial Sequence
  chemically synthesized
aaattatttggataaattct

SEQ ID NO: 603641 - DNA, 20 bp, Artificial Sequence
  chemically synthesized
atttaaattaaaaggtgttt

SEQ ID NO: 603642 - DNA, 20 bp, Artificial Sequence
  chemically synthesized
aaatacaaatttaaattaaa

SEQ ID NO: 603643 - DNA, 20 bp, Artificial Sequence
  chemically synthesized
aatttaaatttgtatttaac

SEQ ID NO: 603644 - DNA, 20 bp, Artificial Sequence
  chemically synthesized
cagctgataaatatgaacct

SEQ ID NO: 603645 - DNA, 20 bp, Artificial Sequence
  chemically synthesized
atgtgtttatcaaatcccta

SEQ ID NO: 603646 - DNA, 20 bp, Artificial Sequence
  chemically synthesized
gttgatttagataatcttct

SEQ ID NO: 603647 - DNA, 20 bp, Artificial Sequence
  chemically synthesized
tggtgaatggtaattacacg

SEQ ID NO: 603648 - DNA, 20 bp, Artificial Sequence
  chemically synthesized
gagctgatctgctggcatct

SEQ ID NO: 603649 - DNA, 20 bp, Artificial Sequence
  chemically synthesized
tcttgcagttttctgaactt

SEQ ID NO: 603650 - DNA, 20 bp, Artificial Sequence
  chemically synthesized
agtagaagttataattattg

SEQ ID NO: 603651 - DNA, 20 bp, Artificial Sequence
  chemically synthesized
acttgccctttcaagcctta

SEQ ID NO: 603652 - DNA, 20 bp, Artificial Sequence
  chemically synthesized
gctgacagagtgaaacatct

SEQ ID NO: 603653 - DNA, 20 bp, Artificial Sequence
  chemically synthesized
gccttaagatgtttcactct

SEQ ID NO: 603654 - DNA, 20 bp, Artificial Sequence
  chemically synthesized
aaaagtgttgagaaaaagtc

SEQ ID NO: 603655 - DNA, 20 bp, Artificial Sequence
  chemically synthesized
tcatgcttttattgccattt

SEQ ID NO: 603656 - DNA, 20 bp, Artificial Sequence
  chemically synthesized
tagcaagtcatgaaaatggc

SEQ ID NO: 603657 - DNA, 20 bp, Artificial Sequence
  chemically synthesized
acttgctacaacttttaatt

SEQ ID NO: 603658 - DNA, 20 bp, Artificial Sequence
  chemically synthesized
ttttaattataagatttcta

SEQ ID NO: 603659 - DNA, 20 bp, Artificial Sequence
  chemically synthesized
tactcagcttttttttacat

SEQ ID NO: 603660 - DNA, 20 bp, Artificial Sequence
  chemically synthesized
atatacatactggattctca

SEQ ID NO: 603661 - DNA, 20 bp, Artificial Sequence
  chemically synthesized
tttttccatcttatatacat

SEQ ID NO: 603662 - DNA, 20 bp, Artificial Sequence
  chemically synthesized
atttctgctaaattatttat

SEQ ID NO: 603663 - DNA, 20 bp, Artificial Sequence
  chemically synthesized
cttccttggaaataggagta

SEQ ID NO: 603664 - DNA, 20 bp, Artificial Sequence
  chemically synthesized
tactcctatttccaaggaag

SEQ ID NO: 603665 - DNA, 20 bp, Artificial Sequence
  chemically synthesized
tatttccaaggaagacaaga

SEQ ID NO: 603666 - DNA, 20 bp, Artificial Sequence
  chemically synthesized
aagggaaataaaggaattca

SEQ ID NO: 603667 - DNA, 20 bp, Artificial Sequence
  chemically synthesized
atagccagaatttcatacta

SEQ ID NO: 603668 - DNA, 20 bp, Artificial Sequence
  chemically synthesized
gtaatgtagttctactctgt

SEQ ID NO: 603669 - DNA, 20 bp, Artificial Sequence
  chemically synthesized
ttgttatagtcaacacttct

SEQ ID NO: 603670 - DNA, 20 bp, Artificial Sequence
  chemically synthesized
cgttatagttatttgaatag

SEQ ID NO: 603671 - DNA, 20 bp, Artificial Sequence
  chemically synthesized
acttaacaatcatattataa

SEQ ID NO: 603672 - DNA, 20 bp, Artificial Sequence
  chemically synthesized
caagagaaatctttgttata

SEQ ID NO: 603673 - DNA, 20 bp, Artificial Sequence
  chemically synthesized
aattatttaaaataaataaa

SEQ ID NO: 603674 - DNA, 20 bp, Artificial Sequence
  chemically synthesized
ttacatgtgaccagtgttaa

SEQ ID NO: 603675 - DNA, 20 bp, Artificial Sequence
  chemically synthesized
tacaggcctatctcttaact

SEQ ID NO: 603676 - DNA, 20 bp, Artificial Sequence
  chemically synthesized
tgcccaggccttctgagtag

SEQ ID NO: 603677 - DNA, 20 bp, Artificial Sequence
  chemically synthesized
tcagaaggcctgggcaggaa

SEQ ID NO: 603678 - DNA, 20 bp, Artificial Sequence
  chemically synthesized
gcaggaagactgcttcagtc

SEQ ID NO: 603679 - DNA, 20 bp, Artificial Sequence
  chemically synthesized
tttgtttagagatggaggtc

SEQ ID NO: 603680 - DNA, 20 bp, Artificial Sequence
  chemically synthesized
ctgactaattttttaaaatt

SEQ ID NO: 603681 - DNA, 20 bp, Artificial Sequence
  chemically synthesized
acgcctgactaattttttaa

SEQ ID NO: 603682 - DNA, 20 bp, Artificial Sequence
  chemically synthesized
tcaggaatctgaggcagaag

SEQ ID NO: 603683 - DNA, 20 bp, Artificial Sequence
  chemically synthesized
tgctcaagcagtccttctgc

SEQ ID NO: 603684 - DNA, 20 bp, Artificial Sequence
  chemically synthesized
gatattgccatattatatga

SEQ ID NO: 603685 - DNA, 20 bp, Artificial Sequence
  chemically synthesized
cttagtaaatagtgttgtct

SEQ ID NO: 603686 - DNA, 20 bp, Artificial Sequence
  chemically synthesized
ataagcatttacataattta

SEQ ID NO: 603687 - DNA, 20 bp, Artificial Sequence
  chemically synthesized
ctaagcacattaaattatgt

SEQ ID NO: 603688 - DNA, 20 bp, Artificial Sequence
  chemically synthesized
ttttcagatacataaaaata

SEQ ID NO: 603689 - DNA, 20 bp, Artificial Sequence
  chemically synthesized
taaagaaatagctacaaatg

SEQ ID NO: 603690 - DNA, 20 bp, Artificial Sequence
  chemically synthesized
atagctacaaatgtaaagct

SEQ ID NO: 603691 - DNA, 20 bp, Artificial Sequence
  chemically synthesized
acaaatgtaaagctttttgt

SEQ ID NO: 603692 - DNA, 20 bp, Artificial Sequence
  chemically synthesized
ctcaaagagaaacaaaaaca

SEQ ID NO: 603693 - DNA, 20 bp, Artificial Sequence
  chemically synthesized
ctcccgggttcaagcaactc

SEQ ID NO: 603694 - DNA, 20 bp, Artificial Sequence
  chemically synthesized
tcgggaggctgaagcaggag

SEQ ID NO: 603695 - DNA, 20 bp, Artificial Sequence
  chemically synthesized
tgcttcagcctcccgagtag

SEQ ID NO: 603696 - DNA, 20 bp, Artificial Sequence
  chemically synthesized
ttttgtatttttagtagaga

SEQ ID NO: 603697 - DNA, 20 bp, Artificial Sequence
  chemically synthesized
gctgggcggatgatgaggtc

SEQ ID NO: 603698 - DNA, 20 bp, Artificial Sequence
  chemically synthesized
ctcagtgctggggtggggcg

SEQ ID NO: 603699 - DNA, 20 bp, Artificial Sequence
  chemically synthesized
ccaccgtgcctggcctgaat

SEQ ID NO: 603700 - DNA, 20 bp, Artificial Sequence
  chemically synthesized
tttcttaaaaatttatttta

SEQ ID NO: 603701 - DNA, 20 bp, Artificial Sequence
  chemically synthesized
gacctgacgatatctgactt

SEQ ID NO: 603702 - DNA, 20 bp, Artificial Sequence
  chemically synthesized
tattactctgtcttgattac

SEQ ID NO: 603703 - DNA, 20 bp, Artificial Sequence
  chemically synthesized
cttttgccaatattactctg

SEQ ID NO: 603704 - DNA, 20 bp, Artificial Sequence
  chemically synthesized
ctgagctttctattctgttc

SEQ ID NO: 603705 - DNA, 20 bp, Artificial Sequence
  chemically synthesized
atatttatgtggatctgttt

SEQ ID NO: 603706 - DNA, 20 bp, Artificial Sequence
  chemically synthesized
aattgattatatttatgtgg

SEQ ID NO: 603707 - DNA, 20 bp, Artificial Sequence
  chemically synthesized
agatccacataaatataatc

SEQ ID NO: 603708 - DNA, 20 bp, Artificial Sequence
  chemically synthesized
tggttcctttgccaaaaatc

SEQ ID NO: 603709 - DNA, 20 bp, Artificial Sequence
  chemically synthesized
atgttgtgttgttcaggacc

SEQ ID NO: 603710 - DNA, 20 bp, Artificial Sequence
  chemically synthesized
aacacaacatctacatgcaa

SEQ ID NO: 603711 - DNA, 20 bp, Artificial Sequence
  chemically synthesized
attaaaacaaaagaagggtg

SEQ ID NO: 603712 - DNA, 20 bp, Artificial Sequence
  chemically synthesized
gcataaaccttacacccttc

SEQ ID NO: 603713 - DNA, 20 bp, Artificial Sequence
  chemically synthesized
ttcactggatcaacttcatt

SEQ ID NO: 603714 - DNA, 20 bp, Artificial Sequence
  chemically synthesized
cgcgttggccccccaaagtg

SEQ ID NO: 603715 - DNA, 20 bp, Artificial Sequence
  chemically synthesized
gtttgtatttttagtagaga

SEQ ID NO: 603716 - DNA, 20 bp, Artificial Sequence
  chemically synthesized
ctgccaccatgcccagataa

SEQ ID NO: 603717 - DNA, 20 bp, Artificial Sequence
  chemically synthesized
tgcctcagcctccagagtag

SEQ ID NO: 603718 - DNA, 20 bp, Artificial Sequence
  chemically synthesized
aacctctgcctcccgggttc

SEQ ID NO: 603719 - DNA, 20 bp, Artificial Sequence
  chemically synthesized
cacagcattatggttgaaaa

SEQ ID NO: 603720 - DNA, 20 bp, Artificial Sequence
  chemically synthesized
tccatgtgtatccaagaaaa

SEQ ID NO: 603721 - DNA, 20 bp, Artificial Sequence
  chemically synthesized
ctccccactctagtagtccg

SEQ ID NO: 603722 - DNA, 20 bp, Artificial Sequence
  chemically synthesized
gtgtgtatattgtgtgacac

SEQ ID NO: 603723 - DNA, 20 bp, Artificial Sequence
  chemically synthesized
ttggattcaagagtaaatgt

SEQ ID NO: 603724 - DNA, 20 bp, Artificial Sequence
  chemically synthesized
tattttttataatttcaact

SEQ ID NO: 603725 - DNA, 20 bp, Artificial Sequence
  chemically synthesized
tggaaatgtatttatttttg

SEQ ID NO: 603726 - DNA, 20 bp, Artificial Sequence
  chemically synthesized
ctgaatttagaaatttgtgt

SEQ ID NO: 603727 - DNA, 20 bp, Artificial Sequence
  chemically synthesized
cattttactctagagtctgt

SEQ ID NO: 603728 - DNA, 20 bp, Artificial Sequence
  chemically synthesized
tttacattttactctagagt

SEQ ID NO: 603729 - DNA, 20 bp, Artificial Sequence
  chemically synthesized
ctgctatctgctaggagttt

SEQ ID NO: 603730 - DNA, 20 bp, Artificial Sequence
  chemically synthesized
tttctccactgctatctgct

SEQ ID NO: 603731 - DNA, 20 bp, Artificial Sequence
  chemically synthesized
tggagaaaacagaggtgact

SEQ ID NO: 603732 - DNA, 20 bp, Artificial Sequence
  chemically synthesized
atcaacaaactcaaagtcac

SEQ ID NO: 603733 - DNA, 20 bp, Artificial Sequence
  chemically synthesized
gaggtgactttgagtttgtt

SEQ ID NO: 603734 - DNA, 20 bp, Artificial Sequence
  chemically synthesized
gtaaatattttctttgagcc

SEQ ID NO: 603735 - DNA, 20 bp, Artificial Sequence
  chemically synthesized
tagtttgtttgtttttgtta

SEQ ID NO: 603736 - DNA, 20 bp, Artificial Sequence
  chemically synthesized
ttttgcccatgttttagttt

SEQ ID NO: 603737 - DNA, 20 bp, Artificial Sequence
  chemically synthesized
ggatttttgcccatgtttta

SEQ ID NO: 603738 - DNA, 20 bp, Artificial Sequence
  chemically synthesized
ttaaggatttttgcccatgt

SEQ ID NO: 603739 - DNA, 20 bp, Artificial Sequence
  chemically synthesized
tgtctgttaaggatttttgc

SEQ ID NO: 603740 - DNA, 20 bp, Artificial Sequence
  chemically synthesized
tcctttggtgaggtgtctgt

SEQ ID NO: 603741 - DNA, 20 bp, Artificial Sequence
  chemically synthesized
tggcaaataagcaaatgaaa

SEQ ID NO: 603742 - DNA, 20 bp, Artificial Sequence
  chemically synthesized
atgatgtgaaacatattttc

SEQ ID NO: 603743 - DNA, 20 bp, Artificial Sequence
  chemically synthesized
ataggtgtgtagtggtatct

SEQ ID NO: 603744 - DNA, 20 bp, Artificial Sequence
  chemically synthesized
cttttggttttgtcagtgtt

SEQ ID NO: 603745 - DNA, 20 bp, Artificial Sequence
  chemically synthesized
gccccatttctctgtcggct

SEQ ID NO: 603746 - DNA, 20 bp, Artificial Sequence
  chemically synthesized
tcccattgccccatttctct

SEQ ID NO: 603747 - DNA, 20 bp, Artificial Sequence
  chemically synthesized
atggcacagccactttggaa

SEQ ID NO: 603748 - DNA, 20 bp, Artificial Sequence
  chemically synthesized
gccactttggaagacagttt

SEQ ID NO: 603749 - DNA, 20 bp, Artificial Sequence
  chemically synthesized
gattgctggatcatatagta

SEQ ID NO: 603750 - DNA, 20 bp, Artificial Sequence
  chemically synthesized
ctttgtgtaaatgcctaagt

SEQ ID NO: 603751 - DNA, 20 bp, Artificial Sequence
  chemically synthesized
ttcctgcacatgaatgctgc

SEQ ID NO: 603752 - DNA, 20 bp, Artificial Sequence
  chemically synthesized
gcacatgaatgctgcagcag

SEQ ID NO: 603753 - DNA, 20 bp, Artificial Sequence
  chemically synthesized
catctactgaagaacatctt

SEQ ID NO: 603754 - DNA, 20 bp, Artificial Sequence
  chemically synthesized
cattcatctactgaagaaca

SEQ ID NO: 603755 - DNA, 20 bp, Artificial Sequence
  chemically synthesized
attccattgtctggatgtct

SEQ ID NO: 603756 - DNA, 20 bp, Artificial Sequence
  chemically synthesized
ccagacaatggaatattatt

SEQ ID NO: 603757 - DNA, 20 bp, Artificial Sequence
  chemically synthesized
taagttcttccatgtctttt

SEQ ID NO: 603758 - DNA, 20 bp, Artificial Sequence
  chemically synthesized
gcggtaaaatatatagcctt

SEQ ID NO: 603759 - DNA, 20 bp, Artificial Sequence
  chemically synthesized
aaaaggctatatattttacc

SEQ ID NO: 603760 - DNA, 20 bp, Artificial Sequence
  chemically synthesized
attttaccgcaggatttcac

SEQ ID NO: 603761 - DNA, 20 bp, Artificial Sequence
  chemically synthesized
actgattgttttgtagttta

SEQ ID NO: 603762 - DNA, 20 bp, Artificial Sequence
  chemically synthesized
ctagaaaccactgattgttt

SEQ ID NO: 603763 - DNA, 20 bp, Artificial Sequence
  chemically synthesized
atgtaaactacaaaacaatc

SEQ ID NO: 603764 - DNA, 20 bp, Artificial Sequence
  chemically synthesized
cctaatctctagaaaccact

SEQ ID NO: 603765 - DNA, 20 bp, Artificial Sequence
  chemically synthesized
acaaaacaatcagtggtttc

SEQ ID NO: 603766 - DNA, 20 bp, Artificial Sequence
  chemically synthesized
ctctcctaatctctagaaac

SEQ ID NO: 603767 - DNA, 20 bp, Artificial Sequence
  chemically synthesized
tagatgaacgggaaaagtat

SEQ ID NO: 603768 - DNA, 20 bp, Artificial Sequence
  chemically synthesized
ataaatacatgtcattgtaa

SEQ ID NO: 603769 - DNA, 20 bp, Artificial Sequence
  chemically synthesized
ctattggtgccacacattct

SEQ ID NO: 603770 - DNA, 20 bp, Artificial Sequence
  chemically synthesized
ccaaagttcatagtttatac

SEQ ID NO: 603771 - DNA, 20 bp, Artificial Sequence
  chemically synthesized
catcattatctcccaaagtt

SEQ ID NO: 603772 - DNA, 20 bp, Artificial Sequence
  chemically synthesized
atttcccactagagtggtat

SEQ ID NO: 603773 - DNA, 20 bp, Artificial Sequence
  chemically synthesized
agtctattaaaatcacaaaa

SEQ ID NO: 603774 - DNA, 20 bp, Artificial Sequence
  chemically synthesized
ctaattcatgaaaccttttt

SEQ ID NO: 603775 - DNA, 20 bp, Artificial Sequence
  chemically synthesized
aggtttcatgaattaggaat

SEQ ID NO: 603776 - DNA, 20 bp, Artificial Sequence
  chemically synthesized
tggagtttattctgtgaatg

SEQ ID NO: 603777 - DNA, 20 bp, Artificial Sequence
  chemically synthesized
cctgatggagtttattctgt

SEQ ID NO: 603778 - DNA, 20 bp, Artificial Sequence
  chemically synthesized
tatattacagctattcctga

SEQ ID NO: 603779 - DNA, 20 bp, Artificial Sequence
  chemically synthesized
aattttactcttaatttatt

SEQ ID NO: 603780 - DNA, 20 bp, Artificial Sequence
  chemically synthesized
ataaaacaaaattactacct

SEQ ID NO: 603781 - DNA, 20 bp, Artificial Sequence
  chemically synthesized
aaaaatctataaggtagtaa

SEQ ID NO: 603782 - DNA, 20 bp, Artificial Sequence
  chemically synthesized
tgaagggcaacaaatgaaaa

SEQ ID NO: 603783 - DNA, 20 bp, Artificial Sequence
  chemically synthesized
tcttaactaattagacaaaa

SEQ ID NO: 603784 - DNA, 20 bp, Artificial Sequence
  chemically synthesized
taaaaagtgtctgtcacttt

SEQ ID NO: 603785 - DNA, 20 bp, Artificial Sequence
  chemically synthesized
cacttgaaaatttcaaagca

SEQ ID NO: 603786 - DNA, 20 bp, Artificial Sequence
  chemically synthesized
atcacaaaataccacaaact

SEQ ID NO: 603787 - DNA, 20 bp, Artificial Sequence
  chemically synthesized
agcacccagtttgtggtatt

SEQ ID NO: 603788 - DNA, 20 bp, Artificial Sequence
  chemically synthesized
actgaatttcaagacaactc

SEQ ID NO: 603789 - DNA, 20 bp, Artificial Sequence
  chemically synthesized
acttctgagttgtcttgaaa

SEQ ID NO: 603790 - DNA, 20 bp, Artificial Sequence
  chemically synthesized
gtttcacaaagacagtattg

SEQ ID NO: 603791 - DNA, 20 bp, Artificial Sequence
  chemically synthesized
aaccaacaaattagaaccat

SEQ ID NO: 603792 - DNA, 20 bp, Artificial Sequence
  chemically synthesized
agttgagaaaatagaaatat

SEQ ID NO: 603793 - DNA, 20 bp, Artificial Sequence
  chemically synthesized
tatttctattttctcaactt

SEQ ID NO: 603794 - DNA, 20 bp, Artificial Sequence
  chemically synthesized
gatctaagttatctgtcctt

SEQ ID NO: 603795 - DNA, 20 bp, Artificial Sequence
  chemically synthesized
tccttagcagcttatggcat

SEQ ID NO: 603796 - DNA, 20 bp, Artificial Sequence
  chemically synthesized
tttctcctctaagatgctca

SEQ ID NO: 603797 - DNA, 20 bp, Artificial Sequence
  chemically synthesized
tacattacatatttacttaa

SEQ ID NO: 603798 - DNA, 20 bp, Artificial Sequence
  chemically synthesized
tgtaaatatcaagaaagaca

SEQ ID NO: 603799 - DNA, 20 bp, Artificial Sequence
  chemically synthesized
tattttttctttcatctgta

SEQ ID NO: 603800 - DNA, 20 bp, Artificial Sequence
  chemically synthesized
actcaaagaacatcacttta

SEQ ID NO: 603801 - DNA, 20 bp, Artificial Sequence
  chemically synthesized
gagttatcttctcctatcag

SEQ ID NO: 603802 - DNA, 20 bp, Artificial Sequence
  chemically synthesized
gggtttctattttatctaca

SEQ ID NO: 603803 - DNA, 20 bp, Artificial Sequence
  chemically synthesized
ctattttatctacattgagc

SEQ ID NO: 603804 - DNA, 20 bp, Artificial Sequence
  chemically synthesized
tatctacattgagcttttgc

SEQ ID NO: 603805 - DNA, 20 bp, Artificial Sequence
  chemically synthesized
atcatcataatctctttatt

SEQ ID NO: 603806 - DNA, 20 bp, Artificial Sequence
  chemically synthesized
attctagtaagcttagaata

SEQ ID NO: 603807 - DNA, 20 bp, Artificial Sequence
  chemically synthesized
agtaatattaattgattcta

SEQ ID NO: 603808 - DNA, 20 bp, Artificial Sequence
  chemically synthesized
tgttctctgttagtaatatt

SEQ ID NO: 603809 - DNA, 20 bp, Artificial Sequence
  chemically synthesized
gattcctgagatattcaaat

SEQ ID NO: 603810 - DNA, 20 bp, Artificial Sequence
  chemically synthesized
aacaagatattaaaggtcaa

SEQ ID NO: 603811 - DNA, 20 bp, Artificial Sequence
  chemically synthesized
atagtacctactttatagat

SEQ ID NO: 603812 - DNA, 20 bp, Artificial Sequence
  chemically synthesized
gaaagtaatagtacctactt

SEQ ID NO: 603813 - DNA, 20 bp, Artificial Sequence
  chemically synthesized
aggagggaagtgaggcacag

SEQ ID NO: 603814 - DNA, 20 bp, Artificial Sequence
  chemically synthesized
tattttcaatgtggctattg

SEQ ID NO: 603815 - DNA, 20 bp, Artificial Sequence
  chemically synthesized
atgcaatagccacattgaaa

SEQ ID NO: 603816 - DNA, 20 bp, Artificial Sequence
  chemically synthesized
gattccttatactaccaaat

SEQ ID NO: 603817 - DNA, 20 bp, Artificial Sequence
  chemically synthesized
tataaaatggtatacaacaa

SEQ ID NO: 603818 - DNA, 20 bp, Artificial Sequence
  chemically synthesized
caagagaaaactgagcatca

SEQ ID NO: 603819 - DNA, 20 bp, Artificial Sequence
  chemically synthesized
acgatttaatcttactgatg

SEQ ID NO: 603820 - DNA, 20 bp, Artificial Sequence
  chemically synthesized
ctaatatgatgacctttgat

SEQ ID NO: 603821 - DNA, 20 bp, Artificial Sequence
  chemically synthesized
tatcaaaggtcatcatatta

SEQ ID NO: 603822 - DNA, 20 bp, Artificial Sequence
  chemically synthesized
aggtcatcatattaggaagt

SEQ ID NO: 603823 - DNA, 20 bp, Artificial Sequence
  chemically synthesized
cctgctcttctacttataat

SEQ ID NO: 603824 - DNA, 20 bp, Artificial Sequence
  chemically synthesized
agaatatatatcagagcaaa

SEQ ID NO: 603825 - DNA, 20 bp, Artificial Sequence
  chemically synthesized
atatcagagcaaacagagct

SEQ ID NO: 603826 - DNA, 20 bp, Artificial Sequence
  chemically synthesized
taatacatccaaactataag

SEQ ID NO: 603827 - DNA, 20 bp, Artificial Sequence
  chemically synthesized
atggtctctgacagtctata

SEQ ID NO: 603828 - DNA, 20 bp, Artificial Sequence
  chemically synthesized
gtctctttatgcaccagtta

SEQ ID NO: 603829 - DNA, 20 bp, Artificial Sequence
  chemically synthesized
acaaatatgcagataccatt

SEQ ID NO: 603830 - DNA, 20 bp, Artificial Sequence
  chemically synthesized
ctacagctgtgtctgaaatg

SEQ ID NO: 603831 - DNA, 20 bp, Artificial Sequence
  chemically synthesized
tttcagacacagctgtagat

SEQ ID NO: 603832 - DNA, 20 bp, Artificial Sequence
  chemically synthesized
gctgttatcagttctgtctc

SEQ ID NO: 603833 - DNA, 20 bp, Artificial Sequence
  chemically synthesized
cctaccatgtgggacttctg

SEQ ID NO: 603834 - DNA, 20 bp, Artificial Sequence
  chemically synthesized
ctcattttgggaaataaata

SEQ ID NO: 603835 - DNA, 20 bp, Artificial Sequence
  chemically synthesized
ctatttatttcccaaaatga

SEQ ID NO: 603836 - DNA, 20 bp, Artificial Sequence
  chemically synthesized
ggaataattaagctgagaaa

SEQ ID NO: 603837 - DNA, 20 bp, Artificial Sequence
  chemically synthesized
gcttatgtcaaaccattttt

SEQ ID NO: 603838 - DNA, 20 bp, Artificial Sequence
  chemically synthesized
ttcagtttgtcgggtatagt

SEQ ID NO: 603839 - DNA, 20 bp, Artificial Sequence
  chemically synthesized
taagtagaatgagcacatat

SEQ ID NO: 603840 - DNA, 20 bp, Artificial Sequence
  chemically synthesized
aaagtttcctaaatttcttt

SEQ ID NO: 603841 - DNA, 20 bp, Artificial Sequence
  chemically synthesized
gtctcaaaaagaaaaaaaaa

SEQ ID NO: 603842 - DNA, 20 bp, Artificial Sequence
  chemically synthesized
gaggcggagcttgcagtgag

SEQ ID NO: 603843 - DNA, 20 bp, Artificial Sequence
  chemically synthesized
aatggcgtgaacccgggagg

SEQ ID NO: 603844 - DNA, 20 bp, Artificial Sequence
  chemically synthesized
ttttgtatttttagtagaga

SEQ ID NO: 603845 - DNA, 20 bp, Artificial Sequence
  chemically synthesized
cgcctcgacctcccaaagtg

SEQ ID NO: 603846 - DNA, 20 bp, Artificial Sequence
  chemically synthesized
ctcatcatctcttgtgtcaa

SEQ ID NO: 603847 - DNA, 20 bp, Artificial Sequence
  chemically synthesized
ggagaaatggcgattttcag

SEQ ID NO: 603848 - DNA, 20 bp, Artificial Sequence
  chemically synthesized
tggccagatcccaggagaaa

SEQ ID NO: 603849 - DNA, 20 bp, Artificial Sequence
  chemically synthesized
ctcaaatgaaatatatgaac

SEQ ID NO: 603850 - DNA, 20 bp, Artificial Sequence
  chemically synthesized
tttttggtttttgtgctttt

SEQ ID NO: 603851 - DNA, 20 bp, Artificial Sequence
  chemically synthesized
ttagactttgtttttggttt

SEQ ID NO: 603852 - DNA, 20 bp, Artificial Sequence
  chemically synthesized
atatctctttagactttgtt

SEQ ID NO: 603853 - DNA, 20 bp, Artificial Sequence
  chemically synthesized
gcaaaatatatctctttaga

SEQ ID NO: 603854 - DNA, 20 bp, Artificial Sequence
  chemically synthesized
agtttttgtttttgttttga

SEQ ID NO: 603855 - DNA, 20 bp, Artificial Sequence
  chemically synthesized
atgtgagagccagtttttgt

SEQ ID NO: 603856 - DNA, 20 bp, Artificial Sequence
  chemically synthesized
gaatagatgtgagagccagt

SEQ ID NO: 603857 - DNA, 20 bp, Artificial Sequence
  chemically synthesized
gtaagagaatagatgtgaga

SEQ ID NO: 603858 - DNA, 20 bp, Artificial Sequence
  chemically synthesized
ccaatggtgagactgataag

SEQ ID NO: 603859 - DNA, 20 bp, Artificial Sequence
  chemically synthesized
gaacatcagtcattgaatgc

SEQ ID NO: 603860 - DNA, 20 bp, Artificial Sequence
  chemically synthesized
agttctcactttacctatca

SEQ ID NO: 603861 - DNA, 20 bp, Artificial Sequence
  chemically synthesized
tcactttacctatcaccatg

SEQ ID NO: 603862 - DNA, 20 bp, Artificial Sequence
  chemically synthesized
ctatcaccatgatttgattg

SEQ ID NO: 603863 - DNA, 20 bp, Artificial Sequence
  chemically synthesized
ttcttagaagtatttgctaa

SEQ ID NO: 603864 - DNA, 20 bp, Artificial Sequence
  chemically synthesized
ggcttcacgtactacttgaa

SEQ ID NO: 603865 - DNA, 20 bp, Artificial Sequence
  chemically synthesized
tccaaagtgcgagctcaggg

SEQ ID NO: 603866 - DNA, 20 bp, Artificial Sequence
  chemically synthesized
ggagtgtcctaggcctcaat

SEQ ID NO: 603867 - DNA, 20 bp, Artificial Sequence
  chemically synthesized
aggcctcaatctgtgttttc

SEQ ID NO: 603868 - DNA, 20 bp, Artificial Sequence
  chemically synthesized
ttggcctaaacaaaggaaaa

SEQ ID NO: 603869 - DNA, 20 bp, Artificial Sequence
  chemically synthesized
agagagaggggagtggagga

SEQ ID NO: 603870 - DNA, 20 bp, Artificial Sequence
  chemically synthesized
cttgagagagagaggggagt

SEQ ID NO: 603871 - DNA, 20 bp, Artificial Sequence
  chemically synthesized
actttgtgatggattgaatg

SEQ ID NO: 603872 - DNA, 20 bp, Artificial Sequence
  chemically synthesized
tagagccaacaggactttgt

SEQ ID NO: 603873 - DNA, 20 bp, Artificial Sequence
  chemically synthesized
catgataactcactttctgg

SEQ ID NO: 603874 - DNA, 20 bp, Artificial Sequence
  chemically synthesized
ccatcatctctgaggggtat

SEQ ID NO: 603875 - DNA, 20 bp, Artificial Sequence
  chemically synthesized
tttatatttcaccctttgtt

SEQ ID NO: 603876 - DNA, 20 bp, Artificial Sequence
  chemically synthesized
caacacagcagacagagaca

SEQ ID NO: 603877 - DNA, 20 bp, Artificial Sequence
  chemically synthesized
gatcagaccatggtaaggac

SEQ ID NO: 603878 - DNA, 20 bp, Artificial Sequence
  chemically synthesized
aattcttctgctgctaaaca

SEQ ID NO: 603879 - DNA, 20 bp, Artificial Sequence
  chemically synthesized
tggctgcagcagaaaaatca

SEQ ID NO: 603880 - DNA, 20 bp, Artificial Sequence
  chemically synthesized
gtgatttttctgctgcagcc

SEQ ID NO: 603881 - DNA, 20 bp, Artificial Sequence
  chemically synthesized
aataaaatgagagggtatgc

SEQ ID NO: 603882 - DNA, 20 bp, Artificial Sequence
  chemically synthesized
gaacttatcactaacattcc

SEQ ID NO: 603883 - DNA, 20 bp, Artificial Sequence
  chemically synthesized
ccacatgctttacatattag

SEQ ID NO: 603884 - DNA, 20 bp, Artificial Sequence
  chemically synthesized
gataaggatacctgacctta

SEQ ID NO: 603885 - DNA, 20 bp, Artificial Sequence
  chemically synthesized
gcaaattcataacgaactct

SEQ ID NO: 603886 - DNA, 20 bp, Artificial Sequence
  chemically synthesized
tgcagcacctgtccccatgt

SEQ ID NO: 603887 - DNA, 20 bp, Artificial Sequence
  chemically synthesized
tttaatccatccttccttta

SEQ ID NO: 603888 - DNA, 20 bp, Artificial Sequence
  chemically synthesized
tgcaagctcagtaaaggaag

SEQ ID NO: 603889 - DNA, 20 bp, Artificial Sequence
  chemically synthesized
aatatgcagtttctagaata

SEQ ID NO: 603890 - DNA, 20 bp, Artificial Sequence
  chemically synthesized
gcccaactccctaactaata

SEQ ID NO: 603891 - DNA, 20 bp, Artificial Sequence
  chemically synthesized
tctttcttttctacttaggt

SEQ ID NO: 603892 - DNA, 20 bp, Artificial Sequence
  chemically synthesized
gattctaccaagttttgact

SEQ ID NO: 603893 - DNA, 20 bp, Artificial Sequence
  chemically synthesized
aacagagaggtaagattcta

SEQ ID NO: 603894 - DNA, 20 bp, Artificial Sequence
  chemically synthesized
aacttggtagaatcttacct

SEQ ID NO: 603895 - DNA, 20 bp, Artificial Sequence
  chemically synthesized
catgaaataaaaacagagag

SEQ ID NO: 603896 - DNA, 20 bp, Artificial Sequence
  chemically synthesized
actgtatatatacccctttc

SEQ ID NO: 603897 - DNA, 20 bp, Artificial Sequence
  chemically synthesized
tgccttggcctcccaaagtg

SEQ ID NO: 603898 - DNA, 20 bp, Artificial Sequence
  chemically synthesized
ttttgtatttttagtagaga

SEQ ID NO: 603899 - DNA, 20 bp, Artificial Sequence
  chemically synthesized
tcgggaggctgaggcaggag

SEQ ID NO: 603900 - DNA, 20 bp, Artificial Sequence
  chemically synthesized
aacttctgtctcccgggttc

SEQ ID NO: 603901 - DNA, 20 bp, Artificial Sequence
  chemically synthesized
gagacagaagttgcagtgag

SEQ ID NO: 603902 - DNA, 20 bp, Artificial Sequence
  chemically synthesized
aattttcttcttgttaggaa

SEQ ID NO: 603903 - DNA, 20 bp, Artificial Sequence
  chemically synthesized
ggcaatttcgaggaggtaat

SEQ ID NO: 603904 - DNA, 20 bp, Artificial Sequence
  chemically synthesized
atttcgtcctcatgaagtca

SEQ ID NO: 603905 - DNA, 20 bp, Artificial Sequence
  chemically synthesized
gtcatccagcttttctgtat

SEQ ID NO: 603906 - DNA, 20 bp, Artificial Sequence
  chemically synthesized
gtatgtgtgtttttctatag

SEQ ID NO: 603907 - DNA, 20 bp, Artificial Sequence
  chemically synthesized
gttatgaaatatagatcctt

SEQ ID NO: 603908 - DNA, 20 bp, Artificial Sequence
  chemically synthesized
aggatctatatttcataaca

SEQ ID NO: 603909 - DNA, 20 bp, Artificial Sequence
  chemically synthesized
tactaaatactttactcaat

SEQ ID NO: 603910 - DNA, 20 bp, Artificial Sequence
  chemically synthesized
tatatgcttaatatatgatc

SEQ ID NO: 603911 - DNA, 20 bp, Artificial Sequence
  chemically synthesized
cacatgtttagaagccacta

SEQ ID NO: 603912 - DNA, 20 bp, Artificial Sequence
  chemically synthesized
aaataatttagaatccgagt

SEQ ID NO: 603913 - DNA, 20 bp, Artificial Sequence
  chemically synthesized
attgatttactgatgccttt

SEQ ID NO: 603914 - DNA, 20 bp, Artificial Sequence
  chemically synthesized
ataatcactcatttctgata

SEQ ID NO: 603915 - DNA, 20 bp, Artificial Sequence
  chemically synthesized
taaatcaatgtatcagaaat

SEQ ID NO: 603916 - DNA, 20 bp, Artificial Sequence
  chemically synthesized
gaacttccctgtgttgtatt

SEQ ID NO: 603917 - DNA, 20 bp, Artificial Sequence
  chemically synthesized
agttcacaaattcctcaata

SEQ ID NO: 603918 - DNA, 20 bp, Artificial Sequence
  chemically synthesized
aggaggaacagaggtctgaa

SEQ ID NO: 603919 - DNA, 20 bp, Artificial Sequence
  chemically synthesized
ttagagaagatacagaaaga

SEQ ID NO: 603920 - DNA, 20 bp, Artificial Sequence
  chemically synthesized
tcattatagaatgttaaatg

SEQ ID NO: 603921 - DNA, 20 bp, Artificial Sequence
  chemically synthesized
actcatttaacattctataa

SEQ ID NO: 603922 - DNA, 20 bp, Artificial Sequence
  chemically synthesized
gaagagtaacttattcactc

SEQ ID NO: 603923 - DNA, 20 bp, Artificial Sequence
  chemically synthesized
aaatgtttaactatatggat

SEQ ID NO: 603924 - DNA, 20 bp, Artificial Sequence
  chemically synthesized
atccatatagttaaacattt

SEQ ID NO: 603925 - DNA, 20 bp, Artificial Sequence
  chemically synthesized
tgcctaacacacaaaccaat

SEQ ID NO: 603926 - DNA, 20 bp, Artificial Sequence
  chemically synthesized
tttggttttatgtgtgtgtg

SEQ ID NO: 603927 - DNA, 20 bp, Artificial Sequence
  chemically synthesized
gtggctttggttttatgtgt

SEQ ID NO: 603928 - DNA, 20 bp, Artificial Sequence
  chemically synthesized
ggacttgaacgtgaagtggc

SEQ ID NO: 603929 - DNA, 20 bp, Artificial Sequence
  chemically synthesized
aaatcaggacttgaacgtga

SEQ ID NO: 603930 - DNA, 20 bp, Artificial Sequence
  chemically synthesized
aaagccacttcacgttcaag

SEQ ID NO: 603931 - DNA, 20 bp, Artificial Sequence
  chemically synthesized
attttcatttcaattccatt

SEQ ID NO: 603932 - DNA, 20 bp, Artificial Sequence
  chemically synthesized
tgaaatgaaaatggctagaa

SEQ ID NO: 603933 - DNA, 20 bp, Artificial Sequence
  chemically synthesized
aaagcctacaatgatctaat

SEQ ID NO: 603934 - DNA, 20 bp, Artificial Sequence
  chemically synthesized
taaacaaaaattagatcatt

SEQ ID NO: 603935 - DNA, 20 bp, Artificial Sequence
  chemically synthesized
tttgtaggttatcaaagtta

SEQ ID NO: 603936 - DNA, 20 bp, Artificial Sequence
  chemically synthesized
gtctctaagagtatgttaga

SEQ ID NO: 603937 - DNA, 20 bp, Artificial Sequence
  chemically synthesized
acacaagcccacatcttaaa

SEQ ID NO: 603938 - DNA, 20 bp, Artificial Sequence
  chemically synthesized
gaaaaagcttattttaagat

SEQ ID NO: 603939 - DNA, 20 bp, Artificial Sequence
  chemically synthesized
gatagggggcatcaaggaag

SEQ ID NO: 603940 - DNA, 20 bp, Artificial Sequence
  chemically synthesized
ggggcatcaaggaagtgggg

SEQ ID NO: 603941 - DNA, 20 bp, Artificial Sequence
  chemically synthesized
atcaaggaagtggggctttg

SEQ ID NO: 603942 - DNA, 20 bp, Artificial Sequence
  chemically synthesized
ggaatgcagagaggctaaag

SEQ ID NO: 603943 - DNA, 20 bp, Artificial Sequence
  chemically synthesized
cattatgcttctttactaaa

SEQ ID NO: 603944 - DNA, 20 bp, Artificial Sequence
  chemically synthesized
atcttcattaatgtgacaca

SEQ ID NO: 603945 - DNA, 20 bp, Artificial Sequence
  chemically synthesized
agggatatttggtcattagg

SEQ ID NO: 603946 - DNA, 20 bp, Artificial Sequence
  chemically synthesized
ttcttttttactgtattaag

SEQ ID NO: 603947 - DNA, 20 bp, Artificial Sequence
  chemically synthesized
aagatatgattacaaagtgg

SEQ ID NO: 603948 - DNA, 20 bp, Artificial Sequence
  chemically synthesized
acaaagtggtcttgctttta

SEQ ID NO: 603949 - DNA, 20 bp, Artificial Sequence
  chemically synthesized
gagctggcttggcacttcag

SEQ ID NO: 603950 - DNA, 20 bp, Artificial Sequence
  chemically synthesized
tcagctactgatagccagga

SEQ ID NO: 603951 - DNA, 20 bp, Artificial Sequence
  chemically synthesized
gccagctcctggctatcagt

SEQ ID NO: 603952 - DNA, 20 bp, Artificial Sequence
  chemically synthesized
tagctgattttatctttctc

SEQ ID NO: 603953 - DNA, 20 bp, Artificial Sequence
  chemically synthesized
tcagtatgatcttgttatgt

SEQ ID NO: 603954 - DNA, 20 bp, Artificial Sequence
  chemically synthesized
cagacataacaagatcatac

SEQ ID NO: 603955 - DNA, 20 bp, Artificial Sequence
  chemically synthesized
tcatactgaggttttaatat

SEQ ID NO: 603956 - DNA, 20 bp, Artificial Sequence
  chemically synthesized
tactaatgttatattccttt

SEQ ID NO: 603957 - DNA, 20 bp, Artificial Sequence
  chemically synthesized
agtagcagggaagaccagct

SEQ ID NO: 603958 - DNA, 20 bp, Artificial Sequence
  chemically synthesized
aaatagaagtaagccatgat

SEQ ID NO: 603959 - DNA, 20 bp, Artificial Sequence
  chemically synthesized
accctgattaaagctaatat

SEQ ID NO: 603960 - DNA, 20 bp, Artificial Sequence
  chemically synthesized
gccatgatattagctttaat

SEQ ID NO: 603961 - DNA, 20 bp, Artificial Sequence
  chemically synthesized
ctctattcccatcaccaaaa

SEQ ID NO: 603962 - DNA, 20 bp, Artificial Sequence
  chemically synthesized
tttcaagagctgttaaggga

SEQ ID NO: 603963 - DNA, 20 bp, Artificial Sequence
  chemically synthesized
gcaggattaattgaacctgt

SEQ ID NO: 603964 - DNA, 20 bp, Artificial Sequence
  chemically synthesized
cctgaaagtgaactgggtca

SEQ ID NO: 603965 - DNA, 20 bp, Artificial Sequence
  chemically synthesized
ctaggtgacccagttcactt

SEQ ID NO: 603966 - DNA, 20 bp, Artificial Sequence
  chemically synthesized
acccagttcactttcaggtt

SEQ ID NO: 603967 - DNA, 20 bp, Artificial Sequence
  chemically synthesized
actttcaggtttctggatta

SEQ ID NO: 603968 - DNA, 20 bp, Artificial Sequence
  chemically synthesized
aaaggaggtctggggaaata

SEQ ID NO: 603969 - DNA, 20 bp, Artificial Sequence
  chemically synthesized
gcctaatagacaattttaat

SEQ ID NO: 603970 - DNA, 20 bp, Artificial Sequence
  chemically synthesized
aggcagtcagatatatcacc

SEQ ID NO: 603971 - DNA, 20 bp, Artificial Sequence
  chemically synthesized
attgatattcttcagagtcc

SEQ ID NO: 603972 - DNA, 20 bp, Artificial Sequence
  chemically synthesized
ttcttggccatttgttccaa

SEQ ID NO: 603973 - DNA, 20 bp, Artificial Sequence
  chemically synthesized
gcttatgggatactgctttc

SEQ ID NO: 603974 - DNA, 20 bp, Artificial Sequence
  chemically synthesized
tcctcgcttggcttatggga

SEQ ID NO: 603975 - DNA, 20 bp, Artificial Sequence
  chemically synthesized
ctcatgaaattctttcctcg

SEQ ID NO: 603976 - DNA, 20 bp, Artificial Sequence
  chemically synthesized
tttccctcatgaaattcttt

SEQ ID NO: 603977 - DNA, 20 bp, Artificial Sequence
  chemically synthesized
taataggttctagttctaca

SEQ ID NO: 603978 - DNA, 20 bp, Artificial Sequence
  chemically synthesized
ggcacgttaagtattcacat

SEQ ID NO: 603979 - DNA, 20 bp, Artificial Sequence
  chemically synthesized
ttctaaaagatgaaaacaca

SEQ ID NO: 603980 - DNA, 20 bp, Artificial Sequence
  chemically synthesized
atcattagcttttaaaccgg

SEQ ID NO: 603981 - DNA, 20 bp, Artificial Sequence
  chemically synthesized
ctacatcccaggtctttatc

SEQ ID NO: 603982 - DNA, 20 bp, Artificial Sequence
  chemically synthesized
ctaatgataaagacctggga

SEQ ID NO: 603983 - DNA, 20 bp, Artificial Sequence
  chemically synthesized
tggttccattcagctgtata

SEQ ID NO: 603984 - DNA, 20 bp, Artificial Sequence
  chemically synthesized
tatacagctgaatggaacca

SEQ ID NO: 603985 - DNA, 20 bp, Artificial Sequence
  chemically synthesized
ctttccccatcattcacagt

SEQ ID NO: 603986 - DNA, 20 bp, Artificial Sequence
  chemically synthesized
catttactgtgaatgatggg

SEQ ID NO: 603987 - DNA, 20 bp, Artificial Sequence
  chemically synthesized
ggaaagtttaggtaccccac

SEQ ID NO: 603988 - DNA, 20 bp, Artificial Sequence
  chemically synthesized
agtttctctcaacaattatt

SEQ ID NO: 603989 - DNA, 20 bp, Artificial Sequence
  chemically synthesized
catcctaagtatattttcaa

SEQ ID NO: 603990 - DNA, 20 bp, Artificial Sequence
  chemically synthesized
aaatatacttaggatgcacg

SEQ ID NO: 603991 - DNA, 20 bp, Artificial Sequence
  chemically synthesized
aacaaaaccagcagttcttc

SEQ ID NO: 603992 - DNA, 20 bp, Artificial Sequence
  chemically synthesized
cggaaagcttatgaagaact

SEQ ID NO: 603993 - DNA, 20 bp, Artificial Sequence
  chemically synthesized
cgcctcggcctcccaaagtg

SEQ ID NO: 603994 - DNA, 20 bp, Artificial Sequence
  chemically synthesized
ttttgtatttttagtagaga

SEQ ID NO: 603995 - DNA, 20 bp, Artificial Sequence
  chemically synthesized
gcgcccgccaccacacccgg

SEQ ID NO: 603996 - DNA, 20 bp, Artificial Sequence
  chemically synthesized
aacggcgtgaacccgggagg

SEQ ID NO: 603997 - DNA, 20 bp, Artificial Sequence
  chemically synthesized
ggcattactccatttcttta

SEQ ID NO: 603998 - DNA, 20 bp, Artificial Sequence
  chemically synthesized
ctcaattcagctacctgctg

SEQ ID NO: 603999 - DNA, 20 bp, Artificial Sequence
  chemically synthesized
attgaggagatgagagaaac

SEQ ID NO: 604000 - DNA, 20 bp, Artificial Sequence
  chemically synthesized
ctcctgctatcactaaaagc

SEQ ID NO: 604001 - DNA, 20 bp, Artificial Sequence
  chemically synthesized
gaagactttggcactaggtt

SEQ ID NO: 604002 - DNA, 20 bp, Artificial Sequence
  chemically synthesized
aaaagagggatgagtcatag

SEQ ID NO: 604003 - DNA, 20 bp, Artificial Sequence
  chemically synthesized
gtgctgttttcgagggtaaa

SEQ ID NO: 604004 - DNA, 20 bp, Artificial Sequence
  chemically synthesized
atgagtagaataagtatata

SEQ ID NO: 604005 - DNA, 20 bp, Artificial Sequence
  chemically synthesized
atagaaggcttgtcttgaaa

SEQ ID NO: 604006 - DNA, 20 bp, Artificial Sequence
  chemically synthesized
tcttttccttgcttcacttc

SEQ ID NO: 604007 - DNA, 20 bp, Artificial Sequence
  chemically synthesized
gctctattgcactttctttt

SEQ ID NO: 604008 - DNA, 20 bp, Artificial Sequence
  chemically synthesized
atttctcctatctctgttat

SEQ ID NO: 604009 - DNA, 20 bp, Artificial Sequence
  chemically synthesized
aggagaaattggaagcatta

SEQ ID NO: 604010 - DNA, 20 bp, Artificial Sequence
  chemically synthesized
attggaagcattaactggct

SEQ ID NO: 604011 - DNA, 20 bp, Artificial Sequence
  chemically synthesized
ctggaaatcatcaagccagt

SEQ ID NO: 604012 - DNA, 20 bp, Artificial Sequence
  chemically synthesized
tccagcgggagttggtaaaa

SEQ ID NO: 604013 - DNA, 20 bp, Artificial Sequence
  chemically synthesized
gggctcttcctcggatctgc

SEQ ID NO: 604014 - DNA, 20 bp, Artificial Sequence
  chemically synthesized
ctatcaagtcgttatggtca

SEQ ID NO: 604015 - DNA, 20 bp, Artificial Sequence
  chemically synthesized
gaccataacgacttgatagg

SEQ ID NO: 604016 - DNA, 20 bp, Artificial Sequence
  chemically synthesized
caagagaacctcacagaagc

SEQ ID NO: 604017 - DNA, 20 bp, Artificial Sequence
  chemically synthesized
tgataaggtgtctgaaaatc

SEQ ID NO: 604018 - DNA, 20 bp, Artificial Sequence
  chemically synthesized
aatagcctcctttgatcaca

SEQ ID NO: 604019 - DNA, 20 bp, Artificial Sequence
  chemically synthesized
tgatcaaaggaggctatttt

SEQ ID NO: 604020 - DNA, 20 bp, Artificial Sequence
  chemically synthesized
caaaggaggctatttttttt

SEQ ID NO: 604021 - DNA, 20 bp, Artificial Sequence
  chemically synthesized
tcagactttttagctgaatt

SEQ ID NO: 604022 - DNA, 20 bp, Artificial Sequence
  chemically synthesized
aggtaactgctacgtaaagc

SEQ ID NO: 604023 - DNA, 20 bp, Artificial Sequence
  chemically synthesized
caatattctaggacacaatc

SEQ ID NO: 604024 - DNA, 20 bp, Artificial Sequence
  chemically synthesized
cccaagattgtgtcctagaa

SEQ ID NO: 604025 - DNA, 20 bp, Artificial Sequence
  chemically synthesized
tgcctttgaacattttccag

SEQ ID NO: 604026 - DNA, 20 bp, Artificial Sequence
  chemically synthesized
ggaaaatgttcaaaggcaaa

SEQ ID NO: 604027 - DNA, 20 bp, Artificial Sequence
  chemically synthesized
caaattttgatttactagtt

SEQ ID NO: 604028 - DNA, 20 bp, Artificial Sequence
  chemically synthesized
caccaatattgacattatct

SEQ ID NO: 604029 - DNA, 20 bp, Artificial Sequence
  chemically synthesized
atattggtggtccagggaca

SEQ ID NO: 604030 - DNA, 20 bp, Artificial Sequence
  chemically synthesized
attagaaaggtcccccagaa

SEQ ID NO: 604031 - DNA, 20 bp, Artificial Sequence
  chemically synthesized
tttttccttgtatattcacc

SEQ ID NO: 604032 - DNA, 20 bp, Artificial Sequence
  chemically synthesized
gtgaatatacaaggaaaaaa

SEQ ID NO: 604033 - DNA, 20 bp, Artificial Sequence
  chemically synthesized
atacaaggaaaaaattatgc

SEQ ID NO: 604034 - DNA, 20 bp, Artificial Sequence
  chemically synthesized
tttcttcatttactcctttc

SEQ ID NO: 604035 - DNA, 20 bp, Artificial Sequence
  chemically synthesized
taccaactcttttttttttc

SEQ ID NO: 604036 - DNA, 20 bp, Artificial Sequence
  chemically synthesized
atttttaatgaaagcctaaa

SEQ ID NO: 604037 - DNA, 20 bp, Artificial Sequence
  chemically synthesized
tgagtggtattaatccattt

SEQ ID NO: 604038 - DNA, 20 bp, Artificial Sequence
  chemically synthesized
gttcatgacacgagcctgcc

SEQ ID NO: 604039 - DNA, 20 bp, Artificial Sequence
  chemically synthesized
attttcttactacatcacct

SEQ ID NO: 604040 - DNA, 20 bp, Artificial Sequence
  chemically synthesized
cataattacgatgatggata

SEQ ID NO: 604041 - DNA, 20 bp, Artificial Sequence
  chemically synthesized
tcgtaattatgtatttctct

SEQ ID NO: 604042 - DNA, 20 bp, Artificial Sequence
  chemically synthesized
ggacatgaaatgatttacct

SEQ ID NO: 604043 - DNA, 20 bp, Artificial Sequence
  chemically synthesized
gcctactaaaatgggacatg

SEQ ID NO: 604044 - DNA, 20 bp, Artificial Sequence
  chemically synthesized
aaaatgtacagtgttttata

SEQ ID NO: 604045 - DNA, 20 bp, Artificial Sequence
  chemically synthesized
taaaagtgctcaaaaatgta

SEQ ID NO: 604046 - DNA, 20 bp, Artificial Sequence
  chemically synthesized
gttatcatgtggttacctat

SEQ ID NO: 604047 - DNA, 20 bp, Artificial Sequence
  chemically synthesized
gctttgatcaggcaggaaaa

SEQ ID NO: 604048 - DNA, 20 bp, Artificial Sequence
  chemically synthesized
actctgtttctttatcttaa

SEQ ID NO: 604049 - DNA, 20 bp, Artificial Sequence
  chemically synthesized
tcacaggtttctgtctgata

SEQ ID NO: 604050 - DNA, 20 bp, Artificial Sequence
  chemically synthesized
tgattattgatctgattctc

SEQ ID NO: 604051 - DNA, 20 bp, Artificial Sequence
  chemically synthesized
ctaattaaaaatgattattg

SEQ ID NO: 604052 - DNA, 20 bp, Artificial Sequence
  chemically synthesized
gcattttattagctaattaa

SEQ ID NO: 604053 - DNA, 20 bp, Artificial Sequence
  chemically synthesized
attagctaataaaatgctaa

SEQ ID NO: 604054 - DNA, 20 bp, Artificial Sequence
  chemically synthesized
cagtggtcaaatatgtaaca

SEQ ID NO: 604055 - DNA, 20 bp, Artificial Sequence
  chemically synthesized
gtaacatgatgtttgaaaat

SEQ ID NO: 604056 - DNA, 20 bp, Artificial Sequence
  chemically synthesized
ctttgaaggtaaattgtttg

SEQ ID NO: 604057 - DNA, 20 bp, Artificial Sequence
  chemically synthesized
agtatacttctttgaaggta

SEQ ID NO: 604058 - DNA, 20 bp, Artificial Sequence
  chemically synthesized
tctacaattatatattatct

SEQ ID NO: 604059 - DNA, 20 bp, Artificial Sequence
  chemically synthesized
cattataatagactattcta

SEQ ID NO: 604060 - DNA, 20 bp, Artificial Sequence
  chemically synthesized
aaagctattttaaattactt

SEQ ID NO: 604061 - DNA, 20 bp, Artificial Sequence
  chemically synthesized
aaagctaataagtaatttaa

SEQ ID NO: 604062 - DNA, 20 bp, Artificial Sequence
  chemically synthesized
ctttttcaagcagcctaaaa

SEQ ID NO: 604063 - DNA, 20 bp, Artificial Sequence
  chemically synthesized
gaaaaaaaatctatttttta

SEQ ID NO: 604064 - DNA, 20 bp, Artificial Sequence
  chemically synthesized
ttccaaccccaacagcaaac

SEQ ID NO: 604065 - DNA, 20 bp, Artificial Sequence
  chemically synthesized
acattacctcagttacaagc

SEQ ID NO: 604066 - DNA, 20 bp, Artificial Sequence
  chemically synthesized
tgtcgtatttgtaaaaatac

SEQ ID NO: 604067 - DNA, 20 bp, Artificial Sequence
  chemically synthesized
aatacaatggattttgaact

SEQ ID NO: 604068 - DNA, 20 bp, Artificial Sequence
  chemically synthesized
attagctctgctttttctct

SEQ ID NO: 604069 - DNA, 20 bp, Artificial Sequence
  chemically synthesized
catctaaatgtgtatattag

SEQ ID NO: 604070 - DNA, 20 bp, Artificial Sequence
  chemically synthesized
aattacttttcattcataat

SEQ ID NO: 604071 - DNA, 20 bp, Artificial Sequence
  chemically synthesized
tcattcataatcactgcttc

SEQ ID NO: 604072 - DNA, 20 bp, Artificial Sequence
  chemically synthesized
aaatgggcaagctaaggaag

SEQ ID NO: 604073 - DNA, 20 bp, Artificial Sequence
  chemically synthesized
catctttgtatatgattggc

SEQ ID NO: 604074 - DNA, 20 bp, Artificial Sequence
  chemically synthesized
tataaaacatgcatctttgt

SEQ ID NO: 604075 - DNA, 20 bp, Artificial Sequence
  chemically synthesized
tgccaatcatatacaaagat

SEQ ID NO: 604076 - DNA, 20 bp, Artificial Sequence
  chemically synthesized
ttcatctttagggaaattgt

SEQ ID NO: 604077 - DNA, 20 bp, Artificial Sequence
  chemically synthesized
agttttattaatttaatata

SEQ ID NO: 604078 - DNA, 20 bp, Artificial Sequence
  chemically synthesized
aattttgaccttcacaaata

SEQ ID NO: 604079 - DNA, 20 bp, Artificial Sequence
  chemically synthesized
cagtatttacatgtggtagc

SEQ ID NO: 604080 - DNA, 20 bp, Artificial Sequence
  chemically synthesized
aaatatcttataatatatga

SEQ ID NO: 604081 - DNA, 20 bp, Artificial Sequence
  chemically synthesized
attctactctacacaattgt

SEQ ID NO: 604082 - DNA, 20 bp, Artificial Sequence
  chemically synthesized
tacctcaaggctaggcctta

SEQ ID NO: 604083 - DNA, 20 bp, Artificial Sequence
  chemically synthesized
aattttatgacattaattca

SEQ ID NO: 604084 - DNA, 20 bp, Artificial Sequence
  chemically synthesized
taaataatatgtaagttaag

SEQ ID NO: 604085 - DNA, 20 bp, Artificial Sequence
  chemically synthesized
gtcagtcacagaagaatcca

SEQ ID NO: 604086 - DNA, 20 bp, Artificial Sequence
  chemically synthesized
gtttagcctagagaaatctt

SEQ ID NO: 604087 - DNA, 20 bp, Artificial Sequence
  chemically synthesized
aaagatttctctaggctaaa

SEQ ID NO: 604088 - DNA, 20 bp, Artificial Sequence
  chemically synthesized
ttctctaggctaaactttga

SEQ ID NO: 604089 - DNA, 20 bp, Artificial Sequence
  chemically synthesized
ttttagatagcaagcaaaat

SEQ ID NO: 604090 - DNA, 20 bp, Artificial Sequence
  chemically synthesized
attaatgcgatatgataaaa

SEQ ID NO: 604091 - DNA, 20 bp, Artificial Sequence
  chemically synthesized
tatctgtgattctactagtt

SEQ ID NO: 604092 - DNA, 20 bp, Artificial Sequence
  chemically synthesized
taaactccgtgctttgttat

SEQ ID NO: 604093 - DNA, 20 bp, Artificial Sequence
  chemically synthesized
gaatcacagataacaaagca

SEQ ID NO: 604094 - DNA, 20 bp, Artificial Sequence
  chemically synthesized
ttttgtgctgcttgtaaact

SEQ ID NO: 604095 - DNA, 20 bp, Artificial Sequence
  chemically synthesized
ttatatctgtactcattttg

SEQ ID NO: 604096 - DNA, 20 bp, Artificial Sequence
  chemically synthesized
tgagaagttgccttccttcc

SEQ ID NO: 604097 - DNA, 20 bp, Artificial Sequence
  chemically synthesized
gcaaattcaggactctgcaa

SEQ ID NO: 604098 - DNA, 20 bp, Artificial Sequence
  chemically synthesized
tgatataactgaacttcaca

SEQ ID NO: 604099 - DNA, 20 bp, Artificial Sequence
  chemically synthesized
aaaaaataaaagtcattatt

SEQ ID NO: 604100 - DNA, 20 bp, Artificial Sequence
  chemically synthesized
aagaatgataaatgtggata

SEQ ID NO: 604101 - DNA, 20 bp, Artificial Sequence
  chemically synthesized
tagaggtgtcaggcaggagt

SEQ ID NO: 604102 - DNA, 20 bp, Artificial Sequence
  chemically synthesized
taggtagactcaaatttgga

SEQ ID NO: 604103 - DNA, 20 bp, Artificial Sequence
  chemically synthesized
gcttacaggatatattgtag

SEQ ID NO: 604104 - DNA, 20 bp, Artificial Sequence
  chemically synthesized
cctgtaagctattacccagc

SEQ ID NO: 604105 - DNA, 20 bp, Artificial Sequence
  chemically synthesized
cattcaagcagaggctgggt

SEQ ID NO: 604106 - DNA, 20 bp, Artificial Sequence
  chemically synthesized
ctattacccagcctctgctt

SEQ ID NO: 604107 - DNA, 20 bp, Artificial Sequence
  chemically synthesized
ttggtggtcaccattgaaac

SEQ ID NO: 604108 - DNA, 20 bp, Artificial Sequence
  chemically synthesized
attggagactacagaaaagc

SEQ ID NO: 604109 - DNA, 20 bp, Artificial Sequence
  chemically synthesized
agtctccaatcatactgcct

SEQ ID NO: 604110 - DNA, 20 bp, Artificial Sequence
  chemically synthesized
cgtggccaaacccagaggca

SEQ ID NO: 604111 - DNA, 20 bp, Artificial Sequence
  chemically synthesized
aatagtaagagtactgcaag

SEQ ID NO: 604112 - DNA, 20 bp, Artificial Sequence
  chemically synthesized
actgcaagtaaggttttgag

SEQ ID NO: 604113 - DNA, 20 bp, Artificial Sequence
  chemically synthesized
tttgagaagtgcttgcatgt

SEQ ID NO: 604114 - DNA, 20 bp, Artificial Sequence
  chemically synthesized
gtacaatgaccttgaggtga

SEQ ID NO: 604115 - DNA, 20 bp, Artificial Sequence
  chemically synthesized
ggcctcttcacatggacaga

SEQ ID NO: 604116 - DNA, 20 bp, Artificial Sequence
  chemically synthesized
ttatttgcatgcctggtgcc

SEQ ID NO: 604117 - DNA, 20 bp, Artificial Sequence
  chemically synthesized
tggcattgagatgggtcaca

SEQ ID NO: 604118 - DNA, 20 bp, Artificial Sequence
  chemically synthesized
taggagaaataataaatagg

SEQ ID NO: 604119 - DNA, 20 bp, Artificial Sequence
  chemically synthesized
aacaactcacaccaaaatgt

SEQ ID NO: 604120 - DNA, 20 bp, Artificial Sequence
  chemically synthesized
aaaaaaaaaaaaaaaaaaaa

SEQ ID NO: 604121 - DNA, 20 bp, Artificial Sequence
  chemically synthesized
ataaattattcattctaatc

SEQ ID NO: 604122 - DNA, 20 bp, Artificial Sequence
  chemically synthesized
ggctcttctatacctaaatc

SEQ ID NO: 604123 - DNA, 20 bp, Artificial Sequence
  chemically synthesized
actattccattagacacttg

SEQ ID NO: 604124 - DNA, 20 bp, Artificial Sequence
  chemically synthesized
gaaaggctattcatagtctt

SEQ ID NO: 604125 - DNA, 20 bp, Artificial Sequence
  chemically synthesized
gtggtatttgtctttctaca

SEQ ID NO: 604126 - DNA, 20 bp, Artificial Sequence
  chemically synthesized
gatttttttttttttttttt

SEQ ID NO: 604127 - DNA, 20 bp, Artificial Sequence
  chemically synthesized
attgtcttctgtttctttta

SEQ ID NO: 604128 - DNA, 20 bp, Artificial Sequence
  chemically synthesized
gaacattgtcttctgtttct

SEQ ID NO: 604129 - DNA, 20 bp, Artificial Sequence
  chemically synthesized
tcctggaaatgaacattgtc

SEQ ID NO: 604130 - DNA, 20 bp, Artificial Sequence
  chemically synthesized
atctactgataaatttaaag

SEQ ID NO: 604131 - DNA, 20 bp, Artificial Sequence
  chemically synthesized
tacctgatcatcagcctacc

SEQ ID NO: 604132 - DNA, 20 bp, Artificial Sequence
  chemically synthesized
aattacttcaacggatattc

SEQ ID NO: 604133 - DNA, 20 bp, Artificial Sequence
  chemically synthesized
attctatggcttgttgttat

SEQ ID NO: 604134 - DNA, 20 bp, Artificial Sequence
  chemically synthesized
ccagaaagataattattctt

SEQ ID NO: 604135 - DNA, 20 bp, Artificial Sequence
  chemically synthesized
cagggaagaataattatctt

SEQ ID NO: 604136 - DNA, 20 bp, Artificial Sequence
  chemically synthesized
aatactttcattgatatagc

SEQ ID NO: 604137 - DNA, 20 bp, Artificial Sequence
  chemically synthesized
gtttatgtgaaaaaattcct

SEQ ID NO: 604138 - DNA, 20 bp, Artificial Sequence
  chemically synthesized
tgtgatataactggtttaat

SEQ ID NO: 604139 - DNA, 20 bp, Artificial Sequence
  chemically synthesized
agtaattaggttgtgatata

SEQ ID NO: 604140 - DNA, 20 bp, Artificial Sequence
  chemically synthesized
ggagttcaatagatcaggtc

SEQ ID NO: 604141 - DNA, 20 bp, Artificial Sequence
  chemically synthesized
tatgacctgatctattgaac

SEQ ID NO: 604142 - DNA, 20 bp, Artificial Sequence
  chemically synthesized
tgagaaattctaactggttt

SEQ ID NO: 604143 - DNA, 20 bp, Artificial Sequence
  chemically synthesized
aacaaatgtgagaaattcta

SEQ ID NO: 604144 - DNA, 20 bp, Artificial Sequence
  chemically synthesized
ttctcacatttgttgcaggc

SEQ ID NO: 604145 - DNA, 20 bp, Artificial Sequence
  chemically synthesized
tgtgttccattaatttctgt

SEQ ID NO: 604146 - DNA, 20 bp, Artificial Sequence
  chemically synthesized
aaatgcgaatatgtttttct

SEQ ID NO: 604147 - DNA, 20 bp, Artificial Sequence
  chemically synthesized
tgtgagaatataaaatgcga

SEQ ID NO: 604148 - DNA, 20 bp, Artificial Sequence
  chemically synthesized
cagctgcccataggatgaga

SEQ ID NO: 604149 - DNA, 20 bp, Artificial Sequence
  chemically synthesized
aatctgtatgctatgaaccg

SEQ ID NO: 604150 - DNA, 20 bp, Artificial Sequence
  chemically synthesized
aaacttgacggttcatagca

SEQ ID NO: 604151 - DNA, 20 bp, Artificial Sequence
  chemically synthesized
tgaaattaagagactaggga

SEQ ID NO: 604152 - DNA, 20 bp, Artificial Sequence
  chemically synthesized
acttactgacattcagtgac

SEQ ID NO: 604153 - DNA, 20 bp, Artificial Sequence
  chemically synthesized
gttatctgtgtatgcattac

SEQ ID NO: 604154 - DNA, 20 bp, Artificial Sequence
  chemically synthesized
gtgtatgcattacaaatgtt

SEQ ID NO: 604155 - DNA, 20 bp, Artificial Sequence
  chemically synthesized
atggatttttattgtgtcat

SEQ ID NO: 604156 - DNA, 20 bp, Artificial Sequence
  chemically synthesized
ctttcctacattttttatcc

SEQ ID NO: 604157 - DNA, 20 bp, Artificial Sequence
  chemically synthesized
cacaagtttgactatcaggt

SEQ ID NO: 604158 - DNA, 20 bp, Artificial Sequence
  chemically synthesized
tcctgtttcttcattcataa

SEQ ID NO: 604159 - DNA, 20 bp, Artificial Sequence
  chemically synthesized
aacatcgctgaagagagtgt

SEQ ID NO: 604160 - DNA, 20 bp, Artificial Sequence
  chemically synthesized
aatactctcctactatggtt

SEQ ID NO: 604161 - DNA, 20 bp, Artificial Sequence
  chemically synthesized
agatgattgaaatataattc

SEQ ID NO: 604162 - DNA, 20 bp, Artificial Sequence
  chemically synthesized
tgatgataaatatgcataaa

SEQ ID NO: 604163 - DNA, 20 bp, Artificial Sequence
  chemically synthesized
atgtcttaaaacatttttat

SEQ ID NO: 604164 - DNA, 20 bp, Artificial Sequence
  chemically synthesized
ttgggccaaagcaaaaataa

SEQ ID NO: 604165 - DNA, 20 bp, Artificial Sequence
  chemically synthesized
tgtccaatatactggcaaat

SEQ ID NO: 604166 - DNA, 20 bp, Artificial Sequence
  chemically synthesized
aggggtgtcccttaaccagt

SEQ ID NO: 604167 - DNA, 20 bp, Artificial Sequence
  chemically synthesized
gagacactgtgtatcatact

SEQ ID NO: 604168 - DNA, 20 bp, Artificial Sequence
  chemically synthesized
agtgtctcaaggggttccct

SEQ ID NO: 604169 - DNA, 20 bp, Artificial Sequence
  chemically synthesized
tatttgtgccatactttatt

SEQ ID NO: 604170 - DNA, 20 bp, Artificial Sequence
  chemically synthesized
tttcttatttcacttcccta

SEQ ID NO: 604171 - DNA, 20 bp, Artificial Sequence
  chemically synthesized
ctgggatcactttccaaata

SEQ ID NO: 604172 - DNA, 20 bp, Artificial Sequence
  chemically synthesized
aagagaaggatttaggtgca

SEQ ID NO: 604173 - DNA, 20 bp, Artificial Sequence
  chemically synthesized
cccaagagtagatctgaaga

SEQ ID NO: 604174 - DNA, 20 bp, Artificial Sequence
  chemically synthesized
ttgaggctgttgattattgc

SEQ ID NO: 604175 - DNA, 20 bp, Artificial Sequence
  chemically synthesized
atgctaggttcatttgaggc

SEQ ID NO: 604176 - DNA, 20 bp, Artificial Sequence
  chemically synthesized
gatgggccagagctttgata

SEQ ID NO: 604177 - DNA, 20 bp, Artificial Sequence
  chemically synthesized
gctgcagaaagaggatgggc

SEQ ID NO: 604178 - DNA, 20 bp, Artificial Sequence
  chemically synthesized
agttctactctgataattgc

SEQ ID NO: 604179 - DNA, 20 bp, Artificial Sequence
  chemically synthesized
ggctacatatgcgggtctga

SEQ ID NO: 604180 - DNA, 20 bp, Artificial Sequence
  chemically synthesized
ctcattcccttcttttacat

SEQ ID NO: 604181 - DNA, 20 bp, Artificial Sequence
  chemically synthesized
actagaaattggatggactc

SEQ ID NO: 604182 - DNA, 20 bp, Artificial Sequence
  chemically synthesized
gagtccatccaatttctagt

SEQ ID NO: 604183 - DNA, 20 bp, Artificial Sequence
  chemically synthesized
gaggcagaggttgtggtgag

SEQ ID NO: 604184 - DNA, 20 bp, Artificial Sequence
  chemically synthesized
ttaacactgttgaccatact

SEQ ID NO: 604185 - DNA, 20 bp, Artificial Sequence
  chemically synthesized
ccgtttgtaatttttcttcc

SEQ ID NO: 604186 - DNA, 20 bp, Artificial Sequence
  chemically synthesized
gtgagagatagtagagtaga

SEQ ID NO: 604187 - DNA, 20 bp, Artificial Sequence
  chemically synthesized
aattcaaggcatgatgactg

SEQ ID NO: 604188 - DNA, 20 bp, Artificial Sequence
  chemically synthesized
ttgaattgcaatctatttat

SEQ ID NO: 604189 - DNA, 20 bp, Artificial Sequence
  chemically synthesized
acatatcagaatcattgata

SEQ ID NO: 604190 - DNA, 20 bp, Artificial Sequence
  chemically synthesized
accttggcatataatgttta

SEQ ID NO: 604191 - DNA, 20 bp, Artificial Sequence
  chemically synthesized
tctccttaaacattatatgc

SEQ ID NO: 604192 - DNA, 20 bp, Artificial Sequence
  chemically synthesized
aaactttaaaccttggcata

SEQ ID NO: 604193 - DNA, 20 bp, Artificial Sequence
  chemically synthesized
aaacattatatgccaaggtt

SEQ ID NO: 604194 - DNA, 20 bp, Artificial Sequence
  chemically synthesized
ctggggaatactgatagagt

SEQ ID NO: 604195 - DNA, 20 bp, Artificial Sequence
  chemically synthesized
taatatcatcacattgggaa

SEQ ID NO: 604196 - DNA, 20 bp, Artificial Sequence
  chemically synthesized
agatttagtgtcttttaagg

SEQ ID NO: 604197 - DNA, 20 bp, Artificial Sequence
  chemically synthesized
aagtttaatatcaagtaact

SEQ ID NO: 604198 - DNA, 20 bp, Artificial Sequence
  chemically synthesized
tctcccatttctggagtttg

SEQ ID NO: 604199 - DNA, 20 bp, Artificial Sequence
  chemically synthesized
aaatttatgtctcccatttc

SEQ ID NO: 604200 - DNA, 20 bp, Artificial Sequence
  chemically synthesized
aaatgggagacataaatttc

SEQ ID NO: 604201 - DNA, 20 bp, Artificial Sequence
  chemically synthesized
tttctgtggtttataagcta

SEQ ID NO: 604202 - DNA, 20 bp, Artificial Sequence
  chemically synthesized
taacaaaataccataaactg

SEQ ID NO: 604203 - DNA, 20 bp, Artificial Sequence
  chemically synthesized
aaggaagagagagggtttta

SEQ ID NO: 604204 - DNA, 20 bp, Artificial Sequence
  chemically synthesized
taaacatgggaaggaagaga

SEQ ID NO: 604205 - DNA, 20 bp, Artificial Sequence
  chemically synthesized
aaaaccctctctcttccttc

SEQ ID NO: 604206 - DNA, 20 bp, Artificial Sequence
  chemically synthesized
gagacagagaatgtatgtgt

SEQ ID NO: 604207 - DNA, 20 bp, Artificial Sequence
  chemically synthesized
attctctgtctcctgaatat

SEQ ID NO: 604208 - DNA, 20 bp, Artificial Sequence
  chemically synthesized
ttggtcacatttaatggcaa

SEQ ID NO: 604209 - DNA, 20 bp, Artificial Sequence
  chemically synthesized
aatgtgaccaaaaataccgc

SEQ ID NO: 604210 - DNA, 20 bp, Artificial Sequence
  chemically synthesized
attgacgcataatagatgta

SEQ ID NO: 604211 - DNA, 20 bp, Artificial Sequence
  chemically synthesized
tatctagcatagacaaatat

SEQ ID NO: 604212 - DNA, 20 bp, Artificial Sequence
  chemically synthesized
atatacggtagtaaaaacat

SEQ ID NO: 604213 - DNA, 20 bp, Artificial Sequence
  chemically synthesized
aatgaaggtaacataatcag

SEQ ID NO: 604214 - DNA, 20 bp, Artificial Sequence
  chemically synthesized
gaaaaatgagaaagtctttg

SEQ ID NO: 604215 - DNA, 20 bp, Artificial Sequence
  chemically synthesized
cagttaagaggtctatgaag

SEQ ID NO: 604216 - DNA, 20 bp, Artificial Sequence
  chemically synthesized
caagtacttgtagaaacaaa

SEQ ID NO: 604217 - DNA, 20 bp, Artificial Sequence
  chemically synthesized
tttagaaaatatgaagcgaa

SEQ ID NO: 604218 - DNA, 20 bp, Artificial Sequence
  chemically synthesized
atatttatggaagagtcagt

SEQ ID NO: 604219 - DNA, 20 bp, Artificial Sequence
  chemically synthesized
caaatgcattatattaacaa

SEQ ID NO: 604220 - DNA, 20 bp, Artificial Sequence
  chemically synthesized
tccaccagtcactttcaaat

SEQ ID NO: 604221 - DNA, 20 bp, Artificial Sequence
  chemically synthesized
tgagggtgagactagagaga

SEQ ID NO: 604222 - DNA, 20 bp, Artificial Sequence
  chemically synthesized
atcaaatgagggtgagacta

SEQ ID NO: 604223 - DNA, 20 bp, Artificial Sequence
  chemically synthesized
atctctctagtctcaccctc

SEQ ID NO: 604224 - DNA, 20 bp, Artificial Sequence
  chemically synthesized
ttgatttagactatctctaa

SEQ ID NO: 604225 - DNA, 20 bp, Artificial Sequence
  chemically synthesized
cctagtaccttgaggcacgt

SEQ ID NO: 604226 - DNA, 20 bp, Artificial Sequence
  chemically synthesized
tgccagcctagtaccttgag

SEQ ID NO: 604227 - DNA, 20 bp, Artificial Sequence
  chemically synthesized
ctttctccaacataggcttc

SEQ ID NO: 604228 - DNA, 20 bp, Artificial Sequence
  chemically synthesized
ctgctgaagcctatgttgga

SEQ ID NO: 604229 - DNA, 20 bp, Artificial Sequence
  chemically synthesized
agtagaaatctttctccaac

SEQ ID NO: 604230 - DNA, 20 bp, Artificial Sequence
  chemically synthesized
aggcgttgaattgacattgc

SEQ ID NO: 604231 - DNA, 20 bp, Artificial Sequence
  chemically synthesized
caaagtgccatactttgggg

SEQ ID NO: 604232 - DNA, 20 bp, Artificial Sequence
  chemically synthesized
ccttccagtgttctttagtt

SEQ ID NO: 604233 - DNA, 20 bp, Artificial Sequence
  chemically synthesized
cagagggaccttggttttga

SEQ ID NO: 604234 - DNA, 20 bp, Artificial Sequence
  chemically synthesized
gaggagaaggtcagagggac

SEQ ID NO: 604235 - DNA, 20 bp, Artificial Sequence
  chemically synthesized
tggctttggaggagagggtt

SEQ ID NO: 604236 - DNA, 20 bp, Artificial Sequence
  chemically synthesized
ttatggttggctttggagga

SEQ ID NO: 604237 - DNA, 20 bp, Artificial Sequence
  chemically synthesized
ttataattctggcttttatg

SEQ ID NO: 604238 - DNA, 20 bp, Artificial Sequence
  chemically synthesized
gcaaaatacagagttataat

SEQ ID NO: 604239 - DNA, 20 bp, Artificial Sequence
  chemically synthesized
taaaaaattctctgacatac

SEQ ID NO: 604240 - DNA, 20 bp, Artificial Sequence
  chemically synthesized
gagtagacagccatgtagga

SEQ ID NO: 604241 - DNA, 20 bp, Artificial Sequence
  chemically synthesized
ttatcaactctaagcataaa

SEQ ID NO: 604242 - DNA, 20 bp, Artificial Sequence
  chemically synthesized
gacccaaaggaaaactgttt

SEQ ID NO: 604243 - DNA, 20 bp, Artificial Sequence
  chemically synthesized
gacccaatgacccaaaggaa

SEQ ID NO: 604244 - DNA, 20 bp, Artificial Sequence
  chemically synthesized
gcatgagatatttatctaat

SEQ ID NO: 604245 - DNA, 20 bp, Artificial Sequence
  chemically synthesized
acttttattagataaatatc

SEQ ID NO: 604246 - DNA, 20 bp, Artificial Sequence
  chemically synthesized
actgcagaaaaaagaaacaa

SEQ ID NO: 604247 - DNA, 20 bp, Artificial Sequence
  chemically synthesized
cagaaaaaagaaacaaagtt

SEQ ID NO: 604248 - DNA, 20 bp, Artificial Sequence
  chemically synthesized
ttcaaactaaaaacaaacaa

SEQ ID NO: 604249 - DNA, 20 bp, Artificial Sequence
  chemically synthesized
aagaaacaaagttgtttgtt

SEQ ID NO: 604250 - DNA, 20 bp, Artificial Sequence
  chemically synthesized
cgtctcaaaaaaaaaaaaaa

SEQ ID NO: 604251 - DNA, 20 bp, Artificial Sequence
  chemically synthesized
aatggcgtgaacctgggagg

SEQ ID NO: 604252 - DNA, 20 bp, Artificial Sequence
  chemically synthesized
ttttgtatttttagtagaga

SEQ ID NO: 604253 - DNA, 20 bp, Artificial Sequence
  chemically synthesized
cgcctcggcctcccaaagtg

SEQ ID NO: 604254 - DNA, 20 bp, Artificial Sequence
  chemically synthesized
aatacacctctaaaagtgtt

SEQ ID NO: 604255 - DNA, 20 bp, Artificial Sequence
  chemically synthesized
ttcctgaaaaaggcaaaatt

SEQ ID NO: 604256 - DNA, 20 bp, Artificial Sequence
  chemically synthesized
gggaaaaaaaggagacattt

SEQ ID NO: 604257 - DNA, 20 bp, Artificial Sequence
  chemically synthesized
cccttcataaagcatatact

SEQ ID NO: 604258 - DNA, 20 bp, Artificial Sequence
  chemically synthesized
gcacatagtaagcacttagt

SEQ ID NO: 604259 - DNA, 20 bp, Artificial Sequence
  chemically synthesized
tagtccacattatcaagtaa

SEQ ID NO: 604260 - DNA, 20 bp, Artificial Sequence
  chemically synthesized
gtaatttggtttagtgaagc

SEQ ID NO: 604261 - DNA, 20 bp, Artificial Sequence
  chemically synthesized
ccatttttatcttgtcaaac

SEQ ID NO: 604262 - DNA, 20 bp, Artificial Sequence
  chemically synthesized
catttgtttgacaagataaa

SEQ ID NO: 604263 - DNA, 20 bp, Artificial Sequence
  chemically synthesized
taatttacagagaaggtgtt

SEQ ID NO: 604264 - DNA, 20 bp, Artificial Sequence
  chemically synthesized
ttaatcctaatttacagaga

SEQ ID NO: 604265 - DNA, 20 bp, Artificial Sequence
  chemically synthesized
aaaaacaccttctctgtaaa

SEQ ID NO: 604266 - DNA, 20 bp, Artificial Sequence
  chemically synthesized
tctctgtaaattaggattaa

SEQ ID NO: 604267 - DNA, 20 bp, Artificial Sequence
  chemically synthesized
ggcagagcctctaggctaga

SEQ ID NO: 604268 - DNA, 20 bp, Artificial Sequence
  chemically synthesized
attggttatctccacacaaa

SEQ ID NO: 604269 - DNA, 20 bp, Artificial Sequence
  chemically synthesized
gagtcaacaccatggtaact

SEQ ID NO: 604270 - DNA, 20 bp, Artificial Sequence
  chemically synthesized
caacaccatggtaactgtct

SEQ ID NO: 604271 - DNA, 20 bp, Artificial Sequence
  chemically synthesized
tctgtttgcttctctgtctg

SEQ ID NO: 604272 - DNA, 20 bp, Artificial Sequence
  chemically synthesized
atttcacatcctgttgtttg

SEQ ID NO: 604273 - DNA, 20 bp, Artificial Sequence
  chemically synthesized
ttctgtagaatttcacatcc

SEQ ID NO: 604274 - DNA, 20 bp, Artificial Sequence
  chemically synthesized
ttatacaaagatcgtatgga

SEQ ID NO: 604275 - DNA, 20 bp, Artificial Sequence
  chemically synthesized
atcgtatggagagtgattac

SEQ ID NO: 604276 - DNA, 20 bp, Artificial Sequence
  chemically synthesized
attacgctcgttttttgatg

SEQ ID NO: 604277 - DNA, 20 bp, Artificial Sequence
  chemically synthesized
tactagggcagtggtgagga

SEQ ID NO: 604278 - DNA, 20 bp, Artificial Sequence
  chemically synthesized
aagaagtataacattaacct

SEQ ID NO: 604279 - DNA, 20 bp, Artificial Sequence
  chemically synthesized
tggaacaaagaaacatatta

SEQ ID NO: 604280 - DNA, 20 bp, Artificial Sequence
  chemically synthesized
agaagagtccaaactcatta

SEQ ID NO: 604281 - DNA, 20 bp, Artificial Sequence
  chemically synthesized
tttctatcattattgtgata

SEQ ID NO: 604282 - DNA, 20 bp, Artificial Sequence
  chemically synthesized
aagaattgggttcagtgtcc

SEQ ID NO: 604283 - DNA, 20 bp, Artificial Sequence
  chemically synthesized
agattaggttaggaatagct

SEQ ID NO: 604284 - DNA, 20 bp, Artificial Sequence
  chemically synthesized
gaagcaacataaaataaata

SEQ ID NO: 604285 - DNA, 20 bp, Artificial Sequence
  chemically synthesized
taatcttaatatttatttta

SEQ ID NO: 604286 - DNA, 20 bp, Artificial Sequence
  chemically synthesized
ggacttcttccttcaaacat

SEQ ID NO: 604287 - DNA, 20 bp, Artificial Sequence
  chemically synthesized
agttttagcaaggaaatcag

SEQ ID NO: 604288 - DNA, 20 bp, Artificial Sequence
  chemically synthesized
gcacattatgtgtggacaaa

SEQ ID NO: 604289 - DNA, 20 bp, Artificial Sequence
  chemically synthesized
agttaactgtcagctactag

SEQ ID NO: 604290 - DNA, 20 bp, Artificial Sequence
  chemically synthesized
gggtgaagaggaagcagagg

SEQ ID NO: 604291 - DNA, 20 bp, Artificial Sequence
  chemically synthesized
gggaggccttgaaaccctgc

SEQ ID NO: 604292 - DNA, 20 bp, Artificial Sequence
  chemically synthesized
gagtgccaatggcctacatc

SEQ ID NO: 604293 - DNA, 20 bp, Artificial Sequence
  chemically synthesized
ccaatggcctacatccaacg

SEQ ID NO: 604294 - DNA, 20 bp, Artificial Sequence
  chemically synthesized
ttcccggatcctactcagac

SEQ ID NO: 604295 - DNA, 20 bp, Artificial Sequence
  chemically synthesized
ctggcttccaagaagcaatt

SEQ ID NO: 604296 - DNA, 20 bp, Artificial Sequence
  chemically synthesized
aaggaataaaataaacgtgc

SEQ ID NO: 604297 - DNA, 20 bp, Artificial Sequence
  chemically synthesized
ttccttatcaatttagcaac

SEQ ID NO: 604298 - DNA, 20 bp, Artificial Sequence
  chemically synthesized
actatcgcttcatcactttt

SEQ ID NO: 604299 - DNA, 20 bp, Artificial Sequence
  chemically synthesized
tcactttttgtggtttgtcg

SEQ ID NO: 604300 - DNA, 20 bp, Artificial Sequence
  chemically synthesized
catggcaaatgaacagacac

SEQ ID NO: 604301 - DNA, 20 bp, Artificial Sequence
  chemically synthesized
cacctctgatttaaatgtct

SEQ ID NO: 604302 - DNA, 20 bp, Artificial Sequence
  chemically synthesized
tgggtgctatctactcttcc

SEQ ID NO: 604303 - DNA, 20 bp, Artificial Sequence
  chemically synthesized
aagtcttcagtgttttcctt

SEQ ID NO: 604304 - DNA, 20 bp, Artificial Sequence
  chemically synthesized
tggcattgaaaataagtctt

SEQ ID NO: 604305 - DNA, 20 bp, Artificial Sequence
  chemically synthesized
ttttcaatgccatattcaac

SEQ ID NO: 604306 - DNA, 20 bp, Artificial Sequence
  chemically synthesized
gttggattctgtacatgtat

SEQ ID NO: 604307 - DNA, 20 bp, Artificial Sequence
  chemically synthesized
ttttgcttcttcataaaatt

SEQ ID NO: 604308 - DNA, 20 bp, Artificial Sequence
  chemically synthesized
tgatacataagttcattagc

SEQ ID NO: 604309 - DNA, 20 bp, Artificial Sequence
  chemically synthesized
cactaaggaatatattagtg

SEQ ID NO: 604310 - DNA, 20 bp, Artificial Sequence
  chemically synthesized
cagtccactaatatattcct

SEQ ID NO: 604311 - DNA, 20 bp, Artificial Sequence
  chemically synthesized
ttaaatgcagtctaacttta

SEQ ID NO: 604312 - DNA, 20 bp, Artificial Sequence
  chemically synthesized
gttatttttttattagctaa

SEQ ID NO: 604313 - DNA, 20 bp, Artificial Sequence
  chemically synthesized
cttctcattctctgttcaca

SEQ ID NO: 604314 - DNA, 20 bp, Artificial Sequence
  chemically synthesized
aaccataaataataacaaat

SEQ ID NO: 604315 - DNA, 20 bp, Artificial Sequence
  chemically synthesized
tttgtaaaggagaaaaaaat

SEQ ID NO: 604316 - DNA, 20 bp, Artificial Sequence
  chemically synthesized
actttacaagttttaatttc

SEQ ID NO: 604317 - DNA, 20 bp, Artificial Sequence
  chemically synthesized
gccctgtatgatgggacttt

SEQ ID NO: 604318 - DNA, 20 bp, Artificial Sequence
  chemically synthesized
atcatacagggcaagtaagt

SEQ ID NO: 604319 - DNA, 20 bp, Artificial Sequence
  chemically synthesized
aaaaagaccttccatttttt

SEQ ID NO: 604320 - DNA, 20 bp, Artificial Sequence
  chemically synthesized
gaatatttggtatatatgcc

SEQ ID NO: 604321 - DNA, 20 bp, Artificial Sequence
  chemically synthesized
attcaactggatgaggctga

SEQ ID NO: 604322 - DNA, 20 bp, Artificial Sequence
  chemically synthesized
tgagagatacctgtgtatat

SEQ ID NO: 604323 - DNA, 20 bp, Artificial Sequence
  chemically synthesized
tagttctttgagatgtttgt

SEQ ID NO: 604324 - DNA, 20 bp, Artificial Sequence
  chemically synthesized
aacatttctctagttctttg

SEQ ID NO: 604325 - DNA, 20 bp, Artificial Sequence
  chemically synthesized
aacatctcaaagaactagag

SEQ ID NO: 604326 - DNA, 20 bp, Artificial Sequence
  chemically synthesized
ttatatagcactaattcatg

SEQ ID NO: 604327 - DNA, 20 bp, Artificial Sequence
  chemically synthesized
aatttatgtaaatgtgtcat

SEQ ID NO: 604328 - DNA, 20 bp, Artificial Sequence
  chemically synthesized
gcttggaggacttccactct

SEQ ID NO: 604329 - DNA, 20 bp, Artificial Sequence
  chemically synthesized
taatcaaattagttaagtct

SEQ ID NO: 604330 - DNA, 20 bp, Artificial Sequence
  chemically synthesized
caagctcccagacttaacta

SEQ ID NO: 604331 - DNA, 20 bp, Artificial Sequence
  chemically synthesized
taactaatttgattagtgaa

SEQ ID NO: 604332 - DNA, 20 bp, Artificial Sequence
  chemically synthesized
ttatgaaattctacatgcta

SEQ ID NO: 604333 - DNA, 20 bp, Artificial Sequence
  chemically synthesized
ggtttctaaggatgaggctt

SEQ ID NO: 604334 - DNA, 20 bp, Artificial Sequence
  chemically synthesized
tcctttcaggtttctaagga

SEQ ID NO: 604335 - DNA, 20 bp, Artificial Sequence
  chemically synthesized
caggcatcagcattttcctt

SEQ ID NO: 604336 - DNA, 20 bp, Artificial Sequence
  chemically synthesized
aattaaaatgttcattaaga

SEQ ID NO: 604337 - DNA, 20 bp, Artificial Sequence
  chemically synthesized
acattttaattagctaggaa

SEQ ID NO: 604338 - DNA, 20 bp, Artificial Sequence
  chemically synthesized
ttgttcctattaatgttaaa

SEQ ID NO: 604339 - DNA, 20 bp, Artificial Sequence
  chemically synthesized
taataccaacaaagaataat

SEQ ID NO: 604340 - DNA, 20 bp, Artificial Sequence
  chemically synthesized
aagaagaaataattttggag

SEQ ID NO: 604341 - DNA, 20 bp, Artificial Sequence
  chemically synthesized
cggaaaactctgaagaagaa

SEQ ID NO: 604342 - DNA, 20 bp, Artificial Sequence
  chemically synthesized
taaaaatcacctttcttctt

SEQ ID NO: 604343 - DNA, 20 bp, Artificial Sequence
  chemically synthesized
gtaggtcatcttcaaatggt

SEQ ID NO: 604344 - DNA, 20 bp, Artificial Sequence
  chemically synthesized
tcaagatgcacatcatctgt

SEQ ID NO: 604345 - DNA, 20 bp, Artificial Sequence
  chemically synthesized
ttctgggaaaacttgtccct

SEQ ID NO: 604346 - DNA, 20 bp, Artificial Sequence
  chemically synthesized
gtggaaacaagcagagaggg

SEQ ID NO: 604347 - DNA, 20 bp, Artificial Sequence
  chemically synthesized
gggaaaacttgtccctctct

SEQ ID NO: 604348 - DNA, 20 bp, Artificial Sequence
  chemically synthesized
tctgcttgtttccacatggc

SEQ ID NO: 604349 - DNA, 20 bp, Artificial Sequence
  chemically synthesized
aattgaatttgtattctatt

SEQ ID NO: 604350 - DNA, 20 bp, Artificial Sequence
  chemically synthesized
taaaaatatttttagaacta

SEQ ID NO: 604351 - DNA, 20 bp, Artificial Sequence
  chemically synthesized
gcttgttttcttttggttaa

SEQ ID NO: 604352 - DNA, 20 bp, Artificial Sequence
  chemically synthesized
aactatttatctaaatatta

SEQ ID NO: 604353 - DNA, 20 bp, Artificial Sequence
  chemically synthesized
agggaactatttatctaaat

SEQ ID NO: 604354 - DNA, 20 bp, Artificial Sequence
  chemically synthesized
tagttccctctccaaatcaa

SEQ ID NO: 604355 - DNA, 20 bp, Artificial Sequence
  chemically synthesized
gtgtgtgtgtatacaaacta

SEQ ID NO: 604356 - DNA, 20 bp, Artificial Sequence
  chemically synthesized
tatacacacacacaacacat

SEQ ID NO: 604357 - DNA, 20 bp, Artificial Sequence
  chemically synthesized
gaaggggggaagatagggcc

SEQ ID NO: 604358 - DNA, 20 bp, Artificial Sequence
  chemically synthesized
ttgtaatatgtgtgatacgt

SEQ ID NO: 604359 - DNA, 20 bp, Artificial Sequence
  chemically synthesized
tgatacgtgtgtgtttgtgt

SEQ ID NO: 604360 - DNA, 20 bp, Artificial Sequence
  chemically synthesized
tgtgtttgtgtgtatgttta

SEQ ID NO: 604361 - DNA, 20 bp, Artificial Sequence
  chemically synthesized
ttttgtatttttagtagaga

SEQ ID NO: 604362 - DNA, 20 bp, Artificial Sequence
  chemically synthesized
tgcctcagcctcccgagtag

SEQ ID NO: 604363 - DNA, 20 bp, Artificial Sequence
  chemically synthesized
tcgggaggctgaggcaggag

SEQ ID NO: 604364 - DNA, 20 bp, Artificial Sequence
  chemically synthesized
gaggcagaagttgcagtgag

SEQ ID NO: 604365 - DNA, 20 bp, Artificial Sequence
  chemically synthesized
gtgtgtgtaaatcaggcacc

SEQ ID NO: 604366 - DNA, 20 bp, Artificial Sequence
  chemically synthesized
tagggattaaaacctgtggt

SEQ ID NO: 604367 - DNA, 20 bp, Artificial Sequence
  chemically synthesized
aataccagaaagataaaaat

SEQ ID NO: 604368 - DNA, 20 bp, Artificial Sequence
  chemically synthesized
ttcttcgatcttcagcgact

SEQ ID NO: 604369 - DNA, 20 bp, Artificial Sequence
  chemically synthesized
tacttcaggaccagtttgat

SEQ ID NO: 604370 - DNA, 20 bp, Artificial Sequence
  chemically synthesized
cagtatgtttttacttcagg

SEQ ID NO: 604371 - DNA, 20 bp, Artificial Sequence
  chemically synthesized
ccttttatttttggtttaca

SEQ ID NO: 604372 - DNA, 20 bp, Artificial Sequence
  chemically synthesized
gggggagttagccttttatt

SEQ ID NO: 604373 - DNA, 20 bp, Artificial Sequence
  chemically synthesized
ttcagagagaagaggctgta

SEQ ID NO: 604374 - DNA, 20 bp, Artificial Sequence
  chemically synthesized
ctctctgaagcctgctagct

SEQ ID NO: 604375 - DNA, 20 bp, Artificial Sequence
  chemically synthesized
gtagatgaagcttttagcta

SEQ ID NO: 604376 - DNA, 20 bp, Artificial Sequence
  chemically synthesized
ccaaagttttatcatgtaga

SEQ ID NO: 604377 - DNA, 20 bp, Artificial Sequence
  chemically synthesized
agataagacattgtggatac

SEQ ID NO: 604378 - DNA, 20 bp, Artificial Sequence
  chemically synthesized
gacctgggatcaatagaaag

SEQ ID NO: 604379 - DNA, 20 bp, Artificial Sequence
  chemically synthesized
attttctggttgacaattgg

SEQ ID NO: 604380 - DNA, 20 bp, Artificial Sequence
  chemically synthesized
tcaaccaattgtcaaccaga

SEQ ID NO: 604381 - DNA, 20 bp, Artificial Sequence
  chemically synthesized
caggacaactgggtgggggt

SEQ ID NO: 604382 - DNA, 20 bp, Artificial Sequence
  chemically synthesized
aaaaaaaaaaaaagaaatac

SEQ ID NO: 604383 - DNA, 20 bp, Artificial Sequence
  chemically synthesized
ccaagattgtgtcactgcac

SEQ ID NO: 604384 - DNA, 20 bp, Artificial Sequence
  chemically synthesized
gaggcggaggttgcagtgag

SEQ ID NO: 604385 - DNA, 20 bp, Artificial Sequence
  chemically synthesized
ttccctatttttcatagaga

SEQ ID NO: 604386 - DNA, 20 bp, Artificial Sequence
  chemically synthesized
ttttcatagagacggggttt

SEQ ID NO: 604387 - DNA, 20 bp, Artificial Sequence
  chemically synthesized
cgactcagcctcccaaagtg

SEQ ID NO: 604388 - DNA, 20 bp, Artificial Sequence
  chemically synthesized
caagtacatttaagaaatac

SEQ ID NO: 604389 - DNA, 20 bp, Artificial Sequence
  chemically synthesized
ccaatgtatttcttaaatgt

SEQ ID NO: 604390 - DNA, 20 bp, Artificial Sequence
  chemically synthesized
ccaaggtggttggggtgcag

SEQ ID NO: 604391 - DNA, 20 bp, Artificial Sequence
  chemically synthesized
tgtgcccaaggtggttgggg

SEQ ID NO: 604392 - DNA, 20 bp, Artificial Sequence
  chemically synthesized
aaaaaaaaaaaaaaaaaaaa

SEQ ID NO: 604393 - DNA, 20 bp, Artificial Sequence
  chemically synthesized
cccaggaggcgggggttgca

SEQ ID NO: 604394 - DNA, 20 bp, Artificial Sequence
  chemically synthesized
tcgggaggctgaggcacgag

SEQ ID NO: 604395 - DNA, 20 bp, Artificial Sequence
  chemically synthesized
tgcctcagcctcccgagtac

SEQ ID NO: 604396 - DNA, 20 bp, Artificial Sequence
  chemically synthesized
aggtctcagttaatttagaa

SEQ ID NO: 604397 - DNA, 20 bp, Artificial Sequence
  chemically synthesized
ctaaattaactgagacctgt

SEQ ID NO: 604398 - DNA, 20 bp, Artificial Sequence
  chemically synthesized
attttctgggtctacaatac

SEQ ID NO: 604399 - DNA, 20 bp, Artificial Sequence
  chemically synthesized
tttttaaaaattacttgtaa

SEQ ID NO: 604400 - DNA, 20 bp, Artificial Sequence
  chemically synthesized
ttacttacctctctaattaa

SEQ ID NO: 604401 - DNA, 20 bp, Artificial Sequence
  chemically synthesized
cccaagatacaaaaactgag

SEQ ID NO: 604402 - DNA, 20 bp, Artificial Sequence
  chemically synthesized
gatacaaaaactgagatcag

SEQ ID NO: 604403 - DNA, 20 bp, Artificial Sequence
  chemically synthesized
acaatataagcaaagctgat

SEQ ID NO: 604404 - DNA, 20 bp, Artificial Sequence
  chemically synthesized
gagatcagctttgcttatat

SEQ ID NO: 604405 - DNA, 20 bp, Artificial Sequence
  chemically synthesized
acatctttagattttattta

SEQ ID NO: 604406 - DNA, 20 bp, Artificial Sequence
  chemically synthesized
taactgggaattataacatc

SEQ ID NO: 604407 - DNA, 20 bp, Artificial Sequence
  chemically synthesized
tgtaaaccactgaagagttt

SEQ ID NO: 604408 - DNA, 20 bp, Artificial Sequence
  chemically synthesized
aaaaagcctataaactcttc

SEQ ID NO: 604409 - DNA, 20 bp, Artificial Sequence
  chemically synthesized
aggtgctgtgtaaaccactg

SEQ ID NO: 604410 - DNA, 20 bp, Artificial Sequence
  chemically synthesized
tttgataggaatgttaatat

SEQ ID NO: 604411 - DNA, 20 bp, Artificial Sequence
  chemically synthesized
accatgcaaatataaggaaa

SEQ ID NO: 604412 - DNA, 20 bp, Artificial Sequence
  chemically synthesized
tgcatggtctcaaatgtatt

SEQ ID NO: 604413 - DNA, 20 bp, Artificial Sequence
  chemically synthesized
aacatattattttatgagtg

SEQ ID NO: 604414 - DNA, 20 bp, Artificial Sequence
  chemically synthesized
agcacatcactcataaaata

SEQ ID NO: 604415 - DNA, 20 bp, Artificial Sequence
  chemically synthesized
tgtttcagtacagtaaaatt

SEQ ID NO: 604416 - DNA, 20 bp, Artificial Sequence
  chemically synthesized
gtacagtaaaatttaatgat

SEQ ID NO: 604417 - DNA, 20 bp, Artificial Sequence
  chemically synthesized
tactaaaaaatcaatttctg

SEQ ID NO: 604418 - DNA, 20 bp, Artificial Sequence
  chemically synthesized
gacaaggtaaacgccacaga

SEQ ID NO: 604419 - DNA, 20 bp, Artificial Sequence
  chemically synthesized
attttgtgcttggactagaa

SEQ ID NO: 604420 - DNA, 20 bp, Artificial Sequence
  chemically synthesized
acaattttaaggacaatatt

SEQ ID NO: 604421 - DNA, 20 bp, Artificial Sequence
  chemically synthesized
cataccgaattatatactta

SEQ ID NO: 604422 - DNA, 20 bp, Artificial Sequence
  chemically synthesized
atacttagtatgtttaaaaa

SEQ ID NO: 604423 - DNA, 20 bp, Artificial Sequence
  chemically synthesized
catgcccttgcatacaaatt

SEQ ID NO: 604424 - DNA, 20 bp, Artificial Sequence
  chemically synthesized
tgcatacaaattgaatgatt

SEQ ID NO: 604425 - DNA, 20 bp, Artificial Sequence
  chemically synthesized
actcagacatttttggcatt

SEQ ID NO: 604426 - DNA, 20 bp, Artificial Sequence
  chemically synthesized
catcttggcacccatagaat

SEQ ID NO: 604427 - DNA, 20 bp, Artificial Sequence
  chemically synthesized
tttattctcttcactgcaat

SEQ ID NO: 604428 - DNA, 20 bp, Artificial Sequence
  chemically synthesized
agaataaaactgctgtaaaa

SEQ ID NO: 604429 - DNA, 20 bp, Artificial Sequence
  chemically synthesized
gcagagaagcaatattttac

SEQ ID NO: 604430 - DNA, 20 bp, Artificial Sequence
  chemically synthesized
cagacgtcaaaatattttag

SEQ ID NO: 604431 - DNA, 20 bp, Artificial Sequence
  chemically synthesized
tttaataccaaattaaggta

SEQ ID NO: 604432 - DNA, 20 bp, Artificial Sequence
  chemically synthesized
accaatgaattttgaaatga

SEQ ID NO: 604433 - DNA, 20 bp, Artificial Sequence
  chemically synthesized
aatattaccaatgaattttg

SEQ ID NO: 604434 - DNA, 20 bp, Artificial Sequence
  chemically synthesized
atatttatttctaaagtgtg

SEQ ID NO: 604435 - DNA, 20 bp, Artificial Sequence
  chemically synthesized
attgaacagatgtcacattt

SEQ ID NO: 604436 - DNA, 20 bp, Artificial Sequence
  chemically synthesized
acagatgtcacatttataag

SEQ ID NO: 604437 - DNA, 20 bp, Artificial Sequence
  chemically synthesized
tcttaccttttaatttttaa

SEQ ID NO: 604438 - DNA, 20 bp, Artificial Sequence
  chemically synthesized
tctgacattttagaatttgt

SEQ ID NO: 604439 - DNA, 20 bp, Artificial Sequence
  chemically synthesized
gcccacgtgttttcacactc

SEQ ID NO: 604440 - DNA, 20 bp, Artificial Sequence
  chemically synthesized
gggtcatgcagtttttgccc

SEQ ID NO: 604441 - DNA, 20 bp, Artificial Sequence
  chemically synthesized
atttcccatcctctgggtca

SEQ ID NO: 604442 - DNA, 20 bp, Artificial Sequence
  chemically synthesized
aaaaataggctttaggcatc

SEQ ID NO: 604443 - DNA, 20 bp, Artificial Sequence
  chemically synthesized
caatttattgaaaatgaaaa

SEQ ID NO: 604444 - DNA, 20 bp, Artificial Sequence
  chemically synthesized
ggtgattttcttgcacagaa

SEQ ID NO: 604445 - DNA, 20 bp, Artificial Sequence
  chemically synthesized
atttctattaacctgtgtta

SEQ ID NO: 604446 - DNA, 20 bp, Artificial Sequence
  chemically synthesized
atcatagatttattactctg

SEQ ID NO: 604447 - DNA, 20 bp, Artificial Sequence
  chemically synthesized
agtatattatattgtatgat

SEQ ID NO: 604448 - DNA, 20 bp, Artificial Sequence
  chemically synthesized
ttgattttaaaatatatgac

SEQ ID NO: 604449 - DNA, 20 bp, Artificial Sequence
  chemically synthesized
atatattttaaaatcaaatg

SEQ ID NO: 604450 - DNA, 20 bp, Artificial Sequence
  chemically synthesized
tcattttaaataaactttac

SEQ ID NO: 604451 - DNA, 20 bp, Artificial Sequence
  chemically synthesized
cataaggacataggcagctt

SEQ ID NO: 604452 - DNA, 20 bp, Artificial Sequence
  chemically synthesized
ttatttatcataaggacata

SEQ ID NO: 604453 - DNA, 20 bp, Artificial Sequence
  chemically synthesized
agagggcgcacattcccttt

SEQ ID NO: 604454 - DNA, 20 bp, Artificial Sequence
  chemically synthesized
ctttcagagcttgtcttcaa

SEQ ID NO: 604455 - DNA, 20 bp, Artificial Sequence
  chemically synthesized
cttgtcttcaatttggcttc

SEQ ID NO: 604456 - DNA, 20 bp, Artificial Sequence
  chemically synthesized
gtgacaaatgaaattttcat

SEQ ID NO: 604457 - DNA, 20 bp, Artificial Sequence
  chemically synthesized
tctcaagggattctatgtat

SEQ ID NO: 604458 - DNA, 20 bp, Artificial Sequence
  chemically synthesized
aactgtggacatattttctc

SEQ ID NO: 604459 - DNA, 20 bp, Artificial Sequence
  chemically synthesized
atcccttgagaaaatatgtc

SEQ ID NO: 604460 - DNA, 20 bp, Artificial Sequence
  chemically synthesized
tatgtccacagtttggagag

SEQ ID NO: 604461 - DNA, 20 bp, Artificial Sequence
  chemically synthesized
caaataatttagtaaaattt

SEQ ID NO: 604462 - DNA, 20 bp, Artificial Sequence
  chemically synthesized
attttctggattatgtagca

SEQ ID NO: 604463 - DNA, 20 bp, Artificial Sequence
  chemically synthesized
gtagttttccttcccaagtt

SEQ ID NO: 604464 - DNA, 20 bp, Artificial Sequence
  chemically synthesized
attgattttaactaattttt

SEQ ID NO: 604465 - DNA, 20 bp, Artificial Sequence
  chemically synthesized
tggacactcgtactctaaaa

SEQ ID NO: 604466 - DNA, 20 bp, Artificial Sequence
  chemically synthesized
gatttaggagtataatttta

SEQ ID NO: 604467 - DNA, 20 bp, Artificial Sequence
  chemically synthesized
aattatactcctaaatcacc

SEQ ID NO: 604468 - DNA, 20 bp, Artificial Sequence
  chemically synthesized
ttggcattttaaaaaacttt

SEQ ID NO: 604469 - DNA, 20 bp, Artificial Sequence
  chemically synthesized
tctgttctttaaatttgaat

SEQ ID NO: 604470 - DNA, 20 bp, Artificial Sequence
  chemically synthesized
gaaagcctgtgacctgatta

SEQ ID NO: 604471 - DNA, 20 bp, Artificial Sequence
  chemically synthesized
ttaagcatcttaatcaggtc

SEQ ID NO: 604472 - DNA, 20 bp, Artificial Sequence
  chemically synthesized
tttctttttgaaagcctgtg

SEQ ID NO: 604473 - DNA, 20 bp, Artificial Sequence
  chemically synthesized
atacaaggtttcttgagcga

SEQ ID NO: 604474 - DNA, 20 bp, Artificial Sequence
  chemically synthesized
gataacatacaaggtttctt

SEQ ID NO: 604475 - DNA, 20 bp, Artificial Sequence
  chemically synthesized
aagctattacagataacata

SEQ ID NO: 604476 - DNA, 20 bp, Artificial Sequence
  chemically synthesized
aaaccttgtatgttatctgt

SEQ ID NO: 604477 - DNA, 20 bp, Artificial Sequence
  chemically synthesized
tctgtaatagcttttatttt

SEQ ID NO: 604478 - DNA, 20 bp, Artificial Sequence
  chemically synthesized
agaaaagttgaagatcttca

SEQ ID NO: 604479 - DNA, 20 bp, Artificial Sequence
  chemically synthesized
cctgttcttgagtcttgact

SEQ ID NO: 604480 - DNA, 20 bp, Artificial Sequence
  chemically synthesized
agaacaggtctgtctgaatc

SEQ ID NO: 604481 - DNA, 20 bp, Artificial Sequence
  chemically synthesized
aatgtagtgttgtagaaatc

SEQ ID NO: 604482 - DNA, 20 bp, Artificial Sequence
  chemically synthesized
ttttttttttaagatgggtt

SEQ ID NO: 604483 - DNA, 20 bp, Artificial Sequence
  chemically synthesized
atccttattttttttttaag

SEQ ID NO: 604484 - DNA, 20 bp, Artificial Sequence
  chemically synthesized
gctacacagtacagtaattt

SEQ ID NO: 604485 - DNA, 20 bp, Artificial Sequence
  chemically synthesized
agtggttttgactacgctat

SEQ ID NO: 604486 - DNA, 20 bp, Artificial Sequence
  chemically synthesized
ctatcttggattatatgaga

SEQ ID NO: 604487 - DNA, 20 bp, Artificial Sequence
  chemically synthesized
gtatcatcagattagaaagt

SEQ ID NO: 604488 - DNA, 20 bp, Artificial Sequence
  chemically synthesized
ctgatgtgagaaattgtatc

SEQ ID NO: 604489 - DNA, 20 bp, Artificial Sequence
  chemically synthesized
taagtagtaacttttttcat

SEQ ID NO: 604490 - DNA, 20 bp, Artificial Sequence
  chemically synthesized
tacagagacctttttcactg

SEQ ID NO: 604491 - DNA, 20 bp, Artificial Sequence
  chemically synthesized
ctctagtgtcccatggcaac

SEQ ID NO: 604492 - DNA, 20 bp, Artificial Sequence
  chemically synthesized
cagacataatctagaataag

SEQ ID NO: 604493 - DNA, 20 bp, Artificial Sequence
  chemically synthesized
tctatggaagctgcacttat

SEQ ID NO: 604494 - DNA, 20 bp, Artificial Sequence
  chemically synthesized
caaattatttagctgaaata

SEQ ID NO: 604495 - DNA, 20 bp, Artificial Sequence
  chemically synthesized
gctatgttgtaataagttaa

SEQ ID NO: 604496 - DNA, 20 bp, Artificial Sequence
  chemically synthesized
taggatttgaacccagacag

SEQ ID NO: 604497 - DNA, 20 bp, Artificial Sequence
  chemically synthesized
ctgggttcaaatcctagctg

SEQ ID NO: 604498 - DNA, 20 bp, Artificial Sequence
  chemically synthesized
gtttacaggaagcatcgcag

SEQ ID NO: 604499 - DNA, 20 bp, Artificial Sequence
  chemically synthesized
aagtgacttgctcatggtca

SEQ ID NO: 604500 - DNA, 20 bp, Artificial Sequence
  chemically synthesized
acttaaaatagcattacgaa

SEQ ID NO: 604501 - DNA, 20 bp, Artificial Sequence
  chemically synthesized
ataacaatagctaatatgta

SEQ ID NO: 604502 - DNA, 20 bp, Artificial Sequence
  chemically synthesized
tcttccatgatcctttttta

SEQ ID NO: 604503 - DNA, 20 bp, Artificial Sequence
  chemically synthesized
tgagaaagtgagaaatggca

SEQ ID NO: 604504 - DNA, 20 bp, Artificial Sequence
  chemically synthesized
tcacgtgtgagagtagtcat

SEQ ID NO: 604505 - DNA, 20 bp, Artificial Sequence
  chemically synthesized
tttattcttgttattccaat

SEQ ID NO: 604506 - DNA, 20 bp, Artificial Sequence
  chemically synthesized
gtctttgttatagctgtgtt

SEQ ID NO: 604507 - DNA, 20 bp, Artificial Sequence
  chemically synthesized
tttcattgtctttgttatag

SEQ ID NO: 604508 - DNA, 20 bp, Artificial Sequence
  chemically synthesized
tttgctgttgatttttgttt

SEQ ID NO: 604509 - DNA, 20 bp, Artificial Sequence
  chemically synthesized
gagactattttgctgttgat

SEQ ID NO: 604510 - DNA, 20 bp, Artificial Sequence
  chemically synthesized
gtaaaatgagactattttgc

SEQ ID NO: 604511 - DNA, 20 bp, Artificial Sequence
  chemically synthesized
ttgtcccatagaacatactt

SEQ ID NO: 604512 - DNA, 20 bp, Artificial Sequence
  chemically synthesized
gtcatgctcattcatttata

SEQ ID NO: 604513 - DNA, 20 bp, Artificial Sequence
  chemically synthesized
ttcatttatacattgtttat

SEQ ID NO: 604514 - DNA, 20 bp, Artificial Sequence
  chemically synthesized
tagctatagcagcagagttg

SEQ ID NO: 604515 - DNA, 20 bp, Artificial Sequence
  chemically synthesized
agggccagagagtaaatatt

SEQ ID NO: 604516 - DNA, 20 bp, Artificial Sequence
  chemically synthesized
tagactgggaagggggaaag

SEQ ID NO: 604517 - DNA, 20 bp, Artificial Sequence
  chemically synthesized
ggagagagaggccatcttac

SEQ ID NO: 604518 - DNA, 20 bp, Artificial Sequence
  chemically synthesized
gcaatggctccccatgacca

SEQ ID NO: 604519 - DNA, 20 bp, Artificial Sequence
  chemically synthesized
aataactaaaggtattcaat

SEQ ID NO: 604520 - DNA, 20 bp, Artificial Sequence
  chemically synthesized
cagcagaagtatgaagtaaa

SEQ ID NO: 604521 - DNA, 20 bp, Artificial Sequence
  chemically synthesized
acttacatgggattaagtat

SEQ ID NO: 604522 - DNA, 20 bp, Artificial Sequence
  chemically synthesized
acaagaatacttaatcccat

SEQ ID NO: 604523 - DNA, 20 bp, Artificial Sequence
  chemically synthesized
tgtatgcgaacaaaacttac

SEQ ID NO: 604524 - DNA, 20 bp, Artificial Sequence
  chemically synthesized
catgtaagttttgttcgcat

SEQ ID NO: 604525 - DNA, 20 bp, Artificial Sequence
  chemically synthesized
cactttcctcatcttgagcc

SEQ ID NO: 604526 - DNA, 20 bp, Artificial Sequence
  chemically synthesized
ttaaggaagaaaagttcact

SEQ ID NO: 604527 - DNA, 20 bp, Artificial Sequence
  chemically synthesized
aagtactaataaaatgttag

SEQ ID NO: 604528 - DNA, 20 bp, Artificial Sequence
  chemically synthesized
ttttattagtacttcttcat

SEQ ID NO: 604529 - DNA, 20 bp, Artificial Sequence
  chemically synthesized
catgacagtttatgctgggt

SEQ ID NO: 604530 - DNA, 20 bp, Artificial Sequence
  chemically synthesized
tgggtgcaagcttcctgagg

SEQ ID NO: 604531 - DNA, 20 bp, Artificial Sequence
  chemically synthesized
taaatctaagctttccctca

SEQ ID NO: 604532 - DNA, 20 bp, Artificial Sequence
  chemically synthesized
gcaagcttcctgagggaaag

SEQ ID NO: 604533 - DNA, 20 bp, Artificial Sequence
  chemically synthesized
cagttactttaactgtaaat

SEQ ID NO: 604534 - DNA, 20 bp, Artificial Sequence
  chemically synthesized
atttacagttaaagtaactg

SEQ ID NO: 604535 - DNA, 20 bp, Artificial Sequence
  chemically synthesized
tattcactcaactaatatct

SEQ ID NO: 604536 - DNA, 20 bp, Artificial Sequence
  chemically synthesized
aagaaagaagagacagcaac

SEQ ID NO: 604537 - DNA, 20 bp, Artificial Sequence
  chemically synthesized
aagtcatcatccaatgcatg

SEQ ID NO: 604538 - DNA, 20 bp, Artificial Sequence
  chemically synthesized
cctttcacactgagagagtt

SEQ ID NO: 604539 - DNA, 20 bp, Artificial Sequence
  chemically synthesized
tcaaggacctttcacactga

SEQ ID NO: 604540 - DNA, 20 bp, Artificial Sequence
  chemically synthesized
tctctcagtgtgaaaggtcc

SEQ ID NO: 604541 - DNA, 20 bp, Artificial Sequence
  chemically synthesized
cttgagtttaagagaagtca

SEQ ID NO: 604542 - DNA, 20 bp, Artificial Sequence
  chemically synthesized
tcaacatgcttgtgggtctt

SEQ ID NO: 604543 - DNA, 20 bp, Artificial Sequence
  chemically synthesized
ttaagtacacgtcagattga

SEQ ID NO: 604544 - DNA, 20 bp, Artificial Sequence
  chemically synthesized
cagtggggcattaagtacac

SEQ ID NO: 604545 - DNA, 20 bp, Artificial Sequence
  chemically synthesized
gccccactgccagcatcatg

SEQ ID NO: 604546 - DNA, 20 bp, Artificial Sequence
  chemically synthesized
tgatgcttactaacacagta

SEQ ID NO: 604547 - DNA, 20 bp, Artificial Sequence
  chemically synthesized
gttttgactaaagttcatag

SEQ ID NO: 604548 - DNA, 20 bp, Artificial Sequence
  chemically synthesized
tgttaagcaatgagtattac

SEQ ID NO: 604549 - DNA, 20 bp, Artificial Sequence
  chemically synthesized
gtcaaaacagaagtaatact

SEQ ID NO: 604550 - DNA, 20 bp, Artificial Sequence
  chemically synthesized
aatactcattgcttaacaaa

SEQ ID NO: 604551 - DNA, 20 bp, Artificial Sequence
  chemically synthesized
taagtgctagctgactaaaa

SEQ ID NO: 604552 - DNA, 20 bp, Artificial Sequence
  chemically synthesized
taacaaaataccatagactg

SEQ ID NO: 604553 - DNA, 20 bp, Artificial Sequence
  chemically synthesized
ttcctggtgacagccttctt

SEQ ID NO: 604554 - DNA, 20 bp, Artificial Sequence
  chemically synthesized
ggcttgtagacagcctctgg

SEQ ID NO: 604555 - DNA, 20 bp, Artificial Sequence
  chemically synthesized
actggagtttacaattcagc

SEQ ID NO: 604556 - DNA, 20 bp, Artificial Sequence
  chemically synthesized
ccaggccccatttccagcac

SEQ ID NO: 604557 - DNA, 20 bp, Artificial Sequence
  chemically synthesized
tggaaatggggcctggtggc

SEQ ID NO: 604558 - DNA, 20 bp, Artificial Sequence
  chemically synthesized
gatcatgggagcggatccct

SEQ ID NO: 604559 - DNA, 20 bp, Artificial Sequence
  chemically synthesized
cccattcttccatgtgatgt

SEQ ID NO: 604560 - DNA, 20 bp, Artificial Sequence
  chemically synthesized
tgtttcccctttgccttcca

SEQ ID NO: 604561 - DNA, 20 bp, Artificial Sequence
  chemically synthesized
ctttgccttccatcatgatt

SEQ ID NO: 604562 - DNA, 20 bp, Artificial Sequence
  chemically synthesized
ctgcttctggggaggtctca

SEQ ID NO: 604563 - DNA, 20 bp, Artificial Sequence
  chemically synthesized
ctccccagaagcagacgcca

SEQ ID NO: 604564 - DNA, 20 bp, Artificial Sequence
  chemically synthesized
tgtagaggaagcatggtggc

SEQ ID NO: 604565 - DNA, 20 bp, Artificial Sequence
  chemically synthesized
agacgccaccatgcttcctc

SEQ ID NO: 604566 - DNA, 20 bp, Artificial Sequence
  chemically synthesized
aactgagtgacttacatgaa

SEQ ID NO: 604567 - DNA, 20 bp, Artificial Sequence
  chemically synthesized
ccttataagaagacacaaca

SEQ ID NO: 604568 - DNA, 20 bp, Artificial Sequence
  chemically synthesized
atgaagatagggctcttctg

SEQ ID NO: 604569 - DNA, 20 bp, Artificial Sequence
  chemically synthesized
aatggagactttggaagata

SEQ ID NO: 604570 - DNA, 20 bp, Artificial Sequence
  chemically synthesized
atttccaaattccatcacat

SEQ ID NO: 604571 - DNA, 20 bp, Artificial Sequence
  chemically synthesized
aattccatcacattggagat

SEQ ID NO: 604572 - DNA, 20 bp, Artificial Sequence
  chemically synthesized
atgtgttcatttgtaaagag

SEQ ID NO: 604573 - DNA, 20 bp, Artificial Sequence
  chemically synthesized
ctcctttccccaggagaaag

SEQ ID NO: 604574 - DNA, 20 bp, Artificial Sequence
  chemically synthesized
tttctcctggggaaaggaga

SEQ ID NO: 604575 - DNA, 20 bp, Artificial Sequence
  chemically synthesized
ttacatgtgtttgtcttgaa

SEQ ID NO: 604576 - DNA, 20 bp, Artificial Sequence
  chemically synthesized
cactgtggaaattatattac

SEQ ID NO: 604577 - DNA, 20 bp, Artificial Sequence
  chemically synthesized
aatggaatgtatatggcctt

SEQ ID NO: 604578 - DNA, 20 bp, Artificial Sequence
  chemically synthesized
ttccatttcaggggtgacga

SEQ ID NO: 604579 - DNA, 20 bp, Artificial Sequence
  chemically synthesized
ggtgacgaaatagattcttg

SEQ ID NO: 604580 - DNA, 20 bp, Artificial Sequence
  chemically synthesized
atagattcttggggagatta

SEQ ID NO: 604581 - DNA, 20 bp, Artificial Sequence
  chemically synthesized
agattaagtggcttaagtca

SEQ ID NO: 604582 - DNA, 20 bp, Artificial Sequence
  chemically synthesized
agttggagaagaaaaaagac

SEQ ID NO: 604583 - DNA, 20 bp, Artificial Sequence
  chemically synthesized
tagagcagatgtatctctgc

SEQ ID NO: 604584 - DNA, 20 bp, Artificial Sequence
  chemically synthesized
agatgtatctctgctgtggc

SEQ ID NO: 604585 - DNA, 20 bp, Artificial Sequence
  chemically synthesized
ttaggactgccaggcagaaa

SEQ ID NO: 604586 - DNA, 20 bp, Artificial Sequence
  chemically synthesized
ttctgcctggcagtcctaac

SEQ ID NO: 604587 - DNA, 20 bp, Artificial Sequence
  chemically synthesized
cagaagctggggctttctaa

SEQ ID NO: 604588 - DNA, 20 bp, Artificial Sequence
  chemically synthesized
tttaatctctgttagaaagc

SEQ ID NO: 604589 - DNA, 20 bp, Artificial Sequence
  chemically synthesized
tattaccagagctcagaagc

SEQ ID NO: 604590 - DNA, 20 bp, Artificial Sequence
  chemically synthesized
tggtaatatcactttttctg

SEQ ID NO: 604591 - DNA, 20 bp, Artificial Sequence
  chemically synthesized
tctccagctctagggatatt

SEQ ID NO: 604592 - DNA, 20 bp, Artificial Sequence
  chemically synthesized
tagcagcttccttacgttac

SEQ ID NO: 604593 - DNA, 20 bp, Artificial Sequence
  chemically synthesized
ctccatcccctgcgctgcgt

SEQ ID NO: 604594 - DNA, 20 bp, Artificial Sequence
  chemically synthesized
ctgcgtctcagttttctact

SEQ ID NO: 604595 - DNA, 20 bp, Artificial Sequence
  chemically synthesized
tgcttagccaattccttata

SEQ ID NO: 604596 - DNA, 20 bp, Artificial Sequence
  chemically synthesized
cgtttcctctctttaaatca

SEQ ID NO: 604597 - DNA, 20 bp, Artificial Sequence
  chemically synthesized
ctctctttaaatcacagtga

SEQ ID NO: 604598 - DNA, 20 bp, Artificial Sequence
  chemically synthesized
ttgtcagaaaaacaaaatca

SEQ ID NO: 604599 - DNA, 20 bp, Artificial Sequence
  chemically synthesized
ggatgttgatgagggatttt

SEQ ID NO: 604600 - DNA, 20 bp, Artificial Sequence
  chemically synthesized
aatatttattggatgttgat

SEQ ID NO: 604601 - DNA, 20 bp, Artificial Sequence
  chemically synthesized
aatacctactatgagctgac

SEQ ID NO: 604602 - DNA, 20 bp, Artificial Sequence
  chemically synthesized
ataggtgtacagatgacaag

SEQ ID NO: 604603 - DNA, 20 bp, Artificial Sequence
  chemically synthesized
agaaatgatttcttccctca

SEQ ID NO: 604604 - DNA, 20 bp, Artificial Sequence
  chemically synthesized
tcattaccatacaatttggc

SEQ ID NO: 604605 - DNA, 20 bp, Artificial Sequence
  chemically synthesized
tgctaaggcctcccaaagta

SEQ ID NO: 604606 - DNA, 20 bp, Artificial Sequence
  chemically synthesized
gtttcaccgtgttggctagg

SEQ ID NO: 604607 - DNA, 20 bp, Artificial Sequence
  chemically synthesized
ttttgtatttttagtagaga

SEQ ID NO: 604608 - DNA, 20 bp, Artificial Sequence
  chemically synthesized
ttgggaggctgaggcaggac

SEQ ID NO: 604609 - DNA, 20 bp, Artificial Sequence
  chemically synthesized
atcctctgccccgtgggttc

SEQ ID NO: 604610 - DNA, 20 bp, Artificial Sequence
  chemically synthesized
ctggagtgcagtggcgcgat

SEQ ID NO: 604611 - DNA, 20 bp, Artificial Sequence
  chemically synthesized
gaggcagttctcagccattt

SEQ ID NO: 604612 - DNA, 20 bp, Artificial Sequence
  chemically synthesized
gtacctactgttttctctgc

SEQ ID NO: 604613 - DNA, 20 bp, Artificial Sequence
  chemically synthesized
agcttctgtttctttgtacc

SEQ ID NO: 604614 - DNA, 20 bp, Artificial Sequence
  chemically synthesized
aacagtaggtacaaagaaac

SEQ ID NO: 604615 - DNA, 20 bp, Artificial Sequence
  chemically synthesized
tgctctgtgctttcttaagc

SEQ ID NO: 604616 - DNA, 20 bp, Artificial Sequence
  chemically synthesized
tccaaatgctctgtgctttc

SEQ ID NO: 604617 - DNA, 20 bp, Artificial Sequence
  chemically synthesized
ctctttgatctccaaatgct

SEQ ID NO: 604618 - DNA, 20 bp, Artificial Sequence
  chemically synthesized
tgttccgcactgccctatgc

SEQ ID NO: 604619 - DNA, 20 bp, Artificial Sequence
  chemically synthesized
gaactttgttccgcactgcc

SEQ ID NO: 604620 - DNA, 20 bp, Artificial Sequence
  chemically synthesized
tcagactttagcagacagtg

SEQ ID NO: 604621 - DNA, 20 bp, Artificial Sequence
  chemically synthesized
ctattagtctgtaagaagaa

SEQ ID NO: 604622 - DNA, 20 bp, Artificial Sequence
  chemically synthesized
aatcgtttgttcagtgactc

SEQ ID NO: 604623 - DNA, 20 bp, Artificial Sequence
  chemically synthesized
aatcaactgagtcactgaac

SEQ ID NO: 604624 - DNA, 20 bp, Artificial Sequence
  chemically synthesized
ttaaaagcaaaataagatca

SEQ ID NO: 604625 - DNA, 20 bp, Artificial Sequence
  chemically synthesized
gaacaaacgatttgatctta

SEQ ID NO: 604626 - DNA, 20 bp, Artificial Sequence
  chemically synthesized
tcttgacaaaggaaggagta

SEQ ID NO: 604627 - DNA, 20 bp, Artificial Sequence
  chemically synthesized
acattgatttatattctggc

SEQ ID NO: 604628 - DNA, 20 bp, Artificial Sequence
  chemically synthesized
accagtccacaattgagata

SEQ ID NO: 604629 - DNA, 20 bp, Artificial Sequence
  chemically synthesized
tcaattgtggactggtacta

SEQ ID NO: 604630 - DNA, 20 bp, Artificial Sequence
  chemically synthesized
tggactggtactaaaaagtt

SEQ ID NO: 604631 - DNA, 20 bp, Artificial Sequence
  chemically synthesized
gatctttagctgcctacctc

SEQ ID NO: 604632 - DNA, 20 bp, Artificial Sequence
  chemically synthesized
gaatttctacgccatgcatt

SEQ ID NO: 604633 - DNA, 20 bp, Artificial Sequence
  chemically synthesized
tatcttaaaatgcagtttta

SEQ ID NO: 604634 - DNA, 20 bp, Artificial Sequence
  chemically synthesized
tcccgagggatatcttaaaa

SEQ ID NO: 604635 - DNA, 20 bp, Artificial Sequence
  chemically synthesized
tctgatctcacctctcttat

SEQ ID NO: 604636 - DNA, 20 bp, Artificial Sequence
  chemically synthesized
tttttctgtatgaaattttt

SEQ ID NO: 604637 - DNA, 20 bp, Artificial Sequence
  chemically synthesized
aaaatttcatacagaaaaat

SEQ ID NO: 604638 - DNA, 20 bp, Artificial Sequence
  chemically synthesized
aatgtacctgttaaattctc

SEQ ID NO: 604639 - DNA, 20 bp, Artificial Sequence
  chemically synthesized
gaatttaacaggtacatttg

SEQ ID NO: 604640 - DNA, 20 bp, Artificial Sequence
  chemically synthesized
tggaatctaaaatatagttt

SEQ ID NO: 604641 - DNA, 20 bp, Artificial Sequence
  chemically synthesized
tctaaactccaaaactatat

SEQ ID NO: 604642 - DNA, 20 bp, Artificial Sequence
  chemically synthesized
tttctgactggaatctaaaa

SEQ ID NO: 604643 - DNA, 20 bp, Artificial Sequence
  chemically synthesized
atgcttataggctatgtatt

SEQ ID NO: 604644 - DNA, 20 bp, Artificial Sequence
  chemically synthesized
tgttcatccctgtataattc

SEQ ID NO: 604645 - DNA, 20 bp, Artificial Sequence
  chemically synthesized
atctttatcatcacctatat

SEQ ID NO: 604646 - DNA, 20 bp, Artificial Sequence
  chemically synthesized
atcaaaaatataggtgatga

SEQ ID NO: 604647 - DNA, 20 bp, Artificial Sequence
  chemically synthesized
gtgattttattttcttctta

SEQ ID NO: 604648 - DNA, 20 bp, Artificial Sequence
  chemically synthesized
cagtctacataagactcaaa

SEQ ID NO: 604649 - DNA, 20 bp, Artificial Sequence
  chemically synthesized
gtttctgggacattgttctc

SEQ ID NO: 604650 - DNA, 20 bp, Artificial Sequence
  chemically synthesized
ttcttgaaatttttctctcc

SEQ ID NO: 604651 - DNA, 20 bp, Artificial Sequence
  chemically synthesized
ctttgtcttgtgcttgacag

SEQ ID NO: 604652 - DNA, 20 bp, Artificial Sequence
  chemically synthesized
ttccctttttgacctttgtc

SEQ ID NO: 604653 - DNA, 20 bp, Artificial Sequence
  chemically synthesized
tctctggcgaccttgctgag

SEQ ID NO: 604654 - DNA, 20 bp, Artificial Sequence
  chemically synthesized
atctgtattcccttacggac

SEQ ID NO: 604655 - DNA, 20 bp, Artificial Sequence
  chemically synthesized
gaatacagatagttcaggtc

SEQ ID NO: 604656 - DNA, 20 bp, Artificial Sequence
  chemically synthesized
atagttgagtgcaaataaaa

SEQ ID NO: 604657 - DNA, 20 bp, Artificial Sequence
  chemically synthesized
tgacttttatttgcactcaa

SEQ ID NO: 604658 - DNA, 20 bp, Artificial Sequence
  chemically synthesized
gagctgttacatataatttt

SEQ ID NO: 604659 - DNA, 20 bp, Artificial Sequence
  chemically synthesized
caatatagtgcatttctatt

SEQ ID NO: 604660 - DNA, 20 bp, Artificial Sequence
  chemically synthesized
agaaatggatcctggcccag

SEQ ID NO: 604661 - DNA, 20 bp, Artificial Sequence
  chemically synthesized
cttgtttcatccactagaat

SEQ ID NO: 604662 - DNA, 20 bp, Artificial Sequence
  chemically synthesized
atgaaatgatctatccatat

SEQ ID NO: 604663 - DNA, 20 bp, Artificial Sequence
  chemically synthesized
tatgatgaaatgatctatcc

SEQ ID NO: 604664 - DNA, 20 bp, Artificial Sequence
  chemically synthesized
tgttgcatcttgtgacacct

SEQ ID NO: 604665 - DNA, 20 bp, Artificial Sequence
  chemically synthesized
ggtcataggggaaaggatgg

SEQ ID NO: 604666 - DNA, 20 bp, Artificial Sequence
  chemically synthesized
gtgcaggtcataggggaaag

SEQ ID NO: 604667 - DNA, 20 bp, Artificial Sequence
  chemically synthesized
cacttcttttgtgattcttc

SEQ ID NO: 604668 - DNA, 20 bp, Artificial Sequence
  chemically synthesized
accgggcattttcacttctt

SEQ ID NO: 604669 - DNA, 20 bp, Artificial Sequence
  chemically synthesized
taactgatgacattccacca

SEQ ID NO: 604670 - DNA, 20 bp, Artificial Sequence
  chemically synthesized
gatgacattccaccattgtg

SEQ ID NO: 604671 - DNA, 20 bp, Artificial Sequence
  chemically synthesized
gtttttgccccaccttaacc

SEQ ID NO: 604672 - DNA, 20 bp, Artificial Sequence
  chemically synthesized
gtcacaaggtgctcagtggg

SEQ ID NO: 604673 - DNA, 20 bp, Artificial Sequence
  chemically synthesized
tagtggaaaattacagtcaa

SEQ ID NO: 604674 - DNA, 20 bp, Artificial Sequence
  chemically synthesized
gataggggtggggccgtttt

SEQ ID NO: 604675 - DNA, 20 bp, Artificial Sequence
  chemically synthesized
cggaagggagataggggtgg

SEQ ID NO: 604676 - DNA, 20 bp, Artificial Sequence
  chemically synthesized
agccttgttgctcacacaaa

SEQ ID NO: 604677 - DNA, 20 bp, Artificial Sequence
  chemically synthesized
ccgtgtgaagagaccaccaa

SEQ ID NO: 604678 - DNA, 20 bp, Artificial Sequence
  chemically synthesized
ccttatgacagcccccataa

SEQ ID NO: 604679 - DNA, 20 bp, Artificial Sequence
  chemically synthesized
cttgtcatttacagtctgac

SEQ ID NO: 604680 - DNA, 20 bp, Artificial Sequence
  chemically synthesized
aatgacaagacactccagtg

SEQ ID NO: 604681 - DNA, 20 bp, Artificial Sequence
  chemically synthesized
gtcccacgtgattctgctgc

SEQ ID NO: 604682 - DNA, 20 bp, Artificial Sequence
  chemically synthesized
ttaatttctaacaaggtccc

SEQ ID NO: 604683 - DNA, 20 bp, Artificial Sequence
  chemically synthesized
tcagcatgcgtcggagtcac

SEQ ID NO: 604684 - DNA, 20 bp, Artificial Sequence
  chemically synthesized
tggcatgacaacagtggttc

SEQ ID NO: 604685 - DNA, 20 bp, Artificial Sequence
  chemically synthesized
tggtgtataagtatcaccga

SEQ ID NO: 604686 - DNA, 20 bp, Artificial Sequence
  chemically synthesized
aatatttttgggcccaccag

SEQ ID NO: 604687 - DNA, 20 bp, Artificial Sequence
  chemically synthesized
tttgggcccaccagcagtgt

SEQ ID NO: 604688 - DNA, 20 bp, Artificial Sequence
  chemically synthesized
ccagcagtgtttctgattca

SEQ ID NO: 604689 - DNA, 20 bp, Artificial Sequence
  chemically synthesized
acctgggaccttctttgaaa

SEQ ID NO: 604690 - DNA, 20 bp, Artificial Sequence
  chemically synthesized
aagaaggtcccaggtgatga

SEQ ID NO: 604691 - DNA, 20 bp, Artificial Sequence
  chemically synthesized
gatgatactgtttcatgcac

SEQ ID NO: 604692 - DNA, 20 bp, Artificial Sequence
  chemically synthesized
tatattcttcaaaacactgc

SEQ ID NO: 604693 - DNA, 20 bp, Artificial Sequence
  chemically synthesized
catcaagaataaatcaatag

SEQ ID NO: 604694 - DNA, 20 bp, Artificial Sequence
  chemically synthesized
taaccatctattaaatgttc

SEQ ID NO: 604695 - DNA, 20 bp, Artificial Sequence
  chemically synthesized
tgaggatgtgaagatggtat

SEQ ID NO: 604696 - DNA, 20 bp, Artificial Sequence
  chemically synthesized
accttggtcataaattcaaa

SEQ ID NO: 604697 - DNA, 20 bp, Artificial Sequence
  chemically synthesized
cattgcaactataacactag

SEQ ID NO: 604698 - DNA, 20 bp, Artificial Sequence
  chemically synthesized
aggtccagaaaggttaaata

SEQ ID NO: 604699 - DNA, 20 bp, Artificial Sequence
  chemically synthesized
cctaaggagactagacttat

SEQ ID NO: 604700 - DNA, 20 bp, Artificial Sequence
  chemically synthesized
aaaaagaagcaaatcatcta

SEQ ID NO: 604701 - DNA, 20 bp, Artificial Sequence
  chemically synthesized
gaaacaaaacattttagatg

SEQ ID NO: 604702 - DNA, 20 bp, Artificial Sequence
  chemically synthesized
gaagcaaatcatctaaaatg

SEQ ID NO: 604703 - DNA, 20 bp, Artificial Sequence
  chemically synthesized
ccatagaaacaaaacatttt

SEQ ID NO: 604704 - DNA, 20 bp, Artificial Sequence
  chemically synthesized
aataggcaaaagtgtcatta

SEQ ID NO: 604705 - DNA, 20 bp, Artificial Sequence
  chemically synthesized
gtatattttgccatacaact

SEQ ID NO: 604706 - DNA, 20 bp, Artificial Sequence
  chemically synthesized
ttgccatacaactttcagat

SEQ ID NO: 604707 - DNA, 20 bp, Artificial Sequence
  chemically synthesized
ttttagatattgattataac

SEQ ID NO: 604708 - DNA, 20 bp, Artificial Sequence
  chemically synthesized
taaaacatttttgttttaga

SEQ ID NO: 604709 - DNA, 20 bp, Artificial Sequence
  chemically synthesized
ataatcaatatctaaaacaa

SEQ ID NO: 604710 - DNA, 20 bp, Artificial Sequence
  chemically synthesized
gagactcatgcctaaaacat

SEQ ID NO: 604711 - DNA, 20 bp, Artificial Sequence
  chemically synthesized
gataacagataagaccgctc

SEQ ID NO: 604712 - DNA, 20 bp, Artificial Sequence
  chemically synthesized
tttgtttctgttttttgttt

SEQ ID NO: 604713 - DNA, 20 bp, Artificial Sequence
  chemically synthesized
tcagtttgtttctgtttttt

SEQ ID NO: 604714 - DNA, 20 bp, Artificial Sequence
  chemically synthesized
cttttcagtttgtttctgtt

SEQ ID NO: 604715 - DNA, 20 bp, Artificial Sequence
  chemically synthesized
tattctacttttcagtttgt

SEQ ID NO: 604716 - DNA, 20 bp, Artificial Sequence
  chemically synthesized
attatatattctacttttca

SEQ ID NO: 604717 - DNA, 20 bp, Artificial Sequence
  chemically synthesized
tattattatatattctactt

SEQ ID NO: 604718 - DNA, 20 bp, Artificial Sequence
  chemically synthesized
tgcaggaaatagccgagaaa

SEQ ID NO: 604719 - DNA, 20 bp, Artificial Sequence
  chemically synthesized
ggtaagcagacagaatgtaa

SEQ ID NO: 604720 - DNA, 20 bp, Artificial Sequence
  chemically synthesized
agaaagcaagcttacattct

SEQ ID NO: 604721 - DNA, 20 bp, Artificial Sequence
  chemically synthesized
ccagggtaagcagacagaat

SEQ ID NO: 604722 - DNA, 20 bp, Artificial Sequence
  chemically synthesized
gaaatgcctcagttcacctg

SEQ ID NO: 604723 - DNA, 20 bp, Artificial Sequence
  chemically synthesized
ggacaaagatattcatttat

SEQ ID NO: 604724 - DNA, 20 bp, Artificial Sequence
  chemically synthesized
accaggcagaatgaatggca

SEQ ID NO: 604725 - DNA, 20 bp, Artificial Sequence
  chemically synthesized
gttgctacaaaagtataaat

SEQ ID NO: 604726 - DNA, 20 bp, Artificial Sequence
  chemically synthesized
tattttaagggatttttaaa

SEQ ID NO: 604727 - DNA, 20 bp, Artificial Sequence
  chemically synthesized
aatcatgtagcagttatttt

SEQ ID NO: 604728 - DNA, 20 bp, Artificial Sequence
  chemically synthesized
aatcccttaaaataactgct

SEQ ID NO: 604729 - DNA, 20 bp, Artificial Sequence
  chemically synthesized
tagttaattggtatttatcc

SEQ ID NO: 604730 - DNA, 20 bp, Artificial Sequence
  chemically synthesized
ccaattaactagataataga

SEQ ID NO: 604731 - DNA, 20 bp, Artificial Sequence
  chemically synthesized
cataaatttttctctttaca

SEQ ID NO: 604732 - DNA, 20 bp, Artificial Sequence
  chemically synthesized
agtcgattcctaaataatta

SEQ ID NO: 604733 - DNA, 20 bp, Artificial Sequence
  chemically synthesized
taactatctaaggtacattt

SEQ ID NO: 604734 - DNA, 20 bp, Artificial Sequence
  chemically synthesized
taaaattcagctttctacca

SEQ ID NO: 604735 - DNA, 20 bp, Artificial Sequence
  chemically synthesized
aacaattaagggatttaaaa

SEQ ID NO: 604736 - DNA, 20 bp, Artificial Sequence
  chemically synthesized
agctgaattttaaatccctt

SEQ ID NO: 604737 - DNA, 20 bp, Artificial Sequence
  chemically synthesized
cttatttacccaaaacaatt

SEQ ID NO: 604738 - DNA, 20 bp, Artificial Sequence
  chemically synthesized
attaaagatcatcaggatgg

SEQ ID NO: 604739 - DNA, 20 bp, Artificial Sequence
  chemically synthesized
ggatacaataagtaaccaat

SEQ ID NO: 604740 - DNA, 20 bp, Artificial Sequence
  chemically synthesized
ttacacttctttatgtttta

SEQ ID NO: 604741 - DNA, 20 bp, Artificial Sequence
  chemically synthesized
aagcctattattacacttct

SEQ ID NO: 604742 - DNA, 20 bp, Artificial Sequence
  chemically synthesized
aaacataaagaagtgtaata

SEQ ID NO: 604743 - DNA, 20 bp, Artificial Sequence
  chemically synthesized
gaagtgtaataataggcttc

SEQ ID NO: 604744 - DNA, 20 bp, Artificial Sequence
  chemically synthesized
cagccagtaaattacattac

SEQ ID NO: 604745 - DNA, 20 bp, Artificial Sequence
  chemically synthesized
atttactggctgaagtggaa

SEQ ID NO: 604746 - DNA, 20 bp, Artificial Sequence
  chemically synthesized
ctgaatgccataggaagcac

SEQ ID NO: 604747 - DNA, 20 bp, Artificial Sequence
  chemically synthesized
atacctccaaaataaaaccc

SEQ ID NO: 604748 - DNA, 20 bp, Artificial Sequence
  chemically synthesized
tgggttttattttggaggta

SEQ ID NO: 604749 - DNA, 20 bp, Artificial Sequence
  chemically synthesized
taaaatgaatatatctaaaa

SEQ ID NO: 604750 - DNA, 20 bp, Artificial Sequence
  chemically synthesized
agagaactgccctcctttct

SEQ ID NO: 604751 - DNA, 20 bp, Artificial Sequence
  chemically synthesized
tcttttccttatttattata

SEQ ID NO: 604752 - DNA, 20 bp, Artificial Sequence
  chemically synthesized
tagagatgtcaggtggtaaa

SEQ ID NO: 604753 - DNA, 20 bp, Artificial Sequence
  chemically synthesized
taagaaatgtaaaattacct

SEQ ID NO: 604754 - DNA, 20 bp, Artificial Sequence
  chemically synthesized
ggaaggtaattttacatttc

SEQ ID NO: 604755 - DNA, 20 bp, Artificial Sequence
  chemically synthesized
tacatttcttaggtttgaga

SEQ ID NO: 604756 - DNA, 20 bp, Artificial Sequence
  chemically synthesized
atagagatgatgaagatgga

SEQ ID NO: 604757 - DNA, 20 bp, Artificial Sequence
  chemically synthesized
aacattcaataaatgcagtg

SEQ ID NO: 604758 - DNA, 20 bp, Artificial Sequence
  chemically synthesized
atcgaaccactgcatttatt

SEQ ID NO: 604759 - DNA, 20 bp, Artificial Sequence
  chemically synthesized
caccttaaaggcaatgtatt

SEQ ID NO: 604760 - DNA, 20 bp, Artificial Sequence
  chemically synthesized
gcttatttaatcctcatgac

SEQ ID NO: 604761 - DNA, 20 bp, Artificial Sequence
  chemically synthesized
actttataaaacaactgtca

SEQ ID NO: 604762 - DNA, 20 bp, Artificial Sequence
  chemically synthesized
aaattacttgttatctgtgc

SEQ ID NO: 604763 - DNA, 20 bp, Artificial Sequence
  chemically synthesized
gaaacctgcctgttttaatt

SEQ ID NO: 604764 - DNA, 20 bp, Artificial Sequence
  chemically synthesized
taagctagtaattaaaacag

SEQ ID NO: 604765 - DNA, 20 bp, Artificial Sequence
  chemically synthesized
ctgtggtatttgtgaaacct

SEQ ID NO: 604766 - DNA, 20 bp, Artificial Sequence
  chemically synthesized
tctttgtgtccatgtgtact

SEQ ID NO: 604767 - DNA, 20 bp, Artificial Sequence
  chemically synthesized
aatcagcataatatctgata

SEQ ID NO: 604768 - DNA, 20 bp, Artificial Sequence
  chemically synthesized
aaactacctatcagatatta

SEQ ID NO: 604769 - DNA, 20 bp, Artificial Sequence
  chemically synthesized
atgggtaaattgcgtgttgt

SEQ ID NO: 604770 - DNA, 20 bp, Artificial Sequence
  chemically synthesized
taggttcaaggggttaacgt

SEQ ID NO: 604771 - DNA, 20 bp, Artificial Sequence
  chemically synthesized
cctttttttttttcccaact

SEQ ID NO: 604772 - DNA, 20 bp, Artificial Sequence
  chemically synthesized
cagcattcaaacctcagtaa

SEQ ID NO: 604773 - DNA, 20 bp, Artificial Sequence
  chemically synthesized
gcttttggaatcagaattac

SEQ ID NO: 604774 - DNA, 20 bp, Artificial Sequence
  chemically synthesized
agtaattctgattccaaaag

SEQ ID NO: 604775 - DNA, 20 bp, Artificial Sequence
  chemically synthesized
gtagcaaatatggaaaaaat

SEQ ID NO: 604776 - DNA, 20 bp, Artificial Sequence
  chemically synthesized
tatggttaattggaaggaac

SEQ ID NO: 604777 - DNA, 20 bp, Artificial Sequence
  chemically synthesized
ttgctggatgcacaagcgga

SEQ ID NO: 604778 - DNA, 20 bp, Artificial Sequence
  chemically synthesized
ctttatatctctaaagctat

SEQ ID NO: 604779 - DNA, 20 bp, Artificial Sequence
  chemically synthesized
cggaaatagctttagagata

SEQ ID NO: 604780 - DNA, 20 bp, Artificial Sequence
  chemically synthesized
tgtgacactctccctcaaat

SEQ ID NO: 604781 - DNA, 20 bp, Artificial Sequence
  chemically synthesized
agagtgtcacatctggagct

SEQ ID NO: 604782 - DNA, 20 bp, Artificial Sequence
  chemically synthesized
ttatctggattatctcctct

SEQ ID NO: 604783 - DNA, 20 bp, Artificial Sequence
  chemically synthesized
ccggccttttgacttcttta

SEQ ID NO: 604784 - DNA, 20 bp, Artificial Sequence
  chemically synthesized
cacttcagcctcccaaagtg

SEQ ID NO: 604785 - DNA, 20 bp, Artificial Sequence
  chemically synthesized
tttgtattttttagtagaga

SEQ ID NO: 604786 - DNA, 20 bp, Artificial Sequence
  chemically synthesized
ctcgggaggttgaggcagag

SEQ ID NO: 604787 - DNA, 20 bp, Artificial Sequence
  chemically synthesized
gcttactgcaacctccgcct

SEQ ID NO: 604788 - DNA, 20 bp, Artificial Sequence
  chemically synthesized
ctggagtgcagtggcgggat

SEQ ID NO: 604789 - DNA, 20 bp, Artificial Sequence
  chemically synthesized
cacccacgactctttacctg

SEQ ID NO: 604790 - DNA, 20 bp, Artificial Sequence
  chemically synthesized
ttatttaaatgatgtcctct

SEQ ID NO: 604791 - DNA, 20 bp, Artificial Sequence
  chemically synthesized
ggtcttgaccatctgttgaa

SEQ ID NO: 604792 - DNA, 20 bp, Artificial Sequence
  chemically synthesized
caatattcagtgaaatatta

SEQ ID NO: 604793 - DNA, 20 bp, Artificial Sequence
  chemically synthesized
aagctttatattagctagtg

SEQ ID NO: 604794 - DNA, 20 bp, Artificial Sequence
  chemically synthesized
aaacggggcactagctaata

SEQ ID NO: 604795 - DNA, 20 bp, Artificial Sequence
  chemically synthesized
ggcatcatgcaaatataacc

SEQ ID NO: 604796 - DNA, 20 bp, Artificial Sequence
  chemically synthesized
ggaatcttgttaaagtattg

SEQ ID NO: 604797 - DNA, 20 bp, Artificial Sequence
  chemically synthesized
ttaatcattacaatacttta

SEQ ID NO: 604798 - DNA, 20 bp, Artificial Sequence
  chemically synthesized
caattaatgaatttgttcct

SEQ ID NO: 604799 - DNA, 20 bp, Artificial Sequence
  chemically synthesized
ctgaacacgctatatacgac

SEQ ID NO: 604800 - DNA, 20 bp, Artificial Sequence
  chemically synthesized
aactttcactctcaagtgtg

SEQ ID NO: 604801 - DNA, 20 bp, Artificial Sequence
  chemically synthesized
gggacaacaggtgtaactgg

SEQ ID NO: 604802 - DNA, 20 bp, Artificial Sequence
  chemically synthesized
ggatggcttcaggtaaatca

SEQ ID NO: 604803 - DNA, 20 bp, Artificial Sequence
  chemically synthesized
atatatgactaaggtaatcc

SEQ ID NO: 604804 - DNA, 20 bp, Artificial Sequence
  chemically synthesized
aagacattttactatacagc

SEQ ID NO: 604805 - DNA, 20 bp, Artificial Sequence
  chemically synthesized
acagctacagtgtacctcag

SEQ ID NO: 604806 - DNA, 20 bp, Artificial Sequence
  chemically synthesized
tatgtgctcagtagtagatt

SEQ ID NO: 604807 - DNA, 20 bp, Artificial Sequence
  chemically synthesized
ggatttattatgtgctcagt

SEQ ID NO: 604808 - DNA, 20 bp, Artificial Sequence
  chemically synthesized
ataataaatcctcaatttat

SEQ ID NO: 604809 - DNA, 20 bp, Artificial Sequence
  chemically synthesized
aaataaaagctaacataaat

SEQ ID NO: 604810 - DNA, 20 bp, Artificial Sequence
  chemically synthesized
agtcccattgggcacataca

SEQ ID NO: 604811 - DNA, 20 bp, Artificial Sequence
  chemically synthesized
ctccaaaatttgtttgtatc

SEQ ID NO: 604812 - DNA, 20 bp, Artificial Sequence
  chemically synthesized
tgaaataccttctctccaaa

SEQ ID NO: 604813 - DNA, 20 bp, Artificial Sequence
  chemically synthesized
aaaagtgtgttctgacttct

SEQ ID NO: 604814 - DNA, 20 bp, Artificial Sequence
  chemically synthesized
ttattggctcctgtttggag

SEQ ID NO: 604815 - DNA, 20 bp, Artificial Sequence
  chemically synthesized
tctccaaacaggagccaata

SEQ ID NO: 604816 - DNA, 20 bp, Artificial Sequence
  chemically synthesized
ttcaaaagcttattattggc

SEQ ID NO: 604817 - DNA, 20 bp, Artificial Sequence
  chemically synthesized
caataataagcttttgaaga

SEQ ID NO: 604818 - DNA, 20 bp, Artificial Sequence
  chemically synthesized
tcatgtcaatctctgtcttc

SEQ ID NO: 604819 - DNA, 20 bp, Artificial Sequence
  chemically synthesized
gaagacagagattgacatga

SEQ ID NO: 604820 - DNA, 20 bp, Artificial Sequence
  chemically synthesized
atacagaaattaacagagca

SEQ ID NO: 604821 - DNA, 20 bp, Artificial Sequence
  chemically synthesized
gcaactaggtgtccctatta

SEQ ID NO: 604822 - DNA, 20 bp, Artificial Sequence
  chemically synthesized
tagacaacgcttagtggaca

SEQ ID NO: 604823 - DNA, 20 bp, Artificial Sequence
  chemically synthesized
attaaacatgtgtttataga

SEQ ID NO: 604824 - DNA, 20 bp, Artificial Sequence
  chemically synthesized
actaagcgttgtctataaac

SEQ ID NO: 604825 - DNA, 20 bp, Artificial Sequence
  chemically synthesized
tgtttgttgtcacattaaac

SEQ ID NO: 604826 - DNA, 20 bp, Artificial Sequence
  chemically synthesized
tcctagtaagatgtacatta

SEQ ID NO: 604827 - DNA, 20 bp, Artificial Sequence
  chemically synthesized
aataataaaagaaattcatc

SEQ ID NO: 604828 - DNA, 20 bp, Artificial Sequence
  chemically synthesized
aagaaattcatcaaaagctt

SEQ ID NO: 604829 - DNA, 20 bp, Artificial Sequence
  chemically synthesized
agcataatggcacaaatccg

SEQ ID NO: 604830 - DNA, 20 bp, Artificial Sequence
  chemically synthesized
agcttcacggatttgtgcca

SEQ ID NO: 604831 - DNA, 20 bp, Artificial Sequence
  chemically synthesized
ttttcactccatcaattttt

SEQ ID NO: 604832 - DNA, 20 bp, Artificial Sequence
  chemically synthesized
ttctattaccatcgtgagta

SEQ ID NO: 604833 - DNA, 20 bp, Artificial Sequence
  chemically synthesized
aaaaagaatgctaatattca

SEQ ID NO: 604834 - DNA, 20 bp, Artificial Sequence
  chemically synthesized
attacctatcctatcacaga

SEQ ID NO: 604835 - DNA, 20 bp, Artificial Sequence
  chemically synthesized
taggataggtaataaatatt

SEQ ID NO: 604836 - DNA, 20 bp, Artificial Sequence
  chemically synthesized
attttaggctttgtggacta

SEQ ID NO: 604837 - DNA, 20 bp, Artificial Sequence
  chemically synthesized
ttactttcgcattacaacgg

SEQ ID NO: 604838 - DNA, 20 bp, Artificial Sequence
  chemically synthesized
caaactcatttatttatcac

SEQ ID NO: 604839 - DNA, 20 bp, Artificial Sequence
  chemically synthesized
taatcataagtgataaataa

SEQ ID NO: 604840 - DNA, 20 bp, Artificial Sequence
  chemically synthesized
tcaaatttcagtgttataaa

SEQ ID NO: 604841 - DNA, 20 bp, Artificial Sequence
  chemically synthesized
gtcataaaatattatttttc

SEQ ID NO: 604842 - DNA, 20 bp, Artificial Sequence
  chemically synthesized
tcatcagccaagaagtgttt

SEQ ID NO: 604843 - DNA, 20 bp, Artificial Sequence
  chemically synthesized
ggtatggctcatcagccaag

SEQ ID NO: 604844 - DNA, 20 bp, Artificial Sequence
  chemically synthesized
ctaaccaaatttagcatgct

SEQ ID NO: 604845 - DNA, 20 bp, Artificial Sequence
  chemically synthesized
gctaaatttggttagcaggt

SEQ ID NO: 604846 - DNA, 20 bp, Artificial Sequence
  chemically synthesized
agtttggtgacccctggact

SEQ ID NO: 604847 - DNA, 20 bp, Artificial Sequence
  chemically synthesized
ggtgacccctggactagtgg

SEQ ID NO: 604848 - DNA, 20 bp, Artificial Sequence
  chemically synthesized
ggccttttctccctggttgt

SEQ ID NO: 604849 - DNA, 20 bp, Artificial Sequence
  chemically synthesized
acaaccagggagaaaaggcc

SEQ ID NO: 604850 - DNA, 20 bp, Artificial Sequence
  chemically synthesized
ttattcaaatatattatttg

SEQ ID NO: 604851 - DNA, 20 bp, Artificial Sequence
  chemically synthesized
taatatatttgaataacttc

SEQ ID NO: 604852 - DNA, 20 bp, Artificial Sequence
  chemically synthesized
atttgtgtataccagggtag

SEQ ID NO: 604853 - DNA, 20 bp, Artificial Sequence
  chemically synthesized
attctaatgtcaagtgttcc

SEQ ID NO: 604854 - DNA, 20 bp, Artificial Sequence
  chemically synthesized
tccatgagtttctaaacata

SEQ ID NO: 604855 - DNA, 20 bp, Artificial Sequence
  chemically synthesized
gccgtatgtttttaagcagc

SEQ ID NO: 604856 - DNA, 20 bp, Artificial Sequence
  chemically synthesized
tatgctgcttaaaaacatac

SEQ ID NO: 604857 - DNA, 20 bp, Artificial Sequence
  chemically synthesized
aaagaacgttaaaatctgcc

SEQ ID NO: 604858 - DNA, 20 bp, Artificial Sequence
  chemically synthesized
tcattccagttattgtaatt

SEQ ID NO: 604859 - DNA, 20 bp, Artificial Sequence
  chemically synthesized
ccttttaaaataatttttat

SEQ ID NO: 604860 - DNA, 20 bp, Artificial Sequence
  chemically synthesized
tgccatcattttaatatatc

SEQ ID NO: 604861 - DNA, 20 bp, Artificial Sequence
  chemically synthesized
gaaatgtgttctgtaattac

SEQ ID NO: 604862 - DNA, 20 bp, Artificial Sequence
  chemically synthesized
taatagatgggatccatcct

SEQ ID NO: 604863 - DNA, 20 bp, Artificial Sequence
  chemically synthesized
aagggcctgcttgttgagtc

SEQ ID NO: 604864 - DNA, 20 bp, Artificial Sequence
  chemically synthesized
ttttttcttccttataaagg

SEQ ID NO: 604865 - DNA, 20 bp, Artificial Sequence
  chemically synthesized
aaaaagaaagaaagaaactt

SEQ ID NO: 604866 - DNA, 20 bp, Artificial Sequence
  chemically synthesized
tgtggtagcattttaatcct

SEQ ID NO: 604867 - DNA, 20 bp, Artificial Sequence
  chemically synthesized
taggattaaaatgctaccac

SEQ ID NO: 604868 - DNA, 20 bp, Artificial Sequence
  chemically synthesized
taccacagtagtttatcacc

SEQ ID NO: 604869 - DNA, 20 bp, Artificial Sequence
  chemically synthesized
agtttatcacctatagtttc

SEQ ID NO: 604870 - DNA, 20 bp, Artificial Sequence
  chemically synthesized
aagtaaatgcttaatggaaa

SEQ ID NO: 604871 - DNA, 20 bp, Artificial Sequence
  chemically synthesized
tcactatcgcaacagaaagt

SEQ ID NO: 604872 - DNA, 20 bp, Artificial Sequence
  chemically synthesized
gcatttactttctgttgcga

SEQ ID NO: 604873 - DNA, 20 bp, Artificial Sequence
  chemically synthesized
ttgcgatagtgatttcttgt

SEQ ID NO: 604874 - DNA, 20 bp, Artificial Sequence
  chemically synthesized
taactgacattacaggtacc

SEQ ID NO: 604875 - DNA, 20 bp, Artificial Sequence
  chemically synthesized
atttacagcagttttgttgg

SEQ ID NO: 604876 - DNA, 20 bp, Artificial Sequence
  chemically synthesized
caccaacaaaactgctgtaa

SEQ ID NO: 604877 - DNA, 20 bp, Artificial Sequence
  chemically synthesized
agtggagaaaactcatttac

SEQ ID NO: 604878 - DNA, 20 bp, Artificial Sequence
  chemically synthesized
tctccacttcatttgcagat

SEQ ID NO: 604879 - DNA, 20 bp, Artificial Sequence
  chemically synthesized
taggaaaaggtgagagcatc

SEQ ID NO: 604880 - DNA, 20 bp, Artificial Sequence
  chemically synthesized
caaaagaagaggcagattac

SEQ ID NO: 604881 - DNA, 20 bp, Artificial Sequence
  chemically synthesized
accacctccccaaaagaaga

SEQ ID NO: 604882 - DNA, 20 bp, Artificial Sequence
  chemically synthesized
gtggtggaagttcctcttga

SEQ ID NO: 604883 - DNA, 20 bp, Artificial Sequence
  chemically synthesized
tcccttgtggtcaccgtagt

SEQ ID NO: 604884 - DNA, 20 bp, Artificial Sequence
  chemically synthesized
acctctgtttcaatacttct

SEQ ID NO: 604885 - DNA, 20 bp, Artificial Sequence
  chemically synthesized
tctttctagcaatgtctgac

SEQ ID NO: 604886 - DNA, 20 bp, Artificial Sequence
  chemically synthesized
gctagaaagacttcagtaaa

SEQ ID NO: 604887 - DNA, 20 bp, Artificial Sequence
  chemically synthesized
ggaaaataatgagaaactgt

SEQ ID NO: 604888 - DNA, 20 bp, Artificial Sequence
  chemically synthesized
tcaatctaccaacaagcaag

SEQ ID NO: 604889 - DNA, 20 bp, Artificial Sequence
  chemically synthesized
agaaactgttcttgcttgtt

SEQ ID NO: 604890 - DNA, 20 bp, Artificial Sequence
  chemically synthesized
accatattgaagccaaataa

SEQ ID NO: 604891 - DNA, 20 bp, Artificial Sequence
  chemically synthesized
agtcagataaaacaatttta

SEQ ID NO: 604892 - DNA, 20 bp, Artificial Sequence
  chemically synthesized
ataaaattgttttatctgac

SEQ ID NO: 604893 - DNA, 20 bp, Artificial Sequence
  chemically synthesized
cgctaaattgactttcgatg

SEQ ID NO: 604894 - DNA, 20 bp, Artificial Sequence
  chemically synthesized
tgcccccaccccttatttcc

SEQ ID NO: 604895 - DNA, 20 bp, Artificial Sequence
  chemically synthesized
ttctgatagttaattctaca

SEQ ID NO: 604896 - DNA, 20 bp, Artificial Sequence
  chemically synthesized
ttaattctacatgctgttta

SEQ ID NO: 604897 - DNA, 20 bp, Artificial Sequence
  chemically synthesized
tccattgcctagaacatttt

SEQ ID NO: 604898 - DNA, 20 bp, Artificial Sequence
  chemically synthesized
gaacattttaaatgcttatt

SEQ ID NO: 604899 - DNA, 20 bp, Artificial Sequence
  chemically synthesized
gcatttttggttatcataca

SEQ ID NO: 604900 - DNA, 20 bp, Artificial Sequence
  chemically synthesized
ctctttaatcaaataagtga

SEQ ID NO: 604901 - DNA, 20 bp, Artificial Sequence
  chemically synthesized
ttttaaaagctgtttcactt

SEQ ID NO: 604902 - DNA, 20 bp, Artificial Sequence
  chemically synthesized
ccttttattgtaattttaaa

SEQ ID NO: 604903 - DNA, 20 bp, Artificial Sequence
  chemically synthesized
aatgctaaaaaacacactac

SEQ ID NO: 604904 - DNA, 20 bp, Artificial Sequence
  chemically synthesized
ctaaaaaacacactactctt

SEQ ID NO: 604905 - DNA, 20 bp, Artificial Sequence
  chemically synthesized
atttaaatcaaacaagagta

SEQ ID NO: 604906 - DNA, 20 bp, Artificial Sequence
  chemically synthesized
tactcttgtttgatttaaat

SEQ ID NO: 604907 - DNA, 20 bp, Artificial Sequence
  chemically synthesized
attcatcactggagacactt

SEQ ID NO: 604908 - DNA, 20 bp, Artificial Sequence
  chemically synthesized
aaagtatgaacaggaggtaa

SEQ ID NO: 604909 - DNA, 20 bp, Artificial Sequence
  chemically synthesized
gagacggagaatatgataag

SEQ ID NO: 604910 - DNA, 20 bp, Artificial Sequence
  chemically synthesized
gtctcacagagctcctctca

SEQ ID NO: 604911 - DNA, 20 bp, Artificial Sequence
  chemically synthesized
aagttggattgccagaagga

SEQ ID NO: 604912 - DNA, 20 bp, Artificial Sequence
  chemically synthesized
gaaacagaccttgcatataa

SEQ ID NO: 604913 - DNA, 20 bp, Artificial Sequence
  chemically synthesized
caatccaacttatatgcaag

SEQ ID NO: 604914 - DNA, 20 bp, Artificial Sequence
  chemically synthesized
ctcctttgcttgtaaccaga

SEQ ID NO: 604915 - DNA, 20 bp, Artificial Sequence
  chemically synthesized
acccagccagatccctgctc

SEQ ID NO: 604916 - DNA, 20 bp, Artificial Sequence
  chemically synthesized
ggagcagggatctggctggg

SEQ ID NO: 604917 - DNA, 20 bp, Artificial Sequence
  chemically synthesized
aatttgccaagaggtaaggg

SEQ ID NO: 604918 - DNA, 20 bp, Artificial Sequence
  chemically synthesized
cagtcctcgtgtatgaggca

SEQ ID NO: 604919 - DNA, 20 bp, Artificial Sequence
  chemically synthesized
ctccctgcctcatacacgag

SEQ ID NO: 604920 - DNA, 20 bp, Artificial Sequence
  chemically synthesized
aagctgaaataagaagatcc

SEQ ID NO: 604921 - DNA, 20 bp, Artificial Sequence
  chemically synthesized
aagcctcaggatcttcttat

SEQ ID NO: 604922 - DNA, 20 bp, Artificial Sequence
  chemically synthesized
ttttacttaagacatcatgg

SEQ ID NO: 604923 - DNA, 20 bp, Artificial Sequence
  chemically synthesized
tccatgatgtcttaagtaaa

SEQ ID NO: 604924 - DNA, 20 bp, Artificial Sequence
  chemically synthesized
gtaaaaattgctttgacata

SEQ ID NO: 604925 - DNA, 20 bp, Artificial Sequence
  chemically synthesized
ctttacctatgtgagggact

SEQ ID NO: 604926 - DNA, 20 bp, Artificial Sequence
  chemically synthesized
gctaaaaggatactaagaat

SEQ ID NO: 604927 - DNA, 20 bp, Artificial Sequence
  chemically synthesized
agtttctacatttgccaagc

SEQ ID NO: 604928 - DNA, 20 bp, Artificial Sequence
  chemically synthesized
gatcctagagaagataaaac

SEQ ID NO: 604929 - DNA, 20 bp, Artificial Sequence
  chemically synthesized
tttatcttctctaggatctc

SEQ ID NO: 604930 - DNA, 20 bp, Artificial Sequence
  chemically synthesized
aattaaagttgtttgaggtt

SEQ ID NO: 604931 - DNA, 20 bp, Artificial Sequence
  chemically synthesized
gtcaacagacttataattaa

SEQ ID NO: 604932 - DNA, 20 bp, Artificial Sequence
  chemically synthesized
ttttttagagctatgttgct

SEQ ID NO: 604933 - DNA, 20 bp, Artificial Sequence
  chemically synthesized
ttaagctttttttagagcta

SEQ ID NO: 604934 - DNA, 20 bp, Artificial Sequence
  chemically synthesized
gaaagcaacatagctctaaa

SEQ ID NO: 604935 - DNA, 20 bp, Artificial Sequence
  chemically synthesized
gcaatgtttgagtttatatt

SEQ ID NO: 604936 - DNA, 20 bp, Artificial Sequence
  chemically synthesized
ttttgtgttgggtgcaatgt

SEQ ID NO: 604937 - DNA, 20 bp, Artificial Sequence
  chemically synthesized
tggtcattttgtgttgggtg

SEQ ID NO: 604938 - DNA, 20 bp, Artificial Sequence
  chemically synthesized
aatgaccattacgtgataaa

SEQ ID NO: 604939 - DNA, 20 bp, Artificial Sequence
  chemically synthesized
atttctagtcaaaaagaaaa

SEQ ID NO: 604940 - DNA, 20 bp, Artificial Sequence
  chemically synthesized
aaaagaaaatgtagttttta

SEQ ID NO: 604941 - DNA, 20 bp, Artificial Sequence
  chemically synthesized
tattttttaaccatgagaaa

SEQ ID NO: 604942 - DNA, 20 bp, Artificial Sequence
  chemically synthesized
aactgcattttctttgcaaa

SEQ ID NO: 604943 - DNA, 20 bp, Artificial Sequence
  chemically synthesized
aacttgctttgcaaagaaaa

SEQ ID NO: 604944 - DNA, 20 bp, Artificial Sequence
  chemically synthesized
gaggctagaagataatattt

SEQ ID NO: 604945 - DNA, 20 bp, Artificial Sequence
  chemically synthesized
gaatctctgcattctggtct

SEQ ID NO: 604946 - DNA, 20 bp, Artificial Sequence
  chemically synthesized
taaacatacagaccagaatg

SEQ ID NO: 604947 - DNA, 20 bp, Artificial Sequence
  chemically synthesized
gattggatataactgcatga

SEQ ID NO: 604948 - DNA, 20 bp, Artificial Sequence
  chemically synthesized
tttagtagcacaaatgttct

SEQ ID NO: 604949 - DNA, 20 bp, Artificial Sequence
  chemically synthesized
aggttgagtatatttttaaa

SEQ ID NO: 604950 - DNA, 20 bp, Artificial Sequence
  chemically synthesized
tcttactactcttttattaa

SEQ ID NO: 604951 - DNA, 20 bp, Artificial Sequence
  chemically synthesized
atttttcaattacagtgtag

SEQ ID NO: 604952 - DNA, 20 bp, Artificial Sequence
  chemically synthesized
ctatatttacagggtgaatg

SEQ ID NO: 604953 - DNA, 20 bp, Artificial Sequence
  chemically synthesized
ttgtatgaagtaggttttga

SEQ ID NO: 604954 - DNA, 20 bp, Artificial Sequence
  chemically synthesized
ttttattctgattgtatgaa

SEQ ID NO: 604955 - DNA, 20 bp, Artificial Sequence
  chemically synthesized
acatgactgattgtttttta

SEQ ID NO: 604956 - DNA, 20 bp, Artificial Sequence
  chemically synthesized
aggaaatttagtacatgact

SEQ ID NO: 604957 - DNA, 20 bp, Artificial Sequence
  chemically synthesized
cataaggaaatttagtacat

SEQ ID NO: 604958 - DNA, 20 bp, Artificial Sequence
  chemically synthesized
agtcatgtactaaatttcct

SEQ ID NO: 604959 - DNA, 20 bp, Artificial Sequence
  chemically synthesized
cctctcctgtctatatttcc

SEQ ID NO: 604960 - DNA, 20 bp, Artificial Sequence
  chemically synthesized
gaaggccatttaacatgacc

SEQ ID NO: 604961 - DNA, 20 bp, Artificial Sequence
  chemically synthesized
tgcatgctaagaaaggagct

SEQ ID NO: 604962 - DNA, 20 bp, Artificial Sequence
  chemically synthesized
gtttgcttgcatgctaagaa

SEQ ID NO: 604963 - DNA, 20 bp, Artificial Sequence
  chemically synthesized
catctttcccaatggggaaa

SEQ ID NO: 604964 - DNA, 20 bp, Artificial Sequence
  chemically synthesized
agaacatctttcccaatggg

SEQ ID NO: 604965 - DNA, 20 bp, Artificial Sequence
  chemically synthesized
ttaacaaccagaggaatcct

SEQ ID NO: 604966 - DNA, 20 bp, Artificial Sequence
  chemically synthesized
caagaggaagtcttaatcag

SEQ ID NO: 604967 - DNA, 20 bp, Artificial Sequence
  chemically synthesized
taagacttcctcttgttaaa

SEQ ID NO: 604968 - DNA, 20 bp, Artificial Sequence
  chemically synthesized
gctttcattcagaactcaaa

SEQ ID NO: 604969 - DNA, 20 bp, Artificial Sequence
  chemically synthesized
tagaaatgatattcaattta

SEQ ID NO: 604970 - DNA, 20 bp, Artificial Sequence
  chemically synthesized
tatcatttctacctgatatt

SEQ ID NO: 604971 - DNA, 20 bp, Artificial Sequence
  chemically synthesized
tatttatcagggtcatgatt

SEQ ID NO: 604972 - DNA, 20 bp, Artificial Sequence
  chemically synthesized
gaaaatgatatttatcaggg

SEQ ID NO: 604973 - DNA, 20 bp, Artificial Sequence
  chemically synthesized
ctagcaaataactggcatta

SEQ ID NO: 604974 - DNA, 20 bp, Artificial Sequence
  chemically synthesized
atttgctagaagtagatata

SEQ ID NO: 604975 - DNA, 20 bp, Artificial Sequence
  chemically synthesized
cttgattcgtcatccaaaac

SEQ ID NO: 604976 - DNA, 20 bp, Artificial Sequence
  chemically synthesized
gtcatccaaaaccaatgttt

SEQ ID NO: 604977 - DNA, 20 bp, Artificial Sequence
  chemically synthesized
ggtgtccaaagccaagaaac

SEQ ID NO: 604978 - DNA, 20 bp, Artificial Sequence
  chemically synthesized
acttacacagttttagaatt

SEQ ID NO: 604979 - DNA, 20 bp, Artificial Sequence
  chemically synthesized
ttcagctgctgaataactta

SEQ ID NO: 604980 - DNA, 20 bp, Artificial Sequence
  chemically synthesized
gttattcagcagctgaacca

SEQ ID NO: 604981 - DNA, 20 bp, Artificial Sequence
  chemically synthesized
acaaggtttctataaaattc

SEQ ID NO: 604982 - DNA, 20 bp, Artificial Sequence
  chemically synthesized
tgccgtaaggttcctaaata

SEQ ID NO: 604983 - DNA, 20 bp, Artificial Sequence
  chemically synthesized
attcatcttcacaattattt

SEQ ID NO: 604984 - DNA, 20 bp, Artificial Sequence
  chemically synthesized
gagaaaattacttgattact

SEQ ID NO: 604985 - DNA, 20 bp, Artificial Sequence
  chemically synthesized
taacatttaaagagaaaatt

SEQ ID NO: 604986 - DNA, 20 bp, Artificial Sequence
  chemically synthesized
ttctctttaaatgttatgaa

SEQ ID NO: 604987 - DNA, 20 bp, Artificial Sequence
  chemically synthesized
taaaatgctagctgagagaa

SEQ ID NO: 604988 - DNA, 20 bp, Artificial Sequence
  chemically synthesized
tctcagctagcattttaaca

SEQ ID NO: 604989 - DNA, 20 bp, Artificial Sequence
  chemically synthesized
aggctagatataatatttat

SEQ ID NO: 604990 - DNA, 20 bp, Artificial Sequence
  chemically synthesized
aaccatcatctatgacatga

SEQ ID NO: 604991 - DNA, 20 bp, Artificial Sequence
  chemically synthesized
aacaacctcatgtcatagat

SEQ ID NO: 604992 - DNA, 20 bp, Artificial Sequence
  chemically synthesized
aatattttaatgtcattgga

SEQ ID NO: 604993 - DNA, 20 bp, Artificial Sequence
  chemically synthesized
ttttaatgtcattggaaaac

SEQ ID NO: 604994 - DNA, 20 bp, Artificial Sequence
  chemically synthesized
tttactcaatagtgtaaagc

SEQ ID NO: 604995 - DNA, 20 bp, Artificial Sequence
  chemically synthesized
caaccaatgtttatgtctag

SEQ ID NO: 604996 - DNA, 20 bp, Artificial Sequence
  chemically synthesized
caatgctagacataaacatt

SEQ ID NO: 604997 - DNA, 20 bp, Artificial Sequence
  chemically synthesized
tttctctgtcaaaaatcaac

SEQ ID NO: 604998 - DNA, 20 bp, Artificial Sequence
  chemically synthesized
agtgtatatttctgtattcc

SEQ ID NO: 604999 - DNA, 20 bp, Artificial Sequence
  chemically synthesized
gcaaaactttcaaaattttt

SEQ ID NO: 605000 - DNA, 20 bp, Artificial Sequence
  chemically synthesized
tgtaagcaaagaaaaatttt

SEQ ID NO: 605001 - DNA, 20 bp, Artificial Sequence
  chemically synthesized
aaattttgaaagttttgcca

SEQ ID NO: 605002 - DNA, 20 bp, Artificial Sequence
  chemically synthesized
tttgaaagttttgccaaact

SEQ ID NO: 605003 - DNA, 20 bp, Artificial Sequence
  chemically synthesized
gaaatgatagatttaaaaca

SEQ ID NO: 605004 - DNA, 20 bp, Artificial Sequence
  chemically synthesized
cttaatatataaatagaaat

SEQ ID NO: 605005 - DNA, 20 bp, Artificial Sequence
  chemically synthesized
taatgcattgagtgacagga

SEQ ID NO: 605006 - DNA, 20 bp, Artificial Sequence
  chemically synthesized
tacgttattcttatcatgct

SEQ ID NO: 605007 - DNA, 20 bp, Artificial Sequence
  chemically synthesized
aaggcactacgttattctta

SEQ ID NO: 605008 - DNA, 20 bp, Artificial Sequence
  chemically synthesized
ataacgtagtgccttcacta

SEQ ID NO: 605009 - DNA, 20 bp, Artificial Sequence
  chemically synthesized
gagtcaaaactagaatagaa

SEQ ID NO: 605010 - DNA, 20 bp, Artificial Sequence
  chemically synthesized
taggtcaaactatattctat

SEQ ID NO: 605011 - DNA, 20 bp, Artificial Sequence
  chemically synthesized
aaagtatagttagctagata

SEQ ID NO: 605012 - DNA, 20 bp, Artificial Sequence
  chemically synthesized
tacccagtcacctttcttca

SEQ ID NO: 605013 - DNA, 20 bp, Artificial Sequence
  chemically synthesized
tttccctagtaaaaatggga

SEQ ID NO: 605014 - DNA, 20 bp, Artificial Sequence
  chemically synthesized
tacttgtctttacatttggg

SEQ ID NO: 605015 - DNA, 20 bp, Artificial Sequence
  chemically synthesized
caattattaaacaccagatc

SEQ ID NO: 605016 - DNA, 20 bp, Artificial Sequence
  chemically synthesized
cagtgtataaactatggatc

SEQ ID NO: 605017 - DNA, 20 bp, Artificial Sequence
  chemically synthesized
taaagatgaagaaaataatg

SEQ ID NO: 605018 - DNA, 20 bp, Artificial Sequence
  chemically synthesized
acaggtgtgttacaagcaag

SEQ ID NO: 605019 - DNA, 20 bp, Artificial Sequence
  chemically synthesized
ttaccagcccatgaagctgt

SEQ ID NO: 605020 - DNA, 20 bp, Artificial Sequence
  chemically synthesized
ttgcccagggcccctgctca

SEQ ID NO: 605021 - DNA, 20 bp, Artificial Sequence
  chemically synthesized
ggcccctgctcaggaggctt

SEQ ID NO: 605022 - DNA, 20 bp, Artificial Sequence
  chemically synthesized
cctgctcaggaggcttccat

SEQ ID NO: 605023 - DNA, 20 bp, Artificial Sequence
  chemically synthesized
cttccatgcttgttttcaag

SEQ ID NO: 605024 - DNA, 20 bp, Artificial Sequence
  chemically synthesized
gaatttcaagacagtggaag

SEQ ID NO: 605025 - DNA, 20 bp, Artificial Sequence
  chemically synthesized
ttaggtcttgaacaggaagc

SEQ ID NO: 605026 - DNA, 20 bp, Artificial Sequence
  chemically synthesized
ttgaacaggaagcccttgtt

SEQ ID NO: 605027 - DNA, 20 bp, Artificial Sequence
  chemically synthesized
gcccagtgcaaactgaaaac

SEQ ID NO: 605028 - DNA, 20 bp, Artificial Sequence
  chemically synthesized
ccacaaattatgtagccagt

SEQ ID NO: 605029 - DNA, 20 bp, Artificial Sequence
  chemically synthesized
aaaattcttcaaatttccct

SEQ ID NO: 605030 - DNA, 20 bp, Artificial Sequence
  chemically synthesized
tatactcaaccttcttactc

SEQ ID NO: 605031 - DNA, 20 bp, Artificial Sequence
  chemically synthesized
tcataagattacatatgtta

SEQ ID NO: 605032 - DNA, 20 bp, Artificial Sequence
  chemically synthesized
gaatgagaaaatgtaaattt

SEQ ID NO: 605033 - DNA, 20 bp, Artificial Sequence
  chemically synthesized
agggtgtgcctcttcttgca

SEQ ID NO: 605034 - DNA, 20 bp, Artificial Sequence
  chemically synthesized
aacttcatttcttgagcata

SEQ ID NO: 605035 - DNA, 20 bp, Artificial Sequence
  chemically synthesized
aaagaacttcatttcttgag

SEQ ID NO: 605036 - DNA, 20 bp, Artificial Sequence
  chemically synthesized
ttctttccatcttctcttcc

SEQ ID NO: 605037 - DNA, 20 bp, Artificial Sequence
  chemically synthesized
ttaaatttgctttgatgtac

SEQ ID NO: 605038 - DNA, 20 bp, Artificial Sequence
  chemically synthesized
tgtccttttgtattctttaa

SEQ ID NO: 605039 - DNA, 20 bp, Artificial Sequence
  chemically synthesized
actttttttctaccactgtc

SEQ ID NO: 605040 - DNA, 20 bp, Artificial Sequence
  chemically synthesized
gttaagttatacatgacttg

SEQ ID NO: 605041 - DNA, 20 bp, Artificial Sequence
  chemically synthesized
cgtatagtagtctgtaccat

SEQ ID NO: 605042 - DNA, 20 bp, Artificial Sequence
  chemically synthesized
tatacggccaacctatgtgg

SEQ ID NO: 605043 - DNA, 20 bp, Artificial Sequence
  chemically synthesized
tcagtatagtcacatgctgt

SEQ ID NO: 605044 - DNA, 20 bp, Artificial Sequence
  chemically synthesized
tatttttattgtacctttcg

SEQ ID NO: 605045 - DNA, 20 bp, Artificial Sequence
  chemically synthesized
ttttaaaaaaattttctaaa

SEQ ID NO: 605046 - DNA, 20 bp, Artificial Sequence
  chemically synthesized
tgggttttaaaaaaattttc

SEQ ID NO: 605047 - DNA, 20 bp, Artificial Sequence
  chemically synthesized
agtgttgttggtataatttt

SEQ ID NO: 605048 - DNA, 20 bp, Artificial Sequence
  chemically synthesized
gttttgagcaatttgcttaa

SEQ ID NO: 605049 - DNA, 20 bp, Artificial Sequence
  chemically synthesized
ttaatgtatggttttgagca

SEQ ID NO: 605050 - DNA, 20 bp, Artificial Sequence
  chemically synthesized
gtttgatttccattttaatg

SEQ ID NO: 605051 - DNA, 20 bp, Artificial Sequence
  chemically synthesized
aggtcattcaggagcagttt

SEQ ID NO: 605052 - DNA, 20 bp, Artificial Sequence
  chemically synthesized
ccagaggtcattcaggagca

SEQ ID NO: 605053 - DNA, 20 bp, Artificial Sequence
  chemically synthesized
ttacccagaggtcattcagg

SEQ ID NO: 605054 - DNA, 20 bp, Artificial Sequence
  chemically synthesized
cttgatttctgccttaattt

SEQ ID NO: 605055 - DNA, 20 bp, Artificial Sequence
  chemically synthesized
ttcattagtttcaaataatt

SEQ ID NO: 605056 - DNA, 20 bp, Artificial Sequence
  chemically synthesized
ttacatctttttaaattttc

SEQ ID NO: 605057 - DNA, 20 bp, Artificial Sequence
  chemically synthesized
acgctgctttgtgtgtgtcc

SEQ ID NO: 605058 - DNA, 20 bp, Artificial Sequence
  chemically synthesized
acacaaagcagcgttaagag

SEQ ID NO: 605059 - DNA, 20 bp, Artificial Sequence
  chemically synthesized
gccataagcttgcctcttaa

SEQ ID NO: 605060 - DNA, 20 bp, Artificial Sequence
  chemically synthesized
tgatatgggtgtttcgtgcc

SEQ ID NO: 605061 - DNA, 20 bp, Artificial Sequence
  chemically synthesized
tccttctaactttttgatat

SEQ ID NO: 605062 - DNA, 20 bp, Artificial Sequence
  chemically synthesized
tgtttctcgttccttgtgat

SEQ ID NO: 605063 - DNA, 20 bp, Artificial Sequence
  chemically synthesized
tagctttggggttagtttgc

SEQ ID NO: 605064 - DNA, 20 bp, Artificial Sequence
  chemically synthesized
tcctgtcttctagctttggg

SEQ ID NO: 605065 - DNA, 20 bp, Artificial Sequence
  chemically synthesized
attttggttatttcctgtct

SEQ ID NO: 605066 - DNA, 20 bp, Artificial Sequence
  chemically synthesized
ctcattttccttcagttcag

SEQ ID NO: 605067 - DNA, 20 bp, Artificial Sequence
  chemically synthesized
cctagattcattgacctttt

SEQ ID NO: 605068 - DNA, 20 bp, Artificial Sequence
  chemically synthesized
aaaaggtcaatgaatctagg

SEQ ID NO: 605069 - DNA, 20 bp, Artificial Sequence
  chemically synthesized
attatttcaaagaaacagct

SEQ ID NO: 605070 - DNA, 20 bp, Artificial Sequence
  chemically synthesized
atcccctttgtcatttttta

SEQ ID NO: 605071 - DNA, 20 bp, Artificial Sequence
  chemically synthesized
gttcattatgaatagtctct

SEQ ID NO: 605072 - DNA, 20 bp, Artificial Sequence
  chemically synthesized
tatccattgcttctaggttt

SEQ ID NO: 605073 - DNA, 20 bp, Artificial Sequence
  chemically synthesized
tagcaatttatccattgctt

SEQ ID NO: 605074 - DNA, 20 bp, Artificial Sequence
  chemically synthesized
taagtttctagcaatttatc

SEQ ID NO: 605075 - DNA, 20 bp, Artificial Sequence
  chemically synthesized
tgctagaaacttacaacttt

SEQ ID NO: 605076 - DNA, 20 bp, Artificial Sequence
  chemically synthesized
tggttcaaacttggaaagtt

SEQ ID NO: 605077 - DNA, 20 bp, Artificial Sequence
  chemically synthesized
gaactcattattggtctgtt

SEQ ID NO: 605078 - DNA, 20 bp, Artificial Sequence
  chemically synthesized
tcctgggctttttctggttg

SEQ ID NO: 605079 - DNA, 20 bp, Artificial Sequence
  chemically synthesized
ccagaaaaagcccaggacca

SEQ ID NO: 605080 - DNA, 20 bp, Artificial Sequence
  chemically synthesized
aggtgtgaatctgtctggtc

SEQ ID NO: 605081 - DNA, 20 bp, Artificial Sequence
  chemically synthesized
agtggtttcataggaatgat

SEQ ID NO: 605082 - DNA, 20 bp, Artificial Sequence
  chemically synthesized
gccgctcctcaatttttggg

SEQ ID NO: 605083 - DNA, 20 bp, Artificial Sequence
  chemically synthesized
gccaggttttggtatcagga

SEQ ID NO: 605084 - DNA, 20 bp, Artificial Sequence
  chemically synthesized
ttttggttgttgtgtgtctg

SEQ ID NO: 605085 - DNA, 20 bp, Artificial Sequence
  chemically synthesized
gttcattagggacattggcc

SEQ ID NO: 605086 - DNA, 20 bp, Artificial Sequence
  chemically synthesized
ctttttgatgtgctgctgga

SEQ ID NO: 605087 - DNA, 20 bp, Artificial Sequence
  chemically synthesized
gattagctttttgatgtgct

SEQ ID NO: 605088 - DNA, 20 bp, Artificial Sequence
  chemically synthesized
aagctccttgatcatggtgg

SEQ ID NO: 605089 - DNA, 20 bp, Artificial Sequence
  chemically synthesized
aagctaatccaccatgatca

SEQ ID NO: 605090 - DNA, 20 bp, Artificial Sequence
  chemically synthesized
gatagaagctccttgatcat

SEQ ID NO: 605091 - DNA, 20 bp, Artificial Sequence
  chemically synthesized
cttctatcccagggttgcga

SEQ ID NO: 605092 - DNA, 20 bp, Artificial Sequence
  chemically synthesized
caacatacacaagtcaataa

SEQ ID NO: 605093 - DNA, 20 bp, Artificial Sequence
  chemically synthesized
atgtggtttttgattttttg

SEQ ID NO: 605094 - DNA, 20 bp, Artificial Sequence
  chemically synthesized
tactgaaatgatcatgtggt

SEQ ID NO: 605095 - DNA, 20 bp, Artificial Sequence
  chemically synthesized
tatatctactgaaatgatca

SEQ ID NO: 605096 - DNA, 20 bp, Artificial Sequence
  chemically synthesized
tccttcagtgcctagtttgt

SEQ ID NO: 605097 - DNA, 20 bp, Artificial Sequence
  chemically synthesized
tgaaatatgttccttcagtg

SEQ ID NO: 605098 - DNA, 20 bp, Artificial Sequence
  chemically synthesized
atgtgcaaaagccagaagca

SEQ ID NO: 605099 - DNA, 20 bp, Artificial Sequence
  chemically synthesized
cagttttcaagcacaatgct

SEQ ID NO: 605100 - DNA, 20 bp, Artificial Sequence
  chemically synthesized
cttatgccagttttcaagca

SEQ ID NO: 605101 - DNA, 20 bp, Artificial Sequence
  chemically synthesized
agagggcccccttgtcttat

SEQ ID NO: 605102 - DNA, 20 bp, Artificial Sequence
  chemically synthesized
gatttctagtactatgttca

SEQ ID NO: 605103 - DNA, 20 bp, Artificial Sequence
  chemically synthesized
ctctttcctgattgctttgg

SEQ ID NO: 605104 - DNA, 20 bp, Artificial Sequence
  chemically synthesized
tgcctttatttctctttcct

SEQ ID NO: 605105 - DNA, 20 bp, Artificial Sequence
  chemically synthesized
ggattgcctttatttctctt

SEQ ID NO: 605106 - DNA, 20 bp, Artificial Sequence
  chemically synthesized
tttgacttcctctcttccta

SEQ ID NO: 605107 - DNA, 20 bp, Artificial Sequence
  chemically synthesized
aagagaggaagtcaaattat

SEQ ID NO: 605108 - DNA, 20 bp, Artificial Sequence
  chemically synthesized
tgaggttgtgtatcagatca

SEQ ID NO: 605109 - DNA, 20 bp, Artificial Sequence
  chemically synthesized
gatctgatacacaacctcag

SEQ ID NO: 605110 - DNA, 20 bp, Artificial Sequence
  chemically synthesized
gaacactagtgatatttata

SEQ ID NO: 605111 - DNA, 20 bp, Artificial Sequence
  chemically synthesized
gactgtgttcttcatttggc

SEQ ID NO: 605112 - DNA, 20 bp, Artificial Sequence
  chemically synthesized
agtttagcagtgtttcacct

SEQ ID NO: 605113 - DNA, 20 bp, Artificial Sequence
  chemically synthesized
ttttgtaattctcagtttag

SEQ ID NO: 605114 - DNA, 20 bp, Artificial Sequence
  chemically synthesized
ttgagcaatattttgtaatt

SEQ ID NO: 605115 - DNA, 20 bp, Artificial Sequence
  chemically synthesized
cattatggccattctgtcaa

SEQ ID NO: 605116 - DNA, 20 bp, Artificial Sequence
  chemically synthesized
gggaatagcattgaattaaa

SEQ ID NO: 605117 - DNA, 20 bp, Artificial Sequence
  chemically synthesized
attcagtgaagaatgttatt

SEQ ID NO: 605118 - DNA, 20 bp, Artificial Sequence
  chemically synthesized
tccagcttttttctttttgc

SEQ ID NO: 605119 - DNA, 20 bp, Artificial Sequence
  chemically synthesized
gatggttccagcttttttct

SEQ ID NO: 605120 - DNA, 20 bp, Artificial Sequence
  chemically synthesized
cagtcaggcaatgggatggt

SEQ ID NO: 605121 - DNA, 20 bp, Artificial Sequence
  chemically synthesized
tggttactatatccttgtag

SEQ ID NO: 605122 - DNA, 20 bp, Artificial Sequence
  chemically synthesized
tgtgtctgttttttgtacca

SEQ ID NO: 605123 - DNA, 20 bp, Artificial Sequence
  chemically synthesized
tcttttccattggtttatgt

SEQ ID NO: 605124 - DNA, 20 bp, Artificial Sequence
  chemically synthesized
tcgactctctattcttttcc

SEQ ID NO: 605125 - DNA, 20 bp, Artificial Sequence
  chemically synthesized
cttttcccattgcttgtttt

SEQ ID NO: 605126 - DNA, 20 bp, Artificial Sequence
  chemically synthesized
taggcagtccttttcccatt

SEQ ID NO: 605127 - DNA, 20 bp, Artificial Sequence
  chemically synthesized
tgaataggcagtccttttcc

SEQ ID NO: 605128 - DNA, 20 bp, Artificial Sequence
  chemically synthesized
atatacaaaaattaacccga

SEQ ID NO: 605129 - DNA, 20 bp, Artificial Sequence
  chemically synthesized
aggtttttatagttgttggt

SEQ ID NO: 605130 - DNA, 20 bp, Artificial Sequence
  chemically synthesized
cttcttaggtttttatagtt

SEQ ID NO: 605131 - DNA, 20 bp, Artificial Sequence
  chemically synthesized
gcattacctgggttatcttc

SEQ ID NO: 605132 - DNA, 20 bp, Artificial Sequence
  chemically synthesized
tgtctttgttatgaagtctt

SEQ ID NO: 605133 - DNA, 20 bp, Artificial Sequence
  chemically synthesized
tcaatttttgtttttgtttc

SEQ ID NO: 605134 - DNA, 20 bp, Artificial Sequence
  chemically synthesized
tcccagttttcaatttttgt

SEQ ID NO: 605135 - DNA, 20 bp, Artificial Sequence
  chemically synthesized
attaggtcccagttttcaat

SEQ ID NO: 605136 - DNA, 20 bp, Artificial Sequence
  chemically synthesized
gttctttagtttaattaggt

SEQ ID NO: 605137 - DNA, 20 bp, Artificial Sequence
  chemically synthesized
cttttgttgtgtagaagttc

SEQ ID NO: 605138 - DNA, 20 bp, Artificial Sequence
  chemically synthesized
ggttgtctgtttactctgtt

SEQ ID NO: 605139 - DNA, 20 bp, Artificial Sequence
  chemically synthesized
tttctcccattctgcaggtt

SEQ ID NO: 605140 - DNA, 20 bp, Artificial Sequence
  chemically synthesized
tattagacccttgtcagatg

SEQ ID NO: 605141 - DNA, 20 bp, Artificial Sequence
  chemically synthesized
gcttgtaaatttaagttcct

SEQ ID NO: 605142 - DNA, 20 bp, Artificial Sequence
  chemically synthesized
ttttaatggtgatgtttggt

SEQ ID NO: 605143 - DNA, 20 bp, Artificial Sequence
  chemically synthesized
cccactttttaatggtgatg

SEQ ID NO: 605144 - DNA, 20 bp, Artificial Sequence
  chemically synthesized
ctttgcccactttttaatgg

SEQ ID NO: 605145 - DNA, 20 bp, Artificial Sequence
  chemically synthesized
tgttcagcattttttcatat

SEQ ID NO: 605146 - DNA, 20 bp, Artificial Sequence
  chemically synthesized
ggttttgatctgcacttctc

SEQ ID NO: 605147 - DNA, 20 bp, Artificial Sequence
  chemically synthesized
ggtgtcaaatggtatcttat

SEQ ID NO: 605148 - DNA, 20 bp, Artificial Sequence
  chemically synthesized
ctgtgcaaccttgccagcat

SEQ ID NO: 605149 - DNA, 20 bp, Artificial Sequence
  chemically synthesized
gcaaggttgcacagaaaagg

SEQ ID NO: 605150 - DNA, 20 bp, Artificial Sequence
  chemically synthesized
ttagttcagccaccgtggaa

SEQ ID NO: 605151 - DNA, 20 bp, Artificial Sequence
  chemically synthesized
agccaccgtggaaagcagtt

SEQ ID NO: 605152 - DNA, 20 bp, Artificial Sequence
  chemically synthesized
cgttgtttgggaaatcacca

SEQ ID NO: 605153 - DNA, 20 bp, Artificial Sequence
  chemically synthesized
cgaatggtaattctggtttt

SEQ ID NO: 605154 - DNA, 20 bp, Artificial Sequence
  chemically synthesized
ttgctgggtcgaatggtaat

SEQ ID NO: 605155 - DNA, 20 bp, Artificial Sequence
  chemically synthesized
gtgcatgtgtctttagggtt

SEQ ID NO: 605156 - DNA, 20 bp, Artificial Sequence
  chemically synthesized
ccctaaagacacatgcacat

SEQ ID NO: 605157 - DNA, 20 bp, Artificial Sequence
  chemically synthesized
catgtgtttgctattgtgaa

SEQ ID NO: 605158 - DNA, 20 bp, Artificial Sequence
  chemically synthesized
tgggcatttaggctgattcc

SEQ ID NO: 605159 - DNA, 20 bp, Artificial Sequence
  chemically synthesized
ctaccactgatgggcattta

SEQ ID NO: 605160 - DNA, 20 bp, Artificial Sequence
  chemically synthesized
attctatgcagccatgaaaa

SEQ ID NO: 605161 - DNA, 20 bp, Artificial Sequence
  chemically synthesized
ataatggcctccagctccat

SEQ ID NO: 605162 - DNA, 20 bp, Artificial Sequence
  chemically synthesized
tattttgtgttattgtgtta

SEQ ID NO: 605163 - DNA, 20 bp, Artificial Sequence
  chemically synthesized
gtgatattttgtgttattgt

SEQ ID NO: 605164 - DNA, 20 bp, Artificial Sequence
  chemically synthesized
tctttgagtccgtgtgttct

SEQ ID NO: 605165 - DNA, 20 bp, Artificial Sequence
  chemically synthesized
gctggagggtaagaggaggg

SEQ ID NO: 605166 - DNA, 20 bp, Artificial Sequence
  chemically synthesized
aataagcatagtacccaata

SEQ ID NO: 605167 - DNA, 20 bp, Artificial Sequence
  chemically synthesized
aaaaaactacttattgggta

SEQ ID NO: 605168 - DNA, 20 bp, Artificial Sequence
  chemically synthesized
catgtcacaggggtttgttg

SEQ ID NO: 605169 - DNA, 20 bp, Artificial Sequence
  chemically synthesized
atagataaattgcatgtcac

SEQ ID NO: 605170 - DNA, 20 bp, Artificial Sequence
  chemically synthesized
tttgcttcagaggtacatgt

SEQ ID NO: 605171 - DNA, 20 bp, Artificial Sequence
  chemically synthesized
atattattttttacttttat

SEQ ID NO: 605172 - DNA, 20 bp, Artificial Sequence
  chemically synthesized
attctttaattttaaattca

SEQ ID NO: 605173 - DNA, 20 bp, Artificial Sequence
  chemically synthesized
tttatgctgttattttatga

SEQ ID NO: 605174 - DNA, 20 bp, Artificial Sequence
  chemically synthesized
actgaagacagaattcaaca

SEQ ID NO: 605175 - DNA, 20 bp, Artificial Sequence
  chemically synthesized
agcaagggggaggtccacac

SEQ ID NO: 605176 - DNA, 20 bp, Artificial Sequence
  chemically synthesized
ctctcctgataagagttctc

SEQ ID NO: 605177 - DNA, 20 bp, Artificial Sequence
  chemically synthesized
ctgataagagttctcatgag

SEQ ID NO: 605178 - DNA, 20 bp, Artificial Sequence
  chemically synthesized
taagagttctcatgagattt

SEQ ID NO: 605179 - DNA, 20 bp, Artificial Sequence
  chemically synthesized
cccttgccagatcgtggcca

SEQ ID NO: 605180 - DNA, 20 bp, Artificial Sequence
  chemically synthesized
actgggtgggacctccctga

SEQ ID NO: 605181 - DNA, 20 bp, Artificial Sequence
  chemically synthesized
gggggcttcagccattccac

SEQ ID NO: 605182 - DNA, 20 bp, Artificial Sequence
  chemically synthesized
gctctgatctctccctggga

SEQ ID NO: 605183 - DNA, 20 bp, Artificial Sequence
  chemically synthesized
taaattgtctctttgttctc

SEQ ID NO: 605184 - DNA, 20 bp, Artificial Sequence
  chemically synthesized
acactgctttagctgcgtcc

SEQ ID NO: 605185 - DNA, 20 bp, Artificial Sequence
  chemically synthesized
gctataaatttccctcttaa

SEQ ID NO: 605186 - DNA, 20 bp, Artificial Sequence
  chemically synthesized
tgtttgtttgctcttggttt

SEQ ID NO: 605187 - DNA, 20 bp, Artificial Sequence
  chemically synthesized
ttatttcttgtttgtttgct

SEQ ID NO: 605188 - DNA, 20 bp, Artificial Sequence
  chemically synthesized
tctgatcttggttatttctt

SEQ ID NO: 605189 - DNA, 20 bp, Artificial Sequence
  chemically synthesized
cagctctgatcttggttatt

SEQ ID NO: 605190 - DNA, 20 bp, Artificial Sequence
  chemically synthesized
tggattcatttagttttttg

SEQ ID NO: 605191 - DNA, 20 bp, Artificial Sequence
  chemically synthesized
aaaaccagctcctggattca

SEQ ID NO: 605192 - DNA, 20 bp, Artificial Sequence
  chemically synthesized
aaaactaaatgaatccagga

SEQ ID NO: 605193 - DNA, 20 bp, Artificial Sequence
  chemically synthesized
tttttttccaaaaaccagct

SEQ ID NO: 605194 - DNA, 20 bp, Artificial Sequence
  chemically synthesized
tcaaatttttcattgtgttt

SEQ ID NO: 605195 - DNA, 20 bp, Artificial Sequence
  chemically synthesized
attcctcttcaaatttttca

SEQ ID NO: 605196 - DNA, 20 bp, Artificial Sequence
  chemically synthesized
tgtttatagtattccctgat

SEQ ID NO: 605197 - DNA, 20 bp, Artificial Sequence
  chemically synthesized
tttctagtttatgtgcatag

SEQ ID NO: 605198 - DNA, 20 bp, Artificial Sequence
  chemically synthesized
tatccatttcctctaggttt

SEQ ID NO: 605199 - DNA, 20 bp, Artificial Sequence
  chemically synthesized
caataatttatccatttcct

SEQ ID NO: 605200 - DNA, 20 bp, Artificial Sequence
  chemically synthesized
agctatgattccatctggac

SEQ ID NO: 605201 - DNA, 20 bp, Artificial Sequence
  chemically synthesized
gtaccgctagtagaattcag

SEQ ID NO: 605202 - DNA, 20 bp, Artificial Sequence
  chemically synthesized
cttcttttcaatttttttgg

SEQ ID NO: 605203 - DNA, 20 bp, Artificial Sequence
  chemically synthesized
attccaaaaaaattgaaaag

SEQ ID NO: 605204 - DNA, 20 bp, Artificial Sequence
  chemically synthesized
ggtgatgctgacctcataat

SEQ ID NO: 605205 - DNA, 20 bp, Artificial Sequence
  chemically synthesized
cctccctccctccctccctc

SEQ ID NO: 605206 - DNA, 20 bp, Artificial Sequence
  chemically synthesized
atcaatgatattagcctgaa

SEQ ID NO: 605207 - DNA, 20 bp, Artificial Sequence
  chemically synthesized
gttcatcaatgatattagcc

SEQ ID NO: 605208 - DNA, 20 bp, Artificial Sequence
  chemically synthesized
ctttttgatatgctactgga

SEQ ID NO: 605209 - DNA, 20 bp, Artificial Sequence
  chemically synthesized
gataagctttttgatatgct

SEQ ID NO: 605210 - DNA, 20 bp, Artificial Sequence
  chemically synthesized
ccaaatccagtagcatatca

SEQ ID NO: 605211 - DNA, 20 bp, Artificial Sequence
  chemically synthesized
agcaaacttgattgtggtgg

SEQ ID NO: 605212 - DNA, 20 bp, Artificial Sequence
  chemically synthesized
aaaaagcttatccaccacaa

SEQ ID NO: 605213 - DNA, 20 bp, Artificial Sequence
  chemically synthesized
agcttatccaccacaatcaa

SEQ ID NO: 605214 - DNA, 20 bp, Artificial Sequence
  chemically synthesized
gcatgctagggatgaagcaa

SEQ ID NO: 605215 - DNA, 20 bp, Artificial Sequence
  chemically synthesized
cttcatccctagcatgcaag

SEQ ID NO: 605216 - DNA, 20 bp, Artificial Sequence
  chemically synthesized
taacacatgcaaatcaatac

SEQ ID NO: 605217 - DNA, 20 bp, Artificial Sequence
  chemically synthesized
tttatgtgatgaatcacatg

SEQ ID NO: 605218 - DNA, 20 bp, Artificial Sequence
  chemically synthesized
catgtggtttttgtctttag

SEQ ID NO: 605219 - DNA, 20 bp, Artificial Sequence
  chemically synthesized
gttgtctattgagatagtca

SEQ ID NO: 605220 - DNA, 20 bp, Artificial Sequence
  chemically synthesized
tgaggtatgttccttcgata

SEQ ID NO: 605221 - DNA, 20 bp, Artificial Sequence
  chemically synthesized
tagcttttgcccatttggat

SEQ ID NO: 605222 - DNA, 20 bp, Artificial Sequence
  chemically synthesized
cagttttcagggggaatgct

SEQ ID NO: 605223 - DNA, 20 bp, Artificial Sequence
  chemically synthesized
cttgggccagttttcagggg

SEQ ID NO: 605224 - DNA, 20 bp, Artificial Sequence
  chemically synthesized
agatggcatccttatcttgg

SEQ ID NO: 605225 - DNA, 20 bp, Artificial Sequence
  chemically synthesized
accctttatttctttctctt

SEQ ID NO: 605226 - DNA, 20 bp, Artificial Sequence
  chemically synthesized
agcttttgggctgagacaat

SEQ ID NO: 605227 - DNA, 20 bp, Artificial Sequence
  chemically synthesized
cttgtagtatagtttgaagt

SEQ ID NO: 605228 - DNA, 20 bp, Artificial Sequence
  chemically synthesized
tggtgactgtaaccttgtag

SEQ ID NO: 605229 - DNA, 20 bp, Artificial Sequence
  chemically synthesized
tgtctgttcttgtaccagta

SEQ ID NO: 605230 - DNA, 20 bp, Artificial Sequence
  chemically synthesized
tcttatttctgagttctcta

SEQ ID NO: 605231 - DNA, 20 bp, Artificial Sequence
  chemically synthesized
tttccccattgcttgttttt

SEQ ID NO: 605232 - DNA, 20 bp, Artificial Sequence
  chemically synthesized
taggcagtcctttccccatt

SEQ ID NO: 605233 - DNA, 20 bp, Artificial Sequence
  chemically synthesized
taaataggcagtcctttccc

SEQ ID NO: 605234 - DNA, 20 bp, Artificial Sequence
  chemically synthesized
ccatcttgagttaatttttg

SEQ ID NO: 605235 - DNA, 20 bp, Artificial Sequence
  chemically synthesized
ctatacaaaaattaactcaa

SEQ ID NO: 605236 - DNA, 20 bp, Artificial Sequence
  chemically synthesized
cttctaaggtttttattgtt

SEQ ID NO: 605237 - DNA, 20 bp, Artificial Sequence
  chemically synthesized
aggttttcttctaaggtttt

SEQ ID NO: 605238 - DNA, 20 bp, Artificial Sequence
  chemically synthesized
ttattacctaggttttcttc

SEQ ID NO: 605239 - DNA, 20 bp, Artificial Sequence
  chemically synthesized
cttagaagaaaacctaggta

SEQ ID NO: 605240 - DNA, 20 bp, Artificial Sequence
  chemically synthesized
tatgtcctgaatcttattac

SEQ ID NO: 605241 - DNA, 20 bp, Artificial Sequence
  chemically synthesized
ttcaggacataggcatgggc

SEQ ID NO: 605242 - DNA, 20 bp, Artificial Sequence
  chemically synthesized
tcagtttttgcttttgttgc

SEQ ID NO: 605243 - DNA, 20 bp, Artificial Sequence
  chemically synthesized
attagatcccctttgtcagt

SEQ ID NO: 605244 - DNA, 20 bp, Artificial Sequence
  chemically synthesized
agtttaattagatccccttt

SEQ ID NO: 605245 - DNA, 20 bp, Artificial Sequence
  chemically synthesized
attttgctgtgcagaagttc

SEQ ID NO: 605246 - DNA, 20 bp, Artificial Sequence
  chemically synthesized
ggctgtttatttactctgac

SEQ ID NO: 605247 - DNA, 20 bp, Artificial Sequence
  chemically synthesized
aacttttctcccattctgta

SEQ ID NO: 605248 - DNA, 20 bp, Artificial Sequence
  chemically synthesized
aacagcctacagaatgggag

SEQ ID NO: 605249 - DNA, 20 bp, Artificial Sequence
  chemically synthesized
tatttgtttttttcttgtaa

SEQ ID NO: 605250 - DNA, 20 bp, Artificial Sequence
  chemically synthesized
gcccactttttaatgaggtt

SEQ ID NO: 605251 - DNA, 20 bp, Artificial Sequence
  chemically synthesized
cttttgagaagtgtttgttt

SEQ ID NO: 605252 - DNA, 20 bp, Artificial Sequence
  chemically synthesized
tatgtcttcttttgagaagt

SEQ ID NO: 605253 - DNA, 20 bp, Artificial Sequence
  chemically synthesized
catgtatgtcttcttttgag

SEQ ID NO: 605254 - DNA, 20 bp, Artificial Sequence
  chemically synthesized
tgatgttgagttttctttca

SEQ ID NO: 605255 - DNA, 20 bp, Artificial Sequence
  chemically synthesized
ttctctcatgatcaatgatg

SEQ ID NO: 605256 - DNA, 20 bp, Artificial Sequence
  chemically synthesized
ggcgtgagatgttatctcat

SEQ ID NO: 605257 - DNA, 20 bp, Artificial Sequence
  chemically synthesized
aacccttgtggaagacaatg

SEQ ID NO: 605258 - DNA, 20 bp, Artificial Sequence
  chemically synthesized
gtaatgggattgctggctta

SEQ ID NO: 605259 - DNA, 20 bp, Artificial Sequence
  chemically synthesized
atatacccagtaatgggatt

SEQ ID NO: 605260 - DNA, 20 bp, Artificial Sequence
  chemically synthesized
atttgggtatatacccagta

SEQ ID NO: 605261 - DNA, 20 bp, Artificial Sequence
  chemically synthesized
atgcatgtatctttataata

SEQ ID NO: 605262 - DNA, 20 bp, Artificial Sequence
  chemically synthesized
ctatcattgatgagcattaa

SEQ ID NO: 605263 - DNA, 20 bp, Artificial Sequence
  chemically synthesized
agaaaagaagtttgactcgt

SEQ ID NO: 605264 - DNA, 20 bp, Artificial Sequence
  chemically synthesized
ctgagtgatttatgaagaaa

SEQ ID NO: 605265 - DNA, 20 bp, Artificial Sequence
  chemically synthesized
cttcttttcttcataaatca

SEQ ID NO: 605266 - DNA, 20 bp, Artificial Sequence
  chemically synthesized
ataaagacatacctgaaact

SEQ ID NO: 605267 - DNA, 20 bp, Artificial Sequence
  chemically synthesized
aaataattaaatggaaagtt

SEQ ID NO: 605268 - DNA, 20 bp, Artificial Sequence
  chemically synthesized
cttttttgttatgctgggat

SEQ ID NO: 605269 - DNA, 20 bp, Artificial Sequence
  chemically synthesized
gaatatttagatacttacta

SEQ ID NO: 605270 - DNA, 20 bp, Artificial Sequence
  chemically synthesized
taaattagtaactaatactt

SEQ ID NO: 605271 - DNA, 20 bp, Artificial Sequence
  chemically synthesized
aagtattagtatttgcaaaa

SEQ ID NO: 605272 - DNA, 20 bp, Artificial Sequence
  chemically synthesized
gcaataacaggtaccagtta

SEQ ID NO: 605273 - DNA, 20 bp, Artificial Sequence
  chemically synthesized
tgtaatgcctggatcatgca

SEQ ID NO: 605274 - DNA, 20 bp, Artificial Sequence
  chemically synthesized
catgatccaggcattacaat

SEQ ID NO: 605275 - DNA, 20 bp, Artificial Sequence
  chemically synthesized
gcattacaataagtgttttg

SEQ ID NO: 605276 - DNA, 20 bp, Artificial Sequence
  chemically synthesized
aaagctttacaacatagcaa

SEQ ID NO: 605277 - DNA, 20 bp, Artificial Sequence
  chemically synthesized
aaaactcccttgctatgttg

SEQ ID NO: 605278 - DNA, 20 bp, Artificial Sequence
  chemically synthesized
tcataatagctaccatttat

SEQ ID NO: 605279 - DNA, 20 bp, Artificial Sequence
  chemically synthesized
atatctatgctttgctacta

SEQ ID NO: 605280 - DNA, 20 bp, Artificial Sequence
  chemically synthesized
attcagacttggatttatat

SEQ ID NO: 605281 - DNA, 20 bp, Artificial Sequence
  chemically synthesized
tggatgaatgaacattcaga

SEQ ID NO: 605282 - DNA, 20 bp, Artificial Sequence
  chemically synthesized
acttgtacacttttttgaat

SEQ ID NO: 605283 - DNA, 20 bp, Artificial Sequence
  chemically synthesized
atataatagttatgatgtgc

SEQ ID NO: 605284 - DNA, 20 bp, Artificial Sequence
  chemically synthesized
gaagaattactcaatgttaa

SEQ ID NO: 605285 - DNA, 20 bp, Artificial Sequence
  chemically synthesized
gtgtattttgactaattttg

SEQ ID NO: 605286 - DNA, 20 bp, Artificial Sequence
  chemically synthesized
gccttgatccacagttgtca

SEQ ID NO: 605287 - DNA, 20 bp, Artificial Sequence
  chemically synthesized
tcaggttgacaactgtggat

SEQ ID NO: 605288 - DNA, 20 bp, Artificial Sequence
  chemically synthesized
gtaaccctttggagtgatca

SEQ ID NO: 605289 - DNA, 20 bp, Artificial Sequence
  chemically synthesized
gcatggaggaattgcacttc

SEQ ID NO: 605290 - DNA, 20 bp, Artificial Sequence
  chemically synthesized
gctgttgctatgattatgca

SEQ ID NO: 605291 - DNA, 20 bp, Artificial Sequence
  chemically synthesized
acatactgcataatcatagc

SEQ ID NO: 605292 - DNA, 20 bp, Artificial Sequence
  chemically synthesized
attattatctaaagctgttg

SEQ ID NO: 605293 - DNA, 20 bp, Artificial Sequence
  chemically synthesized
ctttagataataattgatag

SEQ ID NO: 605294 - DNA, 20 bp, Artificial Sequence
  chemically synthesized
tgtgctaccatgcctgtgga

SEQ ID NO: 605295 - DNA, 20 bp, Artificial Sequence
  chemically synthesized
cacaaggcacaaaaatctgg

SEQ ID NO: 605296 - DNA, 20 bp, Artificial Sequence
  chemically synthesized
gcttagagatgcaaatcttt

SEQ ID NO: 605297 - DNA, 20 bp, Artificial Sequence
  chemically synthesized
ttcaacatataaatattttc

SEQ ID NO: 605298 - DNA, 20 bp, Artificial Sequence
  chemically synthesized
tgaccatctgatcttttgcc

SEQ ID NO: 605299 - DNA, 20 bp, Artificial Sequence
  chemically synthesized
tacatccttgtgattagtaa

SEQ ID NO: 605300 - DNA, 20 bp, Artificial Sequence
  chemically synthesized
ttactaatcacaaggatgta

SEQ ID NO: 605301 - DNA, 20 bp, Artificial Sequence
  chemically synthesized
agataaagcattttacatcc

SEQ ID NO: 605302 - DNA, 20 bp, Artificial Sequence
  chemically synthesized
gtatttgacaataattttgc

SEQ ID NO: 605303 - DNA, 20 bp, Artificial Sequence
  chemically synthesized
cttagaaggcatcataagtc

SEQ ID NO: 605304 - DNA, 20 bp, Artificial Sequence
  chemically synthesized
aaatattatatgataattaa

SEQ ID NO: 605305 - DNA, 20 bp, Artificial Sequence
  chemically synthesized
aaaatacattaaattggaca

SEQ ID NO: 605306 - DNA, 20 bp, Artificial Sequence
  chemically synthesized
agaagagatgtatgttgtct

SEQ ID NO: 605307 - DNA, 20 bp, Artificial Sequence
  chemically synthesized
cctgcaaaaattgcaaagca

SEQ ID NO: 605308 - DNA, 20 bp, Artificial Sequence
  chemically synthesized
ggatcagaaaaattaaatct

SEQ ID NO: 605309 - DNA, 20 bp, Artificial Sequence
  chemically synthesized
tatccatccctaattataga

SEQ ID NO: 605310 - DNA, 20 bp, Artificial Sequence
  chemically synthesized
agggatggatattatcaagt

SEQ ID NO: 605311 - DNA, 20 bp, Artificial Sequence
  chemically synthesized
aactctggagtacttagtga

SEQ ID NO: 605312 - DNA, 20 bp, Artificial Sequence
  chemically synthesized
atcttcttcactaagtactc

SEQ ID NO: 605313 - DNA, 20 bp, Artificial Sequence
  chemically synthesized
aatgtctttgatatgtttct

SEQ ID NO: 605314 - DNA, 20 bp, Artificial Sequence
  chemically synthesized
tcgagttctaaatgtctttg

SEQ ID NO: 605315 - DNA, 20 bp, Artificial Sequence
  chemically synthesized
atggccactatagaaatctg

SEQ ID NO: 605316 - DNA, 20 bp, Artificial Sequence
  chemically synthesized
tttaaaggaaaggtaagcta

SEQ ID NO: 605317 - DNA, 20 bp, Artificial Sequence
  chemically synthesized
taaatttataaataaagaat

SEQ ID NO: 605318 - DNA, 20 bp, Artificial Sequence
  chemically synthesized
actgaatgtattaaattttt

SEQ ID NO: 605319 - DNA, 20 bp, Artificial Sequence
  chemically synthesized
gggccttgtatatcagtgca

SEQ ID NO: 605320 - DNA, 20 bp, Artificial Sequence
  chemically synthesized
ttgggaggctgaggcaggag

SEQ ID NO: 605321 - DNA, 20 bp, Artificial Sequence
  chemically synthesized
aagtagccaggcatggtggc

SEQ ID NO: 605322 - DNA, 20 bp, Artificial Sequence
  chemically synthesized
ttttgtatttttagtaaaga

SEQ ID NO: 605323 - DNA, 20 bp, Artificial Sequence
  chemically synthesized
ggtttcaccatgttgaccag

SEQ ID NO: 605324 - DNA, 20 bp, Artificial Sequence
  chemically synthesized
ggtttcaaactcctgacctc

SEQ ID NO: 605325 - DNA, 20 bp, Artificial Sequence
  chemically synthesized
caggcaaatcatctgaggtc

SEQ ID NO: 605326 - DNA, 20 bp, Artificial Sequence
  chemically synthesized
tgccttgtcctcccaaagta

SEQ ID NO: 605327 - DNA, 20 bp, Artificial Sequence
  chemically synthesized
ttttgggtaattcctcaggt

SEQ ID NO: 605328 - DNA, 20 bp, Artificial Sequence
  chemically synthesized
taactcccttaaatttgaga

SEQ ID NO: 605329 - DNA, 20 bp, Artificial Sequence
  chemically synthesized
ataaaaataccttacttatt

SEQ ID NO: 605330 - DNA, 20 bp, Artificial Sequence
  chemically synthesized
taaggtatttttattttaat

SEQ ID NO: 605331 - DNA, 20 bp, Artificial Sequence
  chemically synthesized
attttcttttttaattggca

SEQ ID NO: 605332 - DNA, 20 bp, Artificial Sequence
  chemically synthesized
catcaggcttactagtcgtg

SEQ ID NO: 605333 - DNA, 20 bp, Artificial Sequence
  chemically synthesized
ttttatttaaaagacctttt

SEQ ID NO: 605334 - DNA, 20 bp, Artificial Sequence
  chemically synthesized
aagtttaattaaaaatactc

SEQ ID NO: 605335 - DNA, 20 bp, Artificial Sequence
  chemically synthesized
cctctcttcttttttggcca

SEQ ID NO: 605336 - DNA, 20 bp, Artificial Sequence
  chemically synthesized
acaagggggatatagttgca

SEQ ID NO: 605337 - DNA, 20 bp, Artificial Sequence
  chemically synthesized
ttttgggtataataaaaagc

SEQ ID NO: 605338 - DNA, 20 bp, Artificial Sequence
  chemically synthesized
catagctgtaaatgataagc

SEQ ID NO: 605339 - DNA, 20 bp, Artificial Sequence
  chemically synthesized
cactggcttatcatttacag

SEQ ID NO: 605340 - DNA, 20 bp, Artificial Sequence
  chemically synthesized
gttttatattactatttgat

SEQ ID NO: 605341 - DNA, 20 bp, Artificial Sequence
  chemically synthesized
ggagttttaaatctcccatc

SEQ ID NO: 605342 - DNA, 20 bp, Artificial Sequence
  chemically synthesized
ttttaaatctcccatcaggt

SEQ ID NO: 605343 - DNA, 20 bp, Artificial Sequence
  chemically synthesized
tgccgaagcaagcacctgat

SEQ ID NO: 605344 - DNA, 20 bp, Artificial Sequence
  chemically synthesized
tatatcatctatatcctgat

SEQ ID NO: 605345 - DNA, 20 bp, Artificial Sequence
  chemically synthesized
caaggatgcccaaaaagaga

SEQ ID NO: 605346 - DNA, 20 bp, Artificial Sequence
  chemically synthesized
gcagttcatgtttatgctgt

SEQ ID NO: 605347 - DNA, 20 bp, Artificial Sequence
  chemically synthesized
ctcttcttgtacatggcagt

SEQ ID NO: 605348 - DNA, 20 bp, Artificial Sequence
  chemically synthesized
gtctaaaggttttgtagttt

SEQ ID NO: 605349 - DNA, 20 bp, Artificial Sequence
  chemically synthesized
tcaagcgagtctaaaggttt

SEQ ID NO: 605350 - DNA, 20 bp, Artificial Sequence
  chemically synthesized
caaaactacaaaacctttag

SEQ ID NO: 605351 - DNA, 20 bp, Artificial Sequence
  chemically synthesized
tttttttttcaagcgagtct

SEQ ID NO: 605352 - DNA, 20 bp, Artificial Sequence
  chemically synthesized
gaaaaaaaaaatatatatat

SEQ ID NO: 605353 - DNA, 20 bp, Artificial Sequence
  chemically synthesized
tatattaagtagtatatacc

SEQ ID NO: 605354 - DNA, 20 bp, Artificial Sequence
  chemically synthesized
gttgaaagggtatattagtc

SEQ ID NO: 605355 - DNA, 20 bp, Artificial Sequence
  chemically synthesized
atataccctttcaacagcac

SEQ ID NO: 605356 - DNA, 20 bp, Artificial Sequence
  chemically synthesized
tttcagtcaaatgaggaaag

SEQ ID NO: 605357 - DNA, 20 bp, Artificial Sequence
  chemically synthesized
aatattttaaaatataatgt

SEQ ID NO: 605358 - DNA, 20 bp, Artificial Sequence
  chemically synthesized
agggtacacgtattggatgt

SEQ ID NO: 605359 - DNA, 20 bp, Artificial Sequence
  chemically synthesized
tacttataagtgagaacatg

SEQ ID NO: 605360 - DNA, 20 bp, Artificial Sequence
  chemically synthesized
ataagtgagaacatgcagtg

SEQ ID NO: 605361 - DNA, 20 bp, Artificial Sequence
  chemically synthesized
gtttggttttctgttcccgc

SEQ ID NO: 605362 - DNA, 20 bp, Artificial Sequence
  chemically synthesized
cgcattagtttgctgagaat

SEQ ID NO: 605363 - DNA, 20 bp, Artificial Sequence
  chemically synthesized
ctatcattgatgggcatttg

SEQ ID NO: 605364 - DNA, 20 bp, Artificial Sequence
  chemically synthesized
atgcatgtatctttataata

SEQ ID NO: 605365 - DNA, 20 bp, Artificial Sequence
  chemically synthesized
cactgttggtgggaatgtaa

SEQ ID NO: 605366 - DNA, 20 bp, Artificial Sequence
  chemically synthesized
gcatggtttcagagaaatgg

SEQ ID NO: 605367 - DNA, 20 bp, Artificial Sequence
  chemically synthesized
caagatacaacagacgctgg

SEQ ID NO: 605368 - DNA, 20 bp, Artificial Sequence
  chemically synthesized
ccatctcacgccagacagaa

SEQ ID NO: 605369 - DNA, 20 bp, Artificial Sequence
  chemically synthesized
atatggatgaattgagagaa

SEQ ID NO: 605370 - DNA, 20 bp, Artificial Sequence
  chemically synthesized
aacattctcctctagctcag

SEQ ID NO: 605371 - DNA, 20 bp, Artificial Sequence
  chemically synthesized
acgttttatcgtggttgtta

SEQ ID NO: 605372 - DNA, 20 bp, Artificial Sequence
  chemically synthesized
tgttacgttttatcgtggtt

SEQ ID NO: 605373 - DNA, 20 bp, Artificial Sequence
  chemically synthesized
attctggttatccgctcctg

SEQ ID NO: 605374 - DNA, 20 bp, Artificial Sequence
  chemically synthesized
aggagcggataaccagaata

SEQ ID NO: 605375 - DNA, 20 bp, Artificial Sequence
  chemically synthesized
ttcattgtggagttgtcgta

SEQ ID NO: 605376 - DNA, 20 bp, Artificial Sequence
  chemically synthesized
ggtctattcaggtattgaca

SEQ ID NO: 605377 - DNA, 20 bp, Artificial Sequence
  chemically synthesized
tcaagctctgagattctttc

SEQ ID NO: 605378 - DNA, 20 bp, Artificial Sequence
  chemically synthesized
ccaagcagaggaaagaatct

SEQ ID NO: 605379 - DNA, 20 bp, Artificial Sequence
  chemically synthesized
agcaagatagtcttcaagct

SEQ ID NO: 605380 - DNA, 20 bp, Artificial Sequence
  chemically synthesized
tgctgaaataagacaggcag

SEQ ID NO: 605381 - DNA, 20 bp, Artificial Sequence
  chemically synthesized
gtacaaaacgtctgacaaat

SEQ ID NO: 605382 - DNA, 20 bp, Artificial Sequence
  chemically synthesized
tacataatcccacatttgtc

SEQ ID NO: 605383 - DNA, 20 bp, Artificial Sequence
  chemically synthesized
tatgtaaattctgaagcaaa

SEQ ID NO: 605384 - DNA, 20 bp, Artificial Sequence
  chemically synthesized
tttcaggttccccaaacagt

SEQ ID NO: 605385 - DNA, 20 bp, Artificial Sequence
  chemically synthesized
ctcctggatgatatcctgaa

SEQ ID NO: 605386 - DNA, 20 bp, Artificial Sequence
  chemically synthesized
tttgaatgtttggctggctt

SEQ ID NO: 605387 - DNA, 20 bp, Artificial Sequence
  chemically synthesized
ttcctgaatttgaatgtttg

SEQ ID NO: 605388 - DNA, 20 bp, Artificial Sequence
  chemically synthesized
atcttgtatttcctgaattt

SEQ ID NO: 605389 - DNA, 20 bp, Artificial Sequence
  chemically synthesized
tccctgaatttgaatgttgg

SEQ ID NO: 605390 - DNA, 20 bp, Artificial Sequence
  chemically synthesized
atacgtaatcatacaattct

SEQ ID NO: 605391 - DNA, 20 bp, Artificial Sequence
  chemically synthesized
tcatttaaacctggagaatt

SEQ ID NO: 605392 - DNA, 20 bp, Artificial Sequence
  chemically synthesized
agagatctgctgttaccctg

SEQ ID NO: 605393 - DNA, 20 bp, Artificial Sequence
  chemically synthesized
ccccaatctctactggctta

SEQ ID NO: 605394 - DNA, 20 bp, Artificial Sequence
  chemically synthesized
gcagaaaccctataagccag

SEQ ID NO: 605395 - DNA, 20 bp, Artificial Sequence
  chemically synthesized
aatattagcccccaatctct

SEQ ID NO: 605396 - DNA, 20 bp, Artificial Sequence
  chemically synthesized
gaatttcatatccagacaaa

SEQ ID NO: 605397 - DNA, 20 bp, Artificial Sequence
  chemically synthesized
ttttattcttccttcactta

SEQ ID NO: 605398 - DNA, 20 bp, Artificial Sequence
  chemically synthesized
atcaacatttgcttgtctgg

SEQ ID NO: 605399 - DNA, 20 bp, Artificial Sequence
  chemically synthesized
tagtgacgaattccatcaac

SEQ ID NO: 605400 - DNA, 20 bp, Artificial Sequence
  chemically synthesized
ataaacatacttgtaatttg

SEQ ID NO: 605401 - DNA, 20 bp, Artificial Sequence
  chemically synthesized
aaaaactgcacaaattacaa

SEQ ID NO: 605402 - DNA, 20 bp, Artificial Sequence
  chemically synthesized
ttacagggaatcatgatcat

SEQ ID NO: 605403 - DNA, 20 bp, Artificial Sequence
  chemically synthesized
ttctttaaaaactcaaatga

SEQ ID NO: 605404 - DNA, 20 bp, Artificial Sequence
  chemically synthesized
agaaaagagggcaaatatac

SEQ ID NO: 605405 - DNA, 20 bp, Artificial Sequence
  chemically synthesized
gataataactcttgctatct

SEQ ID NO: 605406 - DNA, 20 bp, Artificial Sequence
  chemically synthesized
acacaagctgagggtattta

SEQ ID NO: 605407 - DNA, 20 bp, Artificial Sequence
  chemically synthesized
ttctaatcaacttaaatacc

SEQ ID NO: 605408 - DNA, 20 bp, Artificial Sequence
  chemically synthesized
aggtattattcaagtcaaat

SEQ ID NO: 605409 - DNA, 20 bp, Artificial Sequence
  chemically synthesized
ctgctctcttgcatttcaaa

SEQ ID NO: 605410 - DNA, 20 bp, Artificial Sequence
  chemically synthesized
tgcaagagagcagtcctcct

SEQ ID NO: 605411 - DNA, 20 bp, Artificial Sequence
  chemically synthesized
cctcctagctgattattttt

SEQ ID NO: 605412 - DNA, 20 bp, Artificial Sequence
  chemically synthesized
gttttgatctcttgccatgc

SEQ ID NO: 605413 - DNA, 20 bp, Artificial Sequence
  chemically synthesized
cgtatgattgctgttcaggt

SEQ ID NO: 605414 - DNA, 20 bp, Artificial Sequence
  chemically synthesized
ataaagaacactgcttgcgc

SEQ ID NO: 605415 - DNA, 20 bp, Artificial Sequence
  chemically synthesized
agttgtactcatataaagaa

SEQ ID NO: 605416 - DNA, 20 bp, Artificial Sequence
  chemically synthesized
tgggtgccttgtcatctcaa

SEQ ID NO: 605417 - DNA, 20 bp, Artificial Sequence
  chemically synthesized
tgtgaggcagggtgtggaaa

SEQ ID NO: 605418 - DNA, 20 bp, Artificial Sequence
  chemically synthesized
tttccacaccctgcctcaca

SEQ ID NO: 605419 - DNA, 20 bp, Artificial Sequence
  chemically synthesized
actactcacatgatatactc

SEQ ID NO: 605420 - DNA, 20 bp, Artificial Sequence
  chemically synthesized
ataatgattgtgggagaaaa

SEQ ID NO: 605421 - DNA, 20 bp, Artificial Sequence
  chemically synthesized
acttgtatgtacattttcta

SEQ ID NO: 605422 - DNA, 20 bp, Artificial Sequence
  chemically synthesized
tatagaaaatgtacatacaa

SEQ ID NO: 605423 - DNA, 20 bp, Artificial Sequence
  chemically synthesized
ttttatccatgttaaattga

SEQ ID NO: 605424 - DNA, 20 bp, Artificial Sequence
  chemically synthesized
aaatagtatcatataagagc

SEQ ID NO: 605425 - DNA, 20 bp, Artificial Sequence
  chemically synthesized
tgatactatttcgctgttgt

SEQ ID NO: 605426 - DNA, 20 bp, Artificial Sequence
  chemically synthesized
gtgagctcaaaaacagccag

SEQ ID NO: 605427 - DNA, 20 bp, Artificial Sequence
  chemically synthesized
gattgatccaaatctttgct

SEQ ID NO: 605428 - DNA, 20 bp, Artificial Sequence
  chemically synthesized
tttccaaaaattatgctgtc

SEQ ID NO: 605429 - DNA, 20 bp, Artificial Sequence
  chemically synthesized
caatgagagaaaactgaaac

SEQ ID NO: 605430 - DNA, 20 bp, Artificial Sequence
  chemically synthesized
agtttttcttaagcttatgt

SEQ ID NO: 605431 - DNA, 20 bp, Artificial Sequence
  chemically synthesized
agcttgagtttttcttaagc

SEQ ID NO: 605432 - DNA, 20 bp, Artificial Sequence
  chemically synthesized
aacataagcttaagaaaaac

SEQ ID NO: 605433 - DNA, 20 bp, Artificial Sequence
  chemically synthesized
acactaagcttgagtttttc

SEQ ID NO: 605434 - DNA, 20 bp, Artificial Sequence
  chemically synthesized
tgttttccagaacactaagc

SEQ ID NO: 605435 - DNA, 20 bp, Artificial Sequence
  chemically synthesized
gtaagttgttttccagaaca

SEQ ID NO: 605436 - DNA, 20 bp, Artificial Sequence
  chemically synthesized
aaaggacttaacatcatgta

SEQ ID NO: 605437 - DNA, 20 bp, Artificial Sequence
  chemically synthesized
agcccacaataggagcgtgt

SEQ ID NO: 605438 - DNA, 20 bp, Artificial Sequence
  chemically synthesized
cacttcggcctcccaaagtg

SEQ ID NO: 605439 - DNA, 20 bp, Artificial Sequence
  chemically synthesized
ttttgtaattttagtagaga

SEQ ID NO: 605440 - DNA, 20 bp, Artificial Sequence
  chemically synthesized
aacggtgtgaacccaggagg

SEQ ID NO: 605441 - DNA, 20 bp, Artificial Sequence
  chemically synthesized
gaggcagagcttgcagtgag

SEQ ID NO: 605442 - DNA, 20 bp, Artificial Sequence
  chemically synthesized
agggctttttgtggttctct

SEQ ID NO: 605443 - DNA, 20 bp, Artificial Sequence
  chemically synthesized
catgtagttcagtgtgtctg

SEQ ID NO: 605444 - DNA, 20 bp, Artificial Sequence
  chemically synthesized
agcatttgaggggaaaaagg

SEQ ID NO: 605445 - DNA, 20 bp, Artificial Sequence
  chemically synthesized
aactcaacctttttcccctc

SEQ ID NO: 605446 - DNA, 20 bp, Artificial Sequence
  chemically synthesized
ctataataaaagaatactgg

SEQ ID NO: 605447 - DNA, 20 bp, Artificial Sequence
  chemically synthesized
taattctataataaaagaat

SEQ ID NO: 605448 - DNA, 20 bp, Artificial Sequence
  chemically synthesized
aatttctagggaattaaaaa

SEQ ID NO: 605449 - DNA, 20 bp, Artificial Sequence
  chemically synthesized
ggaattaaaaataaggcttc

SEQ ID NO: 605450 - DNA, 20 bp, Artificial Sequence
  chemically synthesized
atgtcatcgaaatattactg

SEQ ID NO: 605451 - DNA, 20 bp, Artificial Sequence
  chemically synthesized
tgtacatgtcatcgaaatat

SEQ ID NO: 605452 - DNA, 20 bp, Artificial Sequence
  chemically synthesized
ggaatgggactactttttga

SEQ ID NO: 605453 - DNA, 20 bp, Artificial Sequence
  chemically synthesized
ctccctgaaatgtgaaaagg

SEQ ID NO: 605454 - DNA, 20 bp, Artificial Sequence
  chemically synthesized
cattgtggaaaaccagaatg

SEQ ID NO: 605455 - DNA, 20 bp, Artificial Sequence
  chemically synthesized
atgtgtgtgaatcccaacat

SEQ ID NO: 605456 - DNA, 20 bp, Artificial Sequence
  chemically synthesized
tgtactcctgagcctaaaat

SEQ ID NO: 605457 - DNA, 20 bp, Artificial Sequence
  chemically synthesized
ttaggctcaggagtacatat

SEQ ID NO: 605458 - DNA, 20 bp, Artificial Sequence
  chemically synthesized
cataggtaaatgtgtgtcac

SEQ ID NO: 605459 - DNA, 20 bp, Artificial Sequence
  chemically synthesized
ggtaaatgtgtgtcacaggg

SEQ ID NO: 605460 - DNA, 20 bp, Artificial Sequence
  chemically synthesized
gtaaataagactattggata

SEQ ID NO: 605461 - DNA, 20 bp, Artificial Sequence
  chemically synthesized
tgttgatcccctctatggtc

SEQ ID NO: 605462 - DNA, 20 bp, Artificial Sequence
  chemically synthesized
tatggtctgcagattgtatc

SEQ ID NO: 605463 - DNA, 20 bp, Artificial Sequence
  chemically synthesized
tatcaaaggcttagtaaaga

SEQ ID NO: 605464 - DNA, 20 bp, Artificial Sequence
  chemically synthesized
gtagatttttaggtccttat

SEQ ID NO: 605465 - DNA, 20 bp, Artificial Sequence
  chemically synthesized
gtccttatcacagcttatgg

SEQ ID NO: 605466 - DNA, 20 bp, Artificial Sequence
  chemically synthesized
tggatgagattttctgagca

SEQ ID NO: 605467 - DNA, 20 bp, Artificial Sequence
  chemically synthesized
caggtggctactatgcagac

SEQ ID NO: 605468 - DNA, 20 bp, Artificial Sequence
  chemically synthesized
acgtgcatcccttttaaggg

SEQ ID NO: 605469 - DNA, 20 bp, Artificial Sequence
  chemically synthesized
atggtcagttgccgtgttaa

SEQ ID NO: 605470 - DNA, 20 bp, Artificial Sequence
  chemically synthesized
ccatatgtacccattgcttc

SEQ ID NO: 605471 - DNA, 20 bp, Artificial Sequence
  chemically synthesized
agagtattcccatatgtacc

SEQ ID NO: 605472 - DNA, 20 bp, Artificial Sequence
  chemically synthesized
cctgttttatgtgatctgcc

SEQ ID NO: 605473 - DNA, 20 bp, Artificial Sequence
  chemically synthesized
tagtactatattatgattcc

SEQ ID NO: 605474 - DNA, 20 bp, Artificial Sequence
  chemically synthesized
atagtagttttagtactata

SEQ ID NO: 605475 - DNA, 20 bp, Artificial Sequence
  chemically synthesized
tagcaattaattgacctaat

SEQ ID NO: 605476 - DNA, 20 bp, Artificial Sequence
  chemically synthesized
taggtcaattaattgctaaa

SEQ ID NO: 605477 - DNA, 20 bp, Artificial Sequence
  chemically synthesized
tatgtttaatggaaaacaaa

SEQ ID NO: 605478 - DNA, 20 bp, Artificial Sequence
  chemically synthesized
cattacataataaaaactcc

SEQ ID NO: 605479 - DNA, 20 bp, Artificial Sequence
  chemically synthesized
caaatggagtttttattatg

SEQ ID NO: 605480 - DNA, 20 bp, Artificial Sequence
  chemically synthesized
ttataattttttaacgtaaa

SEQ ID NO: 605481 - DNA, 20 bp, Artificial Sequence
  chemically synthesized
ggattaaaagtaacattgaa

SEQ ID NO: 605482 - DNA, 20 bp, Artificial Sequence
  chemically synthesized
tgtgattgaaaatcatatag

SEQ ID NO: 605483 - DNA, 20 bp, Artificial Sequence
  chemically synthesized
acagcgtaataaaccagcct

SEQ ID NO: 605484 - DNA, 20 bp, Artificial Sequence
  chemically synthesized
ggaaatgccttttggagaca

SEQ ID NO: 605485 - DNA, 20 bp, Artificial Sequence
  chemically synthesized
tattgagacaagtacatgga

SEQ ID NO: 605486 - DNA, 20 bp, Artificial Sequence
  chemically synthesized
aggcatacacttccatattc

SEQ ID NO: 605487 - DNA, 20 bp, Artificial Sequence
  chemically synthesized
atgttaaatactattatata

SEQ ID NO: 605488 - DNA, 20 bp, Artificial Sequence
  chemically synthesized
ggttttattataataatttt

SEQ ID NO: 605489 - DNA, 20 bp, Artificial Sequence
  chemically synthesized
tctcagctacatttggggta

SEQ ID NO: 605490 - DNA, 20 bp, Artificial Sequence
  chemically synthesized
acataccccaaatgtagctg

SEQ ID NO: 605491 - DNA, 20 bp, Artificial Sequence
  chemically synthesized
ttatactaacacatacgggc

SEQ ID NO: 605492 - DNA, 20 bp, Artificial Sequence
  chemically synthesized
tgatttcataaaattatgaa

SEQ ID NO: 605493 - DNA, 20 bp, Artificial Sequence
  chemically synthesized
gtaccttttctgccatagac

SEQ ID NO: 605494 - DNA, 20 bp, Artificial Sequence
  chemically synthesized
tcaggtcttttgatttcttg

SEQ ID NO: 605495 - DNA, 20 bp, Artificial Sequence
  chemically synthesized
ggagaactagggttcaggtc

SEQ ID NO: 605496 - DNA, 20 bp, Artificial Sequence
  chemically synthesized
gaaaaatttacttttcttcc

SEQ ID NO: 605497 - DNA, 20 bp, Artificial Sequence
  chemically synthesized
ccacgaggaacattagccaa

SEQ ID NO: 605498 - DNA, 20 bp, Artificial Sequence
  chemically synthesized
ttcctcgtggttctagcaat

SEQ ID NO: 605499 - DNA, 20 bp, Artificial Sequence
  chemically synthesized
atcacagtctaaccccaaat

SEQ ID NO: 605500 - DNA, 20 bp, Artificial Sequence
  chemically synthesized
atctctgatttggggttaga

SEQ ID NO: 605501 - DNA, 20 bp, Artificial Sequence
  chemically synthesized
caacaagacaggcaaaagaa

SEQ ID NO: 605502 - DNA, 20 bp, Artificial Sequence
  chemically synthesized
ctgtgtttagttaaataaaa

SEQ ID NO: 605503 - DNA, 20 bp, Artificial Sequence
  chemically synthesized
caaccagattagtttttgcc

SEQ ID NO: 605504 - DNA, 20 bp, Artificial Sequence
  chemically synthesized
cacagggcaaaaactaatct

SEQ ID NO: 605505 - DNA, 20 bp, Artificial Sequence
  chemically synthesized
cctacaaaagaagcaaccag

SEQ ID NO: 605506 - DNA, 20 bp, Artificial Sequence
  chemically synthesized
ataaccctacaaaagaagca

SEQ ID NO: 605507 - DNA, 20 bp, Artificial Sequence
  chemically synthesized
tataatgtcactctcttaat

SEQ ID NO: 605508 - DNA, 20 bp, Artificial Sequence
  chemically synthesized
tatcatgctacagactatct

SEQ ID NO: 605509 - DNA, 20 bp, Artificial Sequence
  chemically synthesized
taacctgtgctgtactcttt

SEQ ID NO: 605510 - DNA, 20 bp, Artificial Sequence
  chemically synthesized
caccgggcaaagttatccag

SEQ ID NO: 605511 - DNA, 20 bp, Artificial Sequence
  chemically synthesized
tcttcagtgttgaaagaaga

SEQ ID NO: 605512 - DNA, 20 bp, Artificial Sequence
  chemically synthesized
gaagatcttgtttgagtgaa

SEQ ID NO: 605513 - DNA, 20 bp, Artificial Sequence
  chemically synthesized
ttgagtgaatacagtttgcc

SEQ ID NO: 605514 - DNA, 20 bp, Artificial Sequence
  chemically synthesized
gtgaatacagtttgcccatg

SEQ ID NO: 605515 - DNA, 20 bp, Artificial Sequence
  chemically synthesized
gattgctttttcttttctag

SEQ ID NO: 605516 - DNA, 20 bp, Artificial Sequence
  chemically synthesized
ctgtgatctttcttgtttta

SEQ ID NO: 605517 - DNA, 20 bp, Artificial Sequence
  chemically synthesized
caggcttattctgtgatctt

SEQ ID NO: 605518 - DNA, 20 bp, Artificial Sequence
  chemically synthesized
agtggtgtatggaatgcaac

SEQ ID NO: 605519 - DNA, 20 bp, Artificial Sequence
  chemically synthesized
ccatacaccactatagttca

SEQ ID NO: 605520 - DNA, 20 bp, Artificial Sequence
  chemically synthesized
aatgagcaaatacacgcaaa

SEQ ID NO: 605521 - DNA, 20 bp, Artificial Sequence
  chemically synthesized
gaacttttgatcctttgcgg

SEQ ID NO: 605522 - DNA, 20 bp, Artificial Sequence
  chemically synthesized
caaacttcttgggataatta

SEQ ID NO: 605523 - DNA, 20 bp, Artificial Sequence
  chemically synthesized
taatctatctaattatccca

SEQ ID NO: 605524 - DNA, 20 bp, Artificial Sequence
  chemically synthesized
agtaggtctttattctacgt

SEQ ID NO: 605525 - DNA, 20 bp, Artificial Sequence
  chemically synthesized
acctctagtaggtctttatt

SEQ ID NO: 605526 - DNA, 20 bp, Artificial Sequence
  chemically synthesized
gaagcaatattaccttttca

SEQ ID NO: 605527 - DNA, 20 bp, Artificial Sequence
  chemically synthesized
aaatccaagtgaaaaggtaa

SEQ ID NO: 605528 - DNA, 20 bp, Artificial Sequence
  chemically synthesized
tctaatttccacatgttgat

SEQ ID NO: 605529 - DNA, 20 bp, Artificial Sequence
  chemically synthesized
ggaaattagaaggcacggat

SEQ ID NO: 605530 - DNA, 20 bp, Artificial Sequence
  chemically synthesized
cctggtacctgattgtcagt

SEQ ID NO: 605531 - DNA, 20 bp, Artificial Sequence
  chemically synthesized
agtactcctggtacctgatt

SEQ ID NO: 605532 - DNA, 20 bp, Artificial Sequence
  chemically synthesized
ttttcttcagtactcctggt

SEQ ID NO: 605533 - DNA, 20 bp, Artificial Sequence
  chemically synthesized
cattctcattttctcagctc

SEQ ID NO: 605534 - DNA, 20 bp, Artificial Sequence
  chemically synthesized
aatcacagcatttcagaatg

SEQ ID NO: 605535 - DNA, 20 bp, Artificial Sequence
  chemically synthesized
aaacttgccattctgaaatg

SEQ ID NO: 605536 - DNA, 20 bp, Artificial Sequence
  chemically synthesized
tttggataaaattacaatat

SEQ ID NO: 605537 - DNA, 20 bp, Artificial Sequence
  chemically synthesized
aattacaatattattgtttc

SEQ ID NO: 605538 - DNA, 20 bp, Artificial Sequence
  chemically synthesized
tttggagataaaatctcatt

SEQ ID NO: 605539 - DNA, 20 bp, Artificial Sequence
  chemically synthesized
tatggtcagtaaatcacata

SEQ ID NO: 605540 - DNA, 20 bp, Artificial Sequence
  chemically synthesized
tactcaaataaccagatgtt

SEQ ID NO: 605541 - DNA, 20 bp, Artificial Sequence
  chemically synthesized
tttacttaatgggctctaca

SEQ ID NO: 605542 - DNA, 20 bp, Artificial Sequence
  chemically synthesized
taagtcgctgggcatgacat

SEQ ID NO: 605543 - DNA, 20 bp, Artificial Sequence
  chemically synthesized
aatgcttcagcatctctttt

SEQ ID NO: 605544 - DNA, 20 bp, Artificial Sequence
  chemically synthesized
ggaaatataaatggtataaa

SEQ ID NO: 605545 - DNA, 20 bp, Artificial Sequence
  chemically synthesized
gagggttacaaactcccttt

SEQ ID NO: 605546 - DNA, 20 bp, Artificial Sequence
  chemically synthesized
ttcctttcaaatcaaccaaa

SEQ ID NO: 605547 - DNA, 20 bp, Artificial Sequence
  chemically synthesized
tggttgatttgaaaggaata

SEQ ID NO: 605548 - DNA, 20 bp, Artificial Sequence
  chemically synthesized
atgtgaaatcagtaaatcag

SEQ ID NO: 605549 - DNA, 20 bp, Artificial Sequence
  chemically synthesized
aaagaaaaactgccctgatt

SEQ ID NO: 605550 - DNA, 20 bp, Artificial Sequence
  chemically synthesized
gtcaagtaaaagaaaaactg

SEQ ID NO: 605551 - DNA, 20 bp, Artificial Sequence
  chemically synthesized
cttccttcttctcctttgtt

SEQ ID NO: 605552 - DNA, 20 bp, Artificial Sequence
  chemically synthesized
tatttctcttccttcttctc

SEQ ID NO: 605553 - DNA, 20 bp, Artificial Sequence
  chemically synthesized
cggaaagacaggtatcgcga

SEQ ID NO: 605554 - DNA, 20 bp, Artificial Sequence
  chemically synthesized
ttgtttcggaaagacaggta

SEQ ID NO: 605555 - DNA, 20 bp, Artificial Sequence
  chemically synthesized
cctgtctttccgaaacaaat

SEQ ID NO: 605556 - DNA, 20 bp, Artificial Sequence
  chemically synthesized
tagttcttaaataaacttac

SEQ ID NO: 605557 - DNA, 20 bp, Artificial Sequence
  chemically synthesized
actgctctaggtttggggca

SEQ ID NO: 605558 - DNA, 20 bp, Artificial Sequence
  chemically synthesized
aggaaggtgtattgactgct

SEQ ID NO: 605559 - DNA, 20 bp, Artificial Sequence
  chemically synthesized
tgccatgccaaaatgggcta

SEQ ID NO: 605560 - DNA, 20 bp, Artificial Sequence
  chemically synthesized
atgctctagtggctccttca

SEQ ID NO: 605561 - DNA, 20 bp, Artificial Sequence
  chemically synthesized
tagtttgtcttttactcaga

SEQ ID NO: 605562 - DNA, 20 bp, Artificial Sequence
  chemically synthesized
ctataacatactccaggtga

SEQ ID NO: 605563 - DNA, 20 bp, Artificial Sequence
  chemically synthesized
catttttaaggggaaacaaa

SEQ ID NO: 605564 - DNA, 20 bp, Artificial Sequence
  chemically synthesized
aaggggaaacaaagcaagat

SEQ ID NO: 605565 - DNA, 20 bp, Artificial Sequence
  chemically synthesized
gagatgaaacttaaatcttg

SEQ ID NO: 605566 - DNA, 20 bp, Artificial Sequence
  chemically synthesized
aattagagatgaaacttaaa

SEQ ID NO: 605567 - DNA, 20 bp, Artificial Sequence
  chemically synthesized
acaataagttcagtattttt

SEQ ID NO: 605568 - DNA, 20 bp, Artificial Sequence
  chemically synthesized
cccccacaccgtgagtttta

SEQ ID NO: 605569 - DNA, 20 bp, Artificial Sequence
  chemically synthesized
caaaataaaactcacggtgt

SEQ ID NO: 605570 - DNA, 20 bp, Artificial Sequence
  chemically synthesized
tattgctaaacccccacacc

SEQ ID NO: 605571 - DNA, 20 bp, Artificial Sequence
  chemically synthesized
tgggggtttagcaataggta

SEQ ID NO: 605572 - DNA, 20 bp, Artificial Sequence
  chemically synthesized
ataggtaggtggtttttctt

SEQ ID NO: 605573 - DNA, 20 bp, Artificial Sequence
  chemically synthesized
actcgtgaggctgacaggag

SEQ ID NO: 605574 - DNA, 20 bp, Artificial Sequence
  chemically synthesized
tctaaaaatttaaaaattag

SEQ ID NO: 605575 - DNA, 20 bp, Artificial Sequence
  chemically synthesized
cgggtggatcacttgaggtc

SEQ ID NO: 605576 - DNA, 20 bp, Artificial Sequence
  chemically synthesized
cgccttggcctcccaaagtg

SEQ ID NO: 605577 - DNA, 20 bp, Artificial Sequence
  chemically synthesized
caccatacccagcccaatag

SEQ ID NO: 605578 - DNA, 20 bp, Artificial Sequence
  chemically synthesized
agataggttttgcatattca

SEQ ID NO: 605579 - DNA, 20 bp, Artificial Sequence
  chemically synthesized
tcattttgtttaattcactt

SEQ ID NO: 605580 - DNA, 20 bp, Artificial Sequence
  chemically synthesized
attgaaattcaaatatggct

SEQ ID NO: 605581 - DNA, 20 bp, Artificial Sequence
  chemically synthesized
acttagattttttttttatt

SEQ ID NO: 605582 - DNA, 20 bp, Artificial Sequence
  chemically synthesized
gtaagtcaaagaggattgta

SEQ ID NO: 605583 - DNA, 20 bp, Artificial Sequence
  chemically synthesized
attctgagtaagtaagtcaa

SEQ ID NO: 605584 - DNA, 20 bp, Artificial Sequence
  chemically synthesized
ttacacatatggctatttaa

SEQ ID NO: 605585 - DNA, 20 bp, Artificial Sequence
  chemically synthesized
cattatttaaacaaaatatg

SEQ ID NO: 605586 - DNA, 20 bp, Artificial Sequence
  chemically synthesized
tgtttccaaatcattacata

SEQ ID NO: 605587 - DNA, 20 bp, Artificial Sequence
  chemically synthesized
attctcacactcctcttctg

SEQ ID NO: 605588 - DNA, 20 bp, Artificial Sequence
  chemically synthesized
tcagaagaggagtgtgagaa

SEQ ID NO: 605589 - DNA, 20 bp, Artificial Sequence
  chemically synthesized
gtgagaattatgtttaaaga

SEQ ID NO: 605590 - DNA, 20 bp, Artificial Sequence
  chemically synthesized
taggtaccatgaggttactc

SEQ ID NO: 605591 - DNA, 20 bp, Artificial Sequence
  chemically synthesized
aaaacaggaggcttattttc

SEQ ID NO: 605592 - DNA, 20 bp, Artificial Sequence
  chemically synthesized
taaacaaatgaaaataagcc

SEQ ID NO: 605593 - DNA, 20 bp, Artificial Sequence
  chemically synthesized
tgtggcttaataataaaaca

SEQ ID NO: 605594 - DNA, 20 bp, Artificial Sequence
  chemically synthesized
gcttaccaaatgtttcttca

SEQ ID NO: 605595 - DNA, 20 bp, Artificial Sequence
  chemically synthesized
tcatttttgtaatgcttacc

SEQ ID NO: 605596 - DNA, 20 bp, Artificial Sequence
  chemically synthesized
gactttcactttcatttttg

SEQ ID NO: 605597 - DNA, 20 bp, Artificial Sequence
  chemically synthesized
cgcctcagcctcccaaagtg

SEQ ID NO: 605598 - DNA, 20 bp, Artificial Sequence
  chemically synthesized
tattgtatttttagtacaga

SEQ ID NO: 605599 - DNA, 20 bp, Artificial Sequence
  chemically synthesized
tggttccagcgattccttgc

SEQ ID NO: 605600 - DNA, 20 bp, Artificial Sequence
  chemically synthesized
aacctctgcctccctggttc

SEQ ID NO: 605601 - DNA, 20 bp, Artificial Sequence
  chemically synthesized
ttgagtgcacttttttccta

SEQ ID NO: 605602 - DNA, 20 bp, Artificial Sequence
  chemically synthesized
atcacacaatgtaattataa

SEQ ID NO: 605603 - DNA, 20 bp, Artificial Sequence
  chemically synthesized
atcaatgttataattacatt

SEQ ID NO: 605604 - DNA, 20 bp, Artificial Sequence
  chemically synthesized
actaggtataagtctgggtt

SEQ ID NO: 605605 - DNA, 20 bp, Artificial Sequence
  chemically synthesized
tgagtatcaaaaatgatgat

SEQ ID NO: 605606 - DNA, 20 bp, Artificial Sequence
  chemically synthesized
aaaaatgatgatggcagatt

SEQ ID NO: 605607 - DNA, 20 bp, Artificial Sequence
  chemically synthesized
tggcagattagttgtttggt

SEQ ID NO: 605608 - DNA, 20 bp, Artificial Sequence
  chemically synthesized
ctcccagttccagaactccc

SEQ ID NO: 605609 - DNA, 20 bp, Artificial Sequence
  chemically synthesized
tctaatgtatctggccccat

SEQ ID NO: 605610 - DNA, 20 bp, Artificial Sequence
  chemically synthesized
ttgtcctgtctatccattga

SEQ ID NO: 605611 - DNA, 20 bp, Artificial Sequence
  chemically synthesized
atccattgatgctgattctt

SEQ ID NO: 605612 - DNA, 20 bp, Artificial Sequence
  chemically synthesized
ttaatatgcacatgtaagac

SEQ ID NO: 605613 - DNA, 20 bp, Artificial Sequence
  chemically synthesized
tacatgtgcatattaaataa

SEQ ID NO: 605614 - DNA, 20 bp, Artificial Sequence
  chemically synthesized
ctggcttctataaaaataaa

SEQ ID NO: 605615 - DNA, 20 bp, Artificial Sequence
  chemically synthesized
cttggaggtaggtctacatt

SEQ ID NO: 605616 - DNA, 20 bp, Artificial Sequence
  chemically synthesized
ccatatccactactgaccca

SEQ ID NO: 605617 - DNA, 20 bp, Artificial Sequence
  chemically synthesized
agagacagataagctgttca

SEQ ID NO: 605618 - DNA, 20 bp, Artificial Sequence
  chemically synthesized
tttcacttcaaatcatcttg

SEQ ID NO: 605619 - DNA, 20 bp, Artificial Sequence
  chemically synthesized
attcctgatgagagtgaggt

SEQ ID NO: 605620 - DNA, 20 bp, Artificial Sequence
  chemically synthesized
tttctcctatattggcaaaa

SEQ ID NO: 605621 - DNA, 20 bp, Artificial Sequence
  chemically synthesized
tcaacctcccaaagtacaac

SEQ ID NO: 605622 - DNA, 20 bp, Artificial Sequence
  chemically synthesized
aagaacatcagaattacctg

SEQ ID NO: 605623 - DNA, 20 bp, Artificial Sequence
  chemically synthesized
agatgactaggctccacttc

SEQ ID NO: 605624 - DNA, 20 bp, Artificial Sequence
  chemically synthesized
tgttaggccatcttcagacc

SEQ ID NO: 605625 - DNA, 20 bp, Artificial Sequence
  chemically synthesized
ataattaattcagacaggat

SEQ ID NO: 605626 - DNA, 20 bp, Artificial Sequence
  chemically synthesized
ctcatggtaactgagcaagt

SEQ ID NO: 605627 - DNA, 20 bp, Artificial Sequence
  chemically synthesized
taccataatctcttggatca

SEQ ID NO: 605628 - DNA, 20 bp, Artificial Sequence
  chemically synthesized
ctggggaagcagggtgatcc

SEQ ID NO: 605629 - DNA, 20 bp, Artificial Sequence
  chemically synthesized
atttctgctgtggggactgt

SEQ ID NO: 605630 - DNA, 20 bp, Artificial Sequence
  chemically synthesized
agaaatacatttactcagga

SEQ ID NO: 605631 - DNA, 20 bp, Artificial Sequence
  chemically synthesized
ggatcttcccacgataattt

SEQ ID NO: 605632 - DNA, 20 bp, Artificial Sequence
  chemically synthesized
ataattcacctcataaaagc

SEQ ID NO: 605633 - DNA, 20 bp, Artificial Sequence
  chemically synthesized
aatgaagggaaagaagaaac

SEQ ID NO: 605634 - DNA, 20 bp, Artificial Sequence
  chemically synthesized
atttttatccctgatgccaa

SEQ ID NO: 605635 - DNA, 20 bp, Artificial Sequence
  chemically synthesized
caaaactgatttaagtttta

SEQ ID NO: 605636 - DNA, 20 bp, Artificial Sequence
  chemically synthesized
caaatcagtttaaaacttaa

SEQ ID NO: 605637 - DNA, 20 bp, Artificial Sequence
  chemically synthesized
cagtttaaaacttaaatcag

SEQ ID NO: 605638 - DNA, 20 bp, Artificial Sequence
  chemically synthesized
tttttataatcaaaactgat

SEQ ID NO: 605639 - DNA, 20 bp, Artificial Sequence
  chemically synthesized
ctattattttttataatcaa

SEQ ID NO: 605640 - DNA, 20 bp, Artificial Sequence
  chemically synthesized
ttataaaaaataatagatct

SEQ ID NO: 605641 - DNA, 20 bp, Artificial Sequence
  chemically synthesized
atttaatttgctctagatct

SEQ ID NO: 605642 - DNA, 20 bp, Artificial Sequence
  chemically synthesized
cttgccattgaggtgggagg

SEQ ID NO: 605643 - DNA, 20 bp, Artificial Sequence
  chemically synthesized
tgataacccatgggattgtg

SEQ ID NO: 605644 - DNA, 20 bp, Artificial Sequence
  chemically synthesized
aatagtatcactgataaccc

SEQ ID NO: 605645 - DNA, 20 bp, Artificial Sequence
  chemically synthesized
ttctctttacaataagtgta

SEQ ID NO: 605646 - DNA, 20 bp, Artificial Sequence
  chemically synthesized
tacacttattgtaaagagaa

SEQ ID NO: 605647 - DNA, 20 bp, Artificial Sequence
  chemically synthesized
caaaacaggtaccatctgtc

SEQ ID NO: 605648 - DNA, 20 bp, Artificial Sequence
  chemically synthesized
gaaaactggtgacagatggt

SEQ ID NO: 605649 - DNA, 20 bp, Artificial Sequence
  chemically synthesized
agatggtacctgttttgggt

SEQ ID NO: 605650 - DNA, 20 bp, Artificial Sequence
  chemically synthesized
ctcaaattctagaccagctg

SEQ ID NO: 605651 - DNA, 20 bp, Artificial Sequence
  chemically synthesized
ccagctgtcaggttttgtta

SEQ ID NO: 605652 - DNA, 20 bp, Artificial Sequence
  chemically synthesized
ttctataggtcttgtcattt

SEQ ID NO: 605653 - DNA, 20 bp, Artificial Sequence
  chemically synthesized
tgcttgtgaacaaagagaaa

SEQ ID NO: 605654 - DNA, 20 bp, Artificial Sequence
  chemically synthesized
ttaaaatttgtgttatgtca

SEQ ID NO: 605655 - DNA, 20 bp, Artificial Sequence
  chemically synthesized
agaaagtcaataattttcca

SEQ ID NO: 605656 - DNA, 20 bp, Artificial Sequence
  chemically synthesized
ttttatggccctgaggctag

SEQ ID NO: 605657 - DNA, 20 bp, Artificial Sequence
  chemically synthesized
atttcagtagtcctcatatc

SEQ ID NO: 605658 - DNA, 20 bp, Artificial Sequence
  chemically synthesized
actgatatgaggactactga

SEQ ID NO: 605659 - DNA, 20 bp, Artificial Sequence
  chemically synthesized
aatgttgtaggatacagatc

SEQ ID NO: 605660 - DNA, 20 bp, Artificial Sequence
  chemically synthesized
gatcctgtgttttttcttga

SEQ ID NO: 605661 - DNA, 20 bp, Artificial Sequence
  chemically synthesized
tcattaggaccatctactca

SEQ ID NO: 605662 - DNA, 20 bp, Artificial Sequence
  chemically synthesized
aagttcattaggaccatcta

SEQ ID NO: 605663 - DNA, 20 bp, Artificial Sequence
  chemically synthesized
taatgaactttacatgtgta

SEQ ID NO: 605664 - DNA, 20 bp, Artificial Sequence
  chemically synthesized
atgagattttgcatctcatc

SEQ ID NO: 605665 - DNA, 20 bp, Artificial Sequence
  chemically synthesized
agatgagatgcaaaatctca

SEQ ID NO: 605666 - DNA, 20 bp, Artificial Sequence
  chemically synthesized
tccaaatatgttaaagctag

SEQ ID NO: 605667 - DNA, 20 bp, Artificial Sequence
  chemically synthesized
tctcatctagctttaacata

SEQ ID NO: 605668 - DNA, 20 bp, Artificial Sequence
  chemically synthesized
ctttaacatatttggatttt

SEQ ID NO: 605669 - DNA, 20 bp, Artificial Sequence
  chemically synthesized
atatttggattttgtcagtt

SEQ ID NO: 605670 - DNA, 20 bp, Artificial Sequence
  chemically synthesized
tggcttcctaagaacaactt

SEQ ID NO: 605671 - DNA, 20 bp, Artificial Sequence
  chemically synthesized
agttcctgcatatattgttg

SEQ ID NO: 605672 - DNA, 20 bp, Artificial Sequence
  chemically synthesized
gcaggaactttgactagata

SEQ ID NO: 605673 - DNA, 20 bp, Artificial Sequence
  chemically synthesized
ctgtaaaatatcctcatctc

SEQ ID NO: 605674 - DNA, 20 bp, Artificial Sequence
  chemically synthesized
gctttgctataacttgacct

SEQ ID NO: 605675 - DNA, 20 bp, Artificial Sequence
  chemically synthesized
ccagattcaaggaaaaggga

SEQ ID NO: 605676 - DNA, 20 bp, Artificial Sequence
  chemically synthesized
tcccttttccttgaatctgg

SEQ ID NO: 605677 - DNA, 20 bp, Artificial Sequence
  chemically synthesized
ctgaaaaagtcacaagcctg

SEQ ID NO: 605678 - DNA, 20 bp, Artificial Sequence
  chemically synthesized
aatatgactgaccatcacca

SEQ ID NO: 605679 - DNA, 20 bp, Artificial Sequence
  chemically synthesized
tatgattgaccgtctgaagc

SEQ ID NO: 605680 - DNA, 20 bp, Artificial Sequence
  chemically synthesized
tgctagttaaatacagaatc

SEQ ID NO: 605681 - DNA, 20 bp, Artificial Sequence
  chemically synthesized
tatcaaaatgcagtcatgcc

SEQ ID NO: 605682 - DNA, 20 bp, Artificial Sequence
  chemically synthesized
tcagtaaataagtgagtgac

SEQ ID NO: 605683 - DNA, 20 bp, Artificial Sequence
  chemically synthesized
ggtcactcacttatttactg

SEQ ID NO: 605684 - DNA, 20 bp, Artificial Sequence
  chemically synthesized
cacattttgcctgagaagaa

SEQ ID NO: 605685 - DNA, 20 bp, Artificial Sequence
  chemically synthesized
aacaatgtttgtaaggaata

SEQ ID NO: 605686 - DNA, 20 bp, Artificial Sequence
  chemically synthesized
catatctagaggaatggatg

SEQ ID NO: 605687 - DNA, 20 bp, Artificial Sequence
  chemically synthesized
agaggagaggataaattcat

SEQ ID NO: 605688 - DNA, 20 bp, Artificial Sequence
  chemically synthesized
tatcacaaaagtgaggagaa

SEQ ID NO: 605689 - DNA, 20 bp, Artificial Sequence
  chemically synthesized
cagaggataagatgttgacc

SEQ ID NO: 605690 - DNA, 20 bp, Artificial Sequence
  chemically synthesized
catcttatcctctgcctact

SEQ ID NO: 605691 - DNA, 20 bp, Artificial Sequence
  chemically synthesized
gacattcctccctgaaatct

SEQ ID NO: 605692 - DNA, 20 bp, Artificial Sequence
  chemically synthesized
gtgacacattaagtgaaacg

SEQ ID NO: 605693 - DNA, 20 bp, Artificial Sequence
  chemically synthesized
tacacaatccctcagaagca

SEQ ID NO: 605694 - DNA, 20 bp, Artificial Sequence
  chemically synthesized
gaagcaatcaaaatgcttct

SEQ ID NO: 605695 - DNA, 20 bp, Artificial Sequence
  chemically synthesized
caatccctcagaagcatttt

SEQ ID NO: 605696 - DNA, 20 bp, Artificial Sequence
  chemically synthesized
tattgattcagaagcaatca

SEQ ID NO: 605697 - DNA, 20 bp, Artificial Sequence
  chemically synthesized
gaaaatggttcatgactagt

SEQ ID NO: 605698 - DNA, 20 bp, Artificial Sequence
  chemically synthesized
aactagtcatgaaccatttt

SEQ ID NO: 605699 - DNA, 20 bp, Artificial Sequence
  chemically synthesized
agattctagttgtgtaaacc

SEQ ID NO: 605700 - DNA, 20 bp, Artificial Sequence
  chemically synthesized
aaaatcctttccattaatca

SEQ ID NO: 605701 - DNA, 20 bp, Artificial Sequence
  chemically synthesized
gtaaaccaactgattaatgg

SEQ ID NO: 605702 - DNA, 20 bp, Artificial Sequence
  chemically synthesized
atgacaaaaatgataattat

SEQ ID NO: 605703 - DNA, 20 bp, Artificial Sequence
  chemically synthesized
tgaaacttgtgataagaggc

SEQ ID NO: 605704 - DNA, 20 bp, Artificial Sequence
  chemically synthesized
tcaaacttctgcctcttatc

SEQ ID NO: 605705 - DNA, 20 bp, Artificial Sequence
  chemically synthesized
ttcatcacatcttaacattc

SEQ ID NO: 605706 - DNA, 20 bp, Artificial Sequence
  chemically synthesized
aatgctacttagttcaggtc

SEQ ID NO: 605707 - DNA, 20 bp, Artificial Sequence
  chemically synthesized
tgtaattctttttggtagga

SEQ ID NO: 605708 - DNA, 20 bp, Artificial Sequence
  chemically synthesized
aaagaattacaaaaatgcaa

SEQ ID NO: 605709 - DNA, 20 bp, Artificial Sequence
  chemically synthesized
gcagctgatggggagccatt

SEQ ID NO: 605710 - DNA, 20 bp, Artificial Sequence
  chemically synthesized
gcaaaaatatcagctgtatt

SEQ ID NO: 605711 - DNA, 20 bp, Artificial Sequence
  chemically synthesized
tacagctgatatttttgcac

SEQ ID NO: 605712 - DNA, 20 bp, Artificial Sequence
  chemically synthesized
agttcagaaaagtaacctgt

SEQ ID NO: 605713 - DNA, 20 bp, Artificial Sequence
  chemically synthesized
taatttcttatcaataataa

SEQ ID NO: 605714 - DNA, 20 bp, Artificial Sequence
  chemically synthesized
tgtattacttgttattacaa

SEQ ID NO: 605715 - DNA, 20 bp, Artificial Sequence
  chemically synthesized
tcattggtcttttaatttaa

SEQ ID NO: 605716 - DNA, 20 bp, Artificial Sequence
  chemically synthesized
taccattttaccagctattt

SEQ ID NO: 605717 - DNA, 20 bp, Artificial Sequence
  chemically synthesized
aaatgagtggaaaaatttac

SEQ ID NO: 605718 - DNA, 20 bp, Artificial Sequence
  chemically synthesized
tggaacactacttacaacca

SEQ ID NO: 605719 - DNA, 20 bp, Artificial Sequence
  chemically synthesized
tttcttaaaatttttgatag

SEQ ID NO: 605720 - DNA, 20 bp, Artificial Sequence
  chemically synthesized
tatgatttcttaaaattttt

SEQ ID NO: 605721 - DNA, 20 bp, Artificial Sequence
  chemically synthesized
ttcacgtgacatattctact

SEQ ID NO: 605722 - DNA, 20 bp, Artificial Sequence
  chemically synthesized
aaagaggccggtctgatact

SEQ ID NO: 605723 - DNA, 20 bp, Artificial Sequence
  chemically synthesized
tcacagagtaagagaaactt

SEQ ID NO: 605724 - DNA, 20 bp, Artificial Sequence
  chemically synthesized
aaaaaaaaaaaaaaaaactc

SEQ ID NO: 605725 - DNA, 20 bp, Artificial Sequence
  chemically synthesized
tttggtttcagcaggaattt

SEQ ID NO: 605726 - DNA, 20 bp, Artificial Sequence
  chemically synthesized
tggaaattcctgctgaaacc

SEQ ID NO: 605727 - DNA, 20 bp, Artificial Sequence
  chemically synthesized
gaaaagacttcattgaagca

SEQ ID NO: 605728 - DNA, 20 bp, Artificial Sequence
  chemically synthesized
atgagatttctttggcaata

SEQ ID NO: 605729 - DNA, 20 bp, Artificial Sequence
  chemically synthesized
atacctcgagtgttttgaga

SEQ ID NO: 605730 - DNA, 20 bp, Artificial Sequence
  chemically synthesized
acattgattataaatacctc

SEQ ID NO: 605731 - DNA, 20 bp, Artificial Sequence
  chemically synthesized
tttataatcaatgtcatttg

SEQ ID NO: 605732 - DNA, 20 bp, Artificial Sequence
  chemically synthesized
aattaaagcctatcaaatga

SEQ ID NO: 605733 - DNA, 20 bp, Artificial Sequence
  chemically synthesized
tttgataggctttaattttt

SEQ ID NO: 605734 - DNA, 20 bp, Artificial Sequence
  chemically synthesized
ttgcttgaaaaactaggtga

SEQ ID NO: 605735 - DNA, 20 bp, Artificial Sequence
  chemically synthesized
cagagatccaaacaatatca

SEQ ID NO: 605736 - DNA, 20 bp, Artificial Sequence
  chemically synthesized
tctccaaatctcatgttgaa

SEQ ID NO: 605737 - DNA, 20 bp, Artificial Sequence
  chemically synthesized
gctgggaatcacatttcaac

SEQ ID NO: 605738 - DNA, 20 bp, Artificial Sequence
  chemically synthesized
tggaggtagggcctggtggg

SEQ ID NO: 605739 - DNA, 20 bp, Artificial Sequence
  chemically synthesized
atgagggcggatgtctcatg

SEQ ID NO: 605740 - DNA, 20 bp, Artificial Sequence
  chemically synthesized
tgggaactgactcatcatga

SEQ ID NO: 605741 - DNA, 20 bp, Artificial Sequence
  chemically synthesized
agttagttcacatgaaatct

SEQ ID NO: 605742 - DNA, 20 bp, Artificial Sequence
  chemically synthesized
gtcccagactcttttaaaca

SEQ ID NO: 605743 - DNA, 20 bp, Artificial Sequence
  chemically synthesized
tgggaccttcctcttatctc

SEQ ID NO: 605744 - DNA, 20 bp, Artificial Sequence
  chemically synthesized
tggctccccttctccttctg

SEQ ID NO: 605745 - DNA, 20 bp, Artificial Sequence
  chemically synthesized
cttctccttctgccatgatt

SEQ ID NO: 605746 - DNA, 20 bp, Artificial Sequence
  chemically synthesized
tgctcctggtaagtgcctca

SEQ ID NO: 605747 - DNA, 20 bp, Artificial Sequence
  chemically synthesized
accaggagcagatgctggtg

SEQ ID NO: 605748 - DNA, 20 bp, Artificial Sequence
  chemically synthesized
ctgggtaacttatgaaataa

SEQ ID NO: 605749 - DNA, 20 bp, Artificial Sequence
  chemically synthesized
tgacattgatggagtttaac

SEQ ID NO: 605750 - DNA, 20 bp, Artificial Sequence
  chemically synthesized
gacggttatcctgacattga

SEQ ID NO: 605751 - DNA, 20 bp, Artificial Sequence
  chemically synthesized
tccatcaatgtcaggataac

SEQ ID NO: 605752 - DNA, 20 bp, Artificial Sequence
  chemically synthesized
gttctaaaaaaatagactga

SEQ ID NO: 605753 - DNA, 20 bp, Artificial Sequence
  chemically synthesized
agtctatttttttagaacta

SEQ ID NO: 605754 - DNA, 20 bp, Artificial Sequence
  chemically synthesized
tgaagtcttattctggtatg

SEQ ID NO: 605755 - DNA, 20 bp, Artificial Sequence
  chemically synthesized
aactataggtggattttcaa

SEQ ID NO: 605756 - DNA, 20 bp, Artificial Sequence
  chemically synthesized
aacaaagttgaaaatccacc

SEQ ID NO: 605757 - DNA, 20 bp, Artificial Sequence
  chemically synthesized
taaagtgggaaaaaactata

SEQ ID NO: 605758 - DNA, 20 bp, Artificial Sequence
  chemically synthesized
atgtttatttttgcttggat

SEQ ID NO: 605759 - DNA, 20 bp, Artificial Sequence
  chemically synthesized
attgaatattaaatgtttat

SEQ ID NO: 605760 - DNA, 20 bp, Artificial Sequence
  chemically synthesized
cttctatgctattgaatatt

SEQ ID NO: 605761 - DNA, 20 bp, Artificial Sequence
  chemically synthesized
aatagtgataatatacagta

SEQ ID NO: 605762 - DNA, 20 bp, Artificial Sequence
  chemically synthesized
aaaactggccgtatgtactt

SEQ ID NO: 605763 - DNA, 20 bp, Artificial Sequence
  chemically synthesized
aaagctagaaagtacatacg

SEQ ID NO: 605764 - DNA, 20 bp, Artificial Sequence
  chemically synthesized
cagtgaacaagattcacaca

SEQ ID NO: 605765 - DNA, 20 bp, Artificial Sequence
  chemically synthesized
agaaaaagaagatgcagtga

SEQ ID NO: 605766 - DNA, 20 bp, Artificial Sequence
  chemically synthesized
cttgcagtgcctttttagtg

SEQ ID NO: 605767 - DNA, 20 bp, Artificial Sequence
  chemically synthesized
taaattggaaaagtaaagat

SEQ ID NO: 605768 - DNA, 20 bp, Artificial Sequence
  chemically synthesized
gggatattaaattggaaaag

SEQ ID NO: 605769 - DNA, 20 bp, Artificial Sequence
  chemically synthesized
atccccccgtgtcttttaca

SEQ ID NO: 605770 - DNA, 20 bp, Artificial Sequence
  chemically synthesized
gcggtcttctgtccatctac

SEQ ID NO: 605771 - DNA, 20 bp, Artificial Sequence
  chemically synthesized
caattgtttgctgatgctgt

SEQ ID NO: 605772 - DNA, 20 bp, Artificial Sequence
  chemically synthesized
ttaccaattgtttgctgatg

SEQ ID NO: 605773 - DNA, 20 bp, Artificial Sequence
  chemically synthesized
catcagcaaacaattggtaa

SEQ ID NO: 605774 - DNA, 20 bp, Artificial Sequence
  chemically synthesized
tttaataaaacgtagttacc

SEQ ID NO: 605775 - DNA, 20 bp, Artificial Sequence
  chemically synthesized
tggaagggacactctttctg

SEQ ID NO: 605776 - DNA, 20 bp, Artificial Sequence
  chemically synthesized
ccacttcatattgcttgtct

SEQ ID NO: 605777 - DNA, 20 bp, Artificial Sequence
  chemically synthesized
gtggtataataaccacttca

SEQ ID NO: 605778 - DNA, 20 bp, Artificial Sequence
  chemically synthesized
taacaaagacatacatatag

SEQ ID NO: 605779 - DNA, 20 bp, Artificial Sequence
  chemically synthesized
aagtaaaaggtgtattttcc

SEQ ID NO: 605780 - DNA, 20 bp, Artificial Sequence
  chemically synthesized
aggcaattctcattatgcaa

SEQ ID NO: 605781 - DNA, 20 bp, Artificial Sequence
  chemically synthesized
tggtaggcaattctcattat

SEQ ID NO: 605782 - DNA, 20 bp, Artificial Sequence
  chemically synthesized
ataatgagaattgcctacca

SEQ ID NO: 605783 - DNA, 20 bp, Artificial Sequence
  chemically synthesized
taacttaaattctattacta

SEQ ID NO: 605784 - DNA, 20 bp, Artificial Sequence
  chemically synthesized
attacaaaagtattaaaatt

SEQ ID NO: 605785 - DNA, 20 bp, Artificial Sequence
  chemically synthesized
attgttagttttctcactag

SEQ ID NO: 605786 - DNA, 20 bp, Artificial Sequence
  chemically synthesized
gtagtttttactcagagatt

SEQ ID NO: 605787 - DNA, 20 bp, Artificial Sequence
  chemically synthesized
atgatatagtagtttttact

SEQ ID NO: 605788 - DNA, 20 bp, Artificial Sequence
  chemically synthesized
tagtgacatgttaatgatat

SEQ ID NO: 605789 - DNA, 20 bp, Artificial Sequence
  chemically synthesized
atgtaacataaaccaactat

SEQ ID NO: 605790 - DNA, 20 bp, Artificial Sequence
  chemically synthesized
ccttccaaaaatcattgata

SEQ ID NO: 605791 - DNA, 20 bp, Artificial Sequence
  chemically synthesized
tggaaggaaaacaaatattg

SEQ ID NO: 605792 - DNA, 20 bp, Artificial Sequence
  chemically synthesized
tgcatagaaagcatcacaat

SEQ ID NO: 605793 - DNA, 20 bp, Artificial Sequence
  chemically synthesized
ttgagctaactgccattttg

SEQ ID NO: 605794 - DNA, 20 bp, Artificial Sequence
  chemically synthesized
tccaatatatatatgagaaa

SEQ ID NO: 605795 - DNA, 20 bp, Artificial Sequence
  chemically synthesized
cacgtcaatattttatgatt

SEQ ID NO: 605796 - DNA, 20 bp, Artificial Sequence
  chemically synthesized
ctagaaatcataaaatattg

SEQ ID NO: 605797 - DNA, 20 bp, Artificial Sequence
  chemically synthesized
aaataaagcacgtcaatatt

SEQ ID NO: 605798 - DNA, 20 bp, Artificial Sequence
  chemically synthesized
atatagaattagagttagaa

SEQ ID NO: 605799 - DNA, 20 bp, Artificial Sequence
  chemically synthesized
ttatgagaccttagacactg

SEQ ID NO: 605800 - DNA, 20 bp, Artificial Sequence
  chemically synthesized
cccacctagaggatattaac

SEQ ID NO: 605801 - DNA, 20 bp, Artificial Sequence
  chemically synthesized
catgatgctaatttcatttg

SEQ ID NO: 605802 - DNA, 20 bp, Artificial Sequence
  chemically synthesized
ctacaaaaaaaaaaaaaata

SEQ ID NO: 605803 - DNA, 20 bp, Artificial Sequence
  chemically synthesized
attttttttttttttgtaga

SEQ ID NO: 605804 - DNA, 20 bp, Artificial Sequence
  chemically synthesized
gctcactgcaacctccacct

SEQ ID NO: 605805 - DNA, 20 bp, Artificial Sequence
  chemically synthesized
tgcctcagcctccccagtag

SEQ ID NO: 605806 - DNA, 20 bp, Artificial Sequence
  chemically synthesized
ttttgtatttttagtagaca

SEQ ID NO: 605807 - DNA, 20 bp, Artificial Sequence
  chemically synthesized
tgcctcagcctcccaaagtg

SEQ ID NO: 605808 - DNA, 20 bp, Artificial Sequence
  chemically synthesized
ctcctagtcacttagaaata

SEQ ID NO: 605809 - DNA, 20 bp, Artificial Sequence
  chemically synthesized
tttctaagtgactaggagag

SEQ ID NO: 605810 - DNA, 20 bp, Artificial Sequence
  chemically synthesized
taggagagtcacgtttctta

SEQ ID NO: 605811 - DNA, 20 bp, Artificial Sequence
  chemically synthesized
tgtatttttttttaagtggt

SEQ ID NO: 605812 - DNA, 20 bp, Artificial Sequence
  chemically synthesized
gtaggaaaatgttgactgcc

SEQ ID NO: 605813 - DNA, 20 bp, Artificial Sequence
  chemically synthesized
tgattgagctgcatataagt

SEQ ID NO: 605814 - DNA, 20 bp, Artificial Sequence
  chemically synthesized
tatatgcagctcaatcataa

SEQ ID NO: 605815 - DNA, 20 bp, Artificial Sequence
  chemically synthesized
agctcaatcataagtgagtt

SEQ ID NO: 605816 - DNA, 20 bp, Artificial Sequence
  chemically synthesized
aagaaaaactgaaaactcac

SEQ ID NO: 605817 - DNA, 20 bp, Artificial Sequence
  chemically synthesized
ttcttcataaatatcaatgt

SEQ ID NO: 605818 - DNA, 20 bp, Artificial Sequence
  chemically synthesized
taatgtaactgttaattttt

SEQ ID NO: 605819 - DNA, 20 bp, Artificial Sequence
  chemically synthesized
tctactcaacttattttgaa

SEQ ID NO: 605820 - DNA, 20 bp, Artificial Sequence
  chemically synthesized
tcgcatcactgtttgagcgc

SEQ ID NO: 605821 - DNA, 20 bp, Artificial Sequence
  chemically synthesized
ttcctgtgggtatctcgcat

SEQ ID NO: 605822 - DNA, 20 bp, Artificial Sequence
  chemically synthesized
gagatacccacaggaaatgt

SEQ ID NO: 605823 - DNA, 20 bp, Artificial Sequence
  chemically synthesized
atggttgaagtgactaaatt

SEQ ID NO: 605824 - DNA, 20 bp, Artificial Sequence
  chemically synthesized
attattacgaagcagtatat

SEQ ID NO: 605825 - DNA, 20 bp, Artificial Sequence
  chemically synthesized
ttttagaaaaaacctatata

SEQ ID NO: 605826 - DNA, 20 bp, Artificial Sequence
  chemically synthesized
agttagctaaaaaaatgcaa

SEQ ID NO: 605827 - DNA, 20 bp, Artificial Sequence
  chemically synthesized
tggcacgtaacaaaatggtt

SEQ ID NO: 605828 - DNA, 20 bp, Artificial Sequence
  chemically synthesized
atagattagttgtgggagaa

SEQ ID NO: 605829 - DNA, 20 bp, Artificial Sequence
  chemically synthesized
gagataagattttctccatt

SEQ ID NO: 605830 - DNA, 20 bp, Artificial Sequence
  chemically synthesized
gtgtagtttatacttaagag

SEQ ID NO: 605831 - DNA, 20 bp, Artificial Sequence
  chemically synthesized
tcatcacgtcaggtagatgg

SEQ ID NO: 605832 - DNA, 20 bp, Artificial Sequence
  chemically synthesized
tatgaatatgatgctatagc

SEQ ID NO: 605833 - DNA, 20 bp, Artificial Sequence
  chemically synthesized
tttgtttatgaatatgatgc

SEQ ID NO: 605834 - DNA, 20 bp, Artificial Sequence
  chemically synthesized
tatatatacttgaaagtctt

SEQ ID NO: 605835 - DNA, 20 bp, Artificial Sequence
  chemically synthesized
gtatccactgaagcagcatt

SEQ ID NO: 605836 - DNA, 20 bp, Artificial Sequence
  chemically synthesized
atggggttacaagcttaaaa

SEQ ID NO: 605837 - DNA, 20 bp, Artificial Sequence
  chemically synthesized
acatttccacctatggggtt

SEQ ID NO: 605838 - DNA, 20 bp, Artificial Sequence
  chemically synthesized
cctggaataggggatcttta

SEQ ID NO: 605839 - DNA, 20 bp, Artificial Sequence
  chemically synthesized
taatgggatgcatttaatat

SEQ ID NO: 605840 - DNA, 20 bp, Artificial Sequence
  chemically synthesized
ggataaaggagaactactct

SEQ ID NO: 605841 - DNA, 20 bp, Artificial Sequence
  chemically synthesized
ttctcctttatccatagggg

SEQ ID NO: 605842 - DNA, 20 bp, Artificial Sequence
  chemically synthesized
tgcagttttaggcatccacc

SEQ ID NO: 605843 - DNA, 20 bp, Artificial Sequence
  chemically synthesized
atatagggttttgtactacc

SEQ ID NO: 605844 - DNA, 20 bp, Artificial Sequence
  chemically synthesized
aaattcataaatactatata

SEQ ID NO: 605845 - DNA, 20 bp, Artificial Sequence
  chemically synthesized
acggatagacttgctcttac

SEQ ID NO: 605846 - DNA, 20 bp, Artificial Sequence
  chemically synthesized
agattttgagcaaccccagc

SEQ ID NO: 605847 - DNA, 20 bp, Artificial Sequence
  chemically synthesized
ttcacataaagaaaaccctt

SEQ ID NO: 605848 - DNA, 20 bp, Artificial Sequence
  chemically synthesized
tatgccaaagaaaaactgtg

SEQ ID NO: 605849 - DNA, 20 bp, Artificial Sequence
  chemically synthesized
agtgcttgtgttcaagtcac

SEQ ID NO: 605850 - DNA, 20 bp, Artificial Sequence
  chemically synthesized
gaaacactgtcatggtatcg

SEQ ID NO: 605851 - DNA, 20 bp, Artificial Sequence
  chemically synthesized
caagcactgcgataccatga

SEQ ID NO: 605852 - DNA, 20 bp, Artificial Sequence
  chemically synthesized
catgaagacgctggacaaag

SEQ ID NO: 605853 - DNA, 20 bp, Artificial Sequence
  chemically synthesized
tgagacagaggtgggatagc

SEQ ID NO: 605854 - DNA, 20 bp, Artificial Sequence
  chemically synthesized
ttcataaattttaaattgca

SEQ ID NO: 605855 - DNA, 20 bp, Artificial Sequence
  chemically synthesized
catgcaatttaaaatttatg

SEQ ID NO: 605856 - DNA, 20 bp, Artificial Sequence
  chemically synthesized
tcatccatggttttgctctc

SEQ ID NO: 605857 - DNA, 20 bp, Artificial Sequence
  chemically synthesized
ccctccctccctccctcatc

SEQ ID NO: 605858 - DNA, 20 bp, Artificial Sequence
  chemically synthesized
gagggagggagggagggagg

SEQ ID NO: 605859 - DNA, 20 bp, Artificial Sequence
  chemically synthesized
ggttgcctatgtacctaaaa

SEQ ID NO: 605860 - DNA, 20 bp, Artificial Sequence
  chemically synthesized
ctttatatccaaataatgga

SEQ ID NO: 605861 - DNA, 20 bp, Artificial Sequence
  chemically synthesized
atccaaataatggagcaagt

SEQ ID NO: 605862 - DNA, 20 bp, Artificial Sequence
  chemically synthesized
ggtggggcatagggcttcaa

SEQ ID NO: 605863 - DNA, 20 bp, Artificial Sequence
  chemically synthesized
ccgatgtagtaggtggggca

SEQ ID NO: 605864 - DNA, 20 bp, Artificial Sequence
  chemically synthesized
ctctgtgttgcacatatccc

SEQ ID NO: 605865 - DNA, 20 bp, Artificial Sequence
  chemically synthesized
tctcttgtgaggcctctctc

SEQ ID NO: 605866 - DNA, 20 bp, Artificial Sequence
  chemically synthesized
gttcaagaccaaggtactgg

SEQ ID NO: 605867 - DNA, 20 bp, Artificial Sequence
  chemically synthesized
tggcccccagaatggtgaga

SEQ ID NO: 605868 - DNA, 20 bp, Artificial Sequence
  chemically synthesized
gaatggtgagaaagtgtttg

SEQ ID NO: 605869 - DNA, 20 bp, Artificial Sequence
  chemically synthesized
attaaaaaataacatggact

SEQ ID NO: 605870 - DNA, 20 bp, Artificial Sequence
  chemically synthesized
tacaaaagacaattaagata

SEQ ID NO: 605871 - DNA, 20 bp, Artificial Sequence
  chemically synthesized
taatactttcccatacatac

SEQ ID NO: 605872 - DNA, 20 bp, Artificial Sequence
  chemically synthesized
caacgaccaactcttaaata

SEQ ID NO: 605873 - DNA, 20 bp, Artificial Sequence
  chemically synthesized
caagttatttaagagttggt

SEQ ID NO: 605874 - DNA, 20 bp, Artificial Sequence
  chemically synthesized
agagttggtcgttgtttaca

SEQ ID NO: 605875 - DNA, 20 bp, Artificial Sequence
  chemically synthesized
atagatgacccttggcagtt

SEQ ID NO: 605876 - DNA, 20 bp, Artificial Sequence
  chemically synthesized
cccattaaatctttacgaat

SEQ ID NO: 605877 - DNA, 20 bp, Artificial Sequence
  chemically synthesized
gaagactaaacatttattcg

SEQ ID NO: 605878 - DNA, 20 bp, Artificial Sequence
  chemically synthesized
agtcttcaagtatattcttt

SEQ ID NO: 605879 - DNA, 20 bp, Artificial Sequence
  chemically synthesized
tatcctttagtaacatattc

SEQ ID NO: 605880 - DNA, 20 bp, Artificial Sequence
  chemically synthesized
gagtattttctaagagtaag

SEQ ID NO: 605881 - DNA, 20 bp, Artificial Sequence
  chemically synthesized
ctgccttgctacagaagtga

SEQ ID NO: 605882 - DNA, 20 bp, Artificial Sequence
  chemically synthesized
cttctgtagcaaggcaggca

SEQ ID NO: 605883 - DNA, 20 bp, Artificial Sequence
  chemically synthesized
aagtaatttctaattcactt

SEQ ID NO: 605884 - DNA, 20 bp, Artificial Sequence
  chemically synthesized
catcacaaaaatgtatgggc

SEQ ID NO: 605885 - DNA, 20 bp, Artificial Sequence
  chemically synthesized
gtataaatagataatacacg

SEQ ID NO: 605886 - DNA, 20 bp, Artificial Sequence
  chemically synthesized
tacacgaagtgctttaaatt

SEQ ID NO: 605887 - DNA, 20 bp, Artificial Sequence
  chemically synthesized
aatttatggatttacctatt

SEQ ID NO: 605888 - DNA, 20 bp, Artificial Sequence
  chemically synthesized
gggatatagtcttccaattg

SEQ ID NO: 605889 - DNA, 20 bp, Artificial Sequence
  chemically synthesized
gctgagggatatagtcttcc

SEQ ID NO: 605890 - DNA, 20 bp, Artificial Sequence
  chemically synthesized
tgataggaaccagcatcttt

SEQ ID NO: 605891 - DNA, 20 bp, Artificial Sequence
  chemically synthesized
ttttttaaagaaccactgta

SEQ ID NO: 605892 - DNA, 20 bp, Artificial Sequence
  chemically synthesized
attttttttttctctagaga

SEQ ID NO: 605893 - DNA, 20 bp, Artificial Sequence
  chemically synthesized
aaaaaaatatgtaacttcaa

SEQ ID NO: 605894 - DNA, 20 bp, Artificial Sequence
  chemically synthesized
gtaacttcaactctgtttct

SEQ ID NO: 605895 - DNA, 20 bp, Artificial Sequence
  chemically synthesized
tatttacgtataggaatccc

SEQ ID NO: 605896 - DNA, 20 bp, Artificial Sequence
  chemically synthesized
tgcattattgctaaaagctc

SEQ ID NO: 605897 - DNA, 20 bp, Artificial Sequence
  chemically synthesized
tggttttacatttatgtgta

SEQ ID NO: 605898 - DNA, 20 bp, Artificial Sequence
  chemically synthesized
tttgtgagactttgtaattc

SEQ ID NO: 605899 - DNA, 20 bp, Artificial Sequence
  chemically synthesized
ttagacgaagtgagctgacc

SEQ ID NO: 605900 - DNA, 20 bp, Artificial Sequence
  chemically synthesized
gagcatggacgataatggag

SEQ ID NO: 605901 - DNA, 20 bp, Artificial Sequence
  chemically synthesized
catgctcagatccacaacgg

SEQ ID NO: 605902 - DNA, 20 bp, Artificial Sequence
  chemically synthesized
gacatttctcatctgaattc

SEQ ID NO: 605903 - DNA, 20 bp, Artificial Sequence
  chemically synthesized
aagatttacctcccaggctt

SEQ ID NO: 605904 - DNA, 20 bp, Artificial Sequence
  chemically synthesized
ccatacttaagatttacctc

SEQ ID NO: 605905 - DNA, 20 bp, Artificial Sequence
  chemically synthesized
aaattcaagggtcaccatac

SEQ ID NO: 605906 - DNA, 20 bp, Artificial Sequence
  chemically synthesized
ccaatactgatgggcacagt

SEQ ID NO: 605907 - DNA, 20 bp, Artificial Sequence
  chemically synthesized
ttaacgccaatactgatggg

SEQ ID NO: 605908 - DNA, 20 bp, Artificial Sequence
  chemically synthesized
ttgtgtggtccatggcacat

SEQ ID NO: 605909 - DNA, 20 bp, Artificial Sequence
  chemically synthesized
accacacaatgcatcagcaa

SEQ ID NO: 605910 - DNA, 20 bp, Artificial Sequence
  chemically synthesized
acctgcaataaaataagatg

SEQ ID NO: 605911 - DNA, 20 bp, Artificial Sequence
  chemically synthesized
ccctctgaaaatcccttatt

SEQ ID NO: 605912 - DNA, 20 bp, Artificial Sequence
  chemically synthesized
taagagaaaaatcaagaaat

SEQ ID NO: 605913 - DNA, 20 bp, Artificial Sequence
  chemically synthesized
tcagtaagagtaagttgctt

SEQ ID NO: 605914 - DNA, 20 bp, Artificial Sequence
  chemically synthesized
tttcaacatcagtaagagta

SEQ ID NO: 605915 - DNA, 20 bp, Artificial Sequence
  chemically synthesized
gtttttttcaatggtttttg

SEQ ID NO: 605916 - DNA, 20 bp, Artificial Sequence
  chemically synthesized
aatggatttttgtttttttc

SEQ ID NO: 605917 - DNA, 20 bp, Artificial Sequence
  chemically synthesized
atttctgcctcataatggat

SEQ ID NO: 605918 - DNA, 20 bp, Artificial Sequence
  chemically synthesized
ctgccacatttctgcctcat

SEQ ID NO: 605919 - DNA, 20 bp, Artificial Sequence
  chemically synthesized
tgtggcagagtcctactgaa

SEQ ID NO: 605920 - DNA, 20 bp, Artificial Sequence
  chemically synthesized
gaatagtgtttagccaaggg

SEQ ID NO: 605921 - DNA, 20 bp, Artificial Sequence
  chemically synthesized
gccaagggtatggcttggtt

SEQ ID NO: 605922 - DNA, 20 bp, Artificial Sequence
  chemically synthesized
tttatagtatggtgcttcag

SEQ ID NO: 605923 - DNA, 20 bp, Artificial Sequence
  chemically synthesized
aggtacaccattttatagta

SEQ ID NO: 605924 - DNA, 20 bp, Artificial Sequence
  chemically synthesized
ttgtttcataactcatcaaa

SEQ ID NO: 605925 - DNA, 20 bp, Artificial Sequence
  chemically synthesized
tgagttatgaaacaactact

SEQ ID NO: 605926 - DNA, 20 bp, Artificial Sequence
  chemically synthesized
cttttgaaaaaacttccagt

SEQ ID NO: 605927 - DNA, 20 bp, Artificial Sequence
  chemically synthesized
aaaattccttgagttcagac

SEQ ID NO: 605928 - DNA, 20 bp, Artificial Sequence
  chemically synthesized
acaagttacttaacctatct

SEQ ID NO: 605929 - DNA, 20 bp, Artificial Sequence
  chemically synthesized
aaatcccagacactcagtac

SEQ ID NO: 605930 - DNA, 20 bp, Artificial Sequence
  chemically synthesized
gaagccacagtactgagtgt

SEQ ID NO: 605931 - DNA, 20 bp, Artificial Sequence
  chemically synthesized
caaaatatgaaaagactcca

SEQ ID NO: 605932 - DNA, 20 bp, Artificial Sequence
  chemically synthesized
ccctttggagtcttttcata

SEQ ID NO: 605933 - DNA, 20 bp, Artificial Sequence
  chemically synthesized
ttttcatattttgttttagc

SEQ ID NO: 605934 - DNA, 20 bp, Artificial Sequence
  chemically synthesized
tttgttttagcagaagtttg

SEQ ID NO: 605935 - DNA, 20 bp, Artificial Sequence
  chemically synthesized
tagatttaacatttaatcta

SEQ ID NO: 605936 - DNA, 20 bp, Artificial Sequence
  chemically synthesized
ttcacatccttgtgaagcag

SEQ ID NO: 605937 - DNA, 20 bp, Artificial Sequence
  chemically synthesized
taagcttcacatccttgtga

SEQ ID NO: 605938 - DNA, 20 bp, Artificial Sequence
  chemically synthesized
taatctgcttcacaaggatg

SEQ ID NO: 605939 - DNA, 20 bp, Artificial Sequence
  chemically synthesized
atgtgaagcttaatgttata

SEQ ID NO: 605940 - DNA, 20 bp, Artificial Sequence
  chemically synthesized
ttttgaatcaaattataaca

SEQ ID NO: 605941 - DNA, 20 bp, Artificial Sequence
  chemically synthesized
aaatacagagttacagtgtc

SEQ ID NO: 605942 - DNA, 20 bp, Artificial Sequence
  chemically synthesized
atttgacactgtaactctgt

SEQ ID NO: 605943 - DNA, 20 bp, Artificial Sequence
  chemically synthesized
tgcaagtatttgctgacgtt

SEQ ID NO: 605944 - DNA, 20 bp, Artificial Sequence
  chemically synthesized
ctggaagtgcaagtatttgc

SEQ ID NO: 605945 - DNA, 20 bp, Artificial Sequence
  chemically synthesized
cgtcagcaaatacttgcact

SEQ ID NO: 605946 - DNA, 20 bp, Artificial Sequence
  chemically synthesized
tatttttaaaaggtaagtat

SEQ ID NO: 605947 - DNA, 20 bp, Artificial Sequence
  chemically synthesized
gcaattgtgctgaaagtgta

SEQ ID NO: 605948 - DNA, 20 bp, Artificial Sequence
  chemically synthesized
ctgaaatagcgtagagaaga

SEQ ID NO: 605949 - DNA, 20 bp, Artificial Sequence
  chemically synthesized
ttcttctctacgctatttca

SEQ ID NO: 605950 - DNA, 20 bp, Artificial Sequence
  chemically synthesized
tgacaacaacaaaaggcttt

SEQ ID NO: 605951 - DNA, 20 bp, Artificial Sequence
  chemically synthesized
taacagcagtgacaacaaca

SEQ ID NO: 605952 - DNA, 20 bp, Artificial Sequence
  chemically synthesized
tgtctttttttttttttttt

SEQ ID NO: 605953 - DNA, 20 bp, Artificial Sequence
  chemically synthesized
ctggtgggagctggagagta

SEQ ID NO: 605954 - DNA, 20 bp, Artificial Sequence
  chemically synthesized
cacattcccaggcattcctt

SEQ ID NO: 605955 - DNA, 20 bp, Artificial Sequence
  chemically synthesized
ccaggcattccttggtagct

SEQ ID NO: 605956 - DNA, 20 bp, Artificial Sequence
  chemically synthesized
gcttgaggtttcctcttcct

SEQ ID NO: 605957 - DNA, 20 bp, Artificial Sequence
  chemically synthesized
tgataacgacagtagtagta

SEQ ID NO: 605958 - DNA, 20 bp, Artificial Sequence
  chemically synthesized
tactactgtcgttatcaata

SEQ ID NO: 605959 - DNA, 20 bp, Artificial Sequence
  chemically synthesized
ttatactttatgtaatgatt

SEQ ID NO: 605960 - DNA, 20 bp, Artificial Sequence
  chemically synthesized
caggaagtttatactttatg

SEQ ID NO: 605961 - DNA, 20 bp, Artificial Sequence
  chemically synthesized
agaactgaagtgggaatgca

SEQ ID NO: 605962 - DNA, 20 bp, Artificial Sequence
  chemically synthesized
tgtgaacaaactcaatcttg

SEQ ID NO: 605963 - DNA, 20 bp, Artificial Sequence
  chemically synthesized
aaaactaaagcacagcaaga

SEQ ID NO: 605964 - DNA, 20 bp, Artificial Sequence
  chemically synthesized
caaactcaatcttgctgtgc

SEQ ID NO: 605965 - DNA, 20 bp, Artificial Sequence
  chemically synthesized
ggtgagaaaactaaagcaca

SEQ ID NO: 605966 - DNA, 20 bp, Artificial Sequence
  chemically synthesized
caagcatctcaataattcat

SEQ ID NO: 605967 - DNA, 20 bp, Artificial Sequence
  chemically synthesized
aaatctgtgatgaattattg

SEQ ID NO: 605968 - DNA, 20 bp, Artificial Sequence
  chemically synthesized
tattgagatgcttgtgatag

SEQ ID NO: 605969 - DNA, 20 bp, Artificial Sequence
  chemically synthesized
tttatcacatctggaataaa

SEQ ID NO: 605970 - DNA, 20 bp, Artificial Sequence
  chemically synthesized
atattaaaattctatcatgc

SEQ ID NO: 605971 - DNA, 20 bp, Artificial Sequence
  chemically synthesized
tatcattaattgtccttcta

SEQ ID NO: 605972 - DNA, 20 bp, Artificial Sequence
  chemically synthesized
gcatttttttctatacttga

SEQ ID NO: 605973 - DNA, 20 bp, Artificial Sequence
  chemically synthesized
ttttctatacttgataaagc

SEQ ID NO: 605974 - DNA, 20 bp, Artificial Sequence
  chemically synthesized
tttcaattcttgtataaaac

SEQ ID NO: 605975 - DNA, 20 bp, Artificial Sequence
  chemically synthesized
tacctattggaatatggccc

SEQ ID NO: 605976 - DNA, 20 bp, Artificial Sequence
  chemically synthesized
aacctccaccacccaagttc

SEQ ID NO: 605977 - DNA, 20 bp, Artificial Sequence
  chemically synthesized
agttcaagggattcttgtgc

SEQ ID NO: 605978 - DNA, 20 bp, Artificial Sequence
  chemically synthesized
tgcctcagtttcccaagtag

SEQ ID NO: 605979 - DNA, 20 bp, Artificial Sequence
  chemically synthesized
tttttgtattttagtagaga

SEQ ID NO: 605980 - DNA, 20 bp, Artificial Sequence
  chemically synthesized
cgggcagatcacttgaggtc

SEQ ID NO: 605981 - DNA, 20 bp, Artificial Sequence
  chemically synthesized
cgcctcggcctcgcaaagtg

SEQ ID NO: 605982 - DNA, 20 bp, Artificial Sequence
  chemically synthesized
gggatatttatcttctatgc

SEQ ID NO: 605983 - DNA, 20 bp, Artificial Sequence
  chemically synthesized
ttaggtatgtacgttagaat

SEQ ID NO: 605984 - DNA, 20 bp, Artificial Sequence
  chemically synthesized
ccagagcaggagtcaagttg

SEQ ID NO: 605985 - DNA, 20 bp, Artificial Sequence
  chemically synthesized
aaatgatctgatgatcctta

SEQ ID NO: 605986 - DNA, 20 bp, Artificial Sequence
  chemically synthesized
agactaaggatcatcagatc

SEQ ID NO: 605987 - DNA, 20 bp, Artificial Sequence
  chemically synthesized
aatagtagtttattagctac

SEQ ID NO: 605988 - DNA, 20 bp, Artificial Sequence
  chemically synthesized
tagtccctatggtatttaat

SEQ ID NO: 605989 - DNA, 20 bp, Artificial Sequence
  chemically synthesized
accaattcctagaaagacac

SEQ ID NO: 605990 - DNA, 20 bp, Artificial Sequence
  chemically synthesized
acattacatttttccagatt

SEQ ID NO: 605991 - DNA, 20 bp, Artificial Sequence
  chemically synthesized
gaatttcaacattacatttt

SEQ ID NO: 605992 - DNA, 20 bp, Artificial Sequence
  chemically synthesized
ctgattatgcaggcttggta

SEQ ID NO: 605993 - DNA, 20 bp, Artificial Sequence
  chemically synthesized
aggtttaagtacctgattat

SEQ ID NO: 605994 - DNA, 20 bp, Artificial Sequence
  chemically synthesized
tatgcttgctaggtttaagt

SEQ ID NO: 605995 - DNA, 20 bp, Artificial Sequence
  chemically synthesized
cctttcttgtaatatgcttg

SEQ ID NO: 605996 - DNA, 20 bp, Artificial Sequence
  chemically synthesized
tgttattttcctttcttgta

SEQ ID NO: 605997 - DNA, 20 bp, Artificial Sequence
  chemically synthesized
tttttcctttacgtccatga

SEQ ID NO: 605998 - DNA, 20 bp, Artificial Sequence
  chemically synthesized
ttgctagattttctttgatt

SEQ ID NO: 605999 - DNA, 20 bp, Artificial Sequence
  chemically synthesized
tttgtgtattgctagatttt

SEQ ID NO: 606000 - DNA, 20 bp, Artificial Sequence
  chemically synthesized
tataatcttttttgtgtatt

SEQ ID NO: 606001 - DNA, 20 bp, Artificial Sequence
  chemically synthesized
gaaaatctagcaatacacaa

SEQ ID NO: 606002 - DNA, 20 bp, Artificial Sequence
  chemically synthesized
aaaaagattatacgtcttat

SEQ ID NO: 606003 - DNA, 20 bp, Artificial Sequence
  chemically synthesized
gattatacgtcttatccagg

SEQ ID NO: 606004 - DNA, 20 bp, Artificial Sequence
  chemically synthesized
gtttagtttattacaggaag

SEQ ID NO: 606005 - DNA, 20 bp, Artificial Sequence
  chemically synthesized
tagcattagaaaactaagtc

SEQ ID NO: 606006 - DNA, 20 bp, Artificial Sequence
  chemically synthesized
ctatatgtcaaatcacatga

SEQ ID NO: 606007 - DNA, 20 bp, Artificial Sequence
  chemically synthesized
aagaaaaatacgaccatctc

SEQ ID NO: 606008 - DNA, 20 bp, Artificial Sequence
  chemically synthesized
cttctgttcttaatattcta

SEQ ID NO: 606009 - DNA, 20 bp, Artificial Sequence
  chemically synthesized
cattaagtatgatctttcct

SEQ ID NO: 606010 - DNA, 20 bp, Artificial Sequence
  chemically synthesized
cctacaggaaagatcatact

SEQ ID NO: 606011 - DNA, 20 bp, Artificial Sequence
  chemically synthesized
ataggttgtttttgagtaat

SEQ ID NO: 606012 - DNA, 20 bp, Artificial Sequence
  chemically synthesized
tattcagatgtacatatata

SEQ ID NO: 606013 - DNA, 20 bp, Artificial Sequence
  chemically synthesized
gtgctgatataaagaaatac

SEQ ID NO: 606014 - DNA, 20 bp, Artificial Sequence
  chemically synthesized
ctttctctgagatttatttc

SEQ ID NO: 606015 - DNA, 20 bp, Artificial Sequence
  chemically synthesized
cccaagaaataaatctcaga

SEQ ID NO: 606016 - DNA, 20 bp, Artificial Sequence
  chemically synthesized
taaaggctcttaaactttct

SEQ ID NO: 606017 - DNA, 20 bp, Artificial Sequence
  chemically synthesized
attttctctcaataatgttt

SEQ ID NO: 606018 - DNA, 20 bp, Artificial Sequence
  chemically synthesized
aggtctttattttctctcaa

SEQ ID NO: 606019 - DNA, 20 bp, Artificial Sequence
  chemically synthesized
aataaagacctaactaaatg

SEQ ID NO: 606020 - DNA, 20 bp, Artificial Sequence
  chemically synthesized
aagactttacataataaaaa

SEQ ID NO: 606021 - DNA, 20 bp, Artificial Sequence
  chemically synthesized
aagaatctgctgtggtttta

SEQ ID NO: 606022 - DNA, 20 bp, Artificial Sequence
  chemically synthesized
tgaaatccaattaaaaccac

SEQ ID NO: 606023 - DNA, 20 bp, Artificial Sequence
  chemically synthesized
tgcccccaaaaagaatctgc

SEQ ID NO: 606024 - DNA, 20 bp, Artificial Sequence
  chemically synthesized
atctccatatgaattttaag

SEQ ID NO: 606025 - DNA, 20 bp, Artificial Sequence
  chemically synthesized
tcctttttaaagattatctt

SEQ ID NO: 606026 - DNA, 20 bp, Artificial Sequence
  chemically synthesized
cattttattttcttcctttt

SEQ ID NO: 606027 - DNA, 20 bp, Artificial Sequence
  chemically synthesized
tttaaaaaggaagaaaataa

SEQ ID NO: 606028 - DNA, 20 bp, Artificial Sequence
  chemically synthesized
ctagagtttagtcacattaa

SEQ ID NO: 606029 - DNA, 20 bp, Artificial Sequence
  chemically synthesized
ctgtctagagtttagtcaca

SEQ ID NO: 606030 - DNA, 20 bp, Artificial Sequence
  chemically synthesized
ttaatgtgactaaactctag

SEQ ID NO: 606031 - DNA, 20 bp, Artificial Sequence
  chemically synthesized
tagtcaaataaaagcctgtc

SEQ ID NO: 606032 - DNA, 20 bp, Artificial Sequence
  chemically synthesized
tcctgacctctcttttctta

SEQ ID NO: 606033 - DNA, 20 bp, Artificial Sequence
  chemically synthesized
cagagaatatgtttttggtt

SEQ ID NO: 606034 - DNA, 20 bp, Artificial Sequence
  chemically synthesized
acatctcaaagaggcagaga

SEQ ID NO: 606035 - DNA, 20 bp, Artificial Sequence
  chemically synthesized
gaaagatattcccggattgt

SEQ ID NO: 606036 - DNA, 20 bp, Artificial Sequence
  chemically synthesized
aggtccttgagaaagatatt

SEQ ID NO: 606037 - DNA, 20 bp, Artificial Sequence
  chemically synthesized
attaagtgccaattaacaat

SEQ ID NO: 606038 - DNA, 20 bp, Artificial Sequence
  chemically synthesized
taggatggtgattaggcaat

SEQ ID NO: 606039 - DNA, 20 bp, Artificial Sequence
  chemically synthesized
aagatattagggggttagga

SEQ ID NO: 606040 - DNA, 20 bp, Artificial Sequence
  chemically synthesized
atttttctactagctctcct

SEQ ID NO: 606041 - DNA, 20 bp, Artificial Sequence
  chemically synthesized
tcctgtctttctttcagtag

SEQ ID NO: 606042 - DNA, 20 bp, Artificial Sequence
  chemically synthesized
tcttgaataaagtctttctt

SEQ ID NO: 606043 - DNA, 20 bp, Artificial Sequence
  chemically synthesized
agcctcggcctgccgaagtg

SEQ ID NO: 606044 - DNA, 20 bp, Artificial Sequence
  chemically synthesized
ttttgtattttgagtagaga

SEQ ID NO: 606045 - DNA, 20 bp, Artificial Sequence
  chemically synthesized
tgcctcaacctcctgaatag

SEQ ID NO: 606046 - DNA, 20 bp, Artificial Sequence
  chemically synthesized
tcaggaggttgaggcaggag

SEQ ID NO: 606047 - DNA, 20 bp, Artificial Sequence
  chemically synthesized
atttttttgagatggagttt

SEQ ID NO: 606048 - DNA, 20 bp, Artificial Sequence
  chemically synthesized
atggtaatatttttttgaga

SEQ ID NO: 606049 - DNA, 20 bp, Artificial Sequence
  chemically synthesized
ttaattactatagcattatg

SEQ ID NO: 606050 - DNA, 20 bp, Artificial Sequence
  chemically synthesized
ctgtcctcatgctaattcca

SEQ ID NO: 606051 - DNA, 20 bp, Artificial Sequence
  chemically synthesized
acaggcaagtagagaaataa

SEQ ID NO: 606052 - DNA, 20 bp, Artificial Sequence
  chemically synthesized
ggatcagtttatggactcta

SEQ ID NO: 606053 - DNA, 20 bp, Artificial Sequence
  chemically synthesized
aaatgcctatacgtgcatgg

SEQ ID NO: 606054 - DNA, 20 bp, Artificial Sequence
  chemically synthesized
aggaaaagatggtcttattg

SEQ ID NO: 606055 - DNA, 20 bp, Artificial Sequence
  chemically synthesized
aatattctacagtgccaact

SEQ ID NO: 606056 - DNA, 20 bp, Artificial Sequence
  chemically synthesized
tcctcatacctgtaataata

SEQ ID NO: 606057 - DNA, 20 bp, Artificial Sequence
  chemically synthesized
tgggttgctatataggaact

SEQ ID NO: 606058 - DNA, 20 bp, Artificial Sequence
  chemically synthesized
gtcctgggttgctatatagg

SEQ ID NO: 606059 - DNA, 20 bp, Artificial Sequence
  chemically synthesized
cctatatagcaacccaggac

SEQ ID NO: 606060 - DNA, 20 bp, Artificial Sequence
  chemically synthesized
agcttcagaattttaaagta

SEQ ID NO: 606061 - DNA, 20 bp, Artificial Sequence
  chemically synthesized
atgtttagtgtacttttgtc

SEQ ID NO: 606062 - DNA, 20 bp, Artificial Sequence
  chemically synthesized
gttcacttcaatattttctg

SEQ ID NO: 606063 - DNA, 20 bp, Artificial Sequence
  chemically synthesized
gaactatgttaaatttaaac

SEQ ID NO: 606064 - DNA, 20 bp, Artificial Sequence
  chemically synthesized
tgatatatctcttcataaac

SEQ ID NO: 606065 - DNA, 20 bp, Artificial Sequence
  chemically synthesized
tatatattctgggtattctt

SEQ ID NO: 606066 - DNA, 20 bp, Artificial Sequence
  chemically synthesized
tatttctcttactgatttat

SEQ ID NO: 606067 - DNA, 20 bp, Artificial Sequence
  chemically synthesized
tggattttctatatttctct

SEQ ID NO: 606068 - DNA, 20 bp, Artificial Sequence
  chemically synthesized
tctgaaatgcctgtttttct

SEQ ID NO: 606069 - DNA, 20 bp, Artificial Sequence
  chemically synthesized
aatgaactcttctctgaaat

SEQ ID NO: 606070 - DNA, 20 bp, Artificial Sequence
  chemically synthesized
caccagaaaggctcaaatta

SEQ ID NO: 606071 - DNA, 20 bp, Artificial Sequence
  chemically synthesized
tgcttcatatcttcttgaat

SEQ ID NO: 606072 - DNA, 20 bp, Artificial Sequence
  chemically synthesized
aagtattcaagaagatatga

SEQ ID NO: 606073 - DNA, 20 bp, Artificial Sequence
  chemically synthesized
cagtagtaaatgaaagtaca

SEQ ID NO: 606074 - DNA, 20 bp, Artificial Sequence
  chemically synthesized
tagctttcaagatattaaca

SEQ ID NO: 606075 - DNA, 20 bp, Artificial Sequence
  chemically synthesized
aatcattgggtatatgcata

SEQ ID NO: 606076 - DNA, 20 bp, Artificial Sequence
  chemically synthesized
aagctaaatatgcatatacc

SEQ ID NO: 606077 - DNA, 20 bp, Artificial Sequence
  chemically synthesized
cttaggtaaatacctaatac

SEQ ID NO: 606078 - DNA, 20 bp, Artificial Sequence
  chemically synthesized
gttgatagatgaattatttg

SEQ ID NO: 606079 - DNA, 20 bp, Artificial Sequence
  chemically synthesized
tattctgttcagaaaattgg

SEQ ID NO: 606080 - DNA, 20 bp, Artificial Sequence
  chemically synthesized
tttcactggatactatattt

SEQ ID NO: 606081 - DNA, 20 bp, Artificial Sequence
  chemically synthesized
tttatatatgcagtttttta

SEQ ID NO: 606082 - DNA, 20 bp, Artificial Sequence
  chemically synthesized
agttaaaaaactgcatatat

SEQ ID NO: 606083 - DNA, 20 bp, Artificial Sequence
  chemically synthesized
gtaaatgaaacttttatata

SEQ ID NO: 606084 - DNA, 20 bp, Artificial Sequence
  chemically synthesized
gttacctttgaggagatggg

SEQ ID NO: 606085 - DNA, 20 bp, Artificial Sequence
  chemically synthesized
gggaagagtttatgatacca

SEQ ID NO: 606086 - DNA, 20 bp, Artificial Sequence
  chemically synthesized
atgataccatagggcttgat

SEQ ID NO: 606087 - DNA, 20 bp, Artificial Sequence
  chemically synthesized
cttattacagaagtaacata

SEQ ID NO: 606088 - DNA, 20 bp, Artificial Sequence
  chemically synthesized
caaaggacataagttataat

SEQ ID NO: 606089 - DNA, 20 bp, Artificial Sequence
  chemically synthesized
ctataattataacttatgtc

SEQ ID NO: 606090 - DNA, 20 bp, Artificial Sequence
  chemically synthesized
cttcaatttaaaaagtacca

SEQ ID NO: 606091 - DNA, 20 bp, Artificial Sequence
  chemically synthesized
ttatgtatatataacctgtt

SEQ ID NO: 606092 - DNA, 20 bp, Artificial Sequence
  chemically synthesized
tgtggtatttgtctttctgt

SEQ ID NO: 606093 - DNA, 20 bp, Artificial Sequence
  chemically synthesized
aaaattggatctcatagagc

SEQ ID NO: 606094 - DNA, 20 bp, Artificial Sequence
  chemically synthesized
gtgtggatggaatgaagaga

SEQ ID NO: 606095 - DNA, 20 bp, Artificial Sequence
  chemically synthesized
agaggttgtttaatgggtac

SEQ ID NO: 606096 - DNA, 20 bp, Artificial Sequence
  chemically synthesized
aatacatttacaaaaaattt

SEQ ID NO: 606097 - DNA, 20 bp, Artificial Sequence
  chemically synthesized
agcctcggcctcccaaagtg

SEQ ID NO: 606098 - DNA, 20 bp, Artificial Sequence
  chemically synthesized
tttttgtattttctgtagag

SEQ ID NO: 606099 - DNA, 20 bp, Artificial Sequence
  chemically synthesized
aatggcatgaacccgggagg

SEQ ID NO: 606100 - DNA, 20 bp, Artificial Sequence
  chemically synthesized
gaatattattgttccagcat

SEQ ID NO: 606101 - DNA, 20 bp, Artificial Sequence
  chemically synthesized
tattatgatcactgttatct

SEQ ID NO: 606102 - DNA, 20 bp, Artificial Sequence
  chemically synthesized
attataaagtcagaatagaa

SEQ ID NO: 606103 - DNA, 20 bp, Artificial Sequence
  chemically synthesized
cacaatgtctggattactca

SEQ ID NO: 606104 - DNA, 20 bp, Artificial Sequence
  chemically synthesized
agatttgaaagaacacaatg

SEQ ID NO: 606105 - DNA, 20 bp, Artificial Sequence
  chemically synthesized
atttggccaatagggtgtta

SEQ ID NO: 606106 - DNA, 20 bp, Artificial Sequence
  chemically synthesized
gctgtaagtatacagttaac

SEQ ID NO: 606107 - DNA, 20 bp, Artificial Sequence
  chemically synthesized
taactgtatacttacagcac

SEQ ID NO: 606108 - DNA, 20 bp, Artificial Sequence
  chemically synthesized
ttgatcagctttgatatgtg

SEQ ID NO: 606109 - DNA, 20 bp, Artificial Sequence
  chemically synthesized
aaacttttgagtatgttttg

SEQ ID NO: 606110 - DNA, 20 bp, Artificial Sequence
  chemically synthesized
aagctgatcaaaacatactc

SEQ ID NO: 606111 - DNA, 20 bp, Artificial Sequence
  chemically synthesized
agttattagaaaacttttga

SEQ ID NO: 606112 - DNA, 20 bp, Artificial Sequence
  chemically synthesized
ttacttaaatataaaatggc

SEQ ID NO: 606113 - DNA, 20 bp, Artificial Sequence
  chemically synthesized
gtgactggtatgcttgagga

SEQ ID NO: 606114 - DNA, 20 bp, Artificial Sequence
  chemically synthesized
gagcacttgaattgtgactg

SEQ ID NO: 606115 - DNA, 20 bp, Artificial Sequence
  chemically synthesized
tatatattaacacctgtcac

SEQ ID NO: 606116 - DNA, 20 bp, Artificial Sequence
  chemically synthesized
gacaggtgttaatatatata

SEQ ID NO: 606117 - DNA, 20 bp, Artificial Sequence
  chemically synthesized
gagaatggtttatatatgta

SEQ ID NO: 606118 - DNA, 20 bp, Artificial Sequence
  chemically synthesized
acaacactgttctagaagag

SEQ ID NO: 606119 - DNA, 20 bp, Artificial Sequence
  chemically synthesized
gtgctaaaataaataaatat

SEQ ID NO: 606120 - DNA, 20 bp, Artificial Sequence
  chemically synthesized
cgaatacattactgtgttac

SEQ ID NO: 606121 - DNA, 20 bp, Artificial Sequence
  chemically synthesized
aggtttctgtattcccccgt

SEQ ID NO: 606122 - DNA, 20 bp, Artificial Sequence
  chemically synthesized
attatgtgatttttttcagt

SEQ ID NO: 606123 - DNA, 20 bp, Artificial Sequence
  chemically synthesized
gtgaaaattatgtgattttt

SEQ ID NO: 606124 - DNA, 20 bp, Artificial Sequence
  chemically synthesized
tatgtggccttgtgaaaatt

SEQ ID NO: 606125 - DNA, 20 bp, Artificial Sequence
  chemically synthesized
caaatttctactatgaattt

SEQ ID NO: 606126 - DNA, 20 bp, Artificial Sequence
  chemically synthesized
cagatgtgtgacaactcaac

SEQ ID NO: 606127 - DNA, 20 bp, Artificial Sequence
  chemically synthesized
ccacctgcaagctatatgaa

SEQ ID NO: 606128 - DNA, 20 bp, Artificial Sequence
  chemically synthesized
tgaagttaaatccaagttca

SEQ ID NO: 606129 - DNA, 20 bp, Artificial Sequence
  chemically synthesized
tggatttaacttcattatgc

SEQ ID NO: 606130 - DNA, 20 bp, Artificial Sequence
  chemically synthesized
tattatttttcaggagtttt

SEQ ID NO: 606131 - DNA, 20 bp, Artificial Sequence
  chemically synthesized
ttattagattattatttttc

SEQ ID NO: 606132 - DNA, 20 bp, Artificial Sequence
  chemically synthesized
aagaagcaataattataatt

SEQ ID NO: 606133 - DNA, 20 bp, Artificial Sequence
  chemically synthesized
aataatctaataattataat

SEQ ID NO: 606134 - DNA, 20 bp, Artificial Sequence
  chemically synthesized
gcttcttgggcaacaaatgt

SEQ ID NO: 606135 - DNA, 20 bp, Artificial Sequence
  chemically synthesized
ttgggcaacaaatgttgatg

SEQ ID NO: 606136 - DNA, 20 bp, Artificial Sequence
  chemically synthesized
caaatgttgatgcttagctt

SEQ ID NO: 606137 - DNA, 20 bp, Artificial Sequence
  chemically synthesized
tggattatttccatcacatt

SEQ ID NO: 606138 - DNA, 20 bp, Artificial Sequence
  chemically synthesized
ggaactagagcgaaacatca

SEQ ID NO: 606139 - DNA, 20 bp, Artificial Sequence
  chemically synthesized
ggaatatggttgaaacattt

SEQ ID NO: 606140 - DNA, 20 bp, Artificial Sequence
  chemically synthesized
ttgttcagaaagacgataaa

SEQ ID NO: 606141 - DNA, 20 bp, Artificial Sequence
  chemically synthesized
agtatagcattttctttcca

SEQ ID NO: 606142 - DNA, 20 bp, Artificial Sequence
  chemically synthesized
acattgctgttagtgtcgtt

SEQ ID NO: 606143 - DNA, 20 bp, Artificial Sequence
  chemically synthesized
tcattcttattgtctactta

SEQ ID NO: 606144 - DNA, 20 bp, Artificial Sequence
  chemically synthesized
ctttatattttgccattata

SEQ ID NO: 606145 - DNA, 20 bp, Artificial Sequence
  chemically synthesized
atattttgccattatattca

SEQ ID NO: 606146 - DNA, 20 bp, Artificial Sequence
  chemically synthesized
tatgaaagtaattttgagaa

SEQ ID NO: 606147 - DNA, 20 bp, Artificial Sequence
  chemically synthesized
gagaacttcagctttaaaaa

SEQ ID NO: 606148 - DNA, 20 bp, Artificial Sequence
  chemically synthesized
tccctcattctgtagagaac

SEQ ID NO: 606149 - DNA, 20 bp, Artificial Sequence
  chemically synthesized
ctctacagaatgagggagaa

SEQ ID NO: 606150 - DNA, 20 bp, Artificial Sequence
  chemically synthesized
gagaattatgcttctactag

SEQ ID NO: 606151 - DNA, 20 bp, Artificial Sequence
  chemically synthesized
cttttaaaacatacttgaac

SEQ ID NO: 606152 - DNA, 20 bp, Artificial Sequence
  chemically synthesized
aactggaatctcatgttcaa

SEQ ID NO: 606153 - DNA, 20 bp, Artificial Sequence
  chemically synthesized
aacatacttgaacatgagat

SEQ ID NO: 606154 - DNA, 20 bp, Artificial Sequence
  chemically synthesized
ataatagtaactaatattat

SEQ ID NO: 606155 - DNA, 20 bp, Artificial Sequence
  chemically synthesized
tattattgcttactatattt

SEQ ID NO: 606156 - DNA, 20 bp, Artificial Sequence
  chemically synthesized
actatatttcagtgattttt

SEQ ID NO: 606157 - DNA, 20 bp, Artificial Sequence
  chemically synthesized
tttcagtgatttttaaatgc

SEQ ID NO: 606158 - DNA, 20 bp, Artificial Sequence
  chemically synthesized
tagtttccccatctttaata

SEQ ID NO: 606159 - DNA, 20 bp, Artificial Sequence
  chemically synthesized
gtcacttaaccatccttggc

SEQ ID NO: 606160 - DNA, 20 bp, Artificial Sequence
  chemically synthesized
gggcaagtcacttaaccatc

SEQ ID NO: 606161 - DNA, 20 bp, Artificial Sequence
  chemically synthesized
gagcaggaagggtctatttc

SEQ ID NO: 606162 - DNA, 20 bp, Artificial Sequence
  chemically synthesized
gatttttttgacttaaaagg

SEQ ID NO: 606163 - DNA, 20 bp, Artificial Sequence
  chemically synthesized
acggttggatataattccaa

SEQ ID NO: 606164 - DNA, 20 bp, Artificial Sequence
  chemically synthesized
ttcagttatcttacaagaat

SEQ ID NO: 606165 - DNA, 20 bp, Artificial Sequence
  chemically synthesized
gtaagacacatctcatgtaa

SEQ ID NO: 606166 - DNA, 20 bp, Artificial Sequence
  chemically synthesized
tacttttgcagttaatatta

SEQ ID NO: 606167 - DNA, 20 bp, Artificial Sequence
  chemically synthesized
catgtctgtaccctaattgt

SEQ ID NO: 606168 - DNA, 20 bp, Artificial Sequence
  chemically synthesized
ttcatggaggaaaacttgaa

SEQ ID NO: 606169 - DNA, 20 bp, Artificial Sequence
  chemically synthesized
ctatgtatagaaaactcatt

SEQ ID NO: 606170 - DNA, 20 bp, Artificial Sequence
  chemically synthesized
agacgactctgcttcataag

SEQ ID NO: 606171 - DNA, 20 bp, Artificial Sequence
  chemically synthesized
agatcttatgaagcagagtc

SEQ ID NO: 606172 - DNA, 20 bp, Artificial Sequence
  chemically synthesized
caccgggtttaaacagacga

SEQ ID NO: 606173 - DNA, 20 bp, Artificial Sequence
  chemically synthesized
cgacctctttgcacatacca

SEQ ID NO: 606174 - DNA, 20 bp, Artificial Sequence
  chemically synthesized
gtaacatacagggtatcaga

SEQ ID NO: 606175 - DNA, 20 bp, Artificial Sequence
  chemically synthesized
acctgcatttgattcataca

SEQ ID NO: 606176 - DNA, 20 bp, Artificial Sequence
  chemically synthesized
ctttatgtccctcaacctgc

SEQ ID NO: 606177 - DNA, 20 bp, Artificial Sequence
  chemically synthesized
ctatagacttgtctcatgtt

SEQ ID NO: 606178 - DNA, 20 bp, Artificial Sequence
  chemically synthesized
gatactttggcctacaaggt

SEQ ID NO: 606179 - DNA, 20 bp, Artificial Sequence
  chemically synthesized
atcagaatctggaaagtgac

SEQ ID NO: 606180 - DNA, 20 bp, Artificial Sequence
  chemically synthesized
cttaaaatcctgagtcactt

SEQ ID NO: 606181 - DNA, 20 bp, Artificial Sequence
  chemically synthesized
tcaggattttaagcaaagga

SEQ ID NO: 606182 - DNA, 20 bp, Artificial Sequence
  chemically synthesized
gagcctgtttaatcgttctc

SEQ ID NO: 606183 - DNA, 20 bp, Artificial Sequence
  chemically synthesized
gtcagtgtgggttcccaaga

SEQ ID NO: 606184 - DNA, 20 bp, Artificial Sequence
  chemically synthesized
aacccacactgacttcaatg

SEQ ID NO: 606185 - DNA, 20 bp, Artificial Sequence
  chemically synthesized
agactgaaggcaaggacttt

SEQ ID NO: 606186 - DNA, 20 bp, Artificial Sequence
  chemically synthesized
ggatgaatttggggatgact

SEQ ID NO: 606187 - DNA, 20 bp, Artificial Sequence
  chemically synthesized
taagaaattcagtaaggaaa

SEQ ID NO: 606188 - DNA, 20 bp, Artificial Sequence
  chemically synthesized
tgtacattgccttcctttaa

SEQ ID NO: 606189 - DNA, 20 bp, Artificial Sequence
  chemically synthesized
ggaaggcaatgtacagtgag

SEQ ID NO: 606190 - DNA, 20 bp, Artificial Sequence
  chemically synthesized
gtgaggtaagtttcatcttg

SEQ ID NO: 606191 - DNA, 20 bp, Artificial Sequence
  chemically synthesized
tcatcttgttgagtttgaag

SEQ ID NO: 606192 - DNA, 20 bp, Artificial Sequence
  chemically synthesized
atccagagttaccaacttct

SEQ ID NO: 606193 - DNA, 20 bp, Artificial Sequence
  chemically synthesized
aaaaaggaaggcactttctc

SEQ ID NO: 606194 - DNA, 20 bp, Artificial Sequence
  chemically synthesized
agtgttcatgtgccatttcc

SEQ ID NO: 606195 - DNA, 20 bp, Artificial Sequence
  chemically synthesized
gtgaagaatatttgtagagt

SEQ ID NO: 606196 - DNA, 20 bp, Artificial Sequence
  chemically synthesized
acgattggtactctatctta

SEQ ID NO: 606197 - DNA, 20 bp, Artificial Sequence
  chemically synthesized
gaatacactgtattttacgc

SEQ ID NO: 606198 - DNA, 20 bp, Artificial Sequence
  chemically synthesized
gaactaataattatactcta

SEQ ID NO: 606199 - DNA, 20 bp, Artificial Sequence
  chemically synthesized
tcacagactgtgatatagtg

SEQ ID NO: 606200 - DNA, 20 bp, Artificial Sequence
  chemically synthesized
tctagacactatatcacagt

SEQ ID NO: 606201 - DNA, 20 bp, Artificial Sequence
  chemically synthesized
aagcttgatattaaggatga

SEQ ID NO: 606202 - DNA, 20 bp, Artificial Sequence
  chemically synthesized
aatctgtatcatccttaata

SEQ ID NO: 606203 - DNA, 20 bp, Artificial Sequence
  chemically synthesized
tgtatcatccttaatatcaa

SEQ ID NO: 606204 - DNA, 20 bp, Artificial Sequence
  chemically synthesized
gtgcacatgcttactttgaa

SEQ ID NO: 606205 - DNA, 20 bp, Artificial Sequence
  chemically synthesized
gcacatatgagatagagtgc

SEQ ID NO: 606206 - DNA, 20 bp, Artificial Sequence
  chemically synthesized
gcatgtgcactctatctcat

SEQ ID NO: 606207 - DNA, 20 bp, Artificial Sequence
  chemically synthesized
gcactctatctcatatgtgc

SEQ ID NO: 606208 - DNA, 20 bp, Artificial Sequence
  chemically synthesized
ttaaatttatatacatctct

SEQ ID NO: 606209 - DNA, 20 bp, Artificial Sequence
  chemically synthesized
tttgtatctcaaactaattc

SEQ ID NO: 606210 - DNA, 20 bp, Artificial Sequence
  chemically synthesized
aagtagtataaatcagttga

SEQ ID NO: 606211 - DNA, 20 bp, Artificial Sequence
  chemically synthesized
atgtttatagttcgaaatgt

SEQ ID NO: 606212 - DNA, 20 bp, Artificial Sequence
  chemically synthesized
caacatttcgaactataaac

SEQ ID NO: 606213 - DNA, 20 bp, Artificial Sequence
  chemically synthesized
attgttttaagtcagaaaac

SEQ ID NO: 606214 - DNA, 20 bp, Artificial Sequence
  chemically synthesized
catatacaaatgttacatcc

SEQ ID NO: 606215 - DNA, 20 bp, Artificial Sequence
  chemically synthesized
tctgctcccatattaactta

SEQ ID NO: 606216 - DNA, 20 bp, Artificial Sequence
  chemically synthesized
gagccccagctaaatcctca

SEQ ID NO: 606217 - DNA, 20 bp, Artificial Sequence
  chemically synthesized
ttctggggaaggaagccatt

SEQ ID NO: 606218 - DNA, 20 bp, Artificial Sequence
  chemically synthesized
ttaatatattcctttctagt

SEQ ID NO: 606219 - DNA, 20 bp, Artificial Sequence
  chemically synthesized
atgagtgttcgtgggtgagt

SEQ ID NO: 606220 - DNA, 20 bp, Artificial Sequence
  chemically synthesized
accaataaacagtatcacgc

SEQ ID NO: 606221 - DNA, 20 bp, Artificial Sequence
  chemically synthesized
ttagcaaagcctctgcgtga

SEQ ID NO: 606222 - DNA, 20 bp, Artificial Sequence
  chemically synthesized
aatggaatgaatttgaggta

SEQ ID NO: 606223 - DNA, 20 bp, Artificial Sequence
  chemically synthesized
taccacaaagtatttctaca

SEQ ID NO: 606224 - DNA, 20 bp, Artificial Sequence
  chemically synthesized
ttaatgtcatctgatataaa

SEQ ID NO: 606225 - DNA, 20 bp, Artificial Sequence
  chemically synthesized
catgactcaattttagcgaa

SEQ ID NO: 606226 - DNA, 20 bp, Artificial Sequence
  chemically synthesized
ggaataatttttgcagatga

SEQ ID NO: 606227 - DNA, 20 bp, Artificial Sequence
  chemically synthesized
attattccttcaggcaataa

SEQ ID NO: 606228 - DNA, 20 bp, Artificial Sequence
  chemically synthesized
catgaggccatgctcactgg

SEQ ID NO: 606229 - DNA, 20 bp, Artificial Sequence
  chemically synthesized
ccataccagtgagcatggcc

SEQ ID NO: 606230 - DNA, 20 bp, Artificial Sequence
  chemically synthesized
tttaataatctgatccaaaa

SEQ ID NO: 606231 - DNA, 20 bp, Artificial Sequence
  chemically synthesized
cctggaaaacacaattttgg

SEQ ID NO: 606232 - DNA, 20 bp, Artificial Sequence
  chemically synthesized
ctgatccaaaattgtgtttt

SEQ ID NO: 606233 - DNA, 20 bp, Artificial Sequence
  chemically synthesized
tgcctagatcactgatgaag

SEQ ID NO: 606234 - DNA, 20 bp, Artificial Sequence
  chemically synthesized
tttgttctagtctaactggc

SEQ ID NO: 606235 - DNA, 20 bp, Artificial Sequence
  chemically synthesized
agctactttatccctgttct

SEQ ID NO: 606236 - DNA, 20 bp, Artificial Sequence
  chemically synthesized
agccaggagaacagggataa

SEQ ID NO: 606237 - DNA, 20 bp, Artificial Sequence
  chemically synthesized
aggagaacagggataaagta

SEQ ID NO: 606238 - DNA, 20 bp, Artificial Sequence
  chemically synthesized
gggataaagtagcttgcttg

SEQ ID NO: 606239 - DNA, 20 bp, Artificial Sequence
  chemically synthesized
ttcctgtgccctgcggggca

SEQ ID NO: 606240 - DNA, 20 bp, Artificial Sequence
  chemically synthesized
ttggactgggggacttacac

SEQ ID NO: 606241 - DNA, 20 bp, Artificial Sequence
  chemically synthesized
ctcacactgagagctgcact

SEQ ID NO: 606242 - DNA, 20 bp, Artificial Sequence
  chemically synthesized
actgtcagcttctctggtct

SEQ ID NO: 606243 - DNA, 20 bp, Artificial Sequence
  chemically synthesized
gctactaggttctctcttct

SEQ ID NO: 606244 - DNA, 20 bp, Artificial Sequence
  chemically synthesized
ttatcatggagaattggctc

SEQ ID NO: 606245 - DNA, 20 bp, Artificial Sequence
  chemically synthesized
tgtatataaaatatacattt

SEQ ID NO: 606246 - DNA, 20 bp, Artificial Sequence
  chemically synthesized
agcaagactatcatatcgta

SEQ ID NO: 606247 - DNA, 20 bp, Artificial Sequence
  chemically synthesized
attgcttgagcccagaagtt

SEQ ID NO: 606248 - DNA, 20 bp, Artificial Sequence
  chemically synthesized
ttggaaggctggggagagaa

SEQ ID NO: 606249 - DNA, 20 bp, Artificial Sequence
  chemically synthesized
ctccccagccttccaaagtg

SEQ ID NO: 606250 - DNA, 20 bp, Artificial Sequence
  chemically synthesized
cagaataacatacctaaaaa

SEQ ID NO: 606251 - DNA, 20 bp, Artificial Sequence
  chemically synthesized
atacctaaaaatagggtttt

SEQ ID NO: 606252 - DNA, 20 bp, Artificial Sequence
  chemically synthesized
taaaaatagggttttaatgg

SEQ ID NO: 606253 - DNA, 20 bp, Artificial Sequence
  chemically synthesized
tagagcatcttctataagct

SEQ ID NO: 606254 - DNA, 20 bp, Artificial Sequence
  chemically synthesized
tctataagctatgggcttaa

SEQ ID NO: 606255 - DNA, 20 bp, Artificial Sequence
  chemically synthesized
aggagaaacatggttaagcc

SEQ ID NO: 606256 - DNA, 20 bp, Artificial Sequence
  chemically synthesized
gccttttgttcttgggagat

SEQ ID NO: 606257 - DNA, 20 bp, Artificial Sequence
  chemically synthesized
acagttatctcccaagaaca

SEQ ID NO: 606258 - DNA, 20 bp, Artificial Sequence
  chemically synthesized
tttttatagtcttttttcat

SEQ ID NO: 606259 - DNA, 20 bp, Artificial Sequence
  chemically synthesized
agtttttataaaccacgctc

SEQ ID NO: 606260 - DNA, 20 bp, Artificial Sequence
  chemically synthesized
taaatggtaaatcaagagag

SEQ ID NO: 606261 - DNA, 20 bp, Artificial Sequence
  chemically synthesized
gtgagattggtggaggtggg

SEQ ID NO: 606262 - DNA, 20 bp, Artificial Sequence
  chemically synthesized
ggctgctgctgccatcataa

SEQ ID NO: 606263 - DNA, 20 bp, Artificial Sequence
  chemically synthesized
aactcagtagggagcagcgc

SEQ ID NO: 606264 - DNA, 20 bp, Artificial Sequence
  chemically synthesized
gagttggcagggtgggagcc

SEQ ID NO: 606265 - DNA, 20 bp, Artificial Sequence
  chemically synthesized
ttcttagtatgtggaggcag

SEQ ID NO: 606266 - DNA, 20 bp, Artificial Sequence
  chemically synthesized
acacctggtcttggccgcaa

SEQ ID NO: 606267 - DNA, 20 bp, Artificial Sequence
  chemically synthesized
catgccatccatgtagccta

SEQ ID NO: 606268 - DNA, 20 bp, Artificial Sequence
  chemically synthesized
ggccattcttggcttgaagg

SEQ ID NO: 606269 - DNA, 20 bp, Artificial Sequence
  chemically synthesized
cccccaggcttcaggccatt

SEQ ID NO: 606270 - DNA, 20 bp, Artificial Sequence
  chemically synthesized
cagaactggcagcccagccc

SEQ ID NO: 606271 - DNA, 20 bp, Artificial Sequence
  chemically synthesized
gctgggctgccagttctggg

SEQ ID NO: 606272 - DNA, 20 bp, Artificial Sequence
  chemically synthesized
tggcccagaatgagaactta

SEQ ID NO: 606273 - DNA, 20 bp, Artificial Sequence
  chemically synthesized
tgtctaagtttgtctgagtc

SEQ ID NO: 606274 - DNA, 20 bp, Artificial Sequence
  chemically synthesized
gcggctggtagtcccaatgt

SEQ ID NO: 606275 - DNA, 20 bp, Artificial Sequence
  chemically synthesized
ggagggtgagcaaggtgcag

SEQ ID NO: 606276 - DNA, 20 bp, Artificial Sequence
  chemically synthesized
gagtggggggcatgtttcag

SEQ ID NO: 606277 - DNA, 20 bp, Artificial Sequence
  chemically synthesized
catagcatggtgagtggggg

SEQ ID NO: 606278 - DNA, 20 bp, Artificial Sequence
  chemically synthesized
tgcaaaaggccacagctctt

SEQ ID NO: 606279 - DNA, 20 bp, Artificial Sequence
  chemically synthesized
atgttacagcatgccacaac

SEQ ID NO: 606280 - DNA, 20 bp, Artificial Sequence
  chemically synthesized
ctctgtggttcctggtgtct

SEQ ID NO: 606281 - DNA, 20 bp, Artificial Sequence
  chemically synthesized
gctggaccagatgtaccaca

SEQ ID NO: 606282 - DNA, 20 bp, Artificial Sequence
  chemically synthesized
gcacagtggccaggcctcat

SEQ ID NO: 606283 - DNA, 20 bp, Artificial Sequence
  chemically synthesized
atacctcttactgctctgtg

SEQ ID NO: 606284 - DNA, 20 bp, Artificial Sequence
  chemically synthesized
actcagcctggcaggctgtg

SEQ ID NO: 606285 - DNA, 20 bp, Artificial Sequence
  chemically synthesized
cacccactcagcctggcagg

SEQ ID NO: 606286 - DNA, 20 bp, Artificial Sequence
  chemically synthesized
cggcagcacctctgtctggg

SEQ ID NO: 606287 - DNA, 20 bp, Artificial Sequence
  chemically synthesized
gtggccggcagcacctctgt

SEQ ID NO: 606288 - DNA, 20 bp, Artificial Sequence
  chemically synthesized
acagaggtgctgccggccac

SEQ ID NO: 606289 - DNA, 20 bp, Artificial Sequence
  chemically synthesized
tttatccattttcctccaat

SEQ ID NO: 606290 - DNA, 20 bp, Artificial Sequence
  chemically synthesized
ctccaatgtatgatttagat

SEQ ID NO: 606291 - DNA, 20 bp, Artificial Sequence
  chemically synthesized
cgcaacagatgattcctgag

SEQ ID NO: 606292 - DNA, 20 bp, Artificial Sequence
  chemically synthesized
gactgaactttgaacgcaac

SEQ ID NO: 606293 - DNA, 20 bp, Artificial Sequence
  chemically synthesized
tcagagtaatttcctgtcac

SEQ ID NO: 606294 - DNA, 20 bp, Artificial Sequence
  chemically synthesized
cttatttataaaggcaaaaa

SEQ ID NO: 606295 - DNA, 20 bp, Artificial Sequence
  chemically synthesized
ttattaatgtctatttttat

SEQ ID NO: 606296 - DNA, 20 bp, Artificial Sequence
  chemically synthesized
gttatgttcttactatgtcc

SEQ ID NO: 606297 - DNA, 20 bp, Artificial Sequence
  chemically synthesized
aaaaattcaaatgggatgtg

SEQ ID NO: 606298 - DNA, 20 bp, Artificial Sequence
  chemically synthesized
aattggtcatttatatagtc

SEQ ID NO: 606299 - DNA, 20 bp, Artificial Sequence
  chemically synthesized
gaccaattttagttataaaa

SEQ ID NO: 606300 - DNA, 20 bp, Artificial Sequence
  chemically synthesized
gcagtgatgccagttaactt

SEQ ID NO: 606301 - DNA, 20 bp, Artificial Sequence
  chemically synthesized
aggatgtcagtgcgtagaga

SEQ ID NO: 606302 - DNA, 20 bp, Artificial Sequence
  chemically synthesized
agagtcttgtccttaacttt

SEQ ID NO: 606303 - DNA, 20 bp, Artificial Sequence
  chemically synthesized
ttgtccctcagcaatgttac

SEQ ID NO: 606304 - DNA, 20 bp, Artificial Sequence
  chemically synthesized
tagattctttctctcaaagg

SEQ ID NO: 606305 - DNA, 20 bp, Artificial Sequence
  chemically synthesized
gaaaagtgtgctctccgata

SEQ ID NO: 606306 - DNA, 20 bp, Artificial Sequence
  chemically synthesized
ttagagtttctgaaagatga

SEQ ID NO: 606307 - DNA, 20 bp, Artificial Sequence
  chemically synthesized
gacaggtcagaatatatgct

SEQ ID NO: 606308 - DNA, 20 bp, Artificial Sequence
  chemically synthesized
aaccaaagacaggtcagaat

SEQ ID NO: 606309 - DNA, 20 bp, Artificial Sequence
  chemically synthesized
agcatatattctgacctgtc

SEQ ID NO: 606310 - DNA, 20 bp, Artificial Sequence
  chemically synthesized
cctttagagtcttctttgga

SEQ ID NO: 606311 - DNA, 20 bp, Artificial Sequence
  chemically synthesized
aattctattatgatgatatt

SEQ ID NO: 606312 - DNA, 20 bp, Artificial Sequence
  chemically synthesized
caataggatatatctgcatg

SEQ ID NO: 606313 - DNA, 20 bp, Artificial Sequence
  chemically synthesized
gagatgggcactcaacacta

SEQ ID NO: 606314 - DNA, 20 bp, Artificial Sequence
  chemically synthesized
ggactcagagaaggatctta

SEQ ID NO: 606315 - DNA, 20 bp, Artificial Sequence
  chemically synthesized
taagatccttctctgagtcc

SEQ ID NO: 606316 - DNA, 20 bp, Artificial Sequence
  chemically synthesized
atccttctctgagtcctgat

SEQ ID NO: 606317 - DNA, 20 bp, Artificial Sequence
  chemically synthesized
ttcttttaggggatccaaat

SEQ ID NO: 606318 - DNA, 20 bp, Artificial Sequence
  chemically synthesized
tatgtttaatactggactga

SEQ ID NO: 606319 - DNA, 20 bp, Artificial Sequence
  chemically synthesized
ttcagagactgtggacttta

SEQ ID NO: 606320 - DNA, 20 bp, Artificial Sequence
  chemically synthesized
tgggtatattataattctag

SEQ ID NO: 606321 - DNA, 20 bp, Artificial Sequence
  chemically synthesized
ggtatttgtgttaaattttt

SEQ ID NO: 606322 - DNA, 20 bp, Artificial Sequence
  chemically synthesized
tttatcaatcttttaatact

SEQ ID NO: 606323 - DNA, 20 bp, Artificial Sequence
  chemically synthesized
aggagaaatcataaagtatt

SEQ ID NO: 606324 - DNA, 20 bp, Artificial Sequence
  chemically synthesized
ccatcttctcgtcctcttct

SEQ ID NO: 606325 - DNA, 20 bp, Artificial Sequence
  chemically synthesized
taaaaagtaaactaggtaag

SEQ ID NO: 606326 - DNA, 20 bp, Artificial Sequence
  chemically synthesized
agtgatataatcttgtctta

SEQ ID NO: 606327 - DNA, 20 bp, Artificial Sequence
  chemically synthesized
gcaaagaacctaagaatcat

SEQ ID NO: 606328 - DNA, 20 bp, Artificial Sequence
  chemically synthesized
tccatttgactttgaaacag

SEQ ID NO: 606329 - DNA, 20 bp, Artificial Sequence
  chemically synthesized
gctggaattgtcgtggaatg

SEQ ID NO: 606330 - DNA, 20 bp, Artificial Sequence
  chemically synthesized
aataaagtatagaactcaag

SEQ ID NO: 606331 - DNA, 20 bp, Artificial Sequence
  chemically synthesized
tccttcagtcccaaaagaat

SEQ ID NO: 606332 - DNA, 20 bp, Artificial Sequence
  chemically synthesized
aagcccttgctataactttt

SEQ ID NO: 606333 - DNA, 20 bp, Artificial Sequence
  chemically synthesized
aatcaaagaaaagttatagc

SEQ ID NO: 606334 - DNA, 20 bp, Artificial Sequence
  chemically synthesized
atagcaagggctttctctcc

SEQ ID NO: 606335 - DNA, 20 bp, Artificial Sequence
  chemically synthesized
gctgcccttttagatactag

SEQ ID NO: 606336 - DNA, 20 bp, Artificial Sequence
  chemically synthesized
tgagaacatcaaaagaggaa

SEQ ID NO: 606337 - DNA, 20 bp, Artificial Sequence
  chemically synthesized
taaactctatctgcatttgt

SEQ ID NO: 606338 - DNA, 20 bp, Artificial Sequence
  chemically synthesized
caatcatggacaaatgcaga

SEQ ID NO: 606339 - DNA, 20 bp, Artificial Sequence
  chemically synthesized
aaatgtactgattatcccta

SEQ ID NO: 606340 - DNA, 20 bp, Artificial Sequence
  chemically synthesized
ctactaaatatcggtaaatg

SEQ ID NO: 606341 - DNA, 20 bp, Artificial Sequence
  chemically synthesized
ctcttctgtatttgttttct

SEQ ID NO: 606342 - DNA, 20 bp, Artificial Sequence
  chemically synthesized
gtgggcctatactcttctgt

SEQ ID NO: 606343 - DNA, 20 bp, Artificial Sequence
  chemically synthesized
aaccatctgtgagttctacg

SEQ ID NO: 606344 - DNA, 20 bp, Artificial Sequence
  chemically synthesized
tcaatataattcatccaagg

SEQ ID NO: 606345 - DNA, 20 bp, Artificial Sequence
  chemically synthesized
tcattagctgacccagtgtg

SEQ ID NO: 606346 - DNA, 20 bp, Artificial Sequence
  chemically synthesized
gggtcagctaatgatgaaat

SEQ ID NO: 606347 - DNA, 20 bp, Artificial Sequence
  chemically synthesized
accagtaacctcccttcaac

SEQ ID NO: 606348 - DNA, 20 bp, Artificial Sequence
  chemically synthesized
ttgaaattttctggtaaagt

SEQ ID NO: 606349 - DNA, 20 bp, Artificial Sequence
  chemically synthesized
tctttaaatcacagcacttc

SEQ ID NO: 606350 - DNA, 20 bp, Artificial Sequence
  chemically synthesized
actcataatcagctgaagtg

SEQ ID NO: 606351 - DNA, 20 bp, Artificial Sequence
  chemically synthesized
tagttcttttaaaggacata

SEQ ID NO: 606352 - DNA, 20 bp, Artificial Sequence
  chemically synthesized
aacaacttaaggtcagatta

SEQ ID NO: 606353 - DNA, 20 bp, Artificial Sequence
  chemically synthesized
ctttggaagaacaacttaag

SEQ ID NO: 606354 - DNA, 20 bp, Artificial Sequence
  chemically synthesized
tctagtggagatcacgcaac

SEQ ID NO: 606355 - DNA, 20 bp, Artificial Sequence
  chemically synthesized
gcagcagttgcgtgatctcc

SEQ ID NO: 606356 - DNA, 20 bp, Artificial Sequence
  chemically synthesized
tttaaaacattttatctttc

SEQ ID NO: 606357 - DNA, 20 bp, Artificial Sequence
  chemically synthesized
cttgaagcacctgaaagata

SEQ ID NO: 606358 - DNA, 20 bp, Artificial Sequence
  chemically synthesized
atattcttacatgtgtgttg

SEQ ID NO: 606359 - DNA, 20 bp, Artificial Sequence
  chemically synthesized
atagcagaaaattggcttgg

SEQ ID NO: 606360 - DNA, 20 bp, Artificial Sequence
  chemically synthesized
gctgagcgtcatagcagaaa

SEQ ID NO: 606361 - DNA, 20 bp, Artificial Sequence
  chemically synthesized
accggtttgttggatcaaga

SEQ ID NO: 606362 - DNA, 20 bp, Artificial Sequence
  chemically synthesized
gaggaccggtttgttggatc

SEQ ID NO: 606363 - DNA, 20 bp, Artificial Sequence
  chemically synthesized
cataataggacagtaggagg

SEQ ID NO: 606364 - DNA, 20 bp, Artificial Sequence
  chemically synthesized
gcacagtaactataggatac

SEQ ID NO: 606365 - DNA, 20 bp, Artificial Sequence
  chemically synthesized
ttatagcgtcttacttgaca

SEQ ID NO: 606366 - DNA, 20 bp, Artificial Sequence
  chemically synthesized
ccctcattcttgacaccttc

SEQ ID NO: 606367 - DNA, 20 bp, Artificial Sequence
  chemically synthesized
ttttttttttctattttgga

SEQ ID NO: 606368 - DNA, 20 bp, Artificial Sequence
  chemically synthesized
aatcccttgaacccggtagg

SEQ ID NO: 606369 - DNA, 20 bp, Artificial Sequence
  chemically synthesized
aaactccacctaccgggttc

SEQ ID NO: 606370 - DNA, 20 bp, Artificial Sequence
  chemically synthesized
tgcctcagcctcccgagtag

SEQ ID NO: 606371 - DNA, 20 bp, Artificial Sequence
  chemically synthesized
tttttgtattttcagttgag

SEQ ID NO: 606372 - DNA, 20 bp, Artificial Sequence
  chemically synthesized
tgggtagattacctgaggtc

SEQ ID NO: 606373 - DNA, 20 bp, Artificial Sequence
  chemically synthesized
cactttgggaggctgaggtg

SEQ ID NO: 606374 - DNA, 20 bp, Artificial Sequence
  chemically synthesized
cacctcagcctcccaaagtg

SEQ ID NO: 606375 - DNA, 20 bp, Artificial Sequence
  chemically synthesized
tataggccaggcacagtggc

SEQ ID NO: 606376 - DNA, 20 bp, Artificial Sequence
  chemically synthesized
cactactttttagctccttt

SEQ ID NO: 606377 - DNA, 20 bp, Artificial Sequence
  chemically synthesized
aatcggactgacatctgatt

SEQ ID NO: 606378 - DNA, 20 bp, Artificial Sequence
  chemically synthesized
aaactacaaatcagatgtca

SEQ ID NO: 606379 - DNA, 20 bp, Artificial Sequence
  chemically synthesized
tttttataaatcggactgac

SEQ ID NO: 606380 - DNA, 20 bp, Artificial Sequence
  chemically synthesized
cagtccgatttataaaaacc

SEQ ID NO: 606381 - DNA, 20 bp, Artificial Sequence
  chemically synthesized
tcttagtatgatagaaatct

SEQ ID NO: 606382 - DNA, 20 bp, Artificial Sequence
  chemically synthesized
gtataccattctcgccctca

SEQ ID NO: 606383 - DNA, 20 bp, Artificial Sequence
  chemically synthesized
cctcacagtgtttcagaatg

SEQ ID NO: 606384 - DNA, 20 bp, Artificial Sequence
  chemically synthesized
gtgtcaagctgttccctcta

SEQ ID NO: 606385 - DNA, 20 bp, Artificial Sequence
  chemically synthesized
aaagcaatcctggtagaggg

SEQ ID NO: 606386 - DNA, 20 bp, Artificial Sequence
  chemically synthesized
caagctgttccctctaccag

SEQ ID NO: 606387 - DNA, 20 bp, Artificial Sequence
  chemically synthesized
accaggattgcttttcttcc

SEQ ID NO: 606388 - DNA, 20 bp, Artificial Sequence
  chemically synthesized
ttgagtcctgaatgataaag

SEQ ID NO: 606389 - DNA, 20 bp, Artificial Sequence
  chemically synthesized
tgtaagtgtcacctacctag

SEQ ID NO: 606390 - DNA, 20 bp, Artificial Sequence
  chemically synthesized
attactagggagcaacattg

SEQ ID NO: 606391 - DNA, 20 bp, Artificial Sequence
  chemically synthesized
attattgagtagtgacaata

SEQ ID NO: 606392 - DNA, 20 bp, Artificial Sequence
  chemically synthesized
tactcaataatttcttatgt

SEQ ID NO: 606393 - DNA, 20 bp, Artificial Sequence
  chemically synthesized
acaaatgtttattgatcttt

SEQ ID NO: 606394 - DNA, 20 bp, Artificial Sequence
  chemically synthesized
catggtaccatttatctgac

SEQ ID NO: 606395 - DNA, 20 bp, Artificial Sequence
  chemically synthesized
tcagataaatggtaccatgt

SEQ ID NO: 606396 - DNA, 20 bp, Artificial Sequence
  chemically synthesized
tttggggaaaacatgcacag

SEQ ID NO: 606397 - DNA, 20 bp, Artificial Sequence
  chemically synthesized
gaaggaacaaactcatctgt

SEQ ID NO: 606398 - DNA, 20 bp, Artificial Sequence
  chemically synthesized
gcacagatgagtttgttcct

SEQ ID NO: 606399 - DNA, 20 bp, Artificial Sequence
  chemically synthesized
tttgttccttcctgattgca

SEQ ID NO: 606400 - DNA, 20 bp, Artificial Sequence
  chemically synthesized
tacaatataataggaagaat

SEQ ID NO: 606401 - DNA, 20 bp, Artificial Sequence
  chemically synthesized
ttctgttgaggttagtgtaa

SEQ ID NO: 606402 - DNA, 20 bp, Artificial Sequence
  chemically synthesized
aaaggcagtatttgaattat

SEQ ID NO: 606403 - DNA, 20 bp, Artificial Sequence
  chemically synthesized
cagcctcacttaataggggg

SEQ ID NO: 606404 - DNA, 20 bp, Artificial Sequence
  chemically synthesized
gtttttaaaaagattggaaa

SEQ ID NO: 606405 - DNA, 20 bp, Artificial Sequence
  chemically synthesized
aattgtacatcatgttttta

SEQ ID NO: 606406 - DNA, 20 bp, Artificial Sequence
  chemically synthesized
cattacaaaataattgtaca

SEQ ID NO: 606407 - DNA, 20 bp, Artificial Sequence
  chemically synthesized
tgtttacccctaatttattc

SEQ ID NO: 606408 - DNA, 20 bp, Artificial Sequence
  chemically synthesized
cttggttctagagcagcctc

SEQ ID NO: 606409 - DNA, 20 bp, Artificial Sequence
  chemically synthesized
ccctgttacactatttatta

SEQ ID NO: 606410 - DNA, 20 bp, Artificial Sequence
  chemically synthesized
ttgagacttctaggcaacta

SEQ ID NO: 606411 - DNA, 20 bp, Artificial Sequence
  chemically synthesized
cataacacaagagtggagaa

SEQ ID NO: 606412 - DNA, 20 bp, Artificial Sequence
  chemically synthesized
agtaacgggaaatgtcccaa

SEQ ID NO: 606413 - DNA, 20 bp, Artificial Sequence
  chemically synthesized
ttgttttgcaagtagggaca

SEQ ID NO: 606414 - DNA, 20 bp, Artificial Sequence
  chemically synthesized
tgtccctacttgcaaaacaa

SEQ ID NO: 606415 - DNA, 20 bp, Artificial Sequence
  chemically synthesized
gactgataggtgctaagcac

SEQ ID NO: 606416 - DNA, 20 bp, Artificial Sequence
  chemically synthesized
aagttcccttccacctgcca

SEQ ID NO: 606417 - DNA, 20 bp, Artificial Sequence
  chemically synthesized
aaatgctcatgcatttgaga

SEQ ID NO: 606418 - DNA, 20 bp, Artificial Sequence
  chemically synthesized
ggataaaaatgctcatgcat

SEQ ID NO: 606419 - DNA, 20 bp, Artificial Sequence
  chemically synthesized
aatgcatgagcatttttatc

SEQ ID NO: 606420 - DNA, 20 bp, Artificial Sequence
  chemically synthesized
tttatagtgttctaaaatgt

SEQ ID NO: 606421 - DNA, 20 bp, Artificial Sequence
  chemically synthesized
tagagagacgaagtaaaaag

SEQ ID NO: 606422 - DNA, 20 bp, Artificial Sequence
  chemically synthesized
acttctttttacttcgtctc

SEQ ID NO: 606423 - DNA, 20 bp, Artificial Sequence
  chemically synthesized
tgcatagtcattttattcta

SEQ ID NO: 606424 - DNA, 20 bp, Artificial Sequence
  chemically synthesized
gtcaaaggcatgataggcag

SEQ ID NO: 606425 - DNA, 20 bp, Artificial Sequence
  chemically synthesized
ctatcatgcctttgacattc

SEQ ID NO: 606426 - DNA, 20 bp, Artificial Sequence
  chemically synthesized
atttttggcctcatggcaaa

SEQ ID NO: 606427 - DNA, 20 bp, Artificial Sequence
  chemically synthesized
tcaaggacaactctgaattt

SEQ ID NO: 606428 - DNA, 20 bp, Artificial Sequence
  chemically synthesized
ccttgacagtcatgttgagt

SEQ ID NO: 606429 - DNA, 20 bp, Artificial Sequence
  chemically synthesized
attttgaaggtgtcagccgg

SEQ ID NO: 606430 - DNA, 20 bp, Artificial Sequence
  chemically synthesized
tggtggccagtgtatcataa

SEQ ID NO: 606431 - DNA, 20 bp, Artificial Sequence
  chemically synthesized
caaaattacaagtaaataat

SEQ ID NO: 606432 - DNA, 20 bp, Artificial Sequence
  chemically synthesized
agttttcatttttacatgta

SEQ ID NO: 606433 - DNA, 20 bp, Artificial Sequence
  chemically synthesized
ttggattcattccatggatc

SEQ ID NO: 606434 - DNA, 20 bp, Artificial Sequence
  chemically synthesized
ctttaaaagactcaataaga

SEQ ID NO: 606435 - DNA, 20 bp, Artificial Sequence
  chemically synthesized
actaagtaatggagaatata

SEQ ID NO: 606436 - DNA, 20 bp, Artificial Sequence
  chemically synthesized
tattctccattacttagttg

SEQ ID NO: 606437 - DNA, 20 bp, Artificial Sequence
  chemically synthesized
ccattacttagttgttctga

SEQ ID NO: 606438 - DNA, 20 bp, Artificial Sequence
  chemically synthesized
tgattttgtttcgttcatct

SEQ ID NO: 606439 - DNA, 20 bp, Artificial Sequence
  chemically synthesized
gcattcttgccatattgatc

SEQ ID NO: 606440 - DNA, 20 bp, Artificial Sequence
  chemically synthesized
attgatcaagggtttatatt

SEQ ID NO: 606441 - DNA, 20 bp, Artificial Sequence
  chemically synthesized
taagtccagagggttcttgt

SEQ ID NO: 606442 - DNA, 20 bp, Artificial Sequence
  chemically synthesized
tgaagagtccagagtgctgg

SEQ ID NO: 606443 - DNA, 20 bp, Artificial Sequence
  chemically synthesized
agtagatttgcataaggtac

SEQ ID NO: 606444 - DNA, 20 bp, Artificial Sequence
  chemically synthesized
aaaaagtcagtttaaccttt

SEQ ID NO: 606445 - DNA, 20 bp, Artificial Sequence
  chemically synthesized
tatttagtgtgctcaaaaaa

SEQ ID NO: 606446 - DNA, 20 bp, Artificial Sequence
  chemically synthesized
agacgtgcttactgttttac

SEQ ID NO: 606447 - DNA, 20 bp, Artificial Sequence
  chemically synthesized
gagaaaataggagacgtgct

SEQ ID NO: 606448 - DNA, 20 bp, Artificial Sequence
  chemically synthesized
gaagtctgagaaaataggag

SEQ ID NO: 606449 - DNA, 20 bp, Artificial Sequence
  chemically synthesized
tctgtattttgctgatatta

SEQ ID NO: 606450 - DNA, 20 bp, Artificial Sequence
  chemically synthesized
tctccttaatatcagcaaaa

SEQ ID NO: 606451 - DNA, 20 bp, Artificial Sequence
  chemically synthesized
attatgaactatgcaacgtt

SEQ ID NO: 606452 - DNA, 20 bp, Artificial Sequence
  chemically synthesized
acgttcagggtttactttta

SEQ ID NO: 606453 - DNA, 20 bp, Artificial Sequence
  chemically synthesized
taactccagctttttatgtc

SEQ ID NO: 606454 - DNA, 20 bp, Artificial Sequence
  chemically synthesized
gaacaattgaactttttaac

SEQ ID NO: 606455 - DNA, 20 bp, Artificial Sequence
  chemically synthesized
aaggcctttattcatggatt

SEQ ID NO: 606456 - DNA, 20 bp, Artificial Sequence
  chemically synthesized
caatgatcaaggcctttatt

SEQ ID NO: 606457 - DNA, 20 bp, Artificial Sequence
  chemically synthesized
cattggggtaaagaatgcct

SEQ ID NO: 606458 - DNA, 20 bp, Artificial Sequence
  chemically synthesized
aattttaaatactgacttct

SEQ ID NO: 606459 - DNA, 20 bp, Artificial Sequence
  chemically synthesized
tcatagatgaatttatacaa

SEQ ID NO: 606460 - DNA, 20 bp, Artificial Sequence
  chemically synthesized
tttatacaacggagatttat

SEQ ID NO: 606461 - DNA, 20 bp, Artificial Sequence
  chemically synthesized
gaaactatttggctcatatt

SEQ ID NO: 606462 - DNA, 20 bp, Artificial Sequence
  chemically synthesized
taagcctgaaatatgagcca

SEQ ID NO: 606463 - DNA, 20 bp, Artificial Sequence
  chemically synthesized
atccctagagaagtacacaa

SEQ ID NO: 606464 - DNA, 20 bp, Artificial Sequence
  chemically synthesized
attgtaatataatattgtta

SEQ ID NO: 606465 - DNA, 20 bp, Artificial Sequence
  chemically synthesized
ttaaaatgttttcctttatt

SEQ ID NO: 606466 - DNA, 20 bp, Artificial Sequence
  chemically synthesized
gttttcctttattaaaagct

SEQ ID NO: 606467 - DNA, 20 bp, Artificial Sequence
  chemically synthesized
tgtatgtgtatgtacaatct

SEQ ID NO: 606468 - DNA, 20 bp, Artificial Sequence
  chemically synthesized
ttttcattattttattaaag

SEQ ID NO: 606469 - DNA, 20 bp, Artificial Sequence
  chemically synthesized
ggaatgcttttgtaacactt

SEQ ID NO: 606470 - DNA, 20 bp, Artificial Sequence
  chemically synthesized
aatttaactaggaacatgat

SEQ ID NO: 606471 - DNA, 20 bp, Artificial Sequence
  chemically synthesized
ttattagatacaaatgttac

SEQ ID NO: 606472 - DNA, 20 bp, Artificial Sequence
  chemically synthesized
gagatgtaacattaagaatg

SEQ ID NO: 606473 - DNA, 20 bp, Artificial Sequence
  chemically synthesized
aagaatgcctagattggaca

SEQ ID NO: 606474 - DNA, 20 bp, Artificial Sequence
  chemically synthesized
attcacagaggtataacaaa

SEQ ID NO: 606475 - DNA, 20 bp, Artificial Sequence
  chemically synthesized
tctaaataagtctctagtta

SEQ ID NO: 606476 - DNA, 20 bp, Artificial Sequence
  chemically synthesized
taaaagaagtacaagaaaag

SEQ ID NO: 606477 - DNA, 20 bp, Artificial Sequence
  chemically synthesized
ctggctcttgtccatgtcaa

SEQ ID NO: 606478 - DNA, 20 bp, Artificial Sequence
  chemically synthesized
atgtcaagttggttttcaaa

SEQ ID NO: 606479 - DNA, 20 bp, Artificial Sequence
  chemically synthesized
aaacactgaagtggctctcc

SEQ ID NO: 606480 - DNA, 20 bp, Artificial Sequence
  chemically synthesized
aaaccactggagagccactt

SEQ ID NO: 606481 - DNA, 20 bp, Artificial Sequence
  chemically synthesized
ttatgtaaggctagggaaat

SEQ ID NO: 606482 - DNA, 20 bp, Artificial Sequence
  chemically synthesized
ggctagggaaatttttgatt

SEQ ID NO: 606483 - DNA, 20 bp, Artificial Sequence
  chemically synthesized
ttgttttctattatactgcc

SEQ ID NO: 606484 - DNA, 20 bp, Artificial Sequence
  chemically synthesized
tacaggatacccatccttgt

SEQ ID NO: 606485 - DNA, 20 bp, Artificial Sequence
  chemically synthesized
cgaatttacaggatacccat

SEQ ID NO: 606486 - DNA, 20 bp, Artificial Sequence
  chemically synthesized
tatcctgtaaattcgatggg

SEQ ID NO: 606487 - DNA, 20 bp, Artificial Sequence
  chemically synthesized
gtaaattcgatgggagaagc

SEQ ID NO: 606488 - DNA, 20 bp, Artificial Sequence
  chemically synthesized
aagaaatagacaagtaaaac

SEQ ID NO: 606489 - DNA, 20 bp, Artificial Sequence
  chemically synthesized
gaacagctgttacctatatg

SEQ ID NO: 606490 - DNA, 20 bp, Artificial Sequence
  chemically synthesized
gtgtgtgtgtgtgtgcgtgt

SEQ ID NO: 606491 - DNA, 20 bp, Artificial Sequence
  chemically synthesized
gttctgtgttgtttctaggg

SEQ ID NO: 606492 - DNA, 20 bp, Artificial Sequence
  chemically synthesized
tcatgatgaacagcgttctg

SEQ ID NO: 606493 - DNA, 20 bp, Artificial Sequence
  chemically synthesized
ttaaagtcatttttggagac

SEQ ID NO: 606494 - DNA, 20 bp, Artificial Sequence
  chemically synthesized
actttaaaattaatatattt

SEQ ID NO: 606495 - DNA, 20 bp, Artificial Sequence
  chemically synthesized
atgtttaattacaaatattc

SEQ ID NO: 606496 - DNA, 20 bp, Artificial Sequence
  chemically synthesized
attacaaatattcagtagtt

SEQ ID NO: 606497 - DNA, 20 bp, Artificial Sequence
  chemically synthesized
cttaatgtcctttgcaaatt

SEQ ID NO: 606498 - DNA, 20 bp, Artificial Sequence
  chemically synthesized
agggatttttttgttcatga

SEQ ID NO: 606499 - DNA, 20 bp, Artificial Sequence
  chemically synthesized
ttaacatgatcattagtatc

SEQ ID NO: 606500 - DNA, 20 bp, Artificial Sequence
  chemically synthesized
aacactttctgatctgtact

SEQ ID NO: 606501 - DNA, 20 bp, Artificial Sequence
  chemically synthesized
caagtacagatcagaaagtg

SEQ ID NO: 606502 - DNA, 20 bp, Artificial Sequence
  chemically synthesized
tgatatgatctggaaaggac

SEQ ID NO: 606503 - DNA, 20 bp, Artificial Sequence
  chemically synthesized
ctagacaatactgtgaccag

SEQ ID NO: 606504 - DNA, 20 bp, Artificial Sequence
  chemically synthesized
cctggctggtcacagtattg

SEQ ID NO: 606505 - DNA, 20 bp, Artificial Sequence
  chemically synthesized
tttctagggtagcctgttga

SEQ ID NO: 606506 - DNA, 20 bp, Artificial Sequence
  chemically synthesized
tcctcaacaggctaccctag

SEQ ID NO: 606507 - DNA, 20 bp, Artificial Sequence
  chemically synthesized
catttaagtaagtgaatatc

SEQ ID NO: 606508 - DNA, 20 bp, Artificial Sequence
  chemically synthesized
tttgatattcacttacttaa

SEQ ID NO: 606509 - DNA, 20 bp, Artificial Sequence
  chemically synthesized
ttagttcttatatcagaaca

SEQ ID NO: 606510 - DNA, 20 bp, Artificial Sequence
  chemically synthesized
tttatctttttgttagaaat

SEQ ID NO: 606511 - DNA, 20 bp, Artificial Sequence
  chemically synthesized
tttttgttagaaatgaatgt

SEQ ID NO: 606512 - DNA, 20 bp, Artificial Sequence
  chemically synthesized
gtctttcagaacccccattt

SEQ ID NO: 606513 - DNA, 20 bp, Artificial Sequence
  chemically synthesized
accaaatgggggttctgaaa

SEQ ID NO: 606514 - DNA, 20 bp, Artificial Sequence
  chemically synthesized
tctgaaagactgtttcaatg

SEQ ID NO: 606515 - DNA, 20 bp, Artificial Sequence
  chemically synthesized
aaaggctatacaagcacact

SEQ ID NO: 606516 - DNA, 20 bp, Artificial Sequence
  chemically synthesized
aggctattgagaagcattta

SEQ ID NO: 606517 - DNA, 20 bp, Artificial Sequence
  chemically synthesized
actcaataaatacgaaaaga

SEQ ID NO: 606518 - DNA, 20 bp, Artificial Sequence
  chemically synthesized
attgtctactttatttttaa

SEQ ID NO: 606519 - DNA, 20 bp, Artificial Sequence
  chemically synthesized
tggaaaaggacataggatga

SEQ ID NO: 606520 - DNA, 20 bp, Artificial Sequence
  chemically synthesized
ctgtctcctcatagtcatgc

SEQ ID NO: 606521 - DNA, 20 bp, Artificial Sequence
  chemically synthesized
tcagatgctacacttttgac

SEQ ID NO: 606522 - DNA, 20 bp, Artificial Sequence
  chemically synthesized
tcaaaagtgtagcatctgaa

SEQ ID NO: 606523 - DNA, 20 bp, Artificial Sequence
  chemically synthesized
ccaggaattacacatagaaa

SEQ ID NO: 606524 - DNA, 20 bp, Artificial Sequence
  chemically synthesized
aaagtcacgtgattggttat

SEQ ID NO: 606525 - DNA, 20 bp, Artificial Sequence
  chemically synthesized
ttgatgactttctcaaagtc

SEQ ID NO: 606526 - DNA, 20 bp, Artificial Sequence
  chemically synthesized
agtcatcaaccacaccaagc

SEQ ID NO: 606527 - DNA, 20 bp, Artificial Sequence
  chemically synthesized
agttttacaaattaggaagc

SEQ ID NO: 606528 - DNA, 20 bp, Artificial Sequence
  chemically synthesized
gaaataggcagttttattat

SEQ ID NO: 606529 - DNA, 20 bp, Artificial Sequence
  chemically synthesized
cttaaccacataaagaaata

SEQ ID NO: 606530 - DNA, 20 bp, Artificial Sequence
  chemically synthesized
cctatttctttatgtggtta

SEQ ID NO: 606531 - DNA, 20 bp, Artificial Sequence
  chemically synthesized
aagaagattgaataaggtaa

SEQ ID NO: 606532 - DNA, 20 bp, Artificial Sequence
  chemically synthesized
gttttccaggcaaaatgcaa

SEQ ID NO: 606533 - DNA, 20 bp, Artificial Sequence
  chemically synthesized
gctaatatttttggaattta

SEQ ID NO: 606534 - DNA, 20 bp, Artificial Sequence
  chemically synthesized
atatttagccatatttatat

SEQ ID NO: 606535 - DNA, 20 bp, Artificial Sequence
  chemically synthesized
attaggttaggtcattgcag

SEQ ID NO: 606536 - DNA, 20 bp, Artificial Sequence
  chemically synthesized
ttagtattaggttaggtcat

SEQ ID NO: 606537 - DNA, 20 bp, Artificial Sequence
  chemically synthesized
aatgtattagatgagggtaa

SEQ ID NO: 606538 - DNA, 20 bp, Artificial Sequence
  chemically synthesized
atcataagtgcaggaagaga

SEQ ID NO: 606539 - DNA, 20 bp, Artificial Sequence
  chemically synthesized
taaaactttgctgtaacttc

SEQ ID NO: 606540 - DNA, 20 bp, Artificial Sequence
  chemically synthesized
gaaaacaagtgaagttacag

SEQ ID NO: 606541 - DNA, 20 bp, Artificial Sequence
  chemically synthesized
ttggaagttcaggtattatt

SEQ ID NO: 606542 - DNA, 20 bp, Artificial Sequence
  chemically synthesized
ctgtgataaccatcagatga

SEQ ID NO: 606543 - DNA, 20 bp, Artificial Sequence
  chemically synthesized
gagaattgagggctaccatt

SEQ ID NO: 606544 - DNA, 20 bp, Artificial Sequence
  chemically synthesized
aatgtatgggtgggtgcatg

SEQ ID NO: 606545 - DNA, 20 bp, Artificial Sequence
  chemically synthesized
catatagttacagaattaaa

SEQ ID NO: 606546 - DNA, 20 bp, Artificial Sequence
  chemically synthesized
ttcaatgttattggttttta

SEQ ID NO: 606547 - DNA, 20 bp, Artificial Sequence
  chemically synthesized
ataattatttattcaatgtt

SEQ ID NO: 606548 - DNA, 20 bp, Artificial Sequence
  chemically synthesized
aataattattgaaaaagaaa

SEQ ID NO: 606549 - DNA, 20 bp, Artificial Sequence
  chemically synthesized
attgggagagagttggggtg

SEQ ID NO: 606550 - DNA, 20 bp, Artificial Sequence
  chemically synthesized
atagttgtgaaattcagttc

SEQ ID NO: 606551 - DNA, 20 bp, Artificial Sequence
  chemically synthesized
ttcttatcataagcctatat

SEQ ID NO: 606552 - DNA, 20 bp, Artificial Sequence
  chemically synthesized
actataagggaaacaggaat

SEQ ID NO: 606553 - DNA, 20 bp, Artificial Sequence
  chemically synthesized
atgaattatttcattaagca

SEQ ID NO: 606554 - DNA, 20 bp, Artificial Sequence
  chemically synthesized
acattaaatactcagaatca

SEQ ID NO: 606555 - DNA, 20 bp, Artificial Sequence
  chemically synthesized
atttaatgtgtagctaccac

SEQ ID NO: 606556 - DNA, 20 bp, Artificial Sequence
  chemically synthesized
agctaccactactgcttact

SEQ ID NO: 606557 - DNA, 20 bp, Artificial Sequence
  chemically synthesized
atgttgtggcatttggattc

SEQ ID NO: 606558 - DNA, 20 bp, Artificial Sequence
  chemically synthesized
gatttgaagatgttgtggca

SEQ ID NO: 606559 - DNA, 20 bp, Artificial Sequence
  chemically synthesized
gcagttgcagagaagtgaca

SEQ ID NO: 606560 - DNA, 20 bp, Artificial Sequence
  chemically synthesized
ctctaggatctcaggtggag

SEQ ID NO: 606561 - DNA, 20 bp, Artificial Sequence
  chemically synthesized
tctccattttgagattccag

SEQ ID NO: 606562 - DNA, 20 bp, Artificial Sequence
  chemically synthesized
tgagaccatttctctccatt

SEQ ID NO: 606563 - DNA, 20 bp, Artificial Sequence
  chemically synthesized
cttcagtattaattggtaga

SEQ ID NO: 606564 - DNA, 20 bp, Artificial Sequence
  chemically synthesized
aggtaacttcagtattaatt

SEQ ID NO: 606565 - DNA, 20 bp, Artificial Sequence
  chemically synthesized
cagacaaatagatgtgttca

SEQ ID NO: 606566 - DNA, 20 bp, Artificial Sequence
  chemically synthesized
tggcctggaaggatattaat

SEQ ID NO: 606567 - DNA, 20 bp, Artificial Sequence
  chemically synthesized
caagaagatgcttgatatga

SEQ ID NO: 606568 - DNA, 20 bp, Artificial Sequence
  chemically synthesized
gtggtgcaagaagatgcttg

SEQ ID NO: 606569 - DNA, 20 bp, Artificial Sequence
  chemically synthesized
ttttccactgtggtgcaaga

SEQ ID NO: 606570 - DNA, 20 bp, Artificial Sequence
  chemically synthesized
gagtcttcttggtactcatt

SEQ ID NO: 606571 - DNA, 20 bp, Artificial Sequence
  chemically synthesized
gtttaatttccatgtatttg

SEQ ID NO: 606572 - DNA, 20 bp, Artificial Sequence
  chemically synthesized
ccaaagatcattcaggagca

SEQ ID NO: 606573 - DNA, 20 bp, Artificial Sequence
  chemically synthesized
tcaaaaagttttaatttctt

SEQ ID NO: 606574 - DNA, 20 bp, Artificial Sequence
  chemically synthesized
gtctctttttatttgtttca

SEQ ID NO: 606575 - DNA, 20 bp, Artificial Sequence
  chemically synthesized
tatgttgtatgtctcttttt

SEQ ID NO: 606576 - DNA, 20 bp, Artificial Sequence
  chemically synthesized
gctataaatttccatcttag

SEQ ID NO: 606577 - DNA, 20 bp, Artificial Sequence
  chemically synthesized
ctagttcattgaagtacaat

SEQ ID NO: 606578 - DNA, 20 bp, Artificial Sequence
  chemically synthesized
agctttggtttcggtttgtt

SEQ ID NO: 606579 - DNA, 20 bp, Artificial Sequence
  chemically synthesized
tatattctgctagctttggt

SEQ ID NO: 606580 - DNA, 20 bp, Artificial Sequence
  chemically synthesized
atttcttatattctgctagc

SEQ ID NO: 606581 - DNA, 20 bp, Artificial Sequence
  chemically synthesized
attgttatttcttatattct

SEQ ID NO: 606582 - DNA, 20 bp, Artificial Sequence
  chemically synthesized
aattttttgtcttttattat

SEQ ID NO: 606583 - DNA, 20 bp, Artificial Sequence
  chemically synthesized
acaaaaaattaaaaaaatta

SEQ ID NO: 606584 - DNA, 20 bp, Artificial Sequence
  chemically synthesized
tctagctagtggcctattaa

SEQ ID NO: 606585 - DNA, 20 bp, Artificial Sequence
  chemically synthesized
acaaaattaataggccacta

SEQ ID NO: 606586 - DNA, 20 bp, Artificial Sequence
  chemically synthesized
tgactttgcttatttgattc

SEQ ID NO: 606587 - DNA, 20 bp, Artificial Sequence
  chemically synthesized
tatcatctctgactttgctt

SEQ ID NO: 606588 - DNA, 20 bp, Artificial Sequence
  chemically synthesized
gtcacatctatcatctctga

SEQ ID NO: 606589 - DNA, 20 bp, Artificial Sequence
  chemically synthesized
aactgataccatagaaatac

SEQ ID NO: 606590 - DNA, 20 bp, Artificial Sequence
  chemically synthesized
ccaggaatttattcatttcc

SEQ ID NO: 606591 - DNA, 20 bp, Artificial Sequence
  chemically synthesized
gttattggtctgtccaagat

SEQ ID NO: 606592 - DNA, 20 bp, Artificial Sequence
  chemically synthesized
actatttgttattggtctgt

SEQ ID NO: 606593 - DNA, 20 bp, Artificial Sequence
  chemically synthesized
tgggagatatttattactga

SEQ ID NO: 606594 - DNA, 20 bp, Artificial Sequence
  chemically synthesized
ttttattgggagatatttat

SEQ ID NO: 606595 - DNA, 20 bp, Artificial Sequence
  chemically synthesized
ggctgtgaatacgtctggtc

SEQ ID NO: 606596 - DNA, 20 bp, Artificial Sequence
  chemically synthesized
gatattttgcaacagttaca

SEQ ID NO: 606597 - DNA, 20 bp, Artificial Sequence
  chemically synthesized
attaattagggagaatttcc

SEQ ID NO: 606598 - DNA, 20 bp, Artificial Sequence
  chemically synthesized
gcctttggtatcatggtgat

SEQ ID NO: 606599 - DNA, 20 bp, Artificial Sequence
  chemically synthesized
gttcatcagggatattggcc

SEQ ID NO: 606600 - DNA, 20 bp, Artificial Sequence
  chemically synthesized
ttggtttgctagcattctgt

SEQ ID NO: 606601 - DNA, 20 bp, Artificial Sequence
  chemically synthesized
ctttttgttatgcttttggg

SEQ ID NO: 606602 - DNA, 20 bp, Artificial Sequence
  chemically synthesized
attatctttttgttatgctt

SEQ ID NO: 606603 - DNA, 20 bp, Artificial Sequence
  chemically synthesized
tgtcatgtattatctttttg

SEQ ID NO: 606604 - DNA, 20 bp, Artificial Sequence
  chemically synthesized
agataatacatgacaataac

SEQ ID NO: 606605 - DNA, 20 bp, Artificial Sequence
  chemically synthesized
ggatatatgcagagcaatat

SEQ ID NO: 606606 - DNA, 20 bp, Artificial Sequence
  chemically synthesized
gattcaccacataacacaat

SEQ ID NO: 606607 - DNA, 20 bp, Artificial Sequence
  chemically synthesized
caatatatgcagagcaatat

SEQ ID NO: 606608 - DNA, 20 bp, Artificial Sequence
  chemically synthesized
tattgagatgatcatatgtt

SEQ ID NO: 606609 - DNA, 20 bp, Artificial Sequence
  chemically synthesized
ctgcatctattgagatgatc

SEQ ID NO: 606610 - DNA, 20 bp, Artificial Sequence
  chemically synthesized
ggtctttatcttggggagag

SEQ ID NO: 606611 - DNA, 20 bp, Artificial Sequence
  chemically synthesized
tgtttagtatgatgttggct

SEQ ID NO: 606612 - DNA, 20 bp, Artificial Sequence
  chemically synthesized
ggggggtgctctcaacatgt

SEQ ID NO: 606613 - DNA, 20 bp, Artificial Sequence
  chemically synthesized
gccttttatttctttctctt

SEQ ID NO: 606614 - DNA, 20 bp, Artificial Sequence
  chemically synthesized
aaattgggaaaaagaaagtc

SEQ ID NO: 606615 - DNA, 20 bp, Artificial Sequence
  chemically synthesized
atgatttctcttcactgatg

SEQ ID NO: 606616 - DNA, 20 bp, Artificial Sequence
  chemically synthesized
ggtccttttggaggagtctt

SEQ ID NO: 606617 - DNA, 20 bp, Artificial Sequence
  chemically synthesized
tatttgataaatgacttcag

SEQ ID NO: 606618 - DNA, 20 bp, Artificial Sequence
  chemically synthesized
gaaatgctaccaattttgta

SEQ ID NO: 606619 - DNA, 20 bp, Artificial Sequence
  chemically synthesized
attgagttcttgatttggtt

SEQ ID NO: 606620 - DNA, 20 bp, Artificial Sequence
  chemically synthesized
tgttgtaaatgagattgagt

SEQ ID NO: 606621 - DNA, 20 bp, Artificial Sequence
  chemically synthesized
tttttttgtagttgttgtaa

SEQ ID NO: 606622 - DNA, 20 bp, Artificial Sequence
  chemically synthesized
cttgtagacacctttcactt

SEQ ID NO: 606623 - DNA, 20 bp, Artificial Sequence
  chemically synthesized
tcatctatgatttatttcat

SEQ ID NO: 606624 - DNA, 20 bp, Artificial Sequence
  chemically synthesized
tttccatttgtttgtgtcat

SEQ ID NO: 606625 - DNA, 20 bp, Artificial Sequence
  chemically synthesized
tgagcagggaaagtttttcc

SEQ ID NO: 606626 - DNA, 20 bp, Artificial Sequence
  chemically synthesized
atggaaaaactttccctgct

SEQ ID NO: 606627 - DNA, 20 bp, Artificial Sequence
  chemically synthesized
gctcccaatccatgagcagg

SEQ ID NO: 606628 - DNA, 20 bp, Artificial Sequence
  chemically synthesized
ccacactgctcaaagcaatt

SEQ ID NO: 606629 - DNA, 20 bp, Artificial Sequence
  chemically synthesized
aggactgtgttcaatctgta

SEQ ID NO: 606630 - DNA, 20 bp, Artificial Sequence
  chemically synthesized
ctttgactatttgggctctt

SEQ ID NO: 606631 - DNA, 20 bp, Artificial Sequence
  chemically synthesized
actttattcttcttgcttag

SEQ ID NO: 606632 - DNA, 20 bp, Artificial Sequence
  chemically synthesized
gatgccttcaactttattct

SEQ ID NO: 606633 - DNA, 20 bp, Artificial Sequence
  chemically synthesized
ctgtttttataccagtacca

SEQ ID NO: 606634 - DNA, 20 bp, Artificial Sequence
  chemically synthesized
ctggtataaaaacagataca

SEQ ID NO: 606635 - DNA, 20 bp, Artificial Sequence
  chemically synthesized
tataaaaacagatacatata

SEQ ID NO: 606636 - DNA, 20 bp, Artificial Sequence
  chemically synthesized
ggttaaatcaatctatatgt

SEQ ID NO: 606637 - DNA, 20 bp, Artificial Sequence
  chemically synthesized
agatgtgttggtcatagata

SEQ ID NO: 606638 - DNA, 20 bp, Artificial Sequence
  chemically synthesized
tttatgacccagtttcattc

SEQ ID NO: 606639 - DNA, 20 bp, Artificial Sequence
  chemically synthesized
ttgtatatggtgatttatga

SEQ ID NO: 606640 - DNA, 20 bp, Artificial Sequence
  chemically synthesized
tttgagttaatttttgtata

SEQ ID NO: 606641 - DNA, 20 bp, Artificial Sequence
  chemically synthesized
agtttttcctaggttttctt

SEQ ID NO: 606642 - DNA, 20 bp, Artificial Sequence
  chemically synthesized
agtgtcgagaagagtttttc

SEQ ID NO: 606643 - DNA, 20 bp, Artificial Sequence
  chemically synthesized
taggaaaaactcttctcgac

SEQ ID NO: 606644 - DNA, 20 bp, Artificial Sequence
  chemically synthesized
ttgcccaagccagtgtcgag

SEQ ID NO: 606645 - DNA, 20 bp, Artificial Sequence
  chemically synthesized
attaagttccatttgtctac

SEQ ID NO: 606646 - DNA, 20 bp, Artificial Sequence
  chemically synthesized
tttgtttgtttttgctgttc

SEQ ID NO: 606647 - DNA, 20 bp, Artificial Sequence
  chemically synthesized
tgttttttgtttttttgttt

SEQ ID NO: 606648 - DNA, 20 bp, Artificial Sequence
  chemically synthesized
tgattgttttttgttttttt

SEQ ID NO: 606649 - DNA, 20 bp, Artificial Sequence
  chemically synthesized
ctgttgattgttttttgttt

SEQ ID NO: 606650 - DNA, 20 bp, Artificial Sequence
  chemically synthesized
tgttcattctgttgattgtt

SEQ ID NO: 606651 - DNA, 20 bp, Artificial Sequence
  chemically synthesized
agttgtctgttcattctgtt

SEQ ID NO: 606652 - DNA, 20 bp, Artificial Sequence
  chemically synthesized
tataagttgtctgttcattc

SEQ ID NO: 606653 - DNA, 20 bp, Artificial Sequence
  chemically synthesized
ttgttagatgtatagttcgg

SEQ ID NO: 606654 - DNA, 20 bp, Artificial Sequence
  chemically synthesized
gttacttttagattctagat

SEQ ID NO: 606655 - DNA, 20 bp, Artificial Sequence
  chemically synthesized
tttcttcttgttgagttact

SEQ ID NO: 606656 - DNA, 20 bp, Artificial Sequence
  chemically synthesized
gtgatgttgagcattttctc

SEQ ID NO: 606657 - DNA, 20 bp, Artificial Sequence
  chemically synthesized
ggttttaatttgcatttctc

SEQ ID NO: 606658 - DNA, 20 bp, Artificial Sequence
  chemically synthesized
ggtgtgagatcatatctcct

SEQ ID NO: 606659 - DNA, 20 bp, Artificial Sequence
  chemically synthesized
aaaaaaacaaataatagcca

SEQ ID NO: 606660 - DNA, 20 bp, Artificial Sequence
  chemically synthesized
caccaatcagtatggctatt

SEQ ID NO: 606661 - DNA, 20 bp, Artificial Sequence
  chemically synthesized
gtgtatttgtggggtacatg

SEQ ID NO: 606662 - DNA, 20 bp, Artificial Sequence
  chemically synthesized
tagatactaaattctccatg

SEQ ID NO: 606663 - DNA, 20 bp, Artificial Sequence
  chemically synthesized
ttgcttgtaagacaaaggac

SEQ ID NO: 606664 - DNA, 20 bp, Artificial Sequence
  chemically synthesized
gtcttacaagcaacctaatt

SEQ ID NO: 606665 - DNA, 20 bp, Artificial Sequence
  chemically synthesized
actgtgaaagcatataatta

SEQ ID NO: 606666 - DNA, 20 bp, Artificial Sequence
  chemically synthesized
ctctctatttccatgacttc

SEQ ID NO: 606667 - DNA, 20 bp, Artificial Sequence
  chemically synthesized
caaataagtcagaacataag

SEQ ID NO: 606668 - DNA, 20 bp, Artificial Sequence
  chemically synthesized
gagatgtttgtctttctgtg

SEQ ID NO: 606669 - DNA, 20 bp, Artificial Sequence
  chemically synthesized
acatccttgccaacacctgt

SEQ ID NO: 606670 - DNA, 20 bp, Artificial Sequence
  chemically synthesized
gcaaggatgtggagaaaaga

SEQ ID NO: 606671 - DNA, 20 bp, Artificial Sequence
  chemically synthesized
aatctccatactgttttaca

SEQ ID NO: 606672 - DNA, 20 bp, Artificial Sequence
  chemically synthesized
aaacattatgtaaaacagta

SEQ ID NO: 606673 - DNA, 20 bp, Artificial Sequence
  chemically synthesized
agttctttgagaaatctcca

SEQ ID NO: 606674 - DNA, 20 bp, Artificial Sequence
  chemically synthesized
aggattgcaggatccaatag

SEQ ID NO: 606675 - DNA, 20 bp, Artificial Sequence
  chemically synthesized
tgttgagtatatacccagta

SEQ ID NO: 606676 - DNA, 20 bp, Artificial Sequence
  chemically synthesized
ctttttcatgtaacactttt

SEQ ID NO: 606677 - DNA, 20 bp, Artificial Sequence
  chemically synthesized
tgaaaaagctacctgcagtt

SEQ ID NO: 606678 - DNA, 20 bp, Artificial Sequence
  chemically synthesized
atgataaacatacaactgca

SEQ ID NO: 606679 - DNA, 20 bp, Artificial Sequence
  chemically synthesized
catttactgatggacgctta

SEQ ID NO: 606680 - DNA, 20 bp, Artificial Sequence
  chemically synthesized
caacctaagcgtccatcagt

SEQ ID NO: 606681 - DNA, 20 bp, Artificial Sequence
  chemically synthesized
ttatccaatcatttactgat

SEQ ID NO: 606682 - DNA, 20 bp, Artificial Sequence
  chemically synthesized
tattcatgtaactgcaaaag

SEQ ID NO: 606683 - DNA, 20 bp, Artificial Sequence
  chemically synthesized
agaacatgttgcatttaggt

SEQ ID NO: 606684 - DNA, 20 bp, Artificial Sequence
  chemically synthesized
taagcgagaacatgttgcat

SEQ ID NO: 606685 - DNA, 20 bp, Artificial Sequence
  chemically synthesized
gaaacctaaatgcaacatgt

SEQ ID NO: 606686 - DNA, 20 bp, Artificial Sequence
  chemically synthesized
atgtccgtgtgtaccctttg

SEQ ID NO: 606687 - DNA, 20 bp, Artificial Sequence
  chemically synthesized
tctagatgtccgtgtgtacc

SEQ ID NO: 606688 - DNA, 20 bp, Artificial Sequence
  chemically synthesized
taatataaactggaaactac

SEQ ID NO: 606689 - DNA, 20 bp, Artificial Sequence
  chemically synthesized
gcctataatcttttgtagtt

SEQ ID NO: 606690 - DNA, 20 bp, Artificial Sequence
  chemically synthesized
cctaccagcctataatcttt

SEQ ID NO: 606691 - DNA, 20 bp, Artificial Sequence
  chemically synthesized
attgagtatagtgttcgcta

SEQ ID NO: 606692 - DNA, 20 bp, Artificial Sequence
  chemically synthesized
atatcgtgtagtggtggagt

SEQ ID NO: 606693 - DNA, 20 bp, Artificial Sequence
  chemically synthesized
tagattgagggggtgcatgt

SEQ ID NO: 606694 - DNA, 20 bp, Artificial Sequence
  chemically synthesized
tgtcttagaagaagttttaa

SEQ ID NO: 606695 - DNA, 20 bp, Artificial Sequence
  chemically synthesized
attttaaaacttcttctaag

SEQ ID NO: 606696 - DNA, 20 bp, Artificial Sequence
  chemically synthesized
agtaataagcatgtcttaga

SEQ ID NO: 606697 - DNA, 20 bp, Artificial Sequence
  chemically synthesized
aaatgagacaatacattaac

SEQ ID NO: 606698 - DNA, 20 bp, Artificial Sequence
  chemically synthesized
tacattaacttcagcttgta

SEQ ID NO: 606699 - DNA, 20 bp, Artificial Sequence
  chemically synthesized
taacttcagcttgtacagtg

SEQ ID NO: 606700 - DNA, 20 bp, Artificial Sequence
  chemically synthesized
agatttggtaggtggtgagg

SEQ ID NO: 606701 - DNA, 20 bp, Artificial Sequence
  chemically synthesized
attatccttgcattcttaca

SEQ ID NO: 606702 - DNA, 20 bp, Artificial Sequence
  chemically synthesized
tatttaataatggaaatata

SEQ ID NO: 606703 - DNA, 20 bp, Artificial Sequence
  chemically synthesized
actatttttacataatggtc

SEQ ID NO: 606704 - DNA, 20 bp, Artificial Sequence
  chemically synthesized
actgtagaccattatgtaaa

SEQ ID NO: 606705 - DNA, 20 bp, Artificial Sequence
  chemically synthesized
accattatgtaaaaatagtt

SEQ ID NO: 606706 - DNA, 20 bp, Artificial Sequence
  chemically synthesized
tctagtggatttctaatact

SEQ ID NO: 606707 - DNA, 20 bp, Artificial Sequence
  chemically synthesized
ctgttatgaacagaatttct

SEQ ID NO: 606708 - DNA, 20 bp, Artificial Sequence
  chemically synthesized
ctgaagaatatggagaacta

SEQ ID NO: 606709 - DNA, 20 bp, Artificial Sequence
  chemically synthesized
attcaaccttatattttaac

SEQ ID NO: 606710 - DNA, 20 bp, Artificial Sequence
  chemically synthesized
accttatattttaacacggg

SEQ ID NO: 606711 - DNA, 20 bp, Artificial Sequence
  chemically synthesized
attcatgttatcatgtgtgt

SEQ ID NO: 606712 - DNA, 20 bp, Artificial Sequence
  chemically synthesized
tgtgtgtcttagctttcttg

SEQ ID NO: 606713 - DNA, 20 bp, Artificial Sequence
  chemically synthesized
tttccctaaaatgcatttta

SEQ ID NO: 606714 - DNA, 20 bp, Artificial Sequence
  chemically synthesized
attttaaaatgttttttata

SEQ ID NO: 606715 - DNA, 20 bp, Artificial Sequence
  chemically synthesized
tacctatacgaaagaactga

SEQ ID NO: 606716 - DNA, 20 bp, Artificial Sequence
  chemically synthesized
gaagacactgacctctccaa

SEQ ID NO: 606717 - DNA, 20 bp, Artificial Sequence
  chemically synthesized
cattacttagaatgtcacag

SEQ ID NO: 606718 - DNA, 20 bp, Artificial Sequence
  chemically synthesized
agtaacattacttagaatgt

SEQ ID NO: 606719 - DNA, 20 bp, Artificial Sequence
  chemically synthesized
ctttattagaaattactgag

SEQ ID NO: 606720 - DNA, 20 bp, Artificial Sequence
  chemically synthesized
caaatcaagtatttctagct

SEQ ID NO: 606721 - DNA, 20 bp, Artificial Sequence
  chemically synthesized
ataatctgatagctagaaat

SEQ ID NO: 606722 - DNA, 20 bp, Artificial Sequence
  chemically synthesized
ttgtaaaataagaatatggg

SEQ ID NO: 606723 - DNA, 20 bp, Artificial Sequence
  chemically synthesized
gtatatttgcacagtaatgc

SEQ ID NO: 606724 - DNA, 20 bp, Artificial Sequence
  chemically synthesized
gcaaatatacccttggaata

SEQ ID NO: 606725 - DNA, 20 bp, Artificial Sequence
  chemically synthesized
ggatattagatgtcttctca

SEQ ID NO: 606726 - DNA, 20 bp, Artificial Sequence
  chemically synthesized
ttattttgacataaatgatt

SEQ ID NO: 606727 - DNA, 20 bp, Artificial Sequence
  chemically synthesized
tggtagtattattttgacat

SEQ ID NO: 606728 - DNA, 20 bp, Artificial Sequence
  chemically synthesized
gctaaaccattgactatgaa

SEQ ID NO: 606729 - DNA, 20 bp, Artificial Sequence
  chemically synthesized
ctcaaaccaatttcatagtc

SEQ ID NO: 606730 - DNA, 20 bp, Artificial Sequence
  chemically synthesized
tagaaggaaaaaaggaaagt

SEQ ID NO: 606731 - DNA, 20 bp, Artificial Sequence
  chemically synthesized
gtagaaaaatacatctgtaa

SEQ ID NO: 606732 - DNA, 20 bp, Artificial Sequence
  chemically synthesized
actttacagatgtatttttc

SEQ ID NO: 606733 - DNA, 20 bp, Artificial Sequence
  chemically synthesized
atttttttttgctgtatgcc

SEQ ID NO: 606734 - DNA, 20 bp, Artificial Sequence
  chemically synthesized
taactttctgacaagggcat

SEQ ID NO: 606735 - DNA, 20 bp, Artificial Sequence
  chemically synthesized
cagaaagttagccatgatgg

SEQ ID NO: 606736 - DNA, 20 bp, Artificial Sequence
  chemically synthesized
cacatgttctgattatattg

SEQ ID NO: 606737 - DNA, 20 bp, Artificial Sequence
  chemically synthesized
aaatgtttttagaacacatg

SEQ ID NO: 606738 - DNA, 20 bp, Artificial Sequence
  chemically synthesized
gtcaataattgatgctcagt

SEQ ID NO: 606739 - DNA, 20 bp, Artificial Sequence
  chemically synthesized
agatttcttttgtgttttca

SEQ ID NO: 606740 - DNA, 20 bp, Artificial Sequence
  chemically synthesized
accagagagccagatttctt

SEQ ID NO: 606741 - DNA, 20 bp, Artificial Sequence
  chemically synthesized
tactgtattataaccagaga

SEQ ID NO: 606742 - DNA, 20 bp, Artificial Sequence
  chemically synthesized
tggttataatacagtatttt

SEQ ID NO: 606743 - DNA, 20 bp, Artificial Sequence
  chemically synthesized
tacagtattttttcagatta

SEQ ID NO: 606744 - DNA, 20 bp, Artificial Sequence
  chemically synthesized
tgccctcataagtgcttaat

SEQ ID NO: 606745 - DNA, 20 bp, Artificial Sequence
  chemically synthesized
ttcctgtcttttgccctcat

SEQ ID NO: 606746 - DNA, 20 bp, Artificial Sequence
  chemically synthesized
catgttgtttgtttctgcta

SEQ ID NO: 606747 - DNA, 20 bp, Artificial Sequence
  chemically synthesized
caaggttaaaattacatgtt

SEQ ID NO: 606748 - DNA, 20 bp, Artificial Sequence
  chemically synthesized
ttagcaaggttaaaattaca

SEQ ID NO: 606749 - DNA, 20 bp, Artificial Sequence
  chemically synthesized
taaccttgctaaatatgaga

SEQ ID NO: 606750 - DNA, 20 bp, Artificial Sequence
  chemically synthesized
gacagtgccataggatcaag

SEQ ID NO: 606751 - DNA, 20 bp, Artificial Sequence
  chemically synthesized
aagaaggataagtgattcag

SEQ ID NO: 606752 - DNA, 20 bp, Artificial Sequence
  chemically synthesized
gcaatagttggaagaaggat

SEQ ID NO: 606753 - DNA, 20 bp, Artificial Sequence
  chemically synthesized
tgggactgggcaattgggac

SEQ ID NO: 606754 - DNA, 20 bp, Artificial Sequence
  chemically synthesized
cagtcccagaatctattact

SEQ ID NO: 606755 - DNA, 20 bp, Artificial Sequence
  chemically synthesized
atgaacaaaaagctcaaagt

SEQ ID NO: 606756 - DNA, 20 bp, Artificial Sequence
  chemically synthesized
catatcctaaatctagtcct

SEQ ID NO: 606757 - DNA, 20 bp, Artificial Sequence
  chemically synthesized
atcaaatcaaaaccaatagg

SEQ ID NO: 606758 - DNA, 20 bp, Artificial Sequence
  chemically synthesized
cctaaatctagtcctattgg

SEQ ID NO: 606759 - DNA, 20 bp, Artificial Sequence
  chemically synthesized
tggttttgatttgatatcca

SEQ ID NO: 606760 - DNA, 20 bp, Artificial Sequence
  chemically synthesized
tgatatccagaatgctttgt

SEQ ID NO: 606761 - DNA, 20 bp, Artificial Sequence
  chemically synthesized
ctgtttacaatttttgttgt

SEQ ID NO: 606762 - DNA, 20 bp, Artificial Sequence
  chemically synthesized
ctttcagcaatatcctctta

SEQ ID NO: 606763 - DNA, 20 bp, Artificial Sequence
  chemically synthesized
tcttaacatgttttccggcc

SEQ ID NO: 606764 - DNA, 20 bp, Artificial Sequence
  chemically synthesized
atatcttcttaaatattaag

SEQ ID NO: 606765 - DNA, 20 bp, Artificial Sequence
  chemically synthesized
tttcctaaattgctgctatt

SEQ ID NO: 606766 - DNA, 20 bp, Artificial Sequence
  chemically synthesized
tagtttaatttctcatgaat

SEQ ID NO: 606767 - DNA, 20 bp, Artificial Sequence
  chemically synthesized
ctcatgatcaccctccatga

SEQ ID NO: 606768 - DNA, 20 bp, Artificial Sequence
  chemically synthesized
cttgtactatactgaatgct

SEQ ID NO: 606769 - DNA, 20 bp, Artificial Sequence
  chemically synthesized
agtatagtacaagacatcgt

SEQ ID NO: 606770 - DNA, 20 bp, Artificial Sequence
  chemically synthesized
agtacaagacatcgtaaatg

SEQ ID NO: 606771 - DNA, 20 bp, Artificial Sequence
  chemically synthesized
cagcacccatgtgctataat

SEQ ID NO: 606772 - DNA, 20 bp, Artificial Sequence
  chemically synthesized
ctagatgttcatgttacaga

SEQ ID NO: 606773 - DNA, 20 bp, Artificial Sequence
  chemically synthesized
aaaggcagacatttgggttg

SEQ ID NO: 606774 - DNA, 20 bp, Artificial Sequence
  chemically synthesized
ttcaagaaaaggataggtga

SEQ ID NO: 606775 - DNA, 20 bp, Artificial Sequence
  chemically synthesized
actgagtttctaagaggcta

SEQ ID NO: 606776 - DNA, 20 bp, Artificial Sequence
  chemically synthesized
agtgaaggttatatgtgaaa

SEQ ID NO: 606777 - DNA, 20 bp, Artificial Sequence
  chemically synthesized
gctaggttttccattctttt

SEQ ID NO: 606778 - DNA, 20 bp, Artificial Sequence
  chemically synthesized
tttaaagctgagtttactag

SEQ ID NO: 606779 - DNA, 20 bp, Artificial Sequence
  chemically synthesized
tggaaaacctagctagtaaa

SEQ ID NO: 606780 - DNA, 20 bp, Artificial Sequence
  chemically synthesized
gactgcgatgaagtttaaag

SEQ ID NO: 606781 - DNA, 20 bp, Artificial Sequence
  chemically synthesized
ctggcacagtgagactgcga

SEQ ID NO: 606782 - DNA, 20 bp, Artificial Sequence
  chemically synthesized
gtctcactgtgccaggagac

SEQ ID NO: 606783 - DNA, 20 bp, Artificial Sequence
  chemically synthesized
tgagctttcattaatagtaa

SEQ ID NO: 606784 - DNA, 20 bp, Artificial Sequence
  chemically synthesized
ctttactattaatgaaagct

SEQ ID NO: 606785 - DNA, 20 bp, Artificial Sequence
  chemically synthesized
gctattgaggaggaaaagcc

SEQ ID NO: 606786 - DNA, 20 bp, Artificial Sequence
  chemically synthesized
agtgatgttgacaaagaatg

SEQ ID NO: 606787 - DNA, 20 bp, Artificial Sequence
  chemically synthesized
ttttcacaggggaatgagag

SEQ ID NO: 606788 - DNA, 20 bp, Artificial Sequence
  chemically synthesized
acaggggaatgagaggttcg

SEQ ID NO: 606789 - DNA, 20 bp, Artificial Sequence
  chemically synthesized
gagagaatttagaggtttgc

SEQ ID NO: 606790 - DNA, 20 bp, Artificial Sequence
  chemically synthesized
tgtagggagagaatttagag

SEQ ID NO: 606791 - DNA, 20 bp, Artificial Sequence
  chemically synthesized
ttgctgtagggagagaattt

SEQ ID NO: 606792 - DNA, 20 bp, Artificial Sequence
  chemically synthesized
agcaatgtctatgaaggatg

SEQ ID NO: 606793 - DNA, 20 bp, Artificial Sequence
  chemically synthesized
tttcttggttacccagagta

SEQ ID NO: 606794 - DNA, 20 bp, Artificial Sequence
  chemically synthesized
tacccagagtaaagagtttg

SEQ ID NO: 606795 - DNA, 20 bp, Artificial Sequence
  chemically synthesized
agtaaccaccatataggatc

SEQ ID NO: 606796 - DNA, 20 bp, Artificial Sequence
  chemically synthesized
gtacactgtgaatattacag

SEQ ID NO: 606797 - DNA, 20 bp, Artificial Sequence
  chemically synthesized
gtaatattcacagtgtactt

SEQ ID NO: 606798 - DNA, 20 bp, Artificial Sequence
  chemically synthesized
tcaactggagggcaagatta

SEQ ID NO: 606799 - DNA, 20 bp, Artificial Sequence
  chemically synthesized
ctctctctctcaactggagg

SEQ ID NO: 606800 - DNA, 20 bp, Artificial Sequence
  chemically synthesized
atacagattttattgctggg

SEQ ID NO: 606801 - DNA, 20 bp, Artificial Sequence
  chemically synthesized
tgacaaaattaaagaaaaga

SEQ ID NO: 606802 - DNA, 20 bp, Artificial Sequence
  chemically synthesized
ccatcaccattttttcttaa

SEQ ID NO: 606803 - DNA, 20 bp, Artificial Sequence
  chemically synthesized
aagaaaaaatggtgatggca

SEQ ID NO: 606804 - DNA, 20 bp, Artificial Sequence
  chemically synthesized
aacctaatataatatttatt

SEQ ID NO: 606805 - DNA, 20 bp, Artificial Sequence
  chemically synthesized
aataaatattatattaggtt

SEQ ID NO: 606806 - DNA, 20 bp, Artificial Sequence
  chemically synthesized
ttggtgatgcagcagatggg

SEQ ID NO: 606807 - DNA, 20 bp, Artificial Sequence
  chemically synthesized
aggagaaatttccttacttt

SEQ ID NO: 606808 - DNA, 20 bp, Artificial Sequence
  chemically synthesized
tcttgggaaaaaaagctgca

SEQ ID NO: 606809 - DNA, 20 bp, Artificial Sequence
  chemically synthesized
atatagtcgttgaatcgctt

SEQ ID NO: 606810 - DNA, 20 bp, Artificial Sequence
  chemically synthesized
ccttatttatatagtcgttg

SEQ ID NO: 606811 - DNA, 20 bp, Artificial Sequence
  chemically synthesized
cgattcaacgactatataaa

SEQ ID NO: 606812 - DNA, 20 bp, Artificial Sequence
  chemically synthesized
aacgactatataaataaggc

SEQ ID NO: 606813 - DNA, 20 bp, Artificial Sequence
  chemically synthesized
aagaagtaacatttattttc

SEQ ID NO: 606814 - DNA, 20 bp, Artificial Sequence
  chemically synthesized
tacatacagaattaaaggaa

SEQ ID NO: 606815 - DNA, 20 bp, Artificial Sequence
  chemically synthesized
cttaaaagacaatataatgt

SEQ ID NO: 606816 - DNA, 20 bp, Artificial Sequence
  chemically synthesized
gacaatataatgtacatgtt

SEQ ID NO: 606817 - DNA, 20 bp, Artificial Sequence
  chemically synthesized
ataaagtcaactctttgcta

SEQ ID NO: 606818 - DNA, 20 bp, Artificial Sequence
  chemically synthesized
cctgaatattgataatgctc

SEQ ID NO: 606819 - DNA, 20 bp, Artificial Sequence
  chemically synthesized
tttttttataaaaattaagg

SEQ ID NO: 606820 - DNA, 20 bp, Artificial Sequence
  chemically synthesized
caatattttttgaaatattt

SEQ ID NO: 606821 - DNA, 20 bp, Artificial Sequence
  chemically synthesized
atttgagcactctttttttt

SEQ ID NO: 606822 - DNA, 20 bp, Artificial Sequence
  chemically synthesized
gcataaagaggccagaaggc

SEQ ID NO: 606823 - DNA, 20 bp, Artificial Sequence
  chemically synthesized
aggcaacaggagtatatgca

SEQ ID NO: 606824 - DNA, 20 bp, Artificial Sequence
  chemically synthesized
catatactcctgttgccttc

SEQ ID NO: 606825 - DNA, 20 bp, Artificial Sequence
  chemically synthesized
attttatgacaatatttgtc

SEQ ID NO: 606826 - DNA, 20 bp, Artificial Sequence
  chemically synthesized
tataatgtgaatgaaatgga

SEQ ID NO: 606827 - DNA, 20 bp, Artificial Sequence
  chemically synthesized
gccaggtacctgaaatgttt

SEQ ID NO: 606828 - DNA, 20 bp, Artificial Sequence
  chemically synthesized
aatattctgccaggtacctg

SEQ ID NO: 606829 - DNA, 20 bp, Artificial Sequence
  chemically synthesized
ggcagaatattaagatcctg

SEQ ID NO: 606830 - DNA, 20 bp, Artificial Sequence
  chemically synthesized
gggcagctatgaaggaagtt

SEQ ID NO: 606831 - DNA, 20 bp, Artificial Sequence
  chemically synthesized
gctcttttggagctcttctc

SEQ ID NO: 606832 - DNA, 20 bp, Artificial Sequence
  chemically synthesized
ttggagctcttctccctgga

SEQ ID NO: 606833 - DNA, 20 bp, Artificial Sequence
  chemically synthesized
ttgaagtattttagaaaagg

SEQ ID NO: 606834 - DNA, 20 bp, Artificial Sequence
  chemically synthesized
tttctagtgttccttccagt

SEQ ID NO: 606835 - DNA, 20 bp, Artificial Sequence
  chemically synthesized
ctttggaaataaaagagtga

SEQ ID NO: 606836 - DNA, 20 bp, Artificial Sequence
  chemically synthesized
tttactttggaaataaaaga

SEQ ID NO: 606837 - DNA, 20 bp, Artificial Sequence
  chemically synthesized
agagaacctgggacattaag

SEQ ID NO: 606838 - DNA, 20 bp, Artificial Sequence
  chemically synthesized
ggtagaactggagctcgaat

SEQ ID NO: 606839 - DNA, 20 bp, Artificial Sequence
  chemically synthesized
gaattctggcttctagtggg

SEQ ID NO: 606840 - DNA, 20 bp, Artificial Sequence
  chemically synthesized
gtgggagaagtttgtcttgg

SEQ ID NO: 606841 - DNA, 20 bp, Artificial Sequence
  chemically synthesized
tccaaaaacacatcctgaac

SEQ ID NO: 606842 - DNA, 20 bp, Artificial Sequence
  chemically synthesized
tcacaaatcttttgttcagg

SEQ ID NO: 606843 - DNA, 20 bp, Artificial Sequence
  chemically synthesized
aaaagatttgtgaacaaata

SEQ ID NO: 606844 - DNA, 20 bp, Artificial Sequence
  chemically synthesized
gtatattctccacagtcttt

SEQ ID NO: 606845 - DNA, 20 bp, Artificial Sequence
  chemically synthesized
agaaatgtcccactatggga

SEQ ID NO: 606846 - DNA, 20 bp, Artificial Sequence
  chemically synthesized
cactatgggacaaagattct

SEQ ID NO: 606847 - DNA, 20 bp, Artificial Sequence
  chemically synthesized
tctggtgcagaaccatttca

SEQ ID NO: 606848 - DNA, 20 bp, Artificial Sequence
  chemically synthesized
ggacaaggttgatgtacagc

SEQ ID NO: 606849 - DNA, 20 bp, Artificial Sequence
  chemically synthesized
ttgtccaatccatgacccag

SEQ ID NO: 606850 - DNA, 20 bp, Artificial Sequence
  chemically synthesized
cattgaaagccatcctgggt

SEQ ID NO: 606851 - DNA, 20 bp, Artificial Sequence
  chemically synthesized
taattgaaaaaatattttaa

SEQ ID NO: 606852 - DNA, 20 bp, Artificial Sequence
  chemically synthesized
aaaccaggggtgtccaaccc

SEQ ID NO: 606853 - DNA, 20 bp, Artificial Sequence
  chemically synthesized
aagccaacgggttggacacc

SEQ ID NO: 606854 - DNA, 20 bp, Artificial Sequence
  chemically synthesized
ccgcttttccgatgtggcac

SEQ ID NO: 606855 - DNA, 20 bp, Artificial Sequence
  chemically synthesized
cagtgctagttctctaaccg

SEQ ID NO: 606856 - DNA, 20 bp, Artificial Sequence
  chemically synthesized
caattatgtagaaattgtaa

SEQ ID NO: 606857 - DNA, 20 bp, Artificial Sequence
  chemically synthesized
ctacataattgcaatacagt

SEQ ID NO: 606858 - DNA, 20 bp, Artificial Sequence
  chemically synthesized
tttcctgatggcatagcaga

SEQ ID NO: 606859 - DNA, 20 bp, Artificial Sequence
  chemically synthesized
tttttttaagtttaatgagc

SEQ ID NO: 606860 - DNA, 20 bp, Artificial Sequence
  chemically synthesized
tagagttttttttaagttta

SEQ ID NO: 606861 - DNA, 20 bp, Artificial Sequence
  chemically synthesized
tctaagttctagagtttttt

SEQ ID NO: 606862 - DNA, 20 bp, Artificial Sequence
  chemically synthesized
atacatttatttctaagttc

SEQ ID NO: 606863 - DNA, 20 bp, Artificial Sequence
  chemically synthesized
ttttataatattcagtcata

SEQ ID NO: 606864 - DNA, 20 bp, Artificial Sequence
  chemically synthesized
aatattataaaaagagagaa

SEQ ID NO: 606865 - DNA, 20 bp, Artificial Sequence
  chemically synthesized
gagaattaagtttgacaaaa

SEQ ID NO: 606866 - DNA, 20 bp, Artificial Sequence
  chemically synthesized
tgatctgtggtttttggatt

SEQ ID NO: 606867 - DNA, 20 bp, Artificial Sequence
  chemically synthesized
tctacttatgatctgtggtt

SEQ ID NO: 606868 - DNA, 20 bp, Artificial Sequence
  chemically synthesized
tggcaactctacttatgatc

SEQ ID NO: 606869 - DNA, 20 bp, Artificial Sequence
  chemically synthesized
agtgtgtgtcccaaattgtt

SEQ ID NO: 606870 - DNA, 20 bp, Artificial Sequence
  chemically synthesized
cacacactaagaaaattatt

SEQ ID NO: 606871 - DNA, 20 bp, Artificial Sequence
  chemically synthesized
tatctgaaatttacatttaa

SEQ ID NO: 606872 - DNA, 20 bp, Artificial Sequence
  chemically synthesized
caagatcctttgtaattgtc

SEQ ID NO: 606873 - DNA, 20 bp, Artificial Sequence
  chemically synthesized
acaaaggatcttgtgtgtgt

SEQ ID NO: 606874 - DNA, 20 bp, Artificial Sequence
  chemically synthesized
ataaaatattacaattagct

SEQ ID NO: 606875 - DNA, 20 bp, Artificial Sequence
  chemically synthesized
tttcttatccaaaattatga

SEQ ID NO: 606876 - DNA, 20 bp, Artificial Sequence
  chemically synthesized
tcaataacagaaacaaaaaa

SEQ ID NO: 606877 - DNA, 20 bp, Artificial Sequence
  chemically synthesized
cgctgccagaaagcattttt

SEQ ID NO: 606878 - DNA, 20 bp, Artificial Sequence
  chemically synthesized
taatatttccatcttttttc

SEQ ID NO: 606879 - DNA, 20 bp, Artificial Sequence
  chemically synthesized
tgtcatattctatagaaaag

SEQ ID NO: 606880 - DNA, 20 bp, Artificial Sequence
  chemically synthesized
tgataaatgagagtctgaag

SEQ ID NO: 606881 - DNA, 20 bp, Artificial Sequence
  chemically synthesized
cttcagactctcatttatca

SEQ ID NO: 606882 - DNA, 20 bp, Artificial Sequence
  chemically synthesized
ctcatttatcatcaagcttg

SEQ ID NO: 606883 - DNA, 20 bp, Artificial Sequence
  chemically synthesized
ttatagtaaattgaagctgg

SEQ ID NO: 606884 - DNA, 20 bp, Artificial Sequence
  chemically synthesized
tgcaaatttaaataataagg

SEQ ID NO: 606885 - DNA, 20 bp, Artificial Sequence
  chemically synthesized
ttcctggaagacagacttca

SEQ ID NO: 606886 - DNA, 20 bp, Artificial Sequence
  chemically synthesized
gggtatgtgatttattaaaa

SEQ ID NO: 606887 - DNA, 20 bp, Artificial Sequence
  chemically synthesized
ggatgagaacaacgcagggt

SEQ ID NO: 606888 - DNA, 20 bp, Artificial Sequence
  chemically synthesized
tgcgttgttctcatccacaa

SEQ ID NO: 606889 - DNA, 20 bp, Artificial Sequence
  chemically synthesized
ttgttctcatccacaaatat

SEQ ID NO: 606890 - DNA, 20 bp, Artificial Sequence
  chemically synthesized
ttttaaaaaatacagcatag

SEQ ID NO: 606891 - DNA, 20 bp, Artificial Sequence
  chemically synthesized
aaatggattaagacatttgt

SEQ ID NO: 606892 - DNA, 20 bp, Artificial Sequence
  chemically synthesized
tttttgttacagcagcacaa

SEQ ID NO: 606893 - DNA, 20 bp, Artificial Sequence
  chemically synthesized
cctttattttttcacagttc

SEQ ID NO: 606894 - DNA, 20 bp, Artificial Sequence
  chemically synthesized
ccagatgctaacatcttgat

SEQ ID NO: 606895 - DNA, 20 bp, Artificial Sequence
  chemically synthesized
atctggtgagggccttttca

SEQ ID NO: 606896 - DNA, 20 bp, Artificial Sequence
  chemically synthesized
aggatcaagtcccatataaa

SEQ ID NO: 606897 - DNA, 20 bp, Artificial Sequence
  chemically synthesized
attcttaagggaggagccct

SEQ ID NO: 606898 - DNA, 20 bp, Artificial Sequence
  chemically synthesized
ataagtcccctccaaaattc

SEQ ID NO: 606899 - DNA, 20 bp, Artificial Sequence
  chemically synthesized
acttattcaagccattgcaa

SEQ ID NO: 606900 - DNA, 20 bp, Artificial Sequence
  chemically synthesized
gtttttgcaatctttgttgc

SEQ ID NO: 606901 - DNA, 20 bp, Artificial Sequence
  chemically synthesized
tttaaaaattatttttacct

SEQ ID NO: 606902 - DNA, 20 bp, Artificial Sequence
  chemically synthesized
tttttaaaatatggctgact

SEQ ID NO: 606903 - DNA, 20 bp, Artificial Sequence
  chemically synthesized
ctgtgtataggtactataca

SEQ ID NO: 606904 - DNA, 20 bp, Artificial Sequence
  chemically synthesized
gtataggtactatacacaga

SEQ ID NO: 606905 - DNA, 20 bp, Artificial Sequence
  chemically synthesized
aggtaggtgtatcttatgtt

SEQ ID NO: 606906 - DNA, 20 bp, Artificial Sequence
  chemically synthesized
ctaccttatgttgttgtact

SEQ ID NO: 606907 - DNA, 20 bp, Artificial Sequence
  chemically synthesized
tccattttccttgttctttc

SEQ ID NO: 606908 - DNA, 20 bp, Artificial Sequence
  chemically synthesized
ttagccagtcattcaactct

SEQ ID NO: 606909 - DNA, 20 bp, Artificial Sequence
  chemically synthesized
agtcattcaactctttcagt

SEQ ID NO: 606910 - DNA, 20 bp, Artificial Sequence
  chemically synthesized
tttcaaattttcagtttaca

SEQ ID NO: 606911 - DNA, 20 bp, Artificial Sequence
  chemically synthesized
taataggcttctttcaaatt

SEQ ID NO: 606912 - DNA, 20 bp, Artificial Sequence
  chemically synthesized
ttgctttcaaagaggtcata

SEQ ID NO: 606913 - DNA, 20 bp, Artificial Sequence
  chemically synthesized
cattgtgatgttcagtaata

SEQ ID NO: 606914 - DNA, 20 bp, Artificial Sequence
  chemically synthesized
attccatatattataaattc

SEQ ID NO: 606915 - DNA, 20 bp, Artificial Sequence
  chemically synthesized
tagttccggggtgactgata

SEQ ID NO: 606916 - DNA, 20 bp, Artificial Sequence
  chemically synthesized
gacttataatagttcacaaa

SEQ ID NO: 606917 - DNA, 20 bp, Artificial Sequence
  chemically synthesized
tatgtgaaagtttttagaaa

SEQ ID NO: 606918 - DNA, 20 bp, Artificial Sequence
  chemically synthesized
tcacatttagttgactatgt

SEQ ID NO: 606919 - DNA, 20 bp, Artificial Sequence
  chemically synthesized
atactacttagtcaattatc

SEQ ID NO: 606920 - DNA, 20 bp, Artificial Sequence
  chemically synthesized
agtagtatattttggcagtt

SEQ ID NO: 606921 - DNA, 20 bp, Artificial Sequence
  chemically synthesized
cctgtgaatatgatctggac

SEQ ID NO: 606922 - DNA, 20 bp, Artificial Sequence
  chemically synthesized
tatttcttcctctcttgaag

SEQ ID NO: 606923 - DNA, 20 bp, Artificial Sequence
  chemically synthesized
cctcctttacagcatggaat

SEQ ID NO: 606924 - DNA, 20 bp, Artificial Sequence
  chemically synthesized
aatcactcctatatggtctc

SEQ ID NO: 606925 - DNA, 20 bp, Artificial Sequence
  chemically synthesized
aatcattagagaccatatag

SEQ ID NO: 606926 - DNA, 20 bp, Artificial Sequence
  chemically synthesized
gataaaatactgtattagaa

SEQ ID NO: 606927 - DNA, 20 bp, Artificial Sequence
  chemically synthesized
agccaggttgtttttatatt

SEQ ID NO: 606928 - DNA, 20 bp, Artificial Sequence
  chemically synthesized
atataagcagggctcagcca

SEQ ID NO: 606929 - DNA, 20 bp, Artificial Sequence
  chemically synthesized
ataaaaacaacctggctgag

SEQ ID NO: 606930 - DNA, 20 bp, Artificial Sequence
  chemically synthesized
cagatcatgacgcaattata

SEQ ID NO: 606931 - DNA, 20 bp, Artificial Sequence
  chemically synthesized
ttataaattgttttaaccca

SEQ ID NO: 606932 - DNA, 20 bp, Artificial Sequence
  chemically synthesized
acacaaatagactagagaaa

SEQ ID NO: 606933 - DNA, 20 bp, Artificial Sequence
  chemically synthesized
aacgtttaagaacctggttg

SEQ ID NO: 606934 - DNA, 20 bp, Artificial Sequence
  chemically synthesized
gatgctggaaatgtaattga

SEQ ID NO: 606935 - DNA, 20 bp, Artificial Sequence
  chemically synthesized
ccagcatcagggacatggga

SEQ ID NO: 606936 - DNA, 20 bp, Artificial Sequence
  chemically synthesized
gaattaatgaatgaacaata

SEQ ID NO: 606937 - DNA, 20 bp, Artificial Sequence
  chemically synthesized
ggaaatactctttataaaca

SEQ ID NO: 606938 - DNA, 20 bp, Artificial Sequence
  chemically synthesized
tttgaaaaatgctttaaaca

SEQ ID NO: 606939 - DNA, 20 bp, Artificial Sequence
  chemically synthesized
gttcagaatatagttttgaa

SEQ ID NO: 606940 - DNA, 20 bp, Artificial Sequence
  chemically synthesized
tataagatcaatgttcagaa

SEQ ID NO: 606941 - DNA, 20 bp, Artificial Sequence
  chemically synthesized
tttactctaaaatctttact

SEQ ID NO: 606942 - DNA, 20 bp, Artificial Sequence
  chemically synthesized
tgattaatggaaacttccag

SEQ ID NO: 606943 - DNA, 20 bp, Artificial Sequence
  chemically synthesized
gcactttgtgtgtttaaatg

SEQ ID NO: 606944 - DNA, 20 bp, Artificial Sequence
  chemically synthesized
ctcagctatgtgtgcacttt

SEQ ID NO: 606945 - DNA, 20 bp, Artificial Sequence
  chemically synthesized
caaagtgcacacatagctga

SEQ ID NO: 606946 - DNA, 20 bp, Artificial Sequence
  chemically synthesized
catagctgagagtgtttttt

SEQ ID NO: 606947 - DNA, 20 bp, Artificial Sequence
  chemically synthesized
tttaacagatttaatttttt

SEQ ID NO: 606948 - DNA, 20 bp, Artificial Sequence
  chemically synthesized
agatttaattttttggctgt

SEQ ID NO: 606949 - DNA, 20 bp, Artificial Sequence
  chemically synthesized
tttagattcacgaaaaatta

SEQ ID NO: 606950 - DNA, 20 bp, Artificial Sequence
  chemically synthesized
catataacttgcactcagtc

SEQ ID NO: 606951 - DNA, 20 bp, Artificial Sequence
  chemically synthesized
agctggagactattattata

SEQ ID NO: 606952 - DNA, 20 bp, Artificial Sequence
  chemically synthesized
agagatactgaaatacaaaa

SEQ ID NO: 606953 - DNA, 20 bp, Artificial Sequence
  chemically synthesized
tttgtatttcagtatctctc

SEQ ID NO: 606954 - DNA, 20 bp, Artificial Sequence
  chemically synthesized
ttccatattacactcaattg

SEQ ID NO: 606955 - DNA, 20 bp, Artificial Sequence
  chemically synthesized
tcaattgtcctgtttcctta

SEQ ID NO: 606956 - DNA, 20 bp, Artificial Sequence
  chemically synthesized
gagaaactgtcatagccaaa

SEQ ID NO: 606957 - DNA, 20 bp, Artificial Sequence
  chemically synthesized
cttaatctgcttttggctat

SEQ ID NO: 606958 - DNA, 20 bp, Artificial Sequence
  chemically synthesized
cagtttctcagaatttttct

SEQ ID NO: 606959 - DNA, 20 bp, Artificial Sequence
  chemically synthesized
ttttgtagtatgcctctcag

SEQ ID NO: 606960 - DNA, 20 bp, Artificial Sequence
  chemically synthesized
atgcctctcagtggggattt

SEQ ID NO: 606961 - DNA, 20 bp, Artificial Sequence
  chemically synthesized
ttttttcctcataattaaac

SEQ ID NO: 606962 - DNA, 20 bp, Artificial Sequence
  chemically synthesized
ttctgtggtctttcaaaaac

SEQ ID NO: 606963 - DNA, 20 bp, Artificial Sequence
  chemically synthesized
gggtatatatgctttataaa

SEQ ID NO: 606964 - DNA, 20 bp, Artificial Sequence
  chemically synthesized
ataagtcacgttgagggtat

SEQ ID NO: 606965 - DNA, 20 bp, Artificial Sequence
  chemically synthesized
cctggctaaagtaataggtg

SEQ ID NO: 606966 - DNA, 20 bp, Artificial Sequence
  chemically synthesized
actctttccccctcttttca

SEQ ID NO: 606967 - DNA, 20 bp, Artificial Sequence
  chemically synthesized
cgtgagggcagagaagttac

SEQ ID NO: 606968 - DNA, 20 bp, Artificial Sequence
  chemically synthesized
agagaagttacataagtttt

SEQ ID NO: 606969 - DNA, 20 bp, Artificial Sequence
  chemically synthesized
ttttggagttttttctgcat

SEQ ID NO: 606970 - DNA, 20 bp, Artificial Sequence
  chemically synthesized
tactttgggctaaatccaat

SEQ ID NO: 606971 - DNA, 20 bp, Artificial Sequence
  chemically synthesized
gggctaaatccaatactagt

SEQ ID NO: 606972 - DNA, 20 bp, Artificial Sequence
  chemically synthesized
aatccaaagcaaaaactagt

SEQ ID NO: 606973 - DNA, 20 bp, Artificial Sequence
  chemically synthesized
aatccaatactagtttttgc

SEQ ID NO: 606974 - DNA, 20 bp, Artificial Sequence
  chemically synthesized
tggatttttgctcaaatagt

SEQ ID NO: 606975 - DNA, 20 bp, Artificial Sequence
  chemically synthesized
ggacattgggaagtctctta

SEQ ID NO: 606976 - DNA, 20 bp, Artificial Sequence
  chemically synthesized
gcttctttgacacatcccat

SEQ ID NO: 606977 - DNA, 20 bp, Artificial Sequence
  chemically synthesized
tgacacatcccatcagtgtt

SEQ ID NO: 606978 - DNA, 20 bp, Artificial Sequence
  chemically synthesized
ttttgtttagagcgagaccg

SEQ ID NO: 606979 - DNA, 20 bp, Artificial Sequence
  chemically synthesized
cctttcctagtgttagaatc

SEQ ID NO: 606980 - DNA, 20 bp, Artificial Sequence
  chemically synthesized
ccagaacactgtggagaaac

SEQ ID NO: 606981 - DNA, 20 bp, Artificial Sequence
  chemically synthesized
gcatacctagcaacaggatc

SEQ ID NO: 606982 - DNA, 20 bp, Artificial Sequence
  chemically synthesized
atcctgttgctaggtatgct

SEQ ID NO: 606983 - DNA, 20 bp, Artificial Sequence
  chemically synthesized
gctccttgcttctagggtgt

SEQ ID NO: 606984 - DNA, 20 bp, Artificial Sequence
  chemically synthesized
ttgagttataagaaactcaa

SEQ ID NO: 606985 - DNA, 20 bp, Artificial Sequence
  chemically synthesized
ctagtttaaagaaatcattt

SEQ ID NO: 606986 - DNA, 20 bp, Artificial Sequence
  chemically synthesized
gaacagcggtcatctcaact

SEQ ID NO: 606987 - DNA, 20 bp, Artificial Sequence
  chemically synthesized
gaagttgagatgaccgctgt

SEQ ID NO: 606988 - DNA, 20 bp, Artificial Sequence
  chemically synthesized
tggtaacccctttctctgtc

SEQ ID NO: 606989 - DNA, 20 bp, Artificial Sequence
  chemically synthesized
gggtgaactcagttgaccat

SEQ ID NO: 606990 - DNA, 20 bp, Artificial Sequence
  chemically synthesized
agagactcctggcaaatgcc

SEQ ID NO: 606991 - DNA, 20 bp, Artificial Sequence
  chemically synthesized
ttccatattgatcgagtatc

SEQ ID NO: 606992 - DNA, 20 bp, Artificial Sequence
  chemically synthesized
cttccaaagaaccatattat

SEQ ID NO: 606993 - DNA, 20 bp, Artificial Sequence
  chemically synthesized
aataatatggttctttggaa

SEQ ID NO: 606994 - DNA, 20 bp, Artificial Sequence
  chemically synthesized
ttctctattatgttccactg

SEQ ID NO: 606995 - DNA, 20 bp, Artificial Sequence
  chemically synthesized
aaattaatgcatttgcattc

SEQ ID NO: 606996 - DNA, 20 bp, Artificial Sequence
  chemically synthesized
tctaatttcattcttctgca

SEQ ID NO: 606997 - DNA, 20 bp, Artificial Sequence
  chemically synthesized
acatacaaaaaccaatttga

SEQ ID NO: 606998 - DNA, 20 bp, Artificial Sequence
  chemically synthesized
aagtttttaatccatttcaa

SEQ ID NO: 606999 - DNA, 20 bp, Artificial Sequence
  chemically synthesized
gagagttttgagtcttaaat

SEQ ID NO: 607000 - DNA, 20 bp, Artificial Sequence
  chemically synthesized
atgttttctactaatagatt

SEQ ID NO: 607001 - DNA, 20 bp, Artificial Sequence
  chemically synthesized
tgtcctctatgttttctact

SEQ ID NO: 607002 - DNA, 20 bp, Artificial Sequence
  chemically synthesized
attagtagaaaacatagagg

SEQ ID NO: 607003 - DNA, 20 bp, Artificial Sequence
  chemically synthesized
attgtgatgaagcttgtcct

SEQ ID NO: 607004 - DNA, 20 bp, Artificial Sequence
  chemically synthesized
tattgcccaaataattgtga

SEQ ID NO: 607005 - DNA, 20 bp, Artificial Sequence
  chemically synthesized
tctatttttgcttttgttgc

SEQ ID NO: 607006 - DNA, 20 bp, Artificial Sequence
  chemically synthesized
cctcagtctatttttgcttt

SEQ ID NO: 607007 - DNA, 20 bp, Artificial Sequence
  chemically synthesized
ggtataagtcctcagtctat

SEQ ID NO: 607008 - DNA, 20 bp, Artificial Sequence
  chemically synthesized
ttttttgctgtgcagaaatt

SEQ ID NO: 607009 - DNA, 20 bp, Artificial Sequence
  chemically synthesized
atatgaacccccatcagata

SEQ ID NO: 607010 - DNA, 20 bp, Artificial Sequence
  chemically synthesized
ccatagcaagaaaacaaata

SEQ ID NO: 607011 - DNA, 20 bp, Artificial Sequence
  chemically synthesized
tgcctatttttaatcaggtt

SEQ ID NO: 607012 - DNA, 20 bp, Artificial Sequence
  chemically synthesized
ggttttaatttgcatttccc

SEQ ID NO: 607013 - DNA, 20 bp, Artificial Sequence
  chemically synthesized
aattaaaaccacaatgaggt

SEQ ID NO: 607014 - DNA, 20 bp, Artificial Sequence
  chemically synthesized
caagtaagctgatacctcat

SEQ ID NO: 607015 - DNA, 20 bp, Artificial Sequence
  chemically synthesized
aagaaaagggaacacttata

SEQ ID NO: 607016 - DNA, 20 bp, Artificial Sequence
  chemically synthesized
aactattgttgaaaacagtg

SEQ ID NO: 607017 - DNA, 20 bp, Artificial Sequence
  chemically synthesized
aggtctttgtggaatcacca

SEQ ID NO: 607018 - DNA, 20 bp, Artificial Sequence
  chemically synthesized
attgctgggtccaatggtag

SEQ ID NO: 607019 - DNA, 20 bp, Artificial Sequence
  chemically synthesized
ctttaagtgtatacacaata

SEQ ID NO: 607020 - DNA, 20 bp, Artificial Sequence
  chemically synthesized
gtgcatgtgtctttttggta

SEQ ID NO: 607021 - DNA, 20 bp, Artificial Sequence
  chemically synthesized
agcatttaggttgattgtct

SEQ ID NO: 607022 - DNA, 20 bp, Artificial Sequence
  chemically synthesized
atcacaaagacaatcaacct

SEQ ID NO: 607023 - DNA, 20 bp, Artificial Sequence
  chemically synthesized
ttaccactgataagcattta

SEQ ID NO: 607024 - DNA, 20 bp, Artificial Sequence
  chemically synthesized
tgtttaccacattttcttta

SEQ ID NO: 607025 - DNA, 20 bp, Artificial Sequence
  chemically synthesized
gccgcatagtattccatggt

SEQ ID NO: 607026 - DNA, 20 bp, Artificial Sequence
  chemically synthesized
ctatgcggccatgaaaaaga

SEQ ID NO: 607027 - DNA, 20 bp, Artificial Sequence
  chemically synthesized
ataatggcctccagcttcat

SEQ ID NO: 607028 - DNA, 20 bp, Artificial Sequence
  chemically synthesized
ttttgctaaggataatggcc

SEQ ID NO: 607029 - DNA, 20 bp, Artificial Sequence
  chemically synthesized
agaacgtggtgtatttggtt

SEQ ID NO: 607030 - DNA, 20 bp, Artificial Sequence
  chemically synthesized
ataagtgagaacgtggtgta

SEQ ID NO: 607031 - DNA, 20 bp, Artificial Sequence
  chemically synthesized
actccaataggccccatgtc

SEQ ID NO: 607032 - DNA, 20 bp, Artificial Sequence
  chemically synthesized
acaacagacatggggcctat

SEQ ID NO: 607033 - DNA, 20 bp, Artificial Sequence
  chemically synthesized
gaaaaaataactaatgagta

SEQ ID NO: 607034 - DNA, 20 bp, Artificial Sequence
  chemically synthesized
agattatttcatcaccaggt

SEQ ID NO: 607035 - DNA, 20 bp, Artificial Sequence
  chemically synthesized
tgtgtcatggaagtttattg

SEQ ID NO: 607036 - DNA, 20 bp, Artificial Sequence
  chemically synthesized
gtacaataaacttccatgac

SEQ ID NO: 607037 - DNA, 20 bp, Artificial Sequence
  chemically synthesized
catgggtaaacttgtgtcat

SEQ ID NO: 607038 - DNA, 20 bp, Artificial Sequence
  chemically synthesized
tttaggtgcaagggtacatg

SEQ ID NO: 607039 - DNA, 20 bp, Artificial Sequence
  chemically synthesized
tctttgtcaaaagaaaaaag

SEQ ID NO: 607040 - DNA, 20 bp, Artificial Sequence
  chemically synthesized
cgttatcaacatttatcttt

SEQ ID NO: 607041 - DNA, 20 bp, Artificial Sequence
  chemically synthesized
caaaaaaagataaatgttga

SEQ ID NO: 607042 - DNA, 20 bp, Artificial Sequence
  chemically synthesized
cattcccatttacagtgtgt

SEQ ID NO: 607043 - DNA, 20 bp, Artificial Sequence
  chemically synthesized
actgttttccatgatgcctg

SEQ ID NO: 607044 - DNA, 20 bp, Artificial Sequence
  chemically synthesized
catatttcaaggagccttca

SEQ ID NO: 607045 - DNA, 20 bp, Artificial Sequence
  chemically synthesized
agtgggattttgtatcatat

SEQ ID NO: 607046 - DNA, 20 bp, Artificial Sequence
  chemically synthesized
ctttgtatatataattcata

SEQ ID NO: 607047 - DNA, 20 bp, Artificial Sequence
  chemically synthesized
gtgcagatatttctttgaca

SEQ ID NO: 607048 - DNA, 20 bp, Artificial Sequence
  chemically synthesized
catatgttggtggatatttg

SEQ ID NO: 607049 - DNA, 20 bp, Artificial Sequence
  chemically synthesized
cgttcatatgttggtggata

SEQ ID NO: 607050 - DNA, 20 bp, Artificial Sequence
  chemically synthesized
ggcagtggttttctttcttt

SEQ ID NO: 607051 - DNA, 20 bp, Artificial Sequence
  chemically synthesized
acatataagtgaaattaggc

SEQ ID NO: 607052 - DNA, 20 bp, Artificial Sequence
  chemically synthesized
acttctgtgggatcagctct

SEQ ID NO: 607053 - DNA, 20 bp, Artificial Sequence
  chemically synthesized
ggtaatgcatatgttaatta

SEQ ID NO: 607054 - DNA, 20 bp, Artificial Sequence
  chemically synthesized
tatattcatcatgtacaacg

SEQ ID NO: 607055 - DNA, 20 bp, Artificial Sequence
  chemically synthesized
ttttatctgtcaatttaaag

SEQ ID NO: 607056 - DNA, 20 bp, Artificial Sequence
  chemically synthesized
ttaaagtagggtttaaaaag

SEQ ID NO: 607057 - DNA, 20 bp, Artificial Sequence
  chemically synthesized
aaatgctatcaatttctaaa

SEQ ID NO: 607058 - DNA, 20 bp, Artificial Sequence
  chemically synthesized
cagacccaacttttatattt

SEQ ID NO: 607059 - DNA, 20 bp, Artificial Sequence
  chemically synthesized
gaaagatagaacacactcaa

SEQ ID NO: 607060 - DNA, 20 bp, Artificial Sequence
  chemically synthesized
ttaggtcctggctccttcac

SEQ ID NO: 607061 - DNA, 20 bp, Artificial Sequence
  chemically synthesized
aagagctgtccaacagtagc

SEQ ID NO: 607062 - DNA, 20 bp, Artificial Sequence
  chemically synthesized
gtggtacttttctcttcctc

SEQ ID NO: 607063 - DNA, 20 bp, Artificial Sequence
  chemically synthesized
gaagagaaaagtaccacaat

SEQ ID NO: 607064 - DNA, 20 bp, Artificial Sequence
  chemically synthesized
cactggcaagagggtgaaag

SEQ ID NO: 607065 - DNA, 20 bp, Artificial Sequence
  chemically synthesized
tctgttcaaagaggatgaag

SEQ ID NO: 607066 - DNA, 20 bp, Artificial Sequence
  chemically synthesized
ttttgatagttactctgttt

SEQ ID NO: 607067 - DNA, 20 bp, Artificial Sequence
  chemically synthesized
tttaagtattttgatagtta

SEQ ID NO: 607068 - DNA, 20 bp, Artificial Sequence
  chemically synthesized
gctgatggaattttgtatcc

SEQ ID NO: 607069 - DNA, 20 bp, Artificial Sequence
  chemically synthesized
attacatacaggttccatgt

SEQ ID NO: 607070 - DNA, 20 bp, Artificial Sequence
  chemically synthesized
ttattttactggtttacttc

SEQ ID NO: 607071 - DNA, 20 bp, Artificial Sequence
  chemically synthesized
tatcttttatattttatttt

SEQ ID NO: 607072 - DNA, 20 bp, Artificial Sequence
  chemically synthesized
cgaagtattggggttgttat

SEQ ID NO: 607073 - DNA, 20 bp, Artificial Sequence
  chemically synthesized
gcatttcatattccttttga

SEQ ID NO: 607074 - DNA, 20 bp, Artificial Sequence
  chemically synthesized
tttgagagtgtttacaataa

SEQ ID NO: 607075 - DNA, 20 bp, Artificial Sequence
  chemically synthesized
tgaaagtttattctcataac

SEQ ID NO: 607076 - DNA, 20 bp, Artificial Sequence
  chemically synthesized
actttttgtgtttgataaat

SEQ ID NO: 607077 - DNA, 20 bp, Artificial Sequence
  chemically synthesized
aaaaataaaatgtctacttt

SEQ ID NO: 607078 - DNA, 20 bp, Artificial Sequence
  chemically synthesized
ttaaatggatatctcatctc

SEQ ID NO: 607079 - DNA, 20 bp, Artificial Sequence
  chemically synthesized
aaatactagcaactttcagt

SEQ ID NO: 607080 - DNA, 20 bp, Artificial Sequence
  chemically synthesized
gctttcaaatactagcaact

SEQ ID NO: 607081 - DNA, 20 bp, Artificial Sequence
  chemically synthesized
atttgaaagcatcatttact

SEQ ID NO: 607082 - DNA, 20 bp, Artificial Sequence
  chemically synthesized
gtccaaaagcaaaaagtaaa

SEQ ID NO: 607083 - DNA, 20 bp, Artificial Sequence
  chemically synthesized
tttccttcaacaaatcttta

SEQ ID NO: 607084 - DNA, 20 bp, Artificial Sequence
  chemically synthesized
tgcatagatatgaaactcag

SEQ ID NO: 607085 - DNA, 20 bp, Artificial Sequence
  chemically synthesized
tttgtccattcctaacaaat

SEQ ID NO: 607086 - DNA, 20 bp, Artificial Sequence
  chemically synthesized
aatacctatcttcaatttca

SEQ ID NO: 607087 - DNA, 20 bp, Artificial Sequence
  chemically synthesized
aatataagaaatccattata

SEQ ID NO: 607088 - DNA, 20 bp, Artificial Sequence
  chemically synthesized
atgtatataaatctaattat

SEQ ID NO: 607089 - DNA, 20 bp, Artificial Sequence
  chemically synthesized
aacacagccccttgctatct

SEQ ID NO: 607090 - DNA, 20 bp, Artificial Sequence
  chemically synthesized
ggtctttctttccgtctaga

SEQ ID NO: 607091 - DNA, 20 bp, Artificial Sequence
  chemically synthesized
cagaggaaccggaaatccag

SEQ ID NO: 607092 - DNA, 20 bp, Artificial Sequence
  chemically synthesized
accttgtgcgatcaagctgc

SEQ ID NO: 607093 - DNA, 20 bp, Artificial Sequence
  chemically synthesized
taccttaatctgtgggtcca

SEQ ID NO: 607094 - DNA, 20 bp, Artificial Sequence
  chemically synthesized
tcaagaaatctctgtggacc

SEQ ID NO: 607095 - DNA, 20 bp, Artificial Sequence
  chemically synthesized
agattactgggtgttcaaat

SEQ ID NO: 607096 - DNA, 20 bp, Artificial Sequence
  chemically synthesized
atgaaaccacgatagaacat

SEQ ID NO: 607097 - DNA, 20 bp, Artificial Sequence
  chemically synthesized
agtaatctttcatgttctat

SEQ ID NO: 607098 - DNA, 20 bp, Artificial Sequence
  chemically synthesized
tcattttacaaacttggact

SEQ ID NO: 607099 - DNA, 20 bp, Artificial Sequence
  chemically synthesized
ttattggtcaatctctgagt

SEQ ID NO: 607100 - DNA, 20 bp, Artificial Sequence
  chemically synthesized
ataagaagagatgtacacat

SEQ ID NO: 607101 - DNA, 20 bp, Artificial Sequence
  chemically synthesized
ttgggaggccaaggggagag

SEQ ID NO: 607102 - DNA, 20 bp, Artificial Sequence
  chemically synthesized
acttttgggaggccaagggg

SEQ ID NO: 607103 - DNA, 20 bp, Artificial Sequence
  chemically synthesized
cccttggcctcccaaaagtg

SEQ ID NO: 607104 - DNA, 20 bp, Artificial Sequence
  chemically synthesized
gcgagtccccgaacccagcc

SEQ ID NO: 607105 - DNA, 20 bp, Artificial Sequence
  chemically synthesized
gggatacagaaacatctggt

SEQ ID NO: 607106 - DNA, 20 bp, Artificial Sequence
  chemically synthesized
taccccaaaaatccccaacc

SEQ ID NO: 607107 - DNA, 20 bp, Artificial Sequence
  chemically synthesized
gtcattaaaatattgagcca

SEQ ID NO: 607108 - DNA, 20 bp, Artificial Sequence
  chemically synthesized
tgtctcccagccaaatagag

SEQ ID NO: 607109 - DNA, 20 bp, Artificial Sequence
  chemically synthesized
gttttgaatttgcacttcta

SEQ ID NO: 607110 - DNA, 20 bp, Artificial Sequence
  chemically synthesized
gagtcttgcacacacttcta

SEQ ID NO: 607111 - DNA, 20 bp, Artificial Sequence
  chemically synthesized
tctagacctcatcccagagt

SEQ ID NO: 607112 - DNA, 20 bp, Artificial Sequence
  chemically synthesized
cacatttctagacctcatcc

SEQ ID NO: 607113 - DNA, 20 bp, Artificial Sequence
  chemically synthesized
ctctgcagaatttgggtgag

SEQ ID NO: 607114 - DNA, 20 bp, Artificial Sequence
  chemically synthesized
gaggacaactgccaatcccc

SEQ ID NO: 607115 - DNA, 20 bp, Artificial Sequence
  chemically synthesized
aataattcatagtaatctcc

SEQ ID NO: 607116 - DNA, 20 bp, Artificial Sequence
  chemically synthesized
tctacctgaggctccaaaaa

SEQ ID NO: 607117 - DNA, 20 bp, Artificial Sequence
  chemically synthesized
catgcttcagacacatgaaa

SEQ ID NO: 607118 - DNA, 20 bp, Artificial Sequence
  chemically synthesized
aacttgttctgaggttaatt

SEQ ID NO: 607119 - DNA, 20 bp, Artificial Sequence
  chemically synthesized
agcatgaaattaacctcaga

SEQ ID NO: 607120 - DNA, 20 bp, Artificial Sequence
  chemically synthesized
agtttgaaaacagaagaacc

SEQ ID NO: 607121 - DNA, 20 bp, Artificial Sequence
  chemically synthesized
cctccacaatccttaggttc

SEQ ID NO: 607122 - DNA, 20 bp, Artificial Sequence
  chemically synthesized
gggatgaatgctttttgttt

SEQ ID NO: 607123 - DNA, 20 bp, Artificial Sequence
  chemically synthesized
ccaacaatgggatgaatgct

SEQ ID NO: 607124 - DNA, 20 bp, Artificial Sequence
  chemically synthesized
atcctttccaacaatgggat

SEQ ID NO: 607125 - DNA, 20 bp, Artificial Sequence
  chemically synthesized
agcattcatcccattgttgg

SEQ ID NO: 607126 - DNA, 20 bp, Artificial Sequence
  chemically synthesized
cattgttggaaaggattctg

SEQ ID NO: 607127 - DNA, 20 bp, Artificial Sequence
  chemically synthesized
tagcaaatagtagtccatat

SEQ ID NO: 607128 - DNA, 20 bp, Artificial Sequence
  chemically synthesized
attaaatatgatcaagagtg

SEQ ID NO: 607129 - DNA, 20 bp, Artificial Sequence
  chemically synthesized
accactcttgatcatattta

SEQ ID NO: 607130 - DNA, 20 bp, Artificial Sequence
  chemically synthesized
caattttgtcctataggaag

SEQ ID NO: 607131 - DNA, 20 bp, Artificial Sequence
  chemically synthesized
catatacaaagtataagctc

SEQ ID NO: 607132 - DNA, 20 bp, Artificial Sequence
  chemically synthesized
atgaggactacagcaaactg

SEQ ID NO: 607133 - DNA, 20 bp, Artificial Sequence
  chemically synthesized
actcatctcacttccttatg

SEQ ID NO: 607134 - DNA, 20 bp, Artificial Sequence
  chemically synthesized
tcacttccttatgttatgtt

SEQ ID NO: 607135 - DNA, 20 bp, Artificial Sequence
  chemically synthesized
tctggcttctacaataggca

SEQ ID NO: 607136 - DNA, 20 bp, Artificial Sequence
  chemically synthesized
gtgccccccggggtcttgat

SEQ ID NO: 607137 - DNA, 20 bp, Artificial Sequence
  chemically synthesized
caggtgggctgtatccatat

SEQ ID NO: 607138 - DNA, 20 bp, Artificial Sequence
  chemically synthesized
aaatatggatacagcccacc

SEQ ID NO: 607139 - DNA, 20 bp, Artificial Sequence
  chemically synthesized
ggatacagcccacctggtga

SEQ ID NO: 607140 - DNA, 20 bp, Artificial Sequence
  chemically synthesized
ggtcgaagaattcagttcta

SEQ ID NO: 607141 - DNA, 20 bp, Artificial Sequence
  chemically synthesized
gtgatccatgacccagcaac

SEQ ID NO: 607142 - DNA, 20 bp, Artificial Sequence
  chemically synthesized
cataccttaagtagactagc

SEQ ID NO: 607143 - DNA, 20 bp, Artificial Sequence
  chemically synthesized
tactgctaaaactcagaaga

SEQ ID NO: 607144 - DNA, 20 bp, Artificial Sequence
  chemically synthesized
gtcacataaatctatatctt

SEQ ID NO: 607145 - DNA, 20 bp, Artificial Sequence
  chemically synthesized
tgcccttcagtaaagtaagg

SEQ ID NO: 607146 - DNA, 20 bp, Artificial Sequence
  chemically synthesized
tactgatatgtgaaaaactc

SEQ ID NO: 607147 - DNA, 20 bp, Artificial Sequence
  chemically synthesized
ttactagttatttcaatctt

SEQ ID NO: 607148 - DNA, 20 bp, Artificial Sequence
  chemically synthesized
gaaataactagtaatgaaga

SEQ ID NO: 607149 - DNA, 20 bp, Artificial Sequence
  chemically synthesized
agtgcaggtgaattataggc

SEQ ID NO: 607150 - DNA, 20 bp, Artificial Sequence
  chemically synthesized
attataggccagagttttct

SEQ ID NO: 607151 - DNA, 20 bp, Artificial Sequence
  chemically synthesized
gatatcagtgcctccttcaa

SEQ ID NO: 607152 - DNA, 20 bp, Artificial Sequence
  chemically synthesized
ggaggcactgatatcagaag

SEQ ID NO: 607153 - DNA, 20 bp, Artificial Sequence
  chemically synthesized
caaatgtcctttttcccaaa

SEQ ID NO: 607154 - DNA, 20 bp, Artificial Sequence
  chemically synthesized
ttaacataaccttgccaagg

SEQ ID NO: 607155 - DNA, 20 bp, Artificial Sequence
  chemically synthesized
gaggtcaaggcttcagtgag

SEQ ID NO: 607156 - DNA, 20 bp, Artificial Sequence
  chemically synthesized
atcatttgggcctgggaggt

SEQ ID NO: 607157 - DNA, 20 bp, Artificial Sequence
  chemically synthesized
tgcctcgacctcccaaagtt

SEQ ID NO: 607158 - DNA, 20 bp, Artificial Sequence
  chemically synthesized
acagggtttgtgatttctat

SEQ ID NO: 607159 - DNA, 20 bp, Artificial Sequence
  chemically synthesized
agtcttgggtcacacagggt

SEQ ID NO: 607160 - DNA, 20 bp, Artificial Sequence
  chemically synthesized
gtgcacagtcttgggtcaca

SEQ ID NO: 607161 - DNA, 20 bp, Artificial Sequence
  chemically synthesized
tcaatttctttgttgatgaa

SEQ ID NO: 607162 - DNA, 20 bp, Artificial Sequence
  chemically synthesized
aaactcctgtctcattttca

SEQ ID NO: 607163 - DNA, 20 bp, Artificial Sequence
  chemically synthesized
aaacatgatgaaaatgagac

SEQ ID NO: 607164 - DNA, 20 bp, Artificial Sequence
  chemically synthesized
attttttcctatctgtgcat

SEQ ID NO: 607165 - DNA, 20 bp, Artificial Sequence
  chemically synthesized
taccatgcacagataggaaa

SEQ ID NO: 607166 - DNA, 20 bp, Artificial Sequence
  chemically synthesized
gaaaaaatgtttgcattttt

SEQ ID NO: 607167 - DNA, 20 bp, Artificial Sequence
  chemically synthesized
atatgtatactccattcacc

SEQ ID NO: 607168 - DNA, 20 bp, Artificial Sequence
  chemically synthesized
gttcctagtatcatgtcctg

SEQ ID NO: 607169 - DNA, 20 bp, Artificial Sequence
  chemically synthesized
ctcagatgatctgaacgatt

SEQ ID NO: 607170 - DNA, 20 bp, Artificial Sequence
  chemically synthesized
tctctattctcagatgatct

SEQ ID NO: 607171 - DNA, 20 bp, Artificial Sequence
  chemically synthesized
gttccaagttcttacaactt

SEQ ID NO: 607172 - DNA, 20 bp, Artificial Sequence
  chemically synthesized
ttgttagataacagacatcc

SEQ ID NO: 607173 - DNA, 20 bp, Artificial Sequence
  chemically synthesized
gacatccttatgattgtgcc

SEQ ID NO: 607174 - DNA, 20 bp, Artificial Sequence
  chemically synthesized
caggtgattcatatgtacat

SEQ ID NO: 607175 - DNA, 20 bp, Artificial Sequence
  chemically synthesized
tgcatagtttgacactctcc

SEQ ID NO: 607176 - DNA, 20 bp, Artificial Sequence
  chemically synthesized
aggcctactgacttagaatg

SEQ ID NO: 607177 - DNA, 20 bp, Artificial Sequence
  chemically synthesized
cagtaggcctgggttggggc

SEQ ID NO: 607178 - DNA, 20 bp, Artificial Sequence
  chemically synthesized
aacaactgcccaagggatat

SEQ ID NO: 607179 - DNA, 20 bp, Artificial Sequence
  chemically synthesized
ttataccattgctccttaaa

SEQ ID NO: 607180 - DNA, 20 bp, Artificial Sequence
  chemically synthesized
tctaagacgtagtatttttc

SEQ ID NO: 607181 - DNA, 20 bp, Artificial Sequence
  chemically synthesized
attcctttatgttcatacag

SEQ ID NO: 607182 - DNA, 20 bp, Artificial Sequence
  chemically synthesized
taaaggaattcaatgggaat

SEQ ID NO: 607183 - DNA, 20 bp, Artificial Sequence
  chemically synthesized
gaattcaatgggaatgccag

SEQ ID NO: 607184 - DNA, 20 bp, Artificial Sequence
  chemically synthesized
gccgccttcctacattctaa

SEQ ID NO: 607185 - DNA, 20 bp, Artificial Sequence
  chemically synthesized
cgcctcagcctcccaaagtg

SEQ ID NO: 607186 - DNA, 20 bp, Artificial Sequence
  chemically synthesized
gggtttcaccatgttggcca

SEQ ID NO: 607187 - DNA, 20 bp, Artificial Sequence
  chemically synthesized
ttttgtatttttagtggaga

SEQ ID NO: 607188 - DNA, 20 bp, Artificial Sequence
  chemically synthesized
tcaggaggctgaggcaggac

SEQ ID NO: 607189 - DNA, 20 bp, Artificial Sequence
  chemically synthesized
gcctgagtgacagagtgaaa

SEQ ID NO: 607190 - DNA, 20 bp, Artificial Sequence
  chemically synthesized
ttcttttttgttttttgaaa

SEQ ID NO: 607191 - DNA, 20 bp, Artificial Sequence
  chemically synthesized
gccttcctacattctttctt

SEQ ID NO: 607192 - DNA, 20 bp, Artificial Sequence
  chemically synthesized
taattaaatatagttaaaaa

SEQ ID NO: 607193 - DNA, 20 bp, Artificial Sequence
  chemically synthesized
cagctataaaccgacagata

SEQ ID NO: 607194 - DNA, 20 bp, Artificial Sequence
  chemically synthesized
tattggtaatctaattatct

SEQ ID NO: 607195 - DNA, 20 bp, Artificial Sequence
  chemically synthesized
tatggataagtacttgcaaa

SEQ ID NO: 607196 - DNA, 20 bp, Artificial Sequence
  chemically synthesized
tgtctatgaggaatgacatc

SEQ ID NO: 607197 - DNA, 20 bp, Artificial Sequence
  chemically synthesized
aaatgctattaatgtttatt

SEQ ID NO: 607198 - DNA, 20 bp, Artificial Sequence
  chemically synthesized
aaaattttaaaaaatgctat

SEQ ID NO: 607199 - DNA, 20 bp, Artificial Sequence
  chemically synthesized
atttataaatgcaaaatagt

SEQ ID NO: 607200 - DNA, 20 bp, Artificial Sequence
  chemically synthesized
gatggtcctaatagcatttt

SEQ ID NO: 607201 - DNA, 20 bp, Artificial Sequence
  chemically synthesized
tatgattatgttttcataat

SEQ ID NO: 607202 - DNA, 20 bp, Artificial Sequence
  chemically synthesized
agttagtgcctagcatatga

SEQ ID NO: 607203 - DNA, 20 bp, Artificial Sequence
  chemically synthesized
tttattagttagtgcctagc

SEQ ID NO: 607204 - DNA, 20 bp, Artificial Sequence
  chemically synthesized
taagttttaattgtagtcct

SEQ ID NO: 607205 - DNA, 20 bp, Artificial Sequence
  chemically synthesized
ctcacacctcttggtaattt

SEQ ID NO: 607206 - DNA, 20 bp, Artificial Sequence
  chemically synthesized
ttaggtgtatttttttaaat

SEQ ID NO: 607207 - DNA, 20 bp, Artificial Sequence
  chemically synthesized
gtaatgtattataatgaaag

SEQ ID NO: 607208 - DNA, 20 bp, Artificial Sequence
  chemically synthesized
cttacatgtaaaatacaatt

SEQ ID NO: 607209 - DNA, 20 bp, Artificial Sequence
  chemically synthesized
tcagaaataaaacctgtata

SEQ ID NO: 607210 - DNA, 20 bp, Artificial Sequence
  chemically synthesized
tttcccttaaatcatattat

SEQ ID NO: 607211 - DNA, 20 bp, Artificial Sequence
  chemically synthesized
gtaaaaacatgcattaaaaa

SEQ ID NO: 607212 - DNA, 20 bp, Artificial Sequence
  chemically synthesized
agagaaacttaatttttaat

SEQ ID NO: 607213 - DNA, 20 bp, Artificial Sequence
  chemically synthesized
ccaattttcatcagtacaat

SEQ ID NO: 607214 - DNA, 20 bp, Artificial Sequence
  chemically synthesized
attgtactgatgaaaattgg

SEQ ID NO: 607215 - DNA, 20 bp, Artificial Sequence
  chemically synthesized
cacctcggcctcccaaaatg

SEQ ID NO: 607216 - DNA, 20 bp, Artificial Sequence
  chemically synthesized
ttttgtatttttagtagaga

SEQ ID NO: 607217 - DNA, 20 bp, Artificial Sequence
  chemically synthesized
cctgagtagccgggattaaa

SEQ ID NO: 607218 - DNA, 20 bp, Artificial Sequence
  chemically synthesized
tgcctcagcctcctgagtag

SEQ ID NO: 607219 - DNA, 20 bp, Artificial Sequence
  chemically synthesized
acctctgtccccccgggttc

SEQ ID NO: 607220 - DNA, 20 bp, Artificial Sequence
  chemically synthesized
ttttatctatttttttaaga

SEQ ID NO: 607221 - DNA, 20 bp, Artificial Sequence
  chemically synthesized
ccttgctagaatttttgagc

SEQ ID NO: 607222 - DNA, 20 bp, Artificial Sequence
  chemically synthesized
ctagcaaggtggttcttata

SEQ ID NO: 607223 - DNA, 20 bp, Artificial Sequence
  chemically synthesized
aaggtggttcttatagatag

SEQ ID NO: 607224 - DNA, 20 bp, Artificial Sequence
  chemically synthesized
gttcttatagatagattagt

SEQ ID NO: 607225 - DNA, 20 bp, Artificial Sequence
  chemically synthesized
atagatagattagttttggt

SEQ ID NO: 607226 - DNA, 20 bp, Artificial Sequence
  chemically synthesized
acaattctttatatgcaact

SEQ ID NO: 607227 - DNA, 20 bp, Artificial Sequence
  chemically synthesized
gatgcttctagaatgctgtc

SEQ ID NO: 607228 - DNA, 20 bp, Artificial Sequence
  chemically synthesized
taagtaatttttaaaatcaa

SEQ ID NO: 607229 - DNA, 20 bp, Artificial Sequence
  chemically synthesized
atttttaaaatcaactttgt

SEQ ID NO: 607230 - DNA, 20 bp, Artificial Sequence
  chemically synthesized
tgaaacaaaagctgaaacaa

SEQ ID NO: 607231 - DNA, 20 bp, Artificial Sequence
  chemically synthesized
aaaatcaactttgtttcagc

SEQ ID NO: 607232 - DNA, 20 bp, Artificial Sequence
  chemically synthesized
cataggtatacatgtgccat

SEQ ID NO: 607233 - DNA, 20 bp, Artificial Sequence
  chemically synthesized
aggatgcatgtgcacaactc

SEQ ID NO: 607234 - DNA, 20 bp, Artificial Sequence
  chemically synthesized
ctttctgttttttaacctat

SEQ ID NO: 607235 - DNA, 20 bp, Artificial Sequence
  chemically synthesized
cattacctcaattaataact

SEQ ID NO: 607236 - DNA, 20 bp, Artificial Sequence
  chemically synthesized
cagaaagttattaattgagg

SEQ ID NO: 607237 - DNA, 20 bp, Artificial Sequence
  chemically synthesized
taattgaggtaatgtttaag

SEQ ID NO: 607238 - DNA, 20 bp, Artificial Sequence
  chemically synthesized
ccactaattcacctatctgt

SEQ ID NO: 607239 - DNA, 20 bp, Artificial Sequence
  chemically synthesized
ccttaatataaaaaggtact

SEQ ID NO: 607240 - DNA, 20 bp, Artificial Sequence
  chemically synthesized
gtcattttgaaaagttctct

SEQ ID NO: 607241 - DNA, 20 bp, Artificial Sequence
  chemically synthesized
ctgggctccattcccagata

SEQ ID NO: 607242 - DNA, 20 bp, Artificial Sequence
  chemically synthesized
tcattcgaattacctggttg

SEQ ID NO: 607243 - DNA, 20 bp, Artificial Sequence
  chemically synthesized
gaatgaacatccagggttga

SEQ ID NO: 607244 - DNA, 20 bp, Artificial Sequence
  chemically synthesized
aacaagtcatgttgtctgga

SEQ ID NO: 607245 - DNA, 20 bp, Artificial Sequence
  chemically synthesized
aaggatcaggatgcacaaac

SEQ ID NO: 607246 - DNA, 20 bp, Artificial Sequence
  chemically synthesized
tcatttataaataagtaaac

SEQ ID NO: 607247 - DNA, 20 bp, Artificial Sequence
  chemically synthesized
aattttgatcttgtagaatt

SEQ ID NO: 607248 - DNA, 20 bp, Artificial Sequence
  chemically synthesized
ggtattattgtaattaatcc

SEQ ID NO: 607249 - DNA, 20 bp, Artificial Sequence
  chemically synthesized
taatatcagttgctgaatca

SEQ ID NO: 607250 - DNA, 20 bp, Artificial Sequence
  chemically synthesized
caatttacaggtggggaaac

SEQ ID NO: 607251 - DNA, 20 bp, Artificial Sequence
  chemically synthesized
gcgttttgacccaagtaagc

SEQ ID NO: 607252 - DNA, 20 bp, Artificial Sequence
  chemically synthesized
actttgtcaccttcccttgt

SEQ ID NO: 607253 - DNA, 20 bp, Artificial Sequence
  chemically synthesized
gttcccactttgtcaccttc

SEQ ID NO: 607254 - DNA, 20 bp, Artificial Sequence
  chemically synthesized
ggtgacaaagtgggaactca

SEQ ID NO: 607255 - DNA, 20 bp, Artificial Sequence
  chemically synthesized
tcaggtagtttggctccggg

SEQ ID NO: 607256 - DNA, 20 bp, Artificial Sequence
  chemically synthesized
attttagttcaggcaatatt

SEQ ID NO: 607257 - DNA, 20 bp, Artificial Sequence
  chemically synthesized
ctgaactaaaattaactttt

SEQ ID NO: 607258 - DNA, 20 bp, Artificial Sequence
  chemically synthesized
tattataaagtcatttatgg

SEQ ID NO: 607259 - DNA, 20 bp, Artificial Sequence
  chemically synthesized
taaaattccaccaaatgaac

SEQ ID NO: 607260 - DNA, 20 bp, Artificial Sequence
  chemically synthesized
tcatttggtggaattttata

SEQ ID NO: 607261 - DNA, 20 bp, Artificial Sequence
  chemically synthesized
tcaagagtaacaactgtaat

SEQ ID NO: 607262 - DNA, 20 bp, Artificial Sequence
  chemically synthesized
tgagacaattgttcttagca

SEQ ID NO: 607263 - DNA, 20 bp, Artificial Sequence
  chemically synthesized
aaatttaaaaaatagggtat

SEQ ID NO: 607264 - DNA, 20 bp, Artificial Sequence
  chemically synthesized
tatttttttgggtatatagt

SEQ ID NO: 607265 - DNA, 20 bp, Artificial Sequence
  chemically synthesized
aataacaaaaagtataattg

SEQ ID NO: 607266 - DNA, 20 bp, Artificial Sequence
  chemically synthesized
attttaaaacgtacaacaaa

SEQ ID NO: 607267 - DNA, 20 bp, Artificial Sequence
  chemically synthesized
actgtcaaacataatttgtt

SEQ ID NO: 607268 - DNA, 20 bp, Artificial Sequence
  chemically synthesized
tagtatttgatagcacgaca

SEQ ID NO: 607269 - DNA, 20 bp, Artificial Sequence
  chemically synthesized
ttaatgggtacaaaaatata

SEQ ID NO: 607270 - DNA, 20 bp, Artificial Sequence
  chemically synthesized
gtctctatctccatgagttc

SEQ ID NO: 607271 - DNA, 20 bp, Artificial Sequence
  chemically synthesized
gcatgttctcacttacttgt

SEQ ID NO: 607272 - DNA, 20 bp, Artificial Sequence
  chemically synthesized
cacaagtaagtgagaacatg

SEQ ID NO: 607273 - DNA, 20 bp, Artificial Sequence
  chemically synthesized
agtaagtgagaacatgcaaa

SEQ ID NO: 607274 - DNA, 20 bp, Artificial Sequence
  chemically synthesized
gcaaagtttgtttttctgtg

SEQ ID NO: 607275 - DNA, 20 bp, Artificial Sequence
  chemically synthesized
gatggaactggaggacgtta

SEQ ID NO: 607276 - DNA, 20 bp, Artificial Sequence
  chemically synthesized
tggatctcattctttcttag

SEQ ID NO: 607277 - DNA, 20 bp, Artificial Sequence
  chemically synthesized
gttgacaaaaatgacaagtc

SEQ ID NO: 607278 - DNA, 20 bp, Artificial Sequence
  chemically synthesized
ccctttcaaaaaaaccttct

SEQ ID NO: 607279 - DNA, 20 bp, Artificial Sequence
  chemically synthesized
aaagatcaacaaaacaaaaa

SEQ ID NO: 607280 - DNA, 20 bp, Artificial Sequence
  chemically synthesized
tttattttctcatactaatt

SEQ ID NO: 607281 - DNA, 20 bp, Artificial Sequence
  chemically synthesized
tttctcatactaattttggg

SEQ ID NO: 607282 - DNA, 20 bp, Artificial Sequence
  chemically synthesized
attcaattatttgaaagttc

SEQ ID NO: 607283 - DNA, 20 bp, Artificial Sequence
  chemically synthesized
cctataaactttcctcatag

SEQ ID NO: 607284 - DNA, 20 bp, Artificial Sequence
  chemically synthesized
agtgaaagcagtactatgag

SEQ ID NO: 607285 - DNA, 20 bp, Artificial Sequence
  chemically synthesized
tttcctcatagtactgcttt

SEQ ID NO: 607286 - DNA, 20 bp, Artificial Sequence
  chemically synthesized
tactgctttcactgcttccc

SEQ ID NO: 607287 - DNA, 20 bp, Artificial Sequence
  chemically synthesized
tcccataggttttggttaca

SEQ ID NO: 607288 - DNA, 20 bp, Artificial Sequence
  chemically synthesized
tacattgcgtttcctttttc

SEQ ID NO: 607289 - DNA, 20 bp, Artificial Sequence
  chemically synthesized
tcattcgtttcaagaaattc

SEQ ID NO: 607290 - DNA, 20 bp, Artificial Sequence
  chemically synthesized
ccactgataattcaagagca

SEQ ID NO: 607291 - DNA, 20 bp, Artificial Sequence
  chemically synthesized
gtttaatttccatgtgtctc

SEQ ID NO: 607292 - DNA, 20 bp, Artificial Sequence
  chemically synthesized
caaaaatcaaaataacataa

SEQ ID NO: 607293 - DNA, 20 bp, Artificial Sequence
  chemically synthesized
agaaaagctaatttatgtta

SEQ ID NO: 607294 - DNA, 20 bp, Artificial Sequence
  chemically synthesized
tgatttttgaattttctaag

SEQ ID NO: 607295 - DNA, 20 bp, Artificial Sequence
  chemically synthesized
acttgtttcgtggcagaaca

SEQ ID NO: 607296 - DNA, 20 bp, Artificial Sequence
  chemically synthesized
tctacactgcataataagtc

SEQ ID NO: 607297 - DNA, 20 bp, Artificial Sequence
  chemically synthesized
taataagtctgatgtttctt

SEQ ID NO: 607298 - DNA, 20 bp, Artificial Sequence
  chemically synthesized
gaattgaaatcaccggctat

SEQ ID NO: 607299 - DNA, 20 bp, Artificial Sequence
  chemically synthesized
gaccccaaaacagtaatagc

SEQ ID NO: 607300 - DNA, 20 bp, Artificial Sequence
  chemically synthesized
atctctctaactctaataat

SEQ ID NO: 607301 - DNA, 20 bp, Artificial Sequence
  chemically synthesized
tgaccggcgttgtccctttt

SEQ ID NO: 607302 - DNA, 20 bp, Artificial Sequence
  chemically synthesized
ctattcttttatcagacaaa

SEQ ID NO: 607303 - DNA, 20 bp, Artificial Sequence
  chemically synthesized
aatagctaatcctgttcttt

SEQ ID NO: 607304 - DNA, 20 bp, Artificial Sequence
  chemically synthesized
ccaatcgaaaccaaaaaaga

SEQ ID NO: 607305 - DNA, 20 bp, Artificial Sequence
  chemically synthesized
ctaatcctgttcttttttgg

SEQ ID NO: 607306 - DNA, 20 bp, Artificial Sequence
  chemically synthesized
tctttatctttattggtcaa

SEQ ID NO: 607307 - DNA, 20 bp, Artificial Sequence
  chemically synthesized
caagtgtgtttcttgtaagt

SEQ ID NO: 607308 - DNA, 20 bp, Artificial Sequence
  chemically synthesized
ccattctgtcactcaatgta

SEQ ID NO: 607309 - DNA, 20 bp, Artificial Sequence
  chemically synthesized
cactcaatgtatttagattg

SEQ ID NO: 607310 - DNA, 20 bp, Artificial Sequence
  chemically synthesized
aaaggaaatagcaaaatggg

SEQ ID NO: 607311 - DNA, 20 bp, Artificial Sequence
  chemically synthesized
cattttgctatttcctttct

SEQ ID NO: 607312 - DNA, 20 bp, Artificial Sequence
  chemically synthesized
tttatgtacctgagtacatt

SEQ ID NO: 607313 - DNA, 20 bp, Artificial Sequence
  chemically synthesized
tatttgatttgtggtaacta

SEQ ID NO: 607314 - DNA, 20 bp, Artificial Sequence
  chemically synthesized
tgttgtcatgaatttcaaat

SEQ ID NO: 607315 - DNA, 20 bp, Artificial Sequence
  chemically synthesized
ttttagttttctctttgctt

SEQ ID NO: 607316 - DNA, 20 bp, Artificial Sequence
  chemically synthesized
ttttttttttttagttttct

SEQ ID NO: 607317 - DNA, 20 bp, Artificial Sequence
  chemically synthesized
agtgtagcattttttttttt

SEQ ID NO: 607318 - DNA, 20 bp, Artificial Sequence
  chemically synthesized
cttcatccccccactctttt

SEQ ID NO: 607319 - DNA, 20 bp, Artificial Sequence
  chemically synthesized
acaaagagaatattataaca

SEQ ID NO: 607320 - DNA, 20 bp, Artificial Sequence
  chemically synthesized
acaaaactcactggtgatag

SEQ ID NO: 607321 - DNA, 20 bp, Artificial Sequence
  chemically synthesized
aacaaaccttactatcacca

SEQ ID NO: 607322 - DNA, 20 bp, Artificial Sequence
  chemically synthesized
gctcattaacatccttttct

SEQ ID NO: 607323 - DNA, 20 bp, Artificial Sequence
  chemically synthesized
cctttaccatttcttgtaga

SEQ ID NO: 607324 - DNA, 20 bp, Artificial Sequence
  chemically synthesized
gtttggtgttaatgaaatct

SEQ ID NO: 607325 - DNA, 20 bp, Artificial Sequence
  chemically synthesized
ttctaagacaaagaaaagct

SEQ ID NO: 607326 - DNA, 20 bp, Artificial Sequence
  chemically synthesized
catttctccttcaagtatga

SEQ ID NO: 607327 - DNA, 20 bp, Artificial Sequence
  chemically synthesized
tcatgccactctcctggcct

SEQ ID NO: 607328 - DNA, 20 bp, Artificial Sequence
  chemically synthesized
gacatactggagctatttct

SEQ ID NO: 607329 - DNA, 20 bp, Artificial Sequence
  chemically synthesized
tctatgtgattttttttttt

SEQ ID NO: 607330 - DNA, 20 bp, Artificial Sequence
  chemically synthesized
gatttttttttttatatgat

SEQ ID NO: 607331 - DNA, 20 bp, Artificial Sequence
  chemically synthesized
tttctttatccttgaccttt

SEQ ID NO: 607332 - DNA, 20 bp, Artificial Sequence
  chemically synthesized
tttatccttgacctttggaa

SEQ ID NO: 607333 - DNA, 20 bp, Artificial Sequence
  chemically synthesized
gaacttcccccacctagaga

SEQ ID NO: 607334 - DNA, 20 bp, Artificial Sequence
  chemically synthesized
gaggagacaaaaaagtccta

SEQ ID NO: 607335 - DNA, 20 bp, Artificial Sequence
  chemically synthesized
ctcctctgactgtatttaca

SEQ ID NO: 607336 - DNA, 20 bp, Artificial Sequence
  chemically synthesized
gtcttcaagctaattctttc

SEQ ID NO: 607337 - DNA, 20 bp, Artificial Sequence
  chemically synthesized
ttgatcaagcaggagaaaga

SEQ ID NO: 607338 - DNA, 20 bp, Artificial Sequence
  chemically synthesized
cgaacaaaaattctggagtt

SEQ ID NO: 607339 - DNA, 20 bp, Artificial Sequence
  chemically synthesized
ctttcaactccagaattttt

SEQ ID NO: 607340 - DNA, 20 bp, Artificial Sequence
  chemically synthesized
tcctacacataaatttaaca

SEQ ID NO: 607341 - DNA, 20 bp, Artificial Sequence
  chemically synthesized
tccctttgttaaatttatgt

SEQ ID NO: 607342 - DNA, 20 bp, Artificial Sequence
  chemically synthesized
gaattccttctctgtactat

SEQ ID NO: 607343 - DNA, 20 bp, Artificial Sequence
  chemically synthesized
tcagacagagaattccaaat

SEQ ID NO: 607344 - DNA, 20 bp, Artificial Sequence
  chemically synthesized
aaggtcacatatctgtctct

SEQ ID NO: 607345 - DNA, 20 bp, Artificial Sequence
  chemically synthesized
atttagttcagttggtgaga

SEQ ID NO: 607346 - DNA, 20 bp, Artificial Sequence
  chemically synthesized
catgttttcttggatggtct

SEQ ID NO: 607347 - DNA, 20 bp, Artificial Sequence
  chemically synthesized
tttattgtagtctttgcagt

SEQ ID NO: 607348 - DNA, 20 bp, Artificial Sequence
  chemically synthesized
ttgtagtctttgcagtatcg

SEQ ID NO: 607349 - DNA, 20 bp, Artificial Sequence
  chemically synthesized
tttgtatccatacttctcag

SEQ ID NO: 607350 - DNA, 20 bp, Artificial Sequence
  chemically synthesized
tatttaaaggttcttgggtg

SEQ ID NO: 607351 - DNA, 20 bp, Artificial Sequence
  chemically synthesized
ctgcaagagtcacagcatta

SEQ ID NO: 607352 - DNA, 20 bp, Artificial Sequence
  chemically synthesized
tcccaaagatcaccaaggca

SEQ ID NO: 607353 - DNA, 20 bp, Artificial Sequence
  chemically synthesized
tactgccttggtgatctttg

SEQ ID NO: 607354 - DNA, 20 bp, Artificial Sequence
  chemically synthesized
gattatctaccaggtaatac

SEQ ID NO: 607355 - DNA, 20 bp, Artificial Sequence
  chemically synthesized
gttgaggggaaggaaagaga

SEQ ID NO: 607356 - DNA, 20 bp, Artificial Sequence
  chemically synthesized
cctagtcgtggtagctacag

SEQ ID NO: 607357 - DNA, 20 bp, Artificial Sequence
  chemically synthesized
cacccctgtagctaccacga

SEQ ID NO: 607358 - DNA, 20 bp, Artificial Sequence
  chemically synthesized
tgatcaagacccagtgttgt

SEQ ID NO: 607359 - DNA, 20 bp, Artificial Sequence
  chemically synthesized
gcttcattggatttgccacc

SEQ ID NO: 607360 - DNA, 20 bp, Artificial Sequence
  chemically synthesized
tcggcaggtggcaaatccaa

SEQ ID NO: 607361 - DNA, 20 bp, Artificial Sequence
  chemically synthesized
ggtggcaaatccaatgaagc

SEQ ID NO: 607362 - DNA, 20 bp, Artificial Sequence
  chemically synthesized
aagtgaaaaacacaagcttc

SEQ ID NO: 607363 - DNA, 20 bp, Artificial Sequence
  chemically synthesized
gctaccctgaagtgaaaaac

SEQ ID NO: 607364 - DNA, 20 bp, Artificial Sequence
  chemically synthesized
agggtagcaatttttccctg

SEQ ID NO: 607365 - DNA, 20 bp, Artificial Sequence
  chemically synthesized
cctaatacatgaccccaggc

SEQ ID NO: 607366 - DNA, 20 bp, Artificial Sequence
  chemically synthesized
ctgggtaatttatgaagaaa

SEQ ID NO: 607367 - DNA, 20 bp, Artificial Sequence
  chemically synthesized
agacatgatgctggcatctg

SEQ ID NO: 607368 - DNA, 20 bp, Artificial Sequence
  chemically synthesized
tctgcttctgcggaggcctc

SEQ ID NO: 607369 - DNA, 20 bp, Artificial Sequence
  chemically synthesized
tgctcctccttcgcaatttg

SEQ ID NO: 607370 - DNA, 20 bp, Artificial Sequence
  chemically synthesized
gtttagcactatcctcttag

SEQ ID NO: 607371 - DNA, 20 bp, Artificial Sequence
  chemically synthesized
atggcgttgaatttctcatg

SEQ ID NO: 607372 - DNA, 20 bp, Artificial Sequence
  chemically synthesized
cattcatgagaaattcaacg

SEQ ID NO: 607373 - DNA, 20 bp, Artificial Sequence
  chemically synthesized
ccaggccccacctctgacag

SEQ ID NO: 607374 - DNA, 20 bp, Artificial Sequence
  chemically synthesized
gaggggccaggatggaatag

SEQ ID NO: 607375 - DNA, 20 bp, Artificial Sequence
  chemically synthesized
tgtttaaatgtgagaaggac

SEQ ID NO: 607376 - DNA, 20 bp, Artificial Sequence
  chemically synthesized
actgtttggaagacatgatt

SEQ ID NO: 607377 - DNA, 20 bp, Artificial Sequence
  chemically synthesized
cttgggggactgtttggaag

SEQ ID NO: 607378 - DNA, 20 bp, Artificial Sequence
  chemically synthesized
aataagtaaagaccttgggg

SEQ ID NO: 607379 - DNA, 20 bp, Artificial Sequence
  chemically synthesized
ggagtctcatctgagacaag

SEQ ID NO: 607380 - DNA, 20 bp, Artificial Sequence
  chemically synthesized
cttggaagtaactaattggt

SEQ ID NO: 607381 - DNA, 20 bp, Artificial Sequence
  chemically synthesized
ttgtatcttggaagtaacta

SEQ ID NO: 607382 - DNA, 20 bp, Artificial Sequence
  chemically synthesized
ttagttacttccaagataca

SEQ ID NO: 607383 - DNA, 20 bp, Artificial Sequence
  chemically synthesized
ttggaataggagtgttgact

SEQ ID NO: 607384 - DNA, 20 bp, Artificial Sequence
  chemically synthesized
aagatttaatgactaccctg

SEQ ID NO: 607385 - DNA, 20 bp, Artificial Sequence
  chemically synthesized
aagcagataattttggagtt

SEQ ID NO: 607386 - DNA, 20 bp, Artificial Sequence
  chemically synthesized
aatcttaaaactccaaaatt

SEQ ID NO: 607387 - DNA, 20 bp, Artificial Sequence
  chemically synthesized
ggagtcaaagcagataattt

SEQ ID NO: 607388 - DNA, 20 bp, Artificial Sequence
  chemically synthesized
cttgggagcacaccactccc

SEQ ID NO: 607389 - DNA, 20 bp, Artificial Sequence
  chemically synthesized
ccttgggcagactccaactt

SEQ ID NO: 607390 - DNA, 20 bp, Artificial Sequence
  chemically synthesized
aactttgtggctttctaggg

SEQ ID NO: 607391 - DNA, 20 bp, Artificial Sequence
  chemically synthesized
actcagcaccagaccataag

SEQ ID NO: 607392 - DNA, 20 bp, Artificial Sequence
  chemically synthesized
cttatggtctggtgctgagt

SEQ ID NO: 607393 - DNA, 20 bp, Artificial Sequence
  chemically synthesized
tccagaatggtagatccact

SEQ ID NO: 607394 - DNA, 20 bp, Artificial Sequence
  chemically synthesized
gggcaatgcagagggaaaat

SEQ ID NO: 607395 - DNA, 20 bp, Artificial Sequence
  chemically synthesized
gtgagggttctgcccctgga

SEQ ID NO: 607396 - DNA, 20 bp, Artificial Sequence
  chemically synthesized
gcaggcttctgcctggaaac

SEQ ID NO: 607397 - DNA, 20 bp, Artificial Sequence
  chemically synthesized
tagaggttgtatggaaaagc

SEQ ID NO: 607398 - DNA, 20 bp, Artificial Sequence
  chemically synthesized
ttgaggcttgggaacatcca

SEQ ID NO: 607399 - DNA, 20 bp, Artificial Sequence
  chemically synthesized
ggtgcacagagtgcaagagt

SEQ ID NO: 607400 - DNA, 20 bp, Artificial Sequence
  chemically synthesized
ctcttgcactctgtgcacct

SEQ ID NO: 607401 - DNA, 20 bp, Artificial Sequence
  chemically synthesized
actctgtgcacctgcaggct

SEQ ID NO: 607402 - DNA, 20 bp, Artificial Sequence
  chemically synthesized
gtggctcagagtggcccaag

SEQ ID NO: 607403 - DNA, 20 bp, Artificial Sequence
  chemically synthesized
ccggaggcctaagaggacag

SEQ ID NO: 607404 - DNA, 20 bp, Artificial Sequence
  chemically synthesized
ccattttcaggagaactcaa

SEQ ID NO: 607405 - DNA, 20 bp, Artificial Sequence
  chemically synthesized
cttcttgagttctcctgaaa

SEQ ID NO: 607406 - DNA, 20 bp, Artificial Sequence
  chemically synthesized
aaattttgaaaacctttatg

SEQ ID NO: 607407 - DNA, 20 bp, Artificial Sequence
  chemically synthesized
ttaaaaggaaagcagaccat

SEQ ID NO: 607408 - DNA, 20 bp, Artificial Sequence
  chemically synthesized
gagatacatgtgcagaacgt

SEQ ID NO: 607409 - DNA, 20 bp, Artificial Sequence
  chemically synthesized
acacaacgtcttgaacattt

SEQ ID NO: 607410 - DNA, 20 bp, Artificial Sequence
  chemically synthesized
tccatgctctagatatctgt

SEQ ID NO: 607411 - DNA, 20 bp, Artificial Sequence
  chemically synthesized
attggcaactggagtaaatg

SEQ ID NO: 607412 - DNA, 20 bp, Artificial Sequence
  chemically synthesized
ttctttccatctgagacctc

SEQ ID NO: 607413 - DNA, 20 bp, Artificial Sequence
  chemically synthesized
gaatgtcttagagactggtt

SEQ ID NO: 607414 - DNA, 20 bp, Artificial Sequence
  chemically synthesized
gggtaacagacagaagttgg

SEQ ID NO: 607415 - DNA, 20 bp, Artificial Sequence
  chemically synthesized
tgtctgttacccaatttcaa

SEQ ID NO: 607416 - DNA, 20 bp, Artificial Sequence
  chemically synthesized
aagatacttgaaaatgtaga

SEQ ID NO: 607417 - DNA, 20 bp, Artificial Sequence
  chemically synthesized
agaaaattgttaccaagaag

SEQ ID NO: 607418 - DNA, 20 bp, Artificial Sequence
  chemically synthesized
ctgagtaatttataaagaaa

SEQ ID NO: 607419 - DNA, 20 bp, Artificial Sequence
  chemically synthesized
cttcaccttctgccataatt

SEQ ID NO: 607420 - DNA, 20 bp, Artificial Sequence
  chemically synthesized
caagagtgagagggagggtg

SEQ ID NO: 607421 - DNA, 20 bp, Artificial Sequence
  chemically synthesized
agtaaattcttgcaagatct

SEQ ID NO: 607422 - DNA, 20 bp, Artificial Sequence
  chemically synthesized
ctaggccctacctcaaacac

SEQ ID NO: 607423 - DNA, 20 bp, Artificial Sequence
  chemically synthesized
cgttgaattgtagtaatctg

SEQ ID NO: 607424 - DNA, 20 bp, Artificial Sequence
  chemically synthesized
gcagattactacaattcaac

SEQ ID NO: 607425 - DNA, 20 bp, Artificial Sequence
  chemically synthesized
ttcttaggttcttgagttga

SEQ ID NO: 607426 - DNA, 20 bp, Artificial Sequence
  chemically synthesized
cacagtagaatagagcacca

SEQ ID NO: 607427 - DNA, 20 bp, Artificial Sequence
  chemically synthesized
ctttatcttttgggtggggt

SEQ ID NO: 607428 - DNA, 20 bp, Artificial Sequence
  chemically synthesized
gtggccatgaggagagacat

SEQ ID NO: 607429 - DNA, 20 bp, Artificial Sequence
  chemically synthesized
cctgattccagagtttggct

SEQ ID NO: 607430 - DNA, 20 bp, Artificial Sequence
  chemically synthesized
gctcctagggtccctgattc

SEQ ID NO: 607431 - DNA, 20 bp, Artificial Sequence
  chemically synthesized
atcaagtgggctcctagggt

SEQ ID NO: 607432 - DNA, 20 bp, Artificial Sequence
  chemically synthesized
ctttggcttgcagcttgggt

SEQ ID NO: 607433 - DNA, 20 bp, Artificial Sequence
  chemically synthesized
gagtaaaggggactttggct

SEQ ID NO: 607434 - DNA, 20 bp, Artificial Sequence
  chemically synthesized
gaggtgagagtaaaggggac

SEQ ID NO: 607435 - DNA, 20 bp, Artificial Sequence
  chemically synthesized
acctctcctttcctgaagca

SEQ ID NO: 607436 - DNA, 20 bp, Artificial Sequence
  chemically synthesized
tggctacagggagagaatcc

SEQ ID NO: 607437 - DNA, 20 bp, Artificial Sequence
  chemically synthesized
tgggtgagactcagagctgt

SEQ ID NO: 607438 - DNA, 20 bp, Artificial Sequence
  chemically synthesized
aagtactgcctggctacagc

SEQ ID NO: 607439 - DNA, 20 bp, Artificial Sequence
  chemically synthesized
caagaaagagaactttgtct

SEQ ID NO: 607440 - DNA, 20 bp, Artificial Sequence
  chemically synthesized
ctccaggaaagactccttcc

SEQ ID NO: 607441 - DNA, 20 bp, Artificial Sequence
  chemically synthesized
tggggcagctaagggactgc

SEQ ID NO: 607442 - DNA, 20 bp, Artificial Sequence
  chemically synthesized
atccgctggggcagctaagg

SEQ ID NO: 607443 - DNA, 20 bp, Artificial Sequence
  chemically synthesized
cttgtggcctagactacctt

SEQ ID NO: 607444 - DNA, 20 bp, Artificial Sequence
  chemically synthesized
agcactctaatccatgatga

SEQ ID NO: 607445 - DNA, 20 bp, Artificial Sequence
  chemically synthesized
gttccggcaagccttgtcat

SEQ ID NO: 607446 - DNA, 20 bp, Artificial Sequence
  chemically synthesized
caggttccaaacactgggat

SEQ ID NO: 607447 - DNA, 20 bp, Artificial Sequence
  chemically synthesized
cagggaagaatcatccatcc

SEQ ID NO: 607448 - DNA, 20 bp, Artificial Sequence
  chemically synthesized
ttcatctaaatgctccctct

SEQ ID NO: 607449 - DNA, 20 bp, Artificial Sequence
  chemically synthesized
ttggctgagttctgttcttt

SEQ ID NO: 607450 - DNA, 20 bp, Artificial Sequence
  chemically synthesized
tttccactgtgacagggcag

SEQ ID NO: 607451 - DNA, 20 bp, Artificial Sequence
  chemically synthesized
tgcttgcagaagggagattg

SEQ ID NO: 607452 - DNA, 20 bp, Artificial Sequence
  chemically synthesized
gagtctatgtgcttgcagaa

SEQ ID NO: 607453 - DNA, 20 bp, Artificial Sequence
  chemically synthesized
atggcatgaagagagagtct

SEQ ID NO: 607454 - DNA, 20 bp, Artificial Sequence
  chemically synthesized
ttaggtgcatgatcgtagta

SEQ ID NO: 607455 - DNA, 20 bp, Artificial Sequence
  chemically synthesized
ctaatttttcactcttatga

SEQ ID NO: 607456 - DNA, 20 bp, Artificial Sequence
  chemically synthesized
ctgcaacagggataattact

SEQ ID NO: 607457 - DNA, 20 bp, Artificial Sequence
  chemically synthesized
cagggataattactggaggc

SEQ ID NO: 607458 - DNA, 20 bp, Artificial Sequence
  chemically synthesized
aattactggaggcttctgtt

SEQ ID NO: 607459 - DNA, 20 bp, Artificial Sequence
  chemically synthesized
atttgagggaaaatgagtct

SEQ ID NO: 607460 - DNA, 20 bp, Artificial Sequence
  chemically synthesized
ggattataatatatcatgat

SEQ ID NO: 607461 - DNA, 20 bp, Artificial Sequence
  chemically synthesized
atttcttggattataatata

SEQ ID NO: 607462 - DNA, 20 bp, Artificial Sequence
  chemically synthesized
ttaaaacatgtttgccattt

SEQ ID NO: 607463 - DNA, 20 bp, Artificial Sequence
  chemically synthesized
tataatccaagaaatggcaa

SEQ ID NO: 607464 - DNA, 20 bp, Artificial Sequence
  chemically synthesized
tgttgcttttctatattaaa

SEQ ID NO: 607465 - DNA, 20 bp, Artificial Sequence
  chemically synthesized
aagcttttcttttaaatgaa

SEQ ID NO: 607466 - DNA, 20 bp, Artificial Sequence
  chemically synthesized
aagcaacattcatttaaaag

SEQ ID NO: 607467 - DNA, 20 bp, Artificial Sequence
  chemically synthesized
tatgtttgtacatgcactac

SEQ ID NO: 607468 - DNA, 20 bp, Artificial Sequence
  chemically synthesized
tgcatgtacaaacatatgca

SEQ ID NO: 607469 - DNA, 20 bp, Artificial Sequence
  chemically synthesized
aacaacaaaaaactatgtgc

SEQ ID NO: 607470 - DNA, 20 bp, Artificial Sequence
  chemically synthesized
ttgggagttgaaaaatacta

SEQ ID NO: 607471 - DNA, 20 bp, Artificial Sequence
  chemically synthesized
atattagtatttttcaactc

SEQ ID NO: 607472 - DNA, 20 bp, Artificial Sequence
  chemically synthesized
ttttcaactcccaagattta

SEQ ID NO: 607473 - DNA, 20 bp, Artificial Sequence
  chemically synthesized
caataagtggcctgtgaaat

SEQ ID NO: 607474 - DNA, 20 bp, Artificial Sequence
  chemically synthesized
ttctgtttggattctggctt

SEQ ID NO: 607475 - DNA, 20 bp, Artificial Sequence
  chemically synthesized
gtaattggttctgtttggat

SEQ ID NO: 607476 - DNA, 20 bp, Artificial Sequence
  chemically synthesized
tgagggggtaattggttctg

SEQ ID NO: 607477 - DNA, 20 bp, Artificial Sequence
  chemically synthesized
acatttgagggggtaattgg

SEQ ID NO: 607478 - DNA, 20 bp, Artificial Sequence
  chemically synthesized
atgtgtaagacttcagctgt

SEQ ID NO: 607479 - DNA, 20 bp, Artificial Sequence
  chemically synthesized
aactaggccagtagggtttc

SEQ ID NO: 607480 - DNA, 20 bp, Artificial Sequence
  chemically synthesized
agctgtagaaaccctactgg

SEQ ID NO: 607481 - DNA, 20 bp, Artificial Sequence
  chemically synthesized
aagtaggtaaactaggccag

SEQ ID NO: 607482 - DNA, 20 bp, Artificial Sequence
  chemically synthesized
ctacttgcctcagtaactag

SEQ ID NO: 607483 - DNA, 20 bp, Artificial Sequence
  chemically synthesized
caccgtgacaccatgcagtg

SEQ ID NO: 607484 - DNA, 20 bp, Artificial Sequence
  chemically synthesized
ggaaactactatattagtgc

SEQ ID NO: 607485 - DNA, 20 bp, Artificial Sequence
  chemically synthesized
taaatcttaggcactaatat

SEQ ID NO: 607486 - DNA, 20 bp, Artificial Sequence
  chemically synthesized
ggcaaggtctgacaaaatta

SEQ ID NO: 607487 - DNA, 20 bp, Artificial Sequence
  chemically synthesized
gtaaagaggagaatgaacac

SEQ ID NO: 607488 - DNA, 20 bp, Artificial Sequence
  chemically synthesized
atgatacatgacatgctctc

SEQ ID NO: 607489 - DNA, 20 bp, Artificial Sequence
  chemically synthesized
tttactgtgaggttgtaatt

SEQ ID NO: 607490 - DNA, 20 bp, Artificial Sequence
  chemically synthesized
ctagaaatgaaggaaaatgt

SEQ ID NO: 607491 - DNA, 20 bp, Artificial Sequence
  chemically synthesized
gtaggaaaataaatgttagt

SEQ ID NO: 607492 - DNA, 20 bp, Artificial Sequence
  chemically synthesized
taatggaatgtgagaaatag

SEQ ID NO: 607493 - DNA, 20 bp, Artificial Sequence
  chemically synthesized
tgagaaaatcgaaaatgtgt

SEQ ID NO: 607494 - DNA, 20 bp, Artificial Sequence
  chemically synthesized
atttgaaaacaatgacacat

SEQ ID NO: 607495 - DNA, 20 bp, Artificial Sequence
  chemically synthesized
ggatggaggacaaaaatgga

SEQ ID NO: 607496 - DNA, 20 bp, Artificial Sequence
  chemically synthesized
gtcctccatccatatagctg

SEQ ID NO: 607497 - DNA, 20 bp, Artificial Sequence
  chemically synthesized
tgttttcaaaatgaaaataa

SEQ ID NO: 607498 - DNA, 20 bp, Artificial Sequence
  chemically synthesized
tttcattttgaaaacataaa

SEQ ID NO: 607499 - DNA, 20 bp, Artificial Sequence
  chemically synthesized
ttattgttactaaactgaat

SEQ ID NO: 607500 - DNA, 20 bp, Artificial Sequence
  chemically synthesized
gaatcttttgcatccagcca

SEQ ID NO: 607501 - DNA, 20 bp, Artificial Sequence
  chemically synthesized
gaagctgcgtggctggatgc

SEQ ID NO: 607502 - DNA, 20 bp, Artificial Sequence
  chemically synthesized
tagcctcctcagcctcagtg

SEQ ID NO: 607503 - DNA, 20 bp, Artificial Sequence
  chemically synthesized
ttttgtatttttagtagaga

SEQ ID NO: 607504 - DNA, 20 bp, Artificial Sequence
  chemically synthesized
aatggcgtgaacccgggggg

SEQ ID NO: 607505 - DNA, 20 bp, Artificial Sequence
  chemically synthesized
aaaaaagaaaaagaaaaaga

SEQ ID NO: 607506 - DNA, 20 bp, Artificial Sequence
  chemically synthesized
ggcaaccctcaaatcaatct

SEQ ID NO: 607507 - DNA, 20 bp, Artificial Sequence
  chemically synthesized
taaaagcatttaatcaggaa

SEQ ID NO: 607508 - DNA, 20 bp, Artificial Sequence
  chemically synthesized
tcaaatcaatcttcctgatt

SEQ ID NO: 607509 - DNA, 20 bp, Artificial Sequence
  chemically synthesized
tctttaaaagcatttaatca

SEQ ID NO: 607510 - DNA, 20 bp, Artificial Sequence
  chemically synthesized
caaggacaaatatgaatata

SEQ ID NO: 607511 - DNA, 20 bp, Artificial Sequence
  chemically synthesized
tgaatatatcacgtttggaa

SEQ ID NO: 607512 - DNA, 20 bp, Artificial Sequence
  chemically synthesized
caaaatttttgaagttgaga

SEQ ID NO: 607513 - DNA, 20 bp, Artificial Sequence
  chemically synthesized
taacttaattatgaacaaga

SEQ ID NO: 607514 - DNA, 20 bp, Artificial Sequence
  chemically synthesized
acaagacatagttttgatat

SEQ ID NO: 607515 - DNA, 20 bp, Artificial Sequence
  chemically synthesized
tctgattgggaatttttgta

SEQ ID NO: 607516 - DNA, 20 bp, Artificial Sequence
  chemically synthesized
actaatagactatctcagag

SEQ ID NO: 607517 - DNA, 20 bp, Artificial Sequence
  chemically synthesized
tctgctctctgagatagtct

SEQ ID NO: 607518 - DNA, 20 bp, Artificial Sequence
  chemically synthesized
ctggataatttataaagaaa

SEQ ID NO: 607519 - DNA, 20 bp, Artificial Sequence
  chemically synthesized
ccgaactgtgagtcaattaa

SEQ ID NO: 607520 - DNA, 20 bp, Artificial Sequence
  chemically synthesized
catgtttgcttccccttcca

SEQ ID NO: 607521 - DNA, 20 bp, Artificial Sequence
  chemically synthesized
tgccatgtgaagaaggacat

SEQ ID NO: 607522 - DNA, 20 bp, Artificial Sequence
  chemically synthesized
ctgctgccatgtgaagaagg

SEQ ID NO: 607523 - DNA, 20 bp, Artificial Sequence
  chemically synthesized
tttataaggggcctttcccc

SEQ ID NO: 607524 - DNA, 20 bp, Artificial Sequence
  chemically synthesized
agtgagttctcacaagatct

SEQ ID NO: 607525 - DNA, 20 bp, Artificial Sequence
  chemically synthesized
acagcatgagggttacactc

SEQ ID NO: 607526 - DNA, 20 bp, Artificial Sequence
  chemically synthesized
caggtccctcccacaacaca

SEQ ID NO: 607527 - DNA, 20 bp, Artificial Sequence
  chemically synthesized
acaaagataaataatgctga

SEQ ID NO: 607528 - DNA, 20 bp, Artificial Sequence
  chemically synthesized
tatttatctttgtgagaaag

SEQ ID NO: 607529 - DNA, 20 bp, Artificial Sequence
  chemically synthesized
gagagccgtatcttcaaaaa

SEQ ID NO: 607530 - DNA, 20 bp, Artificial Sequence
  chemically synthesized
atttctgtgaattccagaaa

SEQ ID NO: 607531 - DNA, 20 bp, Artificial Sequence
  chemically synthesized
ataatacaatgcatgtgact

SEQ ID NO: 607532 - DNA, 20 bp, Artificial Sequence
  chemically synthesized
tgacattcggttaggttgca

SEQ ID NO: 607533 - DNA, 20 bp, Artificial Sequence
  chemically synthesized
ttcctacttcttattagtcc

SEQ ID NO: 607534 - DNA, 20 bp, Artificial Sequence
  chemically synthesized
ttattgcaccagaatcttgc

SEQ ID NO: 607535 - DNA, 20 bp, Artificial Sequence
  chemically synthesized
ccatgggtgattaagcagta

SEQ ID NO: 607536 - DNA, 20 bp, Artificial Sequence
  chemically synthesized
atgttgatatcataccccat

SEQ ID NO: 607537 - DNA, 20 bp, Artificial Sequence
  chemically synthesized
ggaacagaagatatctaagt

SEQ ID NO: 607538 - DNA, 20 bp, Artificial Sequence
  chemically synthesized
agtagaggtttacaaagaag

SEQ ID NO: 607539 - DNA, 20 bp, Artificial Sequence
  chemically synthesized
tgtcttaatttcagttagat

SEQ ID NO: 607540 - DNA, 20 bp, Artificial Sequence
  chemically synthesized
ccaggtgatccctgatcagt

SEQ ID NO: 607541 - DNA, 20 bp, Artificial Sequence
  chemically synthesized
aatatcccaggtgatccctg

SEQ ID NO: 607542 - DNA, 20 bp, Artificial Sequence
  chemically synthesized
gatattgctaaactgcacaa

SEQ ID NO: 607543 - DNA, 20 bp, Artificial Sequence
  chemically synthesized
tatatacagaatcagaattg

SEQ ID NO: 607544 - DNA, 20 bp, Artificial Sequence
  chemically synthesized
caccttgatctgcaagttac

SEQ ID NO: 607545 - DNA, 20 bp, Artificial Sequence
  chemically synthesized
tttggtaagttcattgattt

SEQ ID NO: 607546 - DNA, 20 bp, Artificial Sequence
  chemically synthesized
atttcacaatttggtaagtt

SEQ ID NO: 607547 - DNA, 20 bp, Artificial Sequence
  chemically synthesized
tgtgaaataaaatcacaatt

SEQ ID NO: 607548 - DNA, 20 bp, Artificial Sequence
  chemically synthesized
gcacaatctcaaactcctaa

SEQ ID NO: 607549 - DNA, 20 bp, Artificial Sequence
  chemically synthesized
ataaaatcacaattaggagt

SEQ ID NO: 607550 - DNA, 20 bp, Artificial Sequence
  chemically synthesized
ttactgcaacgaattcaatt

SEQ ID NO: 607551 - DNA, 20 bp, Artificial Sequence
  chemically synthesized
ttattttctcccaagtgcag

SEQ ID NO: 607552 - DNA, 20 bp, Artificial Sequence
  chemically synthesized
ctgtccagtcaaagcattga

SEQ ID NO: 607553 - DNA, 20 bp, Artificial Sequence
  chemically synthesized
aaataattgtgaatcaccat

SEQ ID NO: 607554 - DNA, 20 bp, Artificial Sequence
  chemically synthesized
ttcacaattattttccatat

SEQ ID NO: 607555 - DNA, 20 bp, Artificial Sequence
  chemically synthesized
ggccaagtgaagttgtgttt

SEQ ID NO: 607556 - DNA, 20 bp, Artificial Sequence
  chemically synthesized
agtcaggaggccaagtgaag

SEQ ID NO: 607557 - DNA, 20 bp, Artificial Sequence
  chemically synthesized
caacttcacttggcctcctg

SEQ ID NO: 607558 - DNA, 20 bp, Artificial Sequence
  chemically synthesized
tttttttcccttaccgtcac

SEQ ID NO: 607559 - DNA, 20 bp, Artificial Sequence
  chemically synthesized
tcccttaccgtcacagaagt

SEQ ID NO: 607560 - DNA, 20 bp, Artificial Sequence
  chemically synthesized
agaaaagttgatggaacttg

SEQ ID NO: 607561 - DNA, 20 bp, Artificial Sequence
  chemically synthesized
atgcaacctgcagagagcaa

SEQ ID NO: 607562 - DNA, 20 bp, Artificial Sequence
  chemically synthesized
tgcatttttcaatcaaatta

SEQ ID NO: 607563 - DNA, 20 bp, Artificial Sequence
  chemically synthesized
ctctatgaataaactaatta

SEQ ID NO: 607564 - DNA, 20 bp, Artificial Sequence
  chemically synthesized
tattcatagagaagaaaatc

SEQ ID NO: 607565 - DNA, 20 bp, Artificial Sequence
  chemically synthesized
acaactggcacagggaaaac

SEQ ID NO: 607566 - DNA, 20 bp, Artificial Sequence
  chemically synthesized
cacttccacagttggaagtt

SEQ ID NO: 607567 - DNA, 20 bp, Artificial Sequence
  chemically synthesized
acagcattaaaaaaaaaatc

SEQ ID NO: 607568 - DNA, 20 bp, Artificial Sequence
  chemically synthesized
accccttaagaggagtaagc

SEQ ID NO: 607569 - DNA, 20 bp, Artificial Sequence
  chemically synthesized
ttaaaacaagagaatattga

SEQ ID NO: 607570 - DNA, 20 bp, Artificial Sequence
  chemically synthesized
acaaaaccacatcaatattc

SEQ ID NO: 607571 - DNA, 20 bp, Artificial Sequence
  chemically synthesized
gtgccattcctttcataatg

SEQ ID NO: 607572 - DNA, 20 bp, Artificial Sequence
  chemically synthesized
acattatgaaaggaatggca

SEQ ID NO: 607573 - DNA, 20 bp, Artificial Sequence
  chemically synthesized
acaaaactttaccaatgttt

SEQ ID NO: 607574 - DNA, 20 bp, Artificial Sequence
  chemically synthesized
ttaaatcatataaacattgg

SEQ ID NO: 607575 - DNA, 20 bp, Artificial Sequence
  chemically synthesized
ggtcaattacaaaactttac

SEQ ID NO: 607576 - DNA, 20 bp, Artificial Sequence
  chemically synthesized
taacacatctccagtcacaa

SEQ ID NO: 607577 - DNA, 20 bp, Artificial Sequence
  chemically synthesized
ttaataaacttctttattgt

SEQ ID NO: 607578 - DNA, 20 bp, Artificial Sequence
  chemically synthesized
ggtaaaagctaatacaataa

SEQ ID NO: 607579 - DNA, 20 bp, Artificial Sequence
  chemically synthesized
ttgtattttccctccaattc

SEQ ID NO: 607580 - DNA, 20 bp, Artificial Sequence
  chemically synthesized
tccttcataaccacactctc

SEQ ID NO: 607581 - DNA, 20 bp, Artificial Sequence
  chemically synthesized
cacaatggcaacatttaaaa

SEQ ID NO: 607582 - DNA, 20 bp, Artificial Sequence
  chemically synthesized
gggataagggagcatgagca

SEQ ID NO: 607583 - DNA, 20 bp, Artificial Sequence
  chemically synthesized
gtaaaaaacatctatgaggg

SEQ ID NO: 607584 - DNA, 20 bp, Artificial Sequence
  chemically synthesized
ctaccaaacctgaccctcat

SEQ ID NO: 607585 - DNA, 20 bp, Artificial Sequence
  chemically synthesized
ggagaggatcacttgaggcc

SEQ ID NO: 607586 - DNA, 20 bp, Artificial Sequence
  chemically synthesized
ttgcagggaatgaggtcttg

SEQ ID NO: 607587 - DNA, 20 bp, Artificial Sequence
  chemically synthesized
gatgagatagggtataaaaa

SEQ ID NO: 607588 - DNA, 20 bp, Artificial Sequence
  chemically synthesized
tgtcagcctcatgacactat

SEQ ID NO: 607589 - DNA, 20 bp, Artificial Sequence
  chemically synthesized
ttcttttctgttctctactt

SEQ ID NO: 607590 - DNA, 20 bp, Artificial Sequence
  chemically synthesized
ttgccccagttcacataaat

SEQ ID NO: 607591 - DNA, 20 bp, Artificial Sequence
  chemically synthesized
agtttgcctaaggaataagg

SEQ ID NO: 607592 - DNA, 20 bp, Artificial Sequence
  chemically synthesized
ctccagtttgcctaaggaat

SEQ ID NO: 607593 - DNA, 20 bp, Artificial Sequence
  chemically synthesized
ttattccttaggcaaactgg

SEQ ID NO: 607594 - DNA, 20 bp, Artificial Sequence
  chemically synthesized
ctgccttacataaaatcctc

SEQ ID NO: 607595 - DNA, 20 bp, Artificial Sequence
  chemically synthesized
aatacaaagataatagcgtg

SEQ ID NO: 607596 - DNA, 20 bp, Artificial Sequence
  chemically synthesized
atctttgtatttttaatatt

SEQ ID NO: 607597 - DNA, 20 bp, Artificial Sequence
  chemically synthesized
tcttgttttgcataattgtt

SEQ ID NO: 607598 - DNA, 20 bp, Artificial Sequence
  chemically synthesized
tgctttttcctttggaaata

SEQ ID NO: 607599 - DNA, 20 bp, Artificial Sequence
  chemically synthesized
ttttttccttttgacagtaa

SEQ ID NO: 607600 - DNA, 20 bp, Artificial Sequence
  chemically synthesized
gaactaaaactaaacagaga

SEQ ID NO: 607601 - DNA, 20 bp, Artificial Sequence
  chemically synthesized
ttttaaaaaccacttctctg

SEQ ID NO: 607602 - DNA, 20 bp, Artificial Sequence
  chemically synthesized
agttattttaaaaaccactt

SEQ ID NO: 607603 - DNA, 20 bp, Artificial Sequence
  chemically synthesized
ttcctccagtggccttcctg

SEQ ID NO: 607604 - DNA, 20 bp, Artificial Sequence
  chemically synthesized
ctctcacctacataaaatct

SEQ ID NO: 607605 - DNA, 20 bp, Artificial Sequence
  chemically synthesized
actaagtgcaagacaaagcc

SEQ ID NO: 607606 - DNA, 20 bp, Artificial Sequence
  chemically synthesized
tgtcagtcagggctttgaat

SEQ ID NO: 607607 - DNA, 20 bp, Artificial Sequence
  chemically synthesized
ttacatattgtagtgtcagt

SEQ ID NO: 607608 - DNA, 20 bp, Artificial Sequence
  chemically synthesized
gggttgaaatataggtagga

SEQ ID NO: 607609 - DNA, 20 bp, Artificial Sequence
  chemically synthesized
aggcccaaaaatagggacag

SEQ ID NO: 607610 - DNA, 20 bp, Artificial Sequence
  chemically synthesized
tgcaaaggcccaaaaatagg

SEQ ID NO: 607611 - DNA, 20 bp, Artificial Sequence
  chemically synthesized
gatcacaaggaagtgtggtt

SEQ ID NO: 607612 - DNA, 20 bp, Artificial Sequence
  chemically synthesized
gaaggttggtaccatttagt

SEQ ID NO: 607613 - DNA, 20 bp, Artificial Sequence
  chemically synthesized
gactttgaaggttggtacca

SEQ ID NO: 607614 - DNA, 20 bp, Artificial Sequence
  chemically synthesized
ggataggaatatagtttttg

SEQ ID NO: 607615 - DNA, 20 bp, Artificial Sequence
  chemically synthesized
agaaaaataccggataggaa

SEQ ID NO: 607616 - DNA, 20 bp, Artificial Sequence
  chemically synthesized
tggctgccagcctctacaga

SEQ ID NO: 607617 - DNA, 20 bp, Artificial Sequence
  chemically synthesized
attgagtctccagtgccatt

SEQ ID NO: 607618 - DNA, 20 bp, Artificial Sequence
  chemically synthesized
taggttggtacaaaagtaat

SEQ ID NO: 607619 - DNA, 20 bp, Artificial Sequence
  chemically synthesized
attacttacaatggaaaaaa

SEQ ID NO: 607620 - DNA, 20 bp, Artificial Sequence
  chemically synthesized
ttaggttgctgcaaaagtaa

SEQ ID NO: 607621 - DNA, 20 bp, Artificial Sequence
  chemically synthesized
aatagtaagtatgttggtag

SEQ ID NO: 607622 - DNA, 20 bp, Artificial Sequence
  chemically synthesized
aattgctaagtgtaaatgtt

SEQ ID NO: 607623 - DNA, 20 bp, Artificial Sequence
  chemically synthesized
aatgttcatagattttagtg

SEQ ID NO: 607624 - DNA, 20 bp, Artificial Sequence
  chemically synthesized
aaaacttcttgtaaatacag

SEQ ID NO: 607625 - DNA, 20 bp, Artificial Sequence
  chemically synthesized
taagcttatctgtatttaca

SEQ ID NO: 607626 - DNA, 20 bp, Artificial Sequence
  chemically synthesized
tatcaacttagaaattatag

SEQ ID NO: 607627 - DNA, 20 bp, Artificial Sequence
  chemically synthesized
catttctctaatcgctaaac

SEQ ID NO: 607628 - DNA, 20 bp, Artificial Sequence
  chemically synthesized
ttcctgcctaagccttggtt

SEQ ID NO: 607629 - DNA, 20 bp, Artificial Sequence
  chemically synthesized
ccattatttcctgcctaagc

SEQ ID NO: 607630 - DNA, 20 bp, Artificial Sequence
  chemically synthesized
ccaaggcttaggcaggaaat

SEQ ID NO: 607631 - DNA, 20 bp, Artificial Sequence
  chemically synthesized
ttttctctctctacctaaga

SEQ ID NO: 607632 - DNA, 20 bp, Artificial Sequence
  chemically synthesized
agaagtatcgatgaatccat

SEQ ID NO: 607633 - DNA, 20 bp, Artificial Sequence
  chemically synthesized
gaagattactagtaaacaaa

SEQ ID NO: 607634 - DNA, 20 bp, Artificial Sequence
  chemically synthesized
atatatgattacttcagagt

SEQ ID NO: 607635 - DNA, 20 bp, Artificial Sequence
  chemically synthesized
tacctattttttttctaaat

SEQ ID NO: 607636 - DNA, 20 bp, Artificial Sequence
  chemically synthesized
agaatggattatctccaatg

SEQ ID NO: 607637 - DNA, 20 bp, Artificial Sequence
  chemically synthesized
tcatgagaatggattatctc

SEQ ID NO: 607638 - DNA, 20 bp, Artificial Sequence
  chemically synthesized
tccattatcatggtcatgag

SEQ ID NO: 607639 - DNA, 20 bp, Artificial Sequence
  chemically synthesized
ttcaaataaattataacctg

SEQ ID NO: 607640 - DNA, 20 bp, Artificial Sequence
  chemically synthesized
atttgaagcattaagtaaaa

SEQ ID NO: 607641 - DNA, 20 bp, Artificial Sequence
  chemically synthesized
aaactaatctaggttttact

SEQ ID NO: 607642 - DNA, 20 bp, Artificial Sequence
  chemically synthesized
aagcattaagtaaaacctag

SEQ ID NO: 607643 - DNA, 20 bp, Artificial Sequence
  chemically synthesized
attatttttaaaaaactaat

SEQ ID NO: 607644 - DNA, 20 bp, Artificial Sequence
  chemically synthesized
acaataccctcttttcataa

SEQ ID NO: 607645 - DNA, 20 bp, Artificial Sequence
  chemically synthesized
cctcttttcataatcacgtt

SEQ ID NO: 607646 - DNA, 20 bp, Artificial Sequence
  chemically synthesized
tttgtgagaggaaacaaaaa

SEQ ID NO: 607647 - DNA, 20 bp, Artificial Sequence
  chemically synthesized
ctttgctgaacctgattttt

SEQ ID NO: 607648 - DNA, 20 bp, Artificial Sequence
  chemically synthesized
ctttcaaaaatcaggttcag

SEQ ID NO: 607649 - DNA, 20 bp, Artificial Sequence
  chemically synthesized
cattatgtaagctttgctga

SEQ ID NO: 607650 - DNA, 20 bp, Artificial Sequence
  chemically synthesized
aggttcagcaaagcttacat

SEQ ID NO: 607651 - DNA, 20 bp, Artificial Sequence
  chemically synthesized
ctaatgtgataagccattat

SEQ ID NO: 607652 - DNA, 20 bp, Artificial Sequence
  chemically synthesized
gcttatcacattagaattta

SEQ ID NO: 607653 - DNA, 20 bp, Artificial Sequence
  chemically synthesized
cacaaattcagaaataatat

SEQ ID NO: 607654 - DNA, 20 bp, Artificial Sequence
  chemically synthesized
ctgaatttgtgttgctcaaa

SEQ ID NO: 607655 - DNA, 20 bp, Artificial Sequence
  chemically synthesized
ctcattttaaaaactctgtg

SEQ ID NO: 607656 - DNA, 20 bp, Artificial Sequence
  chemically synthesized
gcttttgctaaaacatctca

SEQ ID NO: 607657 - DNA, 20 bp, Artificial Sequence
  chemically synthesized
aaggagagccttctagctgg

SEQ ID NO: 607658 - DNA, 20 bp, Artificial Sequence
  chemically synthesized
tcaagagcttttgtacgtgt

SEQ ID NO: 607659 - DNA, 20 bp, Artificial Sequence
  chemically synthesized
tttgtccttagggaagattc

SEQ ID NO: 607660 - DNA, 20 bp, Artificial Sequence
  chemically synthesized
aaaaattagtttgtccttag

SEQ ID NO: 607661 - DNA, 20 bp, Artificial Sequence
  chemically synthesized
agctgagattgacataaaaa

SEQ ID NO: 607662 - DNA, 20 bp, Artificial Sequence
  chemically synthesized
atggcagtattaccacctag

SEQ ID NO: 607663 - DNA, 20 bp, Artificial Sequence
  chemically synthesized
acataaaaaaagtcttttat

SEQ ID NO: 607664 - DNA, 20 bp, Artificial Sequence
  chemically synthesized
tcacagataaaagacttttt

SEQ ID NO: 607665 - DNA, 20 bp, Artificial Sequence
  chemically synthesized
aattaaaattgcaacttttt

SEQ ID NO: 607666 - DNA, 20 bp, Artificial Sequence
  chemically synthesized
atttcacacagcaattaatt

SEQ ID NO: 607667 - DNA, 20 bp, Artificial Sequence
  chemically synthesized
tgaataattaatgccatatt

SEQ ID NO: 607668 - DNA, 20 bp, Artificial Sequence
  chemically synthesized
tgtcttctcctttgtgcact

SEQ ID NO: 607669 - DNA, 20 bp, Artificial Sequence
  chemically synthesized
gcaaggacagtaaagaggtg

SEQ ID NO: 607670 - DNA, 20 bp, Artificial Sequence
  chemically synthesized
ggattttcaaaactttctaa

SEQ ID NO: 607671 - DNA, 20 bp, Artificial Sequence
  chemically synthesized
agcaacctcaaacaaaatta

SEQ ID NO: 607672 - DNA, 20 bp, Artificial Sequence
  chemically synthesized
aactttctaattttgtttga

SEQ ID NO: 607673 - DNA, 20 bp, Artificial Sequence
  chemically synthesized
gttggcatatgaccacagaa

SEQ ID NO: 607674 - DNA, 20 bp, Artificial Sequence
  chemically synthesized
tgttgagtctgcccactccc

SEQ ID NO: 607675 - DNA, 20 bp, Artificial Sequence
  chemically synthesized
gggcagactcaacagttata

SEQ ID NO: 607676 - DNA, 20 bp, Artificial Sequence
  chemically synthesized
ttcgcctgctgtgatcgtgg

SEQ ID NO: 607677 - DNA, 20 bp, Artificial Sequence
  chemically synthesized
aggcgaataatatcaatatg

SEQ ID NO: 607678 - DNA, 20 bp, Artificial Sequence
  chemically synthesized
atatgcatagattagtatct

SEQ ID NO: 607679 - DNA, 20 bp, Artificial Sequence
  chemically synthesized
aaataaggtacatgtaagat

SEQ ID NO: 607680 - DNA, 20 bp, Artificial Sequence
  chemically synthesized
tatttattctttcaaaaggc

SEQ ID NO: 607681 - DNA, 20 bp, Artificial Sequence
  chemically synthesized
caaaaggcctgagcttaaaa

SEQ ID NO: 607682 - DNA, 20 bp, Artificial Sequence
  chemically synthesized
gaaactcattagatatgcta

SEQ ID NO: 607683 - DNA, 20 bp, Artificial Sequence
  chemically synthesized
caatccttctagcatatcta

SEQ ID NO: 607684 - DNA, 20 bp, Artificial Sequence
  chemically synthesized
ccttggtccttttttttttt

SEQ ID NO: 607685 - DNA, 20 bp, Artificial Sequence
  chemically synthesized
aaaaaaattgtccaaatgcc

SEQ ID NO: 607686 - DNA, 20 bp, Artificial Sequence
  chemically synthesized
aaaagaaatgaagtgccaac

SEQ ID NO: 607687 - DNA, 20 bp, Artificial Sequence
  chemically synthesized
tgtaaagcctatcaagacaa

SEQ ID NO: 607688 - DNA, 20 bp, Artificial Sequence
  chemically synthesized
aataaatctatcttgtcttg

SEQ ID NO: 607689 - DNA, 20 bp, Artificial Sequence
  chemically synthesized
ctcatcattctggatatgtg

SEQ ID NO: 607690 - DNA, 20 bp, Artificial Sequence
  chemically synthesized
cagatctcatcattctggat

SEQ ID NO: 607691 - DNA, 20 bp, Artificial Sequence
  chemically synthesized
cacatatccagaatgatgag

SEQ ID NO: 607692 - DNA, 20 bp, Artificial Sequence
  chemically synthesized
atatattgacttaataaaaa

SEQ ID NO: 607693 - DNA, 20 bp, Artificial Sequence
  chemically synthesized
attttaataagaatttccca

SEQ ID NO: 607694 - DNA, 20 bp, Artificial Sequence
  chemically synthesized
aatttcccaaaacgtttgaa

SEQ ID NO: 607695 - DNA, 20 bp, Artificial Sequence
  chemically synthesized
cctcttgaaaaacattattc

SEQ ID NO: 607696 - DNA, 20 bp, Artificial Sequence
  chemically synthesized
cgtttgaataatgtttttca

SEQ ID NO: 607697 - DNA, 20 bp, Artificial Sequence
  chemically synthesized
agtaactctttaatattttc

SEQ ID NO: 607698 - DNA, 20 bp, Artificial Sequence
  chemically synthesized
aagggctttttcttcagaag

SEQ ID NO: 607699 - DNA, 20 bp, Artificial Sequence
  chemically synthesized
tcgtgtcaactatagctaat

SEQ ID NO: 607700 - DNA, 20 bp, Artificial Sequence
  chemically synthesized
ttatgtacacaatctcctgt

SEQ ID NO: 607701 - DNA, 20 bp, Artificial Sequence
  chemically synthesized
aaaggcacagaagcatgcac

SEQ ID NO: 607702 - DNA, 20 bp, Artificial Sequence
  chemically synthesized
tgccttttatagtgacattt

SEQ ID NO: 607703 - DNA, 20 bp, Artificial Sequence
  chemically synthesized
tctgtcatagttattatttt

SEQ ID NO: 607704 - DNA, 20 bp, Artificial Sequence
  chemically synthesized
gttatctacagaactatgtt

SEQ ID NO: 607705 - DNA, 20 bp, Artificial Sequence
  chemically synthesized
atgcactgttatctacagaa

SEQ ID NO: 607706 - DNA, 20 bp, Artificial Sequence
  chemically synthesized
gattttcatagaaataacat

SEQ ID NO: 607707 - DNA, 20 bp, Artificial Sequence
  chemically synthesized
ctttctttcaagggagactg

SEQ ID NO: 607708 - DNA, 20 bp, Artificial Sequence
  chemically synthesized
ctcagtttgttcccaaggca

SEQ ID NO: 607709 - DNA, 20 bp, Artificial Sequence
  chemically synthesized
ttgatggttaagttacgatt

SEQ ID NO: 607710 - DNA, 20 bp, Artificial Sequence
  chemically synthesized
gatgtggtttgatggttaag

SEQ ID NO: 607711 - DNA, 20 bp, Artificial Sequence
  chemically synthesized
gaagcttgtgattattttga

SEQ ID NO: 607712 - DNA, 20 bp, Artificial Sequence
  chemically synthesized
caaaccacatcaaaataatc

SEQ ID NO: 607713 - DNA, 20 bp, Artificial Sequence
  chemically synthesized
gactaacaagttttggaagc

SEQ ID NO: 607714 - DNA, 20 bp, Artificial Sequence
  chemically synthesized
taagaagactaacaagtttt

SEQ ID NO: 607715 - DNA, 20 bp, Artificial Sequence
  chemically synthesized
gtttttaattaagaagacta

SEQ ID NO: 607716 - DNA, 20 bp, Artificial Sequence
  chemically synthesized
aacaaagcaagtaagtcctt

SEQ ID NO: 607717 - DNA, 20 bp, Artificial Sequence
  chemically synthesized
ttaaaaacaaataaggactt

SEQ ID NO: 607718 - DNA, 20 bp, Artificial Sequence
  chemically synthesized
aacaaataaggacttacttg

SEQ ID NO: 607719 - DNA, 20 bp, Artificial Sequence
  chemically synthesized
ggcattcccatcttgaattt

SEQ ID NO: 607720 - DNA, 20 bp, Artificial Sequence
  chemically synthesized
agattcatctgctcttgtac

SEQ ID NO: 607721 - DNA, 20 bp, Artificial Sequence
  chemically synthesized
ctgataattttcctgttcca

SEQ ID NO: 607722 - DNA, 20 bp, Artificial Sequence
  chemically synthesized
tattctacaattgggaagta

SEQ ID NO: 607723 - DNA, 20 bp, Artificial Sequence
  chemically synthesized
cttctttgtcaggggtacat

SEQ ID NO: 607724 - DNA, 20 bp, Artificial Sequence
  chemically synthesized
tagaactctaggtaaatcgg

SEQ ID NO: 607725 - DNA, 20 bp, Artificial Sequence
  chemically synthesized
ctaggtaaatcggtgtggtt

SEQ ID NO: 607726 - DNA, 20 bp, Artificial Sequence
  chemically synthesized
acaaataaaactcaaaacca

SEQ ID NO: 607727 - DNA, 20 bp, Artificial Sequence
  chemically synthesized
tcggtgtggttttgagtttt

SEQ ID NO: 607728 - DNA, 20 bp, Artificial Sequence
  chemically synthesized
ggttttgagttttatttgtt

SEQ ID NO: 607729 - DNA, 20 bp, Artificial Sequence
  chemically synthesized
agttttaaacttgtggccca

SEQ ID NO: 607730 - DNA, 20 bp, Artificial Sequence
  chemically synthesized
aatataaatctaaatgggcc

SEQ ID NO: 607731 - DNA, 20 bp, Artificial Sequence
  chemically synthesized
aattcatattaaaagtggtt

SEQ ID NO: 607732 - DNA, 20 bp, Artificial Sequence
  chemically synthesized
tttccttaattcatattaaa

SEQ ID NO: 607733 - DNA, 20 bp, Artificial Sequence
  chemically synthesized
actgaagtccttatctcggg

SEQ ID NO: 607734 - DNA, 20 bp, Artificial Sequence
  chemically synthesized
cgagataaggacttcagtgc

SEQ ID NO: 607735 - DNA, 20 bp, Artificial Sequence
  chemically synthesized
ttcctgagatgatacactcg

SEQ ID NO: 607736 - DNA, 20 bp, Artificial Sequence
  chemically synthesized
gacttttcctgagatgatac

SEQ ID NO: 607737 - DNA, 20 bp, Artificial Sequence
  chemically synthesized
tcctgagttgatgtatggta

SEQ ID NO: 607738 - DNA, 20 bp, Artificial Sequence
  chemically synthesized
cttgacacaagagaaagaag

SEQ ID NO: 607739 - DNA, 20 bp, Artificial Sequence
  chemically synthesized
ggattccaacagtcagattt

SEQ ID NO: 607740 - DNA, 20 bp, Artificial Sequence
  chemically synthesized
atgtgcttgggattccaaca

SEQ ID NO: 607741 - DNA, 20 bp, Artificial Sequence
  chemically synthesized
atttagttactatgatgtgc

SEQ ID NO: 607742 - DNA, 20 bp, Artificial Sequence
  chemically synthesized
ttggaaatttagttactatg

SEQ ID NO: 607743 - DNA, 20 bp, Artificial Sequence
  chemically synthesized
acttgccattataacaagtc

SEQ ID NO: 607744 - DNA, 20 bp, Artificial Sequence
  chemically synthesized
ccattataacaagtcatatg

SEQ ID NO: 607745 - DNA, 20 bp, Artificial Sequence
  chemically synthesized
atatgttttgttttgtaaat

SEQ ID NO: 607746 - DNA, 20 bp, Artificial Sequence
  chemically synthesized
tttgttttgtaaattaacgt

SEQ ID NO: 607747 - DNA, 20 bp, Artificial Sequence
  chemically synthesized
tgatgtggaagtggtgaaag

SEQ ID NO: 607748 - DNA, 20 bp, Artificial Sequence
  chemically synthesized
acatcattagaaatctctcc

SEQ ID NO: 607749 - DNA, 20 bp, Artificial Sequence
  chemically synthesized
ggacacattgcaagcacaag

SEQ ID NO: 607750 - DNA, 20 bp, Artificial Sequence
  chemically synthesized
agctttagaagaagtattat

SEQ ID NO: 607751 - DNA, 20 bp, Artificial Sequence
  chemically synthesized
cacgataatacttcttctaa

SEQ ID NO: 607752 - DNA, 20 bp, Artificial Sequence
  chemically synthesized
gtaaacctggaccgttatca

SEQ ID NO: 607753 - DNA, 20 bp, Artificial Sequence
  chemically synthesized
taaagctgtttgataacggt

SEQ ID NO: 607754 - DNA, 20 bp, Artificial Sequence
  chemically synthesized
ctgccaaatgacttgtcttc

SEQ ID NO: 607755 - DNA, 20 bp, Artificial Sequence
  chemically synthesized
tgttacacaattaatgtctt

SEQ ID NO: 607756 - DNA, 20 bp, Artificial Sequence
  chemically synthesized
cctagcattttaaatatttc

SEQ ID NO: 607757 - DNA, 20 bp, Artificial Sequence
  chemically synthesized
attgtctgtatctgctgttc

SEQ ID NO: 607758 - DNA, 20 bp, Artificial Sequence
  chemically synthesized
aacagcagatacagacaata

SEQ ID NO: 607759 - DNA, 20 bp, Artificial Sequence
  chemically synthesized
ttaatacaatattaatttgg

SEQ ID NO: 607760 - DNA, 20 bp, Artificial Sequence
  chemically synthesized
taatattgtattaaagctct

SEQ ID NO: 607761 - DNA, 20 bp, Artificial Sequence
  chemically synthesized
tactccttccagtaatctag

SEQ ID NO: 607762 - DNA, 20 bp, Artificial Sequence
  chemically synthesized
taaattagtatatcacctca

SEQ ID NO: 607763 - DNA, 20 bp, Artificial Sequence
  chemically synthesized
tgccttcctttcccctacct

SEQ ID NO: 607764 - DNA, 20 bp, Artificial Sequence
  chemically synthesized
ttctaacagcataatgactt

SEQ ID NO: 607765 - DNA, 20 bp, Artificial Sequence
  chemically synthesized
tagcctttatttccagaagg

SEQ ID NO: 607766 - DNA, 20 bp, Artificial Sequence
  chemically synthesized
tagaagaactaaaatatgaa

SEQ ID NO: 607767 - DNA, 20 bp, Artificial Sequence
  chemically synthesized
gatgcttcgtacactttgct

SEQ ID NO: 607768 - DNA, 20 bp, Artificial Sequence
  chemically synthesized
gatcttctctttagaattat

SEQ ID NO: 607769 - DNA, 20 bp, Artificial Sequence
  chemically synthesized
tcacaacccttaatccaata

SEQ ID NO: 607770 - DNA, 20 bp, Artificial Sequence
  chemically synthesized
tacacacctttaagctagat

SEQ ID NO: 607771 - DNA, 20 bp, Artificial Sequence
  chemically synthesized
tgtgtaagagcaagcaagga

SEQ ID NO: 607772 - DNA, 20 bp, Artificial Sequence
  chemically synthesized
cagatttttctaatcgacct

SEQ ID NO: 607773 - DNA, 20 bp, Artificial Sequence
  chemically synthesized
gattagaaaaatctggtgag

SEQ ID NO: 607774 - DNA, 20 bp, Artificial Sequence
  chemically synthesized
ctccagaggaagcctttctc

SEQ ID NO: 607775 - DNA, 20 bp, Artificial Sequence
  chemically synthesized
aaactaccccgtctctatta

SEQ ID NO: 607776 - DNA, 20 bp, Artificial Sequence
  chemically synthesized
aagccaagtaatagagacgg

SEQ ID NO: 607777 - DNA, 20 bp, Artificial Sequence
  chemically synthesized
catgagctgtaaacctggcc

SEQ ID NO: 607778 - DNA, 20 bp, Artificial Sequence
  chemically synthesized
aaatctctgcaaacatatgg

SEQ ID NO: 607779 - DNA, 20 bp, Artificial Sequence
  chemically synthesized
taaacctggccatatgtttg

SEQ ID NO: 607780 - DNA, 20 bp, Artificial Sequence
  chemically synthesized
ccatacactcaagtgacagg

SEQ ID NO: 607781 - DNA, 20 bp, Artificial Sequence
  chemically synthesized
cttgggataaactacatgtc

SEQ ID NO: 607782 - DNA, 20 bp, Artificial Sequence
  chemically synthesized
ttaggttaaagcagcagaca

SEQ ID NO: 607783 - DNA, 20 bp, Artificial Sequence
  chemically synthesized
gcaaaaatttgagtaaacta

SEQ ID NO: 607784 - DNA, 20 bp, Artificial Sequence
  chemically synthesized
gcaaaacctcctgcaaactt

SEQ ID NO: 607785 - DNA, 20 bp, Artificial Sequence
  chemically synthesized
agtaaactactaagtttgca

SEQ ID NO: 607786 - DNA, 20 bp, Artificial Sequence
  chemically synthesized
actactaagtttgcaggagg

SEQ ID NO: 607787 - DNA, 20 bp, Artificial Sequence
  chemically synthesized
agtgtactccttgcaggtcg

SEQ ID NO: 607788 - DNA, 20 bp, Artificial Sequence
  chemically synthesized
agtccctcttgagcatgttc

SEQ ID NO: 607789 - DNA, 20 bp, Artificial Sequence
  chemically synthesized
tctacaaatatttctccaat

SEQ ID NO: 607790 - DNA, 20 bp, Artificial Sequence
  chemically synthesized
ttgcaatatttgtggaatgc

SEQ ID NO: 607791 - DNA, 20 bp, Artificial Sequence
  chemically synthesized
tgtttgttagggggccccgt

SEQ ID NO: 607792 - DNA, 20 bp, Artificial Sequence
  chemically synthesized
accctgtttgttagggggcc

SEQ ID NO: 607793 - DNA, 20 bp, Artificial Sequence
  chemically synthesized
gcacggggccccctaacaaa

SEQ ID NO: 607794 - DNA, 20 bp, Artificial Sequence
  chemically synthesized
tttttgattcctttacaaaa

SEQ ID NO: 607795 - DNA, 20 bp, Artificial Sequence
  chemically synthesized
ttctgttgttctacactgct

SEQ ID NO: 607796 - DNA, 20 bp, Artificial Sequence
  chemically synthesized
aaacagcttctgttgttcta

SEQ ID NO: 607797 - DNA, 20 bp, Artificial Sequence
  chemically synthesized
aagcagtgtagaacaacaga

SEQ ID NO: 607798 - DNA, 20 bp, Artificial Sequence
  chemically synthesized
tagaacaacagaagctgttt

SEQ ID NO: 607799 - DNA, 20 bp, Artificial Sequence
  chemically synthesized
tgagattatgaaatccccca

SEQ ID NO: 607800 - DNA, 20 bp, Artificial Sequence
  chemically synthesized
aaaggttgaattttctctgg

SEQ ID NO: 607801 - DNA, 20 bp, Artificial Sequence
  chemically synthesized
ccagagaaaattcaaccttt

SEQ ID NO: 607802 - DNA, 20 bp, Artificial Sequence
  chemically synthesized
agcacaagtaagttggtgct

SEQ ID NO: 607803 - DNA, 20 bp, Artificial Sequence
  chemically synthesized
atcaaatgatgcactctttt

SEQ ID NO: 607804 - DNA, 20 bp, Artificial Sequence
  chemically synthesized
ctctttgatatgatgaagtt

SEQ ID NO: 607805 - DNA, 20 bp, Artificial Sequence
  chemically synthesized
gagagatgtgcgcaggtgga

SEQ ID NO: 607806 - DNA, 20 bp, Artificial Sequence
  chemically synthesized
gtgcgcaggtggaaccagct

SEQ ID NO: 607807 - DNA, 20 bp, Artificial Sequence
  chemically synthesized
tatcagcagataatagaggc

SEQ ID NO: 607808 - DNA, 20 bp, Artificial Sequence
  chemically synthesized
aaataattttatttttgaat

SEQ ID NO: 607809 - DNA, 20 bp, Artificial Sequence
  chemically synthesized
actgtgagctcaccagactt

SEQ ID NO: 607810 - DNA, 20 bp, Artificial Sequence
  chemically synthesized
agaagtctggtgagctcaca

SEQ ID NO: 607811 - DNA, 20 bp, Artificial Sequence
  chemically synthesized
gtgagctcacagtaagttta

SEQ ID NO: 607812 - DNA, 20 bp, Artificial Sequence
  chemically synthesized
tctcccagggctgccagcaa

SEQ ID NO: 607813 - DNA, 20 bp, Artificial Sequence
  chemically synthesized
ttgctggcagccctgggaga

SEQ ID NO: 607814 - DNA, 20 bp, Artificial Sequence
  chemically synthesized
tgcttcctatctgaaccaga

SEQ ID NO: 607815 - DNA, 20 bp, Artificial Sequence
  chemically synthesized
aggatatgatagggtttctt

SEQ ID NO: 607816 - DNA, 20 bp, Artificial Sequence
  chemically synthesized
aggagtaggaaaggatatga

SEQ ID NO: 607817 - DNA, 20 bp, Artificial Sequence
  chemically synthesized
gctaggtaactcccaaagtc

SEQ ID NO: 607818 - DNA, 20 bp, Artificial Sequence
  chemically synthesized
ttacctagccctgcataagc

SEQ ID NO: 607819 - DNA, 20 bp, Artificial Sequence
  chemically synthesized
agccctgcataagccttagt

SEQ ID NO: 607820 - DNA, 20 bp, Artificial Sequence
  chemically synthesized
cattttacagaagcagaaac

SEQ ID NO: 607821 - DNA, 20 bp, Artificial Sequence
  chemically synthesized
ggaacaataatacttccata

SEQ ID NO: 607822 - DNA, 20 bp, Artificial Sequence
  chemically synthesized
aattcctctgcatatataag

SEQ ID NO: 607823 - DNA, 20 bp, Artificial Sequence
  chemically synthesized
gttttgaagcataaattgcc

SEQ ID NO: 607824 - DNA, 20 bp, Artificial Sequence
  chemically synthesized
gaaggtaatcttggggcaat

SEQ ID NO: 607825 - DNA, 20 bp, Artificial Sequence
  chemically synthesized
ttaccttcttaagtcactgt

SEQ ID NO: 607826 - DNA, 20 bp, Artificial Sequence
  chemically synthesized
agatttcaaaaagagttaaa

SEQ ID NO: 607827 - DNA, 20 bp, Artificial Sequence
  chemically synthesized
aaatacgagctaggttaagg

SEQ ID NO: 607828 - DNA, 20 bp, Artificial Sequence
  chemically synthesized
ttatttgaactcaagatagt

SEQ ID NO: 607829 - DNA, 20 bp, Artificial Sequence
  chemically synthesized
gtttacaatgcttcgtttgg

SEQ ID NO: 607830 - DNA, 20 bp, Artificial Sequence
  chemically synthesized
tattagtgctgtttacaatg

SEQ ID NO: 607831 - DNA, 20 bp, Artificial Sequence
  chemically synthesized
ttgagtattagtgctgttta

SEQ ID NO: 607832 - DNA, 20 bp, Artificial Sequence
  chemically synthesized
ttgtgttacttgagtattag

SEQ ID NO: 607833 - DNA, 20 bp, Artificial Sequence
  chemically synthesized
aaatcataaagtgtttaata

SEQ ID NO: 607834 - DNA, 20 bp, Artificial Sequence
  chemically synthesized
gaatcaaaatattaaacact

SEQ ID NO: 607835 - DNA, 20 bp, Artificial Sequence
  chemically synthesized
gtaaatatcaataaatcata

SEQ ID NO: 607836 - DNA, 20 bp, Artificial Sequence
  chemically synthesized
tatgatttattgatatttac

SEQ ID NO: 607837 - DNA, 20 bp, Artificial Sequence
  chemically synthesized
gaaggctgtctttgaaatgt

SEQ ID NO: 607838 - DNA, 20 bp, Artificial Sequence
  chemically synthesized
ctttaagaaggctgtctttg

SEQ ID NO: 607839 - DNA, 20 bp, Artificial Sequence
  chemically synthesized
ataaaattttgcatagctta

SEQ ID NO: 607840 - DNA, 20 bp, Artificial Sequence
  chemically synthesized
gatataaatataaaattttg

SEQ ID NO: 607841 - DNA, 20 bp, Artificial Sequence
  chemically synthesized
actcagatcttaaattcaaa

SEQ ID NO: 607842 - DNA, 20 bp, Artificial Sequence
  chemically synthesized
aattatttgtctagatagac

SEQ ID NO: 607843 - DNA, 20 bp, Artificial Sequence
  chemically synthesized
acatgattttatgaaccatg

SEQ ID NO: 607844 - DNA, 20 bp, Artificial Sequence
  chemically synthesized
ttcctagtcataacctacta

SEQ ID NO: 607845 - DNA, 20 bp, Artificial Sequence
  chemically synthesized
agtgacacagactactattt

SEQ ID NO: 607846 - DNA, 20 bp, Artificial Sequence
  chemically synthesized
ctaacaattattgtctcaat

SEQ ID NO: 607847 - DNA, 20 bp, Artificial Sequence
  chemically synthesized
tttttgtttcagatgtgcat

SEQ ID NO: 607848 - DNA, 20 bp, Artificial Sequence
  chemically synthesized
atatgtatatatgttctaag

SEQ ID NO: 607849 - DNA, 20 bp, Artificial Sequence
  chemically synthesized
ggtgagattaaacttttttc

SEQ ID NO: 607850 - DNA, 20 bp, Artificial Sequence
  chemically synthesized
ttgttttacaaactgcagaa

SEQ ID NO: 607851 - DNA, 20 bp, Artificial Sequence
  chemically synthesized
aattctagagccatttccaa

SEQ ID NO: 607852 - DNA, 20 bp, Artificial Sequence
  chemically synthesized
gcaaatttcttttttcgtcg

SEQ ID NO: 607853 - DNA, 20 bp, Artificial Sequence
  chemically synthesized
tcaggcaaatttcttttttc

SEQ ID NO: 607854 - DNA, 20 bp, Artificial Sequence
  chemically synthesized
aaagacattttaaaataaaa

SEQ ID NO: 607855 - DNA, 20 bp, Artificial Sequence
  chemically synthesized
ttccaaattctcagattaaa

SEQ ID NO: 607856 - DNA, 20 bp, Artificial Sequence
  chemically synthesized
tatatctttatttccaaatt

SEQ ID NO: 607857 - DNA, 20 bp, Artificial Sequence
  chemically synthesized
ttggaaataaagatataaaa

SEQ ID NO: 607858 - DNA, 20 bp, Artificial Sequence
  chemically synthesized
ataaagatataaaaagtggc

SEQ ID NO: 607859 - DNA, 20 bp, Artificial Sequence
  chemically synthesized
gatataaaaagtggcttatg

SEQ ID NO: 607860 - DNA, 20 bp, Artificial Sequence
  chemically synthesized
ctttgtttcagcaccccaaa

SEQ ID NO: 607861 - DNA, 20 bp, Artificial Sequence
  chemically synthesized
cacagaattttacattgtac

SEQ ID NO: 607862 - DNA, 20 bp, Artificial Sequence
  chemically synthesized
acatgtcatggcatcaaatg

SEQ ID NO: 607863 - DNA, 20 bp, Artificial Sequence
  chemically synthesized
tgaagagattttctaggaaa

SEQ ID NO: 607864 - DNA, 20 bp, Artificial Sequence
  chemically synthesized
ttataagaaagatagacccc

SEQ ID NO: 607865 - DNA, 20 bp, Artificial Sequence
  chemically synthesized
tactggcatcttcattcatg

SEQ ID NO: 607866 - DNA, 20 bp, Artificial Sequence
  chemically synthesized
actggaactaattatttttc

SEQ ID NO: 607867 - DNA, 20 bp, Artificial Sequence
  chemically synthesized
actactgtgataaagacaaa

SEQ ID NO: 607868 - DNA, 20 bp, Artificial Sequence
  chemically synthesized
tcctattttgtctttatcac

SEQ ID NO: 607869 - DNA, 20 bp, Artificial Sequence
  chemically synthesized
tttgtctttatcacagtagt

SEQ ID NO: 607870 - DNA, 20 bp, Artificial Sequence
  chemically synthesized
tcttcagtacattgggcaaa

SEQ ID NO: 607871 - DNA, 20 bp, Artificial Sequence
  chemically synthesized
ggcatgacagtgaatggatg

SEQ ID NO: 607872 - DNA, 20 bp, Artificial Sequence
  chemically synthesized
acagtgaatggatgaaacga

SEQ ID NO: 607873 - DNA, 20 bp, Artificial Sequence
  chemically synthesized
aatggatgaaacgattctgt

SEQ ID NO: 607874 - DNA, 20 bp, Artificial Sequence
  chemically synthesized
aaaaaaaaaaacaaaaacag

SEQ ID NO: 607875 - DNA, 20 bp, Artificial Sequence
  chemically synthesized
caacgttatccacagacttc

SEQ ID NO: 607876 - DNA, 20 bp, Artificial Sequence
  chemically synthesized
cagaggcttaattactgcct

SEQ ID NO: 607877 - DNA, 20 bp, Artificial Sequence
  chemically synthesized
tgcctcagcctcccaaagtg

SEQ ID NO: 607878 - DNA, 20 bp, Artificial Sequence
  chemically synthesized
ttttgtatttttagtagaga

SEQ ID NO: 607879 - DNA, 20 bp, Artificial Sequence
  chemically synthesized
aaaggcgtgaacccgggagg

SEQ ID NO: 607880 - DNA, 20 bp, Artificial Sequence
  chemically synthesized
ttgcccaggccggagtgcag

SEQ ID NO: 607881 - DNA, 20 bp, Artificial Sequence
  chemically synthesized
ttttaaaagagacggagtct

SEQ ID NO: 607882 - DNA, 20 bp, Artificial Sequence
  chemically synthesized
ctaaaacagtcatttatcat

SEQ ID NO: 607883 - DNA, 20 bp, Artificial Sequence
  chemically synthesized
aaaaatcagggatgataaat

SEQ ID NO: 607884 - DNA, 20 bp, Artificial Sequence
  chemically synthesized
tgtctccagaaatgagtgtc

SEQ ID NO: 607885 - DNA, 20 bp, Artificial Sequence
  chemically synthesized
tatataaatatattttaaaa

SEQ ID NO: 607886 - DNA, 20 bp, Artificial Sequence
  chemically synthesized
caagatcagacagatagtaa

SEQ ID NO: 607887 - DNA, 20 bp, Artificial Sequence
  chemically synthesized
cgtacgtatatttttatttt

SEQ ID NO: 607888 - DNA, 20 bp, Artificial Sequence
  chemically synthesized
atacgtacgtaaggctgctg

SEQ ID NO: 607889 - DNA, 20 bp, Artificial Sequence
  chemically synthesized
agcatttcttgggatctaga

SEQ ID NO: 607890 - DNA, 20 bp, Artificial Sequence
  chemically synthesized
caagaaatgctctgcaatgc

SEQ ID NO: 607891 - DNA, 20 bp, Artificial Sequence
  chemically synthesized
ccaaagttcattgaaatgat

SEQ ID NO: 607892 - DNA, 20 bp, Artificial Sequence
  chemically synthesized
gaaacacacagagctcattc

SEQ ID NO: 607893 - DNA, 20 bp, Artificial Sequence
  chemically synthesized
gaaacaggtgaatgagctct

SEQ ID NO: 607894 - DNA, 20 bp, Artificial Sequence
  chemically synthesized
agctctgtgtgtttctggaa

SEQ ID NO: 607895 - DNA, 20 bp, Artificial Sequence
  chemically synthesized
ctcagtttgaattgcccaaa

SEQ ID NO: 607896 - DNA, 20 bp, Artificial Sequence
  chemically synthesized
gtagccacttgattacttat

SEQ ID NO: 607897 - DNA, 20 bp, Artificial Sequence
  chemically synthesized
ttcactacctacatgtagcc

SEQ ID NO: 607898 - DNA, 20 bp, Artificial Sequence
  chemically synthesized
gctttgtggtttgctgggct

SEQ ID NO: 607899 - DNA, 20 bp, Artificial Sequence
  chemically synthesized
gctattttttctaagagctt

SEQ ID NO: 607900 - DNA, 20 bp, Artificial Sequence
  chemically synthesized
gtgtcccagctattttttct

SEQ ID NO: 607901 - DNA, 20 bp, Artificial Sequence
  chemically synthesized
gagggcacagtctatcactg

SEQ ID NO: 607902 - DNA, 20 bp, Artificial Sequence
  chemically synthesized
cagttttatatcactgataa

SEQ ID NO: 607903 - DNA, 20 bp, Artificial Sequence
  chemically synthesized
gactgttaacctggatcaaa

SEQ ID NO: 607904 - DNA, 20 bp, Artificial Sequence
  chemically synthesized
tatgcattcaagaccaataa

SEQ ID NO: 607905 - DNA, 20 bp, Artificial Sequence
  chemically synthesized
tttattggtcttgaatgcat

SEQ ID NO: 607906 - DNA, 20 bp, Artificial Sequence
  chemically synthesized
taatcttttactgaggggta

SEQ ID NO: 607907 - DNA, 20 bp, Artificial Sequence
  chemically synthesized
taatctttttacccctcagt

SEQ ID NO: 607908 - DNA, 20 bp, Artificial Sequence
  chemically synthesized
taaaagattatttccaagat

SEQ ID NO: 607909 - DNA, 20 bp, Artificial Sequence
  chemically synthesized
cttctgttatttagtgaaag

SEQ ID NO: 607910 - DNA, 20 bp, Artificial Sequence
  chemically synthesized
agaagagcatttctgaacaa

SEQ ID NO: 607911 - DNA, 20 bp, Artificial Sequence
  chemically synthesized
atattcttgacacatttccg

SEQ ID NO: 607912 - DNA, 20 bp, Artificial Sequence
  chemically synthesized
ttttatgctttgaatagtac

SEQ ID NO: 607913 - DNA, 20 bp, Artificial Sequence
  chemically synthesized
aggtactattcaaagcataa

SEQ ID NO: 607914 - DNA, 20 bp, Artificial Sequence
  chemically synthesized
aatcacttcagtaatcattt

SEQ ID NO: 607915 - DNA, 20 bp, Artificial Sequence
  chemically synthesized
aagcataaaaatgattactg

SEQ ID NO: 607916 - DNA, 20 bp, Artificial Sequence
  chemically synthesized
tgtcatgtacagtgttgcat

SEQ ID NO: 607917 - DNA, 20 bp, Artificial Sequence
  chemically synthesized
agttcaaagttaagccctaa

SEQ ID NO: 607918 - DNA, 20 bp, Artificial Sequence
  chemically synthesized
gatttttcctaaatcctcat

SEQ ID NO: 607919 - DNA, 20 bp, Artificial Sequence
  chemically synthesized
attgttgccctaacagcagg

SEQ ID NO: 607920 - DNA, 20 bp, Artificial Sequence
  chemically synthesized
gcggtagtagttgtatttgt

SEQ ID NO: 607921 - DNA, 20 bp, Artificial Sequence
  chemically synthesized
aaaatgatataatgcgtgtt

SEQ ID NO: 607922 - DNA, 20 bp, Artificial Sequence
  chemically synthesized
ggttctgggacttaaaacca

SEQ ID NO: 607923 - DNA, 20 bp, Artificial Sequence
  chemically synthesized
tgggacttaaaaccaggttg

SEQ ID NO: 607924 - DNA, 20 bp, Artificial Sequence
  chemically synthesized
gtgttttggaatccaaacaa

SEQ ID NO: 607925 - DNA, 20 bp, Artificial Sequence
  chemically synthesized
ttgatcatattgggataaag

SEQ ID NO: 607926 - DNA, 20 bp, Artificial Sequence
  chemically synthesized
taattcattttcttcattta

SEQ ID NO: 607927 - DNA, 20 bp, Artificial Sequence
  chemically synthesized
ttatatttttttaaaagtgc

SEQ ID NO: 607928 - DNA, 20 bp, Artificial Sequence
  chemically synthesized
tataatataacttttttttt

SEQ ID NO: 607929 - DNA, 20 bp, Artificial Sequence
  chemically synthesized
ctttttttttttctgttttt

SEQ ID NO: 607930 - DNA, 20 bp, Artificial Sequence
  chemically synthesized
tcgggaggctgaggcaggag

SEQ ID NO: 607931 - DNA, 20 bp, Artificial Sequence
  chemically synthesized
tgcctcagcctcccgagtag

SEQ ID NO: 607932 - DNA, 20 bp, Artificial Sequence
  chemically synthesized
tataaaaattagcccggtgt

SEQ ID NO: 607933 - DNA, 20 bp, Artificial Sequence
  chemically synthesized
ttttatatttttaatagaga

SEQ ID NO: 607934 - DNA, 20 bp, Artificial Sequence
  chemically synthesized
tgggcggatgacctgaggtc

SEQ ID NO: 607935 - DNA, 20 bp, Artificial Sequence
  chemically synthesized
cacctcagcctcccaaagtg

SEQ ID NO: 607936 - DNA, 20 bp, Artificial Sequence
  chemically synthesized
taatttccacaaattcaatc

SEQ ID NO: 607937 - DNA, 20 bp, Artificial Sequence
  chemically synthesized
tttcctagtagcttccaaac

SEQ ID NO: 607938 - DNA, 20 bp, Artificial Sequence
  chemically synthesized
tgaagacgaggtattttcct

SEQ ID NO: 607939 - DNA, 20 bp, Artificial Sequence
  chemically synthesized
gtgcattatttagacttgac

SEQ ID NO: 607940 - DNA, 20 bp, Artificial Sequence
  chemically synthesized
ataaggacatcatggataat

SEQ ID NO: 607941 - DNA, 20 bp, Artificial Sequence
  chemically synthesized
atgtatttatggggtacatg

SEQ ID NO: 607942 - DNA, 20 bp, Artificial Sequence
  chemically synthesized
aaaatttaaaacataatttt

SEQ ID NO: 607943 - DNA, 20 bp, Artificial Sequence
  chemically synthesized
tttttaaaaaactgttaaaa

SEQ ID NO: 607944 - DNA, 20 bp, Artificial Sequence
  chemically synthesized
cttctgacttctttttctgt

SEQ ID NO: 607945 - DNA, 20 bp, Artificial Sequence
  chemically synthesized
cagcttcttctgacttcttt

SEQ ID NO: 607946 - DNA, 20 bp, Artificial Sequence
  chemically synthesized
tttgttagctttattttttg

SEQ ID NO: 607947 - DNA, 20 bp, Artificial Sequence
  chemically synthesized
ccttcttttagaaagaattt

SEQ ID NO: 607948 - DNA, 20 bp, Artificial Sequence
  chemically synthesized
tctgcgccttctgttaatcc

SEQ ID NO: 607949 - DNA, 20 bp, Artificial Sequence
  chemically synthesized
ttaacatcaaaggcaaatca

SEQ ID NO: 607950 - DNA, 20 bp, Artificial Sequence
  chemically synthesized
tacgtacacatatggggtat

SEQ ID NO: 607951 - DNA, 20 bp, Artificial Sequence
  chemically synthesized
tttgtttaataggctataga

SEQ ID NO: 607952 - DNA, 20 bp, Artificial Sequence
  chemically synthesized
atgtttttggctctagaacc

SEQ ID NO: 607953 - DNA, 20 bp, Artificial Sequence
  chemically synthesized
taaagtataaaaaaaaagat

SEQ ID NO: 607954 - DNA, 20 bp, Artificial Sequence
  chemically synthesized
tagtatttaaagtataaaaa

SEQ ID NO: 607955 - DNA, 20 bp, Artificial Sequence
  chemically synthesized
agggtacatgtgcacaacgt

SEQ ID NO: 607956 - DNA, 20 bp, Artificial Sequence
  chemically synthesized
atgagtgagaacatgtggta

SEQ ID NO: 607957 - DNA, 20 bp, Artificial Sequence
  chemically synthesized
atttggttttttgtccttgc

SEQ ID NO: 607958 - DNA, 20 bp, Artificial Sequence
  chemically synthesized
gcttgctgagaatgatggtc

SEQ ID NO: 607959 - DNA, 20 bp, Artificial Sequence
  chemically synthesized
ctacaaaggacatgaactca

SEQ ID NO: 607960 - DNA, 20 bp, Artificial Sequence
  chemically synthesized
caaatgtccatcgatgatag

SEQ ID NO: 607961 - DNA, 20 bp, Artificial Sequence
  chemically synthesized
ctataaagacagatgcacac

SEQ ID NO: 607962 - DNA, 20 bp, Artificial Sequence
  chemically synthesized
gtgcatctgtctttatagca

SEQ ID NO: 607963 - DNA, 20 bp, Artificial Sequence
  chemically synthesized
ccattactgggtatattccc

SEQ ID NO: 607964 - DNA, 20 bp, Artificial Sequence
  chemically synthesized
ctctcttccacaatggttga

SEQ ID NO: 607965 - DNA, 20 bp, Artificial Sequence
  chemically synthesized
agagcacttttacactgttg

SEQ ID NO: 607966 - DNA, 20 bp, Artificial Sequence
  chemically synthesized
tccacatcctctccagcacc

SEQ ID NO: 607967 - DNA, 20 bp, Artificial Sequence
  chemically synthesized
tatgtgcaatggtatctcat

SEQ ID NO: 607968 - DNA, 20 bp, Artificial Sequence
  chemically synthesized
gcaatggtatctcattgtgg

SEQ ID NO: 607969 - DNA, 20 bp, Artificial Sequence
  chemically synthesized
ctttgcccactttttgatag

SEQ ID NO: 607970 - DNA, 20 bp, Artificial Sequence
  chemically synthesized
gggttgtttttttcttgtaa

SEQ ID NO: 607971 - DNA, 20 bp, Artificial Sequence
  chemically synthesized
gtaaatttgtttgacttctt

SEQ ID NO: 607972 - DNA, 20 bp, Artificial Sequence
  chemically synthesized
ctggatattagccctttgcc

SEQ ID NO: 607973 - DNA, 20 bp, Artificial Sequence
  chemically synthesized
tattagccctttgccagatg

SEQ ID NO: 607974 - DNA, 20 bp, Artificial Sequence
  chemically synthesized
ggttgcctgttcactatgat

SEQ ID NO: 607975 - DNA, 20 bp, Artificial Sequence
  chemically synthesized
ttcactatgatggtagtttc

SEQ ID NO: 607976 - DNA, 20 bp, Artificial Sequence
  chemically synthesized
cttttgctttgcagaagctc

SEQ ID NO: 607977 - DNA, 20 bp, Artificial Sequence
  chemically synthesized
aatgggatctaattaaacca

SEQ ID NO: 607978 - DNA, 20 bp, Artificial Sequence
  chemically synthesized
tcaattttgactcttgttgc

SEQ ID NO: 607979 - DNA, 20 bp, Artificial Sequence
  chemically synthesized
actcttgttgccattgcttt

SEQ ID NO: 607980 - DNA, 20 bp, Artificial Sequence
  chemically synthesized
tatgtcctgaaaggtattgc

SEQ ID NO: 607981 - DNA, 20 bp, Artificial Sequence
  chemically synthesized
ggtattgcctaggttttctt

SEQ ID NO: 607982 - DNA, 20 bp, Artificial Sequence
  chemically synthesized
taggttttcttctaggtttt

SEQ ID NO: 607983 - DNA, 20 bp, Artificial Sequence
  chemically synthesized
tataatgtgtaaggaaggga

SEQ ID NO: 607984 - DNA, 20 bp, Artificial Sequence
  chemically synthesized
gtgtaaggaagggatccagt

SEQ ID NO: 607985 - DNA, 20 bp, Artificial Sequence
  chemically synthesized
cagctttctacatatggcta

SEQ ID NO: 607986 - DNA, 20 bp, Artificial Sequence
  chemically synthesized
taaatagggaatcctttccc

SEQ ID NO: 607987 - DNA, 20 bp, Artificial Sequence
  chemically synthesized
tagggaatcctttccccatt

SEQ ID NO: 607988 - DNA, 20 bp, Artificial Sequence
  chemically synthesized
gagaaaaacaagcaatgggg

SEQ ID NO: 607989 - DNA, 20 bp, Artificial Sequence
  chemically synthesized
ttccccattgcttgtttttc

SEQ ID NO: 607990 - DNA, 20 bp, Artificial Sequence
  chemically synthesized
agatatgtggcattatttct

SEQ ID NO: 607991 - DNA, 20 bp, Artificial Sequence
  chemically synthesized
ctattctgataccagtacca

SEQ ID NO: 607992 - DNA, 20 bp, Artificial Sequence
  chemically synthesized
tggttactgtagccttgtag

SEQ ID NO: 607993 - DNA, 20 bp, Artificial Sequence
  chemically synthesized
aaagctggaggtatcacact

SEQ ID NO: 607994 - DNA, 20 bp, Artificial Sequence
  chemically synthesized
aaatcaggtagtgtgatacc

SEQ ID NO: 607995 - DNA, 20 bp, Artificial Sequence
  chemically synthesized
gatacctccagctttgttct

SEQ ID NO: 607996 - DNA, 20 bp, Artificial Sequence
  chemically synthesized
tccagctttgttcttttggc

SEQ ID NO: 607997 - DNA, 20 bp, Artificial Sequence
  chemically synthesized
tggttccatatgaactttaa

SEQ ID NO: 607998 - DNA, 20 bp, Artificial Sequence
  chemically synthesized
attccgtgtagaaagtcatt

SEQ ID NO: 607999 - DNA, 20 bp, Artificial Sequence
  chemically synthesized
ccatactgcccaaggtaatt

SEQ ID NO: 608000 - DNA, 20 bp, Artificial Sequence
  chemically synthesized
cagtatggccattttcacaa

SEQ ID NO: 608001 - DNA, 20 bp, Artificial Sequence
  chemically synthesized
tgagcatagaatgttcttcc

SEQ ID NO: 608002 - DNA, 20 bp, Artificial Sequence
  chemically synthesized
cctcttgtattttggtgagc

SEQ ID NO: 608003 - DNA, 20 bp, Artificial Sequence
  chemically synthesized
gtccttcacatcccttgcaa

SEQ ID NO: 608004 - DNA, 20 bp, Artificial Sequence
  chemically synthesized
catgagtgaactccattcac

SEQ ID NO: 608005 - DNA, 20 bp, Artificial Sequence
  chemically synthesized
caattgtgaatggagttcac

SEQ ID NO: 608006 - DNA, 20 bp, Artificial Sequence
  chemically synthesized
tgtctgttattggtgtataa

SEQ ID NO: 608007 - DNA, 20 bp, Artificial Sequence
  chemically synthesized
ttattggtgtataagaatgc

SEQ ID NO: 608008 - DNA, 20 bp, Artificial Sequence
  chemically synthesized
gaatgcttgtgatttttgca

SEQ ID NO: 608009 - DNA, 20 bp, Artificial Sequence
  chemically synthesized
gtatcctgagactttgctga

SEQ ID NO: 608010 - DNA, 20 bp, Artificial Sequence
  chemically synthesized
agactttgctgaagttgctt

SEQ ID NO: 608011 - DNA, 20 bp, Artificial Sequence
  chemically synthesized
tgaagttgcttatcagctta

SEQ ID NO: 608012 - DNA, 20 bp, Artificial Sequence
  chemically synthesized
tagattttgggctgagacaa

SEQ ID NO: 608013 - DNA, 20 bp, Artificial Sequence
  chemically synthesized
attgtccctgtttgcagatg

SEQ ID NO: 608014 - DNA, 20 bp, Artificial Sequence
  chemically synthesized
aaaagaggaagtcaaattgt

SEQ ID NO: 608015 - DNA, 20 bp, Artificial Sequence
  chemically synthesized
accctttatttccttcttct

SEQ ID NO: 608016 - DNA, 20 bp, Artificial Sequence
  chemically synthesized
agagggcatccctgtcttgt

SEQ ID NO: 608017 - DNA, 20 bp, Artificial Sequence
  chemically synthesized
cttgtgccagttttcaaagg

SEQ ID NO: 608018 - DNA, 20 bp, Artificial Sequence
  chemically synthesized
cagttttcaaagggaatgct

SEQ ID NO: 608019 - DNA, 20 bp, Artificial Sequence
  chemically synthesized
cattcaatatgatagtggct

SEQ ID NO: 608020 - DNA, 20 bp, Artificial Sequence
  chemically synthesized
ccatcaatacctaatttatt

SEQ ID NO: 608021 - DNA, 20 bp, Artificial Sequence
  chemically synthesized
tgcatctatggagataatca

SEQ ID NO: 608022 - DNA, 20 bp, Artificial Sequence
  chemically synthesized
cagaaccaaagatagaaacc

SEQ ID NO: 608023 - DNA, 20 bp, Artificial Sequence
  chemically synthesized
catgtggtttctatctttgg

SEQ ID NO: 608024 - DNA, 20 bp, Artificial Sequence
  chemically synthesized
tttatatgctgcattatatt

SEQ ID NO: 608025 - DNA, 20 bp, Artificial Sequence
  chemically synthesized
agcttatccaccattatcaa

SEQ ID NO: 608026 - DNA, 20 bp, Artificial Sequence
  chemically synthesized
agcccacttgataatggtgg

SEQ ID NO: 608027 - DNA, 20 bp, Artificial Sequence
  chemically synthesized
ccgaatccagcagcacatca

SEQ ID NO: 608028 - DNA, 20 bp, Artificial Sequence
  chemically synthesized
gataagctttttgatgtgct

SEQ ID NO: 608029 - DNA, 20 bp, Artificial Sequence
  chemically synthesized
ctttttgatgtgctgctgga

SEQ ID NO: 608030 - DNA, 20 bp, Artificial Sequence
  chemically synthesized
tcggattgccagtattttat

SEQ ID NO: 608031 - DNA, 20 bp, Artificial Sequence
  chemically synthesized
ttggtctaaaattctctttt

SEQ ID NO: 608032 - DNA, 20 bp, Artificial Sequence
  chemically synthesized
ttttttttgttttgtctctg

SEQ ID NO: 608033 - DNA, 20 bp, Artificial Sequence
  chemically synthesized
gccaggctttggtatcagga

SEQ ID NO: 608034 - DNA, 20 bp, Artificial Sequence
  chemically synthesized
tgcctcataaaatgagttag

SEQ ID NO: 608035 - DNA, 20 bp, Artificial Sequence
  chemically synthesized
cctctttttctattcattgg

SEQ ID NO: 608036 - DNA, 20 bp, Artificial Sequence
  chemically synthesized
ccaaaaaaagtccaggacca

SEQ ID NO: 608037 - DNA, 20 bp, Artificial Sequence
  chemically synthesized
gagcctgttattggtctatt

SEQ ID NO: 608038 - DNA, 20 bp, Artificial Sequence
  chemically synthesized
tctattcagggattcaactt

SEQ ID NO: 608039 - DNA, 20 bp, Artificial Sequence
  chemically synthesized
ccacgaatttatccattcct

SEQ ID NO: 608040 - DNA, 20 bp, Artificial Sequence
  chemically synthesized
tatccattccttctagattt

SEQ ID NO: 608041 - DNA, 20 bp, Artificial Sequence
  chemically synthesized
tttctagtttatttgcgtag

SEQ ID NO: 608042 - DNA, 20 bp, Artificial Sequence
  chemically synthesized
tttatttgcgtagaggtgtt

SEQ ID NO: 608043 - DNA, 20 bp, Artificial Sequence
  chemically synthesized
tgtttacagttttctctgat

SEQ ID NO: 608044 - DNA, 20 bp, Artificial Sequence
  chemically synthesized
tattattttttattgcatct

SEQ ID NO: 608045 - DNA, 20 bp, Artificial Sequence
  chemically synthesized
tttgttgatcataaccagct

SEQ ID NO: 608046 - DNA, 20 bp, Artificial Sequence
  chemically synthesized
tcataaccagctcctagatt

SEQ ID NO: 608047 - DNA, 20 bp, Artificial Sequence
  chemically synthesized
ctagattcattgatttttta

SEQ ID NO: 608048 - DNA, 20 bp, Artificial Sequence
  chemically synthesized
ttagttatttcttgccttct

SEQ ID NO: 608049 - DNA, 20 bp, Artificial Sequence
  chemically synthesized
tgccttctgctagcttttga

SEQ ID NO: 608050 - DNA, 20 bp, Artificial Sequence
  chemically synthesized
tagcttttgaatgtgtttgc

SEQ ID NO: 608051 - DNA, 20 bp, Artificial Sequence
  chemically synthesized
gggtgtcaattttagatctt

SEQ ID NO: 608052 - DNA, 20 bp, Artificial Sequence
  chemically synthesized
gctataaatttccctctaca

SEQ ID NO: 608053 - DNA, 20 bp, Artificial Sequence
  chemically synthesized
acactgctttaaatgtgtcc

SEQ ID NO: 608054 - DNA, 20 bp, Artificial Sequence
  chemically synthesized
tatgttgtgtctttgttctc

SEQ ID NO: 608055 - DNA, 20 bp, Artificial Sequence
  chemically synthesized
agtcattcagcagcaggttg

SEQ ID NO: 608056 - DNA, 20 bp, Artificial Sequence
  chemically synthesized
gttcagtttccatgtagttg

SEQ ID NO: 608057 - DNA, 20 bp, Artificial Sequence
  chemically synthesized
atgtagttgagtggttttga

SEQ ID NO: 608058 - DNA, 20 bp, Artificial Sequence
  chemically synthesized
tgagtttcttaatccagagt

SEQ ID NO: 608059 - DNA, 20 bp, Artificial Sequence
  chemically synthesized
tttcttaatccagagttcta

SEQ ID NO: 608060 - DNA, 20 bp, Artificial Sequence
  chemically synthesized
cagttcaatcaaactagaac

SEQ ID NO: 608061 - DNA, 20 bp, Artificial Sequence
  chemically synthesized
gttcttttacatttgctgag

SEQ ID NO: 608062 - DNA, 20 bp, Artificial Sequence
  chemically synthesized
gctgagaagaatgtataatc

SEQ ID NO: 608063 - DNA, 20 bp, Artificial Sequence
  chemically synthesized
agaactctccacccctaatc

SEQ ID NO: 608064 - DNA, 20 bp, Artificial Sequence
  chemically synthesized
gttctgtagatgtctatgag

SEQ ID NO: 608065 - DNA, 20 bp, Artificial Sequence
  chemically synthesized
ctctttgtaggtctataagg

SEQ ID NO: 608066 - DNA, 20 bp, Artificial Sequence
  chemically synthesized
atgcacccaattcaggagca

SEQ ID NO: 608067 - DNA, 20 bp, Artificial Sequence
  chemically synthesized
ttgatctttgttggtctaaa

SEQ ID NO: 608068 - DNA, 20 bp, Artificial Sequence
  chemically synthesized
aaagtctgttttatcagaca

SEQ ID NO: 608069 - DNA, 20 bp, Artificial Sequence
  chemically synthesized
tttaatgtaggaattaagat

SEQ ID NO: 608070 - DNA, 20 bp, Artificial Sequence
  chemically synthesized
ccatttttttaatgtaggaa

SEQ ID NO: 608071 - DNA, 20 bp, Artificial Sequence
  chemically synthesized
cattaaaaaaatggctctgg

SEQ ID NO: 608072 - DNA, 20 bp, Artificial Sequence
  chemically synthesized
tcaccctttatgtagtatta

SEQ ID NO: 608073 - DNA, 20 bp, Artificial Sequence
  chemically synthesized
gtcacggttgaggatagctc

SEQ ID NO: 608074 - DNA, 20 bp, Artificial Sequence
  chemically synthesized
agggatccatagtcctgttg

SEQ ID NO: 608075 - DNA, 20 bp, Artificial Sequence
  chemically synthesized
atggatgaactaaaaaatga

SEQ ID NO: 608076 - DNA, 20 bp, Artificial Sequence
  chemically synthesized
aaggatggatgaactaaaaa

SEQ ID NO: 608077 - DNA, 20 bp, Artificial Sequence
  chemically synthesized
attttttagttcatccatcc

SEQ ID NO: 608078 - DNA, 20 bp, Artificial Sequence
  chemically synthesized
tatcagtatatgagattgct

SEQ ID NO: 608079 - DNA, 20 bp, Artificial Sequence
  chemically synthesized
aaattagagtatatcagtat

SEQ ID NO: 608080 - DNA, 20 bp, Artificial Sequence
  chemically synthesized
atactctaattttctagcag

SEQ ID NO: 608081 - DNA, 20 bp, Artificial Sequence
  chemically synthesized
tactataaaaatgtatctgt

SEQ ID NO: 608082 - DNA, 20 bp, Artificial Sequence
  chemically synthesized
gtatctgtaaaagcttatat

SEQ ID NO: 608083 - DNA, 20 bp, Artificial Sequence
  chemically synthesized
agtttattttaaactcacat

SEQ ID NO: 608084 - DNA, 20 bp, Artificial Sequence
  chemically synthesized
agacatctgattttatagta

SEQ ID NO: 608085 - DNA, 20 bp, Artificial Sequence
  chemically synthesized
gagtagagttttagagagac

SEQ ID NO: 608086 - DNA, 20 bp, Artificial Sequence
  chemically synthesized
tatgttttagagagacagag

SEQ ID NO: 608087 - DNA, 20 bp, Artificial Sequence
  chemically synthesized
gactggaaccttcattgaga

SEQ ID NO: 608088 - DNA, 20 bp, Artificial Sequence
  chemically synthesized
ctcaatgaaggttccagtca

SEQ ID NO: 608089 - DNA, 20 bp, Artificial Sequence
  chemically synthesized
aggttccagtcattttgctt

SEQ ID NO: 608090 - DNA, 20 bp, Artificial Sequence
  chemically synthesized
cagataataaatatttacta

SEQ ID NO: 608091 - DNA, 20 bp, Artificial Sequence
  chemically synthesized
aatttcttatttaaggtcat

SEQ ID NO: 608092 - DNA, 20 bp, Artificial Sequence
  chemically synthesized
ggtcatttgtgcttccaatt

SEQ ID NO: 608093 - DNA, 20 bp, Artificial Sequence
  chemically synthesized
aatttcaggttttatataaa

SEQ ID NO: 608094 - DNA, 20 bp, Artificial Sequence
  chemically synthesized
atattactccattttcaagg

SEQ ID NO: 608095 - DNA, 20 bp, Artificial Sequence
  chemically synthesized
gtaatatggcataaaatatt

SEQ ID NO: 608096 - DNA, 20 bp, Artificial Sequence
  chemically synthesized
tattcctattcatatttcat

SEQ ID NO: 608097 - DNA, 20 bp, Artificial Sequence
  chemically synthesized
gtgtgtgtgtgtgtgtgtgt

SEQ ID NO: 608098 - DNA, 20 bp, Artificial Sequence
  chemically synthesized
ttatgagaaaggttctattg

SEQ ID NO: 608099 - DNA, 20 bp, Artificial Sequence
  chemically synthesized
gcttatttctttttcttcct

SEQ ID NO: 608100 - DNA, 20 bp, Artificial Sequence
  chemically synthesized
tttaggagaatttgccataa

SEQ ID NO: 608101 - DNA, 20 bp, Artificial Sequence
  chemically synthesized
ttattttctctctgaccttc

SEQ ID NO: 608102 - DNA, 20 bp, Artificial Sequence
  chemically synthesized
aaggtcagagagaaaataat

SEQ ID NO: 608103 - DNA, 20 bp, Artificial Sequence
  chemically synthesized
acaatttaataacccaatat

SEQ ID NO: 608104 - DNA, 20 bp, Artificial Sequence
  chemically synthesized
taaaagatttctttttaaaa

SEQ ID NO: 608105 - DNA, 20 bp, Artificial Sequence
  chemically synthesized
ttatgaaaattttattataa

SEQ ID NO: 608106 - DNA, 20 bp, Artificial Sequence
  chemically synthesized
ttctgagaaagtttttttat

SEQ ID NO: 608107 - DNA, 20 bp, Artificial Sequence
  chemically synthesized
gccatctaataaatttctga

SEQ ID NO: 608108 - DNA, 20 bp, Artificial Sequence
  chemically synthesized
cacatgaaagacgtctagcc

SEQ ID NO: 608109 - DNA, 20 bp, Artificial Sequence
  chemically synthesized
cctagtgatttctttgttct

SEQ ID NO: 608110 - DNA, 20 bp, Artificial Sequence
  chemically synthesized
gaaataggtcccccctttta

SEQ ID NO: 608111 - DNA, 20 bp, Artificial Sequence
  chemically synthesized
cccacacctcataggtgtga

SEQ ID NO: 608112 - DNA, 20 bp, Artificial Sequence
  chemically synthesized
ctgtcagccaaggaatgtcg

SEQ ID NO: 608113 - DNA, 20 bp, Artificial Sequence
  chemically synthesized
atctctgtcagccaaggaat

SEQ ID NO: 608114 - DNA, 20 bp, Artificial Sequence
  chemically synthesized
aaccgacattccttggctga

SEQ ID NO: 608115 - DNA, 20 bp, Artificial Sequence
  chemically synthesized
ggatgaacataataactctg

SEQ ID NO: 608116 - DNA, 20 bp, Artificial Sequence
  chemically synthesized
ataactctgtactgtttggt

SEQ ID NO: 608117 - DNA, 20 bp, Artificial Sequence
  chemically synthesized
catatgagttggtaattgaa

SEQ ID NO: 608118 - DNA, 20 bp, Artificial Sequence
  chemically synthesized
aatttagtacttttacaaaa

SEQ ID NO: 608119 - DNA, 20 bp, Artificial Sequence
  chemically synthesized
taatgttattttccttaatc

SEQ ID NO: 608120 - DNA, 20 bp, Artificial Sequence
  chemically synthesized
aattaataaaattgttaaac

SEQ ID NO: 608121 - DNA, 20 bp, Artificial Sequence
  chemically synthesized
tgattaaaataaataagact

SEQ ID NO: 608122 - DNA, 20 bp, Artificial Sequence
  chemically synthesized
tttttttcctatttataaat

SEQ ID NO: 608123 - DNA, 20 bp, Artificial Sequence
  chemically synthesized
gtcatttataaataggaaaa

SEQ ID NO: 608124 - DNA, 20 bp, Artificial Sequence
  chemically synthesized
tgcaaaataattcagaagta

SEQ ID NO: 608125 - DNA, 20 bp, Artificial Sequence
  chemically synthesized
gaagtaaactgctttagaca

SEQ ID NO: 608126 - DNA, 20 bp, Artificial Sequence
  chemically synthesized
tgtaaaaaccacttgtctaa

SEQ ID NO: 608127 - DNA, 20 bp, Artificial Sequence
  chemically synthesized
cacgagatatgtgtattttg

SEQ ID NO: 608128 - DNA, 20 bp, Artificial Sequence
  chemically synthesized
gttttcacgagatatgtgta

SEQ ID NO: 608129 - DNA, 20 bp, Artificial Sequence
  chemically synthesized
gtatatgtcaatttgaaata

SEQ ID NO: 608130 - DNA, 20 bp, Artificial Sequence
  chemically synthesized
tctagaatgaccgtagtcca

SEQ ID NO: 608131 - DNA, 20 bp, Artificial Sequence
  chemically synthesized
aacgggctacatgggaatat

SEQ ID NO: 608132 - DNA, 20 bp, Artificial Sequence
  chemically synthesized
aacataaatattcccatgta

SEQ ID NO: 608133 - DNA, 20 bp, Artificial Sequence
  chemically synthesized
ccatgtagcccgttttggaa

SEQ ID NO: 608134 - DNA, 20 bp, Artificial Sequence
  chemically synthesized
tgaaattagtgtaagtgtag

SEQ ID NO: 608135 - DNA, 20 bp, Artificial Sequence
  chemically synthesized
tggatcaaataacaggaaga

SEQ ID NO: 608136 - DNA, 20 bp, Artificial Sequence
  chemically synthesized
tgatccaagactccttaacc

SEQ ID NO: 608137 - DNA, 20 bp, Artificial Sequence
  chemically synthesized
ttatctagccctttacagaa

SEQ ID NO: 608138 - DNA, 20 bp, Artificial Sequence
  chemically synthesized
tcacttaatgtattgtctcc

SEQ ID NO: 608139 - DNA, 20 bp, Artificial Sequence
  chemically synthesized
aaagttttattggaacacat

SEQ ID NO: 608140 - DNA, 20 bp, Artificial Sequence
  chemically synthesized
tgctacctgatttttgtaaa

SEQ ID NO: 608141 - DNA, 20 bp, Artificial Sequence
  chemically synthesized
agggtgaaaatagacttgct

SEQ ID NO: 608142 - DNA, 20 bp, Artificial Sequence
  chemically synthesized
gtctattttcaccctcaggc

SEQ ID NO: 608143 - DNA, 20 bp, Artificial Sequence
  chemically synthesized
ttgctatctcctgatgatga

SEQ ID NO: 608144 - DNA, 20 bp, Artificial Sequence
  chemically synthesized
acagtgagaagttcagagaa

SEQ ID NO: 608145 - DNA, 20 bp, Artificial Sequence
  chemically synthesized
aatttctctgaacttctcac

SEQ ID NO: 608146 - DNA, 20 bp, Artificial Sequence
  chemically synthesized
tctccaatctctccccctcc

SEQ ID NO: 608147 - DNA, 20 bp, Artificial Sequence
  chemically synthesized
atgagaatcaattggagggg

SEQ ID NO: 608148 - DNA, 20 bp, Artificial Sequence
  chemically synthesized
gcagtgagatttcagagatg

SEQ ID NO: 608149 - DNA, 20 bp, Artificial Sequence
  chemically synthesized
ggtagggcagggggagggca

SEQ ID NO: 608150 - DNA, 20 bp, Artificial Sequence
  chemically synthesized
gcggccactggttttatgca

SEQ ID NO: 608151 - DNA, 20 bp, Artificial Sequence
  chemically synthesized
aaagtttcccgaatgcggcc

SEQ ID NO: 608152 - DNA, 20 bp, Artificial Sequence
  chemically synthesized
actccaaagtgaggccgact

SEQ ID NO: 608153 - DNA, 20 bp, Artificial Sequence
  chemically synthesized
tccagaacctgaatttgacc

SEQ ID NO: 608154 - DNA, 20 bp, Artificial Sequence
  chemically synthesized
tagtgtgtacttgaacttgg

SEQ ID NO: 608155 - DNA, 20 bp, Artificial Sequence
  chemically synthesized
taaggctcacagacaacata

SEQ ID NO: 608156 - DNA, 20 bp, Artificial Sequence
  chemically synthesized
taaaaacaatgaggcagtga

SEQ ID NO: 608157 - DNA, 20 bp, Artificial Sequence
  chemically synthesized
taaaatcactttcactgcct

SEQ ID NO: 608158 - DNA, 20 bp, Artificial Sequence
  chemically synthesized
gagaactaacaacaataaag

SEQ ID NO: 608159 - DNA, 20 bp, Artificial Sequence
  chemically synthesized
ataaagaggagtttggttca

SEQ ID NO: 608160 - DNA, 20 bp, Artificial Sequence
  chemically synthesized
tcacctccttaacatacacc

SEQ ID NO: 608161 - DNA, 20 bp, Artificial Sequence
  chemically synthesized
tccttaacatacaccagttg

SEQ ID NO: 608162 - DNA, 20 bp, Artificial Sequence
  chemically synthesized
cacatatatcactaaattct

SEQ ID NO: 608163 - DNA, 20 bp, Artificial Sequence
  chemically synthesized
ttatgaaggatataccacat

SEQ ID NO: 608164 - DNA, 20 bp, Artificial Sequence
  chemically synthesized
gctacccattagttccccca

SEQ ID NO: 608165 - DNA, 20 bp, Artificial Sequence
  chemically synthesized
tccctatgggggaactaatg

SEQ ID NO: 608166 - DNA, 20 bp, Artificial Sequence
  chemically synthesized
ctctacttcttgggcatcta

SEQ ID NO: 608167 - DNA, 20 bp, Artificial Sequence
  chemically synthesized
catctatagtgcttctgtgg

SEQ ID NO: 608168 - DNA, 20 bp, Artificial Sequence
  chemically synthesized
ttaggaagacaattataagg

SEQ ID NO: 608169 - DNA, 20 bp, Artificial Sequence
  chemically synthesized
aaataaactgtctactgtcg

SEQ ID NO: 608170 - DNA, 20 bp, Artificial Sequence
  chemically synthesized
tcggaagcctcacgacagta

SEQ ID NO: 608171 - DNA, 20 bp, Artificial Sequence
  chemically synthesized
gacatacagtataacatact

SEQ ID NO: 608172 - DNA, 20 bp, Artificial Sequence
  chemically synthesized
caagaaatgacacaaactcc

SEQ ID NO: 608173 - DNA, 20 bp, Artificial Sequence
  chemically synthesized
cagtaagtgaaataaacaag

SEQ ID NO: 608174 - DNA, 20 bp, Artificial Sequence
  chemically synthesized
actgccttcttcaatgcagt

SEQ ID NO: 608175 - DNA, 20 bp, Artificial Sequence
  chemically synthesized
ttggcttccctattcaagga

SEQ ID NO: 608176 - DNA, 20 bp, Artificial Sequence
  chemically synthesized
ttgaataggaaaggaatagg

SEQ ID NO: 608177 - DNA, 20 bp, Artificial Sequence
  chemically synthesized
ttaattcttgggaagactct

SEQ ID NO: 608178 - DNA, 20 bp, Artificial Sequence
  chemically synthesized
gataaaattgaagaactttc

SEQ ID NO: 608179 - DNA, 20 bp, Artificial Sequence
  chemically synthesized
ttggctcctaataggagtaa

SEQ ID NO: 608180 - DNA, 20 bp, Artificial Sequence
  chemically synthesized
acagagatacagaccctgaa

SEQ ID NO: 608181 - DNA, 20 bp, Artificial Sequence
  chemically synthesized
ctctgtgtcccatagacaac

SEQ ID NO: 608182 - DNA, 20 bp, Artificial Sequence
  chemically synthesized
gttctatgaaccctaagatc

SEQ ID NO: 608183 - DNA, 20 bp, Artificial Sequence
  chemically synthesized
taaaagtatgaaaccttttg

SEQ ID NO: 608184 - DNA, 20 bp, Artificial Sequence
  chemically synthesized
caagagatggaaacttatca

SEQ ID NO: 608185 - DNA, 20 bp, Artificial Sequence
  chemically synthesized
tcacttagcccaccctgatt

SEQ ID NO: 608186 - DNA, 20 bp, Artificial Sequence
  chemically synthesized
tgctcttatcacttagccca

SEQ ID NO: 608187 - DNA, 20 bp, Artificial Sequence
  chemically synthesized
taagtgataagagcaatcac

SEQ ID NO: 608188 - DNA, 20 bp, Artificial Sequence
  chemically synthesized
tagtatcttcaccaaatcag

SEQ ID NO: 608189 - DNA, 20 bp, Artificial Sequence
  chemically synthesized
gatttggtgaagatactaga

SEQ ID NO: 608190 - DNA, 20 bp, Artificial Sequence
  chemically synthesized
gttctgtttcgcttttctgc

SEQ ID NO: 608191 - DNA, 20 bp, Artificial Sequence
  chemically synthesized
tcacctcacttagggttctg

SEQ ID NO: 608192 - DNA, 20 bp, Artificial Sequence
  chemically synthesized
tatgttcacctcacttaggg

SEQ ID NO: 608193 - DNA, 20 bp, Artificial Sequence
  chemically synthesized
tgtctctgtttatgacttta

SEQ ID NO: 608194 - DNA, 20 bp, Artificial Sequence
  chemically synthesized
aactttcagtgaggttttgt

SEQ ID NO: 608195 - DNA, 20 bp, Artificial Sequence
  chemically synthesized
aacagagacaaaacctcact

SEQ ID NO: 608196 - DNA, 20 bp, Artificial Sequence
  chemically synthesized
ttataagtgaaaactttcag

SEQ ID NO: 608197 - DNA, 20 bp, Artificial Sequence
  chemically synthesized
tttcacttataatattttta

SEQ ID NO: 608198 - DNA, 20 bp, Artificial Sequence
  chemically synthesized
taaatggaaagaaatgtcaa

SEQ ID NO: 608199 - DNA, 20 bp, Artificial Sequence
  chemically synthesized
ttaacaatattaagaaagag

SEQ ID NO: 608200 - DNA, 20 bp, Artificial Sequence
  chemically synthesized
tttcttaatattgttaatac

SEQ ID NO: 608201 - DNA, 20 bp, Artificial Sequence
  chemically synthesized
taatacagaagcttctcctt

SEQ ID NO: 608202 - DNA, 20 bp, Artificial Sequence
  chemically synthesized
aaaccttcaatctttgaagg

SEQ ID NO: 608203 - DNA, 20 bp, Artificial Sequence
  chemically synthesized
aagcttctccttcaaagatt

SEQ ID NO: 608204 - DNA, 20 bp, Artificial Sequence
  chemically synthesized
ttcaaagattgaaggttttt

SEQ ID NO: 608205 - DNA, 20 bp, Artificial Sequence
  chemically synthesized
atctcatggcaaagtagttg

SEQ ID NO: 608206 - DNA, 20 bp, Artificial Sequence
  chemically synthesized
agaacatttctgtgtagtaa

SEQ ID NO: 608207 - DNA, 20 bp, Artificial Sequence
  chemically synthesized
aaaatagatttcctaggtta

SEQ ID NO: 608208 - DNA, 20 bp, Artificial Sequence
  chemically synthesized
ggttactctgattttgctga

SEQ ID NO: 608209 - DNA, 20 bp, Artificial Sequence
  chemically synthesized
tatgaacactaaagtgtgtt

SEQ ID NO: 608210 - DNA, 20 bp, Artificial Sequence
  chemically synthesized
ctatgtctatgaacactaaa

SEQ ID NO: 608211 - DNA, 20 bp, Artificial Sequence
  chemically synthesized
caggcctctctcttatttat

SEQ ID NO: 608212 - DNA, 20 bp, Artificial Sequence
  chemically synthesized
ttatgcatcctattaaggat

SEQ ID NO: 608213 - DNA, 20 bp, Artificial Sequence
  chemically synthesized
actttaccaatttttaatat

SEQ ID NO: 608214 - DNA, 20 bp, Artificial Sequence
  chemically synthesized
acctgtatattaaaaattgg

SEQ ID NO: 608215 - DNA, 20 bp, Artificial Sequence
  chemically synthesized
acatattataatgtctcttc

SEQ ID NO: 608216 - DNA, 20 bp, Artificial Sequence
  chemically synthesized
ggtgctatccactgtgtaga

SEQ ID NO: 608217 - DNA, 20 bp, Artificial Sequence
  chemically synthesized
gaactgaagtatagtgaatt

SEQ ID NO: 608218 - DNA, 20 bp, Artificial Sequence
  chemically synthesized
ttaaattagatgatttagtg

SEQ ID NO: 608219 - DNA, 20 bp, Artificial Sequence
  chemically synthesized
ttatgttgtgaggttaaatt

SEQ ID NO: 608220 - DNA, 20 bp, Artificial Sequence
  chemically synthesized
atttaacctcacaacataag

SEQ ID NO: 608221 - DNA, 20 bp, Artificial Sequence
  chemically synthesized
ctacattttactatgaggag

SEQ ID NO: 608222 - DNA, 20 bp, Artificial Sequence
  chemically synthesized
tattagctcttcgaccttgg

SEQ ID NO: 608223 - DNA, 20 bp, Artificial Sequence
  chemically synthesized
atactgaattcagttcccat

SEQ ID NO: 608224 - DNA, 20 bp, Artificial Sequence
  chemically synthesized
gtctggcaacaagttaatat

SEQ ID NO: 608225 - DNA, 20 bp, Artificial Sequence
  chemically synthesized
taaatctagctatctctggg

SEQ ID NO: 608226 - DNA, 20 bp, Artificial Sequence
  chemically synthesized
agaaacatttcccagagata

SEQ ID NO: 608227 - DNA, 20 bp, Artificial Sequence
  chemically synthesized
aaatataacacattattata

SEQ ID NO: 608228 - DNA, 20 bp, Artificial Sequence
  chemically synthesized
catacactcacagaattgtg

SEQ ID NO: 608229 - DNA, 20 bp, Artificial Sequence
  chemically synthesized
acagaattgtggatagattt

SEQ ID NO: 608230 - DNA, 20 bp, Artificial Sequence
  chemically synthesized
aaatttctgtgaccaatttt

SEQ ID NO: 608231 - DNA, 20 bp, Artificial Sequence
  chemically synthesized
accaattttatatgtttata

SEQ ID NO: 608232 - DNA, 20 bp, Artificial Sequence
  chemically synthesized
taatttttgcattctaaaca

SEQ ID NO: 608233 - DNA, 20 bp, Artificial Sequence
  chemically synthesized
tatttttatatagacaagct

SEQ ID NO: 608234 - DNA, 20 bp, Artificial Sequence
  chemically synthesized
aaaataaaaaatgaactacc

SEQ ID NO: 608235 - DNA, 20 bp, Artificial Sequence
  chemically synthesized
cattgtatctatattttatg

SEQ ID NO: 608236 - DNA, 20 bp, Artificial Sequence
  chemically synthesized
gaaatatgcagcaaatatta

SEQ ID NO: 608237 - DNA, 20 bp, Artificial Sequence
  chemically synthesized
taagttttgacaggtttcgg

SEQ ID NO: 608238 - DNA, 20 bp, Artificial Sequence
  chemically synthesized
tgggtgtgttttaagttttg

SEQ ID NO: 608239 - DNA, 20 bp, Artificial Sequence
  chemically synthesized
aatgtaccaatgggtgtgtt

SEQ ID NO: 608240 - DNA, 20 bp, Artificial Sequence
  chemically synthesized
aagttgaaatgtaccaatgg

SEQ ID NO: 608241 - DNA, 20 bp, Artificial Sequence
  chemically synthesized
tttattctgtttctttccat

SEQ ID NO: 608242 - DNA, 20 bp, Artificial Sequence
  chemically synthesized
caaaaaggtatttctgttta

SEQ ID NO: 608243 - DNA, 20 bp, Artificial Sequence
  chemically synthesized
actatgtgacaaaaaggtat

SEQ ID NO: 608244 - DNA, 20 bp, Artificial Sequence
  chemically synthesized
acatagtgagataatcaata

SEQ ID NO: 608245 - DNA, 20 bp, Artificial Sequence
  chemically synthesized
aactttgtttttaaacatag

SEQ ID NO: 608246 - DNA, 20 bp, Artificial Sequence
  chemically synthesized
atcaatactatgtttaaaaa

SEQ ID NO: 608247 - DNA, 20 bp, Artificial Sequence
  chemically synthesized
attttgaaaatataaagaaa

SEQ ID NO: 608248 - DNA, 20 bp, Artificial Sequence
  chemically synthesized
agtggaatcagctaccatat

SEQ ID NO: 608249 - DNA, 20 bp, Artificial Sequence
  chemically synthesized
atgcaaatcaagaatatggt

SEQ ID NO: 608250 - DNA, 20 bp, Artificial Sequence
  chemically synthesized
acttccaaatagaatatgta

SEQ ID NO: 608251 - DNA, 20 bp, Artificial Sequence
  chemically synthesized
actcagtacatattctattt

SEQ ID NO: 608252 - DNA, 20 bp, Artificial Sequence
  chemically synthesized
ctatttggaagtttttatat

SEQ ID NO: 608253 - DNA, 20 bp, Artificial Sequence
  chemically synthesized
agctgccgtactttcatatt

SEQ ID NO: 608254 - DNA, 20 bp, Artificial Sequence
  chemically synthesized
attttaatttacctttatgt

SEQ ID NO: 608255 - DNA, 20 bp, Artificial Sequence
  chemically synthesized
tccagatttacagtttctgc

SEQ ID NO: 608256 - DNA, 20 bp, Artificial Sequence
  chemically synthesized
tggcttccctattccagatt

SEQ ID NO: 608257 - DNA, 20 bp, Artificial Sequence
  chemically synthesized
accttaaatggcttccctat

SEQ ID NO: 608258 - DNA, 20 bp, Artificial Sequence
  chemically synthesized
acgatttctcttttacctta

SEQ ID NO: 608259 - DNA, 20 bp, Artificial Sequence
  chemically synthesized
taaaagagaaatcgtcacaa

SEQ ID NO: 608260 - DNA, 20 bp, Artificial Sequence
  chemically synthesized
ggaaattctaagcatacttg

SEQ ID NO: 608261 - DNA, 20 bp, Artificial Sequence
  chemically synthesized
tcacaagtatgcttagaatt

SEQ ID NO: 608262 - DNA, 20 bp, Artificial Sequence
  chemically synthesized
acaaaatacaatcctaccta

SEQ ID NO: 608263 - DNA, 20 bp, Artificial Sequence
  chemically synthesized
ttatctgaaaagcttgatag

SEQ ID NO: 608264 - DNA, 20 bp, Artificial Sequence
  chemically synthesized
aggcacaatgttattatctg

SEQ ID NO: 608265 - DNA, 20 bp, Artificial Sequence
  chemically synthesized
cctgaaagtacatgcatgac

SEQ ID NO: 608266 - DNA, 20 bp, Artificial Sequence
  chemically synthesized
acatgcatgacatttgtttg

SEQ ID NO: 608267 - DNA, 20 bp, Artificial Sequence
  chemically synthesized
atgacatttgtttgaaagga

SEQ ID NO: 608268 - DNA, 20 bp, Artificial Sequence
  chemically synthesized
cgtgttaataaatttgtaaa

SEQ ID NO: 608269 - DNA, 20 bp, Artificial Sequence
  chemically synthesized
tgttccgtatagttggccaa

SEQ ID NO: 608270 - DNA, 20 bp, Artificial Sequence
  chemically synthesized
aaactactcccagaataatt

SEQ ID NO: 608271 - DNA, 20 bp, Artificial Sequence
  chemically synthesized
aaactcccaattattctggg

SEQ ID NO: 608272 - DNA, 20 bp, Artificial Sequence
  chemically synthesized
ctgggagtagtttatcagag

SEQ ID NO: 608273 - DNA, 20 bp, Artificial Sequence
  chemically synthesized
tgctgacaaggagcaaattt

SEQ ID NO: 608274 - DNA, 20 bp, Artificial Sequence
  chemically synthesized
ccacagtatacattaaatat

SEQ ID NO: 608275 - DNA, 20 bp, Artificial Sequence
  chemically synthesized
atactgtggcaattttcctt

SEQ ID NO: 608276 - DNA, 20 bp, Artificial Sequence
  chemically synthesized
aaatattgactgaattgact

SEQ ID NO: 608277 - DNA, 20 bp, Artificial Sequence
  chemically synthesized
atccaacagacctcaaagtc

SEQ ID NO: 608278 - DNA, 20 bp, Artificial Sequence
  chemically synthesized
cttcctttgcaaatttggtt

SEQ ID NO: 608279 - DNA, 20 bp, Artificial Sequence
  chemically synthesized
catcaatcttcctttgcaaa

SEQ ID NO: 608280 - DNA, 20 bp, Artificial Sequence
  chemically synthesized
ctgaaaaccaaatttgcaaa

SEQ ID NO: 608281 - DNA, 20 bp, Artificial Sequence
  chemically synthesized
agctttctagtagactccac

SEQ ID NO: 608282 - DNA, 20 bp, Artificial Sequence
  chemically synthesized
atcttgagtggagtctacta

SEQ ID NO: 608283 - DNA, 20 bp, Artificial Sequence
  chemically synthesized
tgagtggagtctactagaaa

SEQ ID NO: 608284 - DNA, 20 bp, Artificial Sequence
  chemically synthesized
tggagtctactagaaagctt

SEQ ID NO: 608285 - DNA, 20 bp, Artificial Sequence
  chemically synthesized
actagaaagcttgtttgatt

SEQ ID NO: 608286 - DNA, 20 bp, Artificial Sequence
  chemically synthesized
attggcaagcctaaaatcaa

SEQ ID NO: 608287 - DNA, 20 bp, Artificial Sequence
  chemically synthesized
atactaaaagagccttaatt

SEQ ID NO: 608288 - DNA, 20 bp, Artificial Sequence
  chemically synthesized
gatataacacattattattt

SEQ ID NO: 608289 - DNA, 20 bp, Artificial Sequence
  chemically synthesized
atgtgttatatccattatta

SEQ ID NO: 608290 - DNA, 20 bp, Artificial Sequence
  chemically synthesized
tagacaaagataagtttacc

SEQ ID NO: 608291 - DNA, 20 bp, Artificial Sequence
  chemically synthesized
agtagataggctagacaaag

SEQ ID NO: 608292 - DNA, 20 bp, Artificial Sequence
  chemically synthesized
tttgtaaaaaattatctatt

SEQ ID NO: 608293 - DNA, 20 bp, Artificial Sequence
  chemically synthesized
acttcatttattttatagag

SEQ ID NO: 608294 - DNA, 20 bp, Artificial Sequence
  chemically synthesized
agtgacagagccagaattcc

SEQ ID NO: 608295 - DNA, 20 bp, Artificial Sequence
  chemically synthesized
ctgtcacttagtacaaatag

SEQ ID NO: 608296 - DNA, 20 bp, Artificial Sequence
  chemically synthesized
aatagtgcctggtcctttgt

SEQ ID NO: 608297 - DNA, 20 bp, Artificial Sequence
  chemically synthesized
gaatgagaacttagatttct

SEQ ID NO: 608298 - DNA, 20 bp, Artificial Sequence
  chemically synthesized
catgattcactgaatgagaa

SEQ ID NO: 608299 - DNA, 20 bp, Artificial Sequence
  chemically synthesized
tgattagcatgccttcagtg

SEQ ID NO: 608300 - DNA, 20 bp, Artificial Sequence
  chemically synthesized
ccttctattttacttatttc

SEQ ID NO: 608301 - DNA, 20 bp, Artificial Sequence
  chemically synthesized
tagtactttcaattcccctt

SEQ ID NO: 608302 - DNA, 20 bp, Artificial Sequence
  chemically synthesized
tagggaaaatatcattgaga

SEQ ID NO: 608303 - DNA, 20 bp, Artificial Sequence
  chemically synthesized
tcctttctctatgtttcttc

SEQ ID NO: 608304 - DNA, 20 bp, Artificial Sequence
  chemically synthesized
acaatcacctcctcctttct

SEQ ID NO: 608305 - DNA, 20 bp, Artificial Sequence
  chemically synthesized
agaaacatagagaaaggagg

SEQ ID NO: 608306 - DNA, 20 bp, Artificial Sequence
  chemically synthesized
aaaggaggaggtgattgtgc

SEQ ID NO: 608307 - DNA, 20 bp, Artificial Sequence
  chemically synthesized
cattcagtaaaatgcagtcc

SEQ ID NO: 608308 - DNA, 20 bp, Artificial Sequence
  chemically synthesized
gaatgtctggcaaggcatgg

SEQ ID NO: 608309 - DNA, 20 bp, Artificial Sequence
  chemically synthesized
aggttttcagcagaagagtg

SEQ ID NO: 608310 - DNA, 20 bp, Artificial Sequence
  chemically synthesized
gaagagtgatgtgatttgcc

SEQ ID NO: 608311 - DNA, 20 bp, Artificial Sequence
  chemically synthesized
caagaccatctggcagacaa

SEQ ID NO: 608312 - DNA, 20 bp, Artificial Sequence
  chemically synthesized
gtaaggcaaggccaaagcag

SEQ ID NO: 608313 - DNA, 20 bp, Artificial Sequence
  chemically synthesized
ggcaaggccaaagcaggcag

SEQ ID NO: 608314 - DNA, 20 bp, Artificial Sequence
  chemically synthesized
atagccttttaaacaagcct

SEQ ID NO: 608315 - DNA, 20 bp, Artificial Sequence
  chemically synthesized
catgtaagtagtcagaagtg

SEQ ID NO: 608316 - DNA, 20 bp, Artificial Sequence
  chemically synthesized
ctggttaaggtggacctggc

SEQ ID NO: 608317 - DNA, 20 bp, Artificial Sequence
  chemically synthesized
aatggcgtgaacccgggagg

SEQ ID NO: 608318 - DNA, 20 bp, Artificial Sequence
  chemically synthesized
ttttgtatttttagtagaga

SEQ ID NO: 608319 - DNA, 20 bp, Artificial Sequence
  chemically synthesized
cgcctcggcctctcaaagtg

SEQ ID NO: 608320 - DNA, 20 bp, Artificial Sequence
  chemically synthesized
ccgcatccggccaaacctgg

SEQ ID NO: 608321 - DNA, 20 bp, Artificial Sequence
  chemically synthesized
ttgttgattagaaaactatg

SEQ ID NO: 608322 - DNA, 20 bp, Artificial Sequence
  chemically synthesized
ttctttctcacacctgatgt

SEQ ID NO: 608323 - DNA, 20 bp, Artificial Sequence
  chemically synthesized
aggtgtgagaaagaacaaga

SEQ ID NO: 608324 - DNA, 20 bp, Artificial Sequence
  chemically synthesized
aatagtttttcctgtgtcag

SEQ ID NO: 608325 - DNA, 20 bp, Artificial Sequence
  chemically synthesized
acacccacatctgcttcgtc

SEQ ID NO: 608326 - DNA, 20 bp, Artificial Sequence
  chemically synthesized
ctaaatttactaacacccac

SEQ ID NO: 608327 - DNA, 20 bp, Artificial Sequence
  chemically synthesized
cagatgtgggtgttagtaaa

SEQ ID NO: 608328 - DNA, 20 bp, Artificial Sequence
  chemically synthesized
atgtataaaaagttgtgtat

SEQ ID NO: 608329 - DNA, 20 bp, Artificial Sequence
  chemically synthesized
aaaagttgtgtatctaagtt

SEQ ID NO: 608330 - DNA, 20 bp, Artificial Sequence
  chemically synthesized
cccaatgtttacccccagct

SEQ ID NO: 608331 - DNA, 20 bp, Artificial Sequence
  chemically synthesized
gtctgtaagttgatgcctcc

SEQ ID NO: 608332 - DNA, 20 bp, Artificial Sequence
  chemically synthesized
tcctgtttttctagcatctg

SEQ ID NO: 608333 - DNA, 20 bp, Artificial Sequence
  chemically synthesized
tttcttcctgtttttctagc

SEQ ID NO: 608334 - DNA, 20 bp, Artificial Sequence
  chemically synthesized
ccacacattccaggttttct

SEQ ID NO: 608335 - DNA, 20 bp, Artificial Sequence
  chemically synthesized
tttctaaggcaccacacatt

SEQ ID NO: 608336 - DNA, 20 bp, Artificial Sequence
  chemically synthesized
acatgcatttactttcccct

SEQ ID NO: 608337 - DNA, 20 bp, Artificial Sequence
  chemically synthesized
aagtaacttaagtaaatgta

SEQ ID NO: 608338 - DNA, 20 bp, Artificial Sequence
  chemically synthesized
tacagtatgctagccacaat

SEQ ID NO: 608339 - DNA, 20 bp, Artificial Sequence
  chemically synthesized
gcatactgtaaaaacttaat

SEQ ID NO: 608340 - DNA, 20 bp, Artificial Sequence
  chemically synthesized
atttgttcaacaaacattta

SEQ ID NO: 608341 - DNA, 20 bp, Artificial Sequence
  chemically synthesized
cggtacactacacttctcta

SEQ ID NO: 608342 - DNA, 20 bp, Artificial Sequence
  chemically synthesized
aaagaatttgagtctagata

SEQ ID NO: 608343 - DNA, 20 bp, Artificial Sequence
  chemically synthesized
taacttagcttaccaacatt

SEQ ID NO: 608344 - DNA, 20 bp, Artificial Sequence
  chemically synthesized
tatattattaacatgtttaa

SEQ ID NO: 608345 - DNA, 20 bp, Artificial Sequence
  chemically synthesized
atgctgtatgtatattatta

SEQ ID NO: 608346 - DNA, 20 bp, Artificial Sequence
  chemically synthesized
ggcacaataacaaaatttgt

SEQ ID NO: 608347 - DNA, 20 bp, Artificial Sequence
  chemically synthesized
tattaattgaatacataaga

SEQ ID NO: 608348 - DNA, 20 bp, Artificial Sequence
  chemically synthesized
atactaaaatgagcacatat

SEQ ID NO: 608349 - DNA, 20 bp, Artificial Sequence
  chemically synthesized
atatccattgtgatctaagt

SEQ ID NO: 608350 - DNA, 20 bp, Artificial Sequence
  chemically synthesized
tgtaggtttcctccactgga

SEQ ID NO: 608351 - DNA, 20 bp, Artificial Sequence
  chemically synthesized
catatattttttgcttactt

SEQ ID NO: 608352 - DNA, 20 bp, Artificial Sequence
  chemically synthesized
cttatgagagcacatatatt

SEQ ID NO: 608353 - DNA, 20 bp, Artificial Sequence
  chemically synthesized
tcatatttcgcttccctttt

SEQ ID NO: 608354 - DNA, 20 bp, Artificial Sequence
  chemically synthesized
ttcctacttctcagttcata

SEQ ID NO: 608355 - DNA, 20 bp, Artificial Sequence
  chemically synthesized
gccatgtctaatacactcag

SEQ ID NO: 608356 - DNA, 20 bp, Artificial Sequence
  chemically synthesized
cactcagcgttgtttcatca

SEQ ID NO: 608357 - DNA, 20 bp, Artificial Sequence
  chemically synthesized
gtttgactgtcaattccccc

SEQ ID NO: 608358 - DNA, 20 bp, Artificial Sequence
  chemically synthesized
ataaatgtagtaccaatgtt

SEQ ID NO: 608359 - DNA, 20 bp, Artificial Sequence
  chemically synthesized
atctccccctctttccctac

SEQ ID NO: 608360 - DNA, 20 bp, Artificial Sequence
  chemically synthesized
aaggacagtacagttgttga

SEQ ID NO: 608361 - DNA, 20 bp, Artificial Sequence
  chemically synthesized
gggatacatgtgcagaacgt

SEQ ID NO: 608362 - DNA, 20 bp, Artificial Sequence
  chemically synthesized
cataaatatacatgtgctat

SEQ ID NO: 608363 - DNA, 20 bp, Artificial Sequence
  chemically synthesized
tgcacccatcaacccgtcat

SEQ ID NO: 608364 - DNA, 20 bp, Artificial Sequence
  chemically synthesized
ggataaatacctaatgcatg

SEQ ID NO: 608365 - DNA, 20 bp, Artificial Sequence
  chemically synthesized
atgagtgagaacatgcggta

SEQ ID NO: 608366 - DNA, 20 bp, Artificial Sequence
  chemically synthesized
atttggttttctgttcctgg

SEQ ID NO: 608367 - DNA, 20 bp, Artificial Sequence
  chemically synthesized
ggttttctgttcctgggtta

SEQ ID NO: 608368 - DNA, 20 bp, Artificial Sequence
  chemically synthesized
tgggttagtttgcttagaat

SEQ ID NO: 608369 - DNA, 20 bp, Artificial Sequence
  chemically synthesized
ttttgttattttagtagaga

SEQ ID NO: 608370 - DNA, 20 bp, Artificial Sequence
  chemically synthesized
gcacccctgcctcccaggtt

SEQ ID NO: 608371 - DNA, 20 bp, Artificial Sequence
  chemically synthesized
gctgtttttttttttttgga

SEQ ID NO: 608372 - DNA, 20 bp, Artificial Sequence
  chemically synthesized
aaccttgctttgtctttgct

SEQ ID NO: 608373 - DNA, 20 bp, Artificial Sequence
  chemically synthesized
aacagcaagcaaagacaaag

SEQ ID NO: 608374 - DNA, 20 bp, Artificial Sequence
  chemically synthesized
ctcacaaaaccttgctttgt

SEQ ID NO: 608375 - DNA, 20 bp, Artificial Sequence
  chemically synthesized
gaattccttgcctcacaaaa

SEQ ID NO: 608376 - DNA, 20 bp, Artificial Sequence
  chemically synthesized
gagggattcttgggtcatat

SEQ ID NO: 608377 - DNA, 20 bp, Artificial Sequence
  chemically synthesized
tttgtgtatatgcccagaag

SEQ ID NO: 608378 - DNA, 20 bp, Artificial Sequence
  chemically synthesized
acacaaccttgtaaagatat

SEQ ID NO: 608379 - DNA, 20 bp, Artificial Sequence
  chemically synthesized
catatcttggctactgtgaa

SEQ ID NO: 608380 - DNA, 20 bp, Artificial Sequence
  chemically synthesized
cagtagccaagatatggaaa

SEQ ID NO: 608381 - DNA, 20 bp, Artificial Sequence
  chemically synthesized
tttatccatggatacttaaa

SEQ ID NO: 608382 - DNA, 20 bp, Artificial Sequence
  chemically synthesized
acgtttaagtatccatggat

SEQ ID NO: 608383 - DNA, 20 bp, Artificial Sequence
  chemically synthesized
catccatgttgtagcaaatg

SEQ ID NO: 608384 - DNA, 20 bp, Artificial Sequence
  chemically synthesized
tagagctcattgatgtcatc

SEQ ID NO: 608385 - DNA, 20 bp, Artificial Sequence
  chemically synthesized
taaactgaaagtcaaatgta

SEQ ID NO: 608386 - DNA, 20 bp, Artificial Sequence
  chemically synthesized
aaatcaccctacatttgact

SEQ ID NO: 608387 - DNA, 20 bp, Artificial Sequence
  chemically synthesized
ctggttattactggcccgga

SEQ ID NO: 608388 - DNA, 20 bp, Artificial Sequence
  chemically synthesized
aggacagagacagttgtctc

SEQ ID NO: 608389 - DNA, 20 bp, Artificial Sequence
  chemically synthesized
ctcatggaactcacactttt

SEQ ID NO: 608390 - DNA, 20 bp, Artificial Sequence
  chemically synthesized
ttcaatataatttatttatt

SEQ ID NO: 608391 - DNA, 20 bp, Artificial Sequence
  chemically synthesized
ataaattatattgaacaaaa

SEQ ID NO: 608392 - DNA, 20 bp, Artificial Sequence
  chemically synthesized
gccactttatgaataaattg

SEQ ID NO: 608393 - DNA, 20 bp, Artificial Sequence
  chemically synthesized
gctgtgtgacacgataaatt

SEQ ID NO: 608394 - DNA, 20 bp, Artificial Sequence
  chemically synthesized
tatttgtactcccttgttgg

SEQ ID NO: 608395 - DNA, 20 bp, Artificial Sequence
  chemically synthesized
tggaccttaagtgccattct

SEQ ID NO: 608396 - DNA, 20 bp, Artificial Sequence
  chemically synthesized
acaatatttagtgcagtatt

SEQ ID NO: 608397 - DNA, 20 bp, Artificial Sequence
  chemically synthesized
tctaatactgcactaaatat

SEQ ID NO: 608398 - DNA, 20 bp, Artificial Sequence
  chemically synthesized
tgacccctaggatttccatc

SEQ ID NO: 608399 - DNA, 20 bp, Artificial Sequence
  chemically synthesized
ctgtcacataatgttgaccc

SEQ ID NO: 608400 - DNA, 20 bp, Artificial Sequence
  chemically synthesized
tgacactgggtcggctacac

SEQ ID NO: 608401 - DNA, 20 bp, Artificial Sequence
  chemically synthesized
gcttaaaagttctcaccatt

SEQ ID NO: 608402 - DNA, 20 bp, Artificial Sequence
  chemically synthesized
gttctcaccattctctgctt

SEQ ID NO: 608403 - DNA, 20 bp, Artificial Sequence
  chemically synthesized
gtgttttttttttttttttt

SEQ ID NO: 608404 - DNA, 20 bp, Artificial Sequence
  chemically synthesized
aagtagctcatcaagatgca

SEQ ID NO: 608405 - DNA, 20 bp, Artificial Sequence
  chemically synthesized
cgcctcggcctcccaaagtg

SEQ ID NO: 608406 - DNA, 20 bp, Artificial Sequence
  chemically synthesized
tttttttttttaaatagtga

SEQ ID NO: 608407 - DNA, 20 bp, Artificial Sequence
  chemically synthesized
tgccttagcctcactagtag

SEQ ID NO: 608408 - DNA, 20 bp, Artificial Sequence
  chemically synthesized
tagtgaggctaaggcagaag

SEQ ID NO: 608409 - DNA, 20 bp, Artificial Sequence
  chemically synthesized
aacctccgcctcctgggctc

SEQ ID NO: 608410 - DNA, 20 bp, Artificial Sequence
  chemically synthesized
gaggcggaggttgcagtgag

SEQ ID NO: 608411 - DNA, 20 bp, Artificial Sequence
  chemically synthesized
gcaaatgggccagcaatttg

SEQ ID NO: 608412 - DNA, 20 bp, Artificial Sequence
  chemically synthesized
gcatttcaaattgctggccc

SEQ ID NO: 608413 - DNA, 20 bp, Artificial Sequence
  chemically synthesized
aaatgtgattcaaaaatata

SEQ ID NO: 608414 - DNA, 20 bp, Artificial Sequence
  chemically synthesized
tgagggtgtttaacaatgaa

SEQ ID NO: 608415 - DNA, 20 bp, Artificial Sequence
  chemically synthesized
catatgagtgtatacactga

SEQ ID NO: 608416 - DNA, 20 bp, Artificial Sequence
  chemically synthesized
gtaaatagtctgagttttga

SEQ ID NO: 608417 - DNA, 20 bp, Artificial Sequence
  chemically synthesized
gaaaaacatcagtaaatagt

SEQ ID NO: 608418 - DNA, 20 bp, Artificial Sequence
  chemically synthesized
tcaaaactcagactatttac

SEQ ID NO: 608419 - DNA, 20 bp, Artificial Sequence
  chemically synthesized
cattattcagtcatgagaaa

SEQ ID NO: 608420 - DNA, 20 bp, Artificial Sequence
  chemically synthesized
atgagaaatcatgtttttga

SEQ ID NO: 608421 - DNA, 20 bp, Artificial Sequence
  chemically synthesized
agaaacaagccctgtcaaaa

SEQ ID NO: 608422 - DNA, 20 bp, Artificial Sequence
  chemically synthesized
gaaatcatgtttttgacagg

SEQ ID NO: 608423 - DNA, 20 bp, Artificial Sequence
  chemically synthesized
tgacagggcttgtttctcaa

SEQ ID NO: 608424 - DNA, 20 bp, Artificial Sequence
  chemically synthesized
taggactctgtctcctgatg

SEQ ID NO: 608425 - DNA, 20 bp, Artificial Sequence
  chemically synthesized
aatagtggaattccagcagc

SEQ ID NO: 608426 - DNA, 20 bp, Artificial Sequence
  chemically synthesized
aaaataagtatcaggcggca

SEQ ID NO: 608427 - DNA, 20 bp, Artificial Sequence
  chemically synthesized
gccgcctgatacttatttta

SEQ ID NO: 608428 - DNA, 20 bp, Artificial Sequence
  chemically synthesized
cactggaacagtttaacatg

SEQ ID NO: 608429 - DNA, 20 bp, Artificial Sequence
  chemically synthesized
gacatcactggaacagttta

SEQ ID NO: 608430 - DNA, 20 bp, Artificial Sequence
  chemically synthesized
agagaccatgacatcactgg

SEQ ID NO: 608431 - DNA, 20 bp, Artificial Sequence
  chemically synthesized
ctctgataaaacttgaactt

SEQ ID NO: 608432 - DNA, 20 bp, Artificial Sequence
  chemically synthesized
aaaaaaaaaatctttcaagt

SEQ ID NO: 608433 - DNA, 20 bp, Artificial Sequence
  chemically synthesized
tagtaagtgattattattag

SEQ ID NO: 608434 - DNA, 20 bp, Artificial Sequence
  chemically synthesized
aacatactcccatttttagt

SEQ ID NO: 608435 - DNA, 20 bp, Artificial Sequence
  chemically synthesized
agtatgttagttaaatacta

SEQ ID NO: 608436 - DNA, 20 bp, Artificial Sequence
  chemically synthesized
ttcagcatacagcttcgata

SEQ ID NO: 608437 - DNA, 20 bp, Artificial Sequence
  chemically synthesized
aatgtaatgaacattcagca

SEQ ID NO: 608438 - DNA, 20 bp, Artificial Sequence
  chemically synthesized
atgtggtatcaacctataaa

SEQ ID NO: 608439 - DNA, 20 bp, Artificial Sequence
  chemically synthesized
cacaggaatttacggtgtac

SEQ ID NO: 608440 - DNA, 20 bp, Artificial Sequence
  chemically synthesized
cagagtgtatcatcaaaatt

SEQ ID NO: 608441 - DNA, 20 bp, Artificial Sequence
  chemically synthesized
tagaagaatgatgttaatat

SEQ ID NO: 608442 - DNA, 20 bp, Artificial Sequence
  chemically synthesized
ctttcatcactgaacctcag

SEQ ID NO: 608443 - DNA, 20 bp, Artificial Sequence
  chemically synthesized
attgattaaactttcctcct

SEQ ID NO: 608444 - DNA, 20 bp, Artificial Sequence
  chemically synthesized
ttatgggaaactggaaggag

SEQ ID NO: 608445 - DNA, 20 bp, Artificial Sequence
  chemically synthesized
gaaataatacatagaattac

SEQ ID NO: 608446 - DNA, 20 bp, Artificial Sequence
  chemically synthesized
ccgtaattctatgtattatt

SEQ ID NO: 608447 - DNA, 20 bp, Artificial Sequence
  chemically synthesized
agtatacttgtgtgctgtga

SEQ ID NO: 608448 - DNA, 20 bp, Artificial Sequence
  chemically synthesized
aggggaagggcaactggatc

SEQ ID NO: 608449 - DNA, 20 bp, Artificial Sequence
  chemically synthesized
cctcctcaattcatttgcag

SEQ ID NO: 608450 - DNA, 20 bp, Artificial Sequence
  chemically synthesized
gacatagttaggtacgattt

SEQ ID NO: 608451 - DNA, 20 bp, Artificial Sequence
  chemically synthesized
gaggtgggagacatagttag

SEQ ID NO: 608452 - DNA, 20 bp, Artificial Sequence
  chemically synthesized
caaggacagaatatttgatt

SEQ ID NO: 608453 - DNA, 20 bp, Artificial Sequence
  chemically synthesized
ggttcaaggacagaatattt

SEQ ID NO: 608454 - DNA, 20 bp, Artificial Sequence
  chemically synthesized
aagaggttcaaggacagaat

SEQ ID NO: 608455 - DNA, 20 bp, Artificial Sequence
  chemically synthesized
ctgtccttgaacctcttcaa

SEQ ID NO: 608456 - DNA, 20 bp, Artificial Sequence
  chemically synthesized
tgtgaaatttcatgtacttt

SEQ ID NO: 608457 - DNA, 20 bp, Artificial Sequence
  chemically synthesized
tctccaccctagcccctgca

SEQ ID NO: 608458 - DNA, 20 bp, Artificial Sequence
  chemically synthesized
actgatctgttgataataaa

SEQ ID NO: 608459 - DNA, 20 bp, Artificial Sequence
  chemically synthesized
agctaactgtatttggaaat

SEQ ID NO: 608460 - DNA, 20 bp, Artificial Sequence
  chemically synthesized
aaccctgatttccaaataca

SEQ ID NO: 608461 - DNA, 20 bp, Artificial Sequence
  chemically synthesized
ttcaactcagcatggccctt

SEQ ID NO: 608462 - DNA, 20 bp, Artificial Sequence
  chemically synthesized
gagaggcactttgcctttag

SEQ ID NO: 608463 - DNA, 20 bp, Artificial Sequence
  chemically synthesized
aaaggcaaagtgcctctcca

SEQ ID NO: 608464 - DNA, 20 bp, Artificial Sequence
  chemically synthesized
caggttttgaataacaagtc

SEQ ID NO: 608465 - DNA, 20 bp, Artificial Sequence
  chemically synthesized
taggcaagagaagggcattg

SEQ ID NO: 608466 - DNA, 20 bp, Artificial Sequence
  chemically synthesized
gaggttgaaggacacattgt

SEQ ID NO: 608467 - DNA, 20 bp, Artificial Sequence
  chemically synthesized
cgtcagttcattttgtgact

SEQ ID NO: 608468 - DNA, 20 bp, Artificial Sequence
  chemically synthesized
cgaacagtcacaaaatgaac

SEQ ID NO: 608469 - DNA, 20 bp, Artificial Sequence
  chemically synthesized
tcacaaaatgaactgacgat

SEQ ID NO: 608470 - DNA, 20 bp, Artificial Sequence
  chemically synthesized
tgatgagccttgatagtcaa

SEQ ID NO: 608471 - DNA, 20 bp, Artificial Sequence
  chemically synthesized
accttctgctacctgctaag

SEQ ID NO: 608472 - DNA, 20 bp, Artificial Sequence
  chemically synthesized
taaattatagcttcataaat

SEQ ID NO: 608473 - DNA, 20 bp, Artificial Sequence
  chemically synthesized
aatcctctgggaccataaat

SEQ ID NO: 608474 - DNA, 20 bp, Artificial Sequence
  chemically synthesized
aagctataatttatggtccc

SEQ ID NO: 608475 - DNA, 20 bp, Artificial Sequence
  chemically synthesized
gaggagacagacactcttac

SEQ ID NO: 608476 - DNA, 20 bp, Artificial Sequence
  chemically synthesized
tagatgatcagtaagtactt

SEQ ID NO: 608477 - DNA, 20 bp, Artificial Sequence
  chemically synthesized
tacttgacagattaaattac

SEQ ID NO: 608478 - DNA, 20 bp, Artificial Sequence
  chemically synthesized
gtatattttaaaagtatcac

SEQ ID NO: 608479 - DNA, 20 bp, Artificial Sequence
  chemically synthesized
gaagacataacttagaaatc

SEQ ID NO: 608480 - DNA, 20 bp, Artificial Sequence
  chemically synthesized
ggcatcttgaattcctaaac

SEQ ID NO: 608481 - DNA, 20 bp, Artificial Sequence
  chemically synthesized
caagcttcccactatacaga

SEQ ID NO: 608482 - DNA, 20 bp, Artificial Sequence
  chemically synthesized
taatcttaatctgtatagtg

SEQ ID NO: 608483 - DNA, 20 bp, Artificial Sequence
  chemically synthesized
accaatcaagcttcccacta

SEQ ID NO: 608484 - DNA, 20 bp, Artificial Sequence
  chemically synthesized
cttaatctgtatagtgggaa

SEQ ID NO: 608485 - DNA, 20 bp, Artificial Sequence
  chemically synthesized
tttatgaggtttaccaccaa

SEQ ID NO: 608486 - DNA, 20 bp, Artificial Sequence
  chemically synthesized
tacttgaatggcaatattta

SEQ ID NO: 608487 - DNA, 20 bp, Artificial Sequence
  chemically synthesized
atatacatgttatcactgtt

SEQ ID NO: 608488 - DNA, 20 bp, Artificial Sequence
  chemically synthesized
acagtgataacatgtatatg

SEQ ID NO: 608489 - DNA, 20 bp, Artificial Sequence
  chemically synthesized
tcttaaaattccaaatagaa

SEQ ID NO: 608490 - DNA, 20 bp, Artificial Sequence
  chemically synthesized
cttctcaaccagtggtttca

SEQ ID NO: 608491 - DNA, 20 bp, Artificial Sequence
  chemically synthesized
ataattacatcttctcaacc

SEQ ID NO: 608492 - DNA, 20 bp, Artificial Sequence
  chemically synthesized
tctttactaaaaataaaggt

SEQ ID NO: 608493 - DNA, 20 bp, Artificial Sequence
  chemically synthesized
acaaagacctttatttttag

SEQ ID NO: 608494 - DNA, 20 bp, Artificial Sequence
  chemically synthesized
ctgtcagaattttctacttc

SEQ ID NO: 608495 - DNA, 20 bp, Artificial Sequence
  chemically synthesized
acttcaaatgatttaaaaat

SEQ ID NO: 608496 - DNA, 20 bp, Artificial Sequence
  chemically synthesized
aaaaataaatgattcaaaag

SEQ ID NO: 608497 - DNA, 20 bp, Artificial Sequence
  chemically synthesized
gtgaacactgtactaatttg

SEQ ID NO: 608498 - DNA, 20 bp, Artificial Sequence
  chemically synthesized
gtacacatttgtcaacatta

SEQ ID NO: 608499 - DNA, 20 bp, Artificial Sequence
  chemically synthesized
cacacacacacacacatcct

SEQ ID NO: 608500 - DNA, 20 bp, Artificial Sequence
  chemically synthesized
tacatataaagtacattccc

SEQ ID NO: 608501 - DNA, 20 bp, Artificial Sequence
  chemically synthesized
tataaagtacattccccagg

SEQ ID NO: 608502 - DNA, 20 bp, Artificial Sequence
  chemically synthesized
gtacattccccagggtttgc

SEQ ID NO: 608503 - DNA, 20 bp, Artificial Sequence
  chemically synthesized
tctatattggtggatctttg

SEQ ID NO: 608504 - DNA, 20 bp, Artificial Sequence
  chemically synthesized
aaagatccaccaatatagat

SEQ ID NO: 608505 - DNA, 20 bp, Artificial Sequence
  chemically synthesized
tccattatttagtaaattat

SEQ ID NO: 608506 - DNA, 20 bp, Artificial Sequence
  chemically synthesized
tttgatgtctggtaattgag

SEQ ID NO: 608507 - DNA, 20 bp, Artificial Sequence
  chemically synthesized
ttctcaattaccagacatca

SEQ ID NO: 608508 - DNA, 20 bp, Artificial Sequence
  chemically synthesized
ggaataagaagtttgttgaa

SEQ ID NO: 608509 - DNA, 20 bp, Artificial Sequence
  chemically synthesized
agttatagttaattggaata

SEQ ID NO: 608510 - DNA, 20 bp, Artificial Sequence
  chemically synthesized
cttattccaattaactataa

SEQ ID NO: 608511 - DNA, 20 bp, Artificial Sequence
  chemically synthesized
atcctgattatggttttatc

SEQ ID NO: 608512 - DNA, 20 bp, Artificial Sequence
  chemically synthesized
aataataatagtatcctgat

SEQ ID NO: 608513 - DNA, 20 bp, Artificial Sequence
  chemically synthesized
atttgttaataataatagta

SEQ ID NO: 608514 - DNA, 20 bp, Artificial Sequence
  chemically synthesized
gatactattattattaacaa

SEQ ID NO: 608515 - DNA, 20 bp, Artificial Sequence
  chemically synthesized
tatgcagaaatagccaagta

SEQ ID NO: 608516 - DNA, 20 bp, Artificial Sequence
  chemically synthesized
tgcagattatatttggcaga

SEQ ID NO: 608517 - DNA, 20 bp, Artificial Sequence
  chemically synthesized
aaatgagtaattagcagagg

SEQ ID NO: 608518 - DNA, 20 bp, Artificial Sequence
  chemically synthesized
atgattttccatttttctaa

SEQ ID NO: 608519 - DNA, 20 bp, Artificial Sequence
  chemically synthesized
gcctcccaggtcaacctgat

SEQ ID NO: 608520 - DNA, 20 bp, Artificial Sequence
  chemically synthesized
caaagtaatctaaccagata

SEQ ID NO: 608521 - DNA, 20 bp, Artificial Sequence
  chemically synthesized
aaaatgaagctctttatctg

SEQ ID NO: 608522 - DNA, 20 bp, Artificial Sequence
  chemically synthesized
agataaagagcttcatttta

SEQ ID NO: 608523 - DNA, 20 bp, Artificial Sequence
  chemically synthesized
ttattcagcttattaaaccc

SEQ ID NO: 608524 - DNA, 20 bp, Artificial Sequence
  chemically synthesized
tcagcttattaaaccctatg

SEQ ID NO: 608525 - DNA, 20 bp, Artificial Sequence
  chemically synthesized
gaatttacagaaacaaacca

SEQ ID NO: 608526 - DNA, 20 bp, Artificial Sequence
  chemically synthesized
atatgcatctactttcatag

SEQ ID NO: 608527 - DNA, 20 bp, Artificial Sequence
  chemically synthesized
aaagtatatgcatctacttt

SEQ ID NO: 608528 - DNA, 20 bp, Artificial Sequence
  chemically synthesized
agtagatgcatatacttttt

SEQ ID NO: 608529 - DNA, 20 bp, Artificial Sequence
  chemically synthesized
tgcatatactttttatatgc

SEQ ID NO: 608530 - DNA, 20 bp, Artificial Sequence
  chemically synthesized
cttgagttagttacatacta

SEQ ID NO: 608531 - DNA, 20 bp, Artificial Sequence
  chemically synthesized
ctcaagtgggctcatccatc

SEQ ID NO: 608532 - DNA, 20 bp, Artificial Sequence
  chemically synthesized
gggctcatccatcattggtt

SEQ ID NO: 608533 - DNA, 20 bp, Artificial Sequence
  chemically synthesized
tatcatataaagaccttgag

SEQ ID NO: 608534 - DNA, 20 bp, Artificial Sequence
  chemically synthesized
atgacaaattggctttcaga

SEQ ID NO: 608535 - DNA, 20 bp, Artificial Sequence
  chemically synthesized
cattctgaaagccaatttgt

SEQ ID NO: 608536 - DNA, 20 bp, Artificial Sequence
  chemically synthesized
atgtcataaaacaatgacaa

SEQ ID NO: 608537 - DNA, 20 bp, Artificial Sequence
  chemically synthesized
tgagaacacctagcatagtc

SEQ ID NO: 608538 - DNA, 20 bp, Artificial Sequence
  chemically synthesized
taatatattcaaaatttagc

SEQ ID NO: 608539 - DNA, 20 bp, Artificial Sequence
  chemically synthesized
taaagtattgctctagaaat

SEQ ID NO: 608540 - DNA, 20 bp, Artificial Sequence
  chemically synthesized
ctaacctatgctaaagatga

SEQ ID NO: 608541 - DNA, 20 bp, Artificial Sequence
  chemically synthesized
tttatgttctgtacatttca

SEQ ID NO: 608542 - DNA, 20 bp, Artificial Sequence
  chemically synthesized
ctattttttcttggaaaatg

SEQ ID NO: 608543 - DNA, 20 bp, Artificial Sequence
  chemically synthesized
catgatatattttattctat

SEQ ID NO: 608544 - DNA, 20 bp, Artificial Sequence
  chemically synthesized
tgaaagagttcagtgttttc

SEQ ID NO: 608545 - DNA, 20 bp, Artificial Sequence
  chemically synthesized
tggtagtatttgaaagagtt

SEQ ID NO: 608546 - DNA, 20 bp, Artificial Sequence
  chemically synthesized
attccttcataaggatggaa

SEQ ID NO: 608547 - DNA, 20 bp, Artificial Sequence
  chemically synthesized
ccatccttatgaaggaatct

SEQ ID NO: 608548 - DNA, 20 bp, Artificial Sequence
  chemically synthesized
tgattaattgctcccaagcc

SEQ ID NO: 608549 - DNA, 20 bp, Artificial Sequence
  chemically synthesized
acttatgcatgggattgggg

SEQ ID NO: 608550 - DNA, 20 bp, Artificial Sequence
  chemically synthesized
tccccaatcccatgcataag

SEQ ID NO: 608551 - DNA, 20 bp, Artificial Sequence
  chemically synthesized
aaagcaatcaggacttatgc

SEQ ID NO: 608552 - DNA, 20 bp, Artificial Sequence
  chemically synthesized
caatcccatgcataagtcct

SEQ ID NO: 608553 - DNA, 20 bp, Artificial Sequence
  chemically synthesized
ttgttctatgtccctggcaa

SEQ ID NO: 608554 - DNA, 20 bp, Artificial Sequence
  chemically synthesized
ttaaagcataaaatgttgta

SEQ ID NO: 608555 - DNA, 20 bp, Artificial Sequence
  chemically synthesized
aaaaatccaactacaacatt

SEQ ID NO: 608556 - DNA, 20 bp, Artificial Sequence
  chemically synthesized
tctggttggaacatgttaag

SEQ ID NO: 608557 - DNA, 20 bp, Artificial Sequence
  chemically synthesized
caaccagaaggtgtccagag

SEQ ID NO: 608558 - DNA, 20 bp, Artificial Sequence
  chemically synthesized
cagaactgtaacattttttt

SEQ ID NO: 608559 - DNA, 20 bp, Artificial Sequence
  chemically synthesized
ggtagttatttctttcccta

SEQ ID NO: 608560 - DNA, 20 bp, Artificial Sequence
  chemically synthesized
gtgtgatgacaatgtgaata

SEQ ID NO: 608561 - DNA, 20 bp, Artificial Sequence
  chemically synthesized
acaatgtgaatatttggatt

SEQ ID NO: 608562 - DNA, 20 bp, Artificial Sequence
  chemically synthesized
cagaaaattccaaaggaatg

SEQ ID NO: 608563 - DNA, 20 bp, Artificial Sequence
  chemically synthesized
ttacataagccaataattcc

SEQ ID NO: 608564 - DNA, 20 bp, Artificial Sequence
  chemically synthesized
gtaattaaaccttgggaatt

SEQ ID NO: 608565 - DNA, 20 bp, Artificial Sequence
  chemically synthesized
tgtgacatcttttcttccat

SEQ ID NO: 608566 - DNA, 20 bp, Artificial Sequence
  chemically synthesized
acatgttactgctccaatgt

SEQ ID NO: 608567 - DNA, 20 bp, Artificial Sequence
  chemically synthesized
cgtgtgtgtgtctgcatatt

SEQ ID NO: 608568 - DNA, 20 bp, Artificial Sequence
  chemically synthesized
atatttcaagttttcttgag

SEQ ID NO: 608569 - DNA, 20 bp, Artificial Sequence
  chemically synthesized
attattgtaccaaacatcat

SEQ ID NO: 608570 - DNA, 20 bp, Artificial Sequence
  chemically synthesized
aaagtccatataaactagaa

SEQ ID NO: 608571 - DNA, 20 bp, Artificial Sequence
  chemically synthesized
tcattttgagttggggtggg

SEQ ID NO: 608572 - DNA, 20 bp, Artificial Sequence
  chemically synthesized
aactcaaaatgatacttggt

SEQ ID NO: 608573 - DNA, 20 bp, Artificial Sequence
  chemically synthesized
ttggtacatgattaaaaaac

SEQ ID NO: 608574 - DNA, 20 bp, Artificial Sequence
  chemically synthesized
aaatagaccattgtttaatc

SEQ ID NO: 608575 - DNA, 20 bp, Artificial Sequence
  chemically synthesized
tgacttaggataaaatagac

SEQ ID NO: 608576 - DNA, 20 bp, Artificial Sequence
  chemically synthesized
ttacgagtaccaacactatt

SEQ ID NO: 608577 - DNA, 20 bp, Artificial Sequence
  chemically synthesized
aggccagtaggtggcaacat

SEQ ID NO: 608578 - DNA, 20 bp, Artificial Sequence
  chemically synthesized
tagcatgaggttttttcttt

SEQ ID NO: 608579 - DNA, 20 bp, Artificial Sequence
  chemically synthesized
aaaacaagtaaccattagca

SEQ ID NO: 608580 - DNA, 20 bp, Artificial Sequence
  chemically synthesized
aaaacctcatgctaatggtt

SEQ ID NO: 608581 - DNA, 20 bp, Artificial Sequence
  chemically synthesized
agtacagaaaaaaaagaaaa

SEQ ID NO: 608582 - DNA, 20 bp, Artificial Sequence
  chemically synthesized
ctgaagaagccctctctgcc

SEQ ID NO: 608583 - DNA, 20 bp, Artificial Sequence
  chemically synthesized
cgttataagccacaggcaga

SEQ ID NO: 608584 - DNA, 20 bp, Artificial Sequence
  chemically synthesized
gatttggagtaaaaatacaa

SEQ ID NO: 608585 - DNA, 20 bp, Artificial Sequence
  chemically synthesized
ttgtatttttactccaaatc

SEQ ID NO: 608586 - DNA, 20 bp, Artificial Sequence
  chemically synthesized
ctgtctctgttcatacaaac

SEQ ID NO: 608587 - DNA, 20 bp, Artificial Sequence
  chemically synthesized
gtactaaaaaaaatcaacta

SEQ ID NO: 608588 - DNA, 20 bp, Artificial Sequence
  chemically synthesized
gtgctttagggaagcactat

SEQ ID NO: 608589 - DNA, 20 bp, Artificial Sequence
  chemically synthesized
gatcgtctactttgtcacaa

SEQ ID NO: 608590 - DNA, 20 bp, Artificial Sequence
  chemically synthesized
gatccctcctatcatgaaga

SEQ ID NO: 608591 - DNA, 20 bp, Artificial Sequence
  chemically synthesized
tgaagtatagattacataga

SEQ ID NO: 608592 - DNA, 20 bp, Artificial Sequence
  chemically synthesized
ctttgagtatatctttgaag

SEQ ID NO: 608593 - DNA, 20 bp, Artificial Sequence
  chemically synthesized
ctatacttcaaagatatact

SEQ ID NO: 608594 - DNA, 20 bp, Artificial Sequence
  chemically synthesized
tgctgcaaattttctcagtc

SEQ ID NO: 608595 - DNA, 20 bp, Artificial Sequence
  chemically synthesized
ttgacatctttaagaggcct

SEQ ID NO: 608596 - DNA, 20 bp, Artificial Sequence
  chemically synthesized
ccaaattctatgatttggtt

SEQ ID NO: 608597 - DNA, 20 bp, Artificial Sequence
  chemically synthesized
cagtaacccaaattctatga

SEQ ID NO: 608598 - DNA, 20 bp, Artificial Sequence
  chemically synthesized
atgacccagtaacccaaatt

SEQ ID NO: 608599 - DNA, 20 bp, Artificial Sequence
  chemically synthesized
atcagatttgtttactattt

SEQ ID NO: 608600 - DNA, 20 bp, Artificial Sequence
  chemically synthesized
agcctataaatagtaaacaa

SEQ ID NO: 608601 - DNA, 20 bp, Artificial Sequence
  chemically synthesized
ggggtttctttggcaatcag

SEQ ID NO: 608602 - DNA, 20 bp, Artificial Sequence
  chemically synthesized
gacctggggtttctttggca

SEQ ID NO: 608603 - DNA, 20 bp, Artificial Sequence
  chemically synthesized
aaggtgtttttagttagacc

SEQ ID NO: 608604 - DNA, 20 bp, Artificial Sequence
  chemically synthesized
cctaggtttgagtgataaca

SEQ ID NO: 608605 - DNA, 20 bp, Artificial Sequence
  chemically synthesized
taaaagtcctggtgcttgcc

SEQ ID NO: 608606 - DNA, 20 bp, Artificial Sequence
  chemically synthesized
attgtgttgtttaaaagtcc

SEQ ID NO: 608607 - DNA, 20 bp, Artificial Sequence
  chemically synthesized
ctttattattctacttattg

SEQ ID NO: 608608 - DNA, 20 bp, Artificial Sequence
  chemically synthesized
tatctgaagttgacatattt

SEQ ID NO: 608609 - DNA, 20 bp, Artificial Sequence
  chemically synthesized
ctgcactttcagagccttcc

SEQ ID NO: 608610 - DNA, 20 bp, Artificial Sequence
  chemically synthesized
ctgaaagtgcaggatataat

SEQ ID NO: 608611 - DNA, 20 bp, Artificial Sequence
  chemically synthesized
ggatataatatctgtttcaa

SEQ ID NO: 608612 - DNA, 20 bp, Artificial Sequence
  chemically synthesized
aatttggtttcttttataaa

SEQ ID NO: 608613 - DNA, 20 bp, Artificial Sequence
  chemically synthesized
ggtttcttttataaatttag

SEQ ID NO: 608614 - DNA, 20 bp, Artificial Sequence
  chemically synthesized
taaaaagttagaagggcaca

SEQ ID NO: 608615 - DNA, 20 bp, Artificial Sequence
  chemically synthesized
gctccaaggttgggatatct

SEQ ID NO: 608616 - DNA, 20 bp, Artificial Sequence
  chemically synthesized
agctgaatgcaatcactgga

SEQ ID NO: 608617 - DNA, 20 bp, Artificial Sequence
  chemically synthesized
agcaagtataaaacattatc

SEQ ID NO: 608618 - DNA, 20 bp, Artificial Sequence
  chemically synthesized
ggatattgactgtataattg

SEQ ID NO: 608619 - DNA, 20 bp, Artificial Sequence
  chemically synthesized
tctctgatggcacagtagcc

SEQ ID NO: 608620 - DNA, 20 bp, Artificial Sequence
  chemically synthesized
tctagaactgagagtaataa

SEQ ID NO: 608621 - DNA, 20 bp, Artificial Sequence
  chemically synthesized
ctctcagttctagatatgcg

SEQ ID NO: 608622 - DNA, 20 bp, Artificial Sequence
  chemically synthesized
aagtacatagcagtatccca

SEQ ID NO: 608623 - DNA, 20 bp, Artificial Sequence
  chemically synthesized
aagtgggatactgctatgta

SEQ ID NO: 608624 - DNA, 20 bp, Artificial Sequence
  chemically synthesized
tcaggccaggcatatgatct

SEQ ID NO: 608625 - DNA, 20 bp, Artificial Sequence
  chemically synthesized
aacaaaaggtctgagtttct

SEQ ID NO: 608626 - DNA, 20 bp, Artificial Sequence
  chemically synthesized
agcagagagaaactcagacc

SEQ ID NO: 608627 - DNA, 20 bp, Artificial Sequence
  chemically synthesized
ccaaataggaaacaaaaggt

SEQ ID NO: 608628 - DNA, 20 bp, Artificial Sequence
  chemically synthesized
tttagctgtaaacaagggaa

SEQ ID NO: 608629 - DNA, 20 bp, Artificial Sequence
  chemically synthesized
agatcttggaaactcttttc

SEQ ID NO: 608630 - DNA, 20 bp, Artificial Sequence
  chemically synthesized
aacttttcgaactcatacag

SEQ ID NO: 608631 - DNA, 20 bp, Artificial Sequence
  chemically synthesized
agttcgaaaagttatggagg

SEQ ID NO: 608632 - DNA, 20 bp, Artificial Sequence
  chemically synthesized
gaaaagttatggagggtagg

SEQ ID NO: 608633 - DNA, 20 bp, Artificial Sequence
  chemically synthesized
ttatggatttaaggagaagt

SEQ ID NO: 608634 - DNA, 20 bp, Artificial Sequence
  chemically synthesized
ggtttaatacagagttttat

SEQ ID NO: 608635 - DNA, 20 bp, Artificial Sequence
  chemically synthesized
gtttgctcaagggtttaata

SEQ ID NO: 608636 - DNA, 20 bp, Artificial Sequence
  chemically synthesized
aaagagttcaaggtttgctc

SEQ ID NO: 608637 - DNA, 20 bp, Artificial Sequence
  chemically synthesized
tgttggctaagtaaagagtt

SEQ ID NO: 608638 - DNA, 20 bp, Artificial Sequence
  chemically synthesized
atcctgtattatttaggatg

SEQ ID NO: 608639 - DNA, 20 bp, Artificial Sequence
  chemically synthesized
attatatcctgtattattta

SEQ ID NO: 608640 - DNA, 20 bp, Artificial Sequence
  chemically synthesized
tagaatgattgttgattatt

SEQ ID NO: 608641 - DNA, 20 bp, Artificial Sequence
  chemically synthesized
taagtacatattagaatgat

SEQ ID NO: 608642 - DNA, 20 bp, Artificial Sequence
  chemically synthesized
gatgatataagtacatatta

SEQ ID NO: 608643 - DNA, 20 bp, Artificial Sequence
  chemically synthesized
atcatcttcagtgccgaatg

SEQ ID NO: 608644 - DNA, 20 bp, Artificial Sequence
  chemically synthesized
tttttgactaacagcaatta

SEQ ID NO: 608645 - DNA, 20 bp, Artificial Sequence
  chemically synthesized
agcatcagtgtcattaatga

SEQ ID NO: 608646 - DNA, 20 bp, Artificial Sequence
  chemically synthesized
ataaaatggagtcattttga

SEQ ID NO: 608647 - DNA, 20 bp, Artificial Sequence
  chemically synthesized
aatggagtcattttgaattg

SEQ ID NO: 608648 - DNA, 20 bp, Artificial Sequence
  chemically synthesized
atttaatgcaccattttttc

SEQ ID NO: 608649 - DNA, 20 bp, Artificial Sequence
  chemically synthesized
ggagagaaatgttttaaaga

SEQ ID NO: 608650 - DNA, 20 bp, Artificial Sequence
  chemically synthesized
agaattggagagaaatgttt

SEQ ID NO: 608651 - DNA, 20 bp, Artificial Sequence
  chemically synthesized
gaagagagagaattggagag

SEQ ID NO: 608652 - DNA, 20 bp, Artificial Sequence
  chemically synthesized
cattaatcttttttccttga

SEQ ID NO: 608653 - DNA, 20 bp, Artificial Sequence
  chemically synthesized
tctgaatctctttcaaggaa

SEQ ID NO: 608654 - DNA, 20 bp, Artificial Sequence
  chemically synthesized
gattaatgaagtcatctgtt

SEQ ID NO: 608655 - DNA, 20 bp, Artificial Sequence
  chemically synthesized
ttactttataaaatgaaagg

SEQ ID NO: 608656 - DNA, 20 bp, Artificial Sequence
  chemically synthesized
aataagaaggtaaaatacag

SEQ ID NO: 608657 - DNA, 20 bp, Artificial Sequence
  chemically synthesized
taccttcttattttctggtt

SEQ ID NO: 608658 - DNA, 20 bp, Artificial Sequence
  chemically synthesized
tgatttataatttgtcatta

SEQ ID NO: 608659 - DNA, 20 bp, Artificial Sequence
  chemically synthesized
aacacacttatgcacacact

SEQ ID NO: 608660 - DNA, 20 bp, Artificial Sequence
  chemically synthesized
atcatgaagtgtgtgcataa

SEQ ID NO: 608661 - DNA, 20 bp, Artificial Sequence
  chemically synthesized
agctatcattagaggaaagg

SEQ ID NO: 608662 - DNA, 20 bp, Artificial Sequence
  chemically synthesized
aacccaacctttcctctaat

SEQ ID NO: 608663 - DNA, 20 bp, Artificial Sequence
  chemically synthesized
tatgctaaaatgacacaaca

SEQ ID NO: 608664 - DNA, 20 bp, Artificial Sequence
  chemically synthesized
ttaatagaatcaattctgga

SEQ ID NO: 608665 - DNA, 20 bp, Artificial Sequence
  chemically synthesized
cacacacaatctcattccag

SEQ ID NO: 608666 - DNA, 20 bp, Artificial Sequence
  chemically synthesized
gtgtgttcaaatcctggcac

SEQ ID NO: 608667 - DNA, 20 bp, Artificial Sequence
  chemically synthesized
gcacatgaaaagcagctgtg

SEQ ID NO: 608668 - DNA, 20 bp, Artificial Sequence
  chemically synthesized
ttttcatgtgcataactgtg

SEQ ID NO: 608669 - DNA, 20 bp, Artificial Sequence
  chemically synthesized
aactgtgcacagatttctta

SEQ ID NO: 608670 - DNA, 20 bp, Artificial Sequence
  chemically synthesized
tgtttataacaaccctattg

SEQ ID NO: 608671 - DNA, 20 bp, Artificial Sequence
  chemically synthesized
acacttttcatacattaatt

SEQ ID NO: 608672 - DNA, 20 bp, Artificial Sequence
  chemically synthesized
acattgaattaatgtatgaa

SEQ ID NO: 608673 - DNA, 20 bp, Artificial Sequence
  chemically synthesized
tgtatgaaaagtgtttacag

SEQ ID NO: 608674 - DNA, 20 bp, Artificial Sequence
  chemically synthesized
ttacagcaatgtttgttata

SEQ ID NO: 608675 - DNA, 20 bp, Artificial Sequence
  chemically synthesized
tctaagatcaacactcagga

SEQ ID NO: 608676 - DNA, 20 bp, Artificial Sequence
  chemically synthesized
ggaaggagcttaggctaata

SEQ ID NO: 608677 - DNA, 20 bp, Artificial Sequence
  chemically synthesized
tgataggtatgtcactcaac

SEQ ID NO: 608678 - DNA, 20 bp, Artificial Sequence
  chemically synthesized
ttgggttgagtgacatacct

SEQ ID NO: 608679 - DNA, 20 bp, Artificial Sequence
  chemically synthesized
aactcattcaagatatataa

SEQ ID NO: 608680 - DNA, 20 bp, Artificial Sequence
  chemically synthesized
tttgtattatttatgcccca

SEQ ID NO: 608681 - DNA, 20 bp, Artificial Sequence
  chemically synthesized
aaaatgttcatatccctttt

SEQ ID NO: 608682 - DNA, 20 bp, Artificial Sequence
  chemically synthesized
tgttatgctcttatgtataa

SEQ ID NO: 608683 - DNA, 20 bp, Artificial Sequence
  chemically synthesized
aacaggtagtgaaagggctc

SEQ ID NO: 608684 - DNA, 20 bp, Artificial Sequence
  chemically synthesized
ctcttgtctttccacgaaca

SEQ ID NO: 608685 - DNA, 20 bp, Artificial Sequence
  chemically synthesized
tgggaagcaggaaagaggtt

SEQ ID NO: 608686 - DNA, 20 bp, Artificial Sequence
  chemically synthesized
gctgaaacatgaaacctctt

SEQ ID NO: 608687 - DNA, 20 bp, Artificial Sequence
  chemically synthesized
ggtagattgggaagcaggaa

SEQ ID NO: 608688 - DNA, 20 bp, Artificial Sequence
  chemically synthesized
tctttcctgcttcccaatct

SEQ ID NO: 608689 - DNA, 20 bp, Artificial Sequence
  chemically synthesized
attatccatgttgaaaatct

SEQ ID NO: 608690 - DNA, 20 bp, Artificial Sequence
  chemically synthesized
tagaaataagtagtattttg

SEQ ID NO: 608691 - DNA, 20 bp, Artificial Sequence
  chemically synthesized
ggcaatgaattcttttgaga

SEQ ID NO: 608692 - DNA, 20 bp, Artificial Sequence
  chemically synthesized
tttacactatgtgtacacaa

SEQ ID NO: 608693 - DNA, 20 bp, Artificial Sequence
  chemically synthesized
tatgtgtacacaaaaatgtt

SEQ ID NO: 608694 - DNA, 20 bp, Artificial Sequence
  chemically synthesized
aatgtttggagattgtgtta

SEQ ID NO: 608695 - DNA, 20 bp, Artificial Sequence
  chemically synthesized
atgcacatttaacaaactct

SEQ ID NO: 608696 - DNA, 20 bp, Artificial Sequence
  chemically synthesized
atcacagtttataaaaccct

SEQ ID NO: 608697 - DNA, 20 bp, Artificial Sequence
  chemically synthesized
tcttagggttttataaactg

SEQ ID NO: 608698 - DNA, 20 bp, Artificial Sequence
  chemically synthesized
taaaatggtataacaatcat

SEQ ID NO: 608699 - DNA, 20 bp, Artificial Sequence
  chemically synthesized
ataccattttatttatctgc

SEQ ID NO: 608700 - DNA, 20 bp, Artificial Sequence
  chemically synthesized
tgaaggatggagaatgttaa

SEQ ID NO: 608701 - DNA, 20 bp, Artificial Sequence
  chemically synthesized
cctcaatacatatgtgtttg

SEQ ID NO: 608702 - DNA, 20 bp, Artificial Sequence
  chemically synthesized
tcatacctcaatacatatgt

SEQ ID NO: 608703 - DNA, 20 bp, Artificial Sequence
  chemically synthesized
gacatcatacctcaatacat

SEQ ID NO: 608704 - DNA, 20 bp, Artificial Sequence
  chemically synthesized
atgtattgaggtatgatgtc

SEQ ID NO: 608705 - DNA, 20 bp, Artificial Sequence
  chemically synthesized
aataatattctaattacgga

SEQ ID NO: 608706 - DNA, 20 bp, Artificial Sequence
  chemically synthesized
ttagaatattatttcctatc

SEQ ID NO: 608707 - DNA, 20 bp, Artificial Sequence
  chemically synthesized
cttcagttttctctattaaa

SEQ ID NO: 608708 - DNA, 20 bp, Artificial Sequence
  chemically synthesized
tgaagaccatgtcactattt

SEQ ID NO: 608709 - DNA, 20 bp, Artificial Sequence
  chemically synthesized
tgaaattgaaaaatatatgt

SEQ ID NO: 608710 - DNA, 20 bp, Artificial Sequence
  chemically synthesized
acatttaaaaatatatgtaa

SEQ ID NO: 608711 - DNA, 20 bp, Artificial Sequence
  chemically synthesized
gagttttacatttttaaatt

SEQ ID NO: 608712 - DNA, 20 bp, Artificial Sequence
  chemically synthesized
tacatgttttatttattttt

SEQ ID NO: 608713 - DNA, 20 bp, Artificial Sequence
  chemically synthesized
ctcttttcaattaattttat

SEQ ID NO: 608714 - DNA, 20 bp, Artificial Sequence
  chemically synthesized
gtagctaagacaacattgtg

SEQ ID NO: 608715 - DNA, 20 bp, Artificial Sequence
  chemically synthesized
actacaaagttaagatataa

SEQ ID NO: 608716 - DNA, 20 bp, Artificial Sequence
  chemically synthesized
cttttatatcttaactttgt

SEQ ID NO: 608717 - DNA, 20 bp, Artificial Sequence
  chemically synthesized
tatgcacatgtgaatatact

SEQ ID NO: 608718 - DNA, 20 bp, Artificial Sequence
  chemically synthesized
tcacattagaagtataggaa

SEQ ID NO: 608719 - DNA, 20 bp, Artificial Sequence
  chemically synthesized
tcattttaatttaaattatg

SEQ ID NO: 608720 - DNA, 20 bp, Artificial Sequence
  chemically synthesized
aaacaaaattccagtgccta

SEQ ID NO: 608721 - DNA, 20 bp, Artificial Sequence
  chemically synthesized
aaactacataggcactggaa

SEQ ID NO: 608722 - DNA, 20 bp, Artificial Sequence
  chemically synthesized
tggaatgctcccttaaaatt

SEQ ID NO: 608723 - DNA, 20 bp, Artificial Sequence
  chemically synthesized
ttactataaaaatccttcat

SEQ ID NO: 608724 - DNA, 20 bp, Artificial Sequence
  chemically synthesized
attattttttaatcacacat

SEQ ID NO: 608725 - DNA, 20 bp, Artificial Sequence
  chemically synthesized
gtgattaaaaaataatattt

SEQ ID NO: 608726 - DNA, 20 bp, Artificial Sequence
  chemically synthesized
atttacatgtttactttgtg

SEQ ID NO: 608727 - DNA, 20 bp, Artificial Sequence
  chemically synthesized
ttttgctctttttttgataa

SEQ ID NO: 608728 - DNA, 20 bp, Artificial Sequence
  chemically synthesized
gcactccagtgctcattata

SEQ ID NO: 608729 - DNA, 20 bp, Artificial Sequence
  chemically synthesized
catccaacttgtcacatatt

SEQ ID NO: 608730 - DNA, 20 bp, Artificial Sequence
  chemically synthesized
gaagtatttgtatttctgtg

SEQ ID NO: 608731 - DNA, 20 bp, Artificial Sequence
  chemically synthesized
gacacagaaatacaaatact

SEQ ID NO: 608732 - DNA, 20 bp, Artificial Sequence
  chemically synthesized
aattgccaaactcagagaat

SEQ ID NO: 608733 - DNA, 20 bp, Artificial Sequence
  chemically synthesized
ccactctaatctctgattct

SEQ ID NO: 608734 - DNA, 20 bp, Artificial Sequence
  chemically synthesized
ctaaaagccaccactctaat

SEQ ID NO: 608735 - DNA, 20 bp, Artificial Sequence
  chemically synthesized
agagaatcagagattagagt

SEQ ID NO: 608736 - DNA, 20 bp, Artificial Sequence
  chemically synthesized
tttcttctgtaaggacactc

SEQ ID NO: 608737 - DNA, 20 bp, Artificial Sequence
  chemically synthesized
gtgtccttacagaagaaaag

SEQ ID NO: 608738 - DNA, 20 bp, Artificial Sequence
  chemically synthesized
aagaaaagaacagttttaac

SEQ ID NO: 608739 - DNA, 20 bp, Artificial Sequence
  chemically synthesized
aaacaccatagggcatcatc

SEQ ID NO: 608740 - DNA, 20 bp, Artificial Sequence
  chemically synthesized
aagcagatgatgatgcccta

SEQ ID NO: 608741 - DNA, 20 bp, Artificial Sequence
  chemically synthesized
agaattacagataaaagtca

SEQ ID NO: 608742 - DNA, 20 bp, Artificial Sequence
  chemically synthesized
aaagtcagactgattagcaa

SEQ ID NO: 608743 - DNA, 20 bp, Artificial Sequence
  chemically synthesized
gtgtgtatgggtgggtgcct

SEQ ID NO: 608744 - DNA, 20 bp, Artificial Sequence
  chemically synthesized
gacagttgccctttgatttt

SEQ ID NO: 608745 - DNA, 20 bp, Artificial Sequence
  chemically synthesized
tattggcctggacagttgcc

SEQ ID NO: 608746 - DNA, 20 bp, Artificial Sequence
  chemically synthesized
gatcacatgttagtgtttat

SEQ ID NO: 608747 - DNA, 20 bp, Artificial Sequence
  chemically synthesized
gtagagaagggatcacatgt

SEQ ID NO: 608748 - DNA, 20 bp, Artificial Sequence
  chemically synthesized
ccccatgaccaaaaaagaat

SEQ ID NO: 608749 - DNA, 20 bp, Artificial Sequence
  chemically synthesized
aaaggacagaatgtgaaaag

SEQ ID NO: 608750 - DNA, 20 bp, Artificial Sequence
  chemically synthesized
tcacaggagtgacaacgtgc

SEQ ID NO: 608751 - DNA, 20 bp, Artificial Sequence
  chemically synthesized
ccttacaactttggcaataa

SEQ ID NO: 608752 - DNA, 20 bp, Artificial Sequence
  chemically synthesized
tgcaaattatatgtttaaaa

SEQ ID NO: 608753 - DNA, 20 bp, Artificial Sequence
  chemically synthesized
atgattaacttatgcaaatt

SEQ ID NO: 608754 - DNA, 20 bp, Artificial Sequence
  chemically synthesized
atgtttaaatttttatattt

SEQ ID NO: 608755 - DNA, 20 bp, Artificial Sequence
  chemically synthesized
tttctttcagtacatttgtt

SEQ ID NO: 608756 - DNA, 20 bp, Artificial Sequence
  chemically synthesized
gttgttttttctttcagtac

SEQ ID NO: 608757 - DNA, 20 bp, Artificial Sequence
  chemically synthesized
gttatacatgacctcataat

SEQ ID NO: 608758 - DNA, 20 bp, Artificial Sequence
  chemically synthesized
tagtgtgttaggtttatcag

SEQ ID NO: 608759 - DNA, 20 bp, Artificial Sequence
  chemically synthesized
ttatcttactttttagtgtg

SEQ ID NO: 608760 - DNA, 20 bp, Artificial Sequence
  chemically synthesized
aggcactgtcctatattttt

SEQ ID NO: 608761 - DNA, 20 bp, Artificial Sequence
  chemically synthesized
aggacagtgcctaattatct

SEQ ID NO: 608762 - DNA, 20 bp, Artificial Sequence
  chemically synthesized
gtatgctaggggagatcagc

SEQ ID NO: 608763 - DNA, 20 bp, Artificial Sequence
  chemically synthesized
ccttttgtatttctacagtt

SEQ ID NO: 608764 - DNA, 20 bp, Artificial Sequence
  chemically synthesized
tgtatttctacagttatatg

SEQ ID NO: 608765 - DNA, 20 bp, Artificial Sequence
  chemically synthesized
ttactattttctattgtttt

SEQ ID NO: 608766 - DNA, 20 bp, Artificial Sequence
  chemically synthesized
acctcgttgttactattttc

SEQ ID NO: 608767 - DNA, 20 bp, Artificial Sequence
  chemically synthesized
acaatagaaaatagtaacaa

SEQ ID NO: 608768 - DNA, 20 bp, Artificial Sequence
  chemically synthesized
gaaaatagtaacaacgaggt

SEQ ID NO: 608769 - DNA, 20 bp, Artificial Sequence
  chemically synthesized
ttttttttgtgaaaagatag

SEQ ID NO: 608770 - DNA, 20 bp, Artificial Sequence
  chemically synthesized
actggcttgttcttgacatt

SEQ ID NO: 608771 - DNA, 20 bp, Artificial Sequence
  chemically synthesized
actgattccacaatatgcaa

SEQ ID NO: 608772 - DNA, 20 bp, Artificial Sequence
  chemically synthesized
gaaattgtcacccaactctt

SEQ ID NO: 608773 - DNA, 20 bp, Artificial Sequence
  chemically synthesized
aattacatttagttcataag

SEQ ID NO: 608774 - DNA, 20 bp, Artificial Sequence
  chemically synthesized
acattaagattccttctgtt

SEQ ID NO: 608775 - DNA, 20 bp, Artificial Sequence
  chemically synthesized
ttttttctcactgcctgaca

SEQ ID NO: 608776 - DNA, 20 bp, Artificial Sequence
  chemically synthesized
ttatgaaaatggaaatacta

SEQ ID NO: 608777 - DNA, 20 bp, Artificial Sequence
  chemically synthesized
tactattttgtttactgggg

SEQ ID NO: 608778 - DNA, 20 bp, Artificial Sequence
  chemically synthesized
atttaggtaaataataaaat

SEQ ID NO: 608779 - DNA, 20 bp, Artificial Sequence
  chemically synthesized
ttcagcatgttttaagtgtt

SEQ ID NO: 608780 - DNA, 20 bp, Artificial Sequence
  chemically synthesized
ggtctttttcagcatgtttt

SEQ ID NO: 608781 - DNA, 20 bp, Artificial Sequence
  chemically synthesized
gattgacgtggtctttttca

SEQ ID NO: 608782 - DNA, 20 bp, Artificial Sequence
  chemically synthesized
aacatgtttaaagtgagtaa

SEQ ID NO: 608783 - DNA, 20 bp, Artificial Sequence
  chemically synthesized
atcaattttactcactttaa

SEQ ID NO: 608784 - DNA, 20 bp, Artificial Sequence
  chemically synthesized
gtgaaaagggaatgaaaaaa

SEQ ID NO: 608785 - DNA, 20 bp, Artificial Sequence
  chemically synthesized
atttagtgaacgtttcttgt

SEQ ID NO: 608786 - DNA, 20 bp, Artificial Sequence
  chemically synthesized
acgaacatcaacaatttagt

SEQ ID NO: 608787 - DNA, 20 bp, Artificial Sequence
  chemically synthesized
acgttcactaaattgttgat

SEQ ID NO: 608788 - DNA, 20 bp, Artificial Sequence
  chemically synthesized
aacctccgcctctggggttc

SEQ ID NO: 608789 - DNA, 20 bp, Artificial Sequence
  chemically synthesized
ctcagaggctgaggcaggag

SEQ ID NO: 608790 - DNA, 20 bp, Artificial Sequence
  chemically synthesized
aggcatgtgccaccacacct

SEQ ID NO: 608791 - DNA, 20 bp, Artificial Sequence
  chemically synthesized
ttttgtatttttacttgaga

SEQ ID NO: 608792 - DNA, 20 bp, Artificial Sequence
  chemically synthesized
aactcctgaactcatgatcc

SEQ ID NO: 608793 - DNA, 20 bp, Artificial Sequence
  chemically synthesized
tgcttcggcctcccagagtg

SEQ ID NO: 608794 - DNA, 20 bp, Artificial Sequence
  chemically synthesized
cttaaaaaactaagctatca

SEQ ID NO: 608795 - DNA, 20 bp, Artificial Sequence
  chemically synthesized
ggtcataatcaatatgatag

SEQ ID NO: 608796 - DNA, 20 bp, Artificial Sequence
  chemically synthesized
gtcatggtcataatcaatat

SEQ ID NO: 608797 - DNA, 20 bp, Artificial Sequence
  chemically synthesized
tatttttctaatatttaacg

SEQ ID NO: 608798 - DNA, 20 bp, Artificial Sequence
  chemically synthesized
attgtatttgaagttcttag

SEQ ID NO: 608799 - DNA, 20 bp, Artificial Sequence
  chemically synthesized
aacaatattcaaagtcagta

SEQ ID NO: 608800 - DNA, 20 bp, Artificial Sequence
  chemically synthesized
atcaaaatactgactttgaa

SEQ ID NO: 608801 - DNA, 20 bp, Artificial Sequence
  chemically synthesized
tattgtttttttcaaaggcc

SEQ ID NO: 608802 - DNA, 20 bp, Artificial Sequence
  chemically synthesized
gtcctcaggcactgagtaga

SEQ ID NO: 608803 - DNA, 20 bp, Artificial Sequence
  chemically synthesized
attaagatttatagacagcc

SEQ ID NO: 608804 - DNA, 20 bp, Artificial Sequence
  chemically synthesized
tagtagtgtacaaaagtaga

SEQ ID NO: 608805 - DNA, 20 bp, Artificial Sequence
  chemically synthesized
aaattttagtagtgtacaaa

SEQ ID NO: 608806 - DNA, 20 bp, Artificial Sequence
  chemically synthesized
tgaaaaatctccaataattc

SEQ ID NO: 608807 - DNA, 20 bp, Artificial Sequence
  chemically synthesized
aattaaagcataagaattat

SEQ ID NO: 608808 - DNA, 20 bp, Artificial Sequence
  chemically synthesized
tacctaattttgaatgaaat

SEQ ID NO: 608809 - DNA, 20 bp, Artificial Sequence
  chemically synthesized
tttgaaaatattggcttata

SEQ ID NO: 608810 - DNA, 20 bp, Artificial Sequence
  chemically synthesized
tttaagtacattttgaaaat

SEQ ID NO: 608811 - DNA, 20 bp, Artificial Sequence
  chemically synthesized
aatttcattttgagcctcaa

SEQ ID NO: 608812 - DNA, 20 bp, Artificial Sequence
  chemically synthesized
ttgactgtgtgtgtgtgtgt

SEQ ID NO: 608813 - DNA, 20 bp, Artificial Sequence
  chemically synthesized
acacacacacacacagtcaa

SEQ ID NO: 608814 - DNA, 20 bp, Artificial Sequence
  chemically synthesized
aaatataaggggcgtagcct

SEQ ID NO: 608815 - DNA, 20 bp, Artificial Sequence
  chemically synthesized
acatattttacatcactttt

SEQ ID NO: 608816 - DNA, 20 bp, Artificial Sequence
  chemically synthesized
tctacctttgaccagtaagt

SEQ ID NO: 608817 - DNA, 20 bp, Artificial Sequence
  chemically synthesized
ttctttatcgcctaatagca

SEQ ID NO: 608818 - DNA, 20 bp, Artificial Sequence
  chemically synthesized
gataaagaatcttagagcag

SEQ ID NO: 608819 - DNA, 20 bp, Artificial Sequence
  chemically synthesized
attttggaatctttgctgct

SEQ ID NO: 608820 - DNA, 20 bp, Artificial Sequence
  chemically synthesized
agcagcaaagattccaaaat

SEQ ID NO: 608821 - DNA, 20 bp, Artificial Sequence
  chemically synthesized
ctaaagccatggaaataacc

SEQ ID NO: 608822 - DNA, 20 bp, Artificial Sequence
  chemically synthesized
cttaagcatagggttatttc

SEQ ID NO: 608823 - DNA, 20 bp, Artificial Sequence
  chemically synthesized
atgaaaatactttaggtggg

SEQ ID NO: 608824 - DNA, 20 bp, Artificial Sequence
  chemically synthesized
atcttgaacagagcttttta

SEQ ID NO: 608825 - DNA, 20 bp, Artificial Sequence
  chemically synthesized
tagagtaagttcatcttgaa

SEQ ID NO: 608826 - DNA, 20 bp, Artificial Sequence
  chemically synthesized
ggtccatcgactcgtactca

SEQ ID NO: 608827 - DNA, 20 bp, Artificial Sequence
  chemically synthesized
ccattgtaggatgcataaac

SEQ ID NO: 608828 - DNA, 20 bp, Artificial Sequence
  chemically synthesized
atgaatgggatccaagaatc

SEQ ID NO: 608829 - DNA, 20 bp, Artificial Sequence
  chemically synthesized
atcgtacaaatatggatata

SEQ ID NO: 608830 - DNA, 20 bp, Artificial Sequence
  chemically synthesized
cgatctctccaatcactgaa

SEQ ID NO: 608831 - DNA, 20 bp, Artificial Sequence
  chemically synthesized
tgatttttccaaactaattt

SEQ ID NO: 608832 - DNA, 20 bp, Artificial Sequence
  chemically synthesized
ttagtttggaaaaatcaaac

SEQ ID NO: 608833 - DNA, 20 bp, Artificial Sequence
  chemically synthesized
accttgtatttcaaacacat

SEQ ID NO: 608834 - DNA, 20 bp, Artificial Sequence
  chemically synthesized
tgctaccttgtatttcaaac

SEQ ID NO: 608835 - DNA, 20 bp, Artificial Sequence
  chemically synthesized
cttctattacgatgaggttg

SEQ ID NO: 608836 - DNA, 20 bp, Artificial Sequence
  chemically synthesized
gacgtaaaactgtgctgcag

SEQ ID NO: 608837 - DNA, 20 bp, Artificial Sequence
  chemically synthesized
caatataaaccctgctgcag

SEQ ID NO: 608838 - DNA, 20 bp, Artificial Sequence
  chemically synthesized
agcagggtttatattgcagg

SEQ ID NO: 608839 - DNA, 20 bp, Artificial Sequence
  chemically synthesized
cgtgaatctaatatattgtt

SEQ ID NO: 608840 - DNA, 20 bp, Artificial Sequence
  chemically synthesized
ttcaaaaccctgaacaatat

SEQ ID NO: 608841 - DNA, 20 bp, Artificial Sequence
  chemically synthesized
tttcttttatatgccccagt

SEQ ID NO: 608842 - DNA, 20 bp, Artificial Sequence
  chemically synthesized
atcacgtttcttttatatgc

SEQ ID NO: 608843 - DNA, 20 bp, Artificial Sequence
  chemically synthesized
tggggcatataaaagaaacg

SEQ ID NO: 608844 - DNA, 20 bp, Artificial Sequence
  chemically synthesized
tgatcaaatgaatgaaagca

SEQ ID NO: 608845 - DNA, 20 bp, Artificial Sequence
  chemically synthesized
tgctttcattcatttgatca

SEQ ID NO: 608846 - DNA, 20 bp, Artificial Sequence
  chemically synthesized
tattctagtccttttcctct

SEQ ID NO: 608847 - DNA, 20 bp, Artificial Sequence
  chemically synthesized
ctgacattacgatatttgca

SEQ ID NO: 608848 - DNA, 20 bp, Artificial Sequence
  chemically synthesized
actacaatgaggaaaaaaat

SEQ ID NO: 608849 - DNA, 20 bp, Artificial Sequence
  chemically synthesized
accattgttctgtcttcttt

SEQ ID NO: 608850 - DNA, 20 bp, Artificial Sequence
  chemically synthesized
atgtatctccctcttcctgg

SEQ ID NO: 608851 - DNA, 20 bp, Artificial Sequence
  chemically synthesized
gtaaagtcactgaactcaaa

SEQ ID NO: 608852 - DNA, 20 bp, Artificial Sequence
  chemically synthesized
agctccagatacactggcct

SEQ ID NO: 608853 - DNA, 20 bp, Artificial Sequence
  chemically synthesized
ctatagggaacaaatcacga

SEQ ID NO: 608854 - DNA, 20 bp, Artificial Sequence
  chemically synthesized
ggaacaaatcacgatggtgt

SEQ ID NO: 608855 - DNA, 20 bp, Artificial Sequence
  chemically synthesized
gaagaaaatccaaaacacca

SEQ ID NO: 608856 - DNA, 20 bp, Artificial Sequence
  chemically synthesized
gagtgtaaagtgaaattatt

SEQ ID NO: 608857 - DNA, 20 bp, Artificial Sequence
  chemically synthesized
ctcaacatcttctctactta

SEQ ID NO: 608858 - DNA, 20 bp, Artificial Sequence
  chemically synthesized
aatatggccatatatgttcc

SEQ ID NO: 608859 - DNA, 20 bp, Artificial Sequence
  chemically synthesized
taccactattccacaagacc

SEQ ID NO: 608860 - DNA, 20 bp, Artificial Sequence
  chemically synthesized
caagacccatcgattagaat

SEQ ID NO: 608861 - DNA, 20 bp, Artificial Sequence
  chemically synthesized
atcgattagaattatggatt

SEQ ID NO: 608862 - DNA, 20 bp, Artificial Sequence
  chemically synthesized
gaaccatatagctgtctaag

SEQ ID NO: 608863 - DNA, 20 bp, Artificial Sequence
  chemically synthesized
aggcagtcggtcacgggaca

SEQ ID NO: 608864 - DNA, 20 bp, Artificial Sequence
  chemically synthesized
tagtgagccctctgtcagag

SEQ ID NO: 608865 - DNA, 20 bp, Artificial Sequence
  chemically synthesized
aaatgtctcaaaatgcaata

SEQ ID NO: 608866 - DNA, 20 bp, Artificial Sequence
  chemically synthesized
catgaattttagcaagttaa

SEQ ID NO: 608867 - DNA, 20 bp, Artificial Sequence
  chemically synthesized
ttttagcaagttaacttagt

SEQ ID NO: 608868 - DNA, 20 bp, Artificial Sequence
  chemically synthesized
caattttggaatttaatttt

SEQ ID NO: 608869 - DNA, 20 bp, Artificial Sequence
  chemically synthesized
aacatggccatgctctcaaa

SEQ ID NO: 608870 - DNA, 20 bp, Artificial Sequence
  chemically synthesized
aacaaattttgagagcatgg

SEQ ID NO: 608871 - DNA, 20 bp, Artificial Sequence
  chemically synthesized
tcatagttcattttgtcctt

SEQ ID NO: 608872 - DNA, 20 bp, Artificial Sequence
  chemically synthesized
taacaccattcatatttatt

SEQ ID NO: 608873 - DNA, 20 bp, Artificial Sequence
  chemically synthesized
gcttgaactggaagtgacat

SEQ ID NO: 608874 - DNA, 20 bp, Artificial Sequence
  chemically synthesized
aaggtcttgtgctggcaatt

SEQ ID NO: 608875 - DNA, 20 bp, Artificial Sequence
  chemically synthesized
ctgggagtatcctagatagt

SEQ ID NO: 608876 - DNA, 20 bp, Artificial Sequence
  chemically synthesized
atagtagctgtttcatcagg

SEQ ID NO: 608877 - DNA, 20 bp, Artificial Sequence
  chemically synthesized
cacaatgaatagcgttccct

SEQ ID NO: 608878 - DNA, 20 bp, Artificial Sequence
  chemically synthesized
taataaccagatctagaatg

SEQ ID NO: 608879 - DNA, 20 bp, Artificial Sequence
  chemically synthesized
agaatgtgttactagtcact

SEQ ID NO: 608880 - DNA, 20 bp, Artificial Sequence
  chemically synthesized
atgataacccaattgtggtt

SEQ ID NO: 608881 - DNA, 20 bp, Artificial Sequence
  chemically synthesized
ctttaccatgataacccaat

SEQ ID NO: 608882 - DNA, 20 bp, Artificial Sequence
  chemically synthesized
acaattgggttatcatggta

SEQ ID NO: 608883 - DNA, 20 bp, Artificial Sequence
  chemically synthesized
atcatggtaaagagctttat

SEQ ID NO: 608884 - DNA, 20 bp, Artificial Sequence
  chemically synthesized
ttttctattgaaagaaggag

SEQ ID NO: 608885 - DNA, 20 bp, Artificial Sequence
  chemically synthesized
acattactgggtatataccc

SEQ ID NO: 608886 - DNA, 20 bp, Artificial Sequence
  chemically synthesized
gtacatgtatctttatagca

SEQ ID NO: 608887 - DNA, 20 bp, Artificial Sequence
  chemically synthesized
ctataaagatacatgtacac

SEQ ID NO: 608888 - DNA, 20 bp, Artificial Sequence
  chemically synthesized
ctatcattgttggacatttg

SEQ ID NO: 608889 - DNA, 20 bp, Artificial Sequence
  chemically synthesized
caaatgtccaacaatgatag

SEQ ID NO: 608890 - DNA, 20 bp, Artificial Sequence
  chemically synthesized
gtttgctgagaatgatggtt

SEQ ID NO: 608891 - DNA, 20 bp, Artificial Sequence
  chemically synthesized
tgcgatagtttgctgagaat

SEQ ID NO: 608892 - DNA, 20 bp, Artificial Sequence
  chemically synthesized
gtttggttttttgtccttgc

SEQ ID NO: 608893 - DNA, 20 bp, Artificial Sequence
  chemically synthesized
atgagtgagaacatgcggtg

SEQ ID NO: 608894 - DNA, 20 bp, Artificial Sequence
  chemically synthesized
cacctatgagtgagaacatg

SEQ ID NO: 608895 - DNA, 20 bp, Artificial Sequence
  chemically synthesized
tgtgtccatgtgttctcatt

SEQ ID NO: 608896 - DNA, 20 bp, Artificial Sequence
  chemically synthesized
atgtaaccattcacctaaca

SEQ ID NO: 608897 - DNA, 20 bp, Artificial Sequence
  chemically synthesized
ccactgagtaataatgactt

SEQ ID NO: 608898 - DNA, 20 bp, Artificial Sequence
  chemically synthesized
tatgtgctataacatttcac

SEQ ID NO: 608899 - DNA, 20 bp, Artificial Sequence
  chemically synthesized
gtgtatgtatgtgtgtgtgt

SEQ ID NO: 608900 - DNA, 20 bp, Artificial Sequence
  chemically synthesized
cacacacagtgtgtatacat

SEQ ID NO: 608901 - DNA, 20 bp, Artificial Sequence
  chemically synthesized
atagaacatactccctatgt

SEQ ID NO: 608902 - DNA, 20 bp, Artificial Sequence
  chemically synthesized
atatatactctatttgaaaa

SEQ ID NO: 608903 - DNA, 20 bp, Artificial Sequence
  chemically synthesized
atacatggttagattataag

SEQ ID NO: 608904 - DNA, 20 bp, Artificial Sequence
  chemically synthesized
aaagatagcactgatacatg

SEQ ID NO: 608905 - DNA, 20 bp, Artificial Sequence
  chemically synthesized
tataactatagcatgaattt

SEQ ID NO: 608906 - DNA, 20 bp, Artificial Sequence
  chemically synthesized
ttgcattaaaaatatttacc

SEQ ID NO: 608907 - DNA, 20 bp, Artificial Sequence
  chemically synthesized
acacttgaatagtgatcacc

SEQ ID NO: 608908 - DNA, 20 bp, Artificial Sequence
  chemically synthesized
tcctatggtgatcactattc

SEQ ID NO: 608909 - DNA, 20 bp, Artificial Sequence
  chemically synthesized
aaaacaggttttcaaagagg

SEQ ID NO: 608910 - DNA, 20 bp, Artificial Sequence
  chemically synthesized
taaactttccctctttgaaa

SEQ ID NO: 608911 - DNA, 20 bp, Artificial Sequence
  chemically synthesized
tgatgtaagacatagttaaa

SEQ ID NO: 608912 - DNA, 20 bp, Artificial Sequence
  chemically synthesized
tgtcttacatcatttcattt

SEQ ID NO: 608913 - DNA, 20 bp, Artificial Sequence
  chemically synthesized
attactcctaaatttaaatt

SEQ ID NO: 608914 - DNA, 20 bp, Artificial Sequence
  chemically synthesized
ggaaacatcaaaagttgtaa

SEQ ID NO: 608915 - DNA, 20 bp, Artificial Sequence
  chemically synthesized
ataagccctcttacaacttt

SEQ ID NO: 608916 - DNA, 20 bp, Artificial Sequence
  chemically synthesized
ctcttacaacttttgatgtt

SEQ ID NO: 608917 - DNA, 20 bp, Artificial Sequence
  chemically synthesized
tgcaaaattatcagtattat

SEQ ID NO: 608918 - DNA, 20 bp, Artificial Sequence
  chemically synthesized
ttatttttaactaccagata

SEQ ID NO: 608919 - DNA, 20 bp, Artificial Sequence
  chemically synthesized
ctatctggtagttaaaaata

SEQ ID NO: 608920 - DNA, 20 bp, Artificial Sequence
  chemically synthesized
ctggtagttaaaaataattt

SEQ ID NO: 608921 - DNA, 20 bp, Artificial Sequence
  chemically synthesized
ttttacatacttaatgatat

SEQ ID NO: 608922 - DNA, 20 bp, Artificial Sequence
  chemically synthesized
acttaatgatatatgggctt

SEQ ID NO: 608923 - DNA, 20 bp, Artificial Sequence
  chemically synthesized
gaattttcctattggggcat

SEQ ID NO: 608924 - DNA, 20 bp, Artificial Sequence
  chemically synthesized
tggggcattctagttttact

SEQ ID NO: 608925 - DNA, 20 bp, Artificial Sequence
  chemically synthesized
tagtaacatttataacatac

SEQ ID NO: 608926 - DNA, 20 bp, Artificial Sequence
  chemically synthesized
cttgcatcatgtattggtta

SEQ ID NO: 608927 - DNA, 20 bp, Artificial Sequence
  chemically synthesized
catttctattgcttcataga

SEQ ID NO: 608928 - DNA, 20 bp, Artificial Sequence
  chemically synthesized
tctatgaagcaatagaaatg

SEQ ID NO: 608929 - DNA, 20 bp, Artificial Sequence
  chemically synthesized
cttaaaaatcttaacatttc

SEQ ID NO: 608930 - DNA, 20 bp, Artificial Sequence
  chemically synthesized
atagaaatgttaagattttt

SEQ ID NO: 608931 - DNA, 20 bp, Artificial Sequence
  chemically synthesized
agccaggaataaatgtgaaa

SEQ ID NO: 608932 - DNA, 20 bp, Artificial Sequence
  chemically synthesized
aactttatttcacatttatt

SEQ ID NO: 608933 - DNA, 20 bp, Artificial Sequence
  chemically synthesized
agtattaccattaatttaat

SEQ ID NO: 608934 - DNA, 20 bp, Artificial Sequence
  chemically synthesized
ttaaattaatggtaatacta

SEQ ID NO: 608935 - DNA, 20 bp, Artificial Sequence
  chemically synthesized
atttaaatttcaggtgagct

SEQ ID NO: 608936 - DNA, 20 bp, Artificial Sequence
  chemically synthesized
aatgagaaataagattagcc

SEQ ID NO: 608937 - DNA, 20 bp, Artificial Sequence
  chemically synthesized
gatcattaatggaatgagaa

SEQ ID NO: 608938 - DNA, 20 bp, Artificial Sequence
  chemically synthesized
aggtattataaagtaaattt

SEQ ID NO: 608939 - DNA, 20 bp, Artificial Sequence
  chemically synthesized
ttaggaagcagataattgcc

SEQ ID NO: 608940 - DNA, 20 bp, Artificial Sequence
  chemically synthesized
tgctaaatccagtggcaatt

SEQ ID NO: 608941 - DNA, 20 bp, Artificial Sequence
  chemically synthesized
tagaaatttctatattgtgt

SEQ ID NO: 608942 - DNA, 20 bp, Artificial Sequence
  chemically synthesized
tcccaaggaaatttttggct

SEQ ID NO: 608943 - DNA, 20 bp, Artificial Sequence
  chemically synthesized
tataatgaagataaaatgta

SEQ ID NO: 608944 - DNA, 20 bp, Artificial Sequence
  chemically synthesized
cttatagtgaatatttatga

SEQ ID NO: 608945 - DNA, 20 bp, Artificial Sequence
  chemically synthesized
ttcataaatattcactataa

SEQ ID NO: 608946 - DNA, 20 bp, Artificial Sequence
  chemically synthesized
gatgagaggtatgtataaca

SEQ ID NO: 608947 - DNA, 20 bp, Artificial Sequence
  chemically synthesized
agaagtaagtatttaaaatg

SEQ ID NO: 608948 - DNA, 20 bp, Artificial Sequence
  chemically synthesized
taaaatgctaagcttgaaaa

SEQ ID NO: 608949 - DNA, 20 bp, Artificial Sequence
  chemically synthesized
tgtgtagcaaatccagattt

SEQ ID NO: 608950 - DNA, 20 bp, Artificial Sequence
  chemically synthesized
cctcttttatgtgtagcaaa

SEQ ID NO: 608951 - DNA, 20 bp, Artificial Sequence
  chemically synthesized
atgcagatgatctagaaatg

SEQ ID NO: 608952 - DNA, 20 bp, Artificial Sequence
  chemically synthesized
tcatcattaatccttccaaa

SEQ ID NO: 608953 - DNA, 20 bp, Artificial Sequence
  chemically synthesized
ggggaaataaactatctttg

SEQ ID NO: 608954 - DNA, 20 bp, Artificial Sequence
  chemically synthesized
ccaaagatagtttatttccc

SEQ ID NO: 608955 - DNA, 20 bp, Artificial Sequence
  chemically synthesized
gtcacatattttgttcatta

SEQ ID NO: 608956 - DNA, 20 bp, Artificial Sequence
  chemically synthesized
atatgtgaccgttaattatg

SEQ ID NO: 608957 - DNA, 20 bp, Artificial Sequence
  chemically synthesized
taatatttttctttacattg

SEQ ID NO: 608958 - DNA, 20 bp, Artificial Sequence
  chemically synthesized
caaacttttttgttttcact

SEQ ID NO: 608959 - DNA, 20 bp, Artificial Sequence
  chemically synthesized
taaactcttagtgaaaacaa

SEQ ID NO: 608960 - DNA, 20 bp, Artificial Sequence
  chemically synthesized
tcaaatctactagcaaactt

SEQ ID NO: 608961 - DNA, 20 bp, Artificial Sequence
  chemically synthesized
tgaaaacaaaaaagtttgct

SEQ ID NO: 608962 - DNA, 20 bp, Artificial Sequence
  chemically synthesized
gctagtagatttgagaccca

SEQ ID NO: 608963 - DNA, 20 bp, Artificial Sequence
  chemically synthesized
aggaggctctgtgttaatct

SEQ ID NO: 608964 - DNA, 20 bp, Artificial Sequence
  chemically synthesized
cataaacttgttaccaaact

SEQ ID NO: 608965 - DNA, 20 bp, Artificial Sequence
  chemically synthesized
gttaatctacaagtttggta

SEQ ID NO: 608966 - DNA, 20 bp, Artificial Sequence
  chemically synthesized
caagtttggtaacaagttta

SEQ ID NO: 608967 - DNA, 20 bp, Artificial Sequence
  chemically synthesized
atatcagtgaaaaaatgtaa

SEQ ID NO: 608968 - DNA, 20 bp, Artificial Sequence
  chemically synthesized
gtgctgccagaattctatag

SEQ ID NO: 608969 - DNA, 20 bp, Artificial Sequence
  chemically synthesized
cgccttggccatccaaagtt

SEQ ID NO: 608970 - DNA, 20 bp, Artificial Sequence
  chemically synthesized
tttgtatttttcagtagaga

SEQ ID NO: 608971 - DNA, 20 bp, Artificial Sequence
  chemically synthesized
tcaggaggctgaggcaggag

SEQ ID NO: 608972 - DNA, 20 bp, Artificial Sequence
  chemically synthesized
ttttttttttttttttgaga

SEQ ID NO: 608973 - DNA, 20 bp, Artificial Sequence
  chemically synthesized
aagaaaagaaagaaatgtat

SEQ ID NO: 608974 - DNA, 20 bp, Artificial Sequence
  chemically synthesized
ataattaagatacatgacaa

SEQ ID NO: 608975 - DNA, 20 bp, Artificial Sequence
  chemically synthesized
tgatgttacaacactttgaa

SEQ ID NO: 608976 - DNA, 20 bp, Artificial Sequence
  chemically synthesized
aaggttaataatttaaagag

SEQ ID NO: 608977 - DNA, 20 bp, Artificial Sequence
  chemically synthesized
aaaatattttctgaaaacaa

SEQ ID NO: 608978 - DNA, 20 bp, Artificial Sequence
  chemically synthesized
attaattttattacaatcta

SEQ ID NO: 608979 - DNA, 20 bp, Artificial Sequence
  chemically synthesized
gtttctacattcattaagta

SEQ ID NO: 608980 - DNA, 20 bp, Artificial Sequence
  chemically synthesized
acattttctgtagggcgatc

SEQ ID NO: 608981 - DNA, 20 bp, Artificial Sequence
  chemically synthesized
aaaatgtgacagtgtgatga

SEQ ID NO: 608982 - DNA, 20 bp, Artificial Sequence
  chemically synthesized
tgttaaacatgatgtcttct

SEQ ID NO: 608983 - DNA, 20 bp, Artificial Sequence
  chemically synthesized
ttataatccttaagaagaca

SEQ ID NO: 608984 - DNA, 20 bp, Artificial Sequence
  chemically synthesized
agatatgctaagtcatgtac

SEQ ID NO: 608985 - DNA, 20 bp, Artificial Sequence
  chemically synthesized
aggtacatgacttagcatat

SEQ ID NO: 608986 - DNA, 20 bp, Artificial Sequence
  chemically synthesized
acctgtaaaatgaaaggtgt

SEQ ID NO: 608987 - DNA, 20 bp, Artificial Sequence
  chemically synthesized
acacatacaaattatttcca

SEQ ID NO: 608988 - DNA, 20 bp, Artificial Sequence
  chemically synthesized
aggagccgaaatggccactt

SEQ ID NO: 608989 - DNA, 20 bp, Artificial Sequence
  chemically synthesized
aatatccaggctcctgatta

SEQ ID NO: 608990 - DNA, 20 bp, Artificial Sequence
  chemically synthesized
agatcttcaaatatccaggc

SEQ ID NO: 608991 - DNA, 20 bp, Artificial Sequence
  chemically synthesized
ctggatatttgaagatctgt

SEQ ID NO: 608992 - DNA, 20 bp, Artificial Sequence
  chemically synthesized
gatgactgtacttgttttag

SEQ ID NO: 608993 - DNA, 20 bp, Artificial Sequence
  chemically synthesized
ctctacttactgatgactgt

SEQ ID NO: 608994 - DNA, 20 bp, Artificial Sequence
  chemically synthesized
tagccacatttcccaactaa

SEQ ID NO: 608995 - DNA, 20 bp, Artificial Sequence
  chemically synthesized
agaagaatcttgtaagttct

SEQ ID NO: 608996 - DNA, 20 bp, Artificial Sequence
  chemically synthesized
aatacaatctgtcagaactt

SEQ ID NO: 608997 - DNA, 20 bp, Artificial Sequence
  chemically synthesized
atttttttaagatggataca

SEQ ID NO: 608998 - DNA, 20 bp, Artificial Sequence
  chemically synthesized
tgatacttctccatcaagag

SEQ ID NO: 608999 - DNA, 20 bp, Artificial Sequence
  chemically synthesized
ttctccatcaagagttgggt

SEQ ID NO: 609000 - DNA, 20 bp, Artificial Sequence
  chemically synthesized
gactaagtcacaaaaggcaa

SEQ ID NO: 609001 - DNA, 20 bp, Artificial Sequence
  chemically synthesized
gtcacaaaaggcaatagagt

SEQ ID NO: 609002 - DNA, 20 bp, Artificial Sequence
  chemically synthesized
cagtcactcactaaatgctg

SEQ ID NO: 609003 - DNA, 20 bp, Artificial Sequence
  chemically synthesized
gccagcatttagtgagtgac

SEQ ID NO: 609004 - DNA, 20 bp, Artificial Sequence
  chemically synthesized
gatgaagctgaagtcatttt

SEQ ID NO: 609005 - DNA, 20 bp, Artificial Sequence
  chemically synthesized
gaagaagccttcaaaatgac

SEQ ID NO: 609006 - DNA, 20 bp, Artificial Sequence
  chemically synthesized
ttctgggtctcagatgggtt

SEQ ID NO: 609007 - DNA, 20 bp, Artificial Sequence
  chemically synthesized
ttcgtttttcttattatctc

SEQ ID NO: 609008 - DNA, 20 bp, Artificial Sequence
  chemically synthesized
gagataataagaaaaacgaa

SEQ ID NO: 609009 - DNA, 20 bp, Artificial Sequence
  chemically synthesized
tgggagcttataaaaacaac

SEQ ID NO: 609010 - DNA, 20 bp, Artificial Sequence
  chemically synthesized
aatgttgtttttataagctc

SEQ ID NO: 609011 - DNA, 20 bp, Artificial Sequence
  chemically synthesized
agcaaatcaactcaaaactt

SEQ ID NO: 609012 - DNA, 20 bp, Artificial Sequence
  chemically synthesized
ttataagctcccaagttttg

SEQ ID NO: 609013 - DNA, 20 bp, Artificial Sequence
  chemically synthesized
agctcacctgtgtaatacag

SEQ ID NO: 609014 - DNA, 20 bp, Artificial Sequence
  chemically synthesized
tatctcttggcatacctgtg

SEQ ID NO: 609015 - DNA, 20 bp, Artificial Sequence
  chemically synthesized
gaagtaagaattcgtgttac

SEQ ID NO: 609016 - DNA, 20 bp, Artificial Sequence
  chemically synthesized
gaattcttacttccataaag

SEQ ID NO: 609017 - DNA, 20 bp, Artificial Sequence
  chemically synthesized
attttaatacttttttattt

SEQ ID NO: 609018 - DNA, 20 bp, Artificial Sequence
  chemically synthesized
aaataaaaaagtattaaaat

SEQ ID NO: 609019 - DNA, 20 bp, Artificial Sequence
  chemically synthesized
tggagatccaaacaaactat

SEQ ID NO: 609020 - DNA, 20 bp, Artificial Sequence
  chemically synthesized
cttatttgtaatcattaata

SEQ ID NO: 609021 - DNA, 20 bp, Artificial Sequence
  chemically synthesized
gcggcttatttgtaatcatt

SEQ ID NO: 609022 - DNA, 20 bp, Artificial Sequence
  chemically synthesized
attacaaataagccgccctg

SEQ ID NO: 609023 - DNA, 20 bp, Artificial Sequence
  chemically synthesized
ccggtgtttaagcaggtcag

SEQ ID NO: 609024 - DNA, 20 bp, Artificial Sequence
  chemically synthesized
gacctgcttaaacaccggaa

SEQ ID NO: 609025 - DNA, 20 bp, Artificial Sequence
  chemically synthesized
aatttagctaatctgtgttc

SEQ ID NO: 609026 - DNA, 20 bp, Artificial Sequence
  chemically synthesized
agtcatgtttattacatttt

SEQ ID NO: 609027 - DNA, 20 bp, Artificial Sequence
  chemically synthesized
tttgaatgctctcatttaag

SEQ ID NO: 609028 - DNA, 20 bp, Artificial Sequence
  chemically synthesized
ttacatttggtaaagatatt

SEQ ID NO: 609029 - DNA, 20 bp, Artificial Sequence
  chemically synthesized
acattttttgacttatattt

SEQ ID NO: 609030 - DNA, 20 bp, Artificial Sequence
  chemically synthesized
ctaacactctatgtgatagt

SEQ ID NO: 609031 - DNA, 20 bp, Artificial Sequence
  chemically synthesized
atgctattttctctctatta

SEQ ID NO: 609032 - DNA, 20 bp, Artificial Sequence
  chemically synthesized
agcatatgcaggtcccacag

SEQ ID NO: 609033 - DNA, 20 bp, Artificial Sequence
  chemically synthesized
agactagattcctattatac

SEQ ID NO: 609034 - DNA, 20 bp, Artificial Sequence
  chemically synthesized
atattccttaatgttcttcg

SEQ ID NO: 609035 - DNA, 20 bp, Artificial Sequence
  chemically synthesized
tgtcctctgaattattctat

SEQ ID NO: 609036 - DNA, 20 bp, Artificial Sequence
  chemically synthesized
atccatgtcccaaatacatt

SEQ ID NO: 609037 - DNA, 20 bp, Artificial Sequence
  chemically synthesized
aataacattcccacactatt

SEQ ID NO: 609038 - DNA, 20 bp, Artificial Sequence
  chemically synthesized
ttaggaaattgatgcttaaa

SEQ ID NO: 609039 - DNA, 20 bp, Artificial Sequence
  chemically synthesized
atcaaaataggttaggaaat

SEQ ID NO: 609040 - DNA, 20 bp, Artificial Sequence
  chemically synthesized
atttgtggagttacatcttt

SEQ ID NO: 609041 - DNA, 20 bp, Artificial Sequence
  chemically synthesized
ataaaattttcatacttaat

SEQ ID NO: 609042 - DNA, 20 bp, Artificial Sequence
  chemically synthesized
gggctttaccttaaataact

SEQ ID NO: 609043 - DNA, 20 bp, Artificial Sequence
  chemically synthesized
aaacctagaggtttttaaaa

SEQ ID NO: 609044 - DNA, 20 bp, Artificial Sequence
  chemically synthesized
aatcatttttttaaaaacct

SEQ ID NO: 609045 - DNA, 20 bp, Artificial Sequence
  chemically synthesized
gtgttatagtccaaaaacct

SEQ ID NO: 609046 - DNA, 20 bp, Artificial Sequence
  chemically synthesized
tgttcatagtggtctcttta

SEQ ID NO: 609047 - DNA, 20 bp, Artificial Sequence
  chemically synthesized
atttaaccatgtttttagat

SEQ ID NO: 609048 - DNA, 20 bp, Artificial Sequence
  chemically synthesized
tctaggaatttaaccatgtt

SEQ ID NO: 609049 - DNA, 20 bp, Artificial Sequence
  chemically synthesized
ttatgtttctaggaatttaa

SEQ ID NO: 609050 - DNA, 20 bp, Artificial Sequence
  chemically synthesized
cagttcagatttggtaggtt

SEQ ID NO: 609051 - DNA, 20 bp, Artificial Sequence
  chemically synthesized
ttttacacagttcagatttg

SEQ ID NO: 609052 - DNA, 20 bp, Artificial Sequence
  chemically synthesized
acttttccatttttacacag

SEQ ID NO: 609053 - DNA, 20 bp, Artificial Sequence
  chemically synthesized
ctgaatagatcaatacaagt

SEQ ID NO: 609054 - DNA, 20 bp, Artificial Sequence
  chemically synthesized
gtcttttgcttttctttgtt

SEQ ID NO: 609055 - DNA, 20 bp, Artificial Sequence
  chemically synthesized
acttatgaagtcacctcgtc

SEQ ID NO: 609056 - DNA, 20 bp, Artificial Sequence
  chemically synthesized
aaaagacgaggtgacttcat

SEQ ID NO: 609057 - DNA, 20 bp, Artificial Sequence
  chemically synthesized
tggcattaattttctttaaa

SEQ ID NO: 609058 - DNA, 20 bp, Artificial Sequence
  chemically synthesized
tttttaaagaaaattaatgc

SEQ ID NO: 609059 - DNA, 20 bp, Artificial Sequence
  chemically synthesized
tttggaagtgctccctccac

SEQ ID NO: 609060 - DNA, 20 bp, Artificial Sequence
  chemically synthesized
gttttcttgggatgtctttt

SEQ ID NO: 609061 - DNA, 20 bp, Artificial Sequence
  chemically synthesized
atctgtcaaggatattgagt

SEQ ID NO: 609062 - DNA, 20 bp, Artificial Sequence
  chemically synthesized
ggatcatataccatgaccaa

SEQ ID NO: 609063 - DNA, 20 bp, Artificial Sequence
  chemically synthesized
ttaacgtggtgtatcatact

SEQ ID NO: 609064 - DNA, 20 bp, Artificial Sequence
  chemically synthesized
catttcattagatgctgaaa

SEQ ID NO: 609065 - DNA, 20 bp, Artificial Sequence
  chemically synthesized
attgtgttgaattttgccaa

SEQ ID NO: 609066 - DNA, 20 bp, Artificial Sequence
  chemically synthesized
tcctagtttgttgagagttt

SEQ ID NO: 609067 - DNA, 20 bp, Artificial Sequence
  chemically synthesized
ccttctattcctagtttgtt

SEQ ID NO: 609068 - DNA, 20 bp, Artificial Sequence
  chemically synthesized
tgaagcaatttccttctatt

SEQ ID NO: 609069 - DNA, 20 bp, Artificial Sequence
  chemically synthesized
acaaactaggaatagaagga

SEQ ID NO: 609070 - DNA, 20 bp, Artificial Sequence
  chemically synthesized
tgacctgcgatctttttata

SEQ ID NO: 609071 - DNA, 20 bp, Artificial Sequence
  chemically synthesized
atcacaacaactgcgaactg

SEQ ID NO: 609072 - DNA, 20 bp, Artificial Sequence
  chemically synthesized
acttaccttgttcctcctgt

SEQ ID NO: 609073 - DNA, 20 bp, Artificial Sequence
  chemically synthesized
ataggaataacattcttcat

SEQ ID NO: 609074 - DNA, 20 bp, Artificial Sequence
  chemically synthesized
gattctagggttttctattc

SEQ ID NO: 609075 - DNA, 20 bp, Artificial Sequence
  chemically synthesized
ctagtgtttttaatggattc

SEQ ID NO: 609076 - DNA, 20 bp, Artificial Sequence
  chemically synthesized
aaattggttctagtgttttt

SEQ ID NO: 609077 - DNA, 20 bp, Artificial Sequence
  chemically synthesized
actgatttttaaattggttc

SEQ ID NO: 609078 - DNA, 20 bp, Artificial Sequence
  chemically synthesized
gattttgtatcctacaactt

SEQ ID NO: 609079 - DNA, 20 bp, Artificial Sequence
  chemically synthesized
aaactcaactaatttttgta

SEQ ID NO: 609080 - DNA, 20 bp, Artificial Sequence
  chemically synthesized
aatcatcatacaaaaattag

SEQ ID NO: 609081 - DNA, 20 bp, Artificial Sequence
  chemically synthesized
ctttgacctctttagtttat

SEQ ID NO: 609082 - DNA, 20 bp, Artificial Sequence
  chemically synthesized
agtacatactctttgacctc

SEQ ID NO: 609083 - DNA, 20 bp, Artificial Sequence
  chemically synthesized
aatttctttcatcaatgttt

SEQ ID NO: 609084 - DNA, 20 bp, Artificial Sequence
  chemically synthesized
tcatctttaatttctttcat

SEQ ID NO: 609085 - DNA, 20 bp, Artificial Sequence
  chemically synthesized
tgaatgtaggatgtctttcc

SEQ ID NO: 609086 - DNA, 20 bp, Artificial Sequence
  chemically synthesized
gataaagattatattagttc

SEQ ID NO: 609087 - DNA, 20 bp, Artificial Sequence
  chemically synthesized
aaatgccattggaattttga

SEQ ID NO: 609088 - DNA, 20 bp, Artificial Sequence
  chemically synthesized
atatgaatttcagagttttt

SEQ ID NO: 609089 - DNA, 20 bp, Artificial Sequence
  chemically synthesized
ttgtggttccatatgaattt

SEQ ID NO: 609090 - DNA, 20 bp, Artificial Sequence
  chemically synthesized
ctcaaggttgatttagccat

SEQ ID NO: 609091 - DNA, 20 bp, Artificial Sequence
  chemically synthesized
attttgtacttctttctcaa

SEQ ID NO: 609092 - DNA, 20 bp, Artificial Sequence
  chemically synthesized
aaaattggaggtatcacact

SEQ ID NO: 609093 - DNA, 20 bp, Artificial Sequence
  chemically synthesized
tacaatttatttttaattac

SEQ ID NO: 609094 - DNA, 20 bp, Artificial Sequence
  chemically synthesized
acatcagttaaccctatatg

SEQ ID NO: 609095 - DNA, 20 bp, Artificial Sequence
  chemically synthesized
gattatcctttcctccttgt

SEQ ID NO: 609096 - DNA, 20 bp, Artificial Sequence
  chemically synthesized
ttttccaacaccatttgttg

SEQ ID NO: 609097 - DNA, 20 bp, Artificial Sequence
  chemically synthesized
cattattttgcacgtggata

SEQ ID NO: 609098 - DNA, 20 bp, Artificial Sequence
  chemically synthesized
cacgtgcaaaataatgaaat

SEQ ID NO: 609099 - DNA, 20 bp, Artificial Sequence
  chemically synthesized
gttttacatttacatatttt

SEQ ID NO: 609100 - DNA, 20 bp, Artificial Sequence
  chemically synthesized
cttctaggagttttatggat

SEQ ID NO: 609101 - DNA, 20 bp, Artificial Sequence
  chemically synthesized
atgttttcttctaggagttt

SEQ ID NO: 609102 - DNA, 20 bp, Artificial Sequence
  chemically synthesized
tttttccaatgttttcttct

SEQ ID NO: 609103 - DNA, 20 bp, Artificial Sequence
  chemically synthesized
tgaatgtcacaagatttttc

SEQ ID NO: 609104 - DNA, 20 bp, Artificial Sequence
  chemically synthesized
taattgcgaggatgaatgtc

SEQ ID NO: 609105 - DNA, 20 bp, Artificial Sequence
  chemically synthesized
attttttttgcttttattgc

SEQ ID NO: 609106 - DNA, 20 bp, Artificial Sequence
  chemically synthesized
aattctattttttttgcttt

SEQ ID NO: 609107 - DNA, 20 bp, Artificial Sequence
  chemically synthesized
tgtagtcttaattctatttt

SEQ ID NO: 609108 - DNA, 20 bp, Artificial Sequence
  chemically synthesized
actacataaaactaaaaatc

SEQ ID NO: 609109 - DNA, 20 bp, Artificial Sequence
  chemically synthesized
ccttttctaaacagaagatt

SEQ ID NO: 609110 - DNA, 20 bp, Artificial Sequence
  chemically synthesized
atttgttcccttttctaaac

SEQ ID NO: 609111 - DNA, 20 bp, Artificial Sequence
  chemically synthesized
catagattgccttttcacag

SEQ ID NO: 609112 - DNA, 20 bp, Artificial Sequence
  chemically synthesized
tggtttgtattttcccattc

SEQ ID NO: 609113 - DNA, 20 bp, Artificial Sequence
  chemically synthesized
taattctcataatatatata

SEQ ID NO: 609114 - DNA, 20 bp, Artificial Sequence
  chemically synthesized
caaaaagacagcaaccaata

SEQ ID NO: 609115 - DNA, 20 bp, Artificial Sequence
  chemically synthesized
gattactattttaaatacat

SEQ ID NO: 609116 - DNA, 20 bp, Artificial Sequence
  chemically synthesized
ttaaatacatcagggcttag

SEQ ID NO: 609117 - DNA, 20 bp, Artificial Sequence
  chemically synthesized
agcccatttttaattgcgtt

SEQ ID NO: 609118 - DNA, 20 bp, Artificial Sequence
  chemically synthesized
agcctttagcccatttttaa

SEQ ID NO: 609119 - DNA, 20 bp, Artificial Sequence
  chemically synthesized
aacgcaattaaaaatgggct

SEQ ID NO: 609120 - DNA, 20 bp, Artificial Sequence
  chemically synthesized
ggtataaatgtgatagctca

SEQ ID NO: 609121 - DNA, 20 bp, Artificial Sequence
  chemically synthesized
ttggatgcctactattaaaa

SEQ ID NO: 609122 - DNA, 20 bp, Artificial Sequence
  chemically synthesized
attgctagatcaagtgggag

SEQ ID NO: 609123 - DNA, 20 bp, Artificial Sequence
  chemically synthesized
ttttggataaatatccaaaa

SEQ ID NO: 609124 - DNA, 20 bp, Artificial Sequence
  chemically synthesized
ttgcaggtatcccttcaaga

SEQ ID NO: 609125 - DNA, 20 bp, Artificial Sequence
  chemically synthesized
catccatcagtggacactga

SEQ ID NO: 609126 - DNA, 20 bp, Artificial Sequence
  chemically synthesized
aaaatgtggtatatacatac

SEQ ID NO: 609127 - DNA, 20 bp, Artificial Sequence
  chemically synthesized
gtcacataaggacaaacact

SEQ ID NO: 609128 - DNA, 20 bp, Artificial Sequence
  chemically synthesized
ctcttataagtagaatcatg

SEQ ID NO: 609129 - DNA, 20 bp, Artificial Sequence
  chemically synthesized
ctatttcactctctgatttg

SEQ ID NO: 609130 - DNA, 20 bp, Artificial Sequence
  chemically synthesized
ctagcaactactatttcact

SEQ ID NO: 609131 - DNA, 20 bp, Artificial Sequence
  chemically synthesized
tagctgaaccttcgttaatt

SEQ ID NO: 609132 - DNA, 20 bp, Artificial Sequence
  chemically synthesized
aacatgggattcaccctctt

SEQ ID NO: 609133 - DNA, 20 bp, Artificial Sequence
  chemically synthesized
tgtgtgtaagaacacttaac

SEQ ID NO: 609134 - DNA, 20 bp, Artificial Sequence
  chemically synthesized
attttcaacagttacactct

SEQ ID NO: 609135 - DNA, 20 bp, Artificial Sequence
  chemically synthesized
atattcacttcaaggttcct

SEQ ID NO: 609136 - DNA, 20 bp, Artificial Sequence
  chemically synthesized
gttgagctaaaacctaacaa

SEQ ID NO: 609137 - DNA, 20 bp, Artificial Sequence
  chemically synthesized
attacccagaaacagaattg

SEQ ID NO: 609138 - DNA, 20 bp, Artificial Sequence
  chemically synthesized
tcagtcacatcaggatgtat

SEQ ID NO: 609139 - DNA, 20 bp, Artificial Sequence
  chemically synthesized
ttagattaaaagtatcacta

SEQ ID NO: 609140 - DNA, 20 bp, Artificial Sequence
  chemically synthesized
gccagccagggagaccactc

SEQ ID NO: 609141 - DNA, 20 bp, Artificial Sequence
  chemically synthesized
tctaaggagtggtctccctg

SEQ ID NO: 609142 - DNA, 20 bp, Artificial Sequence
  chemically synthesized
tccctggctggcttcccatc

SEQ ID NO: 609143 - DNA, 20 bp, Artificial Sequence
  chemically synthesized
gttgggaggggatgaggcag

SEQ ID NO: 609144 - DNA, 20 bp, Artificial Sequence
  chemically synthesized
ctgcctcatcccctcccaac

SEQ ID NO: 609145 - DNA, 20 bp, Artificial Sequence
  chemically synthesized
ctggatgtaaaatcacccag

SEQ ID NO: 609146 - DNA, 20 bp, Artificial Sequence
  chemically synthesized
aaagcagaaaaagcacttct

SEQ ID NO: 609147 - DNA, 20 bp, Artificial Sequence
  chemically synthesized
aaatcacccagaagtgcttt

SEQ ID NO: 609148 - DNA, 20 bp, Artificial Sequence
  chemically synthesized
atgttctgctctgcatggtt

SEQ ID NO: 609149 - DNA, 20 bp, Artificial Sequence
  chemically synthesized
ggcaagttaatataccgagt

SEQ ID NO: 609150 - DNA, 20 bp, Artificial Sequence
  chemically synthesized
tgccgaactctatacaggtt

SEQ ID NO: 609151 - DNA, 20 bp, Artificial Sequence
  chemically synthesized
gaactctatacaggttgtga

SEQ ID NO: 609152 - DNA, 20 bp, Artificial Sequence
  chemically synthesized
atgagaagagatagcctgga

SEQ ID NO: 609153 - DNA, 20 bp, Artificial Sequence
  chemically synthesized
acttttatgagaagagatag

SEQ ID NO: 609154 - DNA, 20 bp, Artificial Sequence
  chemically synthesized
ggtctgatctgagaaaattt

SEQ ID NO: 609155 - DNA, 20 bp, Artificial Sequence
  chemically synthesized
ttagatacatcaggggttag

SEQ ID NO: 609156 - DNA, 20 bp, Artificial Sequence
  chemically synthesized
agtagtaatcatattggttg

SEQ ID NO: 609157 - DNA, 20 bp, Artificial Sequence
  chemically synthesized
ttctcaaaacccggcaacca

SEQ ID NO: 609158 - DNA, 20 bp, Artificial Sequence
  chemically synthesized
ccgggttttgagaacttaca

SEQ ID NO: 609159 - DNA, 20 bp, Artificial Sequence
  chemically synthesized
atagttattaggagtgttaa

SEQ ID NO: 609160 - DNA, 20 bp, Artificial Sequence
  chemically synthesized
taataactatatgagttaga

SEQ ID NO: 609161 - DNA, 20 bp, Artificial Sequence
  chemically synthesized
ttcctcatgtgtattattga

SEQ ID NO: 609162 - DNA, 20 bp, Artificial Sequence
  chemically synthesized
gaatttcttgaactctgggc

SEQ ID NO: 609163 - DNA, 20 bp, Artificial Sequence
  chemically synthesized
gaaagactcaatttgccctt

SEQ ID NO: 609164 - DNA, 20 bp, Artificial Sequence
  chemically synthesized
gaatccatttccatgccttt

SEQ ID NO: 609165 - DNA, 20 bp, Artificial Sequence
  chemically synthesized
gaagctagaaaaggcatgga

SEQ ID NO: 609166 - DNA, 20 bp, Artificial Sequence
  chemically synthesized
gttaatgttagctgaatgag

SEQ ID NO: 609167 - DNA, 20 bp, Artificial Sequence
  chemically synthesized
attttacagttctttagttc

SEQ ID NO: 609168 - DNA, 20 bp, Artificial Sequence
  chemically synthesized
actgtaaaataatgaatatg

SEQ ID NO: 609169 - DNA, 20 bp, Artificial Sequence
  chemically synthesized
atatgtgttgattaggggca

SEQ ID NO: 609170 - DNA, 20 bp, Artificial Sequence
  chemically synthesized
tcatgtgtctatatgtatta

SEQ ID NO: 609171 - DNA, 20 bp, Artificial Sequence
  chemically synthesized
tcgaactaatacatatagac

SEQ ID NO: 609172 - DNA, 20 bp, Artificial Sequence
  chemically synthesized
gatgggttaatttaaaagaa

SEQ ID NO: 609173 - DNA, 20 bp, Artificial Sequence
  chemically synthesized
tggccatcaactattcaggg

SEQ ID NO: 609174 - DNA, 20 bp, Artificial Sequence
  chemically synthesized
gctcactgcaacctccacct

SEQ ID NO: 609175 - DNA, 20 bp, Artificial Sequence
  chemically synthesized
gcttcaagcaatcctcatgc

SEQ ID NO: 609176 - DNA, 20 bp, Artificial Sequence
  chemically synthesized
ttgggaagctgaggcatgag

SEQ ID NO: 609177 - DNA, 20 bp, Artificial Sequence
  chemically synthesized
ctacttgggaagctgaggca

SEQ ID NO: 609178 - DNA, 20 bp, Artificial Sequence
  chemically synthesized
tgcctcagcttcccaagtag

SEQ ID NO: 609179 - DNA, 20 bp, Artificial Sequence
  chemically synthesized
ttacaggtgtgtgccaccac

SEQ ID NO: 609180 - DNA, 20 bp, Artificial Sequence
  chemically synthesized
ccaccacactcgcttaattt

SEQ ID NO: 609181 - DNA, 20 bp, Artificial Sequence
  chemically synthesized
gcctggccaacatggcaaaa

SEQ ID NO: 609182 - DNA, 20 bp, Artificial Sequence
  chemically synthesized
cggggagatcacttgaggct

SEQ ID NO: 609183 - DNA, 20 bp, Artificial Sequence
  chemically synthesized
cgcgtcatcctccaaaagag

SEQ ID NO: 609184 - DNA, 20 bp, Artificial Sequence
  chemically synthesized
ccactacacccagctcgcgg

SEQ ID NO: 609185 - DNA, 20 bp, Artificial Sequence
  chemically synthesized
tacacccagctcgcggtgta

SEQ ID NO: 609186 - DNA, 20 bp, Artificial Sequence
  chemically synthesized
agggtagccttcacttttac

SEQ ID NO: 609187 - DNA, 20 bp, Artificial Sequence
  chemically synthesized
gtgtgtgtatttggaggtgt

SEQ ID NO: 609188 - DNA, 20 bp, Artificial Sequence
  chemically synthesized
cgataaagttacatgctctc

SEQ ID NO: 609189 - DNA, 20 bp, Artificial Sequence
  chemically synthesized
aactttatcggtcaaaatgg

SEQ ID NO: 609190 - DNA, 20 bp, Artificial Sequence
  chemically synthesized
actgtagtaactgctatata

SEQ ID NO: 609191 - DNA, 20 bp, Artificial Sequence
  chemically synthesized
atttcccagacatcgtaccc

SEQ ID NO: 609192 - DNA, 20 bp, Artificial Sequence
  chemically synthesized
gctgatgagttcaaataaca

SEQ ID NO: 609193 - DNA, 20 bp, Artificial Sequence
  chemically synthesized
tttctctgaaaacactttct

SEQ ID NO: 609194 - DNA, 20 bp, Artificial Sequence
  chemically synthesized
gcattctggaatccagaaga

SEQ ID NO: 609195 - DNA, 20 bp, Artificial Sequence
  chemically synthesized
ttggcaatcttatcctggcc

SEQ ID NO: 609196 - DNA, 20 bp, Artificial Sequence
  chemically synthesized
atttaaatccatcggccagg

SEQ ID NO: 609197 - DNA, 20 bp, Artificial Sequence
  chemically synthesized
ttcatagcctcataggcacc

SEQ ID NO: 609198 - DNA, 20 bp, Artificial Sequence
  chemically synthesized
tcataggcacctcaagatta

SEQ ID NO: 609199 - DNA, 20 bp, Artificial Sequence
  chemically synthesized
ttgggagtgaacgttaggat

SEQ ID NO: 609200 - DNA, 20 bp, Artificial Sequence
  chemically synthesized
aacaggtttgggagtgaacg

SEQ ID NO: 609201 - DNA, 20 bp, Artificial Sequence
  chemically synthesized
tgggtgagactgtagaagga

SEQ ID NO: 609202 - DNA, 20 bp, Artificial Sequence
  chemically synthesized
ccttctacagtctcacccat

SEQ ID NO: 609203 - DNA, 20 bp, Artificial Sequence
  chemically synthesized
tgtggcaactctatttggcc

SEQ ID NO: 609204 - DNA, 20 bp, Artificial Sequence
  chemically synthesized
gtaagaaacctcacggtaat

SEQ ID NO: 609205 - DNA, 20 bp, Artificial Sequence
  chemically synthesized
agagaaatcaaggattaccg

SEQ ID NO: 609206 - DNA, 20 bp, Artificial Sequence
  chemically synthesized
tatgaaataattagagaaat

SEQ ID NO: 609207 - DNA, 20 bp, Artificial Sequence
  chemically synthesized
ttaattttatctgtgagctt

SEQ ID NO: 609208 - DNA, 20 bp, Artificial Sequence
  chemically synthesized
tgagccttttaattttatct

SEQ ID NO: 609209 - DNA, 20 bp, Artificial Sequence
  chemically synthesized
ttatttatgtatttttgaga

SEQ ID NO: 609210 - DNA, 20 bp, Artificial Sequence
  chemically synthesized
gcccatgctgtagtgcaatg

SEQ ID NO: 609211 - DNA, 20 bp, Artificial Sequence
  chemically synthesized
aacctccacctcccgggttc

SEQ ID NO: 609212 - DNA, 20 bp, Artificial Sequence
  chemically synthesized
tgcctcagcctcccgagtag

SEQ ID NO: 609213 - DNA, 20 bp, Artificial Sequence
  chemically synthesized
ttttgtatttttagtagaga

SEQ ID NO: 609214 - DNA, 20 bp, Artificial Sequence
  chemically synthesized
ctgctgtcttccctcatgcc

SEQ ID NO: 609215 - DNA, 20 bp, Artificial Sequence
  chemically synthesized
aaaattagaatactttcaga

SEQ ID NO: 609216 - DNA, 20 bp, Artificial Sequence
  chemically synthesized
ttagaatactttcagacaca

SEQ ID NO: 609217 - DNA, 20 bp, Artificial Sequence
  chemically synthesized
tttcagacacagattgtttt

SEQ ID NO: 609218 - DNA, 20 bp, Artificial Sequence
  chemically synthesized
gttttgcatgtttatgtgtc

SEQ ID NO: 609219 - DNA, 20 bp, Artificial Sequence
  chemically synthesized
aacagtacctggcacataat

SEQ ID NO: 609220 - DNA, 20 bp, Artificial Sequence
  chemically synthesized
tacatttgattatttagcgc

SEQ ID NO: 609221 - DNA, 20 bp, Artificial Sequence
  chemically synthesized
tattcatacatttgattatt

SEQ ID NO: 609222 - DNA, 20 bp, Artificial Sequence
  chemically synthesized
acatagagcagtattcatac

SEQ ID NO: 609223 - DNA, 20 bp, Artificial Sequence
  chemically synthesized
gtgacgctgcactttctcga

SEQ ID NO: 609224 - DNA, 20 bp, Artificial Sequence
  chemically synthesized
ttagctcagagtgcttttgt

SEQ ID NO: 609225 - DNA, 20 bp, Artificial Sequence
  chemically synthesized
tttatgcttcccttagctca

SEQ ID NO: 609226 - DNA, 20 bp, Artificial Sequence
  chemically synthesized
aaaattttccatattagctt

SEQ ID NO: 609227 - DNA, 20 bp, Artificial Sequence
  chemically synthesized
ggtgccccaaaattttccat

SEQ ID NO: 609228 - DNA, 20 bp, Artificial Sequence
  chemically synthesized
tatatcataaatcttttcga

SEQ ID NO: 609229 - DNA, 20 bp, Artificial Sequence
  chemically synthesized
tactctcctaaactgcctcg

SEQ ID NO: 609230 - DNA, 20 bp, Artificial Sequence
  chemically synthesized
agccctaataatacaatttt

SEQ ID NO: 609231 - DNA, 20 bp, Artificial Sequence
  chemically synthesized
tctccaagtgaagtttatta

SEQ ID NO: 609232 - DNA, 20 bp, Artificial Sequence
  chemically synthesized
aaacctagtatgtctccaag

SEQ ID NO: 609233 - DNA, 20 bp, Artificial Sequence
  chemically synthesized
aaacttcacttggagacata

SEQ ID NO: 609234 - DNA, 20 bp, Artificial Sequence
  chemically synthesized
gaaatgtggctataactcaa

SEQ ID NO: 609235 - DNA, 20 bp, Artificial Sequence
  chemically synthesized
agatacaatgatcatttgca

SEQ ID NO: 609236 - DNA, 20 bp, Artificial Sequence
  chemically synthesized
tcatttgcatacagattgaa

SEQ ID NO: 609237 - DNA, 20 bp, Artificial Sequence
  chemically synthesized
atttaataataatttaataa

SEQ ID NO: 609238 - DNA, 20 bp, Artificial Sequence
  chemically synthesized
agaatgccaagatatttccc

SEQ ID NO: 609239 - DNA, 20 bp, Artificial Sequence
  chemically synthesized
ctttctgttcttccaacttc

SEQ ID NO: 609240 - DNA, 20 bp, Artificial Sequence
  chemically synthesized
ctgagtgtagaggctgagaa

SEQ ID NO: 609241 - DNA, 20 bp, Artificial Sequence
  chemically synthesized
tgaataaaagccatttgtct

SEQ ID NO: 609242 - DNA, 20 bp, Artificial Sequence
  chemically synthesized
tattcttaatcacagagaca

SEQ ID NO: 609243 - DNA, 20 bp, Artificial Sequence
  chemically synthesized
ctcactccccagacacatca

SEQ ID NO: 609244 - DNA, 20 bp, Artificial Sequence
  chemically synthesized
tctggggagtgagggcatgc

SEQ ID NO: 609245 - DNA, 20 bp, Artificial Sequence
  chemically synthesized
ccagcaagtaaacactttaa

SEQ ID NO: 609246 - DNA, 20 bp, Artificial Sequence
  chemically synthesized
tccatcagaaagctttatta

SEQ ID NO: 609247 - DNA, 20 bp, Artificial Sequence
  chemically synthesized
ggctggatctgattccatca

SEQ ID NO: 609248 - DNA, 20 bp, Artificial Sequence
  chemically synthesized
aggaactcaagacaggctgg

SEQ ID NO: 609249 - DNA, 20 bp, Artificial Sequence
  chemically synthesized
tttcaaaagtgtcaaaagga

SEQ ID NO: 609250 - DNA, 20 bp, Artificial Sequence
  chemically synthesized
gaagatgatgttacatgtag

SEQ ID NO: 609251 - DNA, 20 bp, Artificial Sequence
  chemically synthesized
acatgtaacatcatcttctg

SEQ ID NO: 609252 - DNA, 20 bp, Artificial Sequence
  chemically synthesized
cattccccatcccccatctc

SEQ ID NO: 609253 - DNA, 20 bp, Artificial Sequence
  chemically synthesized
ataagccattcaaataaatg

SEQ ID NO: 609254 - DNA, 20 bp, Artificial Sequence
  chemically synthesized
ataaacattacatttatttg

SEQ ID NO: 609255 - DNA, 20 bp, Artificial Sequence
  chemically synthesized
ataattcaacaaattcactt

SEQ ID NO: 609256 - DNA, 20 bp, Artificial Sequence
  chemically synthesized
aagtgaatttgttgaattat

SEQ ID NO: 609257 - DNA, 20 bp, Artificial Sequence
  chemically synthesized
actttattgagctgcctttt

SEQ ID NO: 609258 - DNA, 20 bp, Artificial Sequence
  chemically synthesized
ggggaaaaaaacccctatat

SEQ ID NO: 609259 - DNA, 20 bp, Artificial Sequence
  chemically synthesized
catacaccaagcaaagatat

SEQ ID NO: 609260 - DNA, 20 bp, Artificial Sequence
  chemically synthesized
taaggaataagtgccacctc

SEQ ID NO: 609261 - DNA, 20 bp, Artificial Sequence
  chemically synthesized
ggcacttattccttaagtct

SEQ ID NO: 609262 - DNA, 20 bp, Artificial Sequence
  chemically synthesized
agaatgagagagagtgagaa

SEQ ID NO: 609263 - DNA, 20 bp, Artificial Sequence
  chemically synthesized
agttatgacctccatccttg

SEQ ID NO: 609264 - DNA, 20 bp, Artificial Sequence
  chemically synthesized
gatggaggtcataactattt

SEQ ID NO: 609265 - DNA, 20 bp, Artificial Sequence
  chemically synthesized
cgatgcattagctgaaaatt

SEQ ID NO: 609266 - DNA, 20 bp, Artificial Sequence
  chemically synthesized
cttagaattttcagctaatg

SEQ ID NO: 609267 - DNA, 20 bp, Artificial Sequence
  chemically synthesized
atcaaaactacactatgaat

SEQ ID NO: 609268 - DNA, 20 bp, Artificial Sequence
  chemically synthesized
ttttaaactcccattcatag

SEQ ID NO: 609269 - DNA, 20 bp, Artificial Sequence
  chemically synthesized
gataaaaatcacatcctcta

SEQ ID NO: 609270 - DNA, 20 bp, Artificial Sequence
  chemically synthesized
aattcgaaacgtgctagagg

SEQ ID NO: 609271 - DNA, 20 bp, Artificial Sequence
  chemically synthesized
caagaattactttttaacaa

SEQ ID NO: 609272 - DNA, 20 bp, Artificial Sequence
  chemically synthesized
gaatgaaatgtgctaggatt

SEQ ID NO: 609273 - DNA, 20 bp, Artificial Sequence
  chemically synthesized
cagcgtgggaatgaaatgtg

SEQ ID NO: 609274 - DNA, 20 bp, Artificial Sequence
  chemically synthesized
tctatatgaggaagactcag

SEQ ID NO: 609275 - DNA, 20 bp, Artificial Sequence
  chemically synthesized
aaaccaggtcatattctcgg

SEQ ID NO: 609276 - DNA, 20 bp, Artificial Sequence
  chemically synthesized
aaacattgccgagaatatga

SEQ ID NO: 609277 - DNA, 20 bp, Artificial Sequence
  chemically synthesized
tactacagagcctgctatac

SEQ ID NO: 609278 - DNA, 20 bp, Artificial Sequence
  chemically synthesized
aattaaaggagagcatatga

SEQ ID NO: 609279 - DNA, 20 bp, Artificial Sequence
  chemically synthesized
tatgtaagaaaaatataact

SEQ ID NO: 609280 - DNA, 20 bp, Artificial Sequence
  chemically synthesized
attgctaattacactatttg

SEQ ID NO: 609281 - DNA, 20 bp, Artificial Sequence
  chemically synthesized
taaaaaacatgaggctcatg

SEQ ID NO: 609282 - DNA, 20 bp, Artificial Sequence
  chemically synthesized
tataaaacttttcatgagcc

SEQ ID NO: 609283 - DNA, 20 bp, Artificial Sequence
  chemically synthesized
tcataaatatgaattcccgt

SEQ ID NO: 609284 - DNA, 20 bp, Artificial Sequence
  chemically synthesized
tcttctctaggtttactata

SEQ ID NO: 609285 - DNA, 20 bp, Artificial Sequence
  chemically synthesized
gctttgttattgagtcttct

SEQ ID NO: 609286 - DNA, 20 bp, Artificial Sequence
  chemically synthesized
ttattgattccctcatgtga

SEQ ID NO: 609287 - DNA, 20 bp, Artificial Sequence
  chemically synthesized
caagttttattgattccctc

SEQ ID NO: 609288 - DNA, 20 bp, Artificial Sequence
  chemically synthesized
tggtttgtttttccaagttt

SEQ ID NO: 609289 - DNA, 20 bp, Artificial Sequence
  chemically synthesized
tgaagagctggtttgttttt

SEQ ID NO: 609290 - DNA, 20 bp, Artificial Sequence
  chemically synthesized
tatctcctcgtgaagagctg

SEQ ID NO: 609291 - DNA, 20 bp, Artificial Sequence
  chemically synthesized
cttttatctcctcgtgaaga

SEQ ID NO: 609292 - DNA, 20 bp, Artificial Sequence
  chemically synthesized
gataatctaacactgctttt

SEQ ID NO: 609293 - DNA, 20 bp, Artificial Sequence
  chemically synthesized
ttcaagcaagtaaaagcagt

SEQ ID NO: 609294 - DNA, 20 bp, Artificial Sequence
  chemically synthesized
ctgcttccaagataatctaa

SEQ ID NO: 609295 - DNA, 20 bp, Artificial Sequence
  chemically synthesized
gattatcttggaagcagttc

SEQ ID NO: 609296 - DNA, 20 bp, Artificial Sequence
  chemically synthesized
ctctgttgtacaaaccagag

SEQ ID NO: 609297 - DNA, 20 bp, Artificial Sequence
  chemically synthesized
aagagctatgcctacacaca

SEQ ID NO: 609298 - DNA, 20 bp, Artificial Sequence
  chemically synthesized
tgtaggcatagctcttgaat

SEQ ID NO: 609299 - DNA, 20 bp, Artificial Sequence
  chemically synthesized
agagaacttcttcccctaag

SEQ ID NO: 609300 - DNA, 20 bp, Artificial Sequence
  chemically synthesized
actgaccgtgatctgcagag

SEQ ID NO: 609301 - DNA, 20 bp, Artificial Sequence
  chemically synthesized
agtagtcctttcgggttact

SEQ ID NO: 609302 - DNA, 20 bp, Artificial Sequence
  chemically synthesized
ctcaccatttccatttaatg

SEQ ID NO: 609303 - DNA, 20 bp, Artificial Sequence
  chemically synthesized
cagaacattaaatggaaatg

SEQ ID NO: 609304 - DNA, 20 bp, Artificial Sequence
  chemically synthesized
taaatggaaatggtgagatt

SEQ ID NO: 609305 - DNA, 20 bp, Artificial Sequence
  chemically synthesized
caatttcgaatatcatttat

SEQ ID NO: 609306 - DNA, 20 bp, Artificial Sequence
  chemically synthesized
atgagcatgctatttagcca

SEQ ID NO: 609307 - DNA, 20 bp, Artificial Sequence
  chemically synthesized
gcttatggatgcctgttttt

SEQ ID NO: 609308 - DNA, 20 bp, Artificial Sequence
  chemically synthesized
agagaaaattgcttatggat

SEQ ID NO: 609309 - DNA, 20 bp, Artificial Sequence
  chemically synthesized
tttactttggatttagagaa

SEQ ID NO: 609310 - DNA, 20 bp, Artificial Sequence
  chemically synthesized
tgaattctgtttttatttac

SEQ ID NO: 609311 - DNA, 20 bp, Artificial Sequence
  chemically synthesized
cagggtatggacctgatgaa

SEQ ID NO: 609312 - DNA, 20 bp, Artificial Sequence
  chemically synthesized
ctttgctgagctagctctgt

SEQ ID NO: 609313 - DNA, 20 bp, Artificial Sequence
  chemically synthesized
gagctagctcagcaaagtga

SEQ ID NO: 609314 - DNA, 20 bp, Artificial Sequence
  chemically synthesized
cattcagcagaaatgttgct

SEQ ID NO: 609315 - DNA, 20 bp, Artificial Sequence
  chemically synthesized
gttgctaaaggtttcttcac

SEQ ID NO: 609316 - DNA, 20 bp, Artificial Sequence
  chemically synthesized
tgggtggtttggatgttttc

SEQ ID NO: 609317 - DNA, 20 bp, Artificial Sequence
  chemically synthesized
ctctcaacagtgggtggttt

SEQ ID NO: 609318 - DNA, 20 bp, Artificial Sequence
  chemically synthesized
tgttctttctctcaacagtg

SEQ ID NO: 609319 - DNA, 20 bp, Artificial Sequence
  chemically synthesized
tagtggggttcttccatgac

SEQ ID NO: 609320 - DNA, 20 bp, Artificial Sequence
  chemically synthesized
ttatgtaacgaagaatttca

SEQ ID NO: 609321 - DNA, 20 bp, Artificial Sequence
  chemically synthesized
aatttcatcatgtttttctt

SEQ ID NO: 609322 - DNA, 20 bp, Artificial Sequence
  chemically synthesized
tttctttattgtttatttga

SEQ ID NO: 609323 - DNA, 20 bp, Artificial Sequence
  chemically synthesized
taacaattttgaaaatagaa

SEQ ID NO: 609324 - DNA, 20 bp, Artificial Sequence
  chemically synthesized
atatgatgtacaaagtcaga

SEQ ID NO: 609325 - DNA, 20 bp, Artificial Sequence
  chemically synthesized
atgacaatatgatgtacaaa

SEQ ID NO: 609326 - DNA, 20 bp, Artificial Sequence
  chemically synthesized
tattgtcataaagtattttt

SEQ ID NO: 609327 - DNA, 20 bp, Artificial Sequence
  chemically synthesized
agagaaagattaaaggcaaa

SEQ ID NO: 609328 - DNA, 20 bp, Artificial Sequence
  chemically synthesized
aactagaacaaagagctaga

SEQ ID NO: 609329 - DNA, 20 bp, Artificial Sequence
  chemically synthesized
tagctctttgttctagttga

SEQ ID NO: 609330 - DNA, 20 bp, Artificial Sequence
  chemically synthesized
gttctagttgatgaagattt

SEQ ID NO: 609331 - DNA, 20 bp, Artificial Sequence
  chemically synthesized
ttttagagtttaatatgtac

SEQ ID NO: 609332 - DNA, 20 bp, Artificial Sequence
  chemically synthesized
atatgaatagtatttttaaa

SEQ ID NO: 609333 - DNA, 20 bp, Artificial Sequence
  chemically synthesized
agtcaatgaagcaaaattga

SEQ ID NO: 609334 - DNA, 20 bp, Artificial Sequence
  chemically synthesized
gacagactaaaccttttcaa

SEQ ID NO: 609335 - DNA, 20 bp, Artificial Sequence
  chemically synthesized
tttttgtacatatacataca

SEQ ID NO: 609336 - DNA, 20 bp, Artificial Sequence
  chemically synthesized
cagctactattcaagatgtt

SEQ ID NO: 609337 - DNA, 20 bp, Artificial Sequence
  chemically synthesized
taaaggacagctactattca

SEQ ID NO: 609338 - DNA, 20 bp, Artificial Sequence
  chemically synthesized
ggcaacatttccacttcctg

SEQ ID NO: 609339 - DNA, 20 bp, Artificial Sequence
  chemically synthesized
atgtacatcacatcactctt

SEQ ID NO: 609340 - DNA, 20 bp, Artificial Sequence
  chemically synthesized
aaaattgatgtgtagtgtta

SEQ ID NO: 609341 - DNA, 20 bp, Artificial Sequence
  chemically synthesized
attaacactacacatcaatt

SEQ ID NO: 609342 - DNA, 20 bp, Artificial Sequence
  chemically synthesized
aatctatcgtcttcctttaa

SEQ ID NO: 609343 - DNA, 20 bp, Artificial Sequence
  chemically synthesized
aatcaaagttaaaggaagac

SEQ ID NO: 609344 - DNA, 20 bp, Artificial Sequence
  chemically synthesized
taggaaaaagtaatatggaa

SEQ ID NO: 609345 - DNA, 20 bp, Artificial Sequence
  chemically synthesized
aaagctactctgttagatgg

SEQ ID NO: 609346 - DNA, 20 bp, Artificial Sequence
  chemically synthesized
caaactagcccatctaacag

SEQ ID NO: 609347 - DNA, 20 bp, Artificial Sequence
  chemically synthesized
attagataagaaacaaaaat

SEQ ID NO: 609348 - DNA, 20 bp, Artificial Sequence
  chemically synthesized
gggaaaatgtaatcttttat

SEQ ID NO: 609349 - DNA, 20 bp, Artificial Sequence
  chemically synthesized
gtaattaaacaaatacacaa

SEQ ID NO: 609350 - DNA, 20 bp, Artificial Sequence
  chemically synthesized
agcggtaaaccattttgtgt

SEQ ID NO: 609351 - DNA, 20 bp, Artificial Sequence
  chemically synthesized
aacaaatacacaaaatggtt

SEQ ID NO: 609352 - DNA, 20 bp, Artificial Sequence
  chemically synthesized
caacattcagttaaaaggta

SEQ ID NO: 609353 - DNA, 20 bp, Artificial Sequence
  chemically synthesized
aaaatcattatatggtattt

SEQ ID NO: 609354 - DNA, 20 bp, Artificial Sequence
  chemically synthesized
ttaaacagaaaaataccata

SEQ ID NO: 609355 - DNA, 20 bp, Artificial Sequence
  chemically synthesized
attccgtgtatgttaaaaat

SEQ ID NO: 609356 - DNA, 20 bp, Artificial Sequence
  chemically synthesized
agtattattgactttaaatg

SEQ ID NO: 609357 - DNA, 20 bp, Artificial Sequence
  chemically synthesized
tataaagtggcagctccttc

SEQ ID NO: 609358 - DNA, 20 bp, Artificial Sequence
  chemically synthesized
actaatgacatacttcacat

SEQ ID NO: 609359 - DNA, 20 bp, Artificial Sequence
  chemically synthesized
gcttatttcacttaatatcc

SEQ ID NO: 609360 - DNA, 20 bp, Artificial Sequence
  chemically synthesized
gtggtacttatctttctgtg

SEQ ID NO: 609361 - DNA, 20 bp, Artificial Sequence
  chemically synthesized
tacttctatgaattcaactt

SEQ ID NO: 609362 - DNA, 20 bp, Artificial Sequence
  chemically synthesized
catagaagtagagagtagaa

SEQ ID NO: 609363 - DNA, 20 bp, Artificial Sequence
  chemically synthesized
tcaggagatctattgtacaa

SEQ ID NO: 609364 - DNA, 20 bp, Artificial Sequence
  chemically synthesized
tgttttacttcatatgctta

SEQ ID NO: 609365 - DNA, 20 bp, Artificial Sequence
  chemically synthesized
attaatacatgttttacttc

SEQ ID NO: 609366 - DNA, 20 bp, Artificial Sequence
  chemically synthesized
gctacattgaactaattaat

SEQ ID NO: 609367 - DNA, 20 bp, Artificial Sequence
  chemically synthesized
tacatttatcatgtacaaca

SEQ ID NO: 609368 - DNA, 20 bp, Artificial Sequence
  chemically synthesized
acatgataaatgtatgcaat

SEQ ID NO: 609369 - DNA, 20 bp, Artificial Sequence
  chemically synthesized
tctttgatttttatattcat

SEQ ID NO: 609370 - DNA, 20 bp, Artificial Sequence
  chemically synthesized
gatttatgtttatcttttat

SEQ ID NO: 609371 - DNA, 20 bp, Artificial Sequence
  chemically synthesized
ccttgacctcctgccaggat

SEQ ID NO: 609372 - DNA, 20 bp, Artificial Sequence
  chemically synthesized
cacattaccttgacctcctg

SEQ ID NO: 609373 - DNA, 20 bp, Artificial Sequence
  chemically synthesized
ttccttgccatacaatttat

SEQ ID NO: 609374 - DNA, 20 bp, Artificial Sequence
  chemically synthesized
atgtatattctgatcaggtg

SEQ ID NO: 609375 - DNA, 20 bp, Artificial Sequence
  chemically synthesized
aacggacttgagactttact

SEQ ID NO: 609376 - DNA, 20 bp, Artificial Sequence
  chemically synthesized
ttgatgaagtcacttgttca

SEQ ID NO: 609377 - DNA, 20 bp, Artificial Sequence
  chemically synthesized
ttcttttgcaagtatcagaa

SEQ ID NO: 609378 - DNA, 20 bp, Artificial Sequence
  chemically synthesized
aaatactttaaaaatagctg

SEQ ID NO: 609379 - DNA, 20 bp, Artificial Sequence
  chemically synthesized
cttctatccgtagaacaata

SEQ ID NO: 609380 - DNA, 20 bp, Artificial Sequence
  chemically synthesized
tgtagttttaaaagatcccc

SEQ ID NO: 609381 - DNA, 20 bp, Artificial Sequence
  chemically synthesized
ggatcttttaaaactacaga

SEQ ID NO: 609382 - DNA, 20 bp, Artificial Sequence
  chemically synthesized
cgatctattgaatcagattc

SEQ ID NO: 609383 - DNA, 20 bp, Artificial Sequence
  chemically synthesized
gctctaccccgatctattga

SEQ ID NO: 609384 - DNA, 20 bp, Artificial Sequence
  chemically synthesized
tattcaaaatgtagcagact

SEQ ID NO: 609385 - DNA, 20 bp, Artificial Sequence
  chemically synthesized
tgtaacagtctgcttataag

SEQ ID NO: 609386 - DNA, 20 bp, Artificial Sequence
  chemically synthesized
aaacgggagatgatgtaaca

SEQ ID NO: 609387 - DNA, 20 bp, Artificial Sequence
  chemically synthesized
aagcagactgttacatcatc

SEQ ID NO: 609388 - DNA, 20 bp, Artificial Sequence
  chemically synthesized
tgttacatcatctcccgttt

SEQ ID NO: 609389 - DNA, 20 bp, Artificial Sequence
  chemically synthesized
caaaaattactttgaccatc

SEQ ID NO: 609390 - DNA, 20 bp, Artificial Sequence
  chemically synthesized
ttccttaataatcttacaaa

SEQ ID NO: 609391 - DNA, 20 bp, Artificial Sequence
  chemically synthesized
agaattccaaagctaagttt

SEQ ID NO: 609392 - DNA, 20 bp, Artificial Sequence
  chemically synthesized
taggcttcagaattccaaag

SEQ ID NO: 609393 - DNA, 20 bp, Artificial Sequence
  chemically synthesized
atcaaatgaattggagattt

SEQ ID NO: 609394 - DNA, 20 bp, Artificial Sequence
  chemically synthesized
aaaacaattatcaaatgaat

SEQ ID NO: 609395 - DNA, 20 bp, Artificial Sequence
  chemically synthesized
aaatctccaattcatttgat

SEQ ID NO: 609396 - DNA, 20 bp, Artificial Sequence
  chemically synthesized
gtttttcaaaatatttgacc

SEQ ID NO: 609397 - DNA, 20 bp, Artificial Sequence
  chemically synthesized
tagtaactagtcagctgtac

SEQ ID NO: 609398 - DNA, 20 bp, Artificial Sequence
  chemically synthesized
ccctttttgttttctcacat

SEQ ID NO: 609399 - DNA, 20 bp, Artificial Sequence
  chemically synthesized
ataggcacaggctcaaccct

SEQ ID NO: 609400 - DNA, 20 bp, Artificial Sequence
  chemically synthesized
ttatacatagacacatgcat

SEQ ID NO: 609401 - DNA, 20 bp, Artificial Sequence
  chemically synthesized
tttttggggggcaataaaaa

SEQ ID NO: 609402 - DNA, 20 bp, Artificial Sequence
  chemically synthesized
tatgtaaatgaaatttatta

SEQ ID NO: 609403 - DNA, 20 bp, Artificial Sequence
  chemically synthesized
tgaacagctgcatttagtcc

SEQ ID NO: 609404 - DNA, 20 bp, Artificial Sequence
  chemically synthesized
atagtttggggcaaaatggc

SEQ ID NO: 609405 - DNA, 20 bp, Artificial Sequence
  chemically synthesized
aatctcagaagtgggatagt

SEQ ID NO: 609406 - DNA, 20 bp, Artificial Sequence
  chemically synthesized
aaactattactatcccactt

SEQ ID NO: 609407 - DNA, 20 bp, Artificial Sequence
  chemically synthesized
attacttatttctacctact

SEQ ID NO: 609408 - DNA, 20 bp, Artificial Sequence
  chemically synthesized
cattaaaatactttgaatat

SEQ ID NO: 609409 - DNA, 20 bp, Artificial Sequence
  chemically synthesized
tattatattcaaagtatttt

SEQ ID NO: 609410 - DNA, 20 bp, Artificial Sequence
  chemically synthesized
aaagatagaaaattcatgaa

SEQ ID NO: 609411 - DNA, 20 bp, Artificial Sequence
  chemically synthesized
ttcctctaattggcacaacc

SEQ ID NO: 609412 - DNA, 20 bp, Artificial Sequence
  chemically synthesized
acaaccagttgtttaacatg

SEQ ID NO: 609413 - DNA, 20 bp, Artificial Sequence
  chemically synthesized
ttgccttatcctccaatatt

SEQ ID NO: 609414 - DNA, 20 bp, Artificial Sequence
  chemically synthesized
gaaatcctatgcataattaa

SEQ ID NO: 609415 - DNA, 20 bp, Artificial Sequence
  chemically synthesized
ggaaactgaattaattatgc

SEQ ID NO: 609416 - DNA, 20 bp, Artificial Sequence
  chemically synthesized
gctaatgtgtccctacctct

SEQ ID NO: 609417 - DNA, 20 bp, Artificial Sequence
  chemically synthesized
attagcgatgtcttggcaac

SEQ ID NO: 609418 - DNA, 20 bp, Artificial Sequence
  chemically synthesized
gtacaatctaccagtttcat

SEQ ID NO: 609419 - DNA, 20 bp, Artificial Sequence
  chemically synthesized
gtgaaaactaagatgaaact

SEQ ID NO: 609420 - DNA, 20 bp, Artificial Sequence
  chemically synthesized
cagttttctatgtacaatct

SEQ ID NO: 609421 - DNA, 20 bp, Artificial Sequence
  chemically synthesized
tagtttgctgttgatgatcc

SEQ ID NO: 609422 - DNA, 20 bp, Artificial Sequence
  chemically synthesized
attgaatgaaggccaggttt

SEQ ID NO: 609423 - DNA, 20 bp, Artificial Sequence
  chemically synthesized
tctagtctattgaatgaagg

SEQ ID NO: 609424 - DNA, 20 bp, Artificial Sequence
  chemically synthesized
agtaaattctttaagtacag

SEQ ID NO: 609425 - DNA, 20 bp, Artificial Sequence
  chemically synthesized
gtcctagcctcctatttctc

SEQ ID NO: 609426 - DNA, 20 bp, Artificial Sequence
  chemically synthesized
tagatcttgaacactttata

SEQ ID NO: 609427 - DNA, 20 bp, Artificial Sequence
  chemically synthesized
agaatttttgtcattcattg

SEQ ID NO: 609428 - DNA, 20 bp, Artificial Sequence
  chemically synthesized
atttccaaagactgtggagt

SEQ ID NO: 609429 - DNA, 20 bp, Artificial Sequence
  chemically synthesized
tgtgctacagccttaggata

SEQ ID NO: 609430 - DNA, 20 bp, Artificial Sequence
  chemically synthesized
tcttcctcctttgttttatt

SEQ ID NO: 609431 - DNA, 20 bp, Artificial Sequence
  chemically synthesized
cctctttcgtcctcttcctc

SEQ ID NO: 609432 - DNA, 20 bp, Artificial Sequence
  chemically synthesized
aggaagaggacgaaagagga

SEQ ID NO: 609433 - DNA, 20 bp, Artificial Sequence
  chemically synthesized
ggtaacaagtagacaccaac

SEQ ID NO: 609434 - DNA, 20 bp, Artificial Sequence
  chemically synthesized
attgttaaatgaataaatag

SEQ ID NO: 609435 - DNA, 20 bp, Artificial Sequence
  chemically synthesized
tcatttaacaattagttcct

SEQ ID NO: 609436 - DNA, 20 bp, Artificial Sequence
  chemically synthesized
tagttcctccatgattctta

SEQ ID NO: 609437 - DNA, 20 bp, Artificial Sequence
  chemically synthesized
tctggcaaagtttcagaagg

SEQ ID NO: 609438 - DNA, 20 bp, Artificial Sequence
  chemically synthesized
cccttctgaaactttgccag

SEQ ID NO: 609439 - DNA, 20 bp, Artificial Sequence
  chemically synthesized
ttgaagtgaatccactctgg

SEQ ID NO: 609440 - DNA, 20 bp, Artificial Sequence
  chemically synthesized
ctcaggtgagaccattgtta

SEQ ID NO: 609441 - DNA, 20 bp, Artificial Sequence
  chemically synthesized
caatggtctcacctgagtta

SEQ ID NO: 609442 - DNA, 20 bp, Artificial Sequence
  chemically synthesized
cagattgggaataggatgat

SEQ ID NO: 609443 - DNA, 20 bp, Artificial Sequence
  chemically synthesized
tattcccaatctgaaatgtt

SEQ ID NO: 609444 - DNA, 20 bp, Artificial Sequence
  chemically synthesized
gtccagcaatctaagaacat

SEQ ID NO: 609445 - DNA, 20 bp, Artificial Sequence
  chemically synthesized
tctctgaaaggagcgtattc

SEQ ID NO: 609446 - DNA, 20 bp, Artificial Sequence
  chemically synthesized
gatgttatgaagcccaaatc

SEQ ID NO: 609447 - DNA, 20 bp, Artificial Sequence
  chemically synthesized
agttttactaaacattggat

SEQ ID NO: 609448 - DNA, 20 bp, Artificial Sequence
  chemically synthesized
actttacagttttactaaac

SEQ ID NO: 609449 - DNA, 20 bp, Artificial Sequence
  chemically synthesized
tccaatgtttagtaaaactg

SEQ ID NO: 609450 - DNA, 20 bp, Artificial Sequence
  chemically synthesized
tattaaggttcaacaaactt

SEQ ID NO: 609451 - DNA, 20 bp, Artificial Sequence
  chemically synthesized
tgtcatttttgtcatatttt

SEQ ID NO: 609452 - DNA, 20 bp, Artificial Sequence
  chemically synthesized
aaatggtctcctacaactag

SEQ ID NO: 609453 - DNA, 20 bp, Artificial Sequence
  chemically synthesized
atacaaatggtctcctacaa

SEQ ID NO: 609454 - DNA, 20 bp, Artificial Sequence
  chemically synthesized
tttccttctaagtaaattct

SEQ ID NO: 609455 - DNA, 20 bp, Artificial Sequence
  chemically synthesized
gcacatatggaataagtgat

SEQ ID NO: 609456 - DNA, 20 bp, Artificial Sequence
  chemically synthesized
tcacttattccatatgtgct

SEQ ID NO: 609457 - DNA, 20 bp, Artificial Sequence
  chemically synthesized
atagaatatacttagactat

SEQ ID NO: 609458 - DNA, 20 bp, Artificial Sequence
  chemically synthesized
ttttgatttcccataaaaag

SEQ ID NO: 609459 - DNA, 20 bp, Artificial Sequence
  chemically synthesized
cccgaagtccataacattta

SEQ ID NO: 609460 - DNA, 20 bp, Artificial Sequence
  chemically synthesized
cttagtgcagtcatcataaa

SEQ ID NO: 609461 - DNA, 20 bp, Artificial Sequence
  chemically synthesized
gactttaactgtcctctgta

SEQ ID NO: 609462 - DNA, 20 bp, Artificial Sequence
  chemically synthesized
atacttcttattacacgaca

SEQ ID NO: 609463 - DNA, 20 bp, Artificial Sequence
  chemically synthesized
taattgttaagttcttactt

SEQ ID NO: 609464 - DNA, 20 bp, Artificial Sequence
  chemically synthesized
tacataaaatgctcacggac

SEQ ID NO: 609465 - DNA, 20 bp, Artificial Sequence
  chemically synthesized
cacggacaccagattttaat

SEQ ID NO: 609466 - DNA, 20 bp, Artificial Sequence
  chemically synthesized
ttttcattctgagacggctt

SEQ ID NO: 609467 - DNA, 20 bp, Artificial Sequence
  chemically synthesized
tctcactattttcattctga

SEQ ID NO: 609468 - DNA, 20 bp, Artificial Sequence
  chemically synthesized
gtgagaactcacaatactgc

SEQ ID NO: 609469 - DNA, 20 bp, Artificial Sequence
  chemically synthesized
ttttactttatgaacaataa

SEQ ID NO: 609470 - DNA, 20 bp, Artificial Sequence
  chemically synthesized
acaataacaccgtttctgat

SEQ ID NO: 609471 - DNA, 20 bp, Artificial Sequence
  chemically synthesized
aaaaatgatcaaatttcgct

SEQ ID NO: 609472 - DNA, 20 bp, Artificial Sequence
  chemically synthesized
aaattcaaaggctagtcaaa

SEQ ID NO: 609473 - DNA, 20 bp, Artificial Sequence
  chemically synthesized
agtgcaatgactggtttcta

SEQ ID NO: 609474 - DNA, 20 bp, Artificial Sequence
  chemically synthesized
catggcagtgtagtgcaatg

SEQ ID NO: 609475 - DNA, 20 bp, Artificial Sequence
  chemically synthesized
tttgaagaccaagtatcgca

SEQ ID NO: 609476 - DNA, 20 bp, Artificial Sequence
  chemically synthesized
aagaccaagtatcgcacaaa

SEQ ID NO: 609477 - DNA, 20 bp, Artificial Sequence
  chemically synthesized
aagattagttttgttgaagg

SEQ ID NO: 609478 - DNA, 20 bp, Artificial Sequence
  chemically synthesized
cctgaggttgactgcccaag

SEQ ID NO: 609479 - DNA, 20 bp, Artificial Sequence
  chemically synthesized
acttccctgaggttgactgc

SEQ ID NO: 609480 - DNA, 20 bp, Artificial Sequence
  chemically synthesized
gggcagtcaacctcagggaa

SEQ ID NO: 609481 - DNA, 20 bp, Artificial Sequence
  chemically synthesized
ctcttctttagatttcccag

SEQ ID NO: 609482 - DNA, 20 bp, Artificial Sequence
  chemically synthesized
ttagacagtagagcctcttc

SEQ ID NO: 609483 - DNA, 20 bp, Artificial Sequence
  chemically synthesized
tctactgtctaaatttcagg

SEQ ID NO: 609484 - DNA, 20 bp, Artificial Sequence
  chemically synthesized
gcatgtgtaattgaaaacaa

SEQ ID NO: 609485 - DNA, 20 bp, Artificial Sequence
  chemically synthesized
cctgctatctttgaaatctt

SEQ ID NO: 609486 - DNA, 20 bp, Artificial Sequence
  chemically synthesized
tatacctgctatctttgaaa

SEQ ID NO: 609487 - DNA, 20 bp, Artificial Sequence
  chemically synthesized
caggtataaatgtgcactca

SEQ ID NO: 609488 - DNA, 20 bp, Artificial Sequence
  chemically synthesized
ctcttaaaagactgaccaac

SEQ ID NO: 609489 - DNA, 20 bp, Artificial Sequence
  chemically synthesized
ctttagttggtcagtctttt

SEQ ID NO: 609490 - DNA, 20 bp, Artificial Sequence
  chemically synthesized
tgacatcctctcacagtttt

SEQ ID NO: 609491 - DNA, 20 bp, Artificial Sequence
  chemically synthesized
gtttctaaatgacatcctct

SEQ ID NO: 609492 - DNA, 20 bp, Artificial Sequence
  chemically synthesized
gtggggaggttgatgctcat

SEQ ID NO: 609493 - DNA, 20 bp, Artificial Sequence
  chemically synthesized
gatgagcatcaacctcccca

SEQ ID NO: 609494 - DNA, 20 bp, Artificial Sequence
  chemically synthesized
ttctcagtgaatttatttat

SEQ ID NO: 609495 - DNA, 20 bp, Artificial Sequence
  chemically synthesized
atgaccagaagtgccttctt

SEQ ID NO: 609496 - DNA, 20 bp, Artificial Sequence
  chemically synthesized
ttttgagcattctggctatg

SEQ ID NO: 609497 - DNA, 20 bp, Artificial Sequence
  chemically synthesized
ttgtgccaacatataggcct

SEQ ID NO: 609498 - DNA, 20 bp, Artificial Sequence
  chemically synthesized
ttaggttattgtttacaacc

SEQ ID NO: 609499 - DNA, 20 bp, Artificial Sequence
  chemically synthesized
atcacatcaatgaattaggt

SEQ ID NO: 609500 - DNA, 20 bp, Artificial Sequence
  chemically synthesized
ggacaaagtgctggaagtaa

SEQ ID NO: 609501 - DNA, 20 bp, Artificial Sequence
  chemically synthesized
aagtaaagtggattattttt

SEQ ID NO: 609502 - DNA, 20 bp, Artificial Sequence
  chemically synthesized
ttttttgaggcttgcatacg

SEQ ID NO: 609503 - DNA, 20 bp, Artificial Sequence
  chemically synthesized
atcatctgatatctaaatgc

SEQ ID NO: 609504 - DNA, 20 bp, Artificial Sequence
  chemically synthesized
aaatattaaaaataacaata

SEQ ID NO: 609505 - DNA, 20 bp, Artificial Sequence
  chemically synthesized
tcagtgaatgaagtgctaaa

SEQ ID NO: 609506 - DNA, 20 bp, Artificial Sequence
  chemically synthesized
cttcattcactgatacaagc

SEQ ID NO: 609507 - DNA, 20 bp, Artificial Sequence
  chemically synthesized
tgttactaaatggtaaaagc

SEQ ID NO: 609508 - DNA, 20 bp, Artificial Sequence
  chemically synthesized
ttgcttttaccatttagtaa

SEQ ID NO: 609509 - DNA, 20 bp, Artificial Sequence
  chemically synthesized
gaaataatttgcgttgatga

SEQ ID NO: 609510 - DNA, 20 bp, Artificial Sequence
  chemically synthesized
gtgcaaaagataaaattgtt

SEQ ID NO: 609511 - DNA, 20 bp, Artificial Sequence
  chemically synthesized
atggaaagtgcaaaagataa

SEQ ID NO: 609512 - DNA, 20 bp, Artificial Sequence
  chemically synthesized
tttatcttttgcactttcca

SEQ ID NO: 609513 - DNA, 20 bp, Artificial Sequence
  chemically synthesized
actttccattacgcttttca

SEQ ID NO: 609514 - DNA, 20 bp, Artificial Sequence
  chemically synthesized
acttgtaacaagatgatggt

SEQ ID NO: 609515 - DNA, 20 bp, Artificial Sequence
  chemically synthesized
ctaaagcgcccagcctgagc

SEQ ID NO: 609516 - DNA, 20 bp, Artificial Sequence
  chemically synthesized
agaaaacagtggctcaggct

SEQ ID NO: 609517 - DNA, 20 bp, Artificial Sequence
  chemically synthesized
tgcctcgtcctcccgaagtg

SEQ ID NO: 609518 - DNA, 20 bp, Artificial Sequence
  chemically synthesized
atttttatatttttagttga

SEQ ID NO: 609519 - DNA, 20 bp, Artificial Sequence
  chemically synthesized
tccacatcctctccggcacc

SEQ ID NO: 609520 - DNA, 20 bp, Artificial Sequence
  chemically synthesized
ggtgtgagatggtatctcat

SEQ ID NO: 609521 - DNA, 20 bp, Artificial Sequence
  chemically synthesized
gagatggtatctcattgtgg

SEQ ID NO: 609522 - DNA, 20 bp, Artificial Sequence
  chemically synthesized
gtgatgatgagcattttttc

SEQ ID NO: 609523 - DNA, 20 bp, Artificial Sequence
  chemically synthesized
gtgcatgtgtctttatagca

SEQ ID NO: 609524 - DNA, 20 bp, Artificial Sequence
  chemically synthesized
ctataaagacacatgcacac

SEQ ID NO: 609525 - DNA, 20 bp, Artificial Sequence
  chemically synthesized
caaatgtccaacaatgatag

SEQ ID NO: 609526 - DNA, 20 bp, Artificial Sequence
  chemically synthesized
gtttgctgagaatgatggtt

SEQ ID NO: 609527 - DNA, 20 bp, Artificial Sequence
  chemically synthesized
tgtgatagtttgctgagaat

SEQ ID NO: 609528 - DNA, 20 bp, Artificial Sequence
  chemically synthesized
gtttggttttttgtccttgt

SEQ ID NO: 609529 - DNA, 20 bp, Artificial Sequence
  chemically synthesized
ctgagtgagaacatgcagtg

SEQ ID NO: 609530 - DNA, 20 bp, Artificial Sequence
  chemically synthesized
cacctctgagtgagaacatg

SEQ ID NO: 609531 - DNA, 20 bp, Artificial Sequence
  chemically synthesized
agggtacatgtgcacaacgt

SEQ ID NO: 609532 - DNA, 20 bp, Artificial Sequence
  chemically synthesized
tttttttttattattatact

SEQ ID NO: 609533 - DNA, 20 bp, Artificial Sequence
  chemically synthesized
tcccgaatagctgggatcac

SEQ ID NO: 609534 - DNA, 20 bp, Artificial Sequence
  chemically synthesized
tcgggaggctgaggttagag

SEQ ID NO: 609535 - DNA, 20 bp, Artificial Sequence
  chemically synthesized
aacctcctcctccctggttc

SEQ ID NO: 609536 - DNA, 20 bp, Artificial Sequence
  chemically synthesized
gtggagtgcagtggcccgat

SEQ ID NO: 609537 - DNA, 20 bp, Artificial Sequence
  chemically synthesized
tcttttttaattttttgttt

SEQ ID NO: 609538 - DNA, 20 bp, Artificial Sequence
  chemically synthesized
tttttcttttttaatttttt

SEQ ID NO: 609539 - DNA, 20 bp, Artificial Sequence
  chemically synthesized
tgtttttttcttttttaatt

SEQ ID NO: 609540 - DNA, 20 bp, Artificial Sequence
  chemically synthesized
aagcattatgcattttgagc

SEQ ID NO: 609541 - DNA, 20 bp, Artificial Sequence
  chemically synthesized
aaacagtggctcaaaatgca

SEQ ID NO: 609542 - DNA, 20 bp, Artificial Sequence
  chemically synthesized
acagggaaaaaaggaaaatc

SEQ ID NO: 609543 - DNA, 20 bp, Artificial Sequence
  chemically synthesized
tgtatcagtcttctaaaagc

SEQ ID NO: 609544 - DNA, 20 bp, Artificial Sequence
  chemically synthesized
attgattaacagaacgctca

SEQ ID NO: 609545 - DNA, 20 bp, Artificial Sequence
  chemically synthesized
gtattggtaggtttaggatt

SEQ ID NO: 609546 - DNA, 20 bp, Artificial Sequence
  chemically synthesized
ttccatttgtattggtaggt

SEQ ID NO: 609547 - DNA, 20 bp, Artificial Sequence
  chemically synthesized
gataagttccatttgtattg

SEQ ID NO: 609548 - DNA, 20 bp, Artificial Sequence
  chemically synthesized
acttccagctaccattattt

SEQ ID NO: 609549 - DNA, 20 bp, Artificial Sequence
  chemically synthesized
atggtagctggaagtaatga

SEQ ID NO: 609550 - DNA, 20 bp, Artificial Sequence
  chemically synthesized
catgagccaccatgcccagc

SEQ ID NO: 609551 - DNA, 20 bp, Artificial Sequence
  chemically synthesized
cacctcagcctcccaaagtg

SEQ ID NO: 609552 - DNA, 20 bp, Artificial Sequence
  chemically synthesized
ttttgtatttttaatagaga

SEQ ID NO: 609553 - DNA, 20 bp, Artificial Sequence
  chemically synthesized
aggcatgcaccaccataccc

SEQ ID NO: 609554 - DNA, 20 bp, Artificial Sequence
  chemically synthesized
tgcctcagcctcccgagtag

SEQ ID NO: 609555 - DNA, 20 bp, Artificial Sequence
  chemically synthesized
tcgggaggctgaggcaggag

SEQ ID NO: 609556 - DNA, 20 bp, Artificial Sequence
  chemically synthesized
ccctccgagacggagtcttg

SEQ ID NO: 609557 - DNA, 20 bp, Artificial Sequence
  chemically synthesized
tctgtgtctcatattttcaa

SEQ ID NO: 609558 - DNA, 20 bp, Artificial Sequence
  chemically synthesized
cacagaaaaatatactccac

SEQ ID NO: 609559 - DNA, 20 bp, Artificial Sequence
  chemically synthesized
ctggcacaaagtaactcaat

SEQ ID NO: 609560 - DNA, 20 bp, Artificial Sequence
  chemically synthesized
gaataaataatttcaaaatt

SEQ ID NO: 609561 - DNA, 20 bp, Artificial Sequence
  chemically synthesized
tttaccacttgccactgtat

SEQ ID NO: 609562 - DNA, 20 bp, Artificial Sequence
  chemically synthesized
ccaaaaactatcccagcgaa

SEQ ID NO: 609563 - DNA, 20 bp, Artificial Sequence
  chemically synthesized
ataaaagccctcttcgctgg

SEQ ID NO: 609564 - DNA, 20 bp, Artificial Sequence
  chemically synthesized
ttaacactgcagagcttcca

SEQ ID NO: 609565 - DNA, 20 bp, Artificial Sequence
  chemically synthesized
gatgtttggtattaacactg

SEQ ID NO: 609566 - DNA, 20 bp, Artificial Sequence
  chemically synthesized
tttgctctgaggcactctca

SEQ ID NO: 609567 - DNA, 20 bp, Artificial Sequence
  chemically synthesized
catttaactgacttttcccc

SEQ ID NO: 609568 - DNA, 20 bp, Artificial Sequence
  chemically synthesized
tcgcaaccaactgtgacttt

SEQ ID NO: 609569 - DNA, 20 bp, Artificial Sequence
  chemically synthesized
ctttaggagttttaaataag

SEQ ID NO: 609570 - DNA, 20 bp, Artificial Sequence
  chemically synthesized
aataagacgtgtttcagttg

SEQ ID NO: 609571 - DNA, 20 bp, Artificial Sequence
  chemically synthesized
gattagggcacacggcagaa

SEQ ID NO: 609572 - DNA, 20 bp, Artificial Sequence
  chemically synthesized
tttaaagatagaacttttcc

SEQ ID NO: 609573 - DNA, 20 bp, Artificial Sequence
  chemically synthesized
tctcttccgtcacaattgtc

SEQ ID NO: 609574 - DNA, 20 bp, Artificial Sequence
  chemically synthesized
tacataccaaatatttgttc

SEQ ID NO: 609575 - DNA, 20 bp, Artificial Sequence
  chemically synthesized
tcaagttagtgtctgttctc

SEQ ID NO: 609576 - DNA, 20 bp, Artificial Sequence
  chemically synthesized
gtagtctcccatgctgactg

SEQ ID NO: 609577 - DNA, 20 bp, Artificial Sequence
  chemically synthesized
agagaattgtaagaaagtac

SEQ ID NO: 609578 - DNA, 20 bp, Artificial Sequence
  chemically synthesized
cctgttgtgggaagaactat

SEQ ID NO: 609579 - DNA, 20 bp, Artificial Sequence
  chemically synthesized
tttgactcagtgacatttaa

SEQ ID NO: 609580 - DNA, 20 bp, Artificial Sequence
  chemically synthesized
agtgacatttaactctgctt

SEQ ID NO: 609581 - DNA, 20 bp, Artificial Sequence
  chemically synthesized
ctgcttaagtgattgtcacc

SEQ ID NO: 609582 - DNA, 20 bp, Artificial Sequence
  chemically synthesized
gtgattgtcacctgcggttt

SEQ ID NO: 609583 - DNA, 20 bp, Artificial Sequence
  chemically synthesized
tgtcacctgcggttttcgtg

SEQ ID NO: 609584 - DNA, 20 bp, Artificial Sequence
  chemically synthesized
ctgctgctagaaaaagtata

SEQ ID NO: 609585 - DNA, 20 bp, Artificial Sequence
  chemically synthesized
atagtctatttgtgaacctt

SEQ ID NO: 609586 - DNA, 20 bp, Artificial Sequence
  chemically synthesized
acacagtgaggccagaataa

SEQ ID NO: 609587 - DNA, 20 bp, Artificial Sequence
  chemically synthesized
attattctttctggtatatt

SEQ ID NO: 609588 - DNA, 20 bp, Artificial Sequence
  chemically synthesized
gggcaaattactcaatgatg

SEQ ID NO: 609589 - DNA, 20 bp, Artificial Sequence
  chemically synthesized
gcagatattgtacaaaatga

SEQ ID NO: 609590 - DNA, 20 bp, Artificial Sequence
  chemically synthesized
aatggacccactacatataa

SEQ ID NO: 609591 - DNA, 20 bp, Artificial Sequence
  chemically synthesized
cttacctattagtgataggg

SEQ ID NO: 609592 - DNA, 20 bp, Artificial Sequence
  chemically synthesized
aaattcactaatttccctgt

SEQ ID NO: 609593 - DNA, 20 bp, Artificial Sequence
  chemically synthesized
tatatacgatctattatttt

SEQ ID NO: 609594 - DNA, 20 bp, Artificial Sequence
  chemically synthesized
ttggcacataattgtaattc

SEQ ID NO: 609595 - DNA, 20 bp, Artificial Sequence
  chemically synthesized
cacataattgtaattcatag

SEQ ID NO: 609596 - DNA, 20 bp, Artificial Sequence
  chemically synthesized
ccaattcaccaagcaattaa

SEQ ID NO: 609597 - DNA, 20 bp, Artificial Sequence
  chemically synthesized
tctaattataaaacgtgatt

SEQ ID NO: 609598 - DNA, 20 bp, Artificial Sequence
  chemically synthesized
ggagccattctaattataaa

SEQ ID NO: 609599 - DNA, 20 bp, Artificial Sequence
  chemically synthesized
tctggtttgtccaatggtcc

SEQ ID NO: 609600 - DNA, 20 bp, Artificial Sequence
  chemically synthesized
cacatcagtgttgtatgcca

SEQ ID NO: 609601 - DNA, 20 bp, Artificial Sequence
  chemically synthesized
accatgacaccatcccacat

SEQ ID NO: 609602 - DNA, 20 bp, Artificial Sequence
  chemically synthesized
ttgttgaagtttgtgtgtga

SEQ ID NO: 609603 - DNA, 20 bp, Artificial Sequence
  chemically synthesized
tcagttattttgtcagttgt

SEQ ID NO: 609604 - DNA, 20 bp, Artificial Sequence
  chemically synthesized
acaaaataactgatggcgaa

SEQ ID NO: 609605 - DNA, 20 bp, Artificial Sequence
  chemically synthesized
taagttttcctgaactaatc

SEQ ID NO: 609606 - DNA, 20 bp, Artificial Sequence
  chemically synthesized
gttagagtactactgaaaac

SEQ ID NO: 609607 - DNA, 20 bp, Artificial Sequence
  chemically synthesized
cgtgatgttcgtccactggt

SEQ ID NO: 609608 - DNA, 20 bp, Artificial Sequence
  chemically synthesized
caaatgcgtgatgttcgtcc

SEQ ID NO: 609609 - DNA, 20 bp, Artificial Sequence
  chemically synthesized
tttcatcagcatgcctccag

SEQ ID NO: 609610 - DNA, 20 bp, Artificial Sequence
  chemically synthesized
gtttgctacttcttgattgg

SEQ ID NO: 609611 - DNA, 20 bp, Artificial Sequence
  chemically synthesized
atgggttaaagtttgctact

SEQ ID NO: 609612 - DNA, 20 bp, Artificial Sequence
  chemically synthesized
tttgtaatttgaaaatgggt

SEQ ID NO: 609613 - DNA, 20 bp, Artificial Sequence
  chemically synthesized
cagtacttatgaaatttcat

SEQ ID NO: 609614 - DNA, 20 bp, Artificial Sequence
  chemically synthesized
tatgaaatttcatttgagtt

SEQ ID NO: 609615 - DNA, 20 bp, Artificial Sequence
  chemically synthesized
tttcatttgagtttggagtt

SEQ ID NO: 609616 - DNA, 20 bp, Artificial Sequence
  chemically synthesized
tttctccatcaatgcttcac

SEQ ID NO: 609617 - DNA, 20 bp, Artificial Sequence
  chemically synthesized
tcacttgtacctttctccat

SEQ ID NO: 609618 - DNA, 20 bp, Artificial Sequence
  chemically synthesized
tatttgtgttacatggtttt

SEQ ID NO: 609619 - DNA, 20 bp, Artificial Sequence
  chemically synthesized
tcatcatcatatttgtgtta

SEQ ID NO: 609620 - DNA, 20 bp, Artificial Sequence
  chemically synthesized
taagaatgcgtaaaacatag

SEQ ID NO: 609621 - DNA, 20 bp, Artificial Sequence
  chemically synthesized
aatgcgtaaaacatagctga

SEQ ID NO: 609622 - DNA, 20 bp, Artificial Sequence
  chemically synthesized
ttaatgaaaatcaatctcag

SEQ ID NO: 609623 - DNA, 20 bp, Artificial Sequence
  chemically synthesized
gagtgcttttagctaagtgt

SEQ ID NO: 609624 - DNA, 20 bp, Artificial Sequence
  chemically synthesized
gagaaagagggatgacatta

SEQ ID NO: 609625 - DNA, 20 bp, Artificial Sequence
  chemically synthesized
ctttctctttcacacattgg

SEQ ID NO: 609626 - DNA, 20 bp, Artificial Sequence
  chemically synthesized
tctttcacacattggtcttg

SEQ ID NO: 609627 - DNA, 20 bp, Artificial Sequence
  chemically synthesized
aataatttctctttttgcat

SEQ ID NO: 609628 - DNA, 20 bp, Artificial Sequence
  chemically synthesized
gtaaaataaagggaaagggg

SEQ ID NO: 609629 - DNA, 20 bp, Artificial Sequence
  chemically synthesized
acccctttccctttatttta

SEQ ID NO: 609630 - DNA, 20 bp, Artificial Sequence
  chemically synthesized
ttttacattgatttccttta

SEQ ID NO: 609631 - DNA, 20 bp, Artificial Sequence
  chemically synthesized
cttgtcacaaactgtcatta

SEQ ID NO: 609632 - DNA, 20 bp, Artificial Sequence
  chemically synthesized
taaaaaataaacataataat

SEQ ID NO: 609633 - DNA, 20 bp, Artificial Sequence
  chemically synthesized
ctaaaggaagttcctgcctt

SEQ ID NO: 609634 - DNA, 20 bp, Artificial Sequence
  chemically synthesized
ccacaaaggcaggaacttcc

SEQ ID NO: 609635 - DNA, 20 bp, Artificial Sequence
  chemically synthesized
aaaggcaggaacttccttta

SEQ ID NO: 609636 - DNA, 20 bp, Artificial Sequence
  chemically synthesized
aggttctctctccattcatt

SEQ ID NO: 609637 - DNA, 20 bp, Artificial Sequence
  chemically synthesized
gacacatgttgaaaattgag

SEQ ID NO: 609638 - DNA, 20 bp, Artificial Sequence
  chemically synthesized
ggctgctcctgttccttgct

SEQ ID NO: 609639 - DNA, 20 bp, Artificial Sequence
  chemically synthesized
ctccctacaaaattctgcaa

SEQ ID NO: 609640 - DNA, 20 bp, Artificial Sequence
  chemically synthesized
acaaaattctgcaaaagaga

SEQ ID NO: 609641 - DNA, 20 bp, Artificial Sequence
  chemically synthesized
gagattcagtttggtataga

SEQ ID NO: 609642 - DNA, 20 bp, Artificial Sequence
  chemically synthesized
attatatacaagaactttta

SEQ ID NO: 609643 - DNA, 20 bp, Artificial Sequence
  chemically synthesized
catacaaccaataagtgaca

SEQ ID NO: 609644 - DNA, 20 bp, Artificial Sequence
  chemically synthesized
ggaaaaaaaaaagtagagtc

SEQ ID NO: 609645 - DNA, 20 bp, Artificial Sequence
  chemically synthesized
taaagttaagcataatgcac

SEQ ID NO: 609646 - DNA, 20 bp, Artificial Sequence
  chemically synthesized
caataggaagctgaggtgca

SEQ ID NO: 609647 - DNA, 20 bp, Artificial Sequence
  chemically synthesized
cagcttcctattgtattgca

SEQ ID NO: 609648 - DNA, 20 bp, Artificial Sequence
  chemically synthesized
atcacatttccaaaaataag

SEQ ID NO: 609649 - DNA, 20 bp, Artificial Sequence
  chemically synthesized
tctcatgctctagaaactgt

SEQ ID NO: 609650 - DNA, 20 bp, Artificial Sequence
  chemically synthesized
atcacttaaaaataatctga

SEQ ID NO: 609651 - DNA, 20 bp, Artificial Sequence
  chemically synthesized
atgctctctaatttggaaat

SEQ ID NO: 609652 - DNA, 20 bp, Artificial Sequence
  chemically synthesized
gtcatcatcactcataggct

SEQ ID NO: 609653 - DNA, 20 bp, Artificial Sequence
  chemically synthesized
taactttgtcatcatcactc

SEQ ID NO: 609654 - DNA, 20 bp, Artificial Sequence
  chemically synthesized
caaagttagtacattttaaa

SEQ ID NO: 609655 - DNA, 20 bp, Artificial Sequence
  chemically synthesized
tactcaagacacaggaaaac

SEQ ID NO: 609656 - DNA, 20 bp, Artificial Sequence
  chemically synthesized
tttagaacaatgaataaaac

SEQ ID NO: 609657 - DNA, 20 bp, Artificial Sequence
  chemically synthesized
ctattttgtagtgtgtatgc

SEQ ID NO: 609658 - DNA, 20 bp, Artificial Sequence
  chemically synthesized
atacacactacaaaatagca

SEQ ID NO: 609659 - DNA, 20 bp, Artificial Sequence
  chemically synthesized
agtcaatattatttttgaaa

SEQ ID NO: 609660 - DNA, 20 bp, Artificial Sequence
  chemically synthesized
tgcttccaaagttctaagga

SEQ ID NO: 609661 - DNA, 20 bp, Artificial Sequence
  chemically synthesized
actccttagaactttggaag

SEQ ID NO: 609662 - DNA, 20 bp, Artificial Sequence
  chemically synthesized
tagcacaaaatttttggaag

SEQ ID NO: 609663 - DNA, 20 bp, Artificial Sequence
  chemically synthesized
tttcaaacccccaggtatgc

SEQ ID NO: 609664 - DNA, 20 bp, Artificial Sequence
  chemically synthesized
tgctaagcgtctgcatacct

SEQ ID NO: 609665 - DNA, 20 bp, Artificial Sequence
  chemically synthesized
gtctgcatacctgggggttt

SEQ ID NO: 609666 - DNA, 20 bp, Artificial Sequence
  chemically synthesized
aatcctacccaccgctgact

SEQ ID NO: 609667 - DNA, 20 bp, Artificial Sequence
  chemically synthesized
aaactatgagtcagcggtgg

SEQ ID NO: 609668 - DNA, 20 bp, Artificial Sequence
  chemically synthesized
caaataatgataattgtaaa

SEQ ID NO: 609669 - DNA, 20 bp, Artificial Sequence
  chemically synthesized
tgaatccctttctcatatat

SEQ ID NO: 609670 - DNA, 20 bp, Artificial Sequence
  chemically synthesized
ttaagctcagatatatgaga

SEQ ID NO: 609671 - DNA, 20 bp, Artificial Sequence
  chemically synthesized
gtgtgtataccatcctaggt

SEQ ID NO: 609672 - DNA, 20 bp, Artificial Sequence
  chemically synthesized
ataaatgtgtgtataccatc

SEQ ID NO: 609673 - DNA, 20 bp, Artificial Sequence
  chemically synthesized
tagttatatattagtgatca

SEQ ID NO: 609674 - DNA, 20 bp, Artificial Sequence
  chemically synthesized
ggagttgctttccaaatatg

SEQ ID NO: 609675 - DNA, 20 bp, Artificial Sequence
  chemically synthesized
gctaatatctagtcaaaggg

SEQ ID NO: 609676 - DNA, 20 bp, Artificial Sequence
  chemically synthesized
aagactaaatagagaaaagg

SEQ ID NO: 609677 - DNA, 20 bp, Artificial Sequence
  chemically synthesized
attcagtaattaaaatagca

SEQ ID NO: 609678 - DNA, 20 bp, Artificial Sequence
  chemically synthesized
ggttatgtggtatttagcat

SEQ ID NO: 609679 - DNA, 20 bp, Artificial Sequence
  chemically synthesized
cacataacccattttcttgg

SEQ ID NO: 609680 - DNA, 20 bp, Artificial Sequence
  chemically synthesized
ttcctgatgaccagaaaccc

SEQ ID NO: 609681 - DNA, 20 bp, Artificial Sequence
  chemically synthesized
gagatagttataccaagccc

SEQ ID NO: 609682 - DNA, 20 bp, Artificial Sequence
  chemically synthesized
gtccccatatgggctctgat

SEQ ID NO: 609683 - DNA, 20 bp, Artificial Sequence
  chemically synthesized
tatctcaatgggaacgtgcc

SEQ ID NO: 609684 - DNA, 20 bp, Artificial Sequence
  chemically synthesized
ggaacgtgccccttgattag

SEQ ID NO: 609685 - DNA, 20 bp, Artificial Sequence
  chemically synthesized
gggatgtgttttctctgagg

SEQ ID NO: 609686 - DNA, 20 bp, Artificial Sequence
  chemically synthesized
cagagaaaacacatcccatt

SEQ ID NO: 609687 - DNA, 20 bp, Artificial Sequence
  chemically synthesized
gggccaaaaccgtcaatggg

SEQ ID NO: 609688 - DNA, 20 bp, Artificial Sequence
  chemically synthesized
tgatattttaatttcataag

SEQ ID NO: 609689 - DNA, 20 bp, Artificial Sequence
  chemically synthesized
gtaataaaatgtttaaaagt

SEQ ID NO: 609690 - DNA, 20 bp, Artificial Sequence
  chemically synthesized
catgtatggcttttgtaata

SEQ ID NO: 609691 - DNA, 20 bp, Artificial Sequence
  chemically synthesized
cattttattacaaaagccat

SEQ ID NO: 609692 - DNA, 20 bp, Artificial Sequence
  chemically synthesized
tttccactacaataagcatg

SEQ ID NO: 609693 - DNA, 20 bp, Artificial Sequence
  chemically synthesized
tttaaatgcgtctgtactgt

SEQ ID NO: 609694 - DNA, 20 bp, Artificial Sequence
  chemically synthesized
attaactttaaatgcgtctg

SEQ ID NO: 609695 - DNA, 20 bp, Artificial Sequence
  chemically synthesized
catactcatctgcctgtcta

SEQ ID NO: 609696 - DNA, 20 bp, Artificial Sequence
  chemically synthesized
agtacatgcatagacagtgt

SEQ ID NO: 609697 - DNA, 20 bp, Artificial Sequence
  chemically synthesized
cttaagatgtgctcaattag

SEQ ID NO: 609698 - DNA, 20 bp, Artificial Sequence
  chemically synthesized
caattagtaaagattcaaaa

SEQ ID NO: 609699 - DNA, 20 bp, Artificial Sequence
  chemically synthesized
ggtatgaagaaatgaagaaa

SEQ ID NO: 609700 - DNA, 20 bp, Artificial Sequence
  chemically synthesized
agagcaatgcctggcataaa

SEQ ID NO: 609701 - DNA, 20 bp, Artificial Sequence
  chemically synthesized
aagtatgttttcagcaaatt

SEQ ID NO: 609702 - DNA, 20 bp, Artificial Sequence
  chemically synthesized
attggacacttgccataagt

SEQ ID NO: 609703 - DNA, 20 bp, Artificial Sequence
  chemically synthesized
cagggtctaggtttgtttgt

SEQ ID NO: 609704 - DNA, 20 bp, Artificial Sequence
  chemically synthesized
aaatcagggtctaggtttgt

SEQ ID NO: 609705 - DNA, 20 bp, Artificial Sequence
  chemically synthesized
caaacacaaacaaacctaga

SEQ ID NO: 609706 - DNA, 20 bp, Artificial Sequence
  chemically synthesized
accataaaatcagggtctag

SEQ ID NO: 609707 - DNA, 20 bp, Artificial Sequence
  chemically synthesized
aggcaccataaaatcagggt

SEQ ID NO: 609708 - DNA, 20 bp, Artificial Sequence
  chemically synthesized
attttacatatatttgatcc

SEQ ID NO: 609709 - DNA, 20 bp, Artificial Sequence
  chemically synthesized
ttgaaagataatactaaatt

SEQ ID NO: 609710 - DNA, 20 bp, Artificial Sequence
  chemically synthesized
tctgattaaaatattacaag

SEQ ID NO: 609711 - DNA, 20 bp, Artificial Sequence
  chemically synthesized
agggttcatgtaaataggcc

SEQ ID NO: 609712 - DNA, 20 bp, Artificial Sequence
  chemically synthesized
actatgcatttatttattag

SEQ ID NO: 609713 - DNA, 20 bp, Artificial Sequence
  chemically synthesized
aatagcccatcaaaataaaa

SEQ ID NO: 609714 - DNA, 20 bp, Artificial Sequence
  chemically synthesized
gagtgttatcatactgaggt

SEQ ID NO: 609715 - DNA, 20 bp, Artificial Sequence
  chemically synthesized
gtgtcattctgcagtccatc

SEQ ID NO: 609716 - DNA, 20 bp, Artificial Sequence
  chemically synthesized
cagtccatcataggttttat

SEQ ID NO: 609717 - DNA, 20 bp, Artificial Sequence
  chemically synthesized
ttgtcggtattttacagcct

SEQ ID NO: 609718 - DNA, 20 bp, Artificial Sequence
  chemically synthesized
tacattgtaataaagtattt

SEQ ID NO: 609719 - DNA, 20 bp, Artificial Sequence
  chemically synthesized
atactaagataactttcaga

SEQ ID NO: 609720 - DNA, 20 bp, Artificial Sequence
  chemically synthesized
atcttagtatttgttgtgcc

SEQ ID NO: 609721 - DNA, 20 bp, Artificial Sequence
  chemically synthesized
tgccttgggtttccacagtt

SEQ ID NO: 609722 - DNA, 20 bp, Artificial Sequence
  chemically synthesized
tcaaacaggtgatttgcttt

SEQ ID NO: 609723 - DNA, 20 bp, Artificial Sequence
  chemically synthesized
aaaatctactaaagcaaatc

SEQ ID NO: 609724 - DNA, 20 bp, Artificial Sequence
  chemically synthesized
aaattattttcaaacaggtg

SEQ ID NO: 609725 - DNA, 20 bp, Artificial Sequence
  chemically synthesized
ttaagaaattattttcaaac

SEQ ID NO: 609726 - DNA, 20 bp, Artificial Sequence
  chemically synthesized
gttttctagataattctaaa

SEQ ID NO: 609727 - DNA, 20 bp, Artificial Sequence
  chemically synthesized
cacatgaatggtaagaggga

SEQ ID NO: 609728 - DNA, 20 bp, Artificial Sequence
  chemically synthesized
ataaatcacatgaatggtaa

SEQ ID NO: 609729 - DNA, 20 bp, Artificial Sequence
  chemically synthesized
ctgaatccctcttaccattc

SEQ ID NO: 609730 - DNA, 20 bp, Artificial Sequence
  chemically synthesized
gaacataaacaccctttctt

SEQ ID NO: 609731 - DNA, 20 bp, Artificial Sequence
  chemically synthesized
gagaataagcagagaagaaa

SEQ ID NO: 609732 - DNA, 20 bp, Artificial Sequence
  chemically synthesized
tctcctgtgatcattagctg

SEQ ID NO: 609733 - DNA, 20 bp, Artificial Sequence
  chemically synthesized
atctccagctggtacttccc

SEQ ID NO: 609734 - DNA, 20 bp, Artificial Sequence
  chemically synthesized
agctggtgggaagtaccagc

SEQ ID NO: 609735 - DNA, 20 bp, Artificial Sequence
  chemically synthesized
ggaaataatagagaaatttc

SEQ ID NO: 609736 - DNA, 20 bp, Artificial Sequence
  chemically synthesized
aactacattccctccattgg

SEQ ID NO: 609737 - DNA, 20 bp, Artificial Sequence
  chemically synthesized
acttcctactattgctcctc

SEQ ID NO: 609738 - DNA, 20 bp, Artificial Sequence
  chemically synthesized
acacagagagtcgcatacat

SEQ ID NO: 609739 - DNA, 20 bp, Artificial Sequence
  chemically synthesized
cactatattttctatggaca

SEQ ID NO: 609740 - DNA, 20 bp, Artificial Sequence
  chemically synthesized
acactgaacctgtcaaatat

SEQ ID NO: 609741 - DNA, 20 bp, Artificial Sequence
  chemically synthesized
aggctaatgtaagtgttctt

SEQ ID NO: 609742 - DNA, 20 bp, Artificial Sequence
  chemically synthesized
atagaacaggctttgtgtta

SEQ ID NO: 609743 - DNA, 20 bp, Artificial Sequence
  chemically synthesized
agtactttagtttttataga

SEQ ID NO: 609744 - DNA, 20 bp, Artificial Sequence
  chemically synthesized
ttacacgatatattcagtac

SEQ ID NO: 609745 - DNA, 20 bp, Artificial Sequence
  chemically synthesized
agtagtgacagtgaaaaatg

SEQ ID NO: 609746 - DNA, 20 bp, Artificial Sequence
  chemically synthesized
gattaaatgggtactcaaag

SEQ ID NO: 609747 - DNA, 20 bp, Artificial Sequence
  chemically synthesized
tacggtttctactgaacgca

SEQ ID NO: 609748 - DNA, 20 bp, Artificial Sequence
  chemically synthesized
ctgacttaagatggtttgac

SEQ ID NO: 609749 - DNA, 20 bp, Artificial Sequence
  chemically synthesized
ctagatggtccctgacttaa

SEQ ID NO: 609750 - DNA, 20 bp, Artificial Sequence
  chemically synthesized
taagtcagggaccatctaga

SEQ ID NO: 609751 - DNA, 20 bp, Artificial Sequence
  chemically synthesized
attgaagtaacttcaggaac

SEQ ID NO: 609752 - DNA, 20 bp, Artificial Sequence
  chemically synthesized
atgttgtgtagtgatcaagt

SEQ ID NO: 609753 - DNA, 20 bp, Artificial Sequence
  chemically synthesized
tctgtatgtccatgtgtacc

SEQ ID NO: 609754 - DNA, 20 bp, Artificial Sequence
  chemically synthesized
cacttataggaaaatacagt

SEQ ID NO: 609755 - DNA, 20 bp, Artificial Sequence
  chemically synthesized
ggaaaatacagtatttgatt

SEQ ID NO: 609756 - DNA, 20 bp, Artificial Sequence
  chemically synthesized
tttcacttaggatgatagcc

SEQ ID NO: 609757 - DNA, 20 bp, Artificial Sequence
  chemically synthesized
tttatctactcatggacaca

SEQ ID NO: 609758 - DNA, 20 bp, Artificial Sequence
  chemically synthesized
ctcatggacacaacttgatt

SEQ ID NO: 609759 - DNA, 20 bp, Artificial Sequence
  chemically synthesized
aaaatgctagttctccctaa

SEQ ID NO: 609760 - DNA, 20 bp, Artificial Sequence
  chemically synthesized
actttaaacttcctataaaa

SEQ ID NO: 609761 - DNA, 20 bp, Artificial Sequence
  chemically synthesized
agtataagcttttttttata

SEQ ID NO: 609762 - DNA, 20 bp, Artificial Sequence
  chemically synthesized
agtaaaccgcacaagaaagt

SEQ ID NO: 609763 - DNA, 20 bp, Artificial Sequence
  chemically synthesized
aaaaagcttatactttcttg

SEQ ID NO: 609764 - DNA, 20 bp, Artificial Sequence
  chemically synthesized
gtttacttctaagaaaacta

SEQ ID NO: 609765 - DNA, 20 bp, Artificial Sequence
  chemically synthesized
aagagaagttccaaaatcta

SEQ ID NO: 609766 - DNA, 20 bp, Artificial Sequence
  chemically synthesized
tttttaaaaataattttatt

SEQ ID NO: 609767 - DNA, 20 bp, Artificial Sequence
  chemically synthesized
gatatgttaatttctttcat

SEQ ID NO: 609768 - DNA, 20 bp, Artificial Sequence
  chemically synthesized
ctcgtggtcagagggtgggg

SEQ ID NO: 609769 - DNA, 20 bp, Artificial Sequence
  chemically synthesized
tttttactaaatgagtagat

SEQ ID NO: 609770 - DNA, 20 bp, Artificial Sequence
  chemically synthesized
ttcagaatttttactaaatg

SEQ ID NO: 609771 - DNA, 20 bp, Artificial Sequence
  chemically synthesized
cacactattaactataatcc

SEQ ID NO: 609772 - DNA, 20 bp, Artificial Sequence
  chemically synthesized
gaaagatctaatataaaaca

SEQ ID NO: 609773 - DNA, 20 bp, Artificial Sequence
  chemically synthesized
gttttatattagatctttca

SEQ ID NO: 609774 - DNA, 20 bp, Artificial Sequence
  chemically synthesized
tccacccccaacctggtaac

SEQ ID NO: 609775 - DNA, 20 bp, Artificial Sequence
  chemically synthesized
tgccttggcctcccaaagtg

SEQ ID NO: 609776 - DNA, 20 bp, Artificial Sequence
  chemically synthesized
ggcaggaggatcacaaggtc

SEQ ID NO: 609777 - DNA, 20 bp, Artificial Sequence
  chemically synthesized
tttttgaatttttagtagtg

SEQ ID NO: 609778 - DNA, 20 bp, Artificial Sequence
  chemically synthesized
actaatttttgaatttttag

SEQ ID NO: 609779 - DNA, 20 bp, Artificial Sequence
  chemically synthesized
tcactactaaaaattcaaaa

SEQ ID NO: 609780 - DNA, 20 bp, Artificial Sequence
  chemically synthesized
actaaaaattcaaaaattag

SEQ ID NO: 609781 - DNA, 20 bp, Artificial Sequence
  chemically synthesized
tgcctcagcctcctgaatag

SEQ ID NO: 609782 - DNA, 20 bp, Artificial Sequence
  chemically synthesized
aacctccacttcctggcttt

SEQ ID NO: 609783 - DNA, 20 bp, Artificial Sequence
  chemically synthesized
gctcactgcaacctccactt

SEQ ID NO: 609784 - DNA, 20 bp, Artificial Sequence
  chemically synthesized
gaagtggaggttgcagtgag

SEQ ID NO: 609785 - DNA, 20 bp, Artificial Sequence
  chemically synthesized
actgcacatcagcctggtga

SEQ ID NO: 609786 - DNA, 20 bp, Artificial Sequence
  chemically synthesized
aggagatcttgaccaggtgt

SEQ ID NO: 609787 - DNA, 20 bp, Artificial Sequence
  chemically synthesized
cctccctaagtccctaagtg

SEQ ID NO: 609788 - DNA, 20 bp, Artificial Sequence
  chemically synthesized
tacgcagatcacctgaggtc

SEQ ID NO: 609789 - DNA, 20 bp, Artificial Sequence
  chemically synthesized
ttttgcatttttagtagaga

SEQ ID NO: 609790 - DNA, 20 bp, Artificial Sequence
  chemically synthesized
tacctcagcctcccaagtag

SEQ ID NO: 609791 - DNA, 20 bp, Artificial Sequence
  chemically synthesized
aacctccacctccccggttc

SEQ ID NO: 609792 - DNA, 20 bp, Artificial Sequence
  chemically synthesized
gttgcagtgagccactgcac

SEQ ID NO: 609793 - DNA, 20 bp, Artificial Sequence
  chemically synthesized
aagatctcctttttttgtgt

SEQ ID NO: 609794 - DNA, 20 bp, Artificial Sequence
  chemically synthesized
aataagaagatctccttttt

SEQ ID NO: 609795 - DNA, 20 bp, Artificial Sequence
  chemically synthesized
gcaatatttttctttctgtg

SEQ ID NO: 609796 - DNA, 20 bp, Artificial Sequence
  chemically synthesized
gaaaaatattgcatgatctc

SEQ ID NO: 609797 - DNA, 20 bp, Artificial Sequence
  chemically synthesized
agcatagttactttttgttt

SEQ ID NO: 609798 - DNA, 20 bp, Artificial Sequence
  chemically synthesized
tgatactcagcatagttact

SEQ ID NO: 609799 - DNA, 20 bp, Artificial Sequence
  chemically synthesized
agataaattatttgaaaata

SEQ ID NO: 609800 - DNA, 20 bp, Artificial Sequence
  chemically synthesized
ttattttcaaataatttatc

SEQ ID NO: 609801 - DNA, 20 bp, Artificial Sequence
  chemically synthesized
aggaatattcttgtcgtatt

SEQ ID NO: 609802 - DNA, 20 bp, Artificial Sequence
  chemically synthesized
tgagtcattctagcatattg

SEQ ID NO: 609803 - DNA, 20 bp, Artificial Sequence
  chemically synthesized
attctagcatattgatatga

SEQ ID NO: 609804 - DNA, 20 bp, Artificial Sequence
  chemically synthesized
agcatattgatatgatttgg

SEQ ID NO: 609805 - DNA, 20 bp, Artificial Sequence
  chemically synthesized
actggggaacacaactcaac

SEQ ID NO: 609806 - DNA, 20 bp, Artificial Sequence
  chemically synthesized
aatgagttctcatgagatct

SEQ ID NO: 609807 - DNA, 20 bp, Artificial Sequence
  chemically synthesized
taaaagtgtgtagtactgcc

SEQ ID NO: 609808 - DNA, 20 bp, Artificial Sequence
  chemically synthesized
ccatgtaaggtataagatgt

SEQ ID NO: 609809 - DNA, 20 bp, Artificial Sequence
  chemically synthesized
ttgagtaatttgtaaagata

SEQ ID NO: 609810 - DNA, 20 bp, Artificial Sequence
  chemically synthesized
ttacaaattactcaatctca

SEQ ID NO: 609811 - DNA, 20 bp, Artificial Sequence
  chemically synthesized
ctcgcattgctataaactac

SEQ ID NO: 609812 - DNA, 20 bp, Artificial Sequence
  chemically synthesized
gcgctccacactgttccaac

SEQ ID NO: 609813 - DNA, 20 bp, Artificial Sequence
  chemically synthesized
cagaagacaggaagatgagg

SEQ ID NO: 609814 - DNA, 20 bp, Artificial Sequence
  chemically synthesized
tgtaacttcctagagacttg

SEQ ID NO: 609815 - DNA, 20 bp, Artificial Sequence
  chemically synthesized
tgcaataaaggtcactctcg

SEQ ID NO: 609816 - DNA, 20 bp, Artificial Sequence
  chemically synthesized
tctcgcaatgctttaacaaa

SEQ ID NO: 609817 - DNA, 20 bp, Artificial Sequence
  chemically synthesized
tggaacttttaacttgagac

SEQ ID NO: 609818 - DNA, 20 bp, Artificial Sequence
  chemically synthesized
aagaagccaggtcacatctt

SEQ ID NO: 609819 - DNA, 20 bp, Artificial Sequence
  chemically synthesized
gcaaaacatttaagatgtga

SEQ ID NO: 609820 - DNA, 20 bp, Artificial Sequence
  chemically synthesized
tacggtcatatgtatgagca

SEQ ID NO: 609821 - DNA, 20 bp, Artificial Sequence
  chemically synthesized
cttcccttttaaatataagt

SEQ ID NO: 609822 - DNA, 20 bp, Artificial Sequence
  chemically synthesized
ttaaaagggaagcagagcat

SEQ ID NO: 609823 - DNA, 20 bp, Artificial Sequence
  chemically synthesized
aaattttctaaacttttatg

SEQ ID NO: 609824 - DNA, 20 bp, Artificial Sequence
  chemically synthesized
accaccccgagaaaataggc

SEQ ID NO: 609825 - DNA, 20 bp, Artificial Sequence
  chemically synthesized
tcccccaccaccccgagaaa

SEQ ID NO: 609826 - DNA, 20 bp, Artificial Sequence
  chemically synthesized
tacttatgcaaatttccgca

SEQ ID NO: 609827 - DNA, 20 bp, Artificial Sequence
  chemically synthesized
tctggaggtctaggaaggaa

SEQ ID NO: 609828 - DNA, 20 bp, Artificial Sequence
  chemically synthesized
gccccagatgtgtcttgggg

SEQ ID NO: 609829 - DNA, 20 bp, Artificial Sequence
  chemically synthesized
gggtgcaagccataagcatt

SEQ ID NO: 609830 - DNA, 20 bp, Artificial Sequence
  chemically synthesized
acatggaagccaccaatgct

SEQ ID NO: 609831 - DNA, 20 bp, Artificial Sequence
  chemically synthesized
taacaccacatggaagccac

SEQ ID NO: 609832 - DNA, 20 bp, Artificial Sequence
  chemically synthesized
ctctcacactctgcacactt

SEQ ID NO: 609833 - DNA, 20 bp, Artificial Sequence
  chemically synthesized
agtgtgcagagtgtgagagt

SEQ ID NO: 609834 - DNA, 20 bp, Artificial Sequence
  chemically synthesized
ttgaggcttgagagcatcca

SEQ ID NO: 609835 - DNA, 20 bp, Artificial Sequence
  chemically synthesized
agacttctacctggacatgc

SEQ ID NO: 609836 - DNA, 20 bp, Artificial Sequence
  chemically synthesized
cccactggggcactgcctac

SEQ ID NO: 609837 - DNA, 20 bp, Artificial Sequence
  chemically synthesized
cctagaatggtctctccagt

SEQ ID NO: 609838 - DNA, 20 bp, Artificial Sequence
  chemically synthesized
atgggctggcattgagtgac

SEQ ID NO: 609839 - DNA, 20 bp, Artificial Sequence
  chemically synthesized
gcagggtgtacagcaccctt

SEQ ID NO: 609840 - DNA, 20 bp, Artificial Sequence
  chemically synthesized
gagcctgtcccttgcatcac

SEQ ID NO: 609841 - DNA, 20 bp, Artificial Sequence
  chemically synthesized
ggagtcaaaggaaattattt

SEQ ID NO: 609842 - DNA, 20 bp, Artificial Sequence
  chemically synthesized
aaggaaattattttggagct

SEQ ID NO: 609843 - DNA, 20 bp, Artificial Sequence
  chemically synthesized
aagatttaatgactaccctg

SEQ ID NO: 609844 - DNA, 20 bp, Artificial Sequence
  chemically synthesized
gcctgtaacccctttcttct

SEQ ID NO: 609845 - DNA, 20 bp, Artificial Sequence
  chemically synthesized
tgtatcttggaagtaactca

SEQ ID NO: 609846 - DNA, 20 bp, Artificial Sequence
  chemically synthesized
tttggggaactgttgggaaa

SEQ ID NO: 609847 - DNA, 20 bp, Artificial Sequence
  chemically synthesized
tctcacatttcaaaatacaa

SEQ ID NO: 609848 - DNA, 20 bp, Artificial Sequence
  chemically synthesized
ttttgaaatgtgagaacaat

SEQ ID NO: 609849 - DNA, 20 bp, Artificial Sequence
  chemically synthesized
gaggggttggggcagaacga

SEQ ID NO: 609850 - DNA, 20 bp, Artificial Sequence
  chemically synthesized
attggggatcacaatacaac

SEQ ID NO: 609851 - DNA, 20 bp, Artificial Sequence
  chemically synthesized
ggaggtgactgaatcatagg

SEQ ID NO: 609852 - DNA, 20 bp, Artificial Sequence
  chemically synthesized
agtaagagggaaatctgccc

SEQ ID NO: 609853 - DNA, 20 bp, Artificial Sequence
  chemically synthesized
agagagcaggcagagatgct

SEQ ID NO: 609854 - DNA, 20 bp, Artificial Sequence
  chemically synthesized
gaaggtgaaggggaagtagg

SEQ ID NO: 609855 - DNA, 20 bp, Artificial Sequence
  chemically synthesized
tacttccccttcaccttcca

SEQ ID NO: 609856 - DNA, 20 bp, Artificial Sequence
  chemically synthesized
atttcctgagacctccccag

SEQ ID NO: 609857 - DNA, 20 bp, Artificial Sequence
  chemically synthesized
ctgggtaatttataaagaaa

SEQ ID NO: 609858 - DNA, 20 bp, Artificial Sequence
  chemically synthesized
taaattacccagtcacaggt

SEQ ID NO: 609859 - DNA, 20 bp, Artificial Sequence
  chemically synthesized
tcaagataaggacatttatt

SEQ ID NO: 609860 - DNA, 20 bp, Artificial Sequence
  chemically synthesized
aaagtaatatatccaatgac

SEQ ID NO: 609861 - DNA, 20 bp, Artificial Sequence
  chemically synthesized
aatgtcattggatatattac

SEQ ID NO: 609862 - DNA, 20 bp, Artificial Sequence
  chemically synthesized
tactgataggactgactagt

SEQ ID NO: 609863 - DNA, 20 bp, Artificial Sequence
  chemically synthesized
gactttaagaaaaggaagaa

SEQ ID NO: 609864 - DNA, 20 bp, Artificial Sequence
  chemically synthesized
aagattaaatattacctgtt

SEQ ID NO: 609865 - DNA, 20 bp, Artificial Sequence
  chemically synthesized
attcagggctttcatttaat

SEQ ID NO: 609866 - DNA, 20 bp, Artificial Sequence
  chemically synthesized
tcttttaaagtgatgaaatt

SEQ ID NO: 609867 - DNA, 20 bp, Artificial Sequence
  chemically synthesized
cttgagtcaacattggaata

SEQ ID NO: 609868 - DNA, 20 bp, Artificial Sequence
  chemically synthesized
cgatataaagaggcaccaat

SEQ ID NO: 609869 - DNA, 20 bp, Artificial Sequence
  chemically synthesized
atattcttggtagcaaaata

SEQ ID NO: 609870 - DNA, 20 bp, Artificial Sequence
  chemically synthesized
actagagaaggtaggcaaat

SEQ ID NO: 609871 - DNA, 20 bp, Artificial Sequence
  chemically synthesized
caactatgtccagttatgtt

SEQ ID NO: 609872 - DNA, 20 bp, Artificial Sequence
  chemically synthesized
gtatttccaactatgtccag

SEQ ID NO: 609873 - DNA, 20 bp, Artificial Sequence
  chemically synthesized
aatcatgatagaggatgcat

SEQ ID NO: 609874 - DNA, 20 bp, Artificial Sequence
  chemically synthesized
aatcacccatgcatcctcta

SEQ ID NO: 609875 - DNA, 20 bp, Artificial Sequence
  chemically synthesized
ttaattattattttcaattc

SEQ ID NO: 609876 - DNA, 20 bp, Artificial Sequence
  chemically synthesized
agatagactggttggaagca

SEQ ID NO: 609877 - DNA, 20 bp, Artificial Sequence
  chemically synthesized
aatactttctatttgaagct

SEQ ID NO: 609878 - DNA, 20 bp, Artificial Sequence
  chemically synthesized
ttcagataatcttaatagag

SEQ ID NO: 609879 - DNA, 20 bp, Artificial Sequence
  chemically synthesized
cctctagaagcttagctcta

SEQ ID NO: 609880 - DNA, 20 bp, Artificial Sequence
  chemically synthesized
cttaatagagctaagcttct

SEQ ID NO: 609881 - DNA, 20 bp, Artificial Sequence
  chemically synthesized
tttggttcatgtaaacctct

SEQ ID NO: 609882 - DNA, 20 bp, Artificial Sequence
  chemically synthesized
gaaccaaataaaaatcagca

SEQ ID NO: 609883 - DNA, 20 bp, Artificial Sequence
  chemically synthesized
aaaggaatatgaaagctcag

SEQ ID NO: 609884 - DNA, 20 bp, Artificial Sequence
  chemically synthesized
ttttcaatttctcattatca

SEQ ID NO: 609885 - DNA, 20 bp, Artificial Sequence
  chemically synthesized
aaagttatagaattatttgc

SEQ ID NO: 609886 - DNA, 20 bp, Artificial Sequence
  chemically synthesized
aaagagaaaccttagtattg

SEQ ID NO: 609887 - DNA, 20 bp, Artificial Sequence
  chemically synthesized
cagtttaaactttgcaatac

SEQ ID NO: 609888 - DNA, 20 bp, Artificial Sequence
  chemically synthesized
ccttagtattgcaaagttta

SEQ ID NO: 609889 - DNA, 20 bp, Artificial Sequence
  chemically synthesized
ggcaaatgcatattaacata

SEQ ID NO: 609890 - DNA, 20 bp, Artificial Sequence
  chemically synthesized
ggatattgtacagatgcaca

SEQ ID NO: 609891 - DNA, 20 bp, Artificial Sequence
  chemically synthesized
gttcttatttaagttatttt

SEQ ID NO: 609892 - DNA, 20 bp, Artificial Sequence
  chemically synthesized
ttatcagtcagtcaatatcc

SEQ ID NO: 609893 - DNA, 20 bp, Artificial Sequence
  chemically synthesized
gttatttcccagaatacctc

SEQ ID NO: 609894 - DNA, 20 bp, Artificial Sequence
  chemically synthesized
aatgcccttttccaacctct

SEQ ID NO: 609895 - DNA, 20 bp, Artificial Sequence
  chemically synthesized
atcatataatacgttgttat

SEQ ID NO: 609896 - DNA, 20 bp, Artificial Sequence
  chemically synthesized
atatatatatatacacacac

SEQ ID NO: 609897 - DNA, 20 bp, Artificial Sequence
  chemically synthesized
aatgctagtaatgttgtctt

SEQ ID NO: 609898 - DNA, 20 bp, Artificial Sequence
  chemically synthesized
aagaaatgctagtaatgttg

SEQ ID NO: 609899 - DNA, 20 bp, Artificial Sequence
  chemically synthesized
aacattactagcatttcttt

SEQ ID NO: 609900 - DNA, 20 bp, Artificial Sequence
  chemically synthesized
agtcaaatcataccttacaa

SEQ ID NO: 609901 - DNA, 20 bp, Artificial Sequence
  chemically synthesized
gacaaaaactcttttgtaag

SEQ ID NO: 609902 - DNA, 20 bp, Artificial Sequence
  chemically synthesized
cattgtcttctaggagttca

SEQ ID NO: 609903 - DNA, 20 bp, Artificial Sequence
  chemically synthesized
ttacttacattttcttttac

SEQ ID NO: 609904 - DNA, 20 bp, Artificial Sequence
  chemically synthesized
tggatgtgagctaagtaaaa

SEQ ID NO: 609905 - DNA, 20 bp, Artificial Sequence
  chemically synthesized
tacattcatttggaaatgtt

SEQ ID NO: 609906 - DNA, 20 bp, Artificial Sequence
  chemically synthesized
tggaaatgttattcgattca

SEQ ID NO: 609907 - DNA, 20 bp, Artificial Sequence
  chemically synthesized
attcacattgtttgccccca

SEQ ID NO: 609908 - DNA, 20 bp, Artificial Sequence
  chemically synthesized
ataaatttaggacctattta

SEQ ID NO: 609909 - DNA, 20 bp, Artificial Sequence
  chemically synthesized
ttgtaacaatgattttctca

SEQ ID NO: 609910 - DNA, 20 bp, Artificial Sequence
  chemically synthesized
acagttgtaacaatgatttt

SEQ ID NO: 609911 - DNA, 20 bp, Artificial Sequence
  chemically synthesized
tgtagaattgacagttgtaa

SEQ ID NO: 609912 - DNA, 20 bp, Artificial Sequence
  chemically synthesized
gtcagatccagagatgtatg

SEQ ID NO: 609913 - DNA, 20 bp, Artificial Sequence
  chemically synthesized
gatctatgcatacattatga

SEQ ID NO: 609914 - DNA, 20 bp, Artificial Sequence
  chemically synthesized
gataataatggggtaaaatg

SEQ ID NO: 609915 - DNA, 20 bp, Artificial Sequence
  chemically synthesized
ctacattttaccccattatt

SEQ ID NO: 609916 - DNA, 20 bp, Artificial Sequence
  chemically synthesized
ttatgtgggataaataaatt

SEQ ID NO: 609917 - DNA, 20 bp, Artificial Sequence
  chemically synthesized
tttatttatcccacataact

SEQ ID NO: 609918 - DNA, 20 bp, Artificial Sequence
  chemically synthesized
tgaatacatagacagtagaa

SEQ ID NO: 609919 - DNA, 20 bp, Artificial Sequence
  chemically synthesized
tattcaacttatacattttc

SEQ ID NO: 609920 - DNA, 20 bp, Artificial Sequence
  chemically synthesized
gtagcatatttttttctgtg

SEQ ID NO: 609921 - DNA, 20 bp, Artificial Sequence
  chemically synthesized
ttactctcatgttcattgcg

SEQ ID NO: 609922 - DNA, 20 bp, Artificial Sequence
  chemically synthesized
gtaaggctatctccacaagg

SEQ ID NO: 609923 - DNA, 20 bp, Artificial Sequence
  chemically synthesized
ctgtgggtctatacccagga

SEQ ID NO: 609924 - DNA, 20 bp, Artificial Sequence
  chemically synthesized
cattatggaaaattgtctgg

SEQ ID NO: 609925 - DNA, 20 bp, Artificial Sequence
  chemically synthesized
aggtatgaagtaatacctta

SEQ ID NO: 609926 - DNA, 20 bp, Artificial Sequence
  chemically synthesized
gaagtaataccttattatga

SEQ ID NO: 609927 - DNA, 20 bp, Artificial Sequence
  chemically synthesized
ttccctaatagtgatattga

SEQ ID NO: 609928 - DNA, 20 bp, Artificial Sequence
  chemically synthesized
cacgttttaatttccctgtt

SEQ ID NO: 609929 - DNA, 20 bp, Artificial Sequence
  chemically synthesized
ccaattttttaattgggtta

SEQ ID NO: 609930 - DNA, 20 bp, Artificial Sequence
  chemically synthesized
atattaaacccttatcagat

SEQ ID NO: 609931 - DNA, 20 bp, Artificial Sequence
  chemically synthesized
ttgcaaaacatatatctgat

SEQ ID NO: 609932 - DNA, 20 bp, Artificial Sequence
  chemically synthesized
atctactcataatctgtagg

SEQ ID NO: 609933 - DNA, 20 bp, Artificial Sequence
  chemically synthesized
agcaaaagaaaaacacagcc

SEQ ID NO: 609934 - DNA, 20 bp, Artificial Sequence
  chemically synthesized
atctgtaggctgtgtttttc

SEQ ID NO: 609935 - DNA, 20 bp, Artificial Sequence
  chemically synthesized
gtgtttttcttttgctttcc

SEQ ID NO: 609936 - DNA, 20 bp, Artificial Sequence
  chemically synthesized
cttttgctttccagaagctt

SEQ ID NO: 609937 - DNA, 20 bp, Artificial Sequence
  chemically synthesized
agtggaactacattaatcta

SEQ ID NO: 609938 - DNA, 20 bp, Artificial Sequence
  chemically synthesized
ttttagattaatgtagttcc

SEQ ID NO: 609939 - DNA, 20 bp, Artificial Sequence
  chemically synthesized
atgtagttccactagtttat

SEQ ID NO: 609940 - DNA, 20 bp, Artificial Sequence
  chemically synthesized
ctctctgacagtcgcctttg

SEQ ID NO: 609941 - DNA, 20 bp, Artificial Sequence
  chemically synthesized
ccttgcaaaggcgactgtca

SEQ ID NO: 609942 - DNA, 20 bp, Artificial Sequence
  chemically synthesized
ctgtcagagagctttttcct

SEQ ID NO: 609943 - DNA, 20 bp, Artificial Sequence
  chemically synthesized
tctgttttcttctaggagtc

SEQ ID NO: 609944 - DNA, 20 bp, Artificial Sequence
  chemically synthesized
tggtggtcctgtccaaaatt

SEQ ID NO: 609945 - DNA, 20 bp, Artificial Sequence
  chemically synthesized
gtccaaaattagttgattat

SEQ ID NO: 609946 - DNA, 20 bp, Artificial Sequence
  chemically synthesized
aattagttgattatataggc

SEQ ID NO: 609947 - DNA, 20 bp, Artificial Sequence
  chemically synthesized
tgagatctctattctgttcc

SEQ ID NO: 609948 - DNA, 20 bp, Artificial Sequence
  chemically synthesized
tctgttccatcagtttatgt

SEQ ID NO: 609949 - DNA, 20 bp, Artificial Sequence
  chemically synthesized
tacaatactctttttaatac

SEQ ID NO: 609950 - DNA, 20 bp, Artificial Sequence
  chemically synthesized
aaaagttggaaatactgctc

SEQ ID NO: 609951 - DNA, 20 bp, Artificial Sequence
  chemically synthesized
tatttccaacttttttttcc

SEQ ID NO: 609952 - DNA, 20 bp, Artificial Sequence
  chemically synthesized
ctcaagattgttctggctat

SEQ ID NO: 609953 - DNA, 20 bp, Artificial Sequence
  chemically synthesized
ctggctatttgggatttcat

SEQ ID NO: 609954 - DNA, 20 bp, Artificial Sequence
  chemically synthesized
ttctgtgaaaaaaaatgcca

SEQ ID NO: 609955 - DNA, 20 bp, Artificial Sequence
  chemically synthesized
aaatgccatttagattttca

SEQ ID NO: 609956 - DNA, 20 bp, Artificial Sequence
  chemically synthesized
tattgagttttttgttctat

SEQ ID NO: 609957 - DNA, 20 bp, Artificial Sequence
  chemically synthesized
taatattttttgttgttgta

SEQ ID NO: 609958 - DNA, 20 bp, Artificial Sequence
  chemically synthesized
tgtaataacaaataatcgat

SEQ ID NO: 609959 - DNA, 20 bp, Artificial Sequence
  chemically synthesized
cctatatactttaaaacatc

SEQ ID NO: 609960 - DNA, 20 bp, Artificial Sequence
  chemically synthesized
aatactatgccattttgtat

SEQ ID NO: 609961 - DNA, 20 bp, Artificial Sequence
  chemically synthesized
gtataagggatttaagcatc

SEQ ID NO: 609962 - DNA, 20 bp, Artificial Sequence
  chemically synthesized
cagtggataccaaaatccaa

SEQ ID NO: 609963 - DNA, 20 bp, Artificial Sequence
  chemically synthesized
taaatatatgggaaaatatc

SEQ ID NO: 609964 - DNA, 20 bp, Artificial Sequence
  chemically synthesized
ttaccttttaatttgttcct

SEQ ID NO: 609965 - DNA, 20 bp, Artificial Sequence
  chemically synthesized
taatttgttcctcaatgttt

SEQ ID NO: 609966 - DNA, 20 bp, Artificial Sequence
  chemically synthesized
taaaaatgcaactaatttta

SEQ ID NO: 609967 - DNA, 20 bp, Artificial Sequence
  chemically synthesized
atttttcttgtggagtcctt

SEQ ID NO: 609968 - DNA, 20 bp, Artificial Sequence
  chemically synthesized
aaaggaagaagtaatattat

SEQ ID NO: 609969 - DNA, 20 bp, Artificial Sequence
  chemically synthesized
gcagtgagacaaaattaata

SEQ ID NO: 609970 - DNA, 20 bp, Artificial Sequence
  chemically synthesized
gaagtggtaagagtgggcat

SEQ ID NO: 609971 - DNA, 20 bp, Artificial Sequence
  chemically synthesized
tttttagcaaatcttaaggg

SEQ ID NO: 609972 - DNA, 20 bp, Artificial Sequence
  chemically synthesized
ttgtactgaaagctttcccc

SEQ ID NO: 609973 - DNA, 20 bp, Artificial Sequence
  chemically synthesized
ggttgtggggtggttgtact

SEQ ID NO: 609974 - DNA, 20 bp, Artificial Sequence
  chemically synthesized
caccgttgatcatattagct

SEQ ID NO: 609975 - DNA, 20 bp, Artificial Sequence
  chemically synthesized
gaagagttataataataaaa

SEQ ID NO: 609976 - DNA, 20 bp, Artificial Sequence
  chemically synthesized
gttataataataaaaggatg

SEQ ID NO: 609977 - DNA, 20 bp, Artificial Sequence
  chemically synthesized
aaaggatgtttagctttatc

SEQ ID NO: 609978 - DNA, 20 bp, Artificial Sequence
  chemically synthesized
tgcatgtattgagataatca

SEQ ID NO: 609979 - DNA, 20 bp, Artificial Sequence
  chemically synthesized
taacagaaagatgaaaaacc

SEQ ID NO: 609980 - DNA, 20 bp, Artificial Sequence
  chemically synthesized
tctgttaatgtagtatgtcg

SEQ ID NO: 609981 - DNA, 20 bp, Artificial Sequence
  chemically synthesized
ttaatgtagtatgtcgcatt

SEQ ID NO: 609982 - DNA, 20 bp, Artificial Sequence
  chemically synthesized
gtttagccctaggacacaag

SEQ ID NO: 609983 - DNA, 20 bp, Artificial Sequence
  chemically synthesized
tagggctaaacccacctggt

SEQ ID NO: 609984 - DNA, 20 bp, Artificial Sequence
  chemically synthesized
ggattataaaccgtgaccag

SEQ ID NO: 609985 - DNA, 20 bp, Artificial Sequence
  chemically synthesized
attagcaagacaaataacac

SEQ ID NO: 609986 - DNA, 20 bp, Artificial Sequence
  chemically synthesized
atattttcttctcttgcggt

SEQ ID NO: 609987 - DNA, 20 bp, Artificial Sequence
  chemically synthesized
agggtgatgctgaagtcata

SEQ ID NO: 609988 - DNA, 20 bp, Artificial Sequence
  chemically synthesized
tatttcctcttctattattt

SEQ ID NO: 609989 - DNA, 20 bp, Artificial Sequence
  chemically synthesized
aatggtataaattactcttt

SEQ ID NO: 609990 - DNA, 20 bp, Artificial Sequence
  chemically synthesized
tttatttatccaatataact

SEQ ID NO: 609991 - DNA, 20 bp, Artificial Sequence
  chemically synthesized
ttggataaataaatctcgat

SEQ ID NO: 609992 - DNA, 20 bp, Artificial Sequence
  chemically synthesized
gtcatcatactaagcagtta

SEQ ID NO: 609993 - DNA, 20 bp, Artificial Sequence
  chemically synthesized
tatccattatcttccataat

SEQ ID NO: 609994 - DNA, 20 bp, Artificial Sequence
  chemically synthesized
cgatatacatagacataatg

SEQ ID NO: 609995 - DNA, 20 bp, Artificial Sequence
  chemically synthesized
gaagccaaaagattacatac

SEQ ID NO: 609996 - DNA, 20 bp, Artificial Sequence
  chemically synthesized
aaatcaggggtatgtaatct

SEQ ID NO: 609997 - DNA, 20 bp, Artificial Sequence
  chemically synthesized
aaatggagcctaaggaagcc

SEQ ID NO: 609998 - DNA, 20 bp, Artificial Sequence
  chemically synthesized
ttttgcaggttttttttttt

SEQ ID NO: 609999 - DNA, 20 bp, Artificial Sequence
  chemically synthesized
aaacattatgagattttttt

SEQ ID NO: 610000 - DNA, 20 bp, Artificial Sequence
  chemically synthesized
aaacctgcaaaaaaatctca

SEQ ID NO: 610001 - DNA, 20 bp, Artificial Sequence
  chemically synthesized
acccactttcttaaaacatt

SEQ ID NO: 610002 - DNA, 20 bp, Artificial Sequence
  chemically synthesized
atgggctacatgtggcccag

SEQ ID NO: 610003 - DNA, 20 bp, Artificial Sequence
  chemically synthesized
tatgtgctaattattttagt

SEQ ID NO: 610004 - DNA, 20 bp, Artificial Sequence
  chemically synthesized
caacaatatgtgctaattat

SEQ ID NO: 610005 - DNA, 20 bp, Artificial Sequence
  chemically synthesized
ttgtatttcaaatgatgaca

SEQ ID NO: 610006 - DNA, 20 bp, Artificial Sequence
  chemically synthesized
ccagttggaccaattttttg

SEQ ID NO: 610007 - DNA, 20 bp, Artificial Sequence
  chemically synthesized
aatttagagtttattattac

SEQ ID NO: 610008 - DNA, 20 bp, Artificial Sequence
  chemically synthesized
caaaaaagtctgatttaatt

SEQ ID NO: 610009 - DNA, 20 bp, Artificial Sequence
  chemically synthesized
cgtttagtttcagcaaaaaa

SEQ ID NO: 610010 - DNA, 20 bp, Artificial Sequence
  chemically synthesized
cacctattttattcacctcg

SEQ ID NO: 610011 - DNA, 20 bp, Artificial Sequence
  chemically synthesized
cacttcacctattttattca

SEQ ID NO: 610012 - DNA, 20 bp, Artificial Sequence
  chemically synthesized
agttcttatcattttcataa

SEQ ID NO: 610013 - DNA, 20 bp, Artificial Sequence
  chemically synthesized
agcagactttagtagactac

SEQ ID NO: 610014 - DNA, 20 bp, Artificial Sequence
  chemically synthesized
atctagagtagtctactaaa

SEQ ID NO: 610015 - DNA, 20 bp, Artificial Sequence
  chemically synthesized
tctactaaagtctgcttttt

SEQ ID NO: 610016 - DNA, 20 bp, Artificial Sequence
  chemically synthesized
ccaagaggagctgttaacat

SEQ ID NO: 610017 - DNA, 20 bp, Artificial Sequence
  chemically synthesized
tcagagtaaaattagcttta

SEQ ID NO: 610018 - DNA, 20 bp, Artificial Sequence
  chemically synthesized
atttattgtttcagagtaaa

SEQ ID NO: 610019 - DNA, 20 bp, Artificial Sequence
  chemically synthesized
tacttcacattgggttgatt

SEQ ID NO: 610020 - DNA, 20 bp, Artificial Sequence
  chemically synthesized
ctgtgatatacttcacattg

SEQ ID NO: 610021 - DNA, 20 bp, Artificial Sequence
  chemically synthesized
agacttatttaatgactgga

SEQ ID NO: 610022 - DNA, 20 bp, Artificial Sequence
  chemically synthesized
ttaaataagtctcaagatcc

SEQ ID NO: 610023 - DNA, 20 bp, Artificial Sequence
  chemically synthesized
gagctaataaagttattcag

SEQ ID NO: 610024 - DNA, 20 bp, Artificial Sequence
  chemically synthesized
actttattagctcttctctt

SEQ ID NO: 610025 - DNA, 20 bp, Artificial Sequence
  chemically synthesized
atatgatgagaaaaagagct

SEQ ID NO: 610026 - DNA, 20 bp, Artificial Sequence
  chemically synthesized
attataaatttacaatgtta

SEQ ID NO: 610027 - DNA, 20 bp, Artificial Sequence
  chemically synthesized
acaatgttactgagattaaa

SEQ ID NO: 610028 - DNA, 20 bp, Artificial Sequence
  chemically synthesized
tttggtagctctcttttttc

SEQ ID NO: 610029 - DNA, 20 bp, Artificial Sequence
  chemically synthesized
tctgatgccaagaacacaac

SEQ ID NO: 610030 - DNA, 20 bp, Artificial Sequence
  chemically synthesized
aaagtttatttgatgtttac

SEQ ID NO: 610031 - DNA, 20 bp, Artificial Sequence
  chemically synthesized
ctaagctgttaaagtttatt

SEQ ID NO: 610032 - DNA, 20 bp, Artificial Sequence
  chemically synthesized
gtaaacatcaaataaacttt

SEQ ID NO: 610033 - DNA, 20 bp, Artificial Sequence
  chemically synthesized
ttatttacgcactaagctgt

SEQ ID NO: 610034 - DNA, 20 bp, Artificial Sequence
  chemically synthesized
gatagtacttaataaatagt

SEQ ID NO: 610035 - DNA, 20 bp, Artificial Sequence
  chemically synthesized
agaaagtatacaatcctaat

SEQ ID NO: 610036 - DNA, 20 bp, Artificial Sequence
  chemically synthesized
tctagattctaaagcaagga

SEQ ID NO: 610037 - DNA, 20 bp, Artificial Sequence
  chemically synthesized
acaatgtctagattctaaag

SEQ ID NO: 610038 - DNA, 20 bp, Artificial Sequence
  chemically synthesized
tccttgctttagaatctaga

SEQ ID NO: 610039 - DNA, 20 bp, Artificial Sequence
  chemically synthesized
aaatggctaagaaaacaatg

SEQ ID NO: 610040 - DNA, 20 bp, Artificial Sequence
  chemically synthesized
agtctttaccagaaatgctg

SEQ ID NO: 610041 - DNA, 20 bp, Artificial Sequence
  chemically synthesized
tgttccagaaatttcaatat

SEQ ID NO: 610042 - DNA, 20 bp, Artificial Sequence
  chemically synthesized
caatatactagatttgacag

SEQ ID NO: 610043 - DNA, 20 bp, Artificial Sequence
  chemically synthesized
atatatatgtatatgcatgc

SEQ ID NO: 610044 - DNA, 20 bp, Artificial Sequence
  chemically synthesized
tgcatgtgtttatatacatg

SEQ ID NO: 610045 - DNA, 20 bp, Artificial Sequence
  chemically synthesized
tacagccactcctgctgttt

SEQ ID NO: 610046 - DNA, 20 bp, Artificial Sequence
  chemically synthesized
gaaaaaagtacagccactcc

SEQ ID NO: 610047 - DNA, 20 bp, Artificial Sequence
  chemically synthesized
gctgtacttttttcagacag

SEQ ID NO: 610048 - DNA, 20 bp, Artificial Sequence
  chemically synthesized
tataatgaccttttttgact

SEQ ID NO: 610049 - DNA, 20 bp, Artificial Sequence
  chemically synthesized
ctctctttagctctaataat

SEQ ID NO: 610050 - DNA, 20 bp, Artificial Sequence
  chemically synthesized
ttttgtacccattaaccaac

SEQ ID NO: 610051 - DNA, 20 bp, Artificial Sequence
  chemically synthesized
ccttgctgtgctcgcaaata

SEQ ID NO: 610052 - DNA, 20 bp, Artificial Sequence
  chemically synthesized
ttttataataactcagtatc

SEQ ID NO: 610053 - DNA, 20 bp, Artificial Sequence
  chemically synthesized
ataataactcagtatcattg

SEQ ID NO: 610054 - DNA, 20 bp, Artificial Sequence
  chemically synthesized
ttgtttataacacaaaggat

SEQ ID NO: 610055 - DNA, 20 bp, Artificial Sequence
  chemically synthesized
ggatggataccccattctcc

SEQ ID NO: 610056 - DNA, 20 bp, Artificial Sequence
  chemically synthesized
tttttaaatttttgtgggta

SEQ ID NO: 610057 - DNA, 20 bp, Artificial Sequence
  chemically synthesized
ggtatatctcttaatctaaa

SEQ ID NO: 610058 - DNA, 20 bp, Artificial Sequence
  chemically synthesized
tgagaatgttcaaaacatta

SEQ ID NO: 610059 - DNA, 20 bp, Artificial Sequence
  chemically synthesized
tccatagaaagttaagattg

SEQ ID NO: 610060 - DNA, 20 bp, Artificial Sequence
  chemically synthesized
gtcattgcctccatagaaag

SEQ ID NO: 610061 - DNA, 20 bp, Artificial Sequence
  chemically synthesized
gctaaccccgcagtgtcata

SEQ ID NO: 610062 - DNA, 20 bp, Artificial Sequence
  chemically synthesized
gaaaatgacatttgttcatg

SEQ ID NO: 610063 - DNA, 20 bp, Artificial Sequence
  chemically synthesized
agataaggtcatattcacaa

SEQ ID NO: 610064 - DNA, 20 bp, Artificial Sequence
  chemically synthesized
tttaaaatactatattttag

SEQ ID NO: 610065 - DNA, 20 bp, Artificial Sequence
  chemically synthesized
gatagggtgtgctgccacat

SEQ ID NO: 610066 - DNA, 20 bp, Artificial Sequence
  chemically synthesized
gtgatggcaaatggccttgt

SEQ ID NO: 610067 - DNA, 20 bp, Artificial Sequence
  chemically synthesized
ggtcatgtgactctcatttg

SEQ ID NO: 610068 - DNA, 20 bp, Artificial Sequence
  chemically synthesized
tattttactctcctggaaag

SEQ ID NO: 610069 - DNA, 20 bp, Artificial Sequence
  chemically synthesized
gatctgttaaattttatctt

SEQ ID NO: 610070 - DNA, 20 bp, Artificial Sequence
  chemically synthesized
agagcagttataaggactgc

SEQ ID NO: 610071 - DNA, 20 bp, Artificial Sequence
  chemically synthesized
gggtttataaattatttgtg

SEQ ID NO: 610072 - DNA, 20 bp, Artificial Sequence
  chemically synthesized
catatttatggggtccaaca

SEQ ID NO: 610073 - DNA, 20 bp, Artificial Sequence
  chemically synthesized
aaattataaatatataagat

SEQ ID NO: 610074 - DNA, 20 bp, Artificial Sequence
  chemically synthesized
taggcctagaatttgaattg

SEQ ID NO: 610075 - DNA, 20 bp, Artificial Sequence
  chemically synthesized
ggcaattcaaattctaggcc

SEQ ID NO: 610076 - DNA, 20 bp, Artificial Sequence
  chemically synthesized
tgggtattcatcttggagat

SEQ ID NO: 610077 - DNA, 20 bp, Artificial Sequence
  chemically synthesized
gtatctttgtaacattcaca

SEQ ID NO: 610078 - DNA, 20 bp, Artificial Sequence
  chemically synthesized
tgtgaatgttacaaagatac

SEQ ID NO: 610079 - DNA, 20 bp, Artificial Sequence
  chemically synthesized
aatagactagcaaaaaaaag

SEQ ID NO: 610080 - DNA, 20 bp, Artificial Sequence
  chemically synthesized
tgaatttttgtaccagttgg

SEQ ID NO: 610081 - DNA, 20 bp, Artificial Sequence
  chemically synthesized
gggcagattaccttctctag

SEQ ID NO: 610082 - DNA, 20 bp, Artificial Sequence
  chemically synthesized
gcactagagaaggtaatctg

SEQ ID NO: 610083 - DNA, 20 bp, Artificial Sequence
  chemically synthesized
agagaaggtaatctgcccag

SEQ ID NO: 610084 - DNA, 20 bp, Artificial Sequence
  chemically synthesized
gtgtaatctaagccaatctg

SEQ ID NO: 610085 - DNA, 20 bp, Artificial Sequence
  chemically synthesized
aggtaatctgcccagattgg

SEQ ID NO: 610086 - DNA, 20 bp, Artificial Sequence
  chemically synthesized
ttcattgagacttgtataaa

SEQ ID NO: 610087 - DNA, 20 bp, Artificial Sequence
  chemically synthesized
aaaatggtttcacgagacca

SEQ ID NO: 610088 - DNA, 20 bp, Artificial Sequence
  chemically synthesized
taacagagcagaactctaaa

SEQ ID NO: 610089 - DNA, 20 bp, Artificial Sequence
  chemically synthesized
atttagaaggtggtctagtc

SEQ ID NO: 610090 - DNA, 20 bp, Artificial Sequence
  chemically synthesized
tctaaattcatttactagag

SEQ ID NO: 610091 - DNA, 20 bp, Artificial Sequence
  chemically synthesized
tgatatagaaaaattaatta

SEQ ID NO: 610092 - DNA, 20 bp, Artificial Sequence
  chemically synthesized
ttaatttttctatatcaggc

SEQ ID NO: 610093 - DNA, 20 bp, Artificial Sequence
  chemically synthesized
tgtatcctaaattaggaaag

SEQ ID NO: 610094 - DNA, 20 bp, Artificial Sequence
  chemically synthesized
aatgtgttaaaagtatttgt

SEQ ID NO: 610095 - DNA, 20 bp, Artificial Sequence
  chemically synthesized
gatgattttctcttaaatat

SEQ ID NO: 610096 - DNA, 20 bp, Artificial Sequence
  chemically synthesized
ccaaattagactgctgtaaa

SEQ ID NO: 610097 - DNA, 20 bp, Artificial Sequence
  chemically synthesized
tgtggtacattttctagtaa

SEQ ID NO: 610098 - DNA, 20 bp, Artificial Sequence
  chemically synthesized
aaaagtatgatcagagtgat

SEQ ID NO: 610099 - DNA, 20 bp, Artificial Sequence
  chemically synthesized
tctgatcactctgatcatac

SEQ ID NO: 610100 - DNA, 20 bp, Artificial Sequence
  chemically synthesized
tttttttgtaatttaatctc

SEQ ID NO: 610101 - DNA, 20 bp, Artificial Sequence
  chemically synthesized
gtaatgccctttataaacta

SEQ ID NO: 610102 - DNA, 20 bp, Artificial Sequence
  chemically synthesized
ccatagtttataaagggcat

SEQ ID NO: 610103 - DNA, 20 bp, Artificial Sequence
  chemically synthesized
ttactgcttgtcaggaaaaa

SEQ ID NO: 610104 - DNA, 20 bp, Artificial Sequence
  chemically synthesized
ggagtgtcattttctgaaaa

SEQ ID NO: 610105 - DNA, 20 bp, Artificial Sequence
  chemically synthesized
aatgacactcctcagttagg

SEQ ID NO: 610106 - DNA, 20 bp, Artificial Sequence
  chemically synthesized
ggattgttactgaagctgat

SEQ ID NO: 610107 - DNA, 20 bp, Artificial Sequence
  chemically synthesized
ccaatgaagagtaaacattt

SEQ ID NO: 610108 - DNA, 20 bp, Artificial Sequence
  chemically synthesized
agactactcttatgctctta

SEQ ID NO: 610109 - DNA, 20 bp, Artificial Sequence
  chemically synthesized
tttgaattttatatttctag

SEQ ID NO: 610110 - DNA, 20 bp, Artificial Sequence
  chemically synthesized
tagaaatataaaattcaaaa

SEQ ID NO: 610111 - DNA, 20 bp, Artificial Sequence
  chemically synthesized
aaaatgtgattttcatgtaa

SEQ ID NO: 610112 - DNA, 20 bp, Artificial Sequence
  chemically synthesized
ttcctaacaagaaatttgaa

SEQ ID NO: 610113 - DNA, 20 bp, Artificial Sequence
  chemically synthesized
tgctttcaaatttcttgtta

SEQ ID NO: 610114 - DNA, 20 bp, Artificial Sequence
  chemically synthesized
atgttactctggagtgtctg

SEQ ID NO: 610115 - DNA, 20 bp, Artificial Sequence
  chemically synthesized
tacttatgcgtgtaatactg

SEQ ID NO: 610116 - DNA, 20 bp, Artificial Sequence
  chemically synthesized
acacgcataagtaaatgaag

SEQ ID NO: 610117 - DNA, 20 bp, Artificial Sequence
  chemically synthesized
attacaacattgggttgtat

SEQ ID NO: 610118 - DNA, 20 bp, Artificial Sequence
  chemically synthesized
aatggagtccaggcactctt

SEQ ID NO: 610119 - DNA, 20 bp, Artificial Sequence
  chemically synthesized
ctctttgtagtttatcaaga

SEQ ID NO: 610120 - DNA, 20 bp, Artificial Sequence
  chemically synthesized
tcaagagcaggtttaacagc

SEQ ID NO: 610121 - DNA, 20 bp, Artificial Sequence
  chemically synthesized
ccatggattaaatgacttca

SEQ ID NO: 610122 - DNA, 20 bp, Artificial Sequence
  chemically synthesized
gctgaagtcatttaatccat

SEQ ID NO: 610123 - DNA, 20 bp, Artificial Sequence
  chemically synthesized
agctgcgtataaaaagcagc

SEQ ID NO: 610124 - DNA, 20 bp, Artificial Sequence
  chemically synthesized
catggctgctttttatacgc

SEQ ID NO: 610125 - DNA, 20 bp, Artificial Sequence
  chemically synthesized
tttatacgcagctgctttat

SEQ ID NO: 610126 - DNA, 20 bp, Artificial Sequence
  chemically synthesized
gagttaaattgtgttagcaa

SEQ ID NO: 610127 - DNA, 20 bp, Artificial Sequence
  chemically synthesized
aaggtgaaatgtctgataag

SEQ ID NO: 610128 - DNA, 20 bp, Artificial Sequence
  chemically synthesized
attcccaaagatatctgcct

SEQ ID NO: 610129 - DNA, 20 bp, Artificial Sequence
  chemically synthesized
tcctgtatttttttgaatct

SEQ ID NO: 610130 - DNA, 20 bp, Artificial Sequence
  chemically synthesized
aggaagttctcactgaagcc

SEQ ID NO: 610131 - DNA, 20 bp, Artificial Sequence
  chemically synthesized
ggcttcagtgagaacttcct

SEQ ID NO: 610132 - DNA, 20 bp, Artificial Sequence
  chemically synthesized
atttattcttatctttcctt

SEQ ID NO: 610133 - DNA, 20 bp, Artificial Sequence
  chemically synthesized
atggccaacgtcaggccttc

SEQ ID NO: 610134 - DNA, 20 bp, Artificial Sequence
  chemically synthesized
tggcaagatggaaagactaa

SEQ ID NO: 610135 - DNA, 20 bp, Artificial Sequence
  chemically synthesized
gagtggataggtaaaagtat

SEQ ID NO: 610136 - DNA, 20 bp, Artificial Sequence
  chemically synthesized
gtcagcagatacttttttca

SEQ ID NO: 610137 - DNA, 20 bp, Artificial Sequence
  chemically synthesized
cttacttgcttacacgtgtt

SEQ ID NO: 610138 - DNA, 20 bp, Artificial Sequence
  chemically synthesized
gttcaacctgtattgaactt

SEQ ID NO: 610139 - DNA, 20 bp, Artificial Sequence
  chemically synthesized
aattacagattttgtagcat

SEQ ID NO: 610140 - DNA, 20 bp, Artificial Sequence
  chemically synthesized
cgtgtagttactcaaaaaat

SEQ ID NO: 610141 - DNA, 20 bp, Artificial Sequence
  chemically synthesized
tgaaatccgaaatgattcaa

SEQ ID NO: 610142 - DNA, 20 bp, Artificial Sequence
  chemically synthesized
ggaaatccttattgaatcat

SEQ ID NO: 610143 - DNA, 20 bp, Artificial Sequence
  chemically synthesized
cttattgaatcatttcggat

SEQ ID NO: 610144 - DNA, 20 bp, Artificial Sequence
  chemically synthesized
atctgaaaatctgaaatccg

SEQ ID NO: 610145 - DNA, 20 bp, Artificial Sequence
  chemically synthesized
atcatttcggatttcagatt

SEQ ID NO: 610146 - DNA, 20 bp, Artificial Sequence
  chemically synthesized
tgttttggattttggatatt

SEQ ID NO: 610147 - DNA, 20 bp, Artificial Sequence
  chemically synthesized
atgcttgggaccagaagtgt

SEQ ID NO: 610148 - DNA, 20 bp, Artificial Sequence
  chemically synthesized
tccaaaatgcttgggaccag

SEQ ID NO: 610149 - DNA, 20 bp, Artificial Sequence
  chemically synthesized
tgttgagtatcccttatcca

SEQ ID NO: 610150 - DNA, 20 bp, Artificial Sequence
  chemically synthesized
tactcaacatatattttggg

SEQ ID NO: 610151 - DNA, 20 bp, Artificial Sequence
  chemically synthesized
aagactaaatattgggcaat

SEQ ID NO: 610152 - DNA, 20 bp, Artificial Sequence
  chemically synthesized
gtcaaccattaatgtagcac

SEQ ID NO: 610153 - DNA, 20 bp, Artificial Sequence
  chemically synthesized
ccaaaatattcattaacatg

SEQ ID NO: 610154 - DNA, 20 bp, Artificial Sequence
  chemically synthesized
ttcatgttaatgaatatttt

SEQ ID NO: 610155 - DNA, 20 bp, Artificial Sequence
  chemically synthesized
atcttctgcctcttttcaaa

SEQ ID NO: 610156 - DNA, 20 bp, Artificial Sequence
  chemically synthesized
cttttcaaacactgattcat

SEQ ID NO: 610157 - DNA, 20 bp, Artificial Sequence
  chemically synthesized
cttgccaagctaccatgaat

SEQ ID NO: 610158 - DNA, 20 bp, Artificial Sequence
  chemically synthesized
tcatggtagcttggcaagct

SEQ ID NO: 610159 - DNA, 20 bp, Artificial Sequence
  chemically synthesized
atactcctcttggagaatca

SEQ ID NO: 610160 - DNA, 20 bp, Artificial Sequence
  chemically synthesized
gattctccaagaggagtatt

SEQ ID NO: 610161 - DNA, 20 bp, Artificial Sequence
  chemically synthesized
tgaaatgtggaaatgttaaa

SEQ ID NO: 610162 - DNA, 20 bp, Artificial Sequence
  chemically synthesized
cacatttcatatatcatctc

SEQ ID NO: 610163 - DNA, 20 bp, Artificial Sequence
  chemically synthesized
ctcagcagatttctaccctt

SEQ ID NO: 610164 - DNA, 20 bp, Artificial Sequence
  chemically synthesized
ttgtatacttatgtctctta

SEQ ID NO: 610165 - DNA, 20 bp, Artificial Sequence
  chemically synthesized
attattaaagaaccagaaca

SEQ ID NO: 610166 - DNA, 20 bp, Artificial Sequence
  chemically synthesized
tgttgaatgccctgctgaga

SEQ ID NO: 610167 - DNA, 20 bp, Artificial Sequence
  chemically synthesized
ttttgctagtacatttagaa

SEQ ID NO: 610168 - DNA, 20 bp, Artificial Sequence
  chemically synthesized
ggctgtgctactatatatgc

SEQ ID NO: 610169 - DNA, 20 bp, Artificial Sequence
  chemically synthesized
agcagaggctgtgctactat

SEQ ID NO: 610170 - DNA, 20 bp, Artificial Sequence
  chemically synthesized
aatatttatagctgagttag

SEQ ID NO: 610171 - DNA, 20 bp, Artificial Sequence
  chemically synthesized
atagctgagttagtcatgtt

SEQ ID NO: 610172 - DNA, 20 bp, Artificial Sequence
  chemically synthesized
aacagtggggatctgaacac

SEQ ID NO: 610173 - DNA, 20 bp, Artificial Sequence
  chemically synthesized
tgcctcagcctccgaaaatg

SEQ ID NO: 610174 - DNA, 20 bp, Artificial Sequence
  chemically synthesized
ttcggaggctgaggcaggag

SEQ ID NO: 610175 - DNA, 20 bp, Artificial Sequence
  chemically synthesized
caggaggatcgcttgaggcc

SEQ ID NO: 610176 - DNA, 20 bp, Artificial Sequence
  chemically synthesized
gttattttgtagagacaggg

SEQ ID NO: 610177 - DNA, 20 bp, Artificial Sequence
  chemically synthesized
tctacaaaataacaataaaa

SEQ ID NO: 610178 - DNA, 20 bp, Artificial Sequence
  chemically synthesized
ctggagtgcactagcacagt

SEQ ID NO: 610179 - DNA, 20 bp, Artificial Sequence
  chemically synthesized
atagatatgtgatccaatcc

SEQ ID NO: 610180 - DNA, 20 bp, Artificial Sequence
  chemically synthesized
acctgacatattttaaaact

SEQ ID NO: 610181 - DNA, 20 bp, Artificial Sequence
  chemically synthesized
gtaggacacaaaaacaattt

SEQ ID NO: 610182 - DNA, 20 bp, Artificial Sequence
  chemically synthesized
ctctttttcataaacattca

SEQ ID NO: 610183 - DNA, 20 bp, Artificial Sequence
  chemically synthesized
aacatcttactatttccaaa

SEQ ID NO: 610184 - DNA, 20 bp, Artificial Sequence
  chemically synthesized
atcacattttggaaatagta

SEQ ID NO: 610185 - DNA, 20 bp, Artificial Sequence
  chemically synthesized
gtaagatgtttgccctagga

SEQ ID NO: 610186 - DNA, 20 bp, Artificial Sequence
  chemically synthesized
tagtcttatctcttactact

SEQ ID NO: 610187 - DNA, 20 bp, Artificial Sequence
  chemically synthesized
agtagttactaatatttttc

SEQ ID NO: 610188 - DNA, 20 bp, Artificial Sequence
  chemically synthesized
atgaaaaatattagtaacta

SEQ ID NO: 610189 - DNA, 20 bp, Artificial Sequence
  chemically synthesized
gtggctcccactacctatat

SEQ ID NO: 610190 - DNA, 20 bp, Artificial Sequence
  chemically synthesized
agtgtggaggctatgtattc

SEQ ID NO: 610191 - DNA, 20 bp, Artificial Sequence
  chemically synthesized
cagatttctgatccaatatt

SEQ ID NO: 610192 - DNA, 20 bp, Artificial Sequence
  chemically synthesized
cttgaaatattggatcagaa

SEQ ID NO: 610193 - DNA, 20 bp, Artificial Sequence
  chemically synthesized
atcttggctcctcctctcaa

SEQ ID NO: 610194 - DNA, 20 bp, Artificial Sequence
  chemically synthesized
gagtgagcgacgcagaagac

SEQ ID NO: 610195 - DNA, 20 bp, Artificial Sequence
  chemically synthesized
ccgagtgaggcaatgcctca

SEQ ID NO: 610196 - DNA, 20 bp, Artificial Sequence
  chemically synthesized
gcagtattcgggtgggtgtg

SEQ ID NO: 610197 - DNA, 20 bp, Artificial Sequence
  chemically synthesized
gtcacacccacccgaatact

SEQ ID NO: 610198 - DNA, 20 bp, Artificial Sequence
  chemically synthesized
ccgaatactgcgtgtttccg

SEQ ID NO: 610199 - DNA, 20 bp, Artificial Sequence
  chemically synthesized
ggcttaaaaaacggcacacc

SEQ ID NO: 610200 - DNA, 20 bp, Artificial Sequence
  chemically synthesized
caggatataatctcctggtg

SEQ ID NO: 610201 - DNA, 20 bp, Artificial Sequence
  chemically synthesized
gtcctaccccaacggaatct

SEQ ID NO: 610202 - DNA, 20 bp, Artificial Sequence
  chemically synthesized
gactgctgtgctagcaatca

SEQ ID NO: 610203 - DNA, 20 bp, Artificial Sequence
  chemically synthesized
ccccagccttgctgccacct

SEQ ID NO: 610204 - DNA, 20 bp, Artificial Sequence
  chemically synthesized
ggaggggcacccgccattgc

SEQ ID NO: 610205 - DNA, 20 bp, Artificial Sequence
  chemically synthesized
gggcacccgccattgcctag

SEQ ID NO: 610206 - DNA, 20 bp, Artificial Sequence
  chemically synthesized
ttaggtaaacaaagcagctg

SEQ ID NO: 610207 - DNA, 20 bp, Artificial Sequence
  chemically synthesized
cagttcaagcttcccagctg

SEQ ID NO: 610208 - DNA, 20 bp, Artificial Sequence
  chemically synthesized
ccacccagttcaagcttccc

SEQ ID NO: 610209 - DNA, 20 bp, Artificial Sequence
  chemically synthesized
tgtggtgggctccacccagt

SEQ ID NO: 610210 - DNA, 20 bp, Artificial Sequence
  chemically synthesized
tgcagaggttactgctgtct

SEQ ID NO: 610211 - DNA, 20 bp, Artificial Sequence
  chemically synthesized
aaaaagacagcagtaacctc

SEQ ID NO: 610212 - DNA, 20 bp, Artificial Sequence
  chemically synthesized
agatttaaatatccctgtct

SEQ ID NO: 610213 - DNA, 20 bp, Artificial Sequence
  chemically synthesized
tgtggatgtcctttctgttt

SEQ ID NO: 610214 - DNA, 20 bp, Artificial Sequence
  chemically synthesized
gttttttgtgtggatgtcct

SEQ ID NO: 610215 - DNA, 20 bp, Artificial Sequence
  chemically synthesized
ttgatgatggtgacgtccag

SEQ ID NO: 610216 - DNA, 20 bp, Artificial Sequence
  chemically synthesized
ctctgtttcttccccatctt

SEQ ID NO: 610217 - DNA, 20 bp, Artificial Sequence
  chemically synthesized
tagagtttccagtttttctg

SEQ ID NO: 610218 - DNA, 20 bp, Artificial Sequence
  chemically synthesized
gtgctctgctttttagagtt

SEQ ID NO: 610219 - DNA, 20 bp, Artificial Sequence
  chemically synthesized
aggagaggtgctctgctttt

SEQ ID NO: 610220 - DNA, 20 bp, Artificial Sequence
  chemically synthesized
cctttggaggaggagaggtg

SEQ ID NO: 610221 - DNA, 20 bp, Artificial Sequence
  chemically synthesized
ctcgtcaaagtcatcctctc

SEQ ID NO: 610222 - DNA, 20 bp, Artificial Sequence
  chemically synthesized
actttgacgagctgagagaa

SEQ ID NO: 610223 - DNA, 20 bp, Artificial Sequence
  chemically synthesized
aagttttcaacttctttgcc

SEQ ID NO: 610224 - DNA, 20 bp, Artificial Sequence
  chemically synthesized
acattcttctaaatgttttt

SEQ ID NO: 610225 - DNA, 20 bp, Artificial Sequence
  chemically synthesized
ttctacttatacattcttct

SEQ ID NO: 610226 - DNA, 20 bp, Artificial Sequence
  chemically synthesized
gtagaataaccattacagag

SEQ ID NO: 610227 - DNA, 20 bp, Artificial Sequence
  chemically synthesized
tcttcacgtacttctctagc

SEQ ID NO: 610228 - DNA, 20 bp, Artificial Sequence
  chemically synthesized
cagttgatcgcatcggctcc

SEQ ID NO: 610229 - DNA, 20 bp, Artificial Sequence
  chemically synthesized
taatgaaatgaaccgagaag

SEQ ID NO: 610230 - DNA, 20 bp, Artificial Sequence
  chemically synthesized
cacatagtcccatatttctt

SEQ ID NO: 610231 - DNA, 20 bp, Artificial Sequence
  chemically synthesized
tgtgaaaagaccaaatctac

SEQ ID NO: 610232 - DNA, 20 bp, Artificial Sequence
  chemically synthesized
tttcaggtacaccaatcaga

SEQ ID NO: 610233 - DNA, 20 bp, Artificial Sequence
  chemically synthesized
ctcctggataatatcctgca

SEQ ID NO: 610234 - DNA, 20 bp, Artificial Sequence
  chemically synthesized
tctgaatgttggcctgcctt

SEQ ID NO: 610235 - DNA, 20 bp, Artificial Sequence
  chemically synthesized
tctagcaaggcaggccaaca

SEQ ID NO: 610236 - DNA, 20 bp, Artificial Sequence
  chemically synthesized
caactccaagacacataatt

SEQ ID NO: 610237 - DNA, 20 bp, Artificial Sequence
  chemically synthesized
agagatccgctgttagtgtg

SEQ ID NO: 610238 - DNA, 20 bp, Artificial Sequence
  chemically synthesized
aatattggcccccactctct

SEQ ID NO: 610239 - DNA, 20 bp, Artificial Sequence
  chemically synthesized
gaatttcacatccaggcaaa

SEQ ID NO: 610240 - DNA, 20 bp, Artificial Sequence
  chemically synthesized
tttctcctttacttatgaag

SEQ ID NO: 610241 - DNA, 20 bp, Artificial Sequence
  chemically synthesized
ttttatttctcctttactta

SEQ ID NO: 610242 - DNA, 20 bp, Artificial Sequence
  chemically synthesized
tctacagacaagcaaatgct

SEQ ID NO: 610243 - DNA, 20 bp, Artificial Sequence
  chemically synthesized
tggtgacaaaatctctcagc

SEQ ID NO: 610244 - DNA, 20 bp, Artificial Sequence
  chemically synthesized
cggttgttcctttccatgtt

SEQ ID NO: 610245 - DNA, 20 bp, Artificial Sequence
  chemically synthesized
ctggtaccggttgttccttt

SEQ ID NO: 610246 - DNA, 20 bp, Artificial Sequence
  chemically synthesized
tcaatggtctttacattttg

SEQ ID NO: 610247 - DNA, 20 bp, Artificial Sequence
  chemically synthesized
tgattttgctcgttagttga

SEQ ID NO: 610248 - DNA, 20 bp, Artificial Sequence
  chemically synthesized
cctgtcattatgatgttagc

SEQ ID NO: 610249 - DNA, 20 bp, Artificial Sequence
  chemically synthesized
tgtgtgtctctgcacatgag

SEQ ID NO: 610250 - DNA, 20 bp, Artificial Sequence
  chemically synthesized
cctgcctttttttgttttcc

SEQ ID NO: 610251 - DNA, 20 bp, Artificial Sequence
  chemically synthesized
ggattgcaacccctgccttt

SEQ ID NO: 610252 - DNA, 20 bp, Artificial Sequence
  chemically synthesized
aaagtctgttttatcagaga

SEQ ID NO: 610253 - DNA, 20 bp, Artificial Sequence
  chemically synthesized
ttgatctttgttggtttaaa

SEQ ID NO: 610254 - DNA, 20 bp, Artificial Sequence
  chemically synthesized
ctttgtctcttttgatcttt

SEQ ID NO: 610255 - DNA, 20 bp, Artificial Sequence
  chemically synthesized
atagttagctcttcctgttg

SEQ ID NO: 610256 - DNA, 20 bp, Artificial Sequence
  chemically synthesized
atgcacccaacaaaggagca

SEQ ID NO: 610257 - DNA, 20 bp, Artificial Sequence
  chemically synthesized
ctctttgtaggtcactcagg

SEQ ID NO: 610258 - DNA, 20 bp, Artificial Sequence
  chemically synthesized
ttcaattcctgggtatcctt

SEQ ID NO: 610259 - DNA, 20 bp, Artificial Sequence
  chemically synthesized
gctgaaaagaatgtatattc

SEQ ID NO: 610260 - DNA, 20 bp, Artificial Sequence
  chemically synthesized
gttcttctacatttgctgag

SEQ ID NO: 610261 - DNA, 20 bp, Artificial Sequence
  chemically synthesized
gattgcactgtggtctgaga

SEQ ID NO: 610262 - DNA, 20 bp, Artificial Sequence
  chemically synthesized
attcttaattctgagttcta

SEQ ID NO: 610263 - DNA, 20 bp, Artificial Sequence
  chemically synthesized
tgagattcttaattctgagt

SEQ ID NO: 610264 - DNA, 20 bp, Artificial Sequence
  chemically synthesized
atgtagttgagcggttttga

SEQ ID NO: 610265 - DNA, 20 bp, Artificial Sequence
  chemically synthesized
gttcagtttccatgtagttg

SEQ ID NO: 610266 - DNA, 20 bp, Artificial Sequence
  chemically synthesized
agtcattcaggaggaggttg

SEQ ID NO: 610267 - DNA, 20 bp, Artificial Sequence
  chemically synthesized
tatgttgtgtctttgttctc

SEQ ID NO: 610268 - DNA, 20 bp, Artificial Sequence
  chemically synthesized
acactgctttgaatgtgtcc

SEQ ID NO: 610269 - DNA, 20 bp, Artificial Sequence
  chemically synthesized
gctataaatttccctctaca

SEQ ID NO: 610270 - DNA, 20 bp, Artificial Sequence
  chemically synthesized
gggtgtcaattttggatctt

SEQ ID NO: 610271 - DNA, 20 bp, Artificial Sequence
  chemically synthesized
tagcttttgaatgtgtttgc

SEQ ID NO: 610272 - DNA, 20 bp, Artificial Sequence
  chemically synthesized
tgtcttctgctagcttttga

SEQ ID NO: 610273 - DNA, 20 bp, Artificial Sequence
  chemically synthesized
ttagttatttcttgtcttct

SEQ ID NO: 610274 - DNA, 20 bp, Artificial Sequence
  chemically synthesized
ctctatttccttcagttctg

SEQ ID NO: 610275 - DNA, 20 bp, Artificial Sequence
  chemically synthesized
ctggattcattaattttttg

SEQ ID NO: 610276 - DNA, 20 bp, Artificial Sequence
  chemically synthesized
aaaaattaatgaatccagga

SEQ ID NO: 610277 - DNA, 20 bp, Artificial Sequence
  chemically synthesized
atcctttcaaaaaaccagct

SEQ ID NO: 610278 - DNA, 20 bp, Artificial Sequence
  chemically synthesized
tatcattttttattgcatct

SEQ ID NO: 610279 - DNA, 20 bp, Artificial Sequence
  chemically synthesized
tgtttgtagtattctctgat

SEQ ID NO: 610280 - DNA, 20 bp, Artificial Sequence
  chemically synthesized
tttctagtttatttgcgtag

SEQ ID NO: 610281 - DNA, 20 bp, Artificial Sequence
  chemically synthesized
tatccatttcttctagattt

SEQ ID NO: 610282 - DNA, 20 bp, Artificial Sequence
  chemically synthesized
gcaggaatttatccatttct

SEQ ID NO: 610283 - DNA, 20 bp, Artificial Sequence
  chemically synthesized
attcagagattcaacttctt

SEQ ID NO: 610284 - DNA, 20 bp, Artificial Sequence
  chemically synthesized
gatcctgttattggtctatt

SEQ ID NO: 610285 - DNA, 20 bp, Artificial Sequence
  chemically synthesized
ctgaaattgtggcaataatc

SEQ ID NO: 610286 - DNA, 20 bp, Artificial Sequence
  chemically synthesized
actctttttggttggtaagc

SEQ ID NO: 610287 - DNA, 20 bp, Artificial Sequence
  chemically synthesized
ccaaaaagagtccaggacca

SEQ ID NO: 610288 - DNA, 20 bp, Artificial Sequence
  chemically synthesized
cctctttttctattgattgg

SEQ ID NO: 610289 - DNA, 20 bp, Artificial Sequence
  chemically synthesized
gggaggattccctctttttc

SEQ ID NO: 610290 - DNA, 20 bp, Artificial Sequence
  chemically synthesized
ggcctcataaaatgagttag

SEQ ID NO: 610291 - DNA, 20 bp, Artificial Sequence
  chemically synthesized
cttttttggttgtgtctctg

SEQ ID NO: 610292 - DNA, 20 bp, Artificial Sequence
  chemically synthesized
tcgttttgccagtattttat

SEQ ID NO: 610293 - DNA, 20 bp, Artificial Sequence
  chemically synthesized
gctttttgatgtgctgctgg

SEQ ID NO: 610294 - DNA, 20 bp, Artificial Sequence
  chemically synthesized
gataagctttttgatgtgct

SEQ ID NO: 610295 - DNA, 20 bp, Artificial Sequence
  chemically synthesized
acgaatccagcagcacatca

SEQ ID NO: 610296 - DNA, 20 bp, Artificial Sequence
  chemically synthesized
agcccacttgatcatggtgg

SEQ ID NO: 610297 - DNA, 20 bp, Artificial Sequence
  chemically synthesized
agcttatccaccatgatcaa

SEQ ID NO: 610298 - DNA, 20 bp, Artificial Sequence
  chemically synthesized
tttatatgctggattacatt

SEQ ID NO: 610299 - DNA, 20 bp, Artificial Sequence
  chemically synthesized
gtctttggctctgtttatat

SEQ ID NO: 610300 - DNA, 20 bp, Artificial Sequence
  chemically synthesized
catgtggtttttgtctttgg

SEQ ID NO: 610301 - DNA, 20 bp, Artificial Sequence
  chemically synthesized
cagagccaaagacaaaaacc

SEQ ID NO: 610302 - DNA, 20 bp, Artificial Sequence
  chemically synthesized
tgcatctatggagataatca

SEQ ID NO: 610303 - DNA, 20 bp, Artificial Sequence
  chemically synthesized
ccgtcaatacctaatttact

SEQ ID NO: 610304 - DNA, 20 bp, Artificial Sequence
  chemically synthesized
cattcagtatgatattggct

SEQ ID NO: 610305 - DNA, 20 bp, Artificial Sequence
  chemically synthesized
cagttttcaaagggaatgct

SEQ ID NO: 610306 - DNA, 20 bp, Artificial Sequence
  chemically synthesized
cttgtgccagttttcaaagg

SEQ ID NO: 610307 - DNA, 20 bp, Artificial Sequence
  chemically synthesized
agagggcatccctgtcttgt

SEQ ID NO: 610308 - DNA, 20 bp, Artificial Sequence
  chemically synthesized
aaaagagaaagtcaaattga

SEQ ID NO: 610309 - DNA, 20 bp, Artificial Sequence
  chemically synthesized
attgaccctgtttgcagatg

SEQ ID NO: 610310 - DNA, 20 bp, Artificial Sequence
  chemically synthesized
gagattttaggctgagacag

SEQ ID NO: 610311 - DNA, 20 bp, Artificial Sequence
  chemically synthesized
tgaagttccctatcagctta

SEQ ID NO: 610312 - DNA, 20 bp, Artificial Sequence
  chemically synthesized
agactttgctgaagttccct

SEQ ID NO: 610313 - DNA, 20 bp, Artificial Sequence
  chemically synthesized
gaatgcttgtgatttttgta

SEQ ID NO: 610314 - DNA, 20 bp, Artificial Sequence
  chemically synthesized
ttgttggtgtataagaatgc

SEQ ID NO: 610315 - DNA, 20 bp, Artificial Sequence
  chemically synthesized
tgtctgttgttggtgtataa

SEQ ID NO: 610316 - DNA, 20 bp, Artificial Sequence
  chemically synthesized
agttcactcatgatttggct

SEQ ID NO: 610317 - DNA, 20 bp, Artificial Sequence
  chemically synthesized
aattgtgaatgggagttcac

SEQ ID NO: 610318 - DNA, 20 bp, Artificial Sequence
  chemically synthesized
atgagtgaactcccattcac

SEQ ID NO: 610319 - DNA, 20 bp, Artificial Sequence
  chemically synthesized
gtccttcacatcccttgtaa

SEQ ID NO: 610320 - DNA, 20 bp, Artificial Sequence
  chemically synthesized
cctcttttatttcattgagc

SEQ ID NO: 610321 - DNA, 20 bp, Artificial Sequence
  chemically synthesized
tgagcatggaatgttcttcc

SEQ ID NO: 610322 - DNA, 20 bp, Artificial Sequence
  chemically synthesized
cagtatggccattttcacga

SEQ ID NO: 610323 - DNA, 20 bp, Artificial Sequence
  chemically synthesized
ccatactgcccaaggtaatt

SEQ ID NO: 610324 - DNA, 20 bp, Artificial Sequence
  chemically synthesized
attctgtgaagaaaggcatt

SEQ ID NO: 610325 - DNA, 20 bp, Artificial Sequence
  chemically synthesized
tggttccatatcaactttaa

SEQ ID NO: 610326 - DNA, 20 bp, Artificial Sequence
  chemically synthesized
gatgcctccagctttgttct

SEQ ID NO: 610327 - DNA, 20 bp, Artificial Sequence
  chemically synthesized
aagtcaggtagtgtgatgcc

SEQ ID NO: 610328 - DNA, 20 bp, Artificial Sequence
  chemically synthesized
tggttactgcagccttgtag

SEQ ID NO: 610329 - DNA, 20 bp, Artificial Sequence
  chemically synthesized
ctgttttggtaccagtacca

SEQ ID NO: 610330 - DNA, 20 bp, Artificial Sequence
  chemically synthesized
tctgttccattgatctatat

SEQ ID NO: 610331 - DNA, 20 bp, Artificial Sequence
  chemically synthesized
ttccccattgcttgtttttc

SEQ ID NO: 610332 - DNA, 20 bp, Artificial Sequence
  chemically synthesized
gagaaaaacaagcaatgggg

SEQ ID NO: 610333 - DNA, 20 bp, Artificial Sequence
  chemically synthesized
tagggaatcctttccccatt

SEQ ID NO: 610334 - DNA, 20 bp, Artificial Sequence
  chemically synthesized
taaatagggaatcctttccc

SEQ ID NO: 610335 - DNA, 20 bp, Artificial Sequence
  chemically synthesized
cagctttctacatatggcta

SEQ ID NO: 610336 - DNA, 20 bp, Artificial Sequence
  chemically synthesized
gtgtgaggaagggatccagt

SEQ ID NO: 610337 - DNA, 20 bp, Artificial Sequence
  chemically synthesized
tataaggtgtgaggaaggga

SEQ ID NO: 610338 - DNA, 20 bp, Artificial Sequence
  chemically synthesized
ttatacaaaaatcaattcaa

SEQ ID NO: 610339 - DNA, 20 bp, Artificial Sequence
  chemically synthesized
taagtttttaatccatgttg

SEQ ID NO: 610340 - DNA, 20 bp, Artificial Sequence
  chemically synthesized
tatggttttaggtctaacgt

SEQ ID NO: 610341 - DNA, 20 bp, Artificial Sequence
  chemically synthesized
ggtttttatggttttaggtc

SEQ ID NO: 610342 - DNA, 20 bp, Artificial Sequence
  chemically synthesized
aggttttcttccagggtttt

SEQ ID NO: 610343 - DNA, 20 bp, Artificial Sequence
  chemically synthesized
gtaatgcctaggttttcttc

SEQ ID NO: 610344 - DNA, 20 bp, Artificial Sequence
  chemically synthesized
tatgtcctgaatggtaatgc

SEQ ID NO: 610345 - DNA, 20 bp, Artificial Sequence
  chemically synthesized
gcttttgttgccattgcttt

SEQ ID NO: 610346 - DNA, 20 bp, Artificial Sequence
  chemically synthesized
tcagttctggcttttgttgc

SEQ ID NO: 610347 - DNA, 20 bp, Artificial Sequence
  chemically synthesized
acgagatcccatttgtcagt

SEQ ID NO: 610348 - DNA, 20 bp, Artificial Sequence
  chemically synthesized
aatgggatctcgttaaacta

SEQ ID NO: 610349 - DNA, 20 bp, Artificial Sequence
  chemically synthesized
cttttgttgtgcagaagctc

SEQ ID NO: 610350 - DNA, 20 bp, Artificial Sequence
  chemically synthesized
ggttgcctgttcactctgat

SEQ ID NO: 610351 - DNA, 20 bp, Artificial Sequence
  chemically synthesized
gtaaatttgtttgagttcat

SEQ ID NO: 610352 - DNA, 20 bp, Artificial Sequence
  chemically synthesized
ttgtttgttttttcttgtaa

SEQ ID NO: 610353 - DNA, 20 bp, Artificial Sequence
  chemically synthesized
gcccactttttgatggggtt

SEQ ID NO: 610354 - DNA, 20 bp, Artificial Sequence
  chemically synthesized
cttcgcccactttttgatgg

SEQ ID NO: 610355 - DNA, 20 bp, Artificial Sequence
  chemically synthesized
gagatggtatctcattgtgg

SEQ ID NO: 610356 - DNA, 20 bp, Artificial Sequence
  chemically synthesized
ggtgtgagatggtatctcat

SEQ ID NO: 610357 - DNA, 20 bp, Artificial Sequence
  chemically synthesized
tccacatcctctccagcacc

SEQ ID NO: 610358 - DNA, 20 bp, Artificial Sequence
  chemically synthesized
ctgacttccacaatggttga

SEQ ID NO: 610359 - DNA, 20 bp, Artificial Sequence
  chemically synthesized
taacgggatggctgggtcaa

SEQ ID NO: 610360 - DNA, 20 bp, Artificial Sequence
  chemically synthesized
gtgcatgtgtctttatagca

SEQ ID NO: 610361 - DNA, 20 bp, Artificial Sequence
  chemically synthesized
ctataaagacacatgcacac

SEQ ID NO: 610362 - DNA, 20 bp, Artificial Sequence
  chemically synthesized
caaatgtccaacaatgatag

SEQ ID NO: 610363 - DNA, 20 bp, Artificial Sequence
  chemically synthesized
ttgcgatagtttactgagaa

SEQ ID NO: 610364 - DNA, 20 bp, Artificial Sequence
  chemically synthesized
gtttggttttttgttcttgc

SEQ ID NO: 610365 - DNA, 20 bp, Artificial Sequence
  chemically synthesized
atgagtgagaatatgtggtg

SEQ ID NO: 610366 - DNA, 20 bp, Artificial Sequence
  chemically synthesized
cacctatgagtgagaatatg

SEQ ID NO: 610367 - DNA, 20 bp, Artificial Sequence
  chemically synthesized
gagggggtagggatagcact

SEQ ID NO: 610368 - DNA, 20 bp, Artificial Sequence
  chemically synthesized
cacaatgtgcacatgtaccc

SEQ ID NO: 610369 - DNA, 20 bp, Artificial Sequence
  chemically synthesized
ttttcttttattattatact

SEQ ID NO: 610370 - DNA, 20 bp, Artificial Sequence
  chemically synthesized
attttggtttgctgaaattt

SEQ ID NO: 610371 - DNA, 20 bp, Artificial Sequence
  chemically synthesized
ttaaaaatttcagcaaacca

SEQ ID NO: 610372 - DNA, 20 bp, Artificial Sequence
  chemically synthesized
atggttattttaacaaacat

SEQ ID NO: 610373 - DNA, 20 bp, Artificial Sequence
  chemically synthesized
atatcatgctcataaataga

SEQ ID NO: 610374 - DNA, 20 bp, Artificial Sequence
  chemically synthesized
taagttttaattaacaggaa

SEQ ID NO: 610375 - DNA, 20 bp, Artificial Sequence
  chemically synthesized
gttgctgttggtggtggtgg

SEQ ID NO: 610376 - DNA, 20 bp, Artificial Sequence
  chemically synthesized
tttcaagaaaaaaaaaatta

SEQ ID NO: 610377 - DNA, 20 bp, Artificial Sequence
  chemically synthesized
gcaccaggtggccatttggg

SEQ ID NO: 610378 - DNA, 20 bp, Artificial Sequence
  chemically synthesized
actcagcccaaatggccacc

SEQ ID NO: 610379 - DNA, 20 bp, Artificial Sequence
  chemically synthesized
tcaagacgtgaagtgtgaat

SEQ ID NO: 610380 - DNA, 20 bp, Artificial Sequence
  chemically synthesized
aatatcttttcttatttaca

SEQ ID NO: 610381 - DNA, 20 bp, Artificial Sequence
  chemically synthesized
actttgtgttcaaggtaaaa

SEQ ID NO: 610382 - DNA, 20 bp, Artificial Sequence
  chemically synthesized
tttaccttgaacacaaagta

SEQ ID NO: 610383 - DNA, 20 bp, Artificial Sequence
  chemically synthesized
tttagtgtgaggaaagaaag

SEQ ID NO: 610384 - DNA, 20 bp, Artificial Sequence
  chemically synthesized
aaaatagtcattttcataga

SEQ ID NO: 610385 - DNA, 20 bp, Artificial Sequence
  chemically synthesized
taggtcttataaaacttccc

SEQ ID NO: 610386 - DNA, 20 bp, Artificial Sequence
  chemically synthesized
cattgtagtaaaaacattgg

SEQ ID NO: 610387 - DNA, 20 bp, Artificial Sequence
  chemically synthesized
cacagccagtctgtcttgct

SEQ ID NO: 610388 - DNA, 20 bp, Artificial Sequence
  chemically synthesized
aaaactacatgctaatatag

SEQ ID NO: 610389 - DNA, 20 bp, Artificial Sequence
  chemically synthesized
aaaactaaactatattagca

SEQ ID NO: 610390 - DNA, 20 bp, Artificial Sequence
  chemically synthesized
aacccaaaactacatgctaa

SEQ ID NO: 610391 - DNA, 20 bp, Artificial Sequence
  chemically synthesized
ctaatgggaatgcagctgag

SEQ ID NO: 610392 - DNA, 20 bp, Artificial Sequence
  chemically synthesized
tccaagtttccaatgcatca

SEQ ID NO: 610393 - DNA, 20 bp, Artificial Sequence
  chemically synthesized
cagatacatgtttttaattt

SEQ ID NO: 610394 - DNA, 20 bp, Artificial Sequence
  chemically synthesized
attatctttctgccacagat

SEQ ID NO: 610395 - DNA, 20 bp, Artificial Sequence
  chemically synthesized
gcacacaccatttttctttt

SEQ ID NO: 610396 - DNA, 20 bp, Artificial Sequence
  chemically synthesized
cttattgcgtgttcagcatc

SEQ ID NO: 610397 - DNA, 20 bp, Artificial Sequence
  chemically synthesized
ttcacatattttgcaaaagt

SEQ ID NO: 610398 - DNA, 20 bp, Artificial Sequence
  chemically synthesized
aaaaataaatttgttggata

SEQ ID NO: 610399 - DNA, 20 bp, Artificial Sequence
  chemically synthesized
tttttatttttttgtcagtt

SEQ ID NO: 610400 - DNA, 20 bp, Artificial Sequence
  chemically synthesized
gacaaaaaaataaaaaagaa

SEQ ID NO: 610401 - DNA, 20 bp, Artificial Sequence
  chemically synthesized
taaaattcctgttatatcaa

SEQ ID NO: 610402 - DNA, 20 bp, Artificial Sequence
  chemically synthesized
aggaaaattaaagcattact

SEQ ID NO: 610403 - DNA, 20 bp, Artificial Sequence
  chemically synthesized
gccgtttttgaatctcctag

SEQ ID NO: 610404 - DNA, 20 bp, Artificial Sequence
  chemically synthesized
gcattactaggagattcaaa

SEQ ID NO: 610405 - DNA, 20 bp, Artificial Sequence
  chemically synthesized
atggtatcaactctatatga

SEQ ID NO: 610406 - DNA, 20 bp, Artificial Sequence
  chemically synthesized
cttcctgtatgtctataggc

SEQ ID NO: 610407 - DNA, 20 bp, Artificial Sequence
  chemically synthesized
ttacagcttcctgtatgtct

SEQ ID NO: 610408 - DNA, 20 bp, Artificial Sequence
  chemically synthesized
tctagtctcattaccttaat

SEQ ID NO: 610409 - DNA, 20 bp, Artificial Sequence
  chemically synthesized
tgggcaaaactgatgaataa

SEQ ID NO: 610410 - DNA, 20 bp, Artificial Sequence
  chemically synthesized
tggcttaatcaggtttattc

SEQ ID NO: 610411 - DNA, 20 bp, Artificial Sequence
  chemically synthesized
cctctgtgattttggcttaa

SEQ ID NO: 610412 - DNA, 20 bp, Artificial Sequence
  chemically synthesized
cactggtaaccctctgtgat

SEQ ID NO: 610413 - DNA, 20 bp, Artificial Sequence
  chemically synthesized
accaagtcactggtaaccct

SEQ ID NO: 610414 - DNA, 20 bp, Artificial Sequence
  chemically synthesized
gggttaccagtgacttggtt

SEQ ID NO: 610415 - DNA, 20 bp, Artificial Sequence
  chemically synthesized
gcgtaggcacaggaataaaa

SEQ ID NO: 610416 - DNA, 20 bp, Artificial Sequence
  chemically synthesized
ggcacaggaataaaactgag

SEQ ID NO: 610417 - DNA, 20 bp, Artificial Sequence
  chemically synthesized
gtccatcatccaaaaccaaa

SEQ ID NO: 610418 - DNA, 20 bp, Artificial Sequence
  chemically synthesized
actttacctaaggtgggtct

SEQ ID NO: 610419 - DNA, 20 bp, Artificial Sequence
  chemically synthesized
tttttttctttataagggag

SEQ ID NO: 610420 - DNA, 20 bp, Artificial Sequence
  chemically synthesized
atgttattttgggatgtctg

SEQ ID NO: 610421 - DNA, 20 bp, Artificial Sequence
  chemically synthesized
cccaaaataacattaagaca

SEQ ID NO: 610422 - DNA, 20 bp, Artificial Sequence
  chemically synthesized
cactgggcttcgacatcagt

SEQ ID NO: 610423 - DNA, 20 bp, Artificial Sequence
  chemically synthesized
ataactaataggaagtagag

SEQ ID NO: 610424 - DNA, 20 bp, Artificial Sequence
  chemically synthesized
tacagataactaataggaag

SEQ ID NO: 610425 - DNA, 20 bp, Artificial Sequence
  chemically synthesized
gtaaattcctttctctcctc

SEQ ID NO: 610426 - DNA, 20 bp, Artificial Sequence
  chemically synthesized
attcctttctctcctcaaca

SEQ ID NO: 610427 - DNA, 20 bp, Artificial Sequence
  chemically synthesized
agcccttaataaagcaattg

SEQ ID NO: 610428 - DNA, 20 bp, Artificial Sequence
  chemically synthesized
gtttcttatttaagccttac

SEQ ID NO: 610429 - DNA, 20 bp, Artificial Sequence
  chemically synthesized
tatgtgccagctactttacc

SEQ ID NO: 610430 - DNA, 20 bp, Artificial Sequence
  chemically synthesized
gaaaatagctaatatttaat

SEQ ID NO: 610431 - DNA, 20 bp, Artificial Sequence
  chemically synthesized
tagctattttcacaaactga

SEQ ID NO: 610432 - DNA, 20 bp, Artificial Sequence
  chemically synthesized
agtccaagaaaagaaacctg

SEQ ID NO: 610433 - DNA, 20 bp, Artificial Sequence
  chemically synthesized
tgacacagcagaactagtaa

SEQ ID NO: 610434 - DNA, 20 bp, Artificial Sequence
  chemically synthesized
gtagaagaagttttcagtct

SEQ ID NO: 610435 - DNA, 20 bp, Artificial Sequence
  chemically synthesized
gtgacaagtgaacatgtaga

SEQ ID NO: 610436 - DNA, 20 bp, Artificial Sequence
  chemically synthesized
attcatttctatgaatttgg

SEQ ID NO: 610437 - DNA, 20 bp, Artificial Sequence
  chemically synthesized
aatttcacacctctcctttt

SEQ ID NO: 610438 - DNA, 20 bp, Artificial Sequence
  chemically synthesized
taattagtgactgttgagaa

SEQ ID NO: 610439 - DNA, 20 bp, Artificial Sequence
  chemically synthesized
atagaataaatgaggcagaa

SEQ ID NO: 610440 - DNA, 20 bp, Artificial Sequence
  chemically synthesized
tgaggcagaagacagctttt

SEQ ID NO: 610441 - DNA, 20 bp, Artificial Sequence
  chemically synthesized
aggcatagagaataacttca

SEQ ID NO: 610442 - DNA, 20 bp, Artificial Sequence
  chemically synthesized
aacatttagtgcaggacttg

SEQ ID NO: 610443 - DNA, 20 bp, Artificial Sequence
  chemically synthesized
aacttgccaagtcctgcact

SEQ ID NO: 610444 - DNA, 20 bp, Artificial Sequence
  chemically synthesized
ttacaagaattaaatgaatt

SEQ ID NO: 610445 - DNA, 20 bp, Artificial Sequence
  chemically synthesized
agggatcttaagaaatttgc

SEQ ID NO: 610446 - DNA, 20 bp, Artificial Sequence
  chemically synthesized
cacagctaaaaagtggcaag

SEQ ID NO: 610447 - DNA, 20 bp, Artificial Sequence
  chemically synthesized
gctgtcctccctactgttca

SEQ ID NO: 610448 - DNA, 20 bp, Artificial Sequence
  chemically synthesized
catggcttctgagacaagag

SEQ ID NO: 610449 - DNA, 20 bp, Artificial Sequence
  chemically synthesized
taaaacacttaattttttat

SEQ ID NO: 610450 - DNA, 20 bp, Artificial Sequence
  chemically synthesized
aaaatcaggaataaaaaatt

SEQ ID NO: 610451 - DNA, 20 bp, Artificial Sequence
  chemically synthesized
ttttgggtaaatttctatga

SEQ ID NO: 610452 - DNA, 20 bp, Artificial Sequence
  chemically synthesized
gtgtttttctcagtttcatg

SEQ ID NO: 610453 - DNA, 20 bp, Artificial Sequence
  chemically synthesized
aatcttacacttgtgttttt

SEQ ID NO: 610454 - DNA, 20 bp, Artificial Sequence
  chemically synthesized
aaactgagaaaaacacaagt

SEQ ID NO: 610455 - DNA, 20 bp, Artificial Sequence
  chemically synthesized
gtattatggtaatcttacac

SEQ ID NO: 610456 - DNA, 20 bp, Artificial Sequence
  chemically synthesized
tacacctttccaaagtgatc

SEQ ID NO: 610457 - DNA, 20 bp, Artificial Sequence
  chemically synthesized
ataggcaatacttctagtta

SEQ ID NO: 610458 - DNA, 20 bp, Artificial Sequence
  chemically synthesized
tctagttagaatgatttgga

SEQ ID NO: 610459 - DNA, 20 bp, Artificial Sequence
  chemically synthesized
attattaacagaccagtggt

SEQ ID NO: 610460 - DNA, 20 bp, Artificial Sequence
  chemically synthesized
acatttcaaccacatacttc

SEQ ID NO: 610461 - DNA, 20 bp, Artificial Sequence
  chemically synthesized
agtcgaaagtaccactgttg

SEQ ID NO: 610462 - DNA, 20 bp, Artificial Sequence
  chemically synthesized
ccattgtggaatcttaagag

SEQ ID NO: 610463 - DNA, 20 bp, Artificial Sequence
  chemically synthesized
aaagtataaaagctcttctc

SEQ ID NO: 610464 - DNA, 20 bp, Artificial Sequence
  chemically synthesized
tctcacaaattcccagttgc

SEQ ID NO: 610465 - DNA, 20 bp, Artificial Sequence
  chemically synthesized
ggagtgttgggatccacccc

SEQ ID NO: 610466 - DNA, 20 bp, Artificial Sequence
  chemically synthesized
agggggtggatcccaacact

SEQ ID NO: 610467 - DNA, 20 bp, Artificial Sequence
  chemically synthesized
aacatgcatcagaataacct

SEQ ID NO: 610468 - DNA, 20 bp, Artificial Sequence
  chemically synthesized
taggttattctgatgcatgt

SEQ ID NO: 610469 - DNA, 20 bp, Artificial Sequence
  chemically synthesized
gcatgttcaagtttgagaac

SEQ ID NO: 610470 - DNA, 20 bp, Artificial Sequence
  chemically synthesized
gatgtgcgccatttccaagc

SEQ ID NO: 610471 - DNA, 20 bp, Artificial Sequence
  chemically synthesized
cacacgataacccgtaaagc

SEQ ID NO: 610472 - DNA, 20 bp, Artificial Sequence
  chemically synthesized
tgaaagcacacgataacccg

SEQ ID NO: 610473 - DNA, 20 bp, Artificial Sequence
  chemically synthesized
cagaagctttacgggttatc

SEQ ID NO: 610474 - DNA, 20 bp, Artificial Sequence
  chemically synthesized
cacatgttctcttgcgttct

SEQ ID NO: 610475 - DNA, 20 bp, Artificial Sequence
  chemically synthesized
cctaccaatctatagtgaca

SEQ ID NO: 610476 - DNA, 20 bp, Artificial Sequence
  chemically synthesized
cccgccaaacttcatgtcac

SEQ ID NO: 610477 - DNA, 20 bp, Artificial Sequence
  chemically synthesized
tagatgcataatgtagtgta

SEQ ID NO: 610478 - DNA, 20 bp, Artificial Sequence
  chemically synthesized
gtaaagagaacatgtgtatc

SEQ ID NO: 610479 - DNA, 20 bp, Artificial Sequence
  chemically synthesized
ctgaggtttaatagtgattc

SEQ ID NO: 610480 - DNA, 20 bp, Artificial Sequence
  chemically synthesized
tccttttttctgaggtttaa

SEQ ID NO: 610481 - DNA, 20 bp, Artificial Sequence
  chemically synthesized
caatatatgatccttttttc

SEQ ID NO: 610482 - DNA, 20 bp, Artificial Sequence
  chemically synthesized
atttctattttatgattata

SEQ ID NO: 610483 - DNA, 20 bp, Artificial Sequence
  chemically synthesized
ttataatattcatttctatt

SEQ ID NO: 610484 - DNA, 20 bp, Artificial Sequence
  chemically synthesized
aaatgaatattataaaagca

SEQ ID NO: 610485 - DNA, 20 bp, Artificial Sequence
  chemically synthesized
ccaattttgtgtcataaact

SEQ ID NO: 610486 - DNA, 20 bp, Artificial Sequence
  chemically synthesized
gagtttatgccctccaaaag

SEQ ID NO: 610487 - DNA, 20 bp, Artificial Sequence
  chemically synthesized
tctaattaagaaagtcttcc

SEQ ID NO: 610488 - DNA, 20 bp, Artificial Sequence
  chemically synthesized
atctgtatccatgtgtagga

SEQ ID NO: 610489 - DNA, 20 bp, Artificial Sequence
  chemically synthesized
aaggttggcattgaattctc

SEQ ID NO: 610490 - DNA, 20 bp, Artificial Sequence
  chemically synthesized
caagtgtttacataacatgc

SEQ ID NO: 610491 - DNA, 20 bp, Artificial Sequence
  chemically synthesized
acagtaagtaaatatatact

SEQ ID NO: 610492 - DNA, 20 bp, Artificial Sequence
  chemically synthesized
aagttttagagtcataaata

SEQ ID NO: 610493 - DNA, 20 bp, Artificial Sequence
  chemically synthesized
catgctataatgaaaagaac

SEQ ID NO: 610494 - DNA, 20 bp, Artificial Sequence
  chemically synthesized
cattatagcatgctgttgta

SEQ ID NO: 610495 - DNA, 20 bp, Artificial Sequence
  chemically synthesized
agatataggaaggtgtgtgt

SEQ ID NO: 610496 - DNA, 20 bp, Artificial Sequence
  chemically synthesized
ataggaaggtgtgtgtgtac

SEQ ID NO: 610497 - DNA, 20 bp, Artificial Sequence
  chemically synthesized
aaaggttaccaaatatacta

SEQ ID NO: 610498 - DNA, 20 bp, Artificial Sequence
  chemically synthesized
gtatgtgccgagaaggaggc

SEQ ID NO: 610499 - DNA, 20 bp, Artificial Sequence
  chemically synthesized
tcttgcgttattatgattat

SEQ ID NO: 610500 - DNA, 20 bp, Artificial Sequence
  chemically synthesized
atcagatttttcttgcgtta

SEQ ID NO: 610501 - DNA, 20 bp, Artificial Sequence
  chemically synthesized
gtgattagctatgtccagtc

SEQ ID NO: 610502 - DNA, 20 bp, Artificial Sequence
  chemically synthesized
tacatttagtggcaatatcc

SEQ ID NO: 610503 - DNA, 20 bp, Artificial Sequence
  chemically synthesized
agagtcatgattctttatca

SEQ ID NO: 610504 - DNA, 20 bp, Artificial Sequence
  chemically synthesized
gctgttgccctctcaaagag

SEQ ID NO: 610505 - DNA, 20 bp, Artificial Sequence
  chemically synthesized
agcgctgacatttctaggtc

SEQ ID NO: 610506 - DNA, 20 bp, Artificial Sequence
  chemically synthesized
tttctaggtcaaaagttttc

SEQ ID NO: 610507 - DNA, 20 bp, Artificial Sequence
  chemically synthesized
aacatctggaggctaattgt

SEQ ID NO: 610508 - DNA, 20 bp, Artificial Sequence
  chemically synthesized
cctaactgacagtgagtgac

SEQ ID NO: 610509 - DNA, 20 bp, Artificial Sequence
  chemically synthesized
cctttgtcactcactgtcag

SEQ ID NO: 610510 - DNA, 20 bp, Artificial Sequence
  chemically synthesized
agttaggattcgaaacatac

SEQ ID NO: 610511 - DNA, 20 bp, Artificial Sequence
  chemically synthesized
aaagggggagaaaagcttta

SEQ ID NO: 610512 - DNA, 20 bp, Artificial Sequence
  chemically synthesized
ttgtgtttaaaaagggggag

SEQ ID NO: 610513 - DNA, 20 bp, Artificial Sequence
  chemically synthesized
gctcctaaagttttaggatt

SEQ ID NO: 610514 - DNA, 20 bp, Artificial Sequence
  chemically synthesized
caagtctggctcctaaagtt

SEQ ID NO: 610515 - DNA, 20 bp, Artificial Sequence
  chemically synthesized
tatgtgccaagtctggctcc

SEQ ID NO: 610516 - DNA, 20 bp, Artificial Sequence
  chemically synthesized
atcaacaaccttatctgtct

SEQ ID NO: 610517 - DNA, 20 bp, Artificial Sequence
  chemically synthesized
tatcttaaggcagctattaa

SEQ ID NO: 610518 - DNA, 20 bp, Artificial Sequence
  chemically synthesized
aattaatagctgccttaaga

SEQ ID NO: 610519 - DNA, 20 bp, Artificial Sequence
  chemically synthesized
ggtatcatatgcaaattctt

SEQ ID NO: 610520 - DNA, 20 bp, Artificial Sequence
  chemically synthesized
caaatgtgcatgagagggtc

SEQ ID NO: 610521 - DNA, 20 bp, Artificial Sequence
  chemically synthesized
ataccaattagagatatgac

SEQ ID NO: 610522 - DNA, 20 bp, Artificial Sequence
  chemically synthesized
tctgtttaaagtatacaact

SEQ ID NO: 610523 - DNA, 20 bp, Artificial Sequence
  chemically synthesized
ttgagttgtatactttaaac

SEQ ID NO: 610524 - DNA, 20 bp, Artificial Sequence
  chemically synthesized
aatttatatgccatacaatc

SEQ ID NO: 610525 - DNA, 20 bp, Artificial Sequence
  chemically synthesized
gctagtcatgtttaaaatgg

SEQ ID NO: 610526 - DNA, 20 bp, Artificial Sequence
  chemically synthesized
tttaaaaggttctaggctag

SEQ ID NO: 610527 - DNA, 20 bp, Artificial Sequence
  chemically synthesized
gcggcttcaacttttgccta

SEQ ID NO: 610528 - DNA, 20 bp, Artificial Sequence
  chemically synthesized
acttgttaggcaaaagttga

SEQ ID NO: 610529 - DNA, 20 bp, Artificial Sequence
  chemically synthesized
aggcaaaagttgaagccgct

SEQ ID NO: 610530 - DNA, 20 bp, Artificial Sequence
  chemically synthesized
taatagtaacataaacatca

SEQ ID NO: 610531 - DNA, 20 bp, Artificial Sequence
  chemically synthesized
cgcttgatgtttatgttact

SEQ ID NO: 610532 - DNA, 20 bp, Artificial Sequence
  chemically synthesized
attgaaagtaatggcaaaaa

SEQ ID NO: 610533 - DNA, 20 bp, Artificial Sequence
  chemically synthesized
taagttggtgcaaaagtaat

SEQ ID NO: 610534 - DNA, 20 bp, Artificial Sequence
  chemically synthesized
ggcactgaacaggtcattag

SEQ ID NO: 610535 - DNA, 20 bp, Artificial Sequence
  chemically synthesized
ctgatattgtcactgcatct

SEQ ID NO: 610536 - DNA, 20 bp, Artificial Sequence
  chemically synthesized
taaaaataaaagacatatta

SEQ ID NO: 610537 - DNA, 20 bp, Artificial Sequence
  chemically synthesized
atttttaggaggaaagaatg

SEQ ID NO: 610538 - DNA, 20 bp, Artificial Sequence
  chemically synthesized
attccgttctaaaataaagc

SEQ ID NO: 610539 - DNA, 20 bp, Artificial Sequence
  chemically synthesized
gaagaatatttaataaaaac

SEQ ID NO: 610540 - DNA, 20 bp, Artificial Sequence
  chemically synthesized
taaaatacatcagagaagcc

SEQ ID NO: 610541 - DNA, 20 bp, Artificial Sequence
  chemically synthesized
tccttgttctcatggaatcc

SEQ ID NO: 610542 - DNA, 20 bp, Artificial Sequence
  chemically synthesized
tctgtggcacatgattactt

SEQ ID NO: 610543 - DNA, 20 bp, Artificial Sequence
  chemically synthesized
cagctgagtctatctgtggc

SEQ ID NO: 610544 - DNA, 20 bp, Artificial Sequence
  chemically synthesized
gaagaccgggagttaatagt

SEQ ID NO: 610545 - DNA, 20 bp, Artificial Sequence
  chemically synthesized
ttcatgcttcggccttgccc

SEQ ID NO: 610546 - DNA, 20 bp, Artificial Sequence
  chemically synthesized
gtgtatcccttctgaatatt

SEQ ID NO: 610547 - DNA, 20 bp, Artificial Sequence
  chemically synthesized
ttgtgattgtccagatgagc

SEQ ID NO: 610548 - DNA, 20 bp, Artificial Sequence
  chemically synthesized
aaacccttgtgattgtccag

SEQ ID NO: 610549 - DNA, 20 bp, Artificial Sequence
  chemically synthesized
aagctcatctggacaatcac

SEQ ID NO: 610550 - DNA, 20 bp, Artificial Sequence
  chemically synthesized
atttactctcctctaaaccc

SEQ ID NO: 610551 - DNA, 20 bp, Artificial Sequence
  chemically synthesized
tctcattgcttaggtctcat

SEQ ID NO: 610552 - DNA, 20 bp, Artificial Sequence
  chemically synthesized
taatttacttcccattttct

SEQ ID NO: 610553 - DNA, 20 bp, Artificial Sequence
  chemically synthesized
aaaaggctggggccaagaat

SEQ ID NO: 610554 - DNA, 20 bp, Artificial Sequence
  chemically synthesized
ggccaagaatcaaggctttg

SEQ ID NO: 610555 - DNA, 20 bp, Artificial Sequence
  chemically synthesized
atatgggaagcaggccaaag

SEQ ID NO: 610556 - DNA, 20 bp, Artificial Sequence
  chemically synthesized
aagagaacatgaaaatttcg

SEQ ID NO: 610557 - DNA, 20 bp, Artificial Sequence
  chemically synthesized
tctacatcgtaggattgcag

SEQ ID NO: 610558 - DNA, 20 bp, Artificial Sequence
  chemically synthesized
atcataatagtatctacatc

SEQ ID NO: 610559 - DNA, 20 bp, Artificial Sequence
  chemically synthesized
cttacttatcctctcttggc

SEQ ID NO: 610560 - DNA, 20 bp, Artificial Sequence
  chemically synthesized
actgctagtaaatggcaaaa

SEQ ID NO: 610561 - DNA, 20 bp, Artificial Sequence
  chemically synthesized
tatcatcagcaccagcctaa

SEQ ID NO: 610562 - DNA, 20 bp, Artificial Sequence
  chemically synthesized
attgagcgccagttgtccac

SEQ ID NO: 610563 - DNA, 20 bp, Artificial Sequence
  chemically synthesized
gtcaatgaagactacatttc

SEQ ID NO: 610564 - DNA, 20 bp, Artificial Sequence
  chemically synthesized
ttttcagaatacttccccct

SEQ ID NO: 610565 - DNA, 20 bp, Artificial Sequence
  chemically synthesized
agtttaaatttaccctgtct

SEQ ID NO: 610566 - DNA, 20 bp, Artificial Sequence
  chemically synthesized
actaataatgataataaaat

SEQ ID NO: 610567 - DNA, 20 bp, Artificial Sequence
  chemically synthesized
acaaataagggtcctttctt

SEQ ID NO: 610568 - DNA, 20 bp, Artificial Sequence
  chemically synthesized
cttatttgtactctttctgg

SEQ ID NO: 610569 - DNA, 20 bp, Artificial Sequence
  chemically synthesized
gttggcactgaacccatagt

SEQ ID NO: 610570 - DNA, 20 bp, Artificial Sequence
  chemically synthesized
aagtgaccgtggaaggaaag

SEQ ID NO: 610571 - DNA, 20 bp, Artificial Sequence
  chemically synthesized
acattccacagagttaaaaa

SEQ ID NO: 610572 - DNA, 20 bp, Artificial Sequence
  chemically synthesized
gctctcagtagaacattaaa

SEQ ID NO: 610573 - DNA, 20 bp, Artificial Sequence
  chemically synthesized
cttatcttgggggaaccaca

SEQ ID NO: 610574 - DNA, 20 bp, Artificial Sequence
  chemically synthesized
gtataagtaatgggtgctat

SEQ ID NO: 610575 - DNA, 20 bp, Artificial Sequence
  chemically synthesized
tttttcaatgaaaatagaca

SEQ ID NO: 610576 - DNA, 20 bp, Artificial Sequence
  chemically synthesized
acaccctgccctgtgcctag

SEQ ID NO: 610577 - DNA, 20 bp, Artificial Sequence
  chemically synthesized
gctaggcacagggcagggtg

SEQ ID NO: 610578 - DNA, 20 bp, Artificial Sequence
  chemically synthesized
ctgtcctcataaacacacaa

SEQ ID NO: 610579 - DNA, 20 bp, Artificial Sequence
  chemically synthesized
gtgttccttaaatccatttt

SEQ ID NO: 610580 - DNA, 20 bp, Artificial Sequence
  chemically synthesized
gtgcttactagctggtgaga

SEQ ID NO: 610581 - DNA, 20 bp, Artificial Sequence
  chemically synthesized
caccagctagtaagcacact

SEQ ID NO: 610582 - DNA, 20 bp, Artificial Sequence
  chemically synthesized
gggtaactgaaaagccctga

SEQ ID NO: 610583 - DNA, 20 bp, Artificial Sequence
  chemically synthesized
ggttgcagaaatgattcaga

SEQ ID NO: 610584 - DNA, 20 bp, Artificial Sequence
  chemically synthesized
ttcctagaagatggttgcag

SEQ ID NO: 610585 - DNA, 20 bp, Artificial Sequence
  chemically synthesized
tttattagatttggcaaatt

SEQ ID NO: 610586 - DNA, 20 bp, Artificial Sequence
  chemically synthesized
gatgtgggttaaaatagttt

SEQ ID NO: 610587 - DNA, 20 bp, Artificial Sequence
  chemically synthesized
ttaagtaagatgtgggttaa

SEQ ID NO: 610588 - DNA, 20 bp, Artificial Sequence
  chemically synthesized
attttaacccacatcttact

SEQ ID NO: 610589 - DNA, 20 bp, Artificial Sequence
  chemically synthesized
tctcataaggcatattctct

SEQ ID NO: 610590 - DNA, 20 bp, Artificial Sequence
  chemically synthesized
gtttcaactgttaaatatgc

SEQ ID NO: 610591 - DNA, 20 bp, Artificial Sequence
  chemically synthesized
gaggtttgagcagataggtg

SEQ ID NO: 610592 - DNA, 20 bp, Artificial Sequence
  chemically synthesized
atgaatctgaaccttaaaaa

SEQ ID NO: 610593 - DNA, 20 bp, Artificial Sequence
  chemically synthesized
ctcaaacctcctttttaagg

SEQ ID NO: 610594 - DNA, 20 bp, Artificial Sequence
  chemically synthesized
tttttcttaggtctaattta

SEQ ID NO: 610595 - DNA, 20 bp, Artificial Sequence
  chemically synthesized
tggagggagggagtaaagaa

SEQ ID NO: 610596 - DNA, 20 bp, Artificial Sequence
  chemically synthesized
cagaagtccagtttaaataa

SEQ ID NO: 610597 - DNA, 20 bp, Artificial Sequence
  chemically synthesized
cttacacaagtgaacagaag

SEQ ID NO: 610598 - DNA, 20 bp, Artificial Sequence
  chemically synthesized
aagaggattgattgggatgg

SEQ ID NO: 610599 - DNA, 20 bp, Artificial Sequence
  chemically synthesized
catcccaatcaatcctcttc

SEQ ID NO: 610600 - DNA, 20 bp, Artificial Sequence
  chemically synthesized
ttgacaaagcagatgaagag

SEQ ID NO: 610601 - DNA, 20 bp, Artificial Sequence
  chemically synthesized
agtattgacaaagcagatga

SEQ ID NO: 610602 - DNA, 20 bp, Artificial Sequence
  chemically synthesized
ctggtaatagtccagatgaa

SEQ ID NO: 610603 - DNA, 20 bp, Artificial Sequence
  chemically synthesized
atacaatttttctcaaatac

SEQ ID NO: 610604 - DNA, 20 bp, Artificial Sequence
  chemically synthesized
tcaaatacgtatgattttag

SEQ ID NO: 610605 - DNA, 20 bp, Artificial Sequence
  chemically synthesized
cttaaaggactgtattctac

SEQ ID NO: 610606 - DNA, 20 bp, Artificial Sequence
  chemically synthesized
gtagacacaatcttacactt

SEQ ID NO: 610607 - DNA, 20 bp, Artificial Sequence
  chemically synthesized
gctgcgtgaaacagtgaagt

SEQ ID NO: 610608 - DNA, 20 bp, Artificial Sequence
  chemically synthesized
tacacaacaactgtaaggat

SEQ ID NO: 610609 - DNA, 20 bp, Artificial Sequence
  chemically synthesized
gtaaggatgtgagtttgaga

SEQ ID NO: 610610 - DNA, 20 bp, Artificial Sequence
  chemically synthesized
agactaacaaccactccttg

SEQ ID NO: 610611 - DNA, 20 bp, Artificial Sequence
  chemically synthesized
taacaaccactccttgctaa

SEQ ID NO: 610612 - DNA, 20 bp, Artificial Sequence
  chemically synthesized
ggacttaagggggtgatctc

SEQ ID NO: 610613 - DNA, 20 bp, Artificial Sequence
  chemically synthesized
acatttcctctttctctttc

SEQ ID NO: 610614 - DNA, 20 bp, Artificial Sequence
  chemically synthesized
gccagagaaagagaaagagg

SEQ ID NO: 610615 - DNA, 20 bp, Artificial Sequence
  chemically synthesized
cccatgaatgagtaacatta

SEQ ID NO: 610616 - DNA, 20 bp, Artificial Sequence
  chemically synthesized
tagagcatttgtatgggggt

SEQ ID NO: 610617 - DNA, 20 bp, Artificial Sequence
  chemically synthesized
tgctgattgatcatcatgac

SEQ ID NO: 610618 - DNA, 20 bp, Artificial Sequence
  chemically synthesized
atatatgtttcaacttaaaa

SEQ ID NO: 610619 - DNA, 20 bp, Artificial Sequence
  chemically synthesized
ttaagttgaaacatatatat

SEQ ID NO: 610620 - DNA, 20 bp, Artificial Sequence
  chemically synthesized
aagatcagaaacttggatat

SEQ ID NO: 610621 - DNA, 20 bp, Artificial Sequence
  chemically synthesized
caggaaatccctatagcctc

SEQ ID NO: 610622 - DNA, 20 bp, Artificial Sequence
  chemically synthesized
gatggaagctaaggaggcta

SEQ ID NO: 610623 - DNA, 20 bp, Artificial Sequence
  chemically synthesized
ctttgcctgaaaatatgctt

SEQ ID NO: 610624 - DNA, 20 bp, Artificial Sequence
  chemically synthesized
atttttacctttgcctgaaa

SEQ ID NO: 610625 - DNA, 20 bp, Artificial Sequence
  chemically synthesized
gtaaaaataattgtaggaat

SEQ ID NO: 610626 - DNA, 20 bp, Artificial Sequence
  chemically synthesized
gagacactgtaatgagttca

SEQ ID NO: 610627 - DNA, 20 bp, Artificial Sequence
  chemically synthesized
tgtaatgagttcaaagtgtt

SEQ ID NO: 610628 - DNA, 20 bp, Artificial Sequence
  chemically synthesized
caaagtgtttacagcttcaa

SEQ ID NO: 610629 - DNA, 20 bp, Artificial Sequence
  chemically synthesized
aagaattcattgcattgaag

SEQ ID NO: 610630 - DNA, 20 bp, Artificial Sequence
  chemically synthesized
ttcttggctacaagccacaa

SEQ ID NO: 610631 - DNA, 20 bp, Artificial Sequence
  chemically synthesized
tttatttctcaaagcacatt

SEQ ID NO: 610632 - DNA, 20 bp, Artificial Sequence
  chemically synthesized
atagaaacaccagtatattc

SEQ ID NO: 610633 - DNA, 20 bp, Artificial Sequence
  chemically synthesized
taaaaagcgagtgaatatac

SEQ ID NO: 610634 - DNA, 20 bp, Artificial Sequence
  chemically synthesized
attattggtccagctgagat

SEQ ID NO: 610635 - DNA, 20 bp, Artificial Sequence
  chemically synthesized
gttgcttttttattcttaat

SEQ ID NO: 610636 - DNA, 20 bp, Artificial Sequence
  chemically synthesized
aggtagtcataatttcaaaa

SEQ ID NO: 610637 - DNA, 20 bp, Artificial Sequence
  chemically synthesized
ccatgattcattactataag

SEQ ID NO: 610638 - DNA, 20 bp, Artificial Sequence
  chemically synthesized
ctgaattactttgtaaataa

SEQ ID NO: 610639 - DNA, 20 bp, Artificial Sequence
  chemically synthesized
catggttatttacaaagtaa

SEQ ID NO: 610640 - DNA, 20 bp, Artificial Sequence
  chemically synthesized
gtaattcagtttcactatga

SEQ ID NO: 610641 - DNA, 20 bp, Artificial Sequence
  chemically synthesized
tatagtcgaagacttttcag

SEQ ID NO: 610642 - DNA, 20 bp, Artificial Sequence
  chemically synthesized
gaagacttttcagggatgtt

SEQ ID NO: 610643 - DNA, 20 bp, Artificial Sequence
  chemically synthesized
aatacagaattttgcagctt

SEQ ID NO: 610644 - DNA, 20 bp, Artificial Sequence
  chemically synthesized
ttaaggaaaatacagaattt

SEQ ID NO: 610645 - DNA, 20 bp, Artificial Sequence
  chemically synthesized
ttctgtattttccttaataa

SEQ ID NO: 610646 - DNA, 20 bp, Artificial Sequence
  chemically synthesized
caggaaaaagacagcgaaca

SEQ ID NO: 610647 - DNA, 20 bp, Artificial Sequence
  chemically synthesized
tctagaagtttgtgtttcct

SEQ ID NO: 610648 - DNA, 20 bp, Artificial Sequence
  chemically synthesized
aatttaaaagttctagaagt

SEQ ID NO: 610649 - DNA, 20 bp, Artificial Sequence
  chemically synthesized
tttaacaatttaaaagttct

SEQ ID NO: 610650 - DNA, 20 bp, Artificial Sequence
  chemically synthesized
aatggtagttacttccacaa

SEQ ID NO: 610651 - DNA, 20 bp, Artificial Sequence
  chemically synthesized
caacttgttggaatatgatt

SEQ ID NO: 610652 - DNA, 20 bp, Artificial Sequence
  chemically synthesized
tatttttacaacttgttgga

SEQ ID NO: 610653 - DNA, 20 bp, Artificial Sequence
  chemically synthesized
agactttcaattctaagaat

SEQ ID NO: 610654 - DNA, 20 bp, Artificial Sequence
  chemically synthesized
aaaatgttactggcatattc

SEQ ID NO: 610655 - DNA, 20 bp, Artificial Sequence
  chemically synthesized
ctggcatattcccatgttta

SEQ ID NO: 610656 - DNA, 20 bp, Artificial Sequence
  chemically synthesized
caaagacgttctatctggag

SEQ ID NO: 610657 - DNA, 20 bp, Artificial Sequence
  chemically synthesized
tatgtctatgattcttgtat

SEQ ID NO: 610658 - DNA, 20 bp, Artificial Sequence
  chemically synthesized
atggatcccttgaagtatgt

SEQ ID NO: 610659 - DNA, 20 bp, Artificial Sequence
  chemically synthesized
aaagtatatggaaactatgt

SEQ ID NO: 610660 - DNA, 20 bp, Artificial Sequence
  chemically synthesized
tgaaaaataaaaaacgtgaa

SEQ ID NO: 610661 - DNA, 20 bp, Artificial Sequence
  chemically synthesized
tgtgagattctgctggatgg

SEQ ID NO: 610662 - DNA, 20 bp, Artificial Sequence
  chemically synthesized
ttttaaaattaaggatctgt

SEQ ID NO: 610663 - DNA, 20 bp, Artificial Sequence
  chemically synthesized
aaccatagcctgccctagac

SEQ ID NO: 610664 - DNA, 20 bp, Artificial Sequence
  chemically synthesized
agggagtgagacccagaaat

SEQ ID NO: 610665 - DNA, 20 bp, Artificial Sequence
  chemically synthesized
attaaacattaaaaagaaaa

SEQ ID NO: 610666 - DNA, 20 bp, Artificial Sequence
  chemically synthesized
agaaatctgtgttttctttt

SEQ ID NO: 610667 - DNA, 20 bp, Artificial Sequence
  chemically synthesized
cctaaatatgcataattatg

SEQ ID NO: 610668 - DNA, 20 bp, Artificial Sequence
  chemically synthesized
tggatatgataattagcctg

SEQ ID NO: 610669 - DNA, 20 bp, Artificial Sequence
  chemically synthesized
ggtaatggatatgataatta

SEQ ID NO: 610670 - DNA, 20 bp, Artificial Sequence
  chemically synthesized
tttgtcatttctttgtgttg

SEQ ID NO: 610671 - DNA, 20 bp, Artificial Sequence
  chemically synthesized
catgtttaaatagctagaag

SEQ ID NO: 610672 - DNA, 20 bp, Artificial Sequence
  chemically synthesized
agttaacagtaatttattgt

SEQ ID NO: 610673 - DNA, 20 bp, Artificial Sequence
  chemically synthesized
tgttaactgaagttacctta

SEQ ID NO: 610674 - DNA, 20 bp, Artificial Sequence
  chemically synthesized
actagtacatatccgtccta

SEQ ID NO: 610675 - DNA, 20 bp, Artificial Sequence
  chemically synthesized
ttatcattttgtatctgtta

SEQ ID NO: 610676 - DNA, 20 bp, Artificial Sequence
  chemically synthesized
ctctcctccctcttaccctc

SEQ ID NO: 610677 - DNA, 20 bp, Artificial Sequence
  chemically synthesized
ctgctaaccactattctact

SEQ ID NO: 610678 - DNA, 20 bp, Artificial Sequence
  chemically synthesized
tcatatgttagagctaaaaa

SEQ ID NO: 610679 - DNA, 20 bp, Artificial Sequence
  chemically synthesized
gttttcatatgttagagcta

SEQ ID NO: 610680 - DNA, 20 bp, Artificial Sequence
  chemically synthesized
ggcacgaagagataaatatc

SEQ ID NO: 610681 - DNA, 20 bp, Artificial Sequence
  chemically synthesized
catccatgttaccaccaatt

SEQ ID NO: 610682 - DNA, 20 bp, Artificial Sequence
  chemically synthesized
tatggctgaataatattcca

SEQ ID NO: 610683 - DNA, 20 bp, Artificial Sequence
  chemically synthesized
tatctgttaatggacactta

SEQ ID NO: 610684 - DNA, 20 bp, Artificial Sequence
  chemically synthesized
gttgattccgtatctcaaca

SEQ ID NO: 610685 - DNA, 20 bp, Artificial Sequence
  chemically synthesized
ttttctggaggccttgttaa

SEQ ID NO: 610686 - DNA, 20 bp, Artificial Sequence
  chemically synthesized
cagaaaattctgatgtgcac

SEQ ID NO: 610687 - DNA, 20 bp, Artificial Sequence
  chemically synthesized
aatttgcgcaacaattttca

SEQ ID NO: 610688 - DNA, 20 bp, Artificial Sequence
  chemically synthesized
ttttacaatgtctcctcaaa

SEQ ID NO: 610689 - DNA, 20 bp, Artificial Sequence
  chemically synthesized
ctcctcaaattttgattcag

SEQ ID NO: 610690 - DNA, 20 bp, Artificial Sequence
  chemically synthesized
ttaatcctcagaattgcctg

SEQ ID NO: 610691 - DNA, 20 bp, Artificial Sequence
  chemically synthesized
taaatcttcccaggcaattc

SEQ ID NO: 610692 - DNA, 20 bp, Artificial Sequence
  chemically synthesized
ccaggcaattctgaggatta

SEQ ID NO: 610693 - DNA, 20 bp, Artificial Sequence
  chemically synthesized
cgttctccaactaaagtttg

SEQ ID NO: 610694 - DNA, 20 bp, Artificial Sequence
  chemically synthesized
gatggtactcgttctccaac

SEQ ID NO: 610695 - DNA, 20 bp, Artificial Sequence
  chemically synthesized
gagtatgtctaaggatgtgg

SEQ ID NO: 610696 - DNA, 20 bp, Artificial Sequence
  chemically synthesized
tccctaggtctcactctcac

SEQ ID NO: 610697 - DNA, 20 bp, Artificial Sequence
  chemically synthesized
cagatccctaggtctcactc

SEQ ID NO: 610698 - DNA, 20 bp, Artificial Sequence
  chemically synthesized
tgagagtgagacctagggat

SEQ ID NO: 610699 - DNA, 20 bp, Artificial Sequence
  chemically synthesized
acctagggatctgtgttttg

SEQ ID NO: 610700 - DNA, 20 bp, Artificial Sequence
  chemically synthesized
gcctggacaacagagtgaga

SEQ ID NO: 610701 - DNA, 20 bp, Artificial Sequence
  chemically synthesized
ctcactgtagcatcaaactc

SEQ ID NO: 610702 - DNA, 20 bp, Artificial Sequence
  chemically synthesized
gatcaggattgcttaaacac

SEQ ID NO: 610703 - DNA, 20 bp, Artificial Sequence
  chemically synthesized
cgctgaggcgggaggatcag

SEQ ID NO: 610704 - DNA, 20 bp, Artificial Sequence
  chemically synthesized
gggacgctgaggcgggagga

SEQ ID NO: 610705 - DNA, 20 bp, Artificial Sequence
  chemically synthesized
cgtcccgaatagttaggact

SEQ ID NO: 610706 - DNA, 20 bp, Artificial Sequence
  chemically synthesized
ttttttttaagtattttttg

SEQ ID NO: 610707 - DNA, 20 bp, Artificial Sequence
  chemically synthesized
agccaacatgccggggagga

SEQ ID NO: 610708 - DNA, 20 bp, Artificial Sequence
  chemically synthesized
tcagggaaggtggtggttaa

SEQ ID NO: 610709 - DNA, 20 bp, Artificial Sequence
  chemically synthesized
ttttctaattttttctgtgg

SEQ ID NO: 610710 - DNA, 20 bp, Artificial Sequence
  chemically synthesized
tatagctatgccttctatat

SEQ ID NO: 610711 - DNA, 20 bp, Artificial Sequence
  chemically synthesized
aataatagtaaaaaagccag

SEQ ID NO: 610712 - DNA, 20 bp, Artificial Sequence
  chemically synthesized
ctaccattattaaaagctat

SEQ ID NO: 610713 - DNA, 20 bp, Artificial Sequence
  chemically synthesized
atagtaagtaccaaataaag

SEQ ID NO: 610714 - DNA, 20 bp, Artificial Sequence
  chemically synthesized
gggaaatacgtgtattacca

SEQ ID NO: 610715 - DNA, 20 bp, Artificial Sequence
  chemically synthesized
aaaaagtgtaggccaggtgt

SEQ ID NO: 610716 - DNA, 20 bp, Artificial Sequence
  chemically synthesized
tgcctcagcctcccaaagtg

SEQ ID NO: 610717 - DNA, 20 bp, Artificial Sequence
  chemically synthesized
gcctggccaacatggcaaaa

SEQ ID NO: 610718 - DNA, 20 bp, Artificial Sequence
  chemically synthesized
tcgtgtatttttagtagaaa

SEQ ID NO: 610719 - DNA, 20 bp, Artificial Sequence
  chemically synthesized
cggggaggctgaggcaggag

SEQ ID NO: 610720 - DNA, 20 bp, Artificial Sequence
  chemically synthesized
aggattaaatgccccaccct

SEQ ID NO: 610721 - DNA, 20 bp, Artificial Sequence
  chemically synthesized
tcagttttcttatctgtata

SEQ ID NO: 610722 - DNA, 20 bp, Artificial Sequence
  chemically synthesized
gataagaaaactgaggagca

SEQ ID NO: 610723 - DNA, 20 bp, Artificial Sequence
  chemically synthesized
gaaaattaaactttttgctc

SEQ ID NO: 610724 - DNA, 20 bp, Artificial Sequence
  chemically synthesized
atagccagctggggtatgag

SEQ ID NO: 610725 - DNA, 20 bp, Artificial Sequence
  chemically synthesized
ctggggtatgagtccagttt

SEQ ID NO: 610726 - DNA, 20 bp, Artificial Sequence
  chemically synthesized
tatgagtccagtttgaaagt

SEQ ID NO: 610727 - DNA, 20 bp, Artificial Sequence
  chemically synthesized
tttaataatacatgtaatgc

SEQ ID NO: 610728 - DNA, 20 bp, Artificial Sequence
  chemically synthesized
acttacctaataccatcatt

SEQ ID NO: 610729 - DNA, 20 bp, Artificial Sequence
  chemically synthesized
tatatcaacatgcaaattaa

SEQ ID NO: 610730 - DNA, 20 bp, Artificial Sequence
  chemically synthesized
tcaatccctatgtattgata

SEQ ID NO: 610731 - DNA, 20 bp, Artificial Sequence
  chemically synthesized
taaaacagattatcaataca

SEQ ID NO: 610732 - DNA, 20 bp, Artificial Sequence
  chemically synthesized
aattgccctctcaaagtaac

SEQ ID NO: 610733 - DNA, 20 bp, Artificial Sequence
  chemically synthesized
ccttacaattgttcacagct

SEQ ID NO: 610734 - DNA, 20 bp, Artificial Sequence
  chemically synthesized
aggaagaatgtgcttatgtt

SEQ ID NO: 610735 - DNA, 20 bp, Artificial Sequence
  chemically synthesized
agaggtgaggaagaatgtgc

SEQ ID NO: 610736 - DNA, 20 bp, Artificial Sequence
  chemically synthesized
acccatagaggtgaggaaga

SEQ ID NO: 610737 - DNA, 20 bp, Artificial Sequence
  chemically synthesized
acctctatgggtactaactg

SEQ ID NO: 610738 - DNA, 20 bp, Artificial Sequence
  chemically synthesized
gagttccatttcctccccac

SEQ ID NO: 610739 - DNA, 20 bp, Artificial Sequence
  chemically synthesized
tcattattttatatgctatg

SEQ ID NO: 610740 - DNA, 20 bp, Artificial Sequence
  chemically synthesized
cccccctaccaaatttacta

SEQ ID NO: 610741 - DNA, 20 bp, Artificial Sequence
  chemically synthesized
aatgtaagccaaaatctaag

SEQ ID NO: 610742 - DNA, 20 bp, Artificial Sequence
  chemically synthesized
gattcaatcacaccttagat

SEQ ID NO: 610743 - DNA, 20 bp, Artificial Sequence
  chemically synthesized
ttatagtgattcaatcacac

SEQ ID NO: 610744 - DNA, 20 bp, Artificial Sequence
  chemically synthesized
ttctcaagggatggatatta

SEQ ID NO: 610745 - DNA, 20 bp, Artificial Sequence
  chemically synthesized
tcagtgacaagatgttggac

SEQ ID NO: 610746 - DNA, 20 bp, Artificial Sequence
  chemically synthesized
ggattcctgccaaattattt

SEQ ID NO: 610747 - DNA, 20 bp, Artificial Sequence
  chemically synthesized
tgaaatgactcatttgttgt

SEQ ID NO: 610748 - DNA, 20 bp, Artificial Sequence
  chemically synthesized
aattgctcacaaggttatta

SEQ ID NO: 610749 - DNA, 20 bp, Artificial Sequence
  chemically synthesized
agaaaacaggataatttata

SEQ ID NO: 610750 - DNA, 20 bp, Artificial Sequence
  chemically synthesized
attaaacagtttataaatta

SEQ ID NO: 610751 - DNA, 20 bp, Artificial Sequence
  chemically synthesized
ttcaatatttcaagttctta

SEQ ID NO: 610752 - DNA, 20 bp, Artificial Sequence
  chemically synthesized
tttgaggatcctggctaaag

SEQ ID NO: 610753 - DNA, 20 bp, Artificial Sequence
  chemically synthesized
ggctaaagccaagatttgct

SEQ ID NO: 610754 - DNA, 20 bp, Artificial Sequence
  chemically synthesized
cctaaaagccttcagcaaat

SEQ ID NO: 610755 - DNA, 20 bp, Artificial Sequence
  chemically synthesized
cctcaattatcagagtctta

SEQ ID NO: 610756 - DNA, 20 bp, Artificial Sequence
  chemically synthesized
ttaattgtgtgtcatttttt

SEQ ID NO: 610757 - DNA, 20 bp, Artificial Sequence
  chemically synthesized
attgattcaataatgagttt

SEQ ID NO: 610758 - DNA, 20 bp, Artificial Sequence
  chemically synthesized
ttctcactattgattcaata

SEQ ID NO: 610759 - DNA, 20 bp, Artificial Sequence
  chemically synthesized
ttagccacataaattctcac

SEQ ID NO: 610760 - DNA, 20 bp, Artificial Sequence
  chemically synthesized
gctaacaccacacatagcaa

SEQ ID NO: 610761 - DNA, 20 bp, Artificial Sequence
  chemically synthesized
tatgtcttaatatgaacaaa

SEQ ID NO: 610762 - DNA, 20 bp, Artificial Sequence
  chemically synthesized
gttcactgatcttttttgaa

SEQ ID NO: 610763 - DNA, 20 bp, Artificial Sequence
  chemically synthesized
agtgacaaataaggcaaggc

SEQ ID NO: 610764 - DNA, 20 bp, Artificial Sequence
  chemically synthesized
tctatatatgtagaaatgta

SEQ ID NO: 610765 - DNA, 20 bp, Artificial Sequence
  chemically synthesized
catatatagaagacactcat

SEQ ID NO: 610766 - DNA, 20 bp, Artificial Sequence
  chemically synthesized
actcataagtgtttattgac

SEQ ID NO: 610767 - DNA, 20 bp, Artificial Sequence
  chemically synthesized
tttacaacattaagaataaa

SEQ ID NO: 610768 - DNA, 20 bp, Artificial Sequence
  chemically synthesized
attttccgttagggaaaaat

SEQ ID NO: 610769 - DNA, 20 bp, Artificial Sequence
  chemically synthesized
taacataaatgtagcaatat

SEQ ID NO: 610770 - DNA, 20 bp, Artificial Sequence
  chemically synthesized
tatgctagttttcatagagt

SEQ ID NO: 610771 - DNA, 20 bp, Artificial Sequence
  chemically synthesized
taatgctatgctagttttca

SEQ ID NO: 610772 - DNA, 20 bp, Artificial Sequence
  chemically synthesized
ttttctaactctaatgctat

SEQ ID NO: 610773 - DNA, 20 bp, Artificial Sequence
  chemically synthesized
tttgaaaatgatagacatga

SEQ ID NO: 610774 - DNA, 20 bp, Artificial Sequence
  chemically synthesized
atagagtttgaaaatgatag

SEQ ID NO: 610775 - DNA, 20 bp, Artificial Sequence
  chemically synthesized
ctagctttctcaaggatgga

SEQ ID NO: 610776 - DNA, 20 bp, Artificial Sequence
  chemically synthesized
ctctatccatccttgagaaa

SEQ ID NO: 610777 - DNA, 20 bp, Artificial Sequence
  chemically synthesized
tccttgagaaagctagtttc

SEQ ID NO: 610778 - DNA, 20 bp, Artificial Sequence
  chemically synthesized
ttatattttaatctgaagaa

SEQ ID NO: 610779 - DNA, 20 bp, Artificial Sequence
  chemically synthesized
acaaaagggagaaaaacttc

SEQ ID NO: 610780 - DNA, 20 bp, Artificial Sequence
  chemically synthesized
ctaacttcatatgaaacacg

SEQ ID NO: 610781 - DNA, 20 bp, Artificial Sequence
  chemically synthesized
ttcatatgaagttaggcgaa

SEQ ID NO: 610782 - DNA, 20 bp, Artificial Sequence
  chemically synthesized
cttgatttacttctaaaata

SEQ ID NO: 610783 - DNA, 20 bp, Artificial Sequence
  chemically synthesized
tgatagatattttgcacatt

SEQ ID NO: 610784 - DNA, 20 bp, Artificial Sequence
  chemically synthesized
atattcattcaataatttat

SEQ ID NO: 610785 - DNA, 20 bp, Artificial Sequence
  chemically synthesized
ggaagaaatacaatacaggt

SEQ ID NO: 610786 - DNA, 20 bp, Artificial Sequence
  chemically synthesized
tattgtatttcttccctgtg

SEQ ID NO: 610787 - DNA, 20 bp, Artificial Sequence
  chemically synthesized
cactgtcatatgcacttctc

SEQ ID NO: 610788 - DNA, 20 bp, Artificial Sequence
  chemically synthesized
ctatctgcctaggagtttgg

SEQ ID NO: 610789 - DNA, 20 bp, Artificial Sequence
  chemically synthesized
gtacccacccctatctgcct

SEQ ID NO: 610790 - DNA, 20 bp, Artificial Sequence
  chemically synthesized
aactgtcttcagcttggaag

SEQ ID NO: 610791 - DNA, 20 bp, Artificial Sequence
  chemically synthesized
ctttcaggcctttaactgtc

SEQ ID NO: 610792 - DNA, 20 bp, Artificial Sequence
  chemically synthesized
tgcaaggatttgatttgtag

SEQ ID NO: 610793 - DNA, 20 bp, Artificial Sequence
  chemically synthesized
tccactgcaaggatttgatt

SEQ ID NO: 610794 - DNA, 20 bp, Artificial Sequence
  chemically synthesized
actacaaatcaaatccttgc

SEQ ID NO: 610795 - DNA, 20 bp, Artificial Sequence
  chemically synthesized
gttctcaatccactgcaagg

SEQ ID NO: 610796 - DNA, 20 bp, Artificial Sequence
  chemically synthesized
gacaagttctcaatccactg

SEQ ID NO: 610797 - DNA, 20 bp, Artificial Sequence
  chemically synthesized
agaacttgtcctcctatttg

SEQ ID NO: 610798 - DNA, 20 bp, Artificial Sequence
  chemically synthesized
ctcctatttggtgtgctttc

SEQ ID NO: 610799 - DNA, 20 bp, Artificial Sequence
  chemically synthesized
attttacttatacctactga

SEQ ID NO: 610800 - DNA, 20 bp, Artificial Sequence
  chemically synthesized
tgctgttctcatgatagtga

SEQ ID NO: 610801 - DNA, 20 bp, Artificial Sequence
  chemically synthesized
gaataagtttcacaaaatct

SEQ ID NO: 610802 - DNA, 20 bp, Artificial Sequence
  chemically synthesized
aaactcccccttacaaagcc

SEQ ID NO: 610803 - DNA, 20 bp, Artificial Sequence
  chemically synthesized
aatctgatggctttgtaagg

SEQ ID NO: 610804 - DNA, 20 bp, Artificial Sequence
  chemically synthesized
tacatggatggcagcagaca

SEQ ID NO: 610805 - DNA, 20 bp, Artificial Sequence
  chemically synthesized
ttgctcttccttgccttcca

SEQ ID NO: 610806 - DNA, 20 bp, Artificial Sequence
  chemically synthesized
cttgccttccagcatgattg

SEQ ID NO: 610807 - DNA, 20 bp, Artificial Sequence
  chemically synthesized
ttagagttccacgtagctag

SEQ ID NO: 610808 - DNA, 20 bp, Artificial Sequence
  chemically synthesized
tggataatttatacaggaaa

SEQ ID NO: 610809 - DNA, 20 bp, Artificial Sequence
  chemically synthesized
ggtaccaattcactgtatta

SEQ ID NO: 610810 - DNA, 20 bp, Artificial Sequence
  chemically synthesized
tgcctgttacccagttccaa

SEQ ID NO: 610811 - DNA, 20 bp, Artificial Sequence
  chemically synthesized
gggtaacaggcagaggttgc

SEQ ID NO: 610812 - DNA, 20 bp, Artificial Sequence
  chemically synthesized
cagaagacaggaaaatgtgg

SEQ ID NO: 610813 - DNA, 20 bp, Artificial Sequence
  chemically synthesized
tgggacttcctagagacttg

SEQ ID NO: 610814 - DNA, 20 bp, Artificial Sequence
  chemically synthesized
tctatctgagaccatctcag

SEQ ID NO: 610815 - DNA, 20 bp, Artificial Sequence
  chemically synthesized
tcatctctatctgagaccat

SEQ ID NO: 610816 - DNA, 20 bp, Artificial Sequence
  chemically synthesized
ccctagagttatagggaact

SEQ ID NO: 610817 - DNA, 20 bp, Artificial Sequence
  chemically synthesized
gggaactttgagcttgagag

SEQ ID NO: 610818 - DNA, 20 bp, Artificial Sequence
  chemically synthesized
tcacgaatgctttgctgctt

SEQ ID NO: 610819 - DNA, 20 bp, Artificial Sequence
  chemically synthesized
aagtcacctcacgaatgctt

SEQ ID NO: 610820 - DNA, 20 bp, Artificial Sequence
  chemically synthesized
caggacccaagtcacctcac

SEQ ID NO: 610821 - DNA, 20 bp, Artificial Sequence
  chemically synthesized
acttgggtcctgttaaggca

SEQ ID NO: 610822 - DNA, 20 bp, Artificial Sequence
  chemically synthesized
ttaaaagggaaacagagcat

SEQ ID NO: 610823 - DNA, 20 bp, Artificial Sequence
  chemically synthesized
aatttttccaaacttttatg

SEQ ID NO: 610824 - DNA, 20 bp, Artificial Sequence
  chemically synthesized
cgtgaatttcttctcagaaa

SEQ ID NO: 610825 - DNA, 20 bp, Artificial Sequence
  chemically synthesized
agacatttttctcattgtct

SEQ ID NO: 610826 - DNA, 20 bp, Artificial Sequence
  chemically synthesized
agcccctcccatcacatgtc

SEQ ID NO: 610827 - DNA, 20 bp, Artificial Sequence
  chemically synthesized
tctggagtttaggaggaaaa

SEQ ID NO: 610828 - DNA, 20 bp, Artificial Sequence
  chemically synthesized
gtgactaaaaggggccgagg

SEQ ID NO: 610829 - DNA, 20 bp, Artificial Sequence
  chemically synthesized
agggcggaagcccaagcctt

SEQ ID NO: 610830 - DNA, 20 bp, Artificial Sequence
  chemically synthesized
gacgtggaagctgccaaggc

SEQ ID NO: 610831 - DNA, 20 bp, Artificial Sequence
  chemically synthesized
caacacgacgtggaagctgc

SEQ ID NO: 610832 - DNA, 20 bp, Artificial Sequence
  chemically synthesized
ggtgcacagaagtcaagaac

SEQ ID NO: 610833 - DNA, 20 bp, Artificial Sequence
  chemically synthesized
ctgcggtttgggaacctctg

SEQ ID NO: 610834 - DNA, 20 bp, Artificial Sequence
  chemically synthesized
gcaaacttctacctgggcat

SEQ ID NO: 610835 - DNA, 20 bp, Artificial Sequence
  chemically synthesized
aaaaacctggatgcccaggt

SEQ ID NO: 610836 - DNA, 20 bp, Artificial Sequence
  chemically synthesized
cccagaatggtagatccact

SEQ ID NO: 610837 - DNA, 20 bp, Artificial Sequence
  chemically synthesized
tttcatgagctggcattgat

SEQ ID NO: 610838 - DNA, 20 bp, Artificial Sequence
  chemically synthesized
tggatgctttcatgagctgg

SEQ ID NO: 610839 - DNA, 20 bp, Artificial Sequence
  chemically synthesized
cagggtacagcctccctcct

SEQ ID NO: 610840 - DNA, 20 bp, Artificial Sequence
  chemically synthesized
gtcttgggccactctgcccc

SEQ ID NO: 610841 - DNA, 20 bp, Artificial Sequence
  chemically synthesized
gcagtcaaaggagatcattt

SEQ ID NO: 610842 - DNA, 20 bp, Artificial Sequence
  chemically synthesized
aaggagatcattttggagct

SEQ ID NO: 610843 - DNA, 20 bp, Artificial Sequence
  chemically synthesized
ctttaagatttgacagccct

SEQ ID NO: 610844 - DNA, 20 bp, Artificial Sequence
  chemically synthesized
ttgcatgtgccctgaagccc

SEQ ID NO: 610845 - DNA, 20 bp, Artificial Sequence
  chemically synthesized
ggagaaattgtccaaaacaa

SEQ ID NO: 610846 - DNA, 20 bp, Artificial Sequence
  chemically synthesized
ctgtatctaggaagtaacta

SEQ ID NO: 610847 - DNA, 20 bp, Artificial Sequence
  chemically synthesized
ctaggaagtaactaatctgc

SEQ ID NO: 610848 - DNA, 20 bp, Artificial Sequence
  chemically synthesized
tgtgagcctataaaatcaaa

SEQ ID NO: 610849 - DNA, 20 bp, Artificial Sequence
  chemically synthesized
taggatgacactttggactg

SEQ ID NO: 610850 - DNA, 20 bp, Artificial Sequence
  chemically synthesized
tttggtgcactgttgggaag

SEQ ID NO: 610851 - DNA, 20 bp, Artificial Sequence
  chemically synthesized
tgcactgttgggaaggcaag

SEQ ID NO: 610852 - DNA, 20 bp, Artificial Sequence
  chemically synthesized
tggttttcaaatgtgaggat

SEQ ID NO: 610853 - DNA, 20 bp, Artificial Sequence
  chemically synthesized
aggggccgggggtggaatga

SEQ ID NO: 610854 - DNA, 20 bp, Artificial Sequence
  chemically synthesized
acaacatgtgggaattcaag

SEQ ID NO: 610855 - DNA, 20 bp, Artificial Sequence
  chemically synthesized
agcatgggaaagacctgtcc

SEQ ID NO: 610856 - DNA, 20 bp, Artificial Sequence
  chemically synthesized
gtgaaagtctcacgagatct

SEQ ID NO: 610857 - DNA, 20 bp, Artificial Sequence
  chemically synthesized
agatctgatggctttgtaag

SEQ ID NO: 610858 - DNA, 20 bp, Artificial Sequence
  chemically synthesized
tgtaagtggagtttccctgc

SEQ ID NO: 610859 - DNA, 20 bp, Artificial Sequence
  chemically synthesized
caggaatgacagagggcaaa

SEQ ID NO: 610860 - DNA, 20 bp, Artificial Sequence
  chemically synthesized
ttactcctccttgccttcca

SEQ ID NO: 610861 - DNA, 20 bp, Artificial Sequence
  chemically synthesized
cttgccttccaccatgattg

SEQ ID NO: 610862 - DNA, 20 bp, Artificial Sequence
  chemically synthesized
tgggtaatttatacagcaaa

SEQ ID NO: 610863 - DNA, 20 bp, Artificial Sequence
  chemically synthesized
tgctgctgataaagagatac

SEQ ID NO: 610864 - DNA, 20 bp, Artificial Sequence
  chemically synthesized
aagtcagtgcttgtgtatta

SEQ ID NO: 610865 - DNA, 20 bp, Artificial Sequence
  chemically synthesized
atacacaagcactgacttct

SEQ ID NO: 610866 - DNA, 20 bp, Artificial Sequence
  chemically synthesized
tgttctaagcagggagaagt

SEQ ID NO: 610867 - DNA, 20 bp, Artificial Sequence
  chemically synthesized
atttagatggaagtctgggt

SEQ ID NO: 610868 - DNA, 20 bp, Artificial Sequence
  chemically synthesized
tcatttcttattcctccaga

SEQ ID NO: 610869 - DNA, 20 bp, Artificial Sequence
  chemically synthesized
tattcctccagatacagatt

SEQ ID NO: 610870 - DNA, 20 bp, Artificial Sequence
  chemically synthesized
cagcataattatgattgtat

SEQ ID NO: 610871 - DNA, 20 bp, Artificial Sequence
  chemically synthesized
tttgaggaataccagcataa

SEQ ID NO: 610872 - DNA, 20 bp, Artificial Sequence
  chemically synthesized
cagaacactttgcccatagg

SEQ ID NO: 610873 - DNA, 20 bp, Artificial Sequence
  chemically synthesized
gcattgagtctaccttagaa

SEQ ID NO: 610874 - DNA, 20 bp, Artificial Sequence
  chemically synthesized
aaatttgtttttcatactca

SEQ ID NO: 610875 - DNA, 20 bp, Artificial Sequence
  chemically synthesized
ttactatgagtggcagtgca

SEQ ID NO: 610876 - DNA, 20 bp, Artificial Sequence
  chemically synthesized
tggttggagtatactccctg

SEQ ID NO: 610877 - DNA, 20 bp, Artificial Sequence
  chemically synthesized
acacagggagtatactccaa

SEQ ID NO: 610878 - DNA, 20 bp, Artificial Sequence
  chemically synthesized
gctgagggaagaatttgtac

SEQ ID NO: 610879 - DNA, 20 bp, Artificial Sequence
  chemically synthesized
tgggtgttctataacattta

SEQ ID NO: 610880 - DNA, 20 bp, Artificial Sequence
  chemically synthesized
aagagtctttagttatttgt

SEQ ID NO: 610881 - DNA, 20 bp, Artificial Sequence
  chemically synthesized
cacaaataactaaagactct

SEQ ID NO: 610882 - DNA, 20 bp, Artificial Sequence
  chemically synthesized
atgtagtatttagaggagat

SEQ ID NO: 610883 - DNA, 20 bp, Artificial Sequence
  chemically synthesized
tgcttgcttgctttattttc

SEQ ID NO: 610884 - DNA, 20 bp, Artificial Sequence
  chemically synthesized
tggtaccttcttaattgctt

SEQ ID NO: 610885 - DNA, 20 bp, Artificial Sequence
  chemically synthesized
ggtttggtaccttcttaatt

SEQ ID NO: 610886 - DNA, 20 bp, Artificial Sequence
  chemically synthesized
gcagggtttggtaccttctt

SEQ ID NO: 610887 - DNA, 20 bp, Artificial Sequence
  chemically synthesized
acccacaaaatagaattgag

SEQ ID NO: 610888 - DNA, 20 bp, Artificial Sequence
  chemically synthesized
accctgctcaattctatttt

SEQ ID NO: 610889 - DNA, 20 bp, Artificial Sequence
  chemically synthesized
ctattttgtgggttttgacc

SEQ ID NO: 610890 - DNA, 20 bp, Artificial Sequence
  chemically synthesized
atcttcattttgacccccca

SEQ ID NO: 610891 - DNA, 20 bp, Artificial Sequence
  chemically synthesized
ttcagcagcacagaacctgt

SEQ ID NO: 610892 - DNA, 20 bp, Artificial Sequence
  chemically synthesized
aagtgaccagcaactctaaa

SEQ ID NO: 610893 - DNA, 20 bp, Artificial Sequence
  chemically synthesized
acatgtaaaagtatttaaaa

SEQ ID NO: 610894 - DNA, 20 bp, Artificial Sequence
  chemically synthesized
taagattgttttgaaaatat

SEQ ID NO: 610895 - DNA, 20 bp, Artificial Sequence
  chemically synthesized
taattgtatccatctgataa

SEQ ID NO: 610896 - DNA, 20 bp, Artificial Sequence
  chemically synthesized
gcgataattgtatccatctg

SEQ ID NO: 610897 - DNA, 20 bp, Artificial Sequence
  chemically synthesized
gaaagttagtcatactgtgt

SEQ ID NO: 610898 - DNA, 20 bp, Artificial Sequence
  chemically synthesized
ccctcagaaagttagtcata

SEQ ID NO: 610899 - DNA, 20 bp, Artificial Sequence
  chemically synthesized
gactaactttctgagggcca

SEQ ID NO: 610900 - DNA, 20 bp, Artificial Sequence
  chemically synthesized
acagcttttaagtaatacag

SEQ ID NO: 610901 - DNA, 20 bp, Artificial Sequence
  chemically synthesized
gagatcttgagatgcactgc

SEQ ID NO: 610902 - DNA, 20 bp, Artificial Sequence
  chemically synthesized
aagtctgagatcttgagatg

SEQ ID NO: 610903 - DNA, 20 bp, Artificial Sequence
  chemically synthesized
cgataccatagaaccttagc

SEQ ID NO: 610904 - DNA, 20 bp, Artificial Sequence
  chemically synthesized
ggcacctatttttttttttt

SEQ ID NO: 610905 - DNA, 20 bp, Artificial Sequence
  chemically synthesized
aatagcttgttcttcagaaa

SEQ ID NO: 610906 - DNA, 20 bp, Artificial Sequence
  chemically synthesized
ttgactcattcatctaaatt

SEQ ID NO: 610907 - DNA, 20 bp, Artificial Sequence
  chemically synthesized
tgagtcaataacaaacttat

SEQ ID NO: 610908 - DNA, 20 bp, Artificial Sequence
  chemically synthesized
tctgtatgtttaaatctgcg

SEQ ID NO: 610909 - DNA, 20 bp, Artificial Sequence
  chemically synthesized
gatttgccgtgaaaatttct

SEQ ID NO: 610910 - DNA, 20 bp, Artificial Sequence
  chemically synthesized
tatttattgacctcatattt

SEQ ID NO: 610911 - DNA, 20 bp, Artificial Sequence
  chemically synthesized
gatagtgggagccatctgca

SEQ ID NO: 610912 - DNA, 20 bp, Artificial Sequence
  chemically synthesized
cttctgtgcctctttcccca

SEQ ID NO: 610913 - DNA, 20 bp, Artificial Sequence
  chemically synthesized
ggtaaaataaaatatcagct

SEQ ID NO: 610914 - DNA, 20 bp, Artificial Sequence
  chemically synthesized
aactgaaggtaaaataaaat

SEQ ID NO: 610915 - DNA, 20 bp, Artificial Sequence
  chemically synthesized
accttcagttctctgtacat

SEQ ID NO: 610916 - DNA, 20 bp, Artificial Sequence
  chemically synthesized
ccaaaactcaggccgtaagg

SEQ ID NO: 610917 - DNA, 20 bp, Artificial Sequence
  chemically synthesized
tcaaagcctttccttacggc

SEQ ID NO: 610918 - DNA, 20 bp, Artificial Sequence
  chemically synthesized
gacatacatgatgtgggaaa

SEQ ID NO: 610919 - DNA, 20 bp, Artificial Sequence
  chemically synthesized
tgctgaagaattgcccatgt

SEQ ID NO: 610920 - DNA, 20 bp, Artificial Sequence
  chemically synthesized
tcacccatacaaaaaaaaag

SEQ ID NO: 610921 - DNA, 20 bp, Artificial Sequence
  chemically synthesized
ttttagtcatgttccgtttt

SEQ ID NO: 610922 - DNA, 20 bp, Artificial Sequence
  chemically synthesized
cctttaagattttagtcatg

SEQ ID NO: 610923 - DNA, 20 bp, Artificial Sequence
  chemically synthesized
gctcacttccgtatcttcct

SEQ ID NO: 610924 - DNA, 20 bp, Artificial Sequence
  chemically synthesized
atagaaatattttaacttca

SEQ ID NO: 610925 - DNA, 20 bp, Artificial Sequence
  chemically synthesized
catttcagggattcttacca

SEQ ID NO: 610926 - DNA, 20 bp, Artificial Sequence
  chemically synthesized
ttagaattcagaatacattt

SEQ ID NO: 610927 - DNA, 20 bp, Artificial Sequence
  chemically synthesized
aagttccctgtgggcaggta

SEQ ID NO: 610928 - DNA, 20 bp, Artificial Sequence
  chemically synthesized
tttgctctttgaggagtaat

SEQ ID NO: 610929 - DNA, 20 bp, Artificial Sequence
  chemically synthesized
atacatgttttataactcaa

SEQ ID NO: 610930 - DNA, 20 bp, Artificial Sequence
  chemically synthesized
ttttcaaacaatattcaatt

SEQ ID NO: 610931 - DNA, 20 bp, Artificial Sequence
  chemically synthesized
ctggcaagcaaataattgaa

SEQ ID NO: 610932 - DNA, 20 bp, Artificial Sequence
  chemically synthesized
taaatagcaataaaaatatc

SEQ ID NO: 610933 - DNA, 20 bp, Artificial Sequence
  chemically synthesized
tcaatggtttgaatttaata

SEQ ID NO: 610934 - DNA, 20 bp, Artificial Sequence
  chemically synthesized
tgatcacttcccaattgagg

SEQ ID NO: 610935 - DNA, 20 bp, Artificial Sequence
  chemically synthesized
cctgcttcctcctgtaacca

SEQ ID NO: 610936 - DNA, 20 bp, Artificial Sequence
  chemically synthesized
gttacaggaggaagcagggt

SEQ ID NO: 610937 - DNA, 20 bp, Artificial Sequence
  chemically synthesized
aggaggaagcagggtatggg

SEQ ID NO: 610938 - DNA, 20 bp, Artificial Sequence
  chemically synthesized
tagcacaagcgaaacccata

SEQ ID NO: 610939 - DNA, 20 bp, Artificial Sequence
  chemically synthesized
agtgcaatgaagaaaaatta

SEQ ID NO: 610940 - DNA, 20 bp, Artificial Sequence
  chemically synthesized
tcttcattgcactgtaatca

SEQ ID NO: 610941 - DNA, 20 bp, Artificial Sequence
  chemically synthesized
tctttgccctagattaagct

SEQ ID NO: 610942 - DNA, 20 bp, Artificial Sequence
  chemically synthesized
gtattcttctttgccctaga

SEQ ID NO: 610943 - DNA, 20 bp, Artificial Sequence
  chemically synthesized
acaattgtattcttctttgc

SEQ ID NO: 610944 - DNA, 20 bp, Artificial Sequence
  chemically synthesized
tagggcaaagaagaatacaa

SEQ ID NO: 610945 - DNA, 20 bp, Artificial Sequence
  chemically synthesized
ataattaatgtgctatggct

SEQ ID NO: 610946 - DNA, 20 bp, Artificial Sequence
  chemically synthesized
taatgtgctatggctattgg

SEQ ID NO: 610947 - DNA, 20 bp, Artificial Sequence
  chemically synthesized
gatttaatttatgcgcttaa

SEQ ID NO: 610948 - DNA, 20 bp, Artificial Sequence
  chemically synthesized
atgttactaagatttaattt

SEQ ID NO: 610949 - DNA, 20 bp, Artificial Sequence
  chemically synthesized
ttacttatatgaaaatgtta

SEQ ID NO: 610950 - DNA, 20 bp, Artificial Sequence
  chemically synthesized
attcagtcctgaacagacaa

SEQ ID NO: 610951 - DNA, 20 bp, Artificial Sequence
  chemically synthesized
cttctacgaaaagtccaggt

SEQ ID NO: 610952 - DNA, 20 bp, Artificial Sequence
  chemically synthesized
agctgctgaaatatgacgtt

SEQ ID NO: 610953 - DNA, 20 bp, Artificial Sequence
  chemically synthesized
agctgagaacgtcatatttc

SEQ ID NO: 610954 - DNA, 20 bp, Artificial Sequence
  chemically synthesized
catatttcagcagcttcaat

SEQ ID NO: 610955 - DNA, 20 bp, Artificial Sequence
  chemically synthesized
cagcagcttcaatacttgtt

SEQ ID NO: 610956 - DNA, 20 bp, Artificial Sequence
  chemically synthesized
caagtataaagtaatgaaat

SEQ ID NO: 610957 - DNA, 20 bp, Artificial Sequence
  chemically synthesized
cataaatttcattactttat

SEQ ID NO: 610958 - DNA, 20 bp, Artificial Sequence
  chemically synthesized
tgacctactagacattcaca

SEQ ID NO: 610959 - DNA, 20 bp, Artificial Sequence
  chemically synthesized
cagaaaaatgtgtagtcgaa

SEQ ID NO: 610960 - DNA, 20 bp, Artificial Sequence
  chemically synthesized
ctctgaatgcttttggtttt

SEQ ID NO: 610961 - DNA, 20 bp, Artificial Sequence
  chemically synthesized
tcttacactctctgaatgct

SEQ ID NO: 610962 - DNA, 20 bp, Artificial Sequence
  chemically synthesized
tttgttctcttacactctct

SEQ ID NO: 610963 - DNA, 20 bp, Artificial Sequence
  chemically synthesized
ttatttaaatatttgaagag

SEQ ID NO: 610964 - DNA, 20 bp, Artificial Sequence
  chemically synthesized
aatattatatgtcttacgca

SEQ ID NO: 610965 - DNA, 20 bp, Artificial Sequence
  chemically synthesized
aaagtcatcaggaaaaaaat

SEQ ID NO: 610966 - DNA, 20 bp, Artificial Sequence
  chemically synthesized
gtttcccaaattgatccaca

SEQ ID NO: 610967 - DNA, 20 bp, Artificial Sequence
  chemically synthesized
gtagatctgtggttttattc

SEQ ID NO: 610968 - DNA, 20 bp, Artificial Sequence
  chemically synthesized
cctctatctatgtgtagatc

SEQ ID NO: 610969 - DNA, 20 bp, Artificial Sequence
  chemically synthesized
cagaagattaaaggctgaag

SEQ ID NO: 610970 - DNA, 20 bp, Artificial Sequence
  chemically synthesized
aaggctttcaccagttatcc

SEQ ID NO: 610971 - DNA, 20 bp, Artificial Sequence
  chemically synthesized
tagcttggagtgcttcctgc

SEQ ID NO: 610972 - DNA, 20 bp, Artificial Sequence
  chemically synthesized
cctttttaataagtagcttg

SEQ ID NO: 610973 - DNA, 20 bp, Artificial Sequence
  chemically synthesized
atcctcttacctttttaata

SEQ ID NO: 610974 - DNA, 20 bp, Artificial Sequence
  chemically synthesized
cagcatatggtttgatatat

SEQ ID NO: 610975 - DNA, 20 bp, Artificial Sequence
  chemically synthesized
agatggggcaagtgacagca

SEQ ID NO: 610976 - DNA, 20 bp, Artificial Sequence
  chemically synthesized
gttagaattaagtgatgcaa

SEQ ID NO: 610977 - DNA, 20 bp, Artificial Sequence
  chemically synthesized
ttccatcagatcctctctta

SEQ ID NO: 610978 - DNA, 20 bp, Artificial Sequence
  chemically synthesized
ctgtggagggatatagggca

SEQ ID NO: 610979 - DNA, 20 bp, Artificial Sequence
  chemically synthesized
atatccctccacagctcatc

SEQ ID NO: 610980 - DNA, 20 bp, Artificial Sequence
  chemically synthesized
gcaagaaattccctacaatt

SEQ ID NO: 610981 - DNA, 20 bp, Artificial Sequence
  chemically synthesized
aattcagggtttaactctta

SEQ ID NO: 610982 - DNA, 20 bp, Artificial Sequence
  chemically synthesized
ggtaatggatatatcaattg

SEQ ID NO: 610983 - DNA, 20 bp, Artificial Sequence
  chemically synthesized
gtgaggtaatggatatatca

SEQ ID NO: 610984 - DNA, 20 bp, Artificial Sequence
  chemically synthesized
attgatatatccattacctc

SEQ ID NO: 610985 - DNA, 20 bp, Artificial Sequence
  chemically synthesized
atagttaatagcaatgtatt

SEQ ID NO: 610986 - DNA, 20 bp, Artificial Sequence
  chemically synthesized
aaccccattcttaacaagtt

SEQ ID NO: 610987 - DNA, 20 bp, Artificial Sequence
  chemically synthesized
gttgagacatacacattcta

SEQ ID NO: 610988 - DNA, 20 bp, Artificial Sequence
  chemically synthesized
ctttgactttataatttttc

SEQ ID NO: 610989 - DNA, 20 bp, Artificial Sequence
  chemically synthesized
aatttttctttcgattctga

SEQ ID NO: 610990 - DNA, 20 bp, Artificial Sequence
  chemically synthesized
tttcgattctgatatggttt

SEQ ID NO: 610991 - DNA, 20 bp, Artificial Sequence
  chemically synthesized
ggaattacgggagctacaat

SEQ ID NO: 610992 - DNA, 20 bp, Artificial Sequence
  chemically synthesized
agcatgggaaagacctgccg

SEQ ID NO: 610993 - DNA, 20 bp, Artificial Sequence
  chemically synthesized
gaatacgtctcacgagatct

SEQ ID NO: 610994 - DNA, 20 bp, Artificial Sequence
  chemically synthesized
gatctgatggttttatacaa

SEQ ID NO: 610995 - DNA, 20 bp, Artificial Sequence
  chemically synthesized
atacaagaaagtttcccgga

SEQ ID NO: 610996 - DNA, 20 bp, Artificial Sequence
  chemically synthesized
tgctgctcatttgccctcca

SEQ ID NO: 610997 - DNA, 20 bp, Artificial Sequence
  chemically synthesized
gactaggtaatttataaagg

SEQ ID NO: 610998 - DNA, 20 bp, Artificial Sequence
  chemically synthesized
gcagcatgagaacagactaa

SEQ ID NO: 610999 - DNA, 20 bp, Artificial Sequence
  chemically synthesized
agactaatacagattccttt

SEQ ID NO: 611000 - DNA, 20 bp, Artificial Sequence
  chemically synthesized
tctctcatttttgctgcagt

SEQ ID NO: 611001 - DNA, 20 bp, Artificial Sequence
  chemically synthesized
agttcaacaatgttatcttt

SEQ ID NO: 611002 - DNA, 20 bp, Artificial Sequence
  chemically synthesized
tttccaggtcccacatgttc

SEQ ID NO: 611003 - DNA, 20 bp, Artificial Sequence
  chemically synthesized
acatgttcctgagttttctt

SEQ ID NO: 611004 - DNA, 20 bp, Artificial Sequence
  chemically synthesized
ttctttgataatcagccaat

SEQ ID NO: 611005 - DNA, 20 bp, Artificial Sequence
  chemically synthesized
cctgacagaaagccatgatt

SEQ ID NO: 611006 - DNA, 20 bp, Artificial Sequence
  chemically synthesized
cagccaatcatggctttctg

SEQ ID NO: 611007 - DNA, 20 bp, Artificial Sequence
  chemically synthesized
aagcaaagcctgacagaaag

SEQ ID NO: 611008 - DNA, 20 bp, Artificial Sequence
  chemically synthesized
aatcatggctttctgtcagg

SEQ ID NO: 611009 - DNA, 20 bp, Artificial Sequence
  chemically synthesized
caatagtcaagagtgtcagt

SEQ ID NO: 611010 - DNA, 20 bp, Artificial Sequence
  chemically synthesized
tgacagcaatagtcaagagt

SEQ ID NO: 611011 - DNA, 20 bp, Artificial Sequence
  chemically synthesized
tcaccactgctctctaagag

SEQ ID NO: 611012 - DNA, 20 bp, Artificial Sequence
  chemically synthesized
gtggtgatacattttaattc

SEQ ID NO: 611013 - DNA, 20 bp, Artificial Sequence
  chemically synthesized
tctctgccatctagagctgc

SEQ ID NO: 611014 - DNA, 20 bp, Artificial Sequence
  chemically synthesized
acacgcagggaggagaaaga

SEQ ID NO: 611015 - DNA, 20 bp, Artificial Sequence
  chemically synthesized
tgccattttggtacctctct

SEQ ID NO: 611016 - DNA, 20 bp, Artificial Sequence
  chemically synthesized
catccaaatgaacacagtag

SEQ ID NO: 611017 - DNA, 20 bp, Artificial Sequence
  chemically synthesized
tttatgaccactgacagtta

SEQ ID NO: 611018 - DNA, 20 bp, Artificial Sequence
  chemically synthesized
ggggggtttgattccgaagt

SEQ ID NO: 611019 - DNA, 20 bp, Artificial Sequence
  chemically synthesized
gcagtaagagtaaatggggg

SEQ ID NO: 611020 - DNA, 20 bp, Artificial Sequence
  chemically synthesized
aattgcagtaagagtaaatg

SEQ ID NO: 611021 - DNA, 20 bp, Artificial Sequence
  chemically synthesized
ttgccctcacacaggtattc

SEQ ID NO: 611022 - DNA, 20 bp, Artificial Sequence
  chemically synthesized
attacgagataacaaagtgt

SEQ ID NO: 611023 - DNA, 20 bp, Artificial Sequence
  chemically synthesized
caccctttattgaacacatc

SEQ ID NO: 611024 - DNA, 20 bp, Artificial Sequence
  chemically synthesized
agcacatggcccctatttgt

SEQ ID NO: 611025 - DNA, 20 bp, Artificial Sequence
  chemically synthesized
cgcctatttggtctcattgt

SEQ ID NO: 611026 - DNA, 20 bp, Artificial Sequence
  chemically synthesized
tttttcattttacatgtctg

SEQ ID NO: 611027 - DNA, 20 bp, Artificial Sequence
  chemically synthesized
ttatttttttcattttacat

SEQ ID NO: 611028 - DNA, 20 bp, Artificial Sequence
  chemically synthesized
tgccctcttttacttcatct

SEQ ID NO: 611029 - DNA, 20 bp, Artificial Sequence
  chemically synthesized
tatttcgaaacatgctctca

SEQ ID NO: 611030 - DNA, 20 bp, Artificial Sequence
  chemically synthesized
agttgcaaaacaatgtgaga

SEQ ID NO: 611031 - DNA, 20 bp, Artificial Sequence
  chemically synthesized
ttatccaattctaactatct

SEQ ID NO: 611032 - DNA, 20 bp, Artificial Sequence
  chemically synthesized
tcagctcaacttctacttct

SEQ ID NO: 611033 - DNA, 20 bp, Artificial Sequence
  chemically synthesized
ctattttccatcacagccct

SEQ ID NO: 611034 - DNA, 20 bp, Artificial Sequence
  chemically synthesized
gattaagcattcagtgcctg

SEQ ID NO: 611035 - DNA, 20 bp, Artificial Sequence
  chemically synthesized
tactaaacttatcaggcact

SEQ ID NO: 611036 - DNA, 20 bp, Artificial Sequence
  chemically synthesized
gttacttccacattttgtct

SEQ ID NO: 611037 - DNA, 20 bp, Artificial Sequence
  chemically synthesized
atgagaaagagaagagtaaa

SEQ ID NO: 611038 - DNA, 20 bp, Artificial Sequence
  chemically synthesized
atttctatattcaatgttca

SEQ ID NO: 611039 - DNA, 20 bp, Artificial Sequence
  chemically synthesized
gcactttccccactttcttt

SEQ ID NO: 611040 - DNA, 20 bp, Artificial Sequence
  chemically synthesized
ccgcatattgctgagcagtg

SEQ ID NO: 611041 - DNA, 20 bp, Artificial Sequence
  chemically synthesized
agatgagttagttactgcaa

SEQ ID NO: 611042 - DNA, 20 bp, Artificial Sequence
  chemically synthesized
gagttagttactgcaaaatt

SEQ ID NO: 611043 - DNA, 20 bp, Artificial Sequence
  chemically synthesized
gaatccatttagcttagttc

SEQ ID NO: 611044 - DNA, 20 bp, Artificial Sequence
  chemically synthesized
caaacagaagaactaagcta

SEQ ID NO: 611045 - DNA, 20 bp, Artificial Sequence
  chemically synthesized
tttgtgaaatgatgaatcca

SEQ ID NO: 611046 - DNA, 20 bp, Artificial Sequence
  chemically synthesized
aatggattcatcatttcaca

SEQ ID NO: 611047 - DNA, 20 bp, Artificial Sequence
  chemically synthesized
ttcttattattttatatatt

SEQ ID NO: 611048 - DNA, 20 bp, Artificial Sequence
  chemically synthesized
acctcagaaattcagatatg

SEQ ID NO: 611049 - DNA, 20 bp, Artificial Sequence
  chemically synthesized
aaagtttaaaactccttttt

SEQ ID NO: 611050 - DNA, 20 bp, Artificial Sequence
  chemically synthesized
gctctctgaaactttaaaaa

SEQ ID NO: 611051 - DNA, 20 bp, Artificial Sequence
  chemically synthesized
gagctacaactacagacgag

SEQ ID NO: 611052 - DNA, 20 bp, Artificial Sequence
  chemically synthesized
caactacagacgagataagc

SEQ ID NO: 611053 - DNA, 20 bp, Artificial Sequence
  chemically synthesized
cagtatgaaattcatcaagc

SEQ ID NO: 611054 - DNA, 20 bp, Artificial Sequence
  chemically synthesized
ttcatactgactactggatc

SEQ ID NO: 611055 - DNA, 20 bp, Artificial Sequence
  chemically synthesized
atcttatgtttaaggcagat

SEQ ID NO: 611056 - DNA, 20 bp, Artificial Sequence
  chemically synthesized
ggcccatgtgatacatttct

SEQ ID NO: 611057 - DNA, 20 bp, Artificial Sequence
  chemically synthesized
gcttctgattccatgtattt

SEQ ID NO: 611058 - DNA, 20 bp, Artificial Sequence
  chemically synthesized
gatttattcagcatctttgc

SEQ ID NO: 611059 - DNA, 20 bp, Artificial Sequence
  chemically synthesized
aatgcagatttattcagcat

SEQ ID NO: 611060 - DNA, 20 bp, Artificial Sequence
  chemically synthesized
aggaactttccatttttcaa

SEQ ID NO: 611061 - DNA, 20 bp, Artificial Sequence
  chemically synthesized
aaaaatggaaagttcctatt

SEQ ID NO: 611062 - DNA, 20 bp, Artificial Sequence
  chemically synthesized
cagtggaatagtaatagttg

SEQ ID NO: 611063 - DNA, 20 bp, Artificial Sequence
  chemically synthesized
aaagaagtcctgtgttacag

SEQ ID NO: 611064 - DNA, 20 bp, Artificial Sequence
  chemically synthesized
ctgttaaatactatgtggca

SEQ ID NO: 611065 - DNA, 20 bp, Artificial Sequence
  chemically synthesized
ggaaggtgaagagagataga

SEQ ID NO: 611066 - DNA, 20 bp, Artificial Sequence
  chemically synthesized
catttctcttctattttcaa

SEQ ID NO: 611067 - DNA, 20 bp, Artificial Sequence
  chemically synthesized
cccattctactgtatgtccc

SEQ ID NO: 611068 - DNA, 20 bp, Artificial Sequence
  chemically synthesized
tgtcccttgagattagagac

SEQ ID NO: 611069 - DNA, 20 bp, Artificial Sequence
  chemically synthesized
ttgaacactatgtatcatgt

SEQ ID NO: 611070 - DNA, 20 bp, Artificial Sequence
  chemically synthesized
catgatacatagtgttcaat

SEQ ID NO: 611071 - DNA, 20 bp, Artificial Sequence
  chemically synthesized
tgatataatgttaaacatat

SEQ ID NO: 611072 - DNA, 20 bp, Artificial Sequence
  chemically synthesized
ttccttgcaagtaaacctga

SEQ ID NO: 611073 - DNA, 20 bp, Artificial Sequence
  chemically synthesized
caacatcaatatatgaagta

SEQ ID NO: 611074 - DNA, 20 bp, Artificial Sequence
  chemically synthesized
tcatatataaatgcacactc

SEQ ID NO: 611075 - DNA, 20 bp, Artificial Sequence
  chemically synthesized
tttttgtacctcacataatg

SEQ ID NO: 611076 - DNA, 20 bp, Artificial Sequence
  chemically synthesized
tcctcttatttcttcttcat

SEQ ID NO: 611077 - DNA, 20 bp, Artificial Sequence
  chemically synthesized
attatttctctctctctctc

SEQ ID NO: 611078 - DNA, 20 bp, Artificial Sequence
  chemically synthesized
atgttatcaactcatgtcca

SEQ ID NO: 611079 - DNA, 20 bp, Artificial Sequence
  chemically synthesized
gaaatccctggataggccag

SEQ ID NO: 611080 - DNA, 20 bp, Artificial Sequence
  chemically synthesized
ataaacccacctggcctatc

SEQ ID NO: 611081 - DNA, 20 bp, Artificial Sequence
  chemically synthesized
tagaatgtgccatacagtag

SEQ ID NO: 611082 - DNA, 20 bp, Artificial Sequence
  chemically synthesized
taaatgagcagattatatac

SEQ ID NO: 611083 - DNA, 20 bp, Artificial Sequence
  chemically synthesized
caccgatttatcactaaatg

SEQ ID NO: 611084 - DNA, 20 bp, Artificial Sequence
  chemically synthesized
cagtctcctgtgaagagcat

SEQ ID NO: 611085 - DNA, 20 bp, Artificial Sequence
  chemically synthesized
cactcagaagtcttagaatt

SEQ ID NO: 611086 - DNA, 20 bp, Artificial Sequence
  chemically synthesized
tgattaaaagtcctcagact

SEQ ID NO: 611087 - DNA, 20 bp, Artificial Sequence
  chemically synthesized
cttttaatcattactatttt

SEQ ID NO: 611088 - DNA, 20 bp, Artificial Sequence
  chemically synthesized
tccaaaagctgtgaaaatag

SEQ ID NO: 611089 - DNA, 20 bp, Artificial Sequence
  chemically synthesized
acacacatacacaatgatga

SEQ ID NO: 611090 - DNA, 20 bp, Artificial Sequence
  chemically synthesized
taaatgtgacaggtccaccc

SEQ ID NO: 611091 - DNA, 20 bp, Artificial Sequence
  chemically synthesized
cagtcatttatggcatctga

SEQ ID NO: 611092 - DNA, 20 bp, Artificial Sequence
  chemically synthesized
ggagctgcactcgccataca

SEQ ID NO: 611093 - DNA, 20 bp, Artificial Sequence
  chemically synthesized
tccagactgaacagtaatgt

SEQ ID NO: 611094 - DNA, 20 bp, Artificial Sequence
  chemically synthesized
atctacaccttactacagat

SEQ ID NO: 611095 - DNA, 20 bp, Artificial Sequence
  chemically synthesized
ttgtttgatctacaccttac

SEQ ID NO: 611096 - DNA, 20 bp, Artificial Sequence
  chemically synthesized
ggaaggaacccagagatatg

SEQ ID NO: 611097 - DNA, 20 bp, Artificial Sequence
  chemically synthesized
agtctggaaggaacccagag

SEQ ID NO: 611098 - DNA, 20 bp, Artificial Sequence
  chemically synthesized
ttccttccagactttccatt

SEQ ID NO: 611099 - DNA, 20 bp, Artificial Sequence
  chemically synthesized
accatgcccagcccgaggac

SEQ ID NO: 611100 - DNA, 20 bp, Artificial Sequence
  chemically synthesized
ctcgggctgggcatggtggc

SEQ ID NO: 611101 - DNA, 20 bp, Artificial Sequence
  chemically synthesized
ttttgtgtttttagtagaga

SEQ ID NO: 611102 - DNA, 20 bp, Artificial Sequence
  chemically synthesized
aactatgcctggctaatttt

SEQ ID NO: 611103 - DNA, 20 bp, Artificial Sequence
  chemically synthesized
tgtctcagcctcccgagtag

SEQ ID NO: 611104 - DNA, 20 bp, Artificial Sequence
  chemically synthesized
aacctctgcctcctaggttc

SEQ ID NO: 611105 - DNA, 20 bp, Artificial Sequence
  chemically synthesized
actcagggtttttttgtttt

SEQ ID NO: 611106 - DNA, 20 bp, Artificial Sequence
  chemically synthesized
ctagtcaggactcagggttt

SEQ ID NO: 611107 - DNA, 20 bp, Artificial Sequence
  chemically synthesized
caggagagctagtcaggact

SEQ ID NO: 611108 - DNA, 20 bp, Artificial Sequence
  chemically synthesized
gatagagtttcatttctcct

SEQ ID NO: 611109 - DNA, 20 bp, Artificial Sequence
  chemically synthesized
ggttgatagagtttcatttc

SEQ ID NO: 611110 - DNA, 20 bp, Artificial Sequence
  chemically synthesized
aataggtgaccatcggttga

SEQ ID NO: 611111 - DNA, 20 bp, Artificial Sequence
  chemically synthesized
ccgaagagatggtaggtgaa

SEQ ID NO: 611112 - DNA, 20 bp, Artificial Sequence
  chemically synthesized
tggtgtcaaggactttgtcc

SEQ ID NO: 611113 - DNA, 20 bp, Artificial Sequence
  chemically synthesized
cttctctgcttcccctacta

SEQ ID NO: 611114 - DNA, 20 bp, Artificial Sequence
  chemically synthesized
gattatctagcttatttctt

SEQ ID NO: 611115 - DNA, 20 bp, Artificial Sequence
  chemically synthesized
gaaattaccttgtttgatta

SEQ ID NO: 611116 - DNA, 20 bp, Artificial Sequence
  chemically synthesized
tcattatctgaaattacctt

SEQ ID NO: 611117 - DNA, 20 bp, Artificial Sequence
  chemically synthesized
atcatcattatctgaaatta

SEQ ID NO: 611118 - DNA, 20 bp, Artificial Sequence
  chemically synthesized
aaggtaatttcagataatga

SEQ ID NO: 611119 - DNA, 20 bp, Artificial Sequence
  chemically synthesized
tcctgtatcctattcacact

SEQ ID NO: 611120 - DNA, 20 bp, Artificial Sequence
  chemically synthesized
ttttacatatggtagactgc

SEQ ID NO: 611121 - DNA, 20 bp, Artificial Sequence
  chemically synthesized
aagagggagaagaagtatgt

SEQ ID NO: 611122 - DNA, 20 bp, Artificial Sequence
  chemically synthesized
ccctgtgtgatctgtcccct

SEQ ID NO: 611123 - DNA, 20 bp, Artificial Sequence
  chemically synthesized
aagaccctgtgtgatctgtc

SEQ ID NO: 611124 - DNA, 20 bp, Artificial Sequence
  chemically synthesized
agatcacacagggtcttgct

SEQ ID NO: 611125 - DNA, 20 bp, Artificial Sequence
  chemically synthesized
tataatgcgaagaactgaga

SEQ ID NO: 611126 - DNA, 20 bp, Artificial Sequence
  chemically synthesized
ggaatatgatggagtgtcag

SEQ ID NO: 611127 - DNA, 20 bp, Artificial Sequence
  chemically synthesized
tggtgcttcctttgaataaa

SEQ ID NO: 611128 - DNA, 20 bp, Artificial Sequence
  chemically synthesized
cattttaattgaaaaataaa

SEQ ID NO: 611129 - DNA, 20 bp, Artificial Sequence
  chemically synthesized
ttcaattaaaatgtaacata

SEQ ID NO: 611130 - DNA, 20 bp, Artificial Sequence
  chemically synthesized
tgctaccgctgtacacaatg

SEQ ID NO: 611131 - DNA, 20 bp, Artificial Sequence
  chemically synthesized
acagcttttttcaattaaaa

SEQ ID NO: 611132 - DNA, 20 bp, Artificial Sequence
  chemically synthesized
tctggttcaagtcaattaag

SEQ ID NO: 611133 - DNA, 20 bp, Artificial Sequence
  chemically synthesized
taaacaatacttttgaatga

SEQ ID NO: 611134 - DNA, 20 bp, Artificial Sequence
  chemically synthesized
taatcttcttcattcaaaag

SEQ ID NO: 611135 - DNA, 20 bp, Artificial Sequence
  chemically synthesized
attaaaatgatttaaaagta

SEQ ID NO: 611136 - DNA, 20 bp, Artificial Sequence
  chemically synthesized
gataatatttaataacatta

SEQ ID NO: 611137 - DNA, 20 bp, Artificial Sequence
  chemically synthesized
atctcaggatcttgaagtct

SEQ ID NO: 611138 - DNA, 20 bp, Artificial Sequence
  chemically synthesized
tgaagtctattggattgtta

SEQ ID NO: 611139 - DNA, 20 bp, Artificial Sequence
  chemically synthesized
gagtgcaaaaatatttatag

SEQ ID NO: 611140 - DNA, 20 bp, Artificial Sequence
  chemically synthesized
aaaaatatttatagttatgt

SEQ ID NO: 611141 - DNA, 20 bp, Artificial Sequence
  chemically synthesized
agttatgttttagtttaaag

SEQ ID NO: 611142 - DNA, 20 bp, Artificial Sequence
  chemically synthesized
acaggcaaattatatttaat

SEQ ID NO: 611143 - DNA, 20 bp, Artificial Sequence
  chemically synthesized
ttttcatctctgacactatc

SEQ ID NO: 611144 - DNA, 20 bp, Artificial Sequence
  chemically synthesized
gatagtgtcagagatgaaaa

SEQ ID NO: 611145 - DNA, 20 bp, Artificial Sequence
  chemically synthesized
cagagatgaaaacagtgttt

SEQ ID NO: 611146 - DNA, 20 bp, Artificial Sequence
  chemically synthesized
aatacactaaagcagacaaa

SEQ ID NO: 611147 - DNA, 20 bp, Artificial Sequence
  chemically synthesized
tcatcacttttctcccttag

SEQ ID NO: 611148 - DNA, 20 bp, Artificial Sequence
  chemically synthesized
gctttgaactagagtcatta

SEQ ID NO: 611149 - DNA, 20 bp, Artificial Sequence
  chemically synthesized
ataaggttggtagaccatta

SEQ ID NO: 611150 - DNA, 20 bp, Artificial Sequence
  chemically synthesized
atcaaggtagacacttgaaa

SEQ ID NO: 611151 - DNA, 20 bp, Artificial Sequence
  chemically synthesized
ttaattggaatttgacgtaa

SEQ ID NO: 611152 - DNA, 20 bp, Artificial Sequence
  chemically synthesized
tagagacatgtttttatcgc

SEQ ID NO: 611153 - DNA, 20 bp, Artificial Sequence
  chemically synthesized
ttttggaaaagtcaatagag

SEQ ID NO: 611154 - DNA, 20 bp, Artificial Sequence
  chemically synthesized
ggctggggtttggagagcac

SEQ ID NO: 611155 - DNA, 20 bp, Artificial Sequence
  chemically synthesized
atgaggctggggtttggaga

SEQ ID NO: 611156 - DNA, 20 bp, Artificial Sequence
  chemically synthesized
tcagtaatagtaaatgaggc

SEQ ID NO: 611157 - DNA, 20 bp, Artificial Sequence
  chemically synthesized
acagtactcttagtatttcg

SEQ ID NO: 611158 - DNA, 20 bp, Artificial Sequence
  chemically synthesized
tgcacacagtactcttagta

SEQ ID NO: 611159 - DNA, 20 bp, Artificial Sequence
  chemically synthesized
gagtactgtgtgcaaataaa

SEQ ID NO: 611160 - DNA, 20 bp, Artificial Sequence
  chemically synthesized
gtgtgcaaataaaaaacgtt

SEQ ID NO: 611161 - DNA, 20 bp, Artificial Sequence
  chemically synthesized
ttttttaacagataatcaac

SEQ ID NO: 611162 - DNA, 20 bp, Artificial Sequence
  chemically synthesized
cgggtaatactcattattta

SEQ ID NO: 611163 - DNA, 20 bp, Artificial Sequence
  chemically synthesized
cgcacacaacaacagtatgc

SEQ ID NO: 611164 - DNA, 20 bp, Artificial Sequence
  chemically synthesized
tcattttaaagattttcgtt

SEQ ID NO: 611165 - DNA, 20 bp, Artificial Sequence
  chemically synthesized
tagtaacattttattcattt

SEQ ID NO: 611166 - DNA, 20 bp, Artificial Sequence
  chemically synthesized
aatggactacataattccat

SEQ ID NO: 611167 - DNA, 20 bp, Artificial Sequence
  chemically synthesized
aattccatttgggtttaagt

SEQ ID NO: 611168 - DNA, 20 bp, Artificial Sequence
  chemically synthesized
tccaactaaatggttaaaaa

SEQ ID NO: 611169 - DNA, 20 bp, Artificial Sequence
  chemically synthesized
ttgtctgtgagtatatattt

SEQ ID NO: 611170 - DNA, 20 bp, Artificial Sequence
  chemically synthesized
gattcataagtgttggatga

SEQ ID NO: 611171 - DNA, 20 bp, Artificial Sequence
  chemically synthesized
tgtttggattcataagtgtt

SEQ ID NO: 611172 - DNA, 20 bp, Artificial Sequence
  chemically synthesized
ttgtaaagttttagaaaatg

SEQ ID NO: 611173 - DNA, 20 bp, Artificial Sequence
  chemically synthesized
ctttcttgtaaagttttaga

SEQ ID NO: 611174 - DNA, 20 bp, Artificial Sequence
  chemically synthesized
cattttctaaaactttacaa

SEQ ID NO: 611175 - DNA, 20 bp, Artificial Sequence
  chemically synthesized
aaaacctataagctttcttg

SEQ ID NO: 611176 - DNA, 20 bp, Artificial Sequence
  chemically synthesized
aaaactttacaagaaagctt

SEQ ID NO: 611177 - DNA, 20 bp, Artificial Sequence
  chemically synthesized
ttttaccatgataaaaacct

SEQ ID NO: 611178 - DNA, 20 bp, Artificial Sequence
  chemically synthesized
gcttataaatgattagaatt

SEQ ID NO: 611179 - DNA, 20 bp, Artificial Sequence
  chemically synthesized
ctgataaattgtatgcttat

SEQ ID NO: 611180 - DNA, 20 bp, Artificial Sequence
  chemically synthesized
atacttaatgctgataaatt

SEQ ID NO: 611181 - DNA, 20 bp, Artificial Sequence
  chemically synthesized
ggggagttatttaatggata

SEQ ID NO: 611182 - DNA, 20 bp, Artificial Sequence
  chemically synthesized
actccccataccttctctcc

SEQ ID NO: 611183 - DNA, 20 bp, Artificial Sequence
  chemically synthesized
gccagatacaaaaggataac

SEQ ID NO: 611184 - DNA, 20 bp, Artificial Sequence
  chemically synthesized
tcatatgttatccttttgta

SEQ ID NO: 611185 - DNA, 20 bp, Artificial Sequence
  chemically synthesized
ttccccttagcatatcatca

SEQ ID NO: 611186 - DNA, 20 bp, Artificial Sequence
  chemically synthesized
tactgtatacatttaccaca

SEQ ID NO: 611187 - DNA, 20 bp, Artificial Sequence
  chemically synthesized
ttcaaaatatatttgtacac

SEQ ID NO: 611188 - DNA, 20 bp, Artificial Sequence
  chemically synthesized
atattttgagaaaccaacat

SEQ ID NO: 611189 - DNA, 20 bp, Artificial Sequence
  chemically synthesized
gtcactgtggaaacaaatat

SEQ ID NO: 611190 - DNA, 20 bp, Artificial Sequence
  chemically synthesized
atttgtttccacagtgactg

SEQ ID NO: 611191 - DNA, 20 bp, Artificial Sequence
  chemically synthesized
tcctcaaccatatttatttt

SEQ ID NO: 611192 - DNA, 20 bp, Artificial Sequence
  chemically synthesized
tgggtttttttttttttttt

SEQ ID NO: 611193 - DNA, 20 bp, Artificial Sequence
  chemically synthesized
gcacttcacacccattagga

SEQ ID NO: 611194 - DNA, 20 bp, Artificial Sequence
  chemically synthesized
ggtgtgaagtgctatctcat

SEQ ID NO: 611195 - DNA, 20 bp, Artificial Sequence
  chemically synthesized
atttccctaatgatcagcga

SEQ ID NO: 611196 - DNA, 20 bp, Artificial Sequence
  chemically synthesized
gagttgatcagaaatttctc

SEQ ID NO: 611197 - DNA, 20 bp, Artificial Sequence
  chemically synthesized
catttattcatttttttaat

SEQ ID NO: 611198 - DNA, 20 bp, Artificial Sequence
  chemically synthesized
attggggattacaattcaac

SEQ ID NO: 611199 - DNA, 20 bp, Artificial Sequence
  chemically synthesized
ccagacaccaactccaacat

SEQ ID NO: 611200 - DNA, 20 bp, Artificial Sequence
  chemically synthesized
tggagttggtgtctggtggg

SEQ ID NO: 611201 - DNA, 20 bp, Artificial Sequence
  chemically synthesized
actggggcaaatttctgatg

SEQ ID NO: 611202 - DNA, 20 bp, Artificial Sequence
  chemically synthesized
ctgatgaatggtttagtact

SEQ ID NO: 611203 - DNA, 20 bp, Artificial Sequence
  chemically synthesized
agagagttcttatgaaatct

SEQ ID NO: 611204 - DNA, 20 bp, Artificial Sequence
  chemically synthesized
atgtcatacacttttaaacg

SEQ ID NO: 611205 - DNA, 20 bp, Artificial Sequence
  chemically synthesized
ctgccaggtcacccttccct

SEQ ID NO: 611206 - DNA, 20 bp, Artificial Sequence
  chemically synthesized
gtcacccttccctttctgct

SEQ ID NO: 611207 - DNA, 20 bp, Artificial Sequence
  chemically synthesized
aagcatgatgctggcatctg

SEQ ID NO: 611208 - DNA, 20 bp, Artificial Sequence
  chemically synthesized
aagccgagcagatgccagca

SEQ ID NO: 611209 - DNA, 20 bp, Artificial Sequence
  chemically synthesized
ctgggtaaattataaagaaa

SEQ ID NO: 611210 - DNA, 20 bp, Artificial Sequence
  chemically synthesized
cctcttttctttataattta

SEQ ID NO: 611211 - DNA, 20 bp, Artificial Sequence
  chemically synthesized
atattaattccctattgaat

SEQ ID NO: 611212 - DNA, 20 bp, Artificial Sequence
  chemically synthesized
gcaacttacggaatgggaga

SEQ ID NO: 611213 - DNA, 20 bp, Artificial Sequence
  chemically synthesized
gatggtgttcattcatgcac

SEQ ID NO: 611214 - DNA, 20 bp, Artificial Sequence
  chemically synthesized
cctaatttttctgttgtagc

SEQ ID NO: 611215 - DNA, 20 bp, Artificial Sequence
  chemically synthesized
agatatttaattgcccaatc

SEQ ID NO: 611216 - DNA, 20 bp, Artificial Sequence
  chemically synthesized
ttaattgcccaatctaatgt

SEQ ID NO: 611217 - DNA, 20 bp, Artificial Sequence
  chemically synthesized
atttggaagaaaacataaac

SEQ ID NO: 611218 - DNA, 20 bp, Artificial Sequence
  chemically synthesized
ttatgttttcttccaaatgt

SEQ ID NO: 611219 - DNA, 20 bp, Artificial Sequence
  chemically synthesized
taaaagttctgtacttttgg

SEQ ID NO: 611220 - DNA, 20 bp, Artificial Sequence
  chemically synthesized
atttattttaaatgtatata

SEQ ID NO: 611221 - DNA, 20 bp, Artificial Sequence
  chemically synthesized
ttcagtttcttagcaacatt

SEQ ID NO: 611222 - DNA, 20 bp, Artificial Sequence
  chemically synthesized
ataaggttgccaaggttttt

SEQ ID NO: 611223 - DNA, 20 bp, Artificial Sequence
  chemically synthesized
acaattttccataaggttgc

SEQ ID NO: 611224 - DNA, 20 bp, Artificial Sequence
  chemically synthesized
accttggcaaccttatggaa

SEQ ID NO: 611225 - DNA, 20 bp, Artificial Sequence
  chemically synthesized
aattgtttgacaatatatag

SEQ ID NO: 611226 - DNA, 20 bp, Artificial Sequence
  chemically synthesized
ctttttttaagccaatacca

SEQ ID NO: 611227 - DNA, 20 bp, Artificial Sequence
  chemically synthesized
cataatcaaaacactgtggt

SEQ ID NO: 611228 - DNA, 20 bp, Artificial Sequence
  chemically synthesized
tttaagccaataccacagtg

SEQ ID NO: 611229 - DNA, 20 bp, Artificial Sequence
  chemically synthesized
taccacagtgttttgattat

SEQ ID NO: 611230 - DNA, 20 bp, Artificial Sequence
  chemically synthesized
ttgattatggtagctttgta

SEQ ID NO: 611231 - DNA, 20 bp, Artificial Sequence
  chemically synthesized
tgaagttgaagggtcatacg

SEQ ID NO: 611232 - DNA, 20 bp, Artificial Sequence
  chemically synthesized
caacttcattcttttttcaa

SEQ ID NO: 611233 - DNA, 20 bp, Artificial Sequence
  chemically synthesized
tttcaactattcctggatcc

SEQ ID NO: 611234 - DNA, 20 bp, Artificial Sequence
  chemically synthesized
tatttctgcagaaaaactaa

SEQ ID NO: 611235 - DNA, 20 bp, Artificial Sequence
  chemically synthesized
ccatctctaagaaaatccca

SEQ ID NO: 611236 - DNA, 20 bp, Artificial Sequence
  chemically synthesized
cttagagatggcactgaatg

SEQ ID NO: 611237 - DNA, 20 bp, Artificial Sequence
  chemically synthesized
gagatggcactgaatgtgta

SEQ ID NO: 611238 - DNA, 20 bp, Artificial Sequence
  chemically synthesized
taaataaatgaaaaggaacc

SEQ ID NO: 611239 - DNA, 20 bp, Artificial Sequence
  chemically synthesized
tttcatttatttataaaaat

SEQ ID NO: 611240 - DNA, 20 bp, Artificial Sequence
  chemically synthesized
aaataaatgtttaatttctt

SEQ ID NO: 611241 - DNA, 20 bp, Artificial Sequence
  chemically synthesized
aaatgtttaatttctttcag

SEQ ID NO: 611242 - DNA, 20 bp, Artificial Sequence
  chemically synthesized
tttgttactattttaaataa

SEQ ID NO: 611243 - DNA, 20 bp, Artificial Sequence
  chemically synthesized
aacagtgatgcagtccaaaa

SEQ ID NO: 611244 - DNA, 20 bp, Artificial Sequence
  chemically synthesized
aaatataacttatttctgta

SEQ ID NO: 611245 - DNA, 20 bp, Artificial Sequence
  chemically synthesized
attgattttatttactgcaa

SEQ ID NO: 611246 - DNA, 20 bp, Artificial Sequence
  chemically synthesized
tgcttaatttattagttcta

SEQ ID NO: 611247 - DNA, 20 bp, Artificial Sequence
  chemically synthesized
atcttatatgtagaaaattc

SEQ ID NO: 611248 - DNA, 20 bp, Artificial Sequence
  chemically synthesized
atataagatcatatcatctg

SEQ ID NO: 611249 - DNA, 20 bp, Artificial Sequence
  chemically synthesized
agagtgtatgcaaaaatttt

SEQ ID NO: 611250 - DNA, 20 bp, Artificial Sequence
  chemically synthesized
ttttgcatacactctttcaa

SEQ ID NO: 611251 - DNA, 20 bp, Artificial Sequence
  chemically synthesized
ttcaaattttcatcagaaaa

SEQ ID NO: 611252 - DNA, 20 bp, Artificial Sequence
  chemically synthesized
catttgaagtgtactctctt

SEQ ID NO: 611253 - DNA, 20 bp, Artificial Sequence
  chemically synthesized
ttgaggtgatagatatgtta

SEQ ID NO: 611254 - DNA, 20 bp, Artificial Sequence
  chemically synthesized
ggtgatagatatgttaacta

SEQ ID NO: 611255 - DNA, 20 bp, Artificial Sequence
  chemically synthesized
ttgcattctcttaaagtctt

SEQ ID NO: 611256 - DNA, 20 bp, Artificial Sequence
  chemically synthesized
aatgcttgccaacaccattt

SEQ ID NO: 611257 - DNA, 20 bp, Artificial Sequence
  chemically synthesized
tatgtattaatgcggcattg

SEQ ID NO: 611258 - DNA, 20 bp, Artificial Sequence
  chemically synthesized
atgcctataatgcggagtag

SEQ ID NO: 611259 - DNA, 20 bp, Artificial Sequence
  chemically synthesized
ttactatgcctataatgcgg

SEQ ID NO: 611260 - DNA, 20 bp, Artificial Sequence
  chemically synthesized
tccgcattataggcatagta

SEQ ID NO: 611261 - DNA, 20 bp, Artificial Sequence
  chemically synthesized
tagtaataggattacattta

SEQ ID NO: 611262 - DNA, 20 bp, Artificial Sequence
  chemically synthesized
ttttattttaatgttagcgg

SEQ ID NO: 611263 - DNA, 20 bp, Artificial Sequence
  chemically synthesized
ctcaaaaaatactaggtgcc

SEQ ID NO: 611264 - DNA, 20 bp, Artificial Sequence
  chemically synthesized
catttgcatatgggtatata

SEQ ID NO: 611265 - DNA, 20 bp, Artificial Sequence
  chemically synthesized
atattttatgatttttctac

SEQ ID NO: 611266 - DNA, 20 bp, Artificial Sequence
  chemically synthesized
taaaaacttatttggatatt

SEQ ID NO: 611267 - DNA, 20 bp, Artificial Sequence
  chemically synthesized
aaaaatcataaaatatccaa

SEQ ID NO: 611268 - DNA, 20 bp, Artificial Sequence
  chemically synthesized
attcaggaaaaaaaacccca

SEQ ID NO: 611269 - DNA, 20 bp, Artificial Sequence
  chemically synthesized
tataacacggaaaatcattt

SEQ ID NO: 611270 - DNA, 20 bp, Artificial Sequence
  chemically synthesized
tcatactccaaaattgacca

SEQ ID NO: 611271 - DNA, 20 bp, Artificial Sequence
  chemically synthesized
gaacttacagtcttaacaaa

SEQ ID NO: 611272 - DNA, 20 bp, Artificial Sequence
  chemically synthesized
tataagtctagaaaaagtaa

SEQ ID NO: 611273 - DNA, 20 bp, Artificial Sequence
  chemically synthesized
tagacttatagtcccaattc

SEQ ID NO: 611274 - DNA, 20 bp, Artificial Sequence
  chemically synthesized
caagaaaattttgtaatgag

SEQ ID NO: 611275 - DNA, 20 bp, Artificial Sequence
  chemically synthesized
gaggtgggtttttttccact

SEQ ID NO: 611276 - DNA, 20 bp, Artificial Sequence
  chemically synthesized
aaaatgggctccaagtaatt

SEQ ID NO: 611277 - DNA, 20 bp, Artificial Sequence
  chemically synthesized
aatcctattgacaaaatagc

SEQ ID NO: 611278 - DNA, 20 bp, Artificial Sequence
  chemically synthesized
aagctaatgctattttgtca

SEQ ID NO: 611279 - DNA, 20 bp, Artificial Sequence
  chemically synthesized
ttttgtcaataggatttttg

SEQ ID NO: 611280 - DNA, 20 bp, Artificial Sequence
  chemically synthesized
ctataaaacattatgcaagt

SEQ ID NO: 611281 - DNA, 20 bp, Artificial Sequence
  chemically synthesized
agtagaatcaaatacttgca

SEQ ID NO: 611282 - DNA, 20 bp, Artificial Sequence
  chemically synthesized
gattctactgtcacaagaac

SEQ ID NO: 611283 - DNA, 20 bp, Artificial Sequence
  chemically synthesized
gagcatcaggtataacacat

SEQ ID NO: 611284 - DNA, 20 bp, Artificial Sequence
  chemically synthesized
cctactatgtgtctgtaaat

SEQ ID NO: 611285 - DNA, 20 bp, Artificial Sequence
  chemically synthesized
tattgcacctttctcccaaa

SEQ ID NO: 611286 - DNA, 20 bp, Artificial Sequence
  chemically synthesized
agttaagcctttatgaaaat

SEQ ID NO: 611287 - DNA, 20 bp, Artificial Sequence
  chemically synthesized
aaagaatcaattattttcat

SEQ ID NO: 611288 - DNA, 20 bp, Artificial Sequence
  chemically synthesized
agagatatagatataacatt

SEQ ID NO: 611289 - DNA, 20 bp, Artificial Sequence
  chemically synthesized
taactttattcaatttccag

SEQ ID NO: 611290 - DNA, 20 bp, Artificial Sequence
  chemically synthesized
caaagtcaatttacataatg

SEQ ID NO: 611291 - DNA, 20 bp, Artificial Sequence
  chemically synthesized
actggtatccactgacgttt

SEQ ID NO: 611292 - DNA, 20 bp, Artificial Sequence
  chemically synthesized
catattctactggtatccac

SEQ ID NO: 611293 - DNA, 20 bp, Artificial Sequence
  chemically synthesized
agtggataccagtagaatat

SEQ ID NO: 611294 - DNA, 20 bp, Artificial Sequence
  chemically synthesized
ttagtgtctgccatagtaga

SEQ ID NO: 611295 - DNA, 20 bp, Artificial Sequence
  chemically synthesized
aatttcagtcttgttattaa

SEQ ID NO: 611296 - DNA, 20 bp, Artificial Sequence
  chemically synthesized
tatttaataacaagactgaa

SEQ ID NO: 611297 - DNA, 20 bp, Artificial Sequence
  chemically synthesized
atagagctattcatccctgg

SEQ ID NO: 611298 - DNA, 20 bp, Artificial Sequence
  chemically synthesized
atcgtaacaatgaaaaacaa

SEQ ID NO: 611299 - DNA, 20 bp, Artificial Sequence
  chemically synthesized
tatctaacggtataaagcaa

SEQ ID NO: 611300 - DNA, 20 bp, Artificial Sequence
  chemically synthesized
gatacaatctttgcccactc

SEQ ID NO: 611301 - DNA, 20 bp, Artificial Sequence
  chemically synthesized
ttatgaaacccacgagtggg

SEQ ID NO: 611302 - DNA, 20 bp, Artificial Sequence
  chemically synthesized
ttgcccactcgtgggtttca

SEQ ID NO: 611303 - DNA, 20 bp, Artificial Sequence
  chemically synthesized
tcttggtgacaaaattggca

SEQ ID NO: 611304 - DNA, 20 bp, Artificial Sequence
  chemically synthesized
ggggaattaaataatataca

SEQ ID NO: 611305 - DNA, 20 bp, Artificial Sequence
  chemically synthesized
tacattctgacattgaattt

SEQ ID NO: 611306 - DNA, 20 bp, Artificial Sequence
  chemically synthesized
aaattataatcccactggga

SEQ ID NO: 611307 - DNA, 20 bp, Artificial Sequence
  chemically synthesized
ttaagaaaatcgtggtccca

SEQ ID NO: 611308 - DNA, 20 bp, Artificial Sequence
  chemically synthesized
tcaataagaggaaaatatcc

SEQ ID NO: 611309 - DNA, 20 bp, Artificial Sequence
  chemically synthesized
atctggtggtcttctcaatg

SEQ ID NO: 611310 - DNA, 20 bp, Artificial Sequence
  chemically synthesized
ccccattgagaagaccacca

SEQ ID NO: 611311 - DNA, 20 bp, Artificial Sequence
  chemically synthesized
ctctgccatagttaggaact

SEQ ID NO: 611312 - DNA, 20 bp, Artificial Sequence
  chemically synthesized
aaaagctggagaaaggacat

SEQ ID NO: 611313 - DNA, 20 bp, Artificial Sequence
  chemically synthesized
tcaaacaaccatgtcctttc

SEQ ID NO: 611314 - DNA, 20 bp, Artificial Sequence
  chemically synthesized
cctttctccagcttttaaag

SEQ ID NO: 611315 - DNA, 20 bp, Artificial Sequence
  chemically synthesized
aatgcagtggctggctgagt

SEQ ID NO: 611316 - DNA, 20 bp, Artificial Sequence
  chemically synthesized
gtagacaggcatggctatat

SEQ ID NO: 611317 - DNA, 20 bp, Artificial Sequence
  chemically synthesized
catatgcatcacctctacca

SEQ ID NO: 611318 - DNA, 20 bp, Artificial Sequence
  chemically synthesized
caaggcttctaagaagtcac

SEQ ID NO: 611319 - DNA, 20 bp, Artificial Sequence
  chemically synthesized
agtcactgtggcttttctgt

SEQ ID NO: 611320 - DNA, 20 bp, Artificial Sequence
  chemically synthesized
gatgatgatgttttttgttt

SEQ ID NO: 611321 - DNA, 20 bp, Artificial Sequence
  chemically synthesized
tcttcacagatgatgatgtt

SEQ ID NO: 611322 - DNA, 20 bp, Artificial Sequence
  chemically synthesized
tctaccttcttcacagatga

SEQ ID NO: 611323 - DNA, 20 bp, Artificial Sequence
  chemically synthesized
gataaatacctgccgagact

SEQ ID NO: 611324 - DNA, 20 bp, Artificial Sequence
  chemically synthesized
ctggacgatttacaaaagaa

SEQ ID NO: 611325 - DNA, 20 bp, Artificial Sequence
  chemically synthesized
gacatgcctttcgcattctg

SEQ ID NO: 611326 - DNA, 20 bp, Artificial Sequence
  chemically synthesized
tggtaagtctcgtgagatct

SEQ ID NO: 611327 - DNA, 20 bp, Artificial Sequence
  chemically synthesized
atgggggcaggtctttcccg

SEQ ID NO: 611328 - DNA, 20 bp, Artificial Sequence
  chemically synthesized
agcacgggaaagacctgccc

SEQ ID NO: 611329 - DNA, 20 bp, Artificial Sequence
  chemically synthesized
tgttccttattggtgactga

SEQ ID NO: 611330 - DNA, 20 bp, Artificial Sequence
  chemically synthesized
tacctgggctacatataaac

SEQ ID NO: 611331 - DNA, 20 bp, Artificial Sequence
  chemically synthesized
aatagaaaggagcttaaaac

SEQ ID NO: 611332 - DNA, 20 bp, Artificial Sequence
  chemically synthesized
acataagtgccaaaatagaa

SEQ ID NO: 611333 - DNA, 20 bp, Artificial Sequence
  chemically synthesized
cttatgtgttaaagcagcaa

SEQ ID NO: 611334 - DNA, 20 bp, Artificial Sequence
  chemically synthesized
ctgaattagctaaacaacct

SEQ ID NO: 611335 - DNA, 20 bp, Artificial Sequence
  chemically synthesized
ttcagtgacacgagatcaca

SEQ ID NO: 611336 - DNA, 20 bp, Artificial Sequence
  chemically synthesized
acgagatcacactttgtttc

SEQ ID NO: 611337 - DNA, 20 bp, Artificial Sequence
  chemically synthesized
gctcttatatctttccaagg

SEQ ID NO: 611338 - DNA, 20 bp, Artificial Sequence
  chemically synthesized
cacctcaaattctgtggtac

SEQ ID NO: 611339 - DNA, 20 bp, Artificial Sequence
  chemically synthesized
cttatagccaagtgatatat

SEQ ID NO: 611340 - DNA, 20 bp, Artificial Sequence
  chemically synthesized
ttctggtttttcctggatag

SEQ ID NO: 611341 - DNA, 20 bp, Artificial Sequence
  chemically synthesized
gcctcctgtttttttttttt

SEQ ID NO: 611342 - DNA, 20 bp, Artificial Sequence
  chemically synthesized
accagaaaaaaaaaaaaaca

SEQ ID NO: 611343 - DNA, 20 bp, Artificial Sequence
  chemically synthesized
tgtcatatttattataagcc

SEQ ID NO: 611344 - DNA, 20 bp, Artificial Sequence
  chemically synthesized
attttatctttgaaatataa

SEQ ID NO: 611345 - DNA, 20 bp, Artificial Sequence
  chemically synthesized
aaagatgactattccatgaa

SEQ ID NO: 611346 - DNA, 20 bp, Artificial Sequence
  chemically synthesized
tttaagttctaggacagtgg

SEQ ID NO: 611347 - DNA, 20 bp, Artificial Sequence
  chemically synthesized
aggacagtggcaaagttttt

SEQ ID NO: 611348 - DNA, 20 bp, Artificial Sequence
  chemically synthesized
atgcatagtctgtactaagt

SEQ ID NO: 611349 - DNA, 20 bp, Artificial Sequence
  chemically synthesized
gaaccacaaaagggtttcct

SEQ ID NO: 611350 - DNA, 20 bp, Artificial Sequence
  chemically synthesized
tacatgttcctgaaccacaa

SEQ ID NO: 611351 - DNA, 20 bp, Artificial Sequence
  chemically synthesized
caaggttggtgtaactgaag

SEQ ID NO: 611352 - DNA, 20 bp, Artificial Sequence
  chemically synthesized
ggctttctatgcctgccttt

SEQ ID NO: 611353 - DNA, 20 bp, Artificial Sequence
  chemically synthesized
ataaaaggcaggcatagaaa

SEQ ID NO: 611354 - DNA, 20 bp, Artificial Sequence
  chemically synthesized
ggcaggcatagaaagccgga

SEQ ID NO: 611355 - DNA, 20 bp, Artificial Sequence
  chemically synthesized
catgttctttctaaacaaaa

SEQ ID NO: 611356 - DNA, 20 bp, Artificial Sequence
  chemically synthesized
gttgtattaacaagagaatg

SEQ ID NO: 611357 - DNA, 20 bp, Artificial Sequence
  chemically synthesized
tgttcacatgccaccacaat

SEQ ID NO: 611358 - DNA, 20 bp, Artificial Sequence
  chemically synthesized
taattgtggtggcatgtgaa

SEQ ID NO: 611359 - DNA, 20 bp, Artificial Sequence
  chemically synthesized
agataattacagttccctct

SEQ ID NO: 611360 - DNA, 20 bp, Artificial Sequence
  chemically synthesized
ggaactgtaattatctgggc

SEQ ID NO: 611361 - DNA, 20 bp, Artificial Sequence
  chemically synthesized
ggaatagaaaactacattta

SEQ ID NO: 611362 - DNA, 20 bp, Artificial Sequence
  chemically synthesized
ttgtattaaatcattgtaaa

SEQ ID NO: 611363 - DNA, 20 bp, Artificial Sequence
  chemically synthesized
atagtaagaccttagatgta

SEQ ID NO: 611364 - DNA, 20 bp, Artificial Sequence
  chemically synthesized
gtgttcttggagttcctttt

SEQ ID NO: 611365 - DNA, 20 bp, Artificial Sequence
  chemically synthesized
tgatcaattgatgtattaat

SEQ ID NO: 611366 - DNA, 20 bp, Artificial Sequence
  chemically synthesized
ttttgaaagcaatataaata

SEQ ID NO: 611367 - DNA, 20 bp, Artificial Sequence
  chemically synthesized
taaagtaatcgacatattta

SEQ ID NO: 611368 - DNA, 20 bp, Artificial Sequence
  chemically synthesized
atgtacatttggagagggaa

SEQ ID NO: 611369 - DNA, 20 bp, Artificial Sequence
  chemically synthesized
ttagtaatttaatcattcat

SEQ ID NO: 611370 - DNA, 20 bp, Artificial Sequence
  chemically synthesized
gtttaatgaaaaacataaat

SEQ ID NO: 611371 - DNA, 20 bp, Artificial Sequence
  chemically synthesized
tcattaaacatttaagttcc

SEQ ID NO: 611372 - DNA, 20 bp, Artificial Sequence
  chemically synthesized
tcctaaaacagtaggaactt

SEQ ID NO: 611373 - DNA, 20 bp, Artificial Sequence
  chemically synthesized
tgtacaaagtccttaactta

SEQ ID NO: 611374 - DNA, 20 bp, Artificial Sequence
  chemically synthesized
tttatttctagtcctagaat

SEQ ID NO: 611375 - DNA, 20 bp, Artificial Sequence
  chemically synthesized
tctttataggacttgccatg

SEQ ID NO: 611376 - DNA, 20 bp, Artificial Sequence
  chemically synthesized
agaggttggctctacttaag

SEQ ID NO: 611377 - DNA, 20 bp, Artificial Sequence
  chemically synthesized
tttaaatgttcctgtagttg

SEQ ID NO: 611378 - DNA, 20 bp, Artificial Sequence
  chemically synthesized
agagagtcatcacaggattc

SEQ ID NO: 611379 - DNA, 20 bp, Artificial Sequence
  chemically synthesized
gttttctccagagagtcatc

SEQ ID NO: 611380 - DNA, 20 bp, Artificial Sequence
  chemically synthesized
gctgatcctttaatatggaa

SEQ ID NO: 611381 - DNA, 20 bp, Artificial Sequence
  chemically synthesized
gaagtgaaggcatggagagc

SEQ ID NO: 611382 - DNA, 20 bp, Artificial Sequence
  chemically synthesized
attagcgcatgcaatattaa

SEQ ID NO: 611383 - DNA, 20 bp, Artificial Sequence
  chemically synthesized
tgattacaaagttactttaa

SEQ ID NO: 611384 - DNA, 20 bp, Artificial Sequence
  chemically synthesized
acaaagttactttaaactgg

SEQ ID NO: 611385 - DNA, 20 bp, Artificial Sequence
  chemically synthesized
ttcactggagataaagctaa

SEQ ID NO: 611386 - DNA, 20 bp, Artificial Sequence
  chemically synthesized
atttgtctgtggtctctgaa

SEQ ID NO: 611387 - DNA, 20 bp, Artificial Sequence
  chemically synthesized
aaaatgtttagatgtagtcc

SEQ ID NO: 611388 - DNA, 20 bp, Artificial Sequence
  chemically synthesized
ctacatctaaacattttttg

SEQ ID NO: 611389 - DNA, 20 bp, Artificial Sequence
  chemically synthesized
gaaatattaatccttccaaa

SEQ ID NO: 611390 - DNA, 20 bp, Artificial Sequence
  chemically synthesized
tagactcatcttaattttca

SEQ ID NO: 611391 - DNA, 20 bp, Artificial Sequence
  chemically synthesized
gccagccttagaaagactga

SEQ ID NO: 611392 - DNA, 20 bp, Artificial Sequence
  chemically synthesized
gacaaactttcatttactta

SEQ ID NO: 611393 - DNA, 20 bp, Artificial Sequence
  chemically synthesized
ctgaaactgattaagtaaat

SEQ ID NO: 611394 - DNA, 20 bp, Artificial Sequence
  chemically synthesized
tttgctaggtttgtagtggc

SEQ ID NO: 611395 - DNA, 20 bp, Artificial Sequence
  chemically synthesized
acttagtttgctaggtttgt

SEQ ID NO: 611396 - DNA, 20 bp, Artificial Sequence
  chemically synthesized
actacaaacctagcaaacta

SEQ ID NO: 611397 - DNA, 20 bp, Artificial Sequence
  chemically synthesized
ttagaaatctacttagtttg

SEQ ID NO: 611398 - DNA, 20 bp, Artificial Sequence
  chemically synthesized
ctgaaaactttagaaatcta

SEQ ID NO: 611399 - DNA, 20 bp, Artificial Sequence
  chemically synthesized
tagcaaactaagtagatttc

SEQ ID NO: 611400 - DNA, 20 bp, Artificial Sequence
  chemically synthesized
tgtcaatgatgagatgacat

SEQ ID NO: 611401 - DNA, 20 bp, Artificial Sequence
  chemically synthesized
tgtgtgtgtgtattaacaaa

SEQ ID NO: 611402 - DNA, 20 bp, Artificial Sequence
  chemically synthesized
ctactccttctgtgccccaa

SEQ ID NO: 611403 - DNA, 20 bp, Artificial Sequence
  chemically synthesized
atcacagcccttgatataat

SEQ ID NO: 611404 - DNA, 20 bp, Artificial Sequence
  chemically synthesized
aactactattatatcaaggg

SEQ ID NO: 611405 - DNA, 20 bp, Artificial Sequence
  chemically synthesized
gtgatgactctccaaaatat

SEQ ID NO: 611406 - DNA, 20 bp, Artificial Sequence
  chemically synthesized
cttttagtttgagcatgtca

SEQ ID NO: 611407 - DNA, 20 bp, Artificial Sequence
  chemically synthesized
tctcattcttgatcagtgct

SEQ ID NO: 611408 - DNA, 20 bp, Artificial Sequence
  chemically synthesized
aaaatcctctcattcttgat

SEQ ID NO: 611409 - DNA, 20 bp, Artificial Sequence
  chemically synthesized
aaaagcactgatcaagaatg

SEQ ID NO: 611410 - DNA, 20 bp, Artificial Sequence
  chemically synthesized
actgatcaagaatgagagga

SEQ ID NO: 611411 - DNA, 20 bp, Artificial Sequence
  chemically synthesized
agaggattttgttttatctt

SEQ ID NO: 611412 - DNA, 20 bp, Artificial Sequence
  chemically synthesized
tttttatctttttgacttgg

SEQ ID NO: 611413 - DNA, 20 bp, Artificial Sequence
  chemically synthesized
ctaggaggtcctaactaagc

SEQ ID NO: 611414 - DNA, 20 bp, Artificial Sequence
  chemically synthesized
atagtcagagtatcaaaatc

SEQ ID NO: 611415 - DNA, 20 bp, Artificial Sequence
  chemically synthesized
tcttcttctgtaccggtttc

SEQ ID NO: 611416 - DNA, 20 bp, Artificial Sequence
  chemically synthesized
ctagttctatcttcttctgt

SEQ ID NO: 611417 - DNA, 20 bp, Artificial Sequence
  chemically synthesized
tatctgctttaggaaatagc

SEQ ID NO: 611418 - DNA, 20 bp, Artificial Sequence
  chemically synthesized
tcagaaacttttacagcagt

SEQ ID NO: 611419 - DNA, 20 bp, Artificial Sequence
  chemically synthesized
cctaaagcagatactgctgt

SEQ ID NO: 611420 - DNA, 20 bp, Artificial Sequence
  chemically synthesized
gcagatactgctgtaaaagt

SEQ ID NO: 611421 - DNA, 20 bp, Artificial Sequence
  chemically synthesized
ctgaggtcatttaaacaggt

SEQ ID NO: 611422 - DNA, 20 bp, Artificial Sequence
  chemically synthesized
cattcaaaaatgaagcaaag

SEQ ID NO: 611423 - DNA, 20 bp, Artificial Sequence
  chemically synthesized
tgggccaataggccctccaa

SEQ ID NO: 611424 - DNA, 20 bp, Artificial Sequence
  chemically synthesized
cctttcctaaccttttcttt

SEQ ID NO: 611425 - DNA, 20 bp, Artificial Sequence
  chemically synthesized
tgctattgctgatttttaaa

SEQ ID NO: 611426 - DNA, 20 bp, Artificial Sequence
  chemically synthesized
gttattgtaactcatgctat

SEQ ID NO: 611427 - DNA, 20 bp, Artificial Sequence
  chemically synthesized
aatgaggaaactgacgaact

SEQ ID NO: 611428 - DNA, 20 bp, Artificial Sequence
  chemically synthesized
tttacacaagcaattagttc

SEQ ID NO: 611429 - DNA, 20 bp, Artificial Sequence
  chemically synthesized
tgacgaactaattgcttgtg

SEQ ID NO: 611430 - DNA, 20 bp, Artificial Sequence
  chemically synthesized
acatctggtaggtagcagag

SEQ ID NO: 611431 - DNA, 20 bp, Artificial Sequence
  chemically synthesized
ctttactcttacatagaggt

SEQ ID NO: 611432 - DNA, 20 bp, Artificial Sequence
  chemically synthesized
ttaactctttaggatacagg

SEQ ID NO: 611433 - DNA, 20 bp, Artificial Sequence
  chemically synthesized
tatattaactctttaggata

SEQ ID NO: 611434 - DNA, 20 bp, Artificial Sequence
  chemically synthesized
ttatgcttggcataagggac

SEQ ID NO: 611435 - DNA, 20 bp, Artificial Sequence
  chemically synthesized
atgttagccatcacgggtaa

SEQ ID NO: 611436 - DNA, 20 bp, Artificial Sequence
  chemically synthesized
acccgtgatggctaacataa

SEQ ID NO: 611437 - DNA, 20 bp, Artificial Sequence
  chemically synthesized
ttgatatgtttattttcccc

SEQ ID NO: 611438 - DNA, 20 bp, Artificial Sequence
  chemically synthesized
tggggaaaataaacatatca

SEQ ID NO: 611439 - DNA, 20 bp, Artificial Sequence
  chemically synthesized
acttgagcttaaacaatttg

SEQ ID NO: 611440 - DNA, 20 bp, Artificial Sequence
  chemically synthesized
tatcaaattgtttaagctca

SEQ ID NO: 611441 - DNA, 20 bp, Artificial Sequence
  chemically synthesized
ccgagtttctgtaaatctac

SEQ ID NO: 611442 - DNA, 20 bp, Artificial Sequence
  chemically synthesized
cttggaacacatgagtttgc

SEQ ID NO: 611443 - DNA, 20 bp, Artificial Sequence
  chemically synthesized
gtggtgttatcttggaacac

SEQ ID NO: 611444 - DNA, 20 bp, Artificial Sequence
  chemically synthesized
ctctcgacagattggtcaga

SEQ ID NO: 611445 - DNA, 20 bp, Artificial Sequence
  chemically synthesized
atggttctaagtatgctctc

SEQ ID NO: 611446 - DNA, 20 bp, Artificial Sequence
  chemically synthesized
agcatgacggaaggatactt

SEQ ID NO: 611447 - DNA, 20 bp, Artificial Sequence
  chemically synthesized
ctatgactattccctgaagg

SEQ ID NO: 611448 - DNA, 20 bp, Artificial Sequence
  chemically synthesized
ttccctgtaaatttaacaag

SEQ ID NO: 611449 - DNA, 20 bp, Artificial Sequence
  chemically synthesized
aaggtgttgatcacccaaag

SEQ ID NO: 611450 - DNA, 20 bp, Artificial Sequence
  chemically synthesized
ctttgactggaggacattac

SEQ ID NO: 611451 - DNA, 20 bp, Artificial Sequence
  chemically synthesized
ggctttcagtcagctctact

SEQ ID NO: 611452 - DNA, 20 bp, Artificial Sequence
  chemically synthesized
tctctcgctagctataaata

SEQ ID NO: 611453 - DNA, 20 bp, Artificial Sequence
  chemically synthesized
ggtgatggatgccctaattt

SEQ ID NO: 611454 - DNA, 20 bp, Artificial Sequence
  chemically synthesized
atttagctaacataaatgat

SEQ ID NO: 611455 - DNA, 20 bp, Artificial Sequence
  chemically synthesized
tagtgtttggtagcacccta

SEQ ID NO: 611456 - DNA, 20 bp, Artificial Sequence
  chemically synthesized
agggtgctaccaaacactag

SEQ ID NO: 611457 - DNA, 20 bp, Artificial Sequence
  chemically synthesized
tagatagaaggaatcagatc

SEQ ID NO: 611458 - DNA, 20 bp, Artificial Sequence
  chemically synthesized
atatttgtgtctctgtgcct

SEQ ID NO: 611459 - DNA, 20 bp, Artificial Sequence
  chemically synthesized
gatttcacttaacaatgtcc

SEQ ID NO: 611460 - DNA, 20 bp, Artificial Sequence
  chemically synthesized
actaagaaagagcactccag

SEQ ID NO: 611461 - DNA, 20 bp, Artificial Sequence
  chemically synthesized
gctcctctggagtgctcttt

SEQ ID NO: 611462 - DNA, 20 bp, Artificial Sequence
  chemically synthesized
ttcaatactatattttctga

SEQ ID NO: 611463 - DNA, 20 bp, Artificial Sequence
  chemically synthesized
ggaatagatcagatgccaga

SEQ ID NO: 611464 - DNA, 20 bp, Artificial Sequence
  chemically synthesized
attccatttgaatttctgct

SEQ ID NO: 611465 - DNA, 20 bp, Artificial Sequence
  chemically synthesized
tttgaatttctgctctgggc

SEQ ID NO: 611466 - DNA, 20 bp, Artificial Sequence
  chemically synthesized
tcctatgttcctatcattta

SEQ ID NO: 611467 - DNA, 20 bp, Artificial Sequence
  chemically synthesized
aatgataggaacataggaaa

SEQ ID NO: 611468 - DNA, 20 bp, Artificial Sequence
  chemically synthesized
atgtacattatataaagatg

SEQ ID NO: 611469 - DNA, 20 bp, Artificial Sequence
  chemically synthesized
cctgctaaagggcaagggtt

SEQ ID NO: 611470 - DNA, 20 bp, Artificial Sequence
  chemically synthesized
aagaaggggtacttggtaaa

SEQ ID NO: 611471 - DNA, 20 bp, Artificial Sequence
  chemically synthesized
tggagaagttgcatcttacg

SEQ ID NO: 611472 - DNA, 20 bp, Artificial Sequence
  chemically synthesized
agatgcaacttctccattaa

SEQ ID NO: 611473 - DNA, 20 bp, Artificial Sequence
  chemically synthesized
tgtaattgactgtggactta

SEQ ID NO: 611474 - DNA, 20 bp, Artificial Sequence
  chemically synthesized
cacagtcaattacactgaaa

SEQ ID NO: 611475 - DNA, 20 bp, Artificial Sequence
  chemically synthesized
acttaagatgctcttggaat

SEQ ID NO: 611476 - DNA, 20 bp, Artificial Sequence
  chemically synthesized
ccaagagcatcttaagttaa

SEQ ID NO: 611477 - DNA, 20 bp, Artificial Sequence
  chemically synthesized
aactacctagaaagaataaa

SEQ ID NO: 611478 - DNA, 20 bp, Artificial Sequence
  chemically synthesized
actgggtaatttagaaagaa

SEQ ID NO: 611479 - DNA, 20 bp, Artificial Sequence
  chemically synthesized
atttagaaagaaagaggttt

SEQ ID NO: 611480 - DNA, 20 bp, Artificial Sequence
  chemically synthesized
caccatgattttaactttcc

SEQ ID NO: 611481 - DNA, 20 bp, Artificial Sequence
  chemically synthesized
tgcttcccctttgcctttca

SEQ ID NO: 611482 - DNA, 20 bp, Artificial Sequence
  chemically synthesized
tgccacctagtgaagagagt

SEQ ID NO: 611483 - DNA, 20 bp, Artificial Sequence
  chemically synthesized
ctcctgccacctagtgaaga

SEQ ID NO: 611484 - DNA, 20 bp, Artificial Sequence
  chemically synthesized
tgatagttctcacaagttct

SEQ ID NO: 611485 - DNA, 20 bp, Artificial Sequence
  chemically synthesized
cagttccctcccttgacacg

SEQ ID NO: 611486 - DNA, 20 bp, Artificial Sequence
  chemically synthesized
aggggccgggagcagaatga

SEQ ID NO: 611487 - DNA, 20 bp, Artificial Sequence
  chemically synthesized
tgttttgaaatgtgatgaca

SEQ ID NO: 611488 - DNA, 20 bp, Artificial Sequence
  chemically synthesized
agactgttgggaaggcatga

SEQ ID NO: 611489 - DNA, 20 bp, Artificial Sequence
  chemically synthesized
ttaagtcaaaattccaagtc

SEQ ID NO: 611490 - DNA, 20 bp, Artificial Sequence
  chemically synthesized
actagcttgcttttggtttt

SEQ ID NO: 611491 - DNA, 20 bp, Artificial Sequence
  chemically synthesized
ttggaagtaactagcttgct

SEQ ID NO: 611492 - DNA, 20 bp, Artificial Sequence
  chemically synthesized
ttgtaccttggaagtaacta

SEQ ID NO: 611493 - DNA, 20 bp, Artificial Sequence
  chemically synthesized
tgcattgtaccttggaagta

SEQ ID NO: 611494 - DNA, 20 bp, Artificial Sequence
  chemically synthesized
tgcaggtataagtattgggt

SEQ ID NO: 611495 - DNA, 20 bp, Artificial Sequence
  chemically synthesized
cctgtgtctactttgctttg

SEQ ID NO: 611496 - DNA, 20 bp, Artificial Sequence
  chemically synthesized
ttgcgtgggacctgtgtcta

SEQ ID NO: 611497 - DNA, 20 bp, Artificial Sequence
  chemically synthesized
aaagtagacacaggtcccac

SEQ ID NO: 611498 - DNA, 20 bp, Artificial Sequence
  chemically synthesized
gatttgggagctttaagatt

SEQ ID NO: 611499 - DNA, 20 bp, Artificial Sequence
  chemically synthesized
tcaaggcagatttgggagct

SEQ ID NO: 611500 - DNA, 20 bp, Artificial Sequence
  chemically synthesized
catggagtcaaggcagattt

SEQ ID NO: 611501 - DNA, 20 bp, Artificial Sequence
  chemically synthesized
gatatgagacatggagtcaa

SEQ ID NO: 611502 - DNA, 20 bp, Artificial Sequence
  chemically synthesized
gctctgcagagcacagcccc

SEQ ID NO: 611503 - DNA, 20 bp, Artificial Sequence
  chemically synthesized
cccatggctttcacagtgcc

SEQ ID NO: 611504 - DNA, 20 bp, Artificial Sequence
  chemically synthesized
agacttctacctgaacatcc

SEQ ID NO: 611505 - DNA, 20 bp, Artificial Sequence
  chemically synthesized
gctgtgcagaaggcaagaaa

SEQ ID NO: 611506 - DNA, 20 bp, Artificial Sequence
  chemically synthesized
gaacaccacatggaagctgc

SEQ ID NO: 611507 - DNA, 20 bp, Artificial Sequence
  chemically synthesized
acatggaagctgccaaggct

SEQ ID NO: 611508 - DNA, 20 bp, Artificial Sequence
  chemically synthesized
gggtgcaagccccaagcctt

SEQ ID NO: 611509 - DNA, 20 bp, Artificial Sequence
  chemically synthesized
ggccaaggtacatcttgcac

SEQ ID NO: 611510 - DNA, 20 bp, Artificial Sequence
  chemically synthesized
gacctggcttcctgtgtcct

SEQ ID NO: 611511 - DNA, 20 bp, Artificial Sequence
  chemically synthesized
tgctctgtgcagccttggga

SEQ ID NO: 611512 - DNA, 20 bp, Artificial Sequence
  chemically synthesized
ccagaggcctagaagggaaa

SEQ ID NO: 611513 - DNA, 20 bp, Artificial Sequence
  chemically synthesized
aggtctctgacataccctga

SEQ ID NO: 611514 - DNA, 20 bp, Artificial Sequence
  chemically synthesized
cattgtcttggctactaaca

SEQ ID NO: 611515 - DNA, 20 bp, Artificial Sequence
  chemically synthesized
tacttatgcaaatttctgca

SEQ ID NO: 611516 - DNA, 20 bp, Artificial Sequence
  chemically synthesized
cttgacttactccctagaaa

SEQ ID NO: 611517 - DNA, 20 bp, Artificial Sequence
  chemically synthesized
aaattttccaaacttttatg

SEQ ID NO: 611518 - DNA, 20 bp, Artificial Sequence
  chemically synthesized
ttaaaaggaaagcagagcat

SEQ ID NO: 611519 - DNA, 20 bp, Artificial Sequence
  chemically synthesized
tacggttatatgcgttcaca

SEQ ID NO: 611520 - DNA, 20 bp, Artificial Sequence
  chemically synthesized
ctctgtgaacgcatataacc

SEQ ID NO: 611521 - DNA, 20 bp, Artificial Sequence
  chemically synthesized
aagtcacatcttgaatgcct

SEQ ID NO: 611522 - DNA, 20 bp, Artificial Sequence
  chemically synthesized
atcttgaatgccttgctgct

SEQ ID NO: 611523 - DNA, 20 bp, Artificial Sequence
  chemically synthesized
tgtggaactttgaacttgag

SEQ ID NO: 611524 - DNA, 20 bp, Artificial Sequence
  chemically synthesized
actcttgctatgctttagca

SEQ ID NO: 611525 - DNA, 20 bp, Artificial Sequence
  chemically synthesized
tggagtaaaagtgactcttg

SEQ ID NO: 611526 - DNA, 20 bp, Artificial Sequence
  chemically synthesized
aatttcccagagacttgttg

SEQ ID NO: 611527 - DNA, 20 bp, Artificial Sequence
  chemically synthesized
aagaagacagaaagatgagg

SEQ ID NO: 611528 - DNA, 20 bp, Artificial Sequence
  chemically synthesized
ccactatctgggcaccaatt

SEQ ID NO: 611529 - DNA, 20 bp, Artificial Sequence
  chemically synthesized
ggcaccaattttctgtttta

SEQ ID NO: 611530 - DNA, 20 bp, Artificial Sequence
  chemically synthesized
ttgggtaatttataagtaaa

SEQ ID NO: 611531 - DNA, 20 bp, Artificial Sequence
  chemically synthesized
cttcaccttccaccatgatt

SEQ ID NO: 611532 - DNA, 20 bp, Artificial Sequence
  chemically synthesized
tgcttccccttcaccttcca

SEQ ID NO: 611533 - DNA, 20 bp, Artificial Sequence
  chemically synthesized
cactgccctgtgaagaaggt

SEQ ID NO: 611534 - DNA, 20 bp, Artificial Sequence
  chemically synthesized
tgtgaatgctcatgtgatct

SEQ ID NO: 611535 - DNA, 20 bp, Artificial Sequence
  chemically synthesized
agagggagggtcctggtggg

SEQ ID NO: 611536 - DNA, 20 bp, Artificial Sequence
  chemically synthesized
caggaccctccctctacacg

SEQ ID NO: 611537 - DNA, 20 bp, Artificial Sequence
  chemically synthesized
caacttattaatgcagaata

SEQ ID NO: 611538 - DNA, 20 bp, Artificial Sequence
  chemically synthesized
aatacaatgagaaattttcc

SEQ ID NO: 611539 - DNA, 20 bp, Artificial Sequence
  chemically synthesized
gcatttgagaacatcagtgg

SEQ ID NO: 611540 - DNA, 20 bp, Artificial Sequence
  chemically synthesized
attaagcatttgagaacatc

SEQ ID NO: 611541 - DNA, 20 bp, Artificial Sequence
  chemically synthesized
actaaaccactgatgttctc

SEQ ID NO: 611542 - DNA, 20 bp, Artificial Sequence
  chemically synthesized
gcatatttttggttggatga

SEQ ID NO: 611543 - DNA, 20 bp, Artificial Sequence
  chemically synthesized
acaagcatatttttggttgg

SEQ ID NO: 611544 - DNA, 20 bp, Artificial Sequence
  chemically synthesized
acaaactcatccaaccaaaa

SEQ ID NO: 611545 - DNA, 20 bp, Artificial Sequence
  chemically synthesized
atatgcttgtgcatgaaagc

SEQ ID NO: 611546 - DNA, 20 bp, Artificial Sequence
  chemically synthesized
actttttgtaaccataaaac

SEQ ID NO: 611547 - DNA, 20 bp, Artificial Sequence
  chemically synthesized
gttttccttatttcatacta

SEQ ID NO: 611548 - DNA, 20 bp, Artificial Sequence
  chemically synthesized
ttatcagtgcatagaatgca

SEQ ID NO: 611549 - DNA, 20 bp, Artificial Sequence
  chemically synthesized
atatacttttttatgaccca

SEQ ID NO: 611550 - DNA, 20 bp, Artificial Sequence
  chemically synthesized
atgggtcataaaaaagtata

SEQ ID NO: 611551 - DNA, 20 bp, Artificial Sequence
  chemically synthesized
agcataaatttgtctttttt

SEQ ID NO: 611552 - DNA, 20 bp, Artificial Sequence
  chemically synthesized
gctccacaattatctgagta

SEQ ID NO: 611553 - DNA, 20 bp, Artificial Sequence
  chemically synthesized
tcaattaaaaacgagcactg

SEQ ID NO: 611554 - DNA, 20 bp, Artificial Sequence
  chemically synthesized
atccagctaatcttatcagt

SEQ ID NO: 611555 - DNA, 20 bp, Artificial Sequence
  chemically synthesized
aacgagcactgataagatta

SEQ ID NO: 611556 - DNA, 20 bp, Artificial Sequence
  chemically synthesized
ttagctggatttctaggtca

SEQ ID NO: 611557 - DNA, 20 bp, Artificial Sequence
  chemically synthesized
tccagtctgtatccctagat

SEQ ID NO: 611558 - DNA, 20 bp, Artificial Sequence
  chemically synthesized
tacagactggactggaagtt

SEQ ID NO: 611559 - DNA, 20 bp, Artificial Sequence
  chemically synthesized
ggactggaagttcctagttt

SEQ ID NO: 611560 - DNA, 20 bp, Artificial Sequence
  chemically synthesized
ggaagttcctagtttttaag

SEQ ID NO: 611561 - DNA, 20 bp, Artificial Sequence
  chemically synthesized
cccattaatttcctagcttg

SEQ ID NO: 611562 - DNA, 20 bp, Artificial Sequence
  chemically synthesized
ttgcatcctcccattaattt

SEQ ID NO: 611563 - DNA, 20 bp, Artificial Sequence
  chemically synthesized
aaattccatacttgcttaaa

SEQ ID NO: 611564 - DNA, 20 bp, Artificial Sequence
  chemically synthesized
agttttctgagaaattccat

SEQ ID NO: 611565 - DNA, 20 bp, Artificial Sequence
  chemically synthesized
ttaaaatttttgctttgagg

SEQ ID NO: 611566 - DNA, 20 bp, Artificial Sequence
  chemically synthesized
ttaacctcaaagcaaaaatt

SEQ ID NO: 611567 - DNA, 20 bp, Artificial Sequence
  chemically synthesized
cctcaaagcaaaaattttaa

SEQ ID NO: 611568 - DNA, 20 bp, Artificial Sequence
  chemically synthesized
accataaacaatcttaaaat

SEQ ID NO: 611569 - DNA, 20 bp, Artificial Sequence
  chemically synthesized
atttcagtcattggggaaag

SEQ ID NO: 611570 - DNA, 20 bp, Artificial Sequence
  chemically synthesized
agttatgcttccttcagatg

SEQ ID NO: 611571 - DNA, 20 bp, Artificial Sequence
  chemically synthesized
cctgaattcagaggtcttat

SEQ ID NO: 611572 - DNA, 20 bp, Artificial Sequence
  chemically synthesized
gacctctgaattcaggactt

SEQ ID NO: 611573 - DNA, 20 bp, Artificial Sequence
  chemically synthesized
tctgttaaaagtttaaaaaa

SEQ ID NO: 611574 - DNA, 20 bp, Artificial Sequence
  chemically synthesized
tcggtattttttaaactttt

SEQ ID NO: 611575 - DNA, 20 bp, Artificial Sequence
  chemically synthesized
atagaaaggagtaatctgtt

SEQ ID NO: 611576 - DNA, 20 bp, Artificial Sequence
  chemically synthesized
ctaaataccaattggaaagg

SEQ ID NO: 611577 - DNA, 20 bp, Artificial Sequence
  chemically synthesized
atttccttgcagaagaatgt

SEQ ID NO: 611578 - DNA, 20 bp, Artificial Sequence
  chemically synthesized
ttcttctgcaaggaaatttc

SEQ ID NO: 611579 - DNA, 20 bp, Artificial Sequence
  chemically synthesized
aaaaacagttgggctgtttc

SEQ ID NO: 611580 - DNA, 20 bp, Artificial Sequence
  chemically synthesized
ataagcatttgaaacagccc

SEQ ID NO: 611581 - DNA, 20 bp, Artificial Sequence
  chemically synthesized
taagtatgcaaaaacagttg

SEQ ID NO: 611582 - DNA, 20 bp, Artificial Sequence
  chemically synthesized
gaatgtatacttgatactta

SEQ ID NO: 611583 - DNA, 20 bp, Artificial Sequence
  chemically synthesized
ttttttagaattcttgctgg

SEQ ID NO: 611584 - DNA, 20 bp, Artificial Sequence
  chemically synthesized
tcagttttttagaattcttg

SEQ ID NO: 611585 - DNA, 20 bp, Artificial Sequence
  chemically synthesized
ccagtaatattcagacatat

SEQ ID NO: 611586 - DNA, 20 bp, Artificial Sequence
  chemically synthesized
aaagagactgtaggtgagac

SEQ ID NO: 611587 - DNA, 20 bp, Artificial Sequence
  chemically synthesized
ctgggcttcatatggttcaa

SEQ ID NO: 611588 - DNA, 20 bp, Artificial Sequence
  chemically synthesized
ttttcagggaatattatcct

SEQ ID NO: 611589 - DNA, 20 bp, Artificial Sequence
  chemically synthesized
ataatattccctgaaaacag

SEQ ID NO: 611590 - DNA, 20 bp, Artificial Sequence
  chemically synthesized
tgtttagcagtagaaatccc

SEQ ID NO: 611591 - DNA, 20 bp, Artificial Sequence
  chemically synthesized
cgaggatctgacattttaaa

SEQ ID NO: 611592 - DNA, 20 bp, Artificial Sequence
  chemically synthesized
ctttcgtctagggtgaggga

SEQ ID NO: 611593 - DNA, 20 bp, Artificial Sequence
  chemically synthesized
agtttttcccttcgtgcctt

SEQ ID NO: 611594 - DNA, 20 bp, Artificial Sequence
  chemically synthesized
gctggacttctaccattgag

SEQ ID NO: 611595 - DNA, 20 bp, Artificial Sequence
  chemically synthesized
tggtctgttgtacttggctg

SEQ ID NO: 611596 - DNA, 20 bp, Artificial Sequence
  chemically synthesized
tctctgtagttttttttctg

SEQ ID NO: 611597 - DNA, 20 bp, Artificial Sequence
  chemically synthesized
ttgaatactactgcactctc

SEQ ID NO: 611598 - DNA, 20 bp, Artificial Sequence
  chemically synthesized
taacatattcccaaaatctt

SEQ ID NO: 611599 - DNA, 20 bp, Artificial Sequence
  chemically synthesized
atttgtcttgttttaagcca

SEQ ID NO: 611600 - DNA, 20 bp, Artificial Sequence
  chemically synthesized
ttaatggcttaaaacaagac

SEQ ID NO: 611601 - DNA, 20 bp, Artificial Sequence
  chemically synthesized
gctgtaagataaaacatttg

SEQ ID NO: 611602 - DNA, 20 bp, Artificial Sequence
  chemically synthesized
agactaaactcaagcaacag

SEQ ID NO: 611603 - DNA, 20 bp, Artificial Sequence
  chemically synthesized
gaacaaagccctgctgttgc

SEQ ID NO: 611604 - DNA, 20 bp, Artificial Sequence
  chemically synthesized
agaaaggaacaaagccctgc

SEQ ID NO: 611605 - DNA, 20 bp, Artificial Sequence
  chemically synthesized
tctggaaattctagaagaga

SEQ ID NO: 611606 - DNA, 20 bp, Artificial Sequence
  chemically synthesized
gatcatgtttctttcccttt

SEQ ID NO: 611607 - DNA, 20 bp, Artificial Sequence
  chemically synthesized
gaaagactatacctactgtt

SEQ ID NO: 611608 - DNA, 20 bp, Artificial Sequence
  chemically synthesized
tgcacactatgtagtcaccg

SEQ ID NO: 611609 - DNA, 20 bp, Artificial Sequence
  chemically synthesized
aaaatagggagggagattaa

SEQ ID NO: 611610 - DNA, 20 bp, Artificial Sequence
  chemically synthesized
agctgatcttaaaataggga

SEQ ID NO: 611611 - DNA, 20 bp, Artificial Sequence
  chemically synthesized
tgtactatactcacaggttc

SEQ ID NO: 611612 - DNA, 20 bp, Artificial Sequence
  chemically synthesized
ccagcatccaactaccaaag

SEQ ID NO: 611613 - DNA, 20 bp, Artificial Sequence
  chemically synthesized
ccaaaggagagtttaaatat

SEQ ID NO: 611614 - DNA, 20 bp, Artificial Sequence
  chemically synthesized
tactcaatatgatacgactt

SEQ ID NO: 611615 - DNA, 20 bp, Artificial Sequence
  chemically synthesized
aagtcgtatcatattgagta

SEQ ID NO: 611616 - DNA, 20 bp, Artificial Sequence
  chemically synthesized
tagtcaaatttattacaggc

SEQ ID NO: 611617 - DNA, 20 bp, Artificial Sequence
  chemically synthesized
taataaatttgactaaatta

SEQ ID NO: 611618 - DNA, 20 bp, Artificial Sequence
  chemically synthesized
atgaacaattagcttaaata

SEQ ID NO: 611619 - DNA, 20 bp, Artificial Sequence
  chemically synthesized
aaataattcatacatgaaca

SEQ ID NO: 611620 - DNA, 20 bp, Artificial Sequence
  chemically synthesized
acagtagctcacacaattcc

SEQ ID NO: 611621 - DNA, 20 bp, Artificial Sequence
  chemically synthesized
gctcacacaattccaagaga

SEQ ID NO: 611622 - DNA, 20 bp, Artificial Sequence
  chemically synthesized
gtcctattcatcccctttat

SEQ ID NO: 611623 - DNA, 20 bp, Artificial Sequence
  chemically synthesized
gtcgcacattccctttttca

SEQ ID NO: 611624 - DNA, 20 bp, Artificial Sequence
  chemically synthesized
cctttttcatgaggttttta

SEQ ID NO: 611625 - DNA, 20 bp, Artificial Sequence
  chemically synthesized
gtggtaaaaattaaatatgt

SEQ ID NO: 611626 - DNA, 20 bp, Artificial Sequence
  chemically synthesized
tcttttgaaactaaattatt

SEQ ID NO: 611627 - DNA, 20 bp, Artificial Sequence
  chemically synthesized
tctgtaaaatctaaaaataa

SEQ ID NO: 611628 - DNA, 20 bp, Artificial Sequence
  chemically synthesized
cacctatgagtgagaacatg

SEQ ID NO: 611629 - DNA, 20 bp, Artificial Sequence
  chemically synthesized
atgagtgagaacatgcggtg

SEQ ID NO: 611630 - DNA, 20 bp, Artificial Sequence
  chemically synthesized
gtttggttttttatccttgc

SEQ ID NO: 611631 - DNA, 20 bp, Artificial Sequence
  chemically synthesized
tgcgatagtttgctgagaat

SEQ ID NO: 611632 - DNA, 20 bp, Artificial Sequence
  chemically synthesized
gtttgctgagaatgatggtt

SEQ ID NO: 611633 - DNA, 20 bp, Artificial Sequence
  chemically synthesized
agggtacatgtgcataacgt

SEQ ID NO: 611634 - DNA, 20 bp, Artificial Sequence
  chemically synthesized
aatctttaaaatttttcttt

SEQ ID NO: 611635 - DNA, 20 bp, Artificial Sequence
  chemically synthesized
aatcaaaaaaagaaaaattt

SEQ ID NO: 611636 - DNA, 20 bp, Artificial Sequence
  chemically synthesized
taattaaagtataatttaaa

SEQ ID NO: 611637 - DNA, 20 bp, Artificial Sequence
  chemically synthesized
atttctatgtaaaatttata

SEQ ID NO: 611638 - DNA, 20 bp, Artificial Sequence
  chemically synthesized
gaagtatatggatacacaga

SEQ ID NO: 611639 - DNA, 20 bp, Artificial Sequence
  chemically synthesized
cttacccgatatgtagtgtg

SEQ ID NO: 611640 - DNA, 20 bp, Artificial Sequence
  chemically synthesized
cataaggcatattttgtctc

SEQ ID NO: 611641 - DNA, 20 bp, Artificial Sequence
  chemically synthesized
ccattgagacaaaatatgcc

SEQ ID NO: 611642 - DNA, 20 bp, Artificial Sequence
  chemically synthesized
ttttaccatataaattacca

SEQ ID NO: 611643 - DNA, 20 bp, Artificial Sequence
  chemically synthesized
tgtatggtacaaaagttgta

SEQ ID NO: 611644 - DNA, 20 bp, Artificial Sequence
  chemically synthesized
gttctgtcgggcataagaat

SEQ ID NO: 611645 - DNA, 20 bp, Artificial Sequence
  chemically synthesized
tcattttatgagacgtgcta

SEQ ID NO: 611646 - DNA, 20 bp, Artificial Sequence
  chemically synthesized
acgtgctattgagttttaga

SEQ ID NO: 611647 - DNA, 20 bp, Artificial Sequence
  chemically synthesized
gataaagtttgaaattttat

SEQ ID NO: 611648 - DNA, 20 bp, Artificial Sequence
  chemically synthesized
tatcaattaccttgggaata

SEQ ID NO: 611649 - DNA, 20 bp, Artificial Sequence
  chemically synthesized
acatatttctgagaaccttc

SEQ ID NO: 611650 - DNA, 20 bp, Artificial Sequence
  chemically synthesized
ttgtatatcaaaccacaggt

SEQ ID NO: 611651 - DNA, 20 bp, Artificial Sequence
  chemically synthesized
actatgctaaaacatatacc

SEQ ID NO: 611652 - DNA, 20 bp, Artificial Sequence
  chemically synthesized
tctaagctgaagaaaggcct

SEQ ID NO: 611653 - DNA, 20 bp, Artificial Sequence
  chemically synthesized
ggtaatcaggaaggcctttc

SEQ ID NO: 611654 - DNA, 20 bp, Artificial Sequence
  chemically synthesized
tccaagtattgaagttgtat

SEQ ID NO: 611655 - DNA, 20 bp, Artificial Sequence
  chemically synthesized
tacttggatactgaccattt

SEQ ID NO: 611656 - DNA, 20 bp, Artificial Sequence
  chemically synthesized
ttgcttgttaatgttaattc

SEQ ID NO: 611657 - DNA, 20 bp, Artificial Sequence
  chemically synthesized
tcaagctgatagattaaatt

SEQ ID NO: 611658 - DNA, 20 bp, Artificial Sequence
  chemically synthesized
ttaatcagttaatttaatct

SEQ ID NO: 611659 - DNA, 20 bp, Artificial Sequence
  chemically synthesized
atcagatacgttatcaagct

SEQ ID NO: 611660 - DNA, 20 bp, Artificial Sequence
  chemically synthesized
ttaatatgtgtgaagaccag

SEQ ID NO: 611661 - DNA, 20 bp, Artificial Sequence
  chemically synthesized
caacaaatgtttcttgaaga

SEQ ID NO: 611662 - DNA, 20 bp, Artificial Sequence
  chemically synthesized
cctgttttttaatgtacaac

SEQ ID NO: 611663 - DNA, 20 bp, Artificial Sequence
  chemically synthesized
cggcctctgaaagtgcgagt

SEQ ID NO: 611664 - DNA, 20 bp, Artificial Sequence
  chemically synthesized
ttttttatttttagtagaga

SEQ ID NO: 611665 - DNA, 20 bp, Artificial Sequence
  chemically synthesized
aatagcgtgaacccgggagg

SEQ ID NO: 611666 - DNA, 20 bp, Artificial Sequence
  chemically synthesized
attctcacttaatgttccag

SEQ ID NO: 611667 - DNA, 20 bp, Artificial Sequence
  chemically synthesized
ttgaaggttaggaattttac

SEQ ID NO: 611668 - DNA, 20 bp, Artificial Sequence
  chemically synthesized
tgagtccttctcatgtttca

SEQ ID NO: 611669 - DNA, 20 bp, Artificial Sequence
  chemically synthesized
aacaacagtatgagtccttc

SEQ ID NO: 611670 - DNA, 20 bp, Artificial Sequence
  chemically synthesized
aacatgagaaggactcatac

SEQ ID NO: 611671 - DNA, 20 bp, Artificial Sequence
  chemically synthesized
gttgattttgttttattcaa

SEQ ID NO: 611672 - DNA, 20 bp, Artificial Sequence
  chemically synthesized
tttttcaaatgtttcgttga

SEQ ID NO: 611673 - DNA, 20 bp, Artificial Sequence
  chemically synthesized
cttctgtttttcaaatgttt

SEQ ID NO: 611674 - DNA, 20 bp, Artificial Sequence
  chemically synthesized
tacaatgtcttctgtttttc

SEQ ID NO: 611675 - DNA, 20 bp, Artificial Sequence
  chemically synthesized
tagtttaaagatacaatgtc

SEQ ID NO: 611676 - DNA, 20 bp, Artificial Sequence
  chemically synthesized
gaatgcaagaaaatgacatc

SEQ ID NO: 611677 - DNA, 20 bp, Artificial Sequence
  chemically synthesized
actcaatataccgggaacac

SEQ ID NO: 611678 - DNA, 20 bp, Artificial Sequence
  chemically synthesized
cacaagcagcagcaagggaa

SEQ ID NO: 611679 - DNA, 20 bp, Artificial Sequence
  chemically synthesized
agtaatccctcttcccttgc

SEQ ID NO: 611680 - DNA, 20 bp, Artificial Sequence
  chemically synthesized
acatccgcatactaaggcaa

SEQ ID NO: 611681 - DNA, 20 bp, Artificial Sequence
  chemically synthesized
gcattcttccttatgtttag

SEQ ID NO: 611682 - DNA, 20 bp, Artificial Sequence
  chemically synthesized
tctttagtgagcattcttcc

SEQ ID NO: 611683 - DNA, 20 bp, Artificial Sequence
  chemically synthesized
acataaggaagaatgctcac

SEQ ID NO: 611684 - DNA, 20 bp, Artificial Sequence
  chemically synthesized
caactgagatatcttgctat

SEQ ID NO: 611685 - DNA, 20 bp, Artificial Sequence
  chemically synthesized
ggtaagaaaaaaattattat

SEQ ID NO: 611686 - DNA, 20 bp, Artificial Sequence
  chemically synthesized
tatttcatatttaaatgcaa

SEQ ID NO: 611687 - DNA, 20 bp, Artificial Sequence
  chemically synthesized
ttcattagattgtattcaaa

SEQ ID NO: 611688 - DNA, 20 bp, Artificial Sequence
  chemically synthesized
gaacatttttcaaagttttc

SEQ ID NO: 611689 - DNA, 20 bp, Artificial Sequence
  chemically synthesized
ctttggaaatgaacattttt

SEQ ID NO: 611690 - DNA, 20 bp, Artificial Sequence
  chemically synthesized
aggctgtttttttgatattc

SEQ ID NO: 611691 - DNA, 20 bp, Artificial Sequence
  chemically synthesized
ctatacacaccaagtctgta

SEQ ID NO: 611692 - DNA, 20 bp, Artificial Sequence
  chemically synthesized
tcttagttttttgttttgtt

SEQ ID NO: 611693 - DNA, 20 bp, Artificial Sequence
  chemically synthesized
aaactattcttagttttttg

SEQ ID NO: 611694 - DNA, 20 bp, Artificial Sequence
  chemically synthesized
aaacaaaacaaaaaactaag

SEQ ID NO: 611695 - DNA, 20 bp, Artificial Sequence
  chemically synthesized
tattgaaactattcttagtt

SEQ ID NO: 611696 - DNA, 20 bp, Artificial Sequence
  chemically synthesized
gcatacatattgaaactatt

SEQ ID NO: 611697 - DNA, 20 bp, Artificial Sequence
  chemically synthesized
cccagaaagattatgtcctt

SEQ ID NO: 611698 - DNA, 20 bp, Artificial Sequence
  chemically synthesized
catttcacagctgaacccca

SEQ ID NO: 611699 - DNA, 20 bp, Artificial Sequence
  chemically synthesized
atcatctagcatgatattta

SEQ ID NO: 611700 - DNA, 20 bp, Artificial Sequence
  chemically synthesized
aactatgtaaatatcatgct

SEQ ID NO: 611701 - DNA, 20 bp, Artificial Sequence
  chemically synthesized
atgactggccctattttctt

SEQ ID NO: 611702 - DNA, 20 bp, Artificial Sequence
  chemically synthesized
ttgtacaggtggagaggtat

SEQ ID NO: 611703 - DNA, 20 bp, Artificial Sequence
  chemically synthesized
tatctgcaaattcaaataac

SEQ ID NO: 611704 - DNA, 20 bp, Artificial Sequence
  chemically synthesized
aaaataacttcaagagtgta

SEQ ID NO: 611705 - DNA, 20 bp, Artificial Sequence
  chemically synthesized
tagtttataactcaaaggat

SEQ ID NO: 611706 - DNA, 20 bp, Artificial Sequence
  chemically synthesized
ggtgacatgctattctcatg

SEQ ID NO: 611707 - DNA, 20 bp, Artificial Sequence
  chemically synthesized
gtatatatatatggtacgtg

SEQ ID NO: 611708 - DNA, 20 bp, Artificial Sequence
  chemically synthesized
ataatttttgtgggtacatg

SEQ ID NO: 611709 - DNA, 20 bp, Artificial Sequence
  chemically synthesized
cacgtatatatacatatatg

SEQ ID NO: 611710 - DNA, 20 bp, Artificial Sequence
  chemically synthesized
aaaaatttccaaaaaaaata

SEQ ID NO: 611711 - DNA, 20 bp, Artificial Sequence
  chemically synthesized
aataagcatagtacccaaca

SEQ ID NO: 611712 - DNA, 20 bp, Artificial Sequence
  chemically synthesized
agaaatctccctgttgggta

SEQ ID NO: 611713 - DNA, 20 bp, Artificial Sequence
  chemically synthesized
tgtgttacaggggctctgag

SEQ ID NO: 611714 - DNA, 20 bp, Artificial Sequence
  chemically synthesized
tagttgttacattttattct

SEQ ID NO: 611715 - DNA, 20 bp, Artificial Sequence
  chemically synthesized
cctgtttacattaaattatc

SEQ ID NO: 611716 - DNA, 20 bp, Artificial Sequence
  chemically synthesized
catataacctatgcacatcc

SEQ ID NO: 611717 - DNA, 20 bp, Artificial Sequence
  chemically synthesized
atataaggaacttaagcatc

SEQ ID NO: 611718 - DNA, 20 bp, Artificial Sequence
  chemically synthesized
ctccagatactaaaatctgt

SEQ ID NO: 611719 - DNA, 20 bp, Artificial Sequence
  chemically synthesized
aagtataatctataaggcat

SEQ ID NO: 611720 - DNA, 20 bp, Artificial Sequence
  chemically synthesized
tatttcaatccatgatgcct

SEQ ID NO: 611721 - DNA, 20 bp, Artificial Sequence
  chemically synthesized
ttcacttttttcatacttaa

SEQ ID NO: 611722 - DNA, 20 bp, Artificial Sequence
  chemically synthesized
tcttttaagttggtcattta

SEQ ID NO: 611723 - DNA, 20 bp, Artificial Sequence
  chemically synthesized
cttaaatgaccaacttaaaa

SEQ ID NO: 611724 - DNA, 20 bp, Artificial Sequence
  chemically synthesized
aaaagatagatttattatta

SEQ ID NO: 611725 - DNA, 20 bp, Artificial Sequence
  chemically synthesized
accatgtctgcactgacatt

SEQ ID NO: 611726 - DNA, 20 bp, Artificial Sequence
  chemically synthesized
attaatgtcagtgcagacat

SEQ ID NO: 611727 - DNA, 20 bp, Artificial Sequence
  chemically synthesized
tacacacctggaactcatct

SEQ ID NO: 611728 - DNA, 20 bp, Artificial Sequence
  chemically synthesized
atcatcctggggctatttaa

SEQ ID NO: 611729 - DNA, 20 bp, Artificial Sequence
  chemically synthesized
gaaaacgatttaataggaac

SEQ ID NO: 611730 - DNA, 20 bp, Artificial Sequence
  chemically synthesized
taaaacaactgttcctatta

SEQ ID NO: 611731 - DNA, 20 bp, Artificial Sequence
  chemically synthesized
tgttcctattaaatcgtttt

SEQ ID NO: 611732 - DNA, 20 bp, Artificial Sequence
  chemically synthesized
atctacttataaaactcaga

SEQ ID NO: 611733 - DNA, 20 bp, Artificial Sequence
  chemically synthesized
atgttacctttatagagaag

SEQ ID NO: 611734 - DNA, 20 bp, Artificial Sequence
  chemically synthesized
ctttttgagagctatagaaa

SEQ ID NO: 611735 - DNA, 20 bp, Artificial Sequence
  chemically synthesized
tcttgtaaatgttgacttaa

SEQ ID NO: 611736 - DNA, 20 bp, Artificial Sequence
  chemically synthesized
agagcattttctcatgttgg

SEQ ID NO: 611737 - DNA, 20 bp, Artificial Sequence
  chemically synthesized
gttggaggtgattaattgca

SEQ ID NO: 611738 - DNA, 20 bp, Artificial Sequence
  chemically synthesized
caccatccttaggtttgagc

SEQ ID NO: 611739 - DNA, 20 bp, Artificial Sequence
  chemically synthesized
tgggtgtccccccaccatcc

SEQ ID NO: 611740 - DNA, 20 bp, Artificial Sequence
  chemically synthesized
gcaaaagtcattgtaagtcc

SEQ ID NO: 611741 - DNA, 20 bp, Artificial Sequence
  chemically synthesized
acgtgtggacttacaatgac

SEQ ID NO: 611742 - DNA, 20 bp, Artificial Sequence
  chemically synthesized
tgtgatttctaataaaaagt

SEQ ID NO: 611743 - DNA, 20 bp, Artificial Sequence
  chemically synthesized
taatgatttctgtttaacat

SEQ ID NO: 611744 - DNA, 20 bp, Artificial Sequence
  chemically synthesized
agtaaggtttagttaatgat

SEQ ID NO: 611745 - DNA, 20 bp, Artificial Sequence
  chemically synthesized
tattttgagtaaggtttagt

SEQ ID NO: 611746 - DNA, 20 bp, Artificial Sequence
  chemically synthesized
aagtccaccactattttgag

SEQ ID NO: 611747 - DNA, 20 bp, Artificial Sequence
  chemically synthesized
tctatagttccttggaagtt

SEQ ID NO: 611748 - DNA, 20 bp, Artificial Sequence
  chemically synthesized
ttcccgctccaaaatcatct

SEQ ID NO: 611749 - DNA, 20 bp, Artificial Sequence
  chemically synthesized
cataaatgcataaatcgata

SEQ ID NO: 611750 - DNA, 20 bp, Artificial Sequence
  chemically synthesized
gatccatacagtagttctta

SEQ ID NO: 611751 - DNA, 20 bp, Artificial Sequence
  chemically synthesized
taagaactactgtatggatc

SEQ ID NO: 611752 - DNA, 20 bp, Artificial Sequence
  chemically synthesized
ggctgcatcataattcttat

SEQ ID NO: 611753 - DNA, 20 bp, Artificial Sequence
  chemically synthesized
aatattttttaaagtacaga

SEQ ID NO: 611754 - DNA, 20 bp, Artificial Sequence
  chemically synthesized
ttatataacagttacctata

SEQ ID NO: 611755 - DNA, 20 bp, Artificial Sequence
  chemically synthesized
gcattttaaagttatgtgcc

SEQ ID NO: 611756 - DNA, 20 bp, Artificial Sequence
  chemically synthesized
gcctggggcacataacttta

SEQ ID NO: 611757 - DNA, 20 bp, Artificial Sequence
  chemically synthesized
gactaagattttttccaatg

SEQ ID NO: 611758 - DNA, 20 bp, Artificial Sequence
  chemically synthesized
tgtgcaggtggctgagtaga

SEQ ID NO: 611759 - DNA, 20 bp, Artificial Sequence
  chemically synthesized
tctaaaaggttttttttttt

SEQ ID NO: 611760 - DNA, 20 bp, Artificial Sequence
  chemically synthesized
agtacatatagactagtcta

SEQ ID NO: 611761 - DNA, 20 bp, Artificial Sequence
  chemically synthesized
tacattaatattatgagcac

SEQ ID NO: 611762 - DNA, 20 bp, Artificial Sequence
  chemically synthesized
gtgctcataatattaatgta

SEQ ID NO: 611763 - DNA, 20 bp, Artificial Sequence
  chemically synthesized
tttaaaattagaattattgt

SEQ ID NO: 611764 - DNA, 20 bp, Artificial Sequence
  chemically synthesized
taatcttgcagatggaatga

SEQ ID NO: 611765 - DNA, 20 bp, Artificial Sequence
  chemically synthesized
taaacattttcattccatct

SEQ ID NO: 611766 - DNA, 20 bp, Artificial Sequence
  chemically synthesized
tttcattccatctgcaagat

SEQ ID NO: 611767 - DNA, 20 bp, Artificial Sequence
  chemically synthesized
caagattaaagtttgaatta

SEQ ID NO: 611768 - DNA, 20 bp, Artificial Sequence
  chemically synthesized
tgcctcttgatcaatctgag

SEQ ID NO: 611769 - DNA, 20 bp, Artificial Sequence
  chemically synthesized
cttattgaaagaaatctttc

SEQ ID NO: 611770 - DNA, 20 bp, Artificial Sequence
  chemically synthesized
agtgaagaacatagcaaagg

SEQ ID NO: 611771 - DNA, 20 bp, Artificial Sequence
  chemically synthesized
atgttcttcactagtctatg

SEQ ID NO: 611772 - DNA, 20 bp, Artificial Sequence
  chemically synthesized
gagtattatcatttctatta

SEQ ID NO: 611773 - DNA, 20 bp, Artificial Sequence
  chemically synthesized
tatcatttctattataatga

SEQ ID NO: 611774 - DNA, 20 bp, Artificial Sequence
  chemically synthesized
attttgcttaaaatgtacat

SEQ ID NO: 611775 - DNA, 20 bp, Artificial Sequence
  chemically synthesized
gtaagacagatctcgctaca

SEQ ID NO: 611776 - DNA, 20 bp, Artificial Sequence
  chemically synthesized
atctcgctacaactagcttt

SEQ ID NO: 611777 - DNA, 20 bp, Artificial Sequence
  chemically synthesized
aacttttttcgtatttcaca

SEQ ID NO: 611778 - DNA, 20 bp, Artificial Sequence
  chemically synthesized
tctctctattatatctcgaa

SEQ ID NO: 611779 - DNA, 20 bp, Artificial Sequence
  chemically synthesized
tacattatttatttttatcc

SEQ ID NO: 611780 - DNA, 20 bp, Artificial Sequence
  chemically synthesized
gaaaaaacctggtgaagtaa

SEQ ID NO: 611781 - DNA, 20 bp, Artificial Sequence
  chemically synthesized
tttaaaacctagttacttca

SEQ ID NO: 611782 - DNA, 20 bp, Artificial Sequence
  chemically synthesized
aaaaaactagtatagaaaaa

SEQ ID NO: 611783 - DNA, 20 bp, Artificial Sequence
  chemically synthesized
cccaatcgttatttttctat

SEQ ID NO: 611784 - DNA, 20 bp, Artificial Sequence
  chemically synthesized
gctgtctcttttcagagtcc

SEQ ID NO: 611785 - DNA, 20 bp, Artificial Sequence
  chemically synthesized
actacaacaatatcatagtc

SEQ ID NO: 611786 - DNA, 20 bp, Artificial Sequence
  chemically synthesized
tacagtgaggtgaatttatt

SEQ ID NO: 611787 - DNA, 20 bp, Artificial Sequence
  chemically synthesized
gtattccaattattaataaa

SEQ ID NO: 611788 - DNA, 20 bp, Artificial Sequence
  chemically synthesized
tcttggaaaagtgatttgaa

SEQ ID NO: 611789 - DNA, 20 bp, Artificial Sequence
  chemically synthesized
ggcaagtgagtctcttggaa

SEQ ID NO: 611790 - DNA, 20 bp, Artificial Sequence
  chemically synthesized
tccaagagactcacttgccc

SEQ ID NO: 611791 - DNA, 20 bp, Artificial Sequence
  chemically synthesized
ttttacctaggctttaatat

SEQ ID NO: 611792 - DNA, 20 bp, Artificial Sequence
  chemically synthesized
aataaaaagatacattttac

SEQ ID NO: 611793 - DNA, 20 bp, Artificial Sequence
  chemically synthesized
ttatttagactttctcagat

SEQ ID NO: 611794 - DNA, 20 bp, Artificial Sequence
  chemically synthesized
aaatcccaccttgagtcata

SEQ ID NO: 611795 - DNA, 20 bp, Artificial Sequence
  chemically synthesized
taatccacatatgactcaag

SEQ ID NO: 611796 - DNA, 20 bp, Artificial Sequence
  chemically synthesized
cgtgatgtgaacatctctta

SEQ ID NO: 611797 - DNA, 20 bp, Artificial Sequence
  chemically synthesized
aggaaatatttgagatagtg

SEQ ID NO: 611798 - DNA, 20 bp, Artificial Sequence
  chemically synthesized
tctccctttgataactttag

SEQ ID NO: 611799 - DNA, 20 bp, Artificial Sequence
  chemically synthesized
ttggatagaatgtcatactt

SEQ ID NO: 611800 - DNA, 20 bp, Artificial Sequence
  chemically synthesized
attaaataattaaagtagaa

SEQ ID NO: 611801 - DNA, 20 bp, Artificial Sequence
  chemically synthesized
atccttctactttaattatt

SEQ ID NO: 611802 - DNA, 20 bp, Artificial Sequence
  chemically synthesized
atactgaattctttttacta

SEQ ID NO: 611803 - DNA, 20 bp, Artificial Sequence
  chemically synthesized
agtatccctcttattctggc

SEQ ID NO: 611804 - DNA, 20 bp, Artificial Sequence
  chemically synthesized
aatgttttgaaaataaatgg

SEQ ID NO: 611805 - DNA, 20 bp, Artificial Sequence
  chemically synthesized
cacatccatcagttgattcc

SEQ ID NO: 611806 - DNA, 20 bp, Artificial Sequence
  chemically synthesized
taattggatgcacatccatc

SEQ ID NO: 611807 - DNA, 20 bp, Artificial Sequence
  chemically synthesized
tttattacagggctaattgg

SEQ ID NO: 611808 - DNA, 20 bp, Artificial Sequence
  chemically synthesized
tcattttattacagggctaa

SEQ ID NO: 611809 - DNA, 20 bp, Artificial Sequence
  chemically synthesized
gaagagaggaatattctgcc

SEQ ID NO: 611810 - DNA, 20 bp, Artificial Sequence
  chemically synthesized
actcagctagtgagttggag

SEQ ID NO: 611811 - DNA, 20 bp, Artificial Sequence
  chemically synthesized
attttggtcatttgcaactg

SEQ ID NO: 611812 - DNA, 20 bp, Artificial Sequence
  chemically synthesized
aaataatagtctctacctcc

SEQ ID NO: 611813 - DNA, 20 bp, Artificial Sequence
  chemically synthesized
cattgcttgatattgtataa

SEQ ID NO: 611814 - DNA, 20 bp, Artificial Sequence
  chemically synthesized
taaacattaagtgctgggca

SEQ ID NO: 611815 - DNA, 20 bp, Artificial Sequence
  chemically synthesized
caagcaatgtgcccagcact

SEQ ID NO: 611816 - DNA, 20 bp, Artificial Sequence
  chemically synthesized
taatgtttaataaatatcac

SEQ ID NO: 611817 - DNA, 20 bp, Artificial Sequence
  chemically synthesized
attactatgtatgtattact

SEQ ID NO: 611818 - DNA, 20 bp, Artificial Sequence
  chemically synthesized
attactcccagcttcagaag

SEQ ID NO: 611819 - DNA, 20 bp, Artificial Sequence
  chemically synthesized
gcacacttgcaaaagtataa

SEQ ID NO: 611820 - DNA, 20 bp, Artificial Sequence
  chemically synthesized
cacagttgtcatggatacat

SEQ ID NO: 611821 - DNA, 20 bp, Artificial Sequence
  chemically synthesized
acacacacacttgacagaga

SEQ ID NO: 611822 - DNA, 20 bp, Artificial Sequence
  chemically synthesized
acacacacacacacttgaca

SEQ ID NO: 611823 - DNA, 20 bp, Artificial Sequence
  chemically synthesized
agtataaatcttttatgaaa

SEQ ID NO: 611824 - DNA, 20 bp, Artificial Sequence
  chemically synthesized
gagtctaatctagttttcat

SEQ ID NO: 611825 - DNA, 20 bp, Artificial Sequence
  chemically synthesized
ccttgagctccagagtctaa

SEQ ID NO: 611826 - DNA, 20 bp, Artificial Sequence
  chemically synthesized
actctggagctcaaggatat

SEQ ID NO: 611827 - DNA, 20 bp, Artificial Sequence
  chemically synthesized
cctgtgaccttcccactcat

SEQ ID NO: 611828 - DNA, 20 bp, Artificial Sequence
  chemically synthesized
ggaaggtcacaggaagacca

SEQ ID NO: 611829 - DNA, 20 bp, Artificial Sequence
  chemically synthesized
cagtatatatagggcctatt

SEQ ID NO: 611830 - DNA, 20 bp, Artificial Sequence
  chemically synthesized
ccacaaataggccctatata

SEQ ID NO: 611831 - DNA, 20 bp, Artificial Sequence
  chemically synthesized
acttataaattaggcacaga

SEQ ID NO: 611832 - DNA, 20 bp, Artificial Sequence
  chemically synthesized
aggagtcctcccttattcat

SEQ ID NO: 611833 - DNA, 20 bp, Artificial Sequence
  chemically synthesized
caggcaaaataactggaaag

SEQ ID NO: 611834 - DNA, 20 bp, Artificial Sequence
  chemically synthesized
ttatttgacataactttagc

SEQ ID NO: 611835 - DNA, 20 bp, Artificial Sequence
  chemically synthesized
atattacgggccaaatacat

SEQ ID NO: 611836 - DNA, 20 bp, Artificial Sequence
  chemically synthesized
aaaatctgatttttgccttt

SEQ ID NO: 611837 - DNA, 20 bp, Artificial Sequence
  chemically synthesized
taaaactaataaaggcaaaa

SEQ ID NO: 611838 - DNA, 20 bp, Artificial Sequence
  chemically synthesized
ccaactagttttgggttaaa

SEQ ID NO: 611839 - DNA, 20 bp, Artificial Sequence
  chemically synthesized
actttttctacacagagcca

SEQ ID NO: 611840 - DNA, 20 bp, Artificial Sequence
  chemically synthesized
gcagcatcagattaacctag

SEQ ID NO: 611841 - DNA, 20 bp, Artificial Sequence
  chemically synthesized
tgttcattttcctaggcagc

SEQ ID NO: 611842 - DNA, 20 bp, Artificial Sequence
  chemically synthesized
gaacatagaaacttattttc

SEQ ID NO: 611843 - DNA, 20 bp, Artificial Sequence
  chemically synthesized
taactcttaatcctaagaaa

SEQ ID NO: 611844 - DNA, 20 bp, Artificial Sequence
  chemically synthesized
atagtagaatttcttgtcac

SEQ ID NO: 611845 - DNA, 20 bp, Artificial Sequence
  chemically synthesized
tcttcatgtcaagtaaacca

SEQ ID NO: 611846 - DNA, 20 bp, Artificial Sequence
  chemically synthesized
aggacaacggccaaaatcag

SEQ ID NO: 611847 - DNA, 20 bp, Artificial Sequence
  chemically synthesized
catgtggaaatctgtatgtt

SEQ ID NO: 611848 - DNA, 20 bp, Artificial Sequence
  chemically synthesized
tggcccagaagcaaccaaca

SEQ ID NO: 611849 - DNA, 20 bp, Artificial Sequence
  chemically synthesized
ttctgggccatccaatgata

SEQ ID NO: 611850 - DNA, 20 bp, Artificial Sequence
  chemically synthesized
ctgtacagctaagtaaatgt

SEQ ID NO: 611851 - DNA, 20 bp, Artificial Sequence
  chemically synthesized
gcatatctggctaaaataca

SEQ ID NO: 611852 - DNA, 20 bp, Artificial Sequence
  chemically synthesized
atccagggttagttttgcta

SEQ ID NO: 611853 - DNA, 20 bp, Artificial Sequence
  chemically synthesized
ttatttaccatttatccagg

SEQ ID NO: 611854 - DNA, 20 bp, Artificial Sequence
  chemically synthesized
agagatcataaaattaagcc

SEQ ID NO: 611855 - DNA, 20 bp, Artificial Sequence
  chemically synthesized
aaatccacttgaaataagca

SEQ ID NO: 611856 - DNA, 20 bp, Artificial Sequence
  chemically synthesized
taagccatttgcttatttca

SEQ ID NO: 611857 - DNA, 20 bp, Artificial Sequence
  chemically synthesized
aattaaaatgatggtaaaat

SEQ ID NO: 611858 - DNA, 20 bp, Artificial Sequence
  chemically synthesized
tattattttaccatcatttt

SEQ ID NO: 611859 - DNA, 20 bp, Artificial Sequence
  chemically synthesized
catcactgtgttctgctatc

SEQ ID NO: 611860 - DNA, 20 bp, Artificial Sequence
  chemically synthesized
agggttgcccaggtgagagg

SEQ ID NO: 611861 - DNA, 20 bp, Artificial Sequence
  chemically synthesized
cctgggcaacccttgctgga

SEQ ID NO: 611862 - DNA, 20 bp, Artificial Sequence
  chemically synthesized
tagaatggtactctgactca

SEQ ID NO: 611863 - DNA, 20 bp, Artificial Sequence
  chemically synthesized
ttctatttattgcttcacgg

SEQ ID NO: 611864 - DNA, 20 bp, Artificial Sequence
  chemically synthesized
tcttcattccttcttctatt

SEQ ID NO: 611865 - DNA, 20 bp, Artificial Sequence
  chemically synthesized
ctgtgcagacaggagataag

SEQ ID NO: 611866 - DNA, 20 bp, Artificial Sequence
  chemically synthesized
aagtttcttaatcctaaaga

SEQ ID NO: 611867 - DNA, 20 bp, Artificial Sequence
  chemically synthesized
tggccatcaaaacattctct

SEQ ID NO: 611868 - DNA, 20 bp, Artificial Sequence
  chemically synthesized
cacatcttcaattactggag

SEQ ID NO: 611869 - DNA, 20 bp, Artificial Sequence
  chemically synthesized
agtaattgaagatgtgaaca

SEQ ID NO: 611870 - DNA, 20 bp, Artificial Sequence
  chemically synthesized
ccagaatctgttgtcccagc

SEQ ID NO: 611871 - DNA, 20 bp, Artificial Sequence
  chemically synthesized
gtctaaacaaatgctgggac

SEQ ID NO: 611872 - DNA, 20 bp, Artificial Sequence
  chemically synthesized
agaaacaactacaatggaac

SEQ ID NO: 611873 - DNA, 20 bp, Artificial Sequence
  chemically synthesized
agaaacaattgttccattgt

SEQ ID NO: 611874 - DNA, 20 bp, Artificial Sequence
  chemically synthesized
ctgcaggatactctcactta

SEQ ID NO: 611875 - DNA, 20 bp, Artificial Sequence
  chemically synthesized
cgtcctcagtgaaataaaat

SEQ ID NO: 611876 - DNA, 20 bp, Artificial Sequence
  chemically synthesized
ggggaagctttatggcaaca

SEQ ID NO: 611877 - DNA, 20 bp, Artificial Sequence
  chemically synthesized
tttcaatcccagtgttgcca

SEQ ID NO: 611878 - DNA, 20 bp, Artificial Sequence
  chemically synthesized
tgttgccataaagcttcccc

SEQ ID NO: 611879 - DNA, 20 bp, Artificial Sequence
  chemically synthesized
tgtccaataaaatcggttgg

SEQ ID NO: 611880 - DNA, 20 bp, Artificial Sequence
  chemically synthesized
gactttaagaagagataaac

SEQ ID NO: 611881 - DNA, 20 bp, Artificial Sequence
  chemically synthesized
taagaagagataaaccctgg

SEQ ID NO: 611882 - DNA, 20 bp, Artificial Sequence
  chemically synthesized
aactgagctataatcaaatc

SEQ ID NO: 611883 - DNA, 20 bp, Artificial Sequence
  chemically synthesized
gttatctattggctgtgtga

SEQ ID NO: 611884 - DNA, 20 bp, Artificial Sequence
  chemically synthesized
tttaataaagctctctaagc

SEQ ID NO: 611885 - DNA, 20 bp, Artificial Sequence
  chemically synthesized
aatggaaaaactgaggctta

SEQ ID NO: 611886 - DNA, 20 bp, Artificial Sequence
  chemically synthesized
tcttttataaatggaaaaac

SEQ ID NO: 611887 - DNA, 20 bp, Artificial Sequence
  chemically synthesized
cttgtacacaacaattccag

SEQ ID NO: 611888 - DNA, 20 bp, Artificial Sequence
  chemically synthesized
tccttttggtagaagagtgc

SEQ ID NO: 611889 - DNA, 20 bp, Artificial Sequence
  chemically synthesized
accaaaaggaacttgcaaat

SEQ ID NO: 611890 - DNA, 20 bp, Artificial Sequence
  chemically synthesized
caaagcacatttttcccctg

SEQ ID NO: 611891 - DNA, 20 bp, Artificial Sequence
  chemically synthesized
aaaatctttgcaggggaaaa

SEQ ID NO: 611892 - DNA, 20 bp, Artificial Sequence
  chemically synthesized
ctttgcaggggaaaaatgtg

SEQ ID NO: 611893 - DNA, 20 bp, Artificial Sequence
  chemically synthesized
aatgtgctttgatttgaagc

SEQ ID NO: 611894 - DNA, 20 bp, Artificial Sequence
  chemically synthesized
gttaatattgctgaataaac

SEQ ID NO: 611895 - DNA, 20 bp, Artificial Sequence
  chemically synthesized
tatttcctaaaagtaaaaac

SEQ ID NO: 611896 - DNA, 20 bp, Artificial Sequence
  chemically synthesized
tttaataaggtggttgaaac

SEQ ID NO: 611897 - DNA, 20 bp, Artificial Sequence
  chemically synthesized
cctaataatttaatagttgt

SEQ ID NO: 611898 - DNA, 20 bp, Artificial Sequence
  chemically synthesized
tcatatgatccactaactcc

SEQ ID NO: 611899 - DNA, 20 bp, Artificial Sequence
  chemically synthesized
ttgccataagacaaaaaatc

SEQ ID NO: 611900 - DNA, 20 bp, Artificial Sequence
  chemically synthesized
caattcagccattttgaagc

SEQ ID NO: 611901 - DNA, 20 bp, Artificial Sequence
  chemically synthesized
tcttagttaatgtattcaaa

SEQ ID NO: 611902 - DNA, 20 bp, Artificial Sequence
  chemically synthesized
attgcttctctgttgaattt

SEQ ID NO: 611903 - DNA, 20 bp, Artificial Sequence
  chemically synthesized
tttttccttttagtggtttt

SEQ ID NO: 611904 - DNA, 20 bp, Artificial Sequence
  chemically synthesized
atttccttctttttcctttt

SEQ ID NO: 611905 - DNA, 20 bp, Artificial Sequence
  chemically synthesized
aaatgaggcactctatccag

SEQ ID NO: 611906 - DNA, 20 bp, Artificial Sequence
  chemically synthesized
acaaaggtacacattcttgt

SEQ ID NO: 611907 - DNA, 20 bp, Artificial Sequence
  chemically synthesized
gttgaagggctctcaattgg

SEQ ID NO: 611908 - DNA, 20 bp, Artificial Sequence
  chemically synthesized
cagtatctagacagctgtgt

SEQ ID NO: 611909 - DNA, 20 bp, Artificial Sequence
  chemically synthesized
gtctagatactgtgcaaagg

SEQ ID NO: 611910 - DNA, 20 bp, Artificial Sequence
  chemically synthesized
tagagtttgtggaacccagc

SEQ ID NO: 611911 - DNA, 20 bp, Artificial Sequence
  chemically synthesized
gttgcagctgcttaggactc

SEQ ID NO: 611912 - DNA, 20 bp, Artificial Sequence
  chemically synthesized
tcaaaaccaggccatgttgc

SEQ ID NO: 611913 - DNA, 20 bp, Artificial Sequence
  chemically synthesized
cctaagcagctgcaacatgg

SEQ ID NO: 611914 - DNA, 20 bp, Artificial Sequence
  chemically synthesized
ctccaggaatgtggagatag

SEQ ID NO: 611915 - DNA, 20 bp, Artificial Sequence
  chemically synthesized
cacccctctgttgggcaggg

SEQ ID NO: 611916 - DNA, 20 bp, Artificial Sequence
  chemically synthesized
agttgcctgggtagcctgtg

SEQ ID NO: 611917 - DNA, 20 bp, Artificial Sequence
  chemically synthesized
gacgcacaggctacccaggc

SEQ ID NO: 611918 - DNA, 20 bp, Artificial Sequence
  chemically synthesized
cctgctactggagagggtaa

SEQ ID NO: 611919 - DNA, 20 bp, Artificial Sequence
  chemically synthesized
tatacaaatttttatgtact

SEQ ID NO: 611920 - DNA, 20 bp, Artificial Sequence
  chemically synthesized
gagacctggggctctcccac

SEQ ID NO: 611921 - DNA, 20 bp, Artificial Sequence
  chemically synthesized
gggcctgaatttgggcccac

SEQ ID NO: 611922 - DNA, 20 bp, Artificial Sequence
  chemically synthesized
acgccagctttggtggtagt

SEQ ID NO: 611923 - DNA, 20 bp, Artificial Sequence
  chemically synthesized
gatggtgcatgtaggttgac

SEQ ID NO: 611924 - DNA, 20 bp, Artificial Sequence
  chemically synthesized
caccatctgcaggcctagga

SEQ ID NO: 611925 - DNA, 20 bp, Artificial Sequence
  chemically synthesized
atggtgttggtggtggatgc

SEQ ID NO: 611926 - DNA, 20 bp, Artificial Sequence
  chemically synthesized
gcatccaccaccaacaccat

SEQ ID NO: 611927 - DNA, 20 bp, Artificial Sequence
  chemically synthesized
ccaccaccaacaccatcatg

SEQ ID NO: 611928 - DNA, 20 bp, Artificial Sequence
  chemically synthesized
cactattgccattacccgca

SEQ ID NO: 611929 - DNA, 20 bp, Artificial Sequence
  chemically synthesized
tgtgtacccacccagcccac

SEQ ID NO: 611930 - DNA, 20 bp, Artificial Sequence
  chemically synthesized
aaccctttggcttataggtg

SEQ ID NO: 611931 - DNA, 20 bp, Artificial Sequence
  chemically synthesized
ggctaaccctttggcttata

SEQ ID NO: 611932 - DNA, 20 bp, Artificial Sequence
  chemically synthesized
gtgtccaggcaggctaaccc

SEQ ID NO: 611933 - DNA, 20 bp, Artificial Sequence
  chemically synthesized
agtcaccggcaaaacttcac

SEQ ID NO: 611934 - DNA, 20 bp, Artificial Sequence
  chemically synthesized
gttgttagcagaagctgtgg

SEQ ID NO: 611935 - DNA, 20 bp, Artificial Sequence
  chemically synthesized
atggtgtctgtaacttcctc

SEQ ID NO: 611936 - DNA, 20 bp, Artificial Sequence
  chemically synthesized
gaagttacagacaccattca

SEQ ID NO: 611937 - DNA, 20 bp, Artificial Sequence
  chemically synthesized
tatatagtagtatacttcct

SEQ ID NO: 611938 - DNA, 20 bp, Artificial Sequence
  chemically synthesized
gtctcctcttgagtctttgc

SEQ ID NO: 611939 - DNA, 20 bp, Artificial Sequence
  chemically synthesized
gttttcatgttctgagattc

SEQ ID NO: 611940 - DNA, 20 bp, Artificial Sequence
  chemically synthesized
aaaagacctgttttcatgtt

SEQ ID NO: 611941 - DNA, 20 bp, Artificial Sequence
  chemically synthesized
tgagtaggttattttaaaag

SEQ ID NO: 611942 - DNA, 20 bp, Artificial Sequence
  chemically synthesized
ttttaaaattttttgttatt

SEQ ID NO: 611943 - DNA, 20 bp, Artificial Sequence
  chemically synthesized
tatggtgttgtatatgtcac

SEQ ID NO: 611944 - DNA, 20 bp, Artificial Sequence
  chemically synthesized
tacaacaccataaagccatg

SEQ ID NO: 611945 - DNA, 20 bp, Artificial Sequence
  chemically synthesized
cataaaaaatgcaagcattt

SEQ ID NO: 611946 - DNA, 20 bp, Artificial Sequence
  chemically synthesized
tagaaggtaaaggagaaact

SEQ ID NO: 611947 - DNA, 20 bp, Artificial Sequence
  chemically synthesized
ttaaatagggtttctaaacc

SEQ ID NO: 611948 - DNA, 20 bp, Artificial Sequence
  chemically synthesized
tcatctattattttgttaaa

SEQ ID NO: 611949 - DNA, 20 bp, Artificial Sequence
  chemically synthesized
taaatctcttgctagacttg

SEQ ID NO: 611950 - DNA, 20 bp, Artificial Sequence
  chemically synthesized
gaaatcttcccaagtctagc

SEQ ID NO: 611951 - DNA, 20 bp, Artificial Sequence
  chemically synthesized
tctttttgtctttggctttt

SEQ ID NO: 611952 - DNA, 20 bp, Artificial Sequence
  chemically synthesized
tttagaattctctttttgtc

SEQ ID NO: 611953 - DNA, 20 bp, Artificial Sequence
  chemically synthesized
gtgacaaggtgcttttctct

SEQ ID NO: 611954 - DNA, 20 bp, Artificial Sequence
  chemically synthesized
aggtttctttataagtgaca

SEQ ID NO: 611955 - DNA, 20 bp, Artificial Sequence
  chemically synthesized
tcacttataaagaaacctcc

SEQ ID NO: 611956 - DNA, 20 bp, Artificial Sequence
  chemically synthesized
aaattcactgttaatctgat

SEQ ID NO: 611957 - DNA, 20 bp, Artificial Sequence
  chemically synthesized
tctcattcttctctggcctg

SEQ ID NO: 611958 - DNA, 20 bp, Artificial Sequence
  chemically synthesized
ctggtggttgttttctttca

SEQ ID NO: 611959 - DNA, 20 bp, Artificial Sequence
  chemically synthesized
gtagagtatccttggctggt

SEQ ID NO: 611960 - DNA, 20 bp, Artificial Sequence
  chemically synthesized
ctaggaactattttatttct

SEQ ID NO: 611961 - DNA, 20 bp, Artificial Sequence
  chemically synthesized
gtatcatggtgataaatttc

SEQ ID NO: 611962 - DNA, 20 bp, Artificial Sequence
  chemically synthesized
catgatactggccttacaag

SEQ ID NO: 611963 - DNA, 20 bp, Artificial Sequence
  chemically synthesized
ctagttgtttttatattttt

SEQ ID NO: 611964 - DNA, 20 bp, Artificial Sequence
  chemically synthesized
ttttgtgtgtttgcactact

SEQ ID NO: 611965 - DNA, 20 bp, Artificial Sequence
  chemically synthesized
aacttttcttgatttttttt

SEQ ID NO: 611966 - DNA, 20 bp, Artificial Sequence
  chemically synthesized
ggtaacatttgagtaacttt

SEQ ID NO: 611967 - DNA, 20 bp, Artificial Sequence
  chemically synthesized
ctttcattttattgatttat

SEQ ID NO: 611968 - DNA, 20 bp, Artificial Sequence
  chemically synthesized
agggcttatttctttcattt

SEQ ID NO: 611969 - DNA, 20 bp, Artificial Sequence
  chemically synthesized
caacattattactgatatgt

SEQ ID NO: 611970 - DNA, 20 bp, Artificial Sequence
  chemically synthesized
cagtaataatgttgaatgta

SEQ ID NO: 611971 - DNA, 20 bp, Artificial Sequence
  chemically synthesized
cagtttatgtcttttatgtg

SEQ ID NO: 611972 - DNA, 20 bp, Artificial Sequence
  chemically synthesized
taaaagacataaactggctg

SEQ ID NO: 611973 - DNA, 20 bp, Artificial Sequence
  chemically synthesized
tatattttttaatccattca

SEQ ID NO: 611974 - DNA, 20 bp, Artificial Sequence
  chemically synthesized
tatgtgtctttacaggtgaa

SEQ ID NO: 611975 - DNA, 20 bp, Artificial Sequence
  chemically synthesized
atttcacctgtaaagacaca

SEQ ID NO: 611976 - DNA, 20 bp, Artificial Sequence
  chemically synthesized
tgctgcttctcccctttggc

SEQ ID NO: 611977 - DNA, 20 bp, Artificial Sequence
  chemically synthesized
catagctgctgcttctcccc

SEQ ID NO: 611978 - DNA, 20 bp, Artificial Sequence
  chemically synthesized
ccaaaggggagaagcagcag

SEQ ID NO: 611979 - DNA, 20 bp, Artificial Sequence
  chemically synthesized
ctgttttatgtaagcatagc

SEQ ID NO: 611980 - DNA, 20 bp, Artificial Sequence
  chemically synthesized
tttactgtttttgactgaaa

SEQ ID NO: 611981 - DNA, 20 bp, Artificial Sequence
  chemically synthesized
atgaccttattgtttgtttt

SEQ ID NO: 611982 - DNA, 20 bp, Artificial Sequence
  chemically synthesized
cattatataatgaccttatt

SEQ ID NO: 611983 - DNA, 20 bp, Artificial Sequence
  chemically synthesized
ttatcattatataatgacct

SEQ ID NO: 611984 - DNA, 20 bp, Artificial Sequence
  chemically synthesized
cattatataatgataaaggg

SEQ ID NO: 611985 - DNA, 20 bp, Artificial Sequence
  chemically synthesized
agctctcgtgttgggtgtat

SEQ ID NO: 611986 - DNA, 20 bp, Artificial Sequence
  chemically synthesized
gctctccctttagatctaat

SEQ ID NO: 611987 - DNA, 20 bp, Artificial Sequence
  chemically synthesized
caaaaaattaacaaagaaac

SEQ ID NO: 611988 - DNA, 20 bp, Artificial Sequence
  chemically synthesized
tctaaggagcagtttcaagc

SEQ ID NO: 611989 - DNA, 20 bp, Artificial Sequence
  chemically synthesized
taggactatttggtctaagg

SEQ ID NO: 611990 - DNA, 20 bp, Artificial Sequence
  chemically synthesized
tctgtcctggagaatgttct

SEQ ID NO: 611991 - DNA, 20 bp, Artificial Sequence
  chemically synthesized
taagaagatattagatatga

SEQ ID NO: 611992 - DNA, 20 bp, Artificial Sequence
  chemically synthesized
gtgttttaagaagatattag

SEQ ID NO: 611993 - DNA, 20 bp, Artificial Sequence
  chemically synthesized
tttctctttttgttatttcc

SEQ ID NO: 611994 - DNA, 20 bp, Artificial Sequence
  chemically synthesized
ccatgtttttgtacaggttc

SEQ ID NO: 611995 - DNA, 20 bp, Artificial Sequence
  chemically synthesized
aggagtatgttgttcaattt

SEQ ID NO: 611996 - DNA, 20 bp, Artificial Sequence
  chemically synthesized
gtcaaggaagaaaattgagg

SEQ ID NO: 611997 - DNA, 20 bp, Artificial Sequence
  chemically synthesized
gttattatattttgatattc

SEQ ID NO: 611998 - DNA, 20 bp, Artificial Sequence
  chemically synthesized
gctatatacatcccccttag

SEQ ID NO: 611999 - DNA, 20 bp, Artificial Sequence
  chemically synthesized
ctccttgaagtactttgtta

SEQ ID NO: 612000 - DNA, 20 bp, Artificial Sequence
  chemically synthesized
ctagctccttgaagtacttt

SEQ ID NO: 612001 - DNA, 20 bp, Artificial Sequence
  chemically synthesized
ttctactaattctgggtttg

SEQ ID NO: 612002 - DNA, 20 bp, Artificial Sequence
  chemically synthesized
atccttctactaattctggg

SEQ ID NO: 612003 - DNA, 20 bp, Artificial Sequence
  chemically synthesized
ttttcatccttctactaatt

SEQ ID NO: 612004 - DNA, 20 bp, Artificial Sequence
  chemically synthesized
tcttgagttttgctcaattt

SEQ ID NO: 612005 - DNA, 20 bp, Artificial Sequence
  chemically synthesized
attttttgctctctattttc

SEQ ID NO: 612006 - DNA, 20 bp, Artificial Sequence
  chemically synthesized
tacaaagtatcaatgaaatg

SEQ ID NO: 612007 - DNA, 20 bp, Artificial Sequence
  chemically synthesized
aagtatcaatgaaatgagaa

SEQ ID NO: 612008 - DNA, 20 bp, Artificial Sequence
  chemically synthesized
tttttcttggttagtctagc

SEQ ID NO: 612009 - DNA, 20 bp, Artificial Sequence
  chemically synthesized
tgtaatgtctccgtcttcat

SEQ ID NO: 612010 - DNA, 20 bp, Artificial Sequence
  chemically synthesized
tttatacattcctctagatt

SEQ ID NO: 612011 - DNA, 20 bp, Artificial Sequence
  chemically synthesized
tccgggaatttatacattcc

SEQ ID NO: 612012 - DNA, 20 bp, Artificial Sequence
  chemically synthesized
cattactaattatagatctg

SEQ ID NO: 612013 - DNA, 20 bp, Artificial Sequence
  chemically synthesized
gttgggaaattttttaagat

SEQ ID NO: 612014 - DNA, 20 bp, Artificial Sequence
  chemically synthesized
tgtcttcgttgggaaatttt

SEQ ID NO: 612015 - DNA, 20 bp, Artificial Sequence
  chemically synthesized
aacacttacaggagaattgg

SEQ ID NO: 612016 - DNA, 20 bp, Artificial Sequence
  chemically synthesized
gggtttggcatcagggtaat

SEQ ID NO: 612017 - DNA, 20 bp, Artificial Sequence
  chemically synthesized
attttttgttgcataattgt

SEQ ID NO: 612018 - DNA, 20 bp, Artificial Sequence
  chemically synthesized
tattacattttttatgttct

SEQ ID NO: 612019 - DNA, 20 bp, Artificial Sequence
  chemically synthesized
ttgatgtaatatgtcatatt

SEQ ID NO: 612020 - DNA, 20 bp, Artificial Sequence
  chemically synthesized
atcatgttttctgtttttca

SEQ ID NO: 612021 - DNA, 20 bp, Artificial Sequence
  chemically synthesized
tctattgaaaggatcatgtt

SEQ ID NO: 612022 - DNA, 20 bp, Artificial Sequence
  chemically synthesized
ttttgtgtctattgaaagga

SEQ ID NO: 612023 - DNA, 20 bp, Artificial Sequence
  chemically synthesized
tttttgtatgcctagtttgt

SEQ ID NO: 612024 - DNA, 20 bp, Artificial Sequence
  chemically synthesized
ttgttaattttttttgtatg

SEQ ID NO: 612025 - DNA, 20 bp, Artificial Sequence
  chemically synthesized
ccattcagtttgatactact

SEQ ID NO: 612026 - DNA, 20 bp, Artificial Sequence
  chemically synthesized
aatttttcagcttttcccca

SEQ ID NO: 612027 - DNA, 20 bp, Artificial Sequence
  chemically synthesized
agttttatagggagaaattt

SEQ ID NO: 612028 - DNA, 20 bp, Artificial Sequence
  chemically synthesized
gagccaccacgcctgaccat

SEQ ID NO: 612029 - DNA, 20 bp, Artificial Sequence
  chemically synthesized
cacctctgcctcccaaagtg

SEQ ID NO: 612030 - DNA, 20 bp, Artificial Sequence
  chemically synthesized
ttttgtatttttagtagaga

SEQ ID NO: 612031 - DNA, 20 bp, Artificial Sequence
  chemically synthesized
aacggcatgaaccctggagg

SEQ ID NO: 612032 - DNA, 20 bp, Artificial Sequence
  chemically synthesized
gaggctgagcttgcaatgag

SEQ ID NO: 612033 - DNA, 20 bp, Artificial Sequence
  chemically synthesized
tcttttttttgtttttggtt

SEQ ID NO: 612034 - DNA, 20 bp, Artificial Sequence
  chemically synthesized
gtcttgttcttttttttgtt

SEQ ID NO: 612035 - DNA, 20 bp, Artificial Sequence
  chemically synthesized
catccttgtcttgttctttt

SEQ ID NO: 612036 - DNA, 20 bp, Artificial Sequence
  chemically synthesized
ggacgccttgtatttctttc

SEQ ID NO: 612037 - DNA, 20 bp, Artificial Sequence
  chemically synthesized
aacaaagagcagtacttgga

SEQ ID NO: 612038 - DNA, 20 bp, Artificial Sequence
  chemically synthesized
tgagagctttctggtgaggg

SEQ ID NO: 612039 - DNA, 20 bp, Artificial Sequence
  chemically synthesized
agatctgagagctttctggt

SEQ ID NO: 612040 - DNA, 20 bp, Artificial Sequence
  chemically synthesized
taaatttatttatcagatct

SEQ ID NO: 612041 - DNA, 20 bp, Artificial Sequence
  chemically synthesized
aaatgctactgaattgtgta

SEQ ID NO: 612042 - DNA, 20 bp, Artificial Sequence
  chemically synthesized
cgttgtaaataggtttgcct

SEQ ID NO: 612043 - DNA, 20 bp, Artificial Sequence
  chemically synthesized
attatttccagccgttgtaa

SEQ ID NO: 612044 - DNA, 20 bp, Artificial Sequence
  chemically synthesized
gctggaaataatacctagga

SEQ ID NO: 612045 - DNA, 20 bp, Artificial Sequence
  chemically synthesized
atttgttggtgtactcttca

SEQ ID NO: 612046 - DNA, 20 bp, Artificial Sequence
  chemically synthesized
ccaacaaatggaaagtcatc

SEQ ID NO: 612047 - DNA, 20 bp, Artificial Sequence
  chemically synthesized
ggactgcattattcaatgta

SEQ ID NO: 612048 - DNA, 20 bp, Artificial Sequence
  chemically synthesized
tctttgttctttttgctcag

SEQ ID NO: 612049 - DNA, 20 bp, Artificial Sequence
  chemically synthesized
taagtctttgttctttttgc

SEQ ID NO: 612050 - DNA, 20 bp, Artificial Sequence
  chemically synthesized
ccttgctgttttgtcaagta

SEQ ID NO: 612051 - DNA, 20 bp, Artificial Sequence
  chemically synthesized
ctgtttttattctaacacct

SEQ ID NO: 612052 - DNA, 20 bp, Artificial Sequence
  chemically synthesized
tctattccattgttctatat

SEQ ID NO: 612053 - DNA, 20 bp, Artificial Sequence
  chemically synthesized
acagacatatagaacaatgg

SEQ ID NO: 612054 - DNA, 20 bp, Artificial Sequence
  chemically synthesized
aaacaagttgtatgtaaata

SEQ ID NO: 612055 - DNA, 20 bp, Artificial Sequence
  chemically synthesized
aatccatgtatttacataca

SEQ ID NO: 612056 - DNA, 20 bp, Artificial Sequence
  chemically synthesized
ttccccctaatgcatgttct

SEQ ID NO: 612057 - DNA, 20 bp, Artificial Sequence
  chemically synthesized
ttcttcaaatggtgctgaga

SEQ ID NO: 612058 - DNA, 20 bp, Artificial Sequence
  chemically synthesized
aatatggtgagagacaggga

SEQ ID NO: 612059 - DNA, 20 bp, Artificial Sequence
  chemically synthesized
tattagaaaattcagctcaa

SEQ ID NO: 612060 - DNA, 20 bp, Artificial Sequence
  chemically synthesized
aaattcagctcaagatggat

SEQ ID NO: 612061 - DNA, 20 bp, Artificial Sequence
  chemically synthesized
ctatgtttgcttcatgtagt

SEQ ID NO: 612062 - DNA, 20 bp, Artificial Sequence
  chemically synthesized
ttttccctatgtttgcttca

SEQ ID NO: 612063 - DNA, 20 bp, Artificial Sequence
  chemically synthesized
gtcctgtctgttttccctat

SEQ ID NO: 612064 - DNA, 20 bp, Artificial Sequence
  chemically synthesized
caaggtcctgtctgttttcc

SEQ ID NO: 612065 - DNA, 20 bp, Artificial Sequence
  chemically synthesized
tttgcctagaccaaggtcct

SEQ ID NO: 612066 - DNA, 20 bp, Artificial Sequence
  chemically synthesized
agacaggaccttggtctagg

SEQ ID NO: 612067 - DNA, 20 bp, Artificial Sequence
  chemically synthesized
tctatttatgtttttgttgc

SEQ ID NO: 612068 - DNA, 20 bp, Artificial Sequence
  chemically synthesized
ctacagtcccaattatctat

SEQ ID NO: 612069 - DNA, 20 bp, Artificial Sequence
  chemically synthesized
attgggactgtagaaaatga

SEQ ID NO: 612070 - DNA, 20 bp, Artificial Sequence
  chemically synthesized
agagcttctgtaaaacaaag

SEQ ID NO: 612071 - DNA, 20 bp, Artificial Sequence
  chemically synthesized
ttcactctgttgaatccttc

SEQ ID NO: 612072 - DNA, 20 bp, Artificial Sequence
  chemically synthesized
gacaacctgctgaatgggag

SEQ ID NO: 612073 - DNA, 20 bp, Artificial Sequence
  chemically synthesized
agatattagtctcttgtctg

SEQ ID NO: 612074 - DNA, 20 bp, Artificial Sequence
  chemically synthesized
tgattatttttttactgtta

SEQ ID NO: 612075 - DNA, 20 bp, Artificial Sequence
  chemically synthesized
ttgtcctttgtccattttta

SEQ ID NO: 612076 - DNA, 20 bp, Artificial Sequence
  chemically synthesized
tgacttgatttgcatttccc

SEQ ID NO: 612077 - DNA, 20 bp, Artificial Sequence
  chemically synthesized
caagatgatggctcatcatg

SEQ ID NO: 612078 - DNA, 20 bp, Artificial Sequence
  chemically synthesized
cgttgcacctcgtcaacatc

SEQ ID NO: 612079 - DNA, 20 bp, Artificial Sequence
  chemically synthesized
cactattgaaaacagtatgg

SEQ ID NO: 612080 - DNA, 20 bp, Artificial Sequence
  chemically synthesized
tttttgagaaatcttctcca

SEQ ID NO: 612081 - DNA, 20 bp, Artificial Sequence
  chemically synthesized
acacatactctatttctatg

SEQ ID NO: 612082 - DNA, 20 bp, Artificial Sequence
  chemically synthesized
tgctgacacatactctattt

SEQ ID NO: 612083 - DNA, 20 bp, Artificial Sequence
  chemically synthesized
tgatagttagaaaagtatat

SEQ ID NO: 612084 - DNA, 20 bp, Artificial Sequence
  chemically synthesized
ttcctgatagttagaaaagt

SEQ ID NO: 612085 - DNA, 20 bp, Artificial Sequence
  chemically synthesized
tgcatggcatacctgtactt

SEQ ID NO: 612086 - DNA, 20 bp, Artificial Sequence
  chemically synthesized
gattgtctcacttaataacc

SEQ ID NO: 612087 - DNA, 20 bp, Artificial Sequence
  chemically synthesized
gtaaaatctatttatctttg

SEQ ID NO: 612088 - DNA, 20 bp, Artificial Sequence
  chemically synthesized
agacaatcgaggcaaagata

SEQ ID NO: 612089 - DNA, 20 bp, Artificial Sequence
  chemically synthesized
acttgaccattacacattca

SEQ ID NO: 612090 - DNA, 20 bp, Artificial Sequence
  chemically synthesized
cttttatttttattgatgca

SEQ ID NO: 612091 - DNA, 20 bp, Artificial Sequence
  chemically synthesized
aaagagaataaatctaagag

SEQ ID NO: 612092 - DNA, 20 bp, Artificial Sequence
  chemically synthesized
ttaaagcaataagctatcct

SEQ ID NO: 612093 - DNA, 20 bp, Artificial Sequence
  chemically synthesized
ataaatctaagaggatagct

SEQ ID NO: 612094 - DNA, 20 bp, Artificial Sequence
  chemically synthesized
gacaagacaactataaatct

SEQ ID NO: 612095 - DNA, 20 bp, Artificial Sequence
  chemically synthesized
attccttgcagagggaaacc

SEQ ID NO: 612096 - DNA, 20 bp, Artificial Sequence
  chemically synthesized
ggaaatttaattgtcataca

SEQ ID NO: 612097 - DNA, 20 bp, Artificial Sequence
  chemically synthesized
gacaattaaatttccctctt

SEQ ID NO: 612098 - DNA, 20 bp, Artificial Sequence
  chemically synthesized
aatagatattaggttggtac

SEQ ID NO: 612099 - DNA, 20 bp, Artificial Sequence
  chemically synthesized
taatatctatttttccagtg

SEQ ID NO: 612100 - DNA, 20 bp, Artificial Sequence
  chemically synthesized
atttttccagtgcccagctt

SEQ ID NO: 612101 - DNA, 20 bp, Artificial Sequence
  chemically synthesized
gcaggttctgtgatgtcttt

SEQ ID NO: 612102 - DNA, 20 bp, Artificial Sequence
  chemically synthesized
gttctgtgatgtcttttttt

SEQ ID NO: 612103 - DNA, 20 bp, Artificial Sequence
  chemically synthesized
cagggcctcagttcttttgc

SEQ ID NO: 612104 - DNA, 20 bp, Artificial Sequence
  chemically synthesized
gagttcaaggctgcggtgag

SEQ ID NO: 612105 - DNA, 20 bp, Artificial Sequence
  chemically synthesized
ttgggaggccaaggcaggag

SEQ ID NO: 612106 - DNA, 20 bp, Artificial Sequence
  chemically synthesized
tgccttggcctcccaatgtg

SEQ ID NO: 612107 - DNA, 20 bp, Artificial Sequence
  chemically synthesized
tgtcttcaaaatggagttaa

SEQ ID NO: 612108 - DNA, 20 bp, Artificial Sequence
  chemically synthesized
tccattttgaagacagtgaa

SEQ ID NO: 612109 - DNA, 20 bp, Artificial Sequence
  chemically synthesized
aagtagtttaaaattttcta

SEQ ID NO: 612110 - DNA, 20 bp, Artificial Sequence
  chemically synthesized
aatgagaataaaatggcata

SEQ ID NO: 612111 - DNA, 20 bp, Artificial Sequence
  chemically synthesized
taccatcattagaatggtca

SEQ ID NO: 612112 - DNA, 20 bp, Artificial Sequence
  chemically synthesized
aagtgttctatagttgatat

SEQ ID NO: 612113 - DNA, 20 bp, Artificial Sequence
  chemically synthesized
aggaatacatgagatattag

SEQ ID NO: 612114 - DNA, 20 bp, Artificial Sequence
  chemically synthesized
atgaaggaatacatgagata

SEQ ID NO: 612115 - DNA, 20 bp, Artificial Sequence
  chemically synthesized
taaaattaacaaataccaat

SEQ ID NO: 612116 - DNA, 20 bp, Artificial Sequence
  chemically synthesized
tatgtaatagacactttgtg

SEQ ID NO: 612117 - DNA, 20 bp, Artificial Sequence
  chemically synthesized
agtgacattaagtgattttt

SEQ ID NO: 612118 - DNA, 20 bp, Artificial Sequence
  chemically synthesized
ttggcctatacagtgacatt

SEQ ID NO: 612119 - DNA, 20 bp, Artificial Sequence
  chemically synthesized
atctcttttcaattagctta

SEQ ID NO: 612120 - DNA, 20 bp, Artificial Sequence
  chemically synthesized
atcctggtaagctaattgaa

SEQ ID NO: 612121 - DNA, 20 bp, Artificial Sequence
  chemically synthesized
taactgagaatctcttttca

SEQ ID NO: 612122 - DNA, 20 bp, Artificial Sequence
  chemically synthesized
tctaggtaagaattatattt

SEQ ID NO: 612123 - DNA, 20 bp, Artificial Sequence
  chemically synthesized
atgcgattgaagatgtgcat

SEQ ID NO: 612124 - DNA, 20 bp, Artificial Sequence
  chemically synthesized
cataatgcacatcttcaatc

SEQ ID NO: 612125 - DNA, 20 bp, Artificial Sequence
  chemically synthesized
ttaaataatgaagtataatc

SEQ ID NO: 612126 - DNA, 20 bp, Artificial Sequence
  chemically synthesized
aaagtatgctttagttaagt

SEQ ID NO: 612127 - DNA, 20 bp, Artificial Sequence
  chemically synthesized
ctaggggctgatttgttaaa

SEQ ID NO: 612128 - DNA, 20 bp, Artificial Sequence
  chemically synthesized
taatttctatctcccctagg

SEQ ID NO: 612129 - DNA, 20 bp, Artificial Sequence
  chemically synthesized
tactaatctttcacattctt

SEQ ID NO: 612130 - DNA, 20 bp, Artificial Sequence
  chemically synthesized
gacaaatcatagaagaatgt

SEQ ID NO: 612131 - DNA, 20 bp, Artificial Sequence
  chemically synthesized
gatatttgtgtgtgcgggag

SEQ ID NO: 612132 - DNA, 20 bp, Artificial Sequence
  chemically synthesized
gcacacacaaatatcatatt

SEQ ID NO: 612133 - DNA, 20 bp, Artificial Sequence
  chemically synthesized
ttgttctccttatccatttc

SEQ ID NO: 612134 - DNA, 20 bp, Artificial Sequence
  chemically synthesized
aaatggataaggagaacaaa

SEQ ID NO: 612135 - DNA, 20 bp, Artificial Sequence
  chemically synthesized
ttccaactgcccagaaaata

SEQ ID NO: 612136 - DNA, 20 bp, Artificial Sequence
  chemically synthesized
ttttgtcatgaagagcaatt

SEQ ID NO: 612137 - DNA, 20 bp, Artificial Sequence
  chemically synthesized
ataccaaataggtatgatac

SEQ ID NO: 612138 - DNA, 20 bp, Artificial Sequence
  chemically synthesized
cttaaatatattttcaactg

SEQ ID NO: 612139 - DNA, 20 bp, Artificial Sequence
  chemically synthesized
attgtctgaaatatttacag

SEQ ID NO: 612140 - DNA, 20 bp, Artificial Sequence
  chemically synthesized
acctataatattgcaatcgc

SEQ ID NO: 612141 - DNA, 20 bp, Artificial Sequence
  chemically synthesized
ccttgttttcagaaaatcta

SEQ ID NO: 612142 - DNA, 20 bp, Artificial Sequence
  chemically synthesized
ctagaactcattatagagta

SEQ ID NO: 612143 - DNA, 20 bp, Artificial Sequence
  chemically synthesized
cactaattttatatcattta

SEQ ID NO: 612144 - DNA, 20 bp, Artificial Sequence
  chemically synthesized
taaacactaattttatatca

SEQ ID NO: 612145 - DNA, 20 bp, Artificial Sequence
  chemically synthesized
caatctaaatgatataaaat

SEQ ID NO: 612146 - DNA, 20 bp, Artificial Sequence
  chemically synthesized
attgagagggttaattctca

SEQ ID NO: 612147 - DNA, 20 bp, Artificial Sequence
  chemically synthesized
cataatggcaagaaatgttt

SEQ ID NO: 612148 - DNA, 20 bp, Artificial Sequence
  chemically synthesized
tttgataccataatggcaag

SEQ ID NO: 612149 - DNA, 20 bp, Artificial Sequence
  chemically synthesized
gccattatggtatcaaaatg

SEQ ID NO: 612150 - DNA, 20 bp, Artificial Sequence
  chemically synthesized
atatcaattggctgaacaag

SEQ ID NO: 612151 - DNA, 20 bp, Artificial Sequence
  chemically synthesized
tatttttaaggcctcttatg

SEQ ID NO: 612152 - DNA, 20 bp, Artificial Sequence
  chemically synthesized
agcaaattctatgtatcttt

SEQ ID NO: 612153 - DNA, 20 bp, Artificial Sequence
  chemically synthesized
agacttggctttgtatgcat

SEQ ID NO: 612154 - DNA, 20 bp, Artificial Sequence
  chemically synthesized
ctggagtgaatgctttcaga

SEQ ID NO: 612155 - DNA, 20 bp, Artificial Sequence
  chemically synthesized
gaaagttttactcctggagt

SEQ ID NO: 612156 - DNA, 20 bp, Artificial Sequence
  chemically synthesized
agaattagctctgcctgttg

SEQ ID NO: 612157 - DNA, 20 bp, Artificial Sequence
  chemically synthesized
taatccctgcatcactcttg

SEQ ID NO: 612158 - DNA, 20 bp, Artificial Sequence
  chemically synthesized
aaaacaactcaagagtgatg

SEQ ID NO: 612159 - DNA, 20 bp, Artificial Sequence
  chemically synthesized
atggtgacacggattctatt

SEQ ID NO: 612160 - DNA, 20 bp, Artificial Sequence
  chemically synthesized
tgacttcctgagaatggtga

SEQ ID NO: 612161 - DNA, 20 bp, Artificial Sequence
  chemically synthesized
ttctcaggaagtcaaaataa

SEQ ID NO: 612162 - DNA, 20 bp, Artificial Sequence
  chemically synthesized
gggattaaaaccaaacccta

SEQ ID NO: 612163 - DNA, 20 bp, Artificial Sequence
  chemically synthesized
catttacaaacccgttaggg

SEQ ID NO: 612164 - DNA, 20 bp, Artificial Sequence
  chemically synthesized
aatgacatttacaaacccgt

SEQ ID NO: 612165 - DNA, 20 bp, Artificial Sequence
  chemically synthesized
tatttcatatcctaaatgga

SEQ ID NO: 612166 - DNA, 20 bp, Artificial Sequence
  chemically synthesized
gaacaggcgcaatcttttat

SEQ ID NO: 612167 - DNA, 20 bp, Artificial Sequence
  chemically synthesized
taaaacaaaaaatcagggat

SEQ ID NO: 612168 - DNA, 20 bp, Artificial Sequence
  chemically synthesized
gcaatcttttatccctgatt

SEQ ID NO: 612169 - DNA, 20 bp, Artificial Sequence
  chemically synthesized
ctatattaagagagtgcttt

SEQ ID NO: 612170 - DNA, 20 bp, Artificial Sequence
  chemically synthesized
aaatcctccctatattaaga

SEQ ID NO: 612171 - DNA, 20 bp, Artificial Sequence
  chemically synthesized
aaagcactctcttaatatag

SEQ ID NO: 612172 - DNA, 20 bp, Artificial Sequence
  chemically synthesized
ttggactggcaaacaaacca

SEQ ID NO: 612173 - DNA, 20 bp, Artificial Sequence
  chemically synthesized
tctgagtttcaaacagattg

SEQ ID NO: 612174 - DNA, 20 bp, Artificial Sequence
  chemically synthesized
tttctctgagtttcaaacag

SEQ ID NO: 612175 - DNA, 20 bp, Artificial Sequence
  chemically synthesized
cattgtttctctgagtttca

SEQ ID NO: 612176 - DNA, 20 bp, Artificial Sequence
  chemically synthesized
gtttcatatacattgtttct

SEQ ID NO: 612177 - DNA, 20 bp, Artificial Sequence
  chemically synthesized
ttggtcgtgggtttcatata

SEQ ID NO: 612178 - DNA, 20 bp, Artificial Sequence
  chemically synthesized
acattctacatgcgttggtc

SEQ ID NO: 612179 - DNA, 20 bp, Artificial Sequence
  chemically synthesized
atcagacaattctcttcccg

SEQ ID NO: 612180 - DNA, 20 bp, Artificial Sequence
  chemically synthesized
atcataacgggaagagaatt

SEQ ID NO: 612181 - DNA, 20 bp, Artificial Sequence
  chemically synthesized
gggtaaacttaataaattat

SEQ ID NO: 612182 - DNA, 20 bp, Artificial Sequence
  chemically synthesized
gcataaacatacataattta

SEQ ID NO: 612183 - DNA, 20 bp, Artificial Sequence
  chemically synthesized
gatttcaggagctgtttcta

SEQ ID NO: 612184 - DNA, 20 bp, Artificial Sequence
  chemically synthesized
acactagaaacagctcctga

SEQ ID NO: 612185 - DNA, 20 bp, Artificial Sequence
  chemically synthesized
ttagcataagcgatttcagg

SEQ ID NO: 612186 - DNA, 20 bp, Artificial Sequence
  chemically synthesized
gtagcagtaggcattagcat

SEQ ID NO: 612187 - DNA, 20 bp, Artificial Sequence
  chemically synthesized
tggtgttttgaggcctgagg

SEQ ID NO: 612188 - DNA, 20 bp, Artificial Sequence
  chemically synthesized
ttaactggtgttttgaggcc

SEQ ID NO: 612189 - DNA, 20 bp, Artificial Sequence
  chemically synthesized
tgatatgctttggccttaac

SEQ ID NO: 612190 - DNA, 20 bp, Artificial Sequence
  chemically synthesized
gatttcatatatagaatttg

SEQ ID NO: 612191 - DNA, 20 bp, Artificial Sequence
  chemically synthesized
attctatatatgaaatccta

SEQ ID NO: 612192 - DNA, 20 bp, Artificial Sequence
  chemically synthesized
taggaagtcattgaaacctt

SEQ ID NO: 612193 - DNA, 20 bp, Artificial Sequence
  chemically synthesized
ttataaagcaattctatcaa

SEQ ID NO: 612194 - DNA, 20 bp, Artificial Sequence
  chemically synthesized
aacataagctttgttgatag

SEQ ID NO: 612195 - DNA, 20 bp, Artificial Sequence
  chemically synthesized
agcaattctatcaacaaagc

SEQ ID NO: 612196 - DNA, 20 bp, Artificial Sequence
  chemically synthesized
atgctttgacaattttaaac

SEQ ID NO: 612197 - DNA, 20 bp, Artificial Sequence
  chemically synthesized
tttaagaaatacctgccaaa

SEQ ID NO: 612198 - DNA, 20 bp, Artificial Sequence
  chemically synthesized
caggtatttcttaaaccaaa

SEQ ID NO: 612199 - DNA, 20 bp, Artificial Sequence
  chemically synthesized
attgggggattgaagctata

SEQ ID NO: 612200 - DNA, 20 bp, Artificial Sequence
  chemically synthesized
ttggggagaattttattatt

SEQ ID NO: 612201 - DNA, 20 bp, Artificial Sequence
  chemically synthesized
ccaataataaaattctcccc

SEQ ID NO: 612202 - DNA, 20 bp, Artificial Sequence
  chemically synthesized
atttaaccagatattggttc

SEQ ID NO: 612203 - DNA, 20 bp, Artificial Sequence
  chemically synthesized
gtgattcatgcctgtatagt

SEQ ID NO: 612204 - DNA, 20 bp, Artificial Sequence
  chemically synthesized
gatagatttaccagcaaaat

SEQ ID NO: 612205 - DNA, 20 bp, Artificial Sequence
  chemically synthesized
agacttagaacactctcttc

SEQ ID NO: 612206 - DNA, 20 bp, Artificial Sequence
  chemically synthesized
cataagaatttttatttact

SEQ ID NO: 612207 - DNA, 20 bp, Artificial Sequence
  chemically synthesized
tttttttctttgaatcatca

SEQ ID NO: 612208 - DNA, 20 bp, Artificial Sequence
  chemically synthesized
ttttcaggagataatctcaa

SEQ ID NO: 612209 - DNA, 20 bp, Artificial Sequence
  chemically synthesized
aaatgtataaatgtgtactt

SEQ ID NO: 612210 - DNA, 20 bp, Artificial Sequence
  chemically synthesized
acttatggctgcaaataaga

SEQ ID NO: 612211 - DNA, 20 bp, Artificial Sequence
  chemically synthesized
tataataataaaaagtttct

SEQ ID NO: 612212 - DNA, 20 bp, Artificial Sequence
  chemically synthesized
aaacttaaagtataataata

SEQ ID NO: 612213 - DNA, 20 bp, Artificial Sequence
  chemically synthesized
aaactttttattattatact

SEQ ID NO: 612214 - DNA, 20 bp, Artificial Sequence
  chemically synthesized
gggatacatgtgcagaacgt

SEQ ID NO: 612215 - DNA, 20 bp, Artificial Sequence
  chemically synthesized
cataggtatacacatgccat

SEQ ID NO: 612216 - DNA, 20 bp, Artificial Sequence
  chemically synthesized
gggaaatacctaacatagat

SEQ ID NO: 612217 - DNA, 20 bp, Artificial Sequence
  chemically synthesized
catgtcttctggttgttcaa

SEQ ID NO: 612218 - DNA, 20 bp, Artificial Sequence
  chemically synthesized
gatttatgagtgagaacatg

SEQ ID NO: 612219 - DNA, 20 bp, Artificial Sequence
  chemically synthesized
tatgagtgagaacatgccga

SEQ ID NO: 612220 - DNA, 20 bp, Artificial Sequence
  chemically synthesized
gtttgattttctgttcctat

SEQ ID NO: 612221 - DNA, 20 bp, Artificial Sequence
  chemically synthesized
ctatgttagtttgctgagaa

SEQ ID NO: 612222 - DNA, 20 bp, Artificial Sequence
  chemically synthesized
gtttgctgagaatgatgttt

SEQ ID NO: 612223 - DNA, 20 bp, Artificial Sequence
  chemically synthesized
ctatgcagcaacaaaaaagg

SEQ ID NO: 612224 - DNA, 20 bp, Artificial Sequence
  chemically synthesized
tatcattgatgggcatttgg

SEQ ID NO: 612225 - DNA, 20 bp, Artificial Sequence
  chemically synthesized
ccaaaggattataaattatt

SEQ ID NO: 612226 - DNA, 20 bp, Artificial Sequence
  chemically synthesized
ccatcactgggtatataccc

SEQ ID NO: 612227 - DNA, 20 bp, Artificial Sequence
  chemically synthesized
ctttgggtatatacccagtg

SEQ ID NO: 612228 - DNA, 20 bp, Artificial Sequence
  chemically synthesized
gggtatatacccagtgatgg

SEQ ID NO: 612229 - DNA, 20 bp, Artificial Sequence
  chemically synthesized
aaacattgtggaagacagtg

SEQ ID NO: 612230 - DNA, 20 bp, Artificial Sequence
  chemically synthesized
aatcaccacactgtcttcca

SEQ ID NO: 612231 - DNA, 20 bp, Artificial Sequence
  chemically synthesized
gagagaatatggagaaatag

SEQ ID NO: 612232 - DNA, 20 bp, Artificial Sequence
  chemically synthesized
tccatattctctccagcatc

SEQ ID NO: 612233 - DNA, 20 bp, Artificial Sequence
  chemically synthesized
agcatgagatggtatctcat

SEQ ID NO: 612234 - DNA, 20 bp, Artificial Sequence
  chemically synthesized
gagatggtatctcattgtgg

SEQ ID NO: 612235 - DNA, 20 bp, Artificial Sequence
  chemically synthesized
atggggttattttcctgtaa

SEQ ID NO: 612236 - DNA, 20 bp, Artificial Sequence
  chemically synthesized
tttcctgtaaatttgtttct

SEQ ID NO: 612237 - DNA, 20 bp, Artificial Sequence
  chemically synthesized
tattagccctttgtcagata

SEQ ID NO: 612238 - DNA, 20 bp, Artificial Sequence
  chemically synthesized
ggctgcctgttcactctgat

SEQ ID NO: 612239 - DNA, 20 bp, Artificial Sequence
  chemically synthesized
gtaagatctcatttgtcaat

SEQ ID NO: 612240 - DNA, 20 bp, Artificial Sequence
  chemically synthesized
tcaattttggcttttcttgc

SEQ ID NO: 612241 - DNA, 20 bp, Artificial Sequence
  chemically synthesized
gcttttcttgccattgcttt

SEQ ID NO: 612242 - DNA, 20 bp, Artificial Sequence
  chemically synthesized
tatgtcctgaaaggtattgc

SEQ ID NO: 612243 - DNA, 20 bp, Artificial Sequence
  chemically synthesized
gtattgcctaggttttcttc

SEQ ID NO: 612244 - DNA, 20 bp, Artificial Sequence
  chemically synthesized
aggttttcttctagggtttt

SEQ ID NO: 612245 - DNA, 20 bp, Artificial Sequence
  chemically synthesized
ttatacaaaaattaactcaa

SEQ ID NO: 612246 - DNA, 20 bp, Artificial Sequence
  chemically synthesized
tataaggggtaaggaagggg

SEQ ID NO: 612247 - DNA, 20 bp, Artificial Sequence
  chemically synthesized
cagtcttctgcatatggcta

SEQ ID NO: 612248 - DNA, 20 bp, Artificial Sequence
  chemically synthesized
atcatcatttattaaatagg

SEQ ID NO: 612249 - DNA, 20 bp, Artificial Sequence
  chemically synthesized
taaatagggaatgctttccc

SEQ ID NO: 612250 - DNA, 20 bp, Artificial Sequence
  chemically synthesized
tagggaatgctttccccatt

SEQ ID NO: 612251 - DNA, 20 bp, Artificial Sequence
  chemically synthesized
ttccccattgcttgtttttg

SEQ ID NO: 612252 - DNA, 20 bp, Artificial Sequence
  chemically synthesized
ctgttctggtaccagtatca

SEQ ID NO: 612253 - DNA, 20 bp, Artificial Sequence
  chemically synthesized
tggttactgtagccttgtag

SEQ ID NO: 612254 - DNA, 20 bp, Artificial Sequence
  chemically synthesized
aagtaaggtagcatgatgcc

SEQ ID NO: 612255 - DNA, 20 bp, Artificial Sequence
  chemically synthesized
gatgcctccagctttgttat

SEQ ID NO: 612256 - DNA, 20 bp, Artificial Sequence
  chemically synthesized
gctttgttatttttgcttag

SEQ ID NO: 612257 - DNA, 20 bp, Artificial Sequence
  chemically synthesized
tagttccacatgaaatttaa

SEQ ID NO: 612258 - DNA, 20 bp, Artificial Sequence
  chemically synthesized
attctgtgaagaaagtgaat

SEQ ID NO: 612259 - DNA, 20 bp, Artificial Sequence
  chemically synthesized
ccatactgcccgaagtaatt

SEQ ID NO: 612260 - DNA, 20 bp, Artificial Sequence
  chemically synthesized
cagtatggccattttcatga

SEQ ID NO: 612261 - DNA, 20 bp, Artificial Sequence
  chemically synthesized
tcttcctatccataagcatg

SEQ ID NO: 612262 - DNA, 20 bp, Artificial Sequence
  chemically synthesized
caaacaaatgaaaaaacatt

SEQ ID NO: 612263 - DNA, 20 bp, Artificial Sequence
  chemically synthesized
taagcatggaatgttttttc

SEQ ID NO: 612264 - DNA, 20 bp, Artificial Sequence
  chemically synthesized
cctctcttacttccttgagc

SEQ ID NO: 612265 - DNA, 20 bp, Artificial Sequence
  chemically synthesized
gtccttcacatcccttataa

SEQ ID NO: 612266 - DNA, 20 bp, Artificial Sequence
  chemically synthesized
aattgtaaatgggagttcac

SEQ ID NO: 612267 - DNA, 20 bp, Artificial Sequence
  chemically synthesized
tgggagttcactcatgattt

SEQ ID NO: 612268 - DNA, 20 bp, Artificial Sequence
  chemically synthesized
tgtttattatcggtgtatag

SEQ ID NO: 612269 - DNA, 20 bp, Artificial Sequence
  chemically synthesized
gaatgcttgttatttttcca

SEQ ID NO: 612270 - DNA, 20 bp, Artificial Sequence
  chemically synthesized
agactttgttgacactgcct

SEQ ID NO: 612271 - DNA, 20 bp, Artificial Sequence
  chemically synthesized
tgacactgcctatcagctta

SEQ ID NO: 612272 - DNA, 20 bp, Artificial Sequence
  chemically synthesized
gagattttcggctgagatga

SEQ ID NO: 612273 - DNA, 20 bp, Artificial Sequence
  chemically synthesized
aaattctctgtttgcagatg

SEQ ID NO: 612274 - DNA, 20 bp, Artificial Sequence
  chemically synthesized
aaagaaagggtattcaaatt

SEQ ID NO: 612275 - DNA, 20 bp, Artificial Sequence
  chemically synthesized
gaataccctttctttctcct

SEQ ID NO: 612276 - DNA, 20 bp, Artificial Sequence
  chemically synthesized
agagggaatttttgtcttgt

SEQ ID NO: 612277 - DNA, 20 bp, Artificial Sequence
  chemically synthesized
cttgtgccagtttttaaagg

SEQ ID NO: 612278 - DNA, 20 bp, Artificial Sequence
  chemically synthesized
cagtttttaaagggagtgct

SEQ ID NO: 612279 - DNA, 20 bp, Artificial Sequence
  chemically synthesized
tgagacacattccatcaata

SEQ ID NO: 612280 - DNA, 20 bp, Artificial Sequence
  chemically synthesized
tgcatctattgagataatca

SEQ ID NO: 612281 - DNA, 20 bp, Artificial Sequence
  chemically synthesized
cagaaccaatgacaaaaacc

SEQ ID NO: 612282 - DNA, 20 bp, Artificial Sequence
  chemically synthesized
catgtggtttttgtcattgg

SEQ ID NO: 612283 - DNA, 20 bp, Artificial Sequence
  chemically synthesized
gtcattggttctgtttatgt

SEQ ID NO: 612284 - DNA, 20 bp, Artificial Sequence
  chemically synthesized
ggttctgtttatgtgatgga

SEQ ID NO: 612285 - DNA, 20 bp, Artificial Sequence
  chemically synthesized
ttatgtgatggattacgttt

SEQ ID NO: 612286 - DNA, 20 bp, Artificial Sequence
  chemically synthesized
cttcatccctgggatgcaag

SEQ ID NO: 612287 - DNA, 20 bp, Artificial Sequence
  chemically synthesized
gttggcttcatccctgggat

SEQ ID NO: 612288 - DNA, 20 bp, Artificial Sequence
  chemically synthesized
aggttatccaccatgatcaa

SEQ ID NO: 612289 - DNA, 20 bp, Artificial Sequence
  chemically synthesized
gataacctttttgatgtgct

SEQ ID NO: 612290 - DNA, 20 bp, Artificial Sequence
  chemically synthesized
ctttttgatgtgctgctgga

SEQ ID NO: 612291 - DNA, 20 bp, Artificial Sequence
  chemically synthesized
ttttttttattgtgtctctg

SEQ ID NO: 612292 - DNA, 20 bp, Artificial Sequence
  chemically synthesized
gggaggagtccttatttttc

SEQ ID NO: 612293 - DNA, 20 bp, Artificial Sequence
  chemically synthesized
cttatttttctattgtttgg

SEQ ID NO: 612294 - DNA, 20 bp, Artificial Sequence
  chemically synthesized
ggctgtgaatctgtctggtc

SEQ ID NO: 612295 - DNA, 20 bp, Artificial Sequence
  chemically synthesized
ccaaaaaaagcccaggacca

SEQ ID NO: 612296 - DNA, 20 bp, Artificial Sequence
  chemically synthesized
ctgtctggtcctgggctttt

SEQ ID NO: 612297 - DNA, 20 bp, Artificial Sequence
  chemically synthesized
gaacttgttattgttctatt

SEQ ID NO: 612298 - DNA, 20 bp, Artificial Sequence
  chemically synthesized
attcagggatttgacttctt

SEQ ID NO: 612299 - DNA, 20 bp, Artificial Sequence
  chemically synthesized
tcctgtacatatacactctt

SEQ ID NO: 612300 - DNA, 20 bp, Artificial Sequence
  chemically synthesized
acaggaatttttccatttct

SEQ ID NO: 612301 - DNA, 20 bp, Artificial Sequence
  chemically synthesized
tttccatttcttctagattt

SEQ ID NO: 612302 - DNA, 20 bp, Artificial Sequence
  chemically synthesized
tttctagtttatttgcgtgg

SEQ ID NO: 612303 - DNA, 20 bp, Artificial Sequence
  chemically synthesized
tgtttatagtattctctgat

SEQ ID NO: 612304 - DNA, 20 bp, Artificial Sequence
  chemically synthesized
tatcattttttactgtgtct

SEQ ID NO: 612305 - DNA, 20 bp, Artificial Sequence
  chemically synthesized
attcaggagctgtttttttg

SEQ ID NO: 612306 - DNA, 20 bp, Artificial Sequence
  chemically synthesized
tcaaaaaaacagctcctgaa

SEQ ID NO: 612307 - DNA, 20 bp, Artificial Sequence
  chemically synthesized
aaaaaaaaactcaattcagg

SEQ ID NO: 612308 - DNA, 20 bp, Artificial Sequence
  chemically synthesized
gaattgagtttttttttttt

SEQ ID NO: 612309 - DNA, 20 bp, Artificial Sequence
  chemically synthesized
ctcttagttatttgtcttct

SEQ ID NO: 612310 - DNA, 20 bp, Artificial Sequence
  chemically synthesized
tgtcttctgatagcttttga

SEQ ID NO: 612311 - DNA, 20 bp, Artificial Sequence
  chemically synthesized
atttaattgtgatgttagga

SEQ ID NO: 612312 - DNA, 20 bp, Artificial Sequence
  chemically synthesized
tctgtgggacacagctaaag

SEQ ID NO: 612313 - DNA, 20 bp, Artificial Sequence
  chemically synthesized
acacttctttagctgtgtcc

SEQ ID NO: 612314 - DNA, 20 bp, Artificial Sequence
  chemically synthesized
cccacagattctgctacatt

SEQ ID NO: 612315 - DNA, 20 bp, Artificial Sequence
  chemically synthesized
tacattgtgtgtttgttctc

SEQ ID NO: 612316 - DNA, 20 bp, Artificial Sequence
  chemically synthesized
tacccagtagtcacccagga

SEQ ID NO: 612317 - DNA, 20 bp, Artificial Sequence
  chemically synthesized
gtcacccaggagcaggtttg

SEQ ID NO: 612318 - DNA, 20 bp, Artificial Sequence
  chemically synthesized
ttccatgtagttgtgcactt

SEQ ID NO: 612319 - DNA, 20 bp, Artificial Sequence
  chemically synthesized
tttcttaatcccgcattcta

SEQ ID NO: 612320 - DNA, 20 bp, Artificial Sequence
  chemically synthesized
cagtgcaatctaattagaat

SEQ ID NO: 612321 - DNA, 20 bp, Artificial Sequence
  chemically synthesized
cactgtgatctgagaggctg

SEQ ID NO: 612322 - DNA, 20 bp, Artificial Sequence
  chemically synthesized
gctgagaagaatgtatattc

SEQ ID NO: 612323 - DNA, 20 bp, Artificial Sequence
  chemically synthesized
gttctgtagatgtctattag

SEQ ID NO: 612324 - DNA, 20 bp, Artificial Sequence
  chemically synthesized
tgaacttgaccacttggctc

SEQ ID NO: 612325 - DNA, 20 bp, Artificial Sequence
  chemically synthesized
agcccagcaagctgagatcc

SEQ ID NO: 612326 - DNA, 20 bp, Artificial Sequence
  chemically synthesized
agaattacaagccagtggat

SEQ ID NO: 612327 - DNA, 20 bp, Artificial Sequence
  chemically synthesized
gtctgaagtggacctgaggc

SEQ ID NO: 612328 - DNA, 20 bp, Artificial Sequence
  chemically synthesized
ggaggggcgtccgccattac

SEQ ID NO: 612329 - DNA, 20 bp, Artificial Sequence
  chemically synthesized
ccattactgaggcttgagta

SEQ ID NO: 612330 - DNA, 20 bp, Artificial Sequence
  chemically synthesized
cagtttgaacttcccagcga

SEQ ID NO: 612331 - DNA, 20 bp, Artificial Sequence
  chemically synthesized
ctgagctacagtgggctctg

SEQ ID NO: 612332 - DNA, 20 bp, Artificial Sequence
  chemically synthesized
tagagaggcagtctggctac

SEQ ID NO: 612333 - DNA, 20 bp, Artificial Sequence
  chemically synthesized
cactgtagccagactgcctc

SEQ ID NO: 612334 - DNA, 20 bp, Artificial Sequence
  chemically synthesized
gaaaggcagcagccccagtc

SEQ ID NO: 612335 - DNA, 20 bp, Artificial Sequence
  chemically synthesized
gtgctctgtctcagggagat

SEQ ID NO: 612336 - DNA, 20 bp, Artificial Sequence
  chemically synthesized
tcttcagagccggcaggcaa

SEQ ID NO: 612337 - DNA, 20 bp, Artificial Sequence
  chemically synthesized
gcactggagctctgctaagg

SEQ ID NO: 612338 - DNA, 20 bp, Artificial Sequence
  chemically synthesized
tggtgggtgcccctctggga

SEQ ID NO: 612339 - DNA, 20 bp, Artificial Sequence
  chemically synthesized
tgctgcctgttccatcctct

SEQ ID NO: 612340 - DNA, 20 bp, Artificial Sequence
  chemically synthesized
cagcagagactgcagaacag

SEQ ID NO: 612341 - DNA, 20 bp, Artificial Sequence
  chemically synthesized
cccctctgctgcaggtttgc

SEQ ID NO: 612342 - DNA, 20 bp, Artificial Sequence
  chemically synthesized
ttcaaacaggcccctctgct

SEQ ID NO: 612343 - DNA, 20 bp, Artificial Sequence
  chemically synthesized
agcaaacctgcagcagaggg

SEQ ID NO: 612344 - DNA, 20 bp, Artificial Sequence
  chemically synthesized
ttgatgctattcctttctgt

SEQ ID NO: 612345 - DNA, 20 bp, Artificial Sequence
  chemically synthesized
tttttgttgatgctattcct

SEQ ID NO: 612346 - DNA, 20 bp, Artificial Sequence
  chemically synthesized
tgacattggtgaccttcaga

SEQ ID NO: 612347 - DNA, 20 bp, Artificial Sequence
  chemically synthesized
tgctggtttttcctcatctt

SEQ ID NO: 612348 - DNA, 20 bp, Artificial Sequence
  chemically synthesized
ggaattttcaccctttttgt

SEQ ID NO: 612349 - DNA, 20 bp, Artificial Sequence
  chemically synthesized
tttggaggagaagaggtgtt

SEQ ID NO: 612350 - DNA, 20 bp, Artificial Sequence
  chemically synthesized
ttctccatccagttttgttc

SEQ ID NO: 612351 - DNA, 20 bp, Artificial Sequence
  chemically synthesized
ttcgtcatactcattctcca

SEQ ID NO: 612352 - DNA, 20 bp, Artificial Sequence
  chemically synthesized
agtatgacgaattgacataa

SEQ ID NO: 612353 - DNA, 20 bp, Artificial Sequence
  chemically synthesized
aacatgctcctttagcttgg

SEQ ID NO: 612354 - DNA, 20 bp, Artificial Sequence
  chemically synthesized
attgggttagaacatgctcc

SEQ ID NO: 612355 - DNA, 20 bp, Artificial Sequence
  chemically synthesized
tctaaccttttttcaaggtt

SEQ ID NO: 612356 - DNA, 20 bp, Artificial Sequence
  chemically synthesized
aggagttgctaactacaata

SEQ ID NO: 612357 - DNA, 20 bp, Artificial Sequence
  chemically synthesized
ttcagttccatcaggtcatt

SEQ ID NO: 612358 - DNA, 20 bp, Artificial Sequence
  chemically synthesized
tgcttcatgaagttgttgtg

SEQ ID NO: 612359 - DNA, 20 bp, Artificial Sequence
  chemically synthesized
attgagctattgatacttgt

SEQ ID NO: 612360 - DNA, 20 bp, Artificial Sequence
  chemically synthesized
tgatatcttttcttctgctg

SEQ ID NO: 612361 - DNA, 20 bp, Artificial Sequence
  chemically synthesized
tccagcagaagaaaagatat

SEQ ID NO: 612362 - DNA, 20 bp, Artificial Sequence
  chemically synthesized
taatgaaataaagtgtgaag

SEQ ID NO: 612363 - DNA, 20 bp, Artificial Sequence
  chemically synthesized
cacatagtcccatatttcgt

SEQ ID NO: 612364 - DNA, 20 bp, Artificial Sequence
  chemically synthesized
actatgtgaaaagacaaaac

SEQ ID NO: 612365 - DNA, 20 bp, Artificial Sequence
  chemically synthesized
tgtgaaaagacaaaacctaa

SEQ ID NO: 612366 - DNA, 20 bp, Artificial Sequence
  chemically synthesized
cccaggtatactaatcaaac

SEQ ID NO: 612367 - DNA, 20 bp, Artificial Sequence
  chemically synthesized
cgccgggataatatcctgaa

SEQ ID NO: 612368 - DNA, 20 bp, Artificial Sequence
  chemically synthesized
tttgaatggtgggctgtctt

SEQ ID NO: 612369 - DNA, 20 bp, Artificial Sequence
  chemically synthesized
caaccccaagacacataatt

SEQ ID NO: 612370 - DNA, 20 bp, Artificial Sequence
  chemically synthesized
caggacagtcaaagagaaag

SEQ ID NO: 612371 - DNA, 20 bp, Artificial Sequence
  chemically synthesized
aaagatctgctgttagtctg

SEQ ID NO: 612372 - DNA, 20 bp, Artificial Sequence
  chemically synthesized
ccctactctcttctggcttg

SEQ ID NO: 612373 - DNA, 20 bp, Artificial Sequence
  chemically synthesized
aatattggcccctactctct

SEQ ID NO: 612374 - DNA, 20 bp, Artificial Sequence
  chemically synthesized
gaatttcatagccagtcaaa

SEQ ID NO: 612375 - DNA, 20 bp, Artificial Sequence
  chemically synthesized
tttctccttcgcttatgaag

SEQ ID NO: 612376 - DNA, 20 bp, Artificial Sequence
  chemically synthesized
ttctatttctccttcgctta

SEQ ID NO: 612377 - DNA, 20 bp, Artificial Sequence
  chemically synthesized
tttaaagcattctatttctc

SEQ ID NO: 612378 - DNA, 20 bp, Artificial Sequence
  chemically synthesized
tcataagcgaaggagaaata

SEQ ID NO: 612379 - DNA, 20 bp, Artificial Sequence
  chemically synthesized
tttaaagacgagcaaatgct

SEQ ID NO: 612380 - DNA, 20 bp, Artificial Sequence
  chemically synthesized
tggtttgtccttgccatatt

SEQ ID NO: 612381 - DNA, 20 bp, Artificial Sequence
  chemically synthesized
atgcttctgcagtggctggt

SEQ ID NO: 612382 - DNA, 20 bp, Artificial Sequence
  chemically synthesized
tcgatggtgtttacaatttg

SEQ ID NO: 612383 - DNA, 20 bp, Artificial Sequence
  chemically synthesized
cagtttcttcatggtgtcga

SEQ ID NO: 612384 - DNA, 20 bp, Artificial Sequence
  chemically synthesized
ttattttgcttgttagttga

SEQ ID NO: 612385 - DNA, 20 bp, Artificial Sequence
  chemically synthesized
attatgatgctagctggtta

SEQ ID NO: 612386 - DNA, 20 bp, Artificial Sequence
  chemically synthesized
gcctatgtgtgtctttgcac

SEQ ID NO: 612387 - DNA, 20 bp, Artificial Sequence
  chemically synthesized
ttttattttttttgctttcc

SEQ ID NO: 612388 - DNA, 20 bp, Artificial Sequence
  chemically synthesized
gcaacccctgcttttatttt

SEQ ID NO: 612389 - DNA, 20 bp, Artificial Sequence
  chemically synthesized
tcagagaatagaattgcaac

SEQ ID NO: 612390 - DNA, 20 bp, Artificial Sequence
  chemically synthesized
taaaatagactttaaactaa

SEQ ID NO: 612391 - DNA, 20 bp, Artificial Sequence
  chemically synthesized
tttgttttttttaaatcttt

SEQ ID NO: 612392 - DNA, 20 bp, Artificial Sequence
  chemically synthesized
taatgcccttctttgtcttt

SEQ ID NO: 612393 - DNA, 20 bp, Artificial Sequence
  chemically synthesized
atgcacccaatacaggagca

SEQ ID NO: 612394 - DNA, 20 bp, Artificial Sequence
  chemically synthesized
ctctatgtaggtctctaaga

SEQ ID NO: 612395 - DNA, 20 bp, Artificial Sequence
  chemically synthesized
gtgttaaagtctcccactat

SEQ ID NO: 612396 - DNA, 20 bp, Artificial Sequence
  chemically synthesized
gctgagaagaatgtatattc

SEQ ID NO: 612397 - DNA, 20 bp, Artificial Sequence
  chemically synthesized
attcttttgcatttgctgag

SEQ ID NO: 612398 - DNA, 20 bp, Artificial Sequence
  chemically synthesized
gtggtctgagaggttggttg

SEQ ID NO: 612399 - DNA, 20 bp, Artificial Sequence
  chemically synthesized
cagtgcaaacaaattagaac

SEQ ID NO: 612400 - DNA, 20 bp, Artificial Sequence
  chemically synthesized
tttcttaatcctgagttcta

SEQ ID NO: 612401 - DNA, 20 bp, Artificial Sequence
  chemically synthesized
atgtagttgtatggttttga

SEQ ID NO: 612402 - DNA, 20 bp, Artificial Sequence
  chemically synthesized
tgttagtttccatgtagttg

SEQ ID NO: 612403 - DNA, 20 bp, Artificial Sequence
  chemically synthesized
caactacatggaaactaaca

SEQ ID NO: 612404 - DNA, 20 bp, Artificial Sequence
  chemically synthesized
tagttattcagaagcagatt

SEQ ID NO: 612405 - DNA, 20 bp, Artificial Sequence
  chemically synthesized
ttacccagtagttattcaga

SEQ ID NO: 612406 - DNA, 20 bp, Artificial Sequence
  chemically synthesized
cacattgtatctttgttctc

SEQ ID NO: 612407 - DNA, 20 bp, Artificial Sequence
  chemically synthesized
acactgctttagctgtgtcc

SEQ ID NO: 612408 - DNA, 20 bp, Artificial Sequence
  chemically synthesized
gctgtaaatttccctctcaa

SEQ ID NO: 612409 - DNA, 20 bp, Artificial Sequence
  chemically synthesized
gggtgttgattttagatctt

SEQ ID NO: 612410 - DNA, 20 bp, Artificial Sequence
  chemically synthesized
tttcagttgtgatgttaggg

SEQ ID NO: 612411 - DNA, 20 bp, Artificial Sequence
  chemically synthesized
ctagcttttgatttgcttgc

SEQ ID NO: 612412 - DNA, 20 bp, Artificial Sequence
  chemically synthesized
ttgtcttctgctagcttttg

SEQ ID NO: 612413 - DNA, 20 bp, Artificial Sequence
  chemically synthesized
atttcttgtcttctgctagc

SEQ ID NO: 612414 - DNA, 20 bp, Artificial Sequence
  chemically synthesized
ttagttatttcttgtcttct

SEQ ID NO: 612415 - DNA, 20 bp, Artificial Sequence
  chemically synthesized
tttttttttttttttttttt

SEQ ID NO: 612416 - DNA, 20 bp, Artificial Sequence
  chemically synthesized
aaaacacctcctggatttgt

SEQ ID NO: 612417 - DNA, 20 bp, Artificial Sequence
  chemically synthesized
aaaacatcaacaaatccagg

SEQ ID NO: 612418 - DNA, 20 bp, Artificial Sequence
  chemically synthesized
ctcttcaaaaaaaaacacct

SEQ ID NO: 612419 - DNA, 20 bp, Artificial Sequence
  chemically synthesized
ccaggaggtgtttttttttg

SEQ ID NO: 612420 - DNA, 20 bp, Artificial Sequence
  chemically synthesized
tatcattttttattgtgtct

SEQ ID NO: 612421 - DNA, 20 bp, Artificial Sequence
  chemically synthesized
tgtttgtagtattctctgat

SEQ ID NO: 612422 - DNA, 20 bp, Artificial Sequence
  chemically synthesized
tttcctgtttatttgcgtag

SEQ ID NO: 612423 - DNA, 20 bp, Artificial Sequence
  chemically synthesized
tctacgcaaataaacaggaa

SEQ ID NO: 612424 - DNA, 20 bp, Artificial Sequence
  chemically synthesized
tcttatcgcttaaacaggtt

SEQ ID NO: 612425 - DNA, 20 bp, Artificial Sequence
  chemically synthesized
aagagcatcttatcgcttaa

SEQ ID NO: 612426 - DNA, 20 bp, Artificial Sequence
  chemically synthesized
ttccaattgaaagagcatct

SEQ ID NO: 612427 - DNA, 20 bp, Artificial Sequence
  chemically synthesized
ttggaagagtctatatatag

SEQ ID NO: 612428 - DNA, 20 bp, Artificial Sequence
  chemically synthesized
tatagaaaggctttacagat

SEQ ID NO: 612429 - DNA, 20 bp, Artificial Sequence
  chemically synthesized
gatccagccactgcttatgg

SEQ ID NO: 612430 - DNA, 20 bp, Artificial Sequence
  chemically synthesized
ctgattaatgaagatccagc

SEQ ID NO: 612431 - DNA, 20 bp, Artificial Sequence
  chemically synthesized
aaaatgtaatatgaaataca

SEQ ID NO: 612432 - DNA, 20 bp, Artificial Sequence
  chemically synthesized
ctgtatttcatattacattt

SEQ ID NO: 612433 - DNA, 20 bp, Artificial Sequence
  chemically synthesized
ttttgttgattttaaattgt

SEQ ID NO: 612434 - DNA, 20 bp, Artificial Sequence
  chemically synthesized
ctattcatgtacctgccttt

SEQ ID NO: 612435 - DNA, 20 bp, Artificial Sequence
  chemically synthesized
ctcgtcaacctactttttaa

SEQ ID NO: 612436 - DNA, 20 bp, Artificial Sequence
  chemically synthesized
ggtgtatatatttacctatt

SEQ ID NO: 612437 - DNA, 20 bp, Artificial Sequence
  chemically synthesized
tttttcttattaagtgacaa

SEQ ID NO: 612438 - DNA, 20 bp, Artificial Sequence
  chemically synthesized
tctatttttaaatcttctct

SEQ ID NO: 612439 - DNA, 20 bp, Artificial Sequence
  chemically synthesized
tcctttcataaaacagtaag

SEQ ID NO: 612440 - DNA, 20 bp, Artificial Sequence
  chemically synthesized
caataatgggaactgaccat

SEQ ID NO: 612441 - DNA, 20 bp, Artificial Sequence
  chemically synthesized
aaagataaggctgttaatat

SEQ ID NO: 612442 - DNA, 20 bp, Artificial Sequence
  chemically synthesized
tttgaaagataaggctgtta

SEQ ID NO: 612443 - DNA, 20 bp, Artificial Sequence
  chemically synthesized
ttgactcgtagtacacattt

SEQ ID NO: 612444 - DNA, 20 bp, Artificial Sequence
  chemically synthesized
tccttagtttgcagtatagg

SEQ ID NO: 612445 - DNA, 20 bp, Artificial Sequence
  chemically synthesized
ctatactgcaaactaaggac

SEQ ID NO: 612446 - DNA, 20 bp, Artificial Sequence
  chemically synthesized
gaaactattaatcctacgtc

SEQ ID NO: 612447 - DNA, 20 bp, Artificial Sequence
  chemically synthesized
caaactaaggacgtaggatt

SEQ ID NO: 612448 - DNA, 20 bp, Artificial Sequence
  chemically synthesized
cacgatagtatccctcctac

SEQ ID NO: 612449 - DNA, 20 bp, Artificial Sequence
  chemically synthesized
tgaatactgtaacccctttt

SEQ ID NO: 612450 - DNA, 20 bp, Artificial Sequence
  chemically synthesized
gatcagattaagttgacttg

SEQ ID NO: 612451 - DNA, 20 bp, Artificial Sequence
  chemically synthesized
tgttagtttgtgaagttggg

SEQ ID NO: 612452 - DNA, 20 bp, Artificial Sequence
  chemically synthesized
aagcaaattacaacaaaaat

SEQ ID NO: 612453 - DNA, 20 bp, Artificial Sequence
  chemically synthesized
aaactaacatttttgttgta

SEQ ID NO: 612454 - DNA, 20 bp, Artificial Sequence
  chemically synthesized
taatttgctttcccaagtac

SEQ ID NO: 612455 - DNA, 20 bp, Artificial Sequence
  chemically synthesized
tcaattgtatgtgaatattc

SEQ ID NO: 612456 - DNA, 20 bp, Artificial Sequence
  chemically synthesized
tgctgcttgttatatctcat

SEQ ID NO: 612457 - DNA, 20 bp, Artificial Sequence
  chemically synthesized
tggggtgggaggagttaact

SEQ ID NO: 612458 - DNA, 20 bp, Artificial Sequence
  chemically synthesized
tgctagatgatctgaggcaa

SEQ ID NO: 612459 - DNA, 20 bp, Artificial Sequence
  chemically synthesized
tcagttttgcagacgcagaa

SEQ ID NO: 612460 - DNA, 20 bp, Artificial Sequence
  chemically synthesized
ctgcgtctgcaaaactgagt

SEQ ID NO: 612461 - DNA, 20 bp, Artificial Sequence
  chemically synthesized
ttatcaaccagaatctagta

SEQ ID NO: 612462 - DNA, 20 bp, Artificial Sequence
  chemically synthesized
ggctgtcttctgggtcattt

SEQ ID NO: 612463 - DNA, 20 bp, Artificial Sequence
  chemically synthesized
accatccatattgaaagatc

SEQ ID NO: 612464 - DNA, 20 bp, Artificial Sequence
  chemically synthesized
tcctgttttggaattgatga

SEQ ID NO: 612465 - DNA, 20 bp, Artificial Sequence
  chemically synthesized
aaatgcttttgggaatatta

SEQ ID NO: 612466 - DNA, 20 bp, Artificial Sequence
  chemically synthesized
attcccaaaagcatttaatt

SEQ ID NO: 612467 - DNA, 20 bp, Artificial Sequence
  chemically synthesized
tacaatagaagctgataatt

SEQ ID NO: 612468 - DNA, 20 bp, Artificial Sequence
  chemically synthesized
attatcagcttctattgtag

SEQ ID NO: 612469 - DNA, 20 bp, Artificial Sequence
  chemically synthesized
ccaaatatcatcttcaatcc

SEQ ID NO: 612470 - DNA, 20 bp, Artificial Sequence
  chemically synthesized
gagttggaaaagtgaaatcg

SEQ ID NO: 612471 - DNA, 20 bp, Artificial Sequence
  chemically synthesized
accgatttcacttttccaac

SEQ ID NO: 612472 - DNA, 20 bp, Artificial Sequence
  chemically synthesized
tagcctctgttctcaattct

SEQ ID NO: 612473 - DNA, 20 bp, Artificial Sequence
  chemically synthesized
atagtcataccttccagacg

SEQ ID NO: 612474 - DNA, 20 bp, Artificial Sequence
  chemically synthesized
ctgttggatggttactcatt

SEQ ID NO: 612475 - DNA, 20 bp, Artificial Sequence
  chemically synthesized
acaacagaagtagtggcagg

SEQ ID NO: 612476 - DNA, 20 bp, Artificial Sequence
  chemically synthesized
agtagtggcaggaatagatt

SEQ ID NO: 612477 - DNA, 20 bp, Artificial Sequence
  chemically synthesized
atatactctataaaaggcaa

SEQ ID NO: 612478 - DNA, 20 bp, Artificial Sequence
  chemically synthesized
aagagtagctaattaattat

SEQ ID NO: 612479 - DNA, 20 bp, Artificial Sequence
  chemically synthesized
aatgttttgcttatgctacc

SEQ ID NO: 612480 - DNA, 20 bp, Artificial Sequence
  chemically synthesized
ataattataaaaagttaatg

SEQ ID NO: 612481 - DNA, 20 bp, Artificial Sequence
  chemically synthesized
tccaaataattataaaaagt

SEQ ID NO: 612482 - DNA, 20 bp, Artificial Sequence
  chemically synthesized
ccatagggcatacacatttt

SEQ ID NO: 612483 - DNA, 20 bp, Artificial Sequence
  chemically synthesized
gtattggaaaacttaagata

SEQ ID NO: 612484 - DNA, 20 bp, Artificial Sequence
  chemically synthesized
aaaatacaaaactacatatc

SEQ ID NO: 612485 - DNA, 20 bp, Artificial Sequence
  chemically synthesized
gcttttagtatggtagagtt

SEQ ID NO: 612486 - DNA, 20 bp, Artificial Sequence
  chemically synthesized
taccactgcttttagtatgg

SEQ ID NO: 612487 - DNA, 20 bp, Artificial Sequence
  chemically synthesized
ttggtaaatttctggactac

SEQ ID NO: 612488 - DNA, 20 bp, Artificial Sequence
  chemically synthesized
tttaccaaccttcaggatcg

SEQ ID NO: 612489 - DNA, 20 bp, Artificial Sequence
  chemically synthesized
gacctatttgactggaatag

SEQ ID NO: 612490 - DNA, 20 bp, Artificial Sequence
  chemically synthesized
ttgtgtatgtgtgtatgtgt

SEQ ID NO: 612491 - DNA, 20 bp, Artificial Sequence
  chemically synthesized
aaatctcatggaacattcta

SEQ ID NO: 612492 - DNA, 20 bp, Artificial Sequence
  chemically synthesized
aaatcaatctagaatgttcc

SEQ ID NO: 612493 - DNA, 20 bp, Artificial Sequence
  chemically synthesized
aagtaaatctcatggaacat

SEQ ID NO: 612494 - DNA, 20 bp, Artificial Sequence
  chemically synthesized
atgttccatgagatttactt

SEQ ID NO: 612495 - DNA, 20 bp, Artificial Sequence
  chemically synthesized
gatcttccattaaaattatt

SEQ ID NO: 612496 - DNA, 20 bp, Artificial Sequence
  chemically synthesized
cacctccgtctcccaaattg

SEQ ID NO: 612497 - DNA, 20 bp, Artificial Sequence
  chemically synthesized
gcctagacaatttggtgaaa

SEQ ID NO: 612498 - DNA, 20 bp, Artificial Sequence
  chemically synthesized
ttttttttttttggtagaaa

SEQ ID NO: 612499 - DNA, 20 bp, Artificial Sequence
  chemically synthesized
ggcatgtgacaccacaccca

SEQ ID NO: 612500 - DNA, 20 bp, Artificial Sequence
  chemically synthesized
gcccaggctagagtacagtg

SEQ ID NO: 612501 - DNA, 20 bp, Artificial Sequence
  chemically synthesized
atgtataccttaaatacata

SEQ ID NO: 612502 - DNA, 20 bp, Artificial Sequence
  chemically synthesized
gcgtagattatttgtcatct

SEQ ID NO: 612503 - DNA, 20 bp, Artificial Sequence
  chemically synthesized
gaagatgacaaataatctac

SEQ ID NO: 612504 - DNA, 20 bp, Artificial Sequence
  chemically synthesized
ttgttgcttggataagctag

SEQ ID NO: 612505 - DNA, 20 bp, Artificial Sequence
  chemically synthesized
ggatgagatagataaatttt

SEQ ID NO: 612506 - DNA, 20 bp, Artificial Sequence
  chemically synthesized
ttatctatctcatccagtct

SEQ ID NO: 612507 - DNA, 20 bp, Artificial Sequence
  chemically synthesized
ccagccatttactggtaatg

SEQ ID NO: 612508 - DNA, 20 bp, Artificial Sequence
  chemically synthesized
ctcttccctaaacttcaaat

SEQ ID NO: 612509 - DNA, 20 bp, Artificial Sequence
  chemically synthesized
gtttagaagaatctataatt

SEQ ID NO: 612510 - DNA, 20 bp, Artificial Sequence
  chemically synthesized
gattactaaatggagataat

SEQ ID NO: 612511 - DNA, 20 bp, Artificial Sequence
  chemically synthesized
attatctccatttagtaatc

SEQ ID NO: 612512 - DNA, 20 bp, Artificial Sequence
  chemically synthesized
cagttcaggacacttgaagc

SEQ ID NO: 612513 - DNA, 20 bp, Artificial Sequence
  chemically synthesized
gaagctcagttcaggacact

SEQ ID NO: 612514 - DNA, 20 bp, Artificial Sequence
  chemically synthesized
caagcttcaagtgtcctgaa

SEQ ID NO: 612515 - DNA, 20 bp, Artificial Sequence
  chemically synthesized
agtgtcctgaactgagcttc

SEQ ID NO: 612516 - DNA, 20 bp, Artificial Sequence
  chemically synthesized
gagaacagcaagaaaagtag

SEQ ID NO: 612517 - DNA, 20 bp, Artificial Sequence
  chemically synthesized
cccttcctcaataatgaaca

SEQ ID NO: 612518 - DNA, 20 bp, Artificial Sequence
  chemically synthesized
tagtcattaaggatgactcc

SEQ ID NO: 612519 - DNA, 20 bp, Artificial Sequence
  chemically synthesized
tcaaaatgtattcagaattt

SEQ ID NO: 612520 - DNA, 20 bp, Artificial Sequence
  chemically synthesized
tgataattcatgcaagataa

SEQ ID NO: 612521 - DNA, 20 bp, Artificial Sequence
  chemically synthesized
gttgccagagtgatctgtta

SEQ ID NO: 612522 - DNA, 20 bp, Artificial Sequence
  chemically synthesized
tcatatccgtcttctcaaat

SEQ ID NO: 612523 - DNA, 20 bp, Artificial Sequence
  chemically synthesized
aatttgtacttcccctaaag

SEQ ID NO: 612524 - DNA, 20 bp, Artificial Sequence
  chemically synthesized
ggtccaggtccctattaact

SEQ ID NO: 612525 - DNA, 20 bp, Artificial Sequence
  chemically synthesized
catattccataaacaggatc

SEQ ID NO: 612526 - DNA, 20 bp, Artificial Sequence
  chemically synthesized
caagtgcaggaaactatgga

SEQ ID NO: 612527 - DNA, 20 bp, Artificial Sequence
  chemically synthesized
aggatccatagtttcctgca

SEQ ID NO: 612528 - DNA, 20 bp, Artificial Sequence
  chemically synthesized
ttcctgcacttggatttgga

SEQ ID NO: 612529 - DNA, 20 bp, Artificial Sequence
  chemically synthesized
aatggaagtaaaggagtgag

SEQ ID NO: 612530 - DNA, 20 bp, Artificial Sequence
  chemically synthesized
cagggaagaacttatcagtg

SEQ ID NO: 612531 - DNA, 20 bp, Artificial Sequence
  chemically synthesized
ggccagcatgcaattttaga

SEQ ID NO: 612532 - DNA, 20 bp, Artificial Sequence
  chemically synthesized
agcctcagcctcccaaagtg

SEQ ID NO: 612533 - DNA, 20 bp, Artificial Sequence
  chemically synthesized
ccttcagcctcagcctccca

SEQ ID NO: 612534 - DNA, 20 bp, Artificial Sequence
  chemically synthesized
cactttgggaggctgaggct

SEQ ID NO: 612535 - DNA, 20 bp, Artificial Sequence
  chemically synthesized
tgggaggctgaggctgaagg

SEQ ID NO: 612536 - DNA, 20 bp, Artificial Sequence
  chemically synthesized
cactatagccacccaggctc

SEQ ID NO: 612537 - DNA, 20 bp, Artificial Sequence
  chemically synthesized
gcctgggtggctatagtgag

SEQ ID NO: 612538 - DNA, 20 bp, Artificial Sequence
  chemically synthesized
tgtgagtttgatttgaggca

SEQ ID NO: 612539 - DNA, 20 bp, Artificial Sequence
  chemically synthesized
aagaaaataagtatatgtga

SEQ ID NO: 612540 - DNA, 20 bp, Artificial Sequence
  chemically synthesized
gagaaagaaaataagtatat

SEQ ID NO: 612541 - DNA, 20 bp, Artificial Sequence
  chemically synthesized
tacttattttctttctcctt

SEQ ID NO: 612542 - DNA, 20 bp, Artificial Sequence
  chemically synthesized
cagtgaacaaaataggcaat

SEQ ID NO: 612543 - DNA, 20 bp, Artificial Sequence
  chemically synthesized
agcctttattttgtgtcagg

SEQ ID NO: 612544 - DNA, 20 bp, Artificial Sequence
  chemically synthesized
attatcaagtaacatggtat

SEQ ID NO: 612545 - DNA, 20 bp, Artificial Sequence
  chemically synthesized
aagaggcagttcttgtctta

SEQ ID NO: 612546 - DNA, 20 bp, Artificial Sequence
  chemically synthesized
tttagagtttaattaattca

SEQ ID NO: 612547 - DNA, 20 bp, Artificial Sequence
  chemically synthesized
tgtctgtgttttttcacatt

SEQ ID NO: 612548 - DNA, 20 bp, Artificial Sequence
  chemically synthesized
acaaaacattttcttattgt

SEQ ID NO: 612549 - DNA, 20 bp, Artificial Sequence
  chemically synthesized
aaaaaacacagacaataaga

SEQ ID NO: 612550 - DNA, 20 bp, Artificial Sequence
  chemically synthesized
cagaaaactttcttgaccgc

SEQ ID NO: 612551 - DNA, 20 bp, Artificial Sequence
  chemically synthesized
gtaaaatctgaagcggtcaa

SEQ ID NO: 612552 - DNA, 20 bp, Artificial Sequence
  chemically synthesized
cagcctcagaaaactttctt

SEQ ID NO: 612553 - DNA, 20 bp, Artificial Sequence
  chemically synthesized
aaagttttctgaggctgaaa

SEQ ID NO: 612554 - DNA, 20 bp, Artificial Sequence
  chemically synthesized
ggctgaaagacagattaaat

SEQ ID NO: 612555 - DNA, 20 bp, Artificial Sequence
  chemically synthesized
gtcttgattatctgagcatg

SEQ ID NO: 612556 - DNA, 20 bp, Artificial Sequence
  chemically synthesized
gtgaggtcttgattatctga

SEQ ID NO: 612557 - DNA, 20 bp, Artificial Sequence
  chemically synthesized
atggagccaggcctgtgagg

SEQ ID NO: 612558 - DNA, 20 bp, Artificial Sequence
  chemically synthesized
ctcacaggcctggctccatt

SEQ ID NO: 612559 - DNA, 20 bp, Artificial Sequence
  chemically synthesized
taagtatcaagtggtgggag

SEQ ID NO: 612560 - DNA, 20 bp, Artificial Sequence
  chemically synthesized
gtttaaaagaaagaaactgg

SEQ ID NO: 612561 - DNA, 20 bp, Artificial Sequence
  chemically synthesized
caacaccttatgcaaactca

SEQ ID NO: 612562 - DNA, 20 bp, Artificial Sequence
  chemically synthesized
caacagattctcaaaggtgt

SEQ ID NO: 612563 - DNA, 20 bp, Artificial Sequence
  chemically synthesized
gtagaagtttcatagctctc

SEQ ID NO: 612564 - DNA, 20 bp, Artificial Sequence
  chemically synthesized
gagagtttttttgtaggagt

SEQ ID NO: 612565 - DNA, 20 bp, Artificial Sequence
  chemically synthesized
agactctgttcacagatatg

SEQ ID NO: 612566 - DNA, 20 bp, Artificial Sequence
  chemically synthesized
atctgtgaacagagtctaca

SEQ ID NO: 612567 - DNA, 20 bp, Artificial Sequence
  chemically synthesized
atttgaatctattaatggac

SEQ ID NO: 612568 - DNA, 20 bp, Artificial Sequence
  chemically synthesized
ctcttaaacaggagtccatt

SEQ ID NO: 612569 - DNA, 20 bp, Artificial Sequence
  chemically synthesized
tttttttcgttattttgttt

SEQ ID NO: 612570 - DNA, 20 bp, Artificial Sequence
  chemically synthesized
tttttttgtttttttcgtta

SEQ ID NO: 612571 - DNA, 20 bp, Artificial Sequence
  chemically synthesized
aactacctttgtaacttttt

SEQ ID NO: 612572 - DNA, 20 bp, Artificial Sequence
  chemically synthesized
aacaaaaaaaaagttacaaa

SEQ ID NO: 612573 - DNA, 20 bp, Artificial Sequence
  chemically synthesized
gcgcctggccaattttgaat

SEQ ID NO: 612574 - DNA, 20 bp, Artificial Sequence
  chemically synthesized
gacgggtcaatcacctgagg

SEQ ID NO: 612575 - DNA, 20 bp, Artificial Sequence
  chemically synthesized
ggtctcgaaatcctggcctc

SEQ ID NO: 612576 - DNA, 20 bp, Artificial Sequence
  chemically synthesized
ttttgtatttttagtagtgt

SEQ ID NO: 612577 - DNA, 20 bp, Artificial Sequence
  chemically synthesized
tcaggaggctgaggcagtag

SEQ ID NO: 612578 - DNA, 20 bp, Artificial Sequence
  chemically synthesized
aacctccacttcccaggttc

SEQ ID NO: 612579 - DNA, 20 bp, Artificial Sequence
  chemically synthesized
aaaaatacataaataaaggt

SEQ ID NO: 612580 - DNA, 20 bp, Artificial Sequence
  chemically synthesized
ataaataaaggtataggttt

SEQ ID NO: 612581 - DNA, 20 bp, Artificial Sequence
  chemically synthesized
aggtttattggtttcttctt

SEQ ID NO: 612582 - DNA, 20 bp, Artificial Sequence
  chemically synthesized
gtattggaaaatatggaggg

SEQ ID NO: 612583 - DNA, 20 bp, Artificial Sequence
  chemically synthesized
taggggtattggaaaatatg

SEQ ID NO: 612584 - DNA, 20 bp, Artificial Sequence
  chemically synthesized
tccaatacccctaacagcta

SEQ ID NO: 612585 - DNA, 20 bp, Artificial Sequence
  chemically synthesized
cagctaacaagcttatggaa

SEQ ID NO: 612586 - DNA, 20 bp, Artificial Sequence
  chemically synthesized
ttgtaaataagctagtttcc

SEQ ID NO: 612587 - DNA, 20 bp, Artificial Sequence
  chemically synthesized
attatccaatttgtaaataa

SEQ ID NO: 612588 - DNA, 20 bp, Artificial Sequence
  chemically synthesized
taggtgggaacatatgagaa

SEQ ID NO: 612589 - DNA, 20 bp, Artificial Sequence
  chemically synthesized
actatgccatagatgagaaa

SEQ ID NO: 612590 - DNA, 20 bp, Artificial Sequence
  chemically synthesized
agtatgatgagaaaaaagag

SEQ ID NO: 612591 - DNA, 20 bp, Artificial Sequence
  chemically synthesized
atctaagtcatataatttat

SEQ ID NO: 612592 - DNA, 20 bp, Artificial Sequence
  chemically synthesized
acctcaaaggccttttggtt

SEQ ID NO: 612593 - DNA, 20 bp, Artificial Sequence
  chemically synthesized
gtgggtttccttcatagttg

SEQ ID NO: 612594 - DNA, 20 bp, Artificial Sequence
  chemically synthesized
aggttaacattaaatgctgt

SEQ ID NO: 612595 - DNA, 20 bp, Artificial Sequence
  chemically synthesized
ttgacttgcaaccaaggatc

SEQ ID NO: 612596 - DNA, 20 bp, Artificial Sequence
  chemically synthesized
gatttttaattaaatcaaca

SEQ ID NO: 612597 - DNA, 20 bp, Artificial Sequence
  chemically synthesized
ttacactatcctaatcatgg

SEQ ID NO: 612598 - DNA, 20 bp, Artificial Sequence
  chemically synthesized
ttggctaacatgtggtagag

SEQ ID NO: 612599 - DNA, 20 bp, Artificial Sequence
  chemically synthesized
gctctaccacatgttagcca

SEQ ID NO: 612600 - DNA, 20 bp, Artificial Sequence
  chemically synthesized
aggttacgtaatttacctaa

SEQ ID NO: 612601 - DNA, 20 bp, Artificial Sequence
  chemically synthesized
gacagcatctacgtcatgga

SEQ ID NO: 612602 - DNA, 20 bp, Artificial Sequence
  chemically synthesized
aacggtgtctacaaaataat

SEQ ID NO: 612603 - DNA, 20 bp, Artificial Sequence
  chemically synthesized
aataataattgtttaaaaac

SEQ ID NO: 612604 - DNA, 20 bp, Artificial Sequence
  chemically synthesized
tacagcaaaataatagaaac

SEQ ID NO: 612605 - DNA, 20 bp, Artificial Sequence
  chemically synthesized
gttctgtaaagataggtgtt

SEQ ID NO: 612606 - DNA, 20 bp, Artificial Sequence
  chemically synthesized
tatatcagttctgtaaagat

SEQ ID NO: 612607 - DNA, 20 bp, Artificial Sequence
  chemically synthesized
acctcccatttcggattaca

SEQ ID NO: 612608 - DNA, 20 bp, Artificial Sequence
  chemically synthesized
gcctcttctccacctcccat

SEQ ID NO: 612609 - DNA, 20 bp, Artificial Sequence
  chemically synthesized
gaggcgagagtaagaatgtg

SEQ ID NO: 612610 - DNA, 20 bp, Artificial Sequence
  chemically synthesized
gtaagaatgtgtgatgattt

SEQ ID NO: 612611 - DNA, 20 bp, Artificial Sequence
  chemically synthesized
tacctcattttaaattttta

SEQ ID NO: 612612 - DNA, 20 bp, Artificial Sequence
  chemically synthesized
aatcattttatagttgtaat

SEQ ID NO: 612613 - DNA, 20 bp, Artificial Sequence
  chemically synthesized
aagcaaaaattacaactata

SEQ ID NO: 612614 - DNA, 20 bp, Artificial Sequence
  chemically synthesized
tggggatgaaacataatatg

SEQ ID NO: 612615 - DNA, 20 bp, Artificial Sequence
  chemically synthesized
tagtatgaaaaccagccata

SEQ ID NO: 612616 - DNA, 20 bp, Artificial Sequence
  chemically synthesized
aaatacctatactgttagaa

SEQ ID NO: 612617 - DNA, 20 bp, Artificial Sequence
  chemically synthesized
ggttataataatatgtgtga

SEQ ID NO: 612618 - DNA, 20 bp, Artificial Sequence
  chemically synthesized
aagaattgaaataaggtaag

SEQ ID NO: 612619 - DNA, 20 bp, Artificial Sequence
  chemically synthesized
attggggtcatgaagacaca

SEQ ID NO: 612620 - DNA, 20 bp, Artificial Sequence
  chemically synthesized
gtcatgaagacacattgtgt

SEQ ID NO: 612621 - DNA, 20 bp, Artificial Sequence
  chemically synthesized
tgtttctgttttccctttgc

SEQ ID NO: 612622 - DNA, 20 bp, Artificial Sequence
  chemically synthesized
tgctcctgattctagtgttc

SEQ ID NO: 612623 - DNA, 20 bp, Artificial Sequence
  chemically synthesized
gctgtggtaatacactaaaa

SEQ ID NO: 612624 - DNA, 20 bp, Artificial Sequence
  chemically synthesized
atatttctaagcaattatca

SEQ ID NO: 612625 - DNA, 20 bp, Artificial Sequence
  chemically synthesized
ttgtgttaaaacccaatgat

SEQ ID NO: 612626 - DNA, 20 bp, Artificial Sequence
  chemically synthesized
tttaacacaaaaagtagaaa

SEQ ID NO: 612627 - DNA, 20 bp, Artificial Sequence
  chemically synthesized
tacaatacccttcaaaggaa

SEQ ID NO: 612628 - DNA, 20 bp, Artificial Sequence
  chemically synthesized
gaagggtattgtagtggact

SEQ ID NO: 612629 - DNA, 20 bp, Artificial Sequence
  chemically synthesized
catgtagttaatatagagca

SEQ ID NO: 612630 - DNA, 20 bp, Artificial Sequence
  chemically synthesized
tggttgaactctctgttcca

SEQ ID NO: 612631 - DNA, 20 bp, Artificial Sequence
  chemically synthesized
caaatacaaaaagaaggggg

SEQ ID NO: 612632 - DNA, 20 bp, Artificial Sequence
  chemically synthesized
cttttcaagaggttcttcac

SEQ ID NO: 612633 - DNA, 20 bp, Artificial Sequence
  chemically synthesized
taatacataaagagagttac

SEQ ID NO: 612634 - DNA, 20 bp, Artificial Sequence
  chemically synthesized
cagtaaacatacccaaattg

SEQ ID NO: 612635 - DNA, 20 bp, Artificial Sequence
  chemically synthesized
gataaaacagggcaatttgg

SEQ ID NO: 612636 - DNA, 20 bp, Artificial Sequence
  chemically synthesized
atatttgttaatattctatt

SEQ ID NO: 612637 - DNA, 20 bp, Artificial Sequence
  chemically synthesized
ttaacaaatatagagtggga

SEQ ID NO: 612638 - DNA, 20 bp, Artificial Sequence
  chemically synthesized
tatagagtgggaacatgctt

SEQ ID NO: 612639 - DNA, 20 bp, Artificial Sequence
  chemically synthesized
tgtggtccttgttggctctc

SEQ ID NO: 612640 - DNA, 20 bp, Artificial Sequence
  chemically synthesized
taacactaagggcccgaaaa

SEQ ID NO: 612641 - DNA, 20 bp, Artificial Sequence
  chemically synthesized
caatgctcatttatgcagcc

SEQ ID NO: 612642 - DNA, 20 bp, Artificial Sequence
  chemically synthesized
aagggatagagacattctgt

SEQ ID NO: 612643 - DNA, 20 bp, Artificial Sequence
  chemically synthesized
gtttctcgtatgacagaaga

SEQ ID NO: 612644 - DNA, 20 bp, Artificial Sequence
  chemically synthesized
tacgagaaacaatgtgttaa

SEQ ID NO: 612645 - DNA, 20 bp, Artificial Sequence
  chemically synthesized
cacgttaagcagcgttaaca

SEQ ID NO: 612646 - DNA, 20 bp, Artificial Sequence
  chemically synthesized
tccaggtgaattactcagca

SEQ ID NO: 612647 - DNA, 20 bp, Artificial Sequence
  chemically synthesized
tttaattaaccccatcccga

SEQ ID NO: 612648 - DNA, 20 bp, Artificial Sequence
  chemically synthesized
ttgtcaggtgtcttgctcca

SEQ ID NO: 612649 - DNA, 20 bp, Artificial Sequence
  chemically synthesized
tggagcaagacacctgacaa

SEQ ID NO: 612650 - DNA, 20 bp, Artificial Sequence
  chemically synthesized
gacaaagatgcttatttgaa

SEQ ID NO: 612651 - DNA, 20 bp, Artificial Sequence
  chemically synthesized
gaaatgtgtttgctcttgga

SEQ ID NO: 612652 - DNA, 20 bp, Artificial Sequence
  chemically synthesized
ccttagagaaaattaatatt

SEQ ID NO: 612653 - DNA, 20 bp, Artificial Sequence
  chemically synthesized
tattcttagcttttctagaa

SEQ ID NO: 612654 - DNA, 20 bp, Artificial Sequence
  chemically synthesized
ctaccattttcctatgccaa

SEQ ID NO: 612655 - DNA, 20 bp, Artificial Sequence
  chemically synthesized
gtgcaagttatgttttctca

SEQ ID NO: 612656 - DNA, 20 bp, Artificial Sequence
  chemically synthesized
tgcctaattttcagtgcaag

SEQ ID NO: 612657 - DNA, 20 bp, Artificial Sequence
  chemically synthesized
gctaaatgcattgcctaatt

SEQ ID NO: 612658 - DNA, 20 bp, Artificial Sequence
  chemically synthesized
tttattttggtcttcctgtt

SEQ ID NO: 612659 - DNA, 20 bp, Artificial Sequence
  chemically synthesized
atatatatatatatatatat

SEQ ID NO: 612660 - DNA, 20 bp, Artificial Sequence
  chemically synthesized
atatacatatgtatttccta

SEQ ID NO: 612661 - DNA, 20 bp, Artificial Sequence
  chemically synthesized
catatgtatttcctacactg

SEQ ID NO: 612662 - DNA, 20 bp, Artificial Sequence
  chemically synthesized
cttaagatgaaaaagatttt

SEQ ID NO: 612663 - DNA, 20 bp, Artificial Sequence
  chemically synthesized
cattatatttcttaagatga

SEQ ID NO: 612664 - DNA, 20 bp, Artificial Sequence
  chemically synthesized
aaagcaagagagagatcttt

SEQ ID NO: 612665 - DNA, 20 bp, Artificial Sequence
  chemically synthesized
aaatccacaaaagatctctc

SEQ ID NO: 612666 - DNA, 20 bp, Artificial Sequence
  chemically synthesized
tctctctcttgctttatagc

SEQ ID NO: 612667 - DNA, 20 bp, Artificial Sequence
  chemically synthesized
ttgatttgctgttccagtgc

SEQ ID NO: 612668 - DNA, 20 bp, Artificial Sequence
  chemically synthesized
acacaattaattatatgaca

SEQ ID NO: 612669 - DNA, 20 bp, Artificial Sequence
  chemically synthesized
ctgaactagaacaaagtata

SEQ ID NO: 612670 - DNA, 20 bp, Artificial Sequence
  chemically synthesized
acaaagtatacagggcttta

SEQ ID NO: 612671 - DNA, 20 bp, Artificial Sequence
  chemically synthesized
aagtgtgtatctgataagac

SEQ ID NO: 612672 - DNA, 20 bp, Artificial Sequence
  chemically synthesized
tctagtatcatttttacctg

SEQ ID NO: 612673 - DNA, 20 bp, Artificial Sequence
  chemically synthesized
atcatttttacctgtatagt

SEQ ID NO: 612674 - DNA, 20 bp, Artificial Sequence
  chemically synthesized
ttggtctttttatacagata

SEQ ID NO: 612675 - DNA, 20 bp, Artificial Sequence
  chemically synthesized
tcggcaaagttagaatacaa

SEQ ID NO: 612676 - DNA, 20 bp, Artificial Sequence
  chemically synthesized
tagaatacaacctggattta

SEQ ID NO: 612677 - DNA, 20 bp, Artificial Sequence
  chemically synthesized
agtggagggggagagtatca

SEQ ID NO: 612678 - DNA, 20 bp, Artificial Sequence
  chemically synthesized
ctttcacgctccgctaatgt

SEQ ID NO: 612679 - DNA, 20 bp, Artificial Sequence
  chemically synthesized
cattaaataacttgtaaaag

SEQ ID NO: 612680 - DNA, 20 bp, Artificial Sequence
  chemically synthesized
ctcatccatagtcataggta

SEQ ID NO: 612681 - DNA, 20 bp, Artificial Sequence
  chemically synthesized
accaccagctggtctgatgg

SEQ ID NO: 612682 - DNA, 20 bp, Artificial Sequence
  chemically synthesized
atcagaccagctggtggtga

SEQ ID NO: 612683 - DNA, 20 bp, Artificial Sequence
  chemically synthesized
ttaacctgtggataattacg

SEQ ID NO: 612684 - DNA, 20 bp, Artificial Sequence
  chemically synthesized
ctcaggagaatcttttcact

SEQ ID NO: 612685 - DNA, 20 bp, Artificial Sequence
  chemically synthesized
attgcaacaaaccaacagtg

SEQ ID NO: 612686 - DNA, 20 bp, Artificial Sequence
  chemically synthesized
atgtaatgaaaaatatcatg

SEQ ID NO: 612687 - DNA, 20 bp, Artificial Sequence
  chemically synthesized
aagatcaaggacattcatat

SEQ ID NO: 612688 - DNA, 20 bp, Artificial Sequence
  chemically synthesized
gccaattagtaatgagacat

SEQ ID NO: 612689 - DNA, 20 bp, Artificial Sequence
  chemically synthesized
tctcaaaggctaggagtcta

SEQ ID NO: 612690 - DNA, 20 bp, Artificial Sequence
  chemically synthesized
tgaatgtgttcactattact

SEQ ID NO: 612691 - DNA, 20 bp, Artificial Sequence
  chemically synthesized
gccatattagacccaacatt

SEQ ID NO: 612692 - DNA, 20 bp, Artificial Sequence
  chemically synthesized
gtttatagaattgctcacct

SEQ ID NO: 612693 - DNA, 20 bp, Artificial Sequence
  chemically synthesized
atgttttatacactgtcttc

SEQ ID NO: 612694 - DNA, 20 bp, Artificial Sequence
  chemically synthesized
tccttggttaacaataagtc

SEQ ID NO: 612695 - DNA, 20 bp, Artificial Sequence
  chemically synthesized
accaaggacttaagatataa

SEQ ID NO: 612696 - DNA, 20 bp, Artificial Sequence
  chemically synthesized
tagtattcctcctatccaaa

SEQ ID NO: 612697 - DNA, 20 bp, Artificial Sequence
  chemically synthesized
ataggaggaatactatagat

SEQ ID NO: 612698 - DNA, 20 bp, Artificial Sequence
  chemically synthesized
ttaattgtggtaattggaca

SEQ ID NO: 612699 - DNA, 20 bp, Artificial Sequence
  chemically synthesized
aaaatatggtcagataaaac

SEQ ID NO: 612700 - DNA, 20 bp, Artificial Sequence
  chemically synthesized
ttaaatgatggtatgaaatc

SEQ ID NO: 612701 - DNA, 20 bp, Artificial Sequence
  chemically synthesized
ttttcagttcagccaataaa

SEQ ID NO: 612702 - DNA, 20 bp, Artificial Sequence
  chemically synthesized
ctgaactgaaaagaagacag

SEQ ID NO: 612703 - DNA, 20 bp, Artificial Sequence
  chemically synthesized
ggataaatatttccttcctt

SEQ ID NO: 612704 - DNA, 20 bp, Artificial Sequence
  chemically synthesized
ccttggttctattttcatta

SEQ ID NO: 612705 - DNA, 20 bp, Artificial Sequence
  chemically synthesized
tcattacttggtttccatgt

SEQ ID NO: 612706 - DNA, 20 bp, Artificial Sequence
  chemically synthesized
tccatgtatttgattgtctc

SEQ ID NO: 612707 - DNA, 20 bp, Artificial Sequence
  chemically synthesized
tgcatgtgcagatgttattc

SEQ ID NO: 612708 - DNA, 20 bp, Artificial Sequence
  chemically synthesized
agatgttattcaacagatta

SEQ ID NO: 612709 - DNA, 20 bp, Artificial Sequence
  chemically synthesized
aacttagaaaaaatgcttag

SEQ ID NO: 612710 - DNA, 20 bp, Artificial Sequence
  chemically synthesized
atccattctaagcatttttt

SEQ ID NO: 612711 - DNA, 20 bp, Artificial Sequence
  chemically synthesized
gcattcatgaaacttagaaa

SEQ ID NO: 612712 - DNA, 20 bp, Artificial Sequence
  chemically synthesized
tctaagtttcatgaatgcag

SEQ ID NO: 612713 - DNA, 20 bp, Artificial Sequence
  chemically synthesized
attctttaataaaagatgta

SEQ ID NO: 612714 - DNA, 20 bp, Artificial Sequence
  chemically synthesized
aagaattattatttattaaa

SEQ ID NO: 612715 - DNA, 20 bp, Artificial Sequence
  chemically synthesized
tcttcttccagcatctcata

SEQ ID NO: 612716 - DNA, 20 bp, Artificial Sequence
  chemically synthesized
ccttaaccttcccagaagga

SEQ ID NO: 612717 - DNA, 20 bp, Artificial Sequence
  chemically synthesized
tcttttaaaagtatgttaaa

SEQ ID NO: 612718 - DNA, 20 bp, Artificial Sequence
  chemically synthesized
tctcattttaacatactttt

SEQ ID NO: 612719 - DNA, 20 bp, Artificial Sequence
  chemically synthesized
tacttttaaaagatttgaga

SEQ ID NO: 612720 - DNA, 20 bp, Artificial Sequence
  chemically synthesized
atgatgctttgtaaacacag

SEQ ID NO: 612721 - DNA, 20 bp, Artificial Sequence
  chemically synthesized
ttcatatctccgaatcgtta

SEQ ID NO: 612722 - DNA, 20 bp, Artificial Sequence
  chemically synthesized
gggattgtgacagatacatg

SEQ ID NO: 612723 - DNA, 20 bp, Artificial Sequence
  chemically synthesized
aaataataggcttagttatc

SEQ ID NO: 612724 - DNA, 20 bp, Artificial Sequence
  chemically synthesized
ggataatccactcctaaata

SEQ ID NO: 612725 - DNA, 20 bp, Artificial Sequence
  chemically synthesized
aactaagcctattatttagg

SEQ ID NO: 612726 - DNA, 20 bp, Artificial Sequence
  chemically synthesized
attatttaggagtggattat

SEQ ID NO: 612727 - DNA, 20 bp, Artificial Sequence
  chemically synthesized
tacggttggaatcagcagat

SEQ ID NO: 612728 - DNA, 20 bp, Artificial Sequence
  chemically synthesized
accaccattaagccactatc

SEQ ID NO: 612729 - DNA, 20 bp, Artificial Sequence
  chemically synthesized
gatagtggcttaatggtggt

SEQ ID NO: 612730 - DNA, 20 bp, Artificial Sequence
  chemically synthesized
acattcatcattggaggatt

SEQ ID NO: 612731 - DNA, 20 bp, Artificial Sequence
  chemically synthesized
aatcacattcatcattggag

SEQ ID NO: 612732 - DNA, 20 bp, Artificial Sequence
  chemically synthesized
aatgaatcacattcatcatt

SEQ ID NO: 612733 - DNA, 20 bp, Artificial Sequence
  chemically synthesized
aagcaatcctccaatgatga

SEQ ID NO: 612734 - DNA, 20 bp, Artificial Sequence
  chemically synthesized
atgaatgtgattcatttgtg

SEQ ID NO: 612735 - DNA, 20 bp, Artificial Sequence
  chemically synthesized
taatgatgctataaaggagt

SEQ ID NO: 612736 - DNA, 20 bp, Artificial Sequence
  chemically synthesized
gtgacataatgatgctataa

SEQ ID NO: 612737 - DNA, 20 bp, Artificial Sequence
  chemically synthesized
tagcatcattatgtcactaa

SEQ ID NO: 612738 - DNA, 20 bp, Artificial Sequence
  chemically synthesized
atcagcctcagcctcgctgt

SEQ ID NO: 612739 - DNA, 20 bp, Artificial Sequence
  chemically synthesized
cttttatgtaggaaaaggag

SEQ ID NO: 612740 - DNA, 20 bp, Artificial Sequence
  chemically synthesized
ctcacctttggggaccagct

SEQ ID NO: 612741 - DNA, 20 bp, Artificial Sequence
  chemically synthesized
gacctgaggacgggacagtt

SEQ ID NO: 612742 - DNA, 20 bp, Artificial Sequence
  chemically synthesized
acagtgagacctgaggacgg

SEQ ID NO: 612743 - DNA, 20 bp, Artificial Sequence
  chemically synthesized
gcgcgcacacacacaaatac

SEQ ID NO: 612744 - DNA, 20 bp, Artificial Sequence
  chemically synthesized
tcaacttttttccttttaaa

SEQ ID NO: 612745 - DNA, 20 bp, Artificial Sequence
  chemically synthesized
aaagttgaaatgtctttgag

SEQ ID NO: 612746 - DNA, 20 bp, Artificial Sequence
  chemically synthesized
atggacatggaggtgcacca

SEQ ID NO: 612747 - DNA, 20 bp, Artificial Sequence
  chemically synthesized
accaagattgaccttcaagg

SEQ ID NO: 612748 - DNA, 20 bp, Artificial Sequence
  chemically synthesized
tgttgctccagctgtggtca

SEQ ID NO: 612749 - DNA, 20 bp, Artificial Sequence
  chemically synthesized
caaatggggttaaaatggct

SEQ ID NO: 612750 - DNA, 20 bp, Artificial Sequence
  chemically synthesized
tcctagctgcaagttgtcta

SEQ ID NO: 612751 - DNA, 20 bp, Artificial Sequence
  chemically synthesized
gctgtgacgtagaccctatg

SEQ ID NO: 612752 - DNA, 20 bp, Artificial Sequence
  chemically synthesized
tgtcacctctgcccttctac

SEQ ID NO: 612753 - DNA, 20 bp, Artificial Sequence
  chemically synthesized
ttttttttttttttccaggg

SEQ ID NO: 612754 - DNA, 20 bp, Artificial Sequence
  chemically synthesized
ggagttgagtttggcaggca

SEQ ID NO: 612755 - DNA, 20 bp, Artificial Sequence
  chemically synthesized
ctggggagtagacttcggag

SEQ ID NO: 612756 - DNA, 20 bp, Artificial Sequence
  chemically synthesized
tctactccccagaacccaga

SEQ ID NO: 612757 - DNA, 20 bp, Artificial Sequence
  chemically synthesized
acagaaactatccttaccat

SEQ ID NO: 612758 - DNA, 20 bp, Artificial Sequence
  chemically synthesized
gaataatcttatatggtaag

SEQ ID NO: 612759 - DNA, 20 bp, Artificial Sequence
  chemically synthesized
gttcttgctctgctcttctg

SEQ ID NO: 612760 - DNA, 20 bp, Artificial Sequence
  chemically synthesized
ggtaggcaggaatttacagg

SEQ ID NO: 612761 - DNA, 20 bp, Artificial Sequence
  chemically synthesized
ctgatagctcaccactgtta

SEQ ID NO: 612762 - DNA, 20 bp, Artificial Sequence
  chemically synthesized
caaccagctggttgccagag

SEQ ID NO: 612763 - DNA, 20 bp, Artificial Sequence
  chemically synthesized
aaagatgccaaacacatgtt

SEQ ID NO: 612764 - DNA, 20 bp, Artificial Sequence
  chemically synthesized
aaaattgcaaagcatataac

SEQ ID NO: 612765 - DNA, 20 bp, Artificial Sequence
  chemically synthesized
acgcatattttgtaacatag

SEQ ID NO: 612766 - DNA, 20 bp, Artificial Sequence
  chemically synthesized
ctatgttacaaaatatgcgt

SEQ ID NO: 612767 - DNA, 20 bp, Artificial Sequence
  chemically synthesized
tgcaaactctgttttcctat

SEQ ID NO: 612768 - DNA, 20 bp, Artificial Sequence
  chemically synthesized
gaaaaacagtaataggaaaa

SEQ ID NO: 612769 - DNA, 20 bp, Artificial Sequence
  chemically synthesized
tgaaaactcaggaatgcaaa

SEQ ID NO: 612770 - DNA, 20 bp, Artificial Sequence
  chemically synthesized
ggaaaacagagtttgcattc

SEQ ID NO: 612771 - DNA, 20 bp, Artificial Sequence
  chemically synthesized
tagaagcccttgaatttcag

SEQ ID NO: 612772 - DNA, 20 bp, Artificial Sequence
  chemically synthesized
tttaatctttgctgaaattc

SEQ ID NO: 612773 - DNA, 20 bp, Artificial Sequence
  chemically synthesized
aaaaaaaagaaaaacacatt

SEQ ID NO: 612774 - DNA, 20 bp, Artificial Sequence
  chemically synthesized
ataatccagtgaatctaaaa

SEQ ID NO: 612775 - DNA, 20 bp, Artificial Sequence
  chemically synthesized
aaaaacacatttttagattc

SEQ ID NO: 612776 - DNA, 20 bp, Artificial Sequence
  chemically synthesized
gagcaagataatttttcaaa

SEQ ID NO: 612777 - DNA, 20 bp, Artificial Sequence
  chemically synthesized
taatttttcaaagtgtgctt

SEQ ID NO: 612778 - DNA, 20 bp, Artificial Sequence
  chemically synthesized
gactgtagactcttcccagc

SEQ ID NO: 612779 - DNA, 20 bp, Artificial Sequence
  chemically synthesized
gtcttgcagtctcaaggata

SEQ ID NO: 612780 - DNA, 20 bp, Artificial Sequence
  chemically synthesized
ctgagacctctcttatagcc

SEQ ID NO: 612781 - DNA, 20 bp, Artificial Sequence
  chemically synthesized
taagagaggtctcagacaaa

SEQ ID NO: 612782 - DNA, 20 bp, Artificial Sequence
  chemically synthesized
gcaatgaggaatatcagaag

SEQ ID NO: 612783 - DNA, 20 bp, Artificial Sequence
  chemically synthesized
ttttcattattagcatgtgg

SEQ ID NO: 612784 - DNA, 20 bp, Artificial Sequence
  chemically synthesized
cgtctcggcctcccaaagtg

SEQ ID NO: 612785 - DNA, 20 bp, Artificial Sequence
  chemically synthesized
ccgcccgtctcggcctccca

SEQ ID NO: 612786 - DNA, 20 bp, Artificial Sequence
  chemically synthesized
tgtattttgttcagtagaga

SEQ ID NO: 612787 - DNA, 20 bp, Artificial Sequence
  chemically synthesized
aatggcatgaacccaggagg

SEQ ID NO: 612788 - DNA, 20 bp, Artificial Sequence
  chemically synthesized
ttatgtctgataatttcttc

SEQ ID NO: 612789 - DNA, 20 bp, Artificial Sequence
  chemically synthesized
ttatcagacataatagtctt

SEQ ID NO: 612790 - DNA, 20 bp, Artificial Sequence
  chemically synthesized
tccatctgaactagtccaag

SEQ ID NO: 612791 - DNA, 20 bp, Artificial Sequence
  chemically synthesized
ctagttcagatggagttgga

SEQ ID NO: 612792 - DNA, 20 bp, Artificial Sequence
  chemically synthesized
aaggcactctgaactgtatt

SEQ ID NO: 612793 - DNA, 20 bp, Artificial Sequence
  chemically synthesized
agtgccttttggagctctgt

SEQ ID NO: 612794 - DNA, 20 bp, Artificial Sequence
  chemically synthesized
gtgcatgcttgagttcttct

SEQ ID NO: 612795 - DNA, 20 bp, Artificial Sequence
  chemically synthesized
ccgctttgcgtaagacagat

SEQ ID NO: 612796 - DNA, 20 bp, Artificial Sequence
  chemically synthesized
acgcaaagcgggatctgcaa

SEQ ID NO: 612797 - DNA, 20 bp, Artificial Sequence
  chemically synthesized
gagtgaatccagtttgcaga

SEQ ID NO: 612798 - DNA, 20 bp, Artificial Sequence
  chemically synthesized
caaataattcctagagtgaa

SEQ ID NO: 612799 - DNA, 20 bp, Artificial Sequence
  chemically synthesized
agtgcatcaagaaacttatg

SEQ ID NO: 612800 - DNA, 20 bp, Artificial Sequence
  chemically synthesized
gtactctgtaaaatcgctac

SEQ ID NO: 612801 - DNA, 20 bp, Artificial Sequence
  chemically synthesized
aaaaataagatgcccaacac

SEQ ID NO: 612802 - DNA, 20 bp, Artificial Sequence
  chemically synthesized
tgttgggcatcttatttttg

SEQ ID NO: 612803 - DNA, 20 bp, Artificial Sequence
  chemically synthesized
gcatcttatttttgtaacgc

SEQ ID NO: 612804 - DNA, 20 bp, Artificial Sequence
  chemically synthesized
ttttattctatcttacatac

SEQ ID NO: 612805 - DNA, 20 bp, Artificial Sequence
  chemically synthesized
gtactgagcaacatatgaaa

SEQ ID NO: 612806 - DNA, 20 bp, Artificial Sequence
  chemically synthesized
acataccgcatctctcccca

SEQ ID NO: 612807 - DNA, 20 bp, Artificial Sequence
  chemically synthesized
gtttggggagagatgcggta

SEQ ID NO: 612808 - DNA, 20 bp, Artificial Sequence
  chemically synthesized
gccttaagtgagcccaagtt

SEQ ID NO: 612809 - DNA, 20 bp, Artificial Sequence
  chemically synthesized
cgctctttctcttcccctct

SEQ ID NO: 612810 - DNA, 20 bp, Artificial Sequence
  chemically synthesized
ttttattccaaattctctga

SEQ ID NO: 612811 - DNA, 20 bp, Artificial Sequence
  chemically synthesized
gcttgaattttaacttgaat

SEQ ID NO: 612812 - DNA, 20 bp, Artificial Sequence
  chemically synthesized
tgcaggcatgagccactgcg

SEQ ID NO: 612813 - DNA, 20 bp, Artificial Sequence
  chemically synthesized
tgcctcggcctcccaaagtg

SEQ ID NO: 612814 - DNA, 20 bp, Artificial Sequence
  chemically synthesized
ttttgtatttttagtagaga

SEQ ID NO: 612815 - DNA, 20 bp, Artificial Sequence
  chemically synthesized
aatggcgtgaatccgggagg

SEQ ID NO: 612816 - DNA, 20 bp, Artificial Sequence
  chemically synthesized
gctcactgcaagctccgcct

SEQ ID NO: 612817 - DNA, 20 bp, Artificial Sequence
  chemically synthesized
aaaataaaaaataaaaaaat

SEQ ID NO: 612818 - DNA, 20 bp, Artificial Sequence
  chemically synthesized
agccctattgtagcagatat

SEQ ID NO: 612819 - DNA, 20 bp, Artificial Sequence
  chemically synthesized
ataatacatgttcttttgtg

SEQ ID NO: 612820 - DNA, 20 bp, Artificial Sequence
  chemically synthesized
ggcaaatacatatggacaga

SEQ ID NO: 612821 - DNA, 20 bp, Artificial Sequence
  chemically synthesized
acttttccaccaccttaaaa

SEQ ID NO: 612822 - DNA, 20 bp, Artificial Sequence
  chemically synthesized
gggagttattcatccctcaa

SEQ ID NO: 612823 - DNA, 20 bp, Artificial Sequence
  chemically synthesized
ctaccaagaaccagaactaa

SEQ ID NO: 612824 - DNA, 20 bp, Artificial Sequence
  chemically synthesized
taaaattcaatttgcatcaa

SEQ ID NO: 612825 - DNA, 20 bp, Artificial Sequence
  chemically synthesized
taacaattacatttcaaaaa

SEQ ID NO: 612826 - DNA, 20 bp, Artificial Sequence
  chemically synthesized
gggattacttttttataaat

SEQ ID NO: 612827 - DNA, 20 bp, Artificial Sequence
  chemically synthesized
atgactgctgtttttactgg

SEQ ID NO: 612828 - DNA, 20 bp, Artificial Sequence
  chemically synthesized
tttggaggctgagaaatgac

SEQ ID NO: 612829 - DNA, 20 bp, Artificial Sequence
  chemically synthesized
tatgacttgtattgattgct

SEQ ID NO: 612830 - DNA, 20 bp, Artificial Sequence
  chemically synthesized
tgtatcatatgacttgtatt

SEQ ID NO: 612831 - DNA, 20 bp, Artificial Sequence
  chemically synthesized
gaggtgtatcatatgacttg

SEQ ID NO: 612832 - DNA, 20 bp, Artificial Sequence
  chemically synthesized
aaatgtgtatgtatttctta

SEQ ID NO: 612833 - DNA, 20 bp, Artificial Sequence
  chemically synthesized
gccactaagatggtaaccgt

SEQ ID NO: 612834 - DNA, 20 bp, Artificial Sequence
  chemically synthesized
attagtggatataagttcat

SEQ ID NO: 612835 - DNA, 20 bp, Artificial Sequence
  chemically synthesized
tgtatgattatgtatacata

SEQ ID NO: 612836 - DNA, 20 bp, Artificial Sequence
  chemically synthesized
tgacctctgcaaaatgggtt

SEQ ID NO: 612837 - DNA, 20 bp, Artificial Sequence
  chemically synthesized
ataatttccaaatcacatta

SEQ ID NO: 612838 - DNA, 20 bp, Artificial Sequence
  chemically synthesized
taatacatacaaactccata

SEQ ID NO: 612839 - DNA, 20 bp, Artificial Sequence
  chemically synthesized
taacataaattattgccaat

SEQ ID NO: 612840 - DNA, 20 bp, Artificial Sequence
  chemically synthesized
tttaatcactaccaaaggaa

SEQ ID NO: 612841 - DNA, 20 bp, Artificial Sequence
  chemically synthesized
agaaagcctcattcctttgg

SEQ ID NO: 612842 - DNA, 20 bp, Artificial Sequence
  chemically synthesized
cttgtctataagttaattta

SEQ ID NO: 612843 - DNA, 20 bp, Artificial Sequence
  chemically synthesized
ttgtgaaaaaaattactcac

SEQ ID NO: 612844 - DNA, 20 bp, Artificial Sequence
  chemically synthesized
taacaaaccctgctccatag

SEQ ID NO: 612845 - DNA, 20 bp, Artificial Sequence
  chemically synthesized
taaaaagcagcactatggag

SEQ ID NO: 612846 - DNA, 20 bp, Artificial Sequence
  chemically synthesized
tgttattgttagaaatacac

SEQ ID NO: 612847 - DNA, 20 bp, Artificial Sequence
  chemically synthesized
tcaagggtaaaaattaaaaa

SEQ ID NO: 612848 - DNA, 20 bp, Artificial Sequence
  chemically synthesized
ttccttttgggtaacattaa

SEQ ID NO: 612849 - DNA, 20 bp, Artificial Sequence
  chemically synthesized
acccaaaaggaaaccattca

SEQ ID NO: 612850 - DNA, 20 bp, Artificial Sequence
  chemically synthesized
ggcaggtaagaatcctgatg

SEQ ID NO: 612851 - DNA, 20 bp, Artificial Sequence
  chemically synthesized
caggattcttacctgccagt

SEQ ID NO: 612852 - DNA, 20 bp, Artificial Sequence
  chemically synthesized
tattccaaatcaaaccaaga

SEQ ID NO: 612853 - DNA, 20 bp, Artificial Sequence
  chemically synthesized
aaatcataaactgactcttg

SEQ ID NO: 612854 - DNA, 20 bp, Artificial Sequence
  chemically synthesized
aaatcaaaccaagagtcagt

SEQ ID NO: 612855 - DNA, 20 bp, Artificial Sequence
  chemically synthesized
atggaaatcataaactgact

SEQ ID NO: 612856 - DNA, 20 bp, Artificial Sequence
  chemically synthesized
ttttacccctttctttaaca

SEQ ID NO: 612857 - DNA, 20 bp, Artificial Sequence
  chemically synthesized
gcatttggtctcttaccttc

SEQ ID NO: 612858 - DNA, 20 bp, Artificial Sequence
  chemically synthesized
atagctaaatgcaattacct

SEQ ID NO: 612859 - DNA, 20 bp, Artificial Sequence
  chemically synthesized
tattttcagagacttagcat

SEQ ID NO: 612860 - DNA, 20 bp, Artificial Sequence
  chemically synthesized
taatttttagattattttca

SEQ ID NO: 612861 - DNA, 20 bp, Artificial Sequence
  chemically synthesized
cacatgcattttgtttaatt

SEQ ID NO: 612862 - DNA, 20 bp, Artificial Sequence
  chemically synthesized
aaagtgattttacacatgca

SEQ ID NO: 612863 - DNA, 20 bp, Artificial Sequence
  chemically synthesized
gggtgcttgtttgttatgga

SEQ ID NO: 612864 - DNA, 20 bp, Artificial Sequence
  chemically synthesized
aaagtaaatatatttggggt

SEQ ID NO: 612865 - DNA, 20 bp, Artificial Sequence
  chemically synthesized
gctgaaagtaaatatatttg

SEQ ID NO: 612866 - DNA, 20 bp, Artificial Sequence
  chemically synthesized
atatttactttcagcacatg

SEQ ID NO: 612867 - DNA, 20 bp, Artificial Sequence
  chemically synthesized
tcagcacatgaatagattac

SEQ ID NO: 612868 - DNA, 20 bp, Artificial Sequence
  chemically synthesized
tccaaataaaatgtcataaa

SEQ ID NO: 612869 - DNA, 20 bp, Artificial Sequence
  chemically synthesized
aaagtatgtttaaaattaag

SEQ ID NO: 612870 - DNA, 20 bp, Artificial Sequence
  chemically synthesized
actgcattttagtaaaacgc

SEQ ID NO: 612871 - DNA, 20 bp, Artificial Sequence
  chemically synthesized
taacattcattctaaaacag

SEQ ID NO: 612872 - DNA, 20 bp, Artificial Sequence
  chemically synthesized
agagagctggcagtttgctc

SEQ ID NO: 612873 - DNA, 20 bp, Artificial Sequence
  chemically synthesized
tagacagagataagagagct

SEQ ID NO: 612874 - DNA, 20 bp, Artificial Sequence
  chemically synthesized
tctcttatctctgtctagga

SEQ ID NO: 612875 - DNA, 20 bp, Artificial Sequence
  chemically synthesized
gtttggaaatgaaaatctgg

SEQ ID NO: 612876 - DNA, 20 bp, Artificial Sequence
  chemically synthesized
attaaggcaaataaaaccct

SEQ ID NO: 612877 - DNA, 20 bp, Artificial Sequence
  chemically synthesized
acaggagacacagagatttg

SEQ ID NO: 612878 - DNA, 20 bp, Artificial Sequence
  chemically synthesized
agtgtgaaggacaggagaca

SEQ ID NO: 612879 - DNA, 20 bp, Artificial Sequence
  chemically synthesized
tcctgtccttcacactcctc

SEQ ID NO: 612880 - DNA, 20 bp, Artificial Sequence
  chemically synthesized
tatgcttgcttttcagatgc

SEQ ID NO: 612881 - DNA, 20 bp, Artificial Sequence
  chemically synthesized
ttttcatatgcttgcttttc

SEQ ID NO: 612882 - DNA, 20 bp, Artificial Sequence
  chemically synthesized
cattgaacatcttttcatat

SEQ ID NO: 612883 - DNA, 20 bp, Artificial Sequence
  chemically synthesized
aaaacattgaacatcttttc

SEQ ID NO: 612884 - DNA, 20 bp, Artificial Sequence
  chemically synthesized
caagcatatgaaaagatgtt

SEQ ID NO: 612885 - DNA, 20 bp, Artificial Sequence
  chemically synthesized
cactagcaggggttgagtca

SEQ ID NO: 612886 - DNA, 20 bp, Artificial Sequence
  chemically synthesized
ttccaaagtggctatatcat

SEQ ID NO: 612887 - DNA, 20 bp, Artificial Sequence
  chemically synthesized
gccactttggaaaacagtct

SEQ ID NO: 612888 - DNA, 20 bp, Artificial Sequence
  chemically synthesized
agttttgtgagaaactgcca

SEQ ID NO: 612889 - DNA, 20 bp, Artificial Sequence
  chemically synthesized
gattgtataataagtacatg

SEQ ID NO: 612890 - DNA, 20 bp, Artificial Sequence
  chemically synthesized
aaatgctcaagagcccaatt

SEQ ID NO: 612891 - DNA, 20 bp, Artificial Sequence
  chemically synthesized
gtgcaggtttttgtgtacac

SEQ ID NO: 612892 - DNA, 20 bp, Artificial Sequence
  chemically synthesized
cgtagtatgaacacttaggt

SEQ ID NO: 612893 - DNA, 20 bp, Artificial Sequence
  chemically synthesized
cctgcacctaagtgttcata

SEQ ID NO: 612894 - DNA, 20 bp, Artificial Sequence
  chemically synthesized
cccctgagggcatctgggtt

SEQ ID NO: 612895 - DNA, 20 bp, Artificial Sequence
  chemically synthesized
catggtgtggctgtactatg

SEQ ID NO: 612896 - DNA, 20 bp, Artificial Sequence
  chemically synthesized
attccatggtgtggctgtac

SEQ ID NO: 612897 - DNA, 20 bp, Artificial Sequence
  chemically synthesized
tccaatttgctgcatgtatc

SEQ ID NO: 612898 - DNA, 20 bp, Artificial Sequence
  chemically synthesized
cttttcaagactctcataga

SEQ ID NO: 612899 - DNA, 20 bp, Artificial Sequence
  chemically synthesized
ttctgcatattgactctgat

SEQ ID NO: 612900 - DNA, 20 bp, Artificial Sequence
  chemically synthesized
tatgcaacattattacgtgt

SEQ ID NO: 612901 - DNA, 20 bp, Artificial Sequence
  chemically synthesized
accaatagtattcagatttt

SEQ ID NO: 612902 - DNA, 20 bp, Artificial Sequence
  chemically synthesized
gggaaaatctgaatactatt

SEQ ID NO: 612903 - DNA, 20 bp, Artificial Sequence
  chemically synthesized
tcataaaaccaccaatagta

SEQ ID NO: 612904 - DNA, 20 bp, Artificial Sequence
  chemically synthesized
tcttggtcatgatatcgtat

SEQ ID NO: 612905 - DNA, 20 bp, Artificial Sequence
  chemically synthesized
aagatgttactacatcgaag

SEQ ID NO: 612906 - DNA, 20 bp, Artificial Sequence
  chemically synthesized
ccagatgatgatgcagatga

SEQ ID NO: 612907 - DNA, 20 bp, Artificial Sequence
  chemically synthesized
tcatcatctgcatcatcatc

SEQ ID NO: 612908 - DNA, 20 bp, Artificial Sequence
  chemically synthesized
gaatcaatagataaattcat

SEQ ID NO: 612909 - DNA, 20 bp, Artificial Sequence
  chemically synthesized
aaagccactatgaatttatc

SEQ ID NO: 612910 - DNA, 20 bp, Artificial Sequence
  chemically synthesized
tatgaatttatctattgatt

SEQ ID NO: 612911 - DNA, 20 bp, Artificial Sequence
  chemically synthesized
agcatgtaaaagtaaaaacc

SEQ ID NO: 612912 - DNA, 20 bp, Artificial Sequence
  chemically synthesized
aattaagtttcatgaaagca

SEQ ID NO: 612913 - DNA, 20 bp, Artificial Sequence
  chemically synthesized
gattgtcactatcactagaa

SEQ ID NO: 612914 - DNA, 20 bp, Artificial Sequence
  chemically synthesized
tgagtctttagtgctatatc

SEQ ID NO: 612915 - DNA, 20 bp, Artificial Sequence
  chemically synthesized
aaatagcatattctctgctt

SEQ ID NO: 612916 - DNA, 20 bp, Artificial Sequence
  chemically synthesized
tttcctaaaaatagcatatt

SEQ ID NO: 612917 - DNA, 20 bp, Artificial Sequence
  chemically synthesized
gcttcccgcagtatgagtga

SEQ ID NO: 612918 - DNA, 20 bp, Artificial Sequence
  chemically synthesized
gcgggaagcactgctggtag

SEQ ID NO: 612919 - DNA, 20 bp, Artificial Sequence
  chemically synthesized
acccaaaacgtatctaccag

SEQ ID NO: 612920 - DNA, 20 bp, Artificial Sequence
  chemically synthesized
cttagatcaagtaataggaa

SEQ ID NO: 612921 - DNA, 20 bp, Artificial Sequence
  chemically synthesized
aggaaatggaggaactatct

SEQ ID NO: 612922 - DNA, 20 bp, Artificial Sequence
  chemically synthesized
aggctctagcaattctacct

SEQ ID NO: 612923 - DNA, 20 bp, Artificial Sequence
  chemically synthesized
ataaccaaaataattaaaaa

SEQ ID NO: 612924 - DNA, 20 bp, Artificial Sequence
  chemically synthesized
tggtctaccaatatcttaat

SEQ ID NO: 612925 - DNA, 20 bp, Artificial Sequence
  chemically synthesized
cgttgtatgtacataccaca

SEQ ID NO: 612926 - DNA, 20 bp, Artificial Sequence
  chemically synthesized
tttccaaggttcatttatgt

SEQ ID NO: 612927 - DNA, 20 bp, Artificial Sequence
  chemically synthesized
tcttgcttatttcacttagc

SEQ ID NO: 612928 - DNA, 20 bp, Artificial Sequence
  chemically synthesized
acaatatttgtcattttatg

SEQ ID NO: 612929 - DNA, 20 bp, Artificial Sequence
  chemically synthesized
gacataaaatgacaaatatt

SEQ ID NO: 612930 - DNA, 20 bp, Artificial Sequence
  chemically synthesized
gggaggtgaaaatggagagt

SEQ ID NO: 612931 - DNA, 20 bp, Artificial Sequence
  chemically synthesized
aagttgaattcatactgatt

SEQ ID NO: 612932 - DNA, 20 bp, Artificial Sequence
  chemically synthesized
atcatcccaagttgaattca

SEQ ID NO: 612933 - DNA, 20 bp, Artificial Sequence
  chemically synthesized
atcaccgctatccatctcta

SEQ ID NO: 612934 - DNA, 20 bp, Artificial Sequence
  chemically synthesized
atttttttagtgtataattc

SEQ ID NO: 612935 - DNA, 20 bp, Artificial Sequence
  chemically synthesized
ttcaggttcattgccctaga

SEQ ID NO: 612936 - DNA, 20 bp, Artificial Sequence
  chemically synthesized
atttcatttatgtgctggcc

SEQ ID NO: 612937 - DNA, 20 bp, Artificial Sequence
  chemically synthesized
agttttaatttgcatttctc

SEQ ID NO: 612938 - DNA, 20 bp, Artificial Sequence
  chemically synthesized
tgtgtgatgtaatatttcat

SEQ ID NO: 612939 - DNA, 20 bp, Artificial Sequence
  chemically synthesized
acatttccaccaacactgtg

SEQ ID NO: 612940 - DNA, 20 bp, Artificial Sequence
  chemically synthesized
gtagtcatgaaaaacagtat

SEQ ID NO: 612941 - DNA, 20 bp, Artificial Sequence
  chemically synthesized
aattttttgagaaacctcca

SEQ ID NO: 612942 - DNA, 20 bp, Artificial Sequence
  chemically synthesized
gtagaattcctgaattatat

SEQ ID NO: 612943 - DNA, 20 bp, Artificial Sequence
  chemically synthesized
gttatttctttgacatattg

SEQ ID NO: 612944 - DNA, 20 bp, Artificial Sequence
  chemically synthesized
gtgcagttatttctttgaca

SEQ ID NO: 612945 - DNA, 20 bp, Artificial Sequence
  chemically synthesized
catctactgatggacactta

SEQ ID NO: 612946 - DNA, 20 bp, Artificial Sequence
  chemically synthesized
tcattgcaaatgagaggatt

SEQ ID NO: 612947 - DNA, 20 bp, Artificial Sequence
  chemically synthesized
cattaatttcattgcaaatg

SEQ ID NO: 612948 - DNA, 20 bp, Artificial Sequence
  chemically synthesized
tgtcatttgacgtaacgtac

SEQ ID NO: 612949 - DNA, 20 bp, Artificial Sequence
  chemically synthesized
gtaatgtttgtctttctgtg

SEQ ID NO: 612950 - DNA, 20 bp, Artificial Sequence
  chemically synthesized
catatacaagtgacatgatg

SEQ ID NO: 612951 - DNA, 20 bp, Artificial Sequence
  chemically synthesized
aaatgttggttagcagggga

SEQ ID NO: 612952 - DNA, 20 bp, Artificial Sequence
  chemically synthesized
attttgaaaattgctaagag

SEQ ID NO: 612953 - DNA, 20 bp, Artificial Sequence
  chemically synthesized
ataaacatatacattaactt

SEQ ID NO: 612954 - DNA, 20 bp, Artificial Sequence
  chemically synthesized
ataaacatataagttaatgt

SEQ ID NO: 612955 - DNA, 20 bp, Artificial Sequence
  chemically synthesized
ataagttaatgtatatgttt

SEQ ID NO: 612956 - DNA, 20 bp, Artificial Sequence
  chemically synthesized
taaaatatctagatgttgtg

SEQ ID NO: 612957 - DNA, 20 bp, Artificial Sequence
  chemically synthesized
aattgtatataccatgtagc

SEQ ID NO: 612958 - DNA, 20 bp, Artificial Sequence
  chemically synthesized
ataatacctaaataaatgtt

SEQ ID NO: 612959 - DNA, 20 bp, Artificial Sequence
  chemically synthesized
tgagacacagttgcctacct

SEQ ID NO: 612960 - DNA, 20 bp, Artificial Sequence
  chemically synthesized
tacttcctttttcttacccc

SEQ ID NO: 612961 - DNA, 20 bp, Artificial Sequence
  chemically synthesized
acatgaatatatcttatgtc

SEQ ID NO: 612962 - DNA, 20 bp, Artificial Sequence
  chemically synthesized
agatatattcatgtactcag

SEQ ID NO: 612963 - DNA, 20 bp, Artificial Sequence
  chemically synthesized
gattaaatctgtaaagaaaa

SEQ ID NO: 612964 - DNA, 20 bp, Artificial Sequence
  chemically synthesized
attccaatctattttttctt

SEQ ID NO: 612965 - DNA, 20 bp, Artificial Sequence
  chemically synthesized
agtgatctgaatgctttctg

SEQ ID NO: 612966 - DNA, 20 bp, Artificial Sequence
  chemically synthesized
taattaccccctagtgatct

SEQ ID NO: 612967 - DNA, 20 bp, Artificial Sequence
  chemically synthesized
cagatcactagggggtaatt

SEQ ID NO: 612968 - DNA, 20 bp, Artificial Sequence
  chemically synthesized
ttaggttcaggagtacatgt

SEQ ID NO: 612969 - DNA, 20 bp, Artificial Sequence
  chemically synthesized
ataggtaaattgcgtgtcat

SEQ ID NO: 612970 - DNA, 20 bp, Artificial Sequence
  chemically synthesized
aataagtatggtgcctgata

SEQ ID NO: 612971 - DNA, 20 bp, Artificial Sequence
  chemically synthesized
ttttttttttttttttgagg

SEQ ID NO: 612972 - DNA, 20 bp, Artificial Sequence
  chemically synthesized
ctcaccacaacctccgcctc

SEQ ID NO: 612973 - DNA, 20 bp, Artificial Sequence
  chemically synthesized
acctccgcctcccgagtttc

SEQ ID NO: 612974 - DNA, 20 bp, Artificial Sequence
  chemically synthesized
ttgggaggctgaggcaggag

SEQ ID NO: 612975 - DNA, 20 bp, Artificial Sequence
  chemically synthesized
tgcctcagcctcccaagtag

SEQ ID NO: 612976 - DNA, 20 bp, Artificial Sequence
  chemically synthesized
ttttgtatttttagtagaga

SEQ ID NO: 612977 - DNA, 20 bp, Artificial Sequence
  chemically synthesized
gtgggagttaggctgggcgc

SEQ ID NO: 612978 - DNA, 20 bp, Artificial Sequence
  chemically synthesized
ataagtgagaacatgtgata

SEQ ID NO: 612979 - DNA, 20 bp, Artificial Sequence
  chemically synthesized
atttggttttctgttcatgc

SEQ ID NO: 612980 - DNA, 20 bp, Artificial Sequence
  chemically synthesized
ggaatacaacccagacaaaa

SEQ ID NO: 612981 - DNA, 20 bp, Artificial Sequence
  chemically synthesized
ataaatgtccatcaacagta

SEQ ID NO: 612982 - DNA, 20 bp, Artificial Sequence
  chemically synthesized
ctactgttgatggacattta

SEQ ID NO: 612983 - DNA, 20 bp, Artificial Sequence
  chemically synthesized
cgataaagacacatgcacat

SEQ ID NO: 612984 - DNA, 20 bp, Artificial Sequence
  chemically synthesized
gttgctgggttgaatggtat

SEQ ID NO: 612985 - DNA, 20 bp, Artificial Sequence
  chemically synthesized
acttctttgaggaatcacca

SEQ ID NO: 612986 - DNA, 20 bp, Artificial Sequence
  chemically synthesized
tgccattgtggaaagcagtg

SEQ ID NO: 612987 - DNA, 20 bp, Artificial Sequence
  chemically synthesized
actgctttccacaatggcag

SEQ ID NO: 612988 - DNA, 20 bp, Artificial Sequence
  chemically synthesized
atgcatacattttcagatac

SEQ ID NO: 612989 - DNA, 20 bp, Artificial Sequence
  chemically synthesized
catatatatgtaattttagt

SEQ ID NO: 612990 - DNA, 20 bp, Artificial Sequence
  chemically synthesized
ggttaaaatatgtaattcta

SEQ ID NO: 612991 - DNA, 20 bp, Artificial Sequence
  chemically synthesized
ctcttctctcaccaggaaat

SEQ ID NO: 612992 - DNA, 20 bp, Artificial Sequence
  chemically synthesized
ctctcaccaggaaatttttg

SEQ ID NO: 612993 - DNA, 20 bp, Artificial Sequence
  chemically synthesized
ccaggaaatttttgttttgt

SEQ ID NO: 612994 - DNA, 20 bp, Artificial Sequence
  chemically synthesized
tttgttttgtttttgattct

SEQ ID NO: 612995 - DNA, 20 bp, Artificial Sequence
  chemically synthesized
tttgtttttgattcttttag

SEQ ID NO: 612996 - DNA, 20 bp, Artificial Sequence
  chemically synthesized
cactttgttaacttttattt

SEQ ID NO: 612997 - DNA, 20 bp, Artificial Sequence
  chemically synthesized
catgtgtgaattgtctgtta

SEQ ID NO: 612998 - DNA, 20 bp, Artificial Sequence
  chemically synthesized
ttgctcattaatttctatat

SEQ ID NO: 612999 - DNA, 20 bp, Artificial Sequence
  chemically synthesized
aataagagataacatttgta

SEQ ID NO: 613000 - DNA, 20 bp, Artificial Sequence
  chemically synthesized
gaatgcttaccacttgcaaa

SEQ ID NO: 613001 - DNA, 20 bp, Artificial Sequence
  chemically synthesized
attcaaaagtaaaactgtct

SEQ ID NO: 613002 - DNA, 20 bp, Artificial Sequence
  chemically synthesized
caaagatcataaatctgtaa

SEQ ID NO: 613003 - DNA, 20 bp, Artificial Sequence
  chemically synthesized
ctgtcttacagatttatgat

SEQ ID NO: 613004 - DNA, 20 bp, Artificial Sequence
  chemically synthesized
tgacatcacaaaaggaattg

SEQ ID NO: 613005 - DNA, 20 bp, Artificial Sequence
  chemically synthesized
tgtggagtttttttcttttc

SEQ ID NO: 613006 - DNA, 20 bp, Artificial Sequence
  chemically synthesized
tttcttttcatatgctttgg

SEQ ID NO: 613007 - DNA, 20 bp, Artificial Sequence
  chemically synthesized
gtgtactgttgaagagtgta

SEQ ID NO: 613008 - DNA, 20 bp, Artificial Sequence
  chemically synthesized
tacacctttaataacctact

SEQ ID NO: 613009 - DNA, 20 bp, Artificial Sequence
  chemically synthesized
taagaataagtggaaaatta

SEQ ID NO: 613010 - DNA, 20 bp, Artificial Sequence
  chemically synthesized
acttattcttatctcaattt

SEQ ID NO: 613011 - DNA, 20 bp, Artificial Sequence
  chemically synthesized
atttgtattgtacgagaaaa

SEQ ID NO: 613012 - DNA, 20 bp, Artificial Sequence
  chemically synthesized
attttgcaaaattctggaaa

SEQ ID NO: 613013 - DNA, 20 bp, Artificial Sequence
  chemically synthesized
attttgcaaaattgttataa

SEQ ID NO: 613014 - DNA, 20 bp, Artificial Sequence
  chemically synthesized
aaaattgttataaaattgct

SEQ ID NO: 613015 - DNA, 20 bp, Artificial Sequence
  chemically synthesized
gtcttttctcatttatctcg

SEQ ID NO: 613016 - DNA, 20 bp, Artificial Sequence
  chemically synthesized
tatctcgtctagtttttatt

SEQ ID NO: 613017 - DNA, 20 bp, Artificial Sequence
  chemically synthesized
ttttctttgttatgactggg

SEQ ID NO: 613018 - DNA, 20 bp, Artificial Sequence
  chemically synthesized
cattcaaaagtgagctcttg

SEQ ID NO: 613019 - DNA, 20 bp, Artificial Sequence
  chemically synthesized
ttttcaagagctcacttttg

SEQ ID NO: 613020 - DNA, 20 bp, Artificial Sequence
  chemically synthesized
acgttgaatacaatttttat

SEQ ID NO: 613021 - DNA, 20 bp, Artificial Sequence
  chemically synthesized
tcagagagaactgtatagcc

SEQ ID NO: 613022 - DNA, 20 bp, Artificial Sequence
  chemically synthesized
gctatacagttctctctgaa

SEQ ID NO: 613023 - DNA, 20 bp, Artificial Sequence
  chemically synthesized
agcttcatttatctttgata

SEQ ID NO: 613024 - DNA, 20 bp, Artificial Sequence
  chemically synthesized
aacagagtatcaaagataaa

SEQ ID NO: 613025 - DNA, 20 bp, Artificial Sequence
  chemically synthesized
ataaatgaagcttccacaag

SEQ ID NO: 613026 - DNA, 20 bp, Artificial Sequence
  chemically synthesized
agttttaaatcagaccttgt

SEQ ID NO: 613027 - DNA, 20 bp, Artificial Sequence
  chemically synthesized
tgaaatatcttctatccaga

SEQ ID NO: 613028 - DNA, 20 bp, Artificial Sequence
  chemically synthesized
catctagtgaattctccaca

SEQ ID NO: 613029 - DNA, 20 bp, Artificial Sequence
  chemically synthesized
aacttggagagagagcctct

SEQ ID NO: 613030 - DNA, 20 bp, Artificial Sequence
  chemically synthesized
cttgtctgtatcatggtgtg

SEQ ID NO: 613031 - DNA, 20 bp, Artificial Sequence
  chemically synthesized
atttcacaccatgatacaga

SEQ ID NO: 613032 - DNA, 20 bp, Artificial Sequence
  chemically synthesized
aggattattatttattttgg

SEQ ID NO: 613033 - DNA, 20 bp, Artificial Sequence
  chemically synthesized
tagcatttcttacactcctt

SEQ ID NO: 613034 - DNA, 20 bp, Artificial Sequence
  chemically synthesized
tgcctcacattgacggtctg

SEQ ID NO: 613035 - DNA, 20 bp, Artificial Sequence
  chemically synthesized
tgttttggccatgaattctc

SEQ ID NO: 613036 - DNA, 20 bp, Artificial Sequence
  chemically synthesized
aatacagcattataagagca

SEQ ID NO: 613037 - DNA, 20 bp, Artificial Sequence
  chemically synthesized
gaagttactgtatggcaggg

SEQ ID NO: 613038 - DNA, 20 bp, Artificial Sequence
  chemically synthesized
gccatacagtaacttctctt

SEQ ID NO: 613039 - DNA, 20 bp, Artificial Sequence
  chemically synthesized
ttcacttcacacagatttta

SEQ ID NO: 613040 - DNA, 20 bp, Artificial Sequence
  chemically synthesized
ttttaaaatctgtgtgaagt

SEQ ID NO: 613041 - DNA, 20 bp, Artificial Sequence
  chemically synthesized
agatgtaatcattcacttca

SEQ ID NO: 613042 - DNA, 20 bp, Artificial Sequence
  chemically synthesized
tgtcatattaatgttttctg

SEQ ID NO: 613043 - DNA, 20 bp, Artificial Sequence
  chemically synthesized
atacatgtcatattaatgtt

SEQ ID NO: 613044 - DNA, 20 bp, Artificial Sequence
  chemically synthesized
cattaacatacatgtcatat

SEQ ID NO: 613045 - DNA, 20 bp, Artificial Sequence
  chemically synthesized
ctatttaatttccaaccata

SEQ ID NO: 613046 - DNA, 20 bp, Artificial Sequence
  chemically synthesized
gtcactgtggttacccaaag

SEQ ID NO: 613047 - DNA, 20 bp, Artificial Sequence
  chemically synthesized
ggttacccaaagttctgctt

SEQ ID NO: 613048 - DNA, 20 bp, Artificial Sequence
  chemically synthesized
ttcacacctattttggtatc

SEQ ID NO: 613049 - DNA, 20 bp, Artificial Sequence
  chemically synthesized
tgaaaatgtaataacatgcc

SEQ ID NO: 613050 - DNA, 20 bp, Artificial Sequence
  chemically synthesized
aagttaaactacgcagcaca

SEQ ID NO: 613051 - DNA, 20 bp, Artificial Sequence
  chemically synthesized
tacaaaagccaattgtgctg

SEQ ID NO: 613052 - DNA, 20 bp, Artificial Sequence
  chemically synthesized
tgtagttcctgtcaacaggc

SEQ ID NO: 613053 - DNA, 20 bp, Artificial Sequence
  chemically synthesized
agtaacatgggatgctgtct

SEQ ID NO: 613054 - DNA, 20 bp, Artificial Sequence
  chemically synthesized
tttacactgttatcttcgga

SEQ ID NO: 613055 - DNA, 20 bp, Artificial Sequence
  chemically synthesized
tttggaggatagaaaacctc

SEQ ID NO: 613056 - DNA, 20 bp, Artificial Sequence
  chemically synthesized
gaggatagaaaacctccatg

SEQ ID NO: 613057 - DNA, 20 bp, Artificial Sequence
  chemically synthesized
attatgtcaaagcaaaccat

SEQ ID NO: 613058 - DNA, 20 bp, Artificial Sequence
  chemically synthesized
aatattctactggagtcaca

SEQ ID NO: 613059 - DNA, 20 bp, Artificial Sequence
  chemically synthesized
agactgcttattgtaacttg

SEQ ID NO: 613060 - DNA, 20 bp, Artificial Sequence
  chemically synthesized
ttctatgtgcaattcttaca

SEQ ID NO: 613061 - DNA, 20 bp, Artificial Sequence
  chemically synthesized
ctaaagaataatttaatgta

SEQ ID NO: 613062 - DNA, 20 bp, Artificial Sequence
  chemically synthesized
acaatatatatttagtaatt

SEQ ID NO: 613063 - DNA, 20 bp, Artificial Sequence
  chemically synthesized
ctggaagtaaatgctccctg

SEQ ID NO: 613064 - DNA, 20 bp, Artificial Sequence
  chemically synthesized
tatgaggaacaattctcgtc

SEQ ID NO: 613065 - DNA, 20 bp, Artificial Sequence
  chemically synthesized
tcgagacaggcaaaaaacct

SEQ ID NO: 613066 - DNA, 20 bp, Artificial Sequence
  chemically synthesized
agtgggataaaagaaaacag

SEQ ID NO: 613067 - DNA, 20 bp, Artificial Sequence
  chemically synthesized
tcgtcaatattttattcaag

SEQ ID NO: 613068 - DNA, 20 bp, Artificial Sequence
  chemically synthesized
accatcatgggatatctaat

SEQ ID NO: 613069 - DNA, 20 bp, Artificial Sequence
  chemically synthesized
gctaagattagatatcccat

SEQ ID NO: 613070 - DNA, 20 bp, Artificial Sequence
  chemically synthesized
tcccatgatggtttacagta

SEQ ID NO: 613071 - DNA, 20 bp, Artificial Sequence
  chemically synthesized
tacttattatattgatatat

SEQ ID NO: 613072 - DNA, 20 bp, Artificial Sequence
  chemically synthesized
atttcaggtttactttcatc

SEQ ID NO: 613073 - DNA, 20 bp, Artificial Sequence
  chemically synthesized
tgaaagtaaacctgaaatat

SEQ ID NO: 613074 - DNA, 20 bp, Artificial Sequence
  chemically synthesized
tttcagaaaaccatcatatt

SEQ ID NO: 613075 - DNA, 20 bp, Artificial Sequence
  chemically synthesized
ctgaaatatgatggttttct

SEQ ID NO: 613076 - DNA, 20 bp, Artificial Sequence
  chemically synthesized
caggaacaagttagtgttat

SEQ ID NO: 613077 - DNA, 20 bp, Artificial Sequence
  chemically synthesized
acaagttagtgttatttttg

SEQ ID NO: 613078 - DNA, 20 bp, Artificial Sequence
  chemically synthesized
ctgacgtcttatttactatt

SEQ ID NO: 613079 - DNA, 20 bp, Artificial Sequence
  chemically synthesized
tatcttacaggaatgtaact

SEQ ID NO: 613080 - DNA, 20 bp, Artificial Sequence
  chemically synthesized
gtgtgtgtgtgtgtgtgatg

SEQ ID NO: 613081 - DNA, 20 bp, Artificial Sequence
  chemically synthesized
gacaggtgacaaagttctga

SEQ ID NO: 613082 - DNA, 20 bp, Artificial Sequence
  chemically synthesized
aattgtatgaaaaaattcat

SEQ ID NO: 613083 - DNA, 20 bp, Artificial Sequence
  chemically synthesized
tgttagatgcagagagagat

SEQ ID NO: 613084 - DNA, 20 bp, Artificial Sequence
  chemically synthesized
tgcagagagagatggatgtt

SEQ ID NO: 613085 - DNA, 20 bp, Artificial Sequence
  chemically synthesized
ttgtgtatcatttaagcatt

SEQ ID NO: 613086 - DNA, 20 bp, Artificial Sequence
  chemically synthesized
aacttccaagttaaaaccgc

SEQ ID NO: 613087 - DNA, 20 bp, Artificial Sequence
  chemically synthesized
aattggctgaatgacgcagg

SEQ ID NO: 613088 - DNA, 20 bp, Artificial Sequence
  chemically synthesized
attgaaattagactaaagca

SEQ ID NO: 613089 - DNA, 20 bp, Artificial Sequence
  chemically synthesized
tgaaacaaatgtgagaaacg

SEQ ID NO: 613090 - DNA, 20 bp, Artificial Sequence
  chemically synthesized
taaagcaggtcgtttctcac

SEQ ID NO: 613091 - DNA, 20 bp, Artificial Sequence
  chemically synthesized
ttggttctcccagatcattt

SEQ ID NO: 613092 - DNA, 20 bp, Artificial Sequence
  chemically synthesized
cctcccttagctaattttaa

SEQ ID NO: 613093 - DNA, 20 bp, Artificial Sequence
  chemically synthesized
tcaccaagactgagtgaaaa

SEQ ID NO: 613094 - DNA, 20 bp, Artificial Sequence
  chemically synthesized
gctaccttttcactcagtct

SEQ ID NO: 613095 - DNA, 20 bp, Artificial Sequence
  chemically synthesized
tttttgtgaaattattttat

SEQ ID NO: 613096 - DNA, 20 bp, Artificial Sequence
  chemically synthesized
tattataaaataatttcaca

SEQ ID NO: 613097 - DNA, 20 bp, Artificial Sequence
  chemically synthesized
aggaaccctgaaatatcctt

SEQ ID NO: 613098 - DNA, 20 bp, Artificial Sequence
  chemically synthesized
gaaatatccttaaaagtttg

SEQ ID NO: 613099 - DNA, 20 bp, Artificial Sequence
  chemically synthesized
cttttagttattgtttaaga

SEQ ID NO: 613100 - DNA, 20 bp, Artificial Sequence
  chemically synthesized
atttcccttttagttattgt

SEQ ID NO: 613101 - DNA, 20 bp, Artificial Sequence
  chemically synthesized
catgggatttcccttttagt

SEQ ID NO: 613102 - DNA, 20 bp, Artificial Sequence
  chemically synthesized
tacataataattttcaatgc

SEQ ID NO: 613103 - DNA, 20 bp, Artificial Sequence
  chemically synthesized
agatggtggaagtacatgct

SEQ ID NO: 613104 - DNA, 20 bp, Artificial Sequence
  chemically synthesized
accaaatagatggtggaagt

SEQ ID NO: 613105 - DNA, 20 bp, Artificial Sequence
  chemically synthesized
tagaatgttggaaggaactt

SEQ ID NO: 613106 - DNA, 20 bp, Artificial Sequence
  chemically synthesized
caacattctagataaacaga

SEQ ID NO: 613107 - DNA, 20 bp, Artificial Sequence
  chemically synthesized
taacatgtttaaaaagcaaa

SEQ ID NO: 613108 - DNA, 20 bp, Artificial Sequence
  chemically synthesized
catcttataaaagacattta

SEQ ID NO: 613109 - DNA, 20 bp, Artificial Sequence
  chemically synthesized
ctcttgaatatggagaagtc

SEQ ID NO: 613110 - DNA, 20 bp, Artificial Sequence
  chemically synthesized
aaggattgtatgaatacttg

SEQ ID NO: 613111 - DNA, 20 bp, Artificial Sequence
  chemically synthesized
tttaaaatgcattatattta

SEQ ID NO: 613112 - DNA, 20 bp, Artificial Sequence
  chemically synthesized
aaaaaatacaggaaaggcaa

SEQ ID NO: 613113 - DNA, 20 bp, Artificial Sequence
  chemically synthesized
tagtttcattgccctgcagc

SEQ ID NO: 613114 - DNA, 20 bp, Artificial Sequence
  chemically synthesized
catgtgcttttacaccacat

SEQ ID NO: 613115 - DNA, 20 bp, Artificial Sequence
  chemically synthesized
tacaccacatttaagattta

SEQ ID NO: 613116 - DNA, 20 bp, Artificial Sequence
  chemically synthesized
ctctcaatggaagaaaatag

SEQ ID NO: 613117 - DNA, 20 bp, Artificial Sequence
  chemically synthesized
gtatttatgatttaataaga

SEQ ID NO: 613118 - DNA, 20 bp, Artificial Sequence
  chemically synthesized
ggttgtatatatcgacgtat

SEQ ID NO: 613119 - DNA, 20 bp, Artificial Sequence
  chemically synthesized
tccacagtggcaatatggcc

SEQ ID NO: 613120 - DNA, 20 bp, Artificial Sequence
  chemically synthesized
ggccatattgccactgtgga

SEQ ID NO: 613121 - DNA, 20 bp, Artificial Sequence
  chemically synthesized
tgtggacctggatttccaat

SEQ ID NO: 613122 - DNA, 20 bp, Artificial Sequence
  chemically synthesized
ctccgtatttcaagaattat

SEQ ID NO: 613123 - DNA, 20 bp, Artificial Sequence
  chemically synthesized
gtaatatagttgaggtcaaa

SEQ ID NO: 613124 - DNA, 20 bp, Artificial Sequence
  chemically synthesized
attttgacctcaactatatt

SEQ ID NO: 613125 - DNA, 20 bp, Artificial Sequence
  chemically synthesized
aaagatactatctctacctt

SEQ ID NO: 613126 - DNA, 20 bp, Artificial Sequence
  chemically synthesized
actatctctaccttcaatga

SEQ ID NO: 613127 - DNA, 20 bp, Artificial Sequence
  chemically synthesized
taaaaaatagactttcaaca

SEQ ID NO: 613128 - DNA, 20 bp, Artificial Sequence
  chemically synthesized
aaatttcctctatatttcag

SEQ ID NO: 613129 - DNA, 20 bp, Artificial Sequence
  chemically synthesized
gagaattatttttaatggag

SEQ ID NO: 613130 - DNA, 20 bp, Artificial Sequence
  chemically synthesized
tttaatggagtcatgttttc

SEQ ID NO: 613131 - DNA, 20 bp, Artificial Sequence
  chemically synthesized
cattaaatgttcatattttc

SEQ ID NO: 613132 - DNA, 20 bp, Artificial Sequence
  chemically synthesized
caaaacttctattttgataa

SEQ ID NO: 613133 - DNA, 20 bp, Artificial Sequence
  chemically synthesized
taaaacaaatttatcaaaat

SEQ ID NO: 613134 - DNA, 20 bp, Artificial Sequence
  chemically synthesized
gcattttattaatacgttca

SEQ ID NO: 613135 - DNA, 20 bp, Artificial Sequence
  chemically synthesized
agagctactttcccaaaaag

SEQ ID NO: 613136 - DNA, 20 bp, Artificial Sequence
  chemically synthesized
ttaaaagagctactttccca

SEQ ID NO: 613137 - DNA, 20 bp, Artificial Sequence
  chemically synthesized
attctatataaggaattttg

SEQ ID NO: 613138 - DNA, 20 bp, Artificial Sequence
  chemically synthesized
taaaaagttggggctatatg

SEQ ID NO: 613139 - DNA, 20 bp, Artificial Sequence
  chemically synthesized
ttgaaattagtatacgtgac

SEQ ID NO: 613140 - DNA, 20 bp, Artificial Sequence
  chemically synthesized
tttaagatttttattgtagc

SEQ ID NO: 613141 - DNA, 20 bp, Artificial Sequence
  chemically synthesized
taatgtcactcaagtatctt

SEQ ID NO: 613142 - DNA, 20 bp, Artificial Sequence
  chemically synthesized
aattatataactataaatag

SEQ ID NO: 613143 - DNA, 20 bp, Artificial Sequence
  chemically synthesized
cccatcccccttagtatacc

SEQ ID NO: 613144 - DNA, 20 bp, Artificial Sequence
  chemically synthesized
ttaaaataattttctgggtg

SEQ ID NO: 613145 - DNA, 20 bp, Artificial Sequence
  chemically synthesized
atattaccttgcaactgaat

SEQ ID NO: 613146 - DNA, 20 bp, Artificial Sequence
  chemically synthesized
tgaatgtgagtttaatgaat

SEQ ID NO: 613147 - DNA, 20 bp, Artificial Sequence
  chemically synthesized
tgagtttaatgaatacgaga

SEQ ID NO: 613148 - DNA, 20 bp, Artificial Sequence
  chemically synthesized
tcaactatagggtctttgcc

SEQ ID NO: 613149 - DNA, 20 bp, Artificial Sequence
  chemically synthesized
cactttatatgtattaattc

SEQ ID NO: 613150 - DNA, 20 bp, Artificial Sequence
  chemically synthesized
tttggaatttgtacttaaat

SEQ ID NO: 613151 - DNA, 20 bp, Artificial Sequence
  chemically synthesized
ttttatgagtaataaataga

SEQ ID NO: 613152 - DNA, 20 bp, Artificial Sequence
  chemically synthesized
aatatgtattatatggctat

SEQ ID NO: 613153 - DNA, 20 bp, Artificial Sequence
  chemically synthesized
acttaaaggacacataaaat

SEQ ID NO: 613154 - DNA, 20 bp, Artificial Sequence
  chemically synthesized
tggcatataatgttagataa

SEQ ID NO: 613155 - DNA, 20 bp, Artificial Sequence
  chemically synthesized
tcattgaaaatagtcactga

SEQ ID NO: 613156 - DNA, 20 bp, Artificial Sequence
  chemically synthesized
ctgtcatctgaatttccacc

SEQ ID NO: 613157 - DNA, 20 bp, Artificial Sequence
  chemically synthesized
taggctttttaaatactcac

SEQ ID NO: 613158 - DNA, 20 bp, Artificial Sequence
  chemically synthesized
tttaaatactcaccttggat

SEQ ID NO: 613159 - DNA, 20 bp, Artificial Sequence
  chemically synthesized
tttaatgtatagcaatgact

SEQ ID NO: 613160 - DNA, 20 bp, Artificial Sequence
  chemically synthesized
tgctttgtagtatcccacat

SEQ ID NO: 613161 - DNA, 20 bp, Artificial Sequence
  chemically synthesized
caattgtctatcacaaggtg

SEQ ID NO: 613162 - DNA, 20 bp, Artificial Sequence
  chemically synthesized
atgaattccgatccctttta

SEQ ID NO: 613163 - DNA, 20 bp, Artificial Sequence
  chemically synthesized
cgtcttccctcttatgattt

SEQ ID NO: 613164 - DNA, 20 bp, Artificial Sequence
  chemically synthesized
ttgtgtcctcgtcttccctc

SEQ ID NO: 613165 - DNA, 20 bp, Artificial Sequence
  chemically synthesized
ataagagggaagacgaggac

SEQ ID NO: 613166 - DNA, 20 bp, Artificial Sequence
  chemically synthesized
tatgatctgtcttcctttct

SEQ ID NO: 613167 - DNA, 20 bp, Artificial Sequence
  chemically synthesized
atacatcttggggagcgggg

SEQ ID NO: 613168 - DNA, 20 bp, Artificial Sequence
  chemically synthesized
atttgatagagatttaactg

SEQ ID NO: 613169 - DNA, 20 bp, Artificial Sequence
  chemically synthesized
cttagaaattacaaatttga

SEQ ID NO: 613170 - DNA, 20 bp, Artificial Sequence
  chemically synthesized
taataattttgtgtctagtt

SEQ ID NO: 613171 - DNA, 20 bp, Artificial Sequence
  chemically synthesized
gcacttttaataattttgtg

SEQ ID NO: 613172 - DNA, 20 bp, Artificial Sequence
  chemically synthesized
aatatctaatagagaatact

SEQ ID NO: 613173 - DNA, 20 bp, Artificial Sequence
  chemically synthesized
agaacttagttatatccaag

SEQ ID NO: 613174 - DNA, 20 bp, Artificial Sequence
  chemically synthesized
atttctttgccctgtcccac

SEQ ID NO: 613175 - DNA, 20 bp, Artificial Sequence
  chemically synthesized
taatagaatggctgtataag

SEQ ID NO: 613176 - DNA, 20 bp, Artificial Sequence
  chemically synthesized
taagagatgtttcatcctag

SEQ ID NO: 613177 - DNA, 20 bp, Artificial Sequence
  chemically synthesized
gatgtttcatcctagctggg

SEQ ID NO: 613178 - DNA, 20 bp, Artificial Sequence
  chemically synthesized
tccacagcttctttttattt

SEQ ID NO: 613179 - DNA, 20 bp, Artificial Sequence
  chemically synthesized
gctctaggtaaaaatgtatc

SEQ ID NO: 613180 - DNA, 20 bp, Artificial Sequence
  chemically synthesized
gtagcatagtctcccatttc

SEQ ID NO: 613181 - DNA, 20 bp, Artificial Sequence
  chemically synthesized
ttctcaggattttgtatttt

SEQ ID NO: 613182 - DNA, 20 bp, Artificial Sequence
  chemically synthesized
agctcatttgtaatagttgg

SEQ ID NO: 613183 - DNA, 20 bp, Artificial Sequence
  chemically synthesized
atcacaaccaactattacaa

SEQ ID NO: 613184 - DNA, 20 bp, Artificial Sequence
  chemically synthesized
gaagtactttcttctcaata

SEQ ID NO: 613185 - DNA, 20 bp, Artificial Sequence
  chemically synthesized
caatttgcattctttgtggt

SEQ ID NO: 613186 - DNA, 20 bp, Artificial Sequence
  chemically synthesized
ttatcctcacttgaatgcca

SEQ ID NO: 613187 - DNA, 20 bp, Artificial Sequence
  chemically synthesized
tttctttcctttccctgtcc

SEQ ID NO: 613188 - DNA, 20 bp, Artificial Sequence
  chemically synthesized
tcctcagtttaaccctgttc

SEQ ID NO: 613189 - DNA, 20 bp, Artificial Sequence
  chemically synthesized
gaacagggttaaactgagga

SEQ ID NO: 613190 - DNA, 20 bp, Artificial Sequence
  chemically synthesized
ctgtagttctaaactagctc

SEQ ID NO: 613191 - DNA, 20 bp, Artificial Sequence
  chemically synthesized
actacagaatatgctagaac

SEQ ID NO: 613192 - DNA, 20 bp, Artificial Sequence
  chemically synthesized
aaatcactcaaaatttagcc

SEQ ID NO: 613193 - DNA, 20 bp, Artificial Sequence
  chemically synthesized
aaatcagagggctaaatttt

SEQ ID NO: 613194 - DNA, 20 bp, Artificial Sequence
  chemically synthesized
tttgagtgatttttttaaac

SEQ ID NO: 613195 - DNA, 20 bp, Artificial Sequence
  chemically synthesized
ataaacctatgaaaagaaac

SEQ ID NO: 613196 - DNA, 20 bp, Artificial Sequence
  chemically synthesized
ttaaaccagggtttcttttc

SEQ ID NO: 613197 - DNA, 20 bp, Artificial Sequence
  chemically synthesized
atagaattaggaggctgttc

SEQ ID NO: 613198 - DNA, 20 bp, Artificial Sequence
  chemically synthesized
tttttttttgaataccagtg

SEQ ID NO: 613199 - DNA, 20 bp, Artificial Sequence
  chemically synthesized
aacctccgcctcatgggttc

SEQ ID NO: 613200 - DNA, 20 bp, Artificial Sequence
  chemically synthesized
ttttttttttttagtagaga

SEQ ID NO: 613201 - DNA, 20 bp, Artificial Sequence
  chemically synthesized
cgccccagcctcccaaagtg

SEQ ID NO: 613202 - DNA, 20 bp, Artificial Sequence
  chemically synthesized
ggttttacacagaaatacat

SEQ ID NO: 613203 - DNA, 20 bp, Artificial Sequence
  chemically synthesized
tatatgtatttctgtgtaaa

SEQ ID NO: 613204 - DNA, 20 bp, Artificial Sequence
  chemically synthesized
atttctgtgtaaaacccgtt

SEQ ID NO: 613205 - DNA, 20 bp, Artificial Sequence
  chemically synthesized
atgagatatagaaaccaaaa

SEQ ID NO: 613206 - DNA, 20 bp, Artificial Sequence
  chemically synthesized
tccatttttaaactgcatac

SEQ ID NO: 613207 - DNA, 20 bp, Artificial Sequence
  chemically synthesized
gagggagaaaaacaaatgta

SEQ ID NO: 613208 - DNA, 20 bp, Artificial Sequence
  chemically synthesized
gctagttccttataatatga

SEQ ID NO: 613209 - DNA, 20 bp, Artificial Sequence
  chemically synthesized
aactagctgtatattttatc

SEQ ID NO: 613210 - DNA, 20 bp, Artificial Sequence
  chemically synthesized
tctatttctttatctttagt

SEQ ID NO: 613211 - DNA, 20 bp, Artificial Sequence
  chemically synthesized
ttcaaataaaaatgttacaa

SEQ ID NO: 613212 - DNA, 20 bp, Artificial Sequence
  chemically synthesized
tttttgtaacatttttattt

SEQ ID NO: 613213 - DNA, 20 bp, Artificial Sequence
  chemically synthesized
tgtaacatttttatttgaaa

SEQ ID NO: 613214 - DNA, 20 bp, Artificial Sequence
  chemically synthesized
cattaaaaagataaattgaa

SEQ ID NO: 613215 - DNA, 20 bp, Artificial Sequence
  chemically synthesized
ctgagagtttgaatttttgt

SEQ ID NO: 613216 - DNA, 20 bp, Artificial Sequence
  chemically synthesized
gaaatggctcaggctgtact

SEQ ID NO: 613217 - DNA, 20 bp, Artificial Sequence
  chemically synthesized
tacagcctgagccatttctc

SEQ ID NO: 613218 - DNA, 20 bp, Artificial Sequence
  chemically synthesized
ttctcatgggttttcatatg

SEQ ID NO: 613219 - DNA, 20 bp, Artificial Sequence
  chemically synthesized
aatgctttttccttcacaaa

SEQ ID NO: 613220 - DNA, 20 bp, Artificial Sequence
  chemically synthesized
cacaaatgtagttttatact

SEQ ID NO: 613221 - DNA, 20 bp, Artificial Sequence
  chemically synthesized
acttataaattaagtttgat

SEQ ID NO: 613222 - DNA, 20 bp, Artificial Sequence
  chemically synthesized
ataatatacttataaattaa

SEQ ID NO: 613223 - DNA, 20 bp, Artificial Sequence
  chemically synthesized
actaataatatacttataaa

SEQ ID NO: 613224 - DNA, 20 bp, Artificial Sequence
  chemically synthesized
acttaatttataagtatatt

SEQ ID NO: 613225 - DNA, 20 bp, Artificial Sequence
  chemically synthesized
tattaaataacatgaatttt

SEQ ID NO: 613226 - DNA, 20 bp, Artificial Sequence
  chemically synthesized
tcactgcattcaaatatatt

SEQ ID NO: 613227 - DNA, 20 bp, Artificial Sequence
  chemically synthesized
actattttcctaagccttta

SEQ ID NO: 613228 - DNA, 20 bp, Artificial Sequence
  chemically synthesized
ctcttcgtcgtaaacttgtt

SEQ ID NO: 613229 - DNA, 20 bp, Artificial Sequence
  chemically synthesized
atttgatgacagagagtaga

SEQ ID NO: 613230 - DNA, 20 bp, Artificial Sequence
  chemically synthesized
gtggtatggcctcaaaggtg

SEQ ID NO: 613231 - DNA, 20 bp, Artificial Sequence
  chemically synthesized
caacatcagagttctcggca

SEQ ID NO: 613232 - DNA, 20 bp, Artificial Sequence
  chemically synthesized
attccaggtatctagttctg

SEQ ID NO: 613233 - DNA, 20 bp, Artificial Sequence
  chemically synthesized
tcggcattccaggtatctag

SEQ ID NO: 613234 - DNA, 20 bp, Artificial Sequence
  chemically synthesized
acagaactagatacctggaa

SEQ ID NO: 613235 - DNA, 20 bp, Artificial Sequence
  chemically synthesized
gatacctggaatgccgatta

SEQ ID NO: 613236 - DNA, 20 bp, Artificial Sequence
  chemically synthesized
cacatacaaagaagaggtga

SEQ ID NO: 613237 - DNA, 20 bp, Artificial Sequence
  chemically synthesized
ctaaccagaagtccaaggtt

SEQ ID NO: 613238 - DNA, 20 bp, Artificial Sequence
  chemically synthesized
gtgttttgccagtgccgctc

SEQ ID NO: 613239 - DNA, 20 bp, Artificial Sequence
  chemically synthesized
agcggcactggcaaaacact

SEQ ID NO: 613240 - DNA, 20 bp, Artificial Sequence
  chemically synthesized
agtctctccatagaatcctc

SEQ ID NO: 613241 - DNA, 20 bp, Artificial Sequence
  chemically synthesized
cttctctcaacttcaccagg

SEQ ID NO: 613242 - DNA, 20 bp, Artificial Sequence
  chemically synthesized
ctaggtatctaaagaatgct

SEQ ID NO: 613243 - DNA, 20 bp, Artificial Sequence
  chemically synthesized
cagtggcgctctcccaacat

SEQ ID NO: 613244 - DNA, 20 bp, Artificial Sequence
  chemically synthesized
attaatagccctctcccctt

SEQ ID NO: 613245 - DNA, 20 bp, Artificial Sequence
  chemically synthesized
agccctctccccttgactgc

SEQ ID NO: 613246 - DNA, 20 bp, Artificial Sequence
  chemically synthesized
agaaactatggtgaagaatg

SEQ ID NO: 613247 - DNA, 20 bp, Artificial Sequence
  chemically synthesized
tgaatccctgcattcttcac

SEQ ID NO: 613248 - DNA, 20 bp, Artificial Sequence
  chemically synthesized
gtttcttcctttaatcctcc

SEQ ID NO: 613249 - DNA, 20 bp, Artificial Sequence
  chemically synthesized
gaatatttatagaaacgtgg

SEQ ID NO: 613250 - DNA, 20 bp, Artificial Sequence
  chemically synthesized
ccacgtttctataaatattc

SEQ ID NO: 613251 - DNA, 20 bp, Artificial Sequence
  chemically synthesized
ttcaactttttctgtatgcc

SEQ ID NO: 613252 - DNA, 20 bp, Artificial Sequence
  chemically synthesized
cctcaatgaactgaaaatga

SEQ ID NO: 613253 - DNA, 20 bp, Artificial Sequence
  chemically synthesized
cattcccaataatgacagac

SEQ ID NO: 613254 - DNA, 20 bp, Artificial Sequence
  chemically synthesized
gttggatgtgcaagaagagc

SEQ ID NO: 613255 - DNA, 20 bp, Artificial Sequence
  chemically synthesized
cttgcacatccaacttcata

SEQ ID NO: 613256 - DNA, 20 bp, Artificial Sequence
  chemically synthesized
atattttatagaagtatcta

SEQ ID NO: 613257 - DNA, 20 bp, Artificial Sequence
  chemically synthesized
acaaataactgtaggtttaa

SEQ ID NO: 613258 - DNA, 20 bp, Artificial Sequence
  chemically synthesized
gattgagagtacaaataact

SEQ ID NO: 613259 - DNA, 20 bp, Artificial Sequence
  chemically synthesized
tttatgacatatttaacagc

SEQ ID NO: 613260 - DNA, 20 bp, Artificial Sequence
  chemically synthesized
gagccattaattcaccactg

SEQ ID NO: 613261 - DNA, 20 bp, Artificial Sequence
  chemically synthesized
tatttccatcaatttttctt

SEQ ID NO: 613262 - DNA, 20 bp, Artificial Sequence
  chemically synthesized
agcagcatttctactgtgcg

SEQ ID NO: 613263 - DNA, 20 bp, Artificial Sequence
  chemically synthesized
ttcttgaataaaatgacact

SEQ ID NO: 613264 - DNA, 20 bp, Artificial Sequence
  chemically synthesized
taagtttgttagtattctat

SEQ ID NO: 613265 - DNA, 20 bp, Artificial Sequence
  chemically synthesized
tatcactgatttttcatttt

SEQ ID NO: 613266 - DNA, 20 bp, Artificial Sequence
  chemically synthesized
ttttcattttgtctgatttt

SEQ ID NO: 613267 - DNA, 20 bp, Artificial Sequence
  chemically synthesized
ttaagttctggggtacatgt

SEQ ID NO: 613268 - DNA, 20 bp, Artificial Sequence
  chemically synthesized
catagttatacacctgcgat

SEQ ID NO: 613269 - DNA, 20 bp, Artificial Sequence
  chemically synthesized
cacttatgagtcagaacatg

SEQ ID NO: 613270 - DNA, 20 bp, Artificial Sequence
  chemically synthesized
atgagtcagaacatgcggtg

SEQ ID NO: 613271 - DNA, 20 bp, Artificial Sequence
  chemically synthesized
gtttggttttctgttcttgt

SEQ ID NO: 613272 - DNA, 20 bp, Artificial Sequence
  chemically synthesized
tgtgttagtttgctgagaat

SEQ ID NO: 613273 - DNA, 20 bp, Artificial Sequence
  chemically synthesized
gtttgctgagaatgatggtt

SEQ ID NO: 613274 - DNA, 20 bp, Artificial Sequence
  chemically synthesized
caaatgtccatcagtgatag

SEQ ID NO: 613275 - DNA, 20 bp, Artificial Sequence
  chemically synthesized
tggccaacatacatacgaaa

SEQ ID NO: 613276 - DNA, 20 bp, Artificial Sequence
  chemically synthesized
taaatggtatctcattgtgg

SEQ ID NO: 613277 - DNA, 20 bp, Artificial Sequence
  chemically synthesized
gttgttaaatggtatctcat

SEQ ID NO: 613278 - DNA, 20 bp, Artificial Sequence
  chemically synthesized
agcatcttttgctgactttt

SEQ ID NO: 613279 - DNA, 20 bp, Artificial Sequence
  chemically synthesized
gagagaatatggagaaatag

SEQ ID NO: 613280 - DNA, 20 bp, Artificial Sequence
  chemically synthesized
aaccattgtggaagacagtg

SEQ ID NO: 613281 - DNA, 20 bp, Artificial Sequence
  chemically synthesized
ctttggatatatacccagta

SEQ ID NO: 613282 - DNA, 20 bp, Artificial Sequence
  chemically synthesized
ctgttactgggtatatatcc

SEQ ID NO: 613283 - DNA, 20 bp, Artificial Sequence
  chemically synthesized
gtgcatgtgtcttcatagta

SEQ ID NO: 613284 - DNA, 20 bp, Artificial Sequence
  chemically synthesized
tagcaaagacttggaactat

SEQ ID NO: 613285 - DNA, 20 bp, Artificial Sequence
  chemically synthesized
atgacccatttaatttctag

SEQ ID NO: 613286 - DNA, 20 bp, Artificial Sequence
  chemically synthesized
caaatgccaacaatggctca

SEQ ID NO: 613287 - DNA, 20 bp, Artificial Sequence
  chemically synthesized
tctctgctcccctatctctg

SEQ ID NO: 613288 - DNA, 20 bp, Artificial Sequence
  chemically synthesized
gcctcagcaagtggagtaga

SEQ ID NO: 613289 - DNA, 20 bp, Artificial Sequence
  chemically synthesized
acttgctgaggcctcattcc

SEQ ID NO: 613290 - DNA, 20 bp, Artificial Sequence
  chemically synthesized
acttaactgttcctaagtat

SEQ ID NO: 613291 - DNA, 20 bp, Artificial Sequence
  chemically synthesized
aaacacaaccctttgtgtgt

SEQ ID NO: 613292 - DNA, 20 bp, Artificial Sequence
  chemically synthesized
aatctctgacacacaaaggg

SEQ ID NO: 613293 - DNA, 20 bp, Artificial Sequence
  chemically synthesized
aattcacaggtatataagtt

SEQ ID NO: 613294 - DNA, 20 bp, Artificial Sequence
  chemically synthesized
ttaaaattcacaggtatata

SEQ ID NO: 613295 - DNA, 20 bp, Artificial Sequence
  chemically synthesized
atttggataggacttcttca

SEQ ID NO: 613296 - DNA, 20 bp, Artificial Sequence
  chemically synthesized
tgtgattatttatatcctgc

SEQ ID NO: 613297 - DNA, 20 bp, Artificial Sequence
  chemically synthesized
gcaggattttttttctaaag

SEQ ID NO: 613298 - DNA, 20 bp, Artificial Sequence
  chemically synthesized
gctcaactttagaaaaaaaa

SEQ ID NO: 613299 - DNA, 20 bp, Artificial Sequence
  chemically synthesized
aaaaaaatcctgcttgagca

SEQ ID NO: 613300 - DNA, 20 bp, Artificial Sequence
  chemically synthesized
gaataaatcaaaatgctcaa

SEQ ID NO: 613301 - DNA, 20 bp, Artificial Sequence
  chemically synthesized
catccataagtacaacttta

SEQ ID NO: 613302 - DNA, 20 bp, Artificial Sequence
  chemically synthesized
aaaacatccataagtacaac

SEQ ID NO: 613303 - DNA, 20 bp, Artificial Sequence
  chemically synthesized
caaactaaagttgtacttat

SEQ ID NO: 613304 - DNA, 20 bp, Artificial Sequence
  chemically synthesized
tacttatggatgttttccat

SEQ ID NO: 613305 - DNA, 20 bp, Artificial Sequence
  chemically synthesized
caacctctgctcccaggttc

SEQ ID NO: 613306 - DNA, 20 bp, Artificial Sequence
  chemically synthesized
ccaccacgctcagctaattt

SEQ ID NO: 613307 - DNA, 20 bp, Artificial Sequence
  chemically synthesized
ttttgtgtttttagtagaga

SEQ ID NO: 613308 - DNA, 20 bp, Artificial Sequence
  chemically synthesized
gcatgagccaccgcgcccag

SEQ ID NO: 613309 - DNA, 20 bp, Artificial Sequence
  chemically synthesized
cctgtggctgaacaataaca

SEQ ID NO: 613310 - DNA, 20 bp, Artificial Sequence
  chemically synthesized
aaggtaaaggttcctttgtt

SEQ ID NO: 613311 - DNA, 20 bp, Artificial Sequence
  chemically synthesized
aaaggttcctttgttccaag

SEQ ID NO: 613312 - DNA, 20 bp, Artificial Sequence
  chemically synthesized
gtttctgcatgagaatgtct

SEQ ID NO: 613313 - DNA, 20 bp, Artificial Sequence
  chemically synthesized
aacaatgctttcatctgagc

SEQ ID NO: 613314 - DNA, 20 bp, Artificial Sequence
  chemically synthesized
cagatgaaagcattgttaat

SEQ ID NO: 613315 - DNA, 20 bp, Artificial Sequence
  chemically synthesized
tgttcaaaagcagatattaa

SEQ ID NO: 613316 - DNA, 20 bp, Artificial Sequence
  chemically synthesized
tagggaaaaggccccaaaat

SEQ ID NO: 613317 - DNA, 20 bp, Artificial Sequence
  chemically synthesized
acagaaaatatagaacctcc

SEQ ID NO: 613318 - DNA, 20 bp, Artificial Sequence
  chemically synthesized
aagaaatgtggccttccctg

SEQ ID NO: 613319 - DNA, 20 bp, Artificial Sequence
  chemically synthesized
tagaaatctgatcatagacc

SEQ ID NO: 613320 - DNA, 20 bp, Artificial Sequence
  chemically synthesized
tagaaaacatggggtctatg

SEQ ID NO: 613321 - DNA, 20 bp, Artificial Sequence
  chemically synthesized
agatttctatatatggcccg

SEQ ID NO: 613322 - DNA, 20 bp, Artificial Sequence
  chemically synthesized
tatatggcccgtggagtttc

SEQ ID NO: 613323 - DNA, 20 bp, Artificial Sequence
  chemically synthesized
atacataagtgtacaacttg

SEQ ID NO: 613324 - DNA, 20 bp, Artificial Sequence
  chemically synthesized
cttctgcggtgctcactgtt

SEQ ID NO: 613325 - DNA, 20 bp, Artificial Sequence
  chemically synthesized
catggaacagtgagcaccgc

SEQ ID NO: 613326 - DNA, 20 bp, Artificial Sequence
  chemically synthesized
gcaccgcagaagattctctt

SEQ ID NO: 613327 - DNA, 20 bp, Artificial Sequence
  chemically synthesized
aaaacgggcaaaatgtttcc

SEQ ID NO: 613328 - DNA, 20 bp, Artificial Sequence
  chemically synthesized
taaacccatggaaacatttt

SEQ ID NO: 613329 - DNA, 20 bp, Artificial Sequence
  chemically synthesized
ttaaatttcaaaaacgggca

SEQ ID NO: 613330 - DNA, 20 bp, Artificial Sequence
  chemically synthesized
aatcagacaaattataccta

SEQ ID NO: 613331 - DNA, 20 bp, Artificial Sequence
  chemically synthesized
aatcatagtaggtataattt

SEQ ID NO: 613332 - DNA, 20 bp, Artificial Sequence
  chemically synthesized
gagaatgtatcatagtcact

SEQ ID NO: 613333 - DNA, 20 bp, Artificial Sequence
  chemically synthesized
atatatgtgagaatgttcat

SEQ ID NO: 613334 - DNA, 20 bp, Artificial Sequence
  chemically synthesized
atgaacattctcacatatat

SEQ ID NO: 613335 - DNA, 20 bp, Artificial Sequence
  chemically synthesized
caagttacagaaatacattt

SEQ ID NO: 613336 - DNA, 20 bp, Artificial Sequence
  chemically synthesized
tatatttccagaagttaatt

SEQ ID NO: 613337 - DNA, 20 bp, Artificial Sequence
  chemically synthesized
tgaggttaaacatttcttaa

SEQ ID NO: 613338 - DNA, 20 bp, Artificial Sequence
  chemically synthesized
attcaagaatcatatttaag

SEQ ID NO: 613339 - DNA, 20 bp, Artificial Sequence
  chemically synthesized
cttttgtgttcctgttcaat

SEQ ID NO: 613340 - DNA, 20 bp, Artificial Sequence
  chemically synthesized
cttgattttttttttaaatt

SEQ ID NO: 613341 - DNA, 20 bp, Artificial Sequence
  chemically synthesized
gtatcccagtcttctgtttt

SEQ ID NO: 613342 - DNA, 20 bp, Artificial Sequence
  chemically synthesized
acatatggagtatcccagtc

SEQ ID NO: 613343 - DNA, 20 bp, Artificial Sequence
  chemically synthesized
taaatgtgtcagttattctc

SEQ ID NO: 613344 - DNA, 20 bp, Artificial Sequence
  chemically synthesized
tacatgtacattcattttaa

SEQ ID NO: 613345 - DNA, 20 bp, Artificial Sequence
  chemically synthesized
atgaatgtacatgtaaatgg

SEQ ID NO: 613346 - DNA, 20 bp, Artificial Sequence
  chemically synthesized
ttggccctttctatttttgt

SEQ ID NO: 613347 - DNA, 20 bp, Artificial Sequence
  chemically synthesized
actaggttctcccactttgt

SEQ ID NO: 613348 - DNA, 20 bp, Artificial Sequence
  chemically synthesized
tatcatgtaatgtggagtaa

SEQ ID NO: 613349 - DNA, 20 bp, Artificial Sequence
  chemically synthesized
atttgtccgtacatatgtgg

SEQ ID NO: 613350 - DNA, 20 bp, Artificial Sequence
  chemically synthesized
tattaaaaataatgcttcct

SEQ ID NO: 613351 - DNA, 20 bp, Artificial Sequence
  chemically synthesized
aacacaccatttattaaaaa

SEQ ID NO: 613352 - DNA, 20 bp, Artificial Sequence
  chemically synthesized
tttggatctgttttacctga

SEQ ID NO: 613353 - DNA, 20 bp, Artificial Sequence
  chemically synthesized
ttttaccattttgtttttgg

SEQ ID NO: 613354 - DNA, 20 bp, Artificial Sequence
  chemically synthesized
gaaccattatcgttttacca

SEQ ID NO: 613355 - DNA, 20 bp, Artificial Sequence
  chemically synthesized
gttattatctatagaaccat

SEQ ID NO: 613356 - DNA, 20 bp, Artificial Sequence
  chemically synthesized
ataacctaatatagtatcat

SEQ ID NO: 613357 - DNA, 20 bp, Artificial Sequence
  chemically synthesized
ttcaacaggtcataaaaata

SEQ ID NO: 613358 - DNA, 20 bp, Artificial Sequence
  chemically synthesized
aaacaagttctccacttgga

SEQ ID NO: 613359 - DNA, 20 bp, Artificial Sequence
  chemically synthesized
aaactatatccaagtggaga

SEQ ID NO: 613360 - DNA, 20 bp, Artificial Sequence
  chemically synthesized
gcaaatgtattttccttttc

SEQ ID NO: 613361 - DNA, 20 bp, Artificial Sequence
  chemically synthesized
ctatattctggatatgagcc

SEQ ID NO: 613362 - DNA, 20 bp, Artificial Sequence
  chemically synthesized
ttaacttttctctttttgaa

SEQ ID NO: 613363 - DNA, 20 bp, Artificial Sequence
  chemically synthesized
tttctctttttgaaacatgc

SEQ ID NO: 613364 - DNA, 20 bp, Artificial Sequence
  chemically synthesized
ttatgatacctgaatccaaa

SEQ ID NO: 613365 - DNA, 20 bp, Artificial Sequence
  chemically synthesized
agtcatataaatttccttct

SEQ ID NO: 613366 - DNA, 20 bp, Artificial Sequence
  chemically synthesized
tccttctatatgttttattg

SEQ ID NO: 613367 - DNA, 20 bp, Artificial Sequence
  chemically synthesized
gagaaaagaagtcctgaaga

SEQ ID NO: 613368 - DNA, 20 bp, Artificial Sequence
  chemically synthesized
tgtgtattcattgtccgttt

SEQ ID NO: 613369 - DNA, 20 bp, Artificial Sequence
  chemically synthesized
ggacagtgtgtgtattcatt

SEQ ID NO: 613370 - DNA, 20 bp, Artificial Sequence
  chemically synthesized
atgaatacacacactgtcca

SEQ ID NO: 613371 - DNA, 20 bp, Artificial Sequence
  chemically synthesized
ctcgccagagataaccacgc

SEQ ID NO: 613372 - DNA, 20 bp, Artificial Sequence
  chemically synthesized
aagtttttggaggagtgtgt

SEQ ID NO: 613373 - DNA, 20 bp, Artificial Sequence
  chemically synthesized
acaatgagcaaaagaatagg

SEQ ID NO: 613374 - DNA, 20 bp, Artificial Sequence
  chemically synthesized
gtgggtttttttgtttgttt

SEQ ID NO: 613375 - DNA, 20 bp, Artificial Sequence
  chemically synthesized
gtgtgtgggtttttttgttt

SEQ ID NO: 613376 - DNA, 20 bp, Artificial Sequence
  chemically synthesized
aggggtgtgtgggttttttt

SEQ ID NO: 613377 - DNA, 20 bp, Artificial Sequence
  chemically synthesized
acccaggggtgtgtgggttt

SEQ ID NO: 613378 - DNA, 20 bp, Artificial Sequence
  chemically synthesized
aaatctccacccaggggtgt

SEQ ID NO: 613379 - DNA, 20 bp, Artificial Sequence
  chemically synthesized
aaaacccacacacccctggg

SEQ ID NO: 613380 - DNA, 20 bp, Artificial Sequence
  chemically synthesized
ttacttgcaagtatgttttg

SEQ ID NO: 613381 - DNA, 20 bp, Artificial Sequence
  chemically synthesized
ggggggggtcttacttgcaa

SEQ ID NO: 613382 - DNA, 20 bp, Artificial Sequence
  chemically synthesized
gaccccccccatacaccctt

SEQ ID NO: 613383 - DNA, 20 bp, Artificial Sequence
  chemically synthesized
cccttgtgttcgtgtgcatt

SEQ ID NO: 613384 - DNA, 20 bp, Artificial Sequence
  chemically synthesized
cttattgagaatatgtgtta

SEQ ID NO: 613385 - DNA, 20 bp, Artificial Sequence
  chemically synthesized
agaatatgtgttattcggtt

SEQ ID NO: 613386 - DNA, 20 bp, Artificial Sequence
  chemically synthesized
attcggttttctgtttctgt

SEQ ID NO: 613387 - DNA, 20 bp, Artificial Sequence
  chemically synthesized
actccagcctgggaggcaga

SEQ ID NO: 613388 - DNA, 20 bp, Artificial Sequence
  chemically synthesized
tcgggaggctgaggtaggag

SEQ ID NO: 613389 - DNA, 20 bp, Artificial Sequence
  chemically synthesized
tacctcagcctcccgagtag

SEQ ID NO: 613390 - DNA, 20 bp, Artificial Sequence
  chemically synthesized
tttgtattttttagtagaga

SEQ ID NO: 613391 - DNA, 20 bp, Artificial Sequence
  chemically synthesized
agcctcggcctcccacagtg

SEQ ID NO: 613392 - DNA, 20 bp, Artificial Sequence
  chemically synthesized
ctgtaccgcattttctttat

SEQ ID NO: 613393 - DNA, 20 bp, Artificial Sequence
  chemically synthesized
cgcattttctttatgcagga

SEQ ID NO: 613394 - DNA, 20 bp, Artificial Sequence
  chemically synthesized
ttgagttttacaggatatcc

SEQ ID NO: 613395 - DNA, 20 bp, Artificial Sequence
  chemically synthesized
gttttacaggatatcccaaa

SEQ ID NO: 613396 - DNA, 20 bp, Artificial Sequence
  chemically synthesized
attattagatttaatttatt

SEQ ID NO: 613397 - DNA, 20 bp, Artificial Sequence
  chemically synthesized
aaagagcggaacacagaatt

SEQ ID NO: 613398 - DNA, 20 bp, Artificial Sequence
  chemically synthesized
tgaaatatcaaaatatcata

SEQ ID NO: 613399 - DNA, 20 bp, Artificial Sequence
  chemically synthesized
aataatctatgagctgattt

SEQ ID NO: 613400 - DNA, 20 bp, Artificial Sequence
  chemically synthesized
aataaacaagaaaatcagct

SEQ ID NO: 613401 - DNA, 20 bp, Artificial Sequence
  chemically synthesized
cgcagccagaataatctatg

SEQ ID NO: 613402 - DNA, 20 bp, Artificial Sequence
  chemically synthesized
tttgtcttaggaagaaatta

SEQ ID NO: 613403 - DNA, 20 bp, Artificial Sequence
  chemically synthesized
ctatgaaagttattttacag

SEQ ID NO: 613404 - DNA, 20 bp, Artificial Sequence
  chemically synthesized
aaactgtgcagcaattaatt

SEQ ID NO: 613405 - DNA, 20 bp, Artificial Sequence
  chemically synthesized
aatcagccaattaattgctg

SEQ ID NO: 613406 - DNA, 20 bp, Artificial Sequence
  chemically synthesized
atgtactcccccaaatgttg

SEQ ID NO: 613407 - DNA, 20 bp, Artificial Sequence
  chemically synthesized
acatgttattattaatctat

SEQ ID NO: 613408 - DNA, 20 bp, Artificial Sequence
  chemically synthesized
ttaaaataaccataagcagg

SEQ ID NO: 613409 - DNA, 20 bp, Artificial Sequence
  chemically synthesized
gatcaacgtactcaatgtac

SEQ ID NO: 613410 - DNA, 20 bp, Artificial Sequence
  chemically synthesized
agtgcctggtgaaatgtatt

SEQ ID NO: 613411 - DNA, 20 bp, Artificial Sequence
  chemically synthesized
tgaaatgtattggtcgatta

SEQ ID NO: 613412 - DNA, 20 bp, Artificial Sequence
  chemically synthesized
agagtcaccaagtggttcag

SEQ ID NO: 613413 - DNA, 20 bp, Artificial Sequence
  chemically synthesized
gaattcctctgacctgccta

SEQ ID NO: 613414 - DNA, 20 bp, Artificial Sequence
  chemically synthesized
tgcctacttggtttagctgt

SEQ ID NO: 613415 - DNA, 20 bp, Artificial Sequence
  chemically synthesized
gtttttttggtttagattta

SEQ ID NO: 613416 - DNA, 20 bp, Artificial Sequence
  chemically synthesized
tggcagatttgtttttttgg

SEQ ID NO: 613417 - DNA, 20 bp, Artificial Sequence
  chemically synthesized
atgaatggcagatttgtttt

SEQ ID NO: 613418 - DNA, 20 bp, Artificial Sequence
  chemically synthesized
acttggggtatgaatggcag

SEQ ID NO: 613419 - DNA, 20 bp, Artificial Sequence
  chemically synthesized
tttttacttggggtatgaat

SEQ ID NO: 613420 - DNA, 20 bp, Artificial Sequence
  chemically synthesized
cataccccaagtaaaaatag

SEQ ID NO: 613421 - DNA, 20 bp, Artificial Sequence
  chemically synthesized
gtgatgtttctgtataattt

SEQ ID NO: 613422 - DNA, 20 bp, Artificial Sequence
  chemically synthesized
ataatttatatgcttggaga

SEQ ID NO: 613423 - DNA, 20 bp, Artificial Sequence
  chemically synthesized
ggagacagcgtttaataagt

SEQ ID NO: 613424 - DNA, 20 bp, Artificial Sequence
  chemically synthesized
acagcgtttaataagtgttg

SEQ ID NO: 613425 - DNA, 20 bp, Artificial Sequence
  chemically synthesized
gatttaaacaaacatcatta

SEQ ID NO: 613426 - DNA, 20 bp, Artificial Sequence
  chemically synthesized
tgttcaaacctgataatgat

SEQ ID NO: 613427 - DNA, 20 bp, Artificial Sequence
  chemically synthesized
aatgtgttcaaacctgataa

SEQ ID NO: 613428 - DNA, 20 bp, Artificial Sequence
  chemically synthesized
taaatatttggtatagaaaa

SEQ ID NO: 613429 - DNA, 20 bp, Artificial Sequence
  chemically synthesized
cggcagtgttttgtgcaaca

SEQ ID NO: 613430 - DNA, 20 bp, Artificial Sequence
  chemically synthesized
gtgaactctgtttcttacgg

SEQ ID NO: 613431 - DNA, 20 bp, Artificial Sequence
  chemically synthesized
gagccaccgtgcccggtgaa

SEQ ID NO: 613432 - DNA, 20 bp, Artificial Sequence
  chemically synthesized
tgcctcagcctcccgaagtg

SEQ ID NO: 613433 - DNA, 20 bp, Artificial Sequence
  chemically synthesized
ttttgtatttttagtagaga

SEQ ID NO: 613434 - DNA, 20 bp, Artificial Sequence
  chemically synthesized
tgtctcagcctcccgagtag

SEQ ID NO: 613435 - DNA, 20 bp, Artificial Sequence
  chemically synthesized
tcgggaggctgagacaggag

SEQ ID NO: 613436 - DNA, 20 bp, Artificial Sequence
  chemically synthesized
aatagcttaaacctggaagg

SEQ ID NO: 613437 - DNA, 20 bp, Artificial Sequence
  chemically synthesized
ctcactgcaaactctgcctt

SEQ ID NO: 613438 - DNA, 20 bp, Artificial Sequence
  chemically synthesized
caactcggtttcttttctta

SEQ ID NO: 613439 - DNA, 20 bp, Artificial Sequence
  chemically synthesized
ggacaaagtcctgcagtcaa

SEQ ID NO: 613440 - DNA, 20 bp, Artificial Sequence
  chemically synthesized
gcaggactttgtccaccaaa

SEQ ID NO: 613441 - DNA, 20 bp, Artificial Sequence
  chemically synthesized
tcagattttacttcatgaag

SEQ ID NO: 613442 - DNA, 20 bp, Artificial Sequence
  chemically synthesized
ctgataggctgctccctgtt

SEQ ID NO: 613443 - DNA, 20 bp, Artificial Sequence
  chemically synthesized
acctgacctgataggctgct

SEQ ID NO: 613444 - DNA, 20 bp, Artificial Sequence
  chemically synthesized
ttccctctgtggcagcatgc

SEQ ID NO: 613445 - DNA, 20 bp, Artificial Sequence
  chemically synthesized
acatgttgtaattcgtgtat

SEQ ID NO: 613446 - DNA, 20 bp, Artificial Sequence
  chemically synthesized
tgtgctctcagtaagaactg

SEQ ID NO: 613447 - DNA, 20 bp, Artificial Sequence
  chemically synthesized
agcatgcttcatgtttgagt

SEQ ID NO: 613448 - DNA, 20 bp, Artificial Sequence
  chemically synthesized
atgctgtgacacagcatgct

SEQ ID NO: 613449 - DNA, 20 bp, Artificial Sequence
  chemically synthesized
ggtctggatgctgtgacaca

SEQ ID NO: 613450 - DNA, 20 bp, Artificial Sequence
  chemically synthesized
aacaatgtcaacaaggcact

SEQ ID NO: 613451 - DNA, 20 bp, Artificial Sequence
  chemically synthesized
ctgctggtcagtgaacactc

SEQ ID NO: 613452 - DNA, 20 bp, Artificial Sequence
  chemically synthesized
ttataaatggtttcatttct

SEQ ID NO: 613453 - DNA, 20 bp, Artificial Sequence
  chemically synthesized
agcttaatagtgaaattata

SEQ ID NO: 613454 - DNA, 20 bp, Artificial Sequence
  chemically synthesized
aaccatttataatttcacta

SEQ ID NO: 613455 - DNA, 20 bp, Artificial Sequence
  chemically synthesized
gctctgttcgtttacaatat

SEQ ID NO: 613456 - DNA, 20 bp, Artificial Sequence
  chemically synthesized
attaatgcctcacaggctct

SEQ ID NO: 613457 - DNA, 20 bp, Artificial Sequence
  chemically synthesized
aggacaattagcgcaaagta

SEQ ID NO: 613458 - DNA, 20 bp, Artificial Sequence
  chemically synthesized
cgctaattgtccttggcctg

SEQ ID NO: 613459 - DNA, 20 bp, Artificial Sequence
  chemically synthesized
gtgttgccattcttagagtg

SEQ ID NO: 613460 - DNA, 20 bp, Artificial Sequence
  chemically synthesized
tctttacaaagcctattttg

SEQ ID NO: 613461 - DNA, 20 bp, Artificial Sequence
  chemically synthesized
gaagaaacaatcataccaaa

SEQ ID NO: 613462 - DNA, 20 bp, Artificial Sequence
  chemically synthesized
tacaaagcctattttggtat

SEQ ID NO: 613463 - DNA, 20 bp, Artificial Sequence
  chemically synthesized
tcttcattctatagcccagt

SEQ ID NO: 613464 - DNA, 20 bp, Artificial Sequence
  chemically synthesized
gaaaatgtttttatgcatgc

SEQ ID NO: 613465 - DNA, 20 bp, Artificial Sequence
  chemically synthesized
tgtttttctatcttactaga

SEQ ID NO: 613466 - DNA, 20 bp, Artificial Sequence
  chemically synthesized
atttttctaaaaagtttggg

SEQ ID NO: 613467 - DNA, 20 bp, Artificial Sequence
  chemically synthesized
atctcctttagatttttcta

SEQ ID NO: 613468 - DNA, 20 bp, Artificial Sequence
  chemically synthesized
aactttttagaaaaatctaa

SEQ ID NO: 613469 - DNA, 20 bp, Artificial Sequence
  chemically synthesized
tttgctagagtcaaatctcc

SEQ ID NO: 613470 - DNA, 20 bp, Artificial Sequence
  chemically synthesized
gttaaaggaaaccttttctg

SEQ ID NO: 613471 - DNA, 20 bp, Artificial Sequence
  chemically synthesized
attaaggtaatcttcacaga

SEQ ID NO: 613472 - DNA, 20 bp, Artificial Sequence
  chemically synthesized
gaaccaaagtgattgaggtt

SEQ ID NO: 613473 - DNA, 20 bp, Artificial Sequence
  chemically synthesized
aattagggaaccaaagtgat

SEQ ID NO: 613474 - DNA, 20 bp, Artificial Sequence
  chemically synthesized
agaataaaattagggaacca

SEQ ID NO: 613475 - DNA, 20 bp, Artificial Sequence
  chemically synthesized
tacaggataagatacaactt

SEQ ID NO: 613476 - DNA, 20 bp, Artificial Sequence
  chemically synthesized
ttacaatgaactatgcagat

SEQ ID NO: 613477 - DNA, 20 bp, Artificial Sequence
  chemically synthesized
ttaactcatttattaagttg

SEQ ID NO: 613478 - DNA, 20 bp, Artificial Sequence
  chemically synthesized
gaaattctaccattatgata

SEQ ID NO: 613479 - DNA, 20 bp, Artificial Sequence
  chemically synthesized
ttctctgggcaatagctaat

SEQ ID NO: 613480 - DNA, 20 bp, Artificial Sequence
  chemically synthesized
tgagtggagaagggaaagag

SEQ ID NO: 613481 - DNA, 20 bp, Artificial Sequence
  chemically synthesized
gcaagtggtttgcattggca

SEQ ID NO: 613482 - DNA, 20 bp, Artificial Sequence
  chemically synthesized
gtttaggtgagaactttgca

SEQ ID NO: 613483 - DNA, 20 bp, Artificial Sequence
  chemically synthesized
aagttctcacctaaacattt

SEQ ID NO: 613484 - DNA, 20 bp, Artificial Sequence
  chemically synthesized
actgttacctataatcaccc

SEQ ID NO: 613485 - DNA, 20 bp, Artificial Sequence
  chemically synthesized
ctgacaattgaacccaggca

SEQ ID NO: 613486 - DNA, 20 bp, Artificial Sequence
  chemically synthesized
ctgggttcaattgtcagctc

SEQ ID NO: 613487 - DNA, 20 bp, Artificial Sequence
  chemically synthesized
aaaatttaatctccctgtat

SEQ ID NO: 613488 - DNA, 20 bp, Artificial Sequence
  chemically synthesized
gatgagaaaactggtataca

SEQ ID NO: 613489 - DNA, 20 bp, Artificial Sequence
  chemically synthesized
tgtgctctcaataacaactg

SEQ ID NO: 613490 - DNA, 20 bp, Artificial Sequence
  chemically synthesized
agcatgcttcatgtttgagt

SEQ ID NO: 613491 - DNA, 20 bp, Artificial Sequence
  chemically synthesized
atcctgtgagacagcatgct

SEQ ID NO: 613492 - DNA, 20 bp, Artificial Sequence
  chemically synthesized
ggtctggatcctgtgagaca

SEQ ID NO: 613493 - DNA, 20 bp, Artificial Sequence
  chemically synthesized
attgctcaaaccattgtaca

SEQ ID NO: 613494 - DNA, 20 bp, Artificial Sequence
  chemically synthesized
ctgccagaaaccatatgtac

SEQ ID NO: 613495 - DNA, 20 bp, Artificial Sequence
  chemically synthesized
gtgtcgatatgcataaagca

SEQ ID NO: 613496 - DNA, 20 bp, Artificial Sequence
  chemically synthesized
tatgcataaagcactaagat

SEQ ID NO: 613497 - DNA, 20 bp, Artificial Sequence
  chemically synthesized
tatgtgacaagcaccaatct

SEQ ID NO: 613498 - DNA, 20 bp, Artificial Sequence
  chemically synthesized
aaactaactgccttgcaagg

SEQ ID NO: 613499 - DNA, 20 bp, Artificial Sequence
  chemically synthesized
aatccccgccttgcaaggca

SEQ ID NO: 613500 - DNA, 20 bp, Artificial Sequence
  chemically synthesized
tcaggttaaaatatctaata

SEQ ID NO: 613501 - DNA, 20 bp, Artificial Sequence
  chemically synthesized
ggggctctacagacacagac

SEQ ID NO: 613502 - DNA, 20 bp, Artificial Sequence
  chemically synthesized
caagacacagaaatatagat

SEQ ID NO: 613503 - DNA, 20 bp, Artificial Sequence
  chemically synthesized
ggaactacttgagaaagacc

SEQ ID NO: 613504 - DNA, 20 bp, Artificial Sequence
  chemically synthesized
accttggagagtaagatggc

SEQ ID NO: 613505 - DNA, 20 bp, Artificial Sequence
  chemically synthesized
caagttaccttggagagtaa

SEQ ID NO: 613506 - DNA, 20 bp, Artificial Sequence
  chemically synthesized
acagtattgacatcttgttc

SEQ ID NO: 613507 - DNA, 20 bp, Artificial Sequence
  chemically synthesized
ctggttcataaggttagcct

SEQ ID NO: 613508 - DNA, 20 bp, Artificial Sequence
  chemically synthesized
gaaaatctaagaggtaaaaa

SEQ ID NO: 613509 - DNA, 20 bp, Artificial Sequence
  chemically synthesized
cagaatctccatttttacct

SEQ ID NO: 613510 - DNA, 20 bp, Artificial Sequence
  chemically synthesized
tccaagaatgtcagaatgat

SEQ ID NO: 613511 - DNA, 20 bp, Artificial Sequence
  chemically synthesized
aaagaggaaaaaaataagac

SEQ ID NO: 613512 - DNA, 20 bp, Artificial Sequence
  chemically synthesized
agcctccccaaatgtctggc

SEQ ID NO: 613513 - DNA, 20 bp, Artificial Sequence
  chemically synthesized
ttttgtatttttagtagaca

SEQ ID NO: 613514 - DNA, 20 bp, Artificial Sequence
  chemically synthesized
gcatgttccatcatgcctgg

SEQ ID NO: 613515 - DNA, 20 bp, Artificial Sequence
  chemically synthesized
ttgggaggccgaggcaggaa

SEQ ID NO: 613516 - DNA, 20 bp, Artificial Sequence
  chemically synthesized
actccagcctgggcgacaga

SEQ ID NO: 613517 - DNA, 20 bp, Artificial Sequence
  chemically synthesized
acacaagaagattggttatt

SEQ ID NO: 613518 - DNA, 20 bp, Artificial Sequence
  chemically synthesized
tgtcaatctatatatacaca

SEQ ID NO: 613519 - DNA, 20 bp, Artificial Sequence
  chemically synthesized
aaccaatcttcttgtgtata

SEQ ID NO: 613520 - DNA, 20 bp, Artificial Sequence
  chemically synthesized
tatatatagattgacagtat

SEQ ID NO: 613521 - DNA, 20 bp, Artificial Sequence
  chemically synthesized
taatggtaattataggactt

SEQ ID NO: 613522 - DNA, 20 bp, Artificial Sequence
  chemically synthesized
ggtctaactactaggcagag

SEQ ID NO: 613523 - DNA, 20 bp, Artificial Sequence
  chemically synthesized
tacataattgaaaggaaata

SEQ ID NO: 613524 - DNA, 20 bp, Artificial Sequence
  chemically synthesized
aattatgtaattatatagtc

SEQ ID NO: 613525 - DNA, 20 bp, Artificial Sequence
  chemically synthesized
catatgcacatgtgtacatt

SEQ ID NO: 613526 - DNA, 20 bp, Artificial Sequence
  chemically synthesized
cagctttttaaaagagtaga

SEQ ID NO: 613527 - DNA, 20 bp, Artificial Sequence
  chemically synthesized
agtctactcttttaaaaagc

SEQ ID NO: 613528 - DNA, 20 bp, Artificial Sequence
  chemically synthesized
cccacttcaggatcagaaac

SEQ ID NO: 613529 - DNA, 20 bp, Artificial Sequence
  chemically synthesized
cccaaggagactctaatagg

SEQ ID NO: 613530 - DNA, 20 bp, Artificial Sequence
  chemically synthesized
cttggggagtatttcttatt

SEQ ID NO: 613531 - DNA, 20 bp, Artificial Sequence
  chemically synthesized
tgagccaataatccaaatgc

SEQ ID NO: 613532 - DNA, 20 bp, Artificial Sequence
  chemically synthesized
tctactcagaagcatctgca

SEQ ID NO: 613533 - DNA, 20 bp, Artificial Sequence
  chemically synthesized
tatgccttgtcttgaattct

SEQ ID NO: 613534 - DNA, 20 bp, Artificial Sequence
  chemically synthesized
ggatcgggagcatttgttag

SEQ ID NO: 613535 - DNA, 20 bp, Artificial Sequence
  chemically synthesized
ggagcatttgttagaggtga

SEQ ID NO: 613536 - DNA, 20 bp, Artificial Sequence
  chemically synthesized
cagatctgtcagccctggtc

SEQ ID NO: 613537 - DNA, 20 bp, Artificial Sequence
  chemically synthesized
tcagaccagggctgacagat

SEQ ID NO: 613538 - DNA, 20 bp, Artificial Sequence
  chemically synthesized
gattaggacaaacaatggtg

SEQ ID NO: 613539 - DNA, 20 bp, Artificial Sequence
  chemically synthesized
tactaacagaatccattcac

SEQ ID NO: 613540 - DNA, 20 bp, Artificial Sequence
  chemically synthesized
caaacatttacacatggcag

SEQ ID NO: 613541 - DNA, 20 bp, Artificial Sequence
  chemically synthesized
taatctacactgccatgtgt

SEQ ID NO: 613542 - DNA, 20 bp, Artificial Sequence
  chemically synthesized
cactgccatgtgtaaatgtt

SEQ ID NO: 613543 - DNA, 20 bp, Artificial Sequence
  chemically synthesized
tttggtgatttttccctacc

SEQ ID NO: 613544 - DNA, 20 bp, Artificial Sequence
  chemically synthesized
actggccaatctcatggata

SEQ ID NO: 613545 - DNA, 20 bp, Artificial Sequence
  chemically synthesized
aaatatcaaacaaaatatcc

SEQ ID NO: 613546 - DNA, 20 bp, Artificial Sequence
  chemically synthesized
atatgcataaatgcaaatca

SEQ ID NO: 613547 - DNA, 20 bp, Artificial Sequence
  chemically synthesized
tcggcaaaattaaaaaatcc

SEQ ID NO: 613548 - DNA, 20 bp, Artificial Sequence
  chemically synthesized
tttttaattttgccgaaatt

SEQ ID NO: 613549 - DNA, 20 bp, Artificial Sequence
  chemically synthesized
atgggtagtgtgccaacatc

SEQ ID NO: 613550 - DNA, 20 bp, Artificial Sequence
  chemically synthesized
ccaacatcataagtttagag

SEQ ID NO: 613551 - DNA, 20 bp, Artificial Sequence
  chemically synthesized
tctgagtataaacacccaaa

SEQ ID NO: 613552 - DNA, 20 bp, Artificial Sequence
  chemically synthesized
gtaattcataagcatgattt

SEQ ID NO: 613553 - DNA, 20 bp, Artificial Sequence
  chemically synthesized
gatcctttcgtaattcataa

SEQ ID NO: 613554 - DNA, 20 bp, Artificial Sequence
  chemically synthesized
gggttaacaaatttcataca

SEQ ID NO: 613555 - DNA, 20 bp, Artificial Sequence
  chemically synthesized
aaatttgttaaccctgacta

SEQ ID NO: 613556 - DNA, 20 bp, Artificial Sequence
  chemically synthesized
ctaaattgctttgggtgata

SEQ ID NO: 613557 - DNA, 20 bp, Artificial Sequence
  chemically synthesized
actcagtcagggaaatgacc

SEQ ID NO: 613558 - DNA, 20 bp, Artificial Sequence
  chemically synthesized
atgagtaagccataatcttt

SEQ ID NO: 613559 - DNA, 20 bp, Artificial Sequence
  chemically synthesized
gtgaaaaatctttcaaagat

SEQ ID NO: 613560 - DNA, 20 bp, Artificial Sequence
  chemically synthesized
aatgttcgtgaaaaatcttt

SEQ ID NO: 613561 - DNA, 20 bp, Artificial Sequence
  chemically synthesized
gaaatcagtgtgtctgtgta

SEQ ID NO: 613562 - DNA, 20 bp, Artificial Sequence
  chemically synthesized
agaaacgagatacacagaca

SEQ ID NO: 613563 - DNA, 20 bp, Artificial Sequence
  chemically synthesized
tcttaatttcactagttaga

SEQ ID NO: 613564 - DNA, 20 bp, Artificial Sequence
  chemically synthesized
tctaactagtgaaattaaga

SEQ ID NO: 613565 - DNA, 20 bp, Artificial Sequence
  chemically synthesized
gatttaataccttatagctg

SEQ ID NO: 613566 - DNA, 20 bp, Artificial Sequence
  chemically synthesized
gttcagctataaggtattaa

SEQ ID NO: 613567 - DNA, 20 bp, Artificial Sequence
  chemically synthesized
aactttagtcaagggggaaa

SEQ ID NO: 613568 - DNA, 20 bp, Artificial Sequence
  chemically synthesized
agacttcttgaaaaaaatgg

SEQ ID NO: 613569 - DNA, 20 bp, Artificial Sequence
  chemically synthesized
cattttttatcttcagctat

SEQ ID NO: 613570 - DNA, 20 bp, Artificial Sequence
  chemically synthesized
cctatacagaagagacatac

SEQ ID NO: 613571 - DNA, 20 bp, Artificial Sequence
  chemically synthesized
ccacagaaggcccatttttg

SEQ ID NO: 613572 - DNA, 20 bp, Artificial Sequence
  chemically synthesized
attagcaaaggtaatttggg

SEQ ID NO: 613573 - DNA, 20 bp, Artificial Sequence
  chemically synthesized
aaaccttgatttcacctcag

SEQ ID NO: 613574 - DNA, 20 bp, Artificial Sequence
  chemically synthesized
aagctttactgaggtgaaat

SEQ ID NO: 613575 - DNA, 20 bp, Artificial Sequence
  chemically synthesized
ccccaactgtctgccagaaa

SEQ ID NO: 613576 - DNA, 20 bp, Artificial Sequence
  chemically synthesized
gtatatattgtcagatatct

SEQ ID NO: 613577 - DNA, 20 bp, Artificial Sequence
  chemically synthesized
acaatatataccgagaaaag

SEQ ID NO: 613578 - DNA, 20 bp, Artificial Sequence
  chemically synthesized
caggaggcaggctggggtag

SEQ ID NO: 613579 - DNA, 20 bp, Artificial Sequence
  chemically synthesized
tttgctaactgactttgaac

SEQ ID NO: 613580 - DNA, 20 bp, Artificial Sequence
  chemically synthesized
aactgactttgaacgacagc

SEQ ID NO: 613581 - DNA, 20 bp, Artificial Sequence
  chemically synthesized
cacatacacacacagacaca

SEQ ID NO: 613582 - DNA, 20 bp, Artificial Sequence
  chemically synthesized
gcaaagataagagacgaagg

SEQ ID NO: 613583 - DNA, 20 bp, Artificial Sequence
  chemically synthesized
gttatttatgactatagact

SEQ ID NO: 613584 - DNA, 20 bp, Artificial Sequence
  chemically synthesized
tagattgctattctaaaaag

SEQ ID NO: 613585 - DNA, 20 bp, Artificial Sequence
  chemically synthesized
ctttttagaatagcaatcta

SEQ ID NO: 613586 - DNA, 20 bp, Artificial Sequence
  chemically synthesized
cccctgactgaaataatcgt

SEQ ID NO: 613587 - DNA, 20 bp, Artificial Sequence
  chemically synthesized
ctaagacgattatttcagtc

SEQ ID NO: 613588 - DNA, 20 bp, Artificial Sequence
  chemically synthesized
tgaagatacatgattgatat

SEQ ID NO: 613589 - DNA, 20 bp, Artificial Sequence
  chemically synthesized
cagagcattcctgtgaagat

SEQ ID NO: 613590 - DNA, 20 bp, Artificial Sequence
  chemically synthesized
ttattttacaaggaacctgt

SEQ ID NO: 613591 - DNA, 20 bp, Artificial Sequence
  chemically synthesized
atcttatcaaatatcttaat

SEQ ID NO: 613592 - DNA, 20 bp, Artificial Sequence
  chemically synthesized
atttatattaatagatatta

SEQ ID NO: 613593 - DNA, 20 bp, Artificial Sequence
  chemically synthesized
gccaaatgaaaatcatacga

SEQ ID NO: 613594 - DNA, 20 bp, Artificial Sequence
  chemically synthesized
ttccttagtaaagcaacctc

SEQ ID NO: 613595 - DNA, 20 bp, Artificial Sequence
  chemically synthesized
ctttactaaggaataggtat

SEQ ID NO: 613596 - DNA, 20 bp, Artificial Sequence
  chemically synthesized
catctagtagaatgactagg

SEQ ID NO: 613597 - DNA, 20 bp, Artificial Sequence
  chemically synthesized
agatgtcataaaactatgtt

SEQ ID NO: 613598 - DNA, 20 bp, Artificial Sequence
  chemically synthesized
ttcagaccagaaactgacaa

SEQ ID NO: 613599 - DNA, 20 bp, Artificial Sequence
  chemically synthesized
gtttctggtctgaaattcta

SEQ ID NO: 613600 - DNA, 20 bp, Artificial Sequence
  chemically synthesized
ttcttaaaaataagtcacat

SEQ ID NO: 613601 - DNA, 20 bp, Artificial Sequence
  chemically synthesized
cactgaagaggttctcaata

SEQ ID NO: 613602 - DNA, 20 bp, Artificial Sequence
  chemically synthesized
ttgagtgtattttttttaat

SEQ ID NO: 613603 - DNA, 20 bp, Artificial Sequence
  chemically synthesized
gtgaaaatgtatcattggaa

SEQ ID NO: 613604 - DNA, 20 bp, Artificial Sequence
  chemically synthesized
acacttccaatgatacattt

SEQ ID NO: 613605 - DNA, 20 bp, Artificial Sequence
  chemically synthesized
taattatccttaaatatagc

SEQ ID NO: 613606 - DNA, 20 bp, Artificial Sequence
  chemically synthesized
gcacactaattatccttaaa

SEQ ID NO: 613607 - DNA, 20 bp, Artificial Sequence
  chemically synthesized
ttttttcatccgtcatcttc

SEQ ID NO: 613608 - DNA, 20 bp, Artificial Sequence
  chemically synthesized
cataggtcaagtctatttga

SEQ ID NO: 613609 - DNA, 20 bp, Artificial Sequence
  chemically synthesized
ttagtttgaatagcaagagt

SEQ ID NO: 613610 - DNA, 20 bp, Artificial Sequence
  chemically synthesized
aattaattcactgaaatgaa

SEQ ID NO: 613611 - DNA, 20 bp, Artificial Sequence
  chemically synthesized
cacccaggtagattgtggtc

SEQ ID NO: 613612 - DNA, 20 bp, Artificial Sequence
  chemically synthesized
aaactttatgtacccaccca

SEQ ID NO: 613613 - DNA, 20 bp, Artificial Sequence
  chemically synthesized
aatctacctgggtgggtaca

SEQ ID NO: 613614 - DNA, 20 bp, Artificial Sequence
  chemically synthesized
cgacatccttatcactcaaa

SEQ ID NO: 613615 - DNA, 20 bp, Artificial Sequence
  chemically synthesized
aaaatgtgtatgcacagcaa

SEQ ID NO: 613616 - DNA, 20 bp, Artificial Sequence
  chemically synthesized
taactcaaattttaggaata

SEQ ID NO: 613617 - DNA, 20 bp, Artificial Sequence
  chemically synthesized
tttaggaatatcgggtttaa

SEQ ID NO: 613618 - DNA, 20 bp, Artificial Sequence
  chemically synthesized
taggtttgaaacaaccctgt

SEQ ID NO: 613619 - DNA, 20 bp, Artificial Sequence
  chemically synthesized
tagatgaaaagctctcacag

SEQ ID NO: 613620 - DNA, 20 bp, Artificial Sequence
  chemically synthesized
atgagacacactattaaatg

SEQ ID NO: 613621 - DNA, 20 bp, Artificial Sequence
  chemically synthesized
tcataaccgttgtggcattt

SEQ ID NO: 613622 - DNA, 20 bp, Artificial Sequence
  chemically synthesized
taattttggctttaccccat

SEQ ID NO: 613623 - DNA, 20 bp, Artificial Sequence
  chemically synthesized
agacagatctgagccataat

SEQ ID NO: 613624 - DNA, 20 bp, Artificial Sequence
  chemically synthesized
ttcttgttctttcaatctta

SEQ ID NO: 613625 - DNA, 20 bp, Artificial Sequence
  chemically synthesized
taaaaggacaaggaagcaac

SEQ ID NO: 613626 - DNA, 20 bp, Artificial Sequence
  chemically synthesized
ttgtccttttataacctact

SEQ ID NO: 613627 - DNA, 20 bp, Artificial Sequence
  chemically synthesized
tcttttgtcatacttcacca

SEQ ID NO: 613628 - DNA, 20 bp, Artificial Sequence
  chemically synthesized
tcatacttcaccaaatcgtt

SEQ ID NO: 613629 - DNA, 20 bp, Artificial Sequence
  chemically synthesized
attgtagggttttaagcaga

SEQ ID NO: 613630 - DNA, 20 bp, Artificial Sequence
  chemically synthesized
attacctcatgaggggattg

SEQ ID NO: 613631 - DNA, 20 bp, Artificial Sequence
  chemically synthesized
aagctgggaattacctcatg

SEQ ID NO: 613632 - DNA, 20 bp, Artificial Sequence
  chemically synthesized
aatcccctcatgaggtaatt

SEQ ID NO: 613633 - DNA, 20 bp, Artificial Sequence
  chemically synthesized
atgtctttgactgattaaat

SEQ ID NO: 613634 - DNA, 20 bp, Artificial Sequence
  chemically synthesized
ttcatgctcaatatgtcttt

SEQ ID NO: 613635 - DNA, 20 bp, Artificial Sequence
  chemically synthesized
catatgattcagtacctagc

SEQ ID NO: 613636 - DNA, 20 bp, Artificial Sequence
  chemically synthesized
cctatgtctgatgtactagc

SEQ ID NO: 613637 - DNA, 20 bp, Artificial Sequence
  chemically synthesized
acatgttctttagtcctttc

SEQ ID NO: 613638 - DNA, 20 bp, Artificial Sequence
  chemically synthesized
tggaaagtatttgttgatcc

SEQ ID NO: 613639 - DNA, 20 bp, Artificial Sequence
  chemically synthesized
ctaatgttagacccatcacc

SEQ ID NO: 613640 - DNA, 20 bp, Artificial Sequence
  chemically synthesized
ttcttgacttgtgtgaaatt

SEQ ID NO: 613641 - DNA, 20 bp, Artificial Sequence
  chemically synthesized
tcacacaagtcaagaaaatc

SEQ ID NO: 613642 - DNA, 20 bp, Artificial Sequence
  chemically synthesized
gatgtcttttgcctggaaac

SEQ ID NO: 613643 - DNA, 20 bp, Artificial Sequence
  chemically synthesized
aaaagacatcccttaaactt

SEQ ID NO: 613644 - DNA, 20 bp, Artificial Sequence
  chemically synthesized
aatcctatgtttttaatcgt

SEQ ID NO: 613645 - DNA, 20 bp, Artificial Sequence
  chemically synthesized
aaacttccacgattaaaaac

SEQ ID NO: 613646 - DNA, 20 bp, Artificial Sequence
  chemically synthesized
ttgtaggaatagtctaaatc

SEQ ID NO: 613647 - DNA, 20 bp, Artificial Sequence
  chemically synthesized
ttgccgcaggtatcattgtt

SEQ ID NO: 613648 - DNA, 20 bp, Artificial Sequence
  chemically synthesized
aaccaaccagtccctgtgtg

SEQ ID NO: 613649 - DNA, 20 bp, Artificial Sequence
  chemically synthesized
tttgtctaagtatatatgtg

SEQ ID NO: 613650 - DNA, 20 bp, Artificial Sequence
  chemically synthesized
ctttaaaaattctagcatgt

SEQ ID NO: 613651 - DNA, 20 bp, Artificial Sequence
  chemically synthesized
acatgctagaatttttaaag

SEQ ID NO: 613652 - DNA, 20 bp, Artificial Sequence
  chemically synthesized
tatagcagcggtagcgggaa

SEQ ID NO: 613653 - DNA, 20 bp, Artificial Sequence
  chemically synthesized
gtgtggctatctgttcagtt

SEQ ID NO: 613654 - DNA, 20 bp, Artificial Sequence
  chemically synthesized
cttgcttgtgtggctatctg

SEQ ID NO: 613655 - DNA, 20 bp, Artificial Sequence
  chemically synthesized
tttttggtttttatgtaggt

SEQ ID NO: 613656 - DNA, 20 bp, Artificial Sequence
  chemically synthesized
ttgatttttggtttttatgt

SEQ ID NO: 613657 - DNA, 20 bp, Artificial Sequence
  chemically synthesized
ctgtgattgctcacttgatt

SEQ ID NO: 613658 - DNA, 20 bp, Artificial Sequence
  chemically synthesized
atcaagtactgtgattgctc

SEQ ID NO: 613659 - DNA, 20 bp, Artificial Sequence
  chemically synthesized
atcaagtgagcaatcacagt

SEQ ID NO: 613660 - DNA, 20 bp, Artificial Sequence
  chemically synthesized
tatgatattaaaatcaagta

SEQ ID NO: 613661 - DNA, 20 bp, Artificial Sequence
  chemically synthesized
atgtctcatgtagacgatct

SEQ ID NO: 613662 - DNA, 20 bp, Artificial Sequence
  chemically synthesized
gtgcttgcaggagggagggc

SEQ ID NO: 613663 - DNA, 20 bp, Artificial Sequence
  chemically synthesized
ggcagcactgggttccaatg

SEQ ID NO: 613664 - DNA, 20 bp, Artificial Sequence
  chemically synthesized
gcttgatgaattctgccctg

SEQ ID NO: 613665 - DNA, 20 bp, Artificial Sequence
  chemically synthesized
ggtctaaatgtgccctctat

SEQ ID NO: 613666 - DNA, 20 bp, Artificial Sequence
  chemically synthesized
actggtgagactagctggaa

SEQ ID NO: 613667 - DNA, 20 bp, Artificial Sequence
  chemically synthesized
gaagtttatttaggacccca

SEQ ID NO: 613668 - DNA, 20 bp, Artificial Sequence
  chemically synthesized
tttgtagcctagactccctt

SEQ ID NO: 613669 - DNA, 20 bp, Artificial Sequence
  chemically synthesized
accaagacttgcccaggaat

SEQ ID NO: 613670 - DNA, 20 bp, Artificial Sequence
  chemically synthesized
cacacaacccagtaagacac

SEQ ID NO: 613671 - DNA, 20 bp, Artificial Sequence
  chemically synthesized
taacccctaacagtgcagct

SEQ ID NO: 613672 - DNA, 20 bp, Artificial Sequence
  chemically synthesized
cagctgacagctttgagaga

SEQ ID NO: 613673 - DNA, 20 bp, Artificial Sequence
  chemically synthesized
gatgccttatcctactgtgg

SEQ ID NO: 613674 - DNA, 20 bp, Artificial Sequence
  chemically synthesized
aggtgacgaattctaccagg

SEQ ID NO: 613675 - DNA, 20 bp, Artificial Sequence
  chemically synthesized
gaatactgcctggctactac

SEQ ID NO: 613676 - DNA, 20 bp, Artificial Sequence
  chemically synthesized
tggccatggggatatactcc

SEQ ID NO: 613677 - DNA, 20 bp, Artificial Sequence
  chemically synthesized
caatagagtggactttgtct

SEQ ID NO: 613678 - DNA, 20 bp, Artificial Sequence
  chemically synthesized
tgcaatcagagaacccagga

SEQ ID NO: 613679 - DNA, 20 bp, Artificial Sequence
  chemically synthesized
atcaagcaagctcctgggtt

SEQ ID NO: 613680 - DNA, 20 bp, Artificial Sequence
  chemically synthesized
ggcctgcaatcagagaaccc

SEQ ID NO: 613681 - DNA, 20 bp, Artificial Sequence
  chemically synthesized
acggagagacccaggcctcg

SEQ ID NO: 613682 - DNA, 20 bp, Artificial Sequence
  chemically synthesized
ctgatgttcactcaaggccc

SEQ ID NO: 613683 - DNA, 20 bp, Artificial Sequence
  chemically synthesized
gtagccatggggaaaaattc

SEQ ID NO: 613684 - DNA, 20 bp, Artificial Sequence
  chemically synthesized
gaatgggacaaactttgtat

SEQ ID NO: 613685 - DNA, 20 bp, Artificial Sequence
  chemically synthesized
ctggcacccaagccacaata

SEQ ID NO: 613686 - DNA, 20 bp, Artificial Sequence
  chemically synthesized
cacaatagaagagagcacca

SEQ ID NO: 613687 - DNA, 20 bp, Artificial Sequence
  chemically synthesized
ctgtctttatccttgacttt

SEQ ID NO: 613688 - DNA, 20 bp, Artificial Sequence
  chemically synthesized
ttggaatgtatcttttctct

SEQ ID NO: 613689 - DNA, 20 bp, Artificial Sequence
  chemically synthesized
aagagaaaagatacattcca

SEQ ID NO: 613690 - DNA, 20 bp, Artificial Sequence
  chemically synthesized
aagcctgttactagttgttg

SEQ ID NO: 613691 - DNA, 20 bp, Artificial Sequence
  chemically synthesized
aagcttaacaacaactagta

SEQ ID NO: 613692 - DNA, 20 bp, Artificial Sequence
  chemically synthesized
ggcatgacatgtcttagcct

SEQ ID NO: 613693 - DNA, 20 bp, Artificial Sequence
  chemically synthesized
tctttatctttcttgttgga

SEQ ID NO: 613694 - DNA, 20 bp, Artificial Sequence
  chemically synthesized
gaccttccaagacagaagct

SEQ ID NO: 613695 - DNA, 20 bp, Artificial Sequence
  chemically synthesized
gtctggtgttgatgaaatcc

SEQ ID NO: 613696 - DNA, 20 bp, Artificial Sequence
  chemically synthesized
tactgagttttgtgccttca

SEQ ID NO: 613697 - DNA, 20 bp, Artificial Sequence
  chemically synthesized
tttgtgtttgtctgtactta

SEQ ID NO: 613698 - DNA, 20 bp, Artificial Sequence
  chemically synthesized
aattacagtattacaatagt

SEQ ID NO: 613699 - DNA, 20 bp, Artificial Sequence
  chemically synthesized
catcacaattacagtattac

SEQ ID NO: 613700 - DNA, 20 bp, Artificial Sequence
  chemically synthesized
gaataagaagagtaaaaaaa

SEQ ID NO: 613701 - DNA, 20 bp, Artificial Sequence
  chemically synthesized
attagagttatttgttaact

SEQ ID NO: 613702 - DNA, 20 bp, Artificial Sequence
  chemically synthesized
tgagatataaacaaacaaca

SEQ ID NO: 613703 - DNA, 20 bp, Artificial Sequence
  chemically synthesized
tctcttttaatctttttgtt

SEQ ID NO: 613704 - DNA, 20 bp, Artificial Sequence
  chemically synthesized
ttcgtctcttttaatctttt

SEQ ID NO: 613705 - DNA, 20 bp, Artificial Sequence
  chemically synthesized
aacaaaaagattaaaagaga

SEQ ID NO: 613706 - DNA, 20 bp, Artificial Sequence
  chemically synthesized
aagattaaaagagacgaagt

SEQ ID NO: 613707 - DNA, 20 bp, Artificial Sequence
  chemically synthesized
agacgaagtttgagttttta

SEQ ID NO: 613708 - DNA, 20 bp, Artificial Sequence
  chemically synthesized
gagtttttaattagttttct

SEQ ID NO: 613709 - DNA, 20 bp, Artificial Sequence
  chemically synthesized
aattagttttctctttgctt

SEQ ID NO: 613710 - DNA, 20 bp, Artificial Sequence
  chemically synthesized
ttgtttatgcaaccagtgtt

SEQ ID NO: 613711 - DNA, 20 bp, Artificial Sequence
  chemically synthesized
ctgtttgaaataatgggtta

SEQ ID NO: 613712 - DNA, 20 bp, Artificial Sequence
  chemically synthesized
cttcttatttgaggctacca

SEQ ID NO: 613713 - DNA, 20 bp, Artificial Sequence
  chemically synthesized
gcctcaaataagaagatata

SEQ ID NO: 613714 - DNA, 20 bp, Artificial Sequence
  chemically synthesized
tctagtggcatgcttttatt

SEQ ID NO: 613715 - DNA, 20 bp, Artificial Sequence
  chemically synthesized
aaggcgatttttctctagtg

SEQ ID NO: 613716 - DNA, 20 bp, Artificial Sequence
  chemically synthesized
cctgtcttcctttttagtga

SEQ ID NO: 613717 - DNA, 20 bp, Artificial Sequence
  chemically synthesized
attttgttttctggttgttt

SEQ ID NO: 613718 - DNA, 20 bp, Artificial Sequence
  chemically synthesized
ttcctaccattttgttttct

SEQ ID NO: 613719 - DNA, 20 bp, Artificial Sequence
  chemically synthesized
ttaagaacttattcctacca

SEQ ID NO: 613720 - DNA, 20 bp, Artificial Sequence
  chemically synthesized
gagagtttatttcatttatg

SEQ ID NO: 613721 - DNA, 20 bp, Artificial Sequence
  chemically synthesized
ctgtcactgtgttttgattg

SEQ ID NO: 613722 - DNA, 20 bp, Artificial Sequence
  chemically synthesized
tttttttttctgtcactgtg

SEQ ID NO: 613723 - DNA, 20 bp, Artificial Sequence
  chemically synthesized
ttttttttttttttctgtca

SEQ ID NO: 613724 - DNA, 20 bp, Artificial Sequence
  chemically synthesized
tgtttgttgttgttgttgtt

SEQ ID NO: 613725 - DNA, 20 bp, Artificial Sequence
  chemically synthesized
ttggtgtttgttgttgttgt

SEQ ID NO: 613726 - DNA, 20 bp, Artificial Sequence
  chemically synthesized
gtaggcaacagattgagtct

SEQ ID NO: 613727 - DNA, 20 bp, Artificial Sequence
  chemically synthesized
gaagcgtgtttcttgtaggc

SEQ ID NO: 613728 - DNA, 20 bp, Artificial Sequence
  chemically synthesized
caatctgttgcctacaagaa

SEQ ID NO: 613729 - DNA, 20 bp, Artificial Sequence
  chemically synthesized
agtctggctttgtaggtgaa

SEQ ID NO: 613730 - DNA, 20 bp, Artificial Sequence
  chemically synthesized
ttacatcccttaattttaag

SEQ ID NO: 613731 - DNA, 20 bp, Artificial Sequence
  chemically synthesized
acagtttgtcttgaaatata

SEQ ID NO: 613732 - DNA, 20 bp, Artificial Sequence
  chemically synthesized
tgttgatctttgtctcttct

SEQ ID NO: 613733 - DNA, 20 bp, Artificial Sequence
  chemically synthesized
attggtatatcttattgctg

SEQ ID NO: 613734 - DNA, 20 bp, Artificial Sequence
  chemically synthesized
gctctctttaggtctaataa

SEQ ID NO: 613735 - DNA, 20 bp, Artificial Sequence
  chemically synthesized
caaggctgaaagtggggtat

SEQ ID NO: 613736 - DNA, 20 bp, Artificial Sequence
  chemically synthesized
tctgtagtacagattaagtt

SEQ ID NO: 613737 - DNA, 20 bp, Artificial Sequence
  chemically synthesized
taggtacatttagtctgtag

SEQ ID NO: 613738 - DNA, 20 bp, Artificial Sequence
  chemically synthesized
cattcctctcatcaccacat

SEQ ID NO: 613739 - DNA, 20 bp, Artificial Sequence
  chemically synthesized
ttcaattttttgaatttaag

SEQ ID NO: 613740 - DNA, 20 bp, Artificial Sequence
  chemically synthesized
atatttcaattttttgaatt

SEQ ID NO: 613741 - DNA, 20 bp, Artificial Sequence
  chemically synthesized
taattttcaaaattcctcat

SEQ ID NO: 613742 - DNA, 20 bp, Artificial Sequence
  chemically synthesized
gagaatatagattaattccc

SEQ ID NO: 613743 - DNA, 20 bp, Artificial Sequence
  chemically synthesized
ccactgatcattcaagagaa

SEQ ID NO: 613744 - DNA, 20 bp, Artificial Sequence
  chemically synthesized
ttagtatgctgtgtttacag

SEQ ID NO: 613745 - DNA, 20 bp, Artificial Sequence
  chemically synthesized
aagttttagtatgctgtgtt

SEQ ID NO: 613746 - DNA, 20 bp, Artificial Sequence
  chemically synthesized
agcccacaagttttagtatg

SEQ ID NO: 613747 - DNA, 20 bp, Artificial Sequence
  chemically synthesized
tactgatttatctgtagccc

SEQ ID NO: 613748 - DNA, 20 bp, Artificial Sequence
  chemically synthesized
tacagataaatcagtactag

SEQ ID NO: 613749 - DNA, 20 bp, Artificial Sequence
  chemically synthesized
attgctgtaaactttgctag

SEQ ID NO: 613750 - DNA, 20 bp, Artificial Sequence
  chemically synthesized
tttttttttttttttgatac

SEQ ID NO: 613751 - DNA, 20 bp, Artificial Sequence
  chemically synthesized
tattctagttctttaagatg

SEQ ID NO: 613752 - DNA, 20 bp, Artificial Sequence
  chemically synthesized
aatagcaaaccaaactcaaa

SEQ ID NO: 613753 - DNA, 20 bp, Artificial Sequence
  chemically synthesized
tgacacaatctaattttgag

SEQ ID NO: 613754 - DNA, 20 bp, Artificial Sequence
  chemically synthesized
cttcatgacacaatctaatt

SEQ ID NO: 613755 - DNA, 20 bp, Artificial Sequence
  chemically synthesized
attacttgttgttggtctgt

SEQ ID NO: 613756 - DNA, 20 bp, Artificial Sequence
  chemically synthesized
tgaagaaaagcccgagacct

SEQ ID NO: 613757 - DNA, 20 bp, Artificial Sequence
  chemically synthesized
agcagtgaagccatcaggtc

SEQ ID NO: 613758 - DNA, 20 bp, Artificial Sequence
  chemically synthesized
agtttgagtattaggtgttt

SEQ ID NO: 613759 - DNA, 20 bp, Artificial Sequence
  chemically synthesized
ttcacaatagtttgagtatt

SEQ ID NO: 613760 - DNA, 20 bp, Artificial Sequence
  chemically synthesized
ttcctcctcctctttttcac

SEQ ID NO: 613761 - DNA, 20 bp, Artificial Sequence
  chemically synthesized
ttttgttttctggatatctg

SEQ ID NO: 613762 - DNA, 20 bp, Artificial Sequence
  chemically synthesized
tcagagataatagcctgcag

SEQ ID NO: 613763 - DNA, 20 bp, Artificial Sequence
  chemically synthesized
atttgtcagagataatagcc

SEQ ID NO: 613764 - DNA, 20 bp, Artificial Sequence
  chemically synthesized
ttggtttgctagtattttgt

SEQ ID NO: 613765 - DNA, 20 bp, Artificial Sequence
  chemically synthesized
ctttttaatgttgtgttgaa

SEQ ID NO: 613766 - DNA, 20 bp, Artificial Sequence
  chemically synthesized
tctgttcatacgatctatca

SEQ ID NO: 613767 - DNA, 20 bp, Artificial Sequence
  chemically synthesized
ttcagcatctattgaaatga

SEQ ID NO: 613768 - DNA, 20 bp, Artificial Sequence
  chemically synthesized
aggcatgttgaatttttatc

SEQ ID NO: 613769 - DNA, 20 bp, Artificial Sequence
  chemically synthesized
ctgcttctatacccagtttt

SEQ ID NO: 613770 - DNA, 20 bp, Artificial Sequence
  chemically synthesized
taaggtatgctgcttctata

SEQ ID NO: 613771 - DNA, 20 bp, Artificial Sequence
  chemically synthesized
gcttttactgtgttaaggta

SEQ ID NO: 613772 - DNA, 20 bp, Artificial Sequence
  chemically synthesized
ttagctgtgggtttctcata

SEQ ID NO: 613773 - DNA, 20 bp, Artificial Sequence
  chemically synthesized
cattcagtatgaaattagct

SEQ ID NO: 613774 - DNA, 20 bp, Artificial Sequence
  chemically synthesized
cagatcttagagaaaagtct

SEQ ID NO: 613775 - DNA, 20 bp, Artificial Sequence
  chemically synthesized
aggatgcccactttcactac

SEQ ID NO: 613776 - DNA, 20 bp, Artificial Sequence
  chemically synthesized
aaagaaagaaacaaagggca

SEQ ID NO: 613777 - DNA, 20 bp, Artificial Sequence
  chemically synthesized
tccttttcaatctggatgcc

SEQ ID NO: 613778 - DNA, 20 bp, Artificial Sequence
  chemically synthesized
aaaaggaagaatcaaatgat

SEQ ID NO: 613779 - DNA, 20 bp, Artificial Sequence
  chemically synthesized
tagttttgtaaacaaggatc

SEQ ID NO: 613780 - DNA, 20 bp, Artificial Sequence
  chemically synthesized
tgaagtcaggtaatgggatt

SEQ ID NO: 613781 - DNA, 20 bp, Artificial Sequence
  chemically synthesized
gtataatttgaagtcaggta

SEQ ID NO: 613782 - DNA, 20 bp, Artificial Sequence
  chemically synthesized
tctgttccattggtctatgt

SEQ ID NO: 613783 - DNA, 20 bp, Artificial Sequence
  chemically synthesized
tcttggcacctttgttaaaa

SEQ ID NO: 613784 - DNA, 20 bp, Artificial Sequence
  chemically synthesized
cattcttttgcatatccata

SEQ ID NO: 613785 - DNA, 20 bp, Artificial Sequence
  chemically synthesized
agatttaagtctttgttcca

SEQ ID NO: 613786 - DNA, 20 bp, Artificial Sequence
  chemically synthesized
gtagtttcatagtttgaggc

SEQ ID NO: 613787 - DNA, 20 bp, Artificial Sequence
  chemically synthesized
atgatttcttgtagtagttt

SEQ ID NO: 613788 - DNA, 20 bp, Artificial Sequence
  chemically synthesized
ttatcccaatgatttcttgt

SEQ ID NO: 613789 - DNA, 20 bp, Artificial Sequence
  chemically synthesized
gtgtcttggagattttatcc

SEQ ID NO: 613790 - DNA, 20 bp, Artificial Sequence
  chemically synthesized
atttgcctagaccagtgtct

SEQ ID NO: 613791 - DNA, 20 bp, Artificial Sequence
  chemically synthesized
tgcatgtttgctttgattgc

SEQ ID NO: 613792 - DNA, 20 bp, Artificial Sequence
  chemically synthesized
catttgtgcatgtttgcttt

SEQ ID NO: 613793 - DNA, 20 bp, Artificial Sequence
  chemically synthesized
gtctcatttgtgcatgtttg

SEQ ID NO: 613794 - DNA, 20 bp, Artificial Sequence
  chemically synthesized
ttgatgtctcatttgtgcat

SEQ ID NO: 613795 - DNA, 20 bp, Artificial Sequence
  chemically synthesized
taacttgatgtctcatttgt

SEQ ID NO: 613796 - DNA, 20 bp, Artificial Sequence
  chemically synthesized
acaaatgagacatcaagtta

SEQ ID NO: 613797 - DNA, 20 bp, Artificial Sequence
  chemically synthesized
gattgtattccttgctgtgt

SEQ ID NO: 613798 - DNA, 20 bp, Artificial Sequence
  chemically synthesized
tgtgtgttgtgtcttcactt

SEQ ID NO: 613799 - DNA, 20 bp, Artificial Sequence
  chemically synthesized
atggagttgtttgagcccct

SEQ ID NO: 613800 - DNA, 20 bp, Artificial Sequence
  chemically synthesized
atatatatttttttctatgg

SEQ ID NO: 613801 - DNA, 20 bp, Artificial Sequence
  chemically synthesized
agaaaaaaatatatataatc

SEQ ID NO: 613802 - DNA, 20 bp, Artificial Sequence
  chemically synthesized
tttttgcccttctttcaatc

SEQ ID NO: 613803 - DNA, 20 bp, Artificial Sequence
  chemically synthesized
aagaagggcaaaaatttgaa

SEQ ID NO: 613804 - DNA, 20 bp, Artificial Sequence
  chemically synthesized
gagatgatacctcattgtag

SEQ ID NO: 613805 - DNA, 20 bp, Artificial Sequence
  chemically synthesized
ggggtgagatgatacctcat

SEQ ID NO: 613806 - DNA, 20 bp, Artificial Sequence
  chemically synthesized
tatcatctcaccccagttaa

SEQ ID NO: 613807 - DNA, 20 bp, Artificial Sequence
  chemically synthesized
gtagtagaaccactgtgaag

SEQ ID NO: 613808 - DNA, 20 bp, Artificial Sequence
  chemically synthesized
gattatatggtagttctgtt

SEQ ID NO: 613809 - DNA, 20 bp, Artificial Sequence
  chemically synthesized
attgctggattatatggtag

SEQ ID NO: 613810 - DNA, 20 bp, Artificial Sequence
  chemically synthesized
atatacccggcagtaggatt

SEQ ID NO: 613811 - DNA, 20 bp, Artificial Sequence
  chemically synthesized
ttttgggtatatacccggca

SEQ ID NO: 613812 - DNA, 20 bp, Artificial Sequence
  chemically synthesized
atatacccaaaagaaaggaa

SEQ ID NO: 613813 - DNA, 20 bp, Artificial Sequence
  chemically synthesized
gtgcagatatttctttgaca

SEQ ID NO: 613814 - DNA, 20 bp, Artificial Sequence
  chemically synthesized
tcaaagaaatatctgcaccc

SEQ ID NO: 613815 - DNA, 20 bp, Artificial Sequence
  chemically synthesized
tgcaaccctattcacaatag

SEQ ID NO: 613816 - DNA, 20 bp, Artificial Sequence
  chemically synthesized
catttgttaatggatacttg

SEQ ID NO: 613817 - DNA, 20 bp, Artificial Sequence
  chemically synthesized
cattcatttgttaatggata

SEQ ID NO: 613818 - DNA, 20 bp, Artificial Sequence
  chemically synthesized
atgcaaagtttgtttttgtg

SEQ ID NO: 613819 - DNA, 20 bp, Artificial Sequence
  chemically synthesized
tatgagtgagcccatgcaaa

SEQ ID NO: 613820 - DNA, 20 bp, Artificial Sequence
  chemically synthesized
tgcatatgagtgagcccatg

SEQ ID NO: 613821 - DNA, 20 bp, Artificial Sequence
  chemically synthesized
ctctctgtctccatgagttc

SEQ ID NO: 613822 - DNA, 20 bp, Artificial Sequence
  chemically synthesized
catggagacagagagtagaa

SEQ ID NO: 613823 - DNA, 20 bp, Artificial Sequence
  chemically synthesized
gttggggacaggaggagtgg

SEQ ID NO: 613824 - DNA, 20 bp, Artificial Sequence
  chemically synthesized
aatagatcttactcattcta

SEQ ID NO: 613825 - DNA, 20 bp, Artificial Sequence
  chemically synthesized
atctatttggcaacacaaga

SEQ ID NO: 613826 - DNA, 20 bp, Artificial Sequence
  chemically synthesized
tgcctcggcctcccaaagtg

SEQ ID NO: 613827 - DNA, 20 bp, Artificial Sequence
  chemically synthesized
ttttgtatttttagtagaga

SEQ ID NO: 613828 - DNA, 20 bp, Artificial Sequence
  chemically synthesized
ctaaaaatacaaaaaattag

SEQ ID NO: 613829 - DNA, 20 bp, Artificial Sequence
  chemically synthesized
aacggcgtgaacccgggagg

SEQ ID NO: 613830 - DNA, 20 bp, Artificial Sequence
  chemically synthesized
aaaaaaaaaaatttgaagtg

SEQ ID NO: 613831 - DNA, 20 bp, Artificial Sequence
  chemically synthesized
cagatacttcacttaccctg

SEQ ID NO: 613832 - DNA, 20 bp, Artificial Sequence
  chemically synthesized
cttcacttaccctgatatga

SEQ ID NO: 613833 - DNA, 20 bp, Artificial Sequence
  chemically synthesized
gtatagtaaagttgctttgt

SEQ ID NO: 613834 - DNA, 20 bp, Artificial Sequence
  chemically synthesized
tattatgtatagtaaagttg

SEQ ID NO: 613835 - DNA, 20 bp, Artificial Sequence
  chemically synthesized
gtgtatattatgtatagtaa

SEQ ID NO: 613836 - DNA, 20 bp, Artificial Sequence
  chemically synthesized
ttcattaaaatggcactgtt

SEQ ID NO: 613837 - DNA, 20 bp, Artificial Sequence
  chemically synthesized
ttaaagtttcattaaaatgg

SEQ ID NO: 613838 - DNA, 20 bp, Artificial Sequence
  chemically synthesized
tattactagagagctttcct

SEQ ID NO: 613839 - DNA, 20 bp, Artificial Sequence
  chemically synthesized
aatttattttcttattacta

SEQ ID NO: 613840 - DNA, 20 bp, Artificial Sequence
  chemically synthesized
ttggtattttgagtgtaata

SEQ ID NO: 613841 - DNA, 20 bp, Artificial Sequence
  chemically synthesized
tatacaatgccattaaaatg

SEQ ID NO: 613842 - DNA, 20 bp, Artificial Sequence
  chemically synthesized
ttttttgatgagtttaaaag

SEQ ID NO: 613843 - DNA, 20 bp, Artificial Sequence
  chemically synthesized
gtgcataagattattttttg

SEQ ID NO: 613844 - DNA, 20 bp, Artificial Sequence
  chemically synthesized
caatggacacattgcagtgc

SEQ ID NO: 613845 - DNA, 20 bp, Artificial Sequence
  chemically synthesized
aactgttaactgacagagat

SEQ ID NO: 613846 - DNA, 20 bp, Artificial Sequence
  chemically synthesized
gacagacttcaactttctac

SEQ ID NO: 613847 - DNA, 20 bp, Artificial Sequence
  chemically synthesized
gaagtatgtgcgtgataaac

SEQ ID NO: 613848 - DNA, 20 bp, Artificial Sequence
  chemically synthesized
gctcctctttttgaataaac

SEQ ID NO: 613849 - DNA, 20 bp, Artificial Sequence
  chemically synthesized
gatcctgatggctttgggat

SEQ ID NO: 613850 - DNA, 20 bp, Artificial Sequence
  chemically synthesized
gctatatgatcctgatggct

SEQ ID NO: 613851 - DNA, 20 bp, Artificial Sequence
  chemically synthesized
cttggatgctatatgatcct

SEQ ID NO: 613852 - DNA, 20 bp, Artificial Sequence
  chemically synthesized
tagcatccaagacacaagga

SEQ ID NO: 613853 - DNA, 20 bp, Artificial Sequence
  chemically synthesized
ccaagacacaaggactacgt

SEQ ID NO: 613854 - DNA, 20 bp, Artificial Sequence
  chemically synthesized
ggtcaaaaacgcagacagaa

SEQ ID NO: 613855 - DNA, 20 bp, Artificial Sequence
  chemically synthesized
cccacaaagcaagattctgt

SEQ ID NO: 613856 - DNA, 20 bp, Artificial Sequence
  chemically synthesized
atttaagtttggcccacaaa

SEQ ID NO: 613857 - DNA, 20 bp, Artificial Sequence
  chemically synthesized
aaagaccttggtctatgtat

SEQ ID NO: 613858 - DNA, 20 bp, Artificial Sequence
  chemically synthesized
ccctctccattttggttacc

SEQ ID NO: 613859 - DNA, 20 bp, Artificial Sequence
  chemically synthesized
aaccaaaatggagagggagt

SEQ ID NO: 613860 - DNA, 20 bp, Artificial Sequence
  chemically synthesized
taaaggattataggtcaggt

SEQ ID NO: 613861 - DNA, 20 bp, Artificial Sequence
  chemically synthesized
gaactgtttctctatcacct

SEQ ID NO: 613862 - DNA, 20 bp, Artificial Sequence
  chemically synthesized
gaaaataatacgatagcagg

SEQ ID NO: 613863 - DNA, 20 bp, Artificial Sequence
  chemically synthesized
tttaatatatcattgactct

SEQ ID NO: 613864 - DNA, 20 bp, Artificial Sequence
  chemically synthesized
ggtgaatatgactaatagaa

SEQ ID NO: 613865 - DNA, 20 bp, Artificial Sequence
  chemically synthesized
attcaccatattctctaata

SEQ ID NO: 613866 - DNA, 20 bp, Artificial Sequence
  chemically synthesized
gtataaattacacagtgcct

SEQ ID NO: 613867 - DNA, 20 bp, Artificial Sequence
  chemically synthesized
aggaatttttagcataaagt

SEQ ID NO: 613868 - DNA, 20 bp, Artificial Sequence
  chemically synthesized
tactttatgctaaaaattcc

SEQ ID NO: 613869 - DNA, 20 bp, Artificial Sequence
  chemically synthesized
ttttgccttcttcttttaat

SEQ ID NO: 613870 - DNA, 20 bp, Artificial Sequence
  chemically synthesized
gccttcttcttttaatatat

SEQ ID NO: 613871 - DNA, 20 bp, Artificial Sequence
  chemically synthesized
caaaaaataaatgataaata

SEQ ID NO: 613872 - DNA, 20 bp, Artificial Sequence
  chemically synthesized
gaggcggaggttgcagtgag

SEQ ID NO: 613873 - DNA, 20 bp, Artificial Sequence
  chemically synthesized
aacctccgcctcccaggttc

SEQ ID NO: 613874 - DNA, 20 bp, Artificial Sequence
  chemically synthesized
gcatgtgtcatcacgtccag

SEQ ID NO: 613875 - DNA, 20 bp, Artificial Sequence
  chemically synthesized
ttttgtatttttagtagaga

SEQ ID NO: 613876 - DNA, 20 bp, Artificial Sequence
  chemically synthesized
acggggtttcactatgttgg

SEQ ID NO: 613877 - DNA, 20 bp, Artificial Sequence
  chemically synthesized
tgaccttgtgatccgcctcc

SEQ ID NO: 613878 - DNA, 20 bp, Artificial Sequence
  chemically synthesized
tccctcagcttcccaaagta

SEQ ID NO: 613879 - DNA, 20 bp, Artificial Sequence
  chemically synthesized
gaccgtgggaacgggggtgg

SEQ ID NO: 613880 - DNA, 20 bp, Artificial Sequence
  chemically synthesized
cccccgttcccacggtctga

SEQ ID NO: 613881 - DNA, 20 bp, Artificial Sequence
  chemically synthesized
actttatagacctttcggtg

SEQ ID NO: 613882 - DNA, 20 bp, Artificial Sequence
  chemically synthesized
ccatccaagagaaatagtat

SEQ ID NO: 613883 - DNA, 20 bp, Artificial Sequence
  chemically synthesized
gatactatagcaaaagtaac

SEQ ID NO: 613884 - DNA, 20 bp, Artificial Sequence
  chemically synthesized
tgagttcagaagttagctat

SEQ ID NO: 613885 - DNA, 20 bp, Artificial Sequence
  chemically synthesized
tgcaacacataggaacgtta

SEQ ID NO: 613886 - DNA, 20 bp, Artificial Sequence
  chemically synthesized
aatctatatttattgagtgc

SEQ ID NO: 613887 - DNA, 20 bp, Artificial Sequence
  chemically synthesized
aatcgtatgcactcaataaa

SEQ ID NO: 613888 - DNA, 20 bp, Artificial Sequence
  chemically synthesized
gtatgcactcaataaatata

SEQ ID NO: 613889 - DNA, 20 bp, Artificial Sequence
  chemically synthesized
caataaatatagattgattt

SEQ ID NO: 613890 - DNA, 20 bp, Artificial Sequence
  chemically synthesized
tgaccaaattctaggtgtaa

SEQ ID NO: 613891 - DNA, 20 bp, Artificial Sequence
  chemically synthesized
ccactgcacctggccgagtt

SEQ ID NO: 613892 - DNA, 20 bp, Artificial Sequence
  chemically synthesized
tgcctcagcgtcccaaagtg

SEQ ID NO: 613893 - DNA, 20 bp, Artificial Sequence
  chemically synthesized
tcttgtatttttagtagaga

SEQ ID NO: 613894 - DNA, 20 bp, Artificial Sequence
  chemically synthesized
aacctccaccttcctagttc

SEQ ID NO: 613895 - DNA, 20 bp, Artificial Sequence
  chemically synthesized
gtgtgtgtgtgtgtgtgaga

SEQ ID NO: 613896 - DNA, 20 bp, Artificial Sequence
  chemically synthesized
gaaagtgcagaatacatgta

SEQ ID NO: 613897 - DNA, 20 bp, Artificial Sequence
  chemically synthesized
atacatgtaaaatgttttct

SEQ ID NO: 613898 - DNA, 20 bp, Artificial Sequence
  chemically synthesized
cctctgtaccatctgcattc

SEQ ID NO: 613899 - DNA, 20 bp, Artificial Sequence
  chemically synthesized
tacagaggatgcacttagaa

SEQ ID NO: 613900 - DNA, 20 bp, Artificial Sequence
  chemically synthesized
acaagaaaagggaggaaaaa

SEQ ID NO: 613901 - DNA, 20 bp, Artificial Sequence
  chemically synthesized
ttctttaaaattcaaccttt

SEQ ID NO: 613902 - DNA, 20 bp, Artificial Sequence
  chemically synthesized
caaggaggaattcatgtttt

SEQ ID NO: 613903 - DNA, 20 bp, Artificial Sequence
  chemically synthesized
cgcctggcccaaggaggaat

SEQ ID NO: 613904 - DNA, 20 bp, Artificial Sequence
  chemically synthesized
gtcttcagttcattttatga

SEQ ID NO: 613905 - DNA, 20 bp, Artificial Sequence
  chemically synthesized
tgagtggatatctgatatta

SEQ ID NO: 613906 - DNA, 20 bp, Artificial Sequence
  chemically synthesized
gtttttaggtcctttcgtgt

SEQ ID NO: 613907 - DNA, 20 bp, Artificial Sequence
  chemically synthesized
aggatttggaaggaatactg

SEQ ID NO: 613908 - DNA, 20 bp, Artificial Sequence
  chemically synthesized
atttctttatttcatactaa

SEQ ID NO: 613909 - DNA, 20 bp, Artificial Sequence
  chemically synthesized
tgtttctttttgaacactgt

SEQ ID NO: 613910 - DNA, 20 bp, Artificial Sequence
  chemically synthesized
tatctgtgtttctttttgaa

SEQ ID NO: 613911 - DNA, 20 bp, Artificial Sequence
  chemically synthesized
ccacttgtcaacctacctat

SEQ ID NO: 613912 - DNA, 20 bp, Artificial Sequence
  chemically synthesized
ttttactttgatttgttcca

SEQ ID NO: 613913 - DNA, 20 bp, Artificial Sequence
  chemically synthesized
tcctttctcaaattttttta

SEQ ID NO: 613914 - DNA, 20 bp, Artificial Sequence
  chemically synthesized
gaaaggaaatgcatttgtga

SEQ ID NO: 613915 - DNA, 20 bp, Artificial Sequence
  chemically synthesized
tgcatttgtgaaggtgttta

SEQ ID NO: 613916 - DNA, 20 bp, Artificial Sequence
  chemically synthesized
tgtgaaggtgtttaagtggt

SEQ ID NO: 613917 - DNA, 20 bp, Artificial Sequence
  chemically synthesized
ctgaaaatccaaagggatca

SEQ ID NO: 613918 - DNA, 20 bp, Artificial Sequence
  chemically synthesized
tactgaaacgtattgatccc

SEQ ID NO: 613919 - DNA, 20 bp, Artificial Sequence
  chemically synthesized
agggataatttagcatgacc

SEQ ID NO: 613920 - DNA, 20 bp, Artificial Sequence
  chemically synthesized
ttcttagcgacagttatgtc

SEQ ID NO: 613921 - DNA, 20 bp, Artificial Sequence
  chemically synthesized
tttttggtgtttccaatgtc

SEQ ID NO: 613922 - DNA, 20 bp, Artificial Sequence
  chemically synthesized
tgtggtatttgcgatatttt

SEQ ID NO: 613923 - DNA, 20 bp, Artificial Sequence
  chemically synthesized
accacaaagaattgcaaaac

SEQ ID NO: 613924 - DNA, 20 bp, Artificial Sequence
  chemically synthesized
tcttcagtaagttttgaatc

SEQ ID NO: 613925 - DNA, 20 bp, Artificial Sequence
  chemically synthesized
ctggtcagcagcgttcttca

SEQ ID NO: 613926 - DNA, 20 bp, Artificial Sequence
  chemically synthesized
aacccattttcatgtaaata

SEQ ID NO: 613927 - DNA, 20 bp, Artificial Sequence
  chemically synthesized
tgtaaataggaagctttccg

SEQ ID NO: 613928 - DNA, 20 bp, Artificial Sequence
  chemically synthesized
acaaaaaaaaaatcaactcg

SEQ ID NO: 613929 - DNA, 20 bp, Artificial Sequence
  chemically synthesized
gctttccgagttgatttttt

SEQ ID NO: 613930 - DNA, 20 bp, Artificial Sequence
  chemically synthesized
tatattattccgcaacagaa

SEQ ID NO: 613931 - DNA, 20 bp, Artificial Sequence
  chemically synthesized
atgctggtaatataaatatg

SEQ ID NO: 613932 - DNA, 20 bp, Artificial Sequence
  chemically synthesized
acatatttatattaccagca

SEQ ID NO: 613933 - DNA, 20 bp, Artificial Sequence
  chemically synthesized
ctgctagggtgttgatcata

SEQ ID NO: 613934 - DNA, 20 bp, Artificial Sequence
  chemically synthesized
cagaatatgatcaacaccct

SEQ ID NO: 613935 - DNA, 20 bp, Artificial Sequence
  chemically synthesized
tcatagtggccattcttgag

SEQ ID NO: 613936 - DNA, 20 bp, Artificial Sequence
  chemically synthesized
gacgacttgtggcatcatag

SEQ ID NO: 613937 - DNA, 20 bp, Artificial Sequence
  chemically synthesized
tcacctaaagatagaaaaat

SEQ ID NO: 613938 - DNA, 20 bp, Artificial Sequence
  chemically synthesized
aatactagtgactgaaatac

SEQ ID NO: 613939 - DNA, 20 bp, Artificial Sequence
  chemically synthesized
aaaaaagtcacactgataaa

SEQ ID NO: 613940 - DNA, 20 bp, Artificial Sequence
  chemically synthesized
catggcatcataccattccc

SEQ ID NO: 613941 - DNA, 20 bp, Artificial Sequence
  chemically synthesized
cctatgttgtggtgatattg

SEQ ID NO: 613942 - DNA, 20 bp, Artificial Sequence
  chemically synthesized
ttctgtaagtgttagctatc

SEQ ID NO: 613943 - DNA, 20 bp, Artificial Sequence
  chemically synthesized
gatatggattatttggctta

SEQ ID NO: 613944 - DNA, 20 bp, Artificial Sequence
  chemically synthesized
gttatagacgatatggatta

SEQ ID NO: 613945 - DNA, 20 bp, Artificial Sequence
  chemically synthesized
acaaggaaagttatagacga

SEQ ID NO: 613946 - DNA, 20 bp, Artificial Sequence
  chemically synthesized
aggagggaatgtaatttatt

SEQ ID NO: 613947 - DNA, 20 bp, Artificial Sequence
  chemically synthesized
caggactttggtaatctgag

SEQ ID NO: 613948 - DNA, 20 bp, Artificial Sequence
  chemically synthesized
cagtcccttattaaactctt

SEQ ID NO: 613949 - DNA, 20 bp, Artificial Sequence
  chemically synthesized
ctgagaagagtttaataagg

SEQ ID NO: 613950 - DNA, 20 bp, Artificial Sequence
  chemically synthesized
acttctctattactagttcc

SEQ ID NO: 613951 - DNA, 20 bp, Artificial Sequence
  chemically synthesized
ctaagaatgaaaagaaggag

SEQ ID NO: 613952 - DNA, 20 bp, Artificial Sequence
  chemically synthesized
atagagagagaactgagaag

SEQ ID NO: 613953 - DNA, 20 bp, Artificial Sequence
  chemically synthesized
agaagagaagattatctgac

SEQ ID NO: 613954 - DNA, 20 bp, Artificial Sequence
  chemically synthesized
cctttgccctctggctacta

SEQ ID NO: 613955 - DNA, 20 bp, Artificial Sequence
  chemically synthesized
tgtctagggtggtgaatgtc

SEQ ID NO: 613956 - DNA, 20 bp, Artificial Sequence
  chemically synthesized
atctccttggctcaaaggaa

SEQ ID NO: 613957 - DNA, 20 bp, Artificial Sequence
  chemically synthesized
cgacggtgttccagtgatac

SEQ ID NO: 613958 - DNA, 20 bp, Artificial Sequence
  chemically synthesized
atagtgatatcaaaatactg

SEQ ID NO: 613959 - DNA, 20 bp, Artificial Sequence
  chemically synthesized
aggaataatgaataaatacc

SEQ ID NO: 613960 - DNA, 20 bp, Artificial Sequence
  chemically synthesized
tgatcttcatagccagattt

SEQ ID NO: 613961 - DNA, 20 bp, Artificial Sequence
  chemically synthesized
ttttcttgatgatcttcata

SEQ ID NO: 613962 - DNA, 20 bp, Artificial Sequence
  chemically synthesized
ttgctagctgcaaggaataa

SEQ ID NO: 613963 - DNA, 20 bp, Artificial Sequence
  chemically synthesized
caagagcaaagctacaaaat

SEQ ID NO: 613964 - DNA, 20 bp, Artificial Sequence
  chemically synthesized
gattataaaaacttgtattt

SEQ ID NO: 613965 - DNA, 20 bp, Artificial Sequence
  chemically synthesized
caaataacattttatatctg

SEQ ID NO: 613966 - DNA, 20 bp, Artificial Sequence
  chemically synthesized
tacatattgggttctagtta

SEQ ID NO: 613967 - DNA, 20 bp, Artificial Sequence
  chemically synthesized
tactctattaagtacactag

SEQ ID NO: 613968 - DNA, 20 bp, Artificial Sequence
  chemically synthesized
tatttaaagttcgaatgcac

SEQ ID NO: 613969 - DNA, 20 bp, Artificial Sequence
  chemically synthesized
ttgatttccattaacgatgg

SEQ ID NO: 613970 - DNA, 20 bp, Artificial Sequence
  chemically synthesized
catcccacttacatataaca

SEQ ID NO: 613971 - DNA, 20 bp, Artificial Sequence
  chemically synthesized
gggatgttatgaacccagaa

SEQ ID NO: 613972 - DNA, 20 bp, Artificial Sequence
  chemically synthesized
gtatgcttaacaaaaagtca

SEQ ID NO: 613973 - DNA, 20 bp, Artificial Sequence
  chemically synthesized
tctgatcaggtctatcctta

SEQ ID NO: 613974 - DNA, 20 bp, Artificial Sequence
  chemically synthesized
attgagacctagctttagaa

SEQ ID NO: 613975 - DNA, 20 bp, Artificial Sequence
  chemically synthesized
aacttctaaagctaggtctc

SEQ ID NO: 613976 - DNA, 20 bp, Artificial Sequence
  chemically synthesized
taaagataaaacaattgaga

SEQ ID NO: 613977 - DNA, 20 bp, Artificial Sequence
  chemically synthesized
aatattaataaaattatggt

SEQ ID NO: 613978 - DNA, 20 bp, Artificial Sequence
  chemically synthesized
aagttattttaaaatttgtg

SEQ ID NO: 613979 - DNA, 20 bp, Artificial Sequence
  chemically synthesized
atttgtggaatgattacaat

SEQ ID NO: 613980 - DNA, 20 bp, Artificial Sequence
  chemically synthesized
ggtggtgtaattagtataat

SEQ ID NO: 613981 - DNA, 20 bp, Artificial Sequence
  chemically synthesized
tgaacattctgaaagttaaa

SEQ ID NO: 613982 - DNA, 20 bp, Artificial Sequence
  chemically synthesized
gtctcaacaacaacaaaaaa

SEQ ID NO: 613983 - DNA, 20 bp, Artificial Sequence
  chemically synthesized
aacctccgcctcccaggttc

SEQ ID NO: 613984 - DNA, 20 bp, Artificial Sequence
  chemically synthesized
tagggacgcggaggcaggag

SEQ ID NO: 613985 - DNA, 20 bp, Artificial Sequence
  chemically synthesized
tgcctccgcgtccctagtag

SEQ ID NO: 613986 - DNA, 20 bp, Artificial Sequence
  chemically synthesized
gggattacaggcgcgagcca

SEQ ID NO: 613987 - DNA, 20 bp, Artificial Sequence
  chemically synthesized
ttttatatttttagtagaga

SEQ ID NO: 613988 - DNA, 20 bp, Artificial Sequence
  chemically synthesized
tgcctcagcctcccaaagtg

SEQ ID NO: 613989 - DNA, 20 bp, Artificial Sequence
  chemically synthesized
gccactgcaccaggcctaaa

SEQ ID NO: 613990 - DNA, 20 bp, Artificial Sequence
  chemically synthesized
aggcctaaatccagtttttc

SEQ ID NO: 613991 - DNA, 20 bp, Artificial Sequence
  chemically synthesized
ctatgtgaatcaaaagaaaa

SEQ ID NO: 613992 - DNA, 20 bp, Artificial Sequence
  chemically synthesized
ttcttttgattcacatagat

SEQ ID NO: 613993 - DNA, 20 bp, Artificial Sequence
  chemically synthesized
taattacaatctatcccaat

SEQ ID NO: 613994 - DNA, 20 bp, Artificial Sequence
  chemically synthesized
gtcagaaaagcaaccattgg

SEQ ID NO: 613995 - DNA, 20 bp, Artificial Sequence
  chemically synthesized
atcttgccaaccttgtacca

SEQ ID NO: 613996 - DNA, 20 bp, Artificial Sequence
  chemically synthesized
aaggttggcaagatgaagca

SEQ ID NO: 613997 - DNA, 20 bp, Artificial Sequence
  chemically synthesized
tatttgcatgctttgaaaca

SEQ ID NO: 613998 - DNA, 20 bp, Artificial Sequence
  chemically synthesized
gtttcaaagcatgcaaataa

SEQ ID NO: 613999 - DNA, 20 bp, Artificial Sequence
  chemically synthesized
ttgaagaatcagtgttattt

SEQ ID NO: 614000 - DNA, 20 bp, Artificial Sequence
  chemically synthesized
atgagccactgcgcctagcc

SEQ ID NO: 614001 - DNA, 20 bp, Artificial Sequence
  chemically synthesized
agggcagatcacttgaagcc

SEQ ID NO: 614002 - DNA, 20 bp, Artificial Sequence
  chemically synthesized
ggccaggctggtctcaaact

SEQ ID NO: 614003 - DNA, 20 bp, Artificial Sequence
  chemically synthesized
ttttgtatttttagtaaagg

SEQ ID NO: 614004 - DNA, 20 bp, Artificial Sequence
  chemically synthesized
gctcactgcaacctctgcct

SEQ ID NO: 614005 - DNA, 20 bp, Artificial Sequence
  chemically synthesized
gaggcagaggttgcagtgag

SEQ ID NO: 614006 - DNA, 20 bp, Artificial Sequence
  chemically synthesized
tccgtctcaaaaaaaaaaaa

SEQ ID NO: 614007 - DNA, 20 bp, Artificial Sequence
  chemically synthesized
tcaaaaaaaaaaaaaaaaga

SEQ ID NO: 614008 - DNA, 20 bp, Artificial Sequence
  chemically synthesized
ccctggaactgagtactcat

SEQ ID NO: 614009 - DNA, 20 bp, Artificial Sequence
  chemically synthesized
gcagagaagaaaagtgatat

SEQ ID NO: 614010 - DNA, 20 bp, Artificial Sequence
  chemically synthesized
ctttggatgccctttgtcca

SEQ ID NO: 614011 - DNA, 20 bp, Artificial Sequence
  chemically synthesized
aattataagaatggtaataa

SEQ ID NO: 614012 - DNA, 20 bp, Artificial Sequence
  chemically synthesized
ggacaatataggtgacaaga

SEQ ID NO: 614013 - DNA, 20 bp, Artificial Sequence
  chemically synthesized
ccacctactgggaagtcatc

SEQ ID NO: 614014 - DNA, 20 bp, Artificial Sequence
  chemically synthesized
cttttctgtgtttccaattt

SEQ ID NO: 614015 - DNA, 20 bp, Artificial Sequence
  chemically synthesized
ctatgtgacatttatctttt

SEQ ID NO: 614016 - DNA, 20 bp, Artificial Sequence
  chemically synthesized
aaggagaacgtctgtcactg

SEQ ID NO: 614017 - DNA, 20 bp, Artificial Sequence
  chemically synthesized
gatgcgagttacacacatcg

SEQ ID NO: 614018 - DNA, 20 bp, Artificial Sequence
  chemically synthesized
acttctgtgtactttttgtg

SEQ ID NO: 614019 - DNA, 20 bp, Artificial Sequence
  chemically synthesized
attcaagttacttatattgt

SEQ ID NO: 614020 - DNA, 20 bp, Artificial Sequence
  chemically synthesized
accattctttactttgcaac

SEQ ID NO: 614021 - DNA, 20 bp, Artificial Sequence
  chemically synthesized
ctttgcaactgctgtttaag

SEQ ID NO: 614022 - DNA, 20 bp, Artificial Sequence
  chemically synthesized
tgaatgtgatgatagtcaag

SEQ ID NO: 614023 - DNA, 20 bp, Artificial Sequence
  chemically synthesized
cattcaggggcaagggttag

SEQ ID NO: 614024 - DNA, 20 bp, Artificial Sequence
  chemically synthesized
tacgtcatcttttctacaaa

SEQ ID NO: 614025 - DNA, 20 bp, Artificial Sequence
  chemically synthesized
ttgttatatcatttgacatc

SEQ ID NO: 614026 - DNA, 20 bp, Artificial Sequence
  chemically synthesized
actctaatgtatttgaaaaa

SEQ ID NO: 614027 - DNA, 20 bp, Artificial Sequence
  chemically synthesized
atattttgatttatatagcc

SEQ ID NO: 614028 - DNA, 20 bp, Artificial Sequence
  chemically synthesized
caaggattatatttcttata

SEQ ID NO: 614029 - DNA, 20 bp, Artificial Sequence
  chemically synthesized
aatataatccttgaagttga

SEQ ID NO: 614030 - DNA, 20 bp, Artificial Sequence
  chemically synthesized
catttaatccttatcaactt

SEQ ID NO: 614031 - DNA, 20 bp, Artificial Sequence
  chemically synthesized
aggtagtagtaaacagaaga

SEQ ID NO: 614032 - DNA, 20 bp, Artificial Sequence
  chemically synthesized
tgccctagttaaactttttc

SEQ ID NO: 614033 - DNA, 20 bp, Artificial Sequence
  chemically synthesized
cttacttgaaagtcttccat

SEQ ID NO: 614034 - DNA, 20 bp, Artificial Sequence
  chemically synthesized
actgtaataaataaaggcct

SEQ ID NO: 614035 - DNA, 20 bp, Artificial Sequence
  chemically synthesized
cactgataaattacatagca

SEQ ID NO: 614036 - DNA, 20 bp, Artificial Sequence
  chemically synthesized
aaaagataaaaacatactgc

SEQ ID NO: 614037 - DNA, 20 bp, Artificial Sequence
  chemically synthesized
aagctgtgaaaacagtggca

SEQ ID NO: 614038 - DNA, 20 bp, Artificial Sequence
  chemically synthesized
aaacatactgccactgtttt

SEQ ID NO: 614039 - DNA, 20 bp, Artificial Sequence
  chemically synthesized
taacaccatgctataattat

SEQ ID NO: 614040 - DNA, 20 bp, Artificial Sequence
  chemically synthesized
tggtgttataatcctattaa

SEQ ID NO: 614041 - DNA, 20 bp, Artificial Sequence
  chemically synthesized
cgacaaaaaaatcactatta

SEQ ID NO: 614042 - DNA, 20 bp, Artificial Sequence
  chemically synthesized
tcaaccttgtatattctatt

SEQ ID NO: 614043 - DNA, 20 bp, Artificial Sequence
  chemically synthesized
tccttagcatgtgaagtttc

SEQ ID NO: 614044 - DNA, 20 bp, Artificial Sequence
  chemically synthesized
ttcatctgatccttagcatg

SEQ ID NO: 614045 - DNA, 20 bp, Artificial Sequence
  chemically synthesized
cgtccacttacgttccaaga

SEQ ID NO: 614046 - DNA, 20 bp, Artificial Sequence
  chemically synthesized
caccccatccgagtgtaccg

SEQ ID NO: 614047 - DNA, 20 bp, Artificial Sequence
  chemically synthesized
cgacttgattaaccacccaa

SEQ ID NO: 614048 - DNA, 20 bp, Artificial Sequence
  chemically synthesized
gacaagcagacatttgccta

SEQ ID NO: 614049 - DNA, 20 bp, Artificial Sequence
  chemically synthesized
ccaaagctgcttaggcaaat

SEQ ID NO: 614050 - DNA, 20 bp, Artificial Sequence
  chemically synthesized
taagagcttctcaaaattag

SEQ ID NO: 614051 - DNA, 20 bp, Artificial Sequence
  chemically synthesized
ctaattttgagaagctctta

SEQ ID NO: 614052 - DNA, 20 bp, Artificial Sequence
  chemically synthesized
taaaaaatgcaaaacatggt

SEQ ID NO: 614053 - DNA, 20 bp, Artificial Sequence
  chemically synthesized
tgactgacactttaacatag

SEQ ID NO: 614054 - DNA, 20 bp, Artificial Sequence
  chemically synthesized
ttaggaaaaaccaatattgg

SEQ ID NO: 614055 - DNA, 20 bp, Artificial Sequence
  chemically synthesized
aattggtaaacagtgccaat

SEQ ID NO: 614056 - DNA, 20 bp, Artificial Sequence
  chemically synthesized
cagcagttgctcctggacag

SEQ ID NO: 614057 - DNA, 20 bp, Artificial Sequence
  chemically synthesized
caatgctacattgcaaaggg

SEQ ID NO: 614058 - DNA, 20 bp, Artificial Sequence
  chemically synthesized
tgaaaagttggtatctattt

SEQ ID NO: 614059 - DNA, 20 bp, Artificial Sequence
  chemically synthesized
caaaatgagtcaaatgccaa

SEQ ID NO: 614060 - DNA, 20 bp, Artificial Sequence
  chemically synthesized
ctcccaaatgtagacctcaa

SEQ ID NO: 614061 - DNA, 20 bp, Artificial Sequence
  chemically synthesized
gttgccctagttgtcccaga

SEQ ID NO: 614062 - DNA, 20 bp, Artificial Sequence
  chemically synthesized
agttagctgggggttggcta

SEQ ID NO: 614063 - DNA, 20 bp, Artificial Sequence
  chemically synthesized
ggaagttcttcaccttactg

SEQ ID NO: 614064 - DNA, 20 bp, Artificial Sequence
  chemically synthesized
tgtatttgaaatagtatgtt

SEQ ID NO: 614065 - DNA, 20 bp, Artificial Sequence
  chemically synthesized
atgttggttgttttaaccta

SEQ ID NO: 614066 - DNA, 20 bp, Artificial Sequence
  chemically synthesized
tttaacctactgagtttcaa

SEQ ID NO: 614067 - DNA, 20 bp, Artificial Sequence
  chemically synthesized
atgtgtacatacatatgaat

SEQ ID NO: 614068 - DNA, 20 bp, Artificial Sequence
  chemically synthesized
ttttataaatatctttataa

SEQ ID NO: 614069 - DNA, 20 bp, Artificial Sequence
  chemically synthesized
aatatttttaaaagagccct

SEQ ID NO: 614070 - DNA, 20 bp, Artificial Sequence
  chemically synthesized
atttcagcagtaaaataatt

SEQ ID NO: 614071 - DNA, 20 bp, Artificial Sequence
  chemically synthesized
gaaattgaatatgggcaaaa

SEQ ID NO: 614072 - DNA, 20 bp, Artificial Sequence
  chemically synthesized
tgcttcgttaattctttttt

SEQ ID NO: 614073 - DNA, 20 bp, Artificial Sequence
  chemically synthesized
caaaaaagaattaacgaagc

SEQ ID NO: 614074 - DNA, 20 bp, Artificial Sequence
  chemically synthesized
attaacgaagcaatagtttt

SEQ ID NO: 614075 - DNA, 20 bp, Artificial Sequence
  chemically synthesized
ttctatgaaactgacaaaac

SEQ ID NO: 614076 - DNA, 20 bp, Artificial Sequence
  chemically synthesized
ggggggtgggggggggggga

SEQ ID NO: 614077 - DNA, 20 bp, Artificial Sequence
  chemically synthesized
aacctccgtctcccagtgtc

SEQ ID NO: 614078 - DNA, 20 bp, Artificial Sequence
  chemically synthesized
ttggaaggctgaggcaggag

SEQ ID NO: 614079 - DNA, 20 bp, Artificial Sequence
  chemically synthesized
tgcctcagccttccaagtag

SEQ ID NO: 614080 - DNA, 20 bp, Artificial Sequence
  chemically synthesized
aggcgcatgccaccacgccc

SEQ ID NO: 614081 - DNA, 20 bp, Artificial Sequence
  chemically synthesized
ttgtatttttttagtagaaa

SEQ ID NO: 614082 - DNA, 20 bp, Artificial Sequence
  chemically synthesized
gcctggccaatgtggtgaaa

SEQ ID NO: 614083 - DNA, 20 bp, Artificial Sequence
  chemically synthesized
ggtgggcggatcacgaggtc

SEQ ID NO: 614084 - DNA, 20 bp, Artificial Sequence
  chemically synthesized
cacctcggcctcccaaagtg

SEQ ID NO: 614085 - DNA, 20 bp, Artificial Sequence
  chemically synthesized
aaacactaagtcttacgaaa

SEQ ID NO: 614086 - DNA, 20 bp, Artificial Sequence
  chemically synthesized
aagctacctttcgtaagact

SEQ ID NO: 614087 - DNA, 20 bp, Artificial Sequence
  chemically synthesized
actttatttttctcccattt

SEQ ID NO: 614088 - DNA, 20 bp, Artificial Sequence
  chemically synthesized
actgtcactttagataaaaa

SEQ ID NO: 614089 - DNA, 20 bp, Artificial Sequence
  chemically synthesized
ttagataaaaagtgtgttta

SEQ ID NO: 614090 - DNA, 20 bp, Artificial Sequence
  chemically synthesized
cattataagctataatttcc

SEQ ID NO: 614091 - DNA, 20 bp, Artificial Sequence
  chemically synthesized
ctgaataaaccactggaaat

SEQ ID NO: 614092 - DNA, 20 bp, Artificial Sequence
  chemically synthesized
aactatttttgatttactat

SEQ ID NO: 614093 - DNA, 20 bp, Artificial Sequence
  chemically synthesized
tttagttcacagggaactat

SEQ ID NO: 614094 - DNA, 20 bp, Artificial Sequence
  chemically synthesized
tagaaacactaactaaaggt

SEQ ID NO: 614095 - DNA, 20 bp, Artificial Sequence
  chemically synthesized
ctaaaactgtcacctttagt

SEQ ID NO: 614096 - DNA, 20 bp, Artificial Sequence
  chemically synthesized
ggcaattttaaattttttct

SEQ ID NO: 614097 - DNA, 20 bp, Artificial Sequence
  chemically synthesized
attgaaatgtcaggtaccta

SEQ ID NO: 614098 - DNA, 20 bp, Artificial Sequence
  chemically synthesized
caataggaaaaattagttat

SEQ ID NO: 614099 - DNA, 20 bp, Artificial Sequence
  chemically synthesized
ttagttataactgcttaaat

SEQ ID NO: 614100 - DNA, 20 bp, Artificial Sequence
  chemically synthesized
cttaaatagaagtttttacc

SEQ ID NO: 614101 - DNA, 20 bp, Artificial Sequence
  chemically synthesized
actacaaaaggtacctaatt

SEQ ID NO: 614102 - DNA, 20 bp, Artificial Sequence
  chemically synthesized
caggattgtttacaattagc

SEQ ID NO: 614103 - DNA, 20 bp, Artificial Sequence
  chemically synthesized
aataaaaatattttgtacag

SEQ ID NO: 614104 - DNA, 20 bp, Artificial Sequence
  chemically synthesized
ttgaaataaaaatattttgt

SEQ ID NO: 614105 - DNA, 20 bp, Artificial Sequence
  chemically synthesized
caaaaggaaattgaaatgac

SEQ ID NO: 614106 - DNA, 20 bp, Artificial Sequence
  chemically synthesized
ccttggtttaaaatatcatt

SEQ ID NO: 614107 - DNA, 20 bp, Artificial Sequence
  chemically synthesized
aaaaagttggttaactattt

SEQ ID NO: 614108 - DNA, 20 bp, Artificial Sequence
  chemically synthesized
aaatagttaaccaacttttt

SEQ ID NO: 614109 - DNA, 20 bp, Artificial Sequence
  chemically synthesized
ctcggtccacattaaccttc

SEQ ID NO: 614110 - DNA, 20 bp, Artificial Sequence
  chemically synthesized
tttttgatgtaactttaagt

SEQ ID NO: 614111 - DNA, 20 bp, Artificial Sequence
  chemically synthesized
tttccatttttgatgtaact

SEQ ID NO: 614112 - DNA, 20 bp, Artificial Sequence
  chemically synthesized
ttgctggtgcaggattcact

SEQ ID NO: 614113 - DNA, 20 bp, Artificial Sequence
  chemically synthesized
tggacacctctgttgctggt

SEQ ID NO: 614114 - DNA, 20 bp, Artificial Sequence
  chemically synthesized
ccaggtgggccatggcacca

SEQ ID NO: 614115 - DNA, 20 bp, Artificial Sequence
  chemically synthesized
gggagtgggagcttcccttg

SEQ ID NO: 614116 - DNA, 20 bp, Artificial Sequence
  chemically synthesized
tacctcccttggctgggagt

SEQ ID NO: 614117 - DNA, 20 bp, Artificial Sequence
  chemically synthesized
tcccagccaagggaggtagt

SEQ ID NO: 614118 - DNA, 20 bp, Artificial Sequence
  chemically synthesized
tgcacagatctgtggaaaaa

SEQ ID NO: 614119 - DNA, 20 bp, Artificial Sequence
  chemically synthesized
tgggtctcaaaacacagctg

SEQ ID NO: 614120 - DNA, 20 bp, Artificial Sequence
  chemically synthesized
gcctgcgagaatctgcacag

SEQ ID NO: 614121 - DNA, 20 bp, Artificial Sequence
  chemically synthesized
gagacgactccttaagactg

SEQ ID NO: 614122 - DNA, 20 bp, Artificial Sequence
  chemically synthesized
cagcagccatcacggtggct

SEQ ID NO: 614123 - DNA, 20 bp, Artificial Sequence
  chemically synthesized
cagtccaccatttttcccct

SEQ ID NO: 614124 - DNA, 20 bp, Artificial Sequence
  chemically synthesized
ttcaggtttgagggagactg

SEQ ID NO: 614125 - DNA, 20 bp, Artificial Sequence
  chemically synthesized
accagctatggcaaataatg

SEQ ID NO: 614126 - DNA, 20 bp, Artificial Sequence
  chemically synthesized
atccctcctcactgggcagg

SEQ ID NO: 614127 - DNA, 20 bp, Artificial Sequence
  chemically synthesized
gaattccagtaactccagcc

SEQ ID NO: 614128 - DNA, 20 bp, Artificial Sequence
  chemically synthesized
ccaggggtttagggaaagaa

SEQ ID NO: 614129 - DNA, 20 bp, Artificial Sequence
  chemically synthesized
aatcccacttgtctgggctt

SEQ ID NO: 614130 - DNA, 20 bp, Artificial Sequence
  chemically synthesized
aatccgggaagcccagacaa

SEQ ID NO: 614131 - DNA, 20 bp, Artificial Sequence
  chemically synthesized
cctgggggaatcccacttgt

SEQ ID NO: 614132 - DNA, 20 bp, Artificial Sequence
  chemically synthesized
tctggctgccccttggtcga

SEQ ID NO: 614133 - DNA, 20 bp, Artificial Sequence
  chemically synthesized
cctcgaccaaggggcagcca

SEQ ID NO: 614134 - DNA, 20 bp, Artificial Sequence
  chemically synthesized
tccctcttctatagggctgc

SEQ ID NO: 614135 - DNA, 20 bp, Artificial Sequence
  chemically synthesized
tgctgttgttgttgctttct

SEQ ID NO: 614136 - DNA, 20 bp, Artificial Sequence
  chemically synthesized
ttgatgctgttgttgttgct

SEQ ID NO: 614137 - DNA, 20 bp, Artificial Sequence
  chemically synthesized
ttttttgttgatgctgttgt

SEQ ID NO: 614138 - DNA, 20 bp, Artificial Sequence
  chemically synthesized
acctttggatggggttttaa

SEQ ID NO: 614139 - DNA, 20 bp, Artificial Sequence
  chemically synthesized
ggaggctgctgacctttgga

SEQ ID NO: 614140 - DNA, 20 bp, Artificial Sequence
  chemically synthesized
catccaaaggtcagcagcct

SEQ ID NO: 614141 - DNA, 20 bp, Artificial Sequence
  chemically synthesized
ttctcatcttcatgagtttg

SEQ ID NO: 614142 - DNA, 20 bp, Artificial Sequence
  chemically synthesized
gttttttgattctcatcttc

SEQ ID NO: 614143 - DNA, 20 bp, Artificial Sequence
  chemically synthesized
gagttttcagtgtttttgtt

SEQ ID NO: 614144 - DNA, 20 bp, Artificial Sequence
  chemically synthesized
gctttttgagttttcagtgt

SEQ ID NO: 614145 - DNA, 20 bp, Artificial Sequence
  chemically synthesized
actctggctttttgagtttt

SEQ ID NO: 614146 - DNA, 20 bp, Artificial Sequence
  chemically synthesized
agaagaggcactctggcttt

SEQ ID NO: 614147 - DNA, 20 bp, Artificial Sequence
  chemically synthesized
acttgcaggagaagaggcac

SEQ ID NO: 614148 - DNA, 20 bp, Artificial Sequence
  chemically synthesized
cagagtgcctcttctcctgc

SEQ ID NO: 614149 - DNA, 20 bp, Artificial Sequence
  chemically synthesized
agacggctgaattgacagaa

SEQ ID NO: 614150 - DNA, 20 bp, Artificial Sequence
  chemically synthesized
attcttgttaacagctcctg

SEQ ID NO: 614151 - DNA, 20 bp, Artificial Sequence
  chemically synthesized
gcggtagcattgtgaagttc

SEQ ID NO: 614152 - DNA, 20 bp, Artificial Sequence
  chemically synthesized
tcaagctctgaaattcattc

SEQ ID NO: 614153 - DNA, 20 bp, Artificial Sequence
  chemically synthesized
ccaagcagaagaatgaattt

SEQ ID NO: 614154 - DNA, 20 bp, Artificial Sequence
  chemically synthesized
gaagaatgaatttcagagct

SEQ ID NO: 614155 - DNA, 20 bp, Artificial Sequence
  chemically synthesized
tgctgaaataacaccagcag

SEQ ID NO: 614156 - DNA, 20 bp, Artificial Sequence
  chemically synthesized
ctttcatgttaaaaaccttc

SEQ ID NO: 614157 - DNA, 20 bp, Artificial Sequence
  chemically synthesized
ccatcaatacctaatctact

SEQ ID NO: 614158 - DNA, 20 bp, Artificial Sequence
  chemically synthesized
catctagtatgatattggct

SEQ ID NO: 614159 - DNA, 20 bp, Artificial Sequence
  chemically synthesized
tagatgggcaaaaactggct

SEQ ID NO: 614160 - DNA, 20 bp, Artificial Sequence
  chemically synthesized
ttgtcataccaaaacctaca

SEQ ID NO: 614161 - DNA, 20 bp, Artificial Sequence
  chemically synthesized
cttgtcttgtgctggttttc

SEQ ID NO: 614162 - DNA, 20 bp, Artificial Sequence
  chemically synthesized
agagggcatccttgtcttgt

SEQ ID NO: 614163 - DNA, 20 bp, Artificial Sequence
  chemically synthesized
atccttgatttctttctctt

SEQ ID NO: 614164 - DNA, 20 bp, Artificial Sequence
  chemically synthesized
cttcctctcttcctatttat

SEQ ID NO: 614165 - DNA, 20 bp, Artificial Sequence
  chemically synthesized
ttttctagatacacagaaga

SEQ ID NO: 614166 - DNA, 20 bp, Artificial Sequence
  chemically synthesized
gagattttggggtgagacga

SEQ ID NO: 614167 - DNA, 20 bp, Artificial Sequence
  chemically synthesized
tgaatttgcttgccagctta

SEQ ID NO: 614168 - DNA, 20 bp, Artificial Sequence
  chemically synthesized
agactttgctgaatttgctt

SEQ ID NO: 614169 - DNA, 20 bp, Artificial Sequence
  chemically synthesized
gtatcctgagactttgctga

SEQ ID NO: 614170 - DNA, 20 bp, Artificial Sequence
  chemically synthesized
gaatgcttgtgatttttaca

SEQ ID NO: 614171 - DNA, 20 bp, Artificial Sequence
  chemically synthesized
gtctattgttgtaggaatgc

SEQ ID NO: 614172 - DNA, 20 bp, Artificial Sequence
  chemically synthesized
ctctctgtctattgttgtag

SEQ ID NO: 614173 - DNA, 20 bp, Artificial Sequence
  chemically synthesized
cattgtaaatgggagttcat

SEQ ID NO: 614174 - DNA, 20 bp, Artificial Sequence
  chemically synthesized
gtcctcttagttccttgagc

SEQ ID NO: 614175 - DNA, 20 bp, Artificial Sequence
  chemically synthesized
tgagcatggaatgttcttcc

SEQ ID NO: 614176 - DNA, 20 bp, Artificial Sequence
  chemically synthesized
cagtatggccattttcacag

SEQ ID NO: 614177 - DNA, 20 bp, Artificial Sequence
  chemically synthesized
aatggccatactgtataatt

SEQ ID NO: 614178 - DNA, 20 bp, Artificial Sequence
  chemically synthesized
acagaattagaaaaaaagaa

SEQ ID NO: 614179 - DNA, 20 bp, Artificial Sequence
  chemically synthesized
tggttctgtatgaattttaa

SEQ ID NO: 614180 - DNA, 20 bp, Artificial Sequence
  chemically synthesized
tctagctttgttatttttgc

SEQ ID NO: 614181 - DNA, 20 bp, Artificial Sequence
  chemically synthesized
taggcttctagctttgttat

SEQ ID NO: 614182 - DNA, 20 bp, Artificial Sequence
  chemically synthesized
aagtcaggtagcattaggct

SEQ ID NO: 614183 - DNA, 20 bp, Artificial Sequence
  chemically synthesized
tagtctgaagtcaggtagca

SEQ ID NO: 614184 - DNA, 20 bp, Artificial Sequence
  chemically synthesized
ctgtttttctaccagtacca

SEQ ID NO: 614185 - DNA, 20 bp, Artificial Sequence
  chemically synthesized
tctgttccattggtctatgt

SEQ ID NO: 614186 - DNA, 20 bp, Artificial Sequence
  chemically synthesized
acatctaatacccaaccaac

SEQ ID NO: 614187 - DNA, 20 bp, Artificial Sequence
  chemically synthesized
ttccccattgcttgtttttg

SEQ ID NO: 614188 - DNA, 20 bp, Artificial Sequence
  chemically synthesized
gacaaaaacaagcaatgggg

SEQ ID NO: 614189 - DNA, 20 bp, Artificial Sequence
  chemically synthesized
tagggaatcctttccccatt

SEQ ID NO: 614190 - DNA, 20 bp, Artificial Sequence
  chemically synthesized
taaatagggaatcctttccc

SEQ ID NO: 614191 - DNA, 20 bp, Artificial Sequence
  chemically synthesized
gtgtaaggaaggtgtccagt

SEQ ID NO: 614192 - DNA, 20 bp, Artificial Sequence
  chemically synthesized
tataaggtgtaaggaaggtg

SEQ ID NO: 614193 - DNA, 20 bp, Artificial Sequence
  chemically synthesized
ttatacaaaaattaactcaa

SEQ ID NO: 614194 - DNA, 20 bp, Artificial Sequence
  chemically synthesized
gtttttatagttagtgggtt

SEQ ID NO: 614195 - DNA, 20 bp, Artificial Sequence
  chemically synthesized
ttacagggtttttatagtta

SEQ ID NO: 614196 - DNA, 20 bp, Artificial Sequence
  chemically synthesized
gtattgcttagattttctta

SEQ ID NO: 614197 - DNA, 20 bp, Artificial Sequence
  chemically synthesized
atatatcctgaatggtattg

SEQ ID NO: 614198 - DNA, 20 bp, Artificial Sequence
  chemically synthesized
tgtgcatatatcctgaatgg

SEQ ID NO: 614199 - DNA, 20 bp, Artificial Sequence
  chemically synthesized
attcaggatatatgcacagg

SEQ ID NO: 614200 - DNA, 20 bp, Artificial Sequence
  chemically synthesized
gatatatgcacaggcaaaga

SEQ ID NO: 614201 - DNA, 20 bp, Artificial Sequence
  chemically synthesized
ttagttttgttgcaattgac

SEQ ID NO: 614202 - DNA, 20 bp, Artificial Sequence
  chemically synthesized
ttctatctcagttgttaatt

SEQ ID NO: 614203 - DNA, 20 bp, Artificial Sequence
  chemically synthesized
taacaactgagatagaacta

SEQ ID NO: 614204 - DNA, 20 bp, Artificial Sequence
  chemically synthesized
ttcattctgatgatgggttt

SEQ ID NO: 614205 - DNA, 20 bp, Artificial Sequence
  chemically synthesized
tttgcctgttcattctgatg

SEQ ID NO: 614206 - DNA, 20 bp, Artificial Sequence
  chemically synthesized
taaatagattgcaaaaattc

SEQ ID NO: 614207 - DNA, 20 bp, Artificial Sequence
  chemically synthesized
agaatgttttgttaatggta

SEQ ID NO: 614208 - DNA, 20 bp, Artificial Sequence
  chemically synthesized
acggcaaggatgcaggggaa

SEQ ID NO: 614209 - DNA, 20 bp, Artificial Sequence
  chemically synthesized
tcttcccctgcatccttgcc

SEQ ID NO: 614210 - DNA, 20 bp, Artificial Sequence
  chemically synthesized
ggtctatccaaggctgaggt

SEQ ID NO: 614211 - DNA, 20 bp, Artificial Sequence
  chemically synthesized
ctccaacctgcaatcttttc

SEQ ID NO: 614212 - DNA, 20 bp, Artificial Sequence
  chemically synthesized
taagagaaaaaaaacacggg

SEQ ID NO: 614213 - DNA, 20 bp, Artificial Sequence
  chemically synthesized
aagcagagaggaaaaataga

SEQ ID NO: 614214 - DNA, 20 bp, Artificial Sequence
  chemically synthesized
aatcttggtctatttttcct

SEQ ID NO: 614215 - DNA, 20 bp, Artificial Sequence
  chemically synthesized
gacaaccattcaaattattc

SEQ ID NO: 614216 - DNA, 20 bp, Artificial Sequence
  chemically synthesized
aagatcaaattctaagtaag

SEQ ID NO: 614217 - DNA, 20 bp, Artificial Sequence
  chemically synthesized
ccttacttagaatttgatct

SEQ ID NO: 614218 - DNA, 20 bp, Artificial Sequence
  chemically synthesized
acttagaatttgatcttcat

SEQ ID NO: 614219 - DNA, 20 bp, Artificial Sequence
  chemically synthesized
ttgtttacctgcaatggtaa

SEQ ID NO: 614220 - DNA, 20 bp, Artificial Sequence
  chemically synthesized
cctgcaatggtaaacaggct

SEQ ID NO: 614221 - DNA, 20 bp, Artificial Sequence
  chemically synthesized
gggaaggagacaagccttaa

SEQ ID NO: 614222 - DNA, 20 bp, Artificial Sequence
  chemically synthesized
cccatacttaagatcaagtg

SEQ ID NO: 614223 - DNA, 20 bp, Artificial Sequence
  chemically synthesized
cgcttgaggaagtacacata

SEQ ID NO: 614224 - DNA, 20 bp, Artificial Sequence
  chemically synthesized
ttccttgtatttttatagta

SEQ ID NO: 614225 - DNA, 20 bp, Artificial Sequence
  chemically synthesized
gagacatcaaggatcaaata

SEQ ID NO: 614226 - DNA, 20 bp, Artificial Sequence
  chemically synthesized
taattccctggaatctattg

SEQ ID NO: 614227 - DNA, 20 bp, Artificial Sequence
  chemically synthesized
tgcagggctctaatcttatc

SEQ ID NO: 614228 - DNA, 20 bp, Artificial Sequence
  chemically synthesized
gtcattggtgctcaatatac

SEQ ID NO: 614229 - DNA, 20 bp, Artificial Sequence
  chemically synthesized
tatctcgtaaataagagctg

SEQ ID NO: 614230 - DNA, 20 bp, Artificial Sequence
  chemically synthesized
gctgggaagattgtgtaaga

SEQ ID NO: 614231 - DNA, 20 bp, Artificial Sequence
  chemically synthesized
agtttgactcattccaaagg

SEQ ID NO: 614232 - DNA, 20 bp, Artificial Sequence
  chemically synthesized
tggaacaagaacagtattgt

SEQ ID NO: 614233 - DNA, 20 bp, Artificial Sequence
  chemically synthesized
ggtaagacacagtcgttgtt

SEQ ID NO: 614234 - DNA, 20 bp, Artificial Sequence
  chemically synthesized
attccactcccactctgaga

SEQ ID NO: 614235 - DNA, 20 bp, Artificial Sequence
  chemically synthesized
ctaagtttcagaaaccctat

SEQ ID NO: 614236 - DNA, 20 bp, Artificial Sequence
  chemically synthesized
ggaattcttctaaacctata

SEQ ID NO: 614237 - DNA, 20 bp, Artificial Sequence
  chemically synthesized
aattccagagttaagatgta

SEQ ID NO: 614238 - DNA, 20 bp, Artificial Sequence
  chemically synthesized
atgtaccttgcttgctagaa

SEQ ID NO: 614239 - DNA, 20 bp, Artificial Sequence
  chemically synthesized
ggggagggagggggtgactg

SEQ ID NO: 614240 - DNA, 20 bp, Artificial Sequence
  chemically synthesized
agaagcatactttcagtctc

SEQ ID NO: 614241 - DNA, 20 bp, Artificial Sequence
  chemically synthesized
caaagcaggcgagactgaaa

SEQ ID NO: 614242 - DNA, 20 bp, Artificial Sequence
  chemically synthesized
tatgcttctgggcactccag

SEQ ID NO: 614243 - DNA, 20 bp, Artificial Sequence
  chemically synthesized
cgagagaggacatgatatcc

SEQ ID NO: 614244 - DNA, 20 bp, Artificial Sequence
  chemically synthesized
gggatagagaccaacagact

SEQ ID NO: 614245 - DNA, 20 bp, Artificial Sequence
  chemically synthesized
gacttcaagagaggatgact

SEQ ID NO: 614246 - DNA, 20 bp, Artificial Sequence
  chemically synthesized
gatgactataggcttgtcat

SEQ ID NO: 614247 - DNA, 20 bp, Artificial Sequence
  chemically synthesized
tttaactgatgctctgacct

SEQ ID NO: 614248 - DNA, 20 bp, Artificial Sequence
  chemically synthesized
cgcaaattgatcaaagtcat

SEQ ID NO: 614249 - DNA, 20 bp, Artificial Sequence
  chemically synthesized
cgtccatgttcatggccagt

SEQ ID NO: 614250 - DNA, 20 bp, Artificial Sequence
  chemically synthesized
aagtttcaagaacagtatac

SEQ ID NO: 614251 - DNA, 20 bp, Artificial Sequence
  chemically synthesized
ttgaattttaaaaaggggac

SEQ ID NO: 614252 - DNA, 20 bp, Artificial Sequence
  chemically synthesized
tgtgacagatatcacatgag

SEQ ID NO: 614253 - DNA, 20 bp, Artificial Sequence
  chemically synthesized
tcacatgaggttagattgaa

SEQ ID NO: 614254 - DNA, 20 bp, Artificial Sequence
  chemically synthesized
gaggttagattgaataatga

SEQ ID NO: 614255 - DNA, 20 bp, Artificial Sequence
  chemically synthesized
tgatttagtttctgcatttc

SEQ ID NO: 614256 - DNA, 20 bp, Artificial Sequence
  chemically synthesized
tctcttcagaaagggcttcc

SEQ ID NO: 614257 - DNA, 20 bp, Artificial Sequence
  chemically synthesized
ttgaattgtatctcttcaga

SEQ ID NO: 614258 - DNA, 20 bp, Artificial Sequence
  chemically synthesized
ttcaaggtatgatcttaaaa

SEQ ID NO: 614259 - DNA, 20 bp, Artificial Sequence
  chemically synthesized
atttagtttaacatctctac

SEQ ID NO: 614260 - DNA, 20 bp, Artificial Sequence
  chemically synthesized
gtaaaagcatctctattaca

SEQ ID NO: 614261 - DNA, 20 bp, Artificial Sequence
  chemically synthesized
tgttaaactaaatgtaatag

SEQ ID NO: 614262 - DNA, 20 bp, Artificial Sequence
  chemically synthesized
aatgtaatagagatgctttt

SEQ ID NO: 614263 - DNA, 20 bp, Artificial Sequence
  chemically synthesized
tttgggtaggagagatatga

SEQ ID NO: 614264 - DNA, 20 bp, Artificial Sequence
  chemically synthesized
taggagagatatgatctagt

SEQ ID NO: 614265 - DNA, 20 bp, Artificial Sequence
  chemically synthesized
catgaggcactggagtcttc

SEQ ID NO: 614266 - DNA, 20 bp, Artificial Sequence
  chemically synthesized
aaataagattagccaccact

SEQ ID NO: 614267 - DNA, 20 bp, Artificial Sequence
  chemically synthesized
caccactaagattagtttaa

SEQ ID NO: 614268 - DNA, 20 bp, Artificial Sequence
  chemically synthesized
aggtggtagccaccactaag

SEQ ID NO: 614269 - DNA, 20 bp, Artificial Sequence
  chemically synthesized
tggtgaggtggtagccacca

SEQ ID NO: 614270 - DNA, 20 bp, Artificial Sequence
  chemically synthesized
gatcaacagtgagtgagaga

SEQ ID NO: 614271 - DNA, 20 bp, Artificial Sequence
  chemically synthesized
tctcactcactgttgatcat

SEQ ID NO: 614272 - DNA, 20 bp, Artificial Sequence
  chemically synthesized
attgctttatcaattgttag

SEQ ID NO: 614273 - DNA, 20 bp, Artificial Sequence
  chemically synthesized
tagtcctgattttacccagc

SEQ ID NO: 614274 - DNA, 20 bp, Artificial Sequence
  chemically synthesized
tccgattcttttagttccct

SEQ ID NO: 614275 - DNA, 20 bp, Artificial Sequence
  chemically synthesized
gcatttcatcaccgaccctt

SEQ ID NO: 614276 - DNA, 20 bp, Artificial Sequence
  chemically synthesized
tcagcttttaaaaggaggag

SEQ ID NO: 614277 - DNA, 20 bp, Artificial Sequence
  chemically synthesized
tcaaaagcacatatttaggg

SEQ ID NO: 614278 - DNA, 20 bp, Artificial Sequence
  chemically synthesized
ttaaaagctgacccctaaat

SEQ ID NO: 614279 - DNA, 20 bp, Artificial Sequence
  chemically synthesized
ataattggctaccaacatct

SEQ ID NO: 614280 - DNA, 20 bp, Artificial Sequence
  chemically synthesized
gacattgaagctacactcag

SEQ ID NO: 614281 - DNA, 20 bp, Artificial Sequence
  chemically synthesized
gtctgagaaacaggcctgag

SEQ ID NO: 614282 - DNA, 20 bp, Artificial Sequence
  chemically synthesized
tttgaggaaataattctagg

SEQ ID NO: 614283 - DNA, 20 bp, Artificial Sequence
  chemically synthesized
aattctaggctcagctttac

SEQ ID NO: 614284 - DNA, 20 bp, Artificial Sequence
  chemically synthesized
tgcattttttcctagcctta

SEQ ID NO: 614285 - DNA, 20 bp, Artificial Sequence
  chemically synthesized
gcttttacaatgttatcatt

SEQ ID NO: 614286 - DNA, 20 bp, Artificial Sequence
  chemically synthesized
gctaatttttagtaactatt

SEQ ID NO: 614287 - DNA, 20 bp, Artificial Sequence
  chemically synthesized
actaaaaattagccaaaacc

SEQ ID NO: 614288 - DNA, 20 bp, Artificial Sequence
  chemically synthesized
tattcgactttggagaagca

SEQ ID NO: 614289 - DNA, 20 bp, Artificial Sequence
  chemically synthesized
attatacataacatgtcatt

SEQ ID NO: 614290 - DNA, 20 bp, Artificial Sequence
  chemically synthesized
tatcttagcctaagctaagg

SEQ ID NO: 614291 - DNA, 20 bp, Artificial Sequence
  chemically synthesized
ttcagattgaaaatcttacc

SEQ ID NO: 614292 - DNA, 20 bp, Artificial Sequence
  chemically synthesized
ttggtcttgtccctgtggac

SEQ ID NO: 614293 - DNA, 20 bp, Artificial Sequence
  chemically synthesized
taatgaaacatcccttagat

SEQ ID NO: 614294 - DNA, 20 bp, Artificial Sequence
  chemically synthesized
ttgagaaactctgatctaag

SEQ ID NO: 614295 - DNA, 20 bp, Artificial Sequence
  chemically synthesized
ttagatcagagtttctcaac

SEQ ID NO: 614296 - DNA, 20 bp, Artificial Sequence
  chemically synthesized
tgcacttgactaacatcttc

SEQ ID NO: 614297 - DNA, 20 bp, Artificial Sequence
  chemically synthesized
tgcaatctaggagcaccagt

SEQ ID NO: 614298 - DNA, 20 bp, Artificial Sequence
  chemically synthesized
acaaaacctcaactggtgct

SEQ ID NO: 614299 - DNA, 20 bp, Artificial Sequence
  chemically synthesized
acaatgaaaaccttaacaga

SEQ ID NO: 614300 - DNA, 20 bp, Artificial Sequence
  chemically synthesized
aagtgccaaacactttctgt

SEQ ID NO: 614301 - DNA, 20 bp, Artificial Sequence
  chemically synthesized
gcactttcacaaaagaacag

SEQ ID NO: 614302 - DNA, 20 bp, Artificial Sequence
  chemically synthesized
agatttaagaaaaagacatg

SEQ ID NO: 614303 - DNA, 20 bp, Artificial Sequence
  chemically synthesized
taccctcaacaatgggtgaa

SEQ ID NO: 614304 - DNA, 20 bp, Artificial Sequence
  chemically synthesized
catttttacagagagccaaa

SEQ ID NO: 614305 - DNA, 20 bp, Artificial Sequence
  chemically synthesized
gccaaagtaagattccccaa

SEQ ID NO: 614306 - DNA, 20 bp, Artificial Sequence
  chemically synthesized
tctgatattctctattgata

SEQ ID NO: 614307 - DNA, 20 bp, Artificial Sequence
  chemically synthesized
attctctattgatacaaaga

SEQ ID NO: 614308 - DNA, 20 bp, Artificial Sequence
  chemically synthesized
cttgaactctggctaccatc

SEQ ID NO: 614309 - DNA, 20 bp, Artificial Sequence
  chemically synthesized
tcttttctttcctaaaaact

SEQ ID NO: 614310 - DNA, 20 bp, Artificial Sequence
  chemically synthesized
gccaggcgagagagaaaact

SEQ ID NO: 614311 - DNA, 20 bp, Artificial Sequence
  chemically synthesized
actgccagttttctctctcg

SEQ ID NO: 614312 - DNA, 20 bp, Artificial Sequence
  chemically synthesized
ccagttttctctctcgcctg

SEQ ID NO: 614313 - DNA, 20 bp, Artificial Sequence
  chemically synthesized
atctaattctccccttaaag

SEQ ID NO: 614314 - DNA, 20 bp, Artificial Sequence
  chemically synthesized
gacaagttgctaagacaaat

SEQ ID NO: 614315 - DNA, 20 bp, Artificial Sequence
  chemically synthesized
aatatgatgttataggtctt

SEQ ID NO: 614316 - DNA, 20 bp, Artificial Sequence
  chemically synthesized
tagtaacttttagcctcttt

SEQ ID NO: 614317 - DNA, 20 bp, Artificial Sequence
  chemically synthesized
agcatggtggtttcagggta

SEQ ID NO: 614318 - DNA, 20 bp, Artificial Sequence
  chemically synthesized
gtagatgtcttctacagcat

SEQ ID NO: 614319 - DNA, 20 bp, Artificial Sequence
  chemically synthesized
gggttcaagacagattcact

SEQ ID NO: 614320 - DNA, 20 bp, Artificial Sequence
  chemically synthesized
tgctggtctggagggttcaa

SEQ ID NO: 614321 - DNA, 20 bp, Artificial Sequence
  chemically synthesized
gaattcagccgtgttcagct

SEQ ID NO: 614322 - DNA, 20 bp, Artificial Sequence
  chemically synthesized
gaatcaggaattcagccgtg

SEQ ID NO: 614323 - DNA, 20 bp, Artificial Sequence
  chemically synthesized
taagctgaacacggctgaat

SEQ ID NO: 614324 - DNA, 20 bp, Artificial Sequence
  chemically synthesized
aacatctcttttatcttttt

SEQ ID NO: 614325 - DNA, 20 bp, Artificial Sequence
  chemically synthesized
attttaagccactgtacttg

SEQ ID NO: 614326 - DNA, 20 bp, Artificial Sequence
  chemically synthesized
taacaaaacaccccaagtac

SEQ ID NO: 614327 - DNA, 20 bp, Artificial Sequence
  chemically synthesized
gagggagcttaggatactct

SEQ ID NO: 614328 - DNA, 20 bp, Artificial Sequence
  chemically synthesized
ggcagagcctccattccaga

SEQ ID NO: 614329 - DNA, 20 bp, Artificial Sequence
  chemically synthesized
caaggtctcgatcgagaggg

SEQ ID NO: 614330 - DNA, 20 bp, Artificial Sequence
  chemically synthesized
ctcttgaactctttctggtt

SEQ ID NO: 614331 - DNA, 20 bp, Artificial Sequence
  chemically synthesized
gttccctgatttactattgc

SEQ ID NO: 614332 - DNA, 20 bp, Artificial Sequence
  chemically synthesized
tattgcctatgtttctattt

SEQ ID NO: 614333 - DNA, 20 bp, Artificial Sequence
  chemically synthesized
gctgtgagaaactctatgca

SEQ ID NO: 614334 - DNA, 20 bp, Artificial Sequence
  chemically synthesized
tatcatggaaacactttgca

SEQ ID NO: 614335 - DNA, 20 bp, Artificial Sequence
  chemically synthesized
cttttcccttctgtagggag

SEQ ID NO: 614336 - DNA, 20 bp, Artificial Sequence
  chemically synthesized
gatatgttttggctatctct

SEQ ID NO: 614337 - DNA, 20 bp, Artificial Sequence
  chemically synthesized
tgcttacaaccgggcctggc

SEQ ID NO: 614338 - DNA, 20 bp, Artificial Sequence
  chemically synthesized
atagtcattcatttattctt

SEQ ID NO: 614339 - DNA, 20 bp, Artificial Sequence
  chemically synthesized
aaaagaccattcggttttct

SEQ ID NO: 614340 - DNA, 20 bp, Artificial Sequence
  chemically synthesized
tggggtctgagaaaagacca

SEQ ID NO: 614341 - DNA, 20 bp, Artificial Sequence
  chemically synthesized
gtgactacattgaccaaagg

SEQ ID NO: 614342 - DNA, 20 bp, Artificial Sequence
  chemically synthesized
aatgtagtcacctccttaaa

SEQ ID NO: 614343 - DNA, 20 bp, Artificial Sequence
  chemically synthesized
tccttaaaaactgtttttct

SEQ ID NO: 614344 - DNA, 20 bp, Artificial Sequence
  chemically synthesized
gtcacagaagcagcaagaaa

SEQ ID NO: 614345 - DNA, 20 bp, Artificial Sequence
  chemically synthesized
gcttctgtgaccagacactt

SEQ ID NO: 614346 - DNA, 20 bp, Artificial Sequence
  chemically synthesized
acttctcctaacacttcttt

SEQ ID NO: 614347 - DNA, 20 bp, Artificial Sequence
  chemically synthesized
taaatgtgaattctccaaga

SEQ ID NO: 614348 - DNA, 20 bp, Artificial Sequence
  chemically synthesized
tttgccgtatcatctgcccc

SEQ ID NO: 614349 - DNA, 20 bp, Artificial Sequence
  chemically synthesized
cccccatggcttaaactcca

SEQ ID NO: 614350 - DNA, 20 bp, Artificial Sequence
  chemically synthesized
tggtttgggggtaatcaata

SEQ ID NO: 614351 - DNA, 20 bp, Artificial Sequence
  chemically synthesized
aagataccacaactaaagaa

SEQ ID NO: 614352 - DNA, 20 bp, Artificial Sequence
  chemically synthesized
tgctacacctatcaaacaca

SEQ ID NO: 614353 - DNA, 20 bp, Artificial Sequence
  chemically synthesized
atctgaggagggaaatcagt

SEQ ID NO: 614354 - DNA, 20 bp, Artificial Sequence
  chemically synthesized
tcagatccagacatattttc

SEQ ID NO: 614355 - DNA, 20 bp, Artificial Sequence
  chemically synthesized
aatacaaatcacttccccat

SEQ ID NO: 614356 - DNA, 20 bp, Artificial Sequence
  chemically synthesized
taagcaaaactatgatgggg

SEQ ID NO: 614357 - DNA, 20 bp, Artificial Sequence
  chemically synthesized
aaatcacttccccatcatag

SEQ ID NO: 614358 - DNA, 20 bp, Artificial Sequence
  chemically synthesized
tcagttataataaactctaa

SEQ ID NO: 614359 - DNA, 20 bp, Artificial Sequence
  chemically synthesized
tataggtgaagaaaccattt

SEQ ID NO: 614360 - DNA, 20 bp, Artificial Sequence
  chemically synthesized
attggataactgtcaagatt

SEQ ID NO: 614361 - DNA, 20 bp, Artificial Sequence
  chemically synthesized
tagactaaattggataactg

SEQ ID NO: 614362 - DNA, 20 bp, Artificial Sequence
  chemically synthesized
gtggttggagtacttacaag

SEQ ID NO: 614363 - DNA, 20 bp, Artificial Sequence
  chemically synthesized
ctccaaccacagttgccccc

SEQ ID NO: 614364 - DNA, 20 bp, Artificial Sequence
  chemically synthesized
cccctagtgctttcttattc

SEQ ID NO: 614365 - DNA, 20 bp, Artificial Sequence
  chemically synthesized
accaacacctttcttcaagg

SEQ ID NO: 614366 - DNA, 20 bp, Artificial Sequence
  chemically synthesized
aaggctctgtttgaatgaat

SEQ ID NO: 614367 - DNA, 20 bp, Artificial Sequence
  chemically synthesized
ttatctgacttgaagttgtt

SEQ ID NO: 614368 - DNA, 20 bp, Artificial Sequence
  chemically synthesized
tagacaatgctagttttagt

SEQ ID NO: 614369 - DNA, 20 bp, Artificial Sequence
  chemically synthesized
cactatgtgcaatagacaat

SEQ ID NO: 614370 - DNA, 20 bp, Artificial Sequence
  chemically synthesized
tattgcacatagtgaatgtt

SEQ ID NO: 614371 - DNA, 20 bp, Artificial Sequence
  chemically synthesized
tcttaaatttggagctgttg

SEQ ID NO: 614372 - DNA, 20 bp, Artificial Sequence
  chemically synthesized
atttggagctgttgaacagt

SEQ ID NO: 614373 - DNA, 20 bp, Artificial Sequence
  chemically synthesized
tttaaatgtgccccatttgg

SEQ ID NO: 614374 - DNA, 20 bp, Artificial Sequence
  chemically synthesized
aacattaaagtaatagtgta

SEQ ID NO: 614375 - DNA, 20 bp, Artificial Sequence
  chemically synthesized
aactacttacactattactt

SEQ ID NO: 614376 - DNA, 20 bp, Artificial Sequence
  chemically synthesized
ttaaatgtacctagaggcta

SEQ ID NO: 614377 - DNA, 20 bp, Artificial Sequence
  chemically synthesized
acagaatataatttttatct

SEQ ID NO: 614378 - DNA, 20 bp, Artificial Sequence
  chemically synthesized
gataaaaattatattctgtc

SEQ ID NO: 614379 - DNA, 20 bp, Artificial Sequence
  chemically synthesized
ttgattttaattggcaatgg

SEQ ID NO: 614380 - DNA, 20 bp, Artificial Sequence
  chemically synthesized
gaggcacttctgtgtctatt

SEQ ID NO: 614381 - DNA, 20 bp, Artificial Sequence
  chemically synthesized
taatagacacagaagtgcct

SEQ ID NO: 614382 - DNA, 20 bp, Artificial Sequence
  chemically synthesized
ccctttgtgtctatcttagt

SEQ ID NO: 614383 - DNA, 20 bp, Artificial Sequence
  chemically synthesized
taacagtgttatttcataat

SEQ ID NO: 614384 - DNA, 20 bp, Artificial Sequence
  chemically synthesized
tgctagagggaaaagggaag

SEQ ID NO: 614385 - DNA, 20 bp, Artificial Sequence
  chemically synthesized
ctgatgcagaatcagtctta

SEQ ID NO: 614386 - DNA, 20 bp, Artificial Sequence
  chemically synthesized
tagctgcagaaacctcttaa

SEQ ID NO: 614387 - DNA, 20 bp, Artificial Sequence
  chemically synthesized
tgagttttgtaatgatactt

SEQ ID NO: 614388 - DNA, 20 bp, Artificial Sequence
  chemically synthesized
ggtgtcagaagtgtagtcaa

SEQ ID NO: 614389 - DNA, 20 bp, Artificial Sequence
  chemically synthesized
accctggttggggaaatgta

SEQ ID NO: 614390 - DNA, 20 bp, Artificial Sequence
  chemically synthesized
tttacatttttccggaacaa

SEQ ID NO: 614391 - DNA, 20 bp, Artificial Sequence
  chemically synthesized
cttttttcaaatgttagcat

SEQ ID NO: 614392 - DNA, 20 bp, Artificial Sequence
  chemically synthesized
caggaatgctaacatttgaa

SEQ ID NO: 614393 - DNA, 20 bp, Artificial Sequence
  chemically synthesized
cagaattatagcattattaa

SEQ ID NO: 614394 - DNA, 20 bp, Artificial Sequence
  chemically synthesized
taatgctataattctgaact

SEQ ID NO: 614395 - DNA, 20 bp, Artificial Sequence
  chemically synthesized
tctagctatagtacaattag

SEQ ID NO: 614396 - DNA, 20 bp, Artificial Sequence
  chemically synthesized
tgtttcaaaattattcaggt

SEQ ID NO: 614397 - DNA, 20 bp, Artificial Sequence
  chemically synthesized
cctctaaagggctaactttc

SEQ ID NO: 614398 - DNA, 20 bp, Artificial Sequence
  chemically synthesized
tagaggttatagccaaaaaa

SEQ ID NO: 614399 - DNA, 20 bp, Artificial Sequence
  chemically synthesized
tcttagtggatctggataaa

SEQ ID NO: 614400 - DNA, 20 bp, Artificial Sequence
  chemically synthesized
tcgtgttttatccagatcca

SEQ ID NO: 614401 - DNA, 20 bp, Artificial Sequence
  chemically synthesized
cacttctgcgtgcccacctc

SEQ ID NO: 614402 - DNA, 20 bp, Artificial Sequence
  chemically synthesized
acctccttggcttttgtggt

SEQ ID NO: 614403 - DNA, 20 bp, Artificial Sequence
  chemically synthesized
atctaaagagatgtagatac

SEQ ID NO: 614404 - DNA, 20 bp, Artificial Sequence
  chemically synthesized
gactgtcttcaggctagtaa

SEQ ID NO: 614405 - DNA, 20 bp, Artificial Sequence
  chemically synthesized
atctctgtttttgttggcaa

SEQ ID NO: 614406 - DNA, 20 bp, Artificial Sequence
  chemically synthesized
acaccaaggcacttccggat

SEQ ID NO: 614407 - DNA, 20 bp, Artificial Sequence
  chemically synthesized
acagagatccggaagtgcct

SEQ ID NO: 614408 - DNA, 20 bp, Artificial Sequence
  chemically synthesized
gcaacttgatacagaaggag

SEQ ID NO: 614409 - DNA, 20 bp, Artificial Sequence
  chemically synthesized
caagttgcaacaagctgaag

SEQ ID NO: 614410 - DNA, 20 bp, Artificial Sequence
  chemically synthesized
aacctgggcctaaactatgc

SEQ ID NO: 614411 - DNA, 20 bp, Artificial Sequence
  chemically synthesized
agctgaagcatagtttaggc

SEQ ID NO: 614412 - DNA, 20 bp, Artificial Sequence
  chemically synthesized
caggaaaacctgggcctaaa

SEQ ID NO: 614413 - DNA, 20 bp, Artificial Sequence
  chemically synthesized
gactgaggctggcactttgc

SEQ ID NO: 614414 - DNA, 20 bp, Artificial Sequence
  chemically synthesized
tttgcctgcgattgctcctt

SEQ ID NO: 614415 - DNA, 20 bp, Artificial Sequence
  chemically synthesized
gagaggagaatttgcatgaa

SEQ ID NO: 614416 - DNA, 20 bp, Artificial Sequence
  chemically synthesized
atgcaaattctcctctccac

SEQ ID NO: 614417 - DNA, 20 bp, Artificial Sequence
  chemically synthesized
aggaatgcttatgtttcagg

SEQ ID NO: 614418 - DNA, 20 bp, Artificial Sequence
  chemically synthesized
tactgtaattagaggaatgc

SEQ ID NO: 614419 - DNA, 20 bp, Artificial Sequence
  chemically synthesized
ctttattactgtaattagag

SEQ ID NO: 614420 - DNA, 20 bp, Artificial Sequence
  chemically synthesized
ctaattacagtaataaaggc

SEQ ID NO: 614421 - DNA, 20 bp, Artificial Sequence
  chemically synthesized
ctcctcggcctcccaaagtg

SEQ ID NO: 614422 - DNA, 20 bp, Artificial Sequence
  chemically synthesized
gtctttttattagagagaga

SEQ ID NO: 614423 - DNA, 20 bp, Artificial Sequence
  chemically synthesized
aatggcatgaacctgggagg

SEQ ID NO: 614424 - DNA, 20 bp, Artificial Sequence
  chemically synthesized
gaggcggagcttgcagtgag

SEQ ID NO: 614425 - DNA, 20 bp, Artificial Sequence
  chemically synthesized
ataaaaataatatggtgtta

SEQ ID NO: 614426 - DNA, 20 bp, Artificial Sequence
  chemically synthesized
tctgtcgaagttaaagatta

SEQ ID NO: 614427 - DNA, 20 bp, Artificial Sequence
  chemically synthesized
ctctaacattctgtcgaagt

SEQ ID NO: 614428 - DNA, 20 bp, Artificial Sequence
  chemically synthesized
atcaaaacctccatagagct

SEQ ID NO: 614429 - DNA, 20 bp, Artificial Sequence
  chemically synthesized
gttcaaacctgtagctctat

SEQ ID NO: 614430 - DNA, 20 bp, Artificial Sequence
  chemically synthesized
aacctgtagctctatggagg

SEQ ID NO: 614431 - DNA, 20 bp, Artificial Sequence
  chemically synthesized
tcttagtaacatattgtgtt

SEQ ID NO: 614432 - DNA, 20 bp, Artificial Sequence
  chemically synthesized
agatagcatttcagagcaca

SEQ ID NO: 614433 - DNA, 20 bp, Artificial Sequence
  chemically synthesized
taatacagatactgtagtat

SEQ ID NO: 614434 - DNA, 20 bp, Artificial Sequence
  chemically synthesized
agtataattcacaacttttt

SEQ ID NO: 614435 - DNA, 20 bp, Artificial Sequence
  chemically synthesized
aagttgtgaattatactgcc

SEQ ID NO: 614436 - DNA, 20 bp, Artificial Sequence
  chemically synthesized
tgtgaattatactgccaatg

SEQ ID NO: 614437 - DNA, 20 bp, Artificial Sequence
  chemically synthesized
ggtttgattagatagaatct

SEQ ID NO: 614438 - DNA, 20 bp, Artificial Sequence
  chemically synthesized
ttgatattatttaaaaatca

SEQ ID NO: 614439 - DNA, 20 bp, Artificial Sequence
  chemically synthesized
gccctacctcaccactcttt

SEQ ID NO: 614440 - DNA, 20 bp, Artificial Sequence
  chemically synthesized
cattgcacctggccccaata

SEQ ID NO: 614441 - DNA, 20 bp, Artificial Sequence
  chemically synthesized
tgcctcagcctcccaaagtg

SEQ ID NO: 614442 - DNA, 20 bp, Artificial Sequence
  chemically synthesized
ttttgtgtttttaatagaga

SEQ ID NO: 614443 - DNA, 20 bp, Artificial Sequence
  chemically synthesized
ccactgtgcccggctaattt

SEQ ID NO: 614444 - DNA, 20 bp, Artificial Sequence
  chemically synthesized
tgcctcagcctccccagtag

SEQ ID NO: 614445 - DNA, 20 bp, Artificial Sequence
  chemically synthesized
tggggaggctgaggcaggag

SEQ ID NO: 614446 - DNA, 20 bp, Artificial Sequence
  chemically synthesized
ttttttgtttgttttttgtt

SEQ ID NO: 614447 - DNA, 20 bp, Artificial Sequence
  chemically synthesized
ttgttttttttttgtttgtt

SEQ ID NO: 614448 - DNA, 20 bp, Artificial Sequence
  chemically synthesized
atattagttgtttttttttt

SEQ ID NO: 614449 - DNA, 20 bp, Artificial Sequence
  chemically synthesized
acaaatattagttgtttttt

SEQ ID NO: 614450 - DNA, 20 bp, Artificial Sequence
  chemically synthesized
tatattaatatacaaatatt

SEQ ID NO: 614451 - DNA, 20 bp, Artificial Sequence
  chemically synthesized
tattatgtcatgagggattc

SEQ ID NO: 614452 - DNA, 20 bp, Artificial Sequence
  chemically synthesized
acacatggatattatgtcat

SEQ ID NO: 614453 - DNA, 20 bp, Artificial Sequence
  chemically synthesized
ggtaacagatgcaggaataa

SEQ ID NO: 614454 - DNA, 20 bp, Artificial Sequence
  chemically synthesized
caaaaggaagatagtagact

SEQ ID NO: 614455 - DNA, 20 bp, Artificial Sequence
  chemically synthesized
ctccaatgctgtttatcacc

SEQ ID NO: 614456 - DNA, 20 bp, Artificial Sequence
  chemically synthesized
gtgactctttcttcctccaa

SEQ ID NO: 614457 - DNA, 20 bp, Artificial Sequence
  chemically synthesized
atatggcacatgactctcat

SEQ ID NO: 614458 - DNA, 20 bp, Artificial Sequence
  chemically synthesized
atgactctcatcacagcttg

SEQ ID NO: 614459 - DNA, 20 bp, Artificial Sequence
  chemically synthesized
acagcttgtgttgcttattc

SEQ ID NO: 614460 - DNA, 20 bp, Artificial Sequence
  chemically synthesized
tttaaaaatatgtgacacat

SEQ ID NO: 614461 - DNA, 20 bp, Artificial Sequence
  chemically synthesized
tttaaaaatatggagaagtt

SEQ ID NO: 614462 - DNA, 20 bp, Artificial Sequence
  chemically synthesized
aatatggagaagttcagcgt

SEQ ID NO: 614463 - DNA, 20 bp, Artificial Sequence
  chemically synthesized
ggagaagttcagcgtttttg

SEQ ID NO: 614464 - DNA, 20 bp, Artificial Sequence
  chemically synthesized
cacccagcctgttgaactgg

SEQ ID NO: 614465 - DNA, 20 bp, Artificial Sequence
  chemically synthesized
atggaagtagagattgaagg

SEQ ID NO: 614466 - DNA, 20 bp, Artificial Sequence
  chemically synthesized
tttgttagagggaatggaag

SEQ ID NO: 614467 - DNA, 20 bp, Artificial Sequence
  chemically synthesized
attaaatgacaacatgccat

SEQ ID NO: 614468 - DNA, 20 bp, Artificial Sequence
  chemically synthesized
atgttgtcatttaattctga

SEQ ID NO: 614469 - DNA, 20 bp, Artificial Sequence
  chemically synthesized
tgtacttgcatgtattccaa

SEQ ID NO: 614470 - DNA, 20 bp, Artificial Sequence
  chemically synthesized
cacacctgtactctccccat

SEQ ID NO: 614471 - DNA, 20 bp, Artificial Sequence
  chemically synthesized
aaaaaccaggaagttttttt

SEQ ID NO: 614472 - DNA, 20 bp, Artificial Sequence
  chemically synthesized
caaaacataaaaaaaaactt

SEQ ID NO: 614473 - DNA, 20 bp, Artificial Sequence
  chemically synthesized
gaatgtgttcaaaaaaacca

SEQ ID NO: 614474 - DNA, 20 bp, Artificial Sequence
  chemically synthesized
actggggatacaatgtggat

SEQ ID NO: 614475 - DNA, 20 bp, Artificial Sequence
  chemically synthesized
tagtttgacatgaccgtaat

SEQ ID NO: 614476 - DNA, 20 bp, Artificial Sequence
  chemically synthesized
attgagttcaggaaccagta

SEQ ID NO: 614477 - DNA, 20 bp, Artificial Sequence
  chemically synthesized
cttactggttcctgaactca

SEQ ID NO: 614478 - DNA, 20 bp, Artificial Sequence
  chemically synthesized
gttggagctttcagcctatt

SEQ ID NO: 614479 - DNA, 20 bp, Artificial Sequence
  chemically synthesized
ttttttttttttggccctgt

SEQ ID NO: 614480 - DNA, 20 bp, Artificial Sequence
  chemically synthesized
ccaaaaaaaaaaaagccttt

SEQ ID NO: 614481 - DNA, 20 bp, Artificial Sequence
  chemically synthesized
gctaagaagactaagctgaa

SEQ ID NO: 614482 - DNA, 20 bp, Artificial Sequence
  chemically synthesized
gcttagtcttcttagcaact

SEQ ID NO: 614483 - DNA, 20 bp, Artificial Sequence
  chemically synthesized
actgattgtctgcctataaa

SEQ ID NO: 614484 - DNA, 20 bp, Artificial Sequence
  chemically synthesized
gcctataaaagatgtttaat

SEQ ID NO: 614485 - DNA, 20 bp, Artificial Sequence
  chemically synthesized
tcaagtccatctcttccaaa

SEQ ID NO: 614486 - DNA, 20 bp, Artificial Sequence
  chemically synthesized
ttgttggcatgaaaatccct

SEQ ID NO: 614487 - DNA, 20 bp, Artificial Sequence
  chemically synthesized
aactatagactagaaactta

SEQ ID NO: 614488 - DNA, 20 bp, Artificial Sequence
  chemically synthesized
cagaaggaagaagagacgaa

SEQ ID NO: 614489 - DNA, 20 bp, Artificial Sequence
  chemically synthesized
gacatactatatagtcttgt

SEQ ID NO: 614490 - DNA, 20 bp, Artificial Sequence
  chemically synthesized
ctatatagtcttgtaattgc

SEQ ID NO: 614491 - DNA, 20 bp, Artificial Sequence
  chemically synthesized
atagtcttgtaattgctttt

SEQ ID NO: 614492 - DNA, 20 bp, Artificial Sequence
  chemically synthesized
ttagtctttttaactcagtt

SEQ ID NO: 614493 - DNA, 20 bp, Artificial Sequence
  chemically synthesized
agaaatcttagtctttttaa

SEQ ID NO: 614494 - DNA, 20 bp, Artificial Sequence
  chemically synthesized
tcaaaactgagttaaaaaga

SEQ ID NO: 614495 - DNA, 20 bp, Artificial Sequence
  chemically synthesized
cacctcggccgtctaaagtg

SEQ ID NO: 614496 - DNA, 20 bp, Artificial Sequence
  chemically synthesized
ttttgtatttgtagtagaga

SEQ ID NO: 614497 - DNA, 20 bp, Artificial Sequence
  chemically synthesized
tgcctcagcctcctgagtag

SEQ ID NO: 614498 - DNA, 20 bp, Artificial Sequence
  chemically synthesized
tcaggaggctgaggcaggag

SEQ ID NO: 614499 - DNA, 20 bp, Artificial Sequence
  chemically synthesized
aacctccgccttctgggttc

SEQ ID NO: 614500 - DNA, 20 bp, Artificial Sequence
  chemically synthesized
tctttttcttttttttgaga

SEQ ID NO: 614501 - DNA, 20 bp, Artificial Sequence
  chemically synthesized
aaaaaagaaaaagaaaaaaa

SEQ ID NO: 614502 - DNA, 20 bp, Artificial Sequence
  chemically synthesized
attacaggtttgaaagaaat

SEQ ID NO: 614503 - DNA, 20 bp, Artificial Sequence
  chemically synthesized
ctttcaaacctgtaatctga

SEQ ID NO: 614504 - DNA, 20 bp, Artificial Sequence
  chemically synthesized
catacaatcatcatcagatt

SEQ ID NO: 614505 - DNA, 20 bp, Artificial Sequence
  chemically synthesized
aagaattgcatacaatcatc

SEQ ID NO: 614506 - DNA, 20 bp, Artificial Sequence
  chemically synthesized
ctttttaaaaagctaaaaat

SEQ ID NO: 614507 - DNA, 20 bp, Artificial Sequence
  chemically synthesized
aaataactcaatctaagatt

SEQ ID NO: 614508 - DNA, 20 bp, Artificial Sequence
  chemically synthesized
gtattcataaataactcaat

SEQ ID NO: 614509 - DNA, 20 bp, Artificial Sequence
  chemically synthesized
cttcgtggtttctgcttcat

SEQ ID NO: 614510 - DNA, 20 bp, Artificial Sequence
  chemically synthesized
ttgccagctgccttcgtggt

SEQ ID NO: 614511 - DNA, 20 bp, Artificial Sequence
  chemically synthesized
tattttttgccagctgcctt

SEQ ID NO: 614512 - DNA, 20 bp, Artificial Sequence
  chemically synthesized
ttgtttctattgtttttaga

SEQ ID NO: 614513 - DNA, 20 bp, Artificial Sequence
  chemically synthesized
gctaaaattccttttgtttc

SEQ ID NO: 614514 - DNA, 20 bp, Artificial Sequence
  chemically synthesized
agcaagttagctaaaattcc

SEQ ID NO: 614515 - DNA, 20 bp, Artificial Sequence
  chemically synthesized
aacaaaaggaattttagcta

SEQ ID NO: 614516 - DNA, 20 bp, Artificial Sequence
  chemically synthesized
ctttaagaactatttggaat

SEQ ID NO: 614517 - DNA, 20 bp, Artificial Sequence
  chemically synthesized
tagttcttaaagtattctga

SEQ ID NO: 614518 - DNA, 20 bp, Artificial Sequence
  chemically synthesized
gtttctttctgtgaagacaa

SEQ ID NO: 614519 - DNA, 20 bp, Artificial Sequence
  chemically synthesized
ttaggacagtattatctgta

SEQ ID NO: 614520 - DNA, 20 bp, Artificial Sequence
  chemically synthesized
agaagatattttttactttt

SEQ ID NO: 614521 - DNA, 20 bp, Artificial Sequence
  chemically synthesized
tttaacttatttttgagagt

SEQ ID NO: 614522 - DNA, 20 bp, Artificial Sequence
  chemically synthesized
agctccttcacattggcaaa

SEQ ID NO: 614523 - DNA, 20 bp, Artificial Sequence
  chemically synthesized
tgaaggagctgtaagaaaaa

SEQ ID NO: 614524 - DNA, 20 bp, Artificial Sequence
  chemically synthesized
tatgctttaatggaaatata

SEQ ID NO: 614525 - DNA, 20 bp, Artificial Sequence
  chemically synthesized
gatgtttttgttgccttaag

SEQ ID NO: 614526 - DNA, 20 bp, Artificial Sequence
  chemically synthesized
ttaagtatttgactgaattt

SEQ ID NO: 614527 - DNA, 20 bp, Artificial Sequence
  chemically synthesized
atattagcactcatgctggt

SEQ ID NO: 614528 - DNA, 20 bp, Artificial Sequence
  chemically synthesized
tttgcctcagcgttgcaaag

SEQ ID NO: 614529 - DNA, 20 bp, Artificial Sequence
  chemically synthesized
aagactctgcaaaccgtact

SEQ ID NO: 614530 - DNA, 20 bp, Artificial Sequence
  chemically synthesized
tcagtcagtaaagccagaag

SEQ ID NO: 614531 - DNA, 20 bp, Artificial Sequence
  chemically synthesized
tccctctattgctccctacc

SEQ ID NO: 614532 - DNA, 20 bp, Artificial Sequence
  chemically synthesized
gtaaatcctttgtccctcct

SEQ ID NO: 614533 - DNA, 20 bp, Artificial Sequence
  chemically synthesized
tgcaagcctggaggagggac

SEQ ID NO: 614534 - DNA, 20 bp, Artificial Sequence
  chemically synthesized
caaaggatttactcattcac

SEQ ID NO: 614535 - DNA, 20 bp, Artificial Sequence
  chemically synthesized
ccttattagcagttccctag

SEQ ID NO: 614536 - DNA, 20 bp, Artificial Sequence
  chemically synthesized
tttagtaacaagctattcaa

SEQ ID NO: 614537 - DNA, 20 bp, Artificial Sequence
  chemically synthesized
acaaaacacaagctaaattg

SEQ ID NO: 614538 - DNA, 20 bp, Artificial Sequence
  chemically synthesized
aacaagctattcaatttagc

SEQ ID NO: 614539 - DNA, 20 bp, Artificial Sequence
  chemically synthesized
gctattcaatttagcttgtg

SEQ ID NO: 614540 - DNA, 20 bp, Artificial Sequence
  chemically synthesized
tagcttgtgttttgtttttc

SEQ ID NO: 614541 - DNA, 20 bp, Artificial Sequence
  chemically synthesized
gtttttcaaaagcttagaga

SEQ ID NO: 614542 - DNA, 20 bp, Artificial Sequence
  chemically synthesized
ggggcgatgaagctgattct

SEQ ID NO: 614543 - DNA, 20 bp, Artificial Sequence
  chemically synthesized
ttctgcagcaggggcgatga

SEQ ID NO: 614544 - DNA, 20 bp, Artificial Sequence
  chemically synthesized
gccccctactcagacctgag

SEQ ID NO: 614545 - DNA, 20 bp, Artificial Sequence
  chemically synthesized
ttttctgctacagtcactca

SEQ ID NO: 614546 - DNA, 20 bp, Artificial Sequence
  chemically synthesized
cattttgatagtgacaagtt

SEQ ID NO: 614547 - DNA, 20 bp, Artificial Sequence
  chemically synthesized
gtatttccattttgatagtg

SEQ ID NO: 614548 - DNA, 20 bp, Artificial Sequence
  chemically synthesized
aaatacattaagtgttgggt

SEQ ID NO: 614549 - DNA, 20 bp, Artificial Sequence
  chemically synthesized
ggtctgtgtttaatgggtaa

SEQ ID NO: 614550 - DNA, 20 bp, Artificial Sequence
  chemically synthesized
gaccacatattatattccac

SEQ ID NO: 614551 - DNA, 20 bp, Artificial Sequence
  chemically synthesized
tccatggttagaatttttaa

SEQ ID NO: 614552 - DNA, 20 bp, Artificial Sequence
  chemically synthesized
aaaaataactacagggctag

SEQ ID NO: 614553 - DNA, 20 bp, Artificial Sequence
  chemically synthesized
ctttgaaaaataactacagg

SEQ ID NO: 614554 - DNA, 20 bp, Artificial Sequence
  chemically synthesized
gatggtatagcaattttcca

SEQ ID NO: 614555 - DNA, 20 bp, Artificial Sequence
  chemically synthesized
catccatactatacacataa

SEQ ID NO: 614556 - DNA, 20 bp, Artificial Sequence
  chemically synthesized
atactatacacataatatgg

SEQ ID NO: 614557 - DNA, 20 bp, Artificial Sequence
  chemically synthesized
cgtagtcacctcctgcacac

SEQ ID NO: 614558 - DNA, 20 bp, Artificial Sequence
  chemically synthesized
acactctggctttttgctct

SEQ ID NO: 614559 - DNA, 20 bp, Artificial Sequence
  chemically synthesized
gagcaaaaagccagagtgta

SEQ ID NO: 614560 - DNA, 20 bp, Artificial Sequence
  chemically synthesized
gttaagaaagctgcatacac

SEQ ID NO: 614561 - DNA, 20 bp, Artificial Sequence
  chemically synthesized
ttcctgcctctaaggtaagc

SEQ ID NO: 614562 - DNA, 20 bp, Artificial Sequence
  chemically synthesized
tgcctctaaggtaagcccta

SEQ ID NO: 614563 - DNA, 20 bp, Artificial Sequence
  chemically synthesized
tgcaggtaaagaaaacaatc

SEQ ID NO: 614564 - DNA, 20 bp, Artificial Sequence
  chemically synthesized
tagattgttttctttacctg

SEQ ID NO: 614565 - DNA, 20 bp, Artificial Sequence
  chemically synthesized
aagcatattacaaatgctgt

SEQ ID NO: 614566 - DNA, 20 bp, Artificial Sequence
  chemically synthesized
aatccagcacagcatttgta

SEQ ID NO: 614567 - DNA, 20 bp, Artificial Sequence
  chemically synthesized
cttaagttaggactatacca

SEQ ID NO: 614568 - DNA, 20 bp, Artificial Sequence
  chemically synthesized
ttatgagatgcaattaattt

SEQ ID NO: 614569 - DNA, 20 bp, Artificial Sequence
  chemically synthesized
ttaatctgtatgactaagag

SEQ ID NO: 614570 - DNA, 20 bp, Artificial Sequence
  chemically synthesized
ccaatccacactcttagtca

SEQ ID NO: 614571 - DNA, 20 bp, Artificial Sequence
  chemically synthesized
aaggaaatcagaaagggtaa

SEQ ID NO: 614572 - DNA, 20 bp, Artificial Sequence
  chemically synthesized
tttctaagcagaattaccct

SEQ ID NO: 614573 - DNA, 20 bp, Artificial Sequence
  chemically synthesized
ttacatttcatatacatggt

SEQ ID NO: 614574 - DNA, 20 bp, Artificial Sequence
  chemically synthesized
aattgccgttcagtgcctga

SEQ ID NO: 614575 - DNA, 20 bp, Artificial Sequence
  chemically synthesized
aatttataatacaatgaaat

SEQ ID NO: 614576 - DNA, 20 bp, Artificial Sequence
  chemically synthesized
gaaatgagagtaatagaaaa

SEQ ID NO: 614577 - DNA, 20 bp, Artificial Sequence
  chemically synthesized
tttcttatttggacactggt

SEQ ID NO: 614578 - DNA, 20 bp, Artificial Sequence
  chemically synthesized
tggggtagtgccagctagta

SEQ ID NO: 614579 - DNA, 20 bp, Artificial Sequence
  chemically synthesized
cattctagagttaacatgct

SEQ ID NO: 614580 - DNA, 20 bp, Artificial Sequence
  chemically synthesized
aattaaatttgttgttagaa

SEQ ID NO: 614581 - DNA, 20 bp, Artificial Sequence
  chemically synthesized
tggctcggcctcccaaagtg

SEQ ID NO: 614582 - DNA, 20 bp, Artificial Sequence
  chemically synthesized
ttttgtatttttagtagaga

SEQ ID NO: 614583 - DNA, 20 bp, Artificial Sequence
  chemically synthesized
gcctgggtgacagagcaaga

SEQ ID NO: 614584 - DNA, 20 bp, Artificial Sequence
  chemically synthesized
ttctgtctttattagatatg

SEQ ID NO: 614585 - DNA, 20 bp, Artificial Sequence
  chemically synthesized
agaaatggaaaggtaagtac

SEQ ID NO: 614586 - DNA, 20 bp, Artificial Sequence
  chemically synthesized
aaaggtaagtacataggttt

SEQ ID NO: 614587 - DNA, 20 bp, Artificial Sequence
  chemically synthesized
tttgatgtactctatccctt

SEQ ID NO: 614588 - DNA, 20 bp, Artificial Sequence
  chemically synthesized
cattgggaatattgaggatg

SEQ ID NO: 614589 - DNA, 20 bp, Artificial Sequence
  chemically synthesized
ataggaaagtaactcatccg

SEQ ID NO: 614590 - DNA, 20 bp, Artificial Sequence
  chemically synthesized
cctgctgtattccctgggtg

SEQ ID NO: 614591 - DNA, 20 bp, Artificial Sequence
  chemically synthesized
aattctagacatattcaaca

SEQ ID NO: 614592 - DNA, 20 bp, Artificial Sequence
  chemically synthesized
cttttcctcatttcctgcct

SEQ ID NO: 614593 - DNA, 20 bp, Artificial Sequence
  chemically synthesized
ctgccacttaactgtcactc

SEQ ID NO: 614594 - DNA, 20 bp, Artificial Sequence
  chemically synthesized
cttttaactaattgttgtta

SEQ ID NO: 614595 - DNA, 20 bp, Artificial Sequence
  chemically synthesized
tcaataaaagtagctgttgg

SEQ ID NO: 614596 - DNA, 20 bp, Artificial Sequence
  chemically synthesized
aattttctgtcagactctcc

SEQ ID NO: 614597 - DNA, 20 bp, Artificial Sequence
  chemically synthesized
ttccaattccagcaacatct

SEQ ID NO: 614598 - DNA, 20 bp, Artificial Sequence
  chemically synthesized
catgtgctacagtaacttgc

SEQ ID NO: 614599 - DNA, 20 bp, Artificial Sequence
  chemically synthesized
tagagttgcgtagagtggag

SEQ ID NO: 614600 - DNA, 20 bp, Artificial Sequence
  chemically synthesized
atgctccactctacgcaact

SEQ ID NO: 614601 - DNA, 20 bp, Artificial Sequence
  chemically synthesized
tcccttaatgatttcttatt

SEQ ID NO: 614602 - DNA, 20 bp, Artificial Sequence
  chemically synthesized
ttgtaaggtgatgagtccct

SEQ ID NO: 614603 - DNA, 20 bp, Artificial Sequence
  chemically synthesized
ggcgacagtgatacacttct

SEQ ID NO: 614604 - DNA, 20 bp, Artificial Sequence
  chemically synthesized
ctcaggatgttaactttatc

SEQ ID NO: 614605 - DNA, 20 bp, Artificial Sequence
  chemically synthesized
aatttaagaactacaagaat

SEQ ID NO: 614606 - DNA, 20 bp, Artificial Sequence
  chemically synthesized
tcttaaatttcaggctgttc

SEQ ID NO: 614607 - DNA, 20 bp, Artificial Sequence
  chemically synthesized
aggtcaaggaatatgctctt

SEQ ID NO: 614608 - DNA, 20 bp, Artificial Sequence
  chemically synthesized
tcagaaaaataatttttaat

SEQ ID NO: 614609 - DNA, 20 bp, Artificial Sequence
  chemically synthesized
tttatgggcctatgactctg

SEQ ID NO: 614610 - DNA, 20 bp, Artificial Sequence
  chemically synthesized
cattctggtttgttcagtta

SEQ ID NO: 614611 - DNA, 20 bp, Artificial Sequence
  chemically synthesized
actgctgtgattaaattcat

SEQ ID NO: 614612 - DNA, 20 bp, Artificial Sequence
  chemically synthesized
gcggtagcttcccttgactg

SEQ ID NO: 614613 - DNA, 20 bp, Artificial Sequence
  chemically synthesized
aatttgtcttggaatgatgc

SEQ ID NO: 614614 - DNA, 20 bp, Artificial Sequence
  chemically synthesized
ttgtacccctgtggtgttat

SEQ ID NO: 614615 - DNA, 20 bp, Artificial Sequence
  chemically synthesized
ccctgtggtgttatctttga

SEQ ID NO: 614616 - DNA, 20 bp, Artificial Sequence
  chemically synthesized
tgttatctttgatttcgatt

SEQ ID NO: 614617 - DNA, 20 bp, Artificial Sequence
  chemically synthesized
gatttcgattagaggtttca

SEQ ID NO: 614618 - DNA, 20 bp, Artificial Sequence
  chemically synthesized
gtttcaggctgcttcctatg

SEQ ID NO: 614619 - DNA, 20 bp, Artificial Sequence
  chemically synthesized
cttacctttcattctcttta

SEQ ID NO: 614620 - DNA, 20 bp, Artificial Sequence
  chemically synthesized
cctactaaagagaatgaaag

SEQ ID NO: 614621 - DNA, 20 bp, Artificial Sequence
  chemically synthesized
ctactgataactgcaaagcc

SEQ ID NO: 614622 - DNA, 20 bp, Artificial Sequence
  chemically synthesized
tgtcatttctcttcaaagcc

SEQ ID NO: 614623 - DNA, 20 bp, Artificial Sequence
  chemically synthesized
gaagcttaatatttatgaaa

SEQ ID NO: 614624 - DNA, 20 bp, Artificial Sequence
  chemically synthesized
caatcatattttcataaata

SEQ ID NO: 614625 - DNA, 20 bp, Artificial Sequence
  chemically synthesized
tttatatttatatacaattg

SEQ ID NO: 614626 - DNA, 20 bp, Artificial Sequence
  chemically synthesized
atcattttaaaaagtaatgt

SEQ ID NO: 614627 - DNA, 20 bp, Artificial Sequence
  chemically synthesized
aacatgcacattacttttta

SEQ ID NO: 614628 - DNA, 20 bp, Artificial Sequence
  chemically synthesized
ataacatgatcacttatacc

SEQ ID NO: 614629 - DNA, 20 bp, Artificial Sequence
  chemically synthesized
tatagcttaatatatttttc

SEQ ID NO: 614630 - DNA, 20 bp, Artificial Sequence
  chemically synthesized
atgaaaaatatattaagcta

SEQ ID NO: 614631 - DNA, 20 bp, Artificial Sequence
  chemically synthesized
atattaagctataacgatta

SEQ ID NO: 614632 - DNA, 20 bp, Artificial Sequence
  chemically synthesized
tttaaaagcaggctaatcgt

SEQ ID NO: 614633 - DNA, 20 bp, Artificial Sequence
  chemically synthesized
ttctttatttaacaacatca

SEQ ID NO: 614634 - DNA, 20 bp, Artificial Sequence
  chemically synthesized
tagggaaatttcaacacatt

SEQ ID NO: 614635 - DNA, 20 bp, Artificial Sequence
  chemically synthesized
gaattataaaacaaataaaa

SEQ ID NO: 614636 - DNA, 20 bp, Artificial Sequence
  chemically synthesized
catcagaaaaacactatttt

SEQ ID NO: 614637 - DNA, 20 bp, Artificial Sequence
  chemically synthesized
aaaatgtagaagcgaaattt

SEQ ID NO: 614638 - DNA, 20 bp, Artificial Sequence
  chemically synthesized
aaatattctaaaccctcaaa

SEQ ID NO: 614639 - DNA, 20 bp, Artificial Sequence
  chemically synthesized
aatgcctgggcagtctccgt

SEQ ID NO: 614640 - DNA, 20 bp, Artificial Sequence
  chemically synthesized
tgtgcctactacctgaaagg

SEQ ID NO: 614641 - DNA, 20 bp, Artificial Sequence
  chemically synthesized
ttcctttcaggtagtaggca

SEQ ID NO: 614642 - DNA, 20 bp, Artificial Sequence
  chemically synthesized
tgactaatatatatttggag

SEQ ID NO: 614643 - DNA, 20 bp, Artificial Sequence
  chemically synthesized
caataaaactcacattctta

SEQ ID NO: 614644 - DNA, 20 bp, Artificial Sequence
  chemically synthesized
tagtcaagcagaataagaat

SEQ ID NO: 614645 - DNA, 20 bp, Artificial Sequence
  chemically synthesized
tcagtttccactgaattgta

SEQ ID NO: 614646 - DNA, 20 bp, Artificial Sequence
  chemically synthesized
ttagatgaatttatttcata

SEQ ID NO: 614647 - DNA, 20 bp, Artificial Sequence
  chemically synthesized
gaaagctgccatgtgggatt

SEQ ID NO: 614648 - DNA, 20 bp, Artificial Sequence
  chemically synthesized
taaaacattcaatcccacat

SEQ ID NO: 614649 - DNA, 20 bp, Artificial Sequence
  chemically synthesized
tattccaggaaagctgccat

SEQ ID NO: 614650 - DNA, 20 bp, Artificial Sequence
  chemically synthesized
agctaatacccataatgata

SEQ ID NO: 614651 - DNA, 20 bp, Artificial Sequence
  chemically synthesized
tttaaaaacatgctaagaat

SEQ ID NO: 614652 - DNA, 20 bp, Artificial Sequence
  chemically synthesized
ttttgaagctaacattctta

SEQ ID NO: 614653 - DNA, 20 bp, Artificial Sequence
  chemically synthesized
caaaatttaatatctcaaaa

SEQ ID NO: 614654 - DNA, 20 bp, Artificial Sequence
  chemically synthesized
accacttggtataaccaaaa

SEQ ID NO: 614655 - DNA, 20 bp, Artificial Sequence
  chemically synthesized
gcaggattttggttatacca

SEQ ID NO: 614656 - DNA, 20 bp, Artificial Sequence
  chemically synthesized
aatagagatatttatccata

SEQ ID NO: 614657 - DNA, 20 bp, Artificial Sequence
  chemically synthesized
tgtgacaatttaggtgtcct

SEQ ID NO: 614658 - DNA, 20 bp, Artificial Sequence
  chemically synthesized
tattattattattatttttt

SEQ ID NO: 614659 - DNA, 20 bp, Artificial Sequence
  chemically synthesized
cctcccaaagtgctgggatt

SEQ ID NO: 614660 - DNA, 20 bp, Artificial Sequence
  chemically synthesized
cacctcggcctcccaaagtg

SEQ ID NO: 614661 - DNA, 20 bp, Artificial Sequence
  chemically synthesized
cactttgggaggccgaggtg

SEQ ID NO: 614662 - DNA, 20 bp, Artificial Sequence
  chemically synthesized
ttttgtatttttagtagaga

SEQ ID NO: 614663 - DNA, 20 bp, Artificial Sequence
  chemically synthesized
aatggcgtgaacccaggagg

SEQ ID NO: 614664 - DNA, 20 bp, Artificial Sequence
  chemically synthesized
tggcgcgatctcggctcact

SEQ ID NO: 614665 - DNA, 20 bp, Artificial Sequence
  chemically synthesized
gaccattttgtttcctttta

SEQ ID NO: 614666 - DNA, 20 bp, Artificial Sequence
  chemically synthesized
ctaaataacccagtagacca

SEQ ID NO: 614667 - DNA, 20 bp, Artificial Sequence
  chemically synthesized
acttattctaaagttaggca

SEQ ID NO: 614668 - DNA, 20 bp, Artificial Sequence
  chemically synthesized
acccttttttactatcacat

SEQ ID NO: 614669 - DNA, 20 bp, Artificial Sequence
  chemically synthesized
ggttcctttttacccgaaat

SEQ ID NO: 614670 - DNA, 20 bp, Artificial Sequence
  chemically synthesized
ttaagtgagaatatggttaa

SEQ ID NO: 614671 - DNA, 20 bp, Artificial Sequence
  chemically synthesized
cgcctcagcctcccaaagtg

SEQ ID NO: 614672 - DNA, 20 bp, Artificial Sequence
  chemically synthesized
ttttgtatttttagtagaga

SEQ ID NO: 614673 - DNA, 20 bp, Artificial Sequence
  chemically synthesized
aatggtgtgaacccgggagg

SEQ ID NO: 614674 - DNA, 20 bp, Artificial Sequence
  chemically synthesized
tatttatttattttttttga

SEQ ID NO: 614675 - DNA, 20 bp, Artificial Sequence
  chemically synthesized
atatacaagaatcgactcaa

SEQ ID NO: 614676 - DNA, 20 bp, Artificial Sequence
  chemically synthesized
taagtctttaatccattttg

SEQ ID NO: 614677 - DNA, 20 bp, Artificial Sequence
  chemically synthesized
ttcttctagtagttttagtt

SEQ ID NO: 614678 - DNA, 20 bp, Artificial Sequence
  chemically synthesized
ccatgttttcttctagtagt

SEQ ID NO: 614679 - DNA, 20 bp, Artificial Sequence
  chemically synthesized
catagtccatgttttcttct

SEQ ID NO: 614680 - DNA, 20 bp, Artificial Sequence
  chemically synthesized
catgagccacctctcatagt

SEQ ID NO: 614681 - DNA, 20 bp, Artificial Sequence
  chemically synthesized
cgcctcaacctcccaaagta

SEQ ID NO: 614682 - DNA, 20 bp, Artificial Sequence
  chemically synthesized
ggcgggcagatcatgaggtc

SEQ ID NO: 614683 - DNA, 20 bp, Artificial Sequence
  chemically synthesized
ttagtagagacggggtttcg

SEQ ID NO: 614684 - DNA, 20 bp, Artificial Sequence
  chemically synthesized
ttttgtatttttagtagaga

SEQ ID NO: 614685 - DNA, 20 bp, Artificial Sequence
  chemically synthesized
aacctccaccttccgggctc

SEQ ID NO: 614686 - DNA, 20 bp, Artificial Sequence
  chemically synthesized
tttttttttttttgagacag

SEQ ID NO: 614687 - DNA, 20 bp, Artificial Sequence
  chemically synthesized
aaaaaaaaaaaacatcaact

SEQ ID NO: 614688 - DNA, 20 bp, Artificial Sequence
  chemically synthesized
caatgtcataagcttttagt

SEQ ID NO: 614689 - DNA, 20 bp, Artificial Sequence
  chemically synthesized
tccttgcccagaccaatgtc

SEQ ID NO: 614690 - DNA, 20 bp, Artificial Sequence
  chemically synthesized
gcttatgacattggtctggg

SEQ ID NO: 614691 - DNA, 20 bp, Artificial Sequence
  chemically synthesized
aatgaagttgcatcaaccta

SEQ ID NO: 614692 - DNA, 20 bp, Artificial Sequence
  chemically synthesized
tatttccttggctgtgcaga

SEQ ID NO: 614693 - DNA, 20 bp, Artificial Sequence
  chemically synthesized
ttgtataccatatacctgaa

SEQ ID NO: 614694 - DNA, 20 bp, Artificial Sequence
  chemically synthesized
ctccatgagttgtcccttca

SEQ ID NO: 614695 - DNA, 20 bp, Artificial Sequence
  chemically synthesized
tgttgtattgctattgagtt

SEQ ID NO: 614696 - DNA, 20 bp, Artificial Sequence
  chemically synthesized
attgggttgttgtattgcta

SEQ ID NO: 614697 - DNA, 20 bp, Artificial Sequence
  chemically synthesized
agactttttttttgaaataa

SEQ ID NO: 614698 - DNA, 20 bp, Artificial Sequence
  chemically synthesized
attttactttgtcatatttt

SEQ ID NO: 614699 - DNA, 20 bp, Artificial Sequence
  chemically synthesized
aagtaaaatcacagtggcaa

SEQ ID NO: 614700 - DNA, 20 bp, Artificial Sequence
  chemically synthesized
ttccttaatcacagttgcca

SEQ ID NO: 614701 - DNA, 20 bp, Artificial Sequence
  chemically synthesized
gggatacatgtgcagaacgt

SEQ ID NO: 614702 - DNA, 20 bp, Artificial Sequence
  chemically synthesized
cataggtatacatgtgccat

SEQ ID NO: 614703 - DNA, 20 bp, Artificial Sequence
  chemically synthesized
tgcatctatcaacccgtcat

SEQ ID NO: 614704 - DNA, 20 bp, Artificial Sequence
  chemically synthesized
ttgtcatatacctgttgtcc

SEQ ID NO: 614705 - DNA, 20 bp, Artificial Sequence
  chemically synthesized
tggacaacaggtatatgaca

SEQ ID NO: 614706 - DNA, 20 bp, Artificial Sequence
  chemically synthesized
acaggtgtggggtgatagca

SEQ ID NO: 614707 - DNA, 20 bp, Artificial Sequence
  chemically synthesized
ttatgttcccattaagggtc

SEQ ID NO: 614708 - DNA, 20 bp, Artificial Sequence
  chemically synthesized
tttttttttgaagaacttcc

SEQ ID NO: 614709 - DNA, 20 bp, Artificial Sequence
  chemically synthesized
atgtacccagtagtgagatt

SEQ ID NO: 614710 - DNA, 20 bp, Artificial Sequence
  chemically synthesized
ccttaggtatgtacccagta

SEQ ID NO: 614711 - DNA, 20 bp, Artificial Sequence
  chemically synthesized
tcaagtagatatctgcacac

SEQ ID NO: 614712 - DNA, 20 bp, Artificial Sequence
  chemically synthesized
catctgttgatggttactta

SEQ ID NO: 614713 - DNA, 20 bp, Artificial Sequence
  chemically synthesized
taagtaaccatcaacagatg

SEQ ID NO: 614714 - DNA, 20 bp, Artificial Sequence
  chemically synthesized
caaccacattgttcccaatt

SEQ ID NO: 614715 - DNA, 20 bp, Artificial Sequence
  chemically synthesized
ggaacaatgtggttgaacct

SEQ ID NO: 614716 - DNA, 20 bp, Artificial Sequence
  chemically synthesized
tggttgaacctggaggattt

SEQ ID NO: 614717 - DNA, 20 bp, Artificial Sequence
  chemically synthesized
ccctcctctcaggaacacac

SEQ ID NO: 614718 - DNA, 20 bp, Artificial Sequence
  chemically synthesized
ccatttgctaagacacatgc

SEQ ID NO: 614719 - DNA, 20 bp, Artificial Sequence
  chemically synthesized
tccagcaaacacagtgctca

SEQ ID NO: 614720 - DNA, 20 bp, Artificial Sequence
  chemically synthesized
ctccaaaaacccattgagca

SEQ ID NO: 614721 - DNA, 20 bp, Artificial Sequence
  chemically synthesized
gaagaatgacaagggaacca

SEQ ID NO: 614722 - DNA, 20 bp, Artificial Sequence
  chemically synthesized
tttgaaggcgggtgtggctt

SEQ ID NO: 614723 - DNA, 20 bp, Artificial Sequence
  chemically synthesized
tgccaggatttgaaggcggg

SEQ ID NO: 614724 - DNA, 20 bp, Artificial Sequence
  chemically synthesized
gtcctgacactgatacagtg

SEQ ID NO: 614725 - DNA, 20 bp, Artificial Sequence
  chemically synthesized
gggcaggtcacaggggatat

SEQ ID NO: 614726 - DNA, 20 bp, Artificial Sequence
  chemically synthesized
tcactcttttgtggatcttc

SEQ ID NO: 614727 - DNA, 20 bp, Artificial Sequence
  chemically synthesized
taactgatgacattccacca

SEQ ID NO: 614728 - DNA, 20 bp, Artificial Sequence
  chemically synthesized
gatgacattccaccattgtg

SEQ ID NO: 614729 - DNA, 20 bp, Artificial Sequence
  chemically synthesized
aagaaccttcttaagggtgg

SEQ ID NO: 614730 - DNA, 20 bp, Artificial Sequence
  chemically synthesized
ataggcggtggagttaggag

SEQ ID NO: 614731 - DNA, 20 bp, Artificial Sequence
  chemically synthesized
tgggattatcattagttctt

SEQ ID NO: 614732 - DNA, 20 bp, Artificial Sequence
  chemically synthesized
aaaggagtcagccaagggtg

SEQ ID NO: 614733 - DNA, 20 bp, Artificial Sequence
  chemically synthesized
aggctttgtgtgagcaacaa

SEQ ID NO: 614734 - DNA, 20 bp, Artificial Sequence
  chemically synthesized
agccttgttgctcacacaaa

SEQ ID NO: 614735 - DNA, 20 bp, Artificial Sequence
  chemically synthesized
ccgagtgaagagaccaccaa

SEQ ID NO: 614736 - DNA, 20 bp, Artificial Sequence
  chemically synthesized
gtcttaaatttctggagggg

SEQ ID NO: 614737 - DNA, 20 bp, Artificial Sequence
  chemically synthesized
tgagatgccccccctttctc

SEQ ID NO: 614738 - DNA, 20 bp, Artificial Sequence
  chemically synthesized
tatgcaggatctaccggaaa

SEQ ID NO: 614739 - DNA, 20 bp, Artificial Sequence
  chemically synthesized
ggctttatatataaattaag

SEQ ID NO: 614740 - DNA, 20 bp, Artificial Sequence
  chemically synthesized
gattcaagaaaaggcagtta

SEQ ID NO: 614741 - DNA, 20 bp, Artificial Sequence
  chemically synthesized
actgcatgtagatccttatg

SEQ ID NO: 614742 - DNA, 20 bp, Artificial Sequence
  chemically synthesized
tttgcagtttaggtgctgga

SEQ ID NO: 614743 - DNA, 20 bp, Artificial Sequence
  chemically synthesized
gatttattaccggtttgctt

SEQ ID NO: 614744 - DNA, 20 bp, Artificial Sequence
  chemically synthesized
tgttgtctgatttattaccg

SEQ ID NO: 614745 - DNA, 20 bp, Artificial Sequence
  chemically synthesized
taattgttgtctgatttatt

SEQ ID NO: 614746 - DNA, 20 bp, Artificial Sequence
  chemically synthesized
tgacttggctcttaattgtt

SEQ ID NO: 614747 - DNA, 20 bp, Artificial Sequence
  chemically synthesized
atgtccatttcacatttgca

SEQ ID NO: 614748 - DNA, 20 bp, Artificial Sequence
  chemically synthesized
aaatggacattcagaagtca

SEQ ID NO: 614749 - DNA, 20 bp, Artificial Sequence
  chemically synthesized
agcagtccacaaggctcttc

SEQ ID NO: 614750 - DNA, 20 bp, Artificial Sequence
  chemically synthesized
agctgttgaagagccttgtg

SEQ ID NO: 614751 - DNA, 20 bp, Artificial Sequence
  chemically synthesized
gtctaaggttaatttcaacg

SEQ ID NO: 614752 - DNA, 20 bp, Artificial Sequence
  chemically synthesized
tcgttgaaattaaccttaga

SEQ ID NO: 614753 - DNA, 20 bp, Artificial Sequence
  chemically synthesized
ctggcctttccttccccgcg

SEQ ID NO: 614754 - DNA, 20 bp, Artificial Sequence
  chemically synthesized
tgtttatgatggattaaggg

SEQ ID NO: 614755 - DNA, 20 bp, Artificial Sequence
  chemically synthesized
ccccaggcatcactgtttat

SEQ ID NO: 614756 - DNA, 20 bp, Artificial Sequence
  chemically synthesized
ctcaactgtgccccaggcat

SEQ ID NO: 614757 - DNA, 20 bp, Artificial Sequence
  chemically synthesized
ctacaccttggaggaagaat

SEQ ID NO: 614758 - DNA, 20 bp, Artificial Sequence
  chemically synthesized
ttggagttggataggaaaaa

SEQ ID NO: 614759 - DNA, 20 bp, Artificial Sequence
  chemically synthesized
tttcagcagttgccattgaa

SEQ ID NO: 614760 - DNA, 20 bp, Artificial Sequence
  chemically synthesized
ggtgctggtactttttgttt

SEQ ID NO: 614761 - DNA, 20 bp, Artificial Sequence
  chemically synthesized
aaaaggtgctggtacttttt

SEQ ID NO: 614762 - DNA, 20 bp, Artificial Sequence
  chemically synthesized
aacaaaaaggtgctggtact

SEQ ID NO: 614763 - DNA, 20 bp, Artificial Sequence
  chemically synthesized
aacaaaaagtaccagcacct

SEQ ID NO: 614764 - DNA, 20 bp, Artificial Sequence
  chemically synthesized
ttggtaagaaggcgaaacat

SEQ ID NO: 614765 - DNA, 20 bp, Artificial Sequence
  chemically synthesized
tcttttttttagacaatctg

SEQ ID NO: 614766 - DNA, 20 bp, Artificial Sequence
  chemically synthesized
aaaagaaattcgggaaatca

SEQ ID NO: 614767 - DNA, 20 bp, Artificial Sequence
  chemically synthesized
ccccagatcatgataaaacg

SEQ ID NO: 614768 - DNA, 20 bp, Artificial Sequence
  chemically synthesized
ctgaggaagccaaattttca

SEQ ID NO: 614769 - DNA, 20 bp, Artificial Sequence
  chemically synthesized
aaaataaagcaaaatgaaaa

SEQ ID NO: 614770 - DNA, 20 bp, Artificial Sequence
  chemically synthesized
aaattttcattttgctttat

SEQ ID NO: 614771 - DNA, 20 bp, Artificial Sequence
  chemically synthesized
ttttatttatattgaaaaca

SEQ ID NO: 614772 - DNA, 20 bp, Artificial Sequence
  chemically synthesized
atggaagaatattaaaaact

SEQ ID NO: 614773 - DNA, 20 bp, Artificial Sequence
  chemically synthesized
gttaatggaagaatattaaa

SEQ ID NO: 614774 - DNA, 20 bp, Artificial Sequence
  chemically synthesized
cttccattaaccataacttc

SEQ ID NO: 614775 - DNA, 20 bp, Artificial Sequence
  chemically synthesized
aacttcattggtttgggaga

SEQ ID NO: 614776 - DNA, 20 bp, Artificial Sequence
  chemically synthesized
tgtaaaatatcctccaacct

SEQ ID NO: 614777 - DNA, 20 bp, Artificial Sequence
  chemically synthesized
aaaatgtctcattaagtctt

SEQ ID NO: 614778 - DNA, 20 bp, Artificial Sequence
  chemically synthesized
ctaaataaaacattaatgtc

SEQ ID NO: 614779 - DNA, 20 bp, Artificial Sequence
  chemically synthesized
tgaaaataaacaggtgacat

SEQ ID NO: 614780 - DNA, 20 bp, Artificial Sequence
  chemically synthesized
ctttttaaagtggctactca

SEQ ID NO: 614781 - DNA, 20 bp, Artificial Sequence
  chemically synthesized
caaaaagtttaaattacata

SEQ ID NO: 614782 - DNA, 20 bp, Artificial Sequence
  chemically synthesized
cagagttacttcttccacat

SEQ ID NO: 614783 - DNA, 20 bp, Artificial Sequence
  chemically synthesized
atatgaggggattgagaaaa

SEQ ID NO: 614784 - DNA, 20 bp, Artificial Sequence
  chemically synthesized
tcacctgccctctgtatatg

SEQ ID NO: 614785 - DNA, 20 bp, Artificial Sequence
  chemically synthesized
gcctaacaacattagaatca

SEQ ID NO: 614786 - DNA, 20 bp, Artificial Sequence
  chemically synthesized
taagttataggattaaatcc

SEQ ID NO: 614787 - DNA, 20 bp, Artificial Sequence
  chemically synthesized
ttggactgttgtcataagtt

SEQ ID NO: 614788 - DNA, 20 bp, Artificial Sequence
  chemically synthesized
tgacaacagtccaagatgca

SEQ ID NO: 614789 - DNA, 20 bp, Artificial Sequence
  chemically synthesized
aagtgatctaaattaaattt

SEQ ID NO: 614790 - DNA, 20 bp, Artificial Sequence
  chemically synthesized
tttccttttctttcccttta

SEQ ID NO: 614791 - DNA, 20 bp, Artificial Sequence
  chemically synthesized
ttacctccccgccttataat

SEQ ID NO: 614792 - DNA, 20 bp, Artificial Sequence
  chemically synthesized
catttgtcctacatcgcttt

SEQ ID NO: 614793 - DNA, 20 bp, Artificial Sequence
  chemically synthesized
gatttttctcatttgtccta

SEQ ID NO: 614794 - DNA, 20 bp, Artificial Sequence
  chemically synthesized
tgtaggacaaatgagaaaaa

SEQ ID NO: 614795 - DNA, 20 bp, Artificial Sequence
  chemically synthesized
tgttggagtagaataaggaa

SEQ ID NO: 614796 - DNA, 20 bp, Artificial Sequence
  chemically synthesized
ttacagatgatagactctcc

SEQ ID NO: 614797 - DNA, 20 bp, Artificial Sequence
  chemically synthesized
atactaatgggtacataatg

SEQ ID NO: 614798 - DNA, 20 bp, Artificial Sequence
  chemically synthesized
cattagtattttattgttag

SEQ ID NO: 614799 - DNA, 20 bp, Artificial Sequence
  chemically synthesized
tgccatccagccttggagtt

SEQ ID NO: 614800 - DNA, 20 bp, Artificial Sequence
  chemically synthesized
atggcagcaactactaggtg

SEQ ID NO: 614801 - DNA, 20 bp, Artificial Sequence
  chemically synthesized
acctagtagttgctgccata

SEQ ID NO: 614802 - DNA, 20 bp, Artificial Sequence
  chemically synthesized
aaaatgattaggctggggaa

SEQ ID NO: 614803 - DNA, 20 bp, Artificial Sequence
  chemically synthesized
attccaggtctgaagagaaa

SEQ ID NO: 614804 - DNA, 20 bp, Artificial Sequence
  chemically synthesized
aactatgacgcgagaggatg

SEQ ID NO: 614805 - DNA, 20 bp, Artificial Sequence
  chemically synthesized
atcctgccatcctctcgcgt

SEQ ID NO: 614806 - DNA, 20 bp, Artificial Sequence
  chemically synthesized
gtaacttggagttgagtgct

SEQ ID NO: 614807 - DNA, 20 bp, Artificial Sequence
  chemically synthesized
ttacttcctgaaaagcagag

SEQ ID NO: 614808 - DNA, 20 bp, Artificial Sequence
  chemically synthesized
gcctcactgaggaagcattt

SEQ ID NO: 614809 - DNA, 20 bp, Artificial Sequence
  chemically synthesized
ctcagtgaggccacagaact

SEQ ID NO: 614810 - DNA, 20 bp, Artificial Sequence
  chemically synthesized
catgatccacatgatctggc

SEQ ID NO: 614811 - DNA, 20 bp, Artificial Sequence
  chemically synthesized
cctcaaccccttacaactgt

SEQ ID NO: 614812 - DNA, 20 bp, Artificial Sequence
  chemically synthesized
ccagtactggaaggaagtgt

SEQ ID NO: 614813 - DNA, 20 bp, Artificial Sequence
  chemically synthesized
cattactgcacattcttctt

SEQ ID NO: 614814 - DNA, 20 bp, Artificial Sequence
  chemically synthesized
ctacacattagcatcacccg

SEQ ID NO: 614815 - DNA, 20 bp, Artificial Sequence
  chemically synthesized
gcttttaaatctgtaccatt

SEQ ID NO: 614816 - DNA, 20 bp, Artificial Sequence
  chemically synthesized
gcatcagaaacacacaatgg

SEQ ID NO: 614817 - DNA, 20 bp, Artificial Sequence
  chemically synthesized
ttctgatgccccccacgcca

SEQ ID NO: 614818 - DNA, 20 bp, Artificial Sequence
  chemically synthesized
atgccccccacgccatgttg

SEQ ID NO: 614819 - DNA, 20 bp, Artificial Sequence
  chemically synthesized
cccccacgccatgttgtttt

SEQ ID NO: 614820 - DNA, 20 bp, Artificial Sequence
  chemically synthesized
cgccatgttgttttgtttgt

SEQ ID NO: 614821 - DNA, 20 bp, Artificial Sequence
  chemically synthesized
ttgttttgtttgttttcgtt

SEQ ID NO: 614822 - DNA, 20 bp, Artificial Sequence
  chemically synthesized
gtttgttttcgttttttgtt

SEQ ID NO: 614823 - DNA, 20 bp, Artificial Sequence
  chemically synthesized
aacctctgcctcctgggttc

SEQ ID NO: 614824 - DNA, 20 bp, Artificial Sequence
  chemically synthesized
ttgggaggccgaggcatgac

SEQ ID NO: 614825 - DNA, 20 bp, Artificial Sequence
  chemically synthesized
tgcctcggcctcccaaatag

SEQ ID NO: 614826 - DNA, 20 bp, Artificial Sequence
  chemically synthesized
ttttgtatttgtagtagaga

SEQ ID NO: 614827 - DNA, 20 bp, Artificial Sequence
  chemically synthesized
cgcctcagcctcccgaagtg

SEQ ID NO: 614828 - DNA, 20 bp, Artificial Sequence
  chemically synthesized
gtaatacagtataggggatg

SEQ ID NO: 614829 - DNA, 20 bp, Artificial Sequence
  chemically synthesized
tatactgtattacttattga

SEQ ID NO: 614830 - DNA, 20 bp, Artificial Sequence
  chemically synthesized
ttgtttcccagctcaggcct

SEQ ID NO: 614831 - DNA, 20 bp, Artificial Sequence
  chemically synthesized
tcctttaagttggttttcag

SEQ ID NO: 614832 - DNA, 20 bp, Artificial Sequence
  chemically synthesized
aactcttcccattcctttaa

SEQ ID NO: 614833 - DNA, 20 bp, Artificial Sequence
  chemically synthesized
ctgcatcatgtgtgggagac

SEQ ID NO: 614834 - DNA, 20 bp, Artificial Sequence
  chemically synthesized
gatgactttatcagatattt

SEQ ID NO: 614835 - DNA, 20 bp, Artificial Sequence
  chemically synthesized
ttatcagacattttctcctg

SEQ ID NO: 614836 - DNA, 20 bp, Artificial Sequence
  chemically synthesized
tacctctactccctaatgat

SEQ ID NO: 614837 - DNA, 20 bp, Artificial Sequence
  chemically synthesized
atgaattaactactctcagt

SEQ ID NO: 614838 - DNA, 20 bp, Artificial Sequence
  chemically synthesized
agcagctgatctatcacgtc

SEQ ID NO: 614839 - DNA, 20 bp, Artificial Sequence
  chemically synthesized
attcataaaattacactgat

SEQ ID NO: 614840 - DNA, 20 bp, Artificial Sequence
  chemically synthesized
gtagttttctaatgtgacat

SEQ ID NO: 614841 - DNA, 20 bp, Artificial Sequence
  chemically synthesized
tttctaatgtgacatttttg

SEQ ID NO: 614842 - DNA, 20 bp, Artificial Sequence
  chemically synthesized
gtcagacaactgagtaacca

SEQ ID NO: 614843 - DNA, 20 bp, Artificial Sequence
  chemically synthesized
cttatttggttattcagttg

SEQ ID NO: 614844 - DNA, 20 bp, Artificial Sequence
  chemically synthesized
agtttcttgacctttttacc

SEQ ID NO: 614845 - DNA, 20 bp, Artificial Sequence
  chemically synthesized
ttacattgaacagagataaa

SEQ ID NO: 614846 - DNA, 20 bp, Artificial Sequence
  chemically synthesized
cacaaaagcccgtatttaga

SEQ ID NO: 614847 - DNA, 20 bp, Artificial Sequence
  chemically synthesized
ggtataatctggctctaaat

SEQ ID NO: 614848 - DNA, 20 bp, Artificial Sequence
  chemically synthesized
cgtatttagagccagattat

SEQ ID NO: 614849 - DNA, 20 bp, Artificial Sequence
  chemically synthesized
aagacatgagagaatgagta

SEQ ID NO: 614850 - DNA, 20 bp, Artificial Sequence
  chemically synthesized
gaataccacctatctcctat

SEQ ID NO: 614851 - DNA, 20 bp, Artificial Sequence
  chemically synthesized
tctcctatatatgtttgcaa

SEQ ID NO: 614852 - DNA, 20 bp, Artificial Sequence
  chemically synthesized
aattcacatatatcttgtaa

SEQ ID NO: 614853 - DNA, 20 bp, Artificial Sequence
  chemically synthesized
aatcacctctgaggggtttt

SEQ ID NO: 614854 - DNA, 20 bp, Artificial Sequence
  chemically synthesized
aagccattaaaacccctcag

SEQ ID NO: 614855 - DNA, 20 bp, Artificial Sequence
  chemically synthesized
agcaaatttaatcacctctg

SEQ ID NO: 614856 - DNA, 20 bp, Artificial Sequence
  chemically synthesized
actactttgcttaataaccc

SEQ ID NO: 614857 - DNA, 20 bp, Artificial Sequence
  chemically synthesized
ggtgtgttcatagtttacta

SEQ ID NO: 614858 - DNA, 20 bp, Artificial Sequence
  chemically synthesized
gtagtaaactatgaacacac

SEQ ID NO: 614859 - DNA, 20 bp, Artificial Sequence
  chemically synthesized
agaaaaaacttaggtgtgtt

SEQ ID NO: 614860 - DNA, 20 bp, Artificial Sequence
  chemically synthesized
cagatgagtttcagtgggct

SEQ ID NO: 614861 - DNA, 20 bp, Artificial Sequence
  chemically synthesized
gcacaaacagatgagtttca

SEQ ID NO: 614862 - DNA, 20 bp, Artificial Sequence
  chemically synthesized
cagcaagcccactgaaactc

SEQ ID NO: 614863 - DNA, 20 bp, Artificial Sequence
  chemically synthesized
ttatttagtagcacaaacag

SEQ ID NO: 614864 - DNA, 20 bp, Artificial Sequence
  chemically synthesized
caacctacagtaggaaaagt

SEQ ID NO: 614865 - DNA, 20 bp, Artificial Sequence
  chemically synthesized
cccctacttttcctactgta

SEQ ID NO: 614866 - DNA, 20 bp, Artificial Sequence
  chemically synthesized
atctcaaggctctgctcctg

SEQ ID NO: 614867 - DNA, 20 bp, Artificial Sequence
  chemically synthesized
cagagccttgagatgggctg

SEQ ID NO: 614868 - DNA, 20 bp, Artificial Sequence
  chemically synthesized
cttgagatgggctggcatgt

SEQ ID NO: 614869 - DNA, 20 bp, Artificial Sequence
  chemically synthesized
aatggcaccggccacccagt

SEQ ID NO: 614870 - DNA, 20 bp, Artificial Sequence
  chemically synthesized
gctttcagcggcaggtttgg

SEQ ID NO: 614871 - DNA, 20 bp, Artificial Sequence
  chemically synthesized
gcttggctttcagcggcagg

SEQ ID NO: 614872 - DNA, 20 bp, Artificial Sequence
  chemically synthesized
gctaggcttggctttcagcg

SEQ ID NO: 614873 - DNA, 20 bp, Artificial Sequence
  chemically synthesized
tcaggctggtagttgctagg

SEQ ID NO: 614874 - DNA, 20 bp, Artificial Sequence
  chemically synthesized
ctgcatcaggctggtagttg

SEQ ID NO: 614875 - DNA, 20 bp, Artificial Sequence
  chemically synthesized
gtttggctgacctaagttga

SEQ ID NO: 614876 - DNA, 20 bp, Artificial Sequence
  chemically synthesized
cattaattctcatggtcatg

SEQ ID NO: 614877 - DNA, 20 bp, Artificial Sequence
  chemically synthesized
ataatcattacctccaactt

SEQ ID NO: 614878 - DNA, 20 bp, Artificial Sequence
  chemically synthesized
taaaaccattaagttggagg

SEQ ID NO: 614879 - DNA, 20 bp, Artificial Sequence
  chemically synthesized
taatgattattacttgatat

SEQ ID NO: 614880 - DNA, 20 bp, Artificial Sequence
  chemically synthesized
caatacatctgcccaaataa

SEQ ID NO: 614881 - DNA, 20 bp, Artificial Sequence
  chemically synthesized
caacatcatgatgtgaacaa

SEQ ID NO: 614882 - DNA, 20 bp, Artificial Sequence
  chemically synthesized
caatgcctcgtttgctggct

SEQ ID NO: 614883 - DNA, 20 bp, Artificial Sequence
  chemically synthesized
catagccagcaaacgaggca

SEQ ID NO: 614884 - DNA, 20 bp, Artificial Sequence
  chemically synthesized
acctctaataaaacccaatg

SEQ ID NO: 614885 - DNA, 20 bp, Artificial Sequence
  chemically synthesized
acgaggcattgggttttatt

SEQ ID NO: 614886 - DNA, 20 bp, Artificial Sequence
  chemically synthesized
tgtccagtctgccaccactg

SEQ ID NO: 614887 - DNA, 20 bp, Artificial Sequence
  chemically synthesized
gggatgagcgggcaaaccaa

SEQ ID NO: 614888 - DNA, 20 bp, Artificial Sequence
  chemically synthesized
gcatgctgcccgcaagcagc

SEQ ID NO: 614889 - DNA, 20 bp, Artificial Sequence
  chemically synthesized
aacgctgcttgcgggcagca

SEQ ID NO: 614890 - DNA, 20 bp, Artificial Sequence
  chemically synthesized
acatacagcggattgaggcc

SEQ ID NO: 614891 - DNA, 20 bp, Artificial Sequence
  chemically synthesized
ggaacacgggccatacatac

SEQ ID NO: 614892 - DNA, 20 bp, Artificial Sequence
  chemically synthesized
ggctctcttgctgggctact

SEQ ID NO: 614893 - DNA, 20 bp, Artificial Sequence
  chemically synthesized
tgtactgcagacacacctga

SEQ ID NO: 614894 - DNA, 20 bp, Artificial Sequence
  chemically synthesized
atcaagtatatggtaaatgc

SEQ ID NO: 614895 - DNA, 20 bp, Artificial Sequence
  chemically synthesized
atcaggtgcatttaccatat

SEQ ID NO: 614896 - DNA, 20 bp, Artificial Sequence
  chemically synthesized
acctatcttactggttatgt

SEQ ID NO: 614897 - DNA, 20 bp, Artificial Sequence
  chemically synthesized
gtgtacgtgtgtgtatgcat

SEQ ID NO: 614898 - DNA, 20 bp, Artificial Sequence
  chemically synthesized
taacaagataccatagactg

SEQ ID NO: 614899 - DNA, 20 bp, Artificial Sequence
  chemically synthesized
actgtgagaaaataaatttc

SEQ ID NO: 614900 - DNA, 20 bp, Artificial Sequence
  chemically synthesized
atttattttctcacagttct

SEQ ID NO: 614901 - DNA, 20 bp, Artificial Sequence
  chemically synthesized
gtgaggacacaggagaaggt

SEQ ID NO: 614902 - DNA, 20 bp, Artificial Sequence
  chemically synthesized
gaaaacaccagagagcttgc

SEQ ID NO: 614903 - DNA, 20 bp, Artificial Sequence
  chemically synthesized
caaagcaagagcaagctctc

SEQ ID NO: 614904 - DNA, 20 bp, Artificial Sequence
  chemically synthesized
cccgtgtaaagaaaacacca

SEQ ID NO: 614905 - DNA, 20 bp, Artificial Sequence
  chemically synthesized
cggatcagagccccacctgc

SEQ ID NO: 614906 - DNA, 20 bp, Artificial Sequence
  chemically synthesized
aatatcgtcccattgggggt

SEQ ID NO: 614907 - DNA, 20 bp, Artificial Sequence
  chemically synthesized
tgttgttatggactgactat

SEQ ID NO: 614908 - DNA, 20 bp, Artificial Sequence
  chemically synthesized
aagaaaatattactgtataa

SEQ ID NO: 614909 - DNA, 20 bp, Artificial Sequence
  chemically synthesized
tatatgaaagtgacaaagca

SEQ ID NO: 614910 - DNA, 20 bp, Artificial Sequence
  chemically synthesized
tggtattacaatactaaacc

SEQ ID NO: 614911 - DNA, 20 bp, Artificial Sequence
  chemically synthesized
ttagtattgtaataccatga

SEQ ID NO: 614912 - DNA, 20 bp, Artificial Sequence
  chemically synthesized
caaacccactcctacacgaa

SEQ ID NO: 614913 - DNA, 20 bp, Artificial Sequence
  chemically synthesized
aaatcttccttcgtgtagga

SEQ ID NO: 614914 - DNA, 20 bp, Artificial Sequence
  chemically synthesized
ttactgtgctaatccacacc

SEQ ID NO: 614915 - DNA, 20 bp, Artificial Sequence
  chemically synthesized
ttgacgcccaaaactccagg

SEQ ID NO: 614916 - DNA, 20 bp, Artificial Sequence
  chemically synthesized
cgtcaaggttgataagggtc

SEQ ID NO: 614917 - DNA, 20 bp, Artificial Sequence
  chemically synthesized
ggttgataagggtcaagggt

SEQ ID NO: 614918 - DNA, 20 bp, Artificial Sequence
  chemically synthesized
tcaagggtttgggttttggc

SEQ ID NO: 614919 - DNA, 20 bp, Artificial Sequence
  chemically synthesized
tttggctctggcttgtggaa

SEQ ID NO: 614920 - DNA, 20 bp, Artificial Sequence
  chemically synthesized
acactcccattccaatggga

SEQ ID NO: 614921 - DNA, 20 bp, Artificial Sequence
  chemically synthesized
cttgtattgccttatataca

SEQ ID NO: 614922 - DNA, 20 bp, Artificial Sequence
  chemically synthesized
taaggcaatacaagaaacct

SEQ ID NO: 614923 - DNA, 20 bp, Artificial Sequence
  chemically synthesized
ttgctaaggcctggaagcct

SEQ ID NO: 614924 - DNA, 20 bp, Artificial Sequence
  chemically synthesized
ttagcaagaagaattggagt

SEQ ID NO: 614925 - DNA, 20 bp, Artificial Sequence
  chemically synthesized
tcaattagaaaatgttccag

SEQ ID NO: 614926 - DNA, 20 bp, Artificial Sequence
  chemically synthesized
ttatatattcggctgaggtt

SEQ ID NO: 614927 - DNA, 20 bp, Artificial Sequence
  chemically synthesized
tcaaggatgctgagctggct

SEQ ID NO: 614928 - DNA, 20 bp, Artificial Sequence
  chemically synthesized
taagattacaagactagcaa

SEQ ID NO: 614929 - DNA, 20 bp, Artificial Sequence
  chemically synthesized
attttctcttatgaacaatt

SEQ ID NO: 614930 - DNA, 20 bp, Artificial Sequence
  chemically synthesized
cagtctagaggaagagatca

SEQ ID NO: 614931 - DNA, 20 bp, Artificial Sequence
  chemically synthesized
tctagtttactgggaactag

SEQ ID NO: 614932 - DNA, 20 bp, Artificial Sequence
  chemically synthesized
actagtaatgcttatcttgc

SEQ ID NO: 614933 - DNA, 20 bp, Artificial Sequence
  chemically synthesized
ttctgctcagaggctgtgct

SEQ ID NO: 614934 - DNA, 20 bp, Artificial Sequence
  chemically synthesized
tctgagcagaaactgtatac

SEQ ID NO: 614935 - DNA, 20 bp, Artificial Sequence
  chemically synthesized
tgtgtacataaacctctgta

SEQ ID NO: 614936 - DNA, 20 bp, Artificial Sequence
  chemically synthesized
gaattagatgtgctgtgccc

SEQ ID NO: 614937 - DNA, 20 bp, Artificial Sequence
  chemically synthesized
ctaaggagtagggtgttctc

SEQ ID NO: 614938 - DNA, 20 bp, Artificial Sequence
  chemically synthesized
acccagagcagtctgctgta

SEQ ID NO: 614939 - DNA, 20 bp, Artificial Sequence
  chemically synthesized
gtatgctatgatcaaatccc

SEQ ID NO: 614940 - DNA, 20 bp, Artificial Sequence
  chemically synthesized
taccctaggggtgtaatcaa

SEQ ID NO: 614941 - DNA, 20 bp, Artificial Sequence
  chemically synthesized
cccctagggtataataggag

SEQ ID NO: 614942 - DNA, 20 bp, Artificial Sequence
  chemically synthesized
ctttcatcatacagaaagta

SEQ ID NO: 614943 - DNA, 20 bp, Artificial Sequence
  chemically synthesized
atggctatttttatccataa

SEQ ID NO: 614944 - DNA, 20 bp, Artificial Sequence
  chemically synthesized
aaggctcatcagcaatgcac

SEQ ID NO: 614945 - DNA, 20 bp, Artificial Sequence
  chemically synthesized
ttccaattctacatgtgact

SEQ ID NO: 614946 - DNA, 20 bp, Artificial Sequence
  chemically synthesized
ctcaaggcaacgtggcctct

SEQ ID NO: 614947 - DNA, 20 bp, Artificial Sequence
  chemically synthesized
cgttgccttgagggctaacc

SEQ ID NO: 614948 - DNA, 20 bp, Artificial Sequence
  chemically synthesized
cagtagtgtgtcttttaggg

SEQ ID NO: 614949 - DNA, 20 bp, Artificial Sequence
  chemically synthesized
gacaccaattgttttgttac

SEQ ID NO: 614950 - DNA, 20 bp, Artificial Sequence
  chemically synthesized
ctggagtgttacgtgacacc

SEQ ID NO: 614951 - DNA, 20 bp, Artificial Sequence
  chemically synthesized
tgcacatttaacatcctata

SEQ ID NO: 614952 - DNA, 20 bp, Artificial Sequence
  chemically synthesized
ttttgtcattgtaaaatgag

SEQ ID NO: 614953 - DNA, 20 bp, Artificial Sequence
  chemically synthesized
ttacaatgacaaaatgaaca

SEQ ID NO: 614954 - DNA, 20 bp, Artificial Sequence
  chemically synthesized
aaatgaacacttagttttca

SEQ ID NO: 614955 - DNA, 20 bp, Artificial Sequence
  chemically synthesized
cagctgcaaggaaaatattt

SEQ ID NO: 614956 - DNA, 20 bp, Artificial Sequence
  chemically synthesized
aggaaaatatttttcagatt

SEQ ID NO: 614957 - DNA, 20 bp, Artificial Sequence
  chemically synthesized
atatttgttgtttcaattgc

SEQ ID NO: 614958 - DNA, 20 bp, Artificial Sequence
  chemically synthesized
aacactttgtcctgaatatt

SEQ ID NO: 614959 - DNA, 20 bp, Artificial Sequence
  chemically synthesized
aacaacaaatattcaggaca

SEQ ID NO: 614960 - DNA, 20 bp, Artificial Sequence
  chemically synthesized
tgtttatagccctttctttt

SEQ ID NO: 614961 - DNA, 20 bp, Artificial Sequence
  chemically synthesized
agggttttcacattgaggaa

SEQ ID NO: 614962 - DNA, 20 bp, Artificial Sequence
  chemically synthesized
ttttgtaattgctgttattc

SEQ ID NO: 614963 - DNA, 20 bp, Artificial Sequence
  chemically synthesized
catcaacgactgggcatttt

SEQ ID NO: 614964 - DNA, 20 bp, Artificial Sequence
  chemically synthesized
tattaaatatgcccttaaaa

SEQ ID NO: 614965 - DNA, 20 bp, Artificial Sequence
  chemically synthesized
ataagtagactgaggaacaa

SEQ ID NO: 614966 - DNA, 20 bp, Artificial Sequence
  chemically synthesized
tacttattagaagttcaaaa

SEQ ID NO: 614967 - DNA, 20 bp, Artificial Sequence
  chemically synthesized
aaactggatttgaaccaaag

SEQ ID NO: 614968 - DNA, 20 bp, Artificial Sequence
  chemically synthesized
aaacaaggctttggttcaaa

SEQ ID NO: 614969 - DNA, 20 bp, Artificial Sequence
  chemically synthesized
ttaagaaatttatctcagaa

SEQ ID NO: 614970 - DNA, 20 bp, Artificial Sequence
  chemically synthesized
attaatggtgaccaaaattt

SEQ ID NO: 614971 - DNA, 20 bp, Artificial Sequence
  chemically synthesized
ctgtttgttctgattacctg

SEQ ID NO: 614972 - DNA, 20 bp, Artificial Sequence
  chemically synthesized
gttctttttattcctgtttg

SEQ ID NO: 614973 - DNA, 20 bp, Artificial Sequence
  chemically synthesized
ttactctttgttctttttat

SEQ ID NO: 614974 - DNA, 20 bp, Artificial Sequence
  chemically synthesized
tgaagaggtgaagggaaaag

SEQ ID NO: 614975 - DNA, 20 bp, Artificial Sequence
  chemically synthesized
ctttatctgaaaataaaaat

SEQ ID NO: 614976 - DNA, 20 bp, Artificial Sequence
  chemically synthesized
atgtcatagattttctctac

SEQ ID NO: 614977 - DNA, 20 bp, Artificial Sequence
  chemically synthesized
atgaaagactctcctaatgt

SEQ ID NO: 614978 - DNA, 20 bp, Artificial Sequence
  chemically synthesized
agtctttcatttaaaaacct

SEQ ID NO: 614979 - DNA, 20 bp, Artificial Sequence
  chemically synthesized
aaccctcctacctaaaacta

SEQ ID NO: 614980 - DNA, 20 bp, Artificial Sequence
  chemically synthesized
aatttggattgaacaagtat

SEQ ID NO: 614981 - DNA, 20 bp, Artificial Sequence
  chemically synthesized
acagaacaattaatggataa

SEQ ID NO: 614982 - DNA, 20 bp, Artificial Sequence
  chemically synthesized
aattatccattaattgttct

SEQ ID NO: 614983 - DNA, 20 bp, Artificial Sequence
  chemically synthesized
ttaattgttctgtctgattt

SEQ ID NO: 614984 - DNA, 20 bp, Artificial Sequence
  chemically synthesized
catcaaataaatatcatttt

SEQ ID NO: 614985 - DNA, 20 bp, Artificial Sequence
  chemically synthesized
attatataacaacagttggc

SEQ ID NO: 614986 - DNA, 20 bp, Artificial Sequence
  chemically synthesized
tcgaaaaagttggtatgccc

SEQ ID NO: 614987 - DNA, 20 bp, Artificial Sequence
  chemically synthesized
ttggtatgcccaaaggctta

SEQ ID NO: 614988 - DNA, 20 bp, Artificial Sequence
  chemically synthesized
agaataaagaaaaagaaatg

SEQ ID NO: 614989 - DNA, 20 bp, Artificial Sequence
  chemically synthesized
tagtatgaacacacattttg

SEQ ID NO: 614990 - DNA, 20 bp, Artificial Sequence
  chemically synthesized
ctgttaagaagccttagttc

SEQ ID NO: 614991 - DNA, 20 bp, Artificial Sequence
  chemically synthesized
tgtctactaatccattgaac

SEQ ID NO: 614992 - DNA, 20 bp, Artificial Sequence
  chemically synthesized
agaatactatgagattctca

SEQ ID NO: 614993 - DNA, 20 bp, Artificial Sequence
  chemically synthesized
ctttattttggcagaatact

SEQ ID NO: 614994 - DNA, 20 bp, Artificial Sequence
  chemically synthesized
tgtgatgctatttagcaagg

SEQ ID NO: 614995 - DNA, 20 bp, Artificial Sequence
  chemically synthesized
ataaaatgataattctacat

SEQ ID NO: 614996 - DNA, 20 bp, Artificial Sequence
  chemically synthesized
agaattatcattttattttt

SEQ ID NO: 614997 - DNA, 20 bp, Artificial Sequence
  chemically synthesized
ccaccaaaagccaagaataa

SEQ ID NO: 614998 - DNA, 20 bp, Artificial Sequence
  chemically synthesized
tccttcaaagcaattttatt

SEQ ID NO: 614999 - DNA, 20 bp, Artificial Sequence
  chemically synthesized
gaaggataattgttaaatgg

SEQ ID NO: 615000 - DNA, 20 bp, Artificial Sequence
  chemically synthesized
ctatggaccgtgttctgatg

SEQ ID NO: 615001 - DNA, 20 bp, Artificial Sequence
  chemically synthesized
agtaaataaaagcaagacac

SEQ ID NO: 615002 - DNA, 20 bp, Artificial Sequence
  chemically synthesized
tgacttccaaaacgccagtg

SEQ ID NO: 615003 - DNA, 20 bp, Artificial Sequence
  chemically synthesized
ctggcgttttggaagtcaaa

SEQ ID NO: 615004 - DNA, 20 bp, Artificial Sequence
  chemically synthesized
cccaggaacttcttcagaat

SEQ ID NO: 615005 - DNA, 20 bp, Artificial Sequence
  chemically synthesized
gcctctctaatatctaaaac

SEQ ID NO: 615006 - DNA, 20 bp, Artificial Sequence
  chemically synthesized
aatggctaccagttcaaatc

SEQ ID NO: 615007 - DNA, 20 bp, Artificial Sequence
  chemically synthesized
tcaggcctgagatacatttg

SEQ ID NO: 615008 - DNA, 20 bp, Artificial Sequence
  chemically synthesized
gacaggttaagccccaaaat

SEQ ID NO: 615009 - DNA, 20 bp, Artificial Sequence
  chemically synthesized
cccaggccaagccctgattt

SEQ ID NO: 615010 - DNA, 20 bp, Artificial Sequence
  chemically synthesized
aagaatcctcccaggccaag

SEQ ID NO: 615011 - DNA, 20 bp, Artificial Sequence
  chemically synthesized
caaaatcagggcttggcctg

SEQ ID NO: 615012 - DNA, 20 bp, Artificial Sequence
  chemically synthesized
gggcttggcctgggaggatt

SEQ ID NO: 615013 - DNA, 20 bp, Artificial Sequence
  chemically synthesized
gagccagtggcgttaaacag

SEQ ID NO: 615014 - DNA, 20 bp, Artificial Sequence
  chemically synthesized
agtaatgttcactaaaacat

SEQ ID NO: 615015 - DNA, 20 bp, Artificial Sequence
  chemically synthesized
ctatgttttagtgaacatta

SEQ ID NO: 615016 - DNA, 20 bp, Artificial Sequence
  chemically synthesized
caattacatgtaaattaagt

SEQ ID NO: 615017 - DNA, 20 bp, Artificial Sequence
  chemically synthesized
gccactcccaccagcaccat

SEQ ID NO: 615018 - DNA, 20 bp, Artificial Sequence
  chemically synthesized
actgtcatggtgctggtggg

SEQ ID NO: 615019 - DNA, 20 bp, Artificial Sequence
  chemically synthesized
gatcacttttgttgccatct

SEQ ID NO: 615020 - DNA, 20 bp, Artificial Sequence
  chemically synthesized
tgttgccatctgctggtttc

SEQ ID NO: 615021 - DNA, 20 bp, Artificial Sequence
  chemically synthesized
gtcgctgcctgctggtacct

SEQ ID NO: 615022 - DNA, 20 bp, Artificial Sequence
  chemically synthesized
agtcctgcccaactcctacc

SEQ ID NO: 615023 - DNA, 20 bp, Artificial Sequence
  chemically synthesized
tatttggtgggtaactggaa

SEQ ID NO: 615024 - DNA, 20 bp, Artificial Sequence
  chemically synthesized
tatatatcaggcactgttcc

SEQ ID NO: 615025 - DNA, 20 bp, Artificial Sequence
  chemically synthesized
tcaggcactgttccaagtgc

SEQ ID NO: 615026 - DNA, 20 bp, Artificial Sequence
  chemically synthesized
ggcaaatatatagtgcactg

SEQ ID NO: 615027 - DNA, 20 bp, Artificial Sequence
  chemically synthesized
tgggatgttttacatacaac

SEQ ID NO: 615028 - DNA, 20 bp, Artificial Sequence
  chemically synthesized
acatggacactgctagactg

SEQ ID NO: 615029 - DNA, 20 bp, Artificial Sequence
  chemically synthesized
atgtccgtatgcatttagat

SEQ ID NO: 615030 - DNA, 20 bp, Artificial Sequence
  chemically synthesized
attattttattttatttcag

SEQ ID NO: 615031 - DNA, 20 bp, Artificial Sequence
  chemically synthesized
cagtttgtatcattttgagt

SEQ ID NO: 615032 - DNA, 20 bp, Artificial Sequence
  chemically synthesized
atttagtataatatcataga

SEQ ID NO: 615033 - DNA, 20 bp, Artificial Sequence
  chemically synthesized
cgcctcagcctcccaaagtg

SEQ ID NO: 615034 - DNA, 20 bp, Artificial Sequence
  chemically synthesized
ttttgtatttttagtagcga

SEQ ID NO: 615035 - DNA, 20 bp, Artificial Sequence
  chemically synthesized
aacctctgcctcccaggttc

SEQ ID NO: 615036 - DNA, 20 bp, Artificial Sequence
  chemically synthesized
aagaaaaagaaagaaagaaa

SEQ ID NO: 615037 - DNA, 20 bp, Artificial Sequence
  chemically synthesized
ttaattctaatgcagaatgt

SEQ ID NO: 615038 - DNA, 20 bp, Artificial Sequence
  chemically synthesized
aaaaaacatgtttaaattta

SEQ ID NO: 615039 - DNA, 20 bp, Artificial Sequence
  chemically synthesized
aataagctaaataaatttaa

SEQ ID NO: 615040 - DNA, 20 bp, Artificial Sequence
  chemically synthesized
gaccacacagagtttaaaaa

SEQ ID NO: 615041 - DNA, 20 bp, Artificial Sequence
  chemically synthesized
gagaatatatttggaccaca

SEQ ID NO: 615042 - DNA, 20 bp, Artificial Sequence
  chemically synthesized
aaatatattctcagtaaagt

SEQ ID NO: 615043 - DNA, 20 bp, Artificial Sequence
  chemically synthesized
agtaagagtttgacttattt

SEQ ID NO: 615044 - DNA, 20 bp, Artificial Sequence
  chemically synthesized
tacagcagctcaactgaatt

SEQ ID NO: 615045 - DNA, 20 bp, Artificial Sequence
  chemically synthesized
ttcagttgagctgctgtaat

SEQ ID NO: 615046 - DNA, 20 bp, Artificial Sequence
  chemically synthesized
ttatgctatatatttttaaa

SEQ ID NO: 615047 - DNA, 20 bp, Artificial Sequence
  chemically synthesized
ggttttgttgataaaaaaaa

SEQ ID NO: 615048 - DNA, 20 bp, Artificial Sequence
  chemically synthesized
aaaagaaagtttgtgaacca

SEQ ID NO: 615049 - DNA, 20 bp, Artificial Sequence
  chemically synthesized
tctcctacaaatttaaactt

SEQ ID NO: 615050 - DNA, 20 bp, Artificial Sequence
  chemically synthesized
tttgattagtgttaaatcac

SEQ ID NO: 615051 - DNA, 20 bp, Artificial Sequence
  chemically synthesized
aaataggaataccgatttgc

SEQ ID NO: 615052 - DNA, 20 bp, Artificial Sequence
  chemically synthesized
aaagttaaataggaataccg

SEQ ID NO: 615053 - DNA, 20 bp, Artificial Sequence
  chemically synthesized
tataaaaagttaaataggaa

SEQ ID NO: 615054 - DNA, 20 bp, Artificial Sequence
  chemically synthesized
cttaattgacactatggaag

SEQ ID NO: 615055 - DNA, 20 bp, Artificial Sequence
  chemically synthesized
atgtattttcagcaaatatt

SEQ ID NO: 615056 - DNA, 20 bp, Artificial Sequence
  chemically synthesized
gggaagggtggcatgtggag

SEQ ID NO: 615057 - DNA, 20 bp, Artificial Sequence
  chemically synthesized
ctttaagagaagggccctca

SEQ ID NO: 615058 - DNA, 20 bp, Artificial Sequence
  chemically synthesized
cctcactctgtttcccaggc

SEQ ID NO: 615059 - DNA, 20 bp, Artificial Sequence
  chemically synthesized
tcaggaggctgaggcagttg

SEQ ID NO: 615060 - DNA, 20 bp, Artificial Sequence
  chemically synthesized
tggtaggattgcttgtgtcc

SEQ ID NO: 615061 - DNA, 20 bp, Artificial Sequence
  chemically synthesized
ttgggaggctgaggtggtag

SEQ ID NO: 615062 - DNA, 20 bp, Artificial Sequence
  chemically synthesized
agttttgggaggctgaggtg

SEQ ID NO: 615063 - DNA, 20 bp, Artificial Sequence
  chemically synthesized
cacctcagcctcccaaaact

SEQ ID NO: 615064 - DNA, 20 bp, Artificial Sequence
  chemically synthesized
gtggcttgtgcttgtaatcc

SEQ ID NO: 615065 - DNA, 20 bp, Artificial Sequence
  chemically synthesized
agggggctgggtgtggtggc

SEQ ID NO: 615066 - DNA, 20 bp, Artificial Sequence
  chemically synthesized
agaaatagggggctgggtgt

SEQ ID NO: 615067 - DNA, 20 bp, Artificial Sequence
  chemically synthesized
agccccctatttcttaagtg

SEQ ID NO: 615068 - DNA, 20 bp, Artificial Sequence
  chemically synthesized
catttgctatagatgtacat

SEQ ID NO: 615069 - DNA, 20 bp, Artificial Sequence
  chemically synthesized
tttaacaaaatatctttact

SEQ ID NO: 615070 - DNA, 20 bp, Artificial Sequence
  chemically synthesized
cgaataagccaaaatgatga

SEQ ID NO: 615071 - DNA, 20 bp, Artificial Sequence
  chemically synthesized
ataacaagcattttcatcat

SEQ ID NO: 615072 - DNA, 20 bp, Artificial Sequence
  chemically synthesized
agctgcttactgccttacat

SEQ ID NO: 615073 - DNA, 20 bp, Artificial Sequence
  chemically synthesized
tttggagttattggaagagt

SEQ ID NO: 615074 - DNA, 20 bp, Artificial Sequence
  chemically synthesized
aataactccaaaagatgaaa

SEQ ID NO: 615075 - DNA, 20 bp, Artificial Sequence
  chemically synthesized
taccactgactacattacag

SEQ ID NO: 615076 - DNA, 20 bp, Artificial Sequence
  chemically synthesized
aaatataccactgactacat

SEQ ID NO: 615077 - DNA, 20 bp, Artificial Sequence
  chemically synthesized
ttttgaaagaaaagtaaaac

SEQ ID NO: 615078 - DNA, 20 bp, Artificial Sequence
  chemically synthesized
aaagaaaagtaaaactatag

SEQ ID NO: 615079 - DNA, 20 bp, Artificial Sequence
  chemically synthesized
cttttataaataatcaaaac

SEQ ID NO: 615080 - DNA, 20 bp, Artificial Sequence
  chemically synthesized
caaattttccacagtataaa

SEQ ID NO: 615081 - DNA, 20 bp, Artificial Sequence
  chemically synthesized
aaaaagaattgtagtaagaa

SEQ ID NO: 615082 - DNA, 20 bp, Artificial Sequence
  chemically synthesized
tagcaaattgcttggctgac

SEQ ID NO: 615083 - DNA, 20 bp, Artificial Sequence
  chemically synthesized
tttgagagttctcaatagca

SEQ ID NO: 615084 - DNA, 20 bp, Artificial Sequence
  chemically synthesized
gtttgaaaattgtatttaat

SEQ ID NO: 615085 - DNA, 20 bp, Artificial Sequence
  chemically synthesized
aaatacaattttcaaacata

SEQ ID NO: 615086 - DNA, 20 bp, Artificial Sequence
  chemically synthesized
tttgtgtttcaaaaaactgg

SEQ ID NO: 615087 - DNA, 20 bp, Artificial Sequence
  chemically synthesized
ttttgaaacacaaattttaa

SEQ ID NO: 615088 - DNA, 20 bp, Artificial Sequence
  chemically synthesized
ttcaaaagcaaagttaaaat

SEQ ID NO: 615089 - DNA, 20 bp, Artificial Sequence
  chemically synthesized
agttaggtaatttctcatca

SEQ ID NO: 615090 - DNA, 20 bp, Artificial Sequence
  chemically synthesized
taaatatcagcattataagc

SEQ ID NO: 615091 - DNA, 20 bp, Artificial Sequence
  chemically synthesized
ataaaactaggttttgaaac

SEQ ID NO: 615092 - DNA, 20 bp, Artificial Sequence
  chemically synthesized
tataagcagctgtttcaaaa

SEQ ID NO: 615093 - DNA, 20 bp, Artificial Sequence
  chemically synthesized
agggcacatgttgcataaaa

SEQ ID NO: 615094 - DNA, 20 bp, Artificial Sequence
  chemically synthesized
ttttctatatgatcgtaatt

SEQ ID NO: 615095 - DNA, 20 bp, Artificial Sequence
  chemically synthesized
ttataaaatagaaaaataaa

SEQ ID NO: 615096 - DNA, 20 bp, Artificial Sequence
  chemically synthesized
ttcagacactctatactaaa

SEQ ID NO: 615097 - DNA, 20 bp, Artificial Sequence
  chemically synthesized
gtcgtcctccgcaactgacc

SEQ ID NO: 615098 - DNA, 20 bp, Artificial Sequence
  chemically synthesized
atatcctttcatctactttt

SEQ ID NO: 615099 - DNA, 20 bp, Artificial Sequence
  chemically synthesized
tcatctacttttatctgttt

SEQ ID NO: 615100 - DNA, 20 bp, Artificial Sequence
  chemically synthesized
gtttcctagtaaattataag

SEQ ID NO: 615101 - DNA, 20 bp, Artificial Sequence
  chemically synthesized
ccaaagattaagggtgtaat

SEQ ID NO: 615102 - DNA, 20 bp, Artificial Sequence
  chemically synthesized
cagtgattacacccttaatc

SEQ ID NO: 615103 - DNA, 20 bp, Artificial Sequence
  chemically synthesized
tttatacttttccataaagc

SEQ ID NO: 615104 - DNA, 20 bp, Artificial Sequence
  chemically synthesized
ggaaaagtataaaatcgctc

SEQ ID NO: 615105 - DNA, 20 bp, Artificial Sequence
  chemically synthesized
acagtcataataaaactgaa

SEQ ID NO: 615106 - DNA, 20 bp, Artificial Sequence
  chemically synthesized
attggccaaaatgtaatagc

SEQ ID NO: 615107 - DNA, 20 bp, Artificial Sequence
  chemically synthesized
tattcttacaaaaattaata

SEQ ID NO: 615108 - DNA, 20 bp, Artificial Sequence
  chemically synthesized
tgtgtttgtgtgtgtgtgat

SEQ ID NO: 615109 - DNA, 20 bp, Artificial Sequence
  chemically synthesized
tgtgtgtgtttgtgtgtgtg

SEQ ID NO: 615110 - DNA, 20 bp, Artificial Sequence
  chemically synthesized
gtgtgtgtgtgtgtgtgtgt

SEQ ID NO: 615111 - DNA, 20 bp, Artificial Sequence
  chemically synthesized
tgagtcagtgaagaaaatgt

SEQ ID NO: 615112 - DNA, 20 bp, Artificial Sequence
  chemically synthesized
gtcacaagtaaaaatttaca

SEQ ID NO: 615113 - DNA, 20 bp, Artificial Sequence
  chemically synthesized
aatatttttcttctaatgca

SEQ ID NO: 615114 - DNA, 20 bp, Artificial Sequence
  chemically synthesized
tttgataaaacaagtggtaa

SEQ ID NO: 615115 - DNA, 20 bp, Artificial Sequence
  chemically synthesized
gttaattaaactgagttacc

SEQ ID NO: 615116 - DNA, 20 bp, Artificial Sequence
  chemically synthesized
tgggatactcctatgccagg

SEQ ID NO: 615117 - DNA, 20 bp, Artificial Sequence
  chemically synthesized
ttaatgagttatattgaact

SEQ ID NO: 615118 - DNA, 20 bp, Artificial Sequence
  chemically synthesized
cttgtatcatgcatactaaa

SEQ ID NO: 615119 - DNA, 20 bp, Artificial Sequence
  chemically synthesized
ccatctttagtatgcatgat

SEQ ID NO: 615120 - DNA, 20 bp, Artificial Sequence
  chemically synthesized
ccatttctttttatagaaat

SEQ ID NO: 615121 - DNA, 20 bp, Artificial Sequence
  chemically synthesized
tttctataaaaagaaatggc

SEQ ID NO: 615122 - DNA, 20 bp, Artificial Sequence
  chemically synthesized
ataaaaagaaatggcaaaag

SEQ ID NO: 615123 - DNA, 20 bp, Artificial Sequence
  chemically synthesized
agctgacaagtgtcttttta

SEQ ID NO: 615124 - DNA, 20 bp, Artificial Sequence
  chemically synthesized
ttttctctttctcctatata

SEQ ID NO: 615125 - DNA, 20 bp, Artificial Sequence
  chemically synthesized
agaaagagaaaaaaggtaaa

SEQ ID NO: 615126 - DNA, 20 bp, Artificial Sequence
  chemically synthesized
aagctgttttcctatatcaa

SEQ ID NO: 615127 - DNA, 20 bp, Artificial Sequence
  chemically synthesized
aaacatgattgatataggaa

SEQ ID NO: 615128 - DNA, 20 bp, Artificial Sequence
  chemically synthesized
ccatacaatttataatgtaa

SEQ ID NO: 615129 - DNA, 20 bp, Artificial Sequence
  chemically synthesized
aatttctttatagtttcttg

SEQ ID NO: 615130 - DNA, 20 bp, Artificial Sequence
  chemically synthesized
cgcacctggccaaatttctt

SEQ ID NO: 615131 - DNA, 20 bp, Artificial Sequence
  chemically synthesized
cgccttggcctcccaaagtg

SEQ ID NO: 615132 - DNA, 20 bp, Artificial Sequence
  chemically synthesized
cgggtggatcacccgaggtc

SEQ ID NO: 615133 - DNA, 20 bp, Artificial Sequence
  chemically synthesized
ttttgtatttttagtagaga

SEQ ID NO: 615134 - DNA, 20 bp, Artificial Sequence
  chemically synthesized
actaaaaatacaaaaattag

SEQ ID NO: 615135 - DNA, 20 bp, Artificial Sequence
  chemically synthesized
aacctccgcctcccgggttc

SEQ ID NO: 615136 - DNA, 20 bp, Artificial Sequence
  chemically synthesized
ataataaatgaaaatttctt

SEQ ID NO: 615137 - DNA, 20 bp, Artificial Sequence
  chemically synthesized
tcatttattatcagcaacta

SEQ ID NO: 615138 - DNA, 20 bp, Artificial Sequence
  chemically synthesized
acataccagtcttcccctct

SEQ ID NO: 615139 - DNA, 20 bp, Artificial Sequence
  chemically synthesized
tctttgtttcttctgaagag

SEQ ID NO: 615140 - DNA, 20 bp, Artificial Sequence
  chemically synthesized
cattgcaattattcaaaagt

SEQ ID NO: 615141 - DNA, 20 bp, Artificial Sequence
  chemically synthesized
gcacaaaatgccctttgtaa

SEQ ID NO: 615142 - DNA, 20 bp, Artificial Sequence
  chemically synthesized
gggcattttgtgcaatgctg

SEQ ID NO: 615143 - DNA, 20 bp, Artificial Sequence
  chemically synthesized
ccaatgctttaacgtttccc

SEQ ID NO: 615144 - DNA, 20 bp, Artificial Sequence
  chemically synthesized
ctgtagggaaacgttaaagc

SEQ ID NO: 615145 - DNA, 20 bp, Artificial Sequence
  chemically synthesized
aggcttggaaaccaatgctt

SEQ ID NO: 615146 - DNA, 20 bp, Artificial Sequence
  chemically synthesized
gctcagctaggcttggaaac

SEQ ID NO: 615147 - DNA, 20 bp, Artificial Sequence
  chemically synthesized
tgggtaactgtaatgctcag

SEQ ID NO: 615148 - DNA, 20 bp, Artificial Sequence
  chemically synthesized
ctgagcattacagttaccca

SEQ ID NO: 615149 - DNA, 20 bp, Artificial Sequence
  chemically synthesized
cactcccagtccctcatacc

SEQ ID NO: 615150 - DNA, 20 bp, Artificial Sequence
  chemically synthesized
cagtccctcatacccagaga

SEQ ID NO: 615151 - DNA, 20 bp, Artificial Sequence
  chemically synthesized
aatttatcttgggtggagcc

SEQ ID NO: 615152 - DNA, 20 bp, Artificial Sequence
  chemically synthesized
aggttgctaacggctgtgtt

SEQ ID NO: 615153 - DNA, 20 bp, Artificial Sequence
  chemically synthesized
gattttaagtaaactacaca

SEQ ID NO: 615154 - DNA, 20 bp, Artificial Sequence
  chemically synthesized
ccacaatataaatctgattg

SEQ ID NO: 615155 - DNA, 20 bp, Artificial Sequence
  chemically synthesized
gtgttcattccacaatataa

SEQ ID NO: 615156 - DNA, 20 bp, Artificial Sequence
  chemically synthesized
caaaatcagtctaaatactg

SEQ ID NO: 615157 - DNA, 20 bp, Artificial Sequence
  chemically synthesized
actaatcctggcagtattta

SEQ ID NO: 615158 - DNA, 20 bp, Artificial Sequence
  chemically synthesized
tttggaatagactaaactgc

SEQ ID NO: 615159 - DNA, 20 bp, Artificial Sequence
  chemically synthesized
taatatcataagaaatccag

SEQ ID NO: 615160 - DNA, 20 bp, Artificial Sequence
  chemically synthesized
ctccttatccatccttacta

SEQ ID NO: 615161 - DNA, 20 bp, Artificial Sequence
  chemically synthesized
taaggagtgggagtggcatt

SEQ ID NO: 615162 - DNA, 20 bp, Artificial Sequence
  chemically synthesized
acacgagaagcaagatatca

SEQ ID NO: 615163 - DNA, 20 bp, Artificial Sequence
  chemically synthesized
tatttataatcactatgata

SEQ ID NO: 615164 - DNA, 20 bp, Artificial Sequence
  chemically synthesized
caacaacaaagtggcaggag

SEQ ID NO: 615165 - DNA, 20 bp, Artificial Sequence
  chemically synthesized
atccattattaacttcctta

SEQ ID NO: 615166 - DNA, 20 bp, Artificial Sequence
  chemically synthesized
ccagcacatttactgagaca

SEQ ID NO: 615167 - DNA, 20 bp, Artificial Sequence
  chemically synthesized
ggatgaataagagggaaagg

SEQ ID NO: 615168 - DNA, 20 bp, Artificial Sequence
  chemically synthesized
aataagagggaaaggtgtag

SEQ ID NO: 615169 - DNA, 20 bp, Artificial Sequence
  chemically synthesized
tatattttatattttaagaa

SEQ ID NO: 615170 - DNA, 20 bp, Artificial Sequence
  chemically synthesized
ttattgagtcacttatgact

SEQ ID NO: 615171 - DNA, 20 bp, Artificial Sequence
  chemically synthesized
tgtaagtcataagtgactca

SEQ ID NO: 615172 - DNA, 20 bp, Artificial Sequence
  chemically synthesized
ggtatgaagtttagataatg

SEQ ID NO: 615173 - DNA, 20 bp, Artificial Sequence
  chemically synthesized
gacatgacttgaaaggggta

SEQ ID NO: 615174 - DNA, 20 bp, Artificial Sequence
  chemically synthesized
gggtatttatttggcccact

SEQ ID NO: 615175 - DNA, 20 bp, Artificial Sequence
  chemically synthesized
aatgtttagaaatagcaaga

SEQ ID NO: 615176 - DNA, 20 bp, Artificial Sequence
  chemically synthesized
gaggtgtagtagagaggaag

SEQ ID NO: 615177 - DNA, 20 bp, Artificial Sequence
  chemically synthesized
tattcaaatggaaaattcaa

SEQ ID NO: 615178 - DNA, 20 bp, Artificial Sequence
  chemically synthesized
gaaccatttttaatgtcaac

SEQ ID NO: 615179 - DNA, 20 bp, Artificial Sequence
  chemically synthesized
ttgggaggctgaggcaggag

SEQ ID NO: 615180 - DNA, 20 bp, Artificial Sequence
  chemically synthesized
tgcctcagcctcccaagtag

SEQ ID NO: 615181 - DNA, 20 bp, Artificial Sequence
  chemically synthesized
ttttgtatttttggtagaga

SEQ ID NO: 615182 - DNA, 20 bp, Artificial Sequence
  chemically synthesized
cactttggaaggccaaggca

SEQ ID NO: 615183 - DNA, 20 bp, Artificial Sequence
  chemically synthesized
tgccttggccttccaaagtg

SEQ ID NO: 615184 - DNA, 20 bp, Artificial Sequence
  chemically synthesized
gagccactgcactcagccca

SEQ ID NO: 615185 - DNA, 20 bp, Artificial Sequence
  chemically synthesized
gcccataatgttttaatggt

SEQ ID NO: 615186 - DNA, 20 bp, Artificial Sequence
  chemically synthesized
tcaagtgactaggcataata

SEQ ID NO: 615187 - DNA, 20 bp, Artificial Sequence
  chemically synthesized
aaagagactccactcttttg

SEQ ID NO: 615188 - DNA, 20 bp, Artificial Sequence
  chemically synthesized
tttaaaacaattttaagtaa

SEQ ID NO: 615189 - DNA, 20 bp, Artificial Sequence
  chemically synthesized
aaagaaacaatcttacttaa

SEQ ID NO: 615190 - DNA, 20 bp, Artificial Sequence
  chemically synthesized
tttatttaaaacaattttaa

SEQ ID NO: 615191 - DNA, 20 bp, Artificial Sequence
  chemically synthesized
cattattttgcgacagaaat

SEQ ID NO: 615192 - DNA, 20 bp, Artificial Sequence
  chemically synthesized
gacagaaatacaagttttgt

SEQ ID NO: 615193 - DNA, 20 bp, Artificial Sequence
  chemically synthesized
ttactgattagagatgcagc

SEQ ID NO: 615194 - DNA, 20 bp, Artificial Sequence
  chemically synthesized
tgattagagatgcagcaaca

SEQ ID NO: 615195 - DNA, 20 bp, Artificial Sequence
  chemically synthesized
aagtaggaagtacataagac

SEQ ID NO: 615196 - DNA, 20 bp, Artificial Sequence
  chemically synthesized
taatcatagattctttgcta

SEQ ID NO: 615197 - DNA, 20 bp, Artificial Sequence
  chemically synthesized
taatccccttagcaaagaat

SEQ ID NO: 615198 - DNA, 20 bp, Artificial Sequence
  chemically synthesized
ttagcaaagaatctatgatt

SEQ ID NO: 615199 - DNA, 20 bp, Artificial Sequence
  chemically synthesized
attttttagaatcttttaat

SEQ ID NO: 615200 - DNA, 20 bp, Artificial Sequence
  chemically synthesized
ttttgctattgatattcaat

SEQ ID NO: 615201 - DNA, 20 bp, Artificial Sequence
  chemically synthesized
gcaggtggtgttgggggagg

SEQ ID NO: 615202 - DNA, 20 bp, Artificial Sequence
  chemically synthesized
ccaacaccacctgctctaaa

SEQ ID NO: 615203 - DNA, 20 bp, Artificial Sequence
  chemically synthesized
taatttgaaagtatacattt

SEQ ID NO: 615204 - DNA, 20 bp, Artificial Sequence
  chemically synthesized
atacatttaattgtttgtta

SEQ ID NO: 615205 - DNA, 20 bp, Artificial Sequence
  chemically synthesized
ttattgactatcttctcctt

SEQ ID NO: 615206 - DNA, 20 bp, Artificial Sequence
  chemically synthesized
gactatcttctccttaatgg

SEQ ID NO: 615207 - DNA, 20 bp, Artificial Sequence
  chemically synthesized
tccttaatggattagtttgt

SEQ ID NO: 615208 - DNA, 20 bp, Artificial Sequence
  chemically synthesized
gaagggttgttgacgtattg

SEQ ID NO: 615209 - DNA, 20 bp, Artificial Sequence
  chemically synthesized
gattctcaatcttggtgcta

SEQ ID NO: 615210 - DNA, 20 bp, Artificial Sequence
  chemically synthesized
tgtgcaaaatctcagtagca

SEQ ID NO: 615211 - DNA, 20 bp, Artificial Sequence
  chemically synthesized
tgctactgagattttgcaca

SEQ ID NO: 615212 - DNA, 20 bp, Artificial Sequence
  chemically synthesized
gggttgacctgaacattatt

SEQ ID NO: 615213 - DNA, 20 bp, Artificial Sequence
  chemically synthesized
agtggcataactaaaagaag

SEQ ID NO: 615214 - DNA, 20 bp, Artificial Sequence
  chemically synthesized
gggttatttcaccatgtccg

SEQ ID NO: 615215 - DNA, 20 bp, Artificial Sequence
  chemically synthesized
ttcagtgattctcaactctg

SEQ ID NO: 615216 - DNA, 20 bp, Artificial Sequence
  chemically synthesized
catttatgtattaaattatt

SEQ ID NO: 615217 - DNA, 20 bp, Artificial Sequence
  chemically synthesized
gaatgagttaatgaataact

SEQ ID NO: 615218 - DNA, 20 bp, Artificial Sequence
  chemically synthesized
tgctttgctcctgcttctac

SEQ ID NO: 615219 - DNA, 20 bp, Artificial Sequence
  chemically synthesized
ctgactggaatgtgctttgc

SEQ ID NO: 615220 - DNA, 20 bp, Artificial Sequence
  chemically synthesized
catatcactatctgactgga

SEQ ID NO: 615221 - DNA, 20 bp, Artificial Sequence
  chemically synthesized
acattccagtcagatagtga

SEQ ID NO: 615222 - DNA, 20 bp, Artificial Sequence
  chemically synthesized
attagggattacaattcaac

SEQ ID NO: 615223 - DNA, 20 bp, Artificial Sequence
  chemically synthesized
ccaggccccacctctaacat

SEQ ID NO: 615224 - DNA, 20 bp, Artificial Sequence
  chemically synthesized
tagaggtggggcctggtggc

SEQ ID NO: 615225 - DNA, 20 bp, Artificial Sequence
  chemically synthesized
ggtggcaggtgattggatca

SEQ ID NO: 615226 - DNA, 20 bp, Artificial Sequence
  chemically synthesized
agtgggctctcacgagatct

SEQ ID NO: 615227 - DNA, 20 bp, Artificial Sequence
  chemically synthesized
cgctccccgtctgccttctg

SEQ ID NO: 615228 - DNA, 20 bp, Artificial Sequence
  chemically synthesized
gtctgccttctgccatgatt

SEQ ID NO: 615229 - DNA, 20 bp, Artificial Sequence
  chemically synthesized
ctgcttctggggcggcctca

SEQ ID NO: 615230 - DNA, 20 bp, Artificial Sequence
  chemically synthesized
cgccccagaagcagaagctg

SEQ ID NO: 615231 - DNA, 20 bp, Artificial Sequence
  chemically synthesized
tgttcaggaagcatagcagc

SEQ ID NO: 615232 - DNA, 20 bp, Artificial Sequence
  chemically synthesized
gcaggctgttcaggaagcat

SEQ ID NO: 615233 - DNA, 20 bp, Artificial Sequence
  chemically synthesized
ctggataatttataaagaaa

SEQ ID NO: 615234 - DNA, 20 bp, Artificial Sequence
  chemically synthesized
aagtagacaccgagggactt

SEQ ID NO: 615235 - DNA, 20 bp, Artificial Sequence
  chemically synthesized
tgtcttagttcttgcatgta

SEQ ID NO: 615236 - DNA, 20 bp, Artificial Sequence
  chemically synthesized
catgcaagaactaagacaga

SEQ ID NO: 615237 - DNA, 20 bp, Artificial Sequence
  chemically synthesized
gcctccctcgcccatttcaa

SEQ ID NO: 615238 - DNA, 20 bp, Artificial Sequence
  chemically synthesized
agttatgtaggtcaaggtta

SEQ ID NO: 615239 - DNA, 20 bp, Artificial Sequence
  chemically synthesized
tttactcttggtagaatgag

SEQ ID NO: 615240 - DNA, 20 bp, Artificial Sequence
  chemically synthesized
ggcgttttaatgaagaggtg

SEQ ID NO: 615241 - DNA, 20 bp, Artificial Sequence
  chemically synthesized
ggttgctccaaatgctgaaa

SEQ ID NO: 615242 - DNA, 20 bp, Artificial Sequence
  chemically synthesized
cattttgcttggccgattga

SEQ ID NO: 615243 - DNA, 20 bp, Artificial Sequence
  chemically synthesized
agaatccattttgcttggcc

SEQ ID NO: 615244 - DNA, 20 bp, Artificial Sequence
  chemically synthesized
caaatcaatcggccaagcaa

SEQ ID NO: 615245 - DNA, 20 bp, Artificial Sequence
  chemically synthesized
atatagaatccattttgctt

SEQ ID NO: 615246 - DNA, 20 bp, Artificial Sequence
  chemically synthesized
taatatttatatagaatcca

SEQ ID NO: 615247 - DNA, 20 bp, Artificial Sequence
  chemically synthesized
tgacattatatgcataagac

SEQ ID NO: 615248 - DNA, 20 bp, Artificial Sequence
  chemically synthesized
aattaaagaactaatttcct

SEQ ID NO: 615249 - DNA, 20 bp, Artificial Sequence
  chemically synthesized
attcaacaaatacagagact

SEQ ID NO: 615250 - DNA, 20 bp, Artificial Sequence
  chemically synthesized
tctcatgaatttacactata

SEQ ID NO: 615251 - DNA, 20 bp, Artificial Sequence
  chemically synthesized
agtattattggccttataat

SEQ ID NO: 615252 - DNA, 20 bp, Artificial Sequence
  chemically synthesized
tccacaattgtaaagttaag

SEQ ID NO: 615253 - DNA, 20 bp, Artificial Sequence
  chemically synthesized
tttcatgaataatgtactga

SEQ ID NO: 615254 - DNA, 20 bp, Artificial Sequence
  chemically synthesized
ttattcatgaaactacttca

SEQ ID NO: 615255 - DNA, 20 bp, Artificial Sequence
  chemically synthesized
tctaaaacaaagcattttga

SEQ ID NO: 615256 - DNA, 20 bp, Artificial Sequence
  chemically synthesized
catgaaactacttcaaaatg

SEQ ID NO: 615257 - DNA, 20 bp, Artificial Sequence
  chemically synthesized
actacttcaaaatgctttgt

SEQ ID NO: 615258 - DNA, 20 bp, Artificial Sequence
  chemically synthesized
aaaaatattggtattcacat

SEQ ID NO: 615259 - DNA, 20 bp, Artificial Sequence
  chemically synthesized
acataactgctttgccaatg

SEQ ID NO: 615260 - DNA, 20 bp, Artificial Sequence
  chemically synthesized
gtgaggtttcatacgaaatt

SEQ ID NO: 615261 - DNA, 20 bp, Artificial Sequence
  chemically synthesized
ggtttcatacgaaattcatt

SEQ ID NO: 615262 - DNA, 20 bp, Artificial Sequence
  chemically synthesized
gattttctgaaaacttatca

SEQ ID NO: 615263 - DNA, 20 bp, Artificial Sequence
  chemically synthesized
tttgacacaaaatcaatatg

SEQ ID NO: 615264 - DNA, 20 bp, Artificial Sequence
  chemically synthesized
attataaaaatgcttgttca

SEQ ID NO: 615265 - DNA, 20 bp, Artificial Sequence
  chemically synthesized
atgaacaagcatttttataa

SEQ ID NO: 615266 - DNA, 20 bp, Artificial Sequence
  chemically synthesized
agaataaaactttattataa

SEQ ID NO: 615267 - DNA, 20 bp, Artificial Sequence
  chemically synthesized
tatagtgagatatgaaggga

SEQ ID NO: 615268 - DNA, 20 bp, Artificial Sequence
  chemically synthesized
tccttcccttcatatctcac

SEQ ID NO: 615269 - DNA, 20 bp, Artificial Sequence
  chemically synthesized
tattagtgattaattcaatg

SEQ ID NO: 615270 - DNA, 20 bp, Artificial Sequence
  chemically synthesized
tttgatcaattctctcctat

SEQ ID NO: 615271 - DNA, 20 bp, Artificial Sequence
  chemically synthesized
acaaagctttaccagaattc

SEQ ID NO: 615272 - DNA, 20 bp, Artificial Sequence
  chemically synthesized
caaaatcatcagaattctgg

SEQ ID NO: 615273 - DNA, 20 bp, Artificial Sequence
  chemically synthesized
ggagtccaaattatgaaata

SEQ ID NO: 615274 - DNA, 20 bp, Artificial Sequence
  chemically synthesized
ggaatttttagcctagtaaa

SEQ ID NO: 615275 - DNA, 20 bp, Artificial Sequence
  chemically synthesized
acctgaaatttgcaagacta

SEQ ID NO: 615276 - DNA, 20 bp, Artificial Sequence
  chemically synthesized
gagctatgttcttatgaacc

SEQ ID NO: 615277 - DNA, 20 bp, Artificial Sequence
  chemically synthesized
tgagctgtgggcacctgatt

SEQ ID NO: 615278 - DNA, 20 bp, Artificial Sequence
  chemically synthesized
tagatttgtgagctgtgggc

SEQ ID NO: 615279 - DNA, 20 bp, Artificial Sequence
  chemically synthesized
acgtaaagagatgtgtcatg

SEQ ID NO: 615280 - DNA, 20 bp, Artificial Sequence
  chemically synthesized
atcaaattctatgaggtaga

SEQ ID NO: 615281 - DNA, 20 bp, Artificial Sequence
  chemically synthesized
catcacattttaaattatcg

SEQ ID NO: 615282 - DNA, 20 bp, Artificial Sequence
  chemically synthesized
ttaatagaacaacacttaat

SEQ ID NO: 615283 - DNA, 20 bp, Artificial Sequence
  chemically synthesized
tatgatatatcacatacttt

SEQ ID NO: 615284 - DNA, 20 bp, Artificial Sequence
  chemically synthesized
taaaatatgagaaattataa

SEQ ID NO: 615285 - DNA, 20 bp, Artificial Sequence
  chemically synthesized
gctctgctgcatggtagaac

SEQ ID NO: 615286 - DNA, 20 bp, Artificial Sequence
  chemically synthesized
atgggaaatatcagccatca

SEQ ID NO: 615287 - DNA, 20 bp, Artificial Sequence
  chemically synthesized
gttttttggaaattgtagac

SEQ ID NO: 615288 - DNA, 20 bp, Artificial Sequence
  chemically synthesized
atgtactttaaaaatatttt

SEQ ID NO: 615289 - DNA, 20 bp, Artificial Sequence
  chemically synthesized
ggttgattactcataagtta

SEQ ID NO: 615290 - DNA, 20 bp, Artificial Sequence
  chemically synthesized
ttacgttcaaatgttgtaaa

SEQ ID NO: 615291 - DNA, 20 bp, Artificial Sequence
  chemically synthesized
tgctgccagacttttagcac

SEQ ID NO: 615292 - DNA, 20 bp, Artificial Sequence
  chemically synthesized
tctctcataaaatgctgaaa

SEQ ID NO: 615293 - DNA, 20 bp, Artificial Sequence
  chemically synthesized
tcgtcatattggtgaattta

SEQ ID NO: 615294 - DNA, 20 bp, Artificial Sequence
  chemically synthesized
cccggttagtgctaaagaca

SEQ ID NO: 615295 - DNA, 20 bp, Artificial Sequence
  chemically synthesized
acagcatttgctgtcaatca

SEQ ID NO: 615296 - DNA, 20 bp, Artificial Sequence
  chemically synthesized
ttattttgtaattataatct

SEQ ID NO: 615297 - DNA, 20 bp, Artificial Sequence
  chemically synthesized
ttttggtatttgagcccttt

SEQ ID NO: 615298 - DNA, 20 bp, Artificial Sequence
  chemically synthesized
tcaaataccaaaaaggatct

SEQ ID NO: 615299 - DNA, 20 bp, Artificial Sequence
  chemically synthesized
cctagtgagatgcaaaggtg

SEQ ID NO: 615300 - DNA, 20 bp, Artificial Sequence
  chemically synthesized
taattacatctgaaatcata

SEQ ID NO: 615301 - DNA, 20 bp, Artificial Sequence
  chemically synthesized
agactatcaaccaaatcgaa

SEQ ID NO: 615302 - DNA, 20 bp, Artificial Sequence
  chemically synthesized
aggtgaccctggtaccatct

SEQ ID NO: 615303 - DNA, 20 bp, Artificial Sequence
  chemically synthesized
accctggtaccatctaactg

SEQ ID NO: 615304 - DNA, 20 bp, Artificial Sequence
  chemically synthesized
aggatattggccctttctaa

SEQ ID NO: 615305 - DNA, 20 bp, Artificial Sequence
  chemically synthesized
aagaaaatcagtatacacag

SEQ ID NO: 615306 - DNA, 20 bp, Artificial Sequence
  chemically synthesized
agataaatcctacctgtgta

SEQ ID NO: 615307 - DNA, 20 bp, Artificial Sequence
  chemically synthesized
ctagaaggttgattatccag

SEQ ID NO: 615308 - DNA, 20 bp, Artificial Sequence
  chemically synthesized
tccctggagtttgactagaa

SEQ ID NO: 615309 - DNA, 20 bp, Artificial Sequence
  chemically synthesized
ttaaactacattgaattccc

SEQ ID NO: 615310 - DNA, 20 bp, Artificial Sequence
  chemically synthesized
tcaaactccagggaattcaa

SEQ ID NO: 615311 - DNA, 20 bp, Artificial Sequence
  chemically synthesized
tgtgatttccctaatatgta

SEQ ID NO: 615312 - DNA, 20 bp, Artificial Sequence
  chemically synthesized
atgactacatatgattcatt

SEQ ID NO: 615313 - DNA, 20 bp, Artificial Sequence
  chemically synthesized
ctcatccatagaatgactac

SEQ ID NO: 615314 - DNA, 20 bp, Artificial Sequence
  chemically synthesized
ttacccccacggaaatacta

SEQ ID NO: 615315 - DNA, 20 bp, Artificial Sequence
  chemically synthesized
agaaaatatctgttctccta

SEQ ID NO: 615316 - DNA, 20 bp, Artificial Sequence
  chemically synthesized
acagatattttctaccaagt

SEQ ID NO: 615317 - DNA, 20 bp, Artificial Sequence
  chemically synthesized
agtctcagcttagtctgtta

SEQ ID NO: 615318 - DNA, 20 bp, Artificial Sequence
  chemically synthesized
actctgcaacatgctgaatc

SEQ ID NO: 615319 - DNA, 20 bp, Artificial Sequence
  chemically synthesized
ggacgcatttctacaaaaac

SEQ ID NO: 615320 - DNA, 20 bp, Artificial Sequence
  chemically synthesized
aatttcttactggatgtgtg

SEQ ID NO: 615321 - DNA, 20 bp, Artificial Sequence
  chemically synthesized
aaattgaattcaatcagtag

SEQ ID NO: 615322 - DNA, 20 bp, Artificial Sequence
  chemically synthesized
aatatttggccaagcttatc

SEQ ID NO: 615323 - DNA, 20 bp, Artificial Sequence
  chemically synthesized
tttgagtttcaaatatttgg

SEQ ID NO: 615324 - DNA, 20 bp, Artificial Sequence
  chemically synthesized
cacaattaatgatttagttt

SEQ ID NO: 615325 - DNA, 20 bp, Artificial Sequence
  chemically synthesized
tacttttgcacaattaatga

SEQ ID NO: 615326 - DNA, 20 bp, Artificial Sequence
  chemically synthesized
tttctttacttttgcacaat

SEQ ID NO: 615327 - DNA, 20 bp, Artificial Sequence
  chemically synthesized
tttggaatattttacattaa

SEQ ID NO: 615328 - DNA, 20 bp, Artificial Sequence
  chemically synthesized
ttcttagttaaaaatagtaa

SEQ ID NO: 615329 - DNA, 20 bp, Artificial Sequence
  chemically synthesized
ggcttgcagacatcagtaaa

SEQ ID NO: 615330 - DNA, 20 bp, Artificial Sequence
  chemically synthesized
aattgaaagagtgaagaaca

SEQ ID NO: 615331 - DNA, 20 bp, Artificial Sequence
  chemically synthesized
agaaagatatggggtggatg

SEQ ID NO: 615332 - DNA, 20 bp, Artificial Sequence
  chemically synthesized
atctttctttcatttggaat

SEQ ID NO: 615333 - DNA, 20 bp, Artificial Sequence
  chemically synthesized
tgtagactcaggcatataac

SEQ ID NO: 615334 - DNA, 20 bp, Artificial Sequence
  chemically synthesized
aattttagaaatagattatt

SEQ ID NO: 615335 - DNA, 20 bp, Artificial Sequence
  chemically synthesized
cagggattagaaattttaga

SEQ ID NO: 615336 - DNA, 20 bp, Artificial Sequence
  chemically synthesized
tgattttgatacatttatgt

SEQ ID NO: 615337 - DNA, 20 bp, Artificial Sequence
  chemically synthesized
tctcattctattaaattatt

SEQ ID NO: 615338 - DNA, 20 bp, Artificial Sequence
  chemically synthesized
ttgttgtgctttggtttacc

SEQ ID NO: 615339 - DNA, 20 bp, Artificial Sequence
  chemically synthesized
cagaaggacatttgttgtgc

SEQ ID NO: 615340 - DNA, 20 bp, Artificial Sequence
  chemically synthesized
tttgttcagaaggacatttg

SEQ ID NO: 615341 - DNA, 20 bp, Artificial Sequence
  chemically synthesized
acaaatgtccttctgaacaa

SEQ ID NO: 615342 - DNA, 20 bp, Artificial Sequence
  chemically synthesized
aacacctcaacttctggatg

SEQ ID NO: 615343 - DNA, 20 bp, Artificial Sequence
  chemically synthesized
tggatgaaaggtttacatga

SEQ ID NO: 615344 - DNA, 20 bp, Artificial Sequence
  chemically synthesized
tgtctaacataatattttct

SEQ ID NO: 615345 - DNA, 20 bp, Artificial Sequence
  chemically synthesized
gatgtgaagatatgactgtg

SEQ ID NO: 615346 - DNA, 20 bp, Artificial Sequence
  chemically synthesized
cgcctcccaattctcctgcc

SEQ ID NO: 615347 - DNA, 20 bp, Artificial Sequence
  chemically synthesized
tcaggaggctgaggcaggag

SEQ ID NO: 615348 - DNA, 20 bp, Artificial Sequence
  chemically synthesized
tgcctcagcctcctgagtag

SEQ ID NO: 615349 - DNA, 20 bp, Artificial Sequence
  chemically synthesized
gtgtgcatttttagtagaga

SEQ ID NO: 615350 - DNA, 20 bp, Artificial Sequence
  chemically synthesized
gaggcaggcggatcacgagg

SEQ ID NO: 615351 - DNA, 20 bp, Artificial Sequence
  chemically synthesized
tgcctcggccccccaaagtg

SEQ ID NO: 615352 - DNA, 20 bp, Artificial Sequence
  chemically synthesized
ccctagaacacactttctta

SEQ ID NO: 615353 - DNA, 20 bp, Artificial Sequence
  chemically synthesized
tttccttttactaataagtg

SEQ ID NO: 615354 - DNA, 20 bp, Artificial Sequence
  chemically synthesized
attagtaaaaggaaatatga

SEQ ID NO: 615355 - DNA, 20 bp, Artificial Sequence
  chemically synthesized
taattgaaagagctctaaga

SEQ ID NO: 615356 - DNA, 20 bp, Artificial Sequence
  chemically synthesized
ttgtctgagattctggtcat

SEQ ID NO: 615357 - DNA, 20 bp, Artificial Sequence
  chemically synthesized
gacaggatagtgtctgttgt

SEQ ID NO: 615358 - DNA, 20 bp, Artificial Sequence
  chemically synthesized
ctatcctgtccacacagagc

SEQ ID NO: 615359 - DNA, 20 bp, Artificial Sequence
  chemically synthesized
ccctgtctgcagtcttcatc

SEQ ID NO: 615360 - DNA, 20 bp, Artificial Sequence
  chemically synthesized
taaaggaattcgtaaaatgt

SEQ ID NO: 615361 - DNA, 20 bp, Artificial Sequence
  chemically synthesized
catggaccttcagtgtcaat

SEQ ID NO: 615362 - DNA, 20 bp, Artificial Sequence
  chemically synthesized
ggtccatgatagtgcctgca

SEQ ID NO: 615363 - DNA, 20 bp, Artificial Sequence
  chemically synthesized
aatataatgtgaaattgttt

SEQ ID NO: 615364 - DNA, 20 bp, Artificial Sequence
  chemically synthesized
acattacaaatataatgtga

SEQ ID NO: 615365 - DNA, 20 bp, Artificial Sequence
  chemically synthesized
gtttacctctctttcccacc

SEQ ID NO: 615366 - DNA, 20 bp, Artificial Sequence
  chemically synthesized
tagtgttaggatacacattt

SEQ ID NO: 615367 - DNA, 20 bp, Artificial Sequence
  chemically synthesized
aatgtgtatcctaacactaa

SEQ ID NO: 615368 - DNA, 20 bp, Artificial Sequence
  chemically synthesized
tgggagcacagccttttgaa

SEQ ID NO: 615369 - DNA, 20 bp, Artificial Sequence
  chemically synthesized
gttatcctagccataacatg

SEQ ID NO: 615370 - DNA, 20 bp, Artificial Sequence
  chemically synthesized
aagttctacaatatactata

SEQ ID NO: 615371 - DNA, 20 bp, Artificial Sequence
  chemically synthesized
gtacacaatttacctcagtt

SEQ ID NO: 615372 - DNA, 20 bp, Artificial Sequence
  chemically synthesized
gtaagtagtacacaatttac

SEQ ID NO: 615373 - DNA, 20 bp, Artificial Sequence
  chemically synthesized
tatattcctttaaggctgta

SEQ ID NO: 615374 - DNA, 20 bp, Artificial Sequence
  chemically synthesized
aaaggaatatacatttaata

SEQ ID NO: 615375 - DNA, 20 bp, Artificial Sequence
  chemically synthesized
ggcaagttttaaatgcagac

SEQ ID NO: 615376 - DNA, 20 bp, Artificial Sequence
  chemically synthesized
attttttcatggttccattg

SEQ ID NO: 615377 - DNA, 20 bp, Artificial Sequence
  chemically synthesized
ttgaattgcattaatgaaaa

SEQ ID NO: 615378 - DNA, 20 bp, Artificial Sequence
  chemically synthesized
agtataaaattgtttctagc

SEQ ID NO: 615379 - DNA, 20 bp, Artificial Sequence
  chemically synthesized
ggctactctgttgagtataa

SEQ ID NO: 615380 - DNA, 20 bp, Artificial Sequence
  chemically synthesized
ctcaacagagtagccaaaag

SEQ ID NO: 615381 - DNA, 20 bp, Artificial Sequence
  chemically synthesized
aattctcacgaacttaaaaa

SEQ ID NO: 615382 - DNA, 20 bp, Artificial Sequence
  chemically synthesized
catgatgtatttctaagttt

SEQ ID NO: 615383 - DNA, 20 bp, Artificial Sequence
  chemically synthesized
ctgactgacatgatgtattt

SEQ ID NO: 615384 - DNA, 20 bp, Artificial Sequence
  chemically synthesized
caaatgactttttgtgtctg

SEQ ID NO: 615385 - DNA, 20 bp, Artificial Sequence
  chemically synthesized
aatatcaaatgactttttgt

SEQ ID NO: 615386 - DNA, 20 bp, Artificial Sequence
  chemically synthesized
gtcatttgatatttaaatca

SEQ ID NO: 615387 - DNA, 20 bp, Artificial Sequence
  chemically synthesized
tcaattctataatttaagct

SEQ ID NO: 615388 - DNA, 20 bp, Artificial Sequence
  chemically synthesized
atttgtttcaattctataat

SEQ ID NO: 615389 - DNA, 20 bp, Artificial Sequence
  chemically synthesized
gtcaactctgttcttctctc

SEQ ID NO: 615390 - DNA, 20 bp, Artificial Sequence
  chemically synthesized
ctctgagtcactttgtcctc

SEQ ID NO: 615391 - DNA, 20 bp, Artificial Sequence
  chemically synthesized
ctgtggaggacaaagtgact

SEQ ID NO: 615392 - DNA, 20 bp, Artificial Sequence
  chemically synthesized
ccctgtactttaagggtaat

SEQ ID NO: 615393 - DNA, 20 bp, Artificial Sequence
  chemically synthesized
ccagataggcccactatagc

SEQ ID NO: 615394 - DNA, 20 bp, Artificial Sequence
  chemically synthesized
gtatctttggcaacagctgc

SEQ ID NO: 615395 - DNA, 20 bp, Artificial Sequence
  chemically synthesized
gagtgcttctcttcctctct

SEQ ID NO: 615396 - DNA, 20 bp, Artificial Sequence
  chemically synthesized
gaaactcagggaagacacaa

SEQ ID NO: 615397 - DNA, 20 bp, Artificial Sequence
  chemically synthesized
gaagcactcttgtgtcttcc

SEQ ID NO: 615398 - DNA, 20 bp, Artificial Sequence
  chemically synthesized
agctctctttggctgatggt

SEQ ID NO: 615399 - DNA, 20 bp, Artificial Sequence
  chemically synthesized
acctttgtagactgtgtgtg

SEQ ID NO: 615400 - DNA, 20 bp, Artificial Sequence
  chemically synthesized
ttccttgtatacatgtagga

SEQ ID NO: 615401 - DNA, 20 bp, Artificial Sequence
  chemically synthesized
tcctacatgtatacaaggaa

SEQ ID NO: 615402 - DNA, 20 bp, Artificial Sequence
  chemically synthesized
tgatggatactagggtcgtt

SEQ ID NO: 615403 - DNA, 20 bp, Artificial Sequence
  chemically synthesized
ctactgttgatggatactag

SEQ ID NO: 615404 - DNA, 20 bp, Artificial Sequence
  chemically synthesized
tttcaatcagcattatgttg

SEQ ID NO: 615405 - DNA, 20 bp, Artificial Sequence
  chemically synthesized
gatgaatcttagcaacataa

SEQ ID NO: 615406 - DNA, 20 bp, Artificial Sequence
  chemically synthesized
tattgcatttattcttctgt

SEQ ID NO: 615407 - DNA, 20 bp, Artificial Sequence
  chemically synthesized
gtcacagaagaataaatgca

SEQ ID NO: 615408 - DNA, 20 bp, Artificial Sequence
  chemically synthesized
aagagaaatagtcttgctct

SEQ ID NO: 615409 - DNA, 20 bp, Artificial Sequence
  chemically synthesized
aacggtggtcgtgaaatttg

SEQ ID NO: 615410 - DNA, 20 bp, Artificial Sequence
  chemically synthesized
gagataacggtggtcgtgaa

SEQ ID NO: 615411 - DNA, 20 bp, Artificial Sequence
  chemically synthesized
tatgtacccatctccaattc

SEQ ID NO: 615412 - DNA, 20 bp, Artificial Sequence
  chemically synthesized
gaattggagatgggtacata

SEQ ID NO: 615413 - DNA, 20 bp, Artificial Sequence
  chemically synthesized
gaagtaataaacacatttgg

SEQ ID NO: 615414 - DNA, 20 bp, Artificial Sequence
  chemically synthesized
acagtttcaatcataaccaa

SEQ ID NO: 615415 - DNA, 20 bp, Artificial Sequence
  chemically synthesized
gaacaaaagattttaagaca

SEQ ID NO: 615416 - DNA, 20 bp, Artificial Sequence
  chemically synthesized
atatcttattacataagaac

SEQ ID NO: 615417 - DNA, 20 bp, Artificial Sequence
  chemically synthesized
gatatttttaaaagacagat

SEQ ID NO: 615418 - DNA, 20 bp, Artificial Sequence
  chemically synthesized
taaaagacagatacatgttt

SEQ ID NO: 615419 - DNA, 20 bp, Artificial Sequence
  chemically synthesized
caacatcaacctaaaagaaa

SEQ ID NO: 615420 - DNA, 20 bp, Artificial Sequence
  chemically synthesized
ctaaaagaaattaagtttat

SEQ ID NO: 615421 - DNA, 20 bp, Artificial Sequence
  chemically synthesized
gaaattaagtttatttttgt

SEQ ID NO: 615422 - DNA, 20 bp, Artificial Sequence
  chemically synthesized
aagtttatttttgtttttgt

SEQ ID NO: 615423 - DNA, 20 bp, Artificial Sequence
  chemically synthesized
aagctgaaagggaaatgctt

SEQ ID NO: 615424 - DNA, 20 bp, Artificial Sequence
  chemically synthesized
aatctgaaaagcatttccct

SEQ ID NO: 615425 - DNA, 20 bp, Artificial Sequence
  chemically synthesized
aacccagcaagctgaaaggg

SEQ ID NO: 615426 - DNA, 20 bp, Artificial Sequence
  chemically synthesized
agcatttccctttcagcttg

SEQ ID NO: 615427 - DNA, 20 bp, Artificial Sequence
  chemically synthesized
ggtttcttgcactaaaagat

SEQ ID NO: 615428 - DNA, 20 bp, Artificial Sequence
  chemically synthesized
tttaataatcatagcagatc

SEQ ID NO: 615429 - DNA, 20 bp, Artificial Sequence
  chemically synthesized
ctactgaagcctctgatctg

SEQ ID NO: 615430 - DNA, 20 bp, Artificial Sequence
  chemically synthesized
cttcagtagggaggagatgg

SEQ ID NO: 615431 - DNA, 20 bp, Artificial Sequence
  chemically synthesized
atgggatagcttattgtgaa

SEQ ID NO: 615432 - DNA, 20 bp, Artificial Sequence
  chemically synthesized
ttgtgaaaaacgattttccc

SEQ ID NO: 615433 - DNA, 20 bp, Artificial Sequence
  chemically synthesized
cacttttaaactagggggaa

SEQ ID NO: 615434 - DNA, 20 bp, Artificial Sequence
  chemically synthesized
gcccctggtaacatttttct

SEQ ID NO: 615435 - DNA, 20 bp, Artificial Sequence
  chemically synthesized
tgacaacgatatatataact

SEQ ID NO: 615436 - DNA, 20 bp, Artificial Sequence
  chemically synthesized
tcactttgcaactttgaaga

SEQ ID NO: 615437 - DNA, 20 bp, Artificial Sequence
  chemically synthesized
atagagcccttcggcaggaa

SEQ ID NO: 615438 - DNA, 20 bp, Artificial Sequence
  chemically synthesized
acaaaaagtcatttaaaaat

SEQ ID NO: 615439 - DNA, 20 bp, Artificial Sequence
  chemically synthesized
atgcaagtccactttaaatt

SEQ ID NO: 615440 - DNA, 20 bp, Artificial Sequence
  chemically synthesized
cctgttttccttagtataaa

SEQ ID NO: 615441 - DNA, 20 bp, Artificial Sequence
  chemically synthesized
atactaaggaaaacaggcta

SEQ ID NO: 615442 - DNA, 20 bp, Artificial Sequence
  chemically synthesized
tagtatcgaaaagccctata

SEQ ID NO: 615443 - DNA, 20 bp, Artificial Sequence
  chemically synthesized
atgtttcatacctggtatca

SEQ ID NO: 615444 - DNA, 20 bp, Artificial Sequence
  chemically synthesized
agctctagcccactgctact

SEQ ID NO: 615445 - DNA, 20 bp, Artificial Sequence
  chemically synthesized
gtgtctgctacacagttcca

SEQ ID NO: 615446 - DNA, 20 bp, Artificial Sequence
  chemically synthesized
tagcagacactgcccactct

SEQ ID NO: 615447 - DNA, 20 bp, Artificial Sequence
  chemically synthesized
gcccactctgttggtttacc

SEQ ID NO: 615448 - DNA, 20 bp, Artificial Sequence
  chemically synthesized
agcccaccaggtcaagcacc

SEQ ID NO: 615449 - DNA, 20 bp, Artificial Sequence
  chemically synthesized
ctgaaacacagagaagcagt

SEQ ID NO: 615450 - DNA, 20 bp, Artificial Sequence
  chemically synthesized
gtcaagcacccactgcttct

SEQ ID NO: 615451 - DNA, 20 bp, Artificial Sequence
  chemically synthesized
ccctcctgtgtgttggatga

SEQ ID NO: 615452 - DNA, 20 bp, Artificial Sequence
  chemically synthesized
cattcctcagaggggtcttc

SEQ ID NO: 615453 - DNA, 20 bp, Artificial Sequence
  chemically synthesized
gggtcttcacaggattgaac

SEQ ID NO: 615454 - DNA, 20 bp, Artificial Sequence
  chemically synthesized
cagctgaataatacactcac

SEQ ID NO: 615455 - DNA, 20 bp, Artificial Sequence
  chemically synthesized
atacactcactattgttttc

SEQ ID NO: 615456 - DNA, 20 bp, Artificial Sequence
  chemically synthesized
gttgctctctagtcctcgcc

SEQ ID NO: 615457 - DNA, 20 bp, Artificial Sequence
  chemically synthesized
tctctagtcctcgcctcagg

SEQ ID NO: 615458 - DNA, 20 bp, Artificial Sequence
  chemically synthesized
tttgtcacagtttgtcttag

SEQ ID NO: 615459 - DNA, 20 bp, Artificial Sequence
  chemically synthesized
tgtaatttgtcacagtttgt

SEQ ID NO: 615460 - DNA, 20 bp, Artificial Sequence
  chemically synthesized
tcgtttggattgtaatttgt

SEQ ID NO: 615461 - DNA, 20 bp, Artificial Sequence
  chemically synthesized
tgtgacaaattacaatccaa

SEQ ID NO: 615462 - DNA, 20 bp, Artificial Sequence
  chemically synthesized
cctgagaggaaagaatctcg

SEQ ID NO: 615463 - DNA, 20 bp, Artificial Sequence
  chemically synthesized
atccccctgagaggaaagaa

SEQ ID NO: 615464 - DNA, 20 bp, Artificial Sequence
  chemically synthesized
gagattctttcctctcaggg

SEQ ID NO: 615465 - DNA, 20 bp, Artificial Sequence
  chemically synthesized
gtctgtgttcattttgataa

SEQ ID NO: 615466 - DNA, 20 bp, Artificial Sequence
  chemically synthesized
ctaactctggggtgaatagg

SEQ ID NO: 615467 - DNA, 20 bp, Artificial Sequence
  chemically synthesized
ttttatttctaggactttat

SEQ ID NO: 615468 - DNA, 20 bp, Artificial Sequence
  chemically synthesized
gctctggtctgtaccgagct

SEQ ID NO: 615469 - DNA, 20 bp, Artificial Sequence
  chemically synthesized
gctgtcagctcggtacagac

SEQ ID NO: 615470 - DNA, 20 bp, Artificial Sequence
  chemically synthesized
agtactaagcgactcataga

SEQ ID NO: 615471 - DNA, 20 bp, Artificial Sequence
  chemically synthesized
ctcctgaatccttttctatg

SEQ ID NO: 615472 - DNA, 20 bp, Artificial Sequence
  chemically synthesized
ttaggctcatagtaacaagc

SEQ ID NO: 615473 - DNA, 20 bp, Artificial Sequence
  chemically synthesized
gctcatagtaacaagcaaca

SEQ ID NO: 615474 - DNA, 20 bp, Artificial Sequence
  chemically synthesized
aaactttagccaaagcaaac

SEQ ID NO: 615475 - DNA, 20 bp, Artificial Sequence
  chemically synthesized
aagcaacagtttgctttggc

SEQ ID NO: 615476 - DNA, 20 bp, Artificial Sequence
  chemically synthesized
cacagattccgatatttatc

SEQ ID NO: 615477 - DNA, 20 bp, Artificial Sequence
  chemically synthesized
tgaaatccaaaggctgtacc

SEQ ID NO: 615478 - DNA, 20 bp, Artificial Sequence
  chemically synthesized
cggaatctgtgggtacagcc

SEQ ID NO: 615479 - DNA, 20 bp, Artificial Sequence
  chemically synthesized
tctctgtttttgatgttgca

SEQ ID NO: 615480 - DNA, 20 bp, Artificial Sequence
  chemically synthesized
gtttccttttgcaaatgcct

SEQ ID NO: 615481 - DNA, 20 bp, Artificial Sequence
  chemically synthesized
tgctgctaggaacattctcc

SEQ ID NO: 615482 - DNA, 20 bp, Artificial Sequence
  chemically synthesized
atttgggctgctcgaagatt

SEQ ID NO: 615483 - DNA, 20 bp, Artificial Sequence
  chemically synthesized
cagagggcatttgggctgct

SEQ ID NO: 615484 - DNA, 20 bp, Artificial Sequence
  chemically synthesized
ggcaggaaaatggacagtta

SEQ ID NO: 615485 - DNA, 20 bp, Artificial Sequence
  chemically synthesized
tcttgattgttttgtgtagc

SEQ ID NO: 615486 - DNA, 20 bp, Artificial Sequence
  chemically synthesized
ccatccctagaatttatctt

SEQ ID NO: 615487 - DNA, 20 bp, Artificial Sequence
  chemically synthesized
catcccatccctagaattta

SEQ ID NO: 615488 - DNA, 20 bp, Artificial Sequence
  chemically synthesized
gtatgacacaaaatgtttta

SEQ ID NO: 615489 - DNA, 20 bp, Artificial Sequence
  chemically synthesized
tactgtatgacacaaaatgt

SEQ ID NO: 615490 - DNA, 20 bp, Artificial Sequence
  chemically synthesized
aatatttactgtatgacaca

SEQ ID NO: 615491 - DNA, 20 bp, Artificial Sequence
  chemically synthesized
gttactgaagttctctgagc

SEQ ID NO: 615492 - DNA, 20 bp, Artificial Sequence
  chemically synthesized
tgggtttcagagcatttcca

SEQ ID NO: 615493 - DNA, 20 bp, Artificial Sequence
  chemically synthesized
ttagtgtagcaggtaagact

SEQ ID NO: 615494 - DNA, 20 bp, Artificial Sequence
  chemically synthesized
tatgtttcaacaatatttgt

SEQ ID NO: 615495 - DNA, 20 bp, Artificial Sequence
  chemically synthesized
ttaaatgttttatcagatac

SEQ ID NO: 615496 - DNA, 20 bp, Artificial Sequence
  chemically synthesized
tataatcctgtaatattttt

SEQ ID NO: 615497 - DNA, 20 bp, Artificial Sequence
  chemically synthesized
ataaaacatttaaaaatatt

SEQ ID NO: 615498 - DNA, 20 bp, Artificial Sequence
  chemically synthesized
tacaggattataaattcagg

SEQ ID NO: 615499 - DNA, 20 bp, Artificial Sequence
  chemically synthesized
gggaagatggcatgaggaag

SEQ ID NO: 615500 - DNA, 20 bp, Artificial Sequence
  chemically synthesized
aagttggcaatgacataaag

SEQ ID NO: 615501 - DNA, 20 bp, Artificial Sequence
  chemically synthesized
agaacatgagtggcacgaat

SEQ ID NO: 615502 - DNA, 20 bp, Artificial Sequence
  chemically synthesized
tgctcatatgaattattttg

SEQ ID NO: 615503 - DNA, 20 bp, Artificial Sequence
  chemically synthesized
atgaggtaaaatataattta

SEQ ID NO: 615504 - DNA, 20 bp, Artificial Sequence
  chemically synthesized
tgatttctgaatttttaggc

SEQ ID NO: 615505 - DNA, 20 bp, Artificial Sequence
  chemically synthesized
tttaggcgaccgcttacatt

SEQ ID NO: 615506 - DNA, 20 bp, Artificial Sequence
  chemically synthesized
aggaaggggaggaggtacac

SEQ ID NO: 615507 - DNA, 20 bp, Artificial Sequence
  chemically synthesized
acacaggatttgtcttgaat

SEQ ID NO: 615508 - DNA, 20 bp, Artificial Sequence
  chemically synthesized
aatgtaggtttccctatttt

SEQ ID NO: 615509 - DNA, 20 bp, Artificial Sequence
  chemically synthesized
cctattttcagagattgtat

SEQ ID NO: 615510 - DNA, 20 bp, Artificial Sequence
  chemically synthesized
gagattgtatatttgcttcc

SEQ ID NO: 615511 - DNA, 20 bp, Artificial Sequence
  chemically synthesized
gagagagggggtgatttagc

SEQ ID NO: 615512 - DNA, 20 bp, Artificial Sequence
  chemically synthesized
ggtggtactaaggagagagg

SEQ ID NO: 615513 - DNA, 20 bp, Artificial Sequence
  chemically synthesized
tagatgctcaatactcatca

SEQ ID NO: 615514 - DNA, 20 bp, Artificial Sequence
  chemically synthesized
tgttcttagtatttctgagc

SEQ ID NO: 615515 - DNA, 20 bp, Artificial Sequence
  chemically synthesized
aaaatcatacaaaataccca

SEQ ID NO: 615516 - DNA, 20 bp, Artificial Sequence
  chemically synthesized
ttaaacttcatgggtatttt

SEQ ID NO: 615517 - DNA, 20 bp, Artificial Sequence
  chemically synthesized
aaatgaattaaaatatatga

SEQ ID NO: 615518 - DNA, 20 bp, Artificial Sequence
  chemically synthesized
tgaatactagaagtagaagt

SEQ ID NO: 615519 - DNA, 20 bp, Artificial Sequence
  chemically synthesized
aatgattgttgactctgatg

SEQ ID NO: 615520 - DNA, 20 bp, Artificial Sequence
  chemically synthesized
tattttggagagaaggagga

SEQ ID NO: 615521 - DNA, 20 bp, Artificial Sequence
  chemically synthesized
ctctccaaaatagaacatgc

SEQ ID NO: 615522 - DNA, 20 bp, Artificial Sequence
  chemically synthesized
atgctgaaatgaatttgaaa

SEQ ID NO: 615523 - DNA, 20 bp, Artificial Sequence
  chemically synthesized
ttatattatatttttactta

SEQ ID NO: 615524 - DNA, 20 bp, Artificial Sequence
  chemically synthesized
ataaaatttcaaaatttact

SEQ ID NO: 615525 - DNA, 20 bp, Artificial Sequence
  chemically synthesized
cttaaattggctagagtttt

SEQ ID NO: 615526 - DNA, 20 bp, Artificial Sequence
  chemically synthesized
ttacagttgcttaaattggc

SEQ ID NO: 615527 - DNA, 20 bp, Artificial Sequence
  chemically synthesized
atgatgtctaaagggattac

SEQ ID NO: 615528 - DNA, 20 bp, Artificial Sequence
  chemically synthesized
agtaaatttaatgatgtcta

SEQ ID NO: 615529 - DNA, 20 bp, Artificial Sequence
  chemically synthesized
tctctctggataatatattt

SEQ ID NO: 615530 - DNA, 20 bp, Artificial Sequence
  chemically synthesized
cacatctttaaaaagtttct

SEQ ID NO: 615531 - DNA, 20 bp, Artificial Sequence
  chemically synthesized
acactaatatcacatcttta

SEQ ID NO: 615532 - DNA, 20 bp, Artificial Sequence
  chemically synthesized
ctattgaagatataattggc

SEQ ID NO: 615533 - DNA, 20 bp, Artificial Sequence
  chemically synthesized
acatgtccaatattactggg

SEQ ID NO: 615534 - DNA, 20 bp, Artificial Sequence
  chemically synthesized
agtaatattggacatgtgat

SEQ ID NO: 615535 - DNA, 20 bp, Artificial Sequence
  chemically synthesized
acttgctaaattgtctttct

SEQ ID NO: 615536 - DNA, 20 bp, Artificial Sequence
  chemically synthesized
caatttagcaagtgttctga

SEQ ID NO: 615537 - DNA, 20 bp, Artificial Sequence
  chemically synthesized
ttttgaaatatacaatgaat

SEQ ID NO: 615538 - DNA, 20 bp, Artificial Sequence
  chemically synthesized
tgatcccatcacaaagaaag

SEQ ID NO: 615539 - DNA, 20 bp, Artificial Sequence
  chemically synthesized
gatgatggatatcccaatta

SEQ ID NO: 615540 - DNA, 20 bp, Artificial Sequence
  chemically synthesized
tgatcatttatacagtatat

SEQ ID NO: 615541 - DNA, 20 bp, Artificial Sequence
  chemically synthesized
caaggagattactatttggc

SEQ ID NO: 615542 - DNA, 20 bp, Artificial Sequence
  chemically synthesized
caggtccctcccctgacaca

SEQ ID NO: 615543 - DNA, 20 bp, Artificial Sequence
  chemically synthesized
ggagatgactggatcatggg

SEQ ID NO: 615544 - DNA, 20 bp, Artificial Sequence
  chemically synthesized
agtgagttctcacgagatct

SEQ ID NO: 615545 - DNA, 20 bp, Artificial Sequence
  chemically synthesized
tgcctccccttcaccttctg

SEQ ID NO: 615546 - DNA, 20 bp, Artificial Sequence
  chemically synthesized
ctgggtgatttataaagaaa

SEQ ID NO: 615547 - DNA, 20 bp, Artificial Sequence
  chemically synthesized
ataaagaactacctgagact

SEQ ID NO: 615548 - DNA, 20 bp, Artificial Sequence
  chemically synthesized
tatcaaaagctacaaactat

SEQ ID NO: 615549 - DNA, 20 bp, Artificial Sequence
  chemically synthesized
atgagcaaacaaaaatagtt

SEQ ID NO: 615550 - DNA, 20 bp, Artificial Sequence
  chemically synthesized
atagtaaatgagcaaacaaa

SEQ ID NO: 615551 - DNA, 20 bp, Artificial Sequence
  chemically synthesized
ttcctatgttttataacatg

SEQ ID NO: 615552 - DNA, 20 bp, Artificial Sequence
  chemically synthesized
aaatgttctcatttgatttc

SEQ ID NO: 615553 - DNA, 20 bp, Artificial Sequence
  chemically synthesized
tagccttaggaaatgttctc

SEQ ID NO: 615554 - DNA, 20 bp, Artificial Sequence
  chemically synthesized
aatgagaacatttcctaagg

SEQ ID NO: 615555 - DNA, 20 bp, Artificial Sequence
  chemically synthesized
atagagcggagattttgaaa

SEQ ID NO: 615556 - DNA, 20 bp, Artificial Sequence
  chemically synthesized
gttagagagaaattatagag

SEQ ID NO: 615557 - DNA, 20 bp, Artificial Sequence
  chemically synthesized
atggttggtgatctttgttg

SEQ ID NO: 615558 - DNA, 20 bp, Artificial Sequence
  chemically synthesized
ggattttatctgatgggtct

SEQ ID NO: 615559 - DNA, 20 bp, Artificial Sequence
  chemically synthesized
gatgggtctcctagtttaca

SEQ ID NO: 615560 - DNA, 20 bp, Artificial Sequence
  chemically synthesized
tattgtctttctggaaatga

SEQ ID NO: 615561 - DNA, 20 bp, Artificial Sequence
  chemically synthesized
cctcatttccagaaagacaa

SEQ ID NO: 615562 - DNA, 20 bp, Artificial Sequence
  chemically synthesized
tcccagtacatcctgtcatg

SEQ ID NO: 615563 - DNA, 20 bp, Artificial Sequence
  chemically synthesized
gctctgcctgacaagaagga

SEQ ID NO: 615564 - DNA, 20 bp, Artificial Sequence
  chemically synthesized
acaagaaggaagaagcttat

SEQ ID NO: 615565 - DNA, 20 bp, Artificial Sequence
  chemically synthesized
gagtcattcagaaagctatc

SEQ ID NO: 615566 - DNA, 20 bp, Artificial Sequence
  chemically synthesized
tctagtgatgatacctgcag

SEQ ID NO: 615567 - DNA, 20 bp, Artificial Sequence
  chemically synthesized
tttctagcagatgaatgtta

SEQ ID NO: 615568 - DNA, 20 bp, Artificial Sequence
  chemically synthesized
tgtgctgaagtctaagacaa

SEQ ID NO: 615569 - DNA, 20 bp, Artificial Sequence
  chemically synthesized
gtctaagacaaaggtgctta

SEQ ID NO: 615570 - DNA, 20 bp, Artificial Sequence
  chemically synthesized
tgtgtatgcgtatgtccaac

SEQ ID NO: 615571 - DNA, 20 bp, Artificial Sequence
  chemically synthesized
ataggacttagatttcagga

SEQ ID NO: 615572 - DNA, 20 bp, Artificial Sequence
  chemically synthesized
caagttttgattaaatagga

SEQ ID NO: 615573 - DNA, 20 bp, Artificial Sequence
  chemically synthesized
ctaagtcctatttaatcaaa

SEQ ID NO: 615574 - DNA, 20 bp, Artificial Sequence
  chemically synthesized
tgggaaggttttgaagcaag

SEQ ID NO: 615575 - DNA, 20 bp, Artificial Sequence
  chemically synthesized
aactttgggaaggttttgaa

SEQ ID NO: 615576 - DNA, 20 bp, Artificial Sequence
  chemically synthesized
aacttgcttcaaaaccttcc

SEQ ID NO: 615577 - DNA, 20 bp, Artificial Sequence
  chemically synthesized
aatacatgttgaaactttgg

SEQ ID NO: 615578 - DNA, 20 bp, Artificial Sequence
  chemically synthesized
ctacttgggaggctgaggtg

SEQ ID NO: 615579 - DNA, 20 bp, Artificial Sequence
  chemically synthesized
accacacacagctaattttt

SEQ ID NO: 615580 - DNA, 20 bp, Artificial Sequence
  chemically synthesized
ttttgtgggttttgcagaga

SEQ ID NO: 615581 - DNA, 20 bp, Artificial Sequence
  chemically synthesized
ttgggaggccaaggcaggca

SEQ ID NO: 615582 - DNA, 20 bp, Artificial Sequence
  chemically synthesized
ccggtcaacatgtattctta

SEQ ID NO: 615583 - DNA, 20 bp, Artificial Sequence
  chemically synthesized
tgtattcttaaacagattta

SEQ ID NO: 615584 - DNA, 20 bp, Artificial Sequence
  chemically synthesized
ctatgaagaaagcattttaa

SEQ ID NO: 615585 - DNA, 20 bp, Artificial Sequence
  chemically synthesized
tgctttcttcatagcattaa

SEQ ID NO: 615586 - DNA, 20 bp, Artificial Sequence
  chemically synthesized
aatttacatgagaactctat

SEQ ID NO: 615587 - DNA, 20 bp, Artificial Sequence
  chemically synthesized
tatcctatgctggaaatata

SEQ ID NO: 615588 - DNA, 20 bp, Artificial Sequence
  chemically synthesized
tttccagcataggatacaca

SEQ ID NO: 615589 - DNA, 20 bp, Artificial Sequence
  chemically synthesized
gtggaattagtctccctttc

SEQ ID NO: 615590 - DNA, 20 bp, Artificial Sequence
  chemically synthesized
tgaaatgtatcacggcaaag

SEQ ID NO: 615591 - DNA, 20 bp, Artificial Sequence
  chemically synthesized
ctgggtcccaaaggacgttc

SEQ ID NO: 615592 - DNA, 20 bp, Artificial Sequence
  chemically synthesized
tttcccactttctcaaccta

SEQ ID NO: 615593 - DNA, 20 bp, Artificial Sequence
  chemically synthesized
cagtctccttagacctggaa

SEQ ID NO: 615594 - DNA, 20 bp, Artificial Sequence
  chemically synthesized
caggtctaaggagactgcct

SEQ ID NO: 615595 - DNA, 20 bp, Artificial Sequence
  chemically synthesized
aaaatagagaaccttgtagg

SEQ ID NO: 615596 - DNA, 20 bp, Artificial Sequence
  chemically synthesized
aagtctgagagcagtgtgta

SEQ ID NO: 615597 - DNA, 20 bp, Artificial Sequence
  chemically synthesized
tgagagcagtgtgtaaaagg

SEQ ID NO: 615598 - DNA, 20 bp, Artificial Sequence
  chemically synthesized
ttctcaattctatctggact

SEQ ID NO: 615599 - DNA, 20 bp, Artificial Sequence
  chemically synthesized
aaggcattgttggtattaat

SEQ ID NO: 615600 - DNA, 20 bp, Artificial Sequence
  chemically synthesized
gattccagagatactatcca

SEQ ID NO: 615601 - DNA, 20 bp, Artificial Sequence
  chemically synthesized
gctaaaaggtaactttaagg

SEQ ID NO: 615602 - DNA, 20 bp, Artificial Sequence
  chemically synthesized
ccttttagctcttttatttt

SEQ ID NO: 615603 - DNA, 20 bp, Artificial Sequence
  chemically synthesized
gtctattctactgaattcag

SEQ ID NO: 615604 - DNA, 20 bp, Artificial Sequence
  chemically synthesized
tattttatttactcttcaaa

SEQ ID NO: 615605 - DNA, 20 bp, Artificial Sequence
  chemically synthesized
aaagaagataccatttgttc

SEQ ID NO: 615606 - DNA, 20 bp, Artificial Sequence
  chemically synthesized
tgaagaaaatatagaaaagt

SEQ ID NO: 615607 - DNA, 20 bp, Artificial Sequence
  chemically synthesized
ctatataacatgtaatttat

SEQ ID NO: 615608 - DNA, 20 bp, Artificial Sequence
  chemically synthesized
atatacccttctttccctca

SEQ ID NO: 615609 - DNA, 20 bp, Artificial Sequence
  chemically synthesized
agtgcttttagttttgggga

SEQ ID NO: 615610 - DNA, 20 bp, Artificial Sequence
  chemically synthesized
tgagtcagtgcttttagttt

SEQ ID NO: 615611 - DNA, 20 bp, Artificial Sequence
  chemically synthesized
ttaaaccatgagtcagtgct

SEQ ID NO: 615612 - DNA, 20 bp, Artificial Sequence
  chemically synthesized
caaaactaaaagcactgact

SEQ ID NO: 615613 - DNA, 20 bp, Artificial Sequence
  chemically synthesized
ttaccctttaaaccatgagt

SEQ ID NO: 615614 - DNA, 20 bp, Artificial Sequence
  chemically synthesized
catttaggctttcctttaca

SEQ ID NO: 615615 - DNA, 20 bp, Artificial Sequence
  chemically synthesized
tatgtttgcaaagatcacat

SEQ ID NO: 615616 - DNA, 20 bp, Artificial Sequence
  chemically synthesized
tttcggctattgatcaccag

SEQ ID NO: 615617 - DNA, 20 bp, Artificial Sequence
  chemically synthesized
ataactggtgatcaatagcc

SEQ ID NO: 615618 - DNA, 20 bp, Artificial Sequence
  chemically synthesized
aatcttcctttttgcatatg

SEQ ID NO: 615619 - DNA, 20 bp, Artificial Sequence
  chemically synthesized
aagcagtacatatgcaaaaa

SEQ ID NO: 615620 - DNA, 20 bp, Artificial Sequence
  chemically synthesized
aggaagattgaaacttaaca

SEQ ID NO: 615621 - DNA, 20 bp, Artificial Sequence
  chemically synthesized
tgacatcaataaacaaaatg

SEQ ID NO: 615622 - DNA, 20 bp, Artificial Sequence
  chemically synthesized
attatctttatccatctagt

SEQ ID NO: 615623 - DNA, 20 bp, Artificial Sequence
  chemically synthesized
agtgattatctttatccatc

SEQ ID NO: 615624 - DNA, 20 bp, Artificial Sequence
  chemically synthesized
gcgtattgactattacataa

SEQ ID NO: 615625 - DNA, 20 bp, Artificial Sequence
  chemically synthesized
cataatacttgggttagata

SEQ ID NO: 615626 - DNA, 20 bp, Artificial Sequence
  chemically synthesized
tcataactttcaaggaagtg

SEQ ID NO: 615627 - DNA, 20 bp, Artificial Sequence
  chemically synthesized
agctgggagaaatttattaa

SEQ ID NO: 615628 - DNA, 20 bp, Artificial Sequence
  chemically synthesized
atcatttttaataaatttct

SEQ ID NO: 615629 - DNA, 20 bp, Artificial Sequence
  chemically synthesized
tctcagagcaatgatggtgt

SEQ ID NO: 615630 - DNA, 20 bp, Artificial Sequence
  chemically synthesized
gcaatgatggtgtctaagct

SEQ ID NO: 615631 - DNA, 20 bp, Artificial Sequence
  chemically synthesized
atttcacagacacagaaact

SEQ ID NO: 615632 - DNA, 20 bp, Artificial Sequence
  chemically synthesized
atgtagactctccaaggagc

SEQ ID NO: 615633 - DNA, 20 bp, Artificial Sequence
  chemically synthesized
gtagactgaatttaattcaa

SEQ ID NO: 615634 - DNA, 20 bp, Artificial Sequence
  chemically synthesized
acatacacatctaatttctg

SEQ ID NO: 615635 - DNA, 20 bp, Artificial Sequence
  chemically synthesized
tccttccgcacatatttgtt

SEQ ID NO: 615636 - DNA, 20 bp, Artificial Sequence
  chemically synthesized
cttgtttactgttttatctt

SEQ ID NO: 615637 - DNA, 20 bp, Artificial Sequence
  chemically synthesized
gtttccttgcatgtcttgtt

SEQ ID NO: 615638 - DNA, 20 bp, Artificial Sequence
  chemically synthesized
gagagtagtttccttgcatg

SEQ ID NO: 615639 - DNA, 20 bp, Artificial Sequence
  chemically synthesized
tagattggaagttccatgag

SEQ ID NO: 615640 - DNA, 20 bp, Artificial Sequence
  chemically synthesized
atttatttgctattccctac

SEQ ID NO: 615641 - DNA, 20 bp, Artificial Sequence
  chemically synthesized
tcaataacacttattatatt

SEQ ID NO: 615642 - DNA, 20 bp, Artificial Sequence
  chemically synthesized
aggtactttctatctgaaca

SEQ ID NO: 615643 - DNA, 20 bp, Artificial Sequence
  chemically synthesized
agggaaggagagagaactag

SEQ ID NO: 615644 - DNA, 20 bp, Artificial Sequence
  chemically synthesized
ctggatttcatagtcaaaga

SEQ ID NO: 615645 - DNA, 20 bp, Artificial Sequence
  chemically synthesized
tttttttggatgtgcaatta

SEQ ID NO: 615646 - DNA, 20 bp, Artificial Sequence
  chemically synthesized
gaataattttcatccttcaa

SEQ ID NO: 615647 - DNA, 20 bp, Artificial Sequence
  chemically synthesized
ccatcatgcaaaataatagc

SEQ ID NO: 615648 - DNA, 20 bp, Artificial Sequence
  chemically synthesized
gatggaatagaggccttcat

SEQ ID NO: 615649 - DNA, 20 bp, Artificial Sequence
  chemically synthesized
aatgccttttaggctacaaa

SEQ ID NO: 615650 - DNA, 20 bp, Artificial Sequence
  chemically synthesized
aatatggtcaagaatgttga

SEQ ID NO: 615651 - DNA, 20 bp, Artificial Sequence
  chemically synthesized
ttatttacactatcaagaaa

SEQ ID NO: 615652 - DNA, 20 bp, Artificial Sequence
  chemically synthesized
ttcgatttatcactatagct

SEQ ID NO: 615653 - DNA, 20 bp, Artificial Sequence
  chemically synthesized
gtgataaatcgaataagttg

SEQ ID NO: 615654 - DNA, 20 bp, Artificial Sequence
  chemically synthesized
atattcaaacctaccaactt

SEQ ID NO: 615655 - DNA, 20 bp, Artificial Sequence
  chemically synthesized
ggtttgaatatgctggataa

SEQ ID NO: 615656 - DNA, 20 bp, Artificial Sequence
  chemically synthesized
agttataatattccttccaa

SEQ ID NO: 615657 - DNA, 20 bp, Artificial Sequence
  chemically synthesized
ttactttttctctgaattct

SEQ ID NO: 615658 - DNA, 20 bp, Artificial Sequence
  chemically synthesized
gataagtgcaaactaaaaga

SEQ ID NO: 615659 - DNA, 20 bp, Artificial Sequence
  chemically synthesized
aaaactatgaaactatgtct

SEQ ID NO: 615660 - DNA, 20 bp, Artificial Sequence
  chemically synthesized
caaactaaaagacatagttt

SEQ ID NO: 615661 - DNA, 20 bp, Artificial Sequence
  chemically synthesized
caaacttttgatctttgcca

SEQ ID NO: 615662 - DNA, 20 bp, Artificial Sequence
  chemically synthesized
caatcatattggcaaagatc

SEQ ID NO: 615663 - DNA, 20 bp, Artificial Sequence
  chemically synthesized
atcaaaagtttggtagtata

SEQ ID NO: 615664 - DNA, 20 bp, Artificial Sequence
  chemically synthesized
tgatgttctcataccttcct

SEQ ID NO: 615665 - DNA, 20 bp, Artificial Sequence
  chemically synthesized
cttactgggggtgctggcat

SEQ ID NO: 615666 - DNA, 20 bp, Artificial Sequence
  chemically synthesized
aaaaaagaacgcataaagaa

SEQ ID NO: 615667 - DNA, 20 bp, Artificial Sequence
  chemically synthesized
aattttctttatgcgttctt

SEQ ID NO: 615668 - DNA, 20 bp, Artificial Sequence
  chemically synthesized
tgtgcaattaactaggtaat

SEQ ID NO: 615669 - DNA, 20 bp, Artificial Sequence
  chemically synthesized
ataaataaatggttggatga

SEQ ID NO: 615670 - DNA, 20 bp, Artificial Sequence
  chemically synthesized
atccatccattcatccatcc

SEQ ID NO: 615671 - DNA, 20 bp, Artificial Sequence
  chemically synthesized
cgtttatctcttcatccatc

SEQ ID NO: 615672 - DNA, 20 bp, Artificial Sequence
  chemically synthesized
atctcatgtttaatttgtat

SEQ ID NO: 615673 - DNA, 20 bp, Artificial Sequence
  chemically synthesized
atagagtctatgggataaat

SEQ ID NO: 615674 - DNA, 20 bp, Artificial Sequence
  chemically synthesized
agagatacaatgttaaataa

SEQ ID NO: 615675 - DNA, 20 bp, Artificial Sequence
  chemically synthesized
aatgaaggagaaaagctacc

SEQ ID NO: 615676 - DNA, 20 bp, Artificial Sequence
  chemically synthesized
cttcatatctgtaatcatga

SEQ ID NO: 615677 - DNA, 20 bp, Artificial Sequence
  chemically synthesized
acctcatgattacagatatg

SEQ ID NO: 615678 - DNA, 20 bp, Artificial Sequence
  chemically synthesized
gggtttggtaaatgcatcac

SEQ ID NO: 615679 - DNA, 20 bp, Artificial Sequence
  chemically synthesized
tagctctctgcaccctctcc

SEQ ID NO: 615680 - DNA, 20 bp, Artificial Sequence
  chemically synthesized
acctatctgcagaattcctt

SEQ ID NO: 615681 - DNA, 20 bp, Artificial Sequence
  chemically synthesized
acttgaaaggaattctgcag

SEQ ID NO: 615682 - DNA, 20 bp, Artificial Sequence
  chemically synthesized
agataggtttgaaagccctg

SEQ ID NO: 615683 - DNA, 20 bp, Artificial Sequence
  chemically synthesized
aaaaaaaaaaaaaatcatgt

SEQ ID NO: 615684 - DNA, 20 bp, Artificial Sequence
  chemically synthesized
acatgatttttttttttttt

SEQ ID NO: 615685 - DNA, 20 bp, Artificial Sequence
  chemically synthesized
ttgttagcttttgagaatac

SEQ ID NO: 615686 - DNA, 20 bp, Artificial Sequence
  chemically synthesized
gtttgcttgctttcttgttt

SEQ ID NO: 615687 - DNA, 20 bp, Artificial Sequence
  chemically synthesized
gaacttttgtttgcttgctt

SEQ ID NO: 615688 - DNA, 20 bp, Artificial Sequence
  chemically synthesized
tgatacctgaacttttgttt

SEQ ID NO: 615689 - DNA, 20 bp, Artificial Sequence
  chemically synthesized
aatgtgatacctgaactttt

SEQ ID NO: 615690 - DNA, 20 bp, Artificial Sequence
  chemically synthesized
tgcaaatgtgatacctgaac

SEQ ID NO: 615691 - DNA, 20 bp, Artificial Sequence
  chemically synthesized
tcacatttgcagtaatatac

SEQ ID NO: 615692 - DNA, 20 bp, Artificial Sequence
  chemically synthesized
tacaagtgctttcattaaaa

SEQ ID NO: 615693 - DNA, 20 bp, Artificial Sequence
  chemically synthesized
ttcattaaaattatgctttt

SEQ ID NO: 615694 - DNA, 20 bp, Artificial Sequence
  chemically synthesized
aaaatatttagacctacccc

SEQ ID NO: 615695 - DNA, 20 bp, Artificial Sequence
  chemically synthesized
aaggttggggaccacttccc

SEQ ID NO: 615696 - DNA, 20 bp, Artificial Sequence
  chemically synthesized
caacctttttagcaccaggg

SEQ ID NO: 615697 - DNA, 20 bp, Artificial Sequence
  chemically synthesized
tcacagacttgggctgggga

SEQ ID NO: 615698 - DNA, 20 bp, Artificial Sequence
  chemically synthesized
gggctggggagatggtttgg

SEQ ID NO: 615699 - DNA, 20 bp, Artificial Sequence
  chemically synthesized
atttaatgataaatgttgta

SEQ ID NO: 615700 - DNA, 20 bp, Artificial Sequence
  chemically synthesized
ctcctatgagaatgtaatgc

SEQ ID NO: 615701 - DNA, 20 bp, Artificial Sequence
  chemically synthesized
tatctgacaggaggcagagc

SEQ ID NO: 615702 - DNA, 20 bp, Artificial Sequence
  chemically synthesized
gctcacttcctgctgttccc

SEQ ID NO: 615703 - DNA, 20 bp, Artificial Sequence
  chemically synthesized
ctggtttctaacaggtcacg

SEQ ID NO: 615704 - DNA, 20 bp, Artificial Sequence
  chemically synthesized
ggaccgattggtctggggcc

SEQ ID NO: 615705 - DNA, 20 bp, Artificial Sequence
  chemically synthesized
ggggcccagggtttggggac

SEQ ID NO: 615706 - DNA, 20 bp, Artificial Sequence
  chemically synthesized
gggacccctgctttggggac

SEQ ID NO: 615707 - DNA, 20 bp, Artificial Sequence
  chemically synthesized
ggcagcatttctgaaactgt

SEQ ID NO: 615708 - DNA, 20 bp, Artificial Sequence
  chemically synthesized
acagaaaaataaaaatctag

SEQ ID NO: 615709 - DNA, 20 bp, Artificial Sequence
  chemically synthesized
ttgagactctacaatacagt

SEQ ID NO: 615710 - DNA, 20 bp, Artificial Sequence
  chemically synthesized
ctcactgaatgaatatttta

SEQ ID NO: 615711 - DNA, 20 bp, Artificial Sequence
  chemically synthesized
caattcatatttggtattta

SEQ ID NO: 615712 - DNA, 20 bp, Artificial Sequence
  chemically synthesized
taaataggagacatagaatt

SEQ ID NO: 615713 - DNA, 20 bp, Artificial Sequence
  chemically synthesized
tcttaacctcatcctcataa

SEQ ID NO: 615714 - DNA, 20 bp, Artificial Sequence
  chemically synthesized
actgcgccccaccctgacaa

SEQ ID NO: 615715 - DNA, 20 bp, Artificial Sequence
  chemically synthesized
tgccttggcctcccaaagta

SEQ ID NO: 615716 - DNA, 20 bp, Artificial Sequence
  chemically synthesized
ttttgtatttttagtagaga

SEQ ID NO: 615717 - DNA, 20 bp, Artificial Sequence
  chemically synthesized
cacctcagcctaccgagtag

SEQ ID NO: 615718 - DNA, 20 bp, Artificial Sequence
  chemically synthesized
tcggtaggctgaggtgggag

SEQ ID NO: 615719 - DNA, 20 bp, Artificial Sequence
  chemically synthesized
aacctctggctcccggggtt

SEQ ID NO: 615720 - DNA, 20 bp, Artificial Sequence
  chemically synthesized
agttgattttttgtttttgt

SEQ ID NO: 615721 - DNA, 20 bp, Artificial Sequence
  chemically synthesized
agataaagttgattttttgt

SEQ ID NO: 615722 - DNA, 20 bp, Artificial Sequence
  chemically synthesized
aagcatagataaagttgatt

SEQ ID NO: 615723 - DNA, 20 bp, Artificial Sequence
  chemically synthesized
aaacaaaaaatcaactttat

SEQ ID NO: 615724 - DNA, 20 bp, Artificial Sequence
  chemically synthesized
ctatagcaaagcatagataa

SEQ ID NO: 615725 - DNA, 20 bp, Artificial Sequence
  chemically synthesized
aattgcctattgtcctacat

SEQ ID NO: 615726 - DNA, 20 bp, Artificial Sequence
  chemically synthesized
tacatggatgattttattaa

SEQ ID NO: 615727 - DNA, 20 bp, Artificial Sequence
  chemically synthesized
ttttacatcaccactacaca

SEQ ID NO: 615728 - DNA, 20 bp, Artificial Sequence
  chemically synthesized
gtgtagtggtgatgtaaaaa

SEQ ID NO: 615729 - DNA, 20 bp, Artificial Sequence
  chemically synthesized
taaaaagatagttttcatca

SEQ ID NO: 615730 - DNA, 20 bp, Artificial Sequence
  chemically synthesized
ttttaaaaagataattcttc

SEQ ID NO: 615731 - DNA, 20 bp, Artificial Sequence
  chemically synthesized
ataattcttcataggttttt

SEQ ID NO: 615732 - DNA, 20 bp, Artificial Sequence
  chemically synthesized
cataggtttttcagggattg

SEQ ID NO: 615733 - DNA, 20 bp, Artificial Sequence
  chemically synthesized
ttcagggattgtctggtttt

SEQ ID NO: 615734 - DNA, 20 bp, Artificial Sequence
  chemically synthesized
gtaacgtctcattgtaaaat

SEQ ID NO: 615735 - DNA, 20 bp, Artificial Sequence
  chemically synthesized
cagaaatacatttaaaataa

SEQ ID NO: 615736 - DNA, 20 bp, Artificial Sequence
  chemically synthesized
tcacttttaattatagaaaa

SEQ ID NO: 615737 - DNA, 20 bp, Artificial Sequence
  chemically synthesized
gaaaatgaagctttccagaa

SEQ ID NO: 615738 - DNA, 20 bp, Artificial Sequence
  chemically synthesized
taaatttaaacataattctg

SEQ ID NO: 615739 - DNA, 20 bp, Artificial Sequence
  chemically synthesized
tatagatgcattaaaaacta

SEQ ID NO: 615740 - DNA, 20 bp, Artificial Sequence
  chemically synthesized
gtacttaaatgtttaaactt

SEQ ID NO: 615741 - DNA, 20 bp, Artificial Sequence
  chemically synthesized
tcaacattattcaggtactt

SEQ ID NO: 615742 - DNA, 20 bp, Artificial Sequence
  chemically synthesized
gcaaggacttctttaataat

SEQ ID NO: 615743 - DNA, 20 bp, Artificial Sequence
  chemically synthesized
tcagaaattattaaagaagt

SEQ ID NO: 615744 - DNA, 20 bp, Artificial Sequence
  chemically synthesized
ttaaagaagtccttgctttc

SEQ ID NO: 615745 - DNA, 20 bp, Artificial Sequence
  chemically synthesized
ccttgctttcttttgcttac

SEQ ID NO: 615746 - DNA, 20 bp, Artificial Sequence
  chemically synthesized
ccatttttttgtttgttttg

SEQ ID NO: 615747 - DNA, 20 bp, Artificial Sequence
  chemically synthesized
gtagccatttttttgtttgt

SEQ ID NO: 615748 - DNA, 20 bp, Artificial Sequence
  chemically synthesized
gatgccgtagccattttttt

SEQ ID NO: 615749 - DNA, 20 bp, Artificial Sequence
  chemically synthesized
tccagatgccgtagccattt

SEQ ID NO: 615750 - DNA, 20 bp, Artificial Sequence
  chemically synthesized
acaaaaaaatggctacggca

SEQ ID NO: 615751 - DNA, 20 bp, Artificial Sequence
  chemically synthesized
ggctacggcatctggattca

SEQ ID NO: 615752 - DNA, 20 bp, Artificial Sequence
  chemically synthesized
cgcctcagcctcccaaagtg

SEQ ID NO: 615753 - DNA, 20 bp, Artificial Sequence
  chemically synthesized
cactttgggaggctgaggcg

SEQ ID NO: 615754 - DNA, 20 bp, Artificial Sequence
  chemically synthesized
ttgggaggctgaggcgggag

SEQ ID NO: 615755 - DNA, 20 bp, Artificial Sequence
  chemically synthesized
cttgaggccaggagttctag

SEQ ID NO: 615756 - DNA, 20 bp, Artificial Sequence
  chemically synthesized
ttcgtggagacagggtcttg

SEQ ID NO: 615757 - DNA, 20 bp, Artificial Sequence
  chemically synthesized
aaccttgaattcctgggctc

SEQ ID NO: 615758 - DNA, 20 bp, Artificial Sequence
  chemically synthesized
aaataaatattagctaacct

SEQ ID NO: 615759 - DNA, 20 bp, Artificial Sequence
  chemically synthesized
agttttacctgagttccttc

SEQ ID NO: 615760 - DNA, 20 bp, Artificial Sequence
  chemically synthesized
gaaattaacttcaatagggc

SEQ ID NO: 615761 - DNA, 20 bp, Artificial Sequence
  chemically synthesized
atttctgtgtgatggaattt

SEQ ID NO: 615762 - DNA, 20 bp, Artificial Sequence
  chemically synthesized
tgtgatggaatttattagct

SEQ ID NO: 615763 - DNA, 20 bp, Artificial Sequence
  chemically synthesized
tagctttatgttttaaaata

SEQ ID NO: 615764 - DNA, 20 bp, Artificial Sequence
  chemically synthesized
gtgagaaaatattctttaga

SEQ ID NO: 615765 - DNA, 20 bp, Artificial Sequence
  chemically synthesized
tcatcagagtttgtaatgta

SEQ ID NO: 615766 - DNA, 20 bp, Artificial Sequence
  chemically synthesized
aagtattcatatccactcat

SEQ ID NO: 615767 - DNA, 20 bp, Artificial Sequence
  chemically synthesized
atgttctttctttggggata

SEQ ID NO: 615768 - DNA, 20 bp, Artificial Sequence
  chemically synthesized
gtgtaaatttttagcataaa

SEQ ID NO: 615769 - DNA, 20 bp, Artificial Sequence
  chemically synthesized
atcttaatattttattttaa

SEQ ID NO: 615770 - DNA, 20 bp, Artificial Sequence
  chemically synthesized
tagaagacagctctgtggcc

SEQ ID NO: 615771 - DNA, 20 bp, Artificial Sequence
  chemically synthesized
gtggccgatggttttggtaa

SEQ ID NO: 615772 - DNA, 20 bp, Artificial Sequence
  chemically synthesized
atggttttggtaataatgtt

SEQ ID NO: 615773 - DNA, 20 bp, Artificial Sequence
  chemically synthesized
aatgtttagggattccagga

SEQ ID NO: 615774 - DNA, 20 bp, Artificial Sequence
  chemically synthesized
gtatttttccaaatgactaa

SEQ ID NO: 615775 - DNA, 20 bp, Artificial Sequence
  chemically synthesized
aagtaggtttttcaaaaact

SEQ ID NO: 615776 - DNA, 20 bp, Artificial Sequence
  chemically synthesized
aaaaaaaaaaaaaaaaaacc

SEQ ID NO: 615777 - DNA, 20 bp, Artificial Sequence
  chemically synthesized
tatggtaggccaaaataact

SEQ ID NO: 615778 - DNA, 20 bp, Artificial Sequence
  chemically synthesized
ggtcacatactgagaactgc

SEQ ID NO: 615779 - DNA, 20 bp, Artificial Sequence
  chemically synthesized
acgttgtactggcaatactt

SEQ ID NO: 615780 - DNA, 20 bp, Artificial Sequence
  chemically synthesized
agtcttccggaatacaatgt

SEQ ID NO: 615781 - DNA, 20 bp, Artificial Sequence
  chemically synthesized
ggaactttaaagaatagaac

SEQ ID NO: 615782 - DNA, 20 bp, Artificial Sequence
  chemically synthesized
tgattcaggtaacaagatct

SEQ ID NO: 615783 - DNA, 20 bp, Artificial Sequence
  chemically synthesized
aggacttctgaaagtgcgtg

SEQ ID NO: 615784 - DNA, 20 bp, Artificial Sequence
  chemically synthesized
cagtttcatgtagttcattt

SEQ ID NO: 615785 - DNA, 20 bp, Artificial Sequence
  chemically synthesized
atcaattgctttagtttggt

SEQ ID NO: 615786 - DNA, 20 bp, Artificial Sequence
  chemically synthesized
gttactgtttcatcaattgc

SEQ ID NO: 615787 - DNA, 20 bp, Artificial Sequence
  chemically synthesized
attcgtgttactgtttcatc

SEQ ID NO: 615788 - DNA, 20 bp, Artificial Sequence
  chemically synthesized
ccttttatatttattcgtgt

SEQ ID NO: 615789 - DNA, 20 bp, Artificial Sequence
  chemically synthesized
aatataaaaggcactgctaa

SEQ ID NO: 615790 - DNA, 20 bp, Artificial Sequence
  chemically synthesized
actgctaaaaaggctttaag

SEQ ID NO: 615791 - DNA, 20 bp, Artificial Sequence
  chemically synthesized
tagattgttatgtagacatg

SEQ ID NO: 615792 - DNA, 20 bp, Artificial Sequence
  chemically synthesized
aagattataacgtttagtag

SEQ ID NO: 615793 - DNA, 20 bp, Artificial Sequence
  chemically synthesized
tcttgaagattataacgttt

SEQ ID NO: 615794 - DNA, 20 bp, Artificial Sequence
  chemically synthesized
tagccttttcttgaagatta

SEQ ID NO: 615795 - DNA, 20 bp, Artificial Sequence
  chemically synthesized
tcatagttgtagccttttct

SEQ ID NO: 615796 - DNA, 20 bp, Artificial Sequence
  chemically synthesized
aaagagcattggtgaatgta

SEQ ID NO: 615797 - DNA, 20 bp, Artificial Sequence
  chemically synthesized
aaatcagcttaatttgtctg

SEQ ID NO: 615798 - DNA, 20 bp, Artificial Sequence
  chemically synthesized
aaaacaaaacagacaaatta

SEQ ID NO: 615799 - DNA, 20 bp, Artificial Sequence
  chemically synthesized
tggccaaatcagcttaattt

SEQ ID NO: 615800 - DNA, 20 bp, Artificial Sequence
  chemically synthesized
acaaattaagctgatttggc

SEQ ID NO: 615801 - DNA, 20 bp, Artificial Sequence
  chemically synthesized
aaaagttaatcaatggccaa

SEQ ID NO: 615802 - DNA, 20 bp, Artificial Sequence
  chemically synthesized
tattgggggacataaatatt

SEQ ID NO: 615803 - DNA, 20 bp, Artificial Sequence
  chemically synthesized
gggggacataaatatttatg

SEQ ID NO: 615804 - DNA, 20 bp, Artificial Sequence
  chemically synthesized
tttgggatacatactcagta

SEQ ID NO: 615805 - DNA, 20 bp, Artificial Sequence
  chemically synthesized
gtgcacatatcttttcaata

SEQ ID NO: 615806 - DNA, 20 bp, Artificial Sequence
  chemically synthesized
attgttcacaatagccaagg

SEQ ID NO: 615807 - DNA, 20 bp, Artificial Sequence
  chemically synthesized
ttatccatgttgtcacaaat

SEQ ID NO: 615808 - DNA, 20 bp, Artificial Sequence
  chemically synthesized
acaacatggataatcctgga

SEQ ID NO: 615809 - DNA, 20 bp, Artificial Sequence
  chemically synthesized
tgcacttagcaaaacttcct

SEQ ID NO: 615810 - DNA, 20 bp, Artificial Sequence
  chemically synthesized
atgttatttggctttctgtg

SEQ ID NO: 615811 - DNA, 20 bp, Artificial Sequence
  chemically synthesized
ataagcgagatcatatgtta

SEQ ID NO: 615812 - DNA, 20 bp, Artificial Sequence
  chemically synthesized
gaaagccaaataacatatga

SEQ ID NO: 615813 - DNA, 20 bp, Artificial Sequence
  chemically synthesized
cagagactgggaggagggtg

SEQ ID NO: 615814 - DNA, 20 bp, Artificial Sequence
  chemically synthesized
ttcgagagatctattgtaca

SEQ ID NO: 615815 - DNA, 20 bp, Artificial Sequence
  chemically synthesized
ctcttgaaaattgctaagag

SEQ ID NO: 615816 - DNA, 20 bp, Artificial Sequence
  chemically synthesized
ttgctaagagagtagatttt

SEQ ID NO: 615817 - DNA, 20 bp, Artificial Sequence
  chemically synthesized
cgcttccgcctcccaaagta

SEQ ID NO: 615818 - DNA, 20 bp, Artificial Sequence
  chemically synthesized
tactttgggaggcggaagcg

SEQ ID NO: 615819 - DNA, 20 bp, Artificial Sequence
  chemically synthesized
ctcctgagctcaggcaatcc

SEQ ID NO: 615820 - DNA, 20 bp, Artificial Sequence
  chemically synthesized
tttgtgtgttttagtagaga

SEQ ID NO: 615821 - DNA, 20 bp, Artificial Sequence
  chemically synthesized
ccacatcctgctaatttttt

SEQ ID NO: 615822 - DNA, 20 bp, Artificial Sequence
  chemically synthesized
tcaggaggctgaggcaggag

SEQ ID NO: 615823 - DNA, 20 bp, Artificial Sequence
  chemically synthesized
aacttctgcctcacaggttc

SEQ ID NO: 615824 - DNA, 20 bp, Artificial Sequence
  chemically synthesized
cgtctcccaggcaggagtgc

SEQ ID NO: 615825 - DNA, 20 bp, Artificial Sequence
  chemically synthesized
attaacatatttattacctc

SEQ ID NO: 615826 - DNA, 20 bp, Artificial Sequence
  chemically synthesized
gtgaggtaataaatatgtta

SEQ ID NO: 615827 - DNA, 20 bp, Artificial Sequence
  chemically synthesized
tatctttatttcattcaaca

SEQ ID NO: 615828 - DNA, 20 bp, Artificial Sequence
  chemically synthesized
taattttaatggatagaaaa

SEQ ID NO: 615829 - DNA, 20 bp, Artificial Sequence
  chemically synthesized
atttaatttaaataaaataa

SEQ ID NO: 615830 - DNA, 20 bp, Artificial Sequence
  chemically synthesized
caagacctctgcagatgatg

SEQ ID NO: 615831 - DNA, 20 bp, Artificial Sequence
  chemically synthesized
atggcatcatctgcagaggt

SEQ ID NO: 615832 - DNA, 20 bp, Artificial Sequence
  chemically synthesized
cttaatgtctgacatatatt

SEQ ID NO: 615833 - DNA, 20 bp, Artificial Sequence
  chemically synthesized
tatttatttagtgattacag

SEQ ID NO: 615834 - DNA, 20 bp, Artificial Sequence
  chemically synthesized
agtcaataaatttatttatt

SEQ ID NO: 615835 - DNA, 20 bp, Artificial Sequence
  chemically synthesized
ggaaggtatgcctgtggcag

SEQ ID NO: 615836 - DNA, 20 bp, Artificial Sequence
  chemically synthesized
gttagattcagagtgggctg

SEQ ID NO: 615837 - DNA, 20 bp, Artificial Sequence
  chemically synthesized
tccagcccactctgaatcta

SEQ ID NO: 615838 - DNA, 20 bp, Artificial Sequence
  chemically synthesized
taagtactctgtcaaaacaa

SEQ ID NO: 615839 - DNA, 20 bp, Artificial Sequence
  chemically synthesized
atgataggttcttaataaat

SEQ ID NO: 615840 - DNA, 20 bp, Artificial Sequence
  chemically synthesized
aaagttatgaaggaaatata

SEQ ID NO: 615841 - DNA, 20 bp, Artificial Sequence
  chemically synthesized
aacttgtttactgaggggta

SEQ ID NO: 615842 - DNA, 20 bp, Artificial Sequence
  chemically synthesized
cctccgccttttagtggaga

SEQ ID NO: 615843 - DNA, 20 bp, Artificial Sequence
  chemically synthesized
actttttctccatcatttgt

SEQ ID NO: 615844 - DNA, 20 bp, Artificial Sequence
  chemically synthesized
aataatccaagacagtatgc

SEQ ID NO: 615845 - DNA, 20 bp, Artificial Sequence
  chemically synthesized
gttaagcaaatgcatactgt

SEQ ID NO: 615846 - DNA, 20 bp, Artificial Sequence
  chemically synthesized
tgcatactgtcttggattat

SEQ ID NO: 615847 - DNA, 20 bp, Artificial Sequence
  chemically synthesized
tttaagttttcgggtattta

SEQ ID NO: 615848 - DNA, 20 bp, Artificial Sequence
  chemically synthesized
cccaactaggatatcctgga

SEQ ID NO: 615849 - DNA, 20 bp, Artificial Sequence
  chemically synthesized
gataagatgatttacattaa

SEQ ID NO: 615850 - DNA, 20 bp, Artificial Sequence
  chemically synthesized
atctaaagattgaagggata

SEQ ID NO: 615851 - DNA, 20 bp, Artificial Sequence
  chemically synthesized
atcatcttatcccttcaatc

SEQ ID NO: 615852 - DNA, 20 bp, Artificial Sequence
  chemically synthesized
agaaagattaatacagaatc

SEQ ID NO: 615853 - DNA, 20 bp, Artificial Sequence
  chemically synthesized
aacataagagcaaattttta

SEQ ID NO: 615854 - DNA, 20 bp, Artificial Sequence
  chemically synthesized
gctaccttgaatatcagatt

SEQ ID NO: 615855 - DNA, 20 bp, Artificial Sequence
  chemically synthesized
tgcaccatgctaccttgaat

SEQ ID NO: 615856 - DNA, 20 bp, Artificial Sequence
  chemically synthesized
tcaaggtagcatggtgcaca

SEQ ID NO: 615857 - DNA, 20 bp, Artificial Sequence
  chemically synthesized
gcatggtgcacacacggatt

SEQ ID NO: 615858 - DNA, 20 bp, Artificial Sequence
  chemically synthesized
gatttagaaaaaaaatagac

SEQ ID NO: 615859 - DNA, 20 bp, Artificial Sequence
  chemically synthesized
aaatagacatgtgtttccct

SEQ ID NO: 615860 - DNA, 20 bp, Artificial Sequence
  chemically synthesized
tggaaactgcctaatacatg

SEQ ID NO: 615861 - DNA, 20 bp, Artificial Sequence
  chemically synthesized
ataaatcatctcatgtatta

SEQ ID NO: 615862 - DNA, 20 bp, Artificial Sequence
  chemically synthesized
atatatataatcaattgtat

SEQ ID NO: 615863 - DNA, 20 bp, Artificial Sequence
  chemically synthesized
cttatcaaaatcatgcatac

SEQ ID NO: 615864 - DNA, 20 bp, Artificial Sequence
  chemically synthesized
gccagcatttctaatatttc

SEQ ID NO: 615865 - DNA, 20 bp, Artificial Sequence
  chemically synthesized
tagaaatattagaaatgctg

SEQ ID NO: 615866 - DNA, 20 bp, Artificial Sequence
  chemically synthesized
aaagaaaaaaattacctcaa

SEQ ID NO: 615867 - DNA, 20 bp, Artificial Sequence
  chemically synthesized
ccctttttttaatgtcatct

SEQ ID NO: 615868 - DNA, 20 bp, Artificial Sequence
  chemically synthesized
tggagttgatgggttctgaa

SEQ ID NO: 615869 - DNA, 20 bp, Artificial Sequence
  chemically synthesized
aaatttgacctcacgccaca

SEQ ID NO: 615870 - DNA, 20 bp, Artificial Sequence
  chemically synthesized
ctgcttgctagtaagaaagc

SEQ ID NO: 615871 - DNA, 20 bp, Artificial Sequence
  chemically synthesized
acaaggggaaaaatataaac

SEQ ID NO: 615872 - DNA, 20 bp, Artificial Sequence
  chemically synthesized
atttgtgaattcaatagcat

SEQ ID NO: 615873 - DNA, 20 bp, Artificial Sequence
  chemically synthesized
aattcaatagcatgactgct

SEQ ID NO: 615874 - DNA, 20 bp, Artificial Sequence
  chemically synthesized
atatgtggatacgtaggtat

SEQ ID NO: 615875 - DNA, 20 bp, Artificial Sequence
  chemically synthesized
actgaaggcaaatattgaat

SEQ ID NO: 615876 - DNA, 20 bp, Artificial Sequence
  chemically synthesized
tctaacattcaatatttgcc

SEQ ID NO: 615877 - DNA, 20 bp, Artificial Sequence
  chemically synthesized
tatttgccttcagtttttca

SEQ ID NO: 615878 - DNA, 20 bp, Artificial Sequence
  chemically synthesized
gtaagtaggttacctgatga

SEQ ID NO: 615879 - DNA, 20 bp, Artificial Sequence
  chemically synthesized
acttacagatgtaaaacttg

SEQ ID NO: 615880 - DNA, 20 bp, Artificial Sequence
  chemically synthesized
tgtttagaagacaaatcatt

SEQ ID NO: 615881 - DNA, 20 bp, Artificial Sequence
  chemically synthesized
ctttactctgaataagataa

SEQ ID NO: 615882 - DNA, 20 bp, Artificial Sequence
  chemically synthesized
ttattttagaaagaactctc

SEQ ID NO: 615883 - DNA, 20 bp, Artificial Sequence
  chemically synthesized
ttgagagttctttctaaaat

SEQ ID NO: 615884 - DNA, 20 bp, Artificial Sequence
  chemically synthesized
ttataggtgaatttgttcaa

SEQ ID NO: 615885 - DNA, 20 bp, Artificial Sequence
  chemically synthesized
aacttacatggggttggggt

SEQ ID NO: 615886 - DNA, 20 bp, Artificial Sequence
  chemically synthesized
agtttgtaatgtctgagaat

SEQ ID NO: 615887 - DNA, 20 bp, Artificial Sequence
  chemically synthesized
ttgtttgtagtactgcaacc

SEQ ID NO: 615888 - DNA, 20 bp, Artificial Sequence
  chemically synthesized
ttattcaccgttttcattat

SEQ ID NO: 615889 - DNA, 20 bp, Artificial Sequence
  chemically synthesized
aatgaaaacggtgaataaac

SEQ ID NO: 615890 - DNA, 20 bp, Artificial Sequence
  chemically synthesized
tgcataaacaaatgtttatt

SEQ ID NO: 615891 - DNA, 20 bp, Artificial Sequence
  chemically synthesized
tgaataaacatttgtttatg

SEQ ID NO: 615892 - DNA, 20 bp, Artificial Sequence
  chemically synthesized
gaataaagccatgcataaac

SEQ ID NO: 615893 - DNA, 20 bp, Artificial Sequence
  chemically synthesized
ttttgttcaccaattccttg

SEQ ID NO: 615894 - DNA, 20 bp, Artificial Sequence
  chemically synthesized
tatgggtaaatgtttttgga

SEQ ID NO: 615895 - DNA, 20 bp, Artificial Sequence
  chemically synthesized
ccttcctttacgttatgggt

SEQ ID NO: 615896 - DNA, 20 bp, Artificial Sequence
  chemically synthesized
agtcactgaatgctattgac

SEQ ID NO: 615897 - DNA, 20 bp, Artificial Sequence
  chemically synthesized
tcaatagcattcagtgactg

SEQ ID NO: 615898 - DNA, 20 bp, Artificial Sequence
  chemically synthesized
aatacaaaaataagcgactt

SEQ ID NO: 615899 - DNA, 20 bp, Artificial Sequence
  chemically synthesized
cctatatctgaaatccctga

SEQ ID NO: 615900 - DNA, 20 bp, Artificial Sequence
  chemically synthesized
atataggagcctggaagcag

SEQ ID NO: 615901 - DNA, 20 bp, Artificial Sequence
  chemically synthesized
ttcccctttctattaagcac

SEQ ID NO: 615902 - DNA, 20 bp, Artificial Sequence
  chemically synthesized
aggggaaagagtcatgaaga

SEQ ID NO: 615903 - DNA, 20 bp, Artificial Sequence
  chemically synthesized
tatcagctgtgtccaaacca

SEQ ID NO: 615904 - DNA, 20 bp, Artificial Sequence
  chemically synthesized
ctatacacacaggcaatcaa

SEQ ID NO: 615905 - DNA, 20 bp, Artificial Sequence
  chemically synthesized
ctactaagctcccttccgtt

SEQ ID NO: 615906 - DNA, 20 bp, Artificial Sequence
  chemically synthesized
tcaaaaaacgtagaacggaa

SEQ ID NO: 615907 - DNA, 20 bp, Artificial Sequence
  chemically synthesized
gctcccttccgttctacgtt

SEQ ID NO: 615908 - DNA, 20 bp, Artificial Sequence
  chemically synthesized
gctggaaagaggacatgacc

SEQ ID NO: 615909 - DNA, 20 bp, Artificial Sequence
  chemically synthesized
tctctctctctcactgttcc

SEQ ID NO: 615910 - DNA, 20 bp, Artificial Sequence
  chemically synthesized
cactgttcctctggtttctc

SEQ ID NO: 615911 - DNA, 20 bp, Artificial Sequence
  chemically synthesized
aagaaaagtatctgtgcttg

SEQ ID NO: 615912 - DNA, 20 bp, Artificial Sequence
  chemically synthesized
ataatataaaagaaaagtat

SEQ ID NO: 615913 - DNA, 20 bp, Artificial Sequence
  chemically synthesized
gggatacatgtgcagaacgt

SEQ ID NO: 615914 - DNA, 20 bp, Artificial Sequence
  chemically synthesized
ataagacagaacatgtggta

SEQ ID NO: 615915 - DNA, 20 bp, Artificial Sequence
  chemically synthesized
tgtggtatttggttttctgt

SEQ ID NO: 615916 - DNA, 20 bp, Artificial Sequence
  chemically synthesized
atttggttttctgttcctgt

SEQ ID NO: 615917 - DNA, 20 bp, Artificial Sequence
  chemically synthesized
tgttttagtttgctgagaat

SEQ ID NO: 615918 - DNA, 20 bp, Artificial Sequence
  chemically synthesized
gtttgctgagaatgatggtt

SEQ ID NO: 615919 - DNA, 20 bp, Artificial Sequence
  chemically synthesized
ctgtgcagccataaaaaatt

SEQ ID NO: 615920 - DNA, 20 bp, Artificial Sequence
  chemically synthesized
ttacatgctgatatacccat

SEQ ID NO: 615921 - DNA, 20 bp, Artificial Sequence
  chemically synthesized
taggtgtatcaaatgcattt

SEQ ID NO: 615922 - DNA, 20 bp, Artificial Sequence
  chemically synthesized
gttagcctagcctatcttaa

SEQ ID NO: 615923 - DNA, 20 bp, Artificial Sequence
  chemically synthesized
ggctaacgtaagtgttctaa

SEQ ID NO: 615924 - DNA, 20 bp, Artificial Sequence
  chemically synthesized
tataaaataggctttgtgtt

SEQ ID NO: 615925 - DNA, 20 bp, Artificial Sequence
  chemically synthesized
attttattataaaataggct

SEQ ID NO: 615926 - DNA, 20 bp, Artificial Sequence
  chemically synthesized
attcaacattttattataaa

SEQ ID NO: 615927 - DNA, 20 bp, Artificial Sequence
  chemically synthesized
ttgaggacctatacaactat

SEQ ID NO: 615928 - DNA, 20 bp, Artificial Sequence
  chemically synthesized
agttgtataggtcctcaaag

SEQ ID NO: 615929 - DNA, 20 bp, Artificial Sequence
  chemically synthesized
tcatatatttttattacttt

SEQ ID NO: 615930 - DNA, 20 bp, Artificial Sequence
  chemically synthesized
agaggaacttccactaagta

SEQ ID NO: 615931 - DNA, 20 bp, Artificial Sequence
  chemically synthesized
cactaagtatctggattaaa

SEQ ID NO: 615932 - DNA, 20 bp, Artificial Sequence
  chemically synthesized
gttttagttgtataaataac

SEQ ID NO: 615933 - DNA, 20 bp, Artificial Sequence
  chemically synthesized
tagttgggaaataatttcta

SEQ ID NO: 615934 - DNA, 20 bp, Artificial Sequence
  chemically synthesized
aattatttcccaactaatca

SEQ ID NO: 615935 - DNA, 20 bp, Artificial Sequence
  chemically synthesized
tgtgaaggcatttaaaagcg

SEQ ID NO: 615936 - DNA, 20 bp, Artificial Sequence
  chemically synthesized
gccttcacaatctaatcata

SEQ ID NO: 615937 - DNA, 20 bp, Artificial Sequence
  chemically synthesized
ggctagaaaagcaggttatg

SEQ ID NO: 615938 - DNA, 20 bp, Artificial Sequence
  chemically synthesized
aatagggctagaaaagcagg

SEQ ID NO: 615939 - DNA, 20 bp, Artificial Sequence
  chemically synthesized
ttggtatttcacccaagcat

SEQ ID NO: 615940 - DNA, 20 bp, Artificial Sequence
  chemically synthesized
ctatatgtttctgaaatctt

SEQ ID NO: 615941 - DNA, 20 bp, Artificial Sequence
  chemically synthesized
gggaaggacaatgggtagct

SEQ ID NO: 615942 - DNA, 20 bp, Artificial Sequence
  chemically synthesized
tactatgaaattacattcct

SEQ ID NO: 615943 - DNA, 20 bp, Artificial Sequence
  chemically synthesized
agggagggaccaacatgtac

SEQ ID NO: 615944 - DNA, 20 bp, Artificial Sequence
  chemically synthesized
tcttcatttgataaatcttt

SEQ ID NO: 615945 - DNA, 20 bp, Artificial Sequence
  chemically synthesized
ttgataaatctttacatgct

SEQ ID NO: 615946 - DNA, 20 bp, Artificial Sequence
  chemically synthesized
gagataaatctcaaagcatg

SEQ ID NO: 615947 - DNA, 20 bp, Artificial Sequence
  chemically synthesized
aatgcaaaagaaatgaatgg

SEQ ID NO: 615948 - DNA, 20 bp, Artificial Sequence
  chemically synthesized
tatataatgcaaaagaaatg

SEQ ID NO: 615949 - DNA, 20 bp, Artificial Sequence
  chemically synthesized
tatgcatatatttttctatt

SEQ ID NO: 615950 - DNA, 20 bp, Artificial Sequence
  chemically synthesized
attacatattatatatattc

SEQ ID NO: 615951 - DNA, 20 bp, Artificial Sequence
  chemically synthesized
ttcatatgattcatatatta

SEQ ID NO: 615952 - DNA, 20 bp, Artificial Sequence
  chemically synthesized
catatattatatggattcat

SEQ ID NO: 615953 - DNA, 20 bp, Artificial Sequence
  chemically synthesized
gttaaattaacagtgaaagc

SEQ ID NO: 615954 - DNA, 20 bp, Artificial Sequence
  chemically synthesized
catacaatttcctcaaaaac

SEQ ID NO: 615955 - DNA, 20 bp, Artificial Sequence
  chemically synthesized
atgaatcatatttattttat

SEQ ID NO: 615956 - DNA, 20 bp, Artificial Sequence
  chemically synthesized
aataagctgctataaaataa

SEQ ID NO: 615957 - DNA, 20 bp, Artificial Sequence
  chemically synthesized
aatttagggttatctcctta

SEQ ID NO: 615958 - DNA, 20 bp, Artificial Sequence
  chemically synthesized
tccccctagcaattacagaa

SEQ ID NO: 615959 - DNA, 20 bp, Artificial Sequence
  chemically synthesized
ataaatatgcattacctgca

SEQ ID NO: 615960 - DNA, 20 bp, Artificial Sequence
  chemically synthesized
aaaatagagtaactgtgtta

SEQ ID NO: 615961 - DNA, 20 bp, Artificial Sequence
  chemically synthesized
acctcagcctacatgtgaac

SEQ ID NO: 615962 - DNA, 20 bp, Artificial Sequence
  chemically synthesized
ggtataaatcaacagaataa

SEQ ID NO: 615963 - DNA, 20 bp, Artificial Sequence
  chemically synthesized
ccataaaaacacttttattc

SEQ ID NO: 615964 - DNA, 20 bp, Artificial Sequence
  chemically synthesized
tttttatggctaaggtcagt

SEQ ID NO: 615965 - DNA, 20 bp, Artificial Sequence
  chemically synthesized
gcacacttatatgcttatac

SEQ ID NO: 615966 - DNA, 20 bp, Artificial Sequence
  chemically synthesized
ataagcacacttatatgctt

SEQ ID NO: 615967 - DNA, 20 bp, Artificial Sequence
  chemically synthesized
acaaacgtataagcatataa

SEQ ID NO: 615968 - DNA, 20 bp, Artificial Sequence
  chemically synthesized
atacttatataagcacactt

SEQ ID NO: 615969 - DNA, 20 bp, Artificial Sequence
  chemically synthesized
tactcacatgctaacgtatc

SEQ ID NO: 615970 - DNA, 20 bp, Artificial Sequence
  chemically synthesized
ttaaagttaattttataggg

SEQ ID NO: 615971 - DNA, 20 bp, Artificial Sequence
  chemically synthesized
ttaaaaactcatacattctt

SEQ ID NO: 615972 - DNA, 20 bp, Artificial Sequence
  chemically synthesized
tatcaaacactaaagaatgt

SEQ ID NO: 615973 - DNA, 20 bp, Artificial Sequence
  chemically synthesized
tttcaaaccttaaaatgaaa

SEQ ID NO: 615974 - DNA, 20 bp, Artificial Sequence
  chemically synthesized
cataaagctgtatttcattt

SEQ ID NO: 615975 - DNA, 20 bp, Artificial Sequence
  chemically synthesized
tgctttgacacagtagatat

SEQ ID NO: 615976 - DNA, 20 bp, Artificial Sequence
  chemically synthesized
tccaatatctactgtgtcaa

SEQ ID NO: 615977 - DNA, 20 bp, Artificial Sequence
  chemically synthesized
ccatttcctttatatactca

SEQ ID NO: 615978 - DNA, 20 bp, Artificial Sequence
  chemically synthesized
gctatgacaaattaaatttt

SEQ ID NO: 615979 - DNA, 20 bp, Artificial Sequence
  chemically synthesized
aatgcgtgtgtgtatatttg

SEQ ID NO: 615980 - DNA, 20 bp, Artificial Sequence
  chemically synthesized
cttgataaggacagatacgt

SEQ ID NO: 615981 - DNA, 20 bp, Artificial Sequence
  chemically synthesized
tttttacttgataaggacag

SEQ ID NO: 615982 - DNA, 20 bp, Artificial Sequence
  chemically synthesized
ctgagcttacattcatgcac

SEQ ID NO: 615983 - DNA, 20 bp, Artificial Sequence
  chemically synthesized
aatagccctgataaagtaga

SEQ ID NO: 615984 - DNA, 20 bp, Artificial Sequence
  chemically synthesized
gtctactttatcagggctat

SEQ ID NO: 615985 - DNA, 20 bp, Artificial Sequence
  chemically synthesized
tttccgattttggctgatag

SEQ ID NO: 615986 - DNA, 20 bp, Artificial Sequence
  chemically synthesized
ctacaatagaatccatttga

SEQ ID NO: 615987 - DNA, 20 bp, Artificial Sequence
  chemically synthesized
tggttacaaaatctcattca

SEQ ID NO: 615988 - DNA, 20 bp, Artificial Sequence
  chemically synthesized
aggtggggtcacaaatcctt

SEQ ID NO: 615989 - DNA, 20 bp, Artificial Sequence
  chemically synthesized
gttaatcagtttgaaacagg

SEQ ID NO: 615990 - DNA, 20 bp, Artificial Sequence
  chemically synthesized
acaaatcctttcctgtttca

SEQ ID NO: 615991 - DNA, 20 bp, Artificial Sequence
  chemically synthesized
aaagagcagtatcagtgtta

SEQ ID NO: 615992 - DNA, 20 bp, Artificial Sequence
  chemically synthesized
atcgctattacttttattac

SEQ ID NO: 615993 - DNA, 20 bp, Artificial Sequence
  chemically synthesized
gcgatgtgtgtcatattata

SEQ ID NO: 615994 - DNA, 20 bp, Artificial Sequence
  chemically synthesized
cgtactcccctagtggggtg

SEQ ID NO: 615995 - DNA, 20 bp, Artificial Sequence
  chemically synthesized
agatggaaaatgtattggtg

SEQ ID NO: 615996 - DNA, 20 bp, Artificial Sequence
  chemically synthesized
aatgcaataggttatagcca

SEQ ID NO: 615997 - DNA, 20 bp, Artificial Sequence
  chemically synthesized
atgactagaagagaatggca

SEQ ID NO: 615998 - DNA, 20 bp, Artificial Sequence
  chemically synthesized
gcaaatgatccccattatag

SEQ ID NO: 615999 - DNA, 20 bp, Artificial Sequence
  chemically synthesized
tccccattatagtgtagttt

SEQ ID NO: 616000 - DNA, 20 bp, Artificial Sequence
  chemically synthesized
ccttttcgggcttgtacatc

SEQ ID NO: 616001 - DNA, 20 bp, Artificial Sequence
  chemically synthesized
tctgatattctccagccttt

SEQ ID NO: 616002 - DNA, 20 bp, Artificial Sequence
  chemically synthesized
gttacagggtgtatctgact

SEQ ID NO: 616003 - DNA, 20 bp, Artificial Sequence
  chemically synthesized
agaaacttcttttctgggat

SEQ ID NO: 616004 - DNA, 20 bp, Artificial Sequence
  chemically synthesized
taaatcagtgatcccagaaa

SEQ ID NO: 616005 - DNA, 20 bp, Artificial Sequence
  chemically synthesized
tggcagagatcactttgctc

SEQ ID NO: 616006 - DNA, 20 bp, Artificial Sequence
  chemically synthesized
tgatctctgccagctggagc

SEQ ID NO: 616007 - DNA, 20 bp, Artificial Sequence
  chemically synthesized
tgaattttccatatcctgga

SEQ ID NO: 616008 - DNA, 20 bp, Artificial Sequence
  chemically synthesized
tacaaaggaattttagccat

SEQ ID NO: 616009 - DNA, 20 bp, Artificial Sequence
  chemically synthesized
ttgtaaggcactacctattt

SEQ ID NO: 616010 - DNA, 20 bp, Artificial Sequence
  chemically synthesized
cctatttccctgtttcttgt

SEQ ID NO: 616011 - DNA, 20 bp, Artificial Sequence
  chemically synthesized
agagataactattgagaaaa

SEQ ID NO: 616012 - DNA, 20 bp, Artificial Sequence
  chemically synthesized
tttcccatttctttcataaa

SEQ ID NO: 616013 - DNA, 20 bp, Artificial Sequence
  chemically synthesized
aaagaaatgggaaaatattt

SEQ ID NO: 616014 - DNA, 20 bp, Artificial Sequence
  chemically synthesized
ttttgtgtctttaggtttcc

SEQ ID NO: 616015 - DNA, 20 bp, Artificial Sequence
  chemically synthesized
acaaatatttttttgtgtct

SEQ ID NO: 616016 - DNA, 20 bp, Artificial Sequence
  chemically synthesized
gagccaaaatataaattcat

SEQ ID NO: 616017 - DNA, 20 bp, Artificial Sequence
  chemically synthesized
ttataaacctttgtgacttt

SEQ ID NO: 616018 - DNA, 20 bp, Artificial Sequence
  chemically synthesized
gagtaaacaggcaaagtcac

SEQ ID NO: 616019 - DNA, 20 bp, Artificial Sequence
  chemically synthesized
accccgaccaatggcaagtg

SEQ ID NO: 616020 - DNA, 20 bp, Artificial Sequence
  chemically synthesized
cacttgccattggtcggggt

SEQ ID NO: 616021 - DNA, 20 bp, Artificial Sequence
  chemically synthesized
tgattagatgtgaaaaaaaa

SEQ ID NO: 616022 - DNA, 20 bp, Artificial Sequence
  chemically synthesized
tgggcatattaaactgaact

SEQ ID NO: 616023 - DNA, 20 bp, Artificial Sequence
  chemically synthesized
agttcatttaaatcacccag

SEQ ID NO: 616024 - DNA, 20 bp, Artificial Sequence
  chemically synthesized
attttgttctttcagcttta

SEQ ID NO: 616025 - DNA, 20 bp, Artificial Sequence
  chemically synthesized
aattgtgcatattttgttct

SEQ ID NO: 616026 - DNA, 20 bp, Artificial Sequence
  chemically synthesized
actaaaaataactgaatggt

SEQ ID NO: 616027 - DNA, 20 bp, Artificial Sequence
  chemically synthesized
ggacacttttcctcacagtc

SEQ ID NO: 616028 - DNA, 20 bp, Artificial Sequence
  chemically synthesized
actctcgtcactgcctctct

SEQ ID NO: 616029 - DNA, 20 bp, Artificial Sequence
  chemically synthesized
ccggcaacgtgtctcatttc

SEQ ID NO: 616030 - DNA, 20 bp, Artificial Sequence
  chemically synthesized
ccagggggtatttagtctgt

SEQ ID NO: 616031 - DNA, 20 bp, Artificial Sequence
  chemically synthesized
tgctcaacctaatttatttc

SEQ ID NO: 616032 - DNA, 20 bp, Artificial Sequence
  chemically synthesized
aacctaatttatttctgcgg

SEQ ID NO: 616033 - DNA, 20 bp, Artificial Sequence
  chemically synthesized
taatttatttctgcggcttg

SEQ ID NO: 616034 - DNA, 20 bp, Artificial Sequence
  chemically synthesized
cttggattgctttctgacta

SEQ ID NO: 616035 - DNA, 20 bp, Artificial Sequence
  chemically synthesized
taacaaaatccacttcttga

SEQ ID NO: 616036 - DNA, 20 bp, Artificial Sequence
  chemically synthesized
acattaaatctttatcaaga

SEQ ID NO: 616037 - DNA, 20 bp, Artificial Sequence
  chemically synthesized
tttgtaatgtccttaactct

SEQ ID NO: 616038 - DNA, 20 bp, Artificial Sequence
  chemically synthesized
cctaagagttaaggacatta

SEQ ID NO: 616039 - DNA, 20 bp, Artificial Sequence
  chemically synthesized
tgatgatgactaccaatatt

SEQ ID NO: 616040 - DNA, 20 bp, Artificial Sequence
  chemically synthesized
tcatcaaaaaacaataggtt

SEQ ID NO: 616041 - DNA, 20 bp, Artificial Sequence
  chemically synthesized
ttttactgaaactctcaacc

SEQ ID NO: 616042 - DNA, 20 bp, Artificial Sequence
  chemically synthesized
tgttcttatatatggttttc

SEQ ID NO: 616043 - DNA, 20 bp, Artificial Sequence
  chemically synthesized
atatttataatgttcttata

SEQ ID NO: 616044 - DNA, 20 bp, Artificial Sequence
  chemically synthesized
catatataagaacattataa

SEQ ID NO: 616045 - DNA, 20 bp, Artificial Sequence
  chemically synthesized
tggaagcacagtgtttatta

SEQ ID NO: 616046 - DNA, 20 bp, Artificial Sequence
  chemically synthesized
tagaaacaaggtaataaaca

SEQ ID NO: 616047 - DNA, 20 bp, Artificial Sequence
  chemically synthesized
ttaaatacatcttggaagca

SEQ ID NO: 616048 - DNA, 20 bp, Artificial Sequence
  chemically synthesized
cctcccacctcagcctccca

SEQ ID NO: 616049 - DNA, 20 bp, Artificial Sequence
  chemically synthesized
agaccatatctttaaaagaa

SEQ ID NO: 616050 - DNA, 20 bp, Artificial Sequence
  chemically synthesized
cctgtaatcccagctattca

SEQ ID NO: 616051 - DNA, 20 bp, Artificial Sequence
  chemically synthesized
caagcaatcctcctgaatag

SEQ ID NO: 616052 - DNA, 20 bp, Artificial Sequence
  chemically synthesized
taatcccagctattcaggag

SEQ ID NO: 616053 - DNA, 20 bp, Artificial Sequence
  chemically synthesized
atgcggtatttctctgtcac

SEQ ID NO: 616054 - DNA, 20 bp, Artificial Sequence
  chemically synthesized
ttttctatttttaaatttaa

SEQ ID NO: 616055 - DNA, 20 bp, Artificial Sequence
  chemically synthesized
agatcttggggcccagtgta

SEQ ID NO: 616056 - DNA, 20 bp, Artificial Sequence
  chemically synthesized
gctacactgggccccaagat

SEQ ID NO: 616057 - DNA, 20 bp, Artificial Sequence
  chemically synthesized
ctccaatttttccccaattt

SEQ ID NO: 616058 - DNA, 20 bp, Artificial Sequence
  chemically synthesized
gacatatgtttgttttatta

SEQ ID NO: 616059 - DNA, 20 bp, Artificial Sequence
  chemically synthesized
agttattgggatggacatat

SEQ ID NO: 616060 - DNA, 20 bp, Artificial Sequence
  chemically synthesized
tttcagttattgggatggac

SEQ ID NO: 616061 - DNA, 20 bp, Artificial Sequence
  chemically synthesized
gtacccctccctccatttac

SEQ ID NO: 616062 - DNA, 20 bp, Artificial Sequence
  chemically synthesized
attaactaccatccagaatc

SEQ ID NO: 616063 - DNA, 20 bp, Artificial Sequence
  chemically synthesized
aaggcaatgatatgacaatc

SEQ ID NO: 616064 - DNA, 20 bp, Artificial Sequence
  chemically synthesized
ggggattgtcatatcattgc

SEQ ID NO: 616065 - DNA, 20 bp, Artificial Sequence
  chemically synthesized
atatcattgcctttgatttc

SEQ ID NO: 616066 - DNA, 20 bp, Artificial Sequence
  chemically synthesized
ttgatttcttttgtttgctc

SEQ ID NO: 616067 - DNA, 20 bp, Artificial Sequence
  chemically synthesized
tgtttgctcatttgttttgt

SEQ ID NO: 616068 - DNA, 20 bp, Artificial Sequence
  chemically synthesized
catttgttttgtgttggttt

SEQ ID NO: 616069 - DNA, 20 bp, Artificial Sequence
  chemically synthesized
ataggaacacctaatgaaaa

SEQ ID NO: 616070 - DNA, 20 bp, Artificial Sequence
  chemically synthesized
aatattttcattaggtgttc

SEQ ID NO: 616071 - DNA, 20 bp, Artificial Sequence
  chemically synthesized
ttcattaggtgttcctatgc

SEQ ID NO: 616072 - DNA, 20 bp, Artificial Sequence
  chemically synthesized
aatggcgtgaacccgggagg

SEQ ID NO: 616073 - DNA, 20 bp, Artificial Sequence
  chemically synthesized
tcttgtatttttagtagaga

SEQ ID NO: 616074 - DNA, 20 bp, Artificial Sequence
  chemically synthesized
catctcggcctcccaaagtg

SEQ ID NO: 616075 - DNA, 20 bp, Artificial Sequence
  chemically synthesized
ccaccgcgcccggcctccct

SEQ ID NO: 616076 - DNA, 20 bp, Artificial Sequence
  chemically synthesized
tccctgacagtttttaaaaa

SEQ ID NO: 616077 - DNA, 20 bp, Artificial Sequence
  chemically synthesized
ttcactcatataataactat

SEQ ID NO: 616078 - DNA, 20 bp, Artificial Sequence
  chemically synthesized
agggccagatagtacatatt

SEQ ID NO: 616079 - DNA, 20 bp, Artificial Sequence
  chemically synthesized
tactatctggccctttaaga

SEQ ID NO: 616080 - DNA, 20 bp, Artificial Sequence
  chemically synthesized
aatgtttgtggacctctaca

SEQ ID NO: 616081 - DNA, 20 bp, Artificial Sequence
  chemically synthesized
tggacctctacattatgttt

SEQ ID NO: 616082 - DNA, 20 bp, Artificial Sequence
  chemically synthesized
cactggagacactcagtgta

SEQ ID NO: 616083 - DNA, 20 bp, Artificial Sequence
  chemically synthesized
gacttctatattcagcgcaa

SEQ ID NO: 616084 - DNA, 20 bp, Artificial Sequence
  chemically synthesized
tcttatttccaaatattctt

SEQ ID NO: 616085 - DNA, 20 bp, Artificial Sequence
  chemically synthesized
tgtctaagggggagagatag

SEQ ID NO: 616086 - DNA, 20 bp, Artificial Sequence
  chemically synthesized
tccttagctgttaatggata

SEQ ID NO: 616087 - DNA, 20 bp, Artificial Sequence
  chemically synthesized
gaaatcattaaaatgagatt

SEQ ID NO: 616088 - DNA, 20 bp, Artificial Sequence
  chemically synthesized
ataatccataaatctcattt

SEQ ID NO: 616089 - DNA, 20 bp, Artificial Sequence
  chemically synthesized
tttctagtgaaatcattaaa

SEQ ID NO: 616090 - DNA, 20 bp, Artificial Sequence
  chemically synthesized
ccccacggattatttacatt

SEQ ID NO: 616091 - DNA, 20 bp, Artificial Sequence
  chemically synthesized
ttacctcctatgtccacccc

SEQ ID NO: 616092 - DNA, 20 bp, Artificial Sequence
  chemically synthesized
tagacgagcaaaaggaagag

SEQ ID NO: 616093 - DNA, 20 bp, Artificial Sequence
  chemically synthesized
gcaagatttaaaagacctta

SEQ ID NO: 616094 - DNA, 20 bp, Artificial Sequence
  chemically synthesized
aagaccttattaagctttta

SEQ ID NO: 616095 - DNA, 20 bp, Artificial Sequence
  chemically synthesized
tacatgtgctaaaacatttt

SEQ ID NO: 616096 - DNA, 20 bp, Artificial Sequence
  chemically synthesized
gaaatcacctgtggtttcta

SEQ ID NO: 616097 - DNA, 20 bp, Artificial Sequence
  chemically synthesized
aaaaactgtctagaaaccac

SEQ ID NO: 616098 - DNA, 20 bp, Artificial Sequence
  chemically synthesized
agtaaagttatgaaatcacc

SEQ ID NO: 616099 - DNA, 20 bp, Artificial Sequence
  chemically synthesized
cttttttttttttctggaga

SEQ ID NO: 616100 - DNA, 20 bp, Artificial Sequence
  chemically synthesized
aacctccgcctcctgggttc

SEQ ID NO: 616101 - DNA, 20 bp, Artificial Sequence
  chemically synthesized
attttgtatttttagtagag

SEQ ID NO: 616102 - DNA, 20 bp, Artificial Sequence
  chemically synthesized
tgcctcggcctcccaaagtg

SEQ ID NO: 616103 - DNA, 20 bp, Artificial Sequence
  chemically synthesized
tacaggcgtgagccaccgcg

SEQ ID NO: 616104 - DNA, 20 bp, Artificial Sequence
  chemically synthesized
ataggatatgcccctttatg

SEQ ID NO: 616105 - DNA, 20 bp, Artificial Sequence
  chemically synthesized
aatgaaaatgagagggaatt

SEQ ID NO: 616106 - DNA, 20 bp, Artificial Sequence
  chemically synthesized
tactactcctgaaaccttca

SEQ ID NO: 616107 - DNA, 20 bp, Artificial Sequence
  chemically synthesized
ctgtttctgggaaactttgt

SEQ ID NO: 616108 - DNA, 20 bp, Artificial Sequence
  chemically synthesized
catgggctaggagtgggctg

SEQ ID NO: 616109 - DNA, 20 bp, Artificial Sequence
  chemically synthesized
tttcttacccttttcttcct

SEQ ID NO: 616110 - DNA, 20 bp, Artificial Sequence
  chemically synthesized
ggatgtgcttgcagtggcag

SEQ ID NO: 616111 - DNA, 20 bp, Artificial Sequence
  chemically synthesized
ctttatccagttatctgagg

SEQ ID NO: 616112 - DNA, 20 bp, Artificial Sequence
  chemically synthesized
tctggggatacttctagcca

SEQ ID NO: 616113 - DNA, 20 bp, Artificial Sequence
  chemically synthesized
atttcaggatcctactgtca

SEQ ID NO: 616114 - DNA, 20 bp, Artificial Sequence
  chemically synthesized
cctgtaatgattcccttata

SEQ ID NO: 616115 - DNA, 20 bp, Artificial Sequence
  chemically synthesized
gtatataagggaatcattac

SEQ ID NO: 616116 - DNA, 20 bp, Artificial Sequence
  chemically synthesized
gtctcagacgcaagcacctg

SEQ ID NO: 616117 - DNA, 20 bp, Artificial Sequence
  chemically synthesized
tgcgtctgagacacttctgg

SEQ ID NO: 616118 - DNA, 20 bp, Artificial Sequence
  chemically synthesized
acacattatcaaaaaacgtg

SEQ ID NO: 616119 - DNA, 20 bp, Artificial Sequence
  chemically synthesized
acttttgttattaaagcatt

SEQ ID NO: 616120 - DNA, 20 bp, Artificial Sequence
  chemically synthesized
cattagcatattaactcctt

SEQ ID NO: 616121 - DNA, 20 bp, Artificial Sequence
  chemically synthesized
gattgagttaatgtgggata

SEQ ID NO: 616122 - DNA, 20 bp, Artificial Sequence
  chemically synthesized
tcctccagtttctaccggga

SEQ ID NO: 616123 - DNA, 20 bp, Artificial Sequence
  chemically synthesized
tcagagtcccggtagaaact

SEQ ID NO: 616124 - DNA, 20 bp, Artificial Sequence
  chemically synthesized
agtcccggtagaaactggag

SEQ ID NO: 616125 - DNA, 20 bp, Artificial Sequence
  chemically synthesized
cgagattgagaaatcaatcc

SEQ ID NO: 616126 - DNA, 20 bp, Artificial Sequence
  chemically synthesized
gcaaactggcctcacatacc

SEQ ID NO: 616127 - DNA, 20 bp, Artificial Sequence
  chemically synthesized
tcaatctcggggtatgtgag

SEQ ID NO: 616128 - DNA, 20 bp, Artificial Sequence
  chemically synthesized
acctcaagggttaagaggaa

SEQ ID NO: 616129 - DNA, 20 bp, Artificial Sequence
  chemically synthesized
ctgaacagctaacattagac

SEQ ID NO: 616130 - DNA, 20 bp, Artificial Sequence
  chemically synthesized
atttattttcatgtggcccc

SEQ ID NO: 616131 - DNA, 20 bp, Artificial Sequence
  chemically synthesized
gcatcagagttcctttgccc

SEQ ID NO: 616132 - DNA, 20 bp, Artificial Sequence
  chemically synthesized
ccatttttcattctttacca

SEQ ID NO: 616133 - DNA, 20 bp, Artificial Sequence
  chemically synthesized
cacagtggtaaagaatgaaa

SEQ ID NO: 616134 - DNA, 20 bp, Artificial Sequence
  chemically synthesized
attaacttgaaagggaaaag

SEQ ID NO: 616135 - DNA, 20 bp, Artificial Sequence
  chemically synthesized
aagttaatctagtatgttga

SEQ ID NO: 616136 - DNA, 20 bp, Artificial Sequence
  chemically synthesized
agagcaaaccaactcaacat

SEQ ID NO: 616137 - DNA, 20 bp, Artificial Sequence
  chemically synthesized
tttgctctttaactaaaccc

SEQ ID NO: 616138 - DNA, 20 bp, Artificial Sequence
  chemically synthesized
tcctcaggctttggaaacag

SEQ ID NO: 616139 - DNA, 20 bp, Artificial Sequence
  chemically synthesized
cagtaggtagtatgttatcc

SEQ ID NO: 616140 - DNA, 20 bp, Artificial Sequence
  chemically synthesized
ctccaggactgctgccttaa

SEQ ID NO: 616141 - DNA, 20 bp, Artificial Sequence
  chemically synthesized
cgtgtgtctgtaaaatacta

SEQ ID NO: 616142 - DNA, 20 bp, Artificial Sequence
  chemically synthesized
acgatgagtctctcttcctc

SEQ ID NO: 616143 - DNA, 20 bp, Artificial Sequence
  chemically synthesized
ctatataatattggttacct

SEQ ID NO: 616144 - DNA, 20 bp, Artificial Sequence
  chemically synthesized
cactgaggtaaccaatatta

SEQ ID NO: 616145 - DNA, 20 bp, Artificial Sequence
  chemically synthesized
cgttgatagtcatgatgagt

SEQ ID NO: 616146 - DNA, 20 bp, Artificial Sequence
  chemically synthesized
caggtactcatcatgactat

SEQ ID NO: 616147 - DNA, 20 bp, Artificial Sequence
  chemically synthesized
gaacctgaaaaaagtagtga

SEQ ID NO: 616148 - DNA, 20 bp, Artificial Sequence
  chemically synthesized
cagaacttccttcattttac

SEQ ID NO: 616149 - DNA, 20 bp, Artificial Sequence
  chemically synthesized
aatccgagcatctcagtttg

SEQ ID NO: 616150 - DNA, 20 bp, Artificial Sequence
  chemically synthesized
aaacttttcaaactgagatg

SEQ ID NO: 616151 - DNA, 20 bp, Artificial Sequence
  chemically synthesized
gtggtctgtaatccgagcat

SEQ ID NO: 616152 - DNA, 20 bp, Artificial Sequence
  chemically synthesized
tggaaatagaacgcagatat

SEQ ID NO: 616153 - DNA, 20 bp, Artificial Sequence
  chemically synthesized
cattttgctacacattggtg

SEQ ID NO: 616154 - DNA, 20 bp, Artificial Sequence
  chemically synthesized
ttaaagagagtggaaagatc

SEQ ID NO: 616155 - DNA, 20 bp, Artificial Sequence
  chemically synthesized
gtaaattaccaagagaacca

SEQ ID NO: 616156 - DNA, 20 bp, Artificial Sequence
  chemically synthesized
atattatcagcaaggcatct

SEQ ID NO: 616157 - DNA, 20 bp, Artificial Sequence
  chemically synthesized
gaaaagggttatcgaattta

SEQ ID NO: 616158 - DNA, 20 bp, Artificial Sequence
  chemically synthesized
cataaaataacctgtgatag

SEQ ID NO: 616159 - DNA, 20 bp, Artificial Sequence
  chemically synthesized
tatcagtattcaaaggactg

SEQ ID NO: 616160 - DNA, 20 bp, Artificial Sequence
  chemically synthesized
aaggactgtagagcttttag

SEQ ID NO: 616161 - DNA, 20 bp, Artificial Sequence
  chemically synthesized
actctgtccctgataaatga

SEQ ID NO: 616162 - DNA, 20 bp, Artificial Sequence
  chemically synthesized
tagtccagttgctagaaaat

SEQ ID NO: 616163 - DNA, 20 bp, Artificial Sequence
  chemically synthesized
tgggcatcactaggaataca

SEQ ID NO: 616164 - DNA, 20 bp, Artificial Sequence
  chemically synthesized
gtagaattaggcaattatat

SEQ ID NO: 616165 - DNA, 20 bp, Artificial Sequence
  chemically synthesized
agagtttaaaaaatcagtaa

SEQ ID NO: 616166 - DNA, 20 bp, Artificial Sequence
  chemically synthesized
gtttaaaataaaaacatcct

SEQ ID NO: 616167 - DNA, 20 bp, Artificial Sequence
  chemically synthesized
acctacttttcaattatcca

SEQ ID NO: 616168 - DNA, 20 bp, Artificial Sequence
  chemically synthesized
tttatttgccaaacgactgt

SEQ ID NO: 616169 - DNA, 20 bp, Artificial Sequence
  chemically synthesized
tctggttttaaatctaatac

SEQ ID NO: 616170 - DNA, 20 bp, Artificial Sequence
  chemically synthesized
ttctacataggggcttgttt

SEQ ID NO: 616171 - DNA, 20 bp, Artificial Sequence
  chemically synthesized
aatctatattctacataggg

SEQ ID NO: 616172 - DNA, 20 bp, Artificial Sequence
  chemically synthesized
tgagaatctatattctacat

SEQ ID NO: 616173 - DNA, 20 bp, Artificial Sequence
  chemically synthesized
aaacaagcccctatgtagaa

SEQ ID NO: 616174 - DNA, 20 bp, Artificial Sequence
  chemically synthesized
aagtaataagacatttccta

SEQ ID NO: 616175 - DNA, 20 bp, Artificial Sequence
  chemically synthesized
agacatttcctagggtgttt

SEQ ID NO: 616176 - DNA, 20 bp, Artificial Sequence
  chemically synthesized
tcagtattgtcggatatcct

SEQ ID NO: 616177 - DNA, 20 bp, Artificial Sequence
  chemically synthesized
aacaactattttttttctct

SEQ ID NO: 616178 - DNA, 20 bp, Artificial Sequence
  chemically synthesized
acaaatagaggtctaattat

SEQ ID NO: 616179 - DNA, 20 bp, Artificial Sequence
  chemically synthesized
aggtctaattataggggatt

SEQ ID NO: 616180 - DNA, 20 bp, Artificial Sequence
  chemically synthesized
gatacctgctaatggactgt

SEQ ID NO: 616181 - DNA, 20 bp, Artificial Sequence
  chemically synthesized
atatatacacatatatattt

SEQ ID NO: 616182 - DNA, 20 bp, Artificial Sequence
  chemically synthesized
ttatgtggttttttggtcat

SEQ ID NO: 616183 - DNA, 20 bp, Artificial Sequence
  chemically synthesized
accactaagaaaagatatta

SEQ ID NO: 616184 - DNA, 20 bp, Artificial Sequence
  chemically synthesized
agtttatcaagaagatgccc

SEQ ID NO: 616185 - DNA, 20 bp, Artificial Sequence
  chemically synthesized
atttcctttcttcataaatg

SEQ ID NO: 616186 - DNA, 20 bp, Artificial Sequence
  chemically synthesized
atgctgcataaaatgaactt

SEQ ID NO: 616187 - DNA, 20 bp, Artificial Sequence
  chemically synthesized
atttcatacatcatccacac

SEQ ID NO: 616188 - DNA, 20 bp, Artificial Sequence
  chemically synthesized
aaaaatagcactgacttcag

SEQ ID NO: 616189 - DNA, 20 bp, Artificial Sequence
  chemically synthesized
tactgatttttgtatattga

SEQ ID NO: 616190 - DNA, 20 bp, Artificial Sequence
  chemically synthesized
aaatgttactgatttttgta

SEQ ID NO: 616191 - DNA, 20 bp, Artificial Sequence
  chemically synthesized
ttactggtatgtagaaatgt

SEQ ID NO: 616192 - DNA, 20 bp, Artificial Sequence
  chemically synthesized
attgcatacttgatttggtg

SEQ ID NO: 616193 - DNA, 20 bp, Artificial Sequence
  chemically synthesized
atgggattgcatacttgatt

SEQ ID NO: 616194 - DNA, 20 bp, Artificial Sequence
  chemically synthesized
tattataaatgggattgcat

SEQ ID NO: 616195 - DNA, 20 bp, Artificial Sequence
  chemically synthesized
attttttatggctattataa

SEQ ID NO: 616196 - DNA, 20 bp, Artificial Sequence
  chemically synthesized
tttctatttgtttgtgtcat

SEQ ID NO: 616197 - DNA, 20 bp, Artificial Sequence
  chemically synthesized
tgagtatggaaagtttttct

SEQ ID NO: 616198 - DNA, 20 bp, Artificial Sequence
  chemically synthesized
atagaaaaactttccatact

SEQ ID NO: 616199 - DNA, 20 bp, Artificial Sequence
  chemically synthesized
tcttctaatccatgagtatg

SEQ ID NO: 616200 - DNA, 20 bp, Artificial Sequence
  chemically synthesized
tagtatggccattttaatga

SEQ ID NO: 616201 - DNA, 20 bp, Artificial Sequence
  chemically synthesized
ggaataacatttaattcgta

SEQ ID NO: 616202 - DNA, 20 bp, Artificial Sequence
  chemically synthesized
gataggaataacatttaatt

SEQ ID NO: 616203 - DNA, 20 bp, Artificial Sequence
  chemically synthesized
gttctgtgaaaaatgatgtt

SEQ ID NO: 616204 - DNA, 20 bp, Artificial Sequence
  chemically synthesized
tggttctatatgaattttag

SEQ ID NO: 616205 - DNA, 20 bp, Artificial Sequence
  chemically synthesized
tctggctttgttctttttcc

SEQ ID NO: 616206 - DNA, 20 bp, Artificial Sequence
  chemically synthesized
aagttgggtaatgtgctgcc

SEQ ID NO: 616207 - DNA, 20 bp, Artificial Sequence
  chemically synthesized
cggttgctgtagccttatag

SEQ ID NO: 616208 - DNA, 20 bp, Artificial Sequence
  chemically synthesized
gcaaccgaatcagcatggta

SEQ ID NO: 616209 - DNA, 20 bp, Artificial Sequence
  chemically synthesized
gtaactgaaacgttatacca

SEQ ID NO: 616210 - DNA, 20 bp, Artificial Sequence
  chemically synthesized
aaatttgctgagagtaaatt

SEQ ID NO: 616211 - DNA, 20 bp, Artificial Sequence
  chemically synthesized
gtgaagagatggatatgtta

SEQ ID NO: 616212 - DNA, 20 bp, Artificial Sequence
  chemically synthesized
tgatgtgcatatacgcagtg

SEQ ID NO: 616213 - DNA, 20 bp, Artificial Sequence
  chemically synthesized
tatatttaagatgtataatg

SEQ ID NO: 616214 - DNA, 20 bp, Artificial Sequence
  chemically synthesized
cagtaccatgctgtttttgt

SEQ ID NO: 616215 - DNA, 20 bp, Artificial Sequence
  chemically synthesized
ttgtgccagtaccatgctgt

SEQ ID NO: 616216 - DNA, 20 bp, Artificial Sequence
  chemically synthesized
ctgtttttgtgccagtacca

SEQ ID NO: 616217 - DNA, 20 bp, Artificial Sequence
  chemically synthesized
tttgttccattggtttatgt

SEQ ID NO: 616218 - DNA, 20 bp, Artificial Sequence
  chemically synthesized
tgggttctctactttgttcc

SEQ ID NO: 616219 - DNA, 20 bp, Artificial Sequence
  chemically synthesized
aaatcatatggctgcaggtg

SEQ ID NO: 616220 - DNA, 20 bp, Artificial Sequence
  chemically synthesized
aaagccacacacctgcagcc

SEQ ID NO: 616221 - DNA, 20 bp, Artificial Sequence
  chemically synthesized
ttgaacagggagtcctttcc

SEQ ID NO: 616222 - DNA, 20 bp, Artificial Sequence
  chemically synthesized
tacatgtcgaaaattaggga

SEQ ID NO: 616223 - DNA, 20 bp, Artificial Sequence
  chemically synthesized
catgtataaaaattaaccca

SEQ ID NO: 616224 - DNA, 20 bp, Artificial Sequence
  chemically synthesized
aaaaattaacccaagatgat

SEQ ID NO: 616225 - DNA, 20 bp, Artificial Sequence
  chemically synthesized
aggttttcttctacaattct

SEQ ID NO: 616226 - DNA, 20 bp, Artificial Sequence
  chemically synthesized
aatgtccagaatgatgtttc

SEQ ID NO: 616227 - DNA, 20 bp, Artificial Sequence
  chemically synthesized
cctaaccccaatgtccagaa

SEQ ID NO: 616228 - DNA, 20 bp, Artificial Sequence
  chemically synthesized
gcttttgaggatttagtcat

SEQ ID NO: 616229 - DNA, 20 bp, Artificial Sequence
  chemically synthesized
ggttttgctccaattgcttt

SEQ ID NO: 616230 - DNA, 20 bp, Artificial Sequence
  chemically synthesized
caattttttggttttgctcc

SEQ ID NO: 616231 - DNA, 20 bp, Artificial Sequence
  chemically synthesized
taggtctcgcttgtcaattt

SEQ ID NO: 616232 - DNA, 20 bp, Artificial Sequence
  chemically synthesized
agctttttagtttaattagg

SEQ ID NO: 616233 - DNA, 20 bp, Artificial Sequence
  chemically synthesized
agcgagacctaattaaacta

SEQ ID NO: 616234 - DNA, 20 bp, Artificial Sequence
  chemically synthesized
cttttgctgtgcagaagctt

SEQ ID NO: 616235 - DNA, 20 bp, Artificial Sequence
  chemically synthesized
gatagtttcttttgctgtgc

SEQ ID NO: 616236 - DNA, 20 bp, Artificial Sequence
  chemically synthesized
aggttgtctgttactctgtt

SEQ ID NO: 616237 - DNA, 20 bp, Artificial Sequence
  chemically synthesized
tttgtgtgatatgtagtttg

SEQ ID NO: 616238 - DNA, 20 bp, Artificial Sequence
  chemically synthesized
tattgaacctttgtgtgata

SEQ ID NO: 616239 - DNA, 20 bp, Artificial Sequence
  chemically synthesized
atggcgttgtattttgcttg

SEQ ID NO: 616240 - DNA, 20 bp, Artificial Sequence
  chemically synthesized
tgttttttgatggcgttgta

SEQ ID NO: 616241 - DNA, 20 bp, Artificial Sequence
  chemically synthesized
ggtgtctgttcatgcccttt

SEQ ID NO: 616242 - DNA, 20 bp, Artificial Sequence
  chemically synthesized
atgttattcagcattttttc

SEQ ID NO: 616243 - DNA, 20 bp, Artificial Sequence
  chemically synthesized
gcgatggtatctcattgtgg

SEQ ID NO: 616244 - DNA, 20 bp, Artificial Sequence
  chemically synthesized
ggtgtgcgatggtatctcat

SEQ ID NO: 616245 - DNA, 20 bp, Artificial Sequence
  chemically synthesized
tcaccagcatttgttgtttt

SEQ ID NO: 616246 - DNA, 20 bp, Artificial Sequence
  chemically synthesized
tctgcggcttcaccagcatt

SEQ ID NO: 616247 - DNA, 20 bp, Artificial Sequence
  chemically synthesized
tataagcattcccttttctc

SEQ ID NO: 616248 - DNA, 20 bp, Artificial Sequence
  chemically synthesized
gtgaagccgcagagaaaagg

SEQ ID NO: 616249 - DNA, 20 bp, Artificial Sequence
  chemically synthesized
ttagttcagccactgtggaa

SEQ ID NO: 616250 - DNA, 20 bp, Artificial Sequence
  chemically synthesized
agccactgtggaaggcagtt

SEQ ID NO: 616251 - DNA, 20 bp, Artificial Sequence
  chemically synthesized
atatattcagtaatgggatt

SEQ ID NO: 616252 - DNA, 20 bp, Artificial Sequence
  chemically synthesized
ttttggatatatattcagta

SEQ ID NO: 616253 - DNA, 20 bp, Artificial Sequence
  chemically synthesized
tatatatccaaaataaataa

SEQ ID NO: 616254 - DNA, 20 bp, Artificial Sequence
  chemically synthesized
atagtattccatggggtata

SEQ ID NO: 616255 - DNA, 20 bp, Artificial Sequence
  chemically synthesized
ctacgaaggacatgatttca

SEQ ID NO: 616256 - DNA, 20 bp, Artificial Sequence
  chemically synthesized
catctgtgttgctacgaagg

SEQ ID NO: 616257 - DNA, 20 bp, Artificial Sequence
  chemically synthesized
aaggtgaaaacgatagacac

SEQ ID NO: 616258 - DNA, 20 bp, Artificial Sequence
  chemically synthesized
ttctagtaatccctagtgtc

SEQ ID NO: 616259 - DNA, 20 bp, Artificial Sequence
  chemically synthesized
actgagtatagtacccaata

SEQ ID NO: 616260 - DNA, 20 bp, Artificial Sequence
  chemically synthesized
ggagcatgcaagtgaattcc

SEQ ID NO: 616261 - DNA, 20 bp, Artificial Sequence
  chemically synthesized
gggttgcctcatttacctag

SEQ ID NO: 616262 - DNA, 20 bp, Artificial Sequence
  chemically synthesized
gggaaggggtcagggaaata

SEQ ID NO: 616263 - DNA, 20 bp, Artificial Sequence
  chemically synthesized
atatttcttccaacttgaag

SEQ ID NO: 616264 - DNA, 20 bp, Artificial Sequence
  chemically synthesized
acttgaagtccagctttaca

SEQ ID NO: 616265 - DNA, 20 bp, Artificial Sequence
  chemically synthesized
attttgtagtttgcggtttt

SEQ ID NO: 616266 - DNA, 20 bp, Artificial Sequence
  chemically synthesized
tgttattttgtagtttgcgg

SEQ ID NO: 616267 - DNA, 20 bp, Artificial Sequence
  chemically synthesized
gtttttgttattttgtagtt

SEQ ID NO: 616268 - DNA, 20 bp, Artificial Sequence
  chemically synthesized
cttgggtgtttttgttattt

SEQ ID NO: 616269 - DNA, 20 bp, Artificial Sequence
  chemically synthesized
ataacaaaaacacccaagca

SEQ ID NO: 616270 - DNA, 20 bp, Artificial Sequence
  chemically synthesized
cttaactaatcacattgctt

SEQ ID NO: 616271 - DNA, 20 bp, Artificial Sequence
  chemically synthesized
aataatgtcttaactaatca

SEQ ID NO: 616272 - DNA, 20 bp, Artificial Sequence
  chemically synthesized
ttaagacattattaaagtgt

SEQ ID NO: 616273 - DNA, 20 bp, Artificial Sequence
  chemically synthesized
taaagtgtgggtgtttccag

SEQ ID NO: 616274 - DNA, 20 bp, Artificial Sequence
  chemically synthesized
ctcaaaaggtaagagaatag

SEQ ID NO: 616275 - DNA, 20 bp, Artificial Sequence
  chemically synthesized
gacagagaaagtgaaagaga

SEQ ID NO: 616276 - DNA, 20 bp, Artificial Sequence
  chemically synthesized
ctatgtcgttatttgaattt

SEQ ID NO: 616277 - DNA, 20 bp, Artificial Sequence
  chemically synthesized
tgagccactgctccagccaa

SEQ ID NO: 616278 - DNA, 20 bp, Artificial Sequence
  chemically synthesized
cgcctcggcctcccaaattg

SEQ ID NO: 616279 - DNA, 20 bp, Artificial Sequence
  chemically synthesized
cgggtggatcacctgaggtc

SEQ ID NO: 616280 - DNA, 20 bp, Artificial Sequence
  chemically synthesized
ttttgtatttttagtagaga

SEQ ID NO: 616281 - DNA, 20 bp, Artificial Sequence
  chemically synthesized
tgcctcagcctcccaactag

SEQ ID NO: 616282 - DNA, 20 bp, Artificial Sequence
  chemically synthesized
ttgggaggctgaggcagaag

SEQ ID NO: 616283 - DNA, 20 bp, Artificial Sequence
  chemically synthesized
agcctctgcctcctggattg

SEQ ID NO: 616284 - DNA, 20 bp, Artificial Sequence
  chemically synthesized
gctcactgcagcctctgcct

SEQ ID NO: 616285 - DNA, 20 bp, Artificial Sequence
  chemically synthesized
gattctctttttttttcttt

SEQ ID NO: 616286 - DNA, 20 bp, Artificial Sequence
  chemically synthesized
aatttcaagattcaagttaa

SEQ ID NO: 616287 - DNA, 20 bp, Artificial Sequence
  chemically synthesized
ctgctactttacagaaaatt

SEQ ID NO: 616288 - DNA, 20 bp, Artificial Sequence
  chemically synthesized
ttgggcttatatttcctttc

SEQ ID NO: 616289 - DNA, 20 bp, Artificial Sequence
  chemically synthesized
ttgcagagtctattaccgtg

SEQ ID NO: 616290 - DNA, 20 bp, Artificial Sequence
  chemically synthesized
tgctataataatagtgtaca

SEQ ID NO: 616291 - DNA, 20 bp, Artificial Sequence
  chemically synthesized
taatagtgtacatactgttt

SEQ ID NO: 616292 - DNA, 20 bp, Artificial Sequence
  chemically synthesized
gattaggtctcgtgttttgt

SEQ ID NO: 616293 - DNA, 20 bp, Artificial Sequence
  chemically synthesized
tctctaactatgattaggtc

SEQ ID NO: 616294 - DNA, 20 bp, Artificial Sequence
  chemically synthesized
attccttctgtgttctctaa

SEQ ID NO: 616295 - DNA, 20 bp, Artificial Sequence
  chemically synthesized
atggggattttagtggtcct

SEQ ID NO: 616296 - DNA, 20 bp, Artificial Sequence
  chemically synthesized
taacccttcacatgataaaa

SEQ ID NO: 616297 - DNA, 20 bp, Artificial Sequence
  chemically synthesized
gggttaagacatacttttga

SEQ ID NO: 616298 - DNA, 20 bp, Artificial Sequence
  chemically synthesized
aacatgtttatatctctaat

SEQ ID NO: 616299 - DNA, 20 bp, Artificial Sequence
  chemically synthesized
tagagatataaacatgttat

SEQ ID NO: 616300 - DNA, 20 bp, Artificial Sequence
  chemically synthesized
tgcgtgacaaatctgtaata

SEQ ID NO: 616301 - DNA, 20 bp, Artificial Sequence
  chemically synthesized
acttgaatcatgtacagata

SEQ ID NO: 616302 - DNA, 20 bp, Artificial Sequence
  chemically synthesized
tttttaatcaaattatctgt

SEQ ID NO: 616303 - DNA, 20 bp, Artificial Sequence
  chemically synthesized
atttgattaaaaattgaaaa

SEQ ID NO: 616304 - DNA, 20 bp, Artificial Sequence
  chemically synthesized
gaatataaatttgtttgaat

SEQ ID NO: 616305 - DNA, 20 bp, Artificial Sequence
  chemically synthesized
atgcttattaatgaatataa

SEQ ID NO: 616306 - DNA, 20 bp, Artificial Sequence
  chemically synthesized
ttggaattttaaaaagtgta

SEQ ID NO: 616307 - DNA, 20 bp, Artificial Sequence
  chemically synthesized
catataatgctgtattatga

SEQ ID NO: 616308 - DNA, 20 bp, Artificial Sequence
  chemically synthesized
tatacatactgtgtattaca

SEQ ID NO: 616309 - DNA, 20 bp, Artificial Sequence
  chemically synthesized
tttattttttcatgtatgta

SEQ ID NO: 616310 - DNA, 20 bp, Artificial Sequence
  chemically synthesized
aatttaaaataaaattttac

SEQ ID NO: 616311 - DNA, 20 bp, Artificial Sequence
  chemically synthesized
ctcctactgatgaatactgg

SEQ ID NO: 616312 - DNA, 20 bp, Artificial Sequence
  chemically synthesized
gactgagttgtacctatatt

SEQ ID NO: 616313 - DNA, 20 bp, Artificial Sequence
  chemically synthesized
ttccagggaaattatcgaag

SEQ ID NO: 616314 - DNA, 20 bp, Artificial Sequence
  chemically synthesized
gataatttccctggaaatgc

SEQ ID NO: 616315 - DNA, 20 bp, Artificial Sequence
  chemically synthesized
aattgcttagtcaagtgtaa

SEQ ID NO: 616316 - DNA, 20 bp, Artificial Sequence
  chemically synthesized
tcaagtgtaagcacgctttc

SEQ ID NO: 616317 - DNA, 20 bp, Artificial Sequence
  chemically synthesized
gcaataccaatcaagagaaa

SEQ ID NO: 616318 - DNA, 20 bp, Artificial Sequence
  chemically synthesized
gaatcaatttatttcatgag

SEQ ID NO: 616319 - DNA, 20 bp, Artificial Sequence
  chemically synthesized
caaactgctctcatgaaata

SEQ ID NO: 616320 - DNA, 20 bp, Artificial Sequence
  chemically synthesized
aacttttccttgtatacttt

SEQ ID NO: 616321 - DNA, 20 bp, Artificial Sequence
  chemically synthesized
attttttcatatacctttgg

SEQ ID NO: 616322 - DNA, 20 bp, Artificial Sequence
  chemically synthesized
atgtgtaattttgttacatg

SEQ ID NO: 616323 - DNA, 20 bp, Artificial Sequence
  chemically synthesized
agattgtgtagtggtcaagt

SEQ ID NO: 616324 - DNA, 20 bp, Artificial Sequence
  chemically synthesized
actccaaccccctcacccta

SEQ ID NO: 616325 - DNA, 20 bp, Artificial Sequence
  chemically synthesized
aggtctaacactttcttcct

SEQ ID NO: 616326 - DNA, 20 bp, Artificial Sequence
  chemically synthesized
gcaatgcatttatttttctg

SEQ ID NO: 616327 - DNA, 20 bp, Artificial Sequence
  chemically synthesized
ttatttttctgaattgattt

SEQ ID NO: 616328 - DNA, 20 bp, Artificial Sequence
  chemically synthesized
attgatttgtaagattcaat

SEQ ID NO: 616329 - DNA, 20 bp, Artificial Sequence
  chemically synthesized
gtaagattcaatttcagttt

SEQ ID NO: 616330 - DNA, 20 bp, Artificial Sequence
  chemically synthesized
cagtttactggtttttaatg

SEQ ID NO: 616331 - DNA, 20 bp, Artificial Sequence
  chemically synthesized
acagattttaaaaattatct

SEQ ID NO: 616332 - DNA, 20 bp, Artificial Sequence
  chemically synthesized
tgtgttttccattttaaatt

SEQ ID NO: 616333 - DNA, 20 bp, Artificial Sequence
  chemically synthesized
gatggtagagaactatgtag

SEQ ID NO: 616334 - DNA, 20 bp, Artificial Sequence
  chemically synthesized
cctatcgttcttcctgttct

SEQ ID NO: 616335 - DNA, 20 bp, Artificial Sequence
  chemically synthesized
cttcctgttctttgggcttc

SEQ ID NO: 616336 - DNA, 20 bp, Artificial Sequence
  chemically synthesized
tttgggcttcttaagcttaa

SEQ ID NO: 616337 - DNA, 20 bp, Artificial Sequence
  chemically synthesized
gaacaaatattcaatcataa

SEQ ID NO: 616338 - DNA, 20 bp, Artificial Sequence
  chemically synthesized
attcactgcattgtgtaaag

SEQ ID NO: 616339 - DNA, 20 bp, Artificial Sequence
  chemically synthesized
aatcatgttaaaaggcaaaa

SEQ ID NO: 616340 - DNA, 20 bp, Artificial Sequence
  chemically synthesized
aagcagggttttgcctttta

SEQ ID NO: 616341 - DNA, 20 bp, Artificial Sequence
  chemically synthesized
tagagatggactatgaaaga

SEQ ID NO: 616342 - DNA, 20 bp, Artificial Sequence
  chemically synthesized
tttcatagtccatctctatc

SEQ ID NO: 616343 - DNA, 20 bp, Artificial Sequence
  chemically synthesized
tatatacacttgagcatatt

SEQ ID NO: 616344 - DNA, 20 bp, Artificial Sequence
  chemically synthesized
gcatattttgggattttctc

SEQ ID NO: 616345 - DNA, 20 bp, Artificial Sequence
  chemically synthesized
ttttctcttttgtttcacta

SEQ ID NO: 616346 - DNA, 20 bp, Artificial Sequence
  chemically synthesized
atctactaaaagtctataca

SEQ ID NO: 616347 - DNA, 20 bp, Artificial Sequence
  chemically synthesized
atctgtttgtatagactttt

SEQ ID NO: 616348 - DNA, 20 bp, Artificial Sequence
  chemically synthesized
gaggcagaggttgcagtgag

SEQ ID NO: 616349 - DNA, 20 bp, Artificial Sequence
  chemically synthesized
aacctctgcctccctggatc

SEQ ID NO: 616350 - DNA, 20 bp, Artificial Sequence
  chemically synthesized
tcgggaggctgcggcaggag

SEQ ID NO: 616351 - DNA, 20 bp, Artificial Sequence
  chemically synthesized
tgccgcagcctcccgagtag

SEQ ID NO: 616352 - DNA, 20 bp, Artificial Sequence
  chemically synthesized
tttgtatttttaagtagagg

SEQ ID NO: 616353 - DNA, 20 bp, Artificial Sequence
  chemically synthesized
cgcctcggcctcgcaaagtg

SEQ ID NO: 616354 - DNA, 20 bp, Artificial Sequence
  chemically synthesized
agacaccgcacccagccagt

SEQ ID NO: 616355 - DNA, 20 bp, Artificial Sequence
  chemically synthesized
atttgcccatgtagctatta

SEQ ID NO: 616356 - DNA, 20 bp, Artificial Sequence
  chemically synthesized
tgggcaaatgacctttcatt

SEQ ID NO: 616357 - DNA, 20 bp, Artificial Sequence
  chemically synthesized
ttatctggcagcaatataga

SEQ ID NO: 616358 - DNA, 20 bp, Artificial Sequence
  chemically synthesized
ggatgtgacaagaattactc

SEQ ID NO: 616359 - DNA, 20 bp, Artificial Sequence
  chemically synthesized
gccaccccaatttaaatttt

SEQ ID NO: 616360 - DNA, 20 bp, Artificial Sequence
  chemically synthesized
tttaaattttatgtgtttct

SEQ ID NO: 616361 - DNA, 20 bp, Artificial Sequence
  chemically synthesized
tttatgtgtttctatcagat

SEQ ID NO: 616362 - DNA, 20 bp, Artificial Sequence
  chemically synthesized
tattctgttatttttccagt

SEQ ID NO: 616363 - DNA, 20 bp, Artificial Sequence
  chemically synthesized
tttgaacttctgtggaaaat

SEQ ID NO: 616364 - DNA, 20 bp, Artificial Sequence
  chemically synthesized
acttctgtggaaaatgatag

SEQ ID NO: 616365 - DNA, 20 bp, Artificial Sequence
  chemically synthesized
taattaatatttaattattt

SEQ ID NO: 616366 - DNA, 20 bp, Artificial Sequence
  chemically synthesized
ctaggttttttcttttctta

SEQ ID NO: 616367 - DNA, 20 bp, Artificial Sequence
  chemically synthesized
ttagttataatagttgtcat

SEQ ID NO: 616368 - DNA, 20 bp, Artificial Sequence
  chemically synthesized
ttttccccaatacttatact

SEQ ID NO: 616369 - DNA, 20 bp, Artificial Sequence
  chemically synthesized
tatacttcctgtttctttta

SEQ ID NO: 616370 - DNA, 20 bp, Artificial Sequence
  chemically synthesized
gcaaaatagcatttaaaaag

SEQ ID NO: 616371 - DNA, 20 bp, Artificial Sequence
  chemically synthesized
acattgatcacagagttggc

SEQ ID NO: 616372 - DNA, 20 bp, Artificial Sequence
  chemically synthesized
tttgagatagacaatatttt

SEQ ID NO: 616373 - DNA, 20 bp, Artificial Sequence
  chemically synthesized
ttagcaatgtaagaatagat

SEQ ID NO: 616374 - DNA, 20 bp, Artificial Sequence
  chemically synthesized
tcatctattcttacattgct

SEQ ID NO: 616375 - DNA, 20 bp, Artificial Sequence
  chemically synthesized
tattcttacattgctaaaag

SEQ ID NO: 616376 - DNA, 20 bp, Artificial Sequence
  chemically synthesized
gtttctactcctaaattagg

SEQ ID NO: 616377 - DNA, 20 bp, Artificial Sequence
  chemically synthesized
tacctacaatgaaggatgta

SEQ ID NO: 616378 - DNA, 20 bp, Artificial Sequence
  chemically synthesized
gattctcttatagtaggcat

SEQ ID NO: 616379 - DNA, 20 bp, Artificial Sequence
  chemically synthesized
agaagaagttatcatgccaa

SEQ ID NO: 616380 - DNA, 20 bp, Artificial Sequence
  chemically synthesized
tctcttattggctaaatctg

SEQ ID NO: 616381 - DNA, 20 bp, Artificial Sequence
  chemically synthesized
ggctaaatctgctatgtttt

SEQ ID NO: 616382 - DNA, 20 bp, Artificial Sequence
  chemically synthesized
gttcaaatcttataaaacat

SEQ ID NO: 616383 - DNA, 20 bp, Artificial Sequence
  chemically synthesized
agatttgaacgtctgtattc

SEQ ID NO: 616384 - DNA, 20 bp, Artificial Sequence
  chemically synthesized
ctgtattcctgagattggtt

SEQ ID NO: 616385 - DNA, 20 bp, Artificial Sequence
  chemically synthesized
atttttttgaagtctcataa

SEQ ID NO: 616386 - DNA, 20 bp, Artificial Sequence
  chemically synthesized
agtctcataatcaagattat

SEQ ID NO: 616387 - DNA, 20 bp, Artificial Sequence
  chemically synthesized
atgttctaaagcccttataa

SEQ ID NO: 616388 - DNA, 20 bp, Artificial Sequence
  chemically synthesized
gggctttagaacatgaacat

SEQ ID NO: 616389 - DNA, 20 bp, Artificial Sequence
  chemically synthesized
agaggtttaaatactatttt

SEQ ID NO: 616390 - DNA, 20 bp, Artificial Sequence
  chemically synthesized
caaacaactaagtatgaatt

SEQ ID NO: 616391 - DNA, 20 bp, Artificial Sequence
  chemically synthesized
taaacagataattcatactt

SEQ ID NO: 616392 - DNA, 20 bp, Artificial Sequence
  chemically synthesized
ttcaaaaatactatattgag

SEQ ID NO: 616393 - DNA, 20 bp, Artificial Sequence
  chemically synthesized
atttttgaagttatttcttg

SEQ ID NO: 616394 - DNA, 20 bp, Artificial Sequence
  chemically synthesized
tatttcttgtactgcttttt

SEQ ID NO: 616395 - DNA, 20 bp, Artificial Sequence
  chemically synthesized
taaaggtttcttacagaatc

SEQ ID NO: 616396 - DNA, 20 bp, Artificial Sequence
  chemically synthesized
ggaaaataagagaactaaac

SEQ ID NO: 616397 - DNA, 20 bp, Artificial Sequence
  chemically synthesized
tagccttaatttttttatat

SEQ ID NO: 616398 - DNA, 20 bp, Artificial Sequence
  chemically synthesized
aaattaaggctattaatttt

SEQ ID NO: 616399 - DNA, 20 bp, Artificial Sequence
  chemically synthesized
ggctattaattttctttgat

SEQ ID NO: 616400 - DNA, 20 bp, Artificial Sequence
  chemically synthesized
tacagctttgttcttattcc

SEQ ID NO: 616401 - DNA, 20 bp, Artificial Sequence
  chemically synthesized
tctcctgttacaaaaacaat

SEQ ID NO: 616402 - DNA, 20 bp, Artificial Sequence
  chemically synthesized
atctttttatggtaaacata

SEQ ID NO: 616403 - DNA, 20 bp, Artificial Sequence
  chemically synthesized
caacaggatgttagcagtgg

SEQ ID NO: 616404 - DNA, 20 bp, Artificial Sequence
  chemically synthesized
aacatcctgttgtctactct

SEQ ID NO: 616405 - DNA, 20 bp, Artificial Sequence
  chemically synthesized
gaatcggacattgaatttac

SEQ ID NO: 616406 - DNA, 20 bp, Artificial Sequence
  chemically synthesized
aaatctaacgtaaattcaat

SEQ ID NO: 616407 - DNA, 20 bp, Artificial Sequence
  chemically synthesized
tctactaatcatcttttcct

SEQ ID NO: 616408 - DNA, 20 bp, Artificial Sequence
  chemically synthesized
aatttaaaacaaataggaaa

SEQ ID NO: 616409 - DNA, 20 bp, Artificial Sequence
  chemically synthesized
atcttttcctatttgtttta

SEQ ID NO: 616410 - DNA, 20 bp, Artificial Sequence
  chemically synthesized
ctatttgttttaaattgctt

SEQ ID NO: 616411 - DNA, 20 bp, Artificial Sequence
  chemically synthesized
gaatatgattaatttgatat

SEQ ID NO: 616412 - DNA, 20 bp, Artificial Sequence
  chemically synthesized
ttgcaacaacacatcattga

SEQ ID NO: 616413 - DNA, 20 bp, Artificial Sequence
  chemically synthesized
aatgatgtgttgttgcaaac

SEQ ID NO: 616414 - DNA, 20 bp, Artificial Sequence
  chemically synthesized
gaagcagggacttcataaac

SEQ ID NO: 616415 - DNA, 20 bp, Artificial Sequence
  chemically synthesized
caaacatatgtttatgaagt

SEQ ID NO: 616416 - DNA, 20 bp, Artificial Sequence
  chemically synthesized
ttttttttcttgttcatatg

SEQ ID NO: 616417 - DNA, 20 bp, Artificial Sequence
  chemically synthesized
gctggattttctttgaattt

SEQ ID NO: 616418 - DNA, 20 bp, Artificial Sequence
  chemically synthesized
cttttgtatgggagctgcta

SEQ ID NO: 616419 - DNA, 20 bp, Artificial Sequence
  chemically synthesized
gctatattgtttacaagttc

SEQ ID NO: 616420 - DNA, 20 bp, Artificial Sequence
  chemically synthesized
ctgtgcattatagtcacctg

SEQ ID NO: 616421 - DNA, 20 bp, Artificial Sequence
  chemically synthesized
aggtggcaacctagtcactg

SEQ ID NO: 616422 - DNA, 20 bp, Artificial Sequence
  chemically synthesized
cctgggaagtttctaattta

SEQ ID NO: 616423 - DNA, 20 bp, Artificial Sequence
  chemically synthesized
agatgcctaggtcccacctg

SEQ ID NO: 616424 - DNA, 20 bp, Artificial Sequence
  chemically synthesized
caggtgggacctaggcatct

SEQ ID NO: 616425 - DNA, 20 bp, Artificial Sequence
  chemically synthesized
tcagcaaaggcagaggacca

SEQ ID NO: 616426 - DNA, 20 bp, Artificial Sequence
  chemically synthesized
ttgttagaatatttgggaaa

SEQ ID NO: 616427 - DNA, 20 bp, Artificial Sequence
  chemically synthesized
atatttgggaaagggtgttt

SEQ ID NO: 616428 - DNA, 20 bp, Artificial Sequence
  chemically synthesized
gtgtttctaagattaaaact

SEQ ID NO: 616429 - DNA, 20 bp, Artificial Sequence
  chemically synthesized
gtttacgaaatacataagcc

SEQ ID NO: 616430 - DNA, 20 bp, Artificial Sequence
  chemically synthesized
cttatgtatttcgtaaacgc

SEQ ID NO: 616431 - DNA, 20 bp, Artificial Sequence
  chemically synthesized
ttactaatttgttaaagcag

SEQ ID NO: 616432 - DNA, 20 bp, Artificial Sequence
  chemically synthesized
ttttagagatactaggatta

SEQ ID NO: 616433 - DNA, 20 bp, Artificial Sequence
  chemically synthesized
tgttttttagagatactagg

SEQ ID NO: 616434 - DNA, 20 bp, Artificial Sequence
  chemically synthesized
actagtgttttttagagata

SEQ ID NO: 616435 - DNA, 20 bp, Artificial Sequence
  chemically synthesized
tcctagtatctctaaaaaac

SEQ ID NO: 616436 - DNA, 20 bp, Artificial Sequence
  chemically synthesized
agctccaggcaaaattaaac

SEQ ID NO: 616437 - DNA, 20 bp, Artificial Sequence
  chemically synthesized
tcataagtattggtgtatac

SEQ ID NO: 616438 - DNA, 20 bp, Artificial Sequence
  chemically synthesized
acaccaatacttatgaggga

SEQ ID NO: 616439 - DNA, 20 bp, Artificial Sequence
  chemically synthesized
tggattttctaaaaggcaat

SEQ ID NO: 616440 - DNA, 20 bp, Artificial Sequence
  chemically synthesized
attgccttttagaaaatcca

SEQ ID NO: 616441 - DNA, 20 bp, Artificial Sequence
  chemically synthesized
aacttgcttaaggaaaactg

SEQ ID NO: 616442 - DNA, 20 bp, Artificial Sequence
  chemically synthesized
atccatccagttttccttaa

SEQ ID NO: 616443 - DNA, 20 bp, Artificial Sequence
  chemically synthesized
tcgtgtatgtgctttctaaa

SEQ ID NO: 616444 - DNA, 20 bp, Artificial Sequence
  chemically synthesized
agatttgtaattgctcgtgt

SEQ ID NO: 616445 - DNA, 20 bp, Artificial Sequence
  chemically synthesized
attcttgagttaggctgaag

SEQ ID NO: 616446 - DNA, 20 bp, Artificial Sequence
  chemically synthesized
agaattaatacaacttcact

SEQ ID NO: 616447 - DNA, 20 bp, Artificial Sequence
  chemically synthesized
atagacatctttatcataaa

SEQ ID NO: 616448 - DNA, 20 bp, Artificial Sequence
  chemically synthesized
gccccaaatgatgtcaagaa

SEQ ID NO: 616449 - DNA, 20 bp, Artificial Sequence
  chemically synthesized
attttcatttttaaaaaaat

SEQ ID NO: 616450 - DNA, 20 bp, Artificial Sequence
  chemically synthesized
tacatttttttaaaaatgaa

SEQ ID NO: 616451 - DNA, 20 bp, Artificial Sequence
  chemically synthesized
tatggctaaattattactag

SEQ ID NO: 616452 - DNA, 20 bp, Artificial Sequence
  chemically synthesized
agctttatggctaaattatt

SEQ ID NO: 616453 - DNA, 20 bp, Artificial Sequence
  chemically synthesized
attgcttttattcttcaatg

SEQ ID NO: 616454 - DNA, 20 bp, Artificial Sequence
  chemically synthesized
tcaatgaaaagttaattaac

SEQ ID NO: 616455 - DNA, 20 bp, Artificial Sequence
  chemically synthesized
cctcattagaggcctgggta

SEQ ID NO: 616456 - DNA, 20 bp, Artificial Sequence
  chemically synthesized
cattttacccaggcctctaa

SEQ ID NO: 616457 - DNA, 20 bp, Artificial Sequence
  chemically synthesized
tccgctccaccccacctccc

SEQ ID NO: 616458 - DNA, 20 bp, Artificial Sequence
  chemically synthesized
gaggtggggtggagcggaaa

SEQ ID NO: 616459 - DNA, 20 bp, Artificial Sequence
  chemically synthesized
ctaaaacatcttcctggaag

SEQ ID NO: 616460 - DNA, 20 bp, Artificial Sequence
  chemically synthesized
cggaaacccagcttccagga

SEQ ID NO: 616461 - DNA, 20 bp, Artificial Sequence
  chemically synthesized
aggaagatgttttaggagaa

SEQ ID NO: 616462 - DNA, 20 bp, Artificial Sequence
  chemically synthesized
gtacctcaaatagcttagga

SEQ ID NO: 616463 - DNA, 20 bp, Artificial Sequence
  chemically synthesized
cttcggtctgttgtacctca

SEQ ID NO: 616464 - DNA, 20 bp, Artificial Sequence
  chemically synthesized
aggattcagttttataacag

SEQ ID NO: 616465 - DNA, 20 bp, Artificial Sequence
  chemically synthesized
ttgtacaaccagcttaagga

SEQ ID NO: 616466 - DNA, 20 bp, Artificial Sequence
  chemically synthesized
gtgactttgtacaaccagct

SEQ ID NO: 616467 - DNA, 20 bp, Artificial Sequence
  chemically synthesized
tagttgtgtgactttgtaca

SEQ ID NO: 616468 - DNA, 20 bp, Artificial Sequence
  chemically synthesized
tgttctacaaatagctcttt

SEQ ID NO: 616469 - DNA, 20 bp, Artificial Sequence
  chemically synthesized
gtcaattttgagtggggttt

SEQ ID NO: 616470 - DNA, 20 bp, Artificial Sequence
  chemically synthesized
ctctcactgtcaattttgag

SEQ ID NO: 616471 - DNA, 20 bp, Artificial Sequence
  chemically synthesized
gtgtgtgtgtgtgtgtgtgt

SEQ ID NO: 616472 - DNA, 20 bp, Artificial Sequence
  chemically synthesized
gtttctttcccaaggccaag

SEQ ID NO: 616473 - DNA, 20 bp, Artificial Sequence
  chemically synthesized
cttcttattaacagagggta

SEQ ID NO: 616474 - DNA, 20 bp, Artificial Sequence
  chemically synthesized
aactctacattgtctaaaga

SEQ ID NO: 616475 - DNA, 20 bp, Artificial Sequence
  chemically synthesized
tctttagacaatgtagagtt

SEQ ID NO: 616476 - DNA, 20 bp, Artificial Sequence
  chemically synthesized
tctggatgccatgtaagctc

SEQ ID NO: 616477 - DNA, 20 bp, Artificial Sequence
  chemically synthesized
tgtagtttcacaagaatctg

SEQ ID NO: 616478 - DNA, 20 bp, Artificial Sequence
  chemically synthesized
attcttgtgaaactacagag

SEQ ID NO: 616479 - DNA, 20 bp, Artificial Sequence
  chemically synthesized
ggactgtctaatccattctc

SEQ ID NO: 616480 - DNA, 20 bp, Artificial Sequence
  chemically synthesized
gattagacagtccaaaacat

SEQ ID NO: 616481 - DNA, 20 bp, Artificial Sequence
  chemically synthesized
gcaaacacaagtacaatctg

SEQ ID NO: 616482 - DNA, 20 bp, Artificial Sequence
  chemically synthesized
caaaacataacagattgtac

SEQ ID NO: 616483 - DNA, 20 bp, Artificial Sequence
  chemically synthesized
cttgtgtttgctctggtaag

SEQ ID NO: 616484 - DNA, 20 bp, Artificial Sequence
  chemically synthesized
tttgctctggtaagtggagc

SEQ ID NO: 616485 - DNA, 20 bp, Artificial Sequence
  chemically synthesized
gatttcctgctcacttaatt

SEQ ID NO: 616486 - DNA, 20 bp, Artificial Sequence
  chemically synthesized
caggaaatctggaatattgt

SEQ ID NO: 616487 - DNA, 20 bp, Artificial Sequence
  chemically synthesized
atgtaaaacacctacaatat

SEQ ID NO: 616488 - DNA, 20 bp, Artificial Sequence
  chemically synthesized
catgctcattctttctttct

SEQ ID NO: 616489 - DNA, 20 bp, Artificial Sequence
  chemically synthesized
aactttgcagttgctaagga

SEQ ID NO: 616490 - DNA, 20 bp, Artificial Sequence
  chemically synthesized
ttgcttctccagaatgacag

SEQ ID NO: 616491 - DNA, 20 bp, Artificial Sequence
  chemically synthesized
ttctcttgcttctccagaat

SEQ ID NO: 616492 - DNA, 20 bp, Artificial Sequence
  chemically synthesized
tctggagaagcaagagaagc

SEQ ID NO: 616493 - DNA, 20 bp, Artificial Sequence
  chemically synthesized
attatgaaaaccttagcttc

SEQ ID NO: 616494 - DNA, 20 bp, Artificial Sequence
  chemically synthesized
caactaaatattatgaaaac

SEQ ID NO: 616495 - DNA, 20 bp, Artificial Sequence
  chemically synthesized
aatattattgctctgcttaa

SEQ ID NO: 616496 - DNA, 20 bp, Artificial Sequence
  chemically synthesized
atgctgcataaatattattg

SEQ ID NO: 616497 - DNA, 20 bp, Artificial Sequence
  chemically synthesized
caaaaattatcgataccaag

SEQ ID NO: 616498 - DNA, 20 bp, Artificial Sequence
  chemically synthesized
ttattttataataactgaac

SEQ ID NO: 616499 - DNA, 20 bp, Artificial Sequence
  chemically synthesized
tcatgatctaataaaaatga

SEQ ID NO: 616500 - DNA, 20 bp, Artificial Sequence
  chemically synthesized
atttttattagatcatgatg

SEQ ID NO: 616501 - DNA, 20 bp, Artificial Sequence
  chemically synthesized
tcacataaaatattttaaag

SEQ ID NO: 616502 - DNA, 20 bp, Artificial Sequence
  chemically synthesized
aaatattttaaagagatgtt

SEQ ID NO: 616503 - DNA, 20 bp, Artificial Sequence
  chemically synthesized
aaagagatgtttggggttta

SEQ ID NO: 616504 - DNA, 20 bp, Artificial Sequence
  chemically synthesized
aggcactatagaaatactta

SEQ ID NO: 616505 - DNA, 20 bp, Artificial Sequence
  chemically synthesized
atagcaagacaatagatggg

SEQ ID NO: 616506 - DNA, 20 bp, Artificial Sequence
  chemically synthesized
acttcacatacactttacct

SEQ ID NO: 616507 - DNA, 20 bp, Artificial Sequence
  chemically synthesized
agacattacaacttcaaaaa

SEQ ID NO: 616508 - DNA, 20 bp, Artificial Sequence
  chemically synthesized
ttgaagttgtaatgtcttac

SEQ ID NO: 616509 - DNA, 20 bp, Artificial Sequence
  chemically synthesized
tgtgtgtgtgtgtgtgtatg

SEQ ID NO: 616510 - DNA, 20 bp, Artificial Sequence
  chemically synthesized
acataatatattagatgata

SEQ ID NO: 616511 - DNA, 20 bp, Artificial Sequence
  chemically synthesized
atccccactgaaaaaaactg

SEQ ID NO: 616512 - DNA, 20 bp, Artificial Sequence
  chemically synthesized
cctcacttttaggcaagctt

SEQ ID NO: 616513 - DNA, 20 bp, Artificial Sequence
  chemically synthesized
ataattctcctcacttttag

SEQ ID NO: 616514 - DNA, 20 bp, Artificial Sequence
  chemically synthesized
aaaagaacagaatgtccttg

SEQ ID NO: 616515 - DNA, 20 bp, Artificial Sequence
  chemically synthesized
tcccctttggttccaacttt

SEQ ID NO: 616516 - DNA, 20 bp, Artificial Sequence
  chemically synthesized
ctatcatgccaccattgtgt

SEQ ID NO: 616517 - DNA, 20 bp, Artificial Sequence
  chemically synthesized
tttcccatcccaaggatttc

SEQ ID NO: 616518 - DNA, 20 bp, Artificial Sequence
  chemically synthesized
taccattgtgtttcccatcc

SEQ ID NO: 616519 - DNA, 20 bp, Artificial Sequence
  chemically synthesized
cgattcttcattctttacca

SEQ ID NO: 616520 - DNA, 20 bp, Artificial Sequence
  chemically synthesized
cacaatggtaaagaatgaag

SEQ ID NO: 616521 - DNA, 20 bp, Artificial Sequence
  chemically synthesized
taatcatcagtatttttaaa

SEQ ID NO: 616522 - DNA, 20 bp, Artificial Sequence
  chemically synthesized
gaatcgctttttaaaaatac

SEQ ID NO: 616523 - DNA, 20 bp, Artificial Sequence
  chemically synthesized
atgattacaatgtattctta

SEQ ID NO: 616524 - DNA, 20 bp, Artificial Sequence
  chemically synthesized
gcgactaatacaaattcatc

SEQ ID NO: 616525 - DNA, 20 bp, Artificial Sequence
  chemically synthesized
gttatgctgattttttttag

SEQ ID NO: 616526 - DNA, 20 bp, Artificial Sequence
  chemically synthesized
tgttgtcaaatttgctgtta

SEQ ID NO: 616527 - DNA, 20 bp, Artificial Sequence
  chemically synthesized
catattcagaaaggatgagt

SEQ ID NO: 616528 - DNA, 20 bp, Artificial Sequence
  chemically synthesized
cagggacatattcagaaagg

SEQ ID NO: 616529 - DNA, 20 bp, Artificial Sequence
  chemically synthesized
tgatggagttgcatacagtg

SEQ ID NO: 616530 - DNA, 20 bp, Artificial Sequence
  chemically synthesized
tgcctctgcacctttacact

SEQ ID NO: 616531 - DNA, 20 bp, Artificial Sequence
  chemically synthesized
atctagttcatggctatagt

SEQ ID NO: 616532 - DNA, 20 bp, Artificial Sequence
  chemically synthesized
agctagaactatagccatga

SEQ ID NO: 616533 - DNA, 20 bp, Artificial Sequence
  chemically synthesized
ctaacccccaagtataggat

SEQ ID NO: 616534 - DNA, 20 bp, Artificial Sequence
  chemically synthesized
ccagtatcctatacttgggg

SEQ ID NO: 616535 - DNA, 20 bp, Artificial Sequence
  chemically synthesized
gacagtagttgtggcaacct

SEQ ID NO: 616536 - DNA, 20 bp, Artificial Sequence
  chemically synthesized
tactactactactactacat

SEQ ID NO: 616537 - DNA, 20 bp, Artificial Sequence
  chemically synthesized
agcacttaaaacaggccaaa

SEQ ID NO: 616538 - DNA, 20 bp, Artificial Sequence
  chemically synthesized
agagcttaaaacagtatttg

SEQ ID NO: 616539 - DNA, 20 bp, Artificial Sequence
  chemically synthesized
ttaaatagctgatacaagta

SEQ ID NO: 616540 - DNA, 20 bp, Artificial Sequence
  chemically synthesized
acactggtttctgtttgaat

SEQ ID NO: 616541 - DNA, 20 bp, Artificial Sequence
  chemically synthesized
cagtgtaaaggcacactggt

SEQ ID NO: 616542 - DNA, 20 bp, Artificial Sequence
  chemically synthesized
gtggtgcagtgtaaaggcac

SEQ ID NO: 616543 - DNA, 20 bp, Artificial Sequence
  chemically synthesized
cctttacactgcaccaccct

SEQ ID NO: 616544 - DNA, 20 bp, Artificial Sequence
  chemically synthesized
tctgctatggtgttcccgaa

SEQ ID NO: 616545 - DNA, 20 bp, Artificial Sequence
  chemically synthesized
caggttagaacatagactca

SEQ ID NO: 616546 - DNA, 20 bp, Artificial Sequence
  chemically synthesized
tgggtagaaagtgcagtgta

SEQ ID NO: 616547 - DNA, 20 bp, Artificial Sequence
  chemically synthesized
gtgcacaaatgaatgtatct

SEQ ID NO: 616548 - DNA, 20 bp, Artificial Sequence
  chemically synthesized
tggttcataaaagactctat

SEQ ID NO: 616549 - DNA, 20 bp, Artificial Sequence
  chemically synthesized
cccgccttttactcccggga

SEQ ID NO: 616550 - DNA, 20 bp, Artificial Sequence
  chemically synthesized
aggcgggagtaagctgacaa

SEQ ID NO: 616551 - DNA, 20 bp, Artificial Sequence
  chemically synthesized
ggacaaaagaaaacttaatt

SEQ ID NO: 616552 - DNA, 20 bp, Artificial Sequence
  chemically synthesized
ttctcagtttatggtgtgtg

SEQ ID NO: 616553 - DNA, 20 bp, Artificial Sequence
  chemically synthesized
ctccctggactgatgatttt

SEQ ID NO: 616554 - DNA, 20 bp, Artificial Sequence
  chemically synthesized
aggaatgagcctccctggac

SEQ ID NO: 616555 - DNA, 20 bp, Artificial Sequence
  chemically synthesized
tgctcacagtagttttaccc

SEQ ID NO: 616556 - DNA, 20 bp, Artificial Sequence
  chemically synthesized
tcagaagttgaaatgctcac

SEQ ID NO: 616557 - DNA, 20 bp, Artificial Sequence
  chemically synthesized
actactgtgagcatttcaac

SEQ ID NO: 616558 - DNA, 20 bp, Artificial Sequence
  chemically synthesized
atgtggcctgaaggaaggct

SEQ ID NO: 616559 - DNA, 20 bp, Artificial Sequence
  chemically synthesized
aagttcctaaaatcttgtgg

SEQ ID NO: 616560 - DNA, 20 bp, Artificial Sequence
  chemically synthesized
tataaagctgaatcgcctcc

SEQ ID NO: 616561 - DNA, 20 bp, Artificial Sequence
  chemically synthesized
ctaaaatcttgtggaggcga

SEQ ID NO: 616562 - DNA, 20 bp, Artificial Sequence
  chemically synthesized
cctacagactctgtccgagc

SEQ ID NO: 616563 - DNA, 20 bp, Artificial Sequence
  chemically synthesized
ccttaaaattatatgtctag

SEQ ID NO: 616564 - DNA, 20 bp, Artificial Sequence
  chemically synthesized
gtagagggacattccagcac

SEQ ID NO: 616565 - DNA, 20 bp, Artificial Sequence
  chemically synthesized
tgctggaatgtccctctacc

SEQ ID NO: 616566 - DNA, 20 bp, Artificial Sequence
  chemically synthesized
atagaatatgtcagaattcc

SEQ ID NO: 616567 - DNA, 20 bp, Artificial Sequence
  chemically synthesized
ttaccttaaactgatcgaaa

SEQ ID NO: 616568 - DNA, 20 bp, Artificial Sequence
  chemically synthesized
agaagaaaagctgattttcg

SEQ ID NO: 616569 - DNA, 20 bp, Artificial Sequence
  chemically synthesized
attcatctcaacagaagaaa

SEQ ID NO: 616570 - DNA, 20 bp, Artificial Sequence
  chemically synthesized
tcagtagaaaaattcttccc

SEQ ID NO: 616571 - DNA, 20 bp, Artificial Sequence
  chemically synthesized
ttctgaggactgggggtggg

SEQ ID NO: 616572 - DNA, 20 bp, Artificial Sequence
  chemically synthesized
gtcctcagaaatatactttg

SEQ ID NO: 616573 - DNA, 20 bp, Artificial Sequence
  chemically synthesized
tttttcttggattatatgaa

SEQ ID NO: 616574 - DNA, 20 bp, Artificial Sequence
  chemically synthesized
tcaagtctctttcagttttt

SEQ ID NO: 616575 - DNA, 20 bp, Artificial Sequence
  chemically synthesized
aaattagtcctcaagtctct

SEQ ID NO: 616576 - DNA, 20 bp, Artificial Sequence
  chemically synthesized
cttagtatctttatttgcgt

SEQ ID NO: 616577 - DNA, 20 bp, Artificial Sequence
  chemically synthesized
ataaaagcacaagaggcccc

SEQ ID NO: 616578 - DNA, 20 bp, Artificial Sequence
  chemically synthesized
tactaagccctcggggcctc

SEQ ID NO: 616579 - DNA, 20 bp, Artificial Sequence
  chemically synthesized
tgttttatactagcacatct

SEQ ID NO: 616580 - DNA, 20 bp, Artificial Sequence
  chemically synthesized
aacaataaagtggctcagga

SEQ ID NO: 616581 - DNA, 20 bp, Artificial Sequence
  chemically synthesized
gagccactttattgttgatg

SEQ ID NO: 616582 - DNA, 20 bp, Artificial Sequence
  chemically synthesized
aagggaaagacttactgaga

SEQ ID NO: 616583 - DNA, 20 bp, Artificial Sequence
  chemically synthesized
aacaaatgctggcattcata

SEQ ID NO: 616584 - DNA, 20 bp, Artificial Sequence
  chemically synthesized
tgtatgaatgccagcatttg

SEQ ID NO: 616585 - DNA, 20 bp, Artificial Sequence
  chemically synthesized
agcatttgttcagcttcttt

SEQ ID NO: 616586 - DNA, 20 bp, Artificial Sequence
  chemically synthesized
tttgttcagcttcttttttt

SEQ ID NO: 616587 - DNA, 20 bp, Artificial Sequence
  chemically synthesized
gaggcagaggttgcagtgaa

SEQ ID NO: 616588 - DNA, 20 bp, Artificial Sequence
  chemically synthesized
aacctctgcctcctgggttc

SEQ ID NO: 616589 - DNA, 20 bp, Artificial Sequence
  chemically synthesized
tcggggagctgaggcgggag

SEQ ID NO: 616590 - DNA, 20 bp, Artificial Sequence
  chemically synthesized
cgcctcagctccccgagtag

SEQ ID NO: 616591 - DNA, 20 bp, Artificial Sequence
  chemically synthesized
aattagccgggtgcagtggt

SEQ ID NO: 616592 - DNA, 20 bp, Artificial Sequence
  chemically synthesized
tttttgtatttttagtacag

SEQ ID NO: 616593 - DNA, 20 bp, Artificial Sequence
  chemically synthesized
tgacctcatgatccgcccgc

SEQ ID NO: 616594 - DNA, 20 bp, Artificial Sequence
  chemically synthesized
cgcctctgcttcccaaagtg

SEQ ID NO: 616595 - DNA, 20 bp, Artificial Sequence
  chemically synthesized
gcccagccttgttcagctcc

SEQ ID NO: 616596 - DNA, 20 bp, Artificial Sequence
  chemically synthesized
ttcagatcaattttataaca

SEQ ID NO: 616597 - DNA, 20 bp, Artificial Sequence
  chemically synthesized
atattccacctcccacgaga

SEQ ID NO: 616598 - DNA, 20 bp, Artificial Sequence
  chemically synthesized
acaactcataacatatttcc

SEQ ID NO: 616599 - DNA, 20 bp, Artificial Sequence
  chemically synthesized
tttggggaaattagtggtga

SEQ ID NO: 616600 - DNA, 20 bp, Artificial Sequence
  chemically synthesized
tttccccaaatttacaagtt

SEQ ID NO: 616601 - DNA, 20 bp, Artificial Sequence
  chemically synthesized
tacaagttaagagtttaaat

SEQ ID NO: 616602 - DNA, 20 bp, Artificial Sequence
  chemically synthesized
atctactttatttttcaggt

SEQ ID NO: 616603 - DNA, 20 bp, Artificial Sequence
  chemically synthesized
tctcatatgaagtaaggtct

SEQ ID NO: 616604 - DNA, 20 bp, Artificial Sequence
  chemically synthesized
ttctttaccttatgttaaat

SEQ ID NO: 616605 - DNA, 20 bp, Artificial Sequence
  chemically synthesized
ttatgttaaatttcagattg

SEQ ID NO: 616606 - DNA, 20 bp, Artificial Sequence
  chemically synthesized
agttcacattactaccttag

SEQ ID NO: 616607 - DNA, 20 bp, Artificial Sequence
  chemically synthesized
cgtcttggccttccaaaatg

SEQ ID NO: 616608 - DNA, 20 bp, Artificial Sequence
  chemically synthesized
ttttgtatttttagtagaga

SEQ ID NO: 616609 - DNA, 20 bp, Artificial Sequence
  chemically synthesized
aaaaatacaaaaaatagttg

SEQ ID NO: 616610 - DNA, 20 bp, Artificial Sequence
  chemically synthesized
tgcctcagcctcccgagtag

SEQ ID NO: 616611 - DNA, 20 bp, Artificial Sequence
  chemically synthesized
aacctccatctcctgggttc

SEQ ID NO: 616612 - DNA, 20 bp, Artificial Sequence
  chemically synthesized
tctgatacagttactcacat

SEQ ID NO: 616613 - DNA, 20 bp, Artificial Sequence
  chemically synthesized
tttatatgtaaaagatgaaa

SEQ ID NO: 616614 - DNA, 20 bp, Artificial Sequence
  chemically synthesized
gaatgaaaaatacaaaaatt

SEQ ID NO: 616615 - DNA, 20 bp, Artificial Sequence
  chemically synthesized
gactattttacgtatgtatg

SEQ ID NO: 616616 - DNA, 20 bp, Artificial Sequence
  chemically synthesized
tctatgatagtgatgaaagt

SEQ ID NO: 616617 - DNA, 20 bp, Artificial Sequence
  chemically synthesized
ttaagttgaatcattggcat

SEQ ID NO: 616618 - DNA, 20 bp, Artificial Sequence
  chemically synthesized
ctatttaaaatctttgatgc

SEQ ID NO: 616619 - DNA, 20 bp, Artificial Sequence
  chemically synthesized
attgctagtccccacttaca

SEQ ID NO: 616620 - DNA, 20 bp, Artificial Sequence
  chemically synthesized
atctatagtgaatatttctg

SEQ ID NO: 616621 - DNA, 20 bp, Artificial Sequence
  chemically synthesized
ttaaactttattacaggtca

SEQ ID NO: 616622 - DNA, 20 bp, Artificial Sequence
  chemically synthesized
tgaaactcaatgacctgtaa

SEQ ID NO: 616623 - DNA, 20 bp, Artificial Sequence
  chemically synthesized
attctatcaaggcaatataa

SEQ ID NO: 616624 - DNA, 20 bp, Artificial Sequence
  chemically synthesized
tttgaaaattccatctgctt

SEQ ID NO: 616625 - DNA, 20 bp, Artificial Sequence
  chemically synthesized
atactgtctttgaaaattcc

SEQ ID NO: 616626 - DNA, 20 bp, Artificial Sequence
  chemically synthesized
gacatgtgcggaaactagga

SEQ ID NO: 616627 - DNA, 20 bp, Artificial Sequence
  chemically synthesized
attcagaatacaagcttctt

SEQ ID NO: 616628 - DNA, 20 bp, Artificial Sequence
  chemically synthesized
cttggtaacacattcagaat

SEQ ID NO: 616629 - DNA, 20 bp, Artificial Sequence
  chemically synthesized
ccatatttcttaccacaaaa

SEQ ID NO: 616630 - DNA, 20 bp, Artificial Sequence
  chemically synthesized
gctgcacctgttaacctgga

SEQ ID NO: 616631 - DNA, 20 bp, Artificial Sequence
  chemically synthesized
ggttaacaggtgcagcagca

SEQ ID NO: 616632 - DNA, 20 bp, Artificial Sequence
  chemically synthesized
agtctgaggaacgcattaac

SEQ ID NO: 616633 - DNA, 20 bp, Artificial Sequence
  chemically synthesized
tgcgttcctcagactgtccc

SEQ ID NO: 616634 - DNA, 20 bp, Artificial Sequence
  chemically synthesized
agactgtcccatctgcttct

SEQ ID NO: 616635 - DNA, 20 bp, Artificial Sequence
  chemically synthesized
tatgtctacctacatatcat

SEQ ID NO: 616636 - DNA, 20 bp, Artificial Sequence
  chemically synthesized
gccaacatgatagaaaagaa

SEQ ID NO: 616637 - DNA, 20 bp, Artificial Sequence
  chemically synthesized
gtatcttaaaattatagtaa

SEQ ID NO: 616638 - DNA, 20 bp, Artificial Sequence
  chemically synthesized
cttagtatcttaaaattata

SEQ ID NO: 616639 - DNA, 20 bp, Artificial Sequence
  chemically synthesized
aagacacttactagtaaaaa

SEQ ID NO: 616640 - DNA, 20 bp, Artificial Sequence
  chemically synthesized
aaggtcttaaattcgataaa

SEQ ID NO: 616641 - DNA, 20 bp, Artificial Sequence
  chemically synthesized
aatttttaaaatgttgattg

SEQ ID NO: 616642 - DNA, 20 bp, Artificial Sequence
  chemically synthesized
tcgtattggaatttttaaaa

SEQ ID NO: 616643 - DNA, 20 bp, Artificial Sequence
  chemically synthesized
tcaacattttaaaaattcca

SEQ ID NO: 616644 - DNA, 20 bp, Artificial Sequence
  chemically synthesized
caaggacctatgagagatac

SEQ ID NO: 616645 - DNA, 20 bp, Artificial Sequence
  chemically synthesized
ggtcacattctatttaaaga

SEQ ID NO: 616646 - DNA, 20 bp, Artificial Sequence
  chemically synthesized
cactcttcatctgtttcata

SEQ ID NO: 616647 - DNA, 20 bp, Artificial Sequence
  chemically synthesized
agctgaatagctcactcttc

SEQ ID NO: 616648 - DNA, 20 bp, Artificial Sequence
  chemically synthesized
ggagccttagtgggttttag

SEQ ID NO: 616649 - DNA, 20 bp, Artificial Sequence
  chemically synthesized
atagtctcactggagcctta

SEQ ID NO: 616650 - DNA, 20 bp, Artificial Sequence
  chemically synthesized
ttcccatatattctccagtt

SEQ ID NO: 616651 - DNA, 20 bp, Artificial Sequence
  chemically synthesized
gtttgtccaccaaacctatc

SEQ ID NO: 616652 - DNA, 20 bp, Artificial Sequence
  chemically synthesized
aaaacaaagaaaagctgtgg

SEQ ID NO: 616653 - DNA, 20 bp, Artificial Sequence
  chemically synthesized
caaacctatccacagctttt

SEQ ID NO: 616654 - DNA, 20 bp, Artificial Sequence
  chemically synthesized
atataggtaaacttatgtca

SEQ ID NO: 616655 - DNA, 20 bp, Artificial Sequence
  chemically synthesized
gtacaacaaatccccatgac

SEQ ID NO: 616656 - DNA, 20 bp, Artificial Sequence
  chemically synthesized
tatgtcatggggatttgttg

SEQ ID NO: 616657 - DNA, 20 bp, Artificial Sequence
  chemically synthesized
aaaaaaataactgatggtta

SEQ ID NO: 616658 - DNA, 20 bp, Artificial Sequence
  chemically synthesized
ggtggagggtgggaggaggg

SEQ ID NO: 616659 - DNA, 20 bp, Artificial Sequence
  chemically synthesized
ttattcccctctaagtgtcc

SEQ ID NO: 616660 - DNA, 20 bp, Artificial Sequence
  chemically synthesized
tgcaagtgagaagacacagt

SEQ ID NO: 616661 - DNA, 20 bp, Artificial Sequence
  chemically synthesized
atttgattttctgttactgt

SEQ ID NO: 616662 - DNA, 20 bp, Artificial Sequence
  chemically synthesized
ccatggtgtatatgtaccac

SEQ ID NO: 616663 - DNA, 20 bp, Artificial Sequence
  chemically synthesized
ctatcattggtgggcattta

SEQ ID NO: 616664 - DNA, 20 bp, Artificial Sequence
  chemically synthesized
gtgcatgtgcctttgtaata

SEQ ID NO: 616665 - DNA, 20 bp, Artificial Sequence
  chemically synthesized
ggtgtgagatggtatttcat

SEQ ID NO: 616666 - DNA, 20 bp, Artificial Sequence
  chemically synthesized
gagatggtatttcattgtgg

SEQ ID NO: 616667 - DNA, 20 bp, Artificial Sequence
  chemically synthesized
ggttttgatttgcatttctc

SEQ ID NO: 616668 - DNA, 20 bp, Artificial Sequence
  chemically synthesized
ttctctaatgattagtgatg

SEQ ID NO: 616669 - DNA, 20 bp, Artificial Sequence
  chemically synthesized
agtgatgttgagcttttttc

SEQ ID NO: 616670 - DNA, 20 bp, Artificial Sequence
  chemically synthesized
ccctttgcccacttttttag

SEQ ID NO: 616671 - DNA, 20 bp, Artificial Sequence
  chemically synthesized
ttagtagggtttttttttct

SEQ ID NO: 616672 - DNA, 20 bp, Artificial Sequence
  chemically synthesized
agggtttttttttctcatag

SEQ ID NO: 616673 - DNA, 20 bp, Artificial Sequence
  chemically synthesized
tgtttaagttccttataaat

SEQ ID NO: 616674 - DNA, 20 bp, Artificial Sequence
  chemically synthesized
ttttagacctttgtcggatg

SEQ ID NO: 616675 - DNA, 20 bp, Artificial Sequence
  chemically synthesized
acaaactacagaatggaaga

SEQ ID NO: 616676 - DNA, 20 bp, Artificial Sequence
  chemically synthesized
gcaaacattttcttccattc

SEQ ID NO: 616677 - DNA, 20 bp, Artificial Sequence
  chemically synthesized
gtttgtctgctcactctgtt

SEQ ID NO: 616678 - DNA, 20 bp, Artificial Sequence
  chemically synthesized
cctttgctgtgcagaaacta

SEQ ID NO: 616679 - DNA, 20 bp, Artificial Sequence
  chemically synthesized
aatggcatctaattaaacta

SEQ ID NO: 616680 - DNA, 20 bp, Artificial Sequence
  chemically synthesized
attagatgccatttttcaat

SEQ ID NO: 616681 - DNA, 20 bp, Artificial Sequence
  chemically synthesized
tcaatttttgcttttgttgc

SEQ ID NO: 616682 - DNA, 20 bp, Artificial Sequence
  chemically synthesized
tttaggacataggaacagac

SEQ ID NO: 616683 - DNA, 20 bp, Artificial Sequence
  chemically synthesized
gtattgcccgggttgtcttc

SEQ ID NO: 616684 - DNA, 20 bp, Artificial Sequence
  chemically synthesized
gggttgtcttccagggtttt

SEQ ID NO: 616685 - DNA, 20 bp, Artificial Sequence
  chemically synthesized
cttccagggtttttatagtt

SEQ ID NO: 616686 - DNA, 20 bp, Artificial Sequence
  chemically synthesized
atgtacaaagattaactcaa

SEQ ID NO: 616687 - DNA, 20 bp, Artificial Sequence
  chemically synthesized
ccccttccttacaccatgta

SEQ ID NO: 616688 - DNA, 20 bp, Artificial Sequence
  chemically synthesized
tacatggtgtaaggaagggg

SEQ ID NO: 616689 - DNA, 20 bp, Artificial Sequence
  chemically synthesized
tgaataggtagtcctttccc

SEQ ID NO: 616690 - DNA, 20 bp, Artificial Sequence
  chemically synthesized
taggtagtcctttccccatt

SEQ ID NO: 616691 - DNA, 20 bp, Artificial Sequence
  chemically synthesized
tttccccattgcttgttttt

SEQ ID NO: 616692 - DNA, 20 bp, Artificial Sequence
  chemically synthesized
tgcagtcttatttcttggtt

SEQ ID NO: 616693 - DNA, 20 bp, Artificial Sequence
  chemically synthesized
ctgttcttgtaccagtatca

SEQ ID NO: 616694 - DNA, 20 bp, Artificial Sequence
  chemically synthesized
tggccactgtagccctgtag

SEQ ID NO: 616695 - DNA, 20 bp, Artificial Sequence
  chemically synthesized
aagtcaggtaatgtgatgca

SEQ ID NO: 616696 - DNA, 20 bp, Artificial Sequence
  chemically synthesized
gatgcatccagcttttctct

SEQ ID NO: 616697 - DNA, 20 bp, Artificial Sequence
  chemically synthesized
tggttccatgtgaactttga

SEQ ID NO: 616698 - DNA, 20 bp, Artificial Sequence
  chemically synthesized
gttctctgaagaatctcaat

SEQ ID NO: 616699 - DNA, 20 bp, Artificial Sequence
  chemically synthesized
ctattcctattaaactacca

SEQ ID NO: 616700 - DNA, 20 bp, Artificial Sequence
  chemically synthesized
gaatagcattgactctaata

SEQ ID NO: 616701 - DNA, 20 bp, Artificial Sequence
  chemically synthesized
cattgactctaataaattgc

SEQ ID NO: 616702 - DNA, 20 bp, Artificial Sequence
  chemically synthesized
tggttccatatgaactttaa

SEQ ID NO: 616703 - DNA, 20 bp, Artificial Sequence
  chemically synthesized
gttctctgaagaatctcaat

SEQ ID NO: 616704 - DNA, 20 bp, Artificial Sequence
  chemically synthesized
ctattcctattaaactacca

SEQ ID NO: 616705 - DNA, 20 bp, Artificial Sequence
  chemically synthesized
cacactgctcaacgcaattt

SEQ ID NO: 616706 - DNA, 20 bp, Artificial Sequence
  chemically synthesized
cagtgtggccattttaatga

SEQ ID NO: 616707 - DNA, 20 bp, Artificial Sequence
  chemically synthesized
tcttcctatccatgaacatg

SEQ ID NO: 616708 - DNA, 20 bp, Artificial Sequence
  chemically synthesized
tgaacatggaatgtttttcc

SEQ ID NO: 616709 - DNA, 20 bp, Artificial Sequence
  chemically synthesized
tttccatttgtttctgtcat

SEQ ID NO: 616710 - DNA, 20 bp, Artificial Sequence
  chemically synthesized
tcatctctgatttctttgag

SEQ ID NO: 616711 - DNA, 20 bp, Artificial Sequence
  chemically synthesized
tctttctatggcagttgtga

SEQ ID NO: 616712 - DNA, 20 bp, Artificial Sequence
  chemically synthesized
agttgtgaatgtgattgcat

SEQ ID NO: 616713 - DNA, 20 bp, Artificial Sequence
  chemically synthesized
gcatgcaacagatgcaatgg

SEQ ID NO: 616714 - DNA, 20 bp, Artificial Sequence
  chemically synthesized
ttgttggtgtataggaatgc

SEQ ID NO: 616715 - DNA, 20 bp, Artificial Sequence
  chemically synthesized
aatgctagtgattttggcac

SEQ ID NO: 616716 - DNA, 20 bp, Artificial Sequence
  chemically synthesized
gtatcctgagactttgctga

SEQ ID NO: 616717 - DNA, 20 bp, Artificial Sequence
  chemically synthesized
tgaagttgtttatcagcaca

SEQ ID NO: 616718 - DNA, 20 bp, Artificial Sequence
  chemically synthesized
aaaccccatggtctcagccc

SEQ ID NO: 616719 - DNA, 20 bp, Artificial Sequence
  chemically synthesized
aagcttttgggctgagacca

SEQ ID NO: 616720 - DNA, 20 bp, Artificial Sequence
  chemically synthesized
tcatgttgtctgcaaacaga

SEQ ID NO: 616721 - DNA, 20 bp, Artificial Sequence
  chemically synthesized
aagagaggaagtcaaactat

SEQ ID NO: 616722 - DNA, 20 bp, Artificial Sequence
  chemically synthesized
cttcctctcttcctagttgg

SEQ ID NO: 616723 - DNA, 20 bp, Artificial Sequence
  chemically synthesized
gcgctttatttctttctctt

SEQ ID NO: 616724 - DNA, 20 bp, Artificial Sequence
  chemically synthesized
agagggcatccttgtcttgt

SEQ ID NO: 616725 - DNA, 20 bp, Artificial Sequence
  chemically synthesized
tttttcactggggtgtgggc

SEQ ID NO: 616726 - DNA, 20 bp, Artificial Sequence
  chemically synthesized
gtgaaaaacaactcactact

SEQ ID NO: 616727 - DNA, 20 bp, Artificial Sequence
  chemically synthesized
agcttaatctggaagtagtg

SEQ ID NO: 616728 - DNA, 20 bp, Artificial Sequence
  chemically synthesized
aacaactcactacttccaga

SEQ ID NO: 616729 - DNA, 20 bp, Artificial Sequence
  chemically synthesized
gagagatggccaaaaatata

SEQ ID NO: 616730 - DNA, 20 bp, Artificial Sequence
  chemically synthesized
ttggccatctctcactgtta

SEQ ID NO: 616731 - DNA, 20 bp, Artificial Sequence
  chemically synthesized
ccatctctcactgttacaaa

SEQ ID NO: 616732 - DNA, 20 bp, Artificial Sequence
  chemically synthesized
ctctcactgttacaaagttt

SEQ ID NO: 616733 - DNA, 20 bp, Artificial Sequence
  chemically synthesized
ttcttctcatcataataaga

SEQ ID NO: 616734 - DNA, 20 bp, Artificial Sequence
  chemically synthesized
aatatgcttcattgcatttc

SEQ ID NO: 616735 - DNA, 20 bp, Artificial Sequence
  chemically synthesized
tataattttagggacgtatt

SEQ ID NO: 616736 - DNA, 20 bp, Artificial Sequence
  chemically synthesized
aatacgtccctaaaattata

SEQ ID NO: 616737 - DNA, 20 bp, Artificial Sequence
  chemically synthesized
aagttgctttctagacaggc

SEQ ID NO: 616738 - DNA, 20 bp, Artificial Sequence
  chemically synthesized
tgttccccagagctgaacag

SEQ ID NO: 616739 - DNA, 20 bp, Artificial Sequence
  chemically synthesized
ccatttcaattactatactt

SEQ ID NO: 616740 - DNA, 20 bp, Artificial Sequence
  chemically synthesized
atgttaaagtcatcgtaaac

SEQ ID NO: 616741 - DNA, 20 bp, Artificial Sequence
  chemically synthesized
aaagtattaaataaaaaaac

SEQ ID NO: 616742 - DNA, 20 bp, Artificial Sequence
  chemically synthesized
cacatattaggcactgaaat

SEQ ID NO: 616743 - DNA, 20 bp, Artificial Sequence
  chemically synthesized
actatgtatactttgcatcc

SEQ ID NO: 616744 - DNA, 20 bp, Artificial Sequence
  chemically synthesized
gacatatgtatagaggaatc

SEQ ID NO: 616745 - DNA, 20 bp, Artificial Sequence
  chemically synthesized
atgtatagaggaatctgagg

SEQ ID NO: 616746 - DNA, 20 bp, Artificial Sequence
  chemically synthesized
atcttgaccacaaaccaagc

SEQ ID NO: 616747 - DNA, 20 bp, Artificial Sequence
  chemically synthesized
aagatggtatatatataatc

SEQ ID NO: 616748 - DNA, 20 bp, Artificial Sequence
  chemically synthesized
tggtatatatataatccttg

SEQ ID NO: 616749 - DNA, 20 bp, Artificial Sequence
  chemically synthesized
atatatataatccttggttt

SEQ ID NO: 616750 - DNA, 20 bp, Artificial Sequence
  chemically synthesized
gtctcaagaagcaaacaaac

SEQ ID NO: 616751 - DNA, 20 bp, Artificial Sequence
  chemically synthesized
tttactttggcctagttgtt

SEQ ID NO: 616752 - DNA, 20 bp, Artificial Sequence
  chemically synthesized
gatagtgtttactttggcct

SEQ ID NO: 616753 - DNA, 20 bp, Artificial Sequence
  chemically synthesized
atgactattataatagttga

SEQ ID NO: 616754 - DNA, 20 bp, Artificial Sequence
  chemically synthesized
ttctggaactctgacagata

SEQ ID NO: 616755 - DNA, 20 bp, Artificial Sequence
  chemically synthesized
aaaaagtgttctcactgtct

SEQ ID NO: 616756 - DNA, 20 bp, Artificial Sequence
  chemically synthesized
gaaaatcagttttctttctg

SEQ ID NO: 616757 - DNA, 20 bp, Artificial Sequence
  chemically synthesized
aataagcacttcagaaagaa

SEQ ID NO: 616758 - DNA, 20 bp, Artificial Sequence
  chemically synthesized
tattttttcttctgtggaaa

SEQ ID NO: 616759 - DNA, 20 bp, Artificial Sequence
  chemically synthesized
gcttctgatgatcaggcttc

SEQ ID NO: 616760 - DNA, 20 bp, Artificial Sequence
  chemically synthesized
ttggctaatgcttctgatga

SEQ ID NO: 616761 - DNA, 20 bp, Artificial Sequence
  chemically synthesized
atatgtttacagacattggc

SEQ ID NO: 616762 - DNA, 20 bp, Artificial Sequence
  chemically synthesized
tctgcatttattttattatt

SEQ ID NO: 616763 - DNA, 20 bp, Artificial Sequence
  chemically synthesized
aaaattaacacaaagattta

SEQ ID NO: 616764 - DNA, 20 bp, Artificial Sequence
  chemically synthesized
actataaatctttgtgttaa

SEQ ID NO: 616765 - DNA, 20 bp, Artificial Sequence
  chemically synthesized
tttataaaacaaaattaaca

SEQ ID NO: 616766 - DNA, 20 bp, Artificial Sequence
  chemically synthesized
gtttctaatgacattagtat

SEQ ID NO: 616767 - DNA, 20 bp, Artificial Sequence
  chemically synthesized
tatactaatgtcattagaaa

SEQ ID NO: 616768 - DNA, 20 bp, Artificial Sequence
  chemically synthesized
ttctctcttacgctgaaaat

SEQ ID NO: 616769 - DNA, 20 bp, Artificial Sequence
  chemically synthesized
caagaattaggaacgaacat

SEQ ID NO: 616770 - DNA, 20 bp, Artificial Sequence
  chemically synthesized
gtgatctgagtggtagctat

SEQ ID NO: 616771 - DNA, 20 bp, Artificial Sequence
  chemically synthesized
gtttatggtatatggttatg

SEQ ID NO: 616772 - DNA, 20 bp, Artificial Sequence
  chemically synthesized
aaaatagaagaaaatgcaat

SEQ ID NO: 616773 - DNA, 20 bp, Artificial Sequence
  chemically synthesized
gatttatctttattcttgcc

SEQ ID NO: 616774 - DNA, 20 bp, Artificial Sequence
  chemically synthesized
aaagggcaagaataaagata

SEQ ID NO: 616775 - DNA, 20 bp, Artificial Sequence
  chemically synthesized
ataagcactgtttattgaag

SEQ ID NO: 616776 - DNA, 20 bp, Artificial Sequence
  chemically synthesized
taaatcgtttcttcaataaa

SEQ ID NO: 616777 - DNA, 20 bp, Artificial Sequence
  chemically synthesized
gtgcaatagtgattgataag

SEQ ID NO: 616778 - DNA, 20 bp, Artificial Sequence
  chemically synthesized
aagtgaaataaaatgtgcaa

SEQ ID NO: 616779 - DNA, 20 bp, Artificial Sequence
  chemically synthesized
acagagattttcaatagaaa

SEQ ID NO: 616780 - DNA, 20 bp, Artificial Sequence
  chemically synthesized
ctttccagtgcctgaagata

SEQ ID NO: 616781 - DNA, 20 bp, Artificial Sequence
  chemically synthesized
caatttaactgtaactcgga

SEQ ID NO: 616782 - DNA, 20 bp, Artificial Sequence
  chemically synthesized
cttagagatataataagtgg

SEQ ID NO: 616783 - DNA, 20 bp, Artificial Sequence
  chemically synthesized
aatatatattttcttaagag

SEQ ID NO: 616784 - DNA, 20 bp, Artificial Sequence
  chemically synthesized
ttatctcaagtaatctcaag

SEQ ID NO: 616785 - DNA, 20 bp, Artificial Sequence
  chemically synthesized
ttaaaggtagtaatcttaac

SEQ ID NO: 616786 - DNA, 20 bp, Artificial Sequence
  chemically synthesized
aagattactacctttaacta

SEQ ID NO: 616787 - DNA, 20 bp, Artificial Sequence
  chemically synthesized
ttcaattaaaatttattaaa

SEQ ID NO: 616788 - DNA, 20 bp, Artificial Sequence
  chemically synthesized
aaaatattaattcaacccag

SEQ ID NO: 616789 - DNA, 20 bp, Artificial Sequence
  chemically synthesized
atgaggtaataaattaacca

SEQ ID NO: 616790 - DNA, 20 bp, Artificial Sequence
  chemically synthesized
ataatgtaagttctggttac

SEQ ID NO: 616791 - DNA, 20 bp, Artificial Sequence
  chemically synthesized
tgtaaccagaacttacatta

SEQ ID NO: 616792 - DNA, 20 bp, Artificial Sequence
  chemically synthesized
ctgcatttatgatatctaag

SEQ ID NO: 616793 - DNA, 20 bp, Artificial Sequence
  chemically synthesized
cacttcttagatatcataaa

SEQ ID NO: 616794 - DNA, 20 bp, Artificial Sequence
  chemically synthesized
aatgcagctttaacatgcag

SEQ ID NO: 616795 - DNA, 20 bp, Artificial Sequence
  chemically synthesized
cccccaaaaaattcctgtat

SEQ ID NO: 616796 - DNA, 20 bp, Artificial Sequence
  chemically synthesized
tttttattttttcttaatta

SEQ ID NO: 616797 - DNA, 20 bp, Artificial Sequence
  chemically synthesized
taagagtatatatctcatag

SEQ ID NO: 616798 - DNA, 20 bp, Artificial Sequence
  chemically synthesized
atcttaagagtatatatctc

SEQ ID NO: 616799 - DNA, 20 bp, Artificial Sequence
  chemically synthesized
atcctatgagatatatactc

SEQ ID NO: 616800 - DNA, 20 bp, Artificial Sequence
  chemically synthesized
tacaaggcacctaatttgaa

SEQ ID NO: 616801 - DNA, 20 bp, Artificial Sequence
  chemically synthesized
tcagaatgtagctattaaga

SEQ ID NO: 616802 - DNA, 20 bp, Artificial Sequence
  chemically synthesized
agggactcttctcatccaat

SEQ ID NO: 616803 - DNA, 20 bp, Artificial Sequence
  chemically synthesized
ctcatccaattccggttttg

SEQ ID NO: 616804 - DNA, 20 bp, Artificial Sequence
  chemically synthesized
gaatctgataacccacagtg

SEQ ID NO: 616805 - DNA, 20 bp, Artificial Sequence
  chemically synthesized
aaaacacaccactgtgggtt

SEQ ID NO: 616806 - DNA, 20 bp, Artificial Sequence
  chemically synthesized
tccaattttgttcattgtct

SEQ ID NO: 616807 - DNA, 20 bp, Artificial Sequence
  chemically synthesized
ggtgagatggcagaattcag

SEQ ID NO: 616808 - DNA, 20 bp, Artificial Sequence
  chemically synthesized
aaatgggtgagatggcagaa

SEQ ID NO: 616809 - DNA, 20 bp, Artificial Sequence
  chemically synthesized
gccactcttactaaatactc

SEQ ID NO: 616810 - DNA, 20 bp, Artificial Sequence
  chemically synthesized
tcttactaaatactcaattg

SEQ ID NO: 616811 - DNA, 20 bp, Artificial Sequence
  chemically synthesized
cgggctacatctctccaaat

SEQ ID NO: 616812 - DNA, 20 bp, Artificial Sequence
  chemically synthesized
tcccagtaaggatttgggca

SEQ ID NO: 616813 - DNA, 20 bp, Artificial Sequence
  chemically synthesized
gtaggttgtaggagtcccag

SEQ ID NO: 616814 - DNA, 20 bp, Artificial Sequence
  chemically synthesized
ttactgggactcctacaacc

SEQ ID NO: 616815 - DNA, 20 bp, Artificial Sequence
  chemically synthesized
cttgtagctgtctttctccc

SEQ ID NO: 616816 - DNA, 20 bp, Artificial Sequence
  chemically synthesized
agttcttgggcttcagtgtg

SEQ ID NO: 616817 - DNA, 20 bp, Artificial Sequence
  chemically synthesized
ttgaagtttatatcaagttc

SEQ ID NO: 616818 - DNA, 20 bp, Artificial Sequence
  chemically synthesized
tgttgtggtggtaagtcttt

SEQ ID NO: 616819 - DNA, 20 bp, Artificial Sequence
  chemically synthesized
caggcatgaaggttgcctat

SEQ ID NO: 616820 - DNA, 20 bp, Artificial Sequence
  chemically synthesized
aataactatgactgtgaaat

SEQ ID NO: 616821 - DNA, 20 bp, Artificial Sequence
  chemically synthesized
atctgatggattttctggtt

SEQ ID NO: 616822 - DNA, 20 bp, Artificial Sequence
  chemically synthesized
aaccataaaccagaaaatcc

SEQ ID NO: 616823 - DNA, 20 bp, Artificial Sequence
  chemically synthesized
agtggtaatctgatggattt

SEQ ID NO: 616824 - DNA, 20 bp, Artificial Sequence
  chemically synthesized
agatggtagagtggtaatct

SEQ ID NO: 616825 - DNA, 20 bp, Artificial Sequence
  chemically synthesized
attaccactctaccatctga

SEQ ID NO: 616826 - DNA, 20 bp, Artificial Sequence
  chemically synthesized
gtctagagggcaggcagtta

SEQ ID NO: 616827 - DNA, 20 bp, Artificial Sequence
  chemically synthesized
ctgccctctagactcaacaa

SEQ ID NO: 616828 - DNA, 20 bp, Artificial Sequence
  chemically synthesized
aggatttatattcttctcca

SEQ ID NO: 616829 - DNA, 20 bp, Artificial Sequence
  chemically synthesized
tatattcttctccaacaagt

SEQ ID NO: 616830 - DNA, 20 bp, Artificial Sequence
  chemically synthesized
tctccaacaagtttttgttt

SEQ ID NO: 616831 - DNA, 20 bp, Artificial Sequence
  chemically synthesized
caacaagtttttgtttttat

SEQ ID NO: 616832 - DNA, 20 bp, Artificial Sequence
  chemically synthesized
ctctactagcaagtctcaac

SEQ ID NO: 616833 - DNA, 20 bp, Artificial Sequence
  chemically synthesized
ccatttgtcattcgattgcc

SEQ ID NO: 616834 - DNA, 20 bp, Artificial Sequence
  chemically synthesized
acagtgtaagtccatttgtc

SEQ ID NO: 616835 - DNA, 20 bp, Artificial Sequence
  chemically synthesized
agggctcagaggagcctagc

SEQ ID NO: 616836 - DNA, 20 bp, Artificial Sequence
  chemically synthesized
acctgaacaaaaaacactaa

SEQ ID NO: 616837 - DNA, 20 bp, Artificial Sequence
  chemically synthesized
tgacctgttagaagctatgt

SEQ ID NO: 616838 - DNA, 20 bp, Artificial Sequence
  chemically synthesized
ggctagagttatcctagaga

SEQ ID NO: 616839 - DNA, 20 bp, Artificial Sequence
  chemically synthesized
ggtaaattattttggcagct

SEQ ID NO: 616840 - DNA, 20 bp, Artificial Sequence
  chemically synthesized
aacaaagggtaaattatttt

SEQ ID NO: 616841 - DNA, 20 bp, Artificial Sequence
  chemically synthesized
ctcctgccttctcactgtct

SEQ ID NO: 616842 - DNA, 20 bp, Artificial Sequence
  chemically synthesized
aagtgccatttagcaaacgt

SEQ ID NO: 616843 - DNA, 20 bp, Artificial Sequence
  chemically synthesized
gattgttccctgggaaacct

SEQ ID NO: 616844 - DNA, 20 bp, Artificial Sequence
  chemically synthesized
aaattacaaaaagtggaaag

SEQ ID NO: 616845 - DNA, 20 bp, Artificial Sequence
  chemically synthesized
tttaaagggagaatgagaga

SEQ ID NO: 616846 - DNA, 20 bp, Artificial Sequence
  chemically synthesized
tgatttgtgtagaggtgact

SEQ ID NO: 616847 - DNA, 20 bp, Artificial Sequence
  chemically synthesized
tcagcatgaactgaactgaa

SEQ ID NO: 616848 - DNA, 20 bp, Artificial Sequence
  chemically synthesized
tctctattataatagtgtat

SEQ ID NO: 616849 - DNA, 20 bp, Artificial Sequence
  chemically synthesized
acgtcagtttaattagtaag

SEQ ID NO: 616850 - DNA, 20 bp, Artificial Sequence
  chemically synthesized
ctaattaaactgacgtccac

SEQ ID NO: 616851 - DNA, 20 bp, Artificial Sequence
  chemically synthesized
aaagataagcaaaagtggac

SEQ ID NO: 616852 - DNA, 20 bp, Artificial Sequence
  chemically synthesized
tttggataactggttattta

SEQ ID NO: 616853 - DNA, 20 bp, Artificial Sequence
  chemically synthesized
ataactggttatttagttgg

SEQ ID NO: 616854 - DNA, 20 bp, Artificial Sequence
  chemically synthesized
ggttatttagttggtttagt

SEQ ID NO: 616855 - DNA, 20 bp, Artificial Sequence
  chemically synthesized
tgttcattgatgttggcgtg

SEQ ID NO: 616856 - DNA, 20 bp, Artificial Sequence
  chemically synthesized
tgaacatgtgaagaaggtaa

SEQ ID NO: 616857 - DNA, 20 bp, Artificial Sequence
  chemically synthesized
caaatggtgcaataaaataa

SEQ ID NO: 616858 - DNA, 20 bp, Artificial Sequence
  chemically synthesized
gtcaatttaaacgaagtact

SEQ ID NO: 616859 - DNA, 20 bp, Artificial Sequence
  chemically synthesized
ttcaatgtaatcatgcagta

SEQ ID NO: 616860 - DNA, 20 bp, Artificial Sequence
  chemically synthesized
tattttatgcttccatggtc

SEQ ID NO: 616861 - DNA, 20 bp, Artificial Sequence
  chemically synthesized
aatgggaggcaatatatatt

SEQ ID NO: 616862 - DNA, 20 bp, Artificial Sequence
  chemically synthesized
atgacataacttatctttca

SEQ ID NO: 616863 - DNA, 20 bp, Artificial Sequence
  chemically synthesized
tgaaagataagttatgtcat

SEQ ID NO: 616864 - DNA, 20 bp, Artificial Sequence
  chemically synthesized
aagttatgtcatcacagttt

SEQ ID NO: 616865 - DNA, 20 bp, Artificial Sequence
  chemically synthesized
tgtcatcacagtttttctgt

SEQ ID NO: 616866 - DNA, 20 bp, Artificial Sequence
  chemically synthesized
tcacagtttttctgtttttg

SEQ ID NO: 616867 - DNA, 20 bp, Artificial Sequence
  chemically synthesized
ctgtttttgtttcgttttgg

SEQ ID NO: 616868 - DNA, 20 bp, Artificial Sequence
  chemically synthesized
tttgtttcgttttggtatgg

SEQ ID NO: 616869 - DNA, 20 bp, Artificial Sequence
  chemically synthesized
cgttttggtatggcttggtt

SEQ ID NO: 616870 - DNA, 20 bp, Artificial Sequence
  chemically synthesized
tcaagggtctctaaggaaat

SEQ ID NO: 616871 - DNA, 20 bp, Artificial Sequence
  chemically synthesized
ctggaatataatatccactt

SEQ ID NO: 616872 - DNA, 20 bp, Artificial Sequence
  chemically synthesized
ttagaagttttttatggtat

SEQ ID NO: 616873 - DNA, 20 bp, Artificial Sequence
  chemically synthesized
ttaaatgtaaaatgtatgat

SEQ ID NO: 616874 - DNA, 20 bp, Artificial Sequence
  chemically synthesized
gtgtatattaaatgtaaaat

SEQ ID NO: 616875 - DNA, 20 bp, Artificial Sequence
  chemically synthesized
ataaggcagagcctttagaa

SEQ ID NO: 616876 - DNA, 20 bp, Artificial Sequence
  chemically synthesized
caatagttaacaaagattta

SEQ ID NO: 616877 - DNA, 20 bp, Artificial Sequence
  chemically synthesized
aaatttccttcaatagttaa

SEQ ID NO: 616878 - DNA, 20 bp, Artificial Sequence
  chemically synthesized
aaaatcagtaattttgttga

SEQ ID NO: 616879 - DNA, 20 bp, Artificial Sequence
  chemically synthesized
ataatcccactcaacaaaat

SEQ ID NO: 616880 - DNA, 20 bp, Artificial Sequence
  chemically synthesized
caaaattactgatttttatt

SEQ ID NO: 616881 - DNA, 20 bp, Artificial Sequence
  chemically synthesized
gtatgctaattaaaatatac

SEQ ID NO: 616882 - DNA, 20 bp, Artificial Sequence
  chemically synthesized
ttttttattttaaaaaggaa

SEQ ID NO: 616883 - DNA, 20 bp, Artificial Sequence
  chemically synthesized
gtgataaagtcagtataaca

SEQ ID NO: 616884 - DNA, 20 bp, Artificial Sequence
  chemically synthesized
aagcagctcataataactgc

SEQ ID NO: 616885 - DNA, 20 bp, Artificial Sequence
  chemically synthesized
aatctcaagcagttattatg

SEQ ID NO: 616886 - DNA, 20 bp, Artificial Sequence
  chemically synthesized
gctcaaaagcagctcataat

SEQ ID NO: 616887 - DNA, 20 bp, Artificial Sequence
  chemically synthesized
gcttttgagctatttgaagg

SEQ ID NO: 616888 - DNA, 20 bp, Artificial Sequence
  chemically synthesized
aggcctatgtacatctaggc

SEQ ID NO: 616889 - DNA, 20 bp, Artificial Sequence
  chemically synthesized
aggggacaaatggcaacgag

SEQ ID NO: 616890 - DNA, 20 bp, Artificial Sequence
  chemically synthesized
gatagcaagaactaagtcat

SEQ ID NO: 616891 - DNA, 20 bp, Artificial Sequence
  chemically synthesized
aacacattttagaccgaaac

SEQ ID NO: 616892 - DNA, 20 bp, Artificial Sequence
  chemically synthesized
gtacaaattattaaggaaac

SEQ ID NO: 616893 - DNA, 20 bp, Artificial Sequence
  chemically synthesized
gtttccttaataatttgtac

SEQ ID NO: 616894 - DNA, 20 bp, Artificial Sequence
  chemically synthesized
ttttttgccattttgtagtc

SEQ ID NO: 616895 - DNA, 20 bp, Artificial Sequence
  chemically synthesized
ggactacaaaatggcaaaaa

SEQ ID NO: 616896 - DNA, 20 bp, Artificial Sequence
  chemically synthesized
aactcatgtatacactataa

SEQ ID NO: 616897 - DNA, 20 bp, Artificial Sequence
  chemically synthesized
aacatgattatagtgtatac

SEQ ID NO: 616898 - DNA, 20 bp, Artificial Sequence
  chemically synthesized
atatgttgtgaagactattt

SEQ ID NO: 616899 - DNA, 20 bp, Artificial Sequence
  chemically synthesized
cattggcagacacattaagg

SEQ ID NO: 616900 - DNA, 20 bp, Artificial Sequence
  chemically synthesized
aaggttatgcttttgagttc

SEQ ID NO: 616901 - DNA, 20 bp, Artificial Sequence
  chemically synthesized
gttctattgcttttctgtac

SEQ ID NO: 616902 - DNA, 20 bp, Artificial Sequence
  chemically synthesized
cttttctgtacttctgtttt

SEQ ID NO: 616903 - DNA, 20 bp, Artificial Sequence
  chemically synthesized
ctgttttatttgatttgaaa

SEQ ID NO: 616904 - DNA, 20 bp, Artificial Sequence
  chemically synthesized
ttcaccataaagagtgtgcc

SEQ ID NO: 616905 - DNA, 20 bp, Artificial Sequence
  chemically synthesized
gtgtgccctttgttttatat

SEQ ID NO: 616906 - DNA, 20 bp, Artificial Sequence
  chemically synthesized
aaagccctatgctcaaccaa

SEQ ID NO: 616907 - DNA, 20 bp, Artificial Sequence
  chemically synthesized
taatcagcattggttgagca

SEQ ID NO: 616908 - DNA, 20 bp, Artificial Sequence
  chemically synthesized
ctttttatttctttaaactg

SEQ ID NO: 616909 - DNA, 20 bp, Artificial Sequence
  chemically synthesized
caaacctgagtaataaacag

SEQ ID NO: 616910 - DNA, 20 bp, Artificial Sequence
  chemically synthesized
taaactggcctgtttattac

SEQ ID NO: 616911 - DNA, 20 bp, Artificial Sequence
  chemically synthesized
tagtgttaagacattttgct

SEQ ID NO: 616912 - DNA, 20 bp, Artificial Sequence
  chemically synthesized
cttcccctagtgttaagaca

SEQ ID NO: 616913 - DNA, 20 bp, Artificial Sequence
  chemically synthesized
tgtcttaacactaggggaag

SEQ ID NO: 616914 - DNA, 20 bp, Artificial Sequence
  chemically synthesized
tttttctacaaagaaccaag

SEQ ID NO: 616915 - DNA, 20 bp, Artificial Sequence
  chemically synthesized
tctaccccatgtctcctgga

SEQ ID NO: 616916 - DNA, 20 bp, Artificial Sequence
  chemically synthesized
actctatccaggagacatgg

SEQ ID NO: 616917 - DNA, 20 bp, Artificial Sequence
  chemically synthesized
ggttgaagaatttgtaacat

SEQ ID NO: 616918 - DNA, 20 bp, Artificial Sequence
  chemically synthesized
caacaatgtggtgagacata

SEQ ID NO: 616919 - DNA, 20 bp, Artificial Sequence
  chemically synthesized
tgttgggtacatgttactga

SEQ ID NO: 616920 - DNA, 20 bp, Artificial Sequence
  chemically synthesized
ctgatctggcttaataatat

SEQ ID NO: 616921 - DNA, 20 bp, Artificial Sequence
  chemically synthesized
gatttaacttcctgtacttg

SEQ ID NO: 616922 - DNA, 20 bp, Artificial Sequence
  chemically synthesized
actgcagtacaagccagggc

SEQ ID NO: 616923 - DNA, 20 bp, Artificial Sequence
  chemically synthesized
aagcatagtgaaactgatgc

SEQ ID NO: 616924 - DNA, 20 bp, Artificial Sequence
  chemically synthesized
aagccagggcatcagtttca

SEQ ID NO: 616925 - DNA, 20 bp, Artificial Sequence
  chemically synthesized
acaaaatgaatttgaaccaa

SEQ ID NO: 616926 - DNA, 20 bp, Artificial Sequence
  chemically synthesized
tacccttcagggtattgtat

SEQ ID NO: 616927 - DNA, 20 bp, Artificial Sequence
  chemically synthesized
cgggtcacatctcacatcat

SEQ ID NO: 616928 - DNA, 20 bp, Artificial Sequence
  chemically synthesized
agcatatgttctagggctcc

SEQ ID NO: 616929 - DNA, 20 bp, Artificial Sequence
  chemically synthesized
aaatttcgttgaatagagtg

SEQ ID NO: 616930 - DNA, 20 bp, Artificial Sequence
  chemically synthesized
atttatgcatacatgtgtat

SEQ ID NO: 616931 - DNA, 20 bp, Artificial Sequence
  chemically synthesized
gcatacatgtgtattgtagt

SEQ ID NO: 616932 - DNA, 20 bp, Artificial Sequence
  chemically synthesized
catgtgaactgtcttcactt

SEQ ID NO: 616933 - DNA, 20 bp, Artificial Sequence
  chemically synthesized
ataataacaggctgaaagaa

SEQ ID NO: 616934 - DNA, 20 bp, Artificial Sequence
  chemically synthesized
ttgcagaagcaaaatctctg

SEQ ID NO: 616935 - DNA, 20 bp, Artificial Sequence
  chemically synthesized
attttcaatctgaccagaga

SEQ ID NO: 616936 - DNA, 20 bp, Artificial Sequence
  chemically synthesized
taacacattttcaatctgac

SEQ ID NO: 616937 - DNA, 20 bp, Artificial Sequence
  chemically synthesized
tttatgcagagaaaaaagat

SEQ ID NO: 616938 - DNA, 20 bp, Artificial Sequence
  chemically synthesized
ataagtaagttgtcaataac

SEQ ID NO: 616939 - DNA, 20 bp, Artificial Sequence
  chemically synthesized
taagttgtcaataactactg

SEQ ID NO: 616940 - DNA, 20 bp, Artificial Sequence
  chemically synthesized
ttgtcaataactactgtttt

SEQ ID NO: 616941 - DNA, 20 bp, Artificial Sequence
  chemically synthesized
caaacatgctcatttcaata

SEQ ID NO: 616942 - DNA, 20 bp, Artificial Sequence
  chemically synthesized
taatccaaatattgaaatga

SEQ ID NO: 616943 - DNA, 20 bp, Artificial Sequence
  chemically synthesized
aatattgaaatgagcatgtt

SEQ ID NO: 616944 - DNA, 20 bp, Artificial Sequence
  chemically synthesized
aatgagcatgtttgctgctt

SEQ ID NO: 616945 - DNA, 20 bp, Artificial Sequence
  chemically synthesized
agtaaatgttaattactaag

SEQ ID NO: 616946 - DNA, 20 bp, Artificial Sequence
  chemically synthesized
gtgtgggtataacatttatc

SEQ ID NO: 616947 - DNA, 20 bp, Artificial Sequence
  chemically synthesized
actcaggaggtcaatgtaaa

SEQ ID NO: 616948 - DNA, 20 bp, Artificial Sequence
  chemically synthesized
ttatttattatcatccagtt

SEQ ID NO: 616949 - DNA, 20 bp, Artificial Sequence
  chemically synthesized
ttatttatttattatcatcc

SEQ ID NO: 616950 - DNA, 20 bp, Artificial Sequence
  chemically synthesized
cacctcagcctcccaaagtg

SEQ ID NO: 616951 - DNA, 20 bp, Artificial Sequence
  chemically synthesized
ttttgtatttttagtagaga

SEQ ID NO: 616952 - DNA, 20 bp, Artificial Sequence
  chemically synthesized
aacctccacctctcaggttc

SEQ ID NO: 616953 - DNA, 20 bp, Artificial Sequence
  chemically synthesized
gaacaattttcaaaataatg

SEQ ID NO: 616954 - DNA, 20 bp, Artificial Sequence
  chemically synthesized
gggaaaaactgaagcattta

SEQ ID NO: 616955 - DNA, 20 bp, Artificial Sequence
  chemically synthesized
aagcaaagcagagtaaatgc

SEQ ID NO: 616956 - DNA, 20 bp, Artificial Sequence
  chemically synthesized
aaactgaagcatttactctg

SEQ ID NO: 616957 - DNA, 20 bp, Artificial Sequence
  chemically synthesized
gatacaaagcaaagcagagt

SEQ ID NO: 616958 - DNA, 20 bp, Artificial Sequence
  chemically synthesized
tacaggtgtgagtcactgag

SEQ ID NO: 616959 - DNA, 20 bp, Artificial Sequence
  chemically synthesized
cacctttgctttccaaagtg

SEQ ID NO: 616960 - DNA, 20 bp, Artificial Sequence
  chemically synthesized
acctcaggtgatccacccac

SEQ ID NO: 616961 - DNA, 20 bp, Artificial Sequence
  chemically synthesized
tgggtggatcacctgaggtc

SEQ ID NO: 616962 - DNA, 20 bp, Artificial Sequence
  chemically synthesized
tttttgtatttttagtagag

SEQ ID NO: 616963 - DNA, 20 bp, Artificial Sequence
  chemically synthesized
tgcctcagcctccctagtag

SEQ ID NO: 616964 - DNA, 20 bp, Artificial Sequence
  chemically synthesized
tagggaggctgaggcaggag

SEQ ID NO: 616965 - DNA, 20 bp, Artificial Sequence
  chemically synthesized
gaggcagaggttgcagtgag

SEQ ID NO: 616966 - DNA, 20 bp, Artificial Sequence
  chemically synthesized
ctttttgttttgttttgatt

SEQ ID NO: 616967 - DNA, 20 bp, Artificial Sequence
  chemically synthesized
aaagagaactttttgttttg

SEQ ID NO: 616968 - DNA, 20 bp, Artificial Sequence
  chemically synthesized
tctataaagagaactttttg

SEQ ID NO: 616969 - DNA, 20 bp, Artificial Sequence
  chemically synthesized
gcagttctataaagagaact

SEQ ID NO: 616970 - DNA, 20 bp, Artificial Sequence
  chemically synthesized
aagaagtaaaaacagtatat

SEQ ID NO: 616971 - DNA, 20 bp, Artificial Sequence
  chemically synthesized
tgagttgcaaaacaatgata

SEQ ID NO: 616972 - DNA, 20 bp, Artificial Sequence
  chemically synthesized
ccattgatgatcattgtttt

SEQ ID NO: 616973 - DNA, 20 bp, Artificial Sequence
  chemically synthesized
gcagccattgatgatcattg

SEQ ID NO: 616974 - DNA, 20 bp, Artificial Sequence
  chemically synthesized
tattggcagccattgatgat

SEQ ID NO: 616975 - DNA, 20 bp, Artificial Sequence
  chemically synthesized
tactttcaacaaaaggtata

SEQ ID NO: 616976 - DNA, 20 bp, Artificial Sequence
  chemically synthesized
ttttgttctttttttactca

SEQ ID NO: 616977 - DNA, 20 bp, Artificial Sequence
  chemically synthesized
tagagagctacttgtagtca

SEQ ID NO: 616978 - DNA, 20 bp, Artificial Sequence
  chemically synthesized
agtctagagagctacttgta

SEQ ID NO: 616979 - DNA, 20 bp, Artificial Sequence
  chemically synthesized
catccacatgatattgttta

SEQ ID NO: 616980 - DNA, 20 bp, Artificial Sequence
  chemically synthesized
tgttgattacatccacatga

SEQ ID NO: 616981 - DNA, 20 bp, Artificial Sequence
  chemically synthesized
caggaccttttgtctaggtt

SEQ ID NO: 616982 - DNA, 20 bp, Artificial Sequence
  chemically synthesized
gaagaaacaggaccttttgt

SEQ ID NO: 616983 - DNA, 20 bp, Artificial Sequence
  chemically synthesized
caacaaacctagacaaaagg

SEQ ID NO: 616984 - DNA, 20 bp, Artificial Sequence
  chemically synthesized
tcctctcttctctctgttgt

SEQ ID NO: 616985 - DNA, 20 bp, Artificial Sequence
  chemically synthesized
cgcacccagccccggaaaat

SEQ ID NO: 616986 - DNA, 20 bp, Artificial Sequence
  chemically synthesized
caccttggcccctcaaagtg

SEQ ID NO: 616987 - DNA, 20 bp, Artificial Sequence
  chemically synthesized
tttttgtatttttagtacag

SEQ ID NO: 616988 - DNA, 20 bp, Artificial Sequence
  chemically synthesized
aacctccgcctcccaggttc

SEQ ID NO: 616989 - DNA, 20 bp, Artificial Sequence
  chemically synthesized
ttacttgggaatacagtctg

SEQ ID NO: 616990 - DNA, 20 bp, Artificial Sequence
  chemically synthesized
gagtagaagtgatatacttt

SEQ ID NO: 616991 - DNA, 20 bp, Artificial Sequence
  chemically synthesized
ctacctacccacttcctatt

SEQ ID NO: 616992 - DNA, 20 bp, Artificial Sequence
  chemically synthesized
aaccattattatcattacca

SEQ ID NO: 616993 - DNA, 20 bp, Artificial Sequence
  chemically synthesized
atgttacttttttattttgt

SEQ ID NO: 616994 - DNA, 20 bp, Artificial Sequence
  chemically synthesized
agttatcccctttacctcat

SEQ ID NO: 616995 - DNA, 20 bp, Artificial Sequence
  chemically synthesized
atcttggcttcaaagtaact

SEQ ID NO: 616996 - DNA, 20 bp, Artificial Sequence
  chemically synthesized
taactatatgctttaatcat

SEQ ID NO: 616997 - DNA, 20 bp, Artificial Sequence
  chemically synthesized
ctggggacctagacaaacta

SEQ ID NO: 616998 - DNA, 20 bp, Artificial Sequence
  chemically synthesized
agtttgtctaggtccccaga

SEQ ID NO: 616999 - DNA, 20 bp, Artificial Sequence
  chemically synthesized
ctaggtccccagagagtgtt

SEQ ID NO: 617000 - DNA, 20 bp, Artificial Sequence
  chemically synthesized
gtgtttttagatttttattt

SEQ ID NO: 617001 - DNA, 20 bp, Artificial Sequence
  chemically synthesized
actattttattatattggct

SEQ ID NO: 617002 - DNA, 20 bp, Artificial Sequence
  chemically synthesized
gttaaagactattttattat

SEQ ID NO: 617003 - DNA, 20 bp, Artificial Sequence
  chemically synthesized
aatgatggttatttatgctt

SEQ ID NO: 617004 - DNA, 20 bp, Artificial Sequence
  chemically synthesized
gaagtataaatgatggttat

SEQ ID NO: 617005 - DNA, 20 bp, Artificial Sequence
  chemically synthesized
tcttagatactttgctttga

SEQ ID NO: 617006 - DNA, 20 bp, Artificial Sequence
  chemically synthesized
tcatactcaaagcaaagtat

SEQ ID NO: 617007 - DNA, 20 bp, Artificial Sequence
  chemically synthesized
cttactctgaatcttagata

SEQ ID NO: 617008 - DNA, 20 bp, Artificial Sequence
  chemically synthesized
gtatctaagattcagagtaa

SEQ ID NO: 617009 - DNA, 20 bp, Artificial Sequence
  chemically synthesized
ggattctcacttgtccaatg

SEQ ID NO: 617010 - DNA, 20 bp, Artificial Sequence
  chemically synthesized
taatatgttgtctaattatg

SEQ ID NO: 617011 - DNA, 20 bp, Artificial Sequence
  chemically synthesized
tctccataattagacaacat

SEQ ID NO: 617012 - DNA, 20 bp, Artificial Sequence
  chemically synthesized
actagacttaccccttgaca

SEQ ID NO: 617013 - DNA, 20 bp, Artificial Sequence
  chemically synthesized
ttatcctgtctgtatctgca

SEQ ID NO: 617014 - DNA, 20 bp, Artificial Sequence
  chemically synthesized
aatcttaggcctcattatta

SEQ ID NO: 617015 - DNA, 20 bp, Artificial Sequence
  chemically synthesized
aaactaaataataatgaggc

SEQ ID NO: 617016 - DNA, 20 bp, Artificial Sequence
  chemically synthesized
cacacatttgacatgaaaat

SEQ ID NO: 617017 - DNA, 20 bp, Artificial Sequence
  chemically synthesized
atgcctcctttataacagag

SEQ ID NO: 617018 - DNA, 20 bp, Artificial Sequence
  chemically synthesized
agattaaaacactgagaatg

SEQ ID NO: 617019 - DNA, 20 bp, Artificial Sequence
  chemically synthesized
aaggggaaacttcccattct

SEQ ID NO: 617020 - DNA, 20 bp, Artificial Sequence
  chemically synthesized
gagaatgggaagtttcccct

SEQ ID NO: 617021 - DNA, 20 bp, Artificial Sequence
  chemically synthesized
ttcaatgccactgtttggtg

SEQ ID NO: 617022 - DNA, 20 bp, Artificial Sequence
  chemically synthesized
acctcttcaatgccactgtt

SEQ ID NO: 617023 - DNA, 20 bp, Artificial Sequence
  chemically synthesized
tcagtcaacctcttcaatgc

SEQ ID NO: 617024 - DNA, 20 bp, Artificial Sequence
  chemically synthesized
tgactgacagtggtctaggg

SEQ ID NO: 617025 - DNA, 20 bp, Artificial Sequence
  chemically synthesized
cccgtggagggaaacctctg

SEQ ID NO: 617026 - DNA, 20 bp, Artificial Sequence
  chemically synthesized
acgctaatgataatctagac

SEQ ID NO: 617027 - DNA, 20 bp, Artificial Sequence
  chemically synthesized
cttgacttagctctgtgatt

SEQ ID NO: 617028 - DNA, 20 bp, Artificial Sequence
  chemically synthesized
gactgatgcttgacttagct

SEQ ID NO: 617029 - DNA, 20 bp, Artificial Sequence
  chemically synthesized
agacattctgaaatttggac

SEQ ID NO: 617030 - DNA, 20 bp, Artificial Sequence
  chemically synthesized
tttgcatcattgtccctgca

SEQ ID NO: 617031 - DNA, 20 bp, Artificial Sequence
  chemically synthesized
gcaagaccttggccactctt

SEQ ID NO: 617032 - DNA, 20 bp, Artificial Sequence
  chemically synthesized
tggctttataccaggatttt

SEQ ID NO: 617033 - DNA, 20 bp, Artificial Sequence
  chemically synthesized
tgggtagtgttggctttata

SEQ ID NO: 617034 - DNA, 20 bp, Artificial Sequence
  chemically synthesized
tggtataaagccaacactac

SEQ ID NO: 617035 - DNA, 20 bp, Artificial Sequence
  chemically synthesized
cctgtgtaatcatgggtagt

SEQ ID NO: 617036 - DNA, 20 bp, Artificial Sequence
  chemically synthesized
cacaggttcataatgccaca

SEQ ID NO: 617037 - DNA, 20 bp, Artificial Sequence
  chemically synthesized
aataaaattcatgaattctt

SEQ ID NO: 617038 - DNA, 20 bp, Artificial Sequence
  chemically synthesized
ctgcctttcagtacctacgg

SEQ ID NO: 617039 - DNA, 20 bp, Artificial Sequence
  chemically synthesized
actaactggtgatgttattc

SEQ ID NO: 617040 - DNA, 20 bp, Artificial Sequence
  chemically synthesized
tccattgctcaatgtctaaa

SEQ ID NO: 617041 - DNA, 20 bp, Artificial Sequence
  chemically synthesized
tgacaaatttgagtccatgt

SEQ ID NO: 617042 - DNA, 20 bp, Artificial Sequence
  chemically synthesized
tcctgtttctcacttcctgt

SEQ ID NO: 617043 - DNA, 20 bp, Artificial Sequence
  chemically synthesized
gtgatctccatcacagatct

SEQ ID NO: 617044 - DNA, 20 bp, Artificial Sequence
  chemically synthesized
ctcacttctctacttcctgt

SEQ ID NO: 617045 - DNA, 20 bp, Artificial Sequence
  chemically synthesized
atgcatcctatttgagtgta

SEQ ID NO: 617046 - DNA, 20 bp, Artificial Sequence
  chemically synthesized
ctatttgagtgtaaaaagtt

SEQ ID NO: 617047 - DNA, 20 bp, Artificial Sequence
  chemically synthesized
tctattattaacctgaagaa

SEQ ID NO: 617048 - DNA, 20 bp, Artificial Sequence
  chemically synthesized
gcacctgaagactttctctg

SEQ ID NO: 617049 - DNA, 20 bp, Artificial Sequence
  chemically synthesized
aaagggtacggacagcgtcc

SEQ ID NO: 617050 - DNA, 20 bp, Artificial Sequence
  chemically synthesized
atagtgtagactatagctgt

SEQ ID NO: 617051 - DNA, 20 bp, Artificial Sequence
  chemically synthesized
tttttttccttcctttagaa

SEQ ID NO: 617052 - DNA, 20 bp, Artificial Sequence
  chemically synthesized
aaccgagattacattttcaa

SEQ ID NO: 617053 - DNA, 20 bp, Artificial Sequence
  chemically synthesized
tctccatgcttcctgttcaa

SEQ ID NO: 617054 - DNA, 20 bp, Artificial Sequence
  chemically synthesized
ccaattcagttgaactatct

SEQ ID NO: 617055 - DNA, 20 bp, Artificial Sequence
  chemically synthesized
agctaactggacaggtcaga

SEQ ID NO: 617056 - DNA, 20 bp, Artificial Sequence
  chemically synthesized
agcctcttctgacctgtcca

SEQ ID NO: 617057 - DNA, 20 bp, Artificial Sequence
  chemically synthesized
gcactgtactttgcacatct

SEQ ID NO: 617058 - DNA, 20 bp, Artificial Sequence
  chemically synthesized
tcttcaccattttcttcaga

SEQ ID NO: 617059 - DNA, 20 bp, Artificial Sequence
  chemically synthesized
ttcagaatctgcttatgctg

SEQ ID NO: 617060 - DNA, 20 bp, Artificial Sequence
  chemically synthesized
catttaatctgaccagcata

SEQ ID NO: 617061 - DNA, 20 bp, Artificial Sequence
  chemically synthesized
tgcttatgctggtcagatta

SEQ ID NO: 617062 - DNA, 20 bp, Artificial Sequence
  chemically synthesized
agattaaatggctttacttg

SEQ ID NO: 617063 - DNA, 20 bp, Artificial Sequence
  chemically synthesized
tgagctgtttccaactttca

SEQ ID NO: 617064 - DNA, 20 bp, Artificial Sequence
  chemically synthesized
ctgtcagaaaaaaaaaaaaa

SEQ ID NO: 617065 - DNA, 20 bp, Artificial Sequence
  chemically synthesized
gattttttttttttttctga

SEQ ID NO: 617066 - DNA, 20 bp, Artificial Sequence
  chemically synthesized
gacagtgatttaacaccact

SEQ ID NO: 617067 - DNA, 20 bp, Artificial Sequence
  chemically synthesized
aaagttttcagttaccttcc

SEQ ID NO: 617068 - DNA, 20 bp, Artificial Sequence
  chemically synthesized
tttcaccagaaatagctatt

SEQ ID NO: 617069 - DNA, 20 bp, Artificial Sequence
  chemically synthesized
gagatagttctcacttcaat

SEQ ID NO: 617070 - DNA, 20 bp, Artificial Sequence
  chemically synthesized
tttgagttttgagaggatcg

SEQ ID NO: 617071 - DNA, 20 bp, Artificial Sequence
  chemically synthesized
tgcatatatacaaagtgaac

SEQ ID NO: 617072 - DNA, 20 bp, Artificial Sequence
  chemically synthesized
tgttaacattttactatttt

SEQ ID NO: 617073 - DNA, 20 bp, Artificial Sequence
  chemically synthesized
tatagtcactgttattgaat

SEQ ID NO: 617074 - DNA, 20 bp, Artificial Sequence
  chemically synthesized
taatactatcactttgggag

SEQ ID NO: 617075 - DNA, 20 bp, Artificial Sequence
  chemically synthesized
caaagtgatagtattaggag

SEQ ID NO: 617076 - DNA, 20 bp, Artificial Sequence
  chemically synthesized
atagtattaggagatgggtt

SEQ ID NO: 617077 - DNA, 20 bp, Artificial Sequence
  chemically synthesized
tgggtttggggctttttggg

SEQ ID NO: 617078 - DNA, 20 bp, Artificial Sequence
  chemically synthesized
caccctggcctcccaaagtg

SEQ ID NO: 617079 - DNA, 20 bp, Artificial Sequence
  chemically synthesized
ttttgtatttttagtagagg

SEQ ID NO: 617080 - DNA, 20 bp, Artificial Sequence
  chemically synthesized
tgcctcagcctcccaagtag

SEQ ID NO: 617081 - DNA, 20 bp, Artificial Sequence
  chemically synthesized
cttgggaggctgaggcagag

SEQ ID NO: 617082 - DNA, 20 bp, Artificial Sequence
  chemically synthesized
gctcactgcaacctctgcct

SEQ ID NO: 617083 - DNA, 20 bp, Artificial Sequence
  chemically synthesized
cctccagcctgggagacaga

SEQ ID NO: 617084 - DNA, 20 bp, Artificial Sequence
  chemically synthesized
ctcagtgacgttcatcttgt

SEQ ID NO: 617085 - DNA, 20 bp, Artificial Sequence
  chemically synthesized
gcatgttaggtgtcttgtga

SEQ ID NO: 617086 - DNA, 20 bp, Artificial Sequence
  chemically synthesized
atatagatattatatttctg

SEQ ID NO: 617087 - DNA, 20 bp, Artificial Sequence
  chemically synthesized
cacccatatatgtacacaca

SEQ ID NO: 617088 - DNA, 20 bp, Artificial Sequence
  chemically synthesized
tatctatgtatgtggtacat

SEQ ID NO: 617089 - DNA, 20 bp, Artificial Sequence
  chemically synthesized
tagtctcataccactcattt

SEQ ID NO: 617090 - DNA, 20 bp, Artificial Sequence
  chemically synthesized
tgagactaaacagaaatgtt

SEQ ID NO: 617091 - DNA, 20 bp, Artificial Sequence
  chemically synthesized
tgccaaaaagcacagaacat

SEQ ID NO: 617092 - DNA, 20 bp, Artificial Sequence
  chemically synthesized
gctttttggcacaaacgcat

SEQ ID NO: 617093 - DNA, 20 bp, Artificial Sequence
  chemically synthesized
tacataataaataaacaaat

SEQ ID NO: 617094 - DNA, 20 bp, Artificial Sequence
  chemically synthesized
atttattatgtatgtattta

SEQ ID NO: 617095 - DNA, 20 bp, Artificial Sequence
  chemically synthesized
atacatatgtgcatatgtgt

SEQ ID NO: 617096 - DNA, 20 bp, Artificial Sequence
  chemically synthesized
cataacgatcacatttcaac

SEQ ID NO: 617097 - DNA, 20 bp, Artificial Sequence
  chemically synthesized
tctgtttatataaattcatc

SEQ ID NO: 617098 - DNA, 20 bp, Artificial Sequence
  chemically synthesized
catgcctgtgccctttatac

SEQ ID NO: 617099 - DNA, 20 bp, Artificial Sequence
  chemically synthesized
ctaccaccaagctatgtcca

SEQ ID NO: 617100 - DNA, 20 bp, Artificial Sequence
  chemically synthesized
aaataggtaatctaaatgga

SEQ ID NO: 617101 - DNA, 20 bp, Artificial Sequence
  chemically synthesized
gagtaagggtttagatggac

SEQ ID NO: 617102 - DNA, 20 bp, Artificial Sequence
  chemically synthesized
atttatgttttcacatgagt

SEQ ID NO: 617103 - DNA, 20 bp, Artificial Sequence
  chemically synthesized
tcaaggagtttgcccttcat

SEQ ID NO: 617104 - DNA, 20 bp, Artificial Sequence
  chemically synthesized
tacatagcaattctacttca

SEQ ID NO: 617105 - DNA, 20 bp, Artificial Sequence
  chemically synthesized
gccaaattaatctcaagagt

SEQ ID NO: 617106 - DNA, 20 bp, Artificial Sequence
  chemically synthesized
agtaacacaagcccagactc

SEQ ID NO: 617107 - DNA, 20 bp, Artificial Sequence
  chemically synthesized
tcctactactctttggataa

SEQ ID NO: 617108 - DNA, 20 bp, Artificial Sequence
  chemically synthesized
gtaaagagtttggagtttct

SEQ ID NO: 617109 - DNA, 20 bp, Artificial Sequence
  chemically synthesized
aagcatatttgtaaagagtt

SEQ ID NO: 617110 - DNA, 20 bp, Artificial Sequence
  chemically synthesized
aaactccaaactctttacaa

SEQ ID NO: 617111 - DNA, 20 bp, Artificial Sequence
  chemically synthesized
tttagcaaagcatatttgta

SEQ ID NO: 617112 - DNA, 20 bp, Artificial Sequence
  chemically synthesized
aaaataactaaaagagtgta

SEQ ID NO: 617113 - DNA, 20 bp, Artificial Sequence
  chemically synthesized
taactaaaagagtgtaattg

SEQ ID NO: 617114 - DNA, 20 bp, Artificial Sequence
  chemically synthesized
ttgcttgtaacatgaaggat

SEQ ID NO: 617115 - DNA, 20 bp, Artificial Sequence
  chemically synthesized
tgtatatcccattctccatg

SEQ ID NO: 617116 - DNA, 20 bp, Artificial Sequence
  chemically synthesized
atatatttatggggtacatg

SEQ ID NO: 617117 - DNA, 20 bp, Artificial Sequence
  chemically synthesized
tgcctcagcctcctggggag

SEQ ID NO: 617118 - DNA, 20 bp, Artificial Sequence
  chemically synthesized
ccaggaggctgaggcaggag

SEQ ID NO: 617119 - DNA, 20 bp, Artificial Sequence
  chemically synthesized
aacctccgcctcccgggttc

SEQ ID NO: 617120 - DNA, 20 bp, Artificial Sequence
  chemically synthesized
taaaaataataacgaaattc

SEQ ID NO: 617121 - DNA, 20 bp, Artificial Sequence
  chemically synthesized
tgtgaaattagacagaattt

SEQ ID NO: 617122 - DNA, 20 bp, Artificial Sequence
  chemically synthesized
tttagcaattgtttagaaca

SEQ ID NO: 617123 - DNA, 20 bp, Artificial Sequence
  chemically synthesized
tgtaaccaaaatattttagc

SEQ ID NO: 617124 - DNA, 20 bp, Artificial Sequence
  chemically synthesized
cacttttttcctattattta

SEQ ID NO: 617125 - DNA, 20 bp, Artificial Sequence
  chemically synthesized
tgggtttcttctgttattgt

SEQ ID NO: 617126 - DNA, 20 bp, Artificial Sequence
  chemically synthesized
aacctctgcctcccgggttc

SEQ ID NO: 617127 - DNA, 20 bp, Artificial Sequence
  chemically synthesized
tgcctcagcctcctgagtag

SEQ ID NO: 617128 - DNA, 20 bp, Artificial Sequence
  chemically synthesized
ttttgtatttttagtagaga

SEQ ID NO: 617129 - DNA, 20 bp, Artificial Sequence
  chemically synthesized
tgaactcttgacttccagtc

SEQ ID NO: 617130 - DNA, 20 bp, Artificial Sequence
  chemically synthesized
tgccttggcctcccaaagtg

SEQ ID NO: 617131 - DNA, 20 bp, Artificial Sequence
  chemically synthesized
aactggctgagtgcggtggc

SEQ ID NO: 617132 - DNA, 20 bp, Artificial Sequence
  chemically synthesized
agcgtgagccaccgcactca

SEQ ID NO: 617133 - DNA, 20 bp, Artificial Sequence
  chemically synthesized
caccgcactcagccagtttg

SEQ ID NO: 617134 - DNA, 20 bp, Artificial Sequence
  chemically synthesized
ttgttaggtttttattaggt

SEQ ID NO: 617135 - DNA, 20 bp, Artificial Sequence
  chemically synthesized
ctgtggcttgcttgtgtttt

SEQ ID NO: 617136 - DNA, 20 bp, Artificial Sequence
  chemically synthesized
ttcttggagctgtggcttgc

SEQ ID NO: 617137 - DNA, 20 bp, Artificial Sequence
  chemically synthesized
gtacacttcttggagctgtg

SEQ ID NO: 617138 - DNA, 20 bp, Artificial Sequence
  chemically synthesized
tgttgtacacttcttggagc

SEQ ID NO: 617139 - DNA, 20 bp, Artificial Sequence
  chemically synthesized
agctccaagaagtgtacaac

SEQ ID NO: 617140 - DNA, 20 bp, Artificial Sequence
  chemically synthesized
tgaaattttcggcccaaagt

SEQ ID NO: 617141 - DNA, 20 bp, Artificial Sequence
  chemically synthesized
taaagttatttttactccat

SEQ ID NO: 617142 - DNA, 20 bp, Artificial Sequence
  chemically synthesized
ttatggagtaaaaataactt

SEQ ID NO: 617143 - DNA, 20 bp, Artificial Sequence
  chemically synthesized
taactttatagtttattgct

SEQ ID NO: 617144 - DNA, 20 bp, Artificial Sequence
  chemically synthesized
gcatgtgtaacaggcattaa

SEQ ID NO: 617145 - DNA, 20 bp, Artificial Sequence
  chemically synthesized
cacattcctcatgaaactat

SEQ ID NO: 617146 - DNA, 20 bp, Artificial Sequence
  chemically synthesized
gtatggggagaagaatcatg

SEQ ID NO: 617147 - DNA, 20 bp, Artificial Sequence
  chemically synthesized
tattattccattctcatata

SEQ ID NO: 617148 - DNA, 20 bp, Artificial Sequence
  chemically synthesized
tctcatataacatgttttcg

SEQ ID NO: 617149 - DNA, 20 bp, Artificial Sequence
  chemically synthesized
gttctatgttctatagtatt

SEQ ID NO: 617150 - DNA, 20 bp, Artificial Sequence
  chemically synthesized
tcaaacctctgtgaatttta

SEQ ID NO: 617151 - DNA, 20 bp, Artificial Sequence
  chemically synthesized
taaatctacctaaaattcac

SEQ ID NO: 617152 - DNA, 20 bp, Artificial Sequence
  chemically synthesized
tacctaaaattcacagaggt

SEQ ID NO: 617153 - DNA, 20 bp, Artificial Sequence
  chemically synthesized
tttgagattcacaaaaggtc

SEQ ID NO: 617154 - DNA, 20 bp, Artificial Sequence
  chemically synthesized
attcacaaaaggtcacttga

SEQ ID NO: 617155 - DNA, 20 bp, Artificial Sequence
  chemically synthesized
ccttatctactcgcaaatat

SEQ ID NO: 617156 - DNA, 20 bp, Artificial Sequence
  chemically synthesized
tagctctcattccttttgct

SEQ ID NO: 617157 - DNA, 20 bp, Artificial Sequence
  chemically synthesized
ttacattcaggggcctgaat

SEQ ID NO: 617158 - DNA, 20 bp, Artificial Sequence
  chemically synthesized
gcaaaaattacatttataac

SEQ ID NO: 617159 - DNA, 20 bp, Artificial Sequence
  chemically synthesized
ttataaccttggcttttaat

SEQ ID NO: 617160 - DNA, 20 bp, Artificial Sequence
  chemically synthesized
cagcttttcattatggtaaa

SEQ ID NO: 617161 - DNA, 20 bp, Artificial Sequence
  chemically synthesized
agcgagtcatacaagttctt

SEQ ID NO: 617162 - DNA, 20 bp, Artificial Sequence
  chemically synthesized
agctgtgaagaacttgtatg

SEQ ID NO: 617163 - DNA, 20 bp, Artificial Sequence
  chemically synthesized
tatgactcgcttataatttt

SEQ ID NO: 617164 - DNA, 20 bp, Artificial Sequence
  chemically synthesized
ttgtattttttttatagagg

SEQ ID NO: 617165 - DNA, 20 bp, Artificial Sequence
  chemically synthesized
gtgaggttttgccatgttac

SEQ ID NO: 617166 - DNA, 20 bp, Artificial Sequence
  chemically synthesized
tgggcagatcacttgagctc

SEQ ID NO: 617167 - DNA, 20 bp, Artificial Sequence
  chemically synthesized
caccttggcctcctaaagtg

SEQ ID NO: 617168 - DNA, 20 bp, Artificial Sequence
  chemically synthesized
acctacttattttcctcctg

SEQ ID NO: 617169 - DNA, 20 bp, Artificial Sequence
  chemically synthesized
atcaatttttttcaataaaa

SEQ ID NO: 617170 - DNA, 20 bp, Artificial Sequence
  chemically synthesized
actgaataaaatagccccag

SEQ ID NO: 617171 - DNA, 20 bp, Artificial Sequence
  chemically synthesized
atattactgaataaaatagc

SEQ ID NO: 617172 - DNA, 20 bp, Artificial Sequence
  chemically synthesized
tatgccagtattcacatagc

SEQ ID NO: 617173 - DNA, 20 bp, Artificial Sequence
  chemically synthesized
acatagcaagagttttgagc

SEQ ID NO: 617174 - DNA, 20 bp, Artificial Sequence
  chemically synthesized
cccactaataaatgttaaag

SEQ ID NO: 617175 - DNA, 20 bp, Artificial Sequence
  chemically synthesized
gttcattagcatctccgtac

SEQ ID NO: 617176 - DNA, 20 bp, Artificial Sequence
  chemically synthesized
ataataatggtgtctaattc

SEQ ID NO: 617177 - DNA, 20 bp, Artificial Sequence
  chemically synthesized
gattcttatgagaatttaat

SEQ ID NO: 617178 - DNA, 20 bp, Artificial Sequence
  chemically synthesized
ggatggtaccttgacatagt

SEQ ID NO: 617179 - DNA, 20 bp, Artificial Sequence
  chemically synthesized
agtagctgttttatcattgt

SEQ ID NO: 617180 - DNA, 20 bp, Artificial Sequence
  chemically synthesized
ataccatacatgcctgtaaa

SEQ ID NO: 617181 - DNA, 20 bp, Artificial Sequence
  chemically synthesized
accagagttcaccacctttg

SEQ ID NO: 617182 - DNA, 20 bp, Artificial Sequence
  chemically synthesized
accacctttgtggagatttg

SEQ ID NO: 617183 - DNA, 20 bp, Artificial Sequence
  chemically synthesized
gataataagagctatataat

SEQ ID NO: 617184 - DNA, 20 bp, Artificial Sequence
  chemically synthesized
ttcctctttagtctgggctc

SEQ ID NO: 617185 - DNA, 20 bp, Artificial Sequence
  chemically synthesized
ctcccatgattcttggtgcc

SEQ ID NO: 617186 - DNA, 20 bp, Artificial Sequence
  chemically synthesized
tgattcttggtgccaaacgt

SEQ ID NO: 617187 - DNA, 20 bp, Artificial Sequence
  chemically synthesized
gagttactgaatttaaacca

SEQ ID NO: 617188 - DNA, 20 bp, Artificial Sequence
  chemically synthesized
tcttccaaatgtcaactata

SEQ ID NO: 617189 - DNA, 20 bp, Artificial Sequence
  chemically synthesized
gtggcttctagtcaatttga

SEQ ID NO: 617190 - DNA, 20 bp, Artificial Sequence
  chemically synthesized
tagtcaatttgaccttgttt

SEQ ID NO: 617191 - DNA, 20 bp, Artificial Sequence
  chemically synthesized
atttgaccttgttttactga

SEQ ID NO: 617192 - DNA, 20 bp, Artificial Sequence
  chemically synthesized
gcaagatggtagatgaatgc

SEQ ID NO: 617193 - DNA, 20 bp, Artificial Sequence
  chemically synthesized
atgaatgcaatggtttattc

SEQ ID NO: 617194 - DNA, 20 bp, Artificial Sequence
  chemically synthesized
tcttaaaagtatataattac

SEQ ID NO: 617195 - DNA, 20 bp, Artificial Sequence
  chemically synthesized
aattatatacttttaagacg

SEQ ID NO: 617196 - DNA, 20 bp, Artificial Sequence
  chemically synthesized
agggcatgttttatgacagg

SEQ ID NO: 617197 - DNA, 20 bp, Artificial Sequence
  chemically synthesized
aaaccattgtgccataaagg

SEQ ID NO: 617198 - DNA, 20 bp, Artificial Sequence
  chemically synthesized
aaacatgccctttatggcac

SEQ ID NO: 617199 - DNA, 20 bp, Artificial Sequence
  chemically synthesized
ccctacctttccatttgcca

SEQ ID NO: 617200 - DNA, 20 bp, Artificial Sequence
  chemically synthesized
tcctttcctcttcaatctgg

SEQ ID NO: 617201 - DNA, 20 bp, Artificial Sequence
  chemically synthesized
ttgaagtagttacaaactca

SEQ ID NO: 617202 - DNA, 20 bp, Artificial Sequence
  chemically synthesized
cagatagaggatggcaagag

SEQ ID NO: 617203 - DNA, 20 bp, Artificial Sequence
  chemically synthesized
aaaagaccatatgactacta

SEQ ID NO: 617204 - DNA, 20 bp, Artificial Sequence
  chemically synthesized
tactaccttgtttgctagaa

SEQ ID NO: 617205 - DNA, 20 bp, Artificial Sequence
  chemically synthesized
accttgtttgctagaacagc

SEQ ID NO: 617206 - DNA, 20 bp, Artificial Sequence
  chemically synthesized
gtttggcttcttcctagcat

SEQ ID NO: 617207 - DNA, 20 bp, Artificial Sequence
  chemically synthesized
catgtgaacttgctatgttg

SEQ ID NO: 617208 - DNA, 20 bp, Artificial Sequence
  chemically synthesized
gcctacatgtgaacttgcta

SEQ ID NO: 617209 - DNA, 20 bp, Artificial Sequence
  chemically synthesized
cctccagccattgagtccaa

SEQ ID NO: 617210 - DNA, 20 bp, Artificial Sequence
  chemically synthesized
gataggacacagcagggatg

SEQ ID NO: 617211 - DNA, 20 bp, Artificial Sequence
  chemically synthesized
catccacggcataataaagt

SEQ ID NO: 617212 - DNA, 20 bp, Artificial Sequence
  chemically synthesized
ataaaatcaccctgatactt

SEQ ID NO: 617213 - DNA, 20 bp, Artificial Sequence
  chemically synthesized
ttttaaactgctaagtatca

SEQ ID NO: 617214 - DNA, 20 bp, Artificial Sequence
  chemically synthesized
tttggggtgtgcatgttttc

SEQ ID NO: 617215 - DNA, 20 bp, Artificial Sequence
  chemically synthesized
aagaaaacattttggggtgt

SEQ ID NO: 617216 - DNA, 20 bp, Artificial Sequence
  chemically synthesized
ctgaaaacatgcacacccca

SEQ ID NO: 617217 - DNA, 20 bp, Artificial Sequence
  chemically synthesized
ctcacttttttatttctgtg

SEQ ID NO: 617218 - DNA, 20 bp, Artificial Sequence
  chemically synthesized
taaaagaatgataattttta

SEQ ID NO: 617219 - DNA, 20 bp, Artificial Sequence
  chemically synthesized
tttgtatgtcacaaatggcc

SEQ ID NO: 617220 - DNA, 20 bp, Artificial Sequence
  chemically synthesized
taaggcttttttttcccact

SEQ ID NO: 617221 - DNA, 20 bp, Artificial Sequence
  chemically synthesized
caccagtttacgggtattcg

SEQ ID NO: 617222 - DNA, 20 bp, Artificial Sequence
  chemically synthesized
attttgtttgtccatttatc

SEQ ID NO: 617223 - DNA, 20 bp, Artificial Sequence
  chemically synthesized
cattgtatggatataccaaa

SEQ ID NO: 617224 - DNA, 20 bp, Artificial Sequence
  chemically synthesized
ctgtaatctttcattttgca

SEQ ID NO: 617225 - DNA, 20 bp, Artificial Sequence
  chemically synthesized
ttaaaaacattatgcaaaat

SEQ ID NO: 617226 - DNA, 20 bp, Artificial Sequence
  chemically synthesized
gacactagaggccacatata

SEQ ID NO: 617227 - DNA, 20 bp, Artificial Sequence
  chemically synthesized
ggagtgactgctaatgggca

SEQ ID NO: 617228 - DNA, 20 bp, Artificial Sequence
  chemically synthesized
ctctctagaagtgtacaatt

SEQ ID NO: 617229 - DNA, 20 bp, Artificial Sequence
  chemically synthesized
tatcctggggattttgttac

SEQ ID NO: 617230 - DNA, 20 bp, Artificial Sequence
  chemically synthesized
tatttagaaatgggatatcc

SEQ ID NO: 617231 - DNA, 20 bp, Artificial Sequence
  chemically synthesized
cagaagacctcaagggaaaa

SEQ ID NO: 617232 - DNA, 20 bp, Artificial Sequence
  chemically synthesized
atttttcccttgaggtcttc

SEQ ID NO: 617233 - DNA, 20 bp, Artificial Sequence
  chemically synthesized
tacacctctttttgttgtgc

SEQ ID NO: 617234 - DNA, 20 bp, Artificial Sequence
  chemically synthesized
ttgtgctgtggctttttgga

SEQ ID NO: 617235 - DNA, 20 bp, Artificial Sequence
  chemically synthesized
ctttttggaagcagatttct

SEQ ID NO: 617236 - DNA, 20 bp, Artificial Sequence
  chemically synthesized
aaatgaacaaacccagagaa

SEQ ID NO: 617237 - DNA, 20 bp, Artificial Sequence
  chemically synthesized
atttctctgggtttgttcat

SEQ ID NO: 617238 - DNA, 20 bp, Artificial Sequence
  chemically synthesized
tatttcagtattagaaccaa

SEQ ID NO: 617239 - DNA, 20 bp, Artificial Sequence
  chemically synthesized
atcctgtctttttttaaatt

SEQ ID NO: 617240 - DNA, 20 bp, Artificial Sequence
  chemically synthesized
gaattgggattattgctact

SEQ ID NO: 617241 - DNA, 20 bp, Artificial Sequence
  chemically synthesized
tcgggaattgggattattgc

SEQ ID NO: 617242 - DNA, 20 bp, Artificial Sequence
  chemically synthesized
tagcaataatcccaattccc

SEQ ID NO: 617243 - DNA, 20 bp, Artificial Sequence
  chemically synthesized
cttgttgaatcactcgggaa

SEQ ID NO: 617244 - DNA, 20 bp, Artificial Sequence
  chemically synthesized
cccaattcccgagtgattca

SEQ ID NO: 617245 - DNA, 20 bp, Artificial Sequence
  chemically synthesized
ttattgtgcagatggtaaga

SEQ ID NO: 617246 - DNA, 20 bp, Artificial Sequence
  chemically synthesized
tggtaagaaactgtttccct

SEQ ID NO: 617247 - DNA, 20 bp, Artificial Sequence
  chemically synthesized
tggtagcaaacaatgaggga

SEQ ID NO: 617248 - DNA, 20 bp, Artificial Sequence
  chemically synthesized
ggaagtcatttttgtgaacc

SEQ ID NO: 617249 - DNA, 20 bp, Artificial Sequence
  chemically synthesized
aagaccaattcctcctaatt

SEQ ID NO: 617250 - DNA, 20 bp, Artificial Sequence
  chemically synthesized
tttatttggttaacaaagta

SEQ ID NO: 617251 - DNA, 20 bp, Artificial Sequence
  chemically synthesized
atattttcagtactcctttt

SEQ ID NO: 617252 - DNA, 20 bp, Artificial Sequence
  chemically synthesized
aaaatattaggttaatgtgt

SEQ ID NO: 617253 - DNA, 20 bp, Artificial Sequence
  chemically synthesized
aatgtttagtcagtggttgt

SEQ ID NO: 617254 - DNA, 20 bp, Artificial Sequence
  chemically synthesized
gttcctgattattctaaata

SEQ ID NO: 617255 - DNA, 20 bp, Artificial Sequence
  chemically synthesized
taagcagattttccactggt

SEQ ID NO: 617256 - DNA, 20 bp, Artificial Sequence
  chemically synthesized
taatcaggaaccagtggaaa

SEQ ID NO: 617257 - DNA, 20 bp, Artificial Sequence
  chemically synthesized
gatgcttcaaggtctagata

SEQ ID NO: 617258 - DNA, 20 bp, Artificial Sequence
  chemically synthesized
aaattttcagaaaaaaaaaa

SEQ ID NO: 617259 - DNA, 20 bp, Artificial Sequence
  chemically synthesized
ttttttttctgaaaatttct

SEQ ID NO: 617260 - DNA, 20 bp, Artificial Sequence
  chemically synthesized
atccagtggcagatactgct

SEQ ID NO: 617261 - DNA, 20 bp, Artificial Sequence
  chemically synthesized
agtggcagatactgctattt

SEQ ID NO: 617262 - DNA, 20 bp, Artificial Sequence
  chemically synthesized
gcagatactgctatttgctt

SEQ ID NO: 617263 - DNA, 20 bp, Artificial Sequence
  chemically synthesized
tcaagacaactatttctttg

SEQ ID NO: 617264 - DNA, 20 bp, Artificial Sequence
  chemically synthesized
atgctttttaaatttttaga

SEQ ID NO: 617265 - DNA, 20 bp, Artificial Sequence
  chemically synthesized
gagtgaatattttttggtta

SEQ ID NO: 617266 - DNA, 20 bp, Artificial Sequence
  chemically synthesized
caaaaaatattcactccaca

SEQ ID NO: 617267 - DNA, 20 bp, Artificial Sequence
  chemically synthesized
tttgctttttaaactttaaa

SEQ ID NO: 617268 - DNA, 20 bp, Artificial Sequence
  chemically synthesized
aaaaaaaaaaaagcattttt

SEQ ID NO: 617269 - DNA, 20 bp, Artificial Sequence
  chemically synthesized
tggcttactgtctacttttt

SEQ ID NO: 617270 - DNA, 20 bp, Artificial Sequence
  chemically synthesized
gatttccaattcttccagga

SEQ ID NO: 617271 - DNA, 20 bp, Artificial Sequence
  chemically synthesized
agcttcctagaccctcatgc

SEQ ID NO: 617272 - DNA, 20 bp, Artificial Sequence
  chemically synthesized
tcctgagactgcttcagcct

SEQ ID NO: 617273 - DNA, 20 bp, Artificial Sequence
  chemically synthesized
tccctatctacttgtcctga

SEQ ID NO: 617274 - DNA, 20 bp, Artificial Sequence
  chemically synthesized
tttttctctcaacaacaaaa

SEQ ID NO: 617275 - DNA, 20 bp, Artificial Sequence
  chemically synthesized
tctcaacaacaaaatcgtga

SEQ ID NO: 617276 - DNA, 20 bp, Artificial Sequence
  chemically synthesized
cttgctacttctaaacaaaa

SEQ ID NO: 617277 - DNA, 20 bp, Artificial Sequence
  chemically synthesized
cttgaaatagagctctttgt

SEQ ID NO: 617278 - DNA, 20 bp, Artificial Sequence
  chemically synthesized
aggccatgactgggtgccag

SEQ ID NO: 617279 - DNA, 20 bp, Artificial Sequence
  chemically synthesized
gcatctgagaggacgacagc

SEQ ID NO: 617280 - DNA, 20 bp, Artificial Sequence
  chemically synthesized
cgacagctagggatttctgg

SEQ ID NO: 617281 - DNA, 20 bp, Artificial Sequence
  chemically synthesized
gctagggatttctgggatag

SEQ ID NO: 617282 - DNA, 20 bp, Artificial Sequence
  chemically synthesized
acatgctgcctcttccttct

SEQ ID NO: 617283 - DNA, 20 bp, Artificial Sequence
  chemically synthesized
tcaactcttggttgcaagat

SEQ ID NO: 617284 - DNA, 20 bp, Artificial Sequence
  chemically synthesized
tttacaccttactatcattc

SEQ ID NO: 617285 - DNA, 20 bp, Artificial Sequence
  chemically synthesized
agcaagaagatcaaaggggc

SEQ ID NO: 617286 - DNA, 20 bp, Artificial Sequence
  chemically synthesized
gattttcatgccatcacagg

SEQ ID NO: 617287 - DNA, 20 bp, Artificial Sequence
  chemically synthesized
atgccatcacagggccagtt

SEQ ID NO: 617288 - DNA, 20 bp, Artificial Sequence
  chemically synthesized
cttgctttagactccattcc

SEQ ID NO: 617289 - DNA, 20 bp, Artificial Sequence
  chemically synthesized
gaaagttaaaatcctctggt

SEQ ID NO: 617290 - DNA, 20 bp, Artificial Sequence
  chemically synthesized
aagtagcagaaactagaacc

SEQ ID NO: 617291 - DNA, 20 bp, Artificial Sequence
  chemically synthesized
catgagccaccgtgccaggc

SEQ ID NO: 617292 - DNA, 20 bp, Artificial Sequence
  chemically synthesized
ccctggcctggcacggtggc

SEQ ID NO: 617293 - DNA, 20 bp, Artificial Sequence
  chemically synthesized
tacctcggcctcccaaagtg

SEQ ID NO: 617294 - DNA, 20 bp, Artificial Sequence
  chemically synthesized
taggtggatcatttgaggtc

SEQ ID NO: 617295 - DNA, 20 bp, Artificial Sequence
  chemically synthesized
ttttgtatttttagtagaga

SEQ ID NO: 617296 - DNA, 20 bp, Artificial Sequence
  chemically synthesized
cctcccgagtagctgggatt

SEQ ID NO: 617297 - DNA, 20 bp, Artificial Sequence
  chemically synthesized
tgcctcagcctcccgagtag

SEQ ID NO: 617298 - DNA, 20 bp, Artificial Sequence
  chemically synthesized
tcgggaggctgaggcaggag

SEQ ID NO: 617299 - DNA, 20 bp, Artificial Sequence
  chemically synthesized
aacctccgcctcccagcttc

SEQ ID NO: 617300 - DNA, 20 bp, Artificial Sequence
  chemically synthesized
attcactgcaacctccgcct

SEQ ID NO: 617301 - DNA, 20 bp, Artificial Sequence
  chemically synthesized
ttgagatcgcgcctctgcac

SEQ ID NO: 617302 - DNA, 20 bp, Artificial Sequence
  chemically synthesized
atttaagaaacgtgaaagca

SEQ ID NO: 617303 - DNA, 20 bp, Artificial Sequence
  chemically synthesized
tggggacaatcacagtgctt

SEQ ID NO: 617304 - DNA, 20 bp, Artificial Sequence
  chemically synthesized
atccgttatggggacaatca

SEQ ID NO: 617305 - DNA, 20 bp, Artificial Sequence
  chemically synthesized
gaaagtccaggaaaatgagt

SEQ ID NO: 617306 - DNA, 20 bp, Artificial Sequence
  chemically synthesized
agtaattgtttcatgtccta

SEQ ID NO: 617307 - DNA, 20 bp, Artificial Sequence
  chemically synthesized
cttttgaaaagtaggggaca

SEQ ID NO: 617308 - DNA, 20 bp, Artificial Sequence
  chemically synthesized
ttccctttgatttattgtgg

SEQ ID NO: 617309 - DNA, 20 bp, Artificial Sequence
  chemically synthesized
aaaataagtgcacattttcc

SEQ ID NO: 617310 - DNA, 20 bp, Artificial Sequence
  chemically synthesized
taaagtaatgggatttttct

SEQ ID NO: 617311 - DNA, 20 bp, Artificial Sequence
  chemically synthesized
gaacagcatattttaaagta

SEQ ID NO: 617312 - DNA, 20 bp, Artificial Sequence
  chemically synthesized
cgtatgcaggtgagtggtat

SEQ ID NO: 617313 - DNA, 20 bp, Artificial Sequence
  chemically synthesized
catttcgagctgtctacttc

SEQ ID NO: 617314 - DNA, 20 bp, Artificial Sequence
  chemically synthesized
atttttaattcattattgtc

SEQ ID NO: 617315 - DNA, 20 bp, Artificial Sequence
  chemically synthesized
tgatttattttttacaaggt

SEQ ID NO: 617316 - DNA, 20 bp, Artificial Sequence
  chemically synthesized
ttttttcttctatgtaccgt

SEQ ID NO: 617317 - DNA, 20 bp, Artificial Sequence
  chemically synthesized
tatacggtacatagaagaaa

SEQ ID NO: 617318 - DNA, 20 bp, Artificial Sequence
  chemically synthesized
tgagccaccacgccaggcta

SEQ ID NO: 617319 - DNA, 20 bp, Artificial Sequence
  chemically synthesized
caccttggactcccaatgtg

SEQ ID NO: 617320 - DNA, 20 bp, Artificial Sequence
  chemically synthesized
tgggagtccaaggtggggcg

SEQ ID NO: 617321 - DNA, 20 bp, Artificial Sequence
  chemically synthesized
ggggcggatcgcttgaggtc

SEQ ID NO: 617322 - DNA, 20 bp, Artificial Sequence
  chemically synthesized
ttttattgtaacagtggaga

SEQ ID NO: 617323 - DNA, 20 bp, Artificial Sequence
  chemically synthesized
tcaggaggttgagacaggag

SEQ ID NO: 617324 - DNA, 20 bp, Artificial Sequence
  chemically synthesized
aacctccgcctcctgggttc

SEQ ID NO: 617325 - DNA, 20 bp, Artificial Sequence
  chemically synthesized
gaaaataagataatacaccc

SEQ ID NO: 617326 - DNA, 20 bp, Artificial Sequence
  chemically synthesized
aatacacccaattgattaaa

SEQ ID NO: 617327 - DNA, 20 bp, Artificial Sequence
  chemically synthesized
gtaaatgttcctatgccttc

SEQ ID NO: 617328 - DNA, 20 bp, Artificial Sequence
  chemically synthesized
gatggatcaccaggtcatta

SEQ ID NO: 617329 - DNA, 20 bp, Artificial Sequence
  chemically synthesized
actctgggttgagtcttata

SEQ ID NO: 617330 - DNA, 20 bp, Artificial Sequence
  chemically synthesized
gtcaaagataattgtgctcc

SEQ ID NO: 617331 - DNA, 20 bp, Artificial Sequence
  chemically synthesized
atagactcttccttccttgt

SEQ ID NO: 617332 - DNA, 20 bp, Artificial Sequence
  chemically synthesized
tccttccttgtagcagcttg

SEQ ID NO: 617333 - DNA, 20 bp, Artificial Sequence
  chemically synthesized
tgcctagattgtgaaaaaca

SEQ ID NO: 617334 - DNA, 20 bp, Artificial Sequence
  chemically synthesized
acctttctaagggtcaaaca

SEQ ID NO: 617335 - DNA, 20 bp, Artificial Sequence
  chemically synthesized
attggaacaagactagtagt

SEQ ID NO: 617336 - DNA, 20 bp, Artificial Sequence
  chemically synthesized
agctagatatttgcccatcg

SEQ ID NO: 617337 - DNA, 20 bp, Artificial Sequence
  chemically synthesized
ataacgatgggcaaatatct

SEQ ID NO: 617338 - DNA, 20 bp, Artificial Sequence
  chemically synthesized
tttgaaatttgaaaaaaatt

SEQ ID NO: 617339 - DNA, 20 bp, Artificial Sequence
  chemically synthesized
tatttgctcggtatttcctc

SEQ ID NO: 617340 - DNA, 20 bp, Artificial Sequence
  chemically synthesized
ataactggtaatagttttgt

SEQ ID NO: 617341 - DNA, 20 bp, Artificial Sequence
  chemically synthesized
aaaggtcagctataactggt

SEQ ID NO: 617342 - DNA, 20 bp, Artificial Sequence
  chemically synthesized
ttaaagtttttcctgtttat

SEQ ID NO: 617343 - DNA, 20 bp, Artificial Sequence
  chemically synthesized
gacttttctcttaaagtttt

SEQ ID NO: 617344 - DNA, 20 bp, Artificial Sequence
  chemically synthesized
actgaagaagacttttctct

SEQ ID NO: 617345 - DNA, 20 bp, Artificial Sequence
  chemically synthesized
ttcttcagtgggtcaaatcc

SEQ ID NO: 617346 - DNA, 20 bp, Artificial Sequence
  chemically synthesized
ccgcccagttcatgaaaacc

SEQ ID NO: 617347 - DNA, 20 bp, Artificial Sequence
  chemically synthesized
gcggactgctacagggcagg

SEQ ID NO: 617348 - DNA, 20 bp, Artificial Sequence
  chemically synthesized
caccctttgctatatagctg

SEQ ID NO: 617349 - DNA, 20 bp, Artificial Sequence
  chemically synthesized
gataaggcatttctcttaga

SEQ ID NO: 617350 - DNA, 20 bp, Artificial Sequence
  chemically synthesized
taagagaaatgccttatctt

SEQ ID NO: 617351 - DNA, 20 bp, Artificial Sequence
  chemically synthesized
tgctattttagggagggagc

SEQ ID NO: 617352 - DNA, 20 bp, Artificial Sequence
  chemically synthesized
gcaaaatagcaagctctttg

SEQ ID NO: 617353 - DNA, 20 bp, Artificial Sequence
  chemically synthesized
aatttttaaaaatccatgca

SEQ ID NO: 617354 - DNA, 20 bp, Artificial Sequence
  chemically synthesized
gacagggtctcactctctca

SEQ ID NO: 617355 - DNA, 20 bp, Artificial Sequence
  chemically synthesized
gaggcggaggttgcatcgag

SEQ ID NO: 617356 - DNA, 20 bp, Artificial Sequence
  chemically synthesized
aacctccgcctcccaggctc

SEQ ID NO: 617357 - DNA, 20 bp, Artificial Sequence
  chemically synthesized
cacctcagcctcctgagtag

SEQ ID NO: 617358 - DNA, 20 bp, Artificial Sequence
  chemically synthesized
tttttatatttttagtagag

SEQ ID NO: 617359 - DNA, 20 bp, Artificial Sequence
  chemically synthesized
tgtctgggcctcccaaagtg

SEQ ID NO: 617360 - DNA, 20 bp, Artificial Sequence
  chemically synthesized
ccggccgtatgatcttttta

SEQ ID NO: 617361 - DNA, 20 bp, Artificial Sequence
  chemically synthesized
tcaagtaacaattttatttc

SEQ ID NO: 617362 - DNA, 20 bp, Artificial Sequence
  chemically synthesized
atttccaactattgccattc

SEQ ID NO: 617363 - DNA, 20 bp, Artificial Sequence
  chemically synthesized
gtaactatggccaaaagagt

SEQ ID NO: 617364 - DNA, 20 bp, Artificial Sequence
  chemically synthesized
taagtcttctttatgtgaga

SEQ ID NO: 617365 - DNA, 20 bp, Artificial Sequence
  chemically synthesized
ctagtttaagtcttctttat

SEQ ID NO: 617366 - DNA, 20 bp, Artificial Sequence
  chemically synthesized
agatggagtcaactagtaca

SEQ ID NO: 617367 - DNA, 20 bp, Artificial Sequence
  chemically synthesized
tatttctcctagacagaaat

SEQ ID NO: 617368 - DNA, 20 bp, Artificial Sequence
  chemically synthesized
ctcagtcacatttgcctaat

SEQ ID NO: 617369 - DNA, 20 bp, Artificial Sequence
  chemically synthesized
gaacttgtaaattataaaga

SEQ ID NO: 617370 - DNA, 20 bp, Artificial Sequence
  chemically synthesized
ggagatcatatgttggtaat

SEQ ID NO: 617371 - DNA, 20 bp, Artificial Sequence
  chemically synthesized
tttctgttgccaatttataa

SEQ ID NO: 617372 - DNA, 20 bp, Artificial Sequence
  chemically synthesized
aactttactgaaatgagatg

SEQ ID NO: 617373 - DNA, 20 bp, Artificial Sequence
  chemically synthesized
tctcatctcatttcagtaaa

SEQ ID NO: 617374 - DNA, 20 bp, Artificial Sequence
  chemically synthesized
tcatctgattcaggttcaaa

SEQ ID NO: 617375 - DNA, 20 bp, Artificial Sequence
  chemically synthesized
aagtgacttgtacatccatc

SEQ ID NO: 617376 - DNA, 20 bp, Artificial Sequence
  chemically synthesized
atgtacaagtcacttatttt

SEQ ID NO: 617377 - DNA, 20 bp, Artificial Sequence
  chemically synthesized
gagttactctggagagtaac

SEQ ID NO: 617378 - DNA, 20 bp, Artificial Sequence
  chemically synthesized
atcaatgttcctagaaatta

SEQ ID NO: 617379 - DNA, 20 bp, Artificial Sequence
  chemically synthesized
atgacctactgttgttacca

SEQ ID NO: 617380 - DNA, 20 bp, Artificial Sequence
  chemically synthesized
tactaggtaatacaaattgg

SEQ ID NO: 617381 - DNA, 20 bp, Artificial Sequence
  chemically synthesized
ctaggcaattgtatttaatt

SEQ ID NO: 617382 - DNA, 20 bp, Artificial Sequence
  chemically synthesized
tggaatgacggaaggtattc

SEQ ID NO: 617383 - DNA, 20 bp, Artificial Sequence
  chemically synthesized
gcttgctttcttgttttcta

SEQ ID NO: 617384 - DNA, 20 bp, Artificial Sequence
  chemically synthesized
ggtcttttgcttgcttgctt

SEQ ID NO: 617385 - DNA, 20 bp, Artificial Sequence
  chemically synthesized
agtatcttggtcttttgctt

SEQ ID NO: 617386 - DNA, 20 bp, Artificial Sequence
  chemically synthesized
caccagtatcttggtctttt

SEQ ID NO: 617387 - DNA, 20 bp, Artificial Sequence
  chemically synthesized
ttttcaccagtatcttggtc

SEQ ID NO: 617388 - DNA, 20 bp, Artificial Sequence
  chemically synthesized
ttgtggttttattgactctt

SEQ ID NO: 617389 - DNA, 20 bp, Artificial Sequence
  chemically synthesized
ttcttcttactcctggtgtt

SEQ ID NO: 617390 - DNA, 20 bp, Artificial Sequence
  chemically synthesized
gtgaagcttcttcttactcc

SEQ ID NO: 617391 - DNA, 20 bp, Artificial Sequence
  chemically synthesized
cacaaacaccaggagtaaga

SEQ ID NO: 617392 - DNA, 20 bp, Artificial Sequence
  chemically synthesized
ctatttgtcaaccaaaggtg

SEQ ID NO: 617393 - DNA, 20 bp, Artificial Sequence
  chemically synthesized
aattctgctggctgttgtaa

SEQ ID NO: 617394 - DNA, 20 bp, Artificial Sequence
  chemically synthesized
agtctcatatagaagctatt

SEQ ID NO: 617395 - DNA, 20 bp, Artificial Sequence
  chemically synthesized
tctaaaggacccaaacccac

SEQ ID NO: 617396 - DNA, 20 bp, Artificial Sequence
  chemically synthesized
tcatcttttaggccacaact

SEQ ID NO: 617397 - DNA, 20 bp, Artificial Sequence
  chemically synthesized
ccctccctaaattacggtga

SEQ ID NO: 617398 - DNA, 20 bp, Artificial Sequence
  chemically synthesized
accttttaacagctatctct

SEQ ID NO: 617399 - DNA, 20 bp, Artificial Sequence
  chemically synthesized
tcaatagctgtccattactg

SEQ ID NO: 617400 - DNA, 20 bp, Artificial Sequence
  chemically synthesized
ttttacaacatttatttgac

SEQ ID NO: 617401 - DNA, 20 bp, Artificial Sequence
  chemically synthesized
ttcaatatggcaaatggaat

SEQ ID NO: 617402 - DNA, 20 bp, Artificial Sequence
  chemically synthesized
cgcctcggcctcccaaagtg

SEQ ID NO: 617403 - DNA, 20 bp, Artificial Sequence
  chemically synthesized
cgggcagatcacttgaggtc

SEQ ID NO: 617404 - DNA, 20 bp, Artificial Sequence
  chemically synthesized
ttttctgtttttagtagaga

SEQ ID NO: 617405 - DNA, 20 bp, Artificial Sequence
  chemically synthesized
ctactacaccagcctaattt

SEQ ID NO: 617406 - DNA, 20 bp, Artificial Sequence
  chemically synthesized
cgcctcagcctcccgagtag

SEQ ID NO: 617407 - DNA, 20 bp, Artificial Sequence
  chemically synthesized
tcgggaggctgaggcgcgag

SEQ ID NO: 617408 - DNA, 20 bp, Artificial Sequence
  chemically synthesized
agatcgcgccactgcaccac

SEQ ID NO: 617409 - DNA, 20 bp, Artificial Sequence
  chemically synthesized
gtacaataagatagacaaat

SEQ ID NO: 617410 - DNA, 20 bp, Artificial Sequence
  chemically synthesized
ccttcagcctagtctctacc

SEQ ID NO: 617411 - DNA, 20 bp, Artificial Sequence
  chemically synthesized
gttggagaagagggtgaagg

SEQ ID NO: 617412 - DNA, 20 bp, Artificial Sequence
  chemically synthesized
aaaatattatgattcggaaa

SEQ ID NO: 617413 - DNA, 20 bp, Artificial Sequence
  chemically synthesized
gaaaaatgaaatgaaaaata

SEQ ID NO: 617414 - DNA, 20 bp, Artificial Sequence
  chemically synthesized
taatatttttcatttcattt

SEQ ID NO: 617415 - DNA, 20 bp, Artificial Sequence
  chemically synthesized
gtcttcatattacttataga

SEQ ID NO: 617416 - DNA, 20 bp, Artificial Sequence
  chemically synthesized
gattacgaacctaggtgggg

SEQ ID NO: 617417 - DNA, 20 bp, Artificial Sequence
  chemically synthesized
gactcctatatgtgcggctt

SEQ ID NO: 617418 - DNA, 20 bp, Artificial Sequence
  chemically synthesized
attcgtctgactcctatatg

SEQ ID NO: 617419 - DNA, 20 bp, Artificial Sequence
  chemically synthesized
ttaatgctatgttcgctgat

SEQ ID NO: 617420 - DNA, 20 bp, Artificial Sequence
  chemically synthesized
gcattaagtcttcttattat

SEQ ID NO: 617421 - DNA, 20 bp, Artificial Sequence
  chemically synthesized
ggaatgcttcttcttccatt

SEQ ID NO: 617422 - DNA, 20 bp, Artificial Sequence
  chemically synthesized
catgatataaattatatagg

SEQ ID NO: 617423 - DNA, 20 bp, Artificial Sequence
  chemically synthesized
ccctatataatttatatcat

SEQ ID NO: 617424 - DNA, 20 bp, Artificial Sequence
  chemically synthesized
tggaggaggaattgagtagg

SEQ ID NO: 617425 - DNA, 20 bp, Artificial Sequence
  chemically synthesized
aagcagaaatgaaccatcta

SEQ ID NO: 617426 - DNA, 20 bp, Artificial Sequence
  chemically synthesized
aatcagggtagatggttcat

SEQ ID NO: 617427 - DNA, 20 bp, Artificial Sequence
  chemically synthesized
tacgctagggtaataatatt

SEQ ID NO: 617428 - DNA, 20 bp, Artificial Sequence
  chemically synthesized
atctttggaccctccttgct

SEQ ID NO: 617429 - DNA, 20 bp, Artificial Sequence
  chemically synthesized
aacaacaagcaaggagggtc

SEQ ID NO: 617430 - DNA, 20 bp, Artificial Sequence
  chemically synthesized
caattaaatctttggaccct

SEQ ID NO: 617431 - DNA, 20 bp, Artificial Sequence
  chemically synthesized
gatttaattgcatatacatt

SEQ ID NO: 617432 - DNA, 20 bp, Artificial Sequence
  chemically synthesized
gtctcattttcaatattctt

SEQ ID NO: 617433 - DNA, 20 bp, Artificial Sequence
  chemically synthesized
cattttcaatattctttaga

SEQ ID NO: 617434 - DNA, 20 bp, Artificial Sequence
  chemically synthesized
gcttgtgatgataattagca

SEQ ID NO: 617435 - DNA, 20 bp, Artificial Sequence
  chemically synthesized
acaaggaaaatgacagaaat

SEQ ID NO: 617436 - DNA, 20 bp, Artificial Sequence
  chemically synthesized
ctcttcttttaactctagta

SEQ ID NO: 617437 - DNA, 20 bp, Artificial Sequence
  chemically synthesized
catgctaacctcggctttgg

SEQ ID NO: 617438 - DNA, 20 bp, Artificial Sequence
  chemically synthesized
cttttccaaagccgaggtta

SEQ ID NO: 617439 - DNA, 20 bp, Artificial Sequence
  chemically synthesized
attcagctaagcatgctaac

SEQ ID NO: 617440 - DNA, 20 bp, Artificial Sequence
  chemically synthesized
agcaatagccatattaacta

SEQ ID NO: 617441 - DNA, 20 bp, Artificial Sequence
  chemically synthesized
tatgtttatttgtctctaaa

SEQ ID NO: 617442 - DNA, 20 bp, Artificial Sequence
  chemically synthesized
ttctgaaatgtctctctagc

SEQ ID NO: 617443 - DNA, 20 bp, Artificial Sequence
  chemically synthesized
gtcctagtcttgcaaatgct

SEQ ID NO: 617444 - DNA, 20 bp, Artificial Sequence
  chemically synthesized
tttataaatacaacaaatat

SEQ ID NO: 617445 - DNA, 20 bp, Artificial Sequence
  chemically synthesized
tttctattactataactaaa

SEQ ID NO: 617446 - DNA, 20 bp, Artificial Sequence
  chemically synthesized
atatgcactattttcaactg

SEQ ID NO: 617447 - DNA, 20 bp, Artificial Sequence
  chemically synthesized
tccagcagaggcttgtatta

SEQ ID NO: 617448 - DNA, 20 bp, Artificial Sequence
  chemically synthesized
ctttattttttatttccagc

SEQ ID NO: 617449 - DNA, 20 bp, Artificial Sequence
  chemically synthesized
aaattattaaataattcatt

SEQ ID NO: 617450 - DNA, 20 bp, Artificial Sequence
  chemically synthesized
tttaatcaaccctgggttca

SEQ ID NO: 617451 - DNA, 20 bp, Artificial Sequence
  chemically synthesized
acaaatcctaatgaacccag

SEQ ID NO: 617452 - DNA, 20 bp, Artificial Sequence
  chemically synthesized
gaaaaatcttttttctcttc

SEQ ID NO: 617453 - DNA, 20 bp, Artificial Sequence
  chemically synthesized
ttcaaatctcatgaagagaa

SEQ ID NO: 617454 - DNA, 20 bp, Artificial Sequence
  chemically synthesized
tcttactggaaagataaact

SEQ ID NO: 617455 - DNA, 20 bp, Artificial Sequence
  chemically synthesized
tgacatatattatagaaaca

SEQ ID NO: 617456 - DNA, 20 bp, Artificial Sequence
  chemically synthesized
cagtttttattaaaggcagt

SEQ ID NO: 617457 - DNA, 20 bp, Artificial Sequence
  chemically synthesized
catcaactgcctttaataaa

SEQ ID NO: 617458 - DNA, 20 bp, Artificial Sequence
  chemically synthesized
ttagctcctttaattataaa

SEQ ID NO: 617459 - DNA, 20 bp, Artificial Sequence
  chemically synthesized
atagacacttgaatatgaaa

SEQ ID NO: 617460 - DNA, 20 bp, Artificial Sequence
  chemically synthesized
tttacttggaatggatgagc

SEQ ID NO: 617461 - DNA, 20 bp, Artificial Sequence
  chemically synthesized
gttggttgatctgtctgtgc

SEQ ID NO: 617462 - DNA, 20 bp, Artificial Sequence
  chemically synthesized
tgctaggttggttgatctgt

SEQ ID NO: 617463 - DNA, 20 bp, Artificial Sequence
  chemically synthesized
ctgttaatttaaatacctgc

SEQ ID NO: 617464 - DNA, 20 bp, Artificial Sequence
  chemically synthesized
agtttttattatatctgcac

SEQ ID NO: 617465 - DNA, 20 bp, Artificial Sequence
  chemically synthesized
tttatattataaatattctt

SEQ ID NO: 617466 - DNA, 20 bp, Artificial Sequence
  chemically synthesized
ccaagaatatttataatata

SEQ ID NO: 617467 - DNA, 20 bp, Artificial Sequence
  chemically synthesized
gagaaagaatatttttaaaa

SEQ ID NO: 617468 - DNA, 20 bp, Artificial Sequence
  chemically synthesized
gcattattaccagcatttgt

SEQ ID NO: 617469 - DNA, 20 bp, Artificial Sequence
  chemically synthesized
tgactaccttcagagttatc

SEQ ID NO: 617470 - DNA, 20 bp, Artificial Sequence
  chemically synthesized
aggtagtcagaagaagacga

SEQ ID NO: 617471 - DNA, 20 bp, Artificial Sequence
  chemically synthesized
tcagaagaagacgacggagt

SEQ ID NO: 617472 - DNA, 20 bp, Artificial Sequence
  chemically synthesized
cgaaatggtgagtctgggtc

SEQ ID NO: 617473 - DNA, 20 bp, Artificial Sequence
  chemically synthesized
agcagtcgaaagcagcctag

SEQ ID NO: 617474 - DNA, 20 bp, Artificial Sequence
  chemically synthesized
tggagagataagcctttcta

SEQ ID NO: 617475 - DNA, 20 bp, Artificial Sequence
  chemically synthesized
ggcttatctctccacatcta

SEQ ID NO: 617476 - DNA, 20 bp, Artificial Sequence
  chemically synthesized
ccccttactgttggcaattc

SEQ ID NO: 617477 - DNA, 20 bp, Artificial Sequence
  chemically synthesized
gcaggcccaccaggaacaga

SEQ ID NO: 617478 - DNA, 20 bp, Artificial Sequence
  chemically synthesized
acactctctgttcctggtgg

SEQ ID NO: 617479 - DNA, 20 bp, Artificial Sequence
  chemically synthesized
gatgttccatccccaaatat

SEQ ID NO: 617480 - DNA, 20 bp, Artificial Sequence
  chemically synthesized
gttggaaactttggagaaat

SEQ ID NO: 617481 - DNA, 20 bp, Artificial Sequence
  chemically synthesized
ttctgaaactacaatttctc

SEQ ID NO: 617482 - DNA, 20 bp, Artificial Sequence
  chemically synthesized
ttcctacatgcagcaaacca

SEQ ID NO: 617483 - DNA, 20 bp, Artificial Sequence
  chemically synthesized
gcccctcccagaggaatctt

SEQ ID NO: 617484 - DNA, 20 bp, Artificial Sequence
  chemically synthesized
attaccagagacttagaatt

SEQ ID NO: 617485 - DNA, 20 bp, Artificial Sequence
  chemically synthesized
tgaagtaacccttatctttc

SEQ ID NO: 617486 - DNA, 20 bp, Artificial Sequence
  chemically synthesized
gagaaaatttactgtcccta

SEQ ID NO: 617487 - DNA, 20 bp, Artificial Sequence
  chemically synthesized
ccagattctctttatcctgt

SEQ ID NO: 617488 - DNA, 20 bp, Artificial Sequence
  chemically synthesized
atcattcatcattaaaagca

SEQ ID NO: 617489 - DNA, 20 bp, Artificial Sequence
  chemically synthesized
ctgaagaagtagtcaaagca

SEQ ID NO: 617490 - DNA, 20 bp, Artificial Sequence
  chemically synthesized
atcttgctttgactacttct

SEQ ID NO: 617491 - DNA, 20 bp, Artificial Sequence
  chemically synthesized
atacaatttgtattcttttc

SEQ ID NO: 617492 - DNA, 20 bp, Artificial Sequence
  chemically synthesized
ttcttttgttttctgcctga

SEQ ID NO: 617493 - DNA, 20 bp, Artificial Sequence
  chemically synthesized
tgttttctgcctgatgtcga

SEQ ID NO: 617494 - DNA, 20 bp, Artificial Sequence
  chemically synthesized
gagcctactaagaactaaaa

SEQ ID NO: 617495 - DNA, 20 bp, Artificial Sequence
  chemically synthesized
tgtgtgtgtatttagttctg

SEQ ID NO: 617496 - DNA, 20 bp, Artificial Sequence
  chemically synthesized
actacaattcagcaatttta

SEQ ID NO: 617497 - DNA, 20 bp, Artificial Sequence
  chemically synthesized
ttctggctgtgatattatat

SEQ ID NO: 617498 - DNA, 20 bp, Artificial Sequence
  chemically synthesized
tcaatttttttaaaagtcaa

SEQ ID NO: 617499 - DNA, 20 bp, Artificial Sequence
  chemically synthesized
tcaattttgatttttttatt

SEQ ID NO: 617500 - DNA, 20 bp, Artificial Sequence
  chemically synthesized
tttgatttttttattttctg

SEQ ID NO: 617501 - DNA, 20 bp, Artificial Sequence
  chemically synthesized
tggatttcactagatgttct

SEQ ID NO: 617502 - DNA, 20 bp, Artificial Sequence
  chemically synthesized
taattgagaatcatcttgct

SEQ ID NO: 617503 - DNA, 20 bp, Artificial Sequence
  chemically synthesized
ctctgagtaaacacagagca

SEQ ID NO: 617504 - DNA, 20 bp, Artificial Sequence
  chemically synthesized
aaaaataagattgctgaaag

SEQ ID NO: 617505 - DNA, 20 bp, Artificial Sequence
  chemically synthesized
tcatgtagcattttttaaaa

SEQ ID NO: 617506 - DNA, 20 bp, Artificial Sequence
  chemically synthesized
acttatcttcaaagcgtctt

SEQ ID NO: 617507 - DNA, 20 bp, Artificial Sequence
  chemically synthesized
gacatagctttaaacagaaa

SEQ ID NO: 617508 - DNA, 20 bp, Artificial Sequence
  chemically synthesized
ctgtttaaagctatgtcctt

SEQ ID NO: 617509 - DNA, 20 bp, Artificial Sequence
  chemically synthesized
ttaaaaaaaacggtaaagga

SEQ ID NO: 617510 - DNA, 20 bp, Artificial Sequence
  chemically synthesized
gctggcagggaaggaatgct

SEQ ID NO: 617511 - DNA, 20 bp, Artificial Sequence
  chemically synthesized
ttctttagctggcagggaag

SEQ ID NO: 617512 - DNA, 20 bp, Artificial Sequence
  chemically synthesized
acacccatttaaaattggta

SEQ ID NO: 617513 - DNA, 20 bp, Artificial Sequence
  chemically synthesized
atttatttacttatttgaga

SEQ ID NO: 617514 - DNA, 20 bp, Artificial Sequence
  chemically synthesized
aacttccgcctcccaggttc

SEQ ID NO: 617515 - DNA, 20 bp, Artificial Sequence
  chemically synthesized
ttgggaggctgaggcaggag

SEQ ID NO: 617516 - DNA, 20 bp, Artificial Sequence
  chemically synthesized
tgcctcagcctcccaagtag

SEQ ID NO: 617517 - DNA, 20 bp, Artificial Sequence
  chemically synthesized
ttttgtatttttagtagaga

SEQ ID NO: 617518 - DNA, 20 bp, Artificial Sequence
  chemically synthesized
cgggtggatcacctgaggtc

SEQ ID NO: 617519 - DNA, 20 bp, Artificial Sequence
  chemically synthesized
ctcttgacctcaggtgatcc

SEQ ID NO: 617520 - DNA, 20 bp, Artificial Sequence
  chemically synthesized
cgctttggccgcccaaagtg

SEQ ID NO: 617521 - DNA, 20 bp, Artificial Sequence
  chemically synthesized
ccaccgtgcccggcccacct

SEQ ID NO: 617522 - DNA, 20 bp, Artificial Sequence
  chemically synthesized
tatatgcttggctctgaaat

SEQ ID NO: 617523 - DNA, 20 bp, Artificial Sequence
  chemically synthesized
tatttatggaagtgcttact

SEQ ID NO: 617524 - DNA, 20 bp, Artificial Sequence
  chemically synthesized
ataataattaatatttatgg

SEQ ID NO: 617525 - DNA, 20 bp, Artificial Sequence
  chemically synthesized
tattattactcatggaacat

SEQ ID NO: 617526 - DNA, 20 bp, Artificial Sequence
  chemically synthesized
cgagaagcagctctgaacaa

SEQ ID NO: 617527 - DNA, 20 bp, Artificial Sequence
  chemically synthesized
tttaaatctactttgttcag

SEQ ID NO: 617528 - DNA, 20 bp, Artificial Sequence
  chemically synthesized
ctcgctggaaaccttttaag

SEQ ID NO: 617529 - DNA, 20 bp, Artificial Sequence
  chemically synthesized
ggtgatacaaacactactta

SEQ ID NO: 617530 - DNA, 20 bp, Artificial Sequence
  chemically synthesized
ctcctagcacttacatagtg

SEQ ID NO: 617531 - DNA, 20 bp, Artificial Sequence
  chemically synthesized
atatccttccccttccattt

SEQ ID NO: 617532 - DNA, 20 bp, Artificial Sequence
  chemically synthesized
atttactagctttttaatag

SEQ ID NO: 617533 - DNA, 20 bp, Artificial Sequence
  chemically synthesized
acttcctttattcacttatc

SEQ ID NO: 617534 - DNA, 20 bp, Artificial Sequence
  chemically synthesized
gtgataagtgaataaaggaa

SEQ ID NO: 617535 - DNA, 20 bp, Artificial Sequence
  chemically synthesized
aagtatgcttaatttcattt

SEQ ID NO: 617536 - DNA, 20 bp, Artificial Sequence
  chemically synthesized
taatttcattttcatgcttt

SEQ ID NO: 617537 - DNA, 20 bp, Artificial Sequence
  chemically synthesized
ttcttatacagatgtagagc

SEQ ID NO: 617538 - DNA, 20 bp, Artificial Sequence
  chemically synthesized
gatacattcttatacagatg

SEQ ID NO: 617539 - DNA, 20 bp, Artificial Sequence
  chemically synthesized
aaaacatcataatagtgcat

SEQ ID NO: 617540 - DNA, 20 bp, Artificial Sequence
  chemically synthesized
gaatcacatatgcactatta

SEQ ID NO: 617541 - DNA, 20 bp, Artificial Sequence
  chemically synthesized
ccaatgcaagataatatttt

SEQ ID NO: 617542 - DNA, 20 bp, Artificial Sequence
  chemically synthesized
acaatgcactctaaaactta

SEQ ID NO: 617543 - DNA, 20 bp, Artificial Sequence
  chemically synthesized
cccttgtaaatggaaacttg

SEQ ID NO: 617544 - DNA, 20 bp, Artificial Sequence
  chemically synthesized
aagtttccatttacaaggga

SEQ ID NO: 617545 - DNA, 20 bp, Artificial Sequence
  chemically synthesized
ctatagcaatttgtggtttt

SEQ ID NO: 617546 - DNA, 20 bp, Artificial Sequence
  chemically synthesized
aactcttaactatagcaatt

SEQ ID NO: 617547 - DNA, 20 bp, Artificial Sequence
  chemically synthesized
aaccacaaattgctatagtt

SEQ ID NO: 617548 - DNA, 20 bp, Artificial Sequence
  chemically synthesized
aaattgctatagttaagagt

SEQ ID NO: 617549 - DNA, 20 bp, Artificial Sequence
  chemically synthesized
aaaaaaatcatatttagaat

SEQ ID NO: 617550 - DNA, 20 bp, Artificial Sequence
  chemically synthesized
ggagtaaacttggattctaa

SEQ ID NO: 617551 - DNA, 20 bp, Artificial Sequence
  chemically synthesized
taaggttctccgggagtaaa

SEQ ID NO: 617552 - DNA, 20 bp, Artificial Sequence
  chemically synthesized
aattcctgacatcttcccaa

SEQ ID NO: 617553 - DNA, 20 bp, Artificial Sequence
  chemically synthesized
tcacaatttctattacactc

SEQ ID NO: 617554 - DNA, 20 bp, Artificial Sequence
  chemically synthesized
taataggacagcccagggag

SEQ ID NO: 617555 - DNA, 20 bp, Artificial Sequence
  chemically synthesized
gctgcatgacagcgactgcc

SEQ ID NO: 617556 - DNA, 20 bp, Artificial Sequence
  chemically synthesized
acagatgccaaaacagaaaa

SEQ ID NO: 617557 - DNA, 20 bp, Artificial Sequence
  chemically synthesized
taattggaataagctatttt

SEQ ID NO: 617558 - DNA, 20 bp, Artificial Sequence
  chemically synthesized
acatgaagtgttttaccttt

SEQ ID NO: 617559 - DNA, 20 bp, Artificial Sequence
  chemically synthesized
tgtagtcaggcccacacatg

SEQ ID NO: 617560 - DNA, 20 bp, Artificial Sequence
  chemically synthesized
atgtgtgggcctgactacag

SEQ ID NO: 617561 - DNA, 20 bp, Artificial Sequence
  chemically synthesized
gtcccccaaaggcatcgtgt

SEQ ID NO: 617562 - DNA, 20 bp, Artificial Sequence
  chemically synthesized
atactttaataatattattt

SEQ ID NO: 617563 - DNA, 20 bp, Artificial Sequence
  chemically synthesized
aataggaataatataattgc

SEQ ID NO: 617564 - DNA, 20 bp, Artificial Sequence
  chemically synthesized
aatattagtagtaaaataat

SEQ ID NO: 617565 - DNA, 20 bp, Artificial Sequence
  chemically synthesized
tagatcagctttaacaatgg

SEQ ID NO: 617566 - DNA, 20 bp, Artificial Sequence
  chemically synthesized
acttctagatcagctttaac

SEQ ID NO: 617567 - DNA, 20 bp, Artificial Sequence
  chemically synthesized
gtctaataacttacttctag

SEQ ID NO: 617568 - DNA, 20 bp, Artificial Sequence
  chemically synthesized
agaagtaagttattagacat

SEQ ID NO: 617569 - DNA, 20 bp, Artificial Sequence
  chemically synthesized
atgaaattccactataatgg

SEQ ID NO: 617570 - DNA, 20 bp, Artificial Sequence
  chemically synthesized
ttaatgttttttagacctct

SEQ ID NO: 617571 - DNA, 20 bp, Artificial Sequence
  chemically synthesized
acctagaggattggttattt

SEQ ID NO: 617572 - DNA, 20 bp, Artificial Sequence
  chemically synthesized
attaaaataaccaatcctct

SEQ ID NO: 617573 - DNA, 20 bp, Artificial Sequence
  chemically synthesized
tgaaaacttaaaaagcacct

SEQ ID NO: 617574 - DNA, 20 bp, Artificial Sequence
  chemically synthesized
accaatcctctaggtgcttt

SEQ ID NO: 617575 - DNA, 20 bp, Artificial Sequence
  chemically synthesized
tccattgcaagttttagatt

SEQ ID NO: 617576 - DNA, 20 bp, Artificial Sequence
  chemically synthesized
gatatccattgcaagtttta

SEQ ID NO: 617577 - DNA, 20 bp, Artificial Sequence
  chemically synthesized
cacagatatccattgcaagt

SEQ ID NO: 617578 - DNA, 20 bp, Artificial Sequence
  chemically synthesized
atgcttcacagatatccatt

SEQ ID NO: 617579 - DNA, 20 bp, Artificial Sequence
  chemically synthesized
tactatacttttcttttgat

SEQ ID NO: 617580 - DNA, 20 bp, Artificial Sequence
  chemically synthesized
tagttcaaggaactgaatga

SEQ ID NO: 617581 - DNA, 20 bp, Artificial Sequence
  chemically synthesized
caattaaaaatacacacatg

SEQ ID NO: 617582 - DNA, 20 bp, Artificial Sequence
  chemically synthesized
tgtaaagtgtgctcatccct

SEQ ID NO: 617583 - DNA, 20 bp, Artificial Sequence
  chemically synthesized
catccctttaagtttcagtg

SEQ ID NO: 617584 - DNA, 20 bp, Artificial Sequence
  chemically synthesized
acaacctttccctttatttg

SEQ ID NO: 617585 - DNA, 20 bp, Artificial Sequence
  chemically synthesized
atttggaaagattattcggt

SEQ ID NO: 617586 - DNA, 20 bp, Artificial Sequence
  chemically synthesized
tctagaactatattgtgggt

SEQ ID NO: 617587 - DNA, 20 bp, Artificial Sequence
  chemically synthesized
tctagaaacagaatagacaa

SEQ ID NO: 617588 - DNA, 20 bp, Artificial Sequence
  chemically synthesized
atcagaagcaactttgtcta

SEQ ID NO: 617589 - DNA, 20 bp, Artificial Sequence
  chemically synthesized
cgtaaggcctcatttatgtc

SEQ ID NO: 617590 - DNA, 20 bp, Artificial Sequence
  chemically synthesized
tggaggcaccttttgatccg

SEQ ID NO: 617591 - DNA, 20 bp, Artificial Sequence
  chemically synthesized
cctccaatgcccgtgtcagc

SEQ ID NO: 617592 - DNA, 20 bp, Artificial Sequence
  chemically synthesized
tcaagcaggaatgccaagtg

SEQ ID NO: 617593 - DNA, 20 bp, Artificial Sequence
  chemically synthesized
agaagctccccacttggcat

SEQ ID NO: 617594 - DNA, 20 bp, Artificial Sequence
  chemically synthesized
cccacttggcattcctgctt

SEQ ID NO: 617595 - DNA, 20 bp, Artificial Sequence
  chemically synthesized
tggcatgtcacctaactggc

SEQ ID NO: 617596 - DNA, 20 bp, Artificial Sequence
  chemically synthesized
cctaataggccctacaccac

SEQ ID NO: 617597 - DNA, 20 bp, Artificial Sequence
  chemically synthesized
atctggctcctggattccag

SEQ ID NO: 617598 - DNA, 20 bp, Artificial Sequence
  chemically synthesized
ggtatgtgggccatctggct

SEQ ID NO: 617599 - DNA, 20 bp, Artificial Sequence
  chemically synthesized
tagcagccagacaaaacaga

SEQ ID NO: 617600 - DNA, 20 bp, Artificial Sequence
  chemically synthesized
caacagtttgctgaatctgc

SEQ ID NO: 617601 - DNA, 20 bp, Artificial Sequence
  chemically synthesized
caccaaaaatgtaactctcc

SEQ ID NO: 617602 - DNA, 20 bp, Artificial Sequence
  chemically synthesized
ctgttggagagttacatttt

SEQ ID NO: 617603 - DNA, 20 bp, Artificial Sequence
  chemically synthesized
aagtatacatagtcctattt

SEQ ID NO: 617604 - DNA, 20 bp, Artificial Sequence
  chemically synthesized
ttctcctttaattagaatgt

SEQ ID NO: 617605 - DNA, 20 bp, Artificial Sequence
  chemically synthesized
ctttccatttagcatgaaat

SEQ ID NO: 617606 - DNA, 20 bp, Artificial Sequence
  chemically synthesized
aatgaaggcttttataatca

SEQ ID NO: 617607 - DNA, 20 bp, Artificial Sequence
  chemically synthesized
caagtagcagggtagaatca

SEQ ID NO: 617608 - DNA, 20 bp, Artificial Sequence
  chemically synthesized
acaggtgaacaaaatctctt

SEQ ID NO: 617609 - DNA, 20 bp, Artificial Sequence
  chemically synthesized
tttatcctagagaagcagca

SEQ ID NO: 617610 - DNA, 20 bp, Artificial Sequence
  chemically synthesized
gtttaatgaaagaaataagt

SEQ ID NO: 617611 - DNA, 20 bp, Artificial Sequence
  chemically synthesized
ttttgttttaaataattcat

SEQ ID NO: 617612 - DNA, 20 bp, Artificial Sequence
  chemically synthesized
tcttttatacaagttatggc

SEQ ID NO: 617613 - DNA, 20 bp, Artificial Sequence
  chemically synthesized
gggcactcttttatacaagt

SEQ ID NO: 617614 - DNA, 20 bp, Artificial Sequence
  chemically synthesized
aaaaattataaaatgataaa

SEQ ID NO: 617615 - DNA, 20 bp, Artificial Sequence
  chemically synthesized
tatatgtatatatgattttc

SEQ ID NO: 617616 - DNA, 20 bp, Artificial Sequence
  chemically synthesized
atatacacatatatatgtat

SEQ ID NO: 617617 - DNA, 20 bp, Artificial Sequence
  chemically synthesized
ttcattatgagacatgctgt

SEQ ID NO: 617618 - DNA, 20 bp, Artificial Sequence
  chemically synthesized
aaaagtagaagttacttaat

SEQ ID NO: 617619 - DNA, 20 bp, Artificial Sequence
  chemically synthesized
gatatactgcttttcctatt

SEQ ID NO: 617620 - DNA, 20 bp, Artificial Sequence
  chemically synthesized
aagtgattaacgctgagata

SEQ ID NO: 617621 - DNA, 20 bp, Artificial Sequence
  chemically synthesized
catgattatttttaaggcat

SEQ ID NO: 617622 - DNA, 20 bp, Artificial Sequence
  chemically synthesized
agaaagaattttggttgcta

SEQ ID NO: 617623 - DNA, 20 bp, Artificial Sequence
  chemically synthesized
aaacacatgtgtgtggctga

SEQ ID NO: 617624 - DNA, 20 bp, Artificial Sequence
  chemically synthesized
aatctgaatcagccacacac

SEQ ID NO: 617625 - DNA, 20 bp, Artificial Sequence
  chemically synthesized
agtcagaaacacatgtgtgt

SEQ ID NO: 617626 - DNA, 20 bp, Artificial Sequence
  chemically synthesized
tgtgtttctgactttattca

SEQ ID NO: 617627 - DNA, 20 bp, Artificial Sequence
  chemically synthesized
agcttttgaagattccattt

SEQ ID NO: 617628 - DNA, 20 bp, Artificial Sequence
  chemically synthesized
agatcttgaactggagcttt

SEQ ID NO: 617629 - DNA, 20 bp, Artificial Sequence
  chemically synthesized
tttatctccagatcttgaac

SEQ ID NO: 617630 - DNA, 20 bp, Artificial Sequence
  chemically synthesized
cttattattttgtcatacac

SEQ ID NO: 617631 - DNA, 20 bp, Artificial Sequence
  chemically synthesized
cgaccgtgtatgacaaaata

SEQ ID NO: 617632 - DNA, 20 bp, Artificial Sequence
  chemically synthesized
cgtgtatgacaaaataataa

SEQ ID NO: 617633 - DNA, 20 bp, Artificial Sequence
  chemically synthesized
caaaataataagtttgcttc

SEQ ID NO: 617634 - DNA, 20 bp, Artificial Sequence
  chemically synthesized
aactataaaatgattttagg

SEQ ID NO: 617635 - DNA, 20 bp, Artificial Sequence
  chemically synthesized
atccaaactataaaatgatt

SEQ ID NO: 617636 - DNA, 20 bp, Artificial Sequence
  chemically synthesized
agctaatcctaaaatcattt

SEQ ID NO: 617637 - DNA, 20 bp, Artificial Sequence
  chemically synthesized
ctgaaactatccaaactata

SEQ ID NO: 617638 - DNA, 20 bp, Artificial Sequence
  chemically synthesized
taaaatcattttatagtttg

SEQ ID NO: 617639 - DNA, 20 bp, Artificial Sequence
  chemically synthesized
acatttgcttccctttacac

SEQ ID NO: 617640 - DNA, 20 bp, Artificial Sequence
  chemically synthesized
ttgagatatgaaagatgaac

SEQ ID NO: 617641 - DNA, 20 bp, Artificial Sequence
  chemically synthesized
tcatctttcatatctcaacc

SEQ ID NO: 617642 - DNA, 20 bp, Artificial Sequence
  chemically synthesized
ttttattacaaaaaggtaat

SEQ ID NO: 617643 - DNA, 20 bp, Artificial Sequence
  chemically synthesized
ctgattttattacaaaaagg

SEQ ID NO: 617644 - DNA, 20 bp, Artificial Sequence
  chemically synthesized
ttacctttttgtaataaaat

SEQ ID NO: 617645 - DNA, 20 bp, Artificial Sequence
  chemically synthesized
gaaatatatttctgttgaaa

SEQ ID NO: 617646 - DNA, 20 bp, Artificial Sequence
  chemically synthesized
gaaatatatttcacaatgaa

SEQ ID NO: 617647 - DNA, 20 bp, Artificial Sequence
  chemically synthesized
tatcttatgtatttttttca

SEQ ID NO: 617648 - DNA, 20 bp, Artificial Sequence
  chemically synthesized
atacataagatattataaaa

SEQ ID NO: 617649 - DNA, 20 bp, Artificial Sequence
  chemically synthesized
ttaaatttttcctaatacac

SEQ ID NO: 617650 - DNA, 20 bp, Artificial Sequence
  chemically synthesized
tagtaccctaccctggtata

SEQ ID NO: 617651 - DNA, 20 bp, Artificial Sequence
  chemically synthesized
tataccagggtagggtacta

SEQ ID NO: 617652 - DNA, 20 bp, Artificial Sequence
  chemically synthesized
gtactataaagttttatttc

SEQ ID NO: 617653 - DNA, 20 bp, Artificial Sequence
  chemically synthesized
tacagagtcacaagtgagtt

SEQ ID NO: 617654 - DNA, 20 bp, Artificial Sequence
  chemically synthesized
catgagctacagagtcacaa

SEQ ID NO: 617655 - DNA, 20 bp, Artificial Sequence
  chemically synthesized
tgccataaagttttatcacc

SEQ ID NO: 617656 - DNA, 20 bp, Artificial Sequence
  chemically synthesized
tgttctgaactagagtgcca

SEQ ID NO: 617657 - DNA, 20 bp, Artificial Sequence
  chemically synthesized
attttgatttttactttttt

SEQ ID NO: 617658 - DNA, 20 bp, Artificial Sequence
  chemically synthesized
cagtgttttgtcacatttca

SEQ ID NO: 617659 - DNA, 20 bp, Artificial Sequence
  chemically synthesized
gtcagatgagaagggttttg

SEQ ID NO: 617660 - DNA, 20 bp, Artificial Sequence
  chemically synthesized
gaatagtggtgtcagatgag

SEQ ID NO: 617661 - DNA, 20 bp, Artificial Sequence
  chemically synthesized
ttctcatctgacaccactat

SEQ ID NO: 617662 - DNA, 20 bp, Artificial Sequence
  chemically synthesized
aatttcaaaatgaaattgac

SEQ ID NO: 617663 - DNA, 20 bp, Artificial Sequence
  chemically synthesized
tgtagcaacttaaatgactg

SEQ ID NO: 617664 - DNA, 20 bp, Artificial Sequence
  chemically synthesized
gcatcaaagtaagtgtagaa

SEQ ID NO: 617665 - DNA, 20 bp, Artificial Sequence
  chemically synthesized
aaagtaagtgtagaaaaatg

SEQ ID NO: 617666 - DNA, 20 bp, Artificial Sequence
  chemically synthesized
ttggaatttaactgcaggaa

SEQ ID NO: 617667 - DNA, 20 bp, Artificial Sequence
  chemically synthesized
ttcgtgtgaaggtcaaatat

SEQ ID NO: 617668 - DNA, 20 bp, Artificial Sequence
  chemically synthesized
aaaaatagtttttaaaagag

SEQ ID NO: 617669 - DNA, 20 bp, Artificial Sequence
  chemically synthesized
aaattaatatattccataaa

SEQ ID NO: 617670 - DNA, 20 bp, Artificial Sequence
  chemically synthesized
taaatagagtccaatttgac

SEQ ID NO: 617671 - DNA, 20 bp, Artificial Sequence
  chemically synthesized
cttgcaaaactttggtgtta

SEQ ID NO: 617672 - DNA, 20 bp, Artificial Sequence
  chemically synthesized
agtgacaatcagaataacac

SEQ ID NO: 617673 - DNA, 20 bp, Artificial Sequence
  chemically synthesized
aactattaataataggatta

SEQ ID NO: 617674 - DNA, 20 bp, Artificial Sequence
  chemically synthesized
aaattagacaactattaata

SEQ ID NO: 617675 - DNA, 20 bp, Artificial Sequence
  chemically synthesized
actattctgttccttagcct

SEQ ID NO: 617676 - DNA, 20 bp, Artificial Sequence
  chemically synthesized
atgaaaatgagaaaacctgt

SEQ ID NO: 617677 - DNA, 20 bp, Artificial Sequence
  chemically synthesized
caaacatatattaatcaatg

SEQ ID NO: 617678 - DNA, 20 bp, Artificial Sequence
  chemically synthesized
aaaacctgtcattgattaat

SEQ ID NO: 617679 - DNA, 20 bp, Artificial Sequence
  chemically synthesized
cctgtcattgattaatatat

SEQ ID NO: 617680 - DNA, 20 bp, Artificial Sequence
  chemically synthesized
ctgcacatagaaatgtaact

SEQ ID NO: 617681 - DNA, 20 bp, Artificial Sequence
  chemically synthesized
gtgattttcacttggcattt

SEQ ID NO: 617682 - DNA, 20 bp, Artificial Sequence
  chemically synthesized
aagtgaaaatcaccactctt

SEQ ID NO: 617683 - DNA, 20 bp, Artificial Sequence
  chemically synthesized
ctgaaataaactcttaagag

SEQ ID NO: 617684 - DNA, 20 bp, Artificial Sequence
  chemically synthesized
ttatttcagagtgttgacta

SEQ ID NO: 617685 - DNA, 20 bp, Artificial Sequence
  chemically synthesized
tttgcctataacataaactt

SEQ ID NO: 617686 - DNA, 20 bp, Artificial Sequence
  chemically synthesized
aacaagtacctcaaaaactc

SEQ ID NO: 617687 - DNA, 20 bp, Artificial Sequence
  chemically synthesized
aacttaagagtttttgaggt

SEQ ID NO: 617688 - DNA, 20 bp, Artificial Sequence
  chemically synthesized
acacttataattccctaagt

SEQ ID NO: 617689 - DNA, 20 bp, Artificial Sequence
  chemically synthesized
tataagtgtcttcttagaga

SEQ ID NO: 617690 - DNA, 20 bp, Artificial Sequence
  chemically synthesized
acagttgaccaactctttta

SEQ ID NO: 617691 - DNA, 20 bp, Artificial Sequence
  chemically synthesized
cctattattatttcaggaga

SEQ ID NO: 617692 - DNA, 20 bp, Artificial Sequence
  chemically synthesized
gtcttcttctcttagaaatg

SEQ ID NO: 617693 - DNA, 20 bp, Artificial Sequence
  chemically synthesized
agtcattgataaaatcatat

SEQ ID NO: 617694 - DNA, 20 bp, Artificial Sequence
  chemically synthesized
gaatcctggattaatctaga

SEQ ID NO: 617695 - DNA, 20 bp, Artificial Sequence
  chemically synthesized
aaatcatattctagattaat

SEQ ID NO: 617696 - DNA, 20 bp, Artificial Sequence
  chemically synthesized
gtagaaataattgaatgaat

SEQ ID NO: 617697 - DNA, 20 bp, Artificial Sequence
  chemically synthesized
cactccctctcttgaaggga

SEQ ID NO: 617698 - DNA, 20 bp, Artificial Sequence
  chemically synthesized
tcttaaatggcccttattat

SEQ ID NO: 617699 - DNA, 20 bp, Artificial Sequence
  chemically synthesized
ccatttaagagaagttattg

SEQ ID NO: 617700 - DNA, 20 bp, Artificial Sequence
  chemically synthesized
tattgagttgctttagaact

SEQ ID NO: 617701 - DNA, 20 bp, Artificial Sequence
  chemically synthesized
ttcatgttaaattaaggttt

SEQ ID NO: 617702 - DNA, 20 bp, Artificial Sequence
  chemically synthesized
tgaaccatttcatgttaaat

SEQ ID NO: 617703 - DNA, 20 bp, Artificial Sequence
  chemically synthesized
gctttacatggatctaagtg

SEQ ID NO: 617704 - DNA, 20 bp, Artificial Sequence
  chemically synthesized
ggtgagaggggtgtagtaag

SEQ ID NO: 617705 - DNA, 20 bp, Artificial Sequence
  chemically synthesized
tactacacccctctcacctg

SEQ ID NO: 617706 - DNA, 20 bp, Artificial Sequence
  chemically synthesized
aggcattcatctagtgctgc

SEQ ID NO: 617707 - DNA, 20 bp, Artificial Sequence
  chemically synthesized
ccttgtgtgaatactttttg

SEQ ID NO: 617708 - DNA, 20 bp, Artificial Sequence
  chemically synthesized
cgtaccaaaaagtattcaca

SEQ ID NO: 617709 - DNA, 20 bp, Artificial Sequence
  chemically synthesized
gggtttcaagaacaggcaca

SEQ ID NO: 617710 - DNA, 20 bp, Artificial Sequence
  chemically synthesized
cttctgttaccattactgct

SEQ ID NO: 617711 - DNA, 20 bp, Artificial Sequence
  chemically synthesized
aagaataacaagaatacata

SEQ ID NO: 617712 - DNA, 20 bp, Artificial Sequence
  chemically synthesized
acatatcttgattccatata

SEQ ID NO: 617713 - DNA, 20 bp, Artificial Sequence
  chemically synthesized
aatcccaaccttttctagga

SEQ ID NO: 617714 - DNA, 20 bp, Artificial Sequence
  chemically synthesized
aagctttatcctagaaaagg

SEQ ID NO: 617715 - DNA, 20 bp, Artificial Sequence
  chemically synthesized
aatggtcccaaattaaggtt

SEQ ID NO: 617716 - DNA, 20 bp, Artificial Sequence
  chemically synthesized
taatttgggaccattctgga

SEQ ID NO: 617717 - DNA, 20 bp, Artificial Sequence
  chemically synthesized
gtactgcatttgtatacttt

SEQ ID NO: 617718 - DNA, 20 bp, Artificial Sequence
  chemically synthesized
tataaaagtatacaaatgca

SEQ ID NO: 617719 - DNA, 20 bp, Artificial Sequence
  chemically synthesized
acaaatgcagtacgttttat

SEQ ID NO: 617720 - DNA, 20 bp, Artificial Sequence
  chemically synthesized
aattatatatattatctaaa

SEQ ID NO: 617721 - DNA, 20 bp, Artificial Sequence
  chemically synthesized
ttcaggttatttctaaggta

SEQ ID NO: 617722 - DNA, 20 bp, Artificial Sequence
  chemically synthesized
ctttgatttttgttaaataa

SEQ ID NO: 617723 - DNA, 20 bp, Artificial Sequence
  chemically synthesized
taaataattcagtttaaatt

SEQ ID NO: 617724 - DNA, 20 bp, Artificial Sequence
  chemically synthesized
gtttttatgtagaaaaaaat

SEQ ID NO: 617725 - DNA, 20 bp, Artificial Sequence
  chemically synthesized
tatgtagaaaaaaatcaagg

SEQ ID NO: 617726 - DNA, 20 bp, Artificial Sequence
  chemically synthesized
gaatataagagaaatcaaat

SEQ ID NO: 617727 - DNA, 20 bp, Artificial Sequence
  chemically synthesized
tctcttatattcaaaagtgc

SEQ ID NO: 617728 - DNA, 20 bp, Artificial Sequence
  chemically synthesized
ttcatctcaatgtagaaaga

SEQ ID NO: 617729 - DNA, 20 bp, Artificial Sequence
  chemically synthesized
atttgcaattatttagcgtg

SEQ ID NO: 617730 - DNA, 20 bp, Artificial Sequence
  chemically synthesized
atacacgctaaataattgca

SEQ ID NO: 617731 - DNA, 20 bp, Artificial Sequence
  chemically synthesized
tgcaaatagcttttaaaggc

SEQ ID NO: 617732 - DNA, 20 bp, Artificial Sequence
  chemically synthesized
caaaaattctaatggacaat

SEQ ID NO: 617733 - DNA, 20 bp, Artificial Sequence
  chemically synthesized
tagtgcatgtatagaacatt

SEQ ID NO: 617734 - DNA, 20 bp, Artificial Sequence
  chemically synthesized
tttgaagtgctcagtagtca

SEQ ID NO: 617735 - DNA, 20 bp, Artificial Sequence
  chemically synthesized
ctagcaaaatggaggaacaa

SEQ ID NO: 617736 - DNA, 20 bp, Artificial Sequence
  chemically synthesized
aagatggcatccatttatct

SEQ ID NO: 617737 - DNA, 20 bp, Artificial Sequence
  chemically synthesized
ctatctaaaagccaacatac

SEQ ID NO: 617738 - DNA, 20 bp, Artificial Sequence
  chemically synthesized
aagtcataaaacatttgtat

SEQ ID NO: 617739 - DNA, 20 bp, Artificial Sequence
  chemically synthesized
tttatgacttaaaaaaatgc

SEQ ID NO: 617740 - DNA, 20 bp, Artificial Sequence
  chemically synthesized
cttaaaaaaatgccacagat

SEQ ID NO: 617741 - DNA, 20 bp, Artificial Sequence
  chemically synthesized
tttagccatttctgcaagac

SEQ ID NO: 617742 - DNA, 20 bp, Artificial Sequence
  chemically synthesized
aggattaagttatttttcta

SEQ ID NO: 617743 - DNA, 20 bp, Artificial Sequence
  chemically synthesized
actagaaaaataacttaatc

SEQ ID NO: 617744 - DNA, 20 bp, Artificial Sequence
  chemically synthesized
gtgaaatggcatattaaaac

SEQ ID NO: 617745 - DNA, 20 bp, Artificial Sequence
  chemically synthesized
tctgttttaatatgccattt

SEQ ID NO: 617746 - DNA, 20 bp, Artificial Sequence
  chemically synthesized
tatgccatttcacagcttgc

SEQ ID NO: 617747 - DNA, 20 bp, Artificial Sequence
  chemically synthesized
ttctggcataatagttttgc

SEQ ID NO: 617748 - DNA, 20 bp, Artificial Sequence
  chemically synthesized
tgtaaatcatgttctggcat

SEQ ID NO: 617749 - DNA, 20 bp, Artificial Sequence
  chemically synthesized
ggcaaaactattatgccaga

SEQ ID NO: 617750 - DNA, 20 bp, Artificial Sequence
  chemically synthesized
gtcattcatttaaaattcag

SEQ ID NO: 617751 - DNA, 20 bp, Artificial Sequence
  chemically synthesized
acaatttggagaaaacaatc

SEQ ID NO: 617752 - DNA, 20 bp, Artificial Sequence
  chemically synthesized
agaatgattcaaaagctttt

SEQ ID NO: 617753 - DNA, 20 bp, Artificial Sequence
  chemically synthesized
aattagaatgattcaaaagc

SEQ ID NO: 617754 - DNA, 20 bp, Artificial Sequence
  chemically synthesized
ctcaccaattagaatgattc

SEQ ID NO: 617755 - DNA, 20 bp, Artificial Sequence
  chemically synthesized
gaataagccctcaccaatta

SEQ ID NO: 617756 - DNA, 20 bp, Artificial Sequence
  chemically synthesized
tttgaatcattctaattggt

SEQ ID NO: 617757 - DNA, 20 bp, Artificial Sequence
  chemically synthesized
ctgtgatctgacagaaaact

SEQ ID NO: 617758 - DNA, 20 bp, Artificial Sequence
  chemically synthesized
gattacaaatacttaaaaca

SEQ ID NO: 617759 - DNA, 20 bp, Artificial Sequence
  chemically synthesized
attcatttgcatcactgctg

SEQ ID NO: 617760 - DNA, 20 bp, Artificial Sequence
  chemically synthesized
attaaattcatttgcatcac

SEQ ID NO: 617761 - DNA, 20 bp, Artificial Sequence
  chemically synthesized
tgatgcaaatgaatttaatt

SEQ ID NO: 617762 - DNA, 20 bp, Artificial Sequence
  chemically synthesized
tgttgtcttacttcccattg

SEQ ID NO: 617763 - DNA, 20 bp, Artificial Sequence
  chemically synthesized
cagcgtgttgtcttacttcc

SEQ ID NO: 617764 - DNA, 20 bp, Artificial Sequence
  chemically synthesized
actagcacttcttttattac

SEQ ID NO: 617765 - DNA, 20 bp, Artificial Sequence
  chemically synthesized
atgtacctggaaatgagtgg

SEQ ID NO: 617766 - DNA, 20 bp, Artificial Sequence
  chemically synthesized
cctggaaatgagtggcccag

SEQ ID NO: 617767 - DNA, 20 bp, Artificial Sequence
  chemically synthesized
tacatgcctaattttaatca

SEQ ID NO: 617768 - DNA, 20 bp, Artificial Sequence
  chemically synthesized
ggaagttgattatacaatca

SEQ ID NO: 617769 - DNA, 20 bp, Artificial Sequence
  chemically synthesized
ctttagaaatgactggggga

SEQ ID NO: 617770 - DNA, 20 bp, Artificial Sequence
  chemically synthesized
ttctaaagataaattaagat

SEQ ID NO: 617771 - DNA, 20 bp, Artificial Sequence
  chemically synthesized
ctttcattaagaataaaaca

SEQ ID NO: 617772 - DNA, 20 bp, Artificial Sequence
  chemically synthesized
ttagaaatatgaagaaatca

SEQ ID NO: 617773 - DNA, 20 bp, Artificial Sequence
  chemically synthesized
ttctaaataacttgcctttt

SEQ ID NO: 617774 - DNA, 20 bp, Artificial Sequence
  chemically synthesized
aaattaaaataaatataatt

SEQ ID NO: 617775 - DNA, 20 bp, Artificial Sequence
  chemically synthesized
cccatcggcctcccaaaata

SEQ ID NO: 617776 - DNA, 20 bp, Artificial Sequence
  chemically synthesized
tttttgtattttagtagaga

SEQ ID NO: 617777 - DNA, 20 bp, Artificial Sequence
  chemically synthesized
ttcctcagcctcccaagtag

SEQ ID NO: 617778 - DNA, 20 bp, Artificial Sequence
  chemically synthesized
ttgggaggctgaggaaggac

SEQ ID NO: 617779 - DNA, 20 bp, Artificial Sequence
  chemically synthesized
aacctctgcctcctgggttc

SEQ ID NO: 617780 - DNA, 20 bp, Artificial Sequence
  chemically synthesized
tttttttttttgagacagag

SEQ ID NO: 617781 - DNA, 20 bp, Artificial Sequence
  chemically synthesized
ttttttttttttttttgaga

SEQ ID NO: 617782 - DNA, 20 bp, Artificial Sequence
  chemically synthesized
ctcaaattcaatataaaata

SEQ ID NO: 617783 - DNA, 20 bp, Artificial Sequence
  chemically synthesized
gtctaatattcagtaaaata

SEQ ID NO: 617784 - DNA, 20 bp, Artificial Sequence
  chemically synthesized
ttagaccaacgcattgtagt

SEQ ID NO: 617785 - DNA, 20 bp, Artificial Sequence
  chemically synthesized
agaatagttgggaactaaat

SEQ ID NO: 617786 - DNA, 20 bp, Artificial Sequence
  chemically synthesized
tcccatttagttcccaacta

SEQ ID NO: 617787 - DNA, 20 bp, Artificial Sequence
  chemically synthesized
aaaactgtaggctttttcct

SEQ ID NO: 617788 - DNA, 20 bp, Artificial Sequence
  chemically synthesized
aaaaccaagaggaaaaagcc

SEQ ID NO: 617789 - DNA, 20 bp, Artificial Sequence
  chemically synthesized
ggttttttggtttaaaaact

SEQ ID NO: 617790 - DNA, 20 bp, Artificial Sequence
  chemically synthesized
cgggttctaaagttaggttt

SEQ ID NO: 617791 - DNA, 20 bp, Artificial Sequence
  chemically synthesized
cacaaatccgggttctaaag

SEQ ID NO: 617792 - DNA, 20 bp, Artificial Sequence
  chemically synthesized
caaaaaacctaactttagaa

SEQ ID NO: 617793 - DNA, 20 bp, Artificial Sequence
  chemically synthesized
agaacccggatttgtgagta

SEQ ID NO: 617794 - DNA, 20 bp, Artificial Sequence
  chemically synthesized
agctcacaaatgtcttgacc

SEQ ID NO: 617795 - DNA, 20 bp, Artificial Sequence
  chemically synthesized
agacatttgtgagctgtaca

SEQ ID NO: 617796 - DNA, 20 bp, Artificial Sequence
  chemically synthesized
agcgaccgcaccagccttct

SEQ ID NO: 617797 - DNA, 20 bp, Artificial Sequence
  chemically synthesized
cgcctcagcctcccaaagtg

SEQ ID NO: 617798 - DNA, 20 bp, Artificial Sequence
  chemically synthesized
ttattgtattttagtagaga

SEQ ID NO: 617799 - DNA, 20 bp, Artificial Sequence
  chemically synthesized
ttgggaggctgtggcaggag

SEQ ID NO: 617800 - DNA, 20 bp, Artificial Sequence
  chemically synthesized
attttatttcattcttttct

SEQ ID NO: 617801 - DNA, 20 bp, Artificial Sequence
  chemically synthesized
aatgccaccttttataaaac

SEQ ID NO: 617802 - DNA, 20 bp, Artificial Sequence
  chemically synthesized
gacacatgcagaaataaaac

SEQ ID NO: 617803 - DNA, 20 bp, Artificial Sequence
  chemically synthesized
ttttatttctgcatgtgtct

SEQ ID NO: 617804 - DNA, 20 bp, Artificial Sequence
  chemically synthesized
gtgctcactttttctcttaa

SEQ ID NO: 617805 - DNA, 20 bp, Artificial Sequence
  chemically synthesized
gaacaatgtaggggagaaaa

SEQ ID NO: 617806 - DNA, 20 bp, Artificial Sequence
  chemically synthesized
aatttatattaaatacattt

SEQ ID NO: 617807 - DNA, 20 bp, Artificial Sequence
  chemically synthesized
gagtggacaacctggcagaa

SEQ ID NO: 617808 - DNA, 20 bp, Artificial Sequence
  chemically synthesized
cccaccccaactttattacc

SEQ ID NO: 617809 - DNA, 20 bp, Artificial Sequence
  chemically synthesized
gtgggggggaatgtagcaaa

SEQ ID NO: 617810 - DNA, 20 bp, Artificial Sequence
  chemically synthesized
acacagagaagactgaacaa

SEQ ID NO: 617811 - DNA, 20 bp, Artificial Sequence
  chemically synthesized
ggccagataattcttttctg

SEQ ID NO: 617812 - DNA, 20 bp, Artificial Sequence
  chemically synthesized
gtcagagactttctcacttc

SEQ ID NO: 617813 - DNA, 20 bp, Artificial Sequence
  chemically synthesized
cttttttatatttgttgtta

SEQ ID NO: 617814 - DNA, 20 bp, Artificial Sequence
  chemically synthesized
tttttttttttttttaaatt

SEQ ID NO: 617815 - DNA, 20 bp, Artificial Sequence
  chemically synthesized
caatttaaaaaaaaaaaaaa

SEQ ID NO: 617816 - DNA, 20 bp, Artificial Sequence
  chemically synthesized
ttaaaaaaaaaaaaaaaata

SEQ ID NO: 617817 - DNA, 20 bp, Artificial Sequence
  chemically synthesized
ttttcaagattcccaagttc

SEQ ID NO: 617818 - DNA, 20 bp, Artificial Sequence
  chemically synthesized
caggattctttttaatattt

SEQ ID NO: 617819 - DNA, 20 bp, Artificial Sequence
  chemically synthesized
cttgaaaatattaaaaagaa

SEQ ID NO: 617820 - DNA, 20 bp, Artificial Sequence
  chemically synthesized
aaaaagaatcctgattcttt

SEQ ID NO: 617821 - DNA, 20 bp, Artificial Sequence
  chemically synthesized
aaggctaaacggagaaagaa

SEQ ID NO: 617822 - DNA, 20 bp, Artificial Sequence
  chemically synthesized
gaacaagttatttaactatt

SEQ ID NO: 617823 - DNA, 20 bp, Artificial Sequence
  chemically synthesized
taataatgtctatctcagta

SEQ ID NO: 617824 - DNA, 20 bp, Artificial Sequence
  chemically synthesized
tatatatccaaaggtatttt

SEQ ID NO: 617825 - DNA, 20 bp, Artificial Sequence
  chemically synthesized
atcatatggtaattccattt

SEQ ID NO: 617826 - DNA, 20 bp, Artificial Sequence
  chemically synthesized
ggtcattttggaaaataata

SEQ ID NO: 617827 - DNA, 20 bp, Artificial Sequence
  chemically synthesized
atatctatcacctcactaac

SEQ ID NO: 617828 - DNA, 20 bp, Artificial Sequence
  chemically synthesized
gtgaggtgatagatatgtta

SEQ ID NO: 617829 - DNA, 20 bp, Artificial Sequence
  chemically synthesized
ggtgatagatatgttaatta

SEQ ID NO: 617830 - DNA, 20 bp, Artificial Sequence
  chemically synthesized
atatgttaattagcttgatt

SEQ ID NO: 617831 - DNA, 20 bp, Artificial Sequence
  chemically synthesized
gaatgtttctgtaatatatt

SEQ ID NO: 617832 - DNA, 20 bp, Artificial Sequence
  chemically synthesized
ctccatagctcaggtgatct

SEQ ID NO: 617833 - DNA, 20 bp, Artificial Sequence
  chemically synthesized
cttgggggttcaggtaggag

SEQ ID NO: 617834 - DNA, 20 bp, Artificial Sequence
  chemically synthesized
atttatttatcttgttttgg

SEQ ID NO: 617835 - DNA, 20 bp, Artificial Sequence
  chemically synthesized
attgcatttatttatcttgt

SEQ ID NO: 617836 - DNA, 20 bp, Artificial Sequence
  chemically synthesized
tctttaattgcatttattta

SEQ ID NO: 617837 - DNA, 20 bp, Artificial Sequence
  chemically synthesized
ctcatgcaaatccattataa

SEQ ID NO: 617838 - DNA, 20 bp, Artificial Sequence
  chemically synthesized
taagtgtcaagcattgttat

SEQ ID NO: 617839 - DNA, 20 bp, Artificial Sequence
  chemically synthesized
ctatgactttttagttactt

SEQ ID NO: 617840 - DNA, 20 bp, Artificial Sequence
  chemically synthesized
gttacttttaggtttaatgt

SEQ ID NO: 617841 - DNA, 20 bp, Artificial Sequence
  chemically synthesized
tctatgtacattatttaaaa

SEQ ID NO: 617842 - DNA, 20 bp, Artificial Sequence
  chemically synthesized
acataactaggaattttaga

SEQ ID NO: 617843 - DNA, 20 bp, Artificial Sequence
  chemically synthesized
tttatctaaaattcctagtt

SEQ ID NO: 617844 - DNA, 20 bp, Artificial Sequence
  chemically synthesized
atatgagaaaaatggacaat

SEQ ID NO: 617845 - DNA, 20 bp, Artificial Sequence
  chemically synthesized
actgtcaggacttggctctg

SEQ ID NO: 617846 - DNA, 20 bp, Artificial Sequence
  chemically synthesized
cccaatgccaagaacactca

SEQ ID NO: 617847 - DNA, 20 bp, Artificial Sequence
  chemically synthesized
tcatacttacaatactaact

SEQ ID NO: 617848 - DNA, 20 bp, Artificial Sequence
  chemically synthesized
gcaagaagttagtattgtaa

SEQ ID NO: 617849 - DNA, 20 bp, Artificial Sequence
  chemically synthesized
atatgcaggctgttcctcag

SEQ ID NO: 617850 - DNA, 20 bp, Artificial Sequence
  chemically synthesized
tgtatggtagttacaacatt

SEQ ID NO: 617851 - DNA, 20 bp, Artificial Sequence
  chemically synthesized
cgtaatattttccaagtgtt

SEQ ID NO: 617852 - DNA, 20 bp, Artificial Sequence
  chemically synthesized
gggtactaaaatgctctttc

SEQ ID NO: 617853 - DNA, 20 bp, Artificial Sequence
  chemically synthesized
gcattttagtacccccagaa

SEQ ID NO: 617854 - DNA, 20 bp, Artificial Sequence
  chemically synthesized
ttaagttacactcaaaattg

SEQ ID NO: 617855 - DNA, 20 bp, Artificial Sequence
  chemically synthesized
cgagctagatagctataatt

SEQ ID NO: 617856 - DNA, 20 bp, Artificial Sequence
  chemically synthesized
tgccaattatagctatctag

SEQ ID NO: 617857 - DNA, 20 bp, Artificial Sequence
  chemically synthesized
ctagctcggatttaaattga

SEQ ID NO: 617858 - DNA, 20 bp, Artificial Sequence
  chemically synthesized
aattagattaaactgtgacc

SEQ ID NO: 617859 - DNA, 20 bp, Artificial Sequence
  chemically synthesized
aaccagaaaaatcactgggt

SEQ ID NO: 617860 - DNA, 20 bp, Artificial Sequence
  chemically synthesized
aactgtgacccagtgatttt

SEQ ID NO: 617861 - DNA, 20 bp, Artificial Sequence
  chemically synthesized
gctttaccaccattaaatat

SEQ ID NO: 617862 - DNA, 20 bp, Artificial Sequence
  chemically synthesized
cttacatttaacgtttttat

SEQ ID NO: 617863 - DNA, 20 bp, Artificial Sequence
  chemically synthesized
ttgcaattgactcttacatt

SEQ ID NO: 617864 - DNA, 20 bp, Artificial Sequence
  chemically synthesized
attttacagcggatcaagta

SEQ ID NO: 617865 - DNA, 20 bp, Artificial Sequence
  chemically synthesized
atcagtgtgggtacatcgaa

SEQ ID NO: 617866 - DNA, 20 bp, Artificial Sequence
  chemically synthesized
aaccttgttcgatgtaccca

SEQ ID NO: 617867 - DNA, 20 bp, Artificial Sequence
  chemically synthesized
tcgtcaaaatgatactttgt

SEQ ID NO: 617868 - DNA, 20 bp, Artificial Sequence
  chemically synthesized
gcaaagacaaagtatcattt

SEQ ID NO: 617869 - DNA, 20 bp, Artificial Sequence
  chemically synthesized
attttgtggcaccatctaag

SEQ ID NO: 617870 - DNA, 20 bp, Artificial Sequence
  chemically synthesized
tgtaaatatttaccatccac

SEQ ID NO: 617871 - DNA, 20 bp, Artificial Sequence
  chemically synthesized
tacacattgtaatattttaa

SEQ ID NO: 617872 - DNA, 20 bp, Artificial Sequence
  chemically synthesized
atattttaagaaagttttag

SEQ ID NO: 617873 - DNA, 20 bp, Artificial Sequence
  chemically synthesized
gaagaaggatattaaagtac

SEQ ID NO: 617874 - DNA, 20 bp, Artificial Sequence
  chemically synthesized
tcacaaaatatgtcaagaaa

SEQ ID NO: 617875 - DNA, 20 bp, Artificial Sequence
  chemically synthesized
tgagccaccgcggccatcaa

SEQ ID NO: 617876 - DNA, 20 bp, Artificial Sequence
  chemically synthesized
cgcctctgcctcccaaagtg

SEQ ID NO: 617877 - DNA, 20 bp, Artificial Sequence
  chemically synthesized
gctaattttttatttttggt

SEQ ID NO: 617878 - DNA, 20 bp, Artificial Sequence
  chemically synthesized
ctgggaggccgaggcaggag

SEQ ID NO: 617879 - DNA, 20 bp, Artificial Sequence
  chemically synthesized
aaccttcacctccagggttc

SEQ ID NO: 617880 - DNA, 20 bp, Artificial Sequence
  chemically synthesized
caccttgggcgacagagcaa

SEQ ID NO: 617881 - DNA, 20 bp, Artificial Sequence
  chemically synthesized
tgtttcaaaaaaaaaaaaaa

SEQ ID NO: 617882 - DNA, 20 bp, Artificial Sequence
  chemically synthesized
aatccagcaataaaatgcaa

SEQ ID NO: 617883 - DNA, 20 bp, Artificial Sequence
  chemically synthesized
aaactagcttgcattttatt

SEQ ID NO: 617884 - DNA, 20 bp, Artificial Sequence
  chemically synthesized
cttgaaaatatgttattaga

SEQ ID NO: 617885 - DNA, 20 bp, Artificial Sequence
  chemically synthesized
tttcaaggttagccattgtc

SEQ ID NO: 617886 - DNA, 20 bp, Artificial Sequence
  chemically synthesized
gttttcattcactgaaataa

SEQ ID NO: 617887 - DNA, 20 bp, Artificial Sequence
  chemically synthesized
gctttcttatagattcatta

SEQ ID NO: 617888 - DNA, 20 bp, Artificial Sequence
  chemically synthesized
caaatatacatatgctttct

SEQ ID NO: 617889 - DNA, 20 bp, Artificial Sequence
  chemically synthesized
acagaaaaaggcaaatatac

SEQ ID NO: 617890 - DNA, 20 bp, Artificial Sequence
  chemically synthesized
cctttttctgttgttatttt

SEQ ID NO: 617891 - DNA, 20 bp, Artificial Sequence
  chemically synthesized
tatagatttaggaggtacag

SEQ ID NO: 617892 - DNA, 20 bp, Artificial Sequence
  chemically synthesized
acaatgtacactattggagt

SEQ ID NO: 617893 - DNA, 20 bp, Artificial Sequence
  chemically synthesized
aatacaaaattttttaaaag

SEQ ID NO: 617894 - DNA, 20 bp, Artificial Sequence
  chemically synthesized
tcaggagaccgaggcaggag

SEQ ID NO: 617895 - DNA, 20 bp, Artificial Sequence
  chemically synthesized
tgcctcggtctcctgaatag

SEQ ID NO: 617896 - DNA, 20 bp, Artificial Sequence
  chemically synthesized
aggcacgcgccaccatgccc

SEQ ID NO: 617897 - DNA, 20 bp, Artificial Sequence
  chemically synthesized
ttttgtatttttagtagaga

SEQ ID NO: 617898 - DNA, 20 bp, Artificial Sequence
  chemically synthesized
tgggagggcagagaacttat

SEQ ID NO: 617899 - DNA, 20 bp, Artificial Sequence
  chemically synthesized
gacacctttgcaaatgtatg

SEQ ID NO: 617900 - DNA, 20 bp, Artificial Sequence
  chemically synthesized
ctcctctctatcagaaagga

SEQ ID NO: 617901 - DNA, 20 bp, Artificial Sequence
  chemically synthesized
ctagttaagaaaatttatta

SEQ ID NO: 617902 - DNA, 20 bp, Artificial Sequence
  chemically synthesized
ttaactagcctttatctacc

SEQ ID NO: 617903 - DNA, 20 bp, Artificial Sequence
  chemically synthesized
aatttctctgacaaagaaca

SEQ ID NO: 617904 - DNA, 20 bp, Artificial Sequence
  chemically synthesized
gtgtgtatgttagtaaactt

SEQ ID NO: 617905 - DNA, 20 bp, Artificial Sequence
  chemically synthesized
tatcaacaagaaaaaaacaa

SEQ ID NO: 617906 - DNA, 20 bp, Artificial Sequence
  chemically synthesized
agtctcagcctcccaaagag

SEQ ID NO: 617907 - DNA, 20 bp, Artificial Sequence
  chemically synthesized
atgttgccaaggctggtctt

SEQ ID NO: 617908 - DNA, 20 bp, Artificial Sequence
  chemically synthesized
ccttccacctcagcctcccc

SEQ ID NO: 617909 - DNA, 20 bp, Artificial Sequence
  chemically synthesized
ctcactatagcttcaacctc

SEQ ID NO: 617910 - DNA, 20 bp, Artificial Sequence
  chemically synthesized
gaggttgaagctatagtgag

SEQ ID NO: 617911 - DNA, 20 bp, Artificial Sequence
  chemically synthesized
gtaatgcaatcttgtctcac

SEQ ID NO: 617912 - DNA, 20 bp, Artificial Sequence
  chemically synthesized
aaaacataattttacctcta

SEQ ID NO: 617913 - DNA, 20 bp, Artificial Sequence
  chemically synthesized
aaatcaaggtagaggtaaaa

SEQ ID NO: 617914 - DNA, 20 bp, Artificial Sequence
  chemically synthesized
atgttttcttcccctatgca

SEQ ID NO: 617915 - DNA, 20 bp, Artificial Sequence
  chemically synthesized
gcaatgtgtttcttttattt

SEQ ID NO: 617916 - DNA, 20 bp, Artificial Sequence
  chemically synthesized
atttaaatgtttatttagca

SEQ ID NO: 617917 - DNA, 20 bp, Artificial Sequence
  chemically synthesized
atttgctcatactactcact

SEQ ID NO: 617918 - DNA, 20 bp, Artificial Sequence
  chemically synthesized
gagagtgagtagtatgagca

SEQ ID NO: 617919 - DNA, 20 bp, Artificial Sequence
  chemically synthesized
gtatgagcaaatggcttttg

SEQ ID NO: 617920 - DNA, 20 bp, Artificial Sequence
  chemically synthesized
cctgacttgagctaaccaca

SEQ ID NO: 617921 - DNA, 20 bp, Artificial Sequence
  chemically synthesized
acacacacacatttgcatat

SEQ ID NO: 617922 - DNA, 20 bp, Artificial Sequence
  chemically synthesized
aaatgctacatatatattct

SEQ ID NO: 617923 - DNA, 20 bp, Artificial Sequence
  chemically synthesized
gtattttaactaacttattg

SEQ ID NO: 617924 - DNA, 20 bp, Artificial Sequence
  chemically synthesized
tgagatgcttgaacaaattg

SEQ ID NO: 617925 - DNA, 20 bp, Artificial Sequence
  chemically synthesized
acaaattgaaatgcttttta

SEQ ID NO: 617926 - DNA, 20 bp, Artificial Sequence
  chemically synthesized
actggagaatatgttatatg

SEQ ID NO: 617927 - DNA, 20 bp, Artificial Sequence
  chemically synthesized
ggcaaagtctcttccaaaac

SEQ ID NO: 617928 - DNA, 20 bp, Artificial Sequence
  chemically synthesized
tccattattagcctataaac

SEQ ID NO: 617929 - DNA, 20 bp, Artificial Sequence
  chemically synthesized
atagtttataggctaataat

SEQ ID NO: 617930 - DNA, 20 bp, Artificial Sequence
  chemically synthesized
taattattggaaaagtgtcc

SEQ ID NO: 617931 - DNA, 20 bp, Artificial Sequence
  chemically synthesized
ccaataattacacaacatgt

SEQ ID NO: 617932 - DNA, 20 bp, Artificial Sequence
  chemically synthesized
gacactgaatttccagcaac

SEQ ID NO: 617933 - DNA, 20 bp, Artificial Sequence
  chemically synthesized
tcagtgtccttacactattc

SEQ ID NO: 617934 - DNA, 20 bp, Artificial Sequence
  chemically synthesized
taactgagatatttttgttt

SEQ ID NO: 617935 - DNA, 20 bp, Artificial Sequence
  chemically synthesized
attttaactgagatattttt

SEQ ID NO: 617936 - DNA, 20 bp, Artificial Sequence
  chemically synthesized
actgattttaactgagatat

SEQ ID NO: 617937 - DNA, 20 bp, Artificial Sequence
  chemically synthesized
caatttgtttcctctgaagt

SEQ ID NO: 617938 - DNA, 20 bp, Artificial Sequence
  chemically synthesized
ccctactgctatcgcgatca

SEQ ID NO: 617939 - DNA, 20 bp, Artificial Sequence
  chemically synthesized
gaaaattttggagaaaaaat

SEQ ID NO: 617940 - DNA, 20 bp, Artificial Sequence
  chemically synthesized
gaaaaaatgttagctttgaa

SEQ ID NO: 617941 - DNA, 20 bp, Artificial Sequence
  chemically synthesized
gtaggctgcgggttggacaa

SEQ ID NO: 617942 - DNA, 20 bp, Artificial Sequence
  chemically synthesized
gcctgtaggctgcgggttgg

SEQ ID NO: 617943 - DNA, 20 bp, Artificial Sequence
  chemically synthesized
acaggctgcatgaggcccag

SEQ ID NO: 617944 - DNA, 20 bp, Artificial Sequence
  chemically synthesized
aatatctcatgatgtttcaa

SEQ ID NO: 617945 - DNA, 20 bp, Artificial Sequence
  chemically synthesized
taaatctaaaaaatatctca

SEQ ID NO: 617946 - DNA, 20 bp, Artificial Sequence
  chemically synthesized
tgaaacatcatgagatattt

SEQ ID NO: 617947 - DNA, 20 bp, Artificial Sequence
  chemically synthesized
aaagcagaattgtcagaact

SEQ ID NO: 617948 - DNA, 20 bp, Artificial Sequence
  chemically synthesized
gaagctaaaagttctgacaa

SEQ ID NO: 617949 - DNA, 20 bp, Artificial Sequence
  chemically synthesized
agttggcaatgaatgtactt

SEQ ID NO: 617950 - DNA, 20 bp, Artificial Sequence
  chemically synthesized
tgttacttaaatgtaacatg

SEQ ID NO: 617951 - DNA, 20 bp, Artificial Sequence
  chemically synthesized
aatgtaacatgttacgttta

SEQ ID NO: 617952 - DNA, 20 bp, Artificial Sequence
  chemically synthesized
tgagattctgcgttggtcat

SEQ ID NO: 617953 - DNA, 20 bp, Artificial Sequence
  chemically synthesized
cgcctcagcctcccaaagtg

SEQ ID NO: 617954 - DNA, 20 bp, Artificial Sequence
  chemically synthesized
ggcgggcagatcacgaggtc

SEQ ID NO: 617955 - DNA, 20 bp, Artificial Sequence
  chemically synthesized
ttttgtatttttagtagagg

SEQ ID NO: 617956 - DNA, 20 bp, Artificial Sequence
  chemically synthesized
tcaggaggctgaggcaggag

SEQ ID NO: 617957 - DNA, 20 bp, Artificial Sequence
  chemically synthesized
aacctccgactccctagttc

SEQ ID NO: 617958 - DNA, 20 bp, Artificial Sequence
  chemically synthesized
ttttttgtttttgtttttgt

SEQ ID NO: 617959 - DNA, 20 bp, Artificial Sequence
  chemically synthesized
tttttgttttttgtttttgt

SEQ ID NO: 617960 - DNA, 20 bp, Artificial Sequence
  chemically synthesized
gttttttttttgttttttgt

SEQ ID NO: 617961 - DNA, 20 bp, Artificial Sequence
  chemically synthesized
ttttcggttttttttttgtt

SEQ ID NO: 617962 - DNA, 20 bp, Artificial Sequence
  chemically synthesized
tcttgttttttcggtttttt

SEQ ID NO: 617963 - DNA, 20 bp, Artificial Sequence
  chemically synthesized
cagaagacatttcttgtttt

SEQ ID NO: 617964 - DNA, 20 bp, Artificial Sequence
  chemically synthesized
gaaattggtcagaagacatt

SEQ ID NO: 617965 - DNA, 20 bp, Artificial Sequence
  chemically synthesized
agaaatgtcttctgaccaat

SEQ ID NO: 617966 - DNA, 20 bp, Artificial Sequence
  chemically synthesized
cttaactcaacacgtgtacg

SEQ ID NO: 617967 - DNA, 20 bp, Artificial Sequence
  chemically synthesized
tatggaattcgttacatgat

SEQ ID NO: 617968 - DNA, 20 bp, Artificial Sequence
  chemically synthesized
gatcatgtaacgaattccat

SEQ ID NO: 617969 - DNA, 20 bp, Artificial Sequence
  chemically synthesized
tcagtttataagctagacta

SEQ ID NO: 617970 - DNA, 20 bp, Artificial Sequence
  chemically synthesized
acatttaccaatcttaatag

SEQ ID NO: 617971 - DNA, 20 bp, Artificial Sequence
  chemically synthesized
aagattggtaaatgtatatt

SEQ ID NO: 617972 - DNA, 20 bp, Artificial Sequence
  chemically synthesized
atattttgtgttttttttct

SEQ ID NO: 617973 - DNA, 20 bp, Artificial Sequence
  chemically synthesized
tactgctttggagtattgaa

SEQ ID NO: 617974 - DNA, 20 bp, Artificial Sequence
  chemically synthesized
tgaaaggagttttagtatag

SEQ ID NO: 617975 - DNA, 20 bp, Artificial Sequence
  chemically synthesized
tgtttttatactaaacatac

SEQ ID NO: 617976 - DNA, 20 bp, Artificial Sequence
  chemically synthesized
actctattatgtaaactaaa

SEQ ID NO: 617977 - DNA, 20 bp, Artificial Sequence
  chemically synthesized
aattcacaattttttttaaa

SEQ ID NO: 617978 - DNA, 20 bp, Artificial Sequence
  chemically synthesized
aatgaacactattgaacaaa

SEQ ID NO: 617979 - DNA, 20 bp, Artificial Sequence
  chemically synthesized
ttcattatatacactttgaa

SEQ ID NO: 617980 - DNA, 20 bp, Artificial Sequence
  chemically synthesized
attttatatcaactatatgt

SEQ ID NO: 617981 - DNA, 20 bp, Artificial Sequence
  chemically synthesized
ctatatgtaattgtttcaaa

SEQ ID NO: 617982 - DNA, 20 bp, Artificial Sequence
  chemically synthesized
tacacttaggttgtctgacc

SEQ ID NO: 617983 - DNA, 20 bp, Artificial Sequence
  chemically synthesized
ttgtctgaccaatagtttct

SEQ ID NO: 617984 - DNA, 20 bp, Artificial Sequence
  chemically synthesized
attcctctatagttacattt

SEQ ID NO: 617985 - DNA, 20 bp, Artificial Sequence
  chemically synthesized
ttttctagtttcctttgcaa

SEQ ID NO: 617986 - DNA, 20 bp, Artificial Sequence
  chemically synthesized
tgtggtagccactagccaca

SEQ ID NO: 617987 - DNA, 20 bp, Artificial Sequence
  chemically synthesized
atagtggctatcccgtgttg

SEQ ID NO: 617988 - DNA, 20 bp, Artificial Sequence
  chemically synthesized
ataaataatactaattgata

SEQ ID NO: 617989 - DNA, 20 bp, Artificial Sequence
  chemically synthesized
acctgttgaagaaataatat

SEQ ID NO: 617990 - DNA, 20 bp, Artificial Sequence
  chemically synthesized
aatattattaaaattacttc

SEQ ID NO: 617991 - DNA, 20 bp, Artificial Sequence
  chemically synthesized
aattacttcacctgtttctt

SEQ ID NO: 617992 - DNA, 20 bp, Artificial Sequence
  chemically synthesized
tccaatagaaatgtattgca

SEQ ID NO: 617993 - DNA, 20 bp, Artificial Sequence
  chemically synthesized
tggatgtgctgccaaacttc

SEQ ID NO: 617994 - DNA, 20 bp, Artificial Sequence
  chemically synthesized
aaagatatataggaatcctg

SEQ ID NO: 617995 - DNA, 20 bp, Artificial Sequence
  chemically synthesized
gctaggcactctaattattc

SEQ ID NO: 617996 - DNA, 20 bp, Artificial Sequence
  chemically synthesized
tagaagagtagctggcacac

SEQ ID NO: 617997 - DNA, 20 bp, Artificial Sequence
  chemically synthesized
ccatcctgtgtcttaacagt

SEQ ID NO: 617998 - DNA, 20 bp, Artificial Sequence
  chemically synthesized
aaaattcagttcctatatca

SEQ ID NO: 617999 - DNA, 20 bp, Artificial Sequence
  chemically synthesized
tgatataggaactgaatttt

SEQ ID NO: 618000 - DNA, 20 bp, Artificial Sequence
  chemically synthesized
agtcacattgtagtcactcc

SEQ ID NO: 618001 - DNA, 20 bp, Artificial Sequence
  chemically synthesized
tctttggccttcagggactg

SEQ ID NO: 618002 - DNA, 20 bp, Artificial Sequence
  chemically synthesized
tgcaatgtctgtgaattgcc

SEQ ID NO: 618003 - DNA, 20 bp, Artificial Sequence
  chemically synthesized
atagttctaaaacagggaca

SEQ ID NO: 618004 - DNA, 20 bp, Artificial Sequence
  chemically synthesized
ctgttcctaaagctgtgtgt

SEQ ID NO: 618005 - DNA, 20 bp, Artificial Sequence
  chemically synthesized
cagggacacacagctttagg

SEQ ID NO: 618006 - DNA, 20 bp, Artificial Sequence
  chemically synthesized
tgtacttcctgttgataaac

SEQ ID NO: 618007 - DNA, 20 bp, Artificial Sequence
  chemically synthesized
agcaaaagactgacaaaagc

SEQ ID NO: 618008 - DNA, 20 bp, Artificial Sequence
  chemically synthesized
ggaaatggaggatggttcat

SEQ ID NO: 618009 - DNA, 20 bp, Artificial Sequence
  chemically synthesized
tcttttgaagagaaaatgtg

SEQ ID NO: 618010 - DNA, 20 bp, Artificial Sequence
  chemically synthesized
gggtggtttctttacaactt

SEQ ID NO: 618011 - DNA, 20 bp, Artificial Sequence
  chemically synthesized
taattatttgaatgctttgg

SEQ ID NO: 618012 - DNA, 20 bp, Artificial Sequence
  chemically synthesized
catattaattatttgaatgc

SEQ ID NO: 618013 - DNA, 20 bp, Artificial Sequence
  chemically synthesized
ctcattcatattaattattt

SEQ ID NO: 618014 - DNA, 20 bp, Artificial Sequence
  chemically synthesized
tatgaatgagaaaggtatca

SEQ ID NO: 618015 - DNA, 20 bp, Artificial Sequence
  chemically synthesized
atgagaaaggtatcatttgg

SEQ ID NO: 618016 - DNA, 20 bp, Artificial Sequence
  chemically synthesized
tttcgtttctactttggcta

SEQ ID NO: 618017 - DNA, 20 bp, Artificial Sequence
  chemically synthesized
tttttttctaatattttaag

SEQ ID NO: 618018 - DNA, 20 bp, Artificial Sequence
  chemically synthesized
agtaagataatgaagagaaa

SEQ ID NO: 618019 - DNA, 20 bp, Artificial Sequence
  chemically synthesized
aaaggttttgagggaactgt

SEQ ID NO: 618020 - DNA, 20 bp, Artificial Sequence
  chemically synthesized
aattaaaaaggttttgaggg

SEQ ID NO: 618021 - DNA, 20 bp, Artificial Sequence
  chemically synthesized
agattttaaaagagaattaa

SEQ ID NO: 618022 - DNA, 20 bp, Artificial Sequence
  chemically synthesized
atttttaaaagatataaaag

SEQ ID NO: 618023 - DNA, 20 bp, Artificial Sequence
  chemically synthesized
tgtggttacaacaagaggac

SEQ ID NO: 618024 - DNA, 20 bp, Artificial Sequence
  chemically synthesized
agtcctcttgttgtaaccac

SEQ ID NO: 618025 - DNA, 20 bp, Artificial Sequence
  chemically synthesized
accttctgaatagaaaaggc

SEQ ID NO: 618026 - DNA, 20 bp, Artificial Sequence
  chemically synthesized
atcccttcattccttccttg

SEQ ID NO: 618027 - DNA, 20 bp, Artificial Sequence
  chemically synthesized
aataaatcccttcattcctt

SEQ ID NO: 618028 - DNA, 20 bp, Artificial Sequence
  chemically synthesized
aacaaagcaaggaaggaatg

SEQ ID NO: 618029 - DNA, 20 bp, Artificial Sequence
  chemically synthesized
gtagagggtatttggacccc

SEQ ID NO: 618030 - DNA, 20 bp, Artificial Sequence
  chemically synthesized
ctggggtccaaataccctct

SEQ ID NO: 618031 - DNA, 20 bp, Artificial Sequence
  chemically synthesized
gaagtggtggcctgcaattg

SEQ ID NO: 618032 - DNA, 20 bp, Artificial Sequence
  chemically synthesized
ctctacttcagcctctgatt

SEQ ID NO: 618033 - DNA, 20 bp, Artificial Sequence
  chemically synthesized
ctatgtaactctacttcagc

SEQ ID NO: 618034 - DNA, 20 bp, Artificial Sequence
  chemically synthesized
ggacactctcctgtgcaaac

SEQ ID NO: 618035 - DNA, 20 bp, Artificial Sequence
  chemically synthesized
gttgctttttgcaaccaatc

SEQ ID NO: 618036 - DNA, 20 bp, Artificial Sequence
  chemically synthesized
cttcaccttagcctctgatt

SEQ ID NO: 618037 - DNA, 20 bp, Artificial Sequence
  chemically synthesized
ctttgtaacttcaccttagc

SEQ ID NO: 618038 - DNA, 20 bp, Artificial Sequence
  chemically synthesized
aaagactgggcccgcaatca

SEQ ID NO: 618039 - DNA, 20 bp, Artificial Sequence
  chemically synthesized
tggctgttcccaaccaatca

SEQ ID NO: 618040 - DNA, 20 bp, Artificial Sequence
  chemically synthesized
tctgctacacagaaaaggtg

SEQ ID NO: 618041 - DNA, 20 bp, Artificial Sequence
  chemically synthesized
gttacttaggggtggaaagt

SEQ ID NO: 618042 - DNA, 20 bp, Artificial Sequence
  chemically synthesized
tggaaagttagggttttgcc

SEQ ID NO: 618043 - DNA, 20 bp, Artificial Sequence
  chemically synthesized
aagtacattttcatgtgttg

SEQ ID NO: 618044 - DNA, 20 bp, Artificial Sequence
  chemically synthesized
ttaatacttttgggggaaca

SEQ ID NO: 618045 - DNA, 20 bp, Artificial Sequence
  chemically synthesized
tacctgggtaagttctttag

SEQ ID NO: 618046 - DNA, 20 bp, Artificial Sequence
  chemically synthesized
aagttctttagtggtgattt

SEQ ID NO: 618047 - DNA, 20 bp, Artificial Sequence
  chemically synthesized
gtatacaccgtacccaatat

SEQ ID NO: 618048 - DNA, 20 bp, Artificial Sequence
  chemically synthesized
cacttatgagtgagaacata

SEQ ID NO: 618049 - DNA, 20 bp, Artificial Sequence
  chemically synthesized
atgagtgagaacatacggtg

SEQ ID NO: 618050 - DNA, 20 bp, Artificial Sequence
  chemically synthesized
cataaatgataacatttgtt

SEQ ID NO: 618051 - DNA, 20 bp, Artificial Sequence
  chemically synthesized
tcttcataaatgataacatt

SEQ ID NO: 618052 - DNA, 20 bp, Artificial Sequence
  chemically synthesized
tcttccactccccaaaatac

SEQ ID NO: 618053 - DNA, 20 bp, Artificial Sequence
  chemically synthesized
attattttataacttgagac

SEQ ID NO: 618054 - DNA, 20 bp, Artificial Sequence
  chemically synthesized
tttataacttgagacatctg

SEQ ID NO: 618055 - DNA, 20 bp, Artificial Sequence
  chemically synthesized
ctaaacagttacattatatg

SEQ ID NO: 618056 - DNA, 20 bp, Artificial Sequence
  chemically synthesized
gtaaactattcatataatgt

SEQ ID NO: 618057 - DNA, 20 bp, Artificial Sequence
  chemically synthesized
ttaaatacactgcctgatag

SEQ ID NO: 618058 - DNA, 20 bp, Artificial Sequence
  chemically synthesized
gtgtatttaatgatctttca

SEQ ID NO: 618059 - DNA, 20 bp, Artificial Sequence
  chemically synthesized
ttgcttcgtattttcttttt

SEQ ID NO: 618060 - DNA, 20 bp, Artificial Sequence
  chemically synthesized
ccgtttttttaattcaaatt

SEQ ID NO: 618061 - DNA, 20 bp, Artificial Sequence
  chemically synthesized
ttggtttactgacttagatg

SEQ ID NO: 618062 - DNA, 20 bp, Artificial Sequence
  chemically synthesized
gagttttatgatagctgata

SEQ ID NO: 618063 - DNA, 20 bp, Artificial Sequence
  chemically synthesized
tattaaacgagctatgtaag

SEQ ID NO: 618064 - DNA, 20 bp, Artificial Sequence
  chemically synthesized
cataaaactctacttacata

SEQ ID NO: 618065 - DNA, 20 bp, Artificial Sequence
  chemically synthesized
gaagaagcatttaaaatgaa

SEQ ID NO: 618066 - DNA, 20 bp, Artificial Sequence
  chemically synthesized
ttagaaacagtcttcatttt

SEQ ID NO: 618067 - DNA, 20 bp, Artificial Sequence
  chemically synthesized
tgaccttccaaaattgtatt

SEQ ID NO: 618068 - DNA, 20 bp, Artificial Sequence
  chemically synthesized
catagcagaatgctttatat

SEQ ID NO: 618069 - DNA, 20 bp, Artificial Sequence
  chemically synthesized
ttaagaataaagtcatagca

SEQ ID NO: 618070 - DNA, 20 bp, Artificial Sequence
  chemically synthesized
cagttttcaagtaaatgtga

SEQ ID NO: 618071 - DNA, 20 bp, Artificial Sequence
  chemically synthesized
atatgccagttttcaagtaa

SEQ ID NO: 618072 - DNA, 20 bp, Artificial Sequence
  chemically synthesized
gaaatgtttcatttcaatat

SEQ ID NO: 618073 - DNA, 20 bp, Artificial Sequence
  chemically synthesized
tctatctccacaaaggatgg

SEQ ID NO: 618074 - DNA, 20 bp, Artificial Sequence
  chemically synthesized
tttgtggagatagagaacgc

SEQ ID NO: 618075 - DNA, 20 bp, Artificial Sequence
  chemically synthesized
ttagtaacaataaatgttgg

SEQ ID NO: 618076 - DNA, 20 bp, Artificial Sequence
  chemically synthesized
atgagtatgaacatctataa

SEQ ID NO: 618077 - DNA, 20 bp, Artificial Sequence
  chemically synthesized
tcttcctgtcattttattgg

SEQ ID NO: 618078 - DNA, 20 bp, Artificial Sequence
  chemically synthesized
tgtagagttacaccttttta

SEQ ID NO: 618079 - DNA, 20 bp, Artificial Sequence
  chemically synthesized
tttttcttctcctgttttct

SEQ ID NO: 618080 - DNA, 20 bp, Artificial Sequence
  chemically synthesized
tgagttgttcatttttcttc

SEQ ID NO: 618081 - DNA, 20 bp, Artificial Sequence
  chemically synthesized
aaaactaacaatttgttaaa

SEQ ID NO: 618082 - DNA, 20 bp, Artificial Sequence
  chemically synthesized
aaaacacattttaacaaatt

SEQ ID NO: 618083 - DNA, 20 bp, Artificial Sequence
  chemically synthesized
tgaaaatttatatttaatat

SEQ ID NO: 618084 - DNA, 20 bp, Artificial Sequence
  chemically synthesized
atttaatatgatagttttcc

SEQ ID NO: 618085 - DNA, 20 bp, Artificial Sequence
  chemically synthesized
ctaagttttaatttataatt

SEQ ID NO: 618086 - DNA, 20 bp, Artificial Sequence
  chemically synthesized
ccttcatcgatatttatttt

SEQ ID NO: 618087 - DNA, 20 bp, Artificial Sequence
  chemically synthesized
tacttgtgtatttttttata

SEQ ID NO: 618088 - DNA, 20 bp, Artificial Sequence
  chemically synthesized
tttttttctggagttggata

SEQ ID NO: 618089 - DNA, 20 bp, Artificial Sequence
  chemically synthesized
ttacacattaacttaaaaac

SEQ ID NO: 618090 - DNA, 20 bp, Artificial Sequence
  chemically synthesized
cttaacattataaagtaaac

SEQ ID NO: 618091 - DNA, 20 bp, Artificial Sequence
  chemically synthesized
gtttactttataatgttaag

SEQ ID NO: 618092 - DNA, 20 bp, Artificial Sequence
  chemically synthesized
tgctccttgttcctgaaaag

SEQ ID NO: 618093 - DNA, 20 bp, Artificial Sequence
  chemically synthesized
ggaacaaggagcatctttct

SEQ ID NO: 618094 - DNA, 20 bp, Artificial Sequence
  chemically synthesized
tttccttttgggttgttcag

SEQ ID NO: 618095 - DNA, 20 bp, Artificial Sequence
  chemically synthesized
ttaacaagaaatttcagtac

SEQ ID NO: 618096 - DNA, 20 bp, Artificial Sequence
  chemically synthesized
gtactgaaatttcttgttaa

SEQ ID NO: 618097 - DNA, 20 bp, Artificial Sequence
  chemically synthesized
aatttcttgttaaatgtgtt

SEQ ID NO: 618098 - DNA, 20 bp, Artificial Sequence
  chemically synthesized
cattttataggtaatgagct

SEQ ID NO: 618099 - DNA, 20 bp, Artificial Sequence
  chemically synthesized
attacctataaaatgaattt

SEQ ID NO: 618100 - DNA, 20 bp, Artificial Sequence
  chemically synthesized
tactaaattattttattggt

SEQ ID NO: 618101 - DNA, 20 bp, Artificial Sequence
  chemically synthesized
gtatttgtttgtgttcatat

SEQ ID NO: 618102 - DNA, 20 bp, Artificial Sequence
  chemically synthesized
atatttgtgtttgttaatat

SEQ ID NO: 618103 - DNA, 20 bp, Artificial Sequence
  chemically synthesized
ggatcccaatttacagatag

SEQ ID NO: 618104 - DNA, 20 bp, Artificial Sequence
  chemically synthesized
gtaaattgggatcccattac

SEQ ID NO: 618105 - DNA, 20 bp, Artificial Sequence
  chemically synthesized
atcccattaccactgcttgc

SEQ ID NO: 618106 - DNA, 20 bp, Artificial Sequence
  chemically synthesized
ttgcaattgttttgcctcga

SEQ ID NO: 618107 - DNA, 20 bp, Artificial Sequence
  chemically synthesized
ggaggtagctgtagtactca

SEQ ID NO: 618108 - DNA, 20 bp, Artificial Sequence
  chemically synthesized
gtctttatccagaatgcatc

SEQ ID NO: 618109 - DNA, 20 bp, Artificial Sequence
  chemically synthesized
tttgtgtgtgtgtaaagtcc

SEQ ID NO: 618110 - DNA, 20 bp, Artificial Sequence
  chemically synthesized
atatgcgtgtgtgtgtgtgt

SEQ ID NO: 618111 - DNA, 20 bp, Artificial Sequence
  chemically synthesized
atgtcaacaaaattattcaa

SEQ ID NO: 618112 - DNA, 20 bp, Artificial Sequence
  chemically synthesized
taaatgtactttaatcatga

SEQ ID NO: 618113 - DNA, 20 bp, Artificial Sequence
  chemically synthesized
tgataaaattaaaatctatt

SEQ ID NO: 618114 - DNA, 20 bp, Artificial Sequence
  chemically synthesized
aattacaagtgatcttagct

SEQ ID NO: 618115 - DNA, 20 bp, Artificial Sequence
  chemically synthesized
ttcctcaaattacaagtgat

SEQ ID NO: 618116 - DNA, 20 bp, Artificial Sequence
  chemically synthesized
ttatttgctttattttgagg

SEQ ID NO: 618117 - DNA, 20 bp, Artificial Sequence
  chemically synthesized
tcttcttcccatttgttctt

SEQ ID NO: 618118 - DNA, 20 bp, Artificial Sequence
  chemically synthesized
ttctcttctgcttgcattgc

SEQ ID NO: 618119 - DNA, 20 bp, Artificial Sequence
  chemically synthesized
ataattttcccataattctc

SEQ ID NO: 618120 - DNA, 20 bp, Artificial Sequence
  chemically synthesized
atttttttatattgtcatga

SEQ ID NO: 618121 - DNA, 20 bp, Artificial Sequence
  chemically synthesized
ctaaataggatgtcaattat

SEQ ID NO: 618122 - DNA, 20 bp, Artificial Sequence
  chemically synthesized
cttgttcctgatcttcctga

SEQ ID NO: 618123 - DNA, 20 bp, Artificial Sequence
  chemically synthesized
tcatgtcatctatgaagaaa

SEQ ID NO: 618124 - DNA, 20 bp, Artificial Sequence
  chemically synthesized
cagggttatttttcgattct

SEQ ID NO: 618125 - DNA, 20 bp, Artificial Sequence
  chemically synthesized
ttattatttccagggttatt

SEQ ID NO: 618126 - DNA, 20 bp, Artificial Sequence
  chemically synthesized
gtgtcctgcaactttgctac

SEQ ID NO: 618127 - DNA, 20 bp, Artificial Sequence
  chemically synthesized
ttgtagcaaagttgcaggac

SEQ ID NO: 618128 - DNA, 20 bp, Artificial Sequence
  chemically synthesized
aagattaatatataaaattc

SEQ ID NO: 618129 - DNA, 20 bp, Artificial Sequence
  chemically synthesized
aaatgttagtggaaatggct

SEQ ID NO: 618130 - DNA, 20 bp, Artificial Sequence
  chemically synthesized
tttttgaaaatgttagtgga

SEQ ID NO: 618131 - DNA, 20 bp, Artificial Sequence
  chemically synthesized
tgtaaagatcttgtatattt

SEQ ID NO: 618132 - DNA, 20 bp, Artificial Sequence
  chemically synthesized
gataactttcatcagagttt

SEQ ID NO: 618133 - DNA, 20 bp, Artificial Sequence
  chemically synthesized
gttcctctgataactttcat

SEQ ID NO: 618134 - DNA, 20 bp, Artificial Sequence
  chemically synthesized
cagttctcctcaagttgatc

SEQ ID NO: 618135 - DNA, 20 bp, Artificial Sequence
  chemically synthesized
gtaacttgctgtgattttga

SEQ ID NO: 618136 - DNA, 20 bp, Artificial Sequence
  chemically synthesized
ggcaaggtaacttgctgtga

SEQ ID NO: 618137 - DNA, 20 bp, Artificial Sequence
  chemically synthesized
atataaggcaaggtaacttg

SEQ ID NO: 618138 - DNA, 20 bp, Artificial Sequence
  chemically synthesized
taccttgccttatatagaca

SEQ ID NO: 618139 - DNA, 20 bp, Artificial Sequence
  chemically synthesized
ttatatagacaaaccgtttc

SEQ ID NO: 618140 - DNA, 20 bp, Artificial Sequence
  chemically synthesized
cctttcatataaactttaga

SEQ ID NO: 618141 - DNA, 20 bp, Artificial Sequence
  chemically synthesized
aagtcttgtagtcagatagt

SEQ ID NO: 618142 - DNA, 20 bp, Artificial Sequence
  chemically synthesized
attattttgccaatacactg

SEQ ID NO: 618143 - DNA, 20 bp, Artificial Sequence
  chemically synthesized
tggaaatagacccacatgaa

SEQ ID NO: 618144 - DNA, 20 bp, Artificial Sequence
  chemically synthesized
tgctccattctattgccatt

SEQ ID NO: 618145 - DNA, 20 bp, Artificial Sequence
  chemically synthesized
ttttttgcatgtagatgtcc

SEQ ID NO: 618146 - DNA, 20 bp, Artificial Sequence
  chemically synthesized
acaaagatcaagttactgct

SEQ ID NO: 618147 - DNA, 20 bp, Artificial Sequence
  chemically synthesized
tgaaaataattttagtttta

SEQ ID NO: 618148 - DNA, 20 bp, Artificial Sequence
  chemically synthesized
ggaaaatcattgaaaataat

SEQ ID NO: 618149 - DNA, 20 bp, Artificial Sequence
  chemically synthesized
actaaaactaaaattatttt

SEQ ID NO: 618150 - DNA, 20 bp, Artificial Sequence
  chemically synthesized
taagaaagactattgcaaga

SEQ ID NO: 618151 - DNA, 20 bp, Artificial Sequence
  chemically synthesized
cttccttttgctcaagctaa

SEQ ID NO: 618152 - DNA, 20 bp, Artificial Sequence
  chemically synthesized
agagagtggagaaaaacagt

SEQ ID NO: 618153 - DNA, 20 bp, Artificial Sequence
  chemically synthesized
agattgagagagtggagaaa

SEQ ID NO: 618154 - DNA, 20 bp, Artificial Sequence
  chemically synthesized
atttgctggtggactaaaaa

SEQ ID NO: 618155 - DNA, 20 bp, Artificial Sequence
  chemically synthesized
acattttgaaagtagatgta

SEQ ID NO: 618156 - DNA, 20 bp, Artificial Sequence
  chemically synthesized
ggctgggtgtgtgcgtgtgg

SEQ ID NO: 618157 - DNA, 20 bp, Artificial Sequence
  chemically synthesized
cttgtacattgtgggagatt

SEQ ID NO: 618158 - DNA, 20 bp, Artificial Sequence
  chemically synthesized
ggtcttggcttgtacattgt

SEQ ID NO: 618159 - DNA, 20 bp, Artificial Sequence
  chemically synthesized
ttattgaccattgtaaaggt

SEQ ID NO: 618160 - DNA, 20 bp, Artificial Sequence
  chemically synthesized
acaatggtcaataaggccct

SEQ ID NO: 618161 - DNA, 20 bp, Artificial Sequence
  chemically synthesized
gtacactctgaggagggagt

SEQ ID NO: 618162 - DNA, 20 bp, Artificial Sequence
  chemically synthesized
gatgccctcctttccttcct

SEQ ID NO: 618163 - DNA, 20 bp, Artificial Sequence
  chemically synthesized
ttttttgtatgcctcttaag

SEQ ID NO: 618164 - DNA, 20 bp, Artificial Sequence
  chemically synthesized
atatccctattctaccctta

SEQ ID NO: 618165 - DNA, 20 bp, Artificial Sequence
  chemically synthesized
ctatatttgtttgtcaactt

SEQ ID NO: 618166 - DNA, 20 bp, Artificial Sequence
  chemically synthesized
ttctctatatttgtttgtca

SEQ ID NO: 618167 - DNA, 20 bp, Artificial Sequence
  chemically synthesized
aactatctgacgttctctat

SEQ ID NO: 618168 - DNA, 20 bp, Artificial Sequence
  chemically synthesized
aacaaatatagagaacgtca

SEQ ID NO: 618169 - DNA, 20 bp, Artificial Sequence
  chemically synthesized
agaacgtcagatagtttgct

SEQ ID NO: 618170 - DNA, 20 bp, Artificial Sequence
  chemically synthesized
gtttgctaaatgtttccctc

SEQ ID NO: 618171 - DNA, 20 bp, Artificial Sequence
  chemically synthesized
gctcgctagctaacagggcc

SEQ ID NO: 618172 - DNA, 20 bp, Artificial Sequence
  chemically synthesized
ctatttcatatcaggtgctc

SEQ ID NO: 618173 - DNA, 20 bp, Artificial Sequence
  chemically synthesized
tcatgtgtatttctgtcaaa

SEQ ID NO: 618174 - DNA, 20 bp, Artificial Sequence
  chemically synthesized
aataatttatatttaaggaa

SEQ ID NO: 618175 - DNA, 20 bp, Artificial Sequence
  chemically synthesized
ctaaatgtttctttctttga

SEQ ID NO: 618176 - DNA, 20 bp, Artificial Sequence
  chemically synthesized
aatttgctaaatgtttcttt

SEQ ID NO: 618177 - DNA, 20 bp, Artificial Sequence
  chemically synthesized
gagttgcagatgaatttgct

SEQ ID NO: 618178 - DNA, 20 bp, Artificial Sequence
  chemically synthesized
agaaatgtgtgaagttactc

SEQ ID NO: 618179 - DNA, 20 bp, Artificial Sequence
  chemically synthesized
catttctaatgaaaaggtct

SEQ ID NO: 618180 - DNA, 20 bp, Artificial Sequence
  chemically synthesized
ggacaagaccgaaagtgatc

SEQ ID NO: 618181 - DNA, 20 bp, Artificial Sequence
  chemically synthesized
gagtatggtttttaaaaggg

SEQ ID NO: 618182 - DNA, 20 bp, Artificial Sequence
  chemically synthesized
aggcagagtatggtttttaa

SEQ ID NO: 618183 - DNA, 20 bp, Artificial Sequence
  chemically synthesized
ttggaacataaaaggcagag

SEQ ID NO: 618184 - DNA, 20 bp, Artificial Sequence
  chemically synthesized
ccctccatgtgcattacaag

SEQ ID NO: 618185 - DNA, 20 bp, Artificial Sequence
  chemically synthesized
tttaaccttaccaagattcc

SEQ ID NO: 618186 - DNA, 20 bp, Artificial Sequence
  chemically synthesized
gtgttgcatttttaacctta

SEQ ID NO: 618187 - DNA, 20 bp, Artificial Sequence
  chemically synthesized
gacactctgaaggtcttcct

SEQ ID NO: 618188 - DNA, 20 bp, Artificial Sequence
  chemically synthesized
tgctttactttgcttcagca

SEQ ID NO: 618189 - DNA, 20 bp, Artificial Sequence
  chemically synthesized
aatctctcttttgtgcttta

SEQ ID NO: 618190 - DNA, 20 bp, Artificial Sequence
  chemically synthesized
aagcaaagtaaagcacaaaa

SEQ ID NO: 618191 - DNA, 20 bp, Artificial Sequence
  chemically synthesized
agagtctttcaatctctctt

SEQ ID NO: 618192 - DNA, 20 bp, Artificial Sequence
  chemically synthesized
agactctgtaggtcaattgg

SEQ ID NO: 618193 - DNA, 20 bp, Artificial Sequence
  chemically synthesized
aaaatatatagtagcccatg

SEQ ID NO: 618194 - DNA, 20 bp, Artificial Sequence
  chemically synthesized
tcaatagtaatgccacaacg

SEQ ID NO: 618195 - DNA, 20 bp, Artificial Sequence
  chemically synthesized
tgccctgaaacacaaaataa

SEQ ID NO: 618196 - DNA, 20 bp, Artificial Sequence
  chemically synthesized
ttttaacaatcctagttatt

SEQ ID NO: 618197 - DNA, 20 bp, Artificial Sequence
  chemically synthesized
acgtatatatacgtatatat

SEQ ID NO: 618198 - DNA, 20 bp, Artificial Sequence
  chemically synthesized
agcattttggatttgggatt

SEQ ID NO: 618199 - DNA, 20 bp, Artificial Sequence
  chemically synthesized
gatttgggagcattttggat

SEQ ID NO: 618200 - DNA, 20 bp, Artificial Sequence
  chemically synthesized
ggtttctgatttgggagcat

SEQ ID NO: 618201 - DNA, 20 bp, Artificial Sequence
  chemically synthesized
catgtcagccctcaaaaggt

SEQ ID NO: 618202 - DNA, 20 bp, Artificial Sequence
  chemically synthesized
gtgtgtcatgtcagccctca

SEQ ID NO: 618203 - DNA, 20 bp, Artificial Sequence
  chemically synthesized
ggaaatgctcattggagcat

SEQ ID NO: 618204 - DNA, 20 bp, Artificial Sequence
  chemically synthesized
ctcattggagcattctggat

SEQ ID NO: 618205 - DNA, 20 bp, Artificial Sequence
  chemically synthesized
aaatgtttcaaattttggat

SEQ ID NO: 618206 - DNA, 20 bp, Artificial Sequence
  chemically synthesized
aaaatagaaatgtttcaaat

SEQ ID NO: 618207 - DNA, 20 bp, Artificial Sequence
  chemically synthesized
tccaaaacgtttgaaaatag

SEQ ID NO: 618208 - DNA, 20 bp, Artificial Sequence
  chemically synthesized
tttgaaacatttctattttc

SEQ ID NO: 618209 - DNA, 20 bp, Artificial Sequence
  chemically synthesized
gattgagcattcttcgtcca

SEQ ID NO: 618210 - DNA, 20 bp, Artificial Sequence
  chemically synthesized
acgaagaatgctcaatcagt

SEQ ID NO: 618211 - DNA, 20 bp, Artificial Sequence
  chemically synthesized
agaatgctcaatcagtatca

SEQ ID NO: 618212 - DNA, 20 bp, Artificial Sequence
  chemically synthesized
tgctcaatcagtatcagatt

SEQ ID NO: 618213 - DNA, 20 bp, Artificial Sequence
  chemically synthesized
ctcaaaatcaatcaatctga

SEQ ID NO: 618214 - DNA, 20 bp, Artificial Sequence
  chemically synthesized
attttgagtcttttaactca

SEQ ID NO: 618215 - DNA, 20 bp, Artificial Sequence
  chemically synthesized
atgcaagtacttgatttaaa

SEQ ID NO: 618216 - DNA, 20 bp, Artificial Sequence
  chemically synthesized
caatttaaatcaagtacttg

SEQ ID NO: 618217 - DNA, 20 bp, Artificial Sequence
  chemically synthesized
agttgagaatcaatgcaagt

SEQ ID NO: 618218 - DNA, 20 bp, Artificial Sequence
  chemically synthesized
gggttcaataaattcctcag

SEQ ID NO: 618219 - DNA, 20 bp, Artificial Sequence
  chemically synthesized
tccaacattctctactacag

SEQ ID NO: 618220 - DNA, 20 bp, Artificial Sequence
  chemically synthesized
acctgaggacctgttagaaa

SEQ ID NO: 618221 - DNA, 20 bp, Artificial Sequence
  chemically synthesized
tctagggtgggacccaggaa

SEQ ID NO: 618222 - DNA, 20 bp, Artificial Sequence
  chemically synthesized
ggattgctgaggcccatagt

SEQ ID NO: 618223 - DNA, 20 bp, Artificial Sequence
  chemically synthesized
tgactatgggcctcagcaat

SEQ ID NO: 618224 - DNA, 20 bp, Artificial Sequence
  chemically synthesized
acctagaaaatgtgttaaaa

SEQ ID NO: 618225 - DNA, 20 bp, Artificial Sequence
  chemically synthesized
acattttctaggtaattcca

SEQ ID NO: 618226 - DNA, 20 bp, Artificial Sequence
  chemically synthesized
aattccaatgcgttttgctg

SEQ ID NO: 618227 - DNA, 20 bp, Artificial Sequence
  chemically synthesized
gcaggctaccatttttgtag

SEQ ID NO: 618228 - DNA, 20 bp, Artificial Sequence
  chemically synthesized
acaactctacaaaaatggta

SEQ ID NO: 618229 - DNA, 20 bp, Artificial Sequence
  chemically synthesized
ctctacaaaaatggtagcct

SEQ ID NO: 618230 - DNA, 20 bp, Artificial Sequence
  chemically synthesized
ttagactgccccaccaccac

SEQ ID NO: 618231 - DNA, 20 bp, Artificial Sequence
  chemically synthesized
ctaattcttctatcattgcc

SEQ ID NO: 618232 - DNA, 20 bp, Artificial Sequence
  chemically synthesized
tctatcattgcctgttgttt

SEQ ID NO: 618233 - DNA, 20 bp, Artificial Sequence
  chemically synthesized
tagtcatgttaatttgcaac

SEQ ID NO: 618234 - DNA, 20 bp, Artificial Sequence
  chemically synthesized
ggttgagccaacaataagat

SEQ ID NO: 618235 - DNA, 20 bp, Artificial Sequence
  chemically synthesized
tcacctgacaagtcatactt

SEQ ID NO: 618236 - DNA, 20 bp, Artificial Sequence
  chemically synthesized
actaattgcttggagaggat

SEQ ID NO: 618237 - DNA, 20 bp, Artificial Sequence
  chemically synthesized
acatagaagacagaatgact

SEQ ID NO: 618238 - DNA, 20 bp, Artificial Sequence
  chemically synthesized
ccacagcatttctattgcat

SEQ ID NO: 618239 - DNA, 20 bp, Artificial Sequence
  chemically synthesized
catttctattgcattaaaga

SEQ ID NO: 618240 - DNA, 20 bp, Artificial Sequence
  chemically synthesized
ttttaattatttgttgatgc

SEQ ID NO: 618241 - DNA, 20 bp, Artificial Sequence
  chemically synthesized
caacatggttttccctctcc

SEQ ID NO: 618242 - DNA, 20 bp, Artificial Sequence
  chemically synthesized
gtgatgaaggcataacccaa

SEQ ID NO: 618243 - DNA, 20 bp, Artificial Sequence
  chemically synthesized
gccttcatcactgtatgaca

SEQ ID NO: 618244 - DNA, 20 bp, Artificial Sequence
  chemically synthesized
ggtaccatcctatcagagat

SEQ ID NO: 618245 - DNA, 20 bp, Artificial Sequence
  chemically synthesized
aattgttcttttctaaataa

SEQ ID NO: 618246 - DNA, 20 bp, Artificial Sequence
  chemically synthesized
gcttcactaatgtccatgta

SEQ ID NO: 618247 - DNA, 20 bp, Artificial Sequence
  chemically synthesized
ccattatttatctgatttta

SEQ ID NO: 618248 - DNA, 20 bp, Artificial Sequence
  chemically synthesized
gatgggcctatccattattt

SEQ ID NO: 618249 - DNA, 20 bp, Artificial Sequence
  chemically synthesized
aggcccatcagccataaaga

SEQ ID NO: 618250 - DNA, 20 bp, Artificial Sequence
  chemically synthesized
tatttacatatgcaagctaa

SEQ ID NO: 618251 - DNA, 20 bp, Artificial Sequence
  chemically synthesized
tggtctcagtgccaagcata

SEQ ID NO: 618252 - DNA, 20 bp, Artificial Sequence
  chemically synthesized
tgatacaagaaaattggaat

SEQ ID NO: 618253 - DNA, 20 bp, Artificial Sequence
  chemically synthesized
gacaattccttttagaaggt

SEQ ID NO: 618254 - DNA, 20 bp, Artificial Sequence
  chemically synthesized
gaagtttcttagaaatatgt

SEQ ID NO: 618255 - DNA, 20 bp, Artificial Sequence
  chemically synthesized
tcacttattgttaatagtaa

SEQ ID NO: 618256 - DNA, 20 bp, Artificial Sequence
  chemically synthesized
acttctttactattaacaat

SEQ ID NO: 618257 - DNA, 20 bp, Artificial Sequence
  chemically synthesized
aaatggattgtgataggtct

SEQ ID NO: 618258 - DNA, 20 bp, Artificial Sequence
  chemically synthesized
tactcagttagtgagacaaa

SEQ ID NO: 618259 - DNA, 20 bp, Artificial Sequence
  chemically synthesized
tttgttacttaggtactttg

SEQ ID NO: 618260 - DNA, 20 bp, Artificial Sequence
  chemically synthesized
ttacttaggtactttgcaaa

SEQ ID NO: 618261 - DNA, 20 bp, Artificial Sequence
  chemically synthesized
ctactgagaaccattccctt

SEQ ID NO: 618262 - DNA, 20 bp, Artificial Sequence
  chemically synthesized
cattcaagggaatggttctc

SEQ ID NO: 618263 - DNA, 20 bp, Artificial Sequence
  chemically synthesized
gaatcaagatgattatacta

SEQ ID NO: 618264 - DNA, 20 bp, Artificial Sequence
  chemically synthesized
taaaccatttagtataatca

SEQ ID NO: 618265 - DNA, 20 bp, Artificial Sequence
  chemically synthesized
tgtgtttgtgtttggaatca

SEQ ID NO: 618266 - DNA, 20 bp, Artificial Sequence
  chemically synthesized
tgacttgtcgaatgatgtgt

SEQ ID NO: 618267 - DNA, 20 bp, Artificial Sequence
  chemically synthesized
ttaagatgacttgtcgaatg

SEQ ID NO: 618268 - DNA, 20 bp, Artificial Sequence
  chemically synthesized
gtattttgaatttcgtataa

SEQ ID NO: 618269 - DNA, 20 bp, Artificial Sequence
  chemically synthesized
ttatttgaatattaacttaa

SEQ ID NO: 618270 - DNA, 20 bp, Artificial Sequence
  chemically synthesized
ataaacaaattattgtgttt

SEQ ID NO: 618271 - DNA, 20 bp, Artificial Sequence
  chemically synthesized
ataatcatgtaaacacaata

SEQ ID NO: 618272 - DNA, 20 bp, Artificial Sequence
  chemically synthesized
tactactcataaacaaatta

SEQ ID NO: 618273 - DNA, 20 bp, Artificial Sequence
  chemically synthesized
tgagtagtagaaataaaaag

SEQ ID NO: 618274 - DNA, 20 bp, Artificial Sequence
  chemically synthesized
gtgatattgtcattttcaaa

SEQ ID NO: 618275 - DNA, 20 bp, Artificial Sequence
  chemically synthesized
ttagataactctactgcaaa

SEQ ID NO: 618276 - DNA, 20 bp, Artificial Sequence
  chemically synthesized
gttttggtgagtgaagtaaa

SEQ ID NO: 618277 - DNA, 20 bp, Artificial Sequence
  chemically synthesized
atgttaatattttttacata

SEQ ID NO: 618278 - DNA, 20 bp, Artificial Sequence
  chemically synthesized
tcaaaatatcttaagtcgag

SEQ ID NO: 618279 - DNA, 20 bp, Artificial Sequence
  chemically synthesized
gcatgtatgggtactcaaaa

SEQ ID NO: 618280 - DNA, 20 bp, Artificial Sequence
  chemically synthesized
tttgagtacccatacatgca

SEQ ID NO: 618281 - DNA, 20 bp, Artificial Sequence
  chemically synthesized
gtattcaatcaattacatga
